United States Patent 11,464,842 (COMPOSITIONS AND METHOD FOR OPTIMIZED PEPTIDE VACCINES USING RESIDUE OPTIMIZATION) - sequence listing, part 4

SEQ ID NO: 39349 - protein, 10 aa, Artificial Sequence
  Description of Artificial Sequence: Synthetic peptide
  Seed: RQKRILVNLS (KKLC1_HUMAN)
RVKRILVNLL

SEQ ID NO: 39350 - protein, 11 aa, Artificial Sequence
  Description of Artificial Sequence: Synthetic peptide
  Seed: RQKRILVNLSM (KKLC1_HUMAN)
RLKRILVNLSV

SEQ ID NO: 39351 - protein, 10 aa, Artificial Sequence
  Description of Artificial Sequence: Synthetic peptide
  Seed: EMSSNSTALA (KKLC1_HUMAN)
EPSSNSTALV

SEQ ID NO: 39352 - protein, 11 aa, Artificial Sequence
  Description of Artificial Sequence: Synthetic peptide
  Seed: IVFWKYRRFQR (KKLC1_HUMAN)
ITFWKYRRFQK

SEQ ID NO: 39353 - protein, 10 aa, Artificial Sequence
  Description of Artificial Sequence: Synthetic peptide
  Seed: KYRRFQRNTG (KKLC1_HUMAN)
KIRRFQRNTI

SEQ ID NO: 39354 - protein, 9 aa, Artificial Sequence
  Description of Artificial Sequence: Synthetic peptide
  Seed: ALIVFWKYR (KKLC1_HUMAN)
AAIVFWKYK

SEQ ID NO: 39355 - protein, 10 aa, Artificial Sequence
  Description of Artificial Sequence: Synthetic peptide
  Seed: MSSNSTALAL (KKLC1_HUMAN)
MMSNSTALAM

SEQ ID NO: 39356 - protein, 9 aa, Artificial Sequence
  Description of Artificial Sequence: Synthetic peptide
  Seed: SNSTALALV (KKLC1_HUMAN)
STSTALALI

SEQ ID NO: 39357 - protein, 10 aa, Artificial Sequence
  Description of Artificial Sequence: Synthetic peptide
  Seed: SMVENKLVEL (KKLC1_HUMAN)
SAVENKLVEY

SEQ ID NO: 39358 - protein, 8 aa, Artificial Sequence
  Description of Artificial Sequence: Synthetic peptide
  Seed: VYDLSRDI (KKLC1_HUMAN)
VFDLSRDM

SEQ ID NO: 39359 - protein, 9 aa, Artificial Sequence
  Description of Artificial Sequence: Synthetic peptide
  Seed: KYRRFQRNT (KKLC1_HUMAN)
KMRRFQRNI

SEQ ID NO: 39360 - protein, 11 aa, Artificial Sequence
  Description of Artificial Sequence: Synthetic peptide
  Seed: YLLLASSILCA (KKLC1_HUMAN)
YKLLASSILCV

SEQ ID NO: 39361 - protein, 9 aa, Artificial Sequence
  Description of Artificial Sequence: Synthetic peptide
  Seed: RQKRILVNL (KKLC1_HUMAN)
RTKRILVNG

SEQ ID NO: 39362 - protein, 10 aa, Artificial Sequence
  Description of Artificial Sequence: Synthetic peptide
  Seed: YLLLASSILC (KKLC1_HUMAN)
YNLLASSILA

SEQ ID NO: 39363 - protein, 8 aa, Artificial Sequence
  Description of Artificial Sequence: Synthetic peptide
  Seed: VENKLVEL (KKLC1_HUMAN)
VENKLVEF

SEQ ID NO: 39364 - protein, 10 aa, Artificial Sequence
  Description of Artificial Sequence: Synthetic peptide
  Seed: KYRRFQRNTG (KKLC1_HUMAN)
KSRRFQRNTK

SEQ ID NO: 39365 - protein, 10 aa, Artificial Sequence
  Description of Artificial Sequence: Synthetic peptide
  Seed: LLASSILCAL (KKLC1_HUMAN)
LQASSILCAL

SEQ ID NO: 39366 - protein, 11 aa, Artificial Sequence
  Description of Artificial Sequence: Synthetic peptide
  Seed: YLLLASSILCA (KKLC1_HUMAN)
YFLLASSILCV

SEQ ID NO: 39367 - protein, 11 aa, Artificial Sequence
  Description of Artificial Sequence: Synthetic peptide
  Seed: RDILNNFPHSI (KKLC1_HUMAN)
RHILNNFPHSV

SEQ ID NO: 39368 - protein, 9 aa, Artificial Sequence
  Description of Artificial Sequence: Synthetic peptide
  Seed: KLVELEHTL (KKLC1_HUMAN)
KIVELEHTW

SEQ ID NO: 39369 - protein, 8 aa, Artificial Sequence
  Description of Artificial Sequence: Synthetic peptide
  Seed: MSSNSTAL (KKLC1_HUMAN)
MSSNSTAF

SEQ ID NO: 39370 - protein, 9 aa, Artificial Sequence
  Description of Artificial Sequence: Synthetic peptide
  Seed: SSNSTALAL (KKLC1_HUMAN)
SLNSTALAY

SEQ ID NO: 39371 - protein, 9 aa, Artificial Sequence
  Description of Artificial Sequence: Synthetic peptide
  Seed: KRILVNLSM (KKLC1_HUMAN)
KYILVNLSL

SEQ ID NO: 39372 - protein, 9 aa, Artificial Sequence
  Description of Artificial Sequence: Synthetic peptide
  Seed: SSNSTALAL (KKLC1_HUMAN)
SQNSTALAF

SEQ ID NO: 39373 - protein, 10 aa, Artificial Sequence
  Description of Artificial Sequence: Synthetic peptide
  Seed: MSSNSTALAL (KKLC1_HUMAN)
MQSNSTALAW

SEQ ID NO: 39374 - protein, 10 aa, Artificial Sequence
  Description of Artificial Sequence: Synthetic peptide
  Seed: KGFRGASPHR (KKLC1_HUMAN)
KSFRGASPHA

SEQ ID NO: 39375 - protein, 9 aa, Artificial Sequence
  Description of Artificial Sequence: Synthetic peptide
  Seed: AVYDLSRDI (KKLC1_HUMAN)
ALYDLSRDL

SEQ ID NO: 39376 - protein, 9 aa, Artificial Sequence
  Description of Artificial Sequence: Synthetic peptide
  Seed: LIVFWKYRR (KKLC1_HUMAN)
LFVFWKYRK

SEQ ID NO: 39377 - protein, 9 aa, Artificial Sequence
  Description of Artificial Sequence: Synthetic peptide
  Seed: ILCALIVFW (KKLC1_HUMAN)
ISCALIVFY

SEQ ID NO: 39378 - protein, 10 aa, Artificial Sequence
  Description of Artificial Sequence: Synthetic peptide
  Seed: LASSILCALI (KKLC1_HUMAN)
LVSSILCALL

SEQ ID NO: 39379 - protein, 9 aa, Artificial Sequence
  Description of Artificial Sequence: Synthetic peptide
  Seed: LLASSILCA (KKLC1_HUMAN)
LLASSILCI

SEQ ID NO: 39380 - protein, 9 aa, Artificial Sequence
  Description of Artificial Sequence: Synthetic peptide
  Seed: KYRRFQRNT (KKLC1_HUMAN)
KQRRFQRNA

SEQ ID NO: 39381 - protein, 9 aa, Artificial Sequence
  Description of Artificial Sequence: Synthetic peptide
  Seed: RQKRILVNL (KKLC1_HUMAN)
RMKRILVNA

SEQ ID NO: 39382 - protein, 9 aa, Artificial Sequence
  Description of Artificial Sequence: Synthetic peptide
  Seed: LASSILCAL (KKLC1_HUMAN)
LRSSILCAF

SEQ ID NO: 39383 - protein, 10 aa, Artificial Sequence
  Description of Artificial Sequence: Synthetic peptide
  Seed: GFRGASPHRK (KKLC1_HUMAN)
GTRGASPHRK

SEQ ID NO: 39384 - protein, 9 aa, Artificial Sequence
  Description of Artificial Sequence: Synthetic peptide
  Seed: LSRDILNNF (KKLC1_HUMAN)
LTRDILNNW

SEQ ID NO: 39385 - protein, 9 aa, Artificial Sequence
  Description of Artificial Sequence: Synthetic peptide
  Seed: LLLASSILC (KKLC1_HUMAN)
LLLASSILI

SEQ ID NO: 39386 - protein, 9 aa, Artificial Sequence
  Description of Artificial Sequence: Synthetic peptide
  Seed: RQKRILVNL (KKLC1_HUMAN)
RRKRILVNM

SEQ ID NO: 39387 - protein, 9 aa, Artificial Sequence
  Description of Artificial Sequence: Synthetic peptide
  Seed: RILVNLSMV (KKLC1_HUMAN)
RVLVNLSMF

SEQ ID NO: 39388 - protein, 11 aa, Artificial Sequence
  Description of Artificial Sequence: Synthetic peptide
  Seed: RDILNNFPHSI (KKLC1_HUMAN)
RNILNNFPHSV

SEQ ID NO: 39389 - protein, 11 aa, Artificial Sequence
  Description of Artificial Sequence: Synthetic peptide
  Seed: MNFYLLLASSI (KKLC1_HUMAN)
MNFYLLLASSF

SEQ ID NO: 39390 - protein, 9 aa, Artificial Sequence
  Description of Artificial Sequence: Synthetic peptide
  Seed: LIVFWKYRR (KKLC1_HUMAN)
LLVFWKYRR

SEQ ID NO: 39391 - protein, 9 aa, Artificial Sequence
  Description of Artificial Sequence: Synthetic peptide
  Seed: YLLLASSIL (KKLC1_HUMAN)
YALLASSIY

SEQ ID NO: 39392 - protein, 11 aa, Artificial Sequence
  Description of Artificial Sequence: Synthetic peptide
  Seed: SILCALIVFWK (KKLC1_HUMAN)
SYLCALIVFWR

SEQ ID NO: 39393 - protein, 9 aa, Artificial Sequence
  Description of Artificial Sequence: Synthetic peptide
  Seed: SNSTALALV (KKLC1_HUMAN)
SMSTALALT

SEQ ID NO: 39394 - protein, 11 aa, Artificial Sequence
  Description of Artificial Sequence: Synthetic peptide
  Seed: SSNSTALALVR (KKLC1_HUMAN)
STNSTALALVY

SEQ ID NO: 39395 - protein, 8 aa, Artificial Sequence
  Description of Artificial Sequence: Synthetic peptide
  Seed: NTDNNLAV (KKLC1_HUMAN)
NFDNNLAL

SEQ ID NO: 39396 - protein, 9 aa, Artificial Sequence
  Description of Artificial Sequence: Synthetic peptide
  Seed: SSILCALIV (KKLC1_HUMAN)
SMILCALIV

SEQ ID NO: 39397 - protein, 9 aa, Artificial Sequence
  Description of Artificial Sequence: Synthetic peptide
  Seed: KGFRGASPH (KKLC1_HUMAN)
KHFRGASPL

SEQ ID NO: 39398 - protein, 10 aa, Artificial Sequence
  Description of Artificial Sequence: Synthetic peptide
  Seed: MSSNSTALAL (KKLC1_HUMAN)
MMSNSTALAY

SEQ ID NO: 39399 - protein, 9 aa, Artificial Sequence
  Description of Artificial Sequence: Synthetic peptide
  Seed: ILNNFPHSI (KKLC1_HUMAN)
IFNNFPHSM

SEQ ID NO: 39400 - protein, 9 aa, Artificial Sequence
  Description of Artificial Sequence: Synthetic peptide
  Seed: VYDLSRDIL (KKLC1_HUMAN)
VSDLSRDIL

SEQ ID NO: 39401 - protein, 10 aa, Artificial Sequence
  Description of Artificial Sequence: Synthetic peptide
  Seed: LASSILCALI (KKLC1_HUMAN)
LLSSILCALT

SEQ ID NO: 39402 - protein, 9 aa, Artificial Sequence
  Description of Artificial Sequence: Synthetic peptide
  Seed: NNFPHSIAR (KKLC1_HUMAN)
NYFPHSIAY

SEQ ID NO: 39403 - protein, 10 aa, Artificial Sequence
  Description of Artificial Sequence: Synthetic peptide
  Seed: AVYDLSRDIL (KKLC1_HUMAN)
AMYDLSRDIF

SEQ ID NO: 39404 - protein, 9 aa, Artificial Sequence
  Description of Artificial Sequence: Synthetic peptide
  Seed: IARQKRILV (KKLC1_HUMAN)
IPRQKRILM

SEQ ID NO: 39405 - protein, 10 aa, Artificial Sequence
  Description of Artificial Sequence: Synthetic peptide
  Seed: CALIVFWKYR (KKLC1_HUMAN)
CTLIVFWKYR

SEQ ID NO: 39406 - protein, 9 aa, Artificial Sequence
  Description of Artificial Sequence: Synthetic peptide
  Seed: LSRDILNNF (KKLC1_HUMAN)
LARDILNNY

SEQ ID NO: 39407 - protein, 9 aa, Artificial Sequence
  Description of Artificial Sequence: Synthetic peptide
  Seed: LLLASSILC (KKLC1_HUMAN)
LMLASSILI

SEQ ID NO: 39408 - protein, 10 aa, Artificial Sequence
  Description of Artificial Sequence: Synthetic peptide
  Seed: MSSNSTALAL (KKLC1_HUMAN)
MLSNSTALAW

SEQ ID NO: 39409 - protein, 9 aa, Artificial Sequence
  Description of Artificial Sequence: Synthetic peptide
  Seed: VENKLVELE (KKLC1_HUMAN)
VENKLVELC

SEQ ID NO: 39410 - protein, 10 aa, Artificial Sequence
  Description of Artificial Sequence: Synthetic peptide
  Seed: QKRILVNLSM (KKLC1_HUMAN)
QCRILVNLSM

SEQ ID NO: 39411 - protein, 10 aa, Artificial Sequence
  Description of Artificial Sequence: Synthetic peptide
  Seed: KYRRFQRNTG (KKLC1_HUMAN)
KFRRFQRNTA

SEQ ID NO: 39412 - protein, 9 aa, Artificial Sequence
  Description of Artificial Sequence: Synthetic peptide
  Seed: LSRDILNNF (KKLC1_HUMAN)
LFRDILNNY

SEQ ID NO: 39413 - protein, 9 aa, Artificial Sequence
  Description of Artificial Sequence: Synthetic peptide
  Seed: NTDNNLAVY (KKLC1_HUMAN)
NMDNNLAVM

SEQ ID NO: 39414 - protein, 10 aa, Artificial Sequence
  Description of Artificial Sequence: Synthetic peptide
  Seed: QKRILVNLSM (KKLC1_HUMAN)
QVRILVNLSL

SEQ ID NO: 39415 - protein, 9 aa, Artificial Sequence
  Description of Artificial Sequence: Synthetic peptide
  Seed: SSNSTALAL (KKLC1_HUMAN)
SVNSTALAW

SEQ ID NO: 39416 - protein, 11 aa, Artificial Sequence
  Description of Artificial Sequence: Synthetic peptide
  Seed: VFWKYRRFQRN (KKLC1_HUMAN)
VFWKYRRFQRR

SEQ ID NO: 39417 - protein, 10 aa, Artificial Sequence
  Description of Artificial Sequence: Synthetic peptide
  Seed: SNSTALALVR (KKLC1_HUMAN)
STSTALALVR

SEQ ID NO: 39418 - protein, 9 aa, Artificial Sequence
  Description of Artificial Sequence: Synthetic peptide
  Seed: RQKRILVNL (KKLC1_HUMAN)
RYKRILVNT

SEQ ID NO: 39419 - protein, 10 aa, Artificial Sequence
  Description of Artificial Sequence: Synthetic peptide
  Seed: KGFRGASPHR (KKLC1_HUMAN)
KLFRGASPHK

SEQ ID NO: 39420 - protein, 10 aa, Artificial Sequence
  Description of Artificial Sequence: Synthetic peptide
  Seed: GEMSSNSTAL (KKLC1_HUMAN)
GKMSSNSTAM

SEQ ID NO: 39421 - protein, 10 aa, Artificial Sequence
  Description of Artificial Sequence: Synthetic peptide
  Seed: GEMSSNSTAL (KKLC1_HUMAN)
GDMSSNSTAV

SEQ ID NO: 39422 - protein, 9 aa, Artificial Sequence
  Description of Artificial Sequence: Synthetic peptide
  Seed: RQKRILVNL (KKLC1_HUMAN)
RAKRILVNM

SEQ ID NO: 39423 - protein, 10 aa, Artificial Sequence
  Description of Artificial Sequence: Synthetic peptide
  Seed: YLLLASSILC (KKLC1_HUMAN)
YFLLASSILM

SEQ ID NO: 39424 - protein, 9 aa, Artificial Sequence
  Description of Artificial Sequence: Synthetic peptide
  Seed: KYRRFQRNT (KKLC1_HUMAN)
KARRFQRNR

SEQ ID NO: 39425 - protein, 10 aa, Artificial Sequence
  Description of Artificial Sequence: Synthetic peptide
  Seed: KLVELEHTLL (KKLC1_HUMAN)
KQVELEHTLW

SEQ ID NO: 39426 - protein, 11 aa, Artificial Sequence
  Description of Artificial Sequence: Synthetic peptide
  Seed: SILCALIVFWK (KKLC1_HUMAN)
SMLCALIVFWR

SEQ ID NO: 39427 - protein, 9 aa, Artificial Sequence
  Description of Artificial Sequence: Synthetic peptide
  Seed: LASSILCAL (KKLC1_HUMAN)
LKSSILCAM

SEQ ID NO: 39428 - protein, 9 aa, Artificial Sequence
  Description of Artificial Sequence: Synthetic peptide
  Seed: KLVELEHTL (KKLC1_HUMAN)
KVVELEHTM

SEQ ID NO: 39429 - protein, 9 aa, Artificial Sequence
  Description of Artificial Sequence: Synthetic peptide
  Seed: LLSKGFRGA (KKLC1_HUMAN)
LMSKGFRGA

SEQ ID NO: 39430 - protein, 8 aa, Artificial Sequence
  Description of Artificial Sequence: Synthetic peptide
  Seed: FQRNTGEM (KKLC1_HUMAN)
FMRNTGEF

SEQ ID NO: 39431 - protein, 11 aa, Artificial Sequence
  Description of Artificial Sequence: Synthetic peptide
  Seed: MNFYLLLASSI (KKLC1_HUMAN)
MYFYLLLASSF

SEQ ID NO: 39432 - protein, 9 aa, Artificial Sequence
  Description of Artificial Sequence: Synthetic peptide
  Seed: MSSNSTALA (KKLC1_HUMAN)
MNSNSTALV

SEQ ID NO: 39433 - protein, 11 aa, Artificial Sequence
  Description of Artificial Sequence: Synthetic peptide
  Seed: LSMVENKLVEL (KKLC1_HUMAN)
LSMVENKLVEW

SEQ ID NO: 39434 - protein, 9 aa, Artificial Sequence
  Description of Artificial Sequence: Synthetic peptide
  Seed: NNFPHSIAR (KKLC1_HUMAN)
NRFPHSIAF

SEQ ID NO: 39435 - protein, 9 aa, Artificial Sequence
  Description of Artificial Sequence: Synthetic peptide
  Seed: LASSILCAL (KKLC1_HUMAN)
LPSSILCAV

SEQ ID NO: 39436 - protein, 9 aa, Artificial Sequence
  Description of Artificial Sequence: Synthetic peptide
  Seed: MVENKLVEL (KKLC1_HUMAN)
MQENKLVEL

SEQ ID NO: 39437 - protein, 10 aa, Artificial Sequence
  Description of Artificial Sequence: Synthetic peptide
  Seed: KGFRGASPHR (KKLC1_HUMAN)
KPFRGASPHK

SEQ ID NO: 39438 - protein, 9 aa, Artificial Sequence
  Description of Artificial Sequence: Synthetic peptide
  Seed: GFRGASPHR (KKLC1_HUMAN)
GSRGASPHR

SEQ ID NO: 39439 - protein, 10 aa, Artificial Sequence
  Description of Artificial Sequence: Synthetic peptide
  Seed: ILCALIVFWK (KKLC1_HUMAN)
ITCALIVFWR

SEQ ID NO: 39440 - protein, 9 aa, Artificial Sequence
  Description of Artificial Sequence: Synthetic peptide
  Seed: ILCALIVFW (KKLC1_HUMAN)
IGCALIVFW

SEQ ID NO: 39441 - protein, 9 aa, Artificial Sequence
  Description of Artificial Sequence: Synthetic peptide
  Seed: KGFRGASPH (KKLC1_HUMAN)
KKFRGASPH

SEQ ID NO: 39442 - protein, 10 aa, Artificial Sequence
  Description of Artificial Sequence: Synthetic peptide
  Seed: LLLASSILCA (KKLC1_HUMAN)
LYLASSILCL

SEQ ID NO: 39443 - protein, 11 aa, Artificial Sequence
  Description of Artificial Sequence: Synthetic peptide
  Seed: YLLLASSILCA (KKLC1_HUMAN)
YDLLASSILCV

SEQ ID NO: 39444 - protein, 10 aa, Artificial Sequence
  Description of Artificial Sequence: Synthetic peptide
  Seed: YLLLASSILC (KKLC1_HUMAN)
YGLLASSILL

SEQ ID NO: 39445 - protein, 9 aa, Artificial Sequence
  Description of Artificial Sequence: Synthetic peptide
  Seed: VELEHTLLS (KKLC1_HUMAN)
VELEHTLLI

SEQ ID NO: 39446 - protein, 9 aa, Artificial Sequence
  Description of Artificial Sequence: Synthetic peptide
  Seed: NSTALALVR (KKLC1_HUMAN)
NVTALALVR

SEQ ID NO: 39447 - protein, 8 aa, Artificial Sequence
  Description of Artificial Sequence: Synthetic peptide
  Seed: VYDLSRDI (KKLC1_HUMAN)
VADLSRDF

SEQ ID NO: 39448 - protein, 9 aa, Artificial Sequence
  Description of Artificial Sequence: Synthetic peptide
  Seed: LLASSILCA (KKLC1_HUMAN)
LMASSILCL

SEQ ID NO: 39449 - protein, 9 aa, Artificial Sequence
  Description of Artificial Sequence: Synthetic peptide
  Seed: SSNSTALAL (KKLC1_HUMAN)
SKNSTALAM

SEQ ID NO: 39450 - protein, 9 aa, Artificial Sequence
  Description of Artificial Sequence: Synthetic peptide
  Seed: LIVFWKYRR (KKLC1_HUMAN)
LQVFWKYRK

SEQ ID NO: 39451 - protein, 10 aa, Artificial Sequence
  Description of Artificial Sequence: Synthetic peptide
  Seed: GFRGASPHRK (KKLC1_HUMAN)
GTRGASPHRR

SEQ ID NO: 39452 - protein, 9 aa, Artificial Sequence
  Description of Artificial Sequence: Synthetic peptide
  Seed: LASSILCAL (KKLC1_HUMAN)
LVSSILCAW

SEQ ID NO: 39453 - protein, 10 aa, Artificial Sequence
  Description of Artificial Sequence: Synthetic peptide
  Seed: EMSSNSTALA (KKLC1_HUMAN)
ECSSNSTALV

SEQ ID NO: 39454 - protein, 9 aa, Artificial Sequence
  Description of Artificial Sequence: Synthetic peptide
  Seed: LVRPSSSGL (KKLC1_HUMAN)
LTRPSSSGM

SEQ ID NO: 39455 - protein, 10 aa, Artificial Sequence
  Description of Artificial Sequence: Synthetic peptide
  Seed: EHTLLSKGFR (KKLC1_HUMAN)
EDTLLSKGFR

SEQ ID NO: 39456 - protein, 9 aa, Artificial Sequence
  Description of Artificial Sequence: Synthetic peptide
  Seed: RQKRILVNL (KKLC1_HUMAN)
RSKRILVNF

SEQ ID NO: 39457 - protein, 9 aa, Artificial Sequence
  Description of Artificial Sequence: Synthetic peptide
  Seed: SSNSTALAL (KKLC1_HUMAN)
SWNSTALAY

SEQ ID NO: 39458 - protein, 9 aa, Artificial Sequence
  Description of Artificial Sequence: Synthetic peptide
  Seed: KLVELEHTL (KKLC1_HUMAN)
KMVELEHTL

SEQ ID NO: 39459 - protein, 10 aa, Artificial Sequence
  Description of Artificial Sequence: Synthetic peptide
  Seed: GEMSSNSTAL (KKLC1_HUMAN)
GEMSSNSTAW

SEQ ID NO: 39460 - protein, 9 aa, Artificial Sequence
  Description of Artificial Sequence: Synthetic peptide
  Seed: IARQKRILV (KKLC1_HUMAN)
IFRQKRILK

SEQ ID NO: 39461 - protein, 9 aa, Artificial Sequence
  Description of Artificial Sequence: Synthetic peptide
  Seed: ILNNFPHSI (KKLC1_HUMAN)
IVNNFPHSI

SEQ ID NO: 39462 - protein, 10 aa, Artificial Sequence
  Description of Artificial Sequence: Synthetic peptide
  Seed: RQKRILVNLS (KKLC1_HUMAN)
RIKRILVNLV

SEQ ID NO: 39463 - protein, 10 aa, Artificial Sequence
  Description of Artificial Sequence: Synthetic peptide
  Seed: RRFQRNTGEM (KKLC1_HUMAN)
RKFQRNTGEF

SEQ ID NO: 39464 - protein, 11 aa, Artificial Sequence
  Description of Artificial Sequence: Synthetic peptide
  Seed: SILCALIVFWK (KKLC1_HUMAN)
SVLCALIVFWR

SEQ ID NO: 39465 - protein, 9 aa, Artificial Sequence
  Description of Artificial Sequence: Synthetic peptide
  Seed: GEMSSNSTA (KKLC1_HUMAN)
GEMSSNSTW

SEQ ID NO: 39466 - protein, 9 aa, Artificial Sequence
  Description of Artificial Sequence: Synthetic peptide
  Seed: ASSILCALI (KKLC1_HUMAN)
ALSILCALM

SEQ ID NO: 39467 - protein, 9 aa, Artificial Sequence
  Description of Artificial Sequence: Synthetic peptide
  Seed: YLLLASSIL (KKLC1_HUMAN)
YMLLASSIF

SEQ ID NO: 39468 - protein, 10 aa, Artificial Sequence
  Description of Artificial Sequence: Synthetic peptide
  Seed: KLVELEHTLL (KKLC1_HUMAN)
KMVELEHTLV

SEQ ID NO: 39469 - protein, 10 aa, Artificial Sequence
  Description of Artificial Sequence: Synthetic peptide
  Seed: AVYDLSRDIL (KKLC1_HUMAN)
AMYDLSRDIV

SEQ ID NO: 39470 - protein, 9 aa, Artificial Sequence
  Description of Artificial Sequence: Synthetic peptide
  Seed: NTDNNLAVY (KKLC1_HUMAN)
NVDNNLAVV

SEQ ID NO: 39471 - protein, 10 aa, Artificial Sequence
  Description of Artificial Sequence: Synthetic peptide
  Seed: RQKRILVNLS (KKLC1_HUMAN)
RSKRILVNLL

SEQ ID NO: 39472 - protein, 11 aa, Artificial Sequence
  Description of Artificial Sequence: Synthetic peptide
  Seed: YLLLASSILCA (KKLC1_HUMAN)
YYLLASSILCI

SEQ ID NO: 39473 - protein, 10 aa, Artificial Sequence
  Description of Artificial Sequence: Synthetic peptide
  Seed: KGFRGASPHR (KKLC1_HUMAN)
KQFRGASPHR

SEQ ID NO: 39474 - protein, 9 aa, Artificial Sequence
  Description of Artificial Sequence: Synthetic peptide
  Seed: EMSSNSTAL (KKLC1_HUMAN)
EASSNSTAY

SEQ ID NO: 39475 - protein, 10 aa, Artificial Sequence
  Description of Artificial Sequence: Synthetic peptide
  Seed: KLVELEHTLL (KKLC1_HUMAN)
KQVELEHTLF

SEQ ID NO: 39476 - protein, 10 aa, Artificial Sequence
  Description of Artificial Sequence: Synthetic peptide
  Seed: ALIVFWKYRR (KKLC1_HUMAN)
ANIVFWKYRR

SEQ ID NO: 39477 - protein, 9 aa, Artificial Sequence
  Description of Artificial Sequence: Synthetic peptide
  Seed: NNFPHSIAR (KKLC1_HUMAN)
NIFPHSIAK

SEQ ID NO: 39478 - protein, 9 aa, Artificial Sequence
  Description of Artificial Sequence: Synthetic peptide
  Seed: SSNSTALAL (KKLC1_HUMAN)
SANSTALAL

SEQ ID NO: 39479 - protein, 9 aa, Artificial Sequence
  Description of Artificial Sequence: Synthetic peptide
  Seed: SSNSTALAL (KKLC1_HUMAN)
SYNSTALAI

SEQ ID NO: 39480 - protein, 11 aa, Artificial Sequence
  Description of Artificial Sequence: Synthetic peptide
  Seed: RDILNNFPHSI (KKLC1_HUMAN)
RLILNNFPHSL

SEQ ID NO: 39481 - protein, 10 aa, Artificial Sequence
  Description of Artificial Sequence: Synthetic peptide
  Seed: KYRRFQRNTG (KKLC1_HUMAN)
KVRRFQRNTL

SEQ ID NO: 39482 - protein, 10 aa, Artificial Sequence
  Description of Artificial Sequence: Synthetic peptide
  Seed: YLLLASSILC (KKLC1_HUMAN)
YKLLASSILV

SEQ ID NO: 39483 - protein, 9 aa, Artificial Sequence
  Description of Artificial Sequence: Synthetic peptide
  Seed: MSSNSTALA (KKLC1_HUMAN)
MTSNSTALI

SEQ ID NO: 39484 - protein, 11 aa, Artificial Sequence
  Description of Artificial Sequence: Synthetic peptide
  Seed: RQKRILVNLSM (KKLC1_HUMAN)
RNKRILVNLSR

SEQ ID NO: 39485 - protein, 9 aa, Artificial Sequence
  Description of Artificial Sequence: Synthetic peptide
  Seed: RQKRILVNL (KKLC1_HUMAN)
RVKRILVNC

SEQ ID NO: 39486 - protein, 10 aa, Artificial Sequence
  Description of Artificial Sequence: Synthetic peptide
  Seed: VFWKYRRFQR (KKLC1_HUMAN)
VSWKYRRFQK

SEQ ID NO: 39487 - protein, 11 aa, Artificial Sequence
  Description of Artificial Sequence: Synthetic peptide
  Seed: YLLLASSILCA (KKLC1_HUMAN)
YHLLASSILCI

SEQ ID NO: 39488 - protein, 10 aa, Artificial Sequence
  Description of Artificial Sequence: Synthetic peptide
  Seed: ALVRPSSSGL (KKLC1_HUMAN)
APVRPSSSGM

SEQ ID NO: 39489 - protein, 10 aa, Artificial Sequence
  Description of Artificial Sequence: Synthetic peptide
  Seed: FYLLLASSIL (KKLC1_HUMAN)
FYLLLASSIY

SEQ ID NO: 39490 - protein, 10 aa, Artificial Sequence
  Description of Artificial Sequence: Synthetic peptide
  Seed: KGFRGASPHR (KKLC1_HUMAN)
KVFRGASPHA

SEQ ID NO: 39491 - protein, 9 aa, Artificial Sequence
  Description of Artificial Sequence: Synthetic peptide
  Seed: RQKRILVNL (KKLC1_HUMAN)
RYKRILVNK

SEQ ID NO: 39492 - protein, 10 aa, Artificial Sequence
  Description of Artificial Sequence: Synthetic peptide
  Seed: RQKRILVNLS (KKLC1_HUMAN)
RVKRILVNLM

SEQ ID NO: 39493 - protein, 10 aa, Artificial Sequence
  Description of Artificial Sequence: Synthetic peptide
  Seed: YLLLASSILC (KKLC1_HUMAN)
YYLLASSILA

SEQ ID NO: 39494 - protein, 9 aa, Artificial Sequence
  Description of Artificial Sequence: Synthetic peptide
  Seed: NNFPHSIAR (KKLC1_HUMAN)
NVFPHSIAY

SEQ ID NO: 39495 - protein, 10 aa, Artificial Sequence
  Description of Artificial Sequence: Synthetic peptide
  Seed: GEMSSNSTAL (KKLC1_HUMAN)
GAMSSNSTAV

SEQ ID NO: 39496 - protein, 9 aa, Artificial Sequence
  Description of Artificial Sequence: Synthetic peptide
  Seed: KYRRFQRNT (KKLC1_HUMAN)
KTRRFQRNG

SEQ ID NO: 39497 - protein, 11 aa, Artificial Sequence
  Description of Artificial Sequence: Synthetic peptide
  Seed: RQKRILVNLSM (KKLC1_HUMAN)
RYKRILVNLSI

SEQ ID NO: 39498 - protein, 10 aa, Artificial Sequence
  Description of Artificial Sequence: Synthetic peptide
  Seed: GEMSSNSTAL (KKLC1_HUMAN)
GRMSSNSTAY

SEQ ID NO: 39499 - protein, 11 aa, Artificial Sequence
  Description of Artificial Sequence: Synthetic peptide
  Seed: LSMVENKLVEL (KKLC1_HUMAN)
LTMVENKLVEW

SEQ ID NO: 39500 - protein, 10 aa, Artificial Sequence
  Description of Artificial Sequence: Synthetic peptide
  Seed: YLLLASSILC (KKLC1_HUMAN)
YGLLASSILV

SEQ ID NO: 39501 - protein, 9 aa, Artificial Sequence
  Description of Artificial Sequence: Synthetic peptide
  Seed: NTDNNLAVY (KKLC1_HUMAN)
NMDNNLAVI

SEQ ID NO: 39502 - protein, 9 aa, Artificial Sequence
  Description of Artificial Sequence: Synthetic peptide
  Seed: NNFPHSIAR (KKLC1_HUMAN)
NQFPHSIAM

SEQ ID NO: 39503 - protein, 9 aa, Artificial Sequence
  Description of Artificial Sequence: Synthetic peptide
  Seed: NTDNNLAVY (KKLC1_HUMAN)
NTDNNLAVV

SEQ ID NO: 39504 - protein, 8 aa, Artificial Sequence
  Description of Artificial Sequence: Synthetic peptide
  Seed: VYDLSRDI (KKLC1_HUMAN)
VTDLSRDI

SEQ ID NO: 39505 - protein, 9 aa, Artificial Sequence
  Description of Artificial Sequence: Synthetic peptide
  Seed: MSSNSTALA (KKLC1_HUMAN)
MMSNSTALV

SEQ ID NO: 39506 - protein, 10 aa, Artificial Sequence
  Description of Artificial Sequence: Synthetic peptide
  Seed: SIARQKRILV (KKLC1_HUMAN)
SRARQKRILK

SEQ ID NO: 39507 - protein, 11 aa, Artificial Sequence
  Description of Artificial Sequence: Synthetic peptide
  Seed: YLLLASSILCA (KKLC1_HUMAN)
YKLLASSILCL

SEQ ID NO: 39508 - protein, 9 aa, Artificial Sequence
  Description of Artificial Sequence: Synthetic peptide
  Seed: LVRPSSSGL (KKLC1_HUMAN)
LGRPSSSGK

SEQ ID NO: 39509 - protein, 11 aa, Artificial Sequence
  Description of Artificial Sequence: Synthetic peptide
  Seed: KLVELEHTLLS (KKLC1_HUMAN)
KMVELEHTLLL

SEQ ID NO: 39510 - protein, 11 aa, Artificial Sequence
  Description of Artificial Sequence: Synthetic peptide
  Seed: MNFYLLLASSI (KKLC1_HUMAN)
MTFYLLLASSF

SEQ ID NO: 39511 - protein, 10 aa, Artificial Sequence
  Description of Artificial Sequence: Synthetic peptide
  Seed: GEMSSNSTAL (KKLC1_HUMAN)
GIMSSNSTAV

SEQ ID NO: 39512 - protein, 9 aa, Artificial Sequence
  Description of Artificial Sequence: Synthetic peptide
  Seed: KYRRFQRNT (KKLC1_HUMAN)
KYRRFQRNK

SEQ ID NO: 39513 - protein, 10 aa, Artificial Sequence
  Description of Artificial Sequence: Synthetic peptide
  Seed: YLLLASSILC (KKLC1_HUMAN)
YHLLASSILL

SEQ ID NO: 39514 - protein, 10 aa, Artificial Sequence
  Description of Artificial Sequence: Synthetic peptide
  Seed: SIARQKRILV (KKLC1_HUMAN)
STARQKRILK

SEQ ID NO: 39515 - protein, 9 aa, Artificial Sequence
  Description of Artificial Sequence: Synthetic peptide
  Seed: KYRRFQRNT (KKLC1_HUMAN)
KVRRFQRNG

SEQ ID NO: 39516 - protein, 9 aa, Artificial Sequence
  Description of Artificial Sequence: Synthetic peptide
  Seed: MSSNSTALA (KKLC1_HUMAN)
MLSNSTALA

SEQ ID NO: 39517 - protein, 11 aa, Artificial Sequence
  Description of Artificial Sequence: Synthetic peptide
  Seed: RQKRILVNLSM (KKLC1_HUMAN)
RQKRILVNLSR

SEQ ID NO: 39518 - protein, 9 aa, Artificial Sequence
  Description of Artificial Sequence: Synthetic peptide
  Seed: SSNSTALAL (KKLC1_HUMAN)
SYNSTALAL

SEQ ID NO: 39519 - protein, 10 aa, Artificial Sequence
  Description of Artificial Sequence: Synthetic peptide
  Seed: NNLAVYDLSR (KKLC1_HUMAN)
NALAVYDLSR

SEQ ID NO: 39520 - protein, 9 aa, Artificial Sequence
  Description of Artificial Sequence: Synthetic peptide
  Seed: FWKYRRFQR (KKLC1_HUMAN)
FYKYRRFQR

SEQ ID NO: 39521 - protein, 9 aa, Artificial Sequence
  Description of Artificial Sequence: Synthetic peptide
  Seed: ILNNFPHSI (KKLC1_HUMAN)
ILNNFPHSK

SEQ ID NO: 39522 - protein, 10 aa, Artificial Sequence
  Description of Artificial Sequence: Synthetic peptide
  Seed: EMSSNSTALA (KKLC1_HUMAN)
EVSSNSTALV

SEQ ID NO: 39523 - protein, 10 aa, Artificial Sequence
  Description of Artificial Sequence: Synthetic peptide
  Seed: RQKRILVNLS (KKLC1_HUMAN)
RTKRILVNLA

SEQ ID NO: 39524 - protein, 11 aa, Artificial Sequence
  Description of Artificial Sequence: Synthetic peptide
  Seed: IVFWKYRRFQR (KKLC1_HUMAN)
ILFWKYRRFQR

SEQ ID NO: 39525 - protein, 10 aa, Artificial Sequence
  Description of Artificial Sequence: Synthetic peptide
  Seed: KGFRGASPHR (KKLC1_HUMAN)
KYFRGASPHV

SEQ ID NO: 39526 - protein, 10 aa, Artificial Sequence
  Description of Artificial Sequence: Synthetic peptide
  Seed: QKRILVNLSM (KKLC1_HUMAN)
QFRILVNLSI

SEQ ID NO: 39527 - protein, 10 aa, Artificial Sequence
  Description of Artificial Sequence: Synthetic peptide
  Seed: ALVRPSSSGL (KKLC1_HUMAN)
AYVRPSSSGK

SEQ ID NO: 39528 - protein, 9 aa, Artificial Sequence
  Description of Artificial Sequence: Synthetic peptide
  Seed: MSSNSTALA (KKLC1_HUMAN)
MQSNSTALM

SEQ ID NO: 39529 - protein, 10 aa, Artificial Sequence
  Description of Artificial Sequence: Synthetic peptide
  Seed: EMSSNSTALA (KKLC1_HUMAN)
ETSSNSTALA

SEQ ID NO: 39530 - protein, 10 aa, Artificial Sequence
  Description of Artificial Sequence: Synthetic peptide
  Seed: QKRILVNLSM (KKLC1_HUMAN)
QFRILVNLSF

SEQ ID NO: 39531 - protein, 9 aa, Artificial Sequence
  Description of Artificial Sequence: Synthetic peptide
  Seed: RQKRILVNL (KKLC1_HUMAN)
RTKRILVNK

SEQ ID NO: 39532 - protein, 9 aa, Artificial Sequence
  Description of Artificial Sequence: Synthetic peptide
  Seed: SILCALIVF (KKLC1_HUMAN)
STLCALIVW

SEQ ID NO: 39533 - protein, 10 aa, Artificial Sequence
  Description of Artificial Sequence: Synthetic peptide
  Seed: LVRPSSSGLI (KKLC1_HUMAN)
LQRPSSSGLK

SEQ ID NO: 39534 - protein, 11 aa, Artificial Sequence
  Description of Artificial Sequence: Synthetic peptide
  Seed: RDILNNFPHSI (KKLC1_HUMAN)
REILNNFPHSA

SEQ ID NO: 39535 - protein, 9 aa, Artificial Sequence
  Description of Artificial Sequence: Synthetic peptide
  Seed: ILNNFPHSI (KKLC1_HUMAN)
IENNFPHSF

SEQ ID NO: 39536 - protein, 10 aa, Artificial Sequence
  Description of Artificial Sequence: Synthetic peptide
  Seed: LLASSILCAL (KKLC1_HUMAN)
LMASSILCAV

SEQ ID NO: 39537 - protein, 11 aa, Artificial Sequence
  Description of Artificial Sequence: Synthetic peptide
  Seed: RQKRILVNLSM (KKLC1_HUMAN)
RQKRILVNLSL

SEQ ID NO: 39538 - protein, 10 aa, Artificial Sequence
  Description of Artificial Sequence: Synthetic peptide
  Seed: KGFRGASPHR (KKLC1_HUMAN)
KSFRGASPHK

SEQ ID NO: 39539 - protein, 9 aa, Artificial Sequence
  Description of Artificial Sequence: Synthetic peptide
  Seed: MVENKLVEL (KKLC1_HUMAN)
MAENKLVEY

SEQ ID NO: 39540 - protein, 8 aa, Artificial Sequence
  Description of Artificial Sequence: Synthetic peptide
  Seed: MSSNSTAL (KKLC1_HUMAN)
MASNSTAM

SEQ ID NO: 39541 - protein, 10 aa, Artificial Sequence
  Description of Artificial Sequence: Synthetic peptide
  Seed: SKGFRGASPH (KKLC1_HUMAN)
SHGFRGASPF

SEQ ID NO: 39542 - protein, 10 aa, Artificial Sequence
  Description of Artificial Sequence: Synthetic peptide
  Seed: KLVELEHTLL (KKLC1_HUMAN)
KTVELEHTLK

SEQ ID NO: 39543 - protein, 9 aa, Artificial Sequence
  Description of Artificial Sequence: Synthetic peptide
  Seed: KRILVNLSM (KKLC1_HUMAN)
KSILVNLSF

SEQ ID NO: 39544 - protein, 8 aa, Artificial Sequence
  Description of Artificial Sequence: Synthetic peptide
  Seed: NTDNNLAV (KKLC1_HUMAN)
NYDNNLAM

SEQ ID NO: 39545 - protein, 8 aa, Artificial Sequence
  Description of Artificial Sequence: Synthetic peptide
  Seed: VYDLSRDI (KKLC1_HUMAN)
VSDLSRDL

SEQ ID NO: 39546 - protein, 9 aa, Artificial Sequence
  Description of Artificial Sequence: Synthetic peptide
  Seed: SSNSTALAL (KKLC1_HUMAN)
SYNSTALAF

SEQ ID NO: 39547 - protein, 9 aa, Artificial Sequence
  Description of Artificial Sequence: Synthetic peptide
  Seed: YLLLASSIL (KKLC1_HUMAN)
YKLLASSIL

SEQ ID NO: 39548 - protein, 10 aa, Artificial Sequence
  Description of Artificial Sequence: Synthetic peptide
  Seed: SSILCALIVF (KKLC1_HUMAN)
SQILCALIVM

SEQ ID NO: 39549 - protein, 10 aa, Artificial Sequence
  Description of Artificial Sequence: Synthetic peptide
  Seed: SMVENKLVEL (KKLC1_HUMAN)
SIVENKLVEV

SEQ ID NO: 39550 - protein, 8 aa, Artificial Sequence
  Description of Artificial Sequence: Synthetic peptide
  Seed: MSSNSTAL (KKLC1_HUMAN)
MASNSTAF

SEQ ID NO: 39551 - protein, 10 aa, Artificial Sequence
  Description of Artificial Sequence: Synthetic peptide
  Seed: SKGFRGASPH (KKLC1_HUMAN)
SSGFRGASPY

SEQ ID NO: 39552 - protein, 10 aa, Artificial Sequence
  Description of Artificial Sequence: Synthetic peptide
  Seed: ILCALIVFWK (KKLC1_HUMAN)
IMCALIVFWR

SEQ ID NO: 39553 - protein, 9 aa, Artificial Sequence
  Description of Artificial Sequence: Synthetic peptide
  Seed: LIVFWKYRR (KKLC1_HUMAN)
LAVFWKYRR

SEQ ID NO: 39554 - protein, 9 aa, Artificial Sequence
  Description of Artificial Sequence: Synthetic peptide
  Seed: KLVELEHTL (KKLC1_HUMAN)
KMVELEHTF

SEQ ID NO: 39555 - protein, 9 aa, Artificial Sequence
  Description of Artificial Sequence: Synthetic peptide
  Seed: KLVELEHTL (KKLC1_HUMAN)
KEVELEHTC

SEQ ID NO: 39556 - protein, 10 aa, Artificial Sequence
  Description of Artificial Sequence: Synthetic peptide
  Seed: NFYLLLASSI (KKLC1_HUMAN)
NEYLLLASSF

SEQ ID NO: 39557 - protein, 10 aa, Artificial Sequence
  Description of Artificial Sequence: Synthetic peptide
  Seed: GEMSSNSTAL (KKLC1_HUMAN)
GKMSSNSTAY

SEQ ID NO: 39558 - protein, 10 aa, Artificial Sequence
  Description of Artificial Sequence: Synthetic peptide
  Seed: YLLLASSILC (KKLC1_HUMAN)
YTLLASSILL

SEQ ID NO: 39559 - protein, 10 aa, Artificial Sequence
  Description of Artificial Sequence: Synthetic peptide
  Seed: AVYDLSRDIL (KKLC1_HUMAN)
ASYDLSRDIY

SEQ ID NO: 39560 - protein, 9 aa, Artificial Sequence
  Description of Artificial Sequence: Synthetic peptide
  Seed: RRFQRNTGE (KKLC1_HUMAN)
RRFQRNTGA

SEQ ID NO: 39561 - protein, 10 aa, Artificial Sequence
  Description of Artificial Sequence: Synthetic peptide
  Seed: CALIVFWKYR (KKLC1_HUMAN)
CKLIVFWKYR

SEQ ID NO: 39562 - protein, 9 aa, Artificial Sequence
  Description of Artificial Sequence: Synthetic peptide
  Seed: VYDLSRDIL (KKLC1_HUMAN)
VYDLSRDII

SEQ ID NO: 39563 - protein, 10 aa, Artificial Sequence
  Description of Artificial Sequence: Synthetic peptide
  Seed: KRILVNLSMV (KKLC1_HUMAN)
KRILVNLSMF

SEQ ID NO: 39564 - protein, 10 aa, Artificial Sequence
  Description of Artificial Sequence: Synthetic peptide
  Seed: KYRRFQRNTG (KKLC1_HUMAN)
KSRRFQRNTM

SEQ ID NO: 39565 - protein, 10 aa, Artificial Sequence
  Description of Artificial Sequence: Synthetic peptide
  Seed: NKLVELEHTL (KKLC1_HUMAN)
NYLVELEHTV

SEQ ID NO: 39566 - protein, 9 aa, Artificial Sequence
  Description of Artificial Sequence: Synthetic peptide
  Seed: AVYDLSRDI (KKLC1_HUMAN)
AQYDLSRDI

SEQ ID NO: 39567 - protein, 9 aa, Artificial Sequence
  Description of Artificial Sequence: Synthetic peptide
  Seed: VYDLSRDIL (KKLC1_HUMAN)
VWDLSRDIL

SEQ ID NO: 39568 - protein, 9 aa, Artificial Sequence
  Description of Artificial Sequence: Synthetic peptide
  Seed: KLVELEHTL (KKLC1_HUMAN)
KIVELEHTR

SEQ ID NO: 39569 - protein, 11 aa, Artificial Sequence
  Description of Artificial Sequence: Synthetic peptide
  Seed: RQKRILVNLSM (KKLC1_HUMAN)
RKKRILVNLSI

SEQ ID NO: 39570 - protein, 10 aa, Artificial Sequence
  Description of Artificial Sequence: Synthetic peptide
  Seed: NFYLLLASSI (KKLC1_HUMAN)
NLYLLLASSF

SEQ ID NO: 39571 - protein, 10 aa, Artificial Sequence
  Description of Artificial Sequence: Synthetic peptide
  Seed: AVYDLSRDIL (KKLC1_HUMAN)
AAYDLSRDIF

SEQ ID NO: 39572 - protein, 10 aa, Artificial Sequence
  Description of Artificial Sequence: Synthetic peptide
  Seed: YLLLASSILC (KKLC1_HUMAN)
YCLLASSILM

SEQ ID NO: 39573 - protein, 9 aa, Artificial Sequence
  Description of Artificial Sequence: Synthetic peptide
  Seed: LVRPSSSGL (KKLC1_HUMAN)
LTRPSSSGK

SEQ ID NO: 39574 - protein, 9 aa, Artificial Sequence
  Description of Artificial Sequence: Synthetic peptide
  Seed: RQKRILVNL (KKLC1_HUMAN)
RVKRILVNY

SEQ ID NO: 39575 - protein, 9 aa, Artificial Sequence
  Description of Artificial Sequence: Synthetic peptide
  Seed: AVYDLSRDI (KKLC1_HUMAN)
ATYDLSRDY

SEQ ID NO: 39576 - protein, 9 aa, Artificial Sequence
  Description of Artificial Sequence: Synthetic peptide
  Seed: KGFRGASPH (KKLC1_HUMAN)
KVFRGASPF

SEQ ID NO: 39577 - protein, 10 aa, Artificial Sequence
  Description of Artificial Sequence: Synthetic peptide
  Seed: GEMSSNSTAL (KKLC1_HUMAN)
GCMSSNSTAV

SEQ ID NO: 39578 - protein, 11 aa, Artificial Sequence
  Description of Artificial Sequence: Synthetic peptide
  Seed: MNFYLLLASSI (KKLC1_HUMAN)
MQFYLLLASSF

SEQ ID NO: 39579 - protein, 9 aa, Artificial Sequence
  Description of Artificial Sequence: Synthetic peptide
  Seed: RQKRILVNL (KKLC1_HUMAN)
RLKRILVNF

SEQ ID NO: 39580 - protein, 9 aa, Artificial Sequence
  Description of Artificial Sequence: Synthetic peptide
  Seed: KYRRFQRNT (KKLC1_HUMAN)
KMRRFQRNG

SEQ ID NO: 39581 - protein, 9 aa, Artificial Sequence
  Description of Artificial Sequence: Synthetic peptide
  Seed: KLVELEHTL (KKLC1_HUMAN)
KVVELEHTI

SEQ ID NO: 39582 - protein, 10 aa, Artificial Sequence
  Description of Artificial Sequence: Synthetic peptide
  Seed: NKLVELEHTL (KKLC1_HUMAN)
NKLVELEHTV

SEQ ID NO: 39583 - protein, 9 aa, Artificial Sequence
  Description of Artificial Sequence: Synthetic peptide
  Seed: LSRDILNNF (KKLC1_HUMAN)
LRRDILNNM

SEQ ID NO: 39584 - protein, 10 aa, Artificial Sequence
  Description of Artificial Sequence: Synthetic peptide
  Seed: MSSNSTALAL (KKLC1_HUMAN)
MRSNSTALAY

SEQ ID NO: 39585 - protein, 11 aa, Artificial Sequence
  Description of Artificial Sequence: Synthetic peptide
  Seed: KLVELEHTLLS (KKLC1_HUMAN)
KMVELEHTLLI

SEQ ID NO: 39586 - protein, 10 aa, Artificial Sequence
  Description of Artificial Sequence: Synthetic peptide
  Seed: TGEMSSNSTA (KKLC1_HUMAN)
TYEMSSNSTA

SEQ ID NO: 39587 - protein, 10 aa, Artificial Sequence
  Description of Artificial Sequence: Synthetic peptide
  Seed: AVYDLSRDIL (KKLC1_HUMAN)
AQYDLSRDIL

SEQ ID NO: 39588 - protein, 9 aa, Artificial Sequence
  Description of Artificial Sequence: Synthetic peptide
  Seed: LVRPSSSGL (KKLC1_HUMAN)
LVRPSSSGW

SEQ ID NO: 39589 - protein, 10 aa, Artificial Sequence
  Description of Artificial Sequence: Synthetic peptide
  Seed: QKRILVNLSM (KKLC1_HUMAN)
QQRILVNLSV

SEQ ID NO: 39590 - protein, 9 aa, Artificial Sequence
  Description of Artificial Sequence: Synthetic peptide
  Seed: KGFRGASPH (KKLC1_HUMAN)
KEFRGASPF

SEQ ID NO: 39591 - protein, 10 aa, Artificial Sequence
  Description of Artificial Sequence: Synthetic peptide
  Seed: YLLLASSILC (KKLC1_HUMAN)
YQLLASSILM

SEQ ID NO: 39592 - protein, 9 aa, Artificial Sequence
  Description of Artificial Sequence: Synthetic peptide
  Seed: MSSNSTALA (KKLC1_HUMAN)
MTSNSTALM

SEQ ID NO: 39593 - protein, 9 aa, Artificial Sequence
  Description of Artificial Sequence: Synthetic peptide
  Seed: VELEHTLLS (KKLC1_HUMAN)
VELEHTLLT

SEQ ID NO: 39594 - protein, 9 aa, Artificial Sequence
  Description of Artificial Sequence: Synthetic peptide
  Seed: ALIVFWKYR (KKLC1_HUMAN)
AFIVFWKYR

SEQ ID NO: 39595 - protein, 9 aa, Artificial Sequence
  Description of Artificial Sequence: Synthetic peptide
  Seed: KLVELEHTL (KKLC1_HUMAN)
KMVELEHTM

SEQ ID NO: 39596 - protein, 10 aa, Artificial Sequence
  Description of Artificial Sequence: Synthetic peptide
  Seed: LASSILCALI (KKLC1_HUMAN)
LLSSILCALP

SEQ ID NO: 39597 - protein, 10 aa, Artificial Sequence
  Description of Artificial Sequence: Synthetic peptide
  Seed: AVYDLSRDIL (KKLC1_HUMAN)
ALYDLSRDIL

SEQ ID NO: 39598 - protein, 10 aa, Artificial Sequence
  Description of Artificial Sequence: Synthetic peptide
  Seed: KGFRGASPHR (KKLC1_HUMAN)
KWFRGASPHR

SEQ ID NO: 39599 - protein, 9 aa, Artificial Sequence
  Description of Artificial Sequence: Synthetic peptide
  Seed: KYRRFQRNT (KKLC1_HUMAN)
KARRFQRNY

SEQ ID NO: 39600 - protein, 9 aa, Artificial Sequence
  Description of Artificial Sequence: Synthetic peptide
  Seed: MVENKLVEL (KKLC1_HUMAN)
MWENKLVEV

SEQ ID NO: 39601 - protein, 10 aa, Artificial Sequence
  Description of Artificial Sequence: Synthetic peptide
  Seed: DILNNFPHSI (KKLC1_HUMAN)
DLLNNFPHSV

SEQ ID NO: 39602 - protein, 9 aa, Artificial Sequence
  Description of Artificial Sequence: Synthetic peptide
  Seed: KGFRGASPH (KKLC1_HUMAN)
KQFRGASPY

SEQ ID NO: 39603 - protein, 10 aa, Artificial Sequence
  Description of Artificial Sequence: Synthetic peptide
  Seed: MSSNSTALAL (KKLC1_HUMAN)
MSSNSTALAM

SEQ ID NO: 39604 - protein, 10 aa, Artificial Sequence
  Description of Artificial Sequence: Synthetic peptide
  Seed: LLLASSILCA (KKLC1_HUMAN)
LILASSILCV

SEQ ID NO: 39605 - protein, 9 aa, Artificial Sequence
  Description of Artificial Sequence: Synthetic peptide
  Seed: LVRPSSSGL (KKLC1_HUMAN)
LTRPSSSGF

SEQ ID NO: 39606 - protein, 9 aa, Artificial Sequence
  Description of Artificial Sequence: Synthetic peptide
  Seed: YLLLASSIL (KKLC1_HUMAN)
YPLLASSIY

SEQ ID NO: 39607 - protein, 10 aa, Artificial Sequence
  Description of Artificial Sequence: Synthetic peptide
  Seed: FYLLLASSIL (KKLC1_HUMAN)
FKLLLASSIV

SEQ ID NO: 39608 - protein, 9 aa, Artificial Sequence
  Description of Artificial Sequence: Synthetic peptide
  Seed: YLLLASSIL (KKLC1_HUMAN)
YRLLASSIY

SEQ ID NO: 39609 - protein, 10 aa, Artificial Sequence
  Description of Artificial Sequence: Synthetic peptide
  Seed: LLASSILCAL (KKLC1_HUMAN)
LIASSILCAI

SEQ ID NO: 39610 - protein, 9 aa, Artificial Sequence
  Description of Artificial Sequence: Synthetic peptide
  Seed: VYDLSRDIL (KKLC1_HUMAN)
VLDLSRDIL

SEQ ID NO: 39611 - protein, 9 aa, Artificial Sequence
  Description of Artificial Sequence: Synthetic peptide
  Seed: SSNSTALAL (KKLC1_HUMAN)
SINSTALAL

SEQ ID NO: 39612 - protein, 10 aa, Artificial Sequence
  Description of Artificial Sequence: Synthetic peptide
  Seed: GEMSSNSTAL (KKLC1_HUMAN)
GGMSSNSTAV

SEQ ID NO: 39613 - protein, 11 aa, Artificial Sequence
  Description of Artificial Sequence: Synthetic peptide
  Seed: GEMSSNSTALA (KKLC1_HUMAN)
GEMSSNSTALC

SEQ ID NO: 39614 - protein, 9 aa, Artificial Sequence
  Description of Artificial Sequence: Synthetic peptide
  Seed: SILCALIVF (KKLC1_HUMAN)
SKLCALIVL

SEQ ID NO: 39615 - protein, 9 aa, Artificial Sequence
  Description of Artificial Sequence: Synthetic peptide
  Seed: KYRRFQRNT (KKLC1_HUMAN)
KMRRFQRNL

SEQ ID NO: 39616 - protein, 9 aa, Artificial Sequence
  Description of Artificial Sequence: Synthetic peptide
  Seed: YLLLASSIL (KKLC1_HUMAN)
YHLLASSIF

SEQ ID NO: 39617 - protein, 11 aa, Artificial Sequence
  Description of Artificial Sequence: Synthetic peptide
  Seed: YLLLASSILCA (KKLC1_HUMAN)
YELLASSILCL

SEQ ID NO: 39618 - protein, 9 aa, Artificial Sequence
  Description of Artificial Sequence: Synthetic peptide
  Seed: YLLLASSIL (KKLC1_HUMAN)
YKLLASSIY

SEQ ID NO: 39619 - protein, 9 aa, Artificial Sequence
  Description of Artificial Sequence: Synthetic peptide
  Seed: MVENKLVEL (KKLC1_HUMAN)
MRENKLVEY

SEQ ID NO: 39620 - protein, 10 aa, Artificial Sequence
  Description of Artificial Sequence: Synthetic peptide
  Seed: LASSILCALI (KKLC1_HUMAN)
LGSSILCALW

SEQ ID NO: 39621 - protein, 10 aa, Artificial Sequence
  Description of Artificial Sequence: Synthetic peptide
  Seed: RRFQRNTGEM (KKLC1_HUMAN)
RRFQRNTGEY

SEQ ID NO: 39622 - protein, 10 aa, Artificial Sequence
  Description of Artificial Sequence: Synthetic peptide
  Seed: LASSILCALI (KKLC1_HUMAN)
LNSSILCALW

SEQ ID NO: 39623 - protein, 8 aa, Artificial Sequence
  Description of Artificial Sequence: Synthetic peptide
  Seed: NTDNNLAV (KKLC1_HUMAN)
NYDNNLAL

SEQ ID NO: 39624 - protein, 11 aa, Artificial Sequence
  Description of Artificial Sequence: Synthetic peptide
  Seed: LLLASSILCAL (KKLC1_HUMAN)
LILASSILCAV

SEQ ID NO: 39625 - protein, 10 aa, Artificial Sequence
  Description of Artificial Sequence: Synthetic peptide
  Seed: DILNNFPHSI (KKLC1_HUMAN)
DGLNNFPHSV

SEQ ID NO: 39626 - protein, 10 aa, Artificial Sequence
  Description of Artificial Sequence: Synthetic peptide
  Seed: RRFQRNTGEM (KKLC1_HUMAN)
RAFQRNTGEF

SEQ ID NO: 39627 - protein, 10 aa, Artificial Sequence
  Description of Artificial Sequence: Synthetic peptide
  Seed: MSSNSTALAL (KKLC1_HUMAN)
MNSNSTALAM

SEQ ID NO: 39628 - protein, 10 aa, Artificial Sequence
  Description of Artificial Sequence: Synthetic peptide
  Seed: KYRRFQRNTG (KKLC1_HUMAN)
KARRFQRNTV

SEQ ID NO: 39629 - protein, 10 aa, Artificial Sequence
  Description of Artificial Sequence: Synthetic peptide
  Seed: KLVELEHTLL (KKLC1_HUMAN)
KVVELEHTLK

SEQ ID NO: 39630 - protein, 10 aa, Artificial Sequence
  Description of Artificial Sequence: Synthetic peptide
  Seed: QKRILVNLSM (KKLC1_HUMAN)
QCRILVNLSL

SEQ ID NO: 39631 - protein, 9 aa, Artificial Sequence
  Description of Artificial Sequence: Synthetic peptide
  Seed: YLLLASSIL (KKLC1_HUMAN)
YFLLASSIV

SEQ ID NO: 39632 - protein, 9 aa, Artificial Sequence
  Description of Artificial Sequence: Synthetic peptide
  Seed: SSNSTALAL (KKLC1_HUMAN)
SPNSTALAY

SEQ ID NO: 39633 - protein, 9 aa, Artificial Sequence
  Description of Artificial Sequence: Synthetic peptide
  Seed: LSRDILNNF (KKLC1_HUMAN)
LGRDILNNW

SEQ ID NO: 39634 - protein, 9 aa, Artificial Sequence
  Description of Artificial Sequence: Synthetic peptide
  Seed: KYRRFQRNT (KKLC1_HUMAN)
KYRRFQRNR

SEQ ID NO: 39635 - protein, 11 aa, Artificial Sequence
  Description of Artificial Sequence: Synthetic peptide
  Seed: YLLLASSILCA (KKLC1_HUMAN)
YALLASSILCI

SEQ ID NO: 39636 - protein, 10 aa, Artificial Sequence
  Description of Artificial Sequence: Synthetic peptide
  Seed: FYLLLASSIL (KKLC1_HUMAN)
FLLLLASSIV

SEQ ID NO: 39637 - protein, 9 aa, Artificial Sequence
  Description of Artificial Sequence: Synthetic peptide
  Seed: SSNSTALAL (KKLC1_HUMAN)
SDNSTALAL

SEQ ID NO: 39638 - protein, 11 aa, Artificial Sequence
  Description of Artificial Sequence: Synthetic peptide
  Seed: YLLLASSILCA (KKLC1_HUMAN)
YSLLASSILCI

SEQ ID NO: 39639 - protein, 11 aa, Artificial Sequence
  Description of Artificial Sequence: Synthetic peptide
  Seed: YLLLASSILCA (KKLC1_HUMAN)
YPLLASSILCL

SEQ ID NO: 39640 - protein, 9 aa, Artificial Sequence
  Description of Artificial Sequence: Synthetic peptide
  Seed: MVENKLVEL (KKLC1_HUMAN)
MIENKLVEV

SEQ ID NO: 39641 - protein, 10 aa, Artificial Sequence
  Description of Artificial Sequence: Synthetic peptide
  Seed: GEMSSNSTAL (KKLC1_HUMAN)
GFMSSNSTAV

SEQ ID NO: 39642 - protein, 10 aa, Artificial Sequence
  Description of Artificial Sequence: Synthetic peptide
  Seed: SNTDNNLAVY (KKLC1_HUMAN)
SPTDNNLAVY

SEQ ID NO: 39643 - protein, 9 aa, Artificial Sequence
  Description of Artificial Sequence: Synthetic peptide
  Seed: KYRRFQRNT (KKLC1_HUMAN)
KFRRFQRNK

SEQ ID NO: 39644 - protein, 11 aa, Artificial Sequence
  Description of Artificial Sequence: Synthetic peptide
  Seed: RQKRILVNLSM (KKLC1_HUMAN)
RFKRILVNLSV

SEQ ID NO: 39645 - protein, 9 aa, Artificial Sequence
  Description of Artificial Sequence: Synthetic peptide
  Seed: FWKYRRFQR (KKLC1_HUMAN)
FTKYRRFQK

SEQ ID NO: 39646 - protein, 10 aa, Artificial Sequence
  Description of Artificial Sequence: Synthetic peptide
  Seed: AVYDLSRDIL (KKLC1_HUMAN)
AAYDLSRDIY

SEQ ID NO: 39647 - protein, 9 aa, Artificial Sequence
  Description of Artificial Sequence: Synthetic peptide
  Seed: NNFPHSIAR (KKLC1_HUMAN)
NSFPHSIAK

SEQ ID NO: 39648 - protein, 10 aa, Artificial Sequence
  Description of Artificial Sequence: Synthetic peptide
  Seed: KLVELEHTLL (KKLC1_HUMAN)
KLVELEHTLF

SEQ ID NO: 39649 - protein, 9 aa, Artificial Sequence
  Description of Artificial Sequence: Synthetic peptide
  Seed: MSSNSTALA (KKLC1_HUMAN)
MISNSTALY

SEQ ID NO: 39650 - protein, 9 aa, Artificial Sequence
  Description of Artificial Sequence: Synthetic peptide
  Seed: KYRRFQRNT (KKLC1_HUMAN)
KLRRFQRNL

SEQ ID NO: 39651 - protein, 9 aa, Artificial Sequence
  Description of Artificial Sequence: Synthetic peptide
  Seed: VYDLSRDIL (KKLC1_HUMAN)
VADLSRDIF

SEQ ID NO: 39652 - protein, 10 aa, Artificial Sequence
  Description of Artificial Sequence: Synthetic peptide
  Seed: NKLVELEHTL (KKLC1_HUMAN)
NLLVELEHTV

SEQ ID NO: 39653 - protein, 11 aa, Artificial Sequence
  Description of Artificial Sequence: Synthetic peptide
  Seed: IVFWKYRRFQR (KKLC1_HUMAN)
IRFWKYRRFQR

SEQ ID NO: 39654 - protein, 10 aa, Artificial Sequence
  Description of Artificial Sequence: Synthetic peptide
  Seed: LASSILCALI (KKLC1_HUMAN)
LMSSILCALH

SEQ ID NO: 39655 - protein, 9 aa, Artificial Sequence
  Description of Artificial Sequence: Synthetic peptide
  Seed: RQKRILVNL (KKLC1_HUMAN)
RIKRILVNS

SEQ ID NO: 39656 - protein, 9 aa, Artificial Sequence
  Description of Artificial Sequence: Synthetic peptide
  Seed: SILCALIVF (KKLC1_HUMAN)
STLCALIVF

SEQ ID NO: 39657 - protein, 10 aa, Artificial Sequence
  Description of Artificial Sequence: Synthetic peptide
  Seed: KYRRFQRNTG (KKLC1_HUMAN)
KVRRFQRNTV

SEQ ID NO: 39658 - protein, 10 aa, Artificial Sequence
  Description of Artificial Sequence: Synthetic peptide
  Seed: SSNSTALALV (KKLC1_HUMAN)
SMNSTALALI

SEQ ID NO: 39659 - protein, 9 aa, Artificial Sequence
  Description of Artificial Sequence: Synthetic peptide
  Seed: NNFPHSIAR (KKLC1_HUMAN)
NVFPHSIAF

SEQ ID NO: 39660 - protein, 10 aa, Artificial Sequence
  Description of Artificial Sequence: Synthetic peptide
  Seed: YLLLASSILC (KKLC1_HUMAN)
YHLLASSILM

SEQ ID NO: 39661 - protein, 9 aa, Artificial Sequence
  Description of Artificial Sequence: Synthetic peptide
  Seed: MVENKLVEL (KKLC1_HUMAN)
MGENKLVEL

SEQ ID NO: 39662 - protein, 9 aa, Artificial Sequence
  Description of Artificial Sequence: Synthetic peptide
  Seed: LLASSILCA (KKLC1_HUMAN)
LLASSILCM

SEQ ID NO: 39663 - protein, 10 aa, Artificial Sequence
  Description of Artificial Sequence: Synthetic peptide
  Seed: ALVRPSSSGL (KKLC1_HUMAN)
AEVRPSSSGK

SEQ ID NO: 39664 - protein, 10 aa, Artificial Sequence
  Description of Artificial Sequence: Synthetic peptide
  Seed: EHTLLSKGFR (KKLC1_HUMAN)
EATLLSKGFR

SEQ ID NO: 39665 - protein, 9 aa, Artificial Sequence
  Description of Artificial Sequence: Synthetic peptide
  Seed: LASSILCAL (KKLC1_HUMAN)
LPSSILCAF

SEQ ID NO: 39666 - protein, 9 aa, Artificial Sequence
  Description of Artificial Sequence: Synthetic peptide
  Seed: LASSILCAL (KKLC1_HUMAN)
LSSSILCAI

SEQ ID NO: 39667 - protein, 11 aa, Artificial Sequence
  Description of Artificial Sequence: Synthetic peptide
  Seed: YLLLASSILCA (KKLC1_HUMAN)
YTLLASSILCV

SEQ ID NO: 39668 - protein, 11 aa, Artificial Sequence
  Description of Artificial Sequence: Synthetic peptide
  Seed: RQKRILVNLSM (KKLC1_HUMAN)
RKKRILVNLSR

SEQ ID NO: 39669 - protein, 9 aa, Artificial Sequence
  Description of Artificial Sequence: Synthetic peptide
  Seed: LSRDILNNF (KKLC1_HUMAN)
LMRDILNNM

SEQ ID NO: 39670 - protein, 9 aa, Artificial Sequence
  Description of Artificial Sequence: Synthetic peptide
  Seed: RQKRILVNL (KKLC1_HUMAN)
RIKRILVNW

SEQ ID NO: 39671 - protein, 10 aa, Artificial Sequence
  Description of Artificial Sequence: Synthetic peptide
  Seed: LASSILCALI (KKLC1_HUMAN)
LCSSILCALW

SEQ ID NO: 39672 - protein, 9 aa, Artificial Sequence
  Description of Artificial Sequence: Synthetic peptide
  Seed: VYDLSRDIL (KKLC1_HUMAN)
VTDLSRDIF

SEQ ID NO: 39673 - protein, 9 aa, Artificial Sequence
  Description of Artificial Sequence: Synthetic peptide
  Seed: LASSILCAL (KKLC1_HUMAN)
LQSSILCAM

SEQ ID NO: 39674 - protein, 11 aa, Artificial Sequence
  Description of Artificial Sequence: Synthetic peptide
  Seed: RQKRILVNLSM (KKLC1_HUMAN)
RTKRILVNLSV

SEQ ID NO: 39675 - protein, 10 aa, Artificial Sequence
  Description of Artificial Sequence: Synthetic peptide
  Seed: YLLLASSILC (KKLC1_HUMAN)
YALLASSILI

SEQ ID NO: 39676 - protein, 8 aa, Artificial Sequence
  Description of Artificial Sequence: Synthetic peptide
  Seed: VENKLVEL (KKLC1_HUMAN)
VDNKLVEL

SEQ ID NO: 39677 - protein, 10 aa, Artificial Sequence
  Description of Artificial Sequence: Synthetic peptide
  Seed: EMSSNSTALA (KKLC1_HUMAN)
EYSSNSTALV

SEQ ID NO: 39678 - protein, 9 aa, Artificial Sequence
  Description of Artificial Sequence: Synthetic peptide
  Seed: RQKRILVNL (KKLC1_HUMAN)
RYKRILVNV

SEQ ID NO: 39679 - protein, 10 aa, Artificial Sequence
  Description of Artificial Sequence: Synthetic peptide
  Seed: KYRRFQRNTG (KKLC1_HUMAN)
KTRRFQRNTF

SEQ ID NO: 39680 - protein, 10 aa, Artificial Sequence
  Description of Artificial Sequence: Synthetic peptide
  Seed: KGFRGASPHR (KKLC1_HUMAN)
KYFRGASPHR

SEQ ID NO: 39681 - protein, 10 aa, Artificial Sequence
  Description of Artificial Sequence: Synthetic peptide
  Seed: NFYLLLASSI (KKLC1_HUMAN)
NDYLLLASSF

SEQ ID NO: 39682 - protein, 9 aa, Artificial Sequence
  Description of Artificial Sequence: Synthetic peptide
  Seed: KYRRFQRNT (KKLC1_HUMAN)
KYRRFQRNM

SEQ ID NO: 39683 - protein, 11 aa, Artificial Sequence
  Description of Artificial Sequence: Synthetic peptide
  Seed: RQKRILVNLSM (KKLC1_HUMAN)
RYKRILVNLSK

SEQ ID NO: 39684 - protein, 10 aa, Artificial Sequence
  Description of Artificial Sequence: Synthetic peptide
  Seed: VFWKYRRFQR (KKLC1_HUMAN)
VQWKYRRFQR

SEQ ID NO: 39685 - protein, 10 aa, Artificial Sequence
  Description of Artificial Sequence: Synthetic peptide
  Seed: RQKRILVNLS (KKLC1_HUMAN)
RSKRILVNLS

SEQ ID NO: 39686 - protein, 9 aa, Artificial Sequence
  Description of Artificial Sequence: Synthetic peptide
  Seed: FPHSIARQK (KKLC1_HUMAN)
FPHSIARQP

SEQ ID NO: 39687 - protein, 10 aa, Artificial Sequence
  Description of Artificial Sequence: Synthetic peptide
  Seed: KGFRGASPHR (KKLC1_HUMAN)
KMFRGASPHA

SEQ ID NO: 39688 - protein, 9 aa, Artificial Sequence
  Description of Artificial Sequence: Synthetic peptide
  Seed: LASSILCAL (KKLC1_HUMAN)
LQSSILCAV

SEQ ID NO: 39689 - protein, 9 aa, Artificial Sequence
  Description of Artificial Sequence: Synthetic peptide
  Seed: ILNNFPHSI (KKLC1_HUMAN)
IANNFPHSM

SEQ ID NO: 39690 - protein, 10 aa, Artificial Sequence
  Description of Artificial Sequence: Synthetic peptide
  Seed: GEMSSNSTAL (KKLC1_HUMAN)
GIMSSNSTAF

SEQ ID NO: 39691 - protein, 10 aa, Artificial Sequence
  Description of Artificial Sequence: Synthetic peptide
  Seed: SNTDNNLAVY (KKLC1_HUMAN)
SATDNNLAVY

SEQ ID NO: 39692 - protein, 9 aa, Artificial Sequence
  Description of Artificial Sequence: Synthetic peptide
  Seed: KYRRFQRNT (KKLC1_HUMAN)
KMRRFQRNY

SEQ ID NO: 39693 - protein, 10 aa, Artificial Sequence
  Description of Artificial Sequence: Synthetic peptide
  Seed: MSSNSTALAL (KKLC1_HUMAN)
MKSNSTALAM

SEQ ID NO: 39694 - protein, 8 aa, Artificial Sequence
  Description of Artificial Sequence: Synthetic peptide
  Seed: VENKLVEL (KKLC1_HUMAN)
VQNKLVEV

SEQ ID NO: 39695 - protein, 9 aa, Artificial Sequence
  Description of Artificial Sequence: Synthetic peptide
  Seed: YLLLASSIL (KKLC1_HUMAN)
YPLLASSIF

SEQ ID NO: 39696 - protein, 9 aa, Artificial Sequence
  Description of Artificial Sequence: Synthetic peptide
  Seed: NTDNNLAVY (KKLC1_HUMAN)
NYDNNLAVF

SEQ ID NO: 39697 - protein, 8 aa, Artificial Sequence
  Description of Artificial Sequence: Synthetic peptide
  Seed: VYDLSRDI (KKLC1_HUMAN)
VFDLSRDF

SEQ ID NO: 39698 - protein, 11 aa, Artificial Sequence
  Description of Artificial Sequence: Synthetic peptide
  Seed: RQKRILVNLSM (KKLC1_HUMAN)
RNKRILVNLSI

SEQ ID NO: 39699 - protein, 10 aa, Artificial Sequence
  Description of Artificial Sequence: Synthetic peptide
  Seed: YLLLASSILC (KKLC1_HUMAN)
YSLLASSILV

SEQ ID NO: 39700 - protein, 9 aa, Artificial Sequence
  Description of Artificial Sequence: Synthetic peptide
  Seed: ILNNFPHSI (KKLC1_HUMAN)
ILNNFPHSR

SEQ ID NO: 39701 - protein, 9 aa, Artificial Sequence
  Description of Artificial Sequence: Synthetic peptide
  Seed: KYRRFQRNT (KKLC1_HUMAN)
KTRRFQRNR

SEQ ID NO: 39702 - protein, 9 aa, Artificial Sequence
  Description of Artificial Sequence: Synthetic peptide
  Seed: IARQKRILV (KKLC1_HUMAN)
IPRQKRILA

SEQ ID NO: 39703 - protein, 8 aa, Artificial Sequence
  Description of Artificial Sequence: Synthetic peptide
  Seed: NTDNNLAV (KKLC1_HUMAN)
NMDNNLAL

SEQ ID NO: 39704 - protein, 9 aa, Artificial Sequence
  Description of Artificial Sequence: Synthetic peptide
  Seed: YLLLASSIL (KKLC1_HUMAN)
YKLLASSIV

SEQ ID NO: 39705 - protein, 9 aa, Artificial Sequence
  Description of Artificial Sequence: Synthetic peptide
  Seed: IARQKRILV (KKLC1_HUMAN)
IPRQKRILF

SEQ ID NO: 39706 - protein, 10 aa, Artificial Sequence
  Description of Artificial Sequence: Synthetic peptide
  Seed: LLASSILCAL (KKLC1_HUMAN)
LVASSILCAY

SEQ ID NO: 39707 - protein, 9 aa, Artificial Sequence
  Description of Artificial Sequence: Synthetic peptide
  Seed: GASPHRKST (KKLC1_HUMAN)
GSSPHRKSF

SEQ ID NO: 39708 - protein, 10 aa, Artificial Sequence
  Description of Artificial Sequence: Synthetic peptide
  Seed: SKGFRGASPH (KKLC1_HUMAN)
SIGFRGASPF

SEQ ID NO: 39709 - protein, 9 aa, Artificial Sequence
  Description of Artificial Sequence: Synthetic peptide
  Seed: MSSNSTALA (KKLC1_HUMAN)
MASNSTALA

SEQ ID NO: 39710 - protein, 9 aa, Artificial Sequence
  Description of Artificial Sequence: Synthetic peptide
  Seed: KYRRFQRNT (KKLC1_HUMAN)
KSRRFQRNY

SEQ ID NO: 39711 - protein, 9 aa, Artificial Sequence
  Description of Artificial Sequence: Synthetic peptide
  Seed: LASSILCAL (KKLC1_HUMAN)
LHSSILCAF

SEQ ID NO: 39712 - protein, 9 aa, Artificial Sequence
  Description of Artificial Sequence: Synthetic peptide
  Seed: RQKRILVNL (KKLC1_HUMAN)
RYKRILVNA

SEQ ID NO: 39713 - protein, 10 aa, Artificial Sequence
  Description of Artificial Sequence: Synthetic peptide
  Seed: KGFRGASPHR (KKLC1_HUMAN)
KYFRGASPHK

SEQ ID NO: 39714 - protein, 9 aa, Artificial Sequence
  Description of Artificial Sequence: Synthetic peptide
  Seed: LASSILCAL (KKLC1_HUMAN)
LLSSILCAA

SEQ ID NO: 39715 - protein, 11 aa, Artificial Sequence
  Description of Artificial Sequence: Synthetic peptide
  Seed: RQKRILVNLSM (KKLC1_HUMAN)
RCKRILVNLSR

SEQ ID NO: 39716 - protein, 9 aa, Artificial Sequence
  Description of Artificial Sequence: Synthetic peptide
  Seed: KYRRFQRNT (KKLC1_HUMAN)
KARRFQRNS

SEQ ID NO: 39717 - protein, 10 aa, Artificial Sequence
  Description of Artificial Sequence: Synthetic peptide
  Seed: KRILVNLSMV (KKLC1_HUMAN)
KLILVNLSMA

SEQ ID NO: 39718 - protein, 9 aa, Artificial Sequence
  Description of Artificial Sequence: Synthetic peptide
  Seed: LASSILCAL (KKLC1_HUMAN)
LESSILCAF

SEQ ID NO: 39719 - protein, 9 aa, Artificial Sequence
  Description of Artificial Sequence: Synthetic peptide
  Seed: MVENKLVEL (KKLC1_HUMAN)
MSENKLVEV

SEQ ID NO: 39720 - protein, 11 aa, Artificial Sequence
  Description of Artificial Sequence: Synthetic peptide
  Seed: RQKRILVNLSM (KKLC1_HUMAN)
RVKRILVNLSL

SEQ ID NO: 39721 - protein, 11 aa, Artificial Sequence
  Description of Artificial Sequence: Synthetic peptide
  Seed: LSMVENKLVEL (KKLC1_HUMAN)
LLMVENKLVEI

SEQ ID NO: 39722 - protein, 10 aa, Artificial Sequence
  Description of Artificial Sequence: Synthetic peptide
  Seed: LLASSILCAL (KKLC1_HUMAN)
LLASSILCAF

SEQ ID NO: 39723 - protein, 10 aa, Artificial Sequence
  Description of Artificial Sequence: Synthetic peptide
  Seed: SILCALIVFW (KKLC1_HUMAN)
STLCALIVFW

SEQ ID NO: 39724 - protein, 9 aa, Artificial Sequence
  Description of Artificial Sequence: Synthetic peptide
  Seed: MVENKLVEL (KKLC1_HUMAN)
MEENKLVEF

SEQ ID NO: 39725 - protein, 9 aa, Artificial Sequence
  Description of Artificial Sequence: Synthetic peptide
  Seed: EMSSNSTAL (KKLC1_HUMAN)
EQSSNSTAY

SEQ ID NO: 39726 - protein, 9 aa, Artificial Sequence
  Description of Artificial Sequence: Synthetic peptide
  Seed: KYRRFQRNT (KKLC1_HUMAN)
KLRRFQRNI

SEQ ID NO: 39727 - protein, 10 aa, Artificial Sequence
  Description of Artificial Sequence: Synthetic peptide
  Seed: GEMSSNSTAL (KKLC1_HUMAN)
GEMSSNSTAA

SEQ ID NO: 39728 - protein, 10 aa, Artificial Sequence
  Description of Artificial Sequence: Synthetic peptide
  Seed: EHTLLSKGFR (KKLC1_HUMAN)
EPTLLSKGFR

SEQ ID NO: 39729 - protein, 10 aa, Artificial Sequence
  Description of Artificial Sequence: Synthetic peptide
  Seed: GEMSSNSTAL (KKLC1_HUMAN)
GTMSSNSTAF

SEQ ID NO: 39730 - protein, 9 aa, Artificial Sequence
  Description of Artificial Sequence: Synthetic peptide
  Seed: RQKRILVNL (KKLC1_HUMAN)
RLKRILVNG

SEQ ID NO: 39731 - protein, 10 aa, Artificial Sequence
  Description of Artificial Sequence: Synthetic peptide
  Seed: YLLLASSILC (KKLC1_HUMAN)
YQLLASSILA

SEQ ID NO: 39732 - protein, 10 aa, Artificial Sequence
  Description of Artificial Sequence: Synthetic peptide
  Seed: QKRILVNLSM (KKLC1_HUMAN)
QRRILVNLSK

SEQ ID NO: 39733 - protein, 9 aa, Artificial Sequence
  Description of Artificial Sequence: Synthetic peptide
  Seed: LLLASSILC (KKLC1_HUMAN)
LTLASSILV

SEQ ID NO: 39734 - protein, 9 aa, Artificial Sequence
  Description of Artificial Sequence: Synthetic peptide
  Seed: KLVELEHTL (KKLC1_HUMAN)
KYVELEHTV

SEQ ID NO: 39735 - protein, 10 aa, Artificial Sequence
  Description of Artificial Sequence: Synthetic peptide
  Seed: SMVENKLVEL (KKLC1_HUMAN)
SRVENKLVEF

SEQ ID NO: 39736 - protein, 10 aa, Artificial Sequence
  Description of Artificial Sequence: Synthetic peptide
  Seed: MSSNSTALAL (KKLC1_HUMAN)
MTSNSTALAM

SEQ ID NO: 39737 - protein, 9 aa, Artificial Sequence
  Description of Artificial Sequence: Synthetic peptide
  Seed: RQKRILVNL (KKLC1_HUMAN)
RTKRILVNW

SEQ ID NO: 39738 - protein, 11 aa, Artificial Sequence
  Description of Artificial Sequence: Synthetic peptide
  Seed: RQKRILVNLSM (KKLC1_HUMAN)
RAKRILVNLSV

SEQ ID NO: 39739 - protein, 9 aa, Artificial Sequence
  Description of Artificial Sequence: Synthetic peptide
  Seed: VYDLSRDIL (KKLC1_HUMAN)
VTDLSRDIV

SEQ ID NO: 39740 - protein, 9 aa, Artificial Sequence
  Description of Artificial Sequence: Synthetic peptide
  Seed: LASSILCAL (KKLC1_HUMAN)
LVSSILCAY

SEQ ID NO: 39741 - protein, 10 aa, Artificial Sequence
  Description of Artificial Sequence: Synthetic peptide
  Seed: QKRILVNLSM (KKLC1_HUMAN)
QLRILVNLSV

SEQ ID NO: 39742 - protein, 10 aa, Artificial Sequence
  Description of Artificial Sequence: Synthetic peptide
  Seed: SNTDNNLAVY (KKLC1_HUMAN)
STTDNNLAVY

SEQ ID NO: 39743 - protein, 9 aa, Artificial Sequence
  Description of Artificial Sequence: Synthetic peptide
  Seed: SNSTALALV (KKLC1_HUMAN)
SASTALALM

SEQ ID NO: 39744 - protein, 10 aa, Artificial Sequence
  Description of Artificial Sequence: Synthetic peptide
  Seed: QKRILVNLSM (KKLC1_HUMAN)
QYRILVNLSM

SEQ ID NO: 39745 - protein, 9 aa, Artificial Sequence
  Description of Artificial Sequence: Synthetic peptide
  Seed: KLVELEHTL (KKLC1_HUMAN)
KMVELEHTW

SEQ ID NO: 39746 - protein, 9 aa, Artificial Sequence
  Description of Artificial Sequence: Synthetic peptide
  Seed: KLVELEHTL (KKLC1_HUMAN)
KQVELEHTT

SEQ ID NO: 39747 - protein, 9 aa, Artificial Sequence
  Description of Artificial Sequence: Synthetic peptide
  Seed: SSILCALIV (KKLC1_HUMAN)
SAILCALIW

SEQ ID NO: 39748 - protein, 9 aa, Artificial Sequence
  Description of Artificial Sequence: Synthetic peptide
  Seed: SNSTALALV (KKLC1_HUMAN)
SQSTALALA

SEQ ID NO: 39749 - protein, 10 aa, Artificial Sequence
  Description of Artificial Sequence: Synthetic peptide
  Seed: KYRRFQRNTG (KKLC1_HUMAN)
KQRRFQRNTK

SEQ ID NO: 39750 - protein, 10 aa, Artificial Sequence
  Description of Artificial Sequence: Synthetic peptide
  Seed: RQKRILVNLS (KKLC1_HUMAN)
RSKRILVNLM

SEQ ID NO: 39751 - protein, 9 aa, Artificial Sequence
  Description of Artificial Sequence: Synthetic peptide
  Seed: RQKRILVNL (KKLC1_HUMAN)
RTKRILVNL

SEQ ID NO: 39752 - protein, 9 aa, Artificial Sequence
  Description of Artificial Sequence: Synthetic peptide
  Seed: YLLLASSIL (KKLC1_HUMAN)
YMLLASSIM

SEQ ID NO: 39753 - protein, 8 aa, Artificial Sequence
  Description of Artificial Sequence: Synthetic peptide
  Seed: VYDLSRDI (KKLC1_HUMAN)
VWDLSRDL

SEQ ID NO: 39754 - protein, 9 aa, Artificial Sequence
  Description of Artificial Sequence: Synthetic peptide
  Seed: SSNSTALAL (KKLC1_HUMAN)
SLNSTALAM

SEQ ID NO: 39755 - protein, 9 aa, Artificial Sequence
  Description of Artificial Sequence: Synthetic peptide
  Seed: IARQKRILV (KKLC1_HUMAN)
ISRQKRILV

SEQ ID NO: 39756 - protein, 9 aa, Artificial Sequence
  Description of Artificial Sequence: Synthetic peptide
  Seed: MVENKLVEL (KKLC1_HUMAN)
MTENKLVEY

SEQ ID NO: 39757 - protein, 10 aa, Artificial Sequence
  Description of Artificial Sequence: Synthetic peptide
  Seed: EHTLLSKGFR (KKLC1_HUMAN)
ETTLLSKGFK

SEQ ID NO: 39758 - protein, 10 aa, Artificial Sequence
  Description of Artificial Sequence: Synthetic peptide
  Seed: SMVENKLVEL (KKLC1_HUMAN)
SEVENKLVEY

SEQ ID NO: 39759 - protein, 10 aa, Artificial Sequence
  Description of Artificial Sequence: Synthetic peptide
  Seed: RQKRILVNLS (KKLC1_HUMAN)
RIKRILVNLK

SEQ ID NO: 39760 - protein, 10 aa, Artificial Sequence
  Description of Artificial Sequence: Synthetic peptide
  Seed: LVRPSSSGLI (KKLC1_HUMAN)
LVRPSSSGLK

SEQ ID NO: 39761 - protein, 9 aa, Artificial Sequence
  Description of Artificial Sequence: Synthetic peptide
  Seed: GFRGASPHR (KKLC1_HUMAN)
GSRGASPHA

SEQ ID NO: 39762 - protein, 9 aa, Artificial Sequence
  Description of Artificial Sequence: Synthetic peptide
  Seed: LASSILCAL (KKLC1_HUMAN)
LMSSILCAA

SEQ ID NO: 39763 - protein, 10 aa, Artificial Sequence
  Description of Artificial Sequence: Synthetic peptide
  Seed: LASSILCALI (KKLC1_HUMAN)
LMSSILCALQ

SEQ ID NO: 39764 - protein, 9 aa, Artificial Sequence
  Description of Artificial Sequence: Synthetic peptide
  Seed: YLLLASSIL (KKLC1_HUMAN)
YQLLASSIY

SEQ ID NO: 39765 - protein, 10 aa, Artificial Sequence
  Description of Artificial Sequence: Synthetic peptide
  Seed: SSNSTALALV (KKLC1_HUMAN)
SVNSTALALL

SEQ ID NO: 39766 - protein, 9 aa, Artificial Sequence
  Description of Artificial Sequence: Synthetic peptide
  Seed: RFQRNTGEM (KKLC1_HUMAN)
RFQRNTGEY

SEQ ID NO: 39767 - protein, 11 aa, Artificial Sequence
  Description of Artificial Sequence: Synthetic peptide
  Seed: YLLLASSILCA (KKLC1_HUMAN)
YNLLASSILCV

SEQ ID NO: 39768 - protein, 11 aa, Artificial Sequence
  Description of Artificial Sequence: Synthetic peptide
  Seed: YLLLASSILCA (KKLC1_HUMAN)
YMLLASSILCV

SEQ ID NO: 39769 - protein, 9 aa, Artificial Sequence
  Description of Artificial Sequence: Synthetic peptide
  Seed: SSNSTALAL (KKLC1_HUMAN)
SHNSTALAF

SEQ ID NO: 39770 - protein, 9 aa, Artificial Sequence
  Description of Artificial Sequence: Synthetic peptide
  Seed: AVYDLSRDI (KKLC1_HUMAN)
AMYDLSRDV

SEQ ID NO: 39771 - protein, 9 aa, Artificial Sequence
  Description of Artificial Sequence: Synthetic peptide
  Seed: KLVELEHTL (KKLC1_HUMAN)
KGVELEHTW

SEQ ID NO: 39772 - protein, 9 aa, Artificial Sequence
  Description of Artificial Sequence: Synthetic peptide
  Seed: KGFRGASPH (KKLC1_HUMAN)
KKFRGASPW

SEQ ID NO: 39773 - protein, 9 aa, Artificial Sequence
  Description of Artificial Sequence: Synthetic peptide
  Seed: KGFRGASPH (KKLC1_HUMAN)
KPFRGASPF

SEQ ID NO: 39774 - protein, 9 aa, Artificial Sequence
  Description of Artificial Sequence: Synthetic peptide
  Seed: NTDNNLAVY (KKLC1_HUMAN)
NMDNNLAVV

SEQ ID NO: 39775 - protein, 9 aa, Artificial Sequence
  Description of Artificial Sequence: Synthetic peptide
  Seed: MVENKLVEL (KKLC1_HUMAN)
MQENKLVEW

SEQ ID NO: 39776 - protein, 9 aa, Artificial Sequence
  Description of Artificial Sequence: Synthetic peptide
  Seed: HSIARQKRI (KKLC1_HUMAN)
HSIARQKRW

SEQ ID NO: 39777 - protein, 10 aa, Artificial Sequence
  Description of Artificial Sequence: Synthetic peptide
  Seed: ILCALIVFWK (KKLC1_HUMAN)
ITCALIVFWK

SEQ ID NO: 39778 - protein, 11 aa, Artificial Sequence
  Description of Artificial Sequence: Synthetic peptide
  Seed: LSMVENKLVEL (KKLC1_HUMAN)
LFMVENKLVEV

SEQ ID NO: 39779 - protein, 10 aa, Artificial Sequence
  Description of Artificial Sequence: Synthetic peptide
  Seed: MSSNSTALAL (KKLC1_HUMAN)
MVSNSTALAW

SEQ ID NO: 39780 - protein, 11 aa, Artificial Sequence
  Description of Artificial Sequence: Synthetic peptide
  Seed: RQKRILVNLSM (KKLC1_HUMAN)
REKRILVNLSM

SEQ ID NO: 39781 - protein, 9 aa, Artificial Sequence
  Description of Artificial Sequence: Synthetic peptide
  Seed: KRILVNLSM (KKLC1_HUMAN)
KQILVNLSI

SEQ ID NO: 39782 - protein, 10 aa, Artificial Sequence
  Description of Artificial Sequence: Synthetic peptide
  Seed: RRFQRNTGEM (KKLC1_HUMAN)
RQFQRNTGEF

SEQ ID NO: 39783 - protein, 9 aa, Artificial Sequence
  Description of Artificial Sequence: Synthetic peptide
  Seed: SSNSTALAL (KKLC1_HUMAN)
SANSTALAF

SEQ ID NO: 39784 - protein, 9 aa, Artificial Sequence
  Description of Artificial Sequence: Synthetic peptide
  Seed: KLVELEHTL (KKLC1_HUMAN)
KRVELEHTV

SEQ ID NO: 39785 - protein, 9 aa, Artificial Sequence
  Description of Artificial Sequence: Synthetic peptide
  Seed: KLVELEHTL (KKLC1_HUMAN)
KEVELEHTY

SEQ ID NO: 39786 - protein, 10 aa, Artificial Sequence
  Description of Artificial Sequence: Synthetic peptide
  Seed: LLASSILCAL (KKLC1_HUMAN)
LTASSILCAF

SEQ ID NO: 39787 - protein, 9 aa, Artificial Sequence
  Description of Artificial Sequence: Synthetic peptide
  Seed: KGFRGASPH (KKLC1_HUMAN)
KMFRGASPL

SEQ ID NO: 39788 - protein, 10 aa, Artificial Sequence
  Description of Artificial Sequence: Synthetic peptide
  Seed: QKRILVNLSM (KKLC1_HUMAN)
QSRILVNLSV

SEQ ID NO: 39789 - protein, 9 aa, Artificial Sequence
  Description of Artificial Sequence: Synthetic peptide
  Seed: SNSTALALV (KKLC1_HUMAN)
SLSTALALM

SEQ ID NO: 39790 - protein, 9 aa, Artificial Sequence
  Description of Artificial Sequence: Synthetic peptide
  Seed: LASSILCAL (KKLC1_HUMAN)
LMSSILCAV

SEQ ID NO: 39791 - protein, 10 aa, Artificial Sequence
  Description of Artificial Sequence: Synthetic peptide
  Seed: CALIVFWKYR (KKLC1_HUMAN)
CMLIVFWKYK

SEQ ID NO: 39792 - protein, 10 aa, Artificial Sequence
  Description of Artificial Sequence: Synthetic peptide
  Seed: MSSNSTALAL (KKLC1_HUMAN)
MESNSTALAM

SEQ ID NO: 39793 - protein, 11 aa, Artificial Sequence
  Description of Artificial Sequence: Synthetic peptide
  Seed: MNFYLLLASSI (KKLC1_HUMAN)
MWFYLLLASSF

SEQ ID NO: 39794 - protein, 10 aa, Artificial Sequence
  Description of Artificial Sequence: Synthetic peptide
  Seed: QKRILVNLSM (KKLC1_HUMAN)
QQRILVNLSL

SEQ ID NO: 39795 - protein, 9 aa, Artificial Sequence
  Description of Artificial Sequence: Synthetic peptide
  Seed: GEMSSNSTA (KKLC1_HUMAN)
GEMSSNSTI

SEQ ID NO: 39796 - protein, 10 aa, Artificial Sequence
  Description of Artificial Sequence: Synthetic peptide
  Seed: EMSSNSTALA (KKLC1_HUMAN)
EVSSNSTALI

SEQ ID NO: 39797 - protein, 9 aa, Artificial Sequence
  Description of Artificial Sequence: Synthetic peptide
  Seed: GFRGASPHR (KKLC1_HUMAN)
GVRGASPHI

SEQ ID NO: 39798 - protein, 11 aa, Artificial Sequence
  Description of Artificial Sequence: Synthetic peptide
  Seed: SSILCALIVFW (KKLC1_HUMAN)
STILCALIVFW

SEQ ID NO: 39799 - protein, 10 aa, Artificial Sequence
  Description of Artificial Sequence: Synthetic peptide
  Seed: LLASSILCAL (KKLC1_HUMAN)
LMASSILCAF

SEQ ID NO: 39800 - protein, 9 aa, Artificial Sequence
  Description of Artificial Sequence: Synthetic peptide
  Seed: VYDLSRDIL (KKLC1_HUMAN)
VGDLSRDIL

SEQ ID NO: 39801 - protein, 11 aa, Artificial Sequence
  Description of Artificial Sequence: Synthetic peptide
  Seed: RDILNNFPHSI (KKLC1_HUMAN)
REILNNFPHSM

SEQ ID NO: 39802 - protein, 10 aa, Artificial Sequence
  Description of Artificial Sequence: Synthetic peptide
  Seed: GEMSSNSTAL (KKLC1_HUMAN)
GQMSSNSTAM

SEQ ID NO: 39803 - protein, 9 aa, Artificial Sequence
  Description of Artificial Sequence: Synthetic peptide
  Seed: MVENKLVEL (KKLC1_HUMAN)
MPENKLVEV

SEQ ID NO: 39804 - protein, 9 aa, Artificial Sequence
  Description of Artificial Sequence: Synthetic peptide
  Seed: SSILCALIV (KKLC1_HUMAN)
STILCALIL

SEQ ID NO: 39805 - protein, 10 aa, Artificial Sequence
  Description of Artificial Sequence: Synthetic peptide
  Seed: FYLLLASSIL (KKLC1_HUMAN)
FTLLLASSIV

SEQ ID NO: 39806 - protein, 9 aa, Artificial Sequence
  Description of Artificial Sequence: Synthetic peptide
  Seed: LVRPSSSGL (KKLC1_HUMAN)
LTRPSSSGY

SEQ ID NO: 39807 - protein, 9 aa, Artificial Sequence
  Description of Artificial Sequence: Synthetic peptide
  Seed: SILCALIVF (KKLC1_HUMAN)
SHLCALIVY

SEQ ID NO: 39808 - protein, 9 aa, Artificial Sequence
  Description of Artificial Sequence: Synthetic peptide
  Seed: MVENKLVEL (KKLC1_HUMAN)
MWENKLVEI

SEQ ID NO: 39809 - protein, 9 aa, Artificial Sequence
  Description of Artificial Sequence: Synthetic peptide
  Seed: YLLLASSIL (KKLC1_HUMAN)
YMLLASSIA

SEQ ID NO: 39810 - protein, 9 aa, Artificial Sequence
  Description of Artificial Sequence: Synthetic peptide
  Seed: KGFRGASPH (KKLC1_HUMAN)
KHFRGASPM

SEQ ID NO: 39811 - protein, 9 aa, Artificial Sequence
  Description of Artificial Sequence: Synthetic peptide
  Seed: YLLLASSIL (KKLC1_HUMAN)
YFLLASSIL

SEQ ID NO: 39812 - protein, 9 aa, Artificial Sequence
  Description of Artificial Sequence: Synthetic peptide
  Seed: IVFWKYRRF (KKLC1_HUMAN)
IMFWKYRRY

SEQ ID NO: 39813 - protein, 10 aa, Artificial Sequence
  Description of Artificial Sequence: Synthetic peptide
  Seed: LASSILCALI (KKLC1_HUMAN)
LKSSILCALW

SEQ ID NO: 39814 - protein, 9 aa, Artificial Sequence
  Description of Artificial Sequence: Synthetic peptide
  Seed: RQKRILVNL (KKLC1_HUMAN)
RQKRILVNF

SEQ ID NO: 39815 - protein, 9 aa, Artificial Sequence
  Description of Artificial Sequence: Synthetic peptide
  Seed: NNFPHSIAR (KKLC1_HUMAN)
NAFPHSIAI

SEQ ID NO: 39816 - protein, 9 aa, Artificial Sequence
  Description of Artificial Sequence: Synthetic peptide
  Seed: RRFQRNTGE (KKLC1_HUMAN)
RRFQRNTGM

SEQ ID NO: 39817 - protein, 9 aa, Artificial Sequence
  Description of Artificial Sequence: Synthetic peptide
  Seed: VNLSMVENK (KKLC1_HUMAN)
VTLSMVENK

SEQ ID NO: 39818 - protein, 9 aa, Artificial Sequence
  Description of Artificial Sequence: Synthetic peptide
  Seed: KLVELEHTL (KKLC1_HUMAN)
KFVELEHTW

SEQ ID NO: 39819 - protein, 9 aa, Artificial Sequence
  Description of Artificial Sequence: Synthetic peptide
  Seed: SSNSTALAL (KKLC1_HUMAN)
SWNSTALAF

SEQ ID NO: 39820 - protein, 9 aa, Artificial Sequence
  Description of Artificial Sequence: Synthetic peptide
  Seed: ILNNFPHSI (KKLC1_HUMAN)
ILNNFPHSL

SEQ ID NO: 39821 - protein, 9 aa, Artificial Sequence
  Description of Artificial Sequence: Synthetic peptide
  Seed: MVENKLVEL (KKLC1_HUMAN)
MWENKLVEF

SEQ ID NO: 39822 - protein, 9 aa, Artificial Sequence
  Description of Artificial Sequence: Synthetic peptide
  Seed: RQKRILVNL (KKLC1_HUMAN)
RNKRILVNK

SEQ ID NO: 39823 - protein, 10 aa, Artificial Sequence
  Description of Artificial Sequence: Synthetic peptide
  Seed: EHTLLSKGFR (KKLC1_HUMAN)
EVTLLSKGFR

SEQ ID NO: 39824 - protein, 9 aa, Artificial Sequence
  Description of Artificial Sequence: Synthetic peptide
  Seed: KYRRFQRNT (KKLC1_HUMAN)
KARRFQRNK

SEQ ID NO: 39825 - protein, 10 aa, Artificial Sequence
  Description of Artificial Sequence: Synthetic peptide
  Seed: SNTDNNLAVY (KKLC1_HUMAN)
SETDNNLAVY

SEQ ID NO: 39826 - protein, 9 aa, Artificial Sequence
  Description of Artificial Sequence: Synthetic peptide
  Seed: KLVELEHTL (KKLC1_HUMAN)
KCVELEHTW

SEQ ID NO: 39827 - protein, 10 aa, Artificial Sequence
  Description of Artificial Sequence: Synthetic peptide
  Seed: GEMSSNSTAL (KKLC1_HUMAN)
GEMSSNSTAC

SEQ ID NO: 39828 - protein, 10 aa, Artificial Sequence
  Description of Artificial Sequence: Synthetic peptide
  Seed: GEMSSNSTAL (KKLC1_HUMAN)
GQMSSNSTAW

SEQ ID NO: 39829 - protein, 9 aa, Artificial Sequence
  Description of Artificial Sequence: Synthetic peptide
  Seed: ILNNFPHSI (KKLC1_HUMAN)
IANNFPHSV

SEQ ID NO: 39830 - protein, 9 aa, Artificial Sequence
  Description of Artificial Sequence: Synthetic peptide
  Seed: IARQKRILV (KKLC1_HUMAN)
IGRQKRILK

SEQ ID NO: 39831 - protein, 9 aa, Artificial Sequence
  Description of Artificial Sequence: Synthetic peptide
  Seed: ILNNFPHSI (KKLC1_HUMAN)
IINNFPHSY

SEQ ID NO: 39832 - protein, 10 aa, Artificial Sequence
  Description of Artificial Sequence: Synthetic peptide
  Seed: QKRILVNLSM (KKLC1_HUMAN)
QVRILVNLSV

SEQ ID NO: 39833 - protein, 10 aa, Artificial Sequence
  Description of Artificial Sequence: Synthetic peptide
  Seed: YLLLASSILC (KKLC1_HUMAN)
YKLLASSILL

SEQ ID NO: 39834 - protein, 9 aa, Artificial Sequence
  Description of Artificial Sequence: Synthetic peptide
  Seed: FYLLLASSI (KKLC1_HUMAN)
FFLLLASSY

SEQ ID NO: 39835 - protein, 11 aa, Artificial Sequence
  Description of Artificial Sequence: Synthetic peptide
  Seed: RQKRILVNLSM (KKLC1_HUMAN)
RTKRILVNLSM

SEQ ID NO: 39836 - protein, 9 aa, Artificial Sequence
  Description of Artificial Sequence: Synthetic peptide
  Seed: FWKYRRFQR (KKLC1_HUMAN)
FMKYRRFQK

SEQ ID NO: 39837 - protein, 10 aa, Artificial Sequence
  Description of Artificial Sequence: Synthetic peptide
  Seed: MSSNSTALAL (KKLC1_HUMAN)
MWSNSTALAW

SEQ ID NO: 39838 - protein, 9 aa, Artificial Sequence
  Description of Artificial Sequence: Synthetic peptide
  Seed: KLVELEHTL (KKLC1_HUMAN)
KHVELEHTF

SEQ ID NO: 39839 - protein, 9 aa, Artificial Sequence
  Description of Artificial Sequence: Synthetic peptide
  Seed: MVENKLVEL (KKLC1_HUMAN)
MAENKLVEW

SEQ ID NO: 39840 - protein, 9 aa, Artificial Sequence
  Description of Artificial Sequence: Synthetic peptide
  Seed: RQKRILVNL (KKLC1_HUMAN)
RQKRILVNV

SEQ ID NO: 39841 - protein, 10 aa, Artificial Sequence
  Description of Artificial Sequence: Synthetic peptide
  Seed: LLASSILCAL (KKLC1_HUMAN)
LMASSILCAI

SEQ ID NO: 39842 - protein, 10 aa, Artificial Sequence
  Description of Artificial Sequence: Synthetic peptide
  Seed: LASSILCALI (KKLC1_HUMAN)
LLSSILCALQ

SEQ ID NO: 39843 - protein, 9 aa, Artificial Sequence
  Description of Artificial Sequence: Synthetic peptide
  Seed: RQKRILVNL (KKLC1_HUMAN)
RTKRILVNY

SEQ ID NO: 39844 - protein, 9 aa, Artificial Sequence
  Description of Artificial Sequence: Synthetic peptide
  Seed: RQKRILVNL (KKLC1_HUMAN)
RFKRILVNY

SEQ ID NO: 39845 - protein, 10 aa, Artificial Sequence
  Description of Artificial Sequence: Synthetic peptide
  Seed: RQKRILVNLS (KKLC1_HUMAN)
RTKRILVNLV

SEQ ID NO: 39846 - protein, 11 aa, Artificial Sequence
  Description of Artificial Sequence: Synthetic peptide
  Seed: RQKRILVNLSM (KKLC1_HUMAN)
RFKRILVNLSL

SEQ ID NO: 39847 - protein, 9 aa, Artificial Sequence
  Description of Artificial Sequence: Synthetic peptide
  Seed: ILNNFPHSI (KKLC1_HUMAN)
IINNFPHSR

SEQ ID NO: 39848 - protein, 10 aa, Artificial Sequence
  Description of Artificial Sequence: Synthetic peptide
  Seed: SMVENKLVEL (KKLC1_HUMAN)
SMVENKLVEI

SEQ ID NO: 39849 - protein, 9 aa, Artificial Sequence
  Description of Artificial Sequence: Synthetic peptide
  Seed: RFQRNTGEM (KKLC1_HUMAN)
RWQRNTGEW

SEQ ID NO: 39850 - protein, 9 aa, Artificial Sequence
  Description of Artificial Sequence: Synthetic peptide
  Seed: LVELEHTLL (KKLC1_HUMAN)
LSELEHTLL

SEQ ID NO: 39851 - protein, 9 aa, Artificial Sequence
  Description of Artificial Sequence: Synthetic peptide
  Seed: MVENKLVEL (KKLC1_HUMAN)
MMENKLVEY

SEQ ID NO: 39852 - protein, 9 aa, Artificial Sequence
  Description of Artificial Sequence: Synthetic peptide
  Seed: RQKRILVNL (KKLC1_HUMAN)
RTKRILVNE

SEQ ID NO: 39853 - protein, 11 aa, Artificial Sequence
  Description of Artificial Sequence: Synthetic peptide
  Seed: RQKRILVNLSM (KKLC1_HUMAN)
RHKRILVNLSI

SEQ ID NO: 39854 - protein, 9 aa, Artificial Sequence
  Description of Artificial Sequence: Synthetic peptide
  Seed: LSRDILNNF (KKLC1_HUMAN)
LVRDILNNM

SEQ ID NO: 39855 - protein, 9 aa, Artificial Sequence
  Description of Artificial Sequence: Synthetic peptide
  Seed: KYRRFQRNT (KKLC1_HUMAN)
KVRRFQRNV

SEQ ID NO: 39856 - protein, 9 aa, Artificial Sequence
  Description of Artificial Sequence: Synthetic peptide
  Seed: LIVFWKYRR (KKLC1_HUMAN)
LYVFWKYRK

SEQ ID NO: 39857 - protein, 11 aa, Artificial Sequence
  Description of Artificial Sequence: Synthetic peptide
  Seed: RQKRILVNLSM (KKLC1_HUMAN)
RPKRILVNLSR

SEQ ID NO: 39858 - protein, 11 aa, Artificial Sequence
  Description of Artificial Sequence: Synthetic peptide
  Seed: YLLLASSILCA (KKLC1_HUMAN)
YHLLASSILCL

SEQ ID NO: 39859 - protein, 9 aa, Artificial Sequence
  Description of Artificial Sequence: Synthetic peptide
  Seed: NTDNNLAVY (KKLC1_HUMAN)
NQDNNLAVL

SEQ ID NO: 39860 - protein, 10 aa, Artificial Sequence
  Description of Artificial Sequence: Synthetic peptide
  Seed: AVYDLSRDIL (KKLC1_HUMAN)
AQYDLSRDIF

SEQ ID NO: 39861 - protein, 9 aa, Artificial Sequence
  Description of Artificial Sequence: Synthetic peptide
  Seed: RFQRNTGEM (KKLC1_HUMAN)
RYQRNTGEL

SEQ ID NO: 39862 - protein, 10 aa, Artificial Sequence
  Description of Artificial Sequence: Synthetic peptide
  Seed: KGFRGASPHR (KKLC1_HUMAN)
KAFRGASPHR

SEQ ID NO: 39863 - protein, 10 aa, Artificial Sequence
  Description of Artificial Sequence: Synthetic peptide
  Seed: KGFRGASPHR (KKLC1_HUMAN)
KEFRGASPHK

SEQ ID NO: 39864 - protein, 9 aa, Artificial Sequence
  Description of Artificial Sequence: Synthetic peptide
  Seed: KRILVNLSM (KKLC1_HUMAN)
KAILVNLSF

SEQ ID NO: 39865 - protein, 9 aa, Artificial Sequence
  Description of Artificial Sequence: Synthetic peptide
  Seed: LSRDILNNF (KKLC1_HUMAN)
LTRDILNNY

SEQ ID NO: 39866 - protein, 9 aa, Artificial Sequence
  Description of Artificial Sequence: Synthetic peptide
  Seed: RILVNLSMV (KKLC1_HUMAN)
RMLVNLSMY

SEQ ID NO: 39867 - protein, 9 aa, Artificial Sequence
  Description of Artificial Sequence: Synthetic peptide
  Seed: LVRPSSSGL (KKLC1_HUMAN)
LLRPSSSGF

SEQ ID NO: 39868 - protein, 10 aa, Artificial Sequence
  Description of Artificial Sequence: Synthetic peptide
  Seed: SSNSTALALV (KKLC1_HUMAN)
SMNSTALALA

SEQ ID NO: 39869 - protein, 10 aa, Artificial Sequence
  Description of Artificial Sequence: Synthetic peptide
  Seed: MSSNSTALAL (KKLC1_HUMAN)
MHSNSTALAF

SEQ ID NO: 39870 - protein, 8 aa, Artificial Sequence
  Description of Artificial Sequence: Synthetic peptide
  Seed: VYDLSRDI (KKLC1_HUMAN)
VFDLSRDV

SEQ ID NO: 39871 - protein, 10 aa, Artificial Sequence
  Description of Artificial Sequence: Synthetic peptide
  Seed: YLLLASSILC (KKLC1_HUMAN)
YALLASSILM

SEQ ID NO: 39872 - protein, 9 aa, Artificial Sequence
  Description of Artificial Sequence: Synthetic peptide
  Seed: LLLASSILC (KKLC1_HUMAN)
LMLASSILL

SEQ ID NO: 39873 - protein, 10 aa, Artificial Sequence
  Description of Artificial Sequence: Synthetic peptide
  Seed: KYRRFQRNTG (KKLC1_HUMAN)
KTRRFQRNTY

SEQ ID NO: 39874 - protein, 9 aa, Artificial Sequence
  Description of Artificial Sequence: Synthetic peptide
  Seed: AVYDLSRDI (KKLC1_HUMAN)
ARYDLSRDL

SEQ ID NO: 39875 - protein, 10 aa, Artificial Sequence
  Description of Artificial Sequence: Synthetic peptide
  Seed: VELEHTLLSK (KKLC1_HUMAN)
VVLEHTLLSR

SEQ ID NO: 39876 - protein, 9 aa, Artificial Sequence
  Description of Artificial Sequence: Synthetic peptide
  Seed: KLVELEHTL (KKLC1_HUMAN)
KYVELEHTW

SEQ ID NO: 39877 - protein, 9 aa, Artificial Sequence
  Description of Artificial Sequence: Synthetic peptide
  Seed: ILNNFPHSI (KKLC1_HUMAN)
IKNNFPHSL

SEQ ID NO: 39878 - protein, 8 aa, Artificial Sequence
  Description of Artificial Sequence: Synthetic peptide
  Seed: VYDLSRDI (KKLC1_HUMAN)
VVDLSRDM

SEQ ID NO: 39879 - protein, 10 aa, Artificial Sequence
  Description of Artificial Sequence: Synthetic peptide
  Seed: CALIVFWKYR (KKLC1_HUMAN)
CHLIVFWKYR

SEQ ID NO: 39880 - protein, 10 aa, Artificial Sequence
  Description of Artificial Sequence: Synthetic peptide
  Seed: KLVELEHTLL (KKLC1_HUMAN)
KTVELEHTLW

SEQ ID NO: 39881 - protein, 9 aa, Artificial Sequence
  Description of Artificial Sequence: Synthetic peptide
  Seed: SSILCALIV (KKLC1_HUMAN)
SQILCALII

SEQ ID NO: 39882 - protein, 9 aa, Artificial Sequence
  Description of Artificial Sequence: Synthetic peptide
  Seed: SSNSTALAL (KKLC1_HUMAN)
SHNSTALAM

SEQ ID NO: 39883 - protein, 9 aa, Artificial Sequence
  Description of Artificial Sequence: Synthetic peptide
  Seed: NNFPHSIAR (KKLC1_HUMAN)
NRFPHSIAL

SEQ ID NO: 39884 - protein, 11 aa, Artificial Sequence
  Description of Artificial Sequence: Synthetic peptide
  Seed: MNFYLLLASSI (KKLC1_HUMAN)
MIFYLLLASSF

SEQ ID NO: 39885 - protein, 10 aa, Artificial Sequence
  Description of Artificial Sequence: Synthetic peptide
  Seed: ALIVFWKYRR (KKLC1_HUMAN)
ASIVFWKYRR

SEQ ID NO: 39886 - protein, 10 aa, Artificial Sequence
  Description of Artificial Sequence: Synthetic peptide
  Seed: LASSILCALI (KKLC1_HUMAN)
LMSSILCALR

SEQ ID NO: 39887 - protein, 10 aa, Artificial Sequence
  Description of Artificial Sequence: Synthetic peptide
  Seed: MSSNSTALAL (KKLC1_HUMAN)
MTSNSTALAL

SEQ ID NO: 39888 - protein, 9 aa, Artificial Sequence
  Description of Artificial Sequence: Synthetic peptide
  Seed: VYDLSRDIL (KKLC1_HUMAN)
VFDLSRDII

SEQ ID NO: 39889 - protein, 10 aa, Artificial Sequence
  Description of Artificial Sequence: Synthetic peptide
  Seed: LASSILCALI (KKLC1_HUMAN)
LMSSILCALN

SEQ ID NO: 39890 - protein, 9 aa, Artificial Sequence
  Description of Artificial Sequence: Synthetic peptide
  Seed: SNSTALALV (KKLC1_HUMAN)
SMSTALALL

SEQ ID NO: 39891 - protein, 9 aa, Artificial Sequence
  Description of Artificial Sequence: Synthetic peptide
  Seed: FPHSIARQK (KKLC1_HUMAN)
FAHSIARQR

SEQ ID NO: 39892 - protein, 11 aa, Artificial Sequence
  Description of Artificial Sequence: Synthetic peptide
  Seed: NSNTDNNLAVY (KKLC1_HUMAN)
NTNTDNNLAVY

SEQ ID NO: 39893 - protein, 10 aa, Artificial Sequence
  Description of Artificial Sequence: Synthetic peptide
  Seed: EHTLLSKGFR (KKLC1_HUMAN)
EGTLLSKGFR

SEQ ID NO: 39894 - protein, 9 aa, Artificial Sequence
  Description of Artificial Sequence: Synthetic peptide
  Seed: NNFPHSIAR (KKLC1_HUMAN)
NSFPHSIAH

SEQ ID NO: 39895 - protein, 11 aa, Artificial Sequence
  Description of Artificial Sequence: Synthetic peptide
  Seed: RQKRILVNLSM (KKLC1_HUMAN)
RHKRILVNLSV

SEQ ID NO: 39896 - protein, 9 aa, Artificial Sequence
  Description of Artificial Sequence: Synthetic peptide
  Seed: NTDNNLAVY (KKLC1_HUMAN)
NIDNNLAVF

SEQ ID NO: 39897 - protein, 10 aa, Artificial Sequence
  Description of Artificial Sequence: Synthetic peptide
  Seed: SMVENKLVEL (KKLC1_HUMAN)
SMVENKLVEW

SEQ ID NO: 39898 - protein, 9 aa, Artificial Sequence
  Description of Artificial Sequence: Synthetic peptide
  Seed: ASSILCALI (KKLC1_HUMAN)
ATSILCALY

SEQ ID NO: 39899 - protein, 9 aa, Artificial Sequence
  Description of Artificial Sequence: Synthetic peptide
  Seed: GFRGASPHR (KKLC1_HUMAN)
GVRGASPHV

SEQ ID NO: 39900 - protein, 9 aa, Artificial Sequence
  Description of Artificial Sequence: Synthetic peptide
  Seed: NTDNNLAVY (KKLC1_HUMAN)
NADNNLAVM

SEQ ID NO: 39901 - protein, 10 aa, Artificial Sequence
  Description of Artificial Sequence: Synthetic peptide
  Seed: CALIVFWKYR (KKLC1_HUMAN)
CNLIVFWKYR

SEQ ID NO: 39902 - protein, 11 aa, Artificial Sequence
  Description of Artificial Sequence: Synthetic peptide
  Seed: RQKRILVNLSM (KKLC1_HUMAN)
RKKRILVNLSL

SEQ ID NO: 39903 - protein, 9 aa, Artificial Sequence
  Description of Artificial Sequence: Synthetic peptide
  Seed: SSNSTALAL (KKLC1_HUMAN)
SANSTALAW

SEQ ID NO: 39904 - protein, 9 aa, Artificial Sequence
  Description of Artificial Sequence: Synthetic peptide
  Seed: GFRGASPHR (KKLC1_HUMAN)
GIRGASPHK

SEQ ID NO: 39905 - protein, 9 aa, Artificial Sequence
  Description of Artificial Sequence: Synthetic peptide
  Seed: KGFRGASPH (KKLC1_HUMAN)
KIFRGASPF

SEQ ID NO: 39906 - protein, 9 aa, Artificial Sequence
  Description of Artificial Sequence: Synthetic peptide
  Seed: YLLLASSIL (KKLC1_HUMAN)
YMLLASSIY

SEQ ID NO: 39907 - protein, 9 aa, Artificial Sequence
  Description of Artificial Sequence: Synthetic peptide
  Seed: SNTDNNLAV (KKLC1_HUMAN)
SVTDNNLAF

SEQ ID NO: 39908 - protein, 9 aa, Artificial Sequence
  Description of Artificial Sequence: Synthetic peptide
  Seed: KRILVNLSM (KKLC1_HUMAN)
KGILVNLSY

SEQ ID NO: 39909 - protein, 10 aa, Artificial Sequence
  Description of Artificial Sequence: Synthetic peptide
  Seed: SMVENKLVEL (KKLC1_HUMAN)
SVVENKLVEL

SEQ ID NO: 39910 - protein, 10 aa, Artificial Sequence
  Description of Artificial Sequence: Synthetic peptide
  Seed: LLASSILCAL (KKLC1_HUMAN)
LAASSILCAV

SEQ ID NO: 39911 - protein, 9 aa, Artificial Sequence
  Description of Artificial Sequence: Synthetic peptide
  Seed: GFRGASPHR (KKLC1_HUMAN)
GARGASPHK

SEQ ID NO: 39912 - protein, 9 aa, Artificial Sequence
  Description of Artificial Sequence: Synthetic peptide
  Seed: VELEHTLLS (KKLC1_HUMAN)
VDLEHTLLL

SEQ ID NO: 39913 - protein, 8 aa, Artificial Sequence
  Description of Artificial Sequence: Synthetic peptide
  Seed: VYDLSRDI (KKLC1_HUMAN)
VIDLSRDV

SEQ ID NO: 39914 - protein, 9 aa, Artificial Sequence
  Description of Artificial Sequence: Synthetic peptide
  Seed: KLVELEHTL (KKLC1_HUMAN)
KMVELEHTY

SEQ ID NO: 39915 - protein, 9 aa, Artificial Sequence
  Description of Artificial Sequence: Synthetic peptide
  Seed: CALIVFWKY (KKLC1_HUMAN)
CALIVFWKW

SEQ ID NO: 39916 - protein, 10 aa, Artificial Sequence
  Description of Artificial Sequence: Synthetic peptide
  Seed: VFWKYRRFQR (KKLC1_HUMAN)
VYWKYRRFQR

SEQ ID NO: 39917 - protein, 9 aa, Artificial Sequence
  Description of Artificial Sequence: Synthetic peptide
  Seed: LSRDILNNF (KKLC1_HUMAN)
LARDILNNV

SEQ ID NO: 39918 - protein, 11 aa, Artificial Sequence
  Description of Artificial Sequence: Synthetic peptide
  Seed: GEMSSNSTALA (KKLC1_HUMAN)
GEMSSNSTALM

SEQ ID NO: 39919 - protein, 10 aa, Artificial Sequence
  Description of Artificial Sequence: Synthetic peptide
  Seed: ILCALIVFWK (KKLC1_HUMAN)
IQCALIVFWR

SEQ ID NO: 39920 - protein, 9 aa, Artificial Sequence
  Description of Artificial Sequence: Synthetic peptide
  Seed: KYRRFQRNT (KKLC1_HUMAN)
KMRRFQRNS

SEQ ID NO: 39921 - protein, 9 aa, Artificial Sequence
  Description of Artificial Sequence: Synthetic peptide
  Seed: MSSNSTALA (KKLC1_HUMAN)
MISNSTALV

SEQ ID NO: 39922 - protein, 11 aa, Artificial Sequence
  Description of Artificial Sequence: Synthetic peptide
  Seed: RQKRILVNLSM (KKLC1_HUMAN)
RVKRILVNLSV

SEQ ID NO: 39923 - protein, 10 aa, Artificial Sequence
  Description of Artificial Sequence: Synthetic peptide
  Seed: SNSTALALVR (KKLC1_HUMAN)
SVSTALALVK

SEQ ID NO: 39924 - protein, 9 aa, Artificial Sequence
  Description of Artificial Sequence: Synthetic peptide
  Seed: LSMVENKLV (KKLC1_HUMAN)
LTMVENKLL

SEQ ID NO: 39925 - protein, 9 aa, Artificial Sequence
  Description of Artificial Sequence: Synthetic peptide
  Seed: VYDLSRDIL (KKLC1_HUMAN)
VYDLSRDIM

SEQ ID NO: 39926 - protein, 10 aa, Artificial Sequence
  Description of Artificial Sequence: Synthetic peptide
  Seed: QKRILVNLSM (KKLC1_HUMAN)
QHRILVNLSF

SEQ ID NO: 39927 - protein, 9 aa, Artificial Sequence
  Description of Artificial Sequence: Synthetic peptide
  Seed: MSSNSTALA (KKLC1_HUMAN)
MLSNSTALI

SEQ ID NO: 39928 - protein, 9 aa, Artificial Sequence
  Description of Artificial Sequence: Synthetic peptide
  Seed: MVENKLVEL (KKLC1_HUMAN)
MYENKLVEI

SEQ ID NO: 39929 - protein, 9 aa, Artificial Sequence
  Description of Artificial Sequence: Synthetic peptide
  Seed: SSNSTALAL (KKLC1_HUMAN)
SFNSTALAF

SEQ ID NO: 39930 - protein, 9 aa, Artificial Sequence
  Description of Artificial Sequence: Synthetic peptide
  Seed: ILNNFPHSI (KKLC1_HUMAN)
IMNNFPHSK

SEQ ID NO: 39931 - protein, 10 aa, Artificial Sequence
  Description of Artificial Sequence: Synthetic peptide
  Seed: KLVELEHTLL (KKLC1_HUMAN)
KLVELEHTLA

SEQ ID NO: 39932 - protein, 10 aa, Artificial Sequence
  Description of Artificial Sequence: Synthetic peptide
  Seed: KRILVNLSMV (KKLC1_HUMAN)
KLILVNLSMV

SEQ ID NO: 39933 - protein, 10 aa, Artificial Sequence
  Description of Artificial Sequence: Synthetic peptide
  Seed: LASSILCALI (KKLC1_HUMAN)
LLSSILCALH

SEQ ID NO: 39934 - protein, 9 aa, Artificial Sequence
  Description of Artificial Sequence: Synthetic peptide
  Seed: KLVELEHTL (KKLC1_HUMAN)
KGVELEHTY

SEQ ID NO: 39935 - protein, 9 aa, Artificial Sequence
  Description of Artificial Sequence: Synthetic peptide
  Seed: NNFPHSIAR (KKLC1_HUMAN)
NVFPHSIAR

SEQ ID NO: 39936 - protein, 10 aa, Artificial Sequence
  Description of Artificial Sequence: Synthetic peptide
  Seed: YLLLASSILC (KKLC1_HUMAN)
YTLLASSILM

SEQ ID NO: 39937 - protein, 9 aa, Artificial Sequence
  Description of Artificial Sequence: Synthetic peptide
  Seed: VYDLSRDIL (KKLC1_HUMAN)
VFDLSRDIV

SEQ ID NO: 39938 - protein, 10 aa, Artificial Sequence
  Description of Artificial Sequence: Synthetic peptide
  Seed: KLVELEHTLL (KKLC1_HUMAN)
KMVELEHTLI

SEQ ID NO: 39939 - protein, 10 aa, Artificial Sequence
  Description of Artificial Sequence: Synthetic peptide
  Seed: DILNNFPHSI (KKLC1_HUMAN)
DYLNNFPHSI

SEQ ID NO: 39940 - protein, 9 aa, Artificial Sequence
  Description of Artificial Sequence: Synthetic peptide
  Seed: ILNNFPHSI (KKLC1_HUMAN)
ITNNFPHSL

SEQ ID NO: 39941 - protein, 10 aa, Artificial Sequence
  Description of Artificial Sequence: Synthetic peptide
  Seed: LLASSILCAL (KKLC1_HUMAN)
LIASSILCAL

SEQ ID NO: 39942 - protein, 10 aa, Artificial Sequence
  Description of Artificial Sequence: Synthetic peptide
  Seed: ALVRPSSSGL (KKLC1_HUMAN)
AMVRPSSSGI

SEQ ID NO: 39943 - protein, 10 aa, Artificial Sequence
  Description of Artificial Sequence: Synthetic peptide
  Seed: SKGFRGASPH (KKLC1_HUMAN)
SAGFRGASPF

SEQ ID NO: 39944 - protein, 9 aa, Artificial Sequence
  Description of Artificial Sequence: Synthetic peptide
  Seed: RQKRILVNL (KKLC1_HUMAN)
RAKRILVNT

SEQ ID NO: 39945 - protein, 10 aa, Artificial Sequence
  Description of Artificial Sequence: Synthetic peptide
  Seed: LLASSILCAL (KKLC1_HUMAN)
LSASSILCAY

SEQ ID NO: 39946 - protein, 10 aa, Artificial Sequence
  Description of Artificial Sequence: Synthetic peptide
  Seed: RRFQRNTGEM (KKLC1_HUMAN)
RAFQRNTGEY

SEQ ID NO: 39947 - protein, 10 aa, Artificial Sequence
  Description of Artificial Sequence: Synthetic peptide
  Seed: MSSNSTALAL (KKLC1_HUMAN)
MDSNSTALAF

SEQ ID NO: 39948 - protein, 10 aa, Artificial Sequence
  Description of Artificial Sequence: Synthetic peptide
  Seed: LASSILCALI (KKLC1_HUMAN)
LASSILCALF

SEQ ID NO: 39949 - protein, 9 aa, Artificial Sequence
  Description of Artificial Sequence: Synthetic peptide
  Seed: ILNNFPHSI (KKLC1_HUMAN)
ILNNFPHSC

SEQ ID NO: 39950 - protein, 9 aa, Artificial Sequence
  Description of Artificial Sequence: Synthetic peptide
  Seed: KLVELEHTL (KKLC1_HUMAN)
KTVELEHTV

SEQ ID NO: 39951 - protein, 9 aa, Artificial Sequence
  Description of Artificial Sequence: Synthetic peptide
  Seed: GASPHRKST (KKLC1_HUMAN)
GASPHRKSL

SEQ ID NO: 39952 - protein, 11 aa, Artificial Sequence
  Description of Artificial Sequence: Synthetic peptide
  Seed: IVFWKYRRFQR (KKLC1_HUMAN)
IYFWKYRRFQR

SEQ ID NO: 39953 - protein, 9 aa, Artificial Sequence
  Description of Artificial Sequence: Synthetic peptide
  Seed: MVENKLVEL (KKLC1_HUMAN)
MEENKLVEM

SEQ ID NO: 39954 - protein, 10 aa, Artificial Sequence
  Description of Artificial Sequence: Synthetic peptide
  Seed: DILNNFPHSI (KKLC1_HUMAN)
DFLNNFPHSI

SEQ ID NO: 39955 - protein, 10 aa, Artificial Sequence
  Description of Artificial Sequence: Synthetic peptide
  Seed: SKGFRGASPH (KKLC1_HUMAN)
SAGFRGASPY

SEQ ID NO: 39956 - protein, 9 aa, Artificial Sequence
  Description of Artificial Sequence: Synthetic peptide
  Seed: KYRRFQRNT (KKLC1_HUMAN)
KVRRFQRNT

SEQ ID NO: 39957 - protein, 9 aa, Artificial Sequence
  Description of Artificial Sequence: Synthetic peptide
  Seed: KLVELEHTL (KKLC1_HUMAN)
KYVELEHTI

SEQ ID NO: 39958 - protein, 9 aa, Artificial Sequence
  Description of Artificial Sequence: Synthetic peptide
  Seed: KYRRFQRNT (KKLC1_HUMAN)
KIRRFQRNK

SEQ ID NO: 39959 - protein, 9 aa, Artificial Sequence
  Description of Artificial Sequence: Synthetic peptide
  Seed: SSNSTALAL (KKLC1_HUMAN)
SANSTALAH

SEQ ID NO: 39960 - protein, 9 aa, Artificial Sequence
  Description of Artificial Sequence: Synthetic peptide
  Seed: LVRPSSSGL (KKLC1_HUMAN)
LLRPSSSGW

SEQ ID NO: 39961 - protein, 10 aa, Artificial Sequence
  Description of Artificial Sequence: Synthetic peptide
  Seed: QKRILVNLSM (KKLC1_HUMAN)
QFRILVNLSV

SEQ ID NO: 39962 - protein, 9 aa, Artificial Sequence
  Description of Artificial Sequence: Synthetic peptide
  Seed: YLLLASSIL (KKLC1_HUMAN)
YALLASSIW

SEQ ID NO: 39963 - protein, 9 aa, Artificial Sequence
  Description of Artificial Sequence: Synthetic peptide
  Seed: KYRRFQRNT (KKLC1_HUMAN)
KFRRFQRNV

SEQ ID NO: 39964 - protein, 9 aa, Artificial Sequence
  Description of Artificial Sequence: Synthetic peptide
  Seed: LVRPSSSGL (KKLC1_HUMAN)
LSRPSSSGV

SEQ ID NO: 39965 - protein, 9 aa, Artificial Sequence
  Description of Artificial Sequence: Synthetic peptide
  Seed: KLVELEHTL (KKLC1_HUMAN)
KAVELEHTW

SEQ ID NO: 39966 - protein, 9 aa, Artificial Sequence
  Description of Artificial Sequence: Synthetic peptide
  Seed: RILVNLSMV (KKLC1_HUMAN)
RTLVNLSMV

SEQ ID NO: 39967 - protein, 10 aa, Artificial Sequence
  Description of Artificial Sequence: Synthetic peptide
  Seed: AVYDLSRDIL (KKLC1_HUMAN)
AQYDLSRDIM

SEQ ID NO: 39968 - protein, 11 aa, Artificial Sequence
  Description of Artificial Sequence: Synthetic peptide
  Seed: RQKRILVNLSM (KKLC1_HUMAN)
RMKRILVNLSM

SEQ ID NO: 39969 - protein, 10 aa, Artificial Sequence
  Description of Artificial Sequence: Synthetic peptide
  Seed: YLLLASSILC (KKLC1_HUMAN)
YTLLASSILI

SEQ ID NO: 39970 - protein, 11 aa, Artificial Sequence
  Description of Artificial Sequence: Synthetic peptide
  Seed: YLLLASSILCA (KKLC1_HUMAN)
YILLASSILCV

SEQ ID NO: 39971 - protein, 9 aa, Artificial Sequence
  Description of Artificial Sequence: Synthetic peptide
  Seed: VELEHTLLS (KKLC1_HUMAN)
VDLEHTLLM

SEQ ID NO: 39972 - protein, 11 aa, Artificial Sequence
  Description of Artificial Sequence: Synthetic peptide
  Seed: YLLLASSILCA (KKLC1_HUMAN)
YALLASSILCV

SEQ ID NO: 39973 - protein, 9 aa, Artificial Sequence
  Description of Artificial Sequence: Synthetic peptide
  Seed: NTDNNLAVY (KKLC1_HUMAN)
NTDNNLAVM

SEQ ID NO: 39974 - protein, 10 aa, Artificial Sequence
  Description of Artificial Sequence: Synthetic peptide
  Seed: SNTDNNLAVY (KKLC1_HUMAN)
SMTDNNLAVF

SEQ ID NO: 39975 - protein, 9 aa, Artificial Sequence
  Description of Artificial Sequence: Synthetic peptide
  Seed: KRILVNLSM (KKLC1_HUMAN)
KQILVNLSH

SEQ ID NO: 39976 - protein, 11 aa, Artificial Sequence
  Description of Artificial Sequence: Synthetic peptide
  Seed: LLASSILCALI (KKLC1_HUMAN)
LMASSILCALI

SEQ ID NO: 39977 - protein, 10 aa, Artificial Sequence
  Description of Artificial Sequence: Synthetic peptide
  Seed: MSSNSTALAL (KKLC1_HUMAN)
MTSNSTALAY

SEQ ID NO: 39978 - protein, 9 aa, Artificial Sequence
  Description of Artificial Sequence: Synthetic peptide
  Seed: KLVELEHTL (KKLC1_HUMAN)
KSVELEHTI

SEQ ID NO: 39979 - protein, 9 aa, Artificial Sequence
  Description of Artificial Sequence: Synthetic peptide
  Seed: SSNSTALAL (KKLC1_HUMAN)
SSNSTALAF

SEQ ID NO: 39980 - protein, 9 aa, Artificial Sequence
  Description of Artificial Sequence: Synthetic peptide
  Seed: NLAVYDLSR (KKLC1_HUMAN)
NSAVYDLSR

SEQ ID NO: 39981 - protein, 11 aa, Artificial Sequence
  Description of Artificial Sequence: Synthetic peptide
  Seed: RQKRILVNLSM (KKLC1_HUMAN)
REKRILVNLSK

SEQ ID NO: 39982 - protein, 9 aa, Artificial Sequence
  Description of Artificial Sequence: Synthetic peptide
  Seed: SNTDNNLAV (KKLC1_HUMAN)
SSTDNNLAM

SEQ ID NO: 39983 - protein, 9 aa, Artificial Sequence
  Description of Artificial Sequence: Synthetic peptide
  Seed: FWKYRRFQR (KKLC1_HUMAN)
FFKYRRFQR

SEQ ID NO: 39984 - protein, 9 aa, Artificial Sequence
  Description of Artificial Sequence: Synthetic peptide
  Seed: RILVNLSMV (KKLC1_HUMAN)
RVLVNLSMV

SEQ ID NO: 39985 - protein, 9 aa, Artificial Sequence
  Description of Artificial Sequence: Synthetic peptide
  Seed: RQKRILVNL (KKLC1_HUMAN)
RFKRILVNM

SEQ ID NO: 39986 - protein, 9 aa, Artificial Sequence
  Description of Artificial Sequence: Synthetic peptide
  Seed: FPHSIARQK (KKLC1_HUMAN)
FVHSIARQR

SEQ ID NO: 39987 - protein, 9 aa, Artificial Sequence
  Description of Artificial Sequence: Synthetic peptide
  Seed: KGFRGASPH (KKLC1_HUMAN)
KRFRGASPM

SEQ ID NO: 39988 - protein, 9 aa, Artificial Sequence
  Description of Artificial Sequence: Synthetic peptide
  Seed: RILVNLSMV (KKLC1_HUMAN)
RMLVNLSMM

SEQ ID NO: 39989 - protein, 11 aa, Artificial Sequence
  Description of Artificial Sequence: Synthetic peptide
  Seed: YLLLASSILCA (KKLC1_HUMAN)
YWLLASSILCL

SEQ ID NO: 39990 - protein, 9 aa, Artificial Sequence
  Description of Artificial Sequence: Synthetic peptide
  Seed: KYRRFQRNT (KKLC1_HUMAN)
KIRRFQRNM

SEQ ID NO: 39991 - protein, 9 aa, Artificial Sequence
  Description of Artificial Sequence: Synthetic peptide
  Seed: NNFPHSIAR (KKLC1_HUMAN)
NNFPHSIAY

SEQ ID NO: 39992 - protein, 9 aa, Artificial Sequence
  Description of Artificial Sequence: Synthetic peptide
  Seed: MSSNSTALA (KKLC1_HUMAN)
MQSNSTALI

SEQ ID NO: 39993 - protein, 11 aa, Artificial Sequence
  Description of Artificial Sequence: Synthetic peptide
  Seed: NNFPHSIARQK (KKLC1_HUMAN)
NAFPHSIARQR

SEQ ID NO: 39994 - protein, 9 aa, Artificial Sequence
  Description of Artificial Sequence: Synthetic peptide
  Seed: RQKRILVNL (KKLC1_HUMAN)
RSKRILVNG

SEQ ID NO: 39995 - protein, 9 aa, Artificial Sequence
  Description of Artificial Sequence: Synthetic peptide
  Seed: KYRRFQRNT (KKLC1_HUMAN)
KIRRFQRNI

SEQ ID NO: 39996 - protein, 9 aa, Artificial Sequence
  Description of Artificial Sequence: Synthetic peptide
  Seed: SNSTALALV (KKLC1_HUMAN)
STSTALALV

SEQ ID NO: 39997 - protein, 9 aa, Artificial Sequence
  Description of Artificial Sequence: Synthetic peptide
  Seed: IVFWKYRRF (KKLC1_HUMAN)
ITFWKYRRM

SEQ ID NO: 39998 - protein, 9 aa, Artificial Sequence
  Description of Artificial Sequence: Synthetic peptide
  Seed: AVYDLSRDI (KKLC1_HUMAN)
AMYDLSRDA

SEQ ID NO: 39999 - protein, 9 aa, Artificial Sequence
  Description of Artificial Sequence: Synthetic peptide
  Seed: SSNSTALAL (KKLC1_HUMAN)
SMNSTALAY

SEQ ID NO: 40000 - protein, 9 aa, Artificial Sequence
  Description of Artificial Sequence: Synthetic peptide
  Seed: ILNNFPHSI (KKLC1_HUMAN)
IWNNFPHSF

SEQ ID NO: 40001 - protein, 9 aa, Artificial Sequence
  Description of Artificial Sequence: Synthetic peptide
  Seed: SILCALIVF (KKLC1_HUMAN)
SMLCALIVM

SEQ ID NO: 40002 - protein, 10 aa, Artificial Sequence
  Description of Artificial Sequence: Synthetic peptide
  Seed: YLLLASSILC (KKLC1_HUMAN)
YCLLASSILV

SEQ ID NO: 40003 - protein, 9 aa, Artificial Sequence
  Description of Artificial Sequence: Synthetic peptide
  Seed: VELEHTLLS (KKLC1_HUMAN)
VELEHTLLA

SEQ ID NO: 40004 - protein, 10 aa, Artificial Sequence
  Description of Artificial Sequence: Synthetic peptide
  Seed: CALIVFWKYR (KKLC1_HUMAN)
CSLIVFWKYR

SEQ ID NO: 40005 - protein, 10 aa, Artificial Sequence
  Description of Artificial Sequence: Synthetic peptide
  Seed: RRFQRNTGEM (KKLC1_HUMAN)
RQFQRNTGEL

SEQ ID NO: 40006 - protein, 11 aa, Artificial Sequence
  Description of Artificial Sequence: Synthetic peptide
  Seed: LLLASSILCAL (KKLC1_HUMAN)
LYLASSILCAV

SEQ ID NO: 40007 - protein, 10 aa, Artificial Sequence
  Description of Artificial Sequence: Synthetic peptide
  Seed: NFYLLLASSI (KKLC1_HUMAN)
NCYLLLASSF

SEQ ID NO: 40008 - protein, 9 aa, Artificial Sequence
  Description of Artificial Sequence: Synthetic peptide
  Seed: VYDLSRDIL (KKLC1_HUMAN)
VMDLSRDIM

SEQ ID NO: 40009 - protein, 9 aa, Artificial Sequence
  Description of Artificial Sequence: Synthetic peptide
  Seed: NSTALALVR (KKLC1_HUMAN)
NATALALVR

SEQ ID NO: 40010 - protein, 10 aa, Artificial Sequence
  Description of Artificial Sequence: Synthetic peptide
  Seed: RQKRILVNLS (KKLC1_HUMAN)
RMKRILVNLK

SEQ ID NO: 40011 - protein, 9 aa, Artificial Sequence
  Description of Artificial Sequence: Synthetic peptide
  Seed: MSSNSTALA (KKLC1_HUMAN)
MTSNSTALV

SEQ ID NO: 40012 - protein, 10 aa, Artificial Sequence
  Description of Artificial Sequence: Synthetic peptide
  Seed: GEMSSNSTAL (KKLC1_HUMAN)
GWMSSNSTAV

SEQ ID NO: 40013 - protein, 9 aa, Artificial Sequence
  Description of Artificial Sequence: Synthetic peptide
  Seed: KYRRFQRNT (KKLC1_HUMAN)
KWRRFQRNK

SEQ ID NO: 40014 - protein, 10 aa, Artificial Sequence
  Description of Artificial Sequence: Synthetic peptide
  Seed: QKRILVNLSM (KKLC1_HUMAN)
QARILVNLSL

SEQ ID NO: 40015 - protein, 10 aa, Artificial Sequence
  Description of Artificial Sequence: Synthetic peptide
  Seed: LASSILCALI (KKLC1_HUMAN)
LISSILCALA

SEQ ID NO: 40016 - protein, 10 aa, Artificial Sequence
  Description of Artificial Sequence: Synthetic peptide
  Seed: RRFQRNTGEM (KKLC1_HUMAN)
RSFQRNTGEF

SEQ ID NO: 40017 - protein, 9 aa, Artificial Sequence
  Description of Artificial Sequence: Synthetic peptide
  Seed: SILCALIVF (KKLC1_HUMAN)
SVLCALIVY

SEQ ID NO: 40018 - protein, 11 aa, Artificial Sequence
  Description of Artificial Sequence: Synthetic peptide
  Seed: YLLLASSILCA (KKLC1_HUMAN)
YNLLASSILCI

SEQ ID NO: 40019 - protein, 10 aa, Artificial Sequence
  Description of Artificial Sequence: Synthetic peptide
  Seed: KLVELEHTLL (KKLC1_HUMAN)
KIVELEHTLV

SEQ ID NO: 40020 - protein, 8 aa, Artificial Sequence
  Description of Artificial Sequence: Synthetic peptide
  Seed: NTDNNLAV (KKLC1_HUMAN)
NVDNNLAL

SEQ ID NO: 40021 - protein, 9 aa, Artificial Sequence
  Description of Artificial Sequence: Synthetic peptide
  Seed: KLVELEHTL (KKLC1_HUMAN)
KLVELEHTF

SEQ ID NO: 40022 - protein, 10 aa, Artificial Sequence
  Description of Artificial Sequence: Synthetic peptide
  Seed: RRFQRNTGEM (KKLC1_HUMAN)
RKFQRNTGEY

SEQ ID NO: 40023 - protein, 9 aa, Artificial Sequence
  Description of Artificial Sequence: Synthetic peptide
  Seed: SSNSTALAL (KKLC1_HUMAN)
SENSTALAA

SEQ ID NO: 40024 - protein, 10 aa, Artificial Sequence
  Description of Artificial Sequence: Synthetic peptide
  Seed: RRFQRNTGEM (KKLC1_HUMAN)
RMFQRNTGEM

SEQ ID NO: 40025 - protein, 9 aa, Artificial Sequence
  Description of Artificial Sequence: Synthetic peptide
  Seed: KRILVNLSM (KKLC1_HUMAN)
KLILVNLSY

SEQ ID NO: 40026 - protein, 10 aa, Artificial Sequence
  Description of Artificial Sequence: Synthetic peptide
  Seed: KYRRFQRNTG (KKLC1_HUMAN)
KSRRFQRNTS

SEQ ID NO: 40027 - protein, 10 aa, Artificial Sequence
  Description of Artificial Sequence: Synthetic peptide
  Seed: LLLASSILCA (KKLC1_HUMAN)
LFLASSILCL

SEQ ID NO: 40028 - protein, 10 aa, Artificial Sequence
  Description of Artificial Sequence: Synthetic peptide
  Seed: QKRILVNLSM (KKLC1_HUMAN)
QERILVNLSL

SEQ ID NO: 40029 - protein, 9 aa, Artificial Sequence
  Description of Artificial Sequence: Synthetic peptide
  Seed: ILNNFPHSI (KKLC1_HUMAN)
IRNNFPHSM

SEQ ID NO: 40030 - protein, 9 aa, Artificial Sequence
  Description of Artificial Sequence: Synthetic peptide
  Seed: LLASSILCA (KKLC1_HUMAN)
LIASSILCA

SEQ ID NO: 40031 - protein, 8 aa, Artificial Sequence
  Description of Artificial Sequence: Synthetic peptide
  Seed: NTDNNLAV (KKLC1_HUMAN)
NIDNNLAI

SEQ ID NO: 40032 - protein, 11 aa, Artificial Sequence
  Description of Artificial Sequence: Synthetic peptide
  Seed: NNFPHSIARQK (KKLC1_HUMAN)
NMFPHSIARQR

SEQ ID NO: 40033 - protein, 9 aa, Artificial Sequence
  Description of Artificial Sequence: Synthetic peptide
  Seed: LASSILCAL (KKLC1_HUMAN)
LVSSILCAT

SEQ ID NO: 40034 - protein, 10 aa, Artificial Sequence
  Description of Artificial Sequence: Synthetic peptide
  Seed: EHTLLSKGFR (KKLC1_HUMAN)
EITLLSKGFR

SEQ ID NO: 40035 - protein, 9 aa, Artificial Sequence
  Description of Artificial Sequence: Synthetic peptide
  Seed: LASSILCAL (KKLC1_HUMAN)
LISSILCAI

SEQ ID NO: 40036 - protein, 9 aa, Artificial Sequence
  Description of Artificial Sequence: Synthetic peptide
  Seed: ILNNFPHSI (KKLC1_HUMAN)
ILNNFPHSV

SEQ ID NO: 40037 - protein, 10 aa, Artificial Sequence
  Description of Artificial Sequence: Synthetic peptide
  Seed: SMVENKLVEL (KKLC1_HUMAN)
SMVENKLVEV

SEQ ID NO: 40038 - protein, 9 aa, Artificial Sequence
  Description of Artificial Sequence: Synthetic peptide
  Seed: NLAVYDLSR (KKLC1_HUMAN)
NAAVYDLSR

SEQ ID NO: 40039 - protein, 10 aa, Artificial Sequence
  Description of Artificial Sequence: Synthetic peptide
  Seed: QKRILVNLSM (KKLC1_HUMAN)
QVRILVNLSM

SEQ ID NO: 40040 - protein, 9 aa, Artificial Sequence
  Description of Artificial Sequence: Synthetic peptide
  Seed: RQKRILVNL (KKLC1_HUMAN)
RVKRILVNK

SEQ ID NO: 40041 - protein, 10 aa, Artificial Sequence
  Description of Artificial Sequence: Synthetic peptide
  Seed: KGFRGASPHR (KKLC1_HUMAN)
KRFRGASPHA

SEQ ID NO: 40042 - protein, 9 aa, Artificial Sequence
  Description of Artificial Sequence: Synthetic peptide
  Seed: LLASSILCA (KKLC1_HUMAN)
LMASSILCT

SEQ ID NO: 40043 - protein, 10 aa, Artificial Sequence
  Description of Artificial Sequence: Synthetic peptide
  Seed: YLLLASSILC (KKLC1_HUMAN)
YQLLASSILV

SEQ ID NO: 40044 - protein, 9 aa, Artificial Sequence
  Description of Artificial Sequence: Synthetic peptide
  Seed: LASSILCAL (KKLC1_HUMAN)
LLSSILCAY

SEQ ID NO: 40045 - protein, 9 aa, Artificial Sequence
  Description of Artificial Sequence: Synthetic peptide
  Seed: SNSTALALV (KKLC1_HUMAN)
SLSTALALA

SEQ ID NO: 40046 - protein, 9 aa, Artificial Sequence
  Description of Artificial Sequence: Synthetic peptide
  Seed: KLVELEHTL (KKLC1_HUMAN)
KAVELEHTR

SEQ ID NO: 40047 - protein, 9 aa, Artificial Sequence
  Description of Artificial Sequence: Synthetic peptide
  Seed: MSSNSTALA (KKLC1_HUMAN)
MVSNSTALF

SEQ ID NO: 40048 - protein, 11 aa, Artificial Sequence
  Description of Artificial Sequence: Synthetic peptide
  Seed: RRFQRNTGEMS (KKLC1_HUMAN)
RRFQRNTGEMV

SEQ ID NO: 40049 - protein, 9 aa, Artificial Sequence
  Description of Artificial Sequence: Synthetic peptide
  Seed: NNFPHSIAR (KKLC1_HUMAN)
NQFPHSIAF

SEQ ID NO: 40050 - protein, 10 aa, Artificial Sequence
  Description of Artificial Sequence: Synthetic peptide
  Seed: SMVENKLVEL (KKLC1_HUMAN)
SQVENKLVEL

SEQ ID NO: 40051 - protein, 10 aa, Artificial Sequence
  Description of Artificial Sequence: Synthetic peptide
  Seed: FYLLLASSIL (KKLC1_HUMAN)
FCLLLASSIV

SEQ ID NO: 40052 - protein, 9 aa, Artificial Sequence
  Description of Artificial Sequence: Synthetic peptide
  Seed: KLVELEHTL (KKLC1_HUMAN)
KHVELEHTY

SEQ ID NO: 40053 - protein, 9 aa, Artificial Sequence
  Description of Artificial Sequence: Synthetic peptide
  Seed: LSKGFRGAS (KKLC1_HUMAN)
LVKGFRGAK

SEQ ID NO: 40054 - protein, 9 aa, Artificial Sequence
  Description of Artificial Sequence: Synthetic peptide
  Seed: ALIVFWKYR (KKLC1_HUMAN)
ATIVFWKYK

SEQ ID NO: 40055 - protein, 9 aa, Artificial Sequence
  Description of Artificial Sequence: Synthetic peptide
  Seed: YLLLASSIL (KKLC1_HUMAN)
YNLLASSIY

SEQ ID NO: 40056 - protein, 9 aa, Artificial Sequence
  Description of Artificial Sequence: Synthetic peptide
  Seed: AVYDLSRDI (KKLC1_HUMAN)
AIYDLSRDY

SEQ ID NO: 40057 - protein, 10 aa, Artificial Sequence
  Description of Artificial Sequence: Synthetic peptide
  Seed: QKRILVNLSM (KKLC1_HUMAN)
QGRILVNLSM

SEQ ID NO: 40058 - protein, 11 aa, Artificial Sequence
  Description of Artificial Sequence: Synthetic peptide
  Seed: YLLLASSILCA (KKLC1_HUMAN)
YCLLASSILCI

SEQ ID NO: 40059 - protein, 10 aa, Artificial Sequence
  Description of Artificial Sequence: Synthetic peptide
  Seed: YLLLASSILC (KKLC1_HUMAN)
YFLLASSILI

SEQ ID NO: 40060 - protein, 9 aa, Artificial Sequence
  Description of Artificial Sequence: Synthetic peptide
  Seed: LLSKGFRGA (KKLC1_HUMAN)
LMSKGFRGM

SEQ ID NO: 40061 - protein, 9 aa, Artificial Sequence
  Description of Artificial Sequence: Synthetic peptide
  Seed: ILNNFPHSI (KKLC1_HUMAN)
ITNNFPHSY

SEQ ID NO: 40062 - protein, 9 aa, Artificial Sequence
  Description of Artificial Sequence: Synthetic peptide
  Seed: KGFRGASPH (KKLC1_HUMAN)
KEFRGASPI

SEQ ID NO: 40063 - protein, 9 aa, Artificial Sequence
  Description of Artificial Sequence: Synthetic peptide
  Seed: SSNSTALAL (KKLC1_HUMAN)
SINSTALAY

SEQ ID NO: 40064 - protein, 9 aa, Artificial Sequence
  Description of Artificial Sequence: Synthetic peptide
  Seed: YLLLASSIL (KKLC1_HUMAN)
YGLLASSIY

SEQ ID NO: 40065 - protein, 10 aa, Artificial Sequence
  Description of Artificial Sequence: Synthetic peptide
  Seed: LASSILCALI (KKLC1_HUMAN)
LLSSILCALI

SEQ ID NO: 40066 - protein, 10 aa, Artificial Sequence
  Description of Artificial Sequence: Synthetic peptide
  Seed: VFWKYRRFQR (KKLC1_HUMAN)
VLWKYRRFQK

SEQ ID NO: 40067 - protein, 9 aa, Artificial Sequence
  Description of Artificial Sequence: Synthetic peptide
  Seed: RFQRNTGEM (KKLC1_HUMAN)
RYQRNTGEI

SEQ ID NO: 40068 - protein, 10 aa, Artificial Sequence
  Description of Artificial Sequence: Synthetic peptide
  Seed: SKGFRGASPH (KKLC1_HUMAN)
SQGFRGASPM

SEQ ID NO: 40069 - protein, 9 aa, Artificial Sequence
  Description of Artificial Sequence: Synthetic peptide
  Seed: ALIVFWKYR (KKLC1_HUMAN)
AYIVFWKYK

SEQ ID NO: 40070 - protein, 10 aa, Artificial Sequence
  Description of Artificial Sequence: Synthetic peptide
  Seed: CALIVFWKYR (KKLC1_HUMAN)
CRLIVFWKYR

SEQ ID NO: 40071 - protein, 9 aa, Artificial Sequence
  Description of Artificial Sequence: Synthetic peptide
  Seed: ILCALIVFW (KKLC1_HUMAN)
IACALIVFW

SEQ ID NO: 40072 - protein, 9 aa, Artificial Sequence
  Description of Artificial Sequence: Synthetic peptide
  Seed: MVENKLVEL (KKLC1_HUMAN)
MSENKLVEW

SEQ ID NO: 40073 - protein, 9 aa, Artificial Sequence
  Description of Artificial Sequence: Synthetic peptide
  Seed: NTDNNLAVY (KKLC1_HUMAN)
NSDNNLAVF

SEQ ID NO: 40074 - protein, 10 aa, Artificial Sequence
  Description of Artificial Sequence: Synthetic peptide
  Seed: SMVENKLVEL (KKLC1_HUMAN)
SMVENKLVEM

SEQ ID NO: 40075 - protein, 8 aa, Artificial Sequence
  Description of Artificial Sequence: Synthetic peptide
  Seed: VYDLSRDI (KKLC1_HUMAN)
VTDLSRDL

SEQ ID NO: 40076 - protein, 11 aa, Artificial Sequence
  Description of Artificial Sequence: Synthetic peptide
  Seed: RQKRILVNLSM (KKLC1_HUMAN)
RSKRILVNLSR

SEQ ID NO: 40077 - protein, 9 aa, Artificial Sequence
  Description of Artificial Sequence: Synthetic peptide
  Seed: MSSNSTALA (KKLC1_HUMAN)
MASNSTALL

SEQ ID NO: 40078 - protein, 9 aa, Artificial Sequence
  Description of Artificial Sequence: Synthetic peptide
  Seed: MVENKLVEL (KKLC1_HUMAN)
MYENKLVEL

SEQ ID NO: 40079 - protein, 9 aa, Artificial Sequence
  Description of Artificial Sequence: Synthetic peptide
  Seed: AVYDLSRDI (KKLC1_HUMAN)
AVYDLSRDF

SEQ ID NO: 40080 - protein, 10 aa, Artificial Sequence
  Description of Artificial Sequence: Synthetic peptide
  Seed: ALIVFWKYRR (KKLC1_HUMAN)
ASIVFWKYRK

SEQ ID NO: 40081 - protein, 10 aa, Artificial Sequence
  Description of Artificial Sequence: Synthetic peptide
  Seed: RRFQRNTGEM (KKLC1_HUMAN)
RRFQRNTGER

SEQ ID NO: 40082 - protein, 9 aa, Artificial Sequence
  Description of Artificial Sequence: Synthetic peptide
  Seed: RQKRILVNL (KKLC1_HUMAN)
RWKRILVNM

SEQ ID NO: 40083 - protein, 10 aa, Artificial Sequence
  Description of Artificial Sequence: Synthetic peptide
  Seed: MSSNSTALAL (KKLC1_HUMAN)
MASNSTALAY

SEQ ID NO: 40084 - protein, 9 aa, Artificial Sequence
  Description of Artificial Sequence: Synthetic peptide
  Seed: KRILVNLSM (KKLC1_HUMAN)
KQILVNLSW

SEQ ID NO: 40085 - protein, 11 aa, Artificial Sequence
  Description of Artificial Sequence: Synthetic peptide
  Seed: KLVELEHTLLS (KKLC1_HUMAN)
KMVELEHTLLV

SEQ ID NO: 40086 - protein, 10 aa, Artificial Sequence
  Description of Artificial Sequence: Synthetic peptide
  Seed: NNLAVYDLSR (KKLC1_HUMAN)
NSLAVYDLSR

SEQ ID NO: 40087 - protein, 11 aa, Artificial Sequence
  Description of Artificial Sequence: Synthetic peptide
  Seed: YLLLASSILCA (KKLC1_HUMAN)
YILLASSILCL

SEQ ID NO: 40088 - protein, 9 aa, Artificial Sequence
  Description of Artificial Sequence: Synthetic peptide
  Seed: RRFQRNTGE (KKLC1_HUMAN)
RRFQRNTGI

SEQ ID NO: 40089 - protein, 9 aa, Artificial Sequence
  Description of Artificial Sequence: Synthetic peptide
  Seed: KLVELEHTL (KKLC1_HUMAN)
KTVELEHTF

SEQ ID NO: 40090 - protein, 9 aa, Artificial Sequence
  Description of Artificial Sequence: Synthetic peptide
  Seed: MSSNSTALA (KKLC1_HUMAN)
MPSNSTALV

SEQ ID NO: 40091 - protein, 10 aa, Artificial Sequence
  Description of Artificial Sequence: Synthetic peptide
  Seed: RQKRILVNLS (KKLC1_HUMAN)
RVKRILVNLI

SEQ ID NO: 40092 - protein, 9 aa, Artificial Sequence
  Description of Artificial Sequence: Synthetic peptide
  Seed: KGFRGASPH (KKLC1_HUMAN)
KLFRGASPM

SEQ ID NO: 40093 - protein, 10 aa, Artificial Sequence
  Description of Artificial Sequence: Synthetic peptide
  Seed: LNNFPHSIAR (KKLC1_HUMAN)
LVNFPHSIAR

SEQ ID NO: 40094 - protein, 9 aa, Artificial Sequence
  Description of Artificial Sequence: Synthetic peptide
  Seed: LSRDILNNF (KKLC1_HUMAN)
LVRDILNNF

SEQ ID NO: 40095 - protein, 9 aa, Artificial Sequence
  Description of Artificial Sequence: Synthetic peptide
  Seed: KGFRGASPH (KKLC1_HUMAN)
KKFRGASPV

SEQ ID NO: 40096 - protein, 8 aa, Artificial Sequence
  Description of Artificial Sequence: Synthetic peptide
  Seed: VENKLVEL (KKLC1_HUMAN)
VENKLVEI

SEQ ID NO: 40097 - protein, 9 aa, Artificial Sequence
  Description of Artificial Sequence: Synthetic peptide
  Seed: MVENKLVEL (KKLC1_HUMAN)
MSENKLVEF

SEQ ID NO: 40098 - protein, 11 aa, Artificial Sequence
  Description of Artificial Sequence: Synthetic peptide
  Seed: IVFWKYRRFQR (KKLC1_HUMAN)
IFFWKYRRFQR

SEQ ID NO: 40099 - protein, 8 aa, Artificial Sequence
  Description of Artificial Sequence: Synthetic peptide
  Seed: VELEHTLL (KKLC1_HUMAN)
VQLEHTLL

SEQ ID NO: 40100 - protein, 9 aa, Artificial Sequence
  Description of Artificial Sequence: Synthetic peptide
  Seed: SSNSTALAL (KKLC1_HUMAN)
SLNSTALAV

SEQ ID NO: 40101 - protein, 9 aa, Artificial Sequence
  Description of Artificial Sequence: Synthetic peptide
  Seed: HTLLSKGFR (KKLC1_HUMAN)
HALLSKGFR

SEQ ID NO: 40102 - protein, 9 aa, Artificial Sequence
  Description of Artificial Sequence: Synthetic peptide
  Seed: NNFPHSIAR (KKLC1_HUMAN)
NAFPHSIAM

SEQ ID NO: 40103 - protein, 10 aa, Artificial Sequence
  Description of Artificial Sequence: Synthetic peptide
  Seed: GEMSSNSTAL (KKLC1_HUMAN)
GQMSSNSTAF

SEQ ID NO: 40104 - protein, 10 aa, Artificial Sequence
  Description of Artificial Sequence: Synthetic peptide
  Seed: VNLSMVENKL (KKLC1_HUMAN)
VMLSMVENKV

SEQ ID NO: 40105 - protein, 9 aa, Artificial Sequence
  Description of Artificial Sequence: Synthetic peptide
  Seed: KRILVNLSM (KKLC1_HUMAN)
KRILVNLSF

SEQ ID NO: 40106 - protein, 9 aa, Artificial Sequence
  Description of Artificial Sequence: Synthetic peptide
  Seed: ELEHTLLSK (KKLC1_HUMAN)
EVEHTLLSK

SEQ ID NO: 40107 - protein, 10 aa, Artificial Sequence
  Description of Artificial Sequence: Synthetic peptide
  Seed: KYRRFQRNTG (KKLC1_HUMAN)
KVRRFQRNTA

SEQ ID NO: 40108 - protein, 10 aa, Artificial Sequence
  Description of Artificial Sequence: Synthetic peptide
  Seed: ALVRPSSSGL (KKLC1_HUMAN)
ALVRPSSSGK

SEQ ID NO: 40109 - protein, 10 aa, Artificial Sequence
  Description of Artificial Sequence: Synthetic peptide
  Seed: GEMSSNSTAL (KKLC1_HUMAN)
GLMSSNSTAL

SEQ ID NO: 40110 - protein, 10 aa, Artificial Sequence
  Description of Artificial Sequence: Synthetic peptide
  Seed: KYRRFQRNTG (KKLC1_HUMAN)
KTRRFQRNTL

SEQ ID NO: 40111 - protein, 9 aa, Artificial Sequence
  Description of Artificial Sequence: Synthetic peptide
  Seed: VNLSMVENK (KKLC1_HUMAN)
VVLSMVENK

SEQ ID NO: 40112 - protein, 11 aa, Artificial Sequence
  Description of Artificial Sequence: Synthetic peptide
  Seed: RQKRILVNLSM (KKLC1_HUMAN)
RHKRILVNLSK

SEQ ID NO: 40113 - protein, 10 aa, Artificial Sequence
  Description of Artificial Sequence: Synthetic peptide
  Seed: VFWKYRRFQR (KKLC1_HUMAN)
VTWKYRRFQK

SEQ ID NO: 40114 - protein, 10 aa, Artificial Sequence
  Description of Artificial Sequence: Synthetic peptide
  Seed: LNNFPHSIAR (KKLC1_HUMAN)
LTNFPHSIAR

SEQ ID NO: 40115 - protein, 9 aa, Artificial Sequence
  Description of Artificial Sequence: Synthetic peptide
  Seed: RQKRILVNL (KKLC1_HUMAN)
RTKRILVNF

SEQ ID NO: 40116 - protein, 10 aa, Artificial Sequence
  Description of Artificial Sequence: Synthetic peptide
  Seed: QKRILVNLSM (KKLC1_HUMAN)
QARILVNLSI

SEQ ID NO: 40117 - protein, 9 aa, Artificial Sequence
  Description of Artificial Sequence: Synthetic peptide
  Seed: MVENKLVEL (KKLC1_HUMAN)
MFENKLVEI

SEQ ID NO: 40118 - protein, 9 aa, Artificial Sequence
  Description of Artificial Sequence: Synthetic peptide
  Seed: LASSILCAL (KKLC1_HUMAN)
LTSSILCAL

SEQ ID NO: 40119 - protein, 9 aa, Artificial Sequence
  Description of Artificial Sequence: Synthetic peptide
  Seed: FWKYRRFQR (KKLC1_HUMAN)
FIKYRRFQR

SEQ ID NO: 40120 - protein, 9 aa, Artificial Sequence
  Description of Artificial Sequence: Synthetic peptide
  Seed: ILNNFPHSI (KKLC1_HUMAN)
IHNNFPHSL

SEQ ID NO: 40121 - protein, 9 aa, Artificial Sequence
  Description of Artificial Sequence: Synthetic peptide
  Seed: MVENKLVEL (KKLC1_HUMAN)
MFENKLVEL

SEQ ID NO: 40122 - protein, 9 aa, Artificial Sequence
  Description of Artificial Sequence: Synthetic peptide
  Seed: NSTALALVR (KKLC1_HUMAN)
NYTALALVR

SEQ ID NO: 40123 - protein, 9 aa, Artificial Sequence
  Description of Artificial Sequence: Synthetic peptide
  Seed: NNFPHSIAR (KKLC1_HUMAN)
NVFPHSIAI

SEQ ID NO: 40124 - protein, 9 aa, Artificial Sequence
  Description of Artificial Sequence: Synthetic peptide
  Seed: NNFPHSIAR (KKLC1_HUMAN)
NVFPHSIAV

SEQ ID NO: 40125 - protein, 10 aa, Artificial Sequence
  Description of Artificial Sequence: Synthetic peptide
  Seed: YLLLASSILC (KKLC1_HUMAN)
YKLLASSILA

SEQ ID NO: 40126 - protein, 9 aa, Artificial Sequence
  Description of Artificial Sequence: Synthetic peptide
  Seed: YLLLASSIL (KKLC1_HUMAN)
YLLLASSIV

SEQ ID NO: 40127 - protein, 10 aa, Artificial Sequence
  Description of Artificial Sequence: Synthetic peptide
  Seed: MSSNSTALAL (KKLC1_HUMAN)
MGSNSTALAF

SEQ ID NO: 40128 - protein, 9 aa, Artificial Sequence
  Description of Artificial Sequence: Synthetic peptide
  Seed: KRILVNLSM (KKLC1_HUMAN)
KMILVNLSY

SEQ ID NO: 40129 - protein, 9 aa, Artificial Sequence
  Description of Artificial Sequence: Synthetic peptide
  Seed: LLASSILCA (KKLC1_HUMAN)
LMASSILCM

SEQ ID NO: 40130 - protein, 10 aa, Artificial Sequence
  Description of Artificial Sequence: Synthetic peptide
  Seed: ALVRPSSSGL (KKLC1_HUMAN)
APVRPSSSGK

SEQ ID NO: 40131 - protein, 9 aa, Artificial Sequence
  Description of Artificial Sequence: Synthetic peptide
  Seed: RQKRILVNL (KKLC1_HUMAN)
RQKRILVNA

SEQ ID NO: 40132 - protein, 10 aa, Artificial Sequence
  Description of Artificial Sequence: Synthetic peptide
  Seed: SSILCALIVF (KKLC1_HUMAN)
SAILCALIVW

SEQ ID NO: 40133 - protein, 9 aa, Artificial Sequence
  Description of Artificial Sequence: Synthetic peptide
  Seed: RQKRILVNL (KKLC1_HUMAN)
RIKRILVNT

SEQ ID NO: 40134 - protein, 9 aa, Artificial Sequence
  Description of Artificial Sequence: Synthetic peptide
  Seed: MSSNSTALA (KKLC1_HUMAN)
MASNSTALF

SEQ ID NO: 40135 - protein, 8 aa, Artificial Sequence
  Description of Artificial Sequence: Synthetic peptide
  Seed: VYDLSRDI (KKLC1_HUMAN)
VADLSRDL

SEQ ID NO: 40136 - protein, 8 aa, Artificial Sequence
  Description of Artificial Sequence: Synthetic peptide
  Seed: VYDLSRDI (KKLC1_HUMAN)
VIDLSRDL

SEQ ID NO: 40137 - protein, 9 aa, Artificial Sequence
  Description of Artificial Sequence: Synthetic peptide
  Seed: FPHSIARQK (KKLC1_HUMAN)
FPHSIARQA

SEQ ID NO: 40138 - protein, 9 aa, Artificial Sequence
  Description of Artificial Sequence: Synthetic peptide
  Seed: KRILVNLSM (KKLC1_HUMAN)
KHILVNLSF

SEQ ID NO: 40139 - protein, 9 aa, Artificial Sequence
  Description of Artificial Sequence: Synthetic peptide
  Seed: ALIVFWKYR (KKLC1_HUMAN)
AWIVFWKYR

SEQ ID NO: 40140 - protein, 9 aa, Artificial Sequence
  Description of Artificial Sequence: Synthetic peptide
  Seed: SNSTALALV (KKLC1_HUMAN)
SMSTALALV

SEQ ID NO: 40141 - protein, 10 aa, Artificial Sequence
  Description of Artificial Sequence: Synthetic peptide
  Seed: TGEMSSNSTA (KKLC1_HUMAN)
TSEMSSNSTA

SEQ ID NO: 40142 - protein, 10 aa, Artificial Sequence
  Description of Artificial Sequence: Synthetic peptide
  Seed: YLLLASSILC (KKLC1_HUMAN)
YTLLASSILV

SEQ ID NO: 40143 - protein, 10 aa, Artificial Sequence
  Description of Artificial Sequence: Synthetic peptide
  Seed: QKRILVNLSM (KKLC1_HUMAN)
QFRILVNLSL

SEQ ID NO: 40144 - protein, 9 aa, Artificial Sequence
  Description of Artificial Sequence: Synthetic peptide
  Seed: RFQRNTGEM (KKLC1_HUMAN)
RYQRNTGEY

SEQ ID NO: 40145 - protein, 9 aa, Artificial Sequence
  Description of Artificial Sequence: Synthetic peptide
  Seed: SNSTALALV (KKLC1_HUMAN)
SVSTALALM

SEQ ID NO: 40146 - protein, 9 aa, Artificial Sequence
  Description of Artificial Sequence: Synthetic peptide
  Seed: CALIVFWKY (KKLC1_HUMAN)
CSLIVFWKW

SEQ ID NO: 40147 - protein, 10 aa, Artificial Sequence
  Description of Artificial Sequence: Synthetic peptide
  Seed: SSILCALIVF (KKLC1_HUMAN)
STILCALIVW

SEQ ID NO: 40148 - protein, 9 aa, Artificial Sequence
  Description of Artificial Sequence: Synthetic peptide
  Seed: RQKRILVNL (KKLC1_HUMAN)
RMKRILVNL

SEQ ID NO: 40149 - protein, 9 aa, Artificial Sequence
  Description of Artificial Sequence: Synthetic peptide
  Seed: MSSNSTALA (KKLC1_HUMAN)
MISNSTALA

SEQ ID NO: 40150 - protein, 9 aa, Artificial Sequence
  Description of Artificial Sequence: Synthetic peptide
  Seed: LVRPSSSGL (KKLC1_HUMAN)
LSRPSSSGI

SEQ ID NO: 40151 - protein, 11 aa, Artificial Sequence
  Description of Artificial Sequence: Synthetic peptide
  Seed: LLLASSILCAL (KKLC1_HUMAN)
LFLASSILCAL

SEQ ID NO: 40152 - protein, 9 aa, Artificial Sequence
  Description of Artificial Sequence: Synthetic peptide
  Seed: LSRDILNNF (KKLC1_HUMAN)
LARDILNNM

SEQ ID NO: 40153 - protein, 9 aa, Artificial Sequence
  Description of Artificial Sequence: Synthetic peptide
  Seed: IARQKRILV (KKLC1_HUMAN)
IIRQKRILL

SEQ ID NO: 40154 - protein, 9 aa, Artificial Sequence
  Description of Artificial Sequence: Synthetic peptide
  Seed: IVFWKYRRF (KKLC1_HUMAN)
ISFWKYRRM

SEQ ID NO: 40155 - protein, 10 aa, Artificial Sequence
  Description of Artificial Sequence: Synthetic peptide
  Seed: LLLASSILCA (KKLC1_HUMAN)
LSLASSILCV

SEQ ID NO: 40156 - protein, 10 aa, Artificial Sequence
  Description of Artificial Sequence: Synthetic peptide
  Seed: RQKRILVNLS (KKLC1_HUMAN)
RAKRILVNLV

SEQ ID NO: 40157 - protein, 9 aa, Artificial Sequence
  Description of Artificial Sequence: Synthetic peptide
  Seed: RQKRILVNL (KKLC1_HUMAN)
RAKRILVNL

SEQ ID NO: 40158 - protein, 9 aa, Artificial Sequence
  Description of Artificial Sequence: Synthetic peptide
  Seed: ILNNFPHSI (KKLC1_HUMAN)
IKNNFPHSY

SEQ ID NO: 40159 - protein, 10 aa, Artificial Sequence
  Description of Artificial Sequence: Synthetic peptide
  Seed: QKRILVNLSM (KKLC1_HUMAN)
QWRILVNLSM

SEQ ID NO: 40160 - protein, 9 aa, Artificial Sequence
  Description of Artificial Sequence: Synthetic peptide
  Seed: ILNNFPHSI (KKLC1_HUMAN)
IWNNFPHSL

SEQ ID NO: 40161 - protein, 9 aa, Artificial Sequence
  Description of Artificial Sequence: Synthetic peptide
  Seed: RQKRILVNL (KKLC1_HUMAN)
RYKRILVNS

SEQ ID NO: 40162 - protein, 11 aa, Artificial Sequence
  Description of Artificial Sequence: Synthetic peptide
  Seed: YLLLASSILCA (KKLC1_HUMAN)
YTLLASSILCL

SEQ ID NO: 40163 - protein, 9 aa, Artificial Sequence
  Description of Artificial Sequence: Synthetic peptide
  Seed: NSTALALVR (KKLC1_HUMAN)
NITALALVR

SEQ ID NO: 40164 - protein, 9 aa, Artificial Sequence
  Description of Artificial Sequence: Synthetic peptide
  Seed: FPHSIARQK (KKLC1_HUMAN)
FSHSIARQR

SEQ ID NO: 40165 - protein, 11 aa, Artificial Sequence
  Description of Artificial Sequence: Synthetic peptide
  Seed: RQKRILVNLSM (KKLC1_HUMAN)
RIKRILVNLSL

SEQ ID NO: 40166 - protein, 9 aa, Artificial Sequence
  Description of Artificial Sequence: Synthetic peptide
  Seed: KRILVNLSM (KKLC1_HUMAN)
KMILVNLSL

SEQ ID NO: 40167 - protein, 9 aa, Artificial Sequence
  Description of Artificial Sequence: Synthetic peptide
  Seed: RILVNLSMV (KKLC1_HUMAN)
RMLVNLSMK

SEQ ID NO: 40168 - protein, 11 aa, Artificial Sequence
  Description of Artificial Sequence: Synthetic peptide
  Seed: YLLLASSILCA (KKLC1_HUMAN)
YWLLASSILCI

SEQ ID NO: 40169 - protein, 9 aa, Artificial Sequence
  Description of Artificial Sequence: Synthetic peptide
  Seed: KLVELEHTL (KKLC1_HUMAN)
KVVELEHTW

SEQ ID NO: 40170 - protein, 9 aa, Artificial Sequence
  Description of Artificial Sequence: Synthetic peptide
  Seed: VYDLSRDIL (KKLC1_HUMAN)
VFDLSRDIL

SEQ ID NO: 40171 - protein, 9 aa, Artificial Sequence
  Description of Artificial Sequence: Synthetic peptide
  Seed: MVENKLVEL (KKLC1_HUMAN)
MYENKLVEM

SEQ ID NO: 40172 - protein, 9 aa, Artificial Sequence
  Description of Artificial Sequence: Synthetic peptide
  Seed: LASSILCAL (KKLC1_HUMAN)
LVSSILCAV

SEQ ID NO: 40173 - protein, 9 aa, Artificial Sequence
  Description of Artificial Sequence: Synthetic peptide
  Seed: ILNNFPHSI (KKLC1_HUMAN)
IQNNFPHSM

SEQ ID NO: 40174 - protein, 10 aa, Artificial Sequence
  Description of Artificial Sequence: Synthetic peptide
  Seed: KGFRGASPHR (KKLC1_HUMAN)
KSFRGASPHV

SEQ ID NO: 40175 - protein, 9 aa, Artificial Sequence
  Description of Artificial Sequence: Synthetic peptide
  Seed: SNSTALALV (KKLC1_HUMAN)
SASTALALA

SEQ ID NO: 40176 - protein, 10 aa, Artificial Sequence
  Description of Artificial Sequence: Synthetic peptide
  Seed: MSSNSTALAL (KKLC1_HUMAN)
MQSNSTALAL

SEQ ID NO: 40177 - protein, 9 aa, Artificial Sequence
  Description of Artificial Sequence: Synthetic peptide
  Seed: SNSTALALV (KKLC1_HUMAN)
SSSTALALV

SEQ ID NO: 40178 - protein, 10 aa, Artificial Sequence
  Description of Artificial Sequence: Synthetic peptide
  Seed: QKRILVNLSM (KKLC1_HUMAN)
QWRILVNLSI

SEQ ID NO: 40179 - protein, 10 aa, Artificial Sequence
  Description of Artificial Sequence: Synthetic peptide
  Seed: KRILVNLSMV (KKLC1_HUMAN)
KMILVNLSMI

SEQ ID NO: 40180 - protein, 9 aa, Artificial Sequence
  Description of Artificial Sequence: Synthetic peptide
  Seed: LCALIVFWK (KKLC1_HUMAN)
LTALIVFWR

SEQ ID NO: 40181 - protein, 9 aa, Artificial Sequence
  Description of Artificial Sequence: Synthetic peptide
  Seed: SILCALIVF (KKLC1_HUMAN)
SALCALIVY

SEQ ID NO: 40182 - protein, 10 aa, Artificial Sequence
  Description of Artificial Sequence: Synthetic peptide
  Seed: NFYLLLASSI (KKLC1_HUMAN)
NYYLLLASSF

SEQ ID NO: 40183 - protein, 9 aa, Artificial Sequence
  Description of Artificial Sequence: Synthetic peptide
  Seed: KRILVNLSM (KKLC1_HUMAN)
KYILVNLSY

SEQ ID NO: 40184 - protein, 9 aa, Artificial Sequence
  Description of Artificial Sequence: Synthetic peptide
  Seed: ILNNFPHSI (KKLC1_HUMAN)
ILNNFPHSY

SEQ ID NO: 40185 - protein, 10 aa, Artificial Sequence
  Description of Artificial Sequence: Synthetic peptide
  Seed: NFYLLLASSI (KKLC1_HUMAN)
NAYLLLASSF

SEQ ID NO: 40186 - protein, 10 aa, Artificial Sequence
  Description of Artificial Sequence: Synthetic peptide
  Seed: EHTLLSKGFR (KKLC1_HUMAN)
EWTLLSKGFR

SEQ ID NO: 40187 - protein, 10 aa, Artificial Sequence
  Description of Artificial Sequence: Synthetic peptide
  Seed: MSSNSTALAL (KKLC1_HUMAN)
MDSNSTALAY

SEQ ID NO: 40188 - protein, 9 aa, Artificial Sequence
  Description of Artificial Sequence: Synthetic peptide
  Seed: MSSNSTALA (KKLC1_HUMAN)
MVSNSTALY

SEQ ID NO: 40189 - protein, 10 aa, Artificial Sequence
  Description of Artificial Sequence: Synthetic peptide
  Seed: SNTDNNLAVY (KKLC1_HUMAN)
SATDNNLAVF

SEQ ID NO: 40190 - protein, 11 aa, Artificial Sequence
  Description of Artificial Sequence: Synthetic peptide
  Seed: LLLASSILCAL (KKLC1_HUMAN)
LQLASSILCAV

SEQ ID NO: 40191 - protein, 9 aa, Artificial Sequence
  Description of Artificial Sequence: Synthetic peptide
  Seed: LVRPSSSGL (KKLC1_HUMAN)
LPRPSSSGI

SEQ ID NO: 40192 - protein, 9 aa, Artificial Sequence
  Description of Artificial Sequence: Synthetic peptide
  Seed: FWKYRRFQR (KKLC1_HUMAN)
FVKYRRFQR

SEQ ID NO: 40193 - protein, 9 aa, Artificial Sequence
  Description of Artificial Sequence: Synthetic peptide
  Seed: KGFRGASPH (KKLC1_HUMAN)
KAFRGASPW

SEQ ID NO: 40194 - protein, 9 aa, Artificial Sequence
  Description of Artificial Sequence: Synthetic peptide
  Seed: ASSILCALI (KKLC1_HUMAN)
AGSILCALW

SEQ ID NO: 40195 - protein, 11 aa, Artificial Sequence
  Description of Artificial Sequence: Synthetic peptide
  Seed: VFWKYRRFQRN (KKLC1_HUMAN)
VMWKYRRFQRR

SEQ ID NO: 40196 - protein, 9 aa, Artificial Sequence
  Description of Artificial Sequence: Synthetic peptide
  Seed: KGFRGASPH (KKLC1_HUMAN)
KSFRGASPM

SEQ ID NO: 40197 - protein, 10 aa, Artificial Sequence
  Description of Artificial Sequence: Synthetic peptide
  Seed: MSSNSTALAL (KKLC1_HUMAN)
MVSNSTALAV

SEQ ID NO: 40198 - protein, 9 aa, Artificial Sequence
  Description of Artificial Sequence: Synthetic peptide
  Seed: NNFPHSIAR (KKLC1_HUMAN)
NIFPHSIAY

SEQ ID NO: 40199 - protein, 9 aa, Artificial Sequence
  Description of Artificial Sequence: Synthetic peptide
  Seed: RQKRILVNL (KKLC1_HUMAN)
RAKRILVNG

SEQ ID NO: 40200 - protein, 10 aa, Artificial Sequence
  Description of Artificial Sequence: Synthetic peptide
  Seed: DLSRDILNNF (KKLC1_HUMAN)
DTSRDILNNF

SEQ ID NO: 40201 - protein, 11 aa, Artificial Sequence
  Description of Artificial Sequence: Synthetic peptide
  Seed: RQKRILVNLSM (KKLC1_HUMAN)
RMKRILVNLSV

SEQ ID NO: 40202 - protein, 9 aa, Artificial Sequence
  Description of Artificial Sequence: Synthetic peptide
  Seed: KLVELEHTL (KKLC1_HUMAN)
KKVELEHTF

SEQ ID NO: 40203 - protein, 9 aa, Artificial Sequence
  Description of Artificial Sequence: Synthetic peptide
  Seed: KRILVNLSM (KKLC1_HUMAN)
KAILVNLSY

SEQ ID NO: 40204 - protein, 9 aa, Artificial Sequence
  Description of Artificial Sequence: Synthetic peptide
  Seed: LVRPSSSGL (KKLC1_HUMAN)
LPRPSSSGL

SEQ ID NO: 40205 - protein, 9 aa, Artificial Sequence
  Description of Artificial Sequence: Synthetic peptide
  Seed: VYDLSRDIL (KKLC1_HUMAN)
VMDLSRDIV

SEQ ID NO: 40206 - protein, 10 aa, Artificial Sequence
  Description of Artificial Sequence: Synthetic peptide
  Seed: KGFRGASPHR (KKLC1_HUMAN)
KVFRGASPHV

SEQ ID NO: 40207 - protein, 10 aa, Artificial Sequence
  Description of Artificial Sequence: Synthetic peptide
  Seed: GEMSSNSTAL (KKLC1_HUMAN)
GSMSSNSTAF

SEQ ID NO: 40208 - protein, 9 aa, Artificial Sequence
  Description of Artificial Sequence: Synthetic peptide
  Seed: RQKRILVNL (KKLC1_HUMAN)
RTKRILVNI

SEQ ID NO: 40209 - protein, 10 aa, Artificial Sequence
  Description of Artificial Sequence: Synthetic peptide
  Seed: KRILVNLSMV (KKLC1_HUMAN)
KRILVNLSMR

SEQ ID NO: 40210 - protein, 11 aa, Artificial Sequence
  Description of Artificial Sequence: Synthetic peptide
  Seed: MSSNSTALALV (KKLC1_HUMAN)
MASNSTALALW

SEQ ID NO: 40211 - protein, 9 aa, Artificial Sequence
  Description of Artificial Sequence: Synthetic peptide
  Seed: MVENKLVEL (KKLC1_HUMAN)
MLENKLVEF

SEQ ID NO: 40212 - protein, 10 aa, Artificial Sequence
  Description of Artificial Sequence: Synthetic peptide
  Seed: RRFQRNTGEM (KKLC1_HUMAN)
REFQRNTGEY

SEQ ID NO: 40213 - protein, 10 aa, Artificial Sequence
  Description of Artificial Sequence: Synthetic peptide
  Seed: VFWKYRRFQR (KKLC1_HUMAN)
VIWKYRRFQR

SEQ ID NO: 40214 - protein, 9 aa, Artificial Sequence
  Description of Artificial Sequence: Synthetic peptide
  Seed: KLVELEHTL (KKLC1_HUMAN)
KEVELEHTA

SEQ ID NO: 40215 - protein, 10 aa, Artificial Sequence
  Description of Artificial Sequence: Synthetic peptide
  Seed: KRILVNLSMV (KKLC1_HUMAN)
KRILVNLSMI

SEQ ID NO: 40216 - protein, 10 aa, Artificial Sequence
  Description of Artificial Sequence: Synthetic peptide
  Seed: LASSILCALI (KKLC1_HUMAN)
LLSSILCALN

SEQ ID NO: 40217 - protein, 10 aa, Artificial Sequence
  Description of Artificial Sequence: Synthetic peptide
  Seed: QKRILVNLSM (KKLC1_HUMAN)
QCRILVNLSF

SEQ ID NO: 40218 - protein, 10 aa, Artificial Sequence
  Description of Artificial Sequence: Synthetic peptide
  Seed: QKRILVNLSM (KKLC1_HUMAN)
QHRILVNLSM

SEQ ID NO: 40219 - protein, 10 aa, Artificial Sequence
  Description of Artificial Sequence: Synthetic peptide
  Seed: EMSSNSTALA (KKLC1_HUMAN)
ETSSNSTALL

SEQ ID NO: 40220 - protein, 10 aa, Artificial Sequence
  Description of Artificial Sequence: Synthetic peptide
  Seed: QKRILVNLSM (KKLC1_HUMAN)
QRRILVNLSR

SEQ ID NO: 40221 - protein, 9 aa, Artificial Sequence
  Description of Artificial Sequence: Synthetic peptide
  Seed: SNTDNNLAV (KKLC1_HUMAN)
SLTDNNLAI

SEQ ID NO: 40222 - protein, 9 aa, Artificial Sequence
  Description of Artificial Sequence: Synthetic peptide
  Seed: KGFRGASPH (KKLC1_HUMAN)
KAFRGASPY

SEQ ID NO: 40223 - protein, 11 aa, Artificial Sequence
  Description of Artificial Sequence: Synthetic peptide
  Seed: YLLLASSILCA (KKLC1_HUMAN)
YDLLASSILCL

SEQ ID NO: 40224 - protein, 11 aa, Artificial Sequence
  Description of Artificial Sequence: Synthetic peptide
  Seed: NNFPHSIARQK (KKLC1_HUMAN)
NLFPHSIARQK

SEQ ID NO: 40225 - protein, 9 aa, Artificial Sequence
  Description of Artificial Sequence: Synthetic peptide
  Seed: NTDNNLAVY (KKLC1_HUMAN)
NADNNLAVF

SEQ ID NO: 40226 - protein, 10 aa, Artificial Sequence
  Description of Artificial Sequence: Synthetic peptide
  Seed: RQKRILVNLS (KKLC1_HUMAN)
RMKRILVNLV

SEQ ID NO: 40227 - protein, 9 aa, Artificial Sequence
  Description of Artificial Sequence: Synthetic peptide
  Seed: SSNSTALAL (KKLC1_HUMAN)
SGNSTALAY

SEQ ID NO: 40228 - protein, 10 aa, Artificial Sequence
  Description of Artificial Sequence: Synthetic peptide
  Seed: YLLLASSILC (KKLC1_HUMAN)
YYLLASSILM

SEQ ID NO: 40229 - protein, 11 aa, Artificial Sequence
  Description of Artificial Sequence: Synthetic peptide
  Seed: LSMVENKLVEL (KKLC1_HUMAN)
LYMVENKLVEV

SEQ ID NO: 40230 - protein, 10 aa, Artificial Sequence
  Description of Artificial Sequence: Synthetic peptide
  Seed: MSSNSTALAL (KKLC1_HUMAN)
MTSNSTALAA

SEQ ID NO: 40231 - protein, 9 aa, Artificial Sequence
  Description of Artificial Sequence: Synthetic peptide
  Seed: NTDNNLAVY (KKLC1_HUMAN)
NFDNNLAVF

SEQ ID NO: 40232 - protein, 10 aa, Artificial Sequence
  Description of Artificial Sequence: Synthetic peptide
  Seed: KGFRGASPHR (KKLC1_HUMAN)
KIFRGASPHA

SEQ ID NO: 40233 - protein, 11 aa, Artificial Sequence
  Description of Artificial Sequence: Synthetic peptide
  Seed: RQKRILVNLSM (KKLC1_HUMAN)
RDKRILVNLSV

SEQ ID NO: 40234 - protein, 9 aa, Artificial Sequence
  Description of Artificial Sequence: Synthetic peptide
  Seed: SSNSTALAL (KKLC1_HUMAN)
SRNSTALAF

SEQ ID NO: 40235 - protein, 10 aa, Artificial Sequence
  Description of Artificial Sequence: Synthetic peptide
  Seed: QKRILVNLSM (KKLC1_HUMAN)
QTRILVNLSF

SEQ ID NO: 40236 - protein, 9 aa, Artificial Sequence
  Description of Artificial Sequence: Synthetic peptide
  Seed: SSNSTALAL (KKLC1_HUMAN)
SMNSTALAM

SEQ ID NO: 40237 - protein, 10 aa, Artificial Sequence
  Description of Artificial Sequence: Synthetic peptide
  Seed: KYRRFQRNTG (KKLC1_HUMAN)
KSRRFQRNTY

SEQ ID NO: 40238 - protein, 9 aa, Artificial Sequence
  Description of Artificial Sequence: Synthetic peptide
  Seed: KGFRGASPH (KKLC1_HUMAN)
KMFRGASPV

SEQ ID NO: 40239 - protein, 9 aa, Artificial Sequence
  Description of Artificial Sequence: Synthetic peptide
  Seed: KLVELEHTL (KKLC1_HUMAN)
KNVELEHTV

SEQ ID NO: 40240 - protein, 9 aa, Artificial Sequence
  Description of Artificial Sequence: Synthetic peptide
  Seed: SNSTALALV (KKLC1_HUMAN)
SISTALALI

SEQ ID NO: 40241 - protein, 9 aa, Artificial Sequence
  Description of Artificial Sequence: Synthetic peptide
  Seed: NNFPHSIAR (KKLC1_HUMAN)
NGFPHSIAY

SEQ ID NO: 40242 - protein, 10 aa, Artificial Sequence
  Description of Artificial Sequence: Synthetic peptide
  Seed: QKRILVNLSM (KKLC1_HUMAN)
QTRILVNLSM

SEQ ID NO: 40243 - protein, 9 aa, Artificial Sequence
  Description of Artificial Sequence: Synthetic peptide
  Seed: RQKRILVNL (KKLC1_HUMAN)
RRKRILVNF

SEQ ID NO: 40244 - protein, 9 aa, Artificial Sequence
  Description of Artificial Sequence: Synthetic peptide
  Seed: SSNSTALAL (KKLC1_HUMAN)
SKNSTALAY

SEQ ID NO: 40245 - protein, 9 aa, Artificial Sequence
  Description of Artificial Sequence: Synthetic peptide
  Seed: KLVELEHTL (KKLC1_HUMAN)
KQVELEHTV

SEQ ID NO: 40246 - protein, 9 aa, Artificial Sequence
  Description of Artificial Sequence: Synthetic peptide
  Seed: IVFWKYRRF (KKLC1_HUMAN)
ITFWKYRRF

SEQ ID NO: 40247 - protein, 10 aa, Artificial Sequence
  Description of Artificial Sequence: Synthetic peptide
  Seed: YLLLASSILC (KKLC1_HUMAN)
YWLLASSILA

SEQ ID NO: 40248 - protein, 10 aa, Artificial Sequence
  Description of Artificial Sequence: Synthetic peptide
  Seed: CALIVFWKYR (KKLC1_HUMAN)
CMLIVFWKYR

SEQ ID NO: 40249 - protein, 10 aa, Artificial Sequence
  Description of Artificial Sequence: Synthetic peptide
  Seed: LLLASSILCA (KKLC1_HUMAN)
LPLASSILCV

SEQ ID NO: 40250 - protein, 9 aa, Artificial Sequence
  Description of Artificial Sequence: Synthetic peptide
  Seed: YLLLASSIL (KKLC1_HUMAN)
YWLLASSIY

SEQ ID NO: 40251 - protein, 9 aa, Artificial Sequence
  Description of Artificial Sequence: Synthetic peptide
  Seed: IARQKRILV (KKLC1_HUMAN)
IPRQKRILV

SEQ ID NO: 40252 - protein, 9 aa, Artificial Sequence
  Description of Artificial Sequence: Synthetic peptide
  Seed: LEHTLLSKG (KKLC1_HUMAN)
LEHTLLSKI

SEQ ID NO: 40253 - protein, 9 aa, Artificial Sequence
  Description of Artificial Sequence: Synthetic peptide
  Seed: LASSILCAL (KKLC1_HUMAN)
LVSSILCAL

SEQ ID NO: 40254 - protein, 10 aa, Artificial Sequence
  Description of Artificial Sequence: Synthetic peptide
  Seed: KYRRFQRNTG (KKLC1_HUMAN)
KSRRFQRNTL

SEQ ID NO: 40255 - protein, 10 aa, Artificial Sequence
  Description of Artificial Sequence: Synthetic peptide
  Seed: MSSNSTALAL (KKLC1_HUMAN)
MPSNSTALAY

SEQ ID NO: 40256 - protein, 9 aa, Artificial Sequence
  Description of Artificial Sequence: Synthetic peptide
  Seed: LASSILCAL (KKLC1_HUMAN)
LSSSILCAY

SEQ ID NO: 40257 - protein, 10 aa, Artificial Sequence
  Description of Artificial Sequence: Synthetic peptide
  Seed: KYRRFQRNTG (KKLC1_HUMAN)
KTRRFQRNTK

SEQ ID NO: 40258 - protein, 9 aa, Artificial Sequence
  Description of Artificial Sequence: Synthetic peptide
  Seed: RQKRILVNL (KKLC1_HUMAN)
RVKRILVNA

SEQ ID NO: 40259 - protein, 9 aa, Artificial Sequence
  Description of Artificial Sequence: Synthetic peptide
  Seed: VYDLSRDIL (KKLC1_HUMAN)
VIDLSRDII

SEQ ID NO: 40260 - protein, 9 aa, Artificial Sequence
  Description of Artificial Sequence: Synthetic peptide
  Seed: YLLLASSIL (KKLC1_HUMAN)
YVLLASSIM

SEQ ID NO: 40261 - protein, 10 aa, Artificial Sequence
  Description of Artificial Sequence: Synthetic peptide
  Seed: YLLLASSILC (KKLC1_HUMAN)
YPLLASSILI

SEQ ID NO: 40262 - protein, 9 aa, Artificial Sequence
  Description of Artificial Sequence: Synthetic peptide
  Seed: CALIVFWKY (KKLC1_HUMAN)
CLLIVFWKY

SEQ ID NO: 40263 - protein, 10 aa, Artificial Sequence
  Description of Artificial Sequence: Synthetic peptide
  Seed: SSILCALIVF (KKLC1_HUMAN)
SKILCALIVY

SEQ ID NO: 40264 - protein, 9 aa, Artificial Sequence
  Description of Artificial Sequence: Synthetic peptide
  Seed: ILNNFPHSI (KKLC1_HUMAN)
IWNNFPHSY

SEQ ID NO: 40265 - protein, 8 aa, Artificial Sequence
  Description of Artificial Sequence: Synthetic peptide
  Seed: VYDLSRDI (KKLC1_HUMAN)
VWDLSRDF

SEQ ID NO: 40266 - protein, 11 aa, Artificial Sequence
  Description of Artificial Sequence: Synthetic peptide
  Seed: IVFWKYRRFQR (KKLC1_HUMAN)
IFFWKYRRFQK

SEQ ID NO: 40267 - protein, 9 aa, Artificial Sequence
  Description of Artificial Sequence: Synthetic peptide
  Seed: RQKRILVNL (KKLC1_HUMAN)
RQKRILVNK

SEQ ID NO: 40268 - protein, 9 aa, Artificial Sequence
  Description of Artificial Sequence: Synthetic peptide
  Seed: SSNSTALAL (KKLC1_HUMAN)
SSNSTALAY

SEQ ID NO: 40269 - protein, 10 aa, Artificial Sequence
  Description of Artificial Sequence: Synthetic peptide
  Seed: QKRILVNLSM (KKLC1_HUMAN)
QFRILVNLSM

SEQ ID NO: 40270 - protein, 10 aa, Artificial Sequence
  Description of Artificial Sequence: Synthetic peptide
  Seed: SIARQKRILV (KKLC1_HUMAN)
SYARQKRILK

SEQ ID NO: 40271 - protein, 9 aa, Artificial Sequence
  Description of Artificial Sequence: Synthetic peptide
  Seed: LASSILCAL (KKLC1_HUMAN)
LKSSILCAY

SEQ ID NO: 40272 - protein, 9 aa, Artificial Sequence
  Description of Artificial Sequence: Synthetic peptide
  Seed: NNFPHSIAR (KKLC1_HUMAN)
NFFPHSIAR

SEQ ID NO: 40273 - protein, 9 aa, Artificial Sequence
  Description of Artificial Sequence: Synthetic peptide
  Seed: SSNSTALAL (KKLC1_HUMAN)
SENSTALAF

SEQ ID NO: 40274 - protein, 9 aa, Artificial Sequence
  Description of Artificial Sequence: Synthetic peptide
  Seed: GASPHRKST (KKLC1_HUMAN)
GVSPHRKSY

SEQ ID NO: 40275 - protein, 10 aa, Artificial Sequence
  Description of Artificial Sequence: Synthetic peptide
  Seed: GEMSSNSTAL (KKLC1_HUMAN)
GVMSSNSTAF

SEQ ID NO: 40276 - protein, 9 aa, Artificial Sequence
  Description of Artificial Sequence: Synthetic peptide
  Seed: SNSTALALV (KKLC1_HUMAN)
SLSTALALL

SEQ ID NO: 40277 - protein, 9 aa, Artificial Sequence
  Description of Artificial Sequence: Synthetic peptide
  Seed: ILNNFPHSI (KKLC1_HUMAN)
IFNNFPHSI

SEQ ID NO: 40278 - protein, 10 aa, Artificial Sequence
  Description of Artificial Sequence: Synthetic peptide
  Seed: RQKRILVNLS (KKLC1_HUMAN)
RTKRILVNLS

SEQ ID NO: 40279 - protein, 9 aa, Artificial Sequence
  Description of Artificial Sequence: Synthetic peptide
  Seed: ASSILCALI (KKLC1_HUMAN)
AMSILCALA

SEQ ID NO: 40280 - protein, 10 aa, Artificial Sequence
  Description of Artificial Sequence: Synthetic peptide
  Seed: EHTLLSKGFR (KKLC1_HUMAN)
EKTLLSKGFR

SEQ ID NO: 40281 - protein, 9 aa, Artificial Sequence
  Description of Artificial Sequence: Synthetic peptide
  Seed: LASSILCAL (KKLC1_HUMAN)
LPSSILCAY

SEQ ID NO: 40282 - protein, 9 aa, Artificial Sequence
  Description of Artificial Sequence: Synthetic peptide
  Seed: ASSILCALI (KKLC1_HUMAN)
AISILCALL

SEQ ID NO: 40283 - protein, 10 aa, Artificial Sequence
  Description of Artificial Sequence: Synthetic peptide
  Seed: FYLLLASSIL (KKLC1_HUMAN)
FSLLLASSIV

SEQ ID NO: 40284 - protein, 9 aa, Artificial Sequence
  Description of Artificial Sequence: Synthetic peptide
  Seed: KYRRFQRNT (KKLC1_HUMAN)
KSRRFQRNM

SEQ ID NO: 40285 - protein, 10 aa, Artificial Sequence
  Description of Artificial Sequence: Synthetic peptide
  Seed: QKRILVNLSM (KKLC1_HUMAN)
QMRILVNLSY

SEQ ID NO: 40286 - protein, 10 aa, Artificial Sequence
  Description of Artificial Sequence: Synthetic peptide
  Seed: GEMSSNSTAL (KKLC1_HUMAN)
GSMSSNSTAV

SEQ ID NO: 40287 - protein, 11 aa, Artificial Sequence
  Description of Artificial Sequence: Synthetic peptide
  Seed: RRFQRNTGEMS (KKLC1_HUMAN)
RRFQRNTGEML

SEQ ID NO: 40288 - protein, 11 aa, Artificial Sequence
  Description of Artificial Sequence: Synthetic peptide
  Seed: RQKRILVNLSM (KKLC1_HUMAN)
RWKRILVNLSM

SEQ ID NO: 40289 - protein, 11 aa, Artificial Sequence
  Description of Artificial Sequence: Synthetic peptide
  Seed: VFWKYRRFQRN (KKLC1_HUMAN)
VYWKYRRFQRR

SEQ ID NO: 40290 - protein, 11 aa, Artificial Sequence
  Description of Artificial Sequence: Synthetic peptide
  Seed: GEMSSNSTALA (KKLC1_HUMAN)
GEMSSNSTALI

SEQ ID NO: 40291 - protein, 9 aa, Artificial Sequence
  Description of Artificial Sequence: Synthetic peptide
  Seed: SNTDNNLAV (KKLC1_HUMAN)
STTDNNLAY

SEQ ID NO: 40292 - protein, 9 aa, Artificial Sequence
  Description of Artificial Sequence: Synthetic peptide
  Seed: SNSTALALV (KKLC1_HUMAN)
STSTALALL

SEQ ID NO: 40293 - protein, 9 aa, Artificial Sequence
  Description of Artificial Sequence: Synthetic peptide
  Seed: LLASSILCA (KKLC1_HUMAN)
LVASSILCL

SEQ ID NO: 40294 - protein, 9 aa, Artificial Sequence
  Description of Artificial Sequence: Synthetic peptide
  Seed: LVRPSSSGL (KKLC1_HUMAN)
LPRPSSSGA

SEQ ID NO: 40295 - protein, 9 aa, Artificial Sequence
  Description of Artificial Sequence: Synthetic peptide
  Seed: MSSNSTALA (KKLC1_HUMAN)
MTSNSTALA

SEQ ID NO: 40296 - protein, 9 aa, Artificial Sequence
  Description of Artificial Sequence: Synthetic peptide
  Seed: NTDNNLAVY (KKLC1_HUMAN)
NSDNNLAVL

SEQ ID NO: 40297 - protein, 9 aa, Artificial Sequence
  Description of Artificial Sequence: Synthetic peptide
  Seed: VYDLSRDIL (KKLC1_HUMAN)
VMDLSRDIL

SEQ ID NO: 40298 - protein, 9 aa, Artificial Sequence
  Description of Artificial Sequence: Synthetic peptide
  Seed: SSNSTALAL (KKLC1_HUMAN)
SMNSTALAL

SEQ ID NO: 40299 - protein, 11 aa, Artificial Sequence
  Description of Artificial Sequence: Synthetic peptide
  Seed: RRFQRNTGEMS (KKLC1_HUMAN)
RRFQRNTGEMF

SEQ ID NO: 40300 - protein, 9 aa, Artificial Sequence
  Description of Artificial Sequence: Synthetic peptide
  Seed: LSRDILNNF (KKLC1_HUMAN)
LTRDILNNL

SEQ ID NO: 40301 - protein, 9 aa, Artificial Sequence
  Description of Artificial Sequence: Synthetic peptide
  Seed: MVENKLVEL (KKLC1_HUMAN)
MSENKLVEY

SEQ ID NO: 40302 - protein, 9 aa, Artificial Sequence
  Description of Artificial Sequence: Synthetic peptide
  Seed: LSKGFRGAS (KKLC1_HUMAN)
LSKGFRGAK

SEQ ID NO: 40303 - protein, 11 aa, Artificial Sequence
  Description of Artificial Sequence: Synthetic peptide
  Seed: RQKRILVNLSM (KKLC1_HUMAN)
RRKRILVNLSL

SEQ ID NO: 40304 - protein, 10 aa, Artificial Sequence
  Description of Artificial Sequence: Synthetic peptide
  Seed: SMVENKLVEL (KKLC1_HUMAN)
SIVENKLVEL

SEQ ID NO: 40305 - protein, 10 aa, Artificial Sequence
  Description of Artificial Sequence: Synthetic peptide
  Seed: MSSNSTALAL (KKLC1_HUMAN)
MDSNSTALAM

SEQ ID NO: 40306 - protein, 10 aa, Artificial Sequence
  Description of Artificial Sequence: Synthetic peptide
  Seed: LASSILCALI (KKLC1_HUMAN)
LLSSILCALC

SEQ ID NO: 40307 - protein, 10 aa, Artificial Sequence
  Description of Artificial Sequence: Synthetic peptide
  Seed: LVRPSSSGLI (KKLC1_HUMAN)
LYRPSSSGLK

SEQ ID NO: 40308 - protein, 9 aa, Artificial Sequence
  Description of Artificial Sequence: Synthetic peptide
  Seed: YLLLASSIL (KKLC1_HUMAN)
YALLASSII

SEQ ID NO: 40309 - protein, 10 aa, Artificial Sequence
  Description of Artificial Sequence: Synthetic peptide
  Seed: YLLLASSILC (KKLC1_HUMAN)
YLLLASSILL

SEQ ID NO: 40310 - protein, 9 aa, Artificial Sequence
  Description of Artificial Sequence: Synthetic peptide
  Seed: NTDNNLAVY (KKLC1_HUMAN)
NYDNNLAVL

SEQ ID NO: 40311 - protein, 9 aa, Artificial Sequence
  Description of Artificial Sequence: Synthetic peptide
  Seed: FWKYRRFQR (KKLC1_HUMAN)
FYKYRRFQK

SEQ ID NO: 40312 - protein, 10 aa, Artificial Sequence
  Description of Artificial Sequence: Synthetic peptide
  Seed: ALVRPSSSGL (KKLC1_HUMAN)
AKVRPSSSGK

SEQ ID NO: 40313 - protein, 11 aa, Artificial Sequence
  Description of Artificial Sequence: Synthetic peptide
  Seed: RQKRILVNLSM (KKLC1_HUMAN)
RQKRILVNLSI

SEQ ID NO: 40314 - protein, 10 aa, Artificial Sequence
  Description of Artificial Sequence: Synthetic peptide
  Seed: SKGFRGASPH (KKLC1_HUMAN)
SQGFRGASPL

SEQ ID NO: 40315 - protein, 9 aa, Artificial Sequence
  Description of Artificial Sequence: Synthetic peptide
  Seed: LVELEHTLL (KKLC1_HUMAN)
LFELEHTLM

SEQ ID NO: 40316 - protein, 9 aa, Artificial Sequence
  Description of Artificial Sequence: Synthetic peptide
  Seed: GFRGASPHR (KKLC1_HUMAN)
GVRGASPHA

SEQ ID NO: 40317 - protein, 9 aa, Artificial Sequence
  Description of Artificial Sequence: Synthetic peptide
  Seed: KRILVNLSM (KKLC1_HUMAN)
KTILVNLSY

SEQ ID NO: 40318 - protein, 10 aa, Artificial Sequence
  Description of Artificial Sequence: Synthetic peptide
  Seed: MSSNSTALAL (KKLC1_HUMAN)
MLSNSTALAM

SEQ ID NO: 40319 - protein, 10 aa, Artificial Sequence
  Description of Artificial Sequence: Synthetic peptide
  Seed: QKRILVNLSM (KKLC1_HUMAN)
QERILVNLSV

SEQ ID NO: 40320 - protein, 9 aa, Artificial Sequence
  Description of Artificial Sequence: Synthetic peptide
  Seed: IARQKRILV (KKLC1_HUMAN)
IMRQKRILV

SEQ ID NO: 40321 - protein, 9 aa, Artificial Sequence
  Description of Artificial Sequence: Synthetic peptide
  Seed: LVELEHTLL (KKLC1_HUMAN)
LFELEHTLF

SEQ ID NO: 40322 - protein, 11 aa, Artificial Sequence
  Description of Artificial Sequence: Synthetic peptide
  Seed: YLLLASSILCA (KKLC1_HUMAN)
YCLLASSILCV

SEQ ID NO: 40323 - protein, 10 aa, Artificial Sequence
  Description of Artificial Sequence: Synthetic peptide
  Seed: KLVELEHTLL (KKLC1_HUMAN)
KMVELEHTLR

SEQ ID NO: 40324 - protein, 10 aa, Artificial Sequence
  Description of Artificial Sequence: Synthetic peptide
  Seed: VELEHTLLSK (KKLC1_HUMAN)
VSLEHTLLSK

SEQ ID NO: 40325 - protein, 9 aa, Artificial Sequence
  Description of Artificial Sequence: Synthetic peptide
  Seed: FYLLLASSI (KKLC1_HUMAN)
FYLLLASSV

SEQ ID NO: 40326 - protein, 10 aa, Artificial Sequence
  Description of Artificial Sequence: Synthetic peptide
  Seed: SMVENKLVEL (KKLC1_HUMAN)
SMVENKLVEY

SEQ ID NO: 40327 - protein, 9 aa, Artificial Sequence
  Description of Artificial Sequence: Synthetic peptide
  Seed: GFRGASPHR (KKLC1_HUMAN)
GTRGASPHM

SEQ ID NO: 40328 - protein, 11 aa, Artificial Sequence
  Description of Artificial Sequence: Synthetic peptide
  Seed: MNFYLLLASSI (KKLC1_HUMAN)
MLFYLLLASSF

SEQ ID NO: 40329 - protein, 9 aa, Artificial Sequence
  Description of Artificial Sequence: Synthetic peptide
  Seed: KGFRGASPH (KKLC1_HUMAN)
KQFRGASPW

SEQ ID NO: 40330 - protein, 9 aa, Artificial Sequence
  Description of Artificial Sequence: Synthetic peptide
  Seed: IARQKRILV (KKLC1_HUMAN)
IVRQKRILL

SEQ ID NO: 40331 - protein, 10 aa, Artificial Sequence
  Description of Artificial Sequence: Synthetic peptide
  Seed: MSSNSTALAL (KKLC1_HUMAN)
MVSNSTALAF

SEQ ID NO: 40332 - protein, 9 aa, Artificial Sequence
  Description of Artificial Sequence: Synthetic peptide
  Seed: NLAVYDLSR (KKLC1_HUMAN)
NYAVYDLSR

SEQ ID NO: 40333 - protein, 9 aa, Artificial Sequence
  Description of Artificial Sequence: Synthetic peptide
  Seed: LASSILCAL (KKLC1_HUMAN)
LMSSILCAL

SEQ ID NO: 40334 - protein, 9 aa, Artificial Sequence
  Description of Artificial Sequence: Synthetic peptide
  Seed: AVYDLSRDI (KKLC1_HUMAN)
AAYDLSRDL

SEQ ID NO: 40335 - protein, 10 aa, Artificial Sequence
  Description of Artificial Sequence: Synthetic peptide
  Seed: LASSILCALI (KKLC1_HUMAN)
LMSSILCALV

SEQ ID NO: 40336 - protein, 9 aa, Artificial Sequence
  Description of Artificial Sequence: Synthetic peptide
  Seed: KLVELEHTL (KKLC1_HUMAN)
KSVELEHTF

SEQ ID NO: 40337 - protein, 9 aa, Artificial Sequence
  Description of Artificial Sequence: Synthetic peptide
  Seed: ALIVFWKYR (KKLC1_HUMAN)
AVIVFWKYK

SEQ ID NO: 40338 - protein, 10 aa, Artificial Sequence
  Description of Artificial Sequence: Synthetic peptide
  Seed: MSSNSTALAL (KKLC1_HUMAN)
MWSNSTALAM

SEQ ID NO: 40339 - protein, 10 aa, Artificial Sequence
  Description of Artificial Sequence: Synthetic peptide
  Seed: TGEMSSNSTA (KKLC1_HUMAN)
TCEMSSNSTA

SEQ ID NO: 40340 - protein, 9 aa, Artificial Sequence
  Description of Artificial Sequence: Synthetic peptide
  Seed: KRILVNLSM (KKLC1_HUMAN)
KIILVNLSF

SEQ ID NO: 40341 - protein, 10 aa, Artificial Sequence
  Description of Artificial Sequence: Synthetic peptide
  Seed: VFWKYRRFQR (KKLC1_HUMAN)
VVWKYRRFQR

SEQ ID NO: 40342 - protein, 10 aa, Artificial Sequence
  Description of Artificial Sequence: Synthetic peptide
  Seed: FYLLLASSIL (KKLC1_HUMAN)
FLLLLASSII

SEQ ID NO: 40343 - protein, 9 aa, Artificial Sequence
  Description of Artificial Sequence: Synthetic peptide
  Seed: IVFWKYRRF (KKLC1_HUMAN)
IQFWKYRRM

SEQ ID NO: 40344 - protein, 9 aa, Artificial Sequence
  Description of Artificial Sequence: Synthetic peptide
  Seed: MSSNSTALA (KKLC1_HUMAN)
MMSNSTALI

SEQ ID NO: 40345 - protein, 9 aa, Artificial Sequence
  Description of Artificial Sequence: Synthetic peptide
  Seed: MSSNSTALA (KKLC1_HUMAN)
MTSNSTALK

SEQ ID NO: 40346 - protein, 9 aa, Artificial Sequence
  Description of Artificial Sequence: Synthetic peptide
  Seed: CALIVFWKY (KKLC1_HUMAN)
CVLIVFWKY

SEQ ID NO: 40347 - protein, 9 aa, Artificial Sequence
  Description of Artificial Sequence: Synthetic peptide
  Seed: LLASSILCA (KKLC1_HUMAN)
LIASSILCI

SEQ ID NO: 40348 - protein, 9 aa, Artificial Sequence
  Description of Artificial Sequence: Synthetic peptide
  Seed: YLLLASSIL (KKLC1_HUMAN)
YSLLASSII

SEQ ID NO: 40349 - protein, 9 aa, Artificial Sequence
  Description of Artificial Sequence: Synthetic peptide
  Seed: SSNSTALAL (KKLC1_HUMAN)
SQNSTALAA

SEQ ID NO: 40350 - protein, 9 aa, Artificial Sequence
  Description of Artificial Sequence: Synthetic peptide
  Seed: SNSTALALV (KKLC1_HUMAN)
SQSTALALV

SEQ ID NO: 40351 - protein, 9 aa, Artificial Sequence
  Description of Artificial Sequence: Synthetic peptide
  Seed: SSNSTALAL (KKLC1_HUMAN)
SQNSTALAV

SEQ ID NO: 40352 - protein, 9 aa, Artificial Sequence
  Description of Artificial Sequence: Synthetic peptide
  Seed: LASSILCAL (KKLC1_HUMAN)
LRSSILCAY

SEQ ID NO: 40353 - protein, 10 aa, Artificial Sequence
  Description of Artificial Sequence: Synthetic peptide
  Seed: MSSNSTALAL (KKLC1_HUMAN)
MMSNSTALAI

SEQ ID NO: 40354 - protein, 9 aa, Artificial Sequence
  Description of Artificial Sequence: Synthetic peptide
  Seed: GEMSSNSTA (KKLC1_HUMAN)
GEMSSNSTP

SEQ ID NO: 40355 - protein, 10 aa, Artificial Sequence
  Description of Artificial Sequence: Synthetic peptide
  Seed: SKGFRGASPH (KKLC1_HUMAN)
STGFRGASPF

SEQ ID NO: 40356 - protein, 10 aa, Artificial Sequence
  Description of Artificial Sequence: Synthetic peptide
  Seed: SMVENKLVEL (KKLC1_HUMAN)
SQVENKLVEV

SEQ ID NO: 40357 - protein, 10 aa, Artificial Sequence
  Description of Artificial Sequence: Synthetic peptide
  Seed: SKGFRGASPH (KKLC1_HUMAN)
SQGFRGASPF

SEQ ID NO: 40358 - protein, 9 aa, Artificial Sequence
  Description of Artificial Sequence: Synthetic peptide
  Seed: RILVNLSMV (KKLC1_HUMAN)
RVLVNLSMK

SEQ ID NO: 40359 - protein, 9 aa, Artificial Sequence
  Description of Artificial Sequence: Synthetic peptide
  Seed: LASSILCAL (KKLC1_HUMAN)
LLSSILCAL

SEQ ID NO: 40360 - protein, 9 aa, Artificial Sequence
  Description of Artificial Sequence: Synthetic peptide
  Seed: YLLLASSIL (KKLC1_HUMAN)
YTLLASSIF

SEQ ID NO: 40361 - protein, 9 aa, Artificial Sequence
  Description of Artificial Sequence: Synthetic peptide
  Seed: LSRDILNNF (KKLC1_HUMAN)
LKRDILNNF

SEQ ID NO: 40362 - protein, 10 aa, Artificial Sequence
  Description of Artificial Sequence: Synthetic peptide
  Seed: MSSNSTALAL (KKLC1_HUMAN)
MTSNSTALAF

SEQ ID NO: 40363 - protein, 9 aa, Artificial Sequence
  Description of Artificial Sequence: Synthetic peptide
  Seed: VENKLVELE (KKLC1_HUMAN)
VENKLVELI

SEQ ID NO: 40364 - protein, 8 aa, Artificial Sequence
  Description of Artificial Sequence: Synthetic peptide
  Seed: YLLLASSI (KKLC1_HUMAN)
YQLLASSI

SEQ ID NO: 40365 - protein, 10 aa, Artificial Sequence
  Description of Artificial Sequence: Synthetic peptide
  Seed: VELEHTLLSK (KKLC1_HUMAN)
VLLEHTLLSR

SEQ ID NO: 40366 - protein, 9 aa, Artificial Sequence
  Description of Artificial Sequence: Synthetic peptide
  Seed: RQKRILVNL (KKLC1_HUMAN)
RAKRILVNS

SEQ ID NO: 40367 - protein, 10 aa, Artificial Sequence
  Description of Artificial Sequence: Synthetic peptide
  Seed: GEMSSNSTAL (KKLC1_HUMAN)
GWMSSNSTAF

SEQ ID NO: 40368 - protein, 9 aa, Artificial Sequence
  Description of Artificial Sequence: Synthetic peptide
  Seed: KLVELEHTL (KKLC1_HUMAN)
KDVELEHTI

SEQ ID NO: 40369 - protein, 9 aa, Artificial Sequence
  Description of Artificial Sequence: Synthetic peptide
  Seed: FYLLLASSI (KKLC1_HUMAN)
FWLLLASSL

SEQ ID NO: 40370 - protein, 10 aa, Artificial Sequence
  Description of Artificial Sequence: Synthetic peptide
  Seed: QKRILVNLSM (KKLC1_HUMAN)
QDRILVNLSF

SEQ ID NO: 40371 - protein, 11 aa, Artificial Sequence
  Description of Artificial Sequence: Synthetic peptide
  Seed: RQKRILVNLSM (KKLC1_HUMAN)
RAKRILVNLSM

SEQ ID NO: 40372 - protein, 10 aa, Artificial Sequence
  Description of Artificial Sequence: Synthetic peptide
  Seed: LASSILCALI (KKLC1_HUMAN)
LASSILCALW

SEQ ID NO: 40373 - protein, 9 aa, Artificial Sequence
  Description of Artificial Sequence: Synthetic peptide
  Seed: NTDNNLAVY (KKLC1_HUMAN)
NPDNNLAVF

SEQ ID NO: 40374 - protein, 9 aa, Artificial Sequence
  Description of Artificial Sequence: Synthetic peptide
  Seed: RQKRILVNL (KKLC1_HUMAN)
RTKRILVNH

SEQ ID NO: 40375 - protein, 10 aa, Artificial Sequence
  Description of Artificial Sequence: Synthetic peptide
  Seed: RQKRILVNLS (KKLC1_HUMAN)
RVKRILVNLV

SEQ ID NO: 40376 - protein, 9 aa, Artificial Sequence
  Description of Artificial Sequence: Synthetic peptide
  Seed: YLLLASSIL (KKLC1_HUMAN)
YTLLASSIM

SEQ ID NO: 40377 - protein, 10 aa, Artificial Sequence
  Description of Artificial Sequence: Synthetic peptide
  Seed: AVYDLSRDIL (KKLC1_HUMAN)
AMYDLSRDIW

SEQ ID NO: 40378 - protein, 10 aa, Artificial Sequence
  Description of Artificial Sequence: Synthetic peptide
  Seed: FYLLLASSIL (KKLC1_HUMAN)
FDLLLASSIV

SEQ ID NO: 40379 - protein, 10 aa, Artificial Sequence
  Description of Artificial Sequence: Synthetic peptide
  Seed: ALVRPSSSGL (KKLC1_HUMAN)
AMVRPSSSGV

SEQ ID NO: 40380 - protein, 10 aa, Artificial Sequence
  Description of Artificial Sequence: Synthetic peptide
  Seed: MSSNSTALAL (KKLC1_HUMAN)
MNSNSTALAY

SEQ ID NO: 40381 - protein, 10 aa, Artificial Sequence
  Description of Artificial Sequence: Synthetic peptide
  Seed: KYRRFQRNTG (KKLC1_HUMAN)
KSRRFQRNTA

SEQ ID NO: 40382 - protein, 9 aa, Artificial Sequence
  Description of Artificial Sequence: Synthetic peptide
  Seed: RQKRILVNL (KKLC1_HUMAN)
RVKRILVNI

SEQ ID NO: 40383 - protein, 11 aa, Artificial Sequence
  Description of Artificial Sequence: Synthetic peptide
  Seed: ILNNFPHSIAR (KKLC1_HUMAN)
IVNNFPHSIAR

SEQ ID NO: 40384 - protein, 10 aa, Artificial Sequence
  Description of Artificial Sequence: Synthetic peptide
  Seed: YLLLASSILC (KKLC1_HUMAN)
YALLASSILA

SEQ ID NO: 40385 - protein, 9 aa, Artificial Sequence
  Description of Artificial Sequence: Synthetic peptide
  Seed: ILNNFPHSI (KKLC1_HUMAN)
IINNFPHSK

SEQ ID NO: 40386 - protein, 9 aa, Artificial Sequence
  Description of Artificial Sequence: Synthetic peptide
  Seed: ALIVFWKYR (KKLC1_HUMAN)
AQIVFWKYR

SEQ ID NO: 40387 - protein, 10 aa, Artificial Sequence
  Description of Artificial Sequence: Synthetic peptide
  Seed: ALVRPSSSGL (KKLC1_HUMAN)
ACVRPSSSGK

SEQ ID NO: 40388 - protein, 11 aa, Artificial Sequence
  Description of Artificial Sequence: Synthetic peptide
  Seed: MNFYLLLASSI (KKLC1_HUMAN)
MSFYLLLASSF

SEQ ID NO: 40389 - protein, 9 aa, Artificial Sequence
  Description of Artificial Sequence: Synthetic peptide
  Seed: NNFPHSIAR (KKLC1_HUMAN)
NIFPHSIAI

SEQ ID NO: 40390 - protein, 9 aa, Artificial Sequence
  Description of Artificial Sequence: Synthetic peptide
  Seed: YLLLASSIL (KKLC1_HUMAN)
YALLASSIL

SEQ ID NO: 40391 - protein, 9 aa, Artificial Sequence
  Description of Artificial Sequence: Synthetic peptide
  Seed: SSNSTALAL (KKLC1_HUMAN)
SKNSTALAF

SEQ ID NO: 40392 - protein, 11 aa, Artificial Sequence
  Description of Artificial Sequence: Synthetic peptide
  Seed: IVFWKYRRFQR (KKLC1_HUMAN)
IDFWKYRRFQR

SEQ ID NO: 40393 - protein, 10 aa, Artificial Sequence
  Description of Artificial Sequence: Synthetic peptide
  Seed: MSSNSTALAL (KKLC1_HUMAN)
MHSNSTALAY

SEQ ID NO: 40394 - protein, 9 aa, Artificial Sequence
  Description of Artificial Sequence: Synthetic peptide
  Seed: KGFRGASPH (KKLC1_HUMAN)
KLFRGASPH

SEQ ID NO: 40395 - protein, 10 aa, Artificial Sequence
  Description of Artificial Sequence: Synthetic peptide
  Seed: ALVRPSSSGL (KKLC1_HUMAN)
APVRPSSSGL

SEQ ID NO: 40396 - protein, 10 aa, Artificial Sequence
  Description of Artificial Sequence: Synthetic peptide
  Seed: MSSNSTALAL (KKLC1_HUMAN)
MFSNSTALAF

SEQ ID NO: 40397 - protein, 9 aa, Artificial Sequence
  Description of Artificial Sequence: Synthetic peptide
  Seed: AVYDLSRDI (KKLC1_HUMAN)
ARYDLSRDV

SEQ ID NO: 40398 - protein, 9 aa, Artificial Sequence
  Description of Artificial Sequence: Synthetic peptide
  Seed: ILNNFPHSI (KKLC1_HUMAN)
ILNNFPHSF

SEQ ID NO: 40399 - protein, 10 aa, Artificial Sequence
  Description of Artificial Sequence: Synthetic peptide
  Seed: RRFQRNTGEM (KKLC1_HUMAN)
RQFQRNTGEM

SEQ ID NO: 40400 - protein, 10 aa, Artificial Sequence
  Description of Artificial Sequence: Synthetic peptide
  Seed: VFWKYRRFQR (KKLC1_HUMAN)
VIWKYRRFQK

SEQ ID NO: 40401 - protein, 11 aa, Artificial Sequence
  Description of Artificial Sequence: Synthetic peptide
  Seed: RQKRILVNLSM (KKLC1_HUMAN)
RAKRILVNLSL

SEQ ID NO: 40402 - protein, 10 aa, Artificial Sequence
  Description of Artificial Sequence: Synthetic peptide
  Seed: GEMSSNSTAL (KKLC1_HUMAN)
GQMSSNSTAY

SEQ ID NO: 40403 - protein, 9 aa, Artificial Sequence
  Description of Artificial Sequence: Synthetic peptide
  Seed: GFRGASPHR (KKLC1_HUMAN)
GTRGASPHL

SEQ ID NO: 40404 - protein, 9 aa, Artificial Sequence
  Description of Artificial Sequence: Synthetic peptide
  Seed: EMSSNSTAL (KKLC1_HUMAN)
EHSSNSTAL

SEQ ID NO: 40405 - protein, 8 aa, Artificial Sequence
  Description of Artificial Sequence: Synthetic peptide
  Seed: LSMVENKL (KKLC1_HUMAN)
LQMVENKI

SEQ ID NO: 40406 - protein, 8 aa, Artificial Sequence
  Description of Artificial Sequence: Synthetic peptide
  Seed: VENKLVEL (KKLC1_HUMAN)
VENKLVEA

SEQ ID NO: 40407 - protein, 9 aa, Artificial Sequence
  Description of Artificial Sequence: Synthetic peptide
  Seed: ILNNFPHSI (KKLC1_HUMAN)
IKNNFPHSF

SEQ ID NO: 40408 - protein, 10 aa, Artificial Sequence
  Description of Artificial Sequence: Synthetic peptide
  Seed: YLLLASSILC (KKLC1_HUMAN)
YELLASSILI

SEQ ID NO: 40409 - protein, 10 aa, Artificial Sequence
  Description of Artificial Sequence: Synthetic peptide
  Seed: MSSNSTALAL (KKLC1_HUMAN)
MWSNSTALAF

SEQ ID NO: 40410 - protein, 9 aa, Artificial Sequence
  Description of Artificial Sequence: Synthetic peptide
  Seed: ASSILCALI (KKLC1_HUMAN)
ALSILCALI

SEQ ID NO: 40411 - protein, 9 aa, Artificial Sequence
  Description of Artificial Sequence: Synthetic peptide
  Seed: SSNSTALAL (KKLC1_HUMAN)
SKNSTALAL

SEQ ID NO: 40412 - protein, 9 aa, Artificial Sequence
  Description of Artificial Sequence: Synthetic peptide
  Seed: KGFRGASPH (KKLC1_HUMAN)
KKFRGASPI

SEQ ID NO: 40413 - protein, 9 aa, Artificial Sequence
  Description of Artificial Sequence: Synthetic peptide
  Seed: SNSTALALV (KKLC1_HUMAN)
SLSTALALV

SEQ ID NO: 40414 - protein, 9 aa, Artificial Sequence
  Description of Artificial Sequence: Synthetic peptide
  Seed: NTDNNLAVY (KKLC1_HUMAN)
NPDNNLAVY

SEQ ID NO: 40415 - protein, 9 aa, Artificial Sequence
  Description of Artificial Sequence: Synthetic peptide
  Seed: VYDLSRDIL (KKLC1_HUMAN)
VLDLSRDIF

SEQ ID NO: 40416 - protein, 9 aa, Artificial Sequence
  Description of Artificial Sequence: Synthetic peptide
  Seed: ILNNFPHSI (KKLC1_HUMAN)
INNNFPHSL

SEQ ID NO: 40417 - protein, 9 aa, Artificial Sequence
  Description of Artificial Sequence: Synthetic peptide
  Seed: KLVELEHTL (KKLC1_HUMAN)
KVVELEHTL

SEQ ID NO: 40418 - protein, 9 aa, Artificial Sequence
  Description of Artificial Sequence: Synthetic peptide
  Seed: NTDNNLAVY (KKLC1_HUMAN)
NVDNNLAVI

SEQ ID NO: 40419 - protein, 10 aa, Artificial Sequence
  Description of Artificial Sequence: Synthetic peptide
  Seed: LLLASSILCA (KKLC1_HUMAN)
LRLASSILCV

SEQ ID NO: 40420 - protein, 10 aa, Artificial Sequence
  Description of Artificial Sequence: Synthetic peptide
  Seed: DILNNFPHSI (KKLC1_HUMAN)
DFLNNFPHSL

SEQ ID NO: 40421 - protein, 10 aa, Artificial Sequence
  Description of Artificial Sequence: Synthetic peptide
  Seed: LASSILCALI (KKLC1_HUMAN)
LHSSILCALW

SEQ ID NO: 40422 - protein, 9 aa, Artificial Sequence
  Description of Artificial Sequence: Synthetic peptide
  Seed: RQKRILVNL (KKLC1_HUMAN)
REKRILVNF

SEQ ID NO: 40423 - protein, 9 aa, Artificial Sequence
  Description of Artificial Sequence: Synthetic peptide
  Seed: ELEHTLLSK (KKLC1_HUMAN)
ESEHTLLSR

SEQ ID NO: 40424 - protein, 11 aa, Artificial Sequence
  Description of Artificial Sequence: Synthetic peptide
  Seed: NSNTDNNLAVY (KKLC1_HUMAN)
NSNTDNNLAVW

SEQ ID NO: 40425 - protein, 10 aa, Artificial Sequence
  Description of Artificial Sequence: Synthetic peptide
  Seed: ALVRPSSSGL (KKLC1_HUMAN)
AQVRPSSSGK

SEQ ID NO: 40426 - protein, 11 aa, Artificial Sequence
  Description of Artificial Sequence: Synthetic peptide
  Seed: MSSNSTALALV (KKLC1_HUMAN)
MASNSTALALF

SEQ ID NO: 40427 - protein, 8 aa, Artificial Sequence
  Description of Artificial Sequence: Synthetic peptide
  Seed: VENKLVEL (KKLC1_HUMAN)
VQNKLVEL

SEQ ID NO: 40428 - protein, 9 aa, Artificial Sequence
  Description of Artificial Sequence: Synthetic peptide
  Seed: ASSILCALI (KKLC1_HUMAN)
ASSILCALY

SEQ ID NO: 40429 - protein, 9 aa, Artificial Sequence
  Description of Artificial Sequence: Synthetic peptide
  Seed: FPHSIARQK (KKLC1_HUMAN)
FIHSIARQR

SEQ ID NO: 40430 - protein, 9 aa, Artificial Sequence
  Description of Artificial Sequence: Synthetic peptide
  Seed: KGFRGASPH (KKLC1_HUMAN)
KCFRGASPY

SEQ ID NO: 40431 - protein, 9 aa, Artificial Sequence
  Description of Artificial Sequence: Synthetic peptide
  Seed: LASSILCAL (KKLC1_HUMAN)
LSSSILCAM

SEQ ID NO: 40432 - protein, 10 aa, Artificial Sequence
  Description of Artificial Sequence: Synthetic peptide
  Seed: RPSSSGLINS (KKLC1_HUMAN)
RPSSSGLINA

SEQ ID NO: 40433 - protein, 9 aa, Artificial Sequence
  Description of Artificial Sequence: Synthetic peptide
  Seed: LSMVENKLV (KKLC1_HUMAN)
LAMVENKLW

SEQ ID NO: 40434 - protein, 9 aa, Artificial Sequence
  Description of Artificial Sequence: Synthetic peptide
  Seed: ILNNFPHSI (KKLC1_HUMAN)
IKNNFPHSM

SEQ ID NO: 40435 - protein, 9 aa, Artificial Sequence
  Description of Artificial Sequence: Synthetic peptide
  Seed: FYLLLASSI (KKLC1_HUMAN)
FWLLLASSF

SEQ ID NO: 40436 - protein, 9 aa, Artificial Sequence
  Description of Artificial Sequence: Synthetic peptide
  Seed: LASSILCAL (KKLC1_HUMAN)
LMSSILCAF

SEQ ID NO: 40437 - protein, 9 aa, Artificial Sequence
  Description of Artificial Sequence: Synthetic peptide
  Seed: GFRGASPHR (KKLC1_HUMAN)
GSRGASPHK

SEQ ID NO: 40438 - protein, 11 aa, Artificial Sequence
  Description of Artificial Sequence: Synthetic peptide
  Seed: RDILNNFPHSI (KKLC1_HUMAN)
RSILNNFPHSV

SEQ ID NO: 40439 - protein, 9 aa, Artificial Sequence
  Description of Artificial Sequence: Synthetic peptide
  Seed: SSNSTALAL (KKLC1_HUMAN)
SYNSTALAW

SEQ ID NO: 40440 - protein, 9 aa, Artificial Sequence
  Description of Artificial Sequence: Synthetic peptide
  Seed: VYDLSRDIL (KKLC1_HUMAN)
VADLSRDII

SEQ ID NO: 40441 - protein, 10 aa, Artificial Sequence
  Description of Artificial Sequence: Synthetic peptide
  Seed: ALVRPSSSGL (KKLC1_HUMAN)
AWVRPSSSGK

SEQ ID NO: 40442 - protein, 9 aa, Artificial Sequence
  Description of Artificial Sequence: Synthetic peptide
  Seed: NLAVYDLSR (KKLC1_HUMAN)
NWAVYDLSR

SEQ ID NO: 40443 - protein, 10 aa, Artificial Sequence
  Description of Artificial Sequence: Synthetic peptide
  Seed: QKRILVNLSM (KKLC1_HUMAN)
QKRILVNLSY

SEQ ID NO: 40444 - protein, 10 aa, Artificial Sequence
  Description of Artificial Sequence: Synthetic peptide
  Seed: SSILCALIVF (KKLC1_HUMAN)
SMILCALIVM

SEQ ID NO: 40445 - protein, 9 aa, Artificial Sequence
  Description of Artificial Sequence: Synthetic peptide
  Seed: NTDNNLAVY (KKLC1_HUMAN)
NIDNNLAVY

SEQ ID NO: 40446 - protein, 10 aa, Artificial Sequence
  Description of Artificial Sequence: Synthetic peptide
  Seed: AVYDLSRDIL (KKLC1_HUMAN)
AVYDLSRDIY

SEQ ID NO: 40447 - protein, 10 aa, Artificial Sequence
  Description of Artificial Sequence: Synthetic peptide
  Seed: SMVENKLVEL (KKLC1_HUMAN)
SLVENKLVEA

SEQ ID NO: 40448 - protein, 9 aa, Artificial Sequence
  Description of Artificial Sequence: Synthetic peptide
  Seed: ILNNFPHSI (KKLC1_HUMAN)
ISNNFPHSV

SEQ ID NO: 40449 - protein, 8 aa, Artificial Sequence
  Description of Artificial Sequence: Synthetic peptide
  Seed: VYDLSRDI (KKLC1_HUMAN)
VMDLSRDL

SEQ ID NO: 40450 - protein, 10 aa, Artificial Sequence
  Description of Artificial Sequence: Synthetic peptide
  Seed: LLASSILCAL (KKLC1_HUMAN)
LQASSILCAI

SEQ ID NO: 40451 - protein, 11 aa, Artificial Sequence
  Description of Artificial Sequence: Synthetic peptide
  Seed: ILNNFPHSIAR (KKLC1_HUMAN)
IMNNFPHSIAK

SEQ ID NO: 40452 - protein, 9 aa, Artificial Sequence
  Description of Artificial Sequence: Synthetic peptide
  Seed: MSSNSTALA (KKLC1_HUMAN)
MASNSTALV

SEQ ID NO: 40453 - protein, 10 aa, Artificial Sequence
  Description of Artificial Sequence: Synthetic peptide
  Seed: FYLLLASSIL (KKLC1_HUMAN)
FELLLASSIV

SEQ ID NO: 40454 - protein, 10 aa, Artificial Sequence
  Description of Artificial Sequence: Synthetic peptide
  Seed: SMVENKLVEL (KKLC1_HUMAN)
SMVENKLVEF

SEQ ID NO: 40455 - protein, 10 aa, Artificial Sequence
  Description of Artificial Sequence: Synthetic peptide
  Seed: LNNFPHSIAR (KKLC1_HUMAN)
LGNFPHSIAR

SEQ ID NO: 40456 - protein, 10 aa, Artificial Sequence
  Description of Artificial Sequence: Synthetic peptide
  Seed: LLLASSILCA (KKLC1_HUMAN)
LGLASSILCL

SEQ ID NO: 40457 - protein, 9 aa, Artificial Sequence
  Description of Artificial Sequence: Synthetic peptide
  Seed: FYLLLASSI (KKLC1_HUMAN)
FYLLLASSM

SEQ ID NO: 40458 - protein, 9 aa, Artificial Sequence
  Description of Artificial Sequence: Synthetic peptide
  Seed: LASSILCAL (KKLC1_HUMAN)
LQSSILCAY

SEQ ID NO: 40459 - protein, 10 aa, Artificial Sequence
  Description of Artificial Sequence: Synthetic peptide
  Seed: LLLASSILCA (KKLC1_HUMAN)
LTLASSILCL

SEQ ID NO: 40460 - protein, 9 aa, Artificial Sequence
  Description of Artificial Sequence: Synthetic peptide
  Seed: SSNSTALAL (KKLC1_HUMAN)
SINSTALAM

SEQ ID NO: 40461 - protein, 9 aa, Artificial Sequence
  Description of Artificial Sequence: Synthetic peptide
  Seed: LIVFWKYRR (KKLC1_HUMAN)
LVVFWKYRR

SEQ ID NO: 40462 - protein, 11 aa, Artificial Sequence
  Description of Artificial Sequence: Synthetic peptide
  Seed: RQKRILVNLSM (KKLC1_HUMAN)
RNKRILVNLSV

SEQ ID NO: 40463 - protein, 9 aa, Artificial Sequence
  Description of Artificial Sequence: Synthetic peptide
  Seed: KYRRFQRNT (KKLC1_HUMAN)
KSRRFQRNK

SEQ ID NO: 40464 - protein, 9 aa, Artificial Sequence
  Description of Artificial Sequence: Synthetic peptide
  Seed: RQKRILVNL (KKLC1_HUMAN)
RFKRILVNG

SEQ ID NO: 40465 - protein, 9 aa, Artificial Sequence
  Description of Artificial Sequence: Synthetic peptide
  Seed: FYLLLASSI (KKLC1_HUMAN)
FFLLLASSL

SEQ ID NO: 40466 - protein, 9 aa, Artificial Sequence
  Description of Artificial Sequence: Synthetic peptide
  Seed: VYDLSRDIL (KKLC1_HUMAN)
VQDLSRDIL

SEQ ID NO: 40467 - protein, 9 aa, Artificial Sequence
  Description of Artificial Sequence: Synthetic peptide
  Seed: LLASSILCA (KKLC1_HUMAN)
LQASSILCL

SEQ ID NO: 40468 - protein, 9 aa, Artificial Sequence
  Description of Artificial Sequence: Synthetic peptide
  Seed: LSMVENKLV (KKLC1_HUMAN)
LSMVENKLF

SEQ ID NO: 40469 - protein, 9 aa, Artificial Sequence
  Description of Artificial Sequence: Synthetic peptide
  Seed: MVENKLVEL (KKLC1_HUMAN)
MLENKLVEA

SEQ ID NO: 40470 - protein, 9 aa, Artificial Sequence
  Description of Artificial Sequence: Synthetic peptide
  Seed: YLLLASSIL (KKLC1_HUMAN)
YLLLASSII

SEQ ID NO: 40471 - protein, 8 aa, Artificial Sequence
  Description of Artificial Sequence: Synthetic peptide
  Seed: NTDNNLAV (KKLC1_HUMAN)
NSDNNLAL

SEQ ID NO: 40472 - protein, 9 aa, Artificial Sequence
  Description of Artificial Sequence: Synthetic peptide
  Seed: KRILVNLSM (KKLC1_HUMAN)
KRILVNLSR

SEQ ID NO: 40473 - protein, 10 aa, Artificial Sequence
  Description of Artificial Sequence: Synthetic peptide
  Seed: KGFRGASPHR (KKLC1_HUMAN)
KMFRGASPHK

SEQ ID NO: 40474 - protein, 8 aa, Artificial Sequence
  Description of Artificial Sequence: Synthetic peptide
  Seed: NTDNNLAV (KKLC1_HUMAN)
NTDNNLAL

SEQ ID NO: 40475 - protein, 9 aa, Artificial Sequence
  Description of Artificial Sequence: Synthetic peptide
  Seed: LVELEHTLL (KKLC1_HUMAN)
LFELEHTLL

SEQ ID NO: 40476 - protein, 9 aa, Artificial Sequence
  Description of Artificial Sequence: Synthetic peptide
  Seed: VYDLSRDIL (KKLC1_HUMAN)
VVDLSRDII

SEQ ID NO: 40477 - protein, 10 aa, Artificial Sequence
  Description of Artificial Sequence: Synthetic peptide
  Seed: KGFRGASPHR (KKLC1_HUMAN)
KAFRGASPHA

SEQ ID NO: 40478 - protein, 11 aa, Artificial Sequence
  Description of Artificial Sequence: Synthetic peptide
  Seed: RDILNNFPHSI (KKLC1_HUMAN)
RIILNNFPHSV

SEQ ID NO: 40479 - protein, 9 aa, Artificial Sequence
  Description of Artificial Sequence: Synthetic peptide
  Seed: ILNNFPHSI (KKLC1_HUMAN)
IMNNFPHSA

SEQ ID NO: 40480 - protein, 9 aa, Artificial Sequence
  Description of Artificial Sequence: Synthetic peptide
  Seed: KYRRFQRNT (KKLC1_HUMAN)
KIRRFQRNL

SEQ ID NO: 40481 - protein, 10 aa, Artificial Sequence
  Description of Artificial Sequence: Synthetic peptide
  Seed: KGFRGASPHR (KKLC1_HUMAN)
KKFRGASPHK

SEQ ID NO: 40482 - protein, 9 aa, Artificial Sequence
  Description of Artificial Sequence: Synthetic peptide
  Seed: VYDLSRDIL (KKLC1_HUMAN)
VIDLSRDIM

SEQ ID NO: 40483 - protein, 9 aa, Artificial Sequence
  Description of Artificial Sequence: Synthetic peptide
  Seed: MSSNSTALA (KKLC1_HUMAN)
MTSNSTALT

SEQ ID NO: 40484 - protein, 9 aa, Artificial Sequence
  Description of Artificial Sequence: Synthetic peptide
  Seed: AVYDLSRDI (KKLC1_HUMAN)
ASYDLSRDF

SEQ ID NO: 40485 - protein, 9 aa, Artificial Sequence
  Description of Artificial Sequence: Synthetic peptide
  Seed: NTDNNLAVY (KKLC1_HUMAN)
NGDNNLAVM

SEQ ID NO: 40486 - protein, 10 aa, Artificial Sequence
  Description of Artificial Sequence: Synthetic peptide
  Seed: ALIVFWKYRR (KKLC1_HUMAN)
ARIVFWKYRR

SEQ ID NO: 40487 - protein, 9 aa, Artificial Sequence
  Description of Artificial Sequence: Synthetic peptide
  Seed: NNFPHSIAR (KKLC1_HUMAN)
NVFPHSIAL

SEQ ID NO: 40488 - protein, 9 aa, Artificial Sequence
  Description of Artificial Sequence: Synthetic peptide
  Seed: YLLLASSIL (KKLC1_HUMAN)
YMLLASSIH

SEQ ID NO: 40489 - protein, 10 aa, Artificial Sequence
  Description of Artificial Sequence: Synthetic peptide
  Seed: YLLLASSILC (KKLC1_HUMAN)
YMLLASSILM

SEQ ID NO: 40490 - protein, 10 aa, Artificial Sequence
  Description of Artificial Sequence: Synthetic peptide
  Seed: KLVELEHTLL (KKLC1_HUMAN)
KLVELEHTLV

SEQ ID NO: 40491 - protein, 9 aa, Artificial Sequence
  Description of Artificial Sequence: Synthetic peptide
  Seed: RQKRILVNL (KKLC1_HUMAN)
RMKRILVNR

SEQ ID NO: 40492 - protein, 9 aa, Artificial Sequence
  Description of Artificial Sequence: Synthetic peptide
  Seed: KRILVNLSM (KKLC1_HUMAN)
KQILVNLSA

SEQ ID NO: 40493 - protein, 10 aa, Artificial Sequence
  Description of Artificial Sequence: Synthetic peptide
  Seed: ALVRPSSSGL (KKLC1_HUMAN)
ANVRPSSSGK

SEQ ID NO: 40494 - protein, 10 aa, Artificial Sequence
  Description of Artificial Sequence: Synthetic peptide
  Seed: TLLSKGFRGA (KKLC1_HUMAN)
TLLSKGFRGL

SEQ ID NO: 40495 - protein, 11 aa, Artificial Sequence
  Description of Artificial Sequence: Synthetic peptide
  Seed: RQKRILVNLSM (KKLC1_HUMAN)
RWKRILVNLSV

SEQ ID NO: 40496 - protein, 9 aa, Artificial Sequence
  Description of Artificial Sequence: Synthetic peptide
  Seed: SILCALIVF (KKLC1_HUMAN)
SMLCALIVY

SEQ ID NO: 40497 - protein, 9 aa, Artificial Sequence
  Description of Artificial Sequence: Synthetic peptide
  Seed: KRILVNLSM (KKLC1_HUMAN)
KSILVNLSY

SEQ ID NO: 40498 - protein, 9 aa, Artificial Sequence
  Description of Artificial Sequence: Synthetic peptide
  Seed: KYRRFQRNT (KKLC1_HUMAN)
KTRRFQRNC

SEQ ID NO: 40499 - protein, 9 aa, Artificial Sequence
  Description of Artificial Sequence: Synthetic peptide
  Seed: AVYDLSRDI (KKLC1_HUMAN)
AIYDLSRDV

SEQ ID NO: 40500 - protein, 9 aa, Artificial Sequence
  Description of Artificial Sequence: Synthetic peptide
  Seed: SILCALIVF (KKLC1_HUMAN)
SLLCALIVF

SEQ ID NO: 40501 - protein, 9 aa, Artificial Sequence
  Description of Artificial Sequence: Synthetic peptide
  Seed: MVENKLVEL (KKLC1_HUMAN)
MAENKLVEF

SEQ ID NO: 40502 - protein, 9 aa, Artificial Sequence
  Description of Artificial Sequence: Synthetic peptide
  Seed: ILNNFPHSI (KKLC1_HUMAN)
IWNNFPHSM

SEQ ID NO: 40503 - protein, 10 aa, Artificial Sequence
  Description of Artificial Sequence: Synthetic peptide
  Seed: YLLLASSILC (KKLC1_HUMAN)
YNLLASSILV

SEQ ID NO: 40504 - protein, 10 aa, Artificial Sequence
  Description of Artificial Sequence: Synthetic peptide
  Seed: RQKRILVNLS (KKLC1_HUMAN)
RYKRILVNLK

SEQ ID NO: 40505 - protein, 9 aa, Artificial Sequence
  Description of Artificial Sequence: Synthetic peptide
  Seed: YLLLASSIL (KKLC1_HUMAN)
YHLLASSIM

SEQ ID NO: 40506 - protein, 9 aa, Artificial Sequence
  Description of Artificial Sequence: Synthetic peptide
  Seed: SSNSTALAL (KKLC1_HUMAN)
SSNSTALAV

SEQ ID NO: 40507 - protein, 9 aa, Artificial Sequence
  Description of Artificial Sequence: Synthetic peptide
  Seed: EMSSNSTAL (KKLC1_HUMAN)
EASSNSTAF

SEQ ID NO: 40508 - protein, 9 aa, Artificial Sequence
  Description of Artificial Sequence: Synthetic peptide
  Seed: KLVELEHTL (KKLC1_HUMAN)
KAVELEHTF

SEQ ID NO: 40509 - protein, 9 aa, Artificial Sequence
  Description of Artificial Sequence: Synthetic peptide
  Seed: LIVFWKYRR (KKLC1_HUMAN)
LMVFWKYRK

SEQ ID NO: 40510 - protein, 10 aa, Artificial Sequence
  Description of Artificial Sequence: Synthetic peptide
  Seed: ALIVFWKYRR (KKLC1_HUMAN)
AFIVFWKYRR

SEQ ID NO: 40511 - protein, 9 aa, Artificial Sequence
  Description of Artificial Sequence: Synthetic peptide
  Seed: KLVELEHTL (KKLC1_HUMAN)
KEVELEHTV

SEQ ID NO: 40512 - protein, 9 aa, Artificial Sequence
  Description of Artificial Sequence: Synthetic peptide
  Seed: RQKRILVNL (KKLC1_HUMAN)
RGKRILVNK

SEQ ID NO: 40513 - protein, 10 aa, Artificial Sequence
  Description of Artificial Sequence: Synthetic peptide
  Seed: DILNNFPHSI (KKLC1_HUMAN)
DMLNNFPHSL

SEQ ID NO: 40514 - protein, 9 aa, Artificial Sequence
  Description of Artificial Sequence: Synthetic peptide
  Seed: KYRRFQRNT (KKLC1_HUMAN)
KFRRFQRNM

SEQ ID NO: 40515 - protein, 10 aa, Artificial Sequence
  Description of Artificial Sequence: Synthetic peptide
  Seed: VFWKYRRFQR (KKLC1_HUMAN)
VYWKYRRFQK

SEQ ID NO: 40516 - protein, 10 aa, Artificial Sequence
  Description of Artificial Sequence: Synthetic peptide
  Seed: AVYDLSRDIL (KKLC1_HUMAN)
ALYDLSRDIW

SEQ ID NO: 40517 - protein, 10 aa, Artificial Sequence
  Description of Artificial Sequence: Synthetic peptide
  Seed: KGFRGASPHR (KKLC1_HUMAN)
KVFRGASPHL

SEQ ID NO: 40518 - protein, 9 aa, Artificial Sequence
  Description of Artificial Sequence: Synthetic peptide
  Seed: ILNNFPHSI (KKLC1_HUMAN)
ITNNFPHSW

SEQ ID NO: 40519 - protein, 9 aa, Artificial Sequence
  Description of Artificial Sequence: Synthetic peptide
  Seed: YLLLASSIL (KKLC1_HUMAN)
YQLLASSIW

SEQ ID NO: 40520 - protein, 9 aa, Artificial Sequence
  Description of Artificial Sequence: Synthetic peptide
  Seed: YLLLASSIL (KKLC1_HUMAN)
YKLLASSIW

SEQ ID NO: 40521 - protein, 9 aa, Artificial Sequence
  Description of Artificial Sequence: Synthetic peptide
  Seed: ILNNFPHSI (KKLC1_HUMAN)
IYNNFPHSV

SEQ ID NO: 40522 - protein, 9 aa, Artificial Sequence
  Description of Artificial Sequence: Synthetic peptide
  Seed: KYRRFQRNT (KKLC1_HUMAN)
KMRRFQRNA

SEQ ID NO: 40523 - protein, 9 aa, Artificial Sequence
  Description of Artificial Sequence: Synthetic peptide
  Seed: ILNNFPHSI (KKLC1_HUMAN)
IFNNFPHSW

SEQ ID NO: 40524 - protein, 11 aa, Artificial Sequence
  Description of Artificial Sequence: Synthetic peptide
  Seed: YLLLASSILCA (KKLC1_HUMAN)
YKLLASSILCI

SEQ ID NO: 40525 - protein, 10 aa, Artificial Sequence
  Description of Artificial Sequence: Synthetic peptide
  Seed: ALIVFWKYRR (KKLC1_HUMAN)
AWIVFWKYRK

SEQ ID NO: 40526 - protein, 11 aa, Artificial Sequence
  Description of Artificial Sequence: Synthetic peptide
  Seed: LCALIVFWKYR (KKLC1_HUMAN)
LMALIVFWKYR

SEQ ID NO: 40527 - protein, 10 aa, Artificial Sequence
  Description of Artificial Sequence: Synthetic peptide
  Seed: MSSNSTALAL (KKLC1_HUMAN)
MSSNSTALAY

SEQ ID NO: 40528 - protein, 10 aa, Artificial Sequence
  Description of Artificial Sequence: Synthetic peptide
  Seed: CALIVFWKYR (KKLC1_HUMAN)
CFLIVFWKYR

SEQ ID NO: 40529 - protein, 9 aa, Artificial Sequence
  Description of Artificial Sequence: Synthetic peptide
  Seed: RQKRILVNL (KKLC1_HUMAN)
RMKRILVNT

SEQ ID NO: 40530 - protein, 10 aa, Artificial Sequence
  Description of Artificial Sequence: Synthetic peptide
  Seed: KGFRGASPHR (KKLC1_HUMAN)
KHFRGASPHK

SEQ ID NO: 40531 - protein, 10 aa, Artificial Sequence
  Description of Artificial Sequence: Synthetic peptide
  Seed: AVYDLSRDIL (KKLC1_HUMAN)
AQYDLSRDII

SEQ ID NO: 40532 - protein, 10 aa, Artificial Sequence
  Description of Artificial Sequence: Synthetic peptide
  Seed: VELEHTLLSK (KKLC1_HUMAN)
VTLEHTLLSR

SEQ ID NO: 40533 - protein, 10 aa, Artificial Sequence
  Description of Artificial Sequence: Synthetic peptide
  Seed: QKRILVNLSM (KKLC1_HUMAN)
QIRILVNLSI

SEQ ID NO: 40534 - protein, 10 aa, Artificial Sequence
  Description of Artificial Sequence: Synthetic peptide
  Seed: SMVENKLVEL (KKLC1_HUMAN)
SRVENKLVEL

SEQ ID NO: 40535 - protein, 11 aa, Artificial Sequence
  Description of Artificial Sequence: Synthetic peptide
  Seed: LSMVENKLVEL (KKLC1_HUMAN)
LTMVENKLVEF

SEQ ID NO: 40536 - protein, 11 aa, Artificial Sequence
  Description of Artificial Sequence: Synthetic peptide
  Seed: RQKRILVNLSM (KKLC1_HUMAN)
RAKRILVNLSR

SEQ ID NO: 40537 - protein, 9 aa, Artificial Sequence
  Description of Artificial Sequence: Synthetic peptide
  Seed: LVRPSSSGL (KKLC1_HUMAN)
LIRPSSSGK

SEQ ID NO: 40538 - protein, 9 aa, Artificial Sequence
  Description of Artificial Sequence: Synthetic peptide
  Seed: SSNSTALAL (KKLC1_HUMAN)
SMNSTALAV

SEQ ID NO: 40539 - protein, 9 aa, Artificial Sequence
  Description of Artificial Sequence: Synthetic peptide
  Seed: KYRRFQRNT (KKLC1_HUMAN)
KTRRFQRNV

SEQ ID NO: 40540 - protein, 10 aa, Artificial Sequence
  Description of Artificial Sequence: Synthetic peptide
  Seed: GEMSSNSTAL (KKLC1_HUMAN)
GTMSSNSTAV

SEQ ID NO: 40541 - protein, 9 aa, Artificial Sequence
  Description of Artificial Sequence: Synthetic peptide
  Seed: FPHSIARQK (KKLC1_HUMAN)
FIHSIARQK

SEQ ID NO: 40542 - protein, 11 aa, Artificial Sequence
  Description of Artificial Sequence: Synthetic peptide
  Seed: YRRFQRNTGEM (KKLC1_HUMAN)
YYRFQRNTGEM

SEQ ID NO: 40543 - protein, 10 aa, Artificial Sequence
  Description of Artificial Sequence: Synthetic peptide
  Seed: LLLASSILCA (KKLC1_HUMAN)
LYLASSILCV

SEQ ID NO: 40544 - protein, 11 aa, Artificial Sequence
  Description of Artificial Sequence: Synthetic peptide
  Seed: ILNNFPHSIAR (KKLC1_HUMAN)
ILNNFPHSIAK

SEQ ID NO: 40545 - protein, 9 aa, Artificial Sequence
  Description of Artificial Sequence: Synthetic peptide
  Seed: KLVELEHTL (KKLC1_HUMAN)
KTVELEHTA

SEQ ID NO: 40546 - protein, 9 aa, Artificial Sequence
  Description of Artificial Sequence: Synthetic peptide
  Seed: LLLASSILC (KKLC1_HUMAN)
LMLASSILA

SEQ ID NO: 40547 - protein, 9 aa, Artificial Sequence
  Description of Artificial Sequence: Synthetic peptide
  Seed: KLVELEHTL (KKLC1_HUMAN)
KYVELEHTL

SEQ ID NO: 40548 - protein, 9 aa, Artificial Sequence
  Description of Artificial Sequence: Synthetic peptide
  Seed: KLVELEHTL (KKLC1_HUMAN)
KFVELEHTF

SEQ ID NO: 40549 - protein, 9 aa, Artificial Sequence
  Description of Artificial Sequence: Synthetic peptide
  Seed: NNFPHSIAR (KKLC1_HUMAN)
NLFPHSIAF

SEQ ID NO: 40550 - protein, 10 aa, Artificial Sequence
  Description of Artificial Sequence: Synthetic peptide
  Seed: QKRILVNLSM (KKLC1_HUMAN)
QRRILVNLSF

SEQ ID NO: 40551 - protein, 8 aa, Artificial Sequence
  Description of Artificial Sequence: Synthetic peptide
  Seed: NTDNNLAV (KKLC1_HUMAN)
NADNNLAV

SEQ ID NO: 40552 - protein, 9 aa, Artificial Sequence
  Description of Artificial Sequence: Synthetic peptide
  Seed: VYDLSRDIL (KKLC1_HUMAN)
VLDLSRDIV

SEQ ID NO: 40553 - protein, 9 aa, Artificial Sequence
  Description of Artificial Sequence: Synthetic peptide
  Seed: FPHSIARQK (KKLC1_HUMAN)
FTHSIARQK

SEQ ID NO: 40554 - protein, 10 aa, Artificial Sequence
  Description of Artificial Sequence: Synthetic peptide
  Seed: AVYDLSRDIL (KKLC1_HUMAN)
AIYDLSRDIV

SEQ ID NO: 40555 - protein, 10 aa, Artificial Sequence
  Description of Artificial Sequence: Synthetic peptide
  Seed: ALIVFWKYRR (KKLC1_HUMAN)
AYIVFWKYRK

SEQ ID NO: 40556 - protein, 9 aa, Artificial Sequence
  Description of Artificial Sequence: Synthetic peptide
  Seed: KLVELEHTL (KKLC1_HUMAN)
KEVELEHTT

SEQ ID NO: 40557 - protein, 10 aa, Artificial Sequence
  Description of Artificial Sequence: Synthetic peptide
  Seed: GEMSSNSTAL (KKLC1_HUMAN)
GMMSSNSTAL

SEQ ID NO: 40558 - protein, 9 aa, Artificial Sequence
  Description of Artificial Sequence: Synthetic peptide
  Seed: EMSSNSTAL (KKLC1_HUMAN)
EISSNSTAY

SEQ ID NO: 40559 - protein, 10 aa, Artificial Sequence
  Description of Artificial Sequence: Synthetic peptide
  Seed: SSNSTALALV (KKLC1_HUMAN)
SLNSTALALV

SEQ ID NO: 40560 - protein, 9 aa, Artificial Sequence
  Description of Artificial Sequence: Synthetic peptide
  Seed: KLVELEHTL (KKLC1_HUMAN)
KHVELEHTM

SEQ ID NO: 40561 - protein, 9 aa, Artificial Sequence
  Description of Artificial Sequence: Synthetic peptide
  Seed: FRGASPHRK (KKLC1_HUMAN)
FRGASPHRF

SEQ ID NO: 40562 - protein, 11 aa, Artificial Sequence
  Description of Artificial Sequence: Synthetic peptide
  Seed: NNFPHSIARQK (KKLC1_HUMAN)
NIFPHSIARQK

SEQ ID NO: 40563 - protein, 9 aa, Artificial Sequence
  Description of Artificial Sequence: Synthetic peptide
  Seed: GFRGASPHR (KKLC1_HUMAN)
GYRGASPHK

SEQ ID NO: 40564 - protein, 9 aa, Artificial Sequence
  Description of Artificial Sequence: Synthetic peptide
  Seed: SILCALIVF (KKLC1_HUMAN)
SKLCALIVM

SEQ ID NO: 40565 - protein, 10 aa, Artificial Sequence
  Description of Artificial Sequence: Synthetic peptide
  Seed: QKRILVNLSM (KKLC1_HUMAN)
QTRILVNLSV

SEQ ID NO: 40566 - protein, 10 aa, Artificial Sequence
  Description of Artificial Sequence: Synthetic peptide
  Seed: GEMSSNSTAL (KKLC1_HUMAN)
GLMSSNSTAI

SEQ ID NO: 40567 - protein, 9 aa, Artificial Sequence
  Description of Artificial Sequence: Synthetic peptide
  Seed: CALIVFWKY (KKLC1_HUMAN)
CTLIVFWKF

SEQ ID NO: 40568 - protein, 9 aa, Artificial Sequence
  Description of Artificial Sequence: Synthetic peptide
  Seed: KYRRFQRNT (KKLC1_HUMAN)
KMRRFQRNM

SEQ ID NO: 40569 - protein, 10 aa, Artificial Sequence
  Description of Artificial Sequence: Synthetic peptide
  Seed: FYLLLASSIL (KKLC1_HUMAN)
FNLLLASSIV

SEQ ID NO: 40570 - protein, 9 aa, Artificial Sequence
  Description of Artificial Sequence: Synthetic peptide
  Seed: FWKYRRFQR (KKLC1_HUMAN)
FSKYRRFQR

SEQ ID NO: 40571 - protein, 9 aa, Artificial Sequence
  Description of Artificial Sequence: Synthetic peptide
  Seed: LVRPSSSGL (KKLC1_HUMAN)
LVRPSSSGY

SEQ ID NO: 40572 - protein, 11 aa, Artificial Sequence
  Description of Artificial Sequence: Synthetic peptide
  Seed: MNFYLLLASSI (KKLC1_HUMAN)
MMFYLLLASSF

SEQ ID NO: 40573 - protein, 9 aa, Artificial Sequence
  Description of Artificial Sequence: Synthetic peptide
  Seed: AVYDLSRDI (KKLC1_HUMAN)
AVYDLSRDV

SEQ ID NO: 40574 - protein, 9 aa, Artificial Sequence
  Description of Artificial Sequence: Synthetic peptide
  Seed: RQKRILVNL (KKLC1_HUMAN)
RAKRILVNW

SEQ ID NO: 40575 - protein, 9 aa, Artificial Sequence
  Description of Artificial Sequence: Synthetic peptide
  Seed: KLVELEHTL (KKLC1_HUMAN)
KNVELEHTW

SEQ ID NO: 40576 - protein, 11 aa, Artificial Sequence
  Description of Artificial Sequence: Synthetic peptide
  Seed: RQKRILVNLSM (KKLC1_HUMAN)
RPKRILVNLSV

SEQ ID NO: 40577 - protein, 9 aa, Artificial Sequence
  Description of Artificial Sequence: Synthetic peptide
  Seed: KLVELEHTL (KKLC1_HUMAN)
KHVELEHTL

SEQ ID NO: 40578 - protein, 9 aa, Artificial Sequence
  Description of Artificial Sequence: Synthetic peptide
  Seed: KLVELEHTL (KKLC1_HUMAN)
KSVELEHTV

SEQ ID NO: 40579 - protein, 9 aa, Artificial Sequence
  Description of Artificial Sequence: Synthetic peptide
  Seed: YLLLASSIL (KKLC1_HUMAN)
YRLLASSIF

SEQ ID NO: 40580 - protein, 9 aa, Artificial Sequence
  Description of Artificial Sequence: Synthetic peptide
  Seed: KLVELEHTL (KKLC1_HUMAN)
KWVELEHTL

SEQ ID NO: 40581 - protein, 9 aa, Artificial Sequence
  Description of Artificial Sequence: Synthetic peptide
  Seed: KLVELEHTL (KKLC1_HUMAN)
KKVELEHTM

SEQ ID NO: 40582 - protein, 9 aa, Artificial Sequence
  Description of Artificial Sequence: Synthetic peptide
  Seed: KLVELEHTL (KKLC1_HUMAN)
KLVELEHTM

SEQ ID NO: 40583 - protein, 9 aa, Artificial Sequence
  Description of Artificial Sequence: Synthetic peptide
  Seed: NNFPHSIAR (KKLC1_HUMAN)
NTFPHSIAH

SEQ ID NO: 40584 - protein, 9 aa, Artificial Sequence
  Description of Artificial Sequence: Synthetic peptide
  Seed: IVFWKYRRF (KKLC1_HUMAN)
IQFWKYRRY

SEQ ID NO: 40585 - protein, 9 aa, Artificial Sequence
  Description of Artificial Sequence: Synthetic peptide
  Seed: MVENKLVEL (KKLC1_HUMAN)
MLENKLVEI

SEQ ID NO: 40586 - protein, 10 aa, Artificial Sequence
  Description of Artificial Sequence: Synthetic peptide
  Seed: LASSILCALI (KKLC1_HUMAN)
LWSSILCALW

SEQ ID NO: 40587 - protein, 10 aa, Artificial Sequence
  Description of Artificial Sequence: Synthetic peptide
  Seed: QKRILVNLSM (KKLC1_HUMAN)
QNRILVNLSL

SEQ ID NO: 40588 - protein, 9 aa, Artificial Sequence
  Description of Artificial Sequence: Synthetic peptide
  Seed: KGFRGASPH (KKLC1_HUMAN)
KEFRGASPL

SEQ ID NO: 40589 - protein, 9 aa, Artificial Sequence
  Description of Artificial Sequence: Synthetic peptide
  Seed: ALIVFWKYR (KKLC1_HUMAN)
AMIVFWKYR

SEQ ID NO: 40590 - protein, 10 aa, Artificial Sequence
  Description of Artificial Sequence: Synthetic peptide
  Seed: KYRRFQRNTG (KKLC1_HUMAN)
KFRRFQRNTK

SEQ ID NO: 40591 - protein, 9 aa, Artificial Sequence
  Description of Artificial Sequence: Synthetic peptide
  Seed: RILVNLSMV (KKLC1_HUMAN)
RMLVNLSMV

SEQ ID NO: 40592 - protein, 9 aa, Artificial Sequence
  Description of Artificial Sequence: Synthetic peptide
  Seed: ILNNFPHSI (KKLC1_HUMAN)
IANNFPHSY

SEQ ID NO: 40593 - protein, 11 aa, Artificial Sequence
  Description of Artificial Sequence: Synthetic peptide
  Seed: RQKRILVNLSM (KKLC1_HUMAN)
RRKRILVNLSI

SEQ ID NO: 40594 - protein, 9 aa, Artificial Sequence
  Description of Artificial Sequence: Synthetic peptide
  Seed: SNSTALALV (KKLC1_HUMAN)
SSSTALALM

SEQ ID NO: 40595 - protein, 9 aa, Artificial Sequence
  Description of Artificial Sequence: Synthetic peptide
  Seed: VELEHTLLS (KKLC1_HUMAN)
VELEHTLLC

SEQ ID NO: 40596 - protein, 10 aa, Artificial Sequence
  Description of Artificial Sequence: Synthetic peptide
  Seed: LVNLSMVENK (KKLC1_HUMAN)
LTNLSMVENR

SEQ ID NO: 40597 - protein, 10 aa, Artificial Sequence
  Description of Artificial Sequence: Synthetic peptide
  Seed: NKLVELEHTL (KKLC1_HUMAN)
NMLVELEHTL

SEQ ID NO: 40598 - protein, 10 aa, Artificial Sequence
  Description of Artificial Sequence: Synthetic peptide
  Seed: EMSSNSTALA (KKLC1_HUMAN)
EFSSNSTALV

SEQ ID NO: 40599 - protein, 9 aa, Artificial Sequence
  Description of Artificial Sequence: Synthetic peptide
  Seed: LSMVENKLV (KKLC1_HUMAN)
LVMVENKLW

SEQ ID NO: 40600 - protein, 10 aa, Artificial Sequence
  Description of Artificial Sequence: Synthetic peptide
  Seed: QKRILVNLSM (KKLC1_HUMAN)
QQRILVNLSM

SEQ ID NO: 40601 - protein, 9 aa, Artificial Sequence
  Description of Artificial Sequence: Synthetic peptide
  Seed: SSNSTALAL (KKLC1_HUMAN)
STNSTALAM

SEQ ID NO: 40602 - protein, 11 aa, Artificial Sequence
  Description of Artificial Sequence: Synthetic peptide
  Seed: LSMVENKLVEL (KKLC1_HUMAN)
LMMVENKLVEA

SEQ ID NO: 40603 - protein, 10 aa, Artificial Sequence
  Description of Artificial Sequence: Synthetic peptide
  Seed: KLVELEHTLL (KKLC1_HUMAN)
KMVELEHTLF

SEQ ID NO: 40604 - protein, 10 aa, Artificial Sequence
  Description of Artificial Sequence: Synthetic peptide
  Seed: GEMSSNSTAL (KKLC1_HUMAN)
GEMSSNSTAT

SEQ ID NO: 40605 - protein, 10 aa, Artificial Sequence
  Description of Artificial Sequence: Synthetic peptide
  Seed: NKLVELEHTL (KKLC1_HUMAN)
NYLVELEHTI

SEQ ID NO: 40606 - protein, 10 aa, Artificial Sequence
  Description of Artificial Sequence: Synthetic peptide
  Seed: GEMSSNSTAL (KKLC1_HUMAN)
GYMSSNSTAV

SEQ ID NO: 40607 - protein, 9 aa, Artificial Sequence
  Description of Artificial Sequence: Synthetic peptide
  Seed: ILNNFPHSI (KKLC1_HUMAN)
IRNNFPHSY

SEQ ID NO: 40608 - protein, 10 aa, Artificial Sequence
  Description of Artificial Sequence: Synthetic peptide
  Seed: KLVELEHTLL (KKLC1_HUMAN)
KMVELEHTLW

SEQ ID NO: 40609 - protein, 10 aa, Artificial Sequence
  Description of Artificial Sequence: Synthetic peptide
  Seed: LASSILCALI (KKLC1_HUMAN)
LMSSILCALY

SEQ ID NO: 40610 - protein, 10 aa, Artificial Sequence
  Description of Artificial Sequence: Synthetic peptide
  Seed: YLLLASSILC (KKLC1_HUMAN)
YCLLASSILL

SEQ ID NO: 40611 - protein, 11 aa, Artificial Sequence
  Description of Artificial Sequence: Synthetic peptide
  Seed: NNFPHSIARQK (KKLC1_HUMAN)
NSFPHSIARQK

SEQ ID NO: 40612 - protein, 9 aa, Artificial Sequence
  Description of Artificial Sequence: Synthetic peptide
  Seed: NNFPHSIAR (KKLC1_HUMAN)
NMFPHSIAK

SEQ ID NO: 40613 - protein, 9 aa, Artificial Sequence
  Description of Artificial Sequence: Synthetic peptide
  Seed: NNFPHSIAR (KKLC1_HUMAN)
NCFPHSIAL

SEQ ID NO: 40614 - protein, 10 aa, Artificial Sequence
  Description of Artificial Sequence: Synthetic peptide
  Seed: YLLLASSILC (KKLC1_HUMAN)
YWLLASSILV

SEQ ID NO: 40615 - protein, 10 aa, Artificial Sequence
  Description of Artificial Sequence: Synthetic peptide
  Seed: EMSSNSTALA (KKLC1_HUMAN)
EWSSNSTALV

SEQ ID NO: 40616 - protein, 10 aa, Artificial Sequence
  Description of Artificial Sequence: Synthetic peptide
  Seed: KGFRGASPHR (KKLC1_HUMAN)
KQFRGASPHA

SEQ ID NO: 40617 - protein, 10 aa, Artificial Sequence
  Description of Artificial Sequence: Synthetic peptide
  Seed: LASSILCALI (KKLC1_HUMAN)
LLSSILCALW

SEQ ID NO: 40618 - protein, 8 aa, Artificial Sequence
  Description of Artificial Sequence: Synthetic peptide
  Seed: NTDNNLAV (KKLC1_HUMAN)
NIDNNLAM

SEQ ID NO: 40619 - protein, 9 aa, Artificial Sequence
  Description of Artificial Sequence: Synthetic peptide
  Seed: KLVELEHTL (KKLC1_HUMAN)
KVVELEHTY

SEQ ID NO: 40620 - protein, 10 aa, Artificial Sequence
  Description of Artificial Sequence: Synthetic peptide
  Seed: MSSNSTALAL (KKLC1_HUMAN)
MLSNSTALAF

SEQ ID NO: 40621 - protein, 9 aa, Artificial Sequence
  Description of Artificial Sequence: Synthetic peptide
  Seed: MVENKLVEL (KKLC1_HUMAN)
MPENKLVEI

SEQ ID NO: 40622 - protein, 10 aa, Artificial Sequence
  Description of Artificial Sequence: Synthetic peptide
  Seed: ALVRPSSSGL (KKLC1_HUMAN)
AIVRPSSSGK

SEQ ID NO: 40623 - protein, 10 aa, Artificial Sequence
  Description of Artificial Sequence: Synthetic peptide
  Seed: KGFRGASPHR (KKLC1_HUMAN)
KHFRGASPHA

SEQ ID NO: 40624 - protein, 10 aa, Artificial Sequence
  Description of Artificial Sequence: Synthetic peptide
  Seed: QKRILVNLSM (KKLC1_HUMAN)
QNRILVNLSM

SEQ ID NO: 40625 - protein, 11 aa, Artificial Sequence
  Description of Artificial Sequence: Synthetic peptide
  Seed: RQKRILVNLSM (KKLC1_HUMAN)
RMKRILVNLSL

SEQ ID NO: 40626 - protein, 10 aa, Artificial Sequence
  Description of Artificial Sequence: Synthetic peptide
  Seed: LASSILCALI (KKLC1_HUMAN)
LVSSILCALW

SEQ ID NO: 40627 - protein, 10 aa, Artificial Sequence
  Description of Artificial Sequence: Synthetic peptide
  Seed: KLVELEHTLL (KKLC1_HUMAN)
KVVELEHTLF

SEQ ID NO: 40628 - protein, 9 aa, Artificial Sequence
  Description of Artificial Sequence: Synthetic peptide
  Seed: RFQRNTGEM (KKLC1_HUMAN)
RWQRNTGEI

SEQ ID NO: 40629 - protein, 11 aa, Artificial Sequence
  Description of Artificial Sequence: Synthetic peptide
  Seed: LSMVENKLVEL (KKLC1_HUMAN)
LMMVENKLVEL

SEQ ID NO: 40630 - protein, 11 aa, Artificial Sequence
  Description of Artificial Sequence: Synthetic peptide
  Seed: RQKRILVNLSM (KKLC1_HUMAN)
RHKRILVNLSR

SEQ ID NO: 40631 - protein, 10 aa, Artificial Sequence
  Description of Artificial Sequence: Synthetic peptide
  Seed: MSSNSTALAL (KKLC1_HUMAN)
MVSNSTALAM

SEQ ID NO: 40632 - protein, 9 aa, Artificial Sequence
  Description of Artificial Sequence: Synthetic peptide
  Seed: ELEHTLLSK (KKLC1_HUMAN)
ETEHTLLSY

SEQ ID NO: 40633 - protein, 9 aa, Artificial Sequence
  Description of Artificial Sequence: Synthetic peptide
  Seed: EHTLLSKGF (KKLC1_HUMAN)
EHTLLSKGL

SEQ ID NO: 40634 - protein, 9 aa, Artificial Sequence
  Description of Artificial Sequence: Synthetic peptide
  Seed: HTLLSKGFR (KKLC1_HUMAN)
HLLLSKGFR

SEQ ID NO: 40635 - protein, 10 aa, Artificial Sequence
  Description of Artificial Sequence: Synthetic peptide
  Seed: QKRILVNLSM (KKLC1_HUMAN)
QPRILVNLSF

SEQ ID NO: 40636 - protein, 9 aa, Artificial Sequence
  Description of Artificial Sequence: Synthetic peptide
  Seed: LLSKGFRGA (KKLC1_HUMAN)
LMSKGFRGL

SEQ ID NO: 40637 - protein, 11 aa, Artificial Sequence
  Description of Artificial Sequence: Synthetic peptide
  Seed: RQKRILVNLSM (KKLC1_HUMAN)
RGKRILVNLSK

SEQ ID NO: 40638 - protein, 10 aa, Artificial Sequence
  Description of Artificial Sequence: Synthetic peptide
  Seed: ALIVFWKYRR (KKLC1_HUMAN)
AVIVFWKYRR

SEQ ID NO: 40639 - protein, 10 aa, Artificial Sequence
  Description of Artificial Sequence: Synthetic peptide
  Seed: MSSNSTALAL (KKLC1_HUMAN)
MCSNSTALAY

SEQ ID NO: 40640 - protein, 9 aa, Artificial Sequence
  Description of Artificial Sequence: Synthetic peptide
  Seed: RQKRILVNL (KKLC1_HUMAN)
RNKRILVNA

SEQ ID NO: 40641 - protein, 9 aa, Artificial Sequence
  Description of Artificial Sequence: Synthetic peptide
  Seed: RQKRILVNL (KKLC1_HUMAN)
RTKRILVNT

SEQ ID NO: 40642 - protein, 11 aa, Artificial Sequence
  Description of Artificial Sequence: Synthetic peptide
  Seed: RDILNNFPHSI (KKLC1_HUMAN)
RFILNNFPHSV

SEQ ID NO: 40643 - protein, 10 aa, Artificial Sequence
  Description of Artificial Sequence: Synthetic peptide
  Seed: SMVENKLVEL (KKLC1_HUMAN)
SQVENKLVEI

SEQ ID NO: 40644 - protein, 9 aa, Artificial Sequence
  Description of Artificial Sequence: Synthetic peptide
  Seed: ILNNFPHSI (KKLC1_HUMAN)
IMNNFPHSM

SEQ ID NO: 40645 - protein, 10 aa, Artificial Sequence
  Description of Artificial Sequence: Synthetic peptide
  Seed: MSSNSTALAL (KKLC1_HUMAN)
MYSNSTALAY

SEQ ID NO: 40646 - protein, 10 aa, Artificial Sequence
  Description of Artificial Sequence: Synthetic peptide
  Seed: LASSILCALI (KKLC1_HUMAN)
LISSILCALI

SEQ ID NO: 40647 - protein, 9 aa, Artificial Sequence
  Description of Artificial Sequence: Synthetic peptide
  Seed: KGFRGASPH (KKLC1_HUMAN)
KQFRGASPH

SEQ ID NO: 40648 - protein, 8 aa, Artificial Sequence
  Description of Artificial Sequence: Synthetic peptide
  Seed: VELEHTLL (KKLC1_HUMAN)
VQLEHTLV

SEQ ID NO: 40649 - protein, 9 aa, Artificial Sequence
  Description of Artificial Sequence: Synthetic peptide
  Seed: KGFRGASPH (KKLC1_HUMAN)
KEFRGASPH

SEQ ID NO: 40650 - protein, 10 aa, Artificial Sequence
  Description of Artificial Sequence: Synthetic peptide
  Seed: GEMSSNSTAL (KKLC1_HUMAN)
GHMSSNSTAV

SEQ ID NO: 40651 - protein, 10 aa, Artificial Sequence
  Description of Artificial Sequence: Synthetic peptide
  Seed: ILCALIVFWK (KKLC1_HUMAN)
IVCALIVFWK

SEQ ID NO: 40652 - protein, 9 aa, Artificial Sequence
  Description of Artificial Sequence: Synthetic peptide
  Seed: KYRRFQRNT (KKLC1_HUMAN)
KTRRFQRNS

SEQ ID NO: 40653 - protein, 10 aa, Artificial Sequence
  Description of Artificial Sequence: Synthetic peptide
  Seed: QKRILVNLSM (KKLC1_HUMAN)
QRRILVNLSL

SEQ ID NO: 40654 - protein, 9 aa, Artificial Sequence
  Description of Artificial Sequence: Synthetic peptide
  Seed: VNLSMVENK (KKLC1_HUMAN)
VTLSMVENR

SEQ ID NO: 40655 - protein, 11 aa, Artificial Sequence
  Description of Artificial Sequence: Synthetic peptide
  Seed: RQKRILVNLSM (KKLC1_HUMAN)
RFKRILVNLSI

SEQ ID NO: 40656 - protein, 10 aa, Artificial Sequence
  Description of Artificial Sequence: Synthetic peptide
  Seed: YLLLASSILC (KKLC1_HUMAN)
YILLASSILV

SEQ ID NO: 40657 - protein, 11 aa, Artificial Sequence
  Description of Artificial Sequence: Synthetic peptide
  Seed: RQKRILVNLSM (KKLC1_HUMAN)
REKRILVNLSR

SEQ ID NO: 40658 - protein, 9 aa, Artificial Sequence
  Description of Artificial Sequence: Synthetic peptide
  Seed: KYRRFQRNT (KKLC1_HUMAN)
KQRRFQRNK

SEQ ID NO: 40659 - protein, 10 aa, Artificial Sequence
  Description of Artificial Sequence: Synthetic peptide
  Seed: LLLASSILCA (KKLC1_HUMAN)
LILASSILCL

SEQ ID NO: 40660 - protein, 9 aa, Artificial Sequence
  Description of Artificial Sequence: Synthetic peptide
  Seed: SSNSTALAL (KKLC1_HUMAN)
SHNSTALAY

SEQ ID NO: 40661 - protein, 9 aa, Artificial Sequence
  Description of Artificial Sequence: Synthetic peptide
  Seed: ASSILCALI (KKLC1_HUMAN)
AVSILCALV

SEQ ID NO: 40662 - protein, 10 aa, Artificial Sequence
  Description of Artificial Sequence: Synthetic peptide
  Seed: SMVENKLVEL (KKLC1_HUMAN)
SQVENKLVEW

SEQ ID NO: 40663 - protein, 10 aa, Artificial Sequence
  Description of Artificial Sequence: Synthetic peptide
  Seed: FYLLLASSIL (KKLC1_HUMAN)
FHLLLASSIV

SEQ ID NO: 40664 - protein, 9 aa, Artificial Sequence
  Description of Artificial Sequence: Synthetic peptide
  Seed: RQKRILVNL (KKLC1_HUMAN)
RAKRILVNK

SEQ ID NO: 40665 - protein, 9 aa, Artificial Sequence
  Description of Artificial Sequence: Synthetic peptide
  Seed: FPHSIARQK (KKLC1_HUMAN)
FPHSIARQT

SEQ ID NO: 40666 - protein, 10 aa, Artificial Sequence
  Description of Artificial Sequence: Synthetic peptide
  Seed: LVRPSSSGLI (KKLC1_HUMAN)
LMRPSSSGLK

SEQ ID NO: 40667 - protein, 9 aa, Artificial Sequence
  Description of Artificial Sequence: Synthetic peptide
  Seed: VYDLSRDIL (KKLC1_HUMAN)
VSDLSRDIM

SEQ ID NO: 40668 - protein, 9 aa, Artificial Sequence
  Description of Artificial Sequence: Synthetic peptide
  Seed: KLVELEHTL (KKLC1_HUMAN)
KEVELEHTL

SEQ ID NO: 40669 - protein, 9 aa, Artificial Sequence
  Description of Artificial Sequence: Synthetic peptide
  Seed: KRILVNLSM (KKLC1_HUMAN)
KYILVNLSF

SEQ ID NO: 40670 - protein, 11 aa, Artificial Sequence
  Description of Artificial Sequence: Synthetic peptide
  Seed: KLVELEHTLLS (KKLC1_HUMAN)
KMVELEHTLLA

SEQ ID NO: 40671 - protein, 9 aa, Artificial Sequence
  Description of Artificial Sequence: Synthetic peptide
  Seed: NNFPHSIAR (KKLC1_HUMAN)
NTFPHSIAM

SEQ ID NO: 40672 - protein, 10 aa, Artificial Sequence
  Description of Artificial Sequence: Synthetic peptide
  Seed: KGFRGASPHR (KKLC1_HUMAN)
KCFRGASPHA

SEQ ID NO: 40673 - protein, 9 aa, Artificial Sequence
  Description of Artificial Sequence: Synthetic peptide
  Seed: KRILVNLSM (KKLC1_HUMAN)
KYILVNLSM

SEQ ID NO: 40674 - protein, 10 aa, Artificial Sequence
  Description of Artificial Sequence: Synthetic peptide
  Seed: LVRPSSSGLI (KKLC1_HUMAN)
LTRPSSSGLK

SEQ ID NO: 40675 - protein, 10 aa, Artificial Sequence
  Description of Artificial Sequence: Synthetic peptide
  Seed: RRFQRNTGEM (KKLC1_HUMAN)
RFFQRNTGEF

SEQ ID NO: 40676 - protein, 9 aa, Artificial Sequence
  Description of Artificial Sequence: Synthetic peptide
  Seed: KRILVNLSM (KKLC1_HUMAN)
KIILVNLSY

SEQ ID NO: 40677 - protein, 10 aa, Artificial Sequence
  Description of Artificial Sequence: Synthetic peptide
  Seed: YLLLASSILC (KKLC1_HUMAN)
YELLASSILM

SEQ ID NO: 40678 - protein, 10 aa, Artificial Sequence
  Description of Artificial Sequence: Synthetic peptide
  Seed: MSSNSTALAL (KKLC1_HUMAN)
MTSNSTALAW

SEQ ID NO: 40679 - protein, 10 aa, Artificial Sequence
  Description of Artificial Sequence: Synthetic peptide
  Seed: GEMSSNSTAL (KKLC1_HUMAN)
GYMSSNSTAF

SEQ ID NO: 40680 - protein, 9 aa, Artificial Sequence
  Description of Artificial Sequence: Synthetic peptide
  Seed: GFRGASPHR (KKLC1_HUMAN)
GIRGASPHR

SEQ ID NO: 40681 - protein, 9 aa, Artificial Sequence
  Description of Artificial Sequence: Synthetic peptide
  Seed: VYDLSRDIL (KKLC1_HUMAN)
VWDLSRDII

SEQ ID NO: 40682 - protein, 9 aa, Artificial Sequence
  Description of Artificial Sequence: Synthetic peptide
  Seed: NNFPHSIAR (KKLC1_HUMAN)
NIFPHSIAL

SEQ ID NO: 40683 - protein, 9 aa, Artificial Sequence
  Description of Artificial Sequence: Synthetic peptide
  Seed: KYRRFQRNT (KKLC1_HUMAN)
KWRRFQRNV

SEQ ID NO: 40684 - protein, 9 aa, Artificial Sequence
  Description of Artificial Sequence: Synthetic peptide
  Seed: ILNNFPHSI (KKLC1_HUMAN)
ILNNFPHSM

SEQ ID NO: 40685 - protein, 10 aa, Artificial Sequence
  Description of Artificial Sequence: Synthetic peptide
  Seed: MSSNSTALAL (KKLC1_HUMAN)
MVSNSTALAY

SEQ ID NO: 40686 - protein, 9 aa, Artificial Sequence
  Description of Artificial Sequence: Synthetic peptide
  Seed: KLVELEHTL (KKLC1_HUMAN)
KGVELEHTL

SEQ ID NO: 40687 - protein, 10 aa, Artificial Sequence
  Description of Artificial Sequence: Synthetic peptide
  Seed: RRFQRNTGEM (KKLC1_HUMAN)
RLFQRNTGEF

SEQ ID NO: 40688 - protein, 10 aa, Artificial Sequence
  Description of Artificial Sequence: Synthetic peptide
  Seed: QKRILVNLSM (KKLC1_HUMAN)
QERILVNLSM

SEQ ID NO: 40689 - protein, 10 aa, Artificial Sequence
  Description of Artificial Sequence: Synthetic peptide
  Seed: EHTLLSKGFR (KKLC1_HUMAN)
EETLLSKGFR

SEQ ID NO: 40690 - protein, 9 aa, Artificial Sequence
  Description of Artificial Sequence: Synthetic peptide
  Seed: GFRGASPHR (KKLC1_HUMAN)
GSRGASPHI

SEQ ID NO: 40691 - protein, 10 aa, Artificial Sequence
  Description of Artificial Sequence: Synthetic peptide
  Seed: LLASSILCAL (KKLC1_HUMAN)
LQASSILCAY

SEQ ID NO: 40692 - protein, 9 aa, Artificial Sequence
  Description of Artificial Sequence: Synthetic peptide
  Seed: RQKRILVNL (KKLC1_HUMAN)
RWKRILVNV

SEQ ID NO: 40693 - protein, 9 aa, Artificial Sequence
  Description of Artificial Sequence: Synthetic peptide
  Seed: RQKRILVNL (KKLC1_HUMAN)
RYKRILVNM

SEQ ID NO: 40694 - protein, 9 aa, Artificial Sequence
  Description of Artificial Sequence: Synthetic peptide
  Seed: RQKRILVNL (KKLC1_HUMAN)
RGKRILVNY

SEQ ID NO: 40695 - protein, 9 aa, Artificial Sequence
  Description of Artificial Sequence: Synthetic peptide
  Seed: KRILVNLSM (KKLC1_HUMAN)
KAILVNLSM

SEQ ID NO: 40696 - protein, 9 aa, Artificial Sequence
  Description of Artificial Sequence: Synthetic peptide
  Seed: KGFRGASPH (KKLC1_HUMAN)
KQFRGASPC

SEQ ID NO: 40697 - protein, 9 aa, Artificial Sequence
  Description of Artificial Sequence: Synthetic peptide
  Seed: KLVELEHTL (KKLC1_HUMAN)
KWVELEHTF

SEQ ID NO: 40698 - protein, 8 aa, Artificial Sequence
  Description of Artificial Sequence: Synthetic peptide
  Seed: VYDLSRDI (KKLC1_HUMAN)
VADLSRDV

SEQ ID NO: 40699 - protein, 9 aa, Artificial Sequence
  Description of Artificial Sequence: Synthetic peptide
  Seed: RRFQRNTGE (KKLC1_HUMAN)
RRFQRNTGL

SEQ ID NO: 40700 - protein, 9 aa, Artificial Sequence
  Description of Artificial Sequence: Synthetic peptide
  Seed: SSNSTALAL (KKLC1_HUMAN)
SFNSTALAL

SEQ ID NO: 40701 - protein, 11 aa, Artificial Sequence
  Description of Artificial Sequence: Synthetic peptide
  Seed: RQKRILVNLSM (KKLC1_HUMAN)
RSKRILVNLSL

SEQ ID NO: 40702 - protein, 9 aa, Artificial Sequence
  Description of Artificial Sequence: Synthetic peptide
  Seed: YLLLASSIL (KKLC1_HUMAN)
YPLLASSII

SEQ ID NO: 40703 - protein, 9 aa, Artificial Sequence
  Description of Artificial Sequence: Synthetic peptide
  Seed: NTDNNLAVY (KKLC1_HUMAN)
NLDNNLAVF

SEQ ID NO: 40704 - protein, 11 aa, Artificial Sequence
  Description of Artificial Sequence: Synthetic peptide
  Seed: KGFRGASPHRK (KKLC1_HUMAN)
KMFRGASPHRK

SEQ ID NO: 40705 - protein, 10 aa, Artificial Sequence
  Description of Artificial Sequence: Synthetic peptide
  Seed: SSNSTALALV (KKLC1_HUMAN)
SLNSTALALA

SEQ ID NO: 40706 - protein, 10 aa, Artificial Sequence
  Description of Artificial Sequence: Synthetic peptide
  Seed: LLLASSILCA (KKLC1_HUMAN)
LVLASSILCV

SEQ ID NO: 40707 - protein, 9 aa, Artificial Sequence
  Description of Artificial Sequence: Synthetic peptide
  Seed: KGFRGASPH (KKLC1_HUMAN)
KMFRGASPF

SEQ ID NO: 40708 - protein, 11 aa, Artificial Sequence
  Description of Artificial Sequence: Synthetic peptide
  Seed: MNFYLLLASSI (KKLC1_HUMAN)
MFFYLLLASSF

SEQ ID NO: 40709 - protein, 9 aa, Artificial Sequence
  Description of Artificial Sequence: Synthetic peptide
  Seed: KLVELEHTL (KKLC1_HUMAN)
KAVELEHTI

SEQ ID NO: 40710 - protein, 10 aa, Artificial Sequence
  Description of Artificial Sequence: Synthetic peptide
  Seed: LNNFPHSIAR (KKLC1_HUMAN)
LTNFPHSIAK

SEQ ID NO: 40711 - protein, 10 aa, Artificial Sequence
  Description of Artificial Sequence: Synthetic peptide
  Seed: SSNSTALALV (KKLC1_HUMAN)
SQNSTALALV

SEQ ID NO: 40712 - protein, 9 aa, Artificial Sequence
  Description of Artificial Sequence: Synthetic peptide
  Seed: KGFRGASPH (KKLC1_HUMAN)
KYFRGASPM

SEQ ID NO: 40713 - protein, 9 aa, Artificial Sequence
  Description of Artificial Sequence: Synthetic peptide
  Seed: LVRPSSSGL (KKLC1_HUMAN)
LLRPSSSGK

SEQ ID NO: 40714 - protein, 9 aa, Artificial Sequence
  Description of Artificial Sequence: Synthetic peptide
  Seed: KYRRFQRNT (KKLC1_HUMAN)
KWRRFQRNI

SEQ ID NO: 40715 - protein, 11 aa, Artificial Sequence
  Description of Artificial Sequence: Synthetic peptide
  Seed: RQKRILVNLSM (KKLC1_HUMAN)
RPKRILVNLSK

SEQ ID NO: 40716 - protein, 9 aa, Artificial Sequence
  Description of Artificial Sequence: Synthetic peptide
  Seed: KYRRFQRNT (KKLC1_HUMAN)
KLRRFQRNK

SEQ ID NO: 40717 - protein, 9 aa, Artificial Sequence
  Description of Artificial Sequence: Synthetic peptide
  Seed: IARQKRILV (KKLC1_HUMAN)
IARQKRILM

SEQ ID NO: 40718 - protein, 8 aa, Artificial Sequence
  Description of Artificial Sequence: Synthetic peptide
  Seed: RPSSSGLI (KKLC1_HUMAN)
RPSSSGLM

SEQ ID NO: 40719 - protein, 9 aa, Artificial Sequence
  Description of Artificial Sequence: Synthetic peptide
  Seed: KLVELEHTL (KKLC1_HUMAN)
KWVELEHTW

SEQ ID NO: 40720 - protein, 9 aa, Artificial Sequence
  Description of Artificial Sequence: Synthetic peptide
  Seed: NTDNNLAVY (KKLC1_HUMAN)
NSDNNLAVI

SEQ ID NO: 40721 - protein, 9 aa, Artificial Sequence
  Description of Artificial Sequence: Synthetic peptide
  Seed: YLLLASSIL (KKLC1_HUMAN)
YILLASSIL

SEQ ID NO: 40722 - protein, 9 aa, Artificial Sequence
  Description of Artificial Sequence: Synthetic peptide
  Seed: SILCALIVF (KKLC1_HUMAN)
SQLCALIVY

SEQ ID NO: 40723 - protein, 9 aa, Artificial Sequence
  Description of Artificial Sequence: Synthetic peptide
  Seed: RQKRILVNL (KKLC1_HUMAN)
RMKRILVNS

SEQ ID NO: 40724 - protein, 11 aa, Artificial Sequence
  Description of Artificial Sequence: Synthetic peptide
  Seed: RQKRILVNLSM (KKLC1_HUMAN)
RQKRILVNLSY

SEQ ID NO: 40725 - protein, 10 aa, Artificial Sequence
  Description of Artificial Sequence: Synthetic peptide
  Seed: MSSNSTALAL (KKLC1_HUMAN)
MISNSTALAF

SEQ ID NO: 40726 - protein, 10 aa, Artificial Sequence
  Description of Artificial Sequence: Synthetic peptide
  Seed: RRFQRNTGEM (KKLC1_HUMAN)
RFFQRNTGEM

SEQ ID NO: 40727 - protein, 10 aa, Artificial Sequence
  Description of Artificial Sequence: Synthetic peptide
  Seed: ALVRPSSSGL (KKLC1_HUMAN)
AHVRPSSSGK

SEQ ID NO: 40728 - protein, 10 aa, Artificial Sequence
  Description of Artificial Sequence: Synthetic peptide
  Seed: LASSILCALI (KKLC1_HUMAN)
LTSSILCALL

SEQ ID NO: 40729 - protein, 9 aa, Artificial Sequence
  Description of Artificial Sequence: Synthetic peptide
  Seed: NNFPHSIAR (KKLC1_HUMAN)
NGFPHSIAM

SEQ ID NO: 40730 - protein, 9 aa, Artificial Sequence
  Description of Artificial Sequence: Synthetic peptide
  Seed: LASSILCAL (KKLC1_HUMAN)
LPSSILCAI

SEQ ID NO: 40731 - protein, 9 aa, Artificial Sequence
  Description of Artificial Sequence: Synthetic peptide
  Seed: KLVELEHTL (KKLC1_HUMAN)
KSVELEHTR

SEQ ID NO: 40732 - protein, 8 aa, Artificial Sequence
  Description of Artificial Sequence: Synthetic peptide
  Seed: NTDNNLAV (KKLC1_HUMAN)
NFDNNLAM

SEQ ID NO: 40733 - protein, 9 aa, Artificial Sequence
  Description of Artificial Sequence: Synthetic peptide
  Seed: KYRRFQRNT (KKLC1_HUMAN)
KFRRFQRNA

SEQ ID NO: 40734 - protein, 10 aa, Artificial Sequence
  Description of Artificial Sequence: Synthetic peptide
  Seed: KGFRGASPHR (KKLC1_HUMAN)
KNFRGASPHR

SEQ ID NO: 40735 - protein, 9 aa, Artificial Sequence
  Description of Artificial Sequence: Synthetic peptide
  Seed: RQKRILVNL (KKLC1_HUMAN)
RTKRILVNV

SEQ ID NO: 40736 - protein, 9 aa, Artificial Sequence
  Description of Artificial Sequence: Synthetic peptide
  Seed: YLLLASSIL (KKLC1_HUMAN)
YLLLASSIY

SEQ ID NO: 40737 - protein, 11 aa, Artificial Sequence
  Description of Artificial Sequence: Synthetic peptide
  Seed: IVFWKYRRFQR (KKLC1_HUMAN)
ISFWKYRRFQK

SEQ ID NO: 40738 - protein, 10 aa, Artificial Sequence
  Description of Artificial Sequence: Synthetic peptide
  Seed: QKRILVNLSM (KKLC1_HUMAN)
QPRILVNLSL

SEQ ID NO: 40739 - protein, 10 aa, Artificial Sequence
  Description of Artificial Sequence: Synthetic peptide
  Seed: SMVENKLVEL (KKLC1_HUMAN)
SLVENKLVEI

SEQ ID NO: 40740 - protein, 10 aa, Artificial Sequence
  Description of Artificial Sequence: Synthetic peptide
  Seed: EMSSNSTALA (KKLC1_HUMAN)
EASSNSTALV

SEQ ID NO: 40741 - protein, 9 aa, Artificial Sequence
  Description of Artificial Sequence: Synthetic peptide
  Seed: RQKRILVNL (KKLC1_HUMAN)
RTKRILVNC

SEQ ID NO: 40742 - protein, 9 aa, Artificial Sequence
  Description of Artificial Sequence: Synthetic peptide
  Seed: NLAVYDLSR (KKLC1_HUMAN)
NAAVYDLSK

SEQ ID NO: 40743 - protein, 10 aa, Artificial Sequence
  Description of Artificial Sequence: Synthetic peptide
  Seed: GEMSSNSTAL (KKLC1_HUMAN)
GMMSSNSTAF

SEQ ID NO: 40744 - protein, 9 aa, Artificial Sequence
  Description of Artificial Sequence: Synthetic peptide
  Seed: KYRRFQRNT (KKLC1_HUMAN)
KLRRFQRNV

SEQ ID NO: 40745 - protein, 9 aa, Artificial Sequence
  Description of Artificial Sequence: Synthetic peptide
  Seed: RQKRILVNL (KKLC1_HUMAN)
RIKRILVNI

SEQ ID NO: 40746 - protein, 11 aa, Artificial Sequence
  Description of Artificial Sequence: Synthetic peptide
  Seed: KLVELEHTLLS (KKLC1_HUMAN)
KLVELEHTLLL

SEQ ID NO: 40747 - protein, 9 aa, Artificial Sequence
  Description of Artificial Sequence: Synthetic peptide
  Seed: VELEHTLLS (KKLC1_HUMAN)
VELEHTLLF

SEQ ID NO: 40748 - protein, 9 aa, Artificial Sequence
  Description of Artificial Sequence: Synthetic peptide
  Seed: LVRPSSSGL (KKLC1_HUMAN)
LARPSSSGM

SEQ ID NO: 40749 - protein, 11 aa, Artificial Sequence
  Description of Artificial Sequence: Synthetic peptide
  Seed: RDILNNFPHSI (KKLC1_HUMAN)
RCILNNFPHSV

SEQ ID NO: 40750 - protein, 8 aa, Artificial Sequence
  Description of Artificial Sequence: Synthetic peptide
  Seed: MSSNSTAL (KKLC1_HUMAN)
MASNSTAL

SEQ ID NO: 40751 - protein, 11 aa, Artificial Sequence
  Description of Artificial Sequence: Synthetic peptide
  Seed: RQKRILVNLSM (KKLC1_HUMAN)
RLKRILVNLSK

SEQ ID NO: 40752 - protein, 9 aa, Artificial Sequence
  Description of Artificial Sequence: Synthetic peptide
  Seed: RQKRILVNL (KKLC1_HUMAN)
RIKRILVNL

SEQ ID NO: 40753 - protein, 9 aa, Artificial Sequence
  Description of Artificial Sequence: Synthetic peptide
  Seed: KLVELEHTL (KKLC1_HUMAN)
KIVELEHTA

SEQ ID NO: 40754 - protein, 8 aa, Artificial Sequence
  Description of Artificial Sequence: Synthetic peptide
  Seed: VYDLSRDI (KKLC1_HUMAN)
VSDLSRDV

SEQ ID NO: 40755 - protein, 11 aa, Artificial Sequence
  Description of Artificial Sequence: Synthetic peptide
  Seed: RQKRILVNLSM (KKLC1_HUMAN)
RTKRILVNLSK

SEQ ID NO: 40756 - protein, 11 aa, Artificial Sequence
  Description of Artificial Sequence: Synthetic peptide
  Seed: RQKRILVNLSM (KKLC1_HUMAN)
RFKRILVNLSR

SEQ ID NO: 40757 - protein, 11 aa, Artificial Sequence
  Description of Artificial Sequence: Synthetic peptide
  Seed: YLLLASSILCA (KKLC1_HUMAN)
YMLLASSILCL

SEQ ID NO: 40758 - protein, 10 aa, Artificial Sequence
  Description of Artificial Sequence: Synthetic peptide
  Seed: LLASSILCAL (KKLC1_HUMAN)
LQASSILCAV

SEQ ID NO: 40759 - protein, 10 aa, Artificial Sequence
  Description of Artificial Sequence: Synthetic peptide
  Seed: QKRILVNLSM (KKLC1_HUMAN)
QSRILVNLSM

SEQ ID NO: 40760 - protein, 10 aa, Artificial Sequence
  Description of Artificial Sequence: Synthetic peptide
  Seed: TGEMSSNSTA (KKLC1_HUMAN)
TAEMSSNSTA

SEQ ID NO: 40761 - protein, 10 aa, Artificial Sequence
  Description of Artificial Sequence: Synthetic peptide
  Seed: NFYLLLASSI (KKLC1_HUMAN)
NIYLLLASSF

SEQ ID NO: 40762 - protein, 11 aa, Artificial Sequence
  Description of Artificial Sequence: Synthetic peptide
  Seed: YLLLASSILCA (KKLC1_HUMAN)
YRLLASSILCV

SEQ ID NO: 40763 - protein, 9 aa, Artificial Sequence
  Description of Artificial Sequence: Synthetic peptide
  Seed: ASSILCALI (KKLC1_HUMAN)
ATSILCALV

SEQ ID NO: 40764 - protein, 10 aa, Artificial Sequence
  Description of Artificial Sequence: Synthetic peptide
  Seed: KGFRGASPHR (KKLC1_HUMAN)
KIFRGASPHR

SEQ ID NO: 40765 - protein, 9 aa, Artificial Sequence
  Description of Artificial Sequence: Synthetic peptide
  Seed: RILVNLSMV (KKLC1_HUMAN)
RLLVNLSMW

SEQ ID NO: 40766 - protein, 9 aa, Artificial Sequence
  Description of Artificial Sequence: Synthetic peptide
  Seed: NNFPHSIAR (KKLC1_HUMAN)
NSFPHSIAL

SEQ ID NO: 40767 - protein, 8 aa, Artificial Sequence
  Description of Artificial Sequence: Synthetic peptide
  Seed: NTDNNLAV (KKLC1_HUMAN)
NFDNNLAI

SEQ ID NO: 40768 - protein, 10 aa, Artificial Sequence
  Description of Artificial Sequence: Synthetic peptide
  Seed: MSSNSTALAL (KKLC1_HUMAN)
MISNSTALAL

SEQ ID NO: 40769 - protein, 9 aa, Artificial Sequence
  Description of Artificial Sequence: Synthetic peptide
  Seed: NNFPHSIAR (KKLC1_HUMAN)
NYFPHSIAK

SEQ ID NO: 40770 - protein, 9 aa, Artificial Sequence
  Description of Artificial Sequence: Synthetic peptide
  Seed: IARQKRILV (KKLC1_HUMAN)
ISRQKRILW

SEQ ID NO: 40771 - protein, 10 aa, Artificial Sequence
  Description of Artificial Sequence: Synthetic peptide
  Seed: ALVRPSSSGL (KKLC1_HUMAN)
AAVRPSSSGK

SEQ ID NO: 40772 - protein, 9 aa, Artificial Sequence
  Description of Artificial Sequence: Synthetic peptide
  Seed: ILNNFPHSI (KKLC1_HUMAN)
ISNNFPHSF

SEQ ID NO: 40773 - protein, 9 aa, Artificial Sequence
  Description of Artificial Sequence: Synthetic peptide
  Seed: RQKRILVNL (KKLC1_HUMAN)
RRKRILVNL

SEQ ID NO: 40774 - protein, 9 aa, Artificial Sequence
  Description of Artificial Sequence: Synthetic peptide
  Seed: GASPHRKST (KKLC1_HUMAN)
GSSPHRKSY

SEQ ID NO: 40775 - protein, 9 aa, Artificial Sequence
  Description of Artificial Sequence: Synthetic peptide
  Seed: MSSNSTALA (KKLC1_HUMAN)
MISNSTALL

SEQ ID NO: 40776 - protein, 10 aa, Artificial Sequence
  Description of Artificial Sequence: Synthetic peptide
  Seed: ILCALIVFWK (KKLC1_HUMAN)
IFCALIVFWR

SEQ ID NO: 40777 - protein, 9 aa, Artificial Sequence
  Description of Artificial Sequence: Synthetic peptide
  Seed: IARQKRILV (KKLC1_HUMAN)
ILRQKRILK

SEQ ID NO: 40778 - protein, 9 aa, Artificial Sequence
  Description of Artificial Sequence: Synthetic peptide
  Seed: SILCALIVF (KKLC1_HUMAN)
SVLCALIVF

SEQ ID NO: 40779 - protein, 9 aa, Artificial Sequence
  Description of Artificial Sequence: Synthetic peptide
  Seed: VYDLSRDIL (KKLC1_HUMAN)
VTDLSRDIL

SEQ ID NO: 40780 - protein, 9 aa, Artificial Sequence
  Description of Artificial Sequence: Synthetic peptide
  Seed: IARQKRILV (KKLC1_HUMAN)
IMRQKRILL

SEQ ID NO: 40781 - protein, 10 aa, Artificial Sequence
  Description of Artificial Sequence: Synthetic peptide
  Seed: RRFQRNTGEM (KKLC1_HUMAN)
RHFQRNTGEF

SEQ ID NO: 40782 - protein, 9 aa, Artificial Sequence
  Description of Artificial Sequence: Synthetic peptide
  Seed: MVENKLVEL (KKLC1_HUMAN)
MSENKLVEM

SEQ ID NO: 40783 - protein, 11 aa, Artificial Sequence
  Description of Artificial Sequence: Synthetic peptide
  Seed: YLLLASSILCA (KKLC1_HUMAN)
YVLLASSILCV

SEQ ID NO: 40784 - protein, 9 aa, Artificial Sequence
  Description of Artificial Sequence: Synthetic peptide
  Seed: KRILVNLSM (KKLC1_HUMAN)
KQILVNLSY

SEQ ID NO: 40785 - protein, 8 aa, Artificial Sequence
  Description of Artificial Sequence: Synthetic peptide
  Seed: VYDLSRDI (KKLC1_HUMAN)
VTDLSRDF

SEQ ID NO: 40786 - protein, 11 aa, Artificial Sequence
  Description of Artificial Sequence: Synthetic peptide
  Seed: RQKRILVNLSM (KKLC1_HUMAN)
RGKRILVNLSM

SEQ ID NO: 40787 - protein, 10 aa, Artificial Sequence
  Description of Artificial Sequence: Synthetic peptide
  Seed: KGFRGASPHR (KKLC1_HUMAN)
KEFRGASPHA

SEQ ID NO: 40788 - protein, 10 aa, Artificial Sequence
  Description of Artificial Sequence: Synthetic peptide
  Seed: KYRRFQRNTG (KKLC1_HUMAN)
KYRRFQRNTK

SEQ ID NO: 40789 - protein, 9 aa, Artificial Sequence
  Description of Artificial Sequence: Synthetic peptide
  Seed: LASSILCAL (KKLC1_HUMAN)
LVSSILCAF

SEQ ID NO: 40790 - protein, 10 aa, Artificial Sequence
  Description of Artificial Sequence: Synthetic peptide
  Seed: LLASSILCAL (KKLC1_HUMAN)
LMASSILCAM

SEQ ID NO: 40791 - protein, 10 aa, Artificial Sequence
  Description of Artificial Sequence: Synthetic peptide
  Seed: MSSNSTALAL (KKLC1_HUMAN)
MCSNSTALAM

SEQ ID NO: 40792 - protein, 9 aa, Artificial Sequence
  Description of Artificial Sequence: Synthetic peptide
  Seed: VELEHTLLS (KKLC1_HUMAN)
VELEHTLLL

SEQ ID NO: 40793 - protein, 10 aa, Artificial Sequence
  Description of Artificial Sequence: Synthetic peptide
  Seed: LLASSILCAL (KKLC1_HUMAN)
LIASSILCAV

SEQ ID NO: 40794 - protein, 10 aa, Artificial Sequence
  Description of Artificial Sequence: Synthetic peptide
  Seed: MSSNSTALAL (KKLC1_HUMAN)
MLSNSTALAY

SEQ ID NO: 40795 - protein, 9 aa, Artificial Sequence
  Description of Artificial Sequence: Synthetic peptide
  Seed: KGFRGASPH (KKLC1_HUMAN)
KQFRGASPM

SEQ ID NO: 40796 - protein, 11 aa, Artificial Sequence
  Description of Artificial Sequence: Synthetic peptide
  Seed: NSNTDNNLAVY (KKLC1_HUMAN)
NYNTDNNLAVY

SEQ ID NO: 40797 - protein, 10 aa, Artificial Sequence
  Description of Artificial Sequence: Synthetic peptide
  Seed: KLVELEHTLL (KKLC1_HUMAN)
KTVELEHTLR

SEQ ID NO: 40798 - protein, 9 aa, Artificial Sequence
  Description of Artificial Sequence: Synthetic peptide
  Seed: KYRRFQRNT (KKLC1_HUMAN)
KLRRFQRNS

SEQ ID NO: 40799 - protein, 9 aa, Artificial Sequence
  Description of Artificial Sequence: Synthetic peptide
  Seed: RQKRILVNL (KKLC1_HUMAN)
RMKRILVNK

SEQ ID NO: 40800 - protein, 10 aa, Artificial Sequence
  Description of Artificial Sequence: Synthetic peptide
  Seed: KGFRGASPHR (KKLC1_HUMAN)
KTFRGASPHK

SEQ ID NO: 40801 - protein, 9 aa, Artificial Sequence
  Description of Artificial Sequence: Synthetic peptide
  Seed: ASSILCALI (KKLC1_HUMAN)
AMSILCALL

SEQ ID NO: 40802 - protein, 9 aa, Artificial Sequence
  Description of Artificial Sequence: Synthetic peptide
  Seed: SNTDNNLAV (KKLC1_HUMAN)
SVTDNNLAM

SEQ ID NO: 40803 - protein, 10 aa, Artificial Sequence
  Description of Artificial Sequence: Synthetic peptide
  Seed: MSSNSTALAL (KKLC1_HUMAN)
MCSNSTALAW

SEQ ID NO: 40804 - protein, 9 aa, Artificial Sequence
  Description of Artificial Sequence: Synthetic peptide
  Seed: LVRPSSSGL (KKLC1_HUMAN)
LARPSSSGF

SEQ ID NO: 40805 - protein, 9 aa, Artificial Sequence
  Description of Artificial Sequence: Synthetic peptide
  Seed: VYDLSRDIL (KKLC1_HUMAN)
VVDLSRDIM

SEQ ID NO: 40806 - protein, 9 aa, Artificial Sequence
  Description of Artificial Sequence: Synthetic peptide
  Seed: KRILVNLSM (KKLC1_HUMAN)
KEILVNLSF

SEQ ID NO: 40807 - protein, 10 aa, Artificial Sequence
  Description of Artificial Sequence: Synthetic peptide
  Seed: KYRRFQRNTG (KKLC1_HUMAN)
KTRRFQRNTR

SEQ ID NO: 40808 - protein, 9 aa, Artificial Sequence
  Description of Artificial Sequence: Synthetic peptide
  Seed: MSSNSTALA (KKLC1_HUMAN)
MSSNSTALF

SEQ ID NO: 40809 - protein, 9 aa, Artificial Sequence
  Description of Artificial Sequence: Synthetic peptide
  Seed: LVRPSSSGL (KKLC1_HUMAN)
LQRPSSSGK

SEQ ID NO: 40810 - protein, 9 aa, Artificial Sequence
  Description of Artificial Sequence: Synthetic peptide
  Seed: KLVELEHTL (KKLC1_HUMAN)
KHVELEHTV

SEQ ID NO: 40811 - protein, 9 aa, Artificial Sequence
  Description of Artificial Sequence: Synthetic peptide
  Seed: LLSKGFRGA (KKLC1_HUMAN)
LISKGFRGV

SEQ ID NO: 40812 - protein, 10 aa, Artificial Sequence
  Description of Artificial Sequence: Synthetic peptide
  Seed: YLLLASSILC (KKLC1_HUMAN)
YALLASSILL

SEQ ID NO: 40813 - protein, 9 aa, Artificial Sequence
  Description of Artificial Sequence: Synthetic peptide
  Seed: SNSTALALV (KKLC1_HUMAN)
SMSTALALM

SEQ ID NO: 40814 - protein, 10 aa, Artificial Sequence
  Description of Artificial Sequence: Synthetic peptide
  Seed: YLLLASSILC (KKLC1_HUMAN)
YPLLASSILL

SEQ ID NO: 40815 - protein, 9 aa, Artificial Sequence
  Description of Artificial Sequence: Synthetic peptide
  Seed: NLSMVENKL (KKLC1_HUMAN)
NLSMVENKV

SEQ ID NO: 40816 - protein, 10 aa, Artificial Sequence
  Description of Artificial Sequence: Synthetic peptide
  Seed: YLLLASSILC (KKLC1_HUMAN)
YWLLASSILI

SEQ ID NO: 40817 - protein, 9 aa, Artificial Sequence
  Description of Artificial Sequence: Synthetic peptide
  Seed: HSIARQKRI (KKLC1_HUMAN)
HSIARQKRF

SEQ ID NO: 40818 - protein, 8 aa, Artificial Sequence
  Description of Artificial Sequence: Synthetic peptide
  Seed: FQRNTGEM (KKLC1_HUMAN)
FMRNTGEY

SEQ ID NO: 40819 - protein, 9 aa, Artificial Sequence
  Description of Artificial Sequence: Synthetic peptide
  Seed: KYRRFQRNT (KKLC1_HUMAN)
KARRFQRNA

SEQ ID NO: 40820 - protein, 10 aa, Artificial Sequence
  Description of Artificial Sequence: Synthetic peptide
  Seed: QKRILVNLSM (KKLC1_HUMAN)
QYRILVNLSV

SEQ ID NO: 40821 - protein, 9 aa, Artificial Sequence
  Description of Artificial Sequence: Synthetic peptide
  Seed: ILCALIVFW (KKLC1_HUMAN)
IQCALIVFL

SEQ ID NO: 40822 - protein, 9 aa, Artificial Sequence
  Description of Artificial Sequence: Synthetic peptide
  Seed: YLLLASSIL (KKLC1_HUMAN)
YYLLASSIL

SEQ ID NO: 40823 - protein, 10 aa, Artificial Sequence
  Description of Artificial Sequence: Synthetic peptide
  Seed: RQKRILVNLS (KKLC1_HUMAN)
RTKRILVNLY

SEQ ID NO: 40824 - protein, 11 aa, Artificial Sequence
  Description of Artificial Sequence: Synthetic peptide
  Seed: NNFPHSIARQK (KKLC1_HUMAN)
NVFPHSIARQR

SEQ ID NO: 40825 - protein, 10 aa, Artificial Sequence
  Description of Artificial Sequence: Synthetic peptide
  Seed: SSILCALIVF (KKLC1_HUMAN)
SHILCALIVY

SEQ ID NO: 40826 - protein, 10 aa, Artificial Sequence
  Description of Artificial Sequence: Synthetic peptide
  Seed: RRFQRNTGEM (KKLC1_HUMAN)
RRFQRNTGEK

SEQ ID NO: 40827 - protein, 10 aa, Artificial Sequence
  Description of Artificial Sequence: Synthetic peptide
  Seed: DILNNFPHSI (KKLC1_HUMAN)
DFLNNFPHSV

SEQ ID NO: 40828 - protein, 11 aa, Artificial Sequence
  Description of Artificial Sequence: Synthetic peptide
  Seed: LSMVENKLVEL (KKLC1_HUMAN)
LMMVENKLVEV

SEQ ID NO: 40829 - protein, 9 aa, Artificial Sequence
  Description of Artificial Sequence: Synthetic peptide
  Seed: RILVNLSMV (KKLC1_HUMAN)
RMLVNLSMF

SEQ ID NO: 40830 - protein, 11 aa, Artificial Sequence
  Description of Artificial Sequence: Synthetic peptide
  Seed: RQKRILVNLSM (KKLC1_HUMAN)
RFKRILVNLSK

SEQ ID NO: 40831 - protein, 10 aa, Artificial Sequence
  Description of Artificial Sequence: Synthetic peptide
  Seed: NFYLLLASSI (KKLC1_HUMAN)
NVYLLLASSF

SEQ ID NO: 40832 - protein, 10 aa, Artificial Sequence
  Description of Artificial Sequence: Synthetic peptide
  Seed: RRFQRNTGEM (KKLC1_HUMAN)
RYFQRNTGEM

SEQ ID NO: 40833 - protein, 9 aa, Artificial Sequence
  Description of Artificial Sequence: Synthetic peptide
  Seed: ILNNFPHSI (KKLC1_HUMAN)
ISNNFPHSL

SEQ ID NO: 40834 - protein, 9 aa, Artificial Sequence
  Description of Artificial Sequence: Synthetic peptide
  Seed: ILNNFPHSI (KKLC1_HUMAN)
IINNFPHSL

SEQ ID NO: 40835 - protein, 10 aa, Artificial Sequence
  Description of Artificial Sequence: Synthetic peptide
  Seed: KGFRGASPHR (KKLC1_HUMAN)
KNFRGASPHK

SEQ ID NO: 40836 - protein, 10 aa, Artificial Sequence
  Description of Artificial Sequence: Synthetic peptide
  Seed: KGFRGASPHR (KKLC1_HUMAN)
KSFRGASPHM

SEQ ID NO: 40837 - protein, 11 aa, Artificial Sequence
  Description of Artificial Sequence: Synthetic peptide
  Seed: YLLLASSILCA (KKLC1_HUMAN)
YCLLASSILCL

SEQ ID NO: 40838 - protein, 10 aa, Artificial Sequence
  Description of Artificial Sequence: Synthetic peptide
  Seed: ILCALIVFWK (KKLC1_HUMAN)
IICALIVFWR

SEQ ID NO: 40839 - protein, 10 aa, Artificial Sequence
  Description of Artificial Sequence: Synthetic peptide
  Seed: RRFQRNTGEM (KKLC1_HUMAN)
RRFQRNTGEI

SEQ ID NO: 40840 - protein, 9 aa, Artificial Sequence
  Description of Artificial Sequence: Synthetic peptide
  Seed: NNFPHSIAR (KKLC1_HUMAN)
NSFPHSIAV

SEQ ID NO: 40841 - protein, 9 aa, Artificial Sequence
  Description of Artificial Sequence: Synthetic peptide
  Seed: KLVELEHTL (KKLC1_HUMAN)
KNVELEHTL

SEQ ID NO: 40842 - protein, 11 aa, Artificial Sequence
  Description of Artificial Sequence: Synthetic peptide
  Seed: RQKRILVNLSM (KKLC1_HUMAN)
RCKRILVNLSL

SEQ ID NO: 40843 - protein, 9 aa, Artificial Sequence
  Description of Artificial Sequence: Synthetic peptide
  Seed: NTDNNLAVY (KKLC1_HUMAN)
NFDNNLAVV

SEQ ID NO: 40844 - protein, 9 aa, Artificial Sequence
  Description of Artificial Sequence: Synthetic peptide
  Seed: RQKRILVNL (KKLC1_HUMAN)
RFKRILVNI

SEQ ID NO: 40845 - protein, 9 aa, Artificial Sequence
  Description of Artificial Sequence: Synthetic peptide
  Seed: KGFRGASPH (KKLC1_HUMAN)
KRFRGASPL

SEQ ID NO: 40846 - protein, 9 aa, Artificial Sequence
  Description of Artificial Sequence: Synthetic peptide
  Seed: MVENKLVEL (KKLC1_HUMAN)
MQENKLVEI

SEQ ID NO: 40847 - protein, 9 aa, Artificial Sequence
  Description of Artificial Sequence: Synthetic peptide
  Seed: KYRRFQRNT (KKLC1_HUMAN)
KVRRFQRNP

SEQ ID NO: 40848 - protein, 9 aa, Artificial Sequence
  Description of Artificial Sequence: Synthetic peptide
  Seed: NTDNNLAVY (KKLC1_HUMAN)
NIDNNLAVI

SEQ ID NO: 40849 - protein, 9 aa, Artificial Sequence
  Description of Artificial Sequence: Synthetic peptide
  Seed: YLLLASSIL (KKLC1_HUMAN)
YSLLASSIL

SEQ ID NO: 40850 - protein, 9 aa, Artificial Sequence
  Description of Artificial Sequence: Synthetic peptide
  Seed: KGFRGASPH (KKLC1_HUMAN)
KMFRGASPH

SEQ ID NO: 40851 - protein, 9 aa, Artificial Sequence
  Description of Artificial Sequence: Synthetic peptide
  Seed: KGFRGASPH (KKLC1_HUMAN)
KSFRGASPY

SEQ ID NO: 40852 - protein, 10 aa, Artificial Sequence
  Description of Artificial Sequence: Synthetic peptide
  Seed: LLLASSILCA (KKLC1_HUMAN)
LCLASSILCV

SEQ ID NO: 40853 - protein, 10 aa, Artificial Sequence
  Description of Artificial Sequence: Synthetic peptide
  Seed: QKRILVNLSM (KKLC1_HUMAN)
QHRILVNLSI

SEQ ID NO: 40854 - protein, 11 aa, Artificial Sequence
  Description of Artificial Sequence: Synthetic peptide
  Seed: RQKRILVNLSM (KKLC1_HUMAN)
RSKRILVNLSV

SEQ ID NO: 40855 - protein, 9 aa, Artificial Sequence
  Description of Artificial Sequence: Synthetic peptide
  Seed: NNFPHSIAR (KKLC1_HUMAN)
NMFPHSIAY

SEQ ID NO: 40856 - protein, 10 aa, Artificial Sequence
  Description of Artificial Sequence: Synthetic peptide
  Seed: MSSNSTALAL (KKLC1_HUMAN)
MASNSTALAL

SEQ ID NO: 40857 - protein, 9 aa, Artificial Sequence
  Description of Artificial Sequence: Synthetic peptide
  Seed: IARQKRILV (KKLC1_HUMAN)
IVRQKRILK

SEQ ID NO: 40858 - protein, 9 aa, Artificial Sequence
  Description of Artificial Sequence: Synthetic peptide
  Seed: GFRGASPHR (KKLC1_HUMAN)
GTRGASPHI

SEQ ID NO: 40859 - protein, 9 aa, Artificial Sequence
  Description of Artificial Sequence: Synthetic peptide
  Seed: MSSNSTALA (KKLC1_HUMAN)
MVSNSTALV

SEQ ID NO: 40860 - protein, 9 aa, Artificial Sequence
  Description of Artificial Sequence: Synthetic peptide
  Seed: LASSILCAL (KKLC1_HUMAN)
LPSSILCAH

SEQ ID NO: 40861 - protein, 9 aa, Artificial Sequence
  Description of Artificial Sequence: Synthetic peptide
  Seed: RQKRILVNL (KKLC1_HUMAN)
RFKRILVNL

SEQ ID NO: 40862 - protein, 8 aa, Artificial Sequence
  Description of Artificial Sequence: Synthetic peptide
  Seed: NTDNNLAV (KKLC1_HUMAN)
NYDNNLAF

SEQ ID NO: 40863 - protein, 9 aa, Artificial Sequence
  Description of Artificial Sequence: Synthetic peptide
  Seed: MSSNSTALA (KKLC1_HUMAN)
MVSNSTALL

SEQ ID NO: 40864 - protein, 10 aa, Artificial Sequence
  Description of Artificial Sequence: Synthetic peptide
  Seed: LLLASSILCA (KKLC1_HUMAN)
LNLASSILCV

SEQ ID NO: 40865 - protein, 9 aa, Artificial Sequence
  Description of Artificial Sequence: Synthetic peptide
  Seed: YLLLASSIL (KKLC1_HUMAN)
YILLASSIY

SEQ ID NO: 40866 - protein, 9 aa, Artificial Sequence
  Description of Artificial Sequence: Synthetic peptide
  Seed: YLLLASSIL (KKLC1_HUMAN)
YTLLASSIY

SEQ ID NO: 40867 - protein, 9 aa, Artificial Sequence
  Description of Artificial Sequence: Synthetic peptide
  Seed: RQKRILVNL (KKLC1_HUMAN)
RWKRILVNA

SEQ ID NO: 40868 - protein, 9 aa, Artificial Sequence
  Description of Artificial Sequence: Synthetic peptide
  Seed: NNFPHSIAR (KKLC1_HUMAN)
NSFPHSIAI

SEQ ID NO: 40869 - protein, 10 aa, Artificial Sequence
  Description of Artificial Sequence: Synthetic peptide
  Seed: ILCALIVFWK (KKLC1_HUMAN)
IFCALIVFWK

SEQ ID NO: 40870 - protein, 9 aa, Artificial Sequence
  Description of Artificial Sequence: Synthetic peptide
  Seed: KLVELEHTL (KKLC1_HUMAN)
KQVELEHTR

SEQ ID NO: 40871 - protein, 9 aa, Artificial Sequence
  Description of Artificial Sequence: Synthetic peptide
  Seed: VENKLVELE (KKLC1_HUMAN)
VENKLVELF

SEQ ID NO: 40872 - protein, 8 aa, Artificial Sequence
  Description of Artificial Sequence: Synthetic peptide
  Seed: FQRNTGEM (KKLC1_HUMAN)
FQRNTGEF

SEQ ID NO: 40873 - protein, 9 aa, Artificial Sequence
  Description of Artificial Sequence: Synthetic peptide
  Seed: SNSTALALV (KKLC1_HUMAN)
SVSTALALA

SEQ ID NO: 40874 - protein, 9 aa, Artificial Sequence
  Description of Artificial Sequence: Synthetic peptide
  Seed: KRILVNLSM (KKLC1_HUMAN)
KHILVNLSL

SEQ ID NO: 40875 - protein, 9 aa, Artificial Sequence
  Description of Artificial Sequence: Synthetic peptide
  Seed: KYRRFQRNT (KKLC1_HUMAN)
KTRRFQRNP

SEQ ID NO: 40876 - protein, 9 aa, Artificial Sequence
  Description of Artificial Sequence: Synthetic peptide
  Seed: KGFRGASPH (KKLC1_HUMAN)
KAFRGASPH

SEQ ID NO: 40877 - protein, 9 aa, Artificial Sequence
  Description of Artificial Sequence: Synthetic peptide
  Seed: KGFRGASPH (KKLC1_HUMAN)
KTFRGASPL

SEQ ID NO: 40878 - protein, 10 aa, Artificial Sequence
  Description of Artificial Sequence: Synthetic peptide
  Seed: LLASSILCAL (KKLC1_HUMAN)
LMASSILCAA

SEQ ID NO: 40879 - protein, 9 aa, Artificial Sequence
  Description of Artificial Sequence: Synthetic peptide
  Seed: NTDNNLAVY (KKLC1_HUMAN)
NMDNNLAVY

SEQ ID NO: 40880 - protein, 9 aa, Artificial Sequence
  Description of Artificial Sequence: Synthetic peptide
  Seed: VYDLSRDIL (KKLC1_HUMAN)
VWDLSRDIF

SEQ ID NO: 40881 - protein, 9 aa, Artificial Sequence
  Description of Artificial Sequence: Synthetic peptide
  Seed: SILCALIVF (KKLC1_HUMAN)
SALCALIVF

SEQ ID NO: 40882 - protein, 10 aa, Artificial Sequence
  Description of Artificial Sequence: Synthetic peptide
  Seed: SKGFRGASPH (KKLC1_HUMAN)
SKGFRGASPF

SEQ ID NO: 40883 - protein, 9 aa, Artificial Sequence
  Description of Artificial Sequence: Synthetic peptide
  Seed: SSNSTALAL (KKLC1_HUMAN)
SMNSTALAF

SEQ ID NO: 40884 - protein, 10 aa, Artificial Sequence
  Description of Artificial Sequence: Synthetic peptide
  Seed: QKRILVNLSM (KKLC1_HUMAN)
QMRILVNLSV

SEQ ID NO: 40885 - protein, 10 aa, Artificial Sequence
  Description of Artificial Sequence: Synthetic peptide
  Seed: YLLLASSILC (KKLC1_HUMAN)
YELLASSILL

SEQ ID NO: 40886 - protein, 8 aa, Artificial Sequence
  Description of Artificial Sequence: Synthetic peptide
  Seed: YLLLASSI (KKLC1_HUMAN)
YQLLASSL

SEQ ID NO: 40887 - protein, 10 aa, Artificial Sequence
  Description of Artificial Sequence: Synthetic peptide
  Seed: NTDNNLAVYD (KKLC1_HUMAN)
NSDNNLAVYY

SEQ ID NO: 40888 - protein, 9 aa, Artificial Sequence
  Description of Artificial Sequence: Synthetic peptide
  Seed: VYDLSRDIL (KKLC1_HUMAN)
VTDLSRDIW

SEQ ID NO: 40889 - protein, 9 aa, Artificial Sequence
  Description of Artificial Sequence: Synthetic peptide
  Seed: ALIVFWKYR (KKLC1_HUMAN)
AFIVFWKYK

SEQ ID NO: 40890 - protein, 10 aa, Artificial Sequence
  Description of Artificial Sequence: Synthetic peptide
  Seed: YLLLASSILC (KKLC1_HUMAN)
YMLLASSILV

SEQ ID NO: 40891 - protein, 10 aa, Artificial Sequence
  Description of Artificial Sequence: Synthetic peptide
  Seed: MSSNSTALAL (KKLC1_HUMAN)
MFSNSTALAM

SEQ ID NO: 40892 - protein, 9 aa, Artificial Sequence
  Description of Artificial Sequence: Synthetic peptide
  Seed: KLVELEHTL (KKLC1_HUMAN)
KYVELEHTF

SEQ ID NO: 40893 - protein, 9 aa, Artificial Sequence
  Description of Artificial Sequence: Synthetic peptide
  Seed: VENKLVELE (KKLC1_HUMAN)
VENKLVELL

SEQ ID NO: 40894 - protein, 9 aa, Artificial Sequence
  Description of Artificial Sequence: Synthetic peptide
  Seed: MVENKLVEL (KKLC1_HUMAN)
MPENKLVEL

SEQ ID NO: 40895 - protein, 10 aa, Artificial Sequence
  Description of Artificial Sequence: Synthetic peptide
  Seed: ALIVFWKYRR (KKLC1_HUMAN)
AFIVFWKYRK

SEQ ID NO: 40896 - protein, 10 aa, Artificial Sequence
  Description of Artificial Sequence: Synthetic peptide
  Seed: ILCALIVFWK (KKLC1_HUMAN)
IGCALIVFWR

SEQ ID NO: 40897 - protein, 10 aa, Artificial Sequence
  Description of Artificial Sequence: Synthetic peptide
  Seed: LASSILCALI (KKLC1_HUMAN)
LLSSILCALD

SEQ ID NO: 40898 - protein, 10 aa, Artificial Sequence
  Description of Artificial Sequence: Synthetic peptide
  Seed: EMSSNSTALA (KKLC1_HUMAN)
ETSSNSTALI

SEQ ID NO: 40899 - protein, 10 aa, Artificial Sequence
  Description of Artificial Sequence: Synthetic peptide
  Seed: KLVELEHTLL (KKLC1_HUMAN)
KQVELEHTLL

SEQ ID NO: 40900 - protein, 10 aa, Artificial Sequence
  Description of Artificial Sequence: Synthetic peptide
  Seed: SMVENKLVEL (KKLC1_HUMAN)
SLVENKLVEF

SEQ ID NO: 40901 - protein, 9 aa, Artificial Sequence
  Description of Artificial Sequence: Synthetic peptide
  Seed: LEHTLLSKG (KKLC1_HUMAN)
LEHTLLSKV

SEQ ID NO: 40902 - protein, 8 aa, Artificial Sequence
  Description of Artificial Sequence: Synthetic peptide
  Seed: NTDNNLAV (KKLC1_HUMAN)
NTDNNLAI

SEQ ID NO: 40903 - protein, 9 aa, Artificial Sequence
  Description of Artificial Sequence: Synthetic peptide
  Seed: LASSILCAL (KKLC1_HUMAN)
LSSSILCAL

SEQ ID NO: 40904 - protein, 10 aa, Artificial Sequence
  Description of Artificial Sequence: Synthetic peptide
  Seed: SKGFRGASPH (KKLC1_HUMAN)
SLGFRGASPY

SEQ ID NO: 40905 - protein, 9 aa, Artificial Sequence
  Description of Artificial Sequence: Synthetic peptide
  Seed: ILNNFPHSI (KKLC1_HUMAN)
IVNNFPHSR

SEQ ID NO: 40906 - protein, 9 aa, Artificial Sequence
  Description of Artificial Sequence: Synthetic peptide
  Seed: KLVELEHTL (KKLC1_HUMAN)
KHVELEHTI

SEQ ID NO: 40907 - protein, 9 aa, Artificial Sequence
  Description of Artificial Sequence: Synthetic peptide
  Seed: IARQKRILV (KKLC1_HUMAN)
IYRQKRILK

SEQ ID NO: 40908 - protein, 9 aa, Artificial Sequence
  Description of Artificial Sequence: Synthetic peptide
  Seed: KYRRFQRNT (KKLC1_HUMAN)
KVRRFQRNR

SEQ ID NO: 40909 - protein, 9 aa, Artificial Sequence
  Description of Artificial Sequence: Synthetic peptide
  Seed: VENKLVELE (KKLC1_HUMAN)
VENKLVELM

SEQ ID NO: 40910 - protein, 9 aa, Artificial Sequence
  Description of Artificial Sequence: Synthetic peptide
  Seed: RQKRILVNL (KKLC1_HUMAN)
RSKRILVNL

SEQ ID NO: 40911 - protein, 9 aa, Artificial Sequence
  Description of Artificial Sequence: Synthetic peptide
  Seed: LASSILCAL (KKLC1_HUMAN)
LLSSILCAT

SEQ ID NO: 40912 - protein, 10 aa, Artificial Sequence
  Description of Artificial Sequence: Synthetic peptide
  Seed: FYLLLASSIL (KKLC1_HUMAN)
FPLLLASSIV

SEQ ID NO: 40913 - protein, 10 aa, Artificial Sequence
  Description of Artificial Sequence: Synthetic peptide
  Seed: GEMSSNSTAL (KKLC1_HUMAN)
GEMSSNSTAY

SEQ ID NO: 40914 - protein, 9 aa, Artificial Sequence
  Description of Artificial Sequence: Synthetic peptide
  Seed: LVRPSSSGL (KKLC1_HUMAN)
LARPSSSGY

SEQ ID NO: 40915 - protein, 11 aa, Artificial Sequence
  Description of Artificial Sequence: Synthetic peptide
  Seed: RQKRILVNLSM (KKLC1_HUMAN)
REKRILVNLSV

SEQ ID NO: 40916 - protein, 10 aa, Artificial Sequence
  Description of Artificial Sequence: Synthetic peptide
  Seed: QKRILVNLSM (KKLC1_HUMAN)
QPRILVNLSV

SEQ ID NO: 40917 - protein, 10 aa, Artificial Sequence
  Description of Artificial Sequence: Synthetic peptide
  Seed: SKGFRGASPH (KKLC1_HUMAN)
SHGFRGASPY

SEQ ID NO: 40918 - protein, 9 aa, Artificial Sequence
  Description of Artificial Sequence: Synthetic peptide
  Seed: SSNSTALAL (KKLC1_HUMAN)
SQNSTALAI

SEQ ID NO: 40919 - protein, 9 aa, Artificial Sequence
  Description of Artificial Sequence: Synthetic peptide
  Seed: SSNSTALAL (KKLC1_HUMAN)
SMNSTALAW

SEQ ID NO: 40920 - protein, 11 aa, Artificial Sequence
  Description of Artificial Sequence: Synthetic peptide
  Seed: RQKRILVNLSM (KKLC1_HUMAN)
RDKRILVNLSM

SEQ ID NO: 40921 - protein, 9 aa, Artificial Sequence
  Description of Artificial Sequence: Synthetic peptide
  Seed: VYDLSRDIL (KKLC1_HUMAN)
VIDLSRDIV

SEQ ID NO: 40922 - protein, 9 aa, Artificial Sequence
  Description of Artificial Sequence: Synthetic peptide
  Seed: RQKRILVNL (KKLC1_HUMAN)
RIKRILVNG

SEQ ID NO: 40923 - protein, 10 aa, Artificial Sequence
  Description of Artificial Sequence: Synthetic peptide
  Seed: QKRILVNLSM (KKLC1_HUMAN)
QGRILVNLSI

SEQ ID NO: 40924 - protein, 10 aa, Artificial Sequence
  Description of Artificial Sequence: Synthetic peptide
  Seed: LASSILCALI (KKLC1_HUMAN)
LLSSILCALF

SEQ ID NO: 40925 - protein, 11 aa, Artificial Sequence
  Description of Artificial Sequence: Synthetic peptide
  Seed: LLLASSILCAL (KKLC1_HUMAN)
LMLASSILCAV

SEQ ID NO: 40926 - protein, 9 aa, Artificial Sequence
  Description of Artificial Sequence: Synthetic peptide
  Seed: RQKRILVNL (KKLC1_HUMAN)
RIKRILVNK

SEQ ID NO: 40927 - protein, 10 aa, Artificial Sequence
  Description of Artificial Sequence: Synthetic peptide
  Seed: LLLASSILCA (KKLC1_HUMAN)
LMLASSILCV

SEQ ID NO: 40928 - protein, 9 aa, Artificial Sequence
  Description of Artificial Sequence: Synthetic peptide
  Seed: IARQKRILV (KKLC1_HUMAN)
IMRQKRILI

SEQ ID NO: 40929 - protein, 10 aa, Artificial Sequence
  Description of Artificial Sequence: Synthetic peptide
  Seed: QKRILVNLSM (KKLC1_HUMAN)
QVRILVNLSF

SEQ ID NO: 40930 - protein, 9 aa, Artificial Sequence
  Description of Artificial Sequence: Synthetic peptide
  Seed: KYRRFQRNT (KKLC1_HUMAN)
KMRRFQRNR

SEQ ID NO: 40931 - protein, 9 aa, Artificial Sequence
  Description of Artificial Sequence: Synthetic peptide
  Seed: KYRRFQRNT (KKLC1_HUMAN)
KARRFQRNI

SEQ ID NO: 40932 - protein, 9 aa, Artificial Sequence
  Description of Artificial Sequence: Synthetic peptide
  Seed: KGFRGASPH (KKLC1_HUMAN)
KLFRGASPF

SEQ ID NO: 40933 - protein, 9 aa, Artificial Sequence
  Description of Artificial Sequence: Synthetic peptide
  Seed: LLLASSILC (KKLC1_HUMAN)
LLLASSILV

SEQ ID NO: 40934 - protein, 11 aa, Artificial Sequence
  Description of Artificial Sequence: Synthetic peptide
  Seed: LSMVENKLVEL (KKLC1_HUMAN)
LLMVENKLVEV

SEQ ID NO: 40935 - protein, 10 aa, Artificial Sequence
  Description of Artificial Sequence: Synthetic peptide
  Seed: RQKRILVNLS (KKLC1_HUMAN)
RYKRILVNLA

SEQ ID NO: 40936 - protein, 9 aa, Artificial Sequence
  Description of Artificial Sequence: Synthetic peptide
  Seed: NNFPHSIAR (KKLC1_HUMAN)
NTFPHSIAL

SEQ ID NO: 40937 - protein, 11 aa, Artificial Sequence
  Description of Artificial Sequence: Synthetic peptide
  Seed: YLLLASSILCA (KKLC1_HUMAN)
YTLLASSILCI

SEQ ID NO: 40938 - protein, 9 aa, Artificial Sequence
  Description of Artificial Sequence: Synthetic peptide
  Seed: YLLLASSIL (KKLC1_HUMAN)
YMLLASSIV

SEQ ID NO: 40939 - protein, 10 aa, Artificial Sequence
  Description of Artificial Sequence: Synthetic peptide
  Seed: TGEMSSNSTA (KKLC1_HUMAN)
TREMSSNSTA

SEQ ID NO: 40940 - protein, 10 aa, Artificial Sequence
  Description of Artificial Sequence: Synthetic peptide
  Seed: CALIVFWKYR (KKLC1_HUMAN)
CILIVFWKYR

SEQ ID NO: 40941 - protein, 9 aa, Artificial Sequence
  Description of Artificial Sequence: Synthetic peptide
  Seed: YLLLASSIL (KKLC1_HUMAN)
YALLASSIF

SEQ ID NO: 40942 - protein, 10 aa, Artificial Sequence
  Description of Artificial Sequence: Synthetic peptide
  Seed: KYRRFQRNTG (KKLC1_HUMAN)
KMRRFQRNTA

SEQ ID NO: 40943 - protein, 10 aa, Artificial Sequence
  Description of Artificial Sequence: Synthetic peptide
  Seed: DILNNFPHSI (KKLC1_HUMAN)
DWLNNFPHSV

SEQ ID NO: 40944 - protein, 10 aa, Artificial Sequence
  Description of Artificial Sequence: Synthetic peptide
  Seed: YLLLASSILC (KKLC1_HUMAN)
YGLLASSILI

SEQ ID NO: 40945 - protein, 9 aa, Artificial Sequence
  Description of Artificial Sequence: Synthetic peptide
  Seed: NTDNNLAVY (KKLC1_HUMAN)
NGDNNLAVF

SEQ ID NO: 40946 - protein, 9 aa, Artificial Sequence
  Description of Artificial Sequence: Synthetic peptide
  Seed: KRILVNLSM (KKLC1_HUMAN)
KRILVNLSA

SEQ ID NO: 40947 - protein, 9 aa, Artificial Sequence
  Description of Artificial Sequence: Synthetic peptide
  Seed: AVYDLSRDI (KKLC1_HUMAN)
AVYDLSRDY

SEQ ID NO: 40948 - protein, 10 aa, Artificial Sequence
  Description of Artificial Sequence: Synthetic peptide
  Seed: AVYDLSRDIL (KKLC1_HUMAN)
ALYDLSRDII

SEQ ID NO: 40949 - protein, 9 aa, Artificial Sequence
  Description of Artificial Sequence: Synthetic peptide
  Seed: KRILVNLSM (KKLC1_HUMAN)
KQILVNLSF

SEQ ID NO: 40950 - protein, 11 aa, Artificial Sequence
  Description of Artificial Sequence: Synthetic peptide
  Seed: KGFRGASPHRK (KKLC1_HUMAN)
KVFRGASPHRR

SEQ ID NO: 40951 - protein, 9 aa, Artificial Sequence
  Description of Artificial Sequence: Synthetic peptide
  Seed: KRILVNLSM (KKLC1_HUMAN)
KKILVNLSL

SEQ ID NO: 40952 - protein, 11 aa, Artificial Sequence
  Description of Artificial Sequence: Synthetic peptide
  Seed: GLINSNTDNNL (KKLC1_HUMAN)
GQINSNTDNNL

SEQ ID NO: 40953 - protein, 9 aa, Artificial Sequence
  Description of Artificial Sequence: Synthetic peptide
  Seed: ILNNFPHSI (KKLC1_HUMAN)
IGNNFPHSL

SEQ ID NO: 40954 - protein, 9 aa, Artificial Sequence
  Description of Artificial Sequence: Synthetic peptide
  Seed: LASSILCAL (KKLC1_HUMAN)
LASSILCAA

SEQ ID NO: 40955 - protein, 11 aa, Artificial Sequence
  Description of Artificial Sequence: Synthetic peptide
  Seed: YLLLASSILCA (KKLC1_HUMAN)
YHLLASSILCV

SEQ ID NO: 40956 - protein, 9 aa, Artificial Sequence
  Description of Artificial Sequence: Synthetic peptide
  Seed: IARQKRILV (KKLC1_HUMAN)
ITRQKRILA

SEQ ID NO: 40957 - protein, 9 aa, Artificial Sequence
  Description of Artificial Sequence: Synthetic peptide
  Seed: NTDNNLAVY (KKLC1_HUMAN)
NSDNNLAVV

SEQ ID NO: 40958 - protein, 9 aa, Artificial Sequence
  Description of Artificial Sequence: Synthetic peptide
  Seed: YLLLASSIL (KKLC1_HUMAN)
YHLLASSIY

SEQ ID NO: 40959 - protein, 10 aa, Artificial Sequence
  Description of Artificial Sequence: Synthetic peptide
  Seed: ALVRPSSSGL (KKLC1_HUMAN)
APVRPSSSGV

SEQ ID NO: 40960 - protein, 10 aa, Artificial Sequence
  Description of Artificial Sequence: Synthetic peptide
  Seed: YLLLASSILC (KKLC1_HUMAN)
YNLLASSILM

SEQ ID NO: 40961 - protein, 10 aa, Artificial Sequence
  Description of Artificial Sequence: Synthetic peptide
  Seed: DILNNFPHSI (KKLC1_HUMAN)
DWLNNFPHSL

SEQ ID NO: 40962 - protein, 10 aa, Artificial Sequence
  Description of Artificial Sequence: Synthetic peptide
  Seed: NKLVELEHTL (KKLC1_HUMAN)
NALVELEHTV

SEQ ID NO: 40963 - protein, 10 aa, Artificial Sequence
  Description of Artificial Sequence: Synthetic peptide
  Seed: YLLLASSILC (KKLC1_HUMAN)
YDLLASSILV

SEQ ID NO: 40964 - protein, 10 aa, Artificial Sequence
  Description of Artificial Sequence: Synthetic peptide
  Seed: LASSILCALI (KKLC1_HUMAN)
LMSSILCALM

SEQ ID NO: 40965 - protein, 10 aa, Artificial Sequence
  Description of Artificial Sequence: Synthetic peptide
  Seed: YLLLASSILC (KKLC1_HUMAN)
YCLLASSILA

SEQ ID NO: 40966 - protein, 9 aa, Artificial Sequence
  Description of Artificial Sequence: Synthetic peptide
  Seed: KGFRGASPH (KKLC1_HUMAN)
KYFRGASPY

SEQ ID NO: 40967 - protein, 10 aa, Artificial Sequence
  Description of Artificial Sequence: Synthetic peptide
  Seed: SNSTALALVR (KKLC1_HUMAN)
SSSTALALVR

SEQ ID NO: 40968 - protein, 11 aa, Artificial Sequence
  Description of Artificial Sequence: Synthetic peptide
  Seed: LLLASSILCAL (KKLC1_HUMAN)
LFLASSILCAI

SEQ ID NO: 40969 - protein, 9 aa, Artificial Sequence
  Description of Artificial Sequence: Synthetic peptide
  Seed: YLLLASSIL (KKLC1_HUMAN)
YNLLASSIM

SEQ ID NO: 40970 - protein, 9 aa, Artificial Sequence
  Description of Artificial Sequence: Synthetic peptide
  Seed: KGFRGASPH (KKLC1_HUMAN)
KTFRGASPY

SEQ ID NO: 40971 - protein, 9 aa, Artificial Sequence
  Description of Artificial Sequence: Synthetic peptide
  Seed: RQKRILVNL (KKLC1_HUMAN)
RQKRILVNI

SEQ ID NO: 40972 - protein, 11 aa, Artificial Sequence
  Description of Artificial Sequence: Synthetic peptide
  Seed: RQKRILVNLSM (KKLC1_HUMAN)
RDKRILVNLSK

SEQ ID NO: 40973 - protein, 10 aa, Artificial Sequence
  Description of Artificial Sequence: Synthetic peptide
  Seed: YLLLASSILC (KKLC1_HUMAN)
YLLLASSILV

SEQ ID NO: 40974 - protein, 9 aa, Artificial Sequence
  Description of Artificial Sequence: Synthetic peptide
  Seed: LLASSILCA (KKLC1_HUMAN)
LMASSILCA

SEQ ID NO: 40975 - protein, 9 aa, Artificial Sequence
  Description of Artificial Sequence: Synthetic peptide
  Seed: LVRPSSSGL (KKLC1_HUMAN)
LLRPSSSGM

SEQ ID NO: 40976 - protein, 9 aa, Artificial Sequence
  Description of Artificial Sequence: Synthetic peptide
  Seed: NTDNNLAVY (KKLC1_HUMAN)
NGDNNLAVL

SEQ ID NO: 40977 - protein, 9 aa, Artificial Sequence
  Description of Artificial Sequence: Synthetic peptide
  Seed: RQKRILVNL (KKLC1_HUMAN)
RIKRILVNM

SEQ ID NO: 40978 - protein, 9 aa, Artificial Sequence
  Description of Artificial Sequence: Synthetic peptide
  Seed: ALIVFWKYR (KKLC1_HUMAN)
AQIVFWKYK

SEQ ID NO: 40979 - protein, 10 aa, Artificial Sequence
  Description of Artificial Sequence: Synthetic peptide
  Seed: NKLVELEHTL (KKLC1_HUMAN)
NFLVELEHTI

SEQ ID NO: 40980 - protein, 9 aa, Artificial Sequence
  Description of Artificial Sequence: Synthetic peptide
  Seed: FPHSIARQK (KKLC1_HUMAN)
FVHSIARQK

SEQ ID NO: 40981 - protein, 11 aa, Artificial Sequence
  Description of Artificial Sequence: Synthetic peptide
  Seed: RQKRILVNLSM (KKLC1_HUMAN)
RTKRILVNLSL

SEQ ID NO: 40982 - protein, 9 aa, Artificial Sequence
  Description of Artificial Sequence: Synthetic peptide
  Seed: RQKRILVNL (KKLC1_HUMAN)
RAKRILVNF

SEQ ID NO: 40983 - protein, 11 aa, Artificial Sequence
  Description of Artificial Sequence: Synthetic peptide
  Seed: NNFPHSIARQK (KKLC1_HUMAN)
NVFPHSIARQK

SEQ ID NO: 40984 - protein, 9 aa, Artificial Sequence
  Description of Artificial Sequence: Synthetic peptide
  Seed: LLASSILCA (KKLC1_HUMAN)
LAASSILCV

SEQ ID NO: 40985 - protein, 10 aa, Artificial Sequence
  Description of Artificial Sequence: Synthetic peptide
  Seed: DILNNFPHSI (KKLC1_HUMAN)
DALNNFPHSV

SEQ ID NO: 40986 - protein, 8 aa, Homo sapiens
  Native (KKLC1_HUMAN)
GEMSSNST

SEQ ID NO: 40987 - protein, 11 aa, Homo sapiens
  Native (KKLC1_HUMAN)
ILNNFPHSIAR

SEQ ID NO: 40988 - protein, 9 aa, Homo sapiens
  Native (KKLC1_HUMAN)
SRDILNNFP

SEQ ID NO: 40989 - protein, 11 aa, Homo sapiens
  Native (KKLC1_HUMAN)
TGEMSSNSTAL

SEQ ID NO: 40990 - protein, 11 aa, Homo sapiens
  Native (KKLC1_HUMAN)
ILVNLSMVENK

SEQ ID NO: 40991 - protein, 9 aa, Homo sapiens
  Native (KKLC1_HUMAN)
GASPHRKST

SEQ ID NO: 40992 - protein, 8 aa, Homo sapiens
  Native (KKLC1_HUMAN)
VYDLSRDI

SEQ ID NO: 40993 - protein, 10 aa, Homo sapiens
  Native (KKLC1_HUMAN)
YLLLASSILC

SEQ ID NO: 40994 - protein, 11 aa, Homo sapiens
  Native (KKLC1_HUMAN)
KGFRGASPHRK

SEQ ID NO: 40995 - protein, 8 aa, Homo sapiens
  Native (KKLC1_HUMAN)
TDNNLAVY

SEQ ID NO: 40996 - protein, 9 aa, Homo sapiens
  Native (KKLC1_HUMAN)
ELEHTLLSK

SEQ ID NO: 40997 - protein, 11 aa, Homo sapiens
  Native (KKLC1_HUMAN)
LLLASSILCAL

SEQ ID NO: 40998 - protein, 9 aa, Homo sapiens
  Native (KKLC1_HUMAN)
KGFRGASPH

SEQ ID NO: 40999 - protein, 10 aa, Homo sapiens
  Native (KKLC1_HUMAN)
LLLASSILCA

SEQ ID NO: 41000 - protein, 8 aa, Homo sapiens
  Native (KKLC1_HUMAN)
RPSSSGLI

SEQ ID NO: 41001 - protein, 9 aa, Homo sapiens
  Native (KKLC1_HUMAN)
LLASSILCA

SEQ ID NO: 41002 - protein, 11 aa, Homo sapiens
  Native (KKLC1_HUMAN)
LCALIVFWKYR

SEQ ID NO: 41003 - protein, 11 aa, Homo sapiens
  Native (KKLC1_HUMAN)
SKGFRGASPHR

SEQ ID NO: 41004 - protein, 10 aa, Homo sapiens
  Native (KKLC1_HUMAN)
NNLAVYDLSR

SEQ ID NO: 41005 - protein, 8 aa, Homo sapiens
  Native (KKLC1_HUMAN)
VENKLVEL

SEQ ID NO: 41006 - protein, 9 aa, Homo sapiens
  Native (KKLC1_HUMAN)
IVFWKYRRF

SEQ ID NO: 41007 - protein, 9 aa, Homo sapiens
  Native (KKLC1_HUMAN)
ILCALIVFW

SEQ ID NO: 41008 - protein, 11 aa, Homo sapiens
  Native (KKLC1_HUMAN)
RQKRILVNLSM

SEQ ID NO: 41009 - protein, 10 aa, Homo sapiens
  Native (KKLC1_HUMAN)
ALVRPSSSGL

SEQ ID NO: 41010 - protein, 10 aa, Homo sapiens
  Native (KKLC1_HUMAN)
MSSNSTALAL

SEQ ID NO: 41011 - protein, 10 aa, Homo sapiens
  Native (KKLC1_HUMAN)
TLLSKGFRGA

SEQ ID NO: 41012 - protein, 11 aa, Homo sapiens
  Native (KKLC1_HUMAN)
GLINSNTDNNL

SEQ ID NO: 41013 - protein, 11 aa, Homo sapiens
  Native (KKLC1_HUMAN)
YLLLASSILCA

SEQ ID NO: 41014 - protein, 9 aa, Homo sapiens
  Native (KKLC1_HUMAN)
SNTDNNLAV

SEQ ID NO: 41015 - protein, 11 aa, Homo sapiens
  Native (KKLC1_HUMAN)
NKLVELEHTLL

SEQ ID NO: 41016 - protein, 8 aa, Homo sapiens
  Native (KKLC1_HUMAN)
YDLSRDIL

SEQ ID NO: 41017 - protein, 10 aa, Homo sapiens
  Native (KKLC1_HUMAN)
LNNFPHSIAR

SEQ ID NO: 41018 - protein, 9 aa, Homo sapiens
  Native (KKLC1_HUMAN)
LEHTLLSKG

SEQ ID NO: 41019 - protein, 11 aa, Homo sapiens
  Native (KKLC1_HUMAN)
LLASSILCALI

SEQ ID NO: 41020 - protein, 10 aa, Homo sapiens
  Native (KKLC1_HUMAN)
TGEMSSNSTA

SEQ ID NO: 41021 - protein, 10 aa, Homo sapiens
  Native (KKLC1_HUMAN)
DILNNFPHSI

SEQ ID NO: 41022 - protein, 9 aa, Homo sapiens
  Native (KKLC1_HUMAN)
RILVNLSMV

SEQ ID NO: 41023 - protein, 9 aa, Homo sapiens
  Native (KKLC1_HUMAN)
ARQKRILVN

SEQ ID NO: 41024 - protein, 11 aa, Homo sapiens
  Native (KKLC1_HUMAN)
LEHTLLSKGFR

SEQ ID NO: 41025 - protein, 10 aa, Homo sapiens
  Native (KKLC1_HUMAN)
QKRILVNLSM

SEQ ID NO: 41026 - protein, 11 aa, Homo sapiens
  Native (KKLC1_HUMAN)
GEMSSNSTALA

SEQ ID NO: 41027 - protein, 8 aa, Homo sapiens
  Native (KKLC1_HUMAN)
SRDILNNF

SEQ ID NO: 41028 - protein, 10 aa, Homo sapiens
  Native (KKLC1_HUMAN)
GFRGASPHRK

SEQ ID NO: 41029 - protein, 8 aa, Homo sapiens
  Native (KKLC1_HUMAN)
MSSNSTAL

SEQ ID NO: 41030 - protein, 11 aa, Homo sapiens
  Native (KKLC1_HUMAN)
CALIVFWKYRR

SEQ ID NO: 41031 - protein, 10 aa, Homo sapiens
  Native (KKLC1_HUMAN)
VNLSMVENKL

SEQ ID NO: 41032 - protein, 11 aa, Homo sapiens
  Native (KKLC1_HUMAN)
NFPHSIARQKR

SEQ ID NO: 41033 - protein, 11 aa, Homo sapiens
  Native (KKLC1_HUMAN)
NSNTDNNLAVY

SEQ ID NO: 41034 - protein, 10 aa, Homo sapiens
  Native (KKLC1_HUMAN)
LINSNTDNNL

SEQ ID NO: 41035 - protein, 9 aa, Homo sapiens
  Native (KKLC1_HUMAN)
ALIVFWKYR

SEQ ID NO: 41036 - protein, 11 aa, Homo sapiens
  Native (KKLC1_HUMAN)
RRFQRNTGEMS

SEQ ID NO: 41037 - protein, 9 aa, Homo sapiens
  Native (KKLC1_HUMAN)
LCALIVFWK

SEQ ID NO: 41038 - protein, 10 aa, Homo sapiens
  Native (KKLC1_HUMAN)
NKLVELEHTL

SEQ ID NO: 41039 - protein, 10 aa, Homo sapiens
  Native (KKLC1_HUMAN)
LASSILCALI

SEQ ID NO: 41040 - protein, 8 aa, Homo sapiens
  Native (KKLC1_HUMAN)
FQRNTGEM

SEQ ID NO: 41041 - protein, 11 aa, Homo sapiens
  Native (KKLC1_HUMAN)
LSMVENKLVEL

SEQ ID NO: 41042 - protein, 8 aa, Homo sapiens
  Native (KKLC1_HUMAN)
LIVFWKYR

SEQ ID NO: 41043 - protein, 10 aa, Homo sapiens
  Native (KKLC1_HUMAN)
SNTDNNLAVY

SEQ ID NO: 41044 - protein, 8 aa, Homo sapiens
  Native (KKLC1_HUMAN)
LVELEHTL

SEQ ID NO: 41045 - protein, 9 aa, Homo sapiens
  Native (KKLC1_HUMAN)
VNLSMVENK

SEQ ID NO: 41046 - protein, 9 aa, Homo sapiens
  Native (KKLC1_HUMAN)
HSIARQKRI

SEQ ID NO: 41047 - protein, 11 aa, Homo sapiens
  Native (KKLC1_HUMAN)
RDILNNFPHSI

SEQ ID NO: 41048 - protein, 8 aa, Homo sapiens
  Native (KKLC1_HUMAN)
TLLSKGFR

SEQ ID NO: 41049 - protein, 11 aa, Homo sapiens
  Native (KKLC1_HUMAN)
VFWKYRRFQRN

SEQ ID NO: 41050 - protein, 9 aa, Homo sapiens
  Native (KKLC1_HUMAN)
EMSSNSTAL

SEQ ID NO: 41051 - protein, 8 aa, Homo sapiens
  Native (KKLC1_HUMAN)
ILVNLSMV

SEQ ID NO: 41052 - protein, 11 aa, Homo sapiens
  Native (KKLC1_HUMAN)
LVNLSMVENKL

SEQ ID NO: 41053 - protein, 9 aa, Homo sapiens
  Native (KKLC1_HUMAN)
GFRGASPHR

SEQ ID NO: 41054 - protein, 8 aa, Homo sapiens
  Native (KKLC1_HUMAN)
NTDNNLAV

SEQ ID NO: 41055 - protein, 11 aa, Homo sapiens
  Native (KKLC1_HUMAN)
MSSNSTALALV

SEQ ID NO: 41056 - protein, 8 aa, Homo sapiens
  Native (KKLC1_HUMAN)
IVFWKYRR

SEQ ID NO: 41057 - protein, 11 aa, Homo sapiens
  Native (KKLC1_HUMAN)
NNFPHSIARQK

SEQ ID NO: 41058 - protein, 10 aa, Homo sapiens
  Native (KKLC1_HUMAN)
LLASSILCAL

SEQ ID NO: 41059 - protein, 11 aa, Homo sapiens
  Native (KKLC1_HUMAN)
NTDNNLAVYDL

SEQ ID NO: 41060 - protein, 9 aa, Homo sapiens
  Native (KKLC1_HUMAN)
KYRRFQRNT

SEQ ID NO: 41061 - protein, 10 aa, Homo sapiens
  Native (KKLC1_HUMAN)
LVRPSSSGLI

SEQ ID NO: 41062 - protein, 8 aa, Homo sapiens
  Native (KKLC1_HUMAN)
VFWKYRRF

SEQ ID NO: 41063 - protein, 11 aa, Homo sapiens
  Native (KKLC1_HUMAN)
ASSILCALIVF

SEQ ID NO: 41064 - protein, 10 aa, Homo sapiens
  Native (KKLC1_HUMAN)
LVNLSMVENK

SEQ ID NO: 41065 - protein, 8 aa, Homo sapiens
  Native (KKLC1_HUMAN)
LSMVENKL

SEQ ID NO: 41066 - protein, 10 aa, Homo sapiens
  Native (KKLC1_HUMAN)
RRFQRNTGEM

SEQ ID NO: 41067 - protein, 9 aa, Homo sapiens
  Native (KKLC1_HUMAN)
AVYDLSRDI

SEQ ID NO: 41068 - protein, 8 aa, Homo sapiens
  Native (KKLC1_HUMAN)
ALIVFWKY

SEQ ID NO: 41069 - protein, 10 aa, Homo sapiens
  Native (KKLC1_HUMAN)
NSNTDNNLAV

SEQ ID NO: 41070 - protein, 10 aa, Homo sapiens
  Native (KKLC1_HUMAN)
SNSTALALVR

SEQ ID NO: 41071 - protein, 11 aa, Homo sapiens
  Native (KKLC1_HUMAN)
YRRFQRNTGEM

SEQ ID NO: 41072 - protein, 11 aa, Homo sapiens
  Native (KKLC1_HUMAN)
SSNSTALALVR

SEQ ID NO: 41073 - protein, 10 aa, Homo sapiens
  Native (KKLC1_HUMAN)
NFYLLLASSI

SEQ ID NO: 41074 - protein, 10 aa, Homo sapiens
  Native (KKLC1_HUMAN)
SILCALIVFW

SEQ ID NO: 41075 - protein, 11 aa, Homo sapiens
  Native (KKLC1_HUMAN)
SILCALIVFWK

SEQ ID NO: 41076 - protein, 11 aa, Homo sapiens
  Native (KKLC1_HUMAN)
KLVELEHTLLS

SEQ ID NO: 41077 - protein, 10 aa, Homo sapiens
  Native (KKLC1_HUMAN)
FYLLLASSIL

SEQ ID NO: 41078 - protein, 10 aa, Homo sapiens
  Native (KKLC1_HUMAN)
CALIVFWKYR

SEQ ID NO: 41079 - protein, 10 aa, Homo sapiens
  Native (KKLC1_HUMAN)
ILNNFPHSIA

SEQ ID NO: 41080 - protein, 9 aa, Homo sapiens
  Native (KKLC1_HUMAN)
LSMVENKLV

SEQ ID NO: 41081 - protein, 9 aa, Homo sapiens
  Native (KKLC1_HUMAN)
VELEHTLLS

SEQ ID NO: 41082 - protein, 9 aa, Homo sapiens
  Native (KKLC1_HUMAN)
FPHSIARQK

SEQ ID NO: 41083 - protein, 8 aa, Homo sapiens
  Native (KKLC1_HUMAN)
SMVENKLV

SEQ ID NO: 41084 - protein, 10 aa, Homo sapiens
  Native (KKLC1_HUMAN)
EHTLLSKGFR

SEQ ID NO: 41085 - protein, 10 aa, Homo sapiens
  Native (KKLC1_HUMAN)
NLSMVENKLV

SEQ ID NO: 41086 - protein, 8 aa, Homo sapiens
  Native (KKLC1_HUMAN)
SSILCALI

SEQ ID NO: 41087 - protein, 10 aa, Homo sapiens
  Native (KKLC1_HUMAN)
VELEHTLLSK

SEQ ID NO: 41088 - protein, 8 aa, Homo sapiens
  Native (KKLC1_HUMAN)
SNSTALAL

SEQ ID NO: 41089 - protein, 9 aa, Homo sapiens
  Native (KKLC1_HUMAN)
INSNTDNNL

SEQ ID NO: 41090 - protein, 10 aa, Homo sapiens
  Native (KKLC1_HUMAN)
RQKRILVNLS

SEQ ID NO: 41091 - protein, 10 aa, Homo sapiens
  Native (KKLC1_HUMAN)
SIARQKRILV

SEQ ID NO: 41092 - protein, 8 aa, Homo sapiens
  Native (KKLC1_HUMAN)
ARQKRILV

SEQ ID NO: 41093 - protein, 8 aa, Homo sapiens
  Native (KKLC1_HUMAN)
NFPHSIAR

SEQ ID NO: 41094 - protein, 10 aa, Homo sapiens
  Native (KKLC1_HUMAN)
NTDNNLAVYD

SEQ ID NO: 41095 - protein, 8 aa, Homo sapiens
  Native (KKLC1_HUMAN)
VRPSSSGL

SEQ ID NO: 41096 - protein, 9 aa, Homo sapiens
  Native (KKLC1_HUMAN)
FRGASPHRK

SEQ ID NO: 41097 - protein, 9 aa, Homo sapiens
  Native (KKLC1_HUMAN)
NLAVYDLSR

SEQ ID NO: 41098 - protein, 8 aa, Homo sapiens
  Native (KKLC1_HUMAN)
HSIARQKR

SEQ ID NO: 41099 - protein, 10 aa, Homo sapiens
  Native (KKLC1_HUMAN)
RPSSSGLINS

SEQ ID NO: 41100 - protein, 11 aa, Homo sapiens
  Native (KKLC1_HUMAN)
NTGEMSSNSTA

SEQ ID NO: 41101 - protein, 8 aa, Homo sapiens
  Native (KKLC1_HUMAN)
YLLLASSI

SEQ ID NO: 41102 - protein, 10 aa, Homo sapiens
  Native (KKLC1_HUMAN)
ALIVFWKYRR

SEQ ID NO: 41103 - protein, 9 aa, Homo sapiens
  Native (KKLC1_HUMAN)
LVELEHTLL

SEQ ID NO: 41104 - protein, 10 aa, Homo sapiens
  Native (KKLC1_HUMAN)
KRILVNLSMV

SEQ ID NO: 41105 - protein, 9 aa, Homo sapiens
  Native (KKLC1_HUMAN)
VRPSSSGLI

SEQ ID NO: 41106 - protein, 9 aa, Homo sapiens
  Native (KKLC1_HUMAN)
LSKGFRGAS

SEQ ID NO: 41107 - protein, 8 aa, Homo sapiens
  Native (KKLC1_HUMAN)
ASSILCAL

SEQ ID NO: 41108 - protein, 10 aa, Homo sapiens
  Native (KKLC1_HUMAN)
SSNSTALALV

SEQ ID NO: 41109 - protein, 9 aa, Homo sapiens
  Native (KKLC1_HUMAN)
IARQKRILV

SEQ ID NO: 41110 - protein, 11 aa, Homo sapiens
  Native (KKLC1_HUMAN)
MNFYLLLASSI

SEQ ID NO: 41111 - protein, 9 aa, Homo sapiens
  Native (KKLC1_HUMAN)
SNSTALALV

SEQ ID NO: 41112 - protein, 10 aa, Homo sapiens
  Native (KKLC1_HUMAN)
EMSSNSTALA

SEQ ID NO: 41113 - protein, 9 aa, Homo sapiens
  Native (KKLC1_HUMAN)
LLLASSILC

SEQ ID NO: 41114 - protein, 9 aa, Homo sapiens
  Native (KKLC1_HUMAN)
SIARQKRIL

SEQ ID NO: 41115 - protein, 11 aa, Homo sapiens
  Native (KKLC1_HUMAN)
FPHSIARQKRI

SEQ ID NO: 41116 - protein, 8 aa, Homo sapiens
  Native (KKLC1_HUMAN)
LCALIVFW

SEQ ID NO: 41117 - protein, 10 aa, Homo sapiens
  Native (KKLC1_HUMAN)
VFWKYRRFQR

SEQ ID NO: 41118 - protein, 10 aa, Homo sapiens
  Native (KKLC1_HUMAN)
AVYDLSRDIL

SEQ ID NO: 41119 - protein, 9 aa, Homo sapiens
  Native (KKLC1_HUMAN)
RRFQRNTGE

SEQ ID NO: 41120 - protein, 9 aa, Homo sapiens
  Native (KKLC1_HUMAN)
SILCALIVF

SEQ ID NO: 41121 - protein, 11 aa, Homo sapiens
  Native (KKLC1_HUMAN)
IVFWKYRRFQR

SEQ ID NO: 41122 - protein, 10 aa, Homo sapiens
  Native (KKLC1_HUMAN)
LEHTLLSKGF

SEQ ID NO: 41123 - protein, 8 aa, Homo sapiens
  Native (KKLC1_HUMAN)
IARQKRIL

SEQ ID NO: 41124 - protein, 11 aa, Homo sapiens
  Native (KKLC1_HUMAN)
EMSSNSTALAL

SEQ ID NO: 41125 - protein, 8 aa, Homo sapiens
  Native (KKLC1_HUMAN)
NSTALALV

SEQ ID NO: 41126 - protein, 10 aa, Homo sapiens
  Native (KKLC1_HUMAN)
DLSRDILNNF

SEQ ID NO: 41127 - protein, 10 aa, Homo sapiens
  Native (KKLC1_HUMAN)
SKGFRGASPH

SEQ ID NO: 41128 - protein, 11 aa, Homo sapiens
  Native (KKLC1_HUMAN)
LVELEHTLLSK

SEQ ID NO: 41129 - protein, 10 aa, Homo sapiens
  Native (KKLC1_HUMAN)
SSILCALIVF

SEQ ID NO: 41130 - protein, 10 aa, Homo sapiens
  Native (KKLC1_HUMAN)
KLVELEHTLL

SEQ ID NO: 41131 - protein, 8 aa, Homo sapiens
  Native (KKLC1_HUMAN)
VELEHTLL

SEQ ID NO: 41132 - protein, 9 aa, Homo sapiens
  Native (KKLC1_HUMAN)
ASSILCALI

SEQ ID NO: 41133 - protein, 8 aa, Homo sapiens
  Native (KKLC1_HUMAN)
STALALVR

SEQ ID NO: 41134 - protein, 10 aa, Homo sapiens
  Native (KKLC1_HUMAN)
KYRRFQRNTG

SEQ ID NO: 41135 - protein, 9 aa, Homo sapiens
  Native (KKLC1_HUMAN)
MSSNSTALA

SEQ ID NO: 41136 - protein, 9 aa, Homo sapiens
  Native (KKLC1_HUMAN)
EHTLLSKGF

SEQ ID NO: 41137 - protein, 9 aa, Homo sapiens
  Native (KKLC1_HUMAN)
SSILCALIV

SEQ ID NO: 41138 - protein, 9 aa, Homo sapiens
  Native (KKLC1_HUMAN)
VENKLVELE

SEQ ID NO: 41139 - protein, 8 aa, Artificial Sequence
  Description of Artificial Sequence: Synthetic peptide
  Seed: ALIVFWKY (KKLC1_HUMAN)
  misc_feature (2)..(2): Xaa can be Gln, Ala, Glu, Phe, Met, Val, Leu, Asn, Thr, Ile, Trp, Tyr, or Ser
  misc_feature (8)..(8): Xaa can be Tyr, Leu, Phe, or Met
AXIVFWKX

SEQ ID NO: 41140 - protein, 9 aa, Artificial Sequence
  Description of Artificial Sequence: Synthetic peptide
  Seed: ALIVFWKYR (KKLC1_HUMAN)
  misc_feature (2)..(2): Xaa can be Val, Met, Thr, Ser, Trp, Phe, Gly, His, Asn, Gln, Leu, Ile, Ala, Tyr, Pro, Lys, Asp, Cys, Arg, or Glu
  misc_feature (9)..(9): Xaa can be Arg, Lys, Tyr, or His
AXIVFWKYX

SEQ ID NO: 41141 - protein, 10 aa, Artificial Sequence
  Description of Artificial Sequence: Synthetic peptide
  Seed: ALIVFWKYRR (KKLC1_HUMAN)
  misc_feature (2)..(2): Xaa can be Met, Ile, Gln, Thr, Ser, Phe, Tyr, Leu, Val, Trp, Ala, Gly, Lys, Glu, Asn, Cys, Arg, His, Asp, or Pro
  misc_feature (10)..(10): Xaa can be Arg, Lys, Tyr, Leu, Phe, His, Met, Asn, Asp, Gly, Glu, Val, Ala, Gln, Thr, Cys, Ile, Trp, Pro, or Ser
AXIVFWKYRX

SEQ ID NO: 41142 - protein, 10 aa, Artificial Sequence
  Description of Artificial Sequence: Synthetic peptide
  Seed: ALVRPSSSGL (KKLC1_HUMAN)
  misc_feature (2)..(2): Xaa can be Thr, Pro, Ser, Gln, Arg, Met, Leu, Tyr, Glu, Ile, Gly, Val, Lys, Ala, Asp, Asn, His, Cys, Phe, or Trp
  misc_feature (10)..(10): Xaa can be Val, Lys, Leu, Met, Ala, Ile, Tyr, Phe, Trp, Gly, Ser, Arg, Thr, or Cys
AXVRPSSSGX

SEQ ID NO: 41143 - protein, 8 aa, Artificial Sequence
  Description of Artificial Sequence: Synthetic peptide
  Seed: ARQKRILV (KKLC1_HUMAN)
  misc_feature (2)..(2): Xaa can be , or Arg
  misc_feature (8)..(8): Xaa can be Val, Leu, Met, Ile, or Phe
AXQKRILX

SEQ ID NO: 41144 - protein, 9 aa, Artificial Sequence
  Description of Artificial Sequence: Synthetic peptide
  Seed: ARQKRILVN (KKLC1_HUMAN)
  misc_feature (2)..(2): Xaa can be Arg, Gln, Ala, Lys, Asn, Gly, Met, Thr, Glu, Leu, Ser, Ile, Asp, Val, Cys, His, Phe, Trp, Pro, or Tyr
  misc_feature (9)..(9): Xaa can be Leu, Ile, Phe, Lys, Met, Arg, Val, Tyr, His, Trp, Gly, Gln, Glu, Ala, Cys, Asn, Pro, Thr, or Ser
AXQKRILVX

SEQ ID NO: 41145 - protein, 10 aa, Artificial Sequence
  Description of Artificial Sequence: Synthetic peptide
  Seed: ARQKRILVNL (KKLC1_HUMAN)
  misc_feature (2)..(2): Xaa can be Arg, Gln, Glu, Gly, Leu, Met, Val, Tyr, Ser, Ala, Ile, Thr, or Asn
  misc_feature (10)..(10): Xaa can be Leu, Phe, Lys, Tyr, Met, Ile, Arg, Trp, Val, Gln, Ala, Cys, or His
AXQKRILVNX

SEQ ID NO: 41146 - protein, 8 aa, Artificial Sequence
  Description of Artificial Sequence: Synthetic peptide
  Seed: ASSILCAL (KKLC1_HUMAN)
  misc_feature (2)..(2): Xaa can be Ala, Ser, Thr, or Val
  misc_feature (8)..(8): Xaa can be Tyr, Leu, Met, Phe, Ile, His, or Val
AXSILCAX

SEQ ID NO: 41147 - protein, 9 aa, Artificial Sequence
  Description of Artificial Sequence: Synthetic peptide
  Seed: ASSILCALI (KKLC1_HUMAN)
  misc_feature (2)..(2): Xaa can be Leu, Met, Ala, Thr, Val, Ser, Gln, Ile, Gly, Asn, Glu, Cys, Pro, Asp, Trp, Tyr, or Phe
  misc_feature (9)..(9): Xaa can be Trp, Phe, Leu, Ile, Val, Ala, Met, Tyr, Thr, Pro, Gly, Ser, or Lys
AXSILCALX

SEQ ID NO: 41148 - protein, 11 aa, Artificial Sequence
  Description of Artificial Sequence: Synthetic peptide
  Seed: ASSILCALIVF (KKLC1_HUMAN)
  misc_feature (2)..(2): Xaa can be Ser, Ala, Thr, Ile, Asn, Met, Gly, Val, Leu, Cys, Pro, or Gln
  misc_feature (11)..(11): Xaa can be Trp, or Phe
AXSILCALIVX

SEQ ID NO: 41149 - protein, 9 aa, Artificial Sequence
  Description of Artificial Sequence: Synthetic peptide
  Seed: AVYDLSRDI (KKLC1_HUMAN)
  misc_feature (2)..(2): Xaa can be Ala, Ile, Gln, Val, Met, Arg, Leu, Thr, Gly, Ser, Tyr, Cys, Glu, Lys, Phe, His, Asn, Asp, Pro, or Trp
  misc_feature (9)..(9): Xaa can be Leu, Phe, Tyr, Ile, Val, Met, Ala, His, Trp, Lys, Arg, Thr, Cys, Ser, or Gln
AXYDLSRDX

SEQ ID NO: 41150 - protein, 10 aa, Artificial Sequence
  Description of Artificial Sequence: Synthetic peptide
  Seed: AVYDLSRDIL (KKLC1_HUMAN)
  misc_feature (2)..(2): Xaa can be Met, Gln, Ile, Thr, Leu, Ala, Val, Ser, Glu, Arg, Gly, Asn, Tyr, His, Phe, Lys, Asp, Cys, or Pro
  misc_feature (10)..(10): Xaa can be Tyr, Phe, Leu, Met, Trp, Lys, Arg, Ile, Val, Ala, His, Thr, or Cys
AXYDLSRDIX

SEQ ID NO: 41151 - protein, 9 aa, Artificial Sequence
  Description of Artificial Sequence: Synthetic peptide
  Seed: CALIVFWKY (KKLC1_HUMAN)
  misc_feature (2)..(2): Xaa can be Thr, Ser, Ala, Gln, Met, Pro, Leu, Asn, Trp, Ile, Phe, Gly, Glu, Val, Cys, Asp, Arg, Tyr, Lys, or His
  misc_feature (9)..(9): Xaa can be Tyr, Trp, Phe, Leu, Met, Ile, or Val
CXLIVFWKX

SEQ ID NO: 41152 - protein, 10 aa, Artificial Sequence
  Description of Artificial Sequence: Synthetic peptide
  Seed: CALIVFWKYR (KKLC1_HUMAN)
  misc_feature (2)..(2): Xaa can be Gly, Arg, Asp, Ala, Thr, Val, Ile, Glu, Tyr, Gln, Met, His, Ser, Phe, Leu, Cys, Pro, Asn, Trp, or Lys
  misc_feature (10)..(10): Xaa can be Arg, or Lys
CXLIVFWKYX

SEQ ID NO: 41153 - protein, 11 aa, Artificial Sequence
  Description of Artificial Sequence: Synthetic peptide
  Seed: CALIVFWKYRR (KKLC1_HUMAN)
  misc_feature (2)..(2): Xaa can be Met, Thr, Trp, Gln, Phe, Arg, Ser, Val, Tyr, Gly, Asp, Glu, Lys, Leu, Ile, Asn, Pro, His, Cys, or Ala
  misc_feature (11)..(11): Xaa can be Arg, or Lys
CXLIVFWKYRX

SEQ ID NO: 41154 - protein, 10 aa, Artificial Sequence
  Description of Artificial Sequence: Synthetic peptide
  Seed: DILNNFPHSI (KKLC1_HUMAN)
  misc_feature (2)..(2): Xaa can be Thr, Phe, Val, Leu, Tyr, Trp, Met, Ala, Ile, Ser, His, Arg, Lys, Gln, Gly, Cys, or Asn
  misc_feature (10)..(10): Xaa can be Val, Leu, Ile, Ala, Met, or Thr
DXLNNFPHSX

SEQ ID NO: 41155 - protein, 10 aa, Artificial Sequence
  Description of Artificial Sequence: Synthetic peptide
  Seed: DLSRDILNNF (KKLC1_HUMAN)
  misc_feature (2)..(2): Xaa can be Val, Thr, Gln, Met, Leu, Ile, Ser, or Ala
  misc_feature (10)..(10): Xaa can be Trp, Tyr, Phe, Leu, or Met
DXSRDILNNX

SEQ ID NO: 41156 - protein, 9 aa, Artificial Sequence
  Description of Artificial Sequence: Synthetic peptide
  Seed: EHTLLSKGF (KKLC1_HUMAN)
  misc_feature (2)..(2): Xaa can be His, Arg, or Gln
  misc_feature (9)..(9): Xaa can be Phe, Leu, Tyr, Val, Ile, Met, or Trp
EXTLLSKGX

SEQ ID NO: 41157 - protein, 10 aa, Artificial Sequence
  Description of Artificial Sequence: Synthetic peptide
  Seed: EHTLLSKGFR (KKLC1_HUMAN)
  misc_feature (2)..(2): Xaa can be Tyr, Phe, Leu, Gln, Thr, Asp, His, Gly, Arg, Ala, Ile, Glu, Ser, Val, Met, Trp, Pro, Cys, Asn, or Lys
  misc_feature (10)..(10): Xaa can be Lys, or Arg
EXTLLSKGFX

SEQ ID NO: 41158 - protein, 9 aa, Artificial Sequence
  Description of Artificial Sequence: Synthetic peptide
  Seed: ELEHTLLSK (KKLC1_HUMAN)
  misc_feature (2)..(2): Xaa can be Ala, Val, Thr, Ser, Ile, Asp, Glu, Phe, Gly, Asn, Gln, Leu, Cys, Tyr, Met, Trp, or Pro
  misc_feature (9)..(9): Xaa can be Lys, Arg, Tyr, Phe, His, Met, or Leu
EXEHTLLSX

SEQ ID NO: 41159 - protein, 9 aa, Artificial Sequence
  Description of Artificial Sequence: Synthetic peptide
  Seed: EMSSNSTAL (KKLC1_HUMAN)
  misc_feature (2)..(2): Xaa can be Ala, Val, Arg, Leu, Ile, His, Gln, Met, Thr, Tyr, Lys, Pro, Phe, Ser, Gly, Glu, Asn, Cys, Trp, or Asp
  misc_feature (9)..(9): Xaa can be Tyr, Phe, Leu, Met, Val, Trp, Ile, Lys, Ala, His, or Cys
EXSSNSTAX

SEQ ID NO: 41160 - protein, 10 aa, Artificial Sequence
  Description of Artificial Sequence: Synthetic peptide
  Seed: EMSSNSTALA (KKLC1_HUMAN)
  misc_feature (2)..(2): Xaa can be Thr, Ala, Ser, Ile, Val, Asp, Asn, Phe, Gln, Pro, Met, His, Cys, Glu, Tyr, Lys, Leu, Trp, Arg, or Gly
  misc_feature (10)..(10): Xaa can be Ile, Ala, Val, Leu, Met, or Thr
EXSSNSTALX

SEQ ID NO: 41161 - protein, 11 aa, Artificial Sequence
  Description of Artificial Sequence: Synthetic peptide
  Seed: EMSSNSTALAL (KKLC1_HUMAN)
  misc_feature (2)..(2): Xaa can be Gln, Leu, Met, or Ile
  misc_feature (11)..(11): Xaa can be Trp, Phe, Leu, Met, Ile, or Tyr
EXSSNSTALAX

SEQ ID NO: 41162 - protein, 9 aa, Artificial Sequence
  Description of Artificial Sequence: Synthetic peptide
  Seed: FPHSIARQK (KKLC1_HUMAN)
  misc_feature (2)..(2): Xaa can be Pro, Ala, Val, Thr, Ile, Ser, Met, Leu, Gly, Cys, Phe, Gln, Asn, Glu, Asp, or Tyr
  misc_feature (9)..(9): Xaa can be Lys, Arg, Tyr, Leu, Ala, His, Met, Phe, Val, Ile, Cys, Asp, Asn, Glu, Pro, Gln, Gly, Trp, Thr, or Ser
FXHSIARQX

SEQ ID NO: 41163 - protein, 11 aa, Artificial Sequence
  Description of Artificial Sequence: Synthetic peptide
  Seed: FPHSIARQKRI (KKLC1_HUMAN)
  misc_feature (2)..(2): Xaa can be , or Pro
  misc_feature (11)..(11): Xaa can be Leu, Val, Cys, Ala, Ile, Phe, or Met
FXHSIARQKRX

SEQ ID NO: 41164 - protein, 8 aa, Artificial Sequence
  Description of Artificial Sequence: Synthetic peptide
  Seed: FQRNTGEM (KKLC1_HUMAN)
  misc_feature (2)..(2): Xaa can be Ala, Ser, Gln, Val, Thr, Gly, Ile, Met, Leu, Lys, Pro, His, Asn, Glu, Asp, Arg, Phe, or Cy s
  misc_feature (8)..(8): Xaa can be Tyr, Phe, Leu, Met, His, Ile, Trp, or Val
FXRNTGEX

SEQ ID NO: 41165 - protein, 9 aa, Artificial Sequence
  Description of Artificial Sequence: Synthetic peptide
  Seed: FRGASPHRK (KKLC1_HUMAN)
  misc_feature (2)..(2): Xaa can be Arg, Tyr, Phe, Trp, Ala, Ser, Lys, Gly, Gln, Met, His, Leu, Val, Ile, Thr, or Asn
  misc_feature (9)..(9): Xaa can be Phe, Leu, Met, Tyr, Ile, Val, Trp, His, Lys, or Arg
FXGASPHRX

SEQ ID NO: 41166 - protein, 9 aa, Artificial Sequence
  Description of Artificial Sequence: Synthetic peptide
  Seed: FWKYRRFQR (KKLC1_HUMAN)
  misc_feature (2)..(2): Xaa can be Asn, Met, Trp, Tyr, Thr, Gly, Ala, Leu, Ser, Ile, Phe, Gln, Val, Glu, Asp, His, Cys, or Pr o
  misc_feature (9)..(9): Xaa can be Arg, or Lys
FXKYRRFQX

SEQ ID NO: 41167 - protein, 9 aa, Artificial Sequence
  Description of Artificial Sequence: Synthetic peptide
  Seed: FYLLLASSI (KKLC1_HUMAN)
  misc_feature (2)..(2): Xaa can be Arg, Tyr, Phe, Trp, Met, Lys, His, Ala, Ser, Thr, Gln, Gly, Leu, Ile, Val, or Pro
  misc_feature (9)..(9): Xaa can be Met, Phe, Tyr, Leu, Trp, Ile, Val, His, Ala, Lys, Cys, Thr, or Arg
FXLLLASSX

SEQ ID NO: 41168 - protein, 10 aa, Artificial Sequence
  Description of Artificial Sequence: Synthetic peptide
  Seed: FYLLLASSIL (KKLC1_HUMAN)
  misc_feature (2)..(2): Xaa can be Met, Leu, Phe, Tyr, Trp, Glu, Ile, Cys, Ser, Lys, His, Val, Arg, Thr, Asn, Gly, Pro, Asp, Gln, or Ala
  misc_feature (10)..(10): Xaa can be Leu, Ala, Ile, Val, Met, Trp, Phe, Tyr, Glu, His, Arg, Gln, Asp, Gly, Ser, Thr, Pro, Cys, Lys, or Asn
FXLLLASSIX

SEQ ID NO: 41169 - protein, 9 aa, Artificial Sequence
  Description of Artificial Sequence: Synthetic peptide
  Seed: GASPHRKST (KKLC1_HUMAN)
  misc_feature (2)..(2): Xaa can be Ala, Ser, Val, Ile, Gln, Thr, Gly, Met, Glu, Leu, Asn, Cys, Phe, Asp, Pro, or Tyr
  misc_feature (9)..(9): Xaa can be Tyr, Phe, Met, Leu, His, Val, Trp, Ile, Ala, Thr, Cys, or Gln
GXSPHRKSX

SEQ ID NO: 41170 - protein, 8 aa, Artificial Sequence
  Description of Artificial Sequence: Synthetic peptide
  Seed: GEMSSNST (KKLC1_HUMAN)
  misc_feature (2)..(2): Xaa can be , or Glu
  misc_feature (8)..(8): Xaa can be Val, Pro, Ala, Met, Leu, Phe, Ile, Cys, or Thr
GXMSSNSX

SEQ ID NO: 41171 - protein, 9 aa, Artificial Sequence
  Description of Artificial Sequence: Synthetic peptide
  Seed: GEMSSNSTA (KKLC1_HUMAN)
  misc_feature (2)..(2): Xaa can be Glu, Asp, or Gln
  misc_feature (9)..(9): Xaa can be Ile, Cys, Val, Leu, Met, Phe, Tyr, Trp, Ala, Pro, Thr, Gln, Glu, Ser, Lys, Arg, Gly, Asp, or His
GXMSSNSTX

SEQ ID NO: 41172 - protein, 10 aa, Artificial Sequence
  Description of Artificial Sequence: Synthetic peptide
  Seed: GEMSSNSTAL (KKLC1_HUMAN)
  misc_feature (2)..(2): Xaa can be Glu, Asp, Gln, Met, Leu, His, Tyr, Val, Ile, Ser, Phe, Thr, Asn, Arg, Ala, Lys, Gly, Cys, Pro, or Trp
  misc_feature (10)..(10): Xaa can be Tyr, Leu, Ile, Phe, Val, Met, Trp, Ala, Thr, Cys, His, Lys, Pro, Asp, Gly, Ser, Arg, Gln, Asn, or Glu
GXMSSNSTAX

SEQ ID NO: 41173 - protein, 11 aa, Artificial Sequence
  Description of Artificial Sequence: Synthetic peptide
  Seed: GEMSSNSTALA (KKLC1_HUMAN)
  misc_feature (2)..(2): Xaa can be Glu, or Asp
  misc_feature (11)..(11): Xaa can be Cys, Ala, Leu, Met, Val, Tyr, Trp, Ser, Pro, Phe, Gly, Thr, or Ile
GXMSSNSTALX

SEQ ID NO: 41174 - protein, 9 aa, Artificial Sequence
  Description of Artificial Sequence: Synthetic peptide
  Seed: GFRGASPHR (KKLC1_HUMAN)
  misc_feature (2)..(2): Xaa can be Thr, Ser, Val, Met, Ile, Ala, Tyr, Leu, Phe, Gly, Gln, Trp, Asn, Pro, Asp, His, or Cys
  misc_feature (9)..(9): Xaa can be Arg, Lys, Val, Ala, Ile, Leu, Met, Ser, Tyr, Gly, Phe, Pro, Thr, His, Gln, Cys, Asn, or Gl u
GXRGASPHX

SEQ ID NO: 41175 - protein, 10 aa, Artificial Sequence
  Description of Artificial Sequence: Synthetic peptide
  Seed: GFRGASPHRK (KKLC1_HUMAN)
  misc_feature (2)..(2): Xaa can be Thr, Ser, Val, Tyr, Met, Ile, Trp, Gly, Gln, Leu, Ala, Phe, or Asn
  misc_feature (10)..(10): Xaa can be Lys, Arg, Ala, Val, Ile, Leu, Met, or Tyr
GXRGASPHRX

SEQ ID NO: 41176 - protein, 11 aa, Artificial Sequence
  Description of Artificial Sequence: Synthetic peptide
  Seed: GLINSNTDNNL (KKLC1_HUMAN)
  misc_feature (2)..(2): Xaa can be Gln, Met, Leu, Ile, Val, Glu, Ala, Thr, Ser, or Asn
  misc_feature (11)..(11): Xaa can be Trp, Phe, Leu, Ile, Met, Val, or Tyr
GXINSNTDNNX

SEQ ID NO: 41177 - protein, 8 aa, Artificial Sequence
  Description of Artificial Sequence: Synthetic peptide
  Seed: HSIARQKR (KKLC1_HUMAN)
  misc_feature (2)..(2): Xaa can be Tyr, Ile, Ser, Leu, Met, Phe, Thr, Ala, or Val
  misc_feature (8)..(8): Xaa can be , or Arg
HXIARQKX

SEQ ID NO: 41178 - protein, 9 aa, Artificial Sequence
  Description of Artificial Sequence: Synthetic peptide
  Seed: HSIARQKRI (KKLC1_HUMAN)
  misc_feature (2)..(2): Xaa can be Gln, Thr, Ser, Val, Ala, Met, Ile, Leu, Gly, Glu, Phe, Pro, Asp, Cys, or Asn
  misc_feature (9)..(9): Xaa can be Trp, Phe, Tyr, Leu, Val, Ile, Met, or Ala
HXIARQKRX

SEQ ID NO: 41179 - protein, 9 aa, Artificial Sequence
  Description of Artificial Sequence: Synthetic peptide
  Seed: HTLLSKGFR (KKLC1_HUMAN)
  misc_feature (2)..(2): Xaa can be Thr, Val, Ile, Asn, Trp, Gln, Ala, Leu, Met, Tyr, Phe, Asp, Ser, Gly, Glu, Pro, His, or Cy s
  misc_feature (9)..(9): Xaa can be Arg, Lys, Tyr, or His
HXLLSKGFX

SEQ ID NO: 41180 - protein, 8 aa, Artificial Sequence
  Description of Artificial Sequence: Synthetic peptide
  Seed: IARQKRIL (KKLC1_HUMAN)
  misc_feature (2)..(2): Xaa can be Ala, Ser, Pro, Leu, Ile, Met, Gln, Gly, Val, Asn, Phe, Thr, Cys, Glu, Asp, His, or Tyr
  misc_feature (8)..(8): Xaa can be Leu, Ile, Met, Val, Phe, Tyr, or Ala
IXRQKRIX

SEQ ID NO: 41181 - protein, 9 aa, Artificial Sequence
  Description of Artificial Sequence: Synthetic peptide
  Seed: IARQKRILV (KKLC1_HUMAN)
  misc_feature (2)..(2): Xaa can be Ser, Thr, Val, Met, Pro, Ala, Leu, Ile, Phe, Gln, Gly, Arg, Asn, Tyr, Glu, Cys, Asp, Trp, His, or Lys
  misc_feature (9)..(9): Xaa can be Met, Leu, Ile, Lys, Val, Phe, Tyr, Trp, Ala, Arg, Ser, Cys, Gly, Thr, His, Pro, Gln, Asn, or Glu
IXRQKRILX

SEQ ID NO: 41182 - protein, 9 aa, Artificial Sequence
  Description of Artificial Sequence: Synthetic peptide
  Seed: ILCALIVFW (KKLC1_HUMAN)
  misc_feature (2)..(2): Xaa can be Thr, Ser, Ala, Gln, Leu, Met, Val, Ile, Cys, Gly, Glu, Pro, Asn, Asp, Phe, Trp, Tyr, Lys, or Arg
  misc_feature (9)..(9): Xaa can be Trp, Phe, Leu, Tyr, Ile, Met, Val, or Cys
IXCALIVFX

SEQ ID NO: 41183 - protein, 10 aa, Artificial Sequence
  Description of Artificial Sequence: Synthetic peptide
  Seed: ILCALIVFWK (KKLC1_HUMAN)
  misc_feature (2)..(2): Xaa can be Met, Gln, Ala, Asn, Trp, Tyr, Leu, Thr, Phe, Gly, Ser, Ile, Val, Glu, Pro, Arg, Cys, His, or Lys
  misc_feature (10)..(10): Xaa can be Arg, Lys, or His
IXCALIVFWX

SEQ ID NO: 41184 - protein, 9 aa, Artificial Sequence
  Description of Artificial Sequence: Synthetic peptide
  Seed: ILNNFPHSI (KKLC1_HUMAN)
  misc_feature (2)..(2): Xaa can be Ala, Tyr, Gln, Met, Phe, Leu, Arg, Ser, Ile, Val, Thr, Trp, Gly, His, Glu, Pro, Asn, Cys, Asp, or Lys
  misc_feature (9)..(9): Xaa can be Phe, Tyr, Val, Ile, Leu, Met, Trp, Arg, Lys, His, Cys, Ala, Thr, Ser, Gln, Gly, or Pro
IXNNFPHSX

SEQ ID NO: 41185 - protein, 10 aa, Artificial Sequence
  Description of Artificial Sequence: Synthetic peptide
  Seed: ILNNFPHSIA (KKLC1_HUMAN)
  misc_feature (2)..(2): Xaa can be Met, Leu, Val, Ile, Thr, or Gln
  misc_feature (10)..(10): Xaa can be Val, Leu, Ile, Pro, Phe, Met, Thr, Ser, Ala, Trp, Glu, Gly, Lys, Gln, Asn, His, Asp, Arg, Cys, or Tyr
IXNNFPHSIX

SEQ ID NO: 41186 - protein, 11 aa, Artificial Sequence
  Description of Artificial Sequence: Synthetic peptide
  Seed: ILNNFPHSIAR (KKLC1_HUMAN)
  misc_feature (2)..(2): Xaa can be Ala, Val, Thr, Ser, Ile, Asp, Asn, Gly, Met, Cys, Phe, Gln, Glu, Leu, Trp, Tyr, Pro, Lys, His, or Arg
  misc_feature (11)..(11): Xaa can be Arg, Lys, Leu, Met, Tyr, Phe, Ile, or Val
IXNNFPHSIAX

SEQ ID NO: 41187 - protein, 8 aa, Artificial Sequence
  Description of Artificial Sequence: Synthetic peptide
  Seed: ILVNLSMV (KKLC1_HUMAN)
  misc_feature (2)..(2): Xaa can be Leu, or Met
  misc_feature (8)..(8): Xaa can be , or Val
IXVNLSMX

SEQ ID NO: 41188 - protein, 11 aa, Artificial Sequence
  Description of Artificial Sequence: Synthetic peptide
  Seed: ILVNLSMVENK (KKLC1_HUMAN)
  misc_feature (2)..(2): Xaa can be Thr, Ile, Met, Leu, Val, Ser, or Ala
  misc_feature (11)..(11): Xaa can be Lys, or Arg
IXVNLSMVENX

SEQ ID NO: 41189 - protein, 9 aa, Artificial Sequence
  Description of Artificial Sequence: Synthetic peptide
  Seed: INSNTDNNL (KKLC1_HUMAN)
  misc_feature (2)..(2): Xaa can be Tyr, Arg, Phe, Ala, Trp, Ser, Gln, Ile, Leu, Thr, Asn, Gly, Met, His, or Val
  misc_feature (9)..(9): Xaa can be Leu, Met, Ile, Phe, or Val
IXSNTDNNX

SEQ ID NO: 41190 - protein, 8 aa, Artificial Sequence
  Description of Artificial Sequence: Synthetic peptide
  Seed: IVFWKYRR (KKLC1_HUMAN)
  misc_feature (2)..(2): Xaa can be Trp, Gln, Ile, Phe, Met, Tyr, Val, Thr, Ser, Leu, Gly, Asn, or Ala
  misc_feature (8)..(8): Xaa can be Arg, or Lys
IXFWKYRX

SEQ ID NO: 41191 - protein, 9 aa, Artificial Sequence
  Description of Artificial Sequence: Synthetic peptide
  Seed: IVFWKYRRF (KKLC1_HUMAN)
  misc_feature (2)..(2): Xaa can be Gln, Ala, Met, Val, Thr, Ser, Gly, Glu, Lys, Leu, Ile, His, Asn, Cys, Pro, Arg, or Asp
  misc_feature (9)..(9): Xaa can be Tyr, Trp, Phe, Met, Leu, Val, Ile, Ala, or His
IXFWKYRRX

SEQ ID NO: 41192 - protein, 11 aa, Artificial Sequence
  Description of Artificial Sequence: Synthetic peptide
  Seed: IVFWKYRRFQR (KKLC1_HUMAN)
  misc_feature (2)..(2): Xaa can be Met, Ile, Ala, Val, Phe, Trp, Ser, Leu, Asn, Arg, Gln, Lys, Thr, Cys, Gly, Tyr, His, Asp, Pro, or Glu
  misc_feature (11)..(11): Xaa can be Arg, Lys, His, or Tyr
IXFWKYRRFQX

SEQ ID NO: 41193 - protein, 9 aa, Artificial Sequence
  Description of Artificial Sequence: Synthetic peptide
  Seed: KGFRGASPH (KKLC1_HUMAN)
  misc_feature (2)..(2): Xaa can be Gln, Met, Ala, Lys, Leu, Ile, Arg, His, Ser, Thr, Val, Glu, Asn, Gly, Phe, Tyr, Cys, Trp, Asp, or Pro
  misc_feature (9)..(9): Xaa can be Tyr, Met, Phe, Leu, Ile, Trp, His, Val, Ala, Gly, Ser, Cys, Thr, Gln, Glu, Asn, Pro, Lys, Asp, or Arg
KXFRGASPX

SEQ ID NO: 41194 - protein, 10 aa, Artificial Sequence
  Description of Artificial Sequence: Synthetic peptide
  Seed: KGFRGASPHR (KKLC1_HUMAN)
  misc_feature (2)..(2): Xaa can be Met, Ser, Val, Thr, Ile, Ala, Tyr, Leu, Asn, Phe, Gln, Trp, Asp, Pro, Gly, Lys, His, Glu, Cys, or Arg
  misc_feature (10)..(10): Xaa can be Ala, Phe, Gly, Ser, Met, Val, Thr, Arg, Tyr, Lys, Ile, Leu, Pro, Gln, Cys, Glu, Asn, or Hi s
KXFRGASPHX

SEQ ID NO: 41195 - protein, 11 aa, Artificial Sequence
  Description of Artificial Sequence: Synthetic peptide
  Seed: KGFRGASPHRK (KKLC1_HUMAN)
  misc_feature (2)..(2): Xaa can be Thr, Val, Ile, Met, Leu, Ser, Tyr, Phe, Asn, Gly, Gln, Ala, Cys, Trp, Arg, Glu, or Lys
  misc_feature (11)..(11): Xaa can be Lys, Arg, Tyr, His, Met, Leu, Phe, Ala, Ile, or Val
KXFRGASPHRX

SEQ ID NO: 41196 - protein, 9 aa, Artificial Sequence
  Description of Artificial Sequence: Synthetic peptide
  Seed: KLVELEHTL (KKLC1_HUMAN)
  misc_feature (2)..(2): Xaa can be Arg, Glu, Gln, Met, Leu, Asp, Ala, Ser, Thr, Val, Tyr, Ile, His, Phe, Trp, Lys, Asn, Gly, Cys, or Pro
  misc_feature (9)..(9): Xaa can be Ile, Met, Trp, Val, Leu, Phe, Tyr, Lys, Arg, His, Cys, Ala, Thr, Ser, Gly, Gln, Pro, Glu, or Asn
KXVELEHTX

SEQ ID NO: 41197 - protein, 10 aa, Artificial Sequence
  Description of Artificial Sequence: Synthetic peptide
  Seed: KLVELEHTLL (KKLC1_HUMAN)
  misc_feature (2)..(2): Xaa can be Leu, Met, Gln, Val, Ile, Thr, Ser, Ala, Glu, Asn, Gly, Tyr, His, Trp, Phe, Lys, Cys, or Ar g
  misc_feature (10)..(10): Xaa can be Trp, Lys, Arg, Leu, Phe, Ile, Met, Tyr, Val, Ala, Thr, Cys, Asp, Pro, His, Gly, Gln, Glu, Ser, or Asn
KXVELEHTLX

SEQ ID NO: 41198 - protein, 11 aa, Artificial Sequence
  Description of Artificial Sequence: Synthetic peptide
  Seed: KLVELEHTLLS (KKLC1_HUMAN)
  misc_feature (2)..(2): Xaa can be Leu, Met, Gln, Val, Ile, Thr, Phe, or Tyr
  misc_feature (11)..(11): Xaa can be Val, Leu, Ile, Ala, Phe, Met, Thr, Cys, or Ser
KXVELEHTLLX

SEQ ID NO: 41199 - protein, 9 aa, Artificial Sequence
  Description of Artificial Sequence: Synthetic peptide
  Seed: KRILVNLSM (KKLC1_HUMAN)
  misc_feature (2)..(2): Xaa can be Arg, Gln, His, Lys, Met, Glu, Ala, Ser, Asp, Gly, Asn, Tyr, Leu, Phe, Thr, Ile, Val, Trp, Cys, or Pro
  misc_feature (9)..(9): Xaa can be Leu, Tyr, Phe, Met, Ile, Val, Lys, His, Arg, Trp, Ala, Gly, Cys, Thr, Ser, Asn, Pro, Gln, or Glu
KXILVNLSX

SEQ ID NO: 41200 - protein, 10 aa, Artificial Sequence
  Description of Artificial Sequence: Synthetic peptide
  Seed: KRILVNLSMV (KKLC1_HUMAN)
  misc_feature (2)..(2): Xaa can be Arg, Leu, Met, Gln, Ile, Val, Lys, Cys, Trp, Gly, Asp, Phe, Asn, His, Tyr, Glu, Thr, Pro, Ala, or Ser
  misc_feature (10)..(10): Xaa can be Val, Leu, Ile, Ala, Met, Thr, Phe, Cys, Glu, Trp, Ser, Lys, Gly, Arg, Pro, Asp, His, Gln, Asn, or Tyr
KXILVNLSMX

SEQ ID NO: 41201 - protein, 9 aa, Artificial Sequence
  Description of Artificial Sequence: Synthetic peptide
  Seed: KYRRFQRNT (KKLC1_HUMAN)
  misc_feature (2)..(2): Xaa can be Thr, Met, Val, Ser, Ile, Ala, Tyr, Leu, Phe, Gln, Trp, Gly, Asn, Cys, His, Lys, Arg, Glu, or Pro
  misc_feature (9)..(9): Xaa can be Lys, Val, Met, Ala, Leu, Ser, Tyr, Arg, Ile, Gly, Thr, Phe, Pro, Cys, Asn, Gln, Glu, His, Asp, or Trp
KXRRFQRNX

SEQ ID NO: 41202 - protein, 10 aa, Artificial Sequence
  Description of Artificial Sequence: Synthetic peptide
  Seed: KYRRFQRNTG (KKLC1_HUMAN)
  misc_feature (2)..(2): Xaa can be Thr, Val, Ser, Met, Tyr, Phe, Ile, Ala, Trp, Leu, Gln, Gly, Asn, His, Cys, Lys, Arg, Glu, or Pro
  misc_feature (10)..(10): Xaa can be Lys, Leu, Ala, Val, Ile, Met, Arg, Ser, Tyr, Gly, Thr, Pro, Phe, Cys, Glu, Gln, Asn, His, Trp, or Asp
KXRRFQRNTX

SEQ ID NO: 41203 - protein, 9 aa, Artificial Sequence
  Description of Artificial Sequence: Synthetic peptide
  Seed: LASSILCAL (KKLC1_HUMAN)
  misc_feature (2)..(2): Xaa can be Pro, Leu, Met, Gln, Ile, Val, Ala, Thr, Ser, Gly, Arg, Asn, Lys, Glu, Asp, Tyr, His, Phe, Cys, or Trp
  misc_feature (9)..(9): Xaa can be Leu, Trp, Tyr, Phe, Met, Val, Ile, Lys, His, Ala, Cys, Thr, Ser, Arg, Gly, Pro, Gln, Asn, or Glu
LXSSILCAX

SEQ ID NO: 41204 - protein, 10 aa, Artificial Sequence
  Description of Artificial Sequence: Synthetic peptide
  Seed: LASSILCALI (KKLC1_HUMAN)
  misc_feature (2)..(2): Xaa can be Ile, Met, Leu, Gln, Ser, Val, Thr, Ala, Phe, Gly, Tyr, Asn, Cys, Glu, His, Arg, Pro, Asp, Trp, or Lys
  misc_feature (10)..(10): Xaa can be Phe, Trp, Val, Met, Tyr, Ile, Leu, Ala, Thr, Ser, Gly, Cys, Asn, Pro, Lys, Asp, Arg, Glu, Gln, or His
LXSSILCALX

SEQ ID NO: 41205 - protein, 8 aa, Artificial Sequence
  Description of Artificial Sequence: Synthetic peptide
  Seed: LCALIVFW (KKLC1_HUMAN)
  misc_feature (2)..(2): Xaa can be Leu, Ile, Thr, Ser, Val, Met, Gln, Ala, Asn, Cys, Asp, or Gly
  misc_feature (8)..(8): Xaa can be , or Trp
LXALIVFX

SEQ ID NO: 41206 - protein, 9 aa, Artificial Sequence
  Description of Artificial Sequence: Synthetic peptide
  Seed: LCALIVFWK (KKLC1_HUMAN)
  misc_feature (2)..(2): Xaa can be Thr, Ser, Ile, Leu, Val, Gly, Met, Ala, Asn, Gln, Glu, Pro, Asp, Phe, or Cys
  misc_feature (9)..(9): Xaa can be Lys, Arg, His, or Tyr
LXALIVFWX

SEQ ID NO: 41207 - protein, 11 aa, Artificial Sequence
  Description of Artificial Sequence: Synthetic peptide
  Seed: LCALIVFWKYR (KKLC1_HUMAN)
  misc_feature (2)..(2): Xaa can be Gly, Lys, Ser, Arg, Phe, Tyr, Ile, Ala, Gln, Thr, Met, His, Trp, Leu, Val, Pro, Cys, Asn, Glu, or Asp
  misc_feature (11)..(11): Xaa can be Arg, or Lys
LXALIVFWKYX

SEQ ID NO: 41208 - protein, 9 aa, Artificial Sequence
  Description of Artificial Sequence: Synthetic peptide
  Seed: LEHTLLSKG (KKLC1_HUMAN)
  misc_feature (2)..(2): Xaa can be Glu, or Asp
  misc_feature (9)..(9): Xaa can be Leu, Cys, Ile, Val, Ala, Met, Ser, Pro, Gly, Tyr, Phe, or Thr
LXHTLLSKX

SEQ ID NO: 41209 - protein, 10 aa, Artificial Sequence
  Description of Artificial Sequence: Synthetic peptide
  Seed: LEHTLLSKGF (KKLC1_HUMAN)
  misc_feature (2)..(2): Xaa can be Glu, Asp, or Gln
  misc_feature (10)..(10): Xaa can be Trp, Phe, Val, Leu, Met, Tyr, or Ile
LXHTLLSKGX

SEQ ID NO: 41210 - protein, 11 aa, Artificial Sequence
  Description of Artificial Sequence: Synthetic peptide
  Seed: LEHTLLSKGFR (KKLC1_HUMAN)
  misc_feature (2)..(2): Xaa can be Met, Phe, Thr, Tyr, Trp, Ala, His, Glu, Lys, Cys, Leu, Gln, Arg, Asn, Pro, Asp, Val, Gly, Ser, or Ile
  misc_feature (11)..(11): Xaa can be Arg, or Lys
LXHTLLSKGFX

SEQ ID NO: 41211 - protein, 10 aa, Artificial Sequence
  Description of Artificial Sequence: Synthetic peptide
  Seed: LINSNTDNNL (KKLC1_HUMAN)
  misc_feature (2)..(2): Xaa can be Arg, Gln, Met, Leu, Ile, Ala, Val, Gly, Pro, Ser, Glu, or Thr
  misc_feature (10)..(10): Xaa can be Leu, Phe, Trp, Ile, Met, Tyr, Val, Arg, or Lys
LXNSNTDNNX

SEQ ID NO: 41212 - protein, 8 aa, Artificial Sequence
  Description of Artificial Sequence: Synthetic peptide
  Seed: LIVFWKYR (KKLC1_HUMAN)
  misc_feature (2)..(2): Xaa can be Phe, Tyr, Met, Trp, Leu, Thr, Ser, Ala, Val, Ile, Gln, or Asn
  misc_feature (8)..(8): Xaa can be Arg, or Lys
LXVFWKYX

SEQ ID NO: 41213 - protein, 9 aa, Artificial Sequence
  Description of Artificial Sequence: Synthetic peptide
  Seed: LIVFWKYRR (KKLC1_HUMAN)
  misc_feature (2)..(2): Xaa can be Met, Leu, Phe, Val, Thr, Tyr, Ile, Gln, Asn, Pro, Trp, Ala, His, Gly, Ser, Asp, Arg, Cys, Glu, or Lys
  misc_feature (9)..(9): Xaa can be Arg, Lys, Tyr, His, Val, Leu, or Met
LXVFWKYRX

SEQ ID NO: 41214 - protein, 9 aa, Artificial Sequence
  Description of Artificial Sequence: Synthetic peptide
  Seed: LLASSILCA (KKLC1_HUMAN)
  misc_feature (2)..(2): Xaa can be Met, Leu, Val, Ile, Gln, Ala, Thr, Ser, Gly, Phe, or Asn
  misc_feature (9)..(9): Xaa can be Val, Leu, Ala, Ile, Met, Thr, Cys, Ser, or Phe
LXASSILCX

SEQ ID NO: 41215 - protein, 10 aa, Artificial Sequence
  Description of Artificial Sequence: Synthetic peptide
  Seed: LLASSILCAL (KKLC1_HUMAN)
  misc_feature (2)..(2): Xaa can be Met, Leu, Gln, Val, Ile, Thr, Phe, Ser, Ala, Trp, Tyr, Gly, Asn, Glu, Asp, Lys, Cys, Pro, Arg, or His
  misc_feature (10)..(10): Xaa can be Phe, Val, Tyr, Leu, Met, Ile, Arg, Lys, Ala, Thr, Cys, Trp, Pro, Ser, His, or Gly
LXASSILCAX

SEQ ID NO: 41216 - protein, 11 aa, Artificial Sequence
  Description of Artificial Sequence: Synthetic peptide
  Seed: LLASSILCALI (KKLC1_HUMAN)
  misc_feature (2)..(2): Xaa can be Met, Leu, Gln, Ile, Thr, or Val
  misc_feature (11)..(11): Xaa can be Val, Leu, Ile, Ala, Met, Trp, Arg, Lys, Ser, Gln, Phe, Thr, Asn, Glu, Tyr, Cys, Asp, His, Gly, or Pro
LXASSILCALX

SEQ ID NO: 41217 - protein, 9 aa, Artificial Sequence
  Description of Artificial Sequence: Synthetic peptide
  Seed: LLLASSILC (KKLC1_HUMAN)
  misc_feature (2)..(2): Xaa can be Met, Leu, Val, Ile, Gln, Thr, Ser, Phe, or Ala
  misc_feature (9)..(9): Xaa can be Val, Ile, Leu, Met, Ala, Thr, Cys, Phe, or Ser
LXLASSILX

SEQ ID NO: 41218 - protein, 10 aa, Artificial Sequence
  Description of Artificial Sequence: Synthetic peptide
  Seed: LLLASSILCA (KKLC1_HUMAN)
  misc_feature (2)..(2): Xaa can be Met, Phe, Leu, Tyr, Gln, Trp, Lys, Pro, Ile, Gly, Ser, Asn, Arg, Asp, Ala, Thr, Val, Cys, His, or Glu
  misc_feature (10)..(10): Xaa can be Leu, Val, Ala, Met, Ile, or Thr
LXLASSILCX

SEQ ID NO: 41219 - protein, 11 aa, Artificial Sequence
  Description of Artificial Sequence: Synthetic peptide
  Seed: LLLASSILCAL (KKLC1_HUMAN)
  misc_feature (2)..(2): Xaa can be Met, Tyr, Leu, Phe, Ser, Ile, Thr, Ala, His, Lys, Gln, Arg, Trp, Val, Gly, Asn, or Cys
  misc_feature (11)..(11): Xaa can be Val, Ile, Leu, Ala, or Met
LXLASSILCAX

SEQ ID NO: 41220 - protein, 9 aa, Artificial Sequence
  Description of Artificial Sequence: Synthetic peptide
  Seed: LLSKGFRGA (KKLC1_HUMAN)
  misc_feature (2)..(2): Xaa can be Leu, Met, Gln, Val, Ile, Ala, Thr, or Ser
  misc_feature (9)..(9): Xaa can be Val, Leu, Ile, Met, Ala, or Thr
LXSKGFRGX

SEQ ID NO: 41221 - protein, 10 aa, Artificial Sequence
  Description of Artificial Sequence: Synthetic peptide
  Seed: LNNFPHSIAR (KKLC1_HUMAN)
  misc_feature (2)..(2): Xaa can be Thr, Asn, Trp, Ile, Tyr, Phe, Leu, Gly, Ala, Ser, Met, Gln, Pro, Val, Cys, His, Lys, Arg, Glu, or Asp
  misc_feature (10)..(10): Xaa can be Arg, Lys, or Tyr
LXNFPHSIAX

SEQ ID NO: 41222 - protein, 9 aa, Artificial Sequence
  Description of Artificial Sequence: Synthetic peptide
  Seed: LSKGFRGAS (KKLC1_HUMAN)
  misc_feature (2)..(2): Xaa can be Thr, Ser, Val, Ala, Asn, Met, Gly, Trp, Gln, Ile, Phe, Leu, or Tyr
  misc_feature (9)..(9): Xaa can be Lys, Ala, Tyr, Val, Ile, Ser, Leu, Met, Gly, or Arg
LXKGFRGAX

SEQ ID NO: 41223 - protein, 8 aa, Artificial Sequence
  Description of Artificial Sequence: Synthetic peptide
  Seed: LSMVENKL (KKLC1_HUMAN)
  misc_feature (2)..(2): Xaa can be Ser, Ala, Thr, Gln, Met, Glu, Gly, Asn, Val, Cys, or Ile
  misc_feature (8)..(8): Xaa can be Trp, Leu, Ile, Val, Met, Phe, or Tyr
LXMVENKX

SEQ ID NO: 41224 - protein, 9 aa, Artificial Sequence
  Description of Artificial Sequence: Synthetic peptide
  Seed: LSMVENKLV (KKLC1_HUMAN)
  misc_feature (2)..(2): Xaa can be Gln, Thr, Ser, Ala, Val, Met, Ile, Gly, Asn, Glu, Asp, Pro, Cys, Leu, Tyr, Lys, Trp, His, Arg, or Phe
  misc_feature (9)..(9): Xaa can be Trp, Phe, Leu, Tyr, Val, Ile, Met, Cys, or Ala
LXMVENKLX

SEQ ID NO: 41225 - protein, 11 aa, Artificial Sequence
  Description of Artificial Sequence: Synthetic peptide
  Seed: LSMVENKLVEL (KKLC1_HUMAN)
  misc_feature (2)..(2): Xaa can be Ala, Ser, Met, Leu, Thr, Phe, Ile, Tyr, Val, Gly, Lys, Trp, Gln, Cys, Arg, Asn, Asp, Pro, Glu, or His
  misc_feature (11)..(11): Xaa can be Trp, Val, Ile, Leu, Phe, Met, Ala, Lys, Tyr, or Thr
LXMVENKLVEX

SEQ ID NO: 41226 - protein, 9 aa, Artificial Sequence
  Description of Artificial Sequence: Synthetic peptide
  Seed: LSRDILNNF (KKLC1_HUMAN)
  misc_feature (2)..(2): Xaa can be Ala, Arg, Ser, Val, Thr, Gln, Ile, Asn, Pro, Gly, Glu, Met, Leu, Phe, Tyr, His, Lys, Asp, Cys, or Trp
  misc_feature (9)..(9): Xaa can be Leu, Phe, Trp, Ile, Tyr, Met, Val, His, Lys, Ala, Arg, Cys, Ser, Gln, or Thr
LXRDILNNX

SEQ ID NO: 41227 - protein, 8 aa, Artificial Sequence
  Description of Artificial Sequence: Synthetic peptide
  Seed: LVELEHTL (KKLC1_HUMAN)
  misc_feature (2)..(2): Xaa can be Ser, Ala, Thr, Cys, Gly, Phe, Met, Val, Ile, Gln, or Leu
  misc_feature (8)..(8): Xaa can be Leu, Phe, Met, Val, or Ile
LXELEHTX

SEQ ID NO: 41228 - protein, 9 aa, Artificial Sequence
  Description of Artificial Sequence: Synthetic peptide
  Seed: LVELEHTLL (KKLC1_HUMAN)
  misc_feature (2)..(2): Xaa can be Ala, Ile, Tyr, Thr, Val, Phe, Ser, Gly, Gln, Trp, Met, Leu, Cys, Arg, His, Asn, Pro, Glu, Asp, or Lys
  misc_feature (9)..(9): Xaa can be Leu, Met, Phe, Ile, Val, Tyr, Lys, Cys, Trp, or Arg
LXELEHTLX

SEQ ID NO: 41229 - protein, 11 aa, Artificial Sequence
  Description of Artificial Sequence: Synthetic peptide
  Seed: LVELEHTLLSK (KKLC1_HUMAN)
  misc_feature (2)..(2): Xaa can be Thr, Ser, Val, Ile, Gln, Asn, Cys, Met, Leu, Ala, or Gly
  misc_feature (11)..(11): Xaa can be Tyr, Lys, His, or Phe
LXELEHTLLSX

SEQ ID NO: 41230 - protein, 10 aa, Artificial Sequence
  Description of Artificial Sequence: Synthetic peptide
  Seed: LVNLSMVENK (KKLC1_HUMAN)
  misc_feature (2)..(2): Xaa can be Ile, Ser, Ala, Val, Thr, Met, Leu, or Gln
  misc_feature (10)..(10): Xaa can be Lys, Tyr, or Arg
LXNLSMVENX

SEQ ID NO: 41231 - protein, 11 aa, Artificial Sequence
  Description of Artificial Sequence: Synthetic peptide
  Seed: LVNLSMVENKL (KKLC1_HUMAN)
  misc_feature (2)..(2): Xaa can be Cys, Lys, Met, Trp, His, Pro, Arg, Asn, Thr, Gly, Phe, Val, Tyr, Gln, Glu, Ser, Ala, Leu, Asp, or Ile
  misc_feature (11)..(11): Xaa can be Val, or Leu
LXNLSMVENKX

SEQ ID NO: 41232 - protein, 9 aa, Artificial Sequence
  Description of Artificial Sequence: Synthetic peptide
  Seed: LVRPSSSGL (KKLC1_HUMAN)
  misc_feature (2)..(2): Xaa can be Pro, Thr, Ser, Val, Ala, Met, Ile, Gln, Tyr, Leu, Arg, Gly, Asn, Phe, Cys, Trp, Lys, Glu, His, or Asp
  misc_feature (9)..(9): Xaa can be Tyr, Phe, Lys, Met, Leu, Val, Ile, Ala, Trp, His, Arg, Gly, Ser, Thr, Cys, Pro, Gln, Asn, or Glu
LXRPSSSGX

SEQ ID NO: 41233 - protein, 10 aa, Artificial Sequence
  Description of Artificial Sequence: Synthetic peptide
  Seed: LVRPSSSGLI (KKLC1_HUMAN)
  misc_feature (2)..(2): Xaa can be Thr, Ser, Val, Tyr, Met, Ala, Ile, Phe, Cys, Gly, Gln, Trp, His, Leu, or Asn
  misc_feature (10)..(10): Xaa can be Lys, Ala, Val, Ile, Met, Leu, Tyr, Ser, Arg, Thr, or Gly
LXRPSSSGLX

SEQ ID NO: 41234 - protein, 11 aa, Artificial Sequence
  Description of Artificial Sequence: Synthetic peptide
  Seed: MNFYLLLASSI (KKLC1_HUMAN)
  misc_feature (2)..(2): Xaa can be Tyr, Trp, Ile, Pro, His, Arg, Glu, Asp, Val, Gln, Ser, Cys, Asn, Thr, Gly, Lys, Phe, Leu, Ala, or Met
  misc_feature (11)..(11): Xaa can be Leu, Trp, Ile, Phe, or Met
MXFYLLLASSX

SEQ ID NO: 41235 - protein, 8 aa, Artificial Sequence
  Description of Artificial Sequence: Synthetic peptide
  Seed: MSSNSTAL (KKLC1_HUMAN)
  misc_feature (2)..(2): Xaa can be Ala, Ser, Thr, Val, Met, Gly, Ile, Gln, Phe, Tyr, or Arg
  misc_feature (8)..(8): Xaa can be Leu, Phe, Tyr, Met, Ile, Val, or His
MXSNSTAX

SEQ ID NO: 41236 - protein, 9 aa, Artificial Sequence
  Description of Artificial Sequence: Synthetic peptide
  Seed: MSSNSTALA (KKLC1_HUMAN)
  misc_feature (2)..(2): Xaa can be Ala, Thr, Met, Leu, Val, Gln, Ser, Ile, Gly, Asn, Pro, Phe, Cys, Tyr, Glu, Trp, or Asp
  misc_feature (9)..(9): Xaa can be Tyr, Phe, Met, Val, Lys, Leu, Ile, Ala, His, Thr, Ser, Cys, Trp, Gly, Pro, Arg, or Gln
MXSNSTALX

SEQ ID NO: 41237 - protein, 10 aa, Artificial Sequence
  Description of Artificial Sequence: Synthetic peptide
  Seed: MSSNSTALAL (KKLC1_HUMAN)
  misc_feature (2)..(2): Xaa can be Leu, Met, Ser, Ala, Thr, Gln, Ile, Val, Arg, Gly, Phe, Asn, Glu, His, Lys, Asp, Tyr, Pro, Trp, or Cys
  misc_feature (10)..(10): Xaa can be Trp, Val, Phe, Leu, Tyr, Met, Ile, Lys, His, Arg, Ala, Cys, Gly, Thr, Asn, Gln, Asp, Glu, Ser, or Pro
MXSNSTALAX

SEQ ID NO: 41238 - protein, 11 aa, Artificial Sequence
  Description of Artificial Sequence: Synthetic peptide
  Seed: MSSNSTALALV (KKLC1_HUMAN)
  misc_feature (2)..(2): Xaa can be Thr, Ser, Leu, Met, Gln, Ala, Val, Ile, Cys, Gly, Asn, Pro, Lys, Phe, Glu, Asp, Trp, or Ty r
  misc_feature (11)..(11): Xaa can be Trp, Phe, Leu, Val, Ile, Met, Ala, or Tyr
MXSNSTALALX

SEQ ID NO: 41239 - protein, 9 aa, Artificial Sequence
  Description of Artificial Sequence: Synthetic peptide
  Seed: MVENKLVEL (KKLC1_HUMAN)
  misc_feature (2)..(2): Xaa can be Glu, Pro, Met, Phe, Ala, Tyr, Leu, Val, Gln, Ile, Ser, Thr, Arg, Trp, Asp, Gly, Asn, Lys, Cys, or His
  misc_feature (9)..(9): Xaa can be Ile, Met, Val, Phe, Tyr, Leu, Trp, Arg, Lys, Cys, Ala, His, Thr, Pro, Ser, or Gly
MXENKLVEX

SEQ ID NO: 41240 - protein, 8 aa, Artificial Sequence
  Description of Artificial Sequence: Synthetic peptide
  Seed: NFPHSIAR (KKLC1_HUMAN)
  misc_feature (2)..(2): Xaa can be , or Phe
  misc_feature (8)..(8): Xaa can be , or Arg
NXPHSIAX

SEQ ID NO: 41241 - protein, 11 aa, Artificial Sequence
  Description of Artificial Sequence: Synthetic peptide
  Seed: NFPHSIARQKR (KKLC1_HUMAN)
  misc_feature (2)..(2): Xaa can be Met, Ala, Phe, Thr, Leu, Ile, Tyr, Val, Ser, or Trp
  misc_feature (11)..(11): Xaa can be , or Arg
NXPHSIARQKX

SEQ ID NO: 41242 - protein, 10 aa, Artificial Sequence
  Description of Artificial Sequence: Synthetic peptide
  Seed: NFYLLLASSI (KKLC1_HUMAN)
  misc_feature (2)..(2): Xaa can be Tyr, Lys, Arg, Trp, Thr, Ala, Pro, Met, His, Gly, Gln, Ile, Phe, Asn, Val, Glu, Cys, Leu, Ser, or Asp
  misc_feature (10)..(10): Xaa can be Ile, Phe, Trp, Leu, or Met
NXYLLLASSX

SEQ ID NO: 41243 - protein, 10 aa, Artificial Sequence
  Description of Artificial Sequence: Synthetic peptide
  Seed: NKLVELEHTL (KKLC1_HUMAN)
  misc_feature (2)..(2): Xaa can be Met, Trp, Leu, Phe, Tyr, Gly, Arg, Thr, Lys, Val, His, Ser, Ile, Ala, Glu, Cys, Gln, Asp, Pro, or Asn
  misc_feature (10)..(10): Xaa can be Val, Leu, Ile, Met, or Ala
NXLVELEHTX

SEQ ID NO: 41244 - protein, 11 aa, Artificial Sequence
  Description of Artificial Sequence: Synthetic peptide
  Seed: NKLVELEHTLL (KKLC1_HUMAN)
  misc_feature (2)..(2): Xaa can be Phe, Tyr, Met, Trp, Leu, Arg, Ser, or Lys
  misc_feature (11)..(11): Xaa can be Leu, Val, Ile, Met, or Ala
NXLVELEHTLX

SEQ ID NO: 41245 - protein, 9 aa, Artificial Sequence
  Description of Artificial Sequence: Synthetic peptide
  Seed: NLAVYDLSR (KKLC1_HUMAN)
  misc_feature (2)..(2): Xaa can be Ala, Thr, Val, Ile, Ser, Met, Leu, Pro, Phe, Tyr, Asn, Cys, Asp, Glu, Gln, Gly, Trp, or Hi s
  misc_feature (9)..(9): Xaa can be Arg, Lys, Tyr, His, Leu, Met, Ile, Phe, or Val
NXAVYDLSX

SEQ ID NO: 41246 - protein, 9 aa, Artificial Sequence
  Description of Artificial Sequence: Synthetic peptide
  Seed: NLSMVENKL (KKLC1_HUMAN)
  misc_feature (2)..(2): Xaa can be Gln, Met, Leu, Ala, Arg, Ile, Val, Thr, Ser, Glu, Tyr, His, Phe, Asn, or Gly
  misc_feature (9)..(9): Xaa can be Leu, Met, Phe, Trp, Val, Ile, Tyr, or Ala
NXSMVENKX

SEQ ID NO: 41247 - protein, 10 aa, Artificial Sequence
  Description of Artificial Sequence: Synthetic peptide
  Seed: NLSMVENKLV (KKLC1_HUMAN)
  misc_feature (2)..(2): Xaa can be Met, Leu, or Ile
  misc_feature (10)..(10): Xaa can be Leu, Val, Ile, Met, or Ala
NXSMVENKLX

SEQ ID NO: 41248 - protein, 9 aa, Artificial Sequence
  Description of Artificial Sequence: Synthetic peptide
  Seed: NNFPHSIAR (KKLC1_HUMAN)
  misc_feature (2)..(2): Xaa can be Ala, Arg, Thr, Ser, Val, Ile, Gly, Gln, Tyr, Leu, Met, Phe, Cys, His, Asn, Trp, Glu, Lys, Pro, or Asp
  misc_feature (9)..(9): Xaa can be Lys, Met, Phe, Arg, Leu, Tyr, Ile, His, Val, Trp, Ala, Cys, Thr, Gln, Ser, Asn, Pro, Glu, or Gly
NXFPHSIAX

SEQ ID NO: 41249 - protein, 11 aa, Artificial Sequence
  Description of Artificial Sequence: Synthetic peptide
  Seed: NNFPHSIARQK (KKLC1_HUMAN)
  misc_feature (2)..(2): Xaa can be Val, Thr, Ile, Ala, Met, Leu, Ser, Gln, Tyr, Trp, Asp, Gly, Glu, Cys, Pro, Phe, His, Asn, or Lys
  misc_feature (11)..(11): Xaa can be Arg, Lys, Tyr, His, Phe, Met, Leu, Gln, Trp, or Asn
NXFPHSIARQX

SEQ ID NO: 41250 - protein, 10 aa, Artificial Sequence
  Description of Artificial Sequence: Synthetic peptide
  Seed: NNLAVYDLSR (KKLC1_HUMAN)
  misc_feature (2)..(2): Xaa can be Thr, Phe, Ser, Tyr, Ala, Ile, Met, Trp, Val, Cys, Gln, Arg, Gly, Leu, Pro, Asn, Lys, or Hi s
  misc_feature (10)..(10): Xaa can be Arg, Lys, or Tyr
NXLAVYDLSX

SEQ ID NO: 41251 - protein, 10 aa, Artificial Sequence
  Description of Artificial Sequence: Synthetic peptide
  Seed: NSNTDNNLAV (KKLC1_HUMAN)
  misc_feature (2)..(2): Xaa can be Ser, Ala, Thr, or Val
  misc_feature (10)..(10): Xaa can be Leu, Met, Ile, Phe, or Val
NXNTDNNLAX

SEQ ID NO: 41252 - protein, 11 aa, Artificial Sequence
  Description of Artificial Sequence: Synthetic peptide
  Seed: NSNTDNNLAVY (KKLC1_HUMAN)
  misc_feature (2)..(2): Xaa can be Val, Ala, Thr, Ser, Met, Ile, Gln, Leu, Gly, Glu, Asn, Tyr, Asp, Pro, Cys, Phe, Trp, Arg, His, or Lys
  misc_feature (11)..(11): Xaa can be Tyr, Trp, Lys, Phe, Arg, Met, Leu, or His
NXNTDNNLAVX

SEQ ID NO: 41253 - protein, 8 aa, Artificial Sequence
  Description of Artificial Sequence: Synthetic peptide
  Seed: NSTALALV (KKLC1_HUMAN)
  misc_feature (2)..(2): Xaa can be Gln, Ala, Ser, or Met
  misc_feature (8)..(8): Xaa can be Val, Ile, Leu, or Met
NXTALALX

SEQ ID NO: 41254 - protein, 9 aa, Artificial Sequence
  Description of Artificial Sequence: Synthetic peptide
  Seed: NSTALALVR (KKLC1_HUMAN)
  misc_feature (2)..(2): Xaa can be Ala, Ser, Val, Ile, Thr, Leu, Pro, Gln, Tyr, Gly, Met, Asp, Asn, Phe, Cys, His, or Trp
  misc_feature (9)..(9): Xaa can be Arg, Lys, Tyr, or His
NXTALALVX

SEQ ID NO: 41255 - protein, 8 aa, Artificial Sequence
  Description of Artificial Sequence: Synthetic peptide
  Seed: NTDNNLAV (KKLC1_HUMAN)
  misc_feature (2)..(2): Xaa can be Tyr, Phe, Ala, Val, Trp, Ile, Leu, Ser, Thr, Asn, Met, Gln, Cys, Gly, Asp, His, Pro, or Gl u
  misc_feature (8)..(8): Xaa can be Leu, Met, Phe, Ile, Val, Tyr, Trp, or Cys
NXDNNLAX

SEQ ID NO: 41256 - protein, 9 aa, Artificial Sequence
  Description of Artificial Sequence: Synthetic peptide
  Seed: NTDNNLAVY (KKLC1_HUMAN)
  misc_feature (2)..(2): Xaa can be Ala, Tyr, Ser, Leu, Val, Thr, Ile, Met, Phe, Gly, Pro, Gln, Cys, Asp, Trp, Asn, Glu, Arg, His, or Lys
  misc_feature (9)..(9): Xaa can be Met, Leu, Phe, Tyr, Ile, Val, Lys, Trp, Arg, Ala, Cys, His, Thr, Ser, or Pro
NXDNNLAVX

SEQ ID NO: 41257 - protein, 10 aa, Artificial Sequence
  Description of Artificial Sequence: Synthetic peptide
  Seed: NTDNNLAVYD (KKLC1_HUMAN)
  misc_feature (2)..(2): Xaa can be Thr, Ser, Ile, Leu, Ala, Met, or Val
  misc_feature (10)..(10): Xaa can be Tyr, Phe, Val, Lys, Ala, His, Cys, Leu, Asp, Ser, Thr, Trp, Glu, Gln, Pro, Met, Gly, Ile, Arg, or Asn
NXDNNLAVYX

SEQ ID NO: 41258 - protein, 11 aa, Artificial Sequence
  Description of Artificial Sequence: Synthetic peptide
  Seed: NTDNNLAVYDL (KKLC1_HUMAN)
  misc_feature (2)..(2): Xaa can be Ala, Ser, Leu, Met, Val, Ile, Thr, Gly, or Cys
  misc_feature (11)..(11): Xaa can be Leu, Phe, Met, Ile, or Val
NXDNNLAVYDX

SEQ ID NO: 41259 - protein, 11 aa, Artificial Sequence
  Description of Artificial Sequence: Synthetic peptide
  Seed: NTGEMSSNSTA (KKLC1_HUMAN)
  misc_feature (2)..(2): Xaa can be Arg, Cys, Phe, Gln, Trp, His, Ser, Lys, Pro, Tyr, Ile, Ala, Gly, Asn, Met, Thr, Val, Leu, Asp, or Glu
  misc_feature (11)..(11): Xaa can be , or Ala
NXGEMSSNSTX

SEQ ID NO: 41260 - protein, 10 aa, Artificial Sequence
  Description of Artificial Sequence: Synthetic peptide
  Seed: QKRILVNLSM (KKLC1_HUMAN)
  misc_feature (2)..(2): Xaa can be Arg, Ser, Asp, Thr, Lys, Ala, Tyr, Leu, Met, Asn, Glu, Gly, Val, Gln, His, Phe, Cys, Pro, Ile, or Trp
  misc_feature (10)..(10): Xaa can be Leu, Tyr, Ile, Met, Ala, Lys, Arg, Val, Phe, Trp, or His
QXRILVNLSX

SEQ ID NO: 41261 - protein, 11 aa, Artificial Sequence
  Description of Artificial Sequence: Synthetic peptide
  Seed: RDILNNFPHSI (KKLC1_HUMAN)
  misc_feature (2)..(2): Xaa can be Glu, Asp, Met, Phe, Leu, Gln, Thr, Ala, Val, Ile, Lys, Asn, His, Pro, Ser, Tyr, Arg, Trp, Cys, or Gly
  misc_feature (11)..(11): Xaa can be Ile, Val, Leu, Met, Ala, Phe, Cys, Trp, Thr, Tyr, Ser, Pro, or Gly
RXILNNFPHSX

SEQ ID NO: 41262 - protein, 9 aa, Artificial Sequence
  Description of Artificial Sequence: Synthetic peptide
  Seed: RFQRNTGEM (KKLC1_HUMAN)
  misc_feature (2)..(2): Xaa can be Phe, Arg, Tyr, Trp, Gln, Met, Ala, His, Glu, Lys, Thr, Val, Leu, Ile, Asp, Gly, Ser, or As n
  misc_feature (9)..(9): Xaa can be Leu, Phe, Met, Tyr, Ile, Val, or Trp
RXQRNTGEX

SEQ ID NO: 41263 - protein, 9 aa, Artificial Sequence
  Description of Artificial Sequence: Synthetic peptide
  Seed: RILVNLSMV (KKLC1_HUMAN)
  misc_feature (2)..(2): Xaa can be Thr, Leu, Gln, Met, Ser, Val, Ala, Ile, Tyr, Asn, Gly, Glu, Asp, Phe, Cys, or Trp
  misc_feature (9)..(9): Xaa can be Lys, Val, Leu, Ile, Trp, Ala, Tyr, Met, Phe, Thr, Cys, Ser, Arg, or Gly
RXLVNLSMX

SEQ ID NO: 41264 - protein, 8 aa, Artificial Sequence
  Description of Artificial Sequence: Synthetic peptide
  Seed: RPSSSGLI (KKLC1_HUMAN)
  misc_feature (2)..(2): Xaa can be , or Pro
  misc_feature (8)..(8): Xaa can be Val, Ile, Ala, Leu, Met, Pro, or Phe
RXSSSGLX

SEQ ID NO: 41265 - protein, 10 aa, Artificial Sequence
  Description of Artificial Sequence: Synthetic peptide
  Seed: RPSSSGLINS (KKLC1_HUMAN)
  misc_feature (2)..(2): Xaa can be , or Pro
  misc_feature (10)..(10): Xaa can be Gly, Ser, Val, Met, Ile, Pro, Cys, Thr, Tyr, Phe, Leu, or Ala
RXSSSGLINX

SEQ ID NO: 41266 - protein, 9 aa, Artificial Sequence
  Description of Artificial Sequence: Synthetic peptide
  Seed: RQKRILVNL (KKLC1_HUMAN)
  misc_feature (2)..(2): Xaa can be Met, Phe, Val, Thr, Ile, Ser, Tyr, Ala, Gln, Trp, Arg, Leu, Gly, Glu, Asn, Asp, Cys, Lys, His, or Pro
  misc_feature (9)..(9): Xaa can be Val, Lys, Tyr, Leu, Ile, Met, Phe, Arg, Trp, Ala, Cys, Ser, Gly, Thr, Pro, Gln, His, Glu, Asn, or Asp
RXKRILVNX

SEQ ID NO: 41267 - protein, 10 aa, Artificial Sequence
  Description of Artificial Sequence: Synthetic peptide
  Seed: RQKRILVNLS (KKLC1_HUMAN)
  misc_feature (2)..(2): Xaa can be Val, Thr, Met, Ser, Tyr, Ala, Ile, Phe, Trp, Leu, Gly, Gln, Asn, Cys, Pro, Lys, His, or Ar g
  misc_feature (10)..(10): Xaa can be Lys, Ala, Val, Ile, Met, Ser, Leu, Arg, Tyr, Gly, Thr, Gln, Cys, Pro, His, Glu, Phe, Asn, Trp, or Asp
RXKRILVNLX

SEQ ID NO: 41268 - protein, 11 aa, Artificial Sequence
  Description of Artificial Sequence: Synthetic peptide
  Seed: RQKRILVNLSM (KKLC1_HUMAN)
  misc_feature (2)..(2): Xaa can be Arg, Lys, Ile, Met, His, Asp, Glu, Thr, Leu, Gln, Pro, Gly, Tyr, Ala, Trp, Asn, Phe, Val, Ser, or Cys
  misc_feature (11)..(11): Xaa can be Tyr, His, Phe, Met, Arg, Ile, Val, Thr, Gly, Lys, Ala, Leu, Trp, Ser, Cys, or Gln
RXKRILVNLSX

SEQ ID NO: 41269 - protein, 9 aa, Artificial Sequence
  Description of Artificial Sequence: Synthetic peptide
  Seed: RRFQRNTGE (KKLC1_HUMAN)
  misc_feature (2)..(2): Xaa can be Arg, Gln, Lys, His, Met, Asn, Gly, Glu, Ala, Leu, Ser, Thr, Asp, Ile, Val, Cys, Trp, Pro, Tyr, or Phe
  misc_feature (9)..(9): Xaa can be Leu, Phe, Ile, Lys, Arg, Met, Tyr, Val, Trp, His, Cys, Ala, Gln, Ser, Gly, Thr, Asn, Glu, or Pro
RXFQRNTGX

SEQ ID NO: 41270 - protein, 10 aa, Artificial Sequence
  Description of Artificial Sequence: Synthetic peptide
  Seed: RRFQRNTGEM (KKLC1_HUMAN)
  misc_feature (2)..(2): Xaa can be Arg, Gln, Met, Lys, Tyr, Phe, His, Glu, Leu, Ala, Trp, Val, Ser, Thr, Asn, Ile, Cys, Pro, or Gly
  misc_feature (10)..(10): Xaa can be Phe, Tyr, Met, Leu, Ile, Trp, Val, Lys, His, Ala, Arg, Ser, Gln, Cys, Gly, Pro, Glu, Asn, or Thr
RXFQRNTGEX

SEQ ID NO: 41271 - protein, 11 aa, Artificial Sequence
  Description of Artificial Sequence: Synthetic peptide
  Seed: RRFQRNTGEMS (KKLC1_HUMAN)
  misc_feature (2)..(2): Xaa can be Arg, Gln, Lys, His, Glu, Ala, Gly, Tyr, Asn, or Met
  misc_feature (11)..(11): Xaa can be Phe, Lys, Tyr, Leu, Ile, Trp, Met, Arg, His, Val, Asp, Thr, Gln, Pro, Asn, Cys, Gly, Ala, Ser, or Glu
RXFQRNTGEMX

SEQ ID NO: 41272 - protein, 9 aa, Artificial Sequence
  Description of Artificial Sequence: Synthetic peptide
  Seed: SIARQKRIL (KKLC1_HUMAN)
  misc_feature (2)..(2): Xaa can be Arg, Pro, Gln, Leu, Met, Ala, Val, Gly, Thr, Ser, Ile, or Asn
  misc_feature (9)..(9): Xaa can be Leu, Met, Ile, Val, Lys, Arg, His, Phe, Trp, or Tyr
SXARQKRIX

SEQ ID NO: 41273 - protein, 10 aa, Artificial Sequence
  Description of Artificial Sequence: Synthetic peptide
  Seed: SIARQKRILV (KKLC1_HUMAN)
  misc_feature (2)..(2): Xaa can be Thr, Val, Ser, Met, Tyr, Phe, Arg, Ile, Trp, Gly, Cys, Leu, Ala, His, Pro, Glu, Lys, Gln, Asn, or Asp
  misc_feature (10)..(10): Xaa can be Val, Lys, Ala, Ile, Ser, Tyr, Met, Leu, Gly, or Thr
SXARQKRILX

SEQ ID NO: 41274 - protein, 9 aa, Artificial Sequence
  Description of Artificial Sequence: Synthetic peptide
  Seed: SILCALIVF (KKLC1_HUMAN)
  misc_feature (2)..(2): Xaa can be Gln, Ala, Met, Ser, Lys, Thr, Val, Ile, Glu, Leu, Gly, Arg, Pro, His, Cys, Asn, Phe, Tyr, Asp, or Trp
  misc_feature (9)..(9): Xaa can be Tyr, Phe, Trp, Met, Leu, Ile, His, Val, Ala, Lys, or Gly
SXLCALIVX

SEQ ID NO: 41275 - protein, 10 aa, Artificial Sequence
  Description of Artificial Sequence: Synthetic peptide
  Seed: SILCALIVFW (KKLC1_HUMAN)
  misc_feature (2)..(2): Xaa can be Thr, Ser, Gly, Ala, Val, Met, Cys, Asn, Leu, Phe, Asp, Glu, Trp, Pro, Gln, or Ile
  misc_feature (10)..(10): Xaa can be Trp, Phe, Met, Ile, Leu, or Tyr
SXLCALIVFX

SEQ ID NO: 41276 - protein, 11 aa, Artificial Sequence
  Description of Artificial Sequence: Synthetic peptide
  Seed: SILCALIVFWK (KKLC1_HUMAN)
  misc_feature (2)..(2): Xaa can be Gln, Leu, Thr, Ser, Phe, Tyr, Met, Val, Ala, Trp, Ile, Arg, Lys, Asn, Gly, or His
  misc_feature (11)..(11): Xaa can be Arg, or Lys
SXLCALIVFWX

SEQ ID NO: 41277 - protein, 10 aa, Artificial Sequence
  Description of Artificial Sequence: Synthetic peptide
  Seed: SKGFRGASPH (KKLC1_HUMAN)
  misc_feature (2)..(2): Xaa can be Gln, Met, Lys, His, Arg, Glu, Ala, Leu, Asn, Val, Tyr, Trp, Ile, Phe, Thr, Ser, Cys, Pro, Asp, or Gly
  misc_feature (10)..(10): Xaa can be Phe, Tyr, Met, Leu, Trp, His, Ile, Ala, Val, or Gly
SXGFRGASPX

SEQ ID NO: 41278 - protein, 11 aa, Artificial Sequence
  Description of Artificial Sequence: Synthetic peptide
  Seed: SKGFRGASPHR (KKLC1_HUMAN)
  misc_feature (2)..(2): Xaa can be Met, Trp, Phe, Tyr, Ile, Pro, Thr, Ser, Gln, Cys, Gly, Lys, His, Asn, Val, Leu, Ala, Arg, Asp, or Glu
  misc_feature (11)..(11): Xaa can be Arg, or Lys
SXGFRGASPHX

SEQ ID NO: 41279 - protein, 8 aa, Artificial Sequence
  Description of Artificial Sequence: Synthetic peptide
  Seed: SMVENKLV (KKLC1_HUMAN)
  misc_feature (2)..(2): Xaa can be Gln, Ser, Ala, Glu, or Met
  misc_feature (8)..(8): Xaa can be Val, Ile, Leu, or Met
SXVENKLX

SEQ ID NO: 41280 - protein, 10 aa, Artificial Sequence
  Description of Artificial Sequence: Synthetic peptide
  Seed: SMVENKLVEL (KKLC1_HUMAN)
  misc_feature (2)..(2): Xaa can be Arg, Met, Leu, Ala, Gln, Val, Ile, Thr, Ser, Tyr, Gly, Glu, Phe, Asn, Pro, Lys, His, Trp, Cys, or Asp
  misc_feature (10)..(10): Xaa can be Lys, Met, Phe, Tyr, Leu, Ile, Val, Trp, Arg, His, Ala, Thr, Cys, Ser, Gln, or Asn
SXVENKLVEX

SEQ ID NO: 41281 - protein, 8 aa, Artificial Sequence
  Description of Artificial Sequence: Synthetic peptide
  Seed: SNSTALAL (KKLC1_HUMAN)
  misc_feature (2)..(2): Xaa can be Ala, Thr, Ser, Val, Ile, Arg, Tyr, His, Phe, Gln, Gly, Asn, Asp, or Glu
  misc_feature (8)..(8): Xaa can be Leu, Val, Met, Ile, or Phe
SXSTALAX

SEQ ID NO: 41282 - protein, 9 aa, Artificial Sequence
  Description of Artificial Sequence: Synthetic peptide
  Seed: SNSTALALV (KKLC1_HUMAN)
  misc_feature (2)..(2): Xaa can be Met, Gln, Ala, Leu, Thr, Val, Ile, Ser, Gly, Cys, Asn, Glu, Asp, Pro, or Phe
  misc_feature (9)..(9): Xaa can be Val, Ile, Leu, Met, Ala, Phe, Thr, Cys, Tyr, or Ser
SXSTALALX

SEQ ID NO: 41283 - protein, 10 aa, Artificial Sequence
  Description of Artificial Sequence: Synthetic peptide
  Seed: SNSTALALVR (KKLC1_HUMAN)
  misc_feature (2)..(2): Xaa can be Thr, Phe, Ile, Tyr, Ala, Val, Trp, Ser, Leu, Gln, Met, Pro, Asp, Lys, Gly, Cys, Glu, His, Arg, or Asn
  misc_feature (10)..(10): Xaa can be Arg, Lys, or Tyr
SXSTALALVX

SEQ ID NO: 41284 - protein, 9 aa, Artificial Sequence
  Description of Artificial Sequence: Synthetic peptide
  Seed: SNTDNNLAV (KKLC1_HUMAN)
  misc_feature (2)..(2): Xaa can be Ala, Thr, Gln, Ser, Arg, Val, Ile, Phe, Tyr, Leu, Met, Gly, Asn, Glu, Asp, Pro, Trp, Lys, His, or Cys
  misc_feature (9)..(9): Xaa can be Leu, Phe, Val, Met, Ile, Tyr, Lys, Arg, Trp, Ala, Cys, His, or Thr
SXTDNNLAX

SEQ ID NO: 41285 - protein, 10 aa, Artificial Sequence
  Description of Artificial Sequence: Synthetic peptide
  Seed: SNTDNNLAVY (KKLC1_HUMAN)
  misc_feature (2)..(2): Xaa can be Ala, Val, Thr, Leu, Ile, Ser, Met, Gln, Gly, Glu, Tyr, Pro, Phe, Asn, Asp, Cys, Lys, His, Arg, or Trp
  misc_feature (10)..(10): Xaa can be Tyr, Phe, Lys, Met, Leu, Arg, Trp, His, Ile, Ala, or Val
SXTDNNLAVX

SEQ ID NO: 41286 - protein, 8 aa, Artificial Sequence
  Description of Artificial Sequence: Synthetic peptide
  Seed: SRDILNNF (KKLC1_HUMAN)
  misc_feature (2)..(2): Xaa can be Tyr, Trp, Phe, His, Arg, Ala, Ser, Thr, Gly, Gln, Glu, Met, Ile, Leu, Asn, Val, Pro, Lys, Asp, or Cys
  misc_feature (8)..(8): Xaa can be Leu, Met, Phe, Ile, Val, Tyr, or Trp
SXDILNNX

SEQ ID NO: 41287 - protein, 9 aa, Artificial Sequence
  Description of Artificial Sequence: Synthetic peptide
  Seed: SRDILNNFP (KKLC1_HUMAN)
  misc_feature (2)..(2): Xaa can be , or Arg
  misc_feature (9)..(9): Xaa can be Ile, Cys, Leu, Met, Val, Ala, or Pro
SXDILNNFX

SEQ ID NO: 41288 - protein, 8 aa, Artificial Sequence
  Description of Artificial Sequence: Synthetic peptide
  Seed: SSILCALI (KKLC1_HUMAN)
  misc_feature (2)..(2): Xaa can be Gln, Ser, Glu, Ala, Gly, or Met
  misc_feature (8)..(8): Xaa can be Val, Ile, Leu, Met, or Phe
SXILCALX

SEQ ID NO: 41289 - protein, 9 aa, Artificial Sequence
  Description of Artificial Sequence: Synthetic peptide
  Seed: SSILCALIV (KKLC1_HUMAN)
  misc_feature (2)..(2): Xaa can be Ala, Gln, Met, Thr, Gly, Ser, Leu, Asn, Ile, Val, Cys, Glu, Phe, Pro, Asp, Lys, Trp, His, or Tyr
  misc_feature (9)..(9): Xaa can be Trp, Val, Met, Ile, Leu, Tyr, Phe, Ala, Lys, Arg, His, Thr, or Cys
SXILCALIX

SEQ ID NO: 41290 - protein, 10 aa, Artificial Sequence
  Description of Artificial Sequence: Synthetic peptide
  Seed: SSILCALIVF (KKLC1_HUMAN)
  misc_feature (2)..(2): Xaa can be Gln, Ser, Met, Lys, Thr, Leu, Ala, Val, His, Asn, Gly, Pro, Ile, Arg, Asp, Cys, Phe, Glu, Trp, or Tyr
  misc_feature (10)..(10): Xaa can be Tyr, Phe, Trp, Met, Leu, Ile, His, Ala, or Val
SXILCALIVX

SEQ ID NO: 41291 - protein, 11 aa, Artificial Sequence
  Description of Artificial Sequence: Synthetic peptide
  Seed: SSILCALIVFW (KKLC1_HUMAN)
  misc_feature (2)..(2): Xaa can be Thr, Ala, Ser, Met, Leu, Asn, Cys, Val, Gln, Ile, Gly, or Pro
  misc_feature (11)..(11): Xaa can be Trp, or Phe
SXILCALIVFX

SEQ ID NO: 41292 - protein, 9 aa, Artificial Sequence
  Description of Artificial Sequence: Synthetic peptide
  Seed: SSNSTALAL (KKLC1_HUMAN)
  misc_feature (2)..(2): Xaa can be Glu, Ala, Pro, Gln, Tyr, Arg, Met, Val, Ser, Phe, Asp, Thr, Ile, Leu, Gly, Asn, Lys, Cys, Trp, or His
  misc_feature (9)..(9): Xaa can be Phe, Ile, Met, Val, Trp, Tyr, Leu, His, Lys, Ala, Arg, Cys, Thr, Gln, Gly, Ser, Asn, Pro, Glu, or Asp
SXNSTALAX

SEQ ID NO: 41293 - protein, 10 aa, Artificial Sequence
  Description of Artificial Sequence: Synthetic peptide
  Seed: SSNSTALALV (KKLC1_HUMAN)
  misc_feature (2)..(2): Xaa can be Met, Leu, Thr, Ser, Val, Ala, Gln, or Ile
  misc_feature (10)..(10): Xaa can be Met, Val, Ile, Leu, Ala, Phe, Pro, Gly, Cys, Ser, Thr, Glu, or Asp
SXNSTALALX

SEQ ID NO: 41294 - protein, 11 aa, Artificial Sequence
  Description of Artificial Sequence: Synthetic peptide
  Seed: SSNSTALALVR (KKLC1_HUMAN)
  misc_feature (2)..(2): Xaa can be Thr, Ser, Leu, Ala, Met, Val, Ile, Gln, Gly, Trp, Tyr, Cys, Phe, Asp, or Asn
  misc_feature (11)..(11): Xaa can be Tyr, Arg, Lys, or His
SXNSTALALVX

SEQ ID NO: 41295 - protein, 8 aa, Artificial Sequence
  Description of Artificial Sequence: Synthetic peptide
  Seed: STALALVR (KKLC1_HUMAN)
  misc_feature (2)..(2): Xaa can be Val, Thr, or Ala
  misc_feature (8)..(8): Xaa can be , or Arg
SXALALVX

SEQ ID NO: 41296 - protein, 8 aa, Artificial Sequence
  Description of Artificial Sequence: Synthetic peptide
  Seed: TDNNLAVY (KKLC1_HUMAN)
  misc_feature (2)..(2): Xaa can be Glu, or Asp
  misc_feature (8)..(8): Xaa can be Tyr, Trp, Met, Phe, Val, Leu, or Ile
TXNNLAVX

SEQ ID NO: 41297 - protein, 10 aa, Artificial Sequence
  Description of Artificial Sequence: Synthetic peptide
  Seed: TGEMSSNSTA (KKLC1_HUMAN)
  misc_feature (2)..(2): Xaa can be Cys, Ala, Met, Phe, Glu, Trp, Tyr, Arg, Gly, Val, Leu, Gln, Asp, Ser, His, Pro, Lys, Ile, Thr, or Asn
  misc_feature (10)..(10): Xaa can be Ile, Val, Pro, Ala, or Leu
TXEMSSNSTX

SEQ ID NO: 41298 - protein, 11 aa, Artificial Sequence
  Description of Artificial Sequence: Synthetic peptide
  Seed: TGEMSSNSTAL (KKLC1_HUMAN)
  misc_feature (2)..(2): Xaa can be Ala, Arg, Ser, Thr, Gly, Val, Ile, Cys, Leu, Tyr, Trp, Glu, Phe, Lys, or Met
  misc_feature (11)..(11): Xaa can be Leu, Met, Phe, Ile, or Val
TXEMSSNSTAX

SEQ ID NO: 41299 - protein, 8 aa, Artificial Sequence
  Description of Artificial Sequence: Synthetic peptide
  Seed: TLLSKGFR (KKLC1_HUMAN)
  misc_feature (2)..(2): Xaa can be Tyr, Ile, Thr, Phe, Val, Trp, Met, or Leu
  misc_feature (8)..(8): Xaa can be , or Arg
TXLSKGFX

SEQ ID NO: 41300 - protein, 10 aa, Artificial Sequence
  Description of Artificial Sequence: Synthetic peptide
  Seed: TLLSKGFRGA (KKLC1_HUMAN)
  misc_feature (2)..(2): Xaa can be Leu, Met, Phe, Tyr, Val, Gln, Ile, Arg, Ala, Lys, His, Cys, Trp, Asn, Ser, Glu, Asp, Pro, Thr, or Gly
  misc_feature (10)..(10): Xaa can be Ile, Val, Ala, Leu, or Met
TXLSKGFRGX

SEQ ID NO: 41301 - protein, 8 aa, Artificial Sequence
  Description of Artificial Sequence: Synthetic peptide
  Seed: VELEHTLL (KKLC1_HUMAN)
  misc_feature (2)..(2): Xaa can be Glu, Asp, Gln, Arg, His, Pro, Ala, Ser, Leu, Thr, Val, Met, Ile, Asn, Gly, Phe, Lys, or Ty r
  misc_feature (8)..(8): Xaa can be Leu, Ile, Val, Met, Phe, Trp, Ala, Tyr, Cys, Thr, Pro, Ser, or His
VXLEHTLX

SEQ ID NO: 41302 - protein, 9 aa, Artificial Sequence
  Description of Artificial Sequence: Synthetic peptide
  Seed: VELEHTLLS (KKLC1_HUMAN)
  misc_feature (2)..(2): Xaa can be Glu, Asp, Gln, Ala, Asn, or Ser
  misc_feature (9)..(9): Xaa can be Leu, Val, Ala, Ile, Phe, Cys, Met, Tyr, Trp, Ser, Lys, Thr, Pro, Arg, His, Gly, Asn, Glu, Asp, or Gln
VXLEHTLLX

SEQ ID NO: 41303 - protein, 10 aa, Artificial Sequence
  Description of Artificial Sequence: Synthetic peptide
  Seed: VELEHTLLSK (KKLC1_HUMAN)
  misc_feature (2)..(2): Xaa can be Leu, Met, Ala, Thr, Val, Ile, Gln, Glu, Ser, Gly, Tyr, Trp, Phe, Arg, Asn, Cys, Asp, Pro, His, or Lys
  misc_feature (10)..(10): Xaa can be Lys, Arg, Tyr, Phe, Leu, Met, Val, His, Ile, Ala, or Trp
VXLEHTLLSX

SEQ ID NO: 41304 - protein, 8 aa, Artificial Sequence
  Description of Artificial Sequence: Synthetic peptide
  Seed: VENKLVEL (KKLC1_HUMAN)
  misc_feature (2)..(2): Xaa can be Glu, Asp, Gln, Arg, Ser, Tyr, Ala, His, Phe, Asn, Gly, Ile, Thr, Leu, Met, Val, Lys, Pro, Cys, or Trp
  misc_feature (8)..(8): Xaa can be Leu, Val, Ile, Met, Phe, Trp, Tyr, Ala, Cys, Ser, Thr, His, Gly, or Pro
VXNKLVEX

SEQ ID NO: 41305 - protein, 9 aa, Artificial Sequence
  Description of Artificial Sequence: Synthetic peptide
  Seed: VENKLVELE (KKLC1_HUMAN)
  misc_feature (2)..(2): Xaa can be Glu, Asp, Gln, or Ala
  misc_feature (9)..(9): Xaa can be Leu, Val, Ala, Met, Phe, Ile, Cys, Pro, Thr, Ser, Lys, Trp, Arg, Gly, Glu, Tyr, Asp, Gln, or Asn
VXNKLVELX

SEQ ID NO: 41306 - protein, 8 aa, Artificial Sequence
  Description of Artificial Sequence: Synthetic peptide
  Seed: VFWKYRRF (KKLC1_HUMAN)
  misc_feature (2)..(2): Xaa can be Tyr, Phe, or Trp
  misc_feature (8)..(8): Xaa can be Leu, Tyr, Met, Phe, or Ile
VXWKYRRX

SEQ ID NO: 41307 - protein, 10 aa, Artificial Sequence
  Description of Artificial Sequence: Synthetic peptide
  Seed: VFWKYRRFQR (KKLC1_HUMAN)
  misc_feature (2)..(2): Xaa can be Met, Phe, Val, Trp, Thr, Tyr, Ser, Cys, Asp, Lys, His, Gln, Leu, Ile, Ala, Glu, Asn, Gly, Pro, or Arg
  misc_feature (10)..(10): Xaa can be Lys, Arg, Tyr, or His
VXWKYRRFQX

SEQ ID NO: 41308 - protein, 11 aa, Artificial Sequence
  Description of Artificial Sequence: Synthetic peptide
  Seed: VFWKYRRFQRN (KKLC1_HUMAN)
  misc_feature (2)..(2): Xaa can be Tyr, Val, Leu, Ile, Thr, Gln, Met, Phe, Ser, Ala, Trp, Arg, Gly, or Asn
  misc_feature (11)..(11): Xaa can be Arg, Lys, Ala, Asn, Met, Gly, Asp, Cys, Phe, Glu, Val, Tyr, Thr, Ser, His, Trp, Leu, Pro, Ile, or Gln
VXWKYRRFQRX

SEQ ID NO: 41309 - protein, 9 aa, Artificial Sequence
  Description of Artificial Sequence: Synthetic peptide
  Seed: VNLSMVENK (KKLC1_HUMAN)
  misc_feature (2)..(2): Xaa can be Met, Leu, Ala, Val, Ile, Ser, Thr, Gln, Asp, Asn, Gly, Glu, Phe, Tyr, Pro, or Trp
  misc_feature (9)..(9): Xaa can be Arg, Lys, Tyr, Met, Leu, Val, Phe, Ile, or His
VXLSMVENX

SEQ ID NO: 41310 - protein, 10 aa, Artificial Sequence
  Description of Artificial Sequence: Synthetic peptide
  Seed: VNLSMVENKL (KKLC1_HUMAN)
  misc_feature (2)..(2): Xaa can be Tyr, Leu, Phe, Met, Trp, Ala, His, Ser, Asp, Val, Gly, Asn, Arg, Pro, Glu, Lys, Ile, Thr, Cys, or Gln
  misc_feature (10)..(10): Xaa can be Leu, Val, Ile, Met, or Ala
VXLSMVENKX

SEQ ID NO: 41311 - protein, 8 aa, Artificial Sequence
  Description of Artificial Sequence: Synthetic peptide
  Seed: VRPSSSGL (KKLC1_HUMAN)
  misc_feature (2)..(2): Xaa can be Tyr, or Arg
  misc_feature (8)..(8): Xaa can be Tyr, Phe, or Leu
VXPSSSGX

SEQ ID NO: 41312 - protein, 9 aa, Artificial Sequence
  Description of Artificial Sequence: Synthetic peptide
  Seed: VRPSSSGLI (KKLC1_HUMAN)
  misc_feature (2)..(2): Xaa can be His, Tyr, Arg, Phe, Ala, Gly, Met, Ser, Trp, Gln, Ile, Thr, Leu, Cys, Val, Pro, or Asn
  misc_feature (9)..(9): Xaa can be Leu, Met, Phe, Tyr, Ile, Val, or Trp
VXPSSSGLX

SEQ ID NO: 41313 - protein, 8 aa, Artificial Sequence
  Description of Artificial Sequence: Synthetic peptide
  Seed: VYDLSRDI (KKLC1_HUMAN)
  misc_feature (2)..(2): Xaa can be Ala, Phe, Tyr, Leu, Val, Ile, Gly, Thr, Ser, Trp, Arg, Asn, Met, Cys, Gln, Asp, Pro, His, Glu, or Lys
  misc_feature (8)..(8): Xaa can be Leu, Ile, Phe, Met, Val, Tyr, Trp, or Cys
VXDLSRDX

SEQ ID NO: 41314 - protein, 9 aa, Artificial Sequence
  Description of Artificial Sequence: Synthetic peptide
  Seed: VYDLSRDIL (KKLC1_HUMAN)
  misc_feature (2)..(2): Xaa can be Ala, Ser, Phe, Tyr, Thr, Ile, Val, Leu, Met, Gly, Trp, Gln, Asn, Asp, Arg, Cys, Glu, His, Pro, or Lys
  misc_feature (9)..(9): Xaa can be Phe, Met, Leu, Ile, Val, Trp, Tyr, Lys, Arg, Cys, Ala, or Thr
VXDLSRDIX

SEQ ID NO: 41315 - protein, 8 aa, Artificial Sequence
  Description of Artificial Sequence: Synthetic peptide
  Seed: YDLSRDIL (KKLC1_HUMAN)
  misc_feature (2)..(2): Xaa can be Glu, Asp, Ala, or Gln
  misc_feature (8)..(8): Xaa can be Leu, Ile, Phe, Met, or Val
YXLSRDIX

SEQ ID NO: 41316 - protein, 8 aa, Artificial Sequence
  Description of Artificial Sequence: Synthetic peptide
  Seed: YLLLASSI (KKLC1_HUMAN)
  misc_feature (2)..(2): Xaa can be Gln, Glu, Asn, Gly, Leu, Asp, Met, Ala, Ser, Val, Ile, Thr, or Pro
  misc_feature (8)..(8): Xaa can be Ile, Val, Leu, Met, Cys, or Phe
YXLLASSX

SEQ ID NO: 41317 - protein, 9 aa, Artificial Sequence
  Description of Artificial Sequence: Synthetic peptide
  Seed: YLLLASSIL (KKLC1_HUMAN)
  misc_feature (2)..(2): Xaa can be Gln, Tyr, Met, Pro, Ala, Lys, Phe, Leu, Thr, Ser, Ile, Glu, Arg, Val, His, Trp, Gly, Asn, Asp, or Cys
  misc_feature (9)..(9): Xaa can be Phe, Tyr, Met, Leu, Ile, Val, Trp, Ala, His, Thr, Gly, Ser, Cys, Gln, Asn, or Pro
YXLLASSIX

SEQ ID NO: 41318 - protein, 10 aa, Artificial Sequence
  Description of Artificial Sequence: Synthetic peptide
  Seed: YLLLASSILC (KKLC1_HUMAN)
  misc_feature (2)..(2): Xaa can be Leu, Met, Val, Gly, Trp, Arg, Glu, Phe, Ala, Asp, Pro, Ser, Gln, Asn, His, Ile, Tyr, Thr, Cys, or Lys
  misc_feature (10)..(10): Xaa can be Met, Leu, Ala, Val, Ser, Ile, Phe, Thr, Gln, Pro, Asp, Cys, Trp, Glu, Asn, His, Arg, Lys, Gly, or Tyr
YXLLASSILX

SEQ ID NO: 41319 - protein, 11 aa, Artificial Sequence
  Description of Artificial Sequence: Synthetic peptide
  Seed: YLLLASSILCA (KKLC1_HUMAN)
  misc_feature (2)..(2): Xaa can be Met, Leu, Ala, Gln, Pro, Asp, Phe, Arg, Val, Lys, Ser, Thr, Asn, Trp, His, Glu, Cys, Gly, Ile, or Tyr
  misc_feature (11)..(11): Xaa can be Ala, Leu, Ile, Met, Val, or Thr
YXLLASSILCX

SEQ ID NO: 41320 - protein, 11 aa, Artificial Sequence
  Description of Artificial Sequence: Synthetic peptide
  Seed: YRRFQRNTGEM (KKLC1_HUMAN)
  misc_feature (2)..(2): Xaa can be Tyr, Arg, Met, Phe, Trp, Cys, Gln, Ser, Gly, Ile, Asn, Leu, Val, Thr, His, Glu, Asp, Pro, Lys, or Ala
  misc_feature (11)..(11): Xaa can be Leu, Met, Phe, Tyr, Arg, Lys, or Ile
YXRFQRNTGEX

SEQ ID NO: 41321 - protein, 9 aa, Artificial Sequence
  Description of Artificial Sequence: Synthetic peptide
  Seed: EADPTGHSY (MAGA1_HUMAN)
EADPTGHSL

SEQ ID NO: 41322 - protein, 9 aa, Artificial Sequence
  Description of Artificial Sequence: Synthetic peptide
  Seed: EADPTGHSY (MAGA1_HUMAN)
ESDPTGHSY

SEQ ID NO: 41323 - protein, 9 aa, Artificial Sequence
  Description of Artificial Sequence: Synthetic peptide
  Seed: EADPTGHSY (MAGA1_HUMAN)
EYDPTGHSL

SEQ ID NO: 41324 - protein, 9 aa, Artificial Sequence
  Description of Artificial Sequence: Synthetic peptide
  Seed: FFFPSLREA (MAGA1_HUMAN)
FAFPSLREL

SEQ ID NO: 41325 - protein, 9 aa, Artificial Sequence
  Description of Artificial Sequence: Synthetic peptide
  Seed: FFFPSLREA (MAGA1_HUMAN)
FMFPSLREL

SEQ ID NO: 41326 - protein, 9 aa, Artificial Sequence
  Description of Artificial Sequence: Synthetic peptide
  Seed: FPSLREAAL (MAGA1_HUMAN)
FPSLREAAF

SEQ ID NO: 41327 - protein, 9 aa, Artificial Sequence
  Description of Artificial Sequence: Synthetic peptide
  Seed: HCFPEIFGK (MAGA1_HUMAN)
HTFPEIFGK

SEQ ID NO: 41328 - protein, 9 aa, Artificial Sequence
  Description of Artificial Sequence: Synthetic peptide
  Seed: IMPKTGFLI (MAGA1_HUMAN)
IMPKTGFLL

SEQ ID NO: 41329 - protein, 9 aa, Artificial Sequence
  Description of Artificial Sequence: Synthetic peptide
  Seed: KVLEYVIKV (MAGA1_HUMAN)
KALEYVIKL

SEQ ID NO: 41330 - protein, 9 aa, Artificial Sequence
  Description of Artificial Sequence: Synthetic peptide
  Seed: KASESLQLV (MAGA1_HUMAN)
KASESLQLL

SEQ ID NO: 41331 - protein, 9 aa, Artificial Sequence
  Description of Artificial Sequence: Synthetic peptide
  Seed: KVLEYVIKV (MAGA1_HUMAN)
KMLEYVIKV

SEQ ID NO: 41332 - protein, 10 aa, Artificial Sequence
  Description of Artificial Sequence: Synthetic peptide
  Seed: KEADPTGHSY (MAGA1_HUMAN)
KQADPTGHSY

SEQ ID NO: 41333 - protein, 10 aa, Artificial Sequence
  Description of Artificial Sequence: Synthetic peptide
  Seed: KEADPTGHSY (MAGA1_HUMAN)
KTADPTGHSY

SEQ ID NO: 41334 - protein, 9 aa, Artificial Sequence
  Description of Artificial Sequence: Synthetic peptide
  Seed: KVLEYVIKV (MAGA1_HUMAN)
KTLEYVIKV

SEQ ID NO: 41335 - protein, 9 aa, Artificial Sequence
  Description of Artificial Sequence: Synthetic peptide
  Seed: KVADLVGFL (MAGA1_HUMAN)
KVADLVGFV

SEQ ID NO: 41336 - protein, 9 aa, Artificial Sequence
  Description of Artificial Sequence: Synthetic peptide
  Seed: MPKTGFLII (MAGA1_HUMAN)
MPKTGFLIL

SEQ ID NO: 41337 - protein, 10 aa, Artificial Sequence
  Description of Artificial Sequence: Synthetic peptide
  Seed: RVRFFFPSLR (MAGA1_HUMAN)
RMRFFFPSLR

SEQ ID NO: 41338 - protein, 10 aa, Artificial Sequence
  Description of Artificial Sequence: Synthetic peptide
  Seed: RVRFFFPSLR (MAGA1_HUMAN)
RVRFFFPSLK

SEQ ID NO: 41339 - protein, 9 aa, Artificial Sequence
  Description of Artificial Sequence: Synthetic peptide
  Seed: SAFPTTINF (MAGA1_HUMAN)
SAFPTTINL

SEQ ID NO: 41340 - protein, 9 aa, Artificial Sequence
  Description of Artificial Sequence: Synthetic peptide
  Seed: SAFPTTINF (MAGA1_HUMAN)
SAFPTTINM

SEQ ID NO: 41341 - protein, 9 aa, Artificial Sequence
  Description of Artificial Sequence: Synthetic peptide
  Seed: SAFPTTINF (MAGA1_HUMAN)
SAFPTTINW

SEQ ID NO: 41342 - protein, 9 aa, Artificial Sequence
  Description of Artificial Sequence: Synthetic peptide
  Seed: SSPLVLGTL (MAGA1_HUMAN)
SAPLVLGTL

SEQ ID NO: 41343 - protein, 9 aa, Artificial Sequence
  Description of Artificial Sequence: Synthetic peptide
  Seed: SAFPTTINF (MAGA1_HUMAN)
SQFPTTINL

SEQ ID NO: 41344 - protein, 9 aa, Artificial Sequence
  Description of Artificial Sequence: Synthetic peptide
  Seed: SYVKVLEYV (MAGA1_HUMAN)
SYVKVLEYF

SEQ ID NO: 41345 - protein, 9 aa, Artificial Sequence
  Description of Artificial Sequence: Synthetic peptide
  Seed: TSYVKVLEY (MAGA1_HUMAN)
TMYVKVLEY

SEQ ID NO: 41346 - protein, 9 aa, Artificial Sequence
  Description of Artificial Sequence: Synthetic peptide
  Seed: TSYVKVLEY (MAGA1_HUMAN)
TRYVKVLEM

SEQ ID NO: 41347 - protein, 9 aa, Artificial Sequence
  Description of Artificial Sequence: Synthetic peptide
  Seed: TSYVKVLEY (MAGA1_HUMAN)
TTYVKVLEY

SEQ ID NO: 41348 - protein, 9 aa, Artificial Sequence
  Description of Artificial Sequence: Synthetic peptide
  Seed: VYDGREHSA (MAGA1_HUMAN)
VFDGREHSL

SEQ ID NO: 41349 - protein, 9 aa, Artificial Sequence
  Description of Artificial Sequence: Synthetic peptide
  Seed: VSARVRFFF (MAGA1_HUMAN)
VMARVRFFF

SEQ ID NO: 41350 - protein, 9 aa, Artificial Sequence
  Description of Artificial Sequence: Synthetic peptide
  Seed: VSARVRFFF (MAGA1_HUMAN)
VSARVRFFY

SEQ ID NO: 41351 - protein, 9 aa, Artificial Sequence
  Description of Artificial Sequence: Synthetic peptide
  Seed: VGFLLLKYR (MAGA1_HUMAN)
VTFLLLKYR

SEQ ID NO: 41352 - protein, 10 aa, Artificial Sequence
  Description of Artificial Sequence: Synthetic peptide
  Seed: YEFLWGPRAL (MAGA1_HUMAN)
YEFLWGPRAM

SEQ ID NO: 41353 - protein, 9 aa, Artificial Sequence
  Description of Artificial Sequence: Synthetic peptide
  Seed: YVIKVSARV (MAGA1_HUMAN)
YTIKVSARM

SEQ ID NO: 41354 - protein, 9 aa, Artificial Sequence
  Description of Artificial Sequence: Synthetic peptide
  Seed: YVIKVSARV (MAGA1_HUMAN)
YTIKVSARY

SEQ ID NO: 41355 - protein, 10 aa, Homo sapiens
  Native (MAGA1_HUMAN)
ADPTGHSYVL

SEQ ID NO: 41356 - protein, 11 aa, Homo sapiens
  Native (MAGA1_HUMAN)
AEMLESVIKNY

SEQ ID NO: 41357 - protein, 9 aa, Homo sapiens
  Native (MAGA1_HUMAN)
AETSYVKVL

SEQ ID NO: 41358 - protein, 9 aa, Homo sapiens
  Native (MAGA1_HUMAN)
ALAETSYVK

SEQ ID NO: 41359 - protein, 9 aa, Homo sapiens
  Native (MAGA1_HUMAN)
DPARYEFLW

SEQ ID NO: 41360 - protein, 9 aa, Homo sapiens
  Native (MAGA1_HUMAN)
EEIWEELSV

SEQ ID NO: 41361 - protein, 9 aa, Homo sapiens
  Native (MAGA1_HUMAN)
EELSVMEVY

SEQ ID NO: 41362 - protein, 9 aa, Homo sapiens
  Native (MAGA1_HUMAN)
ESLQLVFGI

SEQ ID NO: 41363 - protein, 11 aa, Homo sapiens
  Native (MAGA1_HUMAN)
EVYDGREHSAY

SEQ ID NO: 41364 - protein, 9 aa, Homo sapiens
  Native (MAGA1_HUMAN)
FPSLREAAL

SEQ ID NO: 41365 - protein, 9 aa, Homo sapiens
  Native (MAGA1_HUMAN)
FRAVITKKV

SEQ ID NO: 41366 - protein, 9 aa, Homo sapiens
  Native (MAGA1_HUMAN)
IFGKASESL

SEQ ID NO: 41367 - protein, 9 aa, Homo sapiens
  Native (MAGA1_HUMAN)
IMPKTGFLI

SEQ ID NO: 41368 - protein, 10 aa, Homo sapiens
  Native (MAGA1_HUMAN)
KASESLQLVF

SEQ ID NO: 41369 - protein, 10 aa, Homo sapiens
  Native (MAGA1_HUMAN)
KEADPTGHSY

SEQ ID NO: 41370 - protein, 9 aa, Homo sapiens
  Native (MAGA1_HUMAN)
KVLEYVIKV

SEQ ID NO: 41371 - protein, 9 aa, Homo sapiens
  Native (MAGA1_HUMAN)
LEYVIKVSA

SEQ ID NO: 41372 - protein, 9 aa, Homo sapiens
  Native (MAGA1_HUMAN)
LHCKPEEAL

SEQ ID NO: 41373 - protein, 10 aa, Homo sapiens
  Native (MAGA1_HUMAN)
LTQDLVQEKY

SEQ ID NO: 41374 - protein, 9 aa, Homo sapiens
  Native (MAGA1_HUMAN)
LVGFLLLKY

SEQ ID NO: 41375 - protein, 9 aa, Homo sapiens
  Native (MAGA1_HUMAN)
LVLGTLEEV

SEQ ID NO: 41376 - protein, 9 aa, Homo sapiens
  Native (MAGA1_HUMAN)
LVQEKYLEY

SEQ ID NO: 41377 - protein, 9 aa, Homo sapiens
  Native (MAGA1_HUMAN)
LVTCLGLSY

SEQ ID NO: 41378 - protein, 9 aa, Homo sapiens
  Native (MAGA1_HUMAN)
MPKTGFLII

SEQ ID NO: 41379 - protein, 9 aa, Homo sapiens
  Native (MAGA1_HUMAN)
NYKHCFPEI

SEQ ID NO: 41380 - protein, 9 aa, Homo sapiens
  Native (MAGA1_HUMAN)
QEALGLVCV

SEQ ID NO: 41381 - protein, 10 aa, Homo sapiens
  Native (MAGA1_HUMAN)
QVPDSDPARY

SEQ ID NO: 41382 - protein, 10 aa, Homo sapiens
  Native (MAGA1_HUMAN)
RALAETSYVK

SEQ ID NO: 41383 - protein, 9 aa, Homo sapiens
  Native (MAGA1_HUMAN)
RAREPVTKA

SEQ ID NO: 41384 - protein, 9 aa, Homo sapiens
  Native (MAGA1_HUMAN)
RVRFFFPSL

SEQ ID NO: 41385 - protein, 10 aa, Homo sapiens
  Native (MAGA1_HUMAN)
RVRFFFPSLR

SEQ ID NO: 41386 - protein, 9 aa, Homo sapiens
  Native (MAGA1_HUMAN)
SAFPTTINF

SEQ ID NO: 41387 - protein, 9 aa, Homo sapiens
  Native (MAGA1_HUMAN)
SAYGEPRKL

SEQ ID NO: 41388 - protein, 9 aa, Homo sapiens
  Native (MAGA1_HUMAN)
SLFRAVITK

SEQ ID NO: 41389 - protein, 9 aa, Homo sapiens
  Native (MAGA1_HUMAN)
SSPLVLGTL

SEQ ID NO: 41390 - protein, 9 aa, Homo sapiens
  Native (MAGA1_HUMAN)
SVMEVYDGR

SEQ ID NO: 41391 - protein, 10 aa, Homo sapiens
  Native (MAGA1_HUMAN)
SYVKVLEYVI

SEQ ID NO: 41392 - protein, 9 aa, Homo sapiens
  Native (MAGA1_HUMAN)
TSYVKVLEY

SEQ ID NO: 41393 - protein, 9 aa, Homo sapiens
  Native (MAGA1_HUMAN)
TTINFTRQR

SEQ ID NO: 41394 - protein, 9 aa, Homo sapiens
  Native (MAGA1_HUMAN)
VADLVGFLL

SEQ ID NO: 41395 - protein, 9 aa, Homo sapiens
  Native (MAGA1_HUMAN)
VSARVRFFF

SEQ ID NO: 41396 - protein, 10 aa, Homo sapiens
  Native (MAGA1_HUMAN)
YEFLWGPRAL

SEQ ID NO: 41397 - protein, 9 aa, Homo sapiens
  Native (MAGA1_HUMAN)
YVIKVSARV

SEQ ID NO: 41398 - protein, 9 aa, Artificial Sequence
  Description of Artificial Sequence: Synthetic peptide
  Seed: TSYVKVLEY (MAGA1_HUMAN)
TAYVKVLEI

SEQ ID NO: 41399 - protein, 9 aa, Artificial Sequence
  Description of Artificial Sequence: Synthetic peptide
  Seed: RVRFFFPSL (MAGA1_HUMAN)
RWRFFFPSI

SEQ ID NO: 41400 - protein, 9 aa, Artificial Sequence
  Description of Artificial Sequence: Synthetic peptide
  Seed: CILESLFRA (MAGA1_HUMAN)
CQLESLFRM

SEQ ID NO: 41401 - protein, 10 aa, Artificial Sequence
  Description of Artificial Sequence: Synthetic peptide
  Seed: KVADLVGFLL (MAGA1_HUMAN)
KLADLVGFLE

SEQ ID NO: 41402 - protein, 9 aa, Artificial Sequence
  Description of Artificial Sequence: Synthetic peptide
  Seed: STSCILESL (MAGA1_HUMAN)
SMSCILESI

SEQ ID NO: 41403 - protein, 9 aa, Artificial Sequence
  Description of Artificial Sequence: Synthetic peptide
  Seed: KTGFLIIVL (MAGA1_HUMAN)
KVGFLIIVW

SEQ ID NO: 41404 - protein, 9 aa, Artificial Sequence
  Description of Artificial Sequence: Synthetic peptide
  Seed: LHCKPEEAL (MAGA1_HUMAN)
LHCKPEEAV

SEQ ID NO: 41405 - protein, 9 aa, Artificial Sequence
  Description of Artificial Sequence: Synthetic peptide
  Seed: AATSSSSPL (MAGA1_HUMAN)
ANTSSSSPF

SEQ ID NO: 41406 - protein, 9 aa, Artificial Sequence
  Description of Artificial Sequence: Synthetic peptide
  Seed: IFGKASESL (MAGA1_HUMAN)
IAGKASESL

SEQ ID NO: 41407 - protein, 9 aa, Artificial Sequence
  Description of Artificial Sequence: Synthetic peptide
  Seed: FFFPSLREA (MAGA1_HUMAN)
FNFPSLREL

SEQ ID NO: 41408 - protein, 9 aa, Artificial Sequence
  Description of Artificial Sequence: Synthetic peptide
  Seed: GTLEEVPTA (MAGA1_HUMAN)
GILEEVPTI

SEQ ID NO: 41409 - protein, 9 aa, Artificial Sequence
  Description of Artificial Sequence: Synthetic peptide
  Seed: FFFPSLREA (MAGA1_HUMAN)
FQFPSLREM

SEQ ID NO: 41410 - protein, 9 aa, Artificial Sequence
  Description of Artificial Sequence: Synthetic peptide
  Seed: VGFLLLKYR (MAGA1_HUMAN)
VVFLLLKYR

SEQ ID NO: 41411 - protein, 9 aa, Artificial Sequence
  Description of Artificial Sequence: Synthetic peptide
  Seed: AETSYVKVL (MAGA1_HUMAN)
AKTSYVKVF

SEQ ID NO: 41412 - protein, 10 aa, Artificial Sequence
  Description of Artificial Sequence: Synthetic peptide
  Seed: SARVRFFFPS (MAGA1_HUMAN)
SVRVRFFFPA

SEQ ID NO: 41413 - protein, 9 aa, Artificial Sequence
  Description of Artificial Sequence: Synthetic peptide
  Seed: FFFPSLREA (MAGA1_HUMAN)
FAFPSLREW

SEQ ID NO: 41414 - protein, 9 aa, Artificial Sequence
  Description of Artificial Sequence: Synthetic peptide
  Seed: ETSYVKVLE (MAGA1_HUMAN)
EISYVKVLK

SEQ ID NO: 41415 - protein, 11 aa, Artificial Sequence
  Description of Artificial Sequence: Synthetic peptide
  Seed: GASAFPTTINF (MAGA1_HUMAN)
GMSAFPTTINY

SEQ ID NO: 41416 - protein, 9 aa, Artificial Sequence
  Description of Artificial Sequence: Synthetic peptide
  Seed: ITKKVADLV (MAGA1_HUMAN)
IQKKVADLV

SEQ ID NO: 41417 - protein, 9 aa, Artificial Sequence
  Description of Artificial Sequence: Synthetic peptide
  Seed: AQQEALGLV (MAGA1_HUMAN)
AAQEALGLV

SEQ ID NO: 41418 - protein, 9 aa, Artificial Sequence
  Description of Artificial Sequence: Synthetic peptide
  Seed: TQDLVQEKY (MAGA1_HUMAN)
TGDLVQEKI

SEQ ID NO: 41419 - protein, 9 aa, Artificial Sequence
  Description of Artificial Sequence: Synthetic peptide
  Seed: STDPPQSPQ (MAGA1_HUMAN)
SFDPPQSPL

SEQ ID NO: 41420 - protein, 10 aa, Artificial Sequence
  Description of Artificial Sequence: Synthetic peptide
  Seed: DLVGFLLLKY (MAGA1_HUMAN)
DTVGFLLLKR

SEQ ID NO: 41421 - protein, 10 aa, Artificial Sequence
  Description of Artificial Sequence: Synthetic peptide
  Seed: RVRFFFPSLR (MAGA1_HUMAN)
RSRFFFPSLA

SEQ ID NO: 41422 - protein, 9 aa, Artificial Sequence
  Description of Artificial Sequence: Synthetic peptide
  Seed: KASESLQLV (MAGA1_HUMAN)
KRSESLQLI

SEQ ID NO: 41423 - protein, 9 aa, Artificial Sequence
  Description of Artificial Sequence: Synthetic peptide
  Seed: STSCILESL (MAGA1_HUMAN)
SVSCILESM

SEQ ID NO: 41424 - protein, 10 aa, Artificial Sequence
  Description of Artificial Sequence: Synthetic peptide
  Seed: EALEAQQEAL (MAGA1_HUMAN)
ETLEAQQEAY

SEQ ID NO: 41425 - protein, 11 aa, Artificial Sequence
  Description of Artificial Sequence: Synthetic peptide
  Seed: EMLESVIKNYK (MAGA1_HUMAN)
EILESVIKNYK

SEQ ID NO: 41426 - protein, 9 aa, Artificial Sequence
  Description of Artificial Sequence: Synthetic peptide
  Seed: MPKTGFLII (MAGA1_HUMAN)
MAKTGFLIF

SEQ ID NO: 41427 - protein, 10 aa, Artificial Sequence
  Description of Artificial Sequence: Synthetic peptide
  Seed: EVYDGREHSA (MAGA1_HUMAN)
ESYDGREHSK

SEQ ID NO: 41428 - protein, 11 aa, Artificial Sequence
  Description of Artificial Sequence: Synthetic peptide
  Seed: RQVPDSDPARY (MAGA1_HUMAN)
REVPDSDPARF

SEQ ID NO: 41429 - protein, 9 aa, Artificial Sequence
  Description of Artificial Sequence: Synthetic peptide
  Seed: YVIKVSARV (MAGA1_HUMAN)
YQIKVSARA

SEQ ID NO: 41430 - protein, 9 aa, Artificial Sequence
  Description of Artificial Sequence: Synthetic peptide
  Seed: YVIKVSARV (MAGA1_HUMAN)
YVIKVSARY

SEQ ID NO: 41431 - protein, 9 aa, Artificial Sequence
  Description of Artificial Sequence: Synthetic peptide
  Seed: SARVRFFFP (MAGA1_HUMAN)
SLRVRFFFM

SEQ ID NO: 41432 - protein, 11 aa, Artificial Sequence
  Description of Artificial Sequence: Synthetic peptide
  Seed: STDPPQSPQGA (MAGA1_HUMAN)
SGDPPQSPQGF

SEQ ID NO: 41433 - protein, 9 aa, Artificial Sequence
  Description of Artificial Sequence: Synthetic peptide
  Seed: RALAETSYV (MAGA1_HUMAN)
RILAETSYW

SEQ ID NO: 41434 - protein, 9 aa, Artificial Sequence
  Description of Artificial Sequence: Synthetic peptide
  Seed: TSYVKVLEY (MAGA1_HUMAN)
TQYVKVLEM

SEQ ID NO: 41435 - protein, 9 aa, Artificial Sequence
  Description of Artificial Sequence: Synthetic peptide
  Seed: LKYRAREPV (MAGA1_HUMAN)
LKYRAREPM

SEQ ID NO: 41436 - protein, 9 aa, Artificial Sequence
  Description of Artificial Sequence: Synthetic peptide
  Seed: ATSSSSPLV (MAGA1_HUMAN)
AASSSSPLM

SEQ ID NO: 41437 - protein, 11 aa, Artificial Sequence
  Description of Artificial Sequence: Synthetic peptide
  Seed: KLLTQDLVQEK (MAGA1_HUMAN)
KILTQDLVQEK

SEQ ID NO: 41438 - protein, 10 aa, Artificial Sequence
  Description of Artificial Sequence: Synthetic peptide
  Seed: TSYVKVLEYV (MAGA1_HUMAN)
TCYVKVLEYI

SEQ ID NO: 41439 - protein, 9 aa, Artificial Sequence
  Description of Artificial Sequence: Synthetic peptide
  Seed: SAFPTTINF (MAGA1_HUMAN)
SQFPTTINH

SEQ ID NO: 41440 - protein, 9 aa, Artificial Sequence
  Description of Artificial Sequence: Synthetic peptide
  Seed: SAYGEPRKL (MAGA1_HUMAN)
SIYGEPRKV

SEQ ID NO: 41441 - protein, 11 aa, Artificial Sequence
  Description of Artificial Sequence: Synthetic peptide
  Seed: EIFGKASESLQ (MAGA1_HUMAN)
EVFGKASESLK

SEQ ID NO: 41442 - protein, 9 aa, Artificial Sequence
  Description of Artificial Sequence: Synthetic peptide
  Seed: VQEKYLEYR (MAGA1_HUMAN)
VTEKYLEYY

SEQ ID NO: 41443 - protein, 9 aa, Artificial Sequence
  Description of Artificial Sequence: Synthetic peptide
  Seed: LEYVIKVSA (MAGA1_HUMAN)
LDYVIKVSL

SEQ ID NO: 41444 - protein, 11 aa, Artificial Sequence
  Description of Artificial Sequence: Synthetic peptide
  Seed: STDPPQSPQGA (MAGA1_HUMAN)
STDPPQSPQGY

SEQ ID NO: 41445 - protein, 9 aa, Artificial Sequence
  Description of Artificial Sequence: Synthetic peptide
  Seed: RALAETSYV (MAGA1_HUMAN)
RTLAETSYW

SEQ ID NO: 41446 - protein, 9 aa, Artificial Sequence
  Description of Artificial Sequence: Synthetic peptide
  Seed: GLVCVQAAT (MAGA1_HUMAN)
GLVCVQAAL

SEQ ID NO: 41447 - protein, 10 aa, Artificial Sequence
  Description of Artificial Sequence: Synthetic peptide
  Seed: KVLEYVIKVS (MAGA1_HUMAN)
KMLEYVIKVH

SEQ ID NO: 41448 - protein, 9 aa, Artificial Sequence
  Description of Artificial Sequence: Synthetic peptide
  Seed: VSARVRFFF (MAGA1_HUMAN)
VAARVRFFL

SEQ ID NO: 41449 - protein, 9 aa, Artificial Sequence
  Description of Artificial Sequence: Synthetic peptide
  Seed: ATSSSSPLV (MAGA1_HUMAN)
AMSSSSPLK

SEQ ID NO: 41450 - protein, 9 aa, Artificial Sequence
  Description of Artificial Sequence: Synthetic peptide
  Seed: GDNQIMPKT (MAGA1_HUMAN)
GENQIMPKV

SEQ ID NO: 41451 - protein, 11 aa, Artificial Sequence
  Description of Artificial Sequence: Synthetic peptide
  Seed: SSSSPLVLGTL (MAGA1_HUMAN)
SASSPLVLGTY

SEQ ID NO: 41452 - protein, 11 aa, Artificial Sequence
  Description of Artificial Sequence: Synthetic peptide
  Seed: SARVRFFFPSL (MAGA1_HUMAN)
SLRVRFFFPSL

SEQ ID NO: 41453 - protein, 11 aa, Artificial Sequence
  Description of Artificial Sequence: Synthetic peptide
  Seed: FGKASESLQLV (MAGA1_HUMAN)
FLKASESLQLV

SEQ ID NO: 41454 - protein, 10 aa, Artificial Sequence
  Description of Artificial Sequence: Synthetic peptide
  Seed: ESLFRAVITK (MAGA1_HUMAN)
EMLFRAVITR

SEQ ID NO: 41455 - protein, 9 aa, Artificial Sequence
  Description of Artificial Sequence: Synthetic peptide
  Seed: LVTCLGLSY (MAGA1_HUMAN)
LLTCLGLSY

SEQ ID NO: 41456 - protein, 9 aa, Artificial Sequence
  Description of Artificial Sequence: Synthetic peptide
  Seed: SARVRFFFP (MAGA1_HUMAN)
SVRVRFFFF

SEQ ID NO: 41457 - protein, 10 aa, Artificial Sequence
  Description of Artificial Sequence: Synthetic peptide
  Seed: KEADPTGHSY (MAGA1_HUMAN)
KFADPTGHSM

SEQ ID NO: 41458 - protein, 9 aa, Artificial Sequence
  Description of Artificial Sequence: Synthetic peptide
  Seed: AATSSSSPL (MAGA1_HUMAN)
AVTSSSSPY

SEQ ID NO: 41459 - protein, 9 aa, Artificial Sequence
  Description of Artificial Sequence: Synthetic peptide
  Seed: SARVRFFFP (MAGA1_HUMAN)
SYRVRFFFT

SEQ ID NO: 41460 - protein, 9 aa, Artificial Sequence
  Description of Artificial Sequence: Synthetic peptide
  Seed: STDPPQSPQ (MAGA1_HUMAN)
STDPPQSPV

SEQ ID NO: 41461 - protein, 9 aa, Artificial Sequence
  Description of Artificial Sequence: Synthetic peptide
  Seed: VPDSDPARY (MAGA1_HUMAN)
VVDSDPARY

SEQ ID NO: 41462 - protein, 10 aa, Artificial Sequence
  Description of Artificial Sequence: Synthetic peptide
  Seed: ADLVGFLLLK (MAGA1_HUMAN)
AMLVGFLLLR

SEQ ID NO: 41463 - protein, 9 aa, Artificial Sequence
  Description of Artificial Sequence: Synthetic peptide
  Seed: KYRAREPVT (MAGA1_HUMAN)
KMRAREPVK

SEQ ID NO: 41464 - protein, 11 aa, Artificial Sequence
  Description of Artificial Sequence: Synthetic peptide
  Seed: RVRFFFPSLRE (MAGA1_HUMAN)
RFRFFFPSLRY

SEQ ID NO: 41465 - protein, 9 aa, Artificial Sequence
  Description of Artificial Sequence: Synthetic peptide
  Seed: VYDGREHSA (MAGA1_HUMAN)
VGDGREHSM

SEQ ID NO: 41466 - protein, 10 aa, Artificial Sequence
  Description of Artificial Sequence: Synthetic peptide
  Seed: EVYDGREHSA (MAGA1_HUMAN)
ETYDGREHSV

SEQ ID NO: 41467 - protein, 9 aa, Artificial Sequence
  Description of Artificial Sequence: Synthetic peptide
  Seed: GASAFPTTI (MAGA1_HUMAN)
GMSAFPTTI

SEQ ID NO: 41468 - protein, 10 aa, Artificial Sequence
  Description of Artificial Sequence: Synthetic peptide
  Seed: LVGFLLLKYR (MAGA1_HUMAN)
LQGFLLLKYR

SEQ ID NO: 41469 - protein, 9 aa, Artificial Sequence
  Description of Artificial Sequence: Synthetic peptide
  Seed: FFPSLREAA (MAGA1_HUMAN)
FYPSLREAL

SEQ ID NO: 41470 - protein, 10 aa, Artificial Sequence
  Description of Artificial Sequence: Synthetic peptide
  Seed: FPSLREAALR (MAGA1_HUMAN)
FFSLREAALR

SEQ ID NO: 41471 - protein, 9 aa, Artificial Sequence
  Description of Artificial Sequence: Synthetic peptide
  Seed: ESLQLVFGI (MAGA1_HUMAN)
ETLQLVFGF

SEQ ID NO: 41472 - protein, 9 aa, Artificial Sequence
  Description of Artificial Sequence: Synthetic peptide
  Seed: SAFPTTINF (MAGA1_HUMAN)
STFPTTINK

SEQ ID NO: 41473 - protein, 8 aa, Artificial Sequence
  Description of Artificial Sequence: Synthetic peptide
  Seed: RFFFPSLR (MAGA1_HUMAN)
RSFFPSLR

SEQ ID NO: 41474 - protein, 10 aa, Artificial Sequence
  Description of Artificial Sequence: Synthetic peptide
  Seed: SVMEVYDGRE (MAGA1_HUMAN)
SIMEVYDGRR

SEQ ID NO: 41475 - protein, 9 aa, Artificial Sequence
  Description of Artificial Sequence: Synthetic peptide
  Seed: RVRFFFPSL (MAGA1_HUMAN)
RLRFFFPSW

SEQ ID NO: 41476 - protein, 11 aa, Artificial Sequence
  Description of Artificial Sequence: Synthetic peptide
  Seed: GKASESLQLVF (MAGA1_HUMAN)
GQASESLQLVF

SEQ ID NO: 41477 - protein, 9 aa, Artificial Sequence
  Description of Artificial Sequence: Synthetic peptide
  Seed: RVRFFFPSL (MAGA1_HUMAN)
RPRFFFPSA

SEQ ID NO: 41478 - protein, 10 aa, Artificial Sequence
  Description of Artificial Sequence: Synthetic peptide
  Seed: YEFLWGPRAL (MAGA1_HUMAN)
YLFLWGPRAY

SEQ ID NO: 41479 - protein, 10 aa, Artificial Sequence
  Description of Artificial Sequence: Synthetic peptide
  Seed: SARVRFFFPS (MAGA1_HUMAN)
SMRVRFFFPL

SEQ ID NO: 41480 - protein, 9 aa, Artificial Sequence
  Description of Artificial Sequence: Synthetic peptide
  Seed: HSYVLVTCL (MAGA1_HUMAN)
HTYVLVTCV

SEQ ID NO: 41481 - protein, 10 aa, Artificial Sequence
  Description of Artificial Sequence: Synthetic peptide
  Seed: ARVRFFFPSL (MAGA1_HUMAN)
AKVRFFFPSV

SEQ ID NO: 41482 - protein, 10 aa, Artificial Sequence
  Description of Artificial Sequence: Synthetic peptide
  Seed: RVRFFFPSLR (MAGA1_HUMAN)
RQRFFFPSLH

SEQ ID NO: 41483 - protein, 10 aa, Artificial Sequence
  Description of Artificial Sequence: Synthetic peptide
  Seed: LTQDLVQEKY (MAGA1_HUMAN)
LAQDLVQEKW

SEQ ID NO: 41484 - protein, 11 aa, Artificial Sequence
  Description of Artificial Sequence: Synthetic peptide
  Seed: GASAFPTTINF (MAGA1_HUMAN)
GASAFPTTINW

SEQ ID NO: 41485 - protein, 10 aa, Artificial Sequence
  Description of Artificial Sequence: Synthetic peptide
  Seed: IMPKTGFLII (MAGA1_HUMAN)
IYPKTGFLIY

SEQ ID NO: 41486 - protein, 10 aa, Artificial Sequence
  Description of Artificial Sequence: Synthetic peptide
  Seed: RVRFFFPSLR (MAGA1_HUMAN)
RERFFFPSLV

SEQ ID NO: 41487 - protein, 9 aa, Artificial Sequence
  Description of Artificial Sequence: Synthetic peptide
  Seed: ATSSSSPLV (MAGA1_HUMAN)
AASSSSPLV

SEQ ID NO: 41488 - protein, 9 aa, Artificial Sequence
  Description of Artificial Sequence: Synthetic peptide
  Seed: SSSPLVLGT (MAGA1_HUMAN)
SNSPLVLGL

SEQ ID NO: 41489 - protein, 10 aa, Artificial Sequence
  Description of Artificial Sequence: Synthetic peptide
  Seed: KYRAREPVTK (MAGA1_HUMAN)
KIRAREPVTK

SEQ ID NO: 41490 - protein, 9 aa, Artificial Sequence
  Description of Artificial Sequence: Synthetic peptide
  Seed: VRFFFPSLR (MAGA1_HUMAN)
VIFFFPSLK

SEQ ID NO: 41491 - protein, 9 aa, Artificial Sequence
  Description of Artificial Sequence: Synthetic peptide
  Seed: VRFFFPSLR (MAGA1_HUMAN)
VVFFFPSLR

SEQ ID NO: 41492 - protein, 9 aa, Artificial Sequence
  Description of Artificial Sequence: Synthetic peptide
  Seed: CILESLFRA (MAGA1_HUMAN)
CQLESLFRL

SEQ ID NO: 41493 - protein, 10 aa, Artificial Sequence
  Description of Artificial Sequence: Synthetic peptide
  Seed: VKVLEYVIKV (MAGA1_HUMAN)
VRVLEYVIKV

SEQ ID NO: 41494 - protein, 8 aa, Artificial Sequence
  Description of Artificial Sequence: Synthetic peptide
  Seed: VADLVGFL (MAGA1_HUMAN)
VADLVGFV

SEQ ID NO: 41495 - protein, 10 aa, Artificial Sequence
  Description of Artificial Sequence: Synthetic peptide
  Seed: YEFLWGPRAL (MAGA1_HUMAN)
YSFLWGPRAF

SEQ ID NO: 41496 - protein, 9 aa, Artificial Sequence
  Description of Artificial Sequence: Synthetic peptide
  Seed: ATSSSSPLV (MAGA1_HUMAN)
AVSSSSPLL

SEQ ID NO: 41497 - protein, 8 aa, Artificial Sequence
  Description of Artificial Sequence: Synthetic peptide
  Seed: RVRFFFPS (MAGA1_HUMAN)
RLRFFFPK

SEQ ID NO: 41498 - protein, 10 aa, Artificial Sequence
  Description of Artificial Sequence: Synthetic peptide
  Seed: SARVRFFFPS (MAGA1_HUMAN)
SIRVRFFFPK

SEQ ID NO: 41499 - protein, 9 aa, Artificial Sequence
  Description of Artificial Sequence: Synthetic peptide
  Seed: SAFPTTINF (MAGA1_HUMAN)
SNFPTTINY

SEQ ID NO: 41500 - protein, 10 aa, Artificial Sequence
  Description of Artificial Sequence: Synthetic peptide
  Seed: KEADPTGHSY (MAGA1_HUMAN)
KRADPTGHSV

SEQ ID NO: 41501 - protein, 9 aa, Artificial Sequence
  Description of Artificial Sequence: Synthetic peptide
  Seed: TQDLVQEKY (MAGA1_HUMAN)
TVDLVQEKF

SEQ ID NO: 41502 - protein, 9 aa, Artificial Sequence
  Description of Artificial Sequence: Synthetic peptide
  Seed: EIWEELSVM (MAGA1_HUMAN)
ELWEELSVF

SEQ ID NO: 41503 - protein, 9 aa, Artificial Sequence
  Description of Artificial Sequence: Synthetic peptide
  Seed: ETSYVKVLE (MAGA1_HUMAN)
ETSYVKVLR

SEQ ID NO: 41504 - protein, 9 aa, Artificial Sequence
  Description of Artificial Sequence: Synthetic peptide
  Seed: LVQEKYLEY (MAGA1_HUMAN)
LYQEKYLEV

SEQ ID NO: 41505 - protein, 9 aa, Artificial Sequence
  Description of Artificial Sequence: Synthetic peptide
  Seed: KVADLVGFL (MAGA1_HUMAN)
KAADLVGFV

SEQ ID NO: 41506 - protein, 10 aa, Artificial Sequence
  Description of Artificial Sequence: Synthetic peptide
  Seed: RVRFFFPSLR (MAGA1_HUMAN)
RERFFFPSLK

SEQ ID NO: 41507 - protein, 9 aa, Artificial Sequence
  Description of Artificial Sequence: Synthetic peptide
  Seed: SARVRFFFP (MAGA1_HUMAN)
SWRVRFFFV

SEQ ID NO: 41508 - protein, 9 aa, Artificial Sequence
  Description of Artificial Sequence: Synthetic peptide
  Seed: SAFPTTINF (MAGA1_HUMAN)
SVFPTTINK

SEQ ID NO: 41509 - protein, 10 aa, Artificial Sequence
  Description of Artificial Sequence: Synthetic peptide
  Seed: KVSARVRFFF (MAGA1_HUMAN)
KMSARVRFFY

SEQ ID NO: 41510 - protein, 10 aa, Artificial Sequence
  Description of Artificial Sequence: Synthetic peptide
  Seed: QIMPKTGFLI (MAGA1_HUMAN)
QIMPKTGFLV

SEQ ID NO: 41511 - protein, 11 aa, Artificial Sequence
  Description of Artificial Sequence: Synthetic peptide
  Seed: KVADLVGFLLL (MAGA1_HUMAN)
KQADLVGFLLL

SEQ ID NO: 41512 - protein, 9 aa, Artificial Sequence
  Description of Artificial Sequence: Synthetic peptide
  Seed: KVADLVGFL (MAGA1_HUMAN)
KRADLVGFF

SEQ ID NO: 41513 - protein, 9 aa, Artificial Sequence
  Description of Artificial Sequence: Synthetic peptide
  Seed: RAREPVTKA (MAGA1_HUMAN)
RAREPVTKY

SEQ ID NO: 41514 - protein, 10 aa, Artificial Sequence
  Description of Artificial Sequence: Synthetic peptide
  Seed: TSYVKVLEYV (MAGA1_HUMAN)
TQYVKVLEYW

SEQ ID NO: 41515 - protein, 10 aa, Artificial Sequence
  Description of Artificial Sequence: Synthetic peptide
  Seed: ETSYVKVLEY (MAGA1_HUMAN)
EASYVKVLER

SEQ ID NO: 41516 - protein, 9 aa, Artificial Sequence
  Description of Artificial Sequence: Synthetic peptide
  Seed: SESLQLVFG (MAGA1_HUMAN)
SESLQLVFL

SEQ ID NO: 41517 - protein, 9 aa, Artificial Sequence
  Description of Artificial Sequence: Synthetic peptide
  Seed: QIMPKTGFL (MAGA1_HUMAN)
QTMPKTGFA

SEQ ID NO: 41518 - protein, 9 aa, Artificial Sequence
  Description of Artificial Sequence: Synthetic peptide
  Seed: AQQEALGLV (MAGA1_HUMAN)
AQQEALGLW

SEQ ID NO: 41519 - protein, 9 aa, Artificial Sequence
  Description of Artificial Sequence: Synthetic peptide
  Seed: LVGFLLLKY (MAGA1_HUMAN)
LWGFLLLKY

SEQ ID NO: 41520 - protein, 9 aa, Artificial Sequence
  Description of Artificial Sequence: Synthetic peptide
  Seed: EFLWGPRAL (MAGA1_HUMAN)
EYLWGPRAF

SEQ ID NO: 41521 - protein, 10 aa, Artificial Sequence
  Description of Artificial Sequence: Synthetic peptide
  Seed: ADLVGFLLLK (MAGA1_HUMAN)
AQLVGFLLLK

SEQ ID NO: 41522 - protein, 9 aa, Artificial Sequence
  Description of Artificial Sequence: Synthetic peptide
  Seed: STSCILESL (MAGA1_HUMAN)
SISCILESR

SEQ ID NO: 41523 - protein, 11 aa, Artificial Sequence
  Description of Artificial Sequence: Synthetic peptide
  Seed: KVSARVRFFFP (MAGA1_HUMAN)
KMSARVRFFFK

SEQ ID NO: 41524 - protein, 10 aa, Artificial Sequence
  Description of Artificial Sequence: Synthetic peptide
  Seed: KNYKHCFPEI (MAGA1_HUMAN)
KMYKHCFPEF

SEQ ID NO: 41525 - protein, 9 aa, Artificial Sequence
  Description of Artificial Sequence: Synthetic peptide
  Seed: GASAFPTTI (MAGA1_HUMAN)
GTSAFPTTI

SEQ ID NO: 41526 - protein, 9 aa, Artificial Sequence
  Description of Artificial Sequence: Synthetic peptide
  Seed: SARVRFFFP (MAGA1_HUMAN)
STRVRFFFC

SEQ ID NO: 41527 - protein, 9 aa, Artificial Sequence
  Description of Artificial Sequence: Synthetic peptide
  Seed: SAFPTTINF (MAGA1_HUMAN)
SVFPTTINF

SEQ ID NO: 41528 - protein, 8 aa, Artificial Sequence
  Description of Artificial Sequence: Synthetic peptide
  Seed: YVKVLEYV (MAGA1_HUMAN)
YLKVLEYI

SEQ ID NO: 41529 - protein, 9 aa, Artificial Sequence
  Description of Artificial Sequence: Synthetic peptide
  Seed: ATSSSSPLV (MAGA1_HUMAN)
AMSSSSPLM

SEQ ID NO: 41530 - protein, 9 aa, Artificial Sequence
  Description of Artificial Sequence: Synthetic peptide
  Seed: TQDLVQEKY (MAGA1_HUMAN)
TFDLVQEKF

SEQ ID NO: 41531 - protein, 10 aa, Artificial Sequence
  Description of Artificial Sequence: Synthetic peptide
  Seed: KNYKHCFPEI (MAGA1_HUMAN)
KMYKHCFPEA

SEQ ID NO: 41532 - protein, 10 aa, Artificial Sequence
  Description of Artificial Sequence: Synthetic peptide
  Seed: RVRFFFPSLR (MAGA1_HUMAN)
RCRFFFPSLI

SEQ ID NO: 41533 - protein, 10 aa, Artificial Sequence
  Description of Artificial Sequence: Synthetic peptide
  Seed: REAALREEEE (MAGA1_HUMAN)
REAALREEET

SEQ ID NO: 41534 - protein, 9 aa, Artificial Sequence
  Description of Artificial Sequence: Synthetic peptide
  Seed: KVADLVGFL (MAGA1_HUMAN)
KQADLVGFI

SEQ ID NO: 41535 - protein, 9 aa, Artificial Sequence
  Description of Artificial Sequence: Synthetic peptide
  Seed: LKYRAREPV (MAGA1_HUMAN)
LMYRAREPM

SEQ ID NO: 41536 - protein, 9 aa, Artificial Sequence
  Description of Artificial Sequence: Synthetic peptide
  Seed: YVIKVSARV (MAGA1_HUMAN)
YIIKVSARF

SEQ ID NO: 41537 - protein, 9 aa, Artificial Sequence
  Description of Artificial Sequence: Synthetic peptide
  Seed: GTLEEVPTA (MAGA1_HUMAN)
GQLEEVPTM

SEQ ID NO: 41538 - protein, 9 aa, Artificial Sequence
  Description of Artificial Sequence: Synthetic peptide
  Seed: YKHCFPEIF (MAGA1_HUMAN)
YMHCFPEIL

SEQ ID NO: 41539 - protein, 10 aa, Artificial Sequence
  Description of Artificial Sequence: Synthetic peptide
  Seed: FFFPSLREAA (MAGA1_HUMAN)
FMFPSLREAF

SEQ ID NO: 41540 - protein, 9 aa, Artificial Sequence
  Description of Artificial Sequence: Synthetic peptide
  Seed: LESLFRAVI (MAGA1_HUMAN)
LESLFRAVP

SEQ ID NO: 41541 - protein, 9 aa, Artificial Sequence
  Description of Artificial Sequence: Synthetic peptide
  Seed: REPVTKAEM (MAGA1_HUMAN)
RSPVTKAEY

SEQ ID NO: 41542 - protein, 10 aa, Artificial Sequence
  Description of Artificial Sequence: Synthetic peptide
  Seed: FFFPSLREAA (MAGA1_HUMAN)
FHFPSLREAM

SEQ ID NO: 41543 - protein, 9 aa, Artificial Sequence
  Description of Artificial Sequence: Synthetic peptide
  Seed: VQAATSSSS (MAGA1_HUMAN)
VRAATSSSM

SEQ ID NO: 41544 - protein, 9 aa, Artificial Sequence
  Description of Artificial Sequence: Synthetic peptide
  Seed: ATSSSSPLV (MAGA1_HUMAN)
AISSSSPLW

SEQ ID NO: 41545 - protein, 10 aa, Artificial Sequence
  Description of Artificial Sequence: Synthetic peptide
  Seed: SESLQLVFGI (MAGA1_HUMAN)
SFSLQLVFGW

SEQ ID NO: 41546 - protein, 10 aa, Artificial Sequence
  Description of Artificial Sequence: Synthetic peptide
  Seed: RQVPDSDPAR (MAGA1_HUMAN)
RAVPDSDPAL

SEQ ID NO: 41547 - protein, 9 aa, Artificial Sequence
  Description of Artificial Sequence: Synthetic peptide
  Seed: ARVRFFFPS (MAGA1_HUMAN)
AQVRFFFPV

SEQ ID NO: 41548 - protein, 9 aa, Artificial Sequence
  Description of Artificial Sequence: Synthetic peptide
  Seed: SAFPTTINF (MAGA1_HUMAN)
SFFPTTINR

SEQ ID NO: 41549 - protein, 9 aa, Artificial Sequence
  Description of Artificial Sequence: Synthetic peptide
  Seed: LVTCLGLSY (MAGA1_HUMAN)
LKTCLGLSY

SEQ ID NO: 41550 - protein, 9 aa, Artificial Sequence
  Description of Artificial Sequence: Synthetic peptide
  Seed: STSCILESL (MAGA1_HUMAN)
SLSCILESY

SEQ ID NO: 41551 - protein, 10 aa, Artificial Sequence
  Description of Artificial Sequence: Synthetic peptide
  Seed: RVRFFFPSLR (MAGA1_HUMAN)
RYRFFFPSLS

SEQ ID NO: 41552 - protein, 9 aa, Artificial Sequence
  Description of Artificial Sequence: Synthetic peptide
  Seed: RVRFFFPSL (MAGA1_HUMAN)
RLRFFFPSY

SEQ ID NO: 41553 - protein, 9 aa, Artificial Sequence
  Description of Artificial Sequence: Synthetic peptide
  Seed: YVLVTCLGL (MAGA1_HUMAN)
YILVTCLGI

SEQ ID NO: 41554 - protein, 9 aa, Artificial Sequence
  Description of Artificial Sequence: Synthetic peptide
  Seed: LTQDLVQEK (MAGA1_HUMAN)
LVQDLVQEL

SEQ ID NO: 41555 - protein, 11 aa, Artificial Sequence
  Description of Artificial Sequence: Synthetic peptide
  Seed: KVLEYVIKVSA (MAGA1_HUMAN)
KQLEYVIKVSV

SEQ ID NO: 41556 - protein, 10 aa, Artificial Sequence
  Description of Artificial Sequence: Synthetic peptide
  Seed: FFPSLREAAL (MAGA1_HUMAN)
FIPSLREAAY

SEQ ID NO: 41557 - protein, 10 aa, Artificial Sequence
  Description of Artificial Sequence: Synthetic peptide
  Seed: FFPSLREAAL (MAGA1_HUMAN)
FWPSLREAAL

SEQ ID NO: 41558 - protein, 9 aa, Artificial Sequence
  Description of Artificial Sequence: Synthetic peptide
  Seed: DLVGFLLLK (MAGA1_HUMAN)
DFVGFLLLR

SEQ ID NO: 41559 - protein, 8 aa, Artificial Sequence
  Description of Artificial Sequence: Synthetic peptide
  Seed: HSYVLVTC (MAGA1_HUMAN)
HSYVLVTI

SEQ ID NO: 41560 - protein, 9 aa, Artificial Sequence
  Description of Artificial Sequence: Synthetic peptide
  Seed: LFRAVITKK (MAGA1_HUMAN)
LARAVITKK

SEQ ID NO: 41561 - protein, 10 aa, Artificial Sequence
  Description of Artificial Sequence: Synthetic peptide
  Seed: KHCFPEIFGK (MAGA1_HUMAN)
KGCFPEIFGR

SEQ ID NO: 41562 - protein, 9 aa, Artificial Sequence
  Description of Artificial Sequence: Synthetic peptide
  Seed: YVLVTCLGL (MAGA1_HUMAN)
YMLVTCLGY

SEQ ID NO: 41563 - protein, 10 aa, Artificial Sequence
  Description of Artificial Sequence: Synthetic peptide
  Seed: ARVRFFFPSL (MAGA1_HUMAN)
APVRFFFPSI

SEQ ID NO: 41564 - protein, 9 aa, Artificial Sequence
  Description of Artificial Sequence: Synthetic peptide
  Seed: RVRFFFPSL (MAGA1_HUMAN)
RFRFFFPSG

SEQ ID NO: 41565 - protein, 11 aa, Artificial Sequence
  Description of Artificial Sequence: Synthetic peptide
  Seed: FFFPSLREAAL (MAGA1_HUMAN)
FYFPSLREAAM

SEQ ID NO: 41566 - protein, 8 aa, Artificial Sequence
  Description of Artificial Sequence: Synthetic peptide
  Seed: TQDLVQEK (MAGA1_HUMAN)
TTDLVQEY

SEQ ID NO: 41567 - protein, 9 aa, Artificial Sequence
  Description of Artificial Sequence: Synthetic peptide
  Seed: RVRFFFPSL (MAGA1_HUMAN)
RMRFFFPSA

SEQ ID NO: 41568 - protein, 9 aa, Artificial Sequence
  Description of Artificial Sequence: Synthetic peptide
  Seed: SAFPTTINF (MAGA1_HUMAN)
SGFPTTINR

SEQ ID NO: 41569 - protein, 9 aa, Artificial Sequence
  Description of Artificial Sequence: Synthetic peptide
  Seed: TSYVKVLEY (MAGA1_HUMAN)
TSYVKVLEF

SEQ ID NO: 41570 - protein, 10 aa, Artificial Sequence
  Description of Artificial Sequence: Synthetic peptide
  Seed: KEADPTGHSY (MAGA1_HUMAN)
KSADPTGHSL

SEQ ID NO: 41571 - protein, 9 aa, Artificial Sequence
  Description of Artificial Sequence: Synthetic peptide
  Seed: NQIMPKTGF (MAGA1_HUMAN)
NMIMPKTGF

SEQ ID NO: 41572 - protein, 9 aa, Artificial Sequence
  Description of Artificial Sequence: Synthetic peptide
  Seed: TQDLVQEKY (MAGA1_HUMAN)
TADLVQEKM

SEQ ID NO: 41573 - protein, 9 aa, Artificial Sequence
  Description of Artificial Sequence: Synthetic peptide
  Seed: STSCILESL (MAGA1_HUMAN)
SSSCILESW

SEQ ID NO: 41574 - protein, 9 aa, Artificial Sequence
  Description of Artificial Sequence: Synthetic peptide
  Seed: QSPQGASAF (MAGA1_HUMAN)
QTPQGASAR

SEQ ID NO: 41575 - protein, 10 aa, Artificial Sequence
  Description of Artificial Sequence: Synthetic peptide
  Seed: SAFPTTINFT (MAGA1_HUMAN)
SQFPTTINFV

SEQ ID NO: 41576 - protein, 10 aa, Artificial Sequence
  Description of Artificial Sequence: Synthetic peptide
  Seed: FLWGPRALAE (MAGA1_HUMAN)
FLWGPRALAM

SEQ ID NO: 41577 - protein, 9 aa, Artificial Sequence
  Description of Artificial Sequence: Synthetic peptide
  Seed: KYRAREPVT (MAGA1_HUMAN)
KSRAREPVV

SEQ ID NO: 41578 - protein, 9 aa, Artificial Sequence
  Description of Artificial Sequence: Synthetic peptide
  Seed: AATSSSSPL (MAGA1_HUMAN)
ASTSSSSPL

SEQ ID NO: 41579 - protein, 9 aa, Artificial Sequence
  Description of Artificial Sequence: Synthetic peptide
  Seed: ALAETSYVK (MAGA1_HUMAN)
AVAETSYVK

SEQ ID NO: 41580 - protein, 9 aa, Artificial Sequence
  Description of Artificial Sequence: Synthetic peptide
  Seed: RVRFFFPSL (MAGA1_HUMAN)
RIRFFFPSG

SEQ ID NO: 41581 - protein, 9 aa, Artificial Sequence
  Description of Artificial Sequence: Synthetic peptide
  Seed: KVLEYVIKV (MAGA1_HUMAN)
KELEYVIKF

SEQ ID NO: 41582 - protein, 9 aa, Artificial Sequence
  Description of Artificial Sequence: Synthetic peptide
  Seed: VADLVGFLL (MAGA1_HUMAN)
VMDLVGFLI

SEQ ID NO: 41583 - protein, 11 aa, Artificial Sequence
  Description of Artificial Sequence: Synthetic peptide
  Seed: RQVPDSDPARY (MAGA1_HUMAN)
RTVPDSDPARY

SEQ ID NO: 41584 - protein, 10 aa, Artificial Sequence
  Description of Artificial Sequence: Synthetic peptide
  Seed: KEADPTGHSY (MAGA1_HUMAN)
KDADPTGHSF

SEQ ID NO: 41585 - protein, 9 aa, Artificial Sequence
  Description of Artificial Sequence: Synthetic peptide
  Seed: KVSARVRFF (MAGA1_HUMAN)
KVSARVRFW

SEQ ID NO: 41586 - protein, 9 aa, Artificial Sequence
  Description of Artificial Sequence: Synthetic peptide
  Seed: YKHCFPEIF (MAGA1_HUMAN)
YEHCFPEIF

SEQ ID NO: 41587 - protein, 9 aa, Artificial Sequence
  Description of Artificial Sequence: Synthetic peptide
  Seed: RALAETSYV (MAGA1_HUMAN)
RTLAETSYI

SEQ ID NO: 41588 - protein, 8 aa, Artificial Sequence
  Description of Artificial Sequence: Synthetic peptide
  Seed: FLWGPRAL (MAGA1_HUMAN)
FSWGPRAF

SEQ ID NO: 41589 - protein, 9 aa, Artificial Sequence
  Description of Artificial Sequence: Synthetic peptide
  Seed: VQAATSSSS (MAGA1_HUMAN)
VEAATSSSF

SEQ ID NO: 41590 - protein, 9 aa, Artificial Sequence
  Description of Artificial Sequence: Synthetic peptide
  Seed: GTLEEVPTA (MAGA1_HUMAN)
GLLEEVPTV

SEQ ID NO: 41591 - protein, 10 aa, Artificial Sequence
  Description of Artificial Sequence: Synthetic peptide
  Seed: KVSARVRFFF (MAGA1_HUMAN)
KKSARVRFFK

SEQ ID NO: 41592 - protein, 10 aa, Artificial Sequence
  Description of Artificial Sequence: Synthetic peptide
  Seed: VYDGREHSAY (MAGA1_HUMAN)
VYDGREHSAM

SEQ ID NO: 41593 - protein, 11 aa, Artificial Sequence
  Description of Artificial Sequence: Synthetic peptide
  Seed: RVRFFFPSLRE (MAGA1_HUMAN)
RTRFFFPSLRE

SEQ ID NO: 41594 - protein, 9 aa, Artificial Sequence
  Description of Artificial Sequence: Synthetic peptide
  Seed: FPTTINFTR (MAGA1_HUMAN)
FITTINFTR

SEQ ID NO: 41595 - protein, 9 aa, Artificial Sequence
  Description of Artificial Sequence: Synthetic peptide
  Seed: DSDPARYEF (MAGA1_HUMAN)
DADPARYEL

SEQ ID NO: 41596 - protein, 10 aa, Artificial Sequence
  Description of Artificial Sequence: Synthetic peptide
  Seed: KVADLVGFLL (MAGA1_HUMAN)
KVADLVGFLA

SEQ ID NO: 41597 - protein, 9 aa, Artificial Sequence
  Description of Artificial Sequence: Synthetic peptide
  Seed: KAEMLESVI (MAGA1_HUMAN)
KTEMLESVW

SEQ ID NO: 41598 - protein, 9 aa, Artificial Sequence
  Description of Artificial Sequence: Synthetic peptide
  Seed: RAREPVTKA (MAGA1_HUMAN)
RHREPVTKF

SEQ ID NO: 41599 - protein, 11 aa, Artificial Sequence
  Description of Artificial Sequence: Synthetic peptide
  Seed: KEADPTGHSYV (MAGA1_HUMAN)
KMADPTGHSYL

SEQ ID NO: 41600 - protein, 10 aa, Artificial Sequence
  Description of Artificial Sequence: Synthetic peptide
  Seed: SARVRFFFPS (MAGA1_HUMAN)
SSRVRFFFPS

SEQ ID NO: 41601 - protein, 9 aa, Artificial Sequence
  Description of Artificial Sequence: Synthetic peptide
  Seed: RVRFFFPSL (MAGA1_HUMAN)
RNRFFFPSM

SEQ ID NO: 41602 - protein, 9 aa, Artificial Sequence
  Description of Artificial Sequence: Synthetic peptide
  Seed: EADPTGHSY (MAGA1_HUMAN)
ETDPTGHSR

SEQ ID NO: 41603 - protein, 9 aa, Artificial Sequence
  Description of Artificial Sequence: Synthetic peptide
  Seed: LESLFRAVI (MAGA1_HUMAN)
LISLFRAVF

SEQ ID NO: 41604 - protein, 10 aa, Artificial Sequence
  Description of Artificial Sequence: Synthetic peptide
  Seed: MLESVIKNYK (MAGA1_HUMAN)
MQESVIKNYR

SEQ ID NO: 41605 - protein, 11 aa, Artificial Sequence
  Description of Artificial Sequence: Synthetic peptide
  Seed: YEFLWGPRALA (MAGA1_HUMAN)
YEFLWGPRALL

SEQ ID NO: 41606 - protein, 8 aa, Artificial Sequence
  Description of Artificial Sequence: Synthetic peptide
  Seed: VSARVRFF (MAGA1_HUMAN)
VSARVRFW

SEQ ID NO: 41607 - protein, 9 aa, Artificial Sequence
  Description of Artificial Sequence: Synthetic peptide
  Seed: LVQEKYLEY (MAGA1_HUMAN)
LAQEKYLEV

SEQ ID NO: 41608 - protein, 11 aa, Artificial Sequence
  Description of Artificial Sequence: Synthetic peptide
  Seed: RQVPDSDPARY (MAGA1_HUMAN)
RTVPDSDPARL

SEQ ID NO: 41609 - protein, 10 aa, Artificial Sequence
  Description of Artificial Sequence: Synthetic peptide
  Seed: VLVTCLGLSY (MAGA1_HUMAN)
VMVTCLGLSM

SEQ ID NO: 41610 - protein, 9 aa, Artificial Sequence
  Description of Artificial Sequence: Synthetic peptide
  Seed: IAMEGGHAP (MAGA1_HUMAN)
IAMEGGHAA

SEQ ID NO: 41611 - protein, 9 aa, Artificial Sequence
  Description of Artificial Sequence: Synthetic peptide
  Seed: ALREEEEGV (MAGA1_HUMAN)
AQREEEEGL

SEQ ID NO: 41612 - protein, 9 aa, Artificial Sequence
  Description of Artificial Sequence: Synthetic peptide
  Seed: QIMPKTGFL (MAGA1_HUMAN)
QMMPKTGFW

SEQ ID NO: 41613 - protein, 8 aa, Artificial Sequence
  Description of Artificial Sequence: Synthetic peptide
  Seed: YVKVLEYV (MAGA1_HUMAN)
YMKVLEYL

SEQ ID NO: 41614 - protein, 10 aa, Artificial Sequence
  Description of Artificial Sequence: Synthetic peptide
  Seed: EYVIKVSARV (MAGA1_HUMAN)
EKVIKVSARV

SEQ ID NO: 41615 - protein, 10 aa, Artificial Sequence
  Description of Artificial Sequence: Synthetic peptide
  Seed: KVSARVRFFF (MAGA1_HUMAN)
KGSARVRFFW

SEQ ID NO: 41616 - protein, 10 aa, Artificial Sequence
  Description of Artificial Sequence: Synthetic peptide
  Seed: SAFPTTINFT (MAGA1_HUMAN)
SIFPTTINFL

SEQ ID NO: 41617 - protein, 10 aa, Artificial Sequence
  Description of Artificial Sequence: Synthetic peptide
  Seed: YEFLWGPRAL (MAGA1_HUMAN)
YVFLWGPRAM

SEQ ID NO: 41618 - protein, 9 aa, Artificial Sequence
  Description of Artificial Sequence: Synthetic peptide
  Seed: VQAATSSSS (MAGA1_HUMAN)
VYAATSSSF

SEQ ID NO: 41619 - protein, 10 aa, Artificial Sequence
  Description of Artificial Sequence: Synthetic peptide
  Seed: ESLFRAVITK (MAGA1_HUMAN)
EKLFRAVITK

SEQ ID NO: 41620 - protein, 10 aa, Artificial Sequence
  Description of Artificial Sequence: Synthetic peptide
  Seed: EFLWGPRALA (MAGA1_HUMAN)
EFLWGPRALV

SEQ ID NO: 41621 - protein, 10 aa, Artificial Sequence
  Description of Artificial Sequence: Synthetic peptide
  Seed: KEADPTGHSY (MAGA1_HUMAN)
KRADPTGHSF

SEQ ID NO: 41622 - protein, 10 aa, Artificial Sequence
  Description of Artificial Sequence: Synthetic peptide
  Seed: RAREPVTKAE (MAGA1_HUMAN)
RLREPVTKAK

SEQ ID NO: 41623 - protein, 10 aa, Artificial Sequence
  Description of Artificial Sequence: Synthetic peptide
  Seed: ASAFPTTINF (MAGA1_HUMAN)
AAAFPTTINW

SEQ ID NO: 41624 - protein, 10 aa, Artificial Sequence
  Description of Artificial Sequence: Synthetic peptide
  Seed: RVRFFFPSLR (MAGA1_HUMAN)
RWRFFFPSLK

SEQ ID NO: 41625 - protein, 10 aa, Artificial Sequence
  Description of Artificial Sequence: Synthetic peptide
  Seed: FFPSLREAAL (MAGA1_HUMAN)
FCPSLREAAY

SEQ ID NO: 41626 - protein, 9 aa, Artificial Sequence
  Description of Artificial Sequence: Synthetic peptide
  Seed: TSSSSPLVL (MAGA1_HUMAN)
TQSSSPLVF

SEQ ID NO: 41627 - protein, 9 aa, Artificial Sequence
  Description of Artificial Sequence: Synthetic peptide
  Seed: RAREPVTKA (MAGA1_HUMAN)
RPREPVTKI

SEQ ID NO: 41628 - protein, 10 aa, Artificial Sequence
  Description of Artificial Sequence: Synthetic peptide
  Seed: LSVMEVYDGR (MAGA1_HUMAN)
LFVMEVYDGR

SEQ ID NO: 41629 - protein, 9 aa, Artificial Sequence
  Description of Artificial Sequence: Synthetic peptide
  Seed: TTINFTRQR (MAGA1_HUMAN)
TIINFTRQR

SEQ ID NO: 41630 - protein, 9 aa, Artificial Sequence
  Description of Artificial Sequence: Synthetic peptide
  Seed: RAREPVTKA (MAGA1_HUMAN)
RVREPVTKG

SEQ ID NO: 41631 - protein, 10 aa, Artificial Sequence
  Description of Artificial Sequence: Synthetic peptide
  Seed: RVRFFFPSLR (MAGA1_HUMAN)
RGRFFFPSLK

SEQ ID NO: 41632 - protein, 9 aa, Artificial Sequence
  Description of Artificial Sequence: Synthetic peptide
  Seed: FFFPSLREA (MAGA1_HUMAN)
FWFPSLREM

SEQ ID NO: 41633 - protein, 9 aa, Artificial Sequence
  Description of Artificial Sequence: Synthetic peptide
  Seed: RQVPDSDPA (MAGA1_HUMAN)
RRVPDSDPF

SEQ ID NO: 41634 - protein, 9 aa, Artificial Sequence
  Description of Artificial Sequence: Synthetic peptide
  Seed: RALAETSYV (MAGA1_HUMAN)
RILAETSYV

SEQ ID NO: 41635 - protein, 9 aa, Artificial Sequence
  Description of Artificial Sequence: Synthetic peptide
  Seed: FPTTINFTR (MAGA1_HUMAN)
FNTTINFTK

SEQ ID NO: 41636 - protein, 11 aa, Artificial Sequence
  Description of Artificial Sequence: Synthetic peptide
  Seed: RQVPDSDPARY (MAGA1_HUMAN)
RLVPDSDPARL

SEQ ID NO: 41637 - protein, 10 aa, Artificial Sequence
  Description of Artificial Sequence: Synthetic peptide
  Seed: ILESLFRAVI (MAGA1_HUMAN)
IEESLFRAVL

SEQ ID NO: 41638 - protein, 10 aa, Artificial Sequence
  Description of Artificial Sequence: Synthetic peptide
  Seed: KYRAREPVTK (MAGA1_HUMAN)
KTRAREPVTR

SEQ ID NO: 41639 - protein, 11 aa, Artificial Sequence
  Description of Artificial Sequence: Synthetic peptide
  Seed: TKKVADLVGFL (MAGA1_HUMAN)
TSKVADLVGFV

SEQ ID NO: 41640 - protein, 10 aa, Artificial Sequence
  Description of Artificial Sequence: Synthetic peptide
  Seed: FFPSLREAAL (MAGA1_HUMAN)
FMPSLREAAL

SEQ ID NO: 41641 - protein, 9 aa, Artificial Sequence
  Description of Artificial Sequence: Synthetic peptide
  Seed: IMPKTGFLI (MAGA1_HUMAN)
ILPKTGFLI

SEQ ID NO: 41642 - protein, 10 aa, Artificial Sequence
  Description of Artificial Sequence: Synthetic peptide
  Seed: KVADLVGFLL (MAGA1_HUMAN)
KMADLVGFLG

SEQ ID NO: 41643 - protein, 9 aa, Artificial Sequence
  Description of Artificial Sequence: Synthetic peptide
  Seed: TQDLVQEKY (MAGA1_HUMAN)
TTDLVQEKF

SEQ ID NO: 41644 - protein, 9 aa, Artificial Sequence
  Description of Artificial Sequence: Synthetic peptide
  Seed: STSCILESL (MAGA1_HUMAN)
SQSCILESL

SEQ ID NO: 41645 - protein, 11 aa, Artificial Sequence
  Description of Artificial Sequence: Synthetic peptide
  Seed: EIFGKASESLQ (MAGA1_HUMAN)
ESFGKASESLK

SEQ ID NO: 41646 - protein, 9 aa, Artificial Sequence
  Description of Artificial Sequence: Synthetic peptide
  Seed: KVSARVRFF (MAGA1_HUMAN)
KQSARVRFY

SEQ ID NO: 41647 - protein, 9 aa, Artificial Sequence
  Description of Artificial Sequence: Synthetic peptide
  Seed: EPVTKAEML (MAGA1_HUMAN)
ERVTKAEML

SEQ ID NO: 41648 - protein, 9 aa, Artificial Sequence
  Description of Artificial Sequence: Synthetic peptide
  Seed: VQAATSSSS (MAGA1_HUMAN)
VSAATSSSY

SEQ ID NO: 41649 - protein, 9 aa, Artificial Sequence
  Description of Artificial Sequence: Synthetic peptide
  Seed: VYDGREHSA (MAGA1_HUMAN)
VNDGREHSL

SEQ ID NO: 41650 - protein, 9 aa, Artificial Sequence
  Description of Artificial Sequence: Synthetic peptide
  Seed: YVLVTCLGL (MAGA1_HUMAN)
YALVTCLGL

SEQ ID NO: 41651 - protein, 11 aa, Artificial Sequence
  Description of Artificial Sequence: Synthetic peptide
  Seed: YVKVLEYVIKV (MAGA1_HUMAN)
YAKVLEYVIKV

SEQ ID NO: 41652 - protein, 9 aa, Artificial Sequence
  Description of Artificial Sequence: Synthetic peptide
  Seed: EELSVMEVY (MAGA1_HUMAN)
EQLSVMEVF

SEQ ID NO: 41653 - protein, 10 aa, Artificial Sequence
  Description of Artificial Sequence: Synthetic peptide
  Seed: VYDGREHSAY (MAGA1_HUMAN)
VVDGREHSAY

SEQ ID NO: 41654 - protein, 8 aa, Artificial Sequence
  Description of Artificial Sequence: Synthetic peptide
  Seed: RVRFFFPS (MAGA1_HUMAN)
RTRFFFPI

SEQ ID NO: 41655 - protein, 9 aa, Artificial Sequence
  Description of Artificial Sequence: Synthetic peptide
  Seed: SSPLVLGTL (MAGA1_HUMAN)
SPPLVLGTV

SEQ ID NO: 41656 - protein, 10 aa, Artificial Sequence
  Description of Artificial Sequence: Synthetic peptide
  Seed: KVLEYVIKVS (MAGA1_HUMAN)
KMLEYVIKVC

SEQ ID NO: 41657 - protein, 10 aa, Artificial Sequence
  Description of Artificial Sequence: Synthetic peptide
  Seed: KNYKHCFPEI (MAGA1_HUMAN)
KWYKHCFPEI

SEQ ID NO: 41658 - protein, 9 aa, Artificial Sequence
  Description of Artificial Sequence: Synthetic peptide
  Seed: RQRQPSEGS (MAGA1_HUMAN)
RMRQPSEGV

SEQ ID NO: 41659 - protein, 9 aa, Artificial Sequence
  Description of Artificial Sequence: Synthetic peptide
  Seed: GTLEEVPTA (MAGA1_HUMAN)
GQLEEVPTL

SEQ ID NO: 41660 - protein, 10 aa, Artificial Sequence
  Description of Artificial Sequence: Synthetic peptide
  Seed: SSSPLVLGTL (MAGA1_HUMAN)
SASPLVLGTY

SEQ ID NO: 41661 - protein, 10 aa, Artificial Sequence
  Description of Artificial Sequence: Synthetic peptide
  Seed: STSCILESLF (MAGA1_HUMAN)
SHSCILESLW

SEQ ID NO: 41662 - protein, 9 aa, Artificial Sequence
  Description of Artificial Sequence: Synthetic peptide
  Seed: LESLFRAVI (MAGA1_HUMAN)
LSSLFRAVY

SEQ ID NO: 41663 - protein, 9 aa, Artificial Sequence
  Description of Artificial Sequence: Synthetic peptide
  Seed: DLVGFLLLK (MAGA1_HUMAN)
DWVGFLLLK

SEQ ID NO: 41664 - protein, 11 aa, Artificial Sequence
  Description of Artificial Sequence: Synthetic peptide
  Seed: KVSARVRFFFP (MAGA1_HUMAN)
KLSARVRFFFK

SEQ ID NO: 41665 - protein, 9 aa, Artificial Sequence
  Description of Artificial Sequence: Synthetic peptide
  Seed: ALAETSYVK (MAGA1_HUMAN)
ASAETSYVK

SEQ ID NO: 41666 - protein, 10 aa, Artificial Sequence
  Description of Artificial Sequence: Synthetic peptide
  Seed: TTINFTRQRQ (MAGA1_HUMAN)
TIINFTRQRK

SEQ ID NO: 41667 - protein, 10 aa, Artificial Sequence
  Description of Artificial Sequence: Synthetic peptide
  Seed: SSSPLVLGTL (MAGA1_HUMAN)
SSSPLVLGTF

SEQ ID NO: 41668 - protein, 9 aa, Artificial Sequence
  Description of Artificial Sequence: Synthetic peptide
  Seed: VSARVRFFF (MAGA1_HUMAN)
VWARVRFFM

SEQ ID NO: 41669 - protein, 10 aa, Artificial Sequence
  Description of Artificial Sequence: Synthetic peptide
  Seed: KVADLVGFLL (MAGA1_HUMAN)
KLADLVGFLV

SEQ ID NO: 41670 - protein, 9 aa, Artificial Sequence
  Description of Artificial Sequence: Synthetic peptide
  Seed: QQEALGLVC (MAGA1_HUMAN)
QEEALGLVI

SEQ ID NO: 41671 - protein, 10 aa, Artificial Sequence
  Description of Artificial Sequence: Synthetic peptide
  Seed: KEADPTGHSY (MAGA1_HUMAN)
KRADPTGHSW

SEQ ID NO: 41672 - protein, 9 aa, Artificial Sequence
  Description of Artificial Sequence: Synthetic peptide
  Seed: AETSYVKVL (MAGA1_HUMAN)
AETSYVKVI

SEQ ID NO: 41673 - protein, 9 aa, Artificial Sequence
  Description of Artificial Sequence: Synthetic peptide
  Seed: LKYRAREPV (MAGA1_HUMAN)
LIYRAREPY

SEQ ID NO: 41674 - protein, 9 aa, Artificial Sequence
  Description of Artificial Sequence: Synthetic peptide
  Seed: KVLEYVIKV (MAGA1_HUMAN)
KELEYVIKV

SEQ ID NO: 41675 - protein, 10 aa, Artificial Sequence
  Description of Artificial Sequence: Synthetic peptide
  Seed: SVMEVYDGRE (MAGA1_HUMAN)
SAMEVYDGRR

SEQ ID NO: 41676 - protein, 11 aa, Artificial Sequence
  Description of Artificial Sequence: Synthetic peptide
  Seed: SARVRFFFPSL (MAGA1_HUMAN)
SVRVRFFFPSA

SEQ ID NO: 41677 - protein, 9 aa, Artificial Sequence
  Description of Artificial Sequence: Synthetic peptide
  Seed: TSYVKVLEY (MAGA1_HUMAN)
TPYVKVLEY

SEQ ID NO: 41678 - protein, 10 aa, Artificial Sequence
  Description of Artificial Sequence: Synthetic peptide
  Seed: KVLEYVIKVS (MAGA1_HUMAN)
KMLEYVIKVI

SEQ ID NO: 41679 - protein, 9 aa, Artificial Sequence
  Description of Artificial Sequence: Synthetic peptide
  Seed: TQDLVQEKY (MAGA1_HUMAN)
TQDLVQEKL

SEQ ID NO: 41680 - protein, 10 aa, Artificial Sequence
  Description of Artificial Sequence: Synthetic peptide
  Seed: VTKAEMLESV (MAGA1_HUMAN)
VQKAEMLESV

SEQ ID NO: 41681 - protein, 9 aa, Artificial Sequence
  Description of Artificial Sequence: Synthetic peptide
  Seed: RVRFFFPSL (MAGA1_HUMAN)
RFRFFFPSF

SEQ ID NO: 41682 - protein, 10 aa, Artificial Sequence
  Description of Artificial Sequence: Synthetic peptide
  Seed: VKVLEYVIKV (MAGA1_HUMAN)
VQVLEYVIKV

SEQ ID NO: 41683 - protein, 10 aa, Artificial Sequence
  Description of Artificial Sequence: Synthetic peptide
  Seed: ARVRFFFPSL (MAGA1_HUMAN)
AKVRFFFPSI

SEQ ID NO: 41684 - protein, 9 aa, Artificial Sequence
  Description of Artificial Sequence: Synthetic peptide
  Seed: FFFPSLREA (MAGA1_HUMAN)
FQFPSLREL

SEQ ID NO: 41685 - protein, 9 aa, Artificial Sequence
  Description of Artificial Sequence: Synthetic peptide
  Seed: GASAFPTTI (MAGA1_HUMAN)
GSSAFPTTV

SEQ ID NO: 41686 - protein, 9 aa, Artificial Sequence
  Description of Artificial Sequence: Synthetic peptide
  Seed: ALGLVCVQA (MAGA1_HUMAN)
AVGLVCVQV

SEQ ID NO: 41687 - protein, 10 aa, Artificial Sequence
  Description of Artificial Sequence: Synthetic peptide
  Seed: SARVRFFFPS (MAGA1_HUMAN)
SPRVRFFFPF

SEQ ID NO: 41688 - protein, 10 aa, Artificial Sequence
  Description of Artificial Sequence: Synthetic peptide
  Seed: KVLEYVIKVS (MAGA1_HUMAN)
KILEYVIKVV

SEQ ID NO: 41689 - protein, 9 aa, Artificial Sequence
  Description of Artificial Sequence: Synthetic peptide
  Seed: VSARVRFFF (MAGA1_HUMAN)
VTARVRFFL

SEQ ID NO: 41690 - protein, 10 aa, Artificial Sequence
  Description of Artificial Sequence: Synthetic peptide
  Seed: TSYVKVLEYV (MAGA1_HUMAN)
TAYVKVLEYL

SEQ ID NO: 41691 - protein, 9 aa, Artificial Sequence
  Description of Artificial Sequence: Synthetic peptide
  Seed: VRFFFPSLR (MAGA1_HUMAN)
VGFFFPSLK

SEQ ID NO: 41692 - protein, 10 aa, Artificial Sequence
  Description of Artificial Sequence: Synthetic peptide
  Seed: TSYVKVLEYV (MAGA1_HUMAN)
TVYVKVLEYI

SEQ ID NO: 41693 - protein, 10 aa, Artificial Sequence
  Description of Artificial Sequence: Synthetic peptide
  Seed: EMLESVIKNY (MAGA1_HUMAN)
EVLESVIKNW

SEQ ID NO: 41694 - protein, 9 aa, Artificial Sequence
  Description of Artificial Sequence: Synthetic peptide
  Seed: STDPPQSPQ (MAGA1_HUMAN)
SCDPPQSPF

SEQ ID NO: 41695 - protein, 9 aa, Artificial Sequence
  Description of Artificial Sequence: Synthetic peptide
  Seed: CILESLFRA (MAGA1_HUMAN)
CVLESLFRA

SEQ ID NO: 41696 - protein, 11 aa, Artificial Sequence
  Description of Artificial Sequence: Synthetic peptide
  Seed: YEFLWGPRALA (MAGA1_HUMAN)
YKFLWGPRALV

SEQ ID NO: 41697 - protein, 9 aa, Artificial Sequence
  Description of Artificial Sequence: Synthetic peptide
  Seed: FFFPSLREA (MAGA1_HUMAN)
FRFPSLREM

SEQ ID NO: 41698 - protein, 9 aa, Artificial Sequence
  Description of Artificial Sequence: Synthetic peptide
  Seed: YKHCFPEIF (MAGA1_HUMAN)
YVHCFPEIF

SEQ ID NO: 41699 - protein, 10 aa, Artificial Sequence
  Description of Artificial Sequence: Synthetic peptide
  Seed: IKVSARVRFF (MAGA1_HUMAN)
IQVSARVRFM

SEQ ID NO: 41700 - protein, 8 aa, Artificial Sequence
  Description of Artificial Sequence: Synthetic peptide
  Seed: YKHCFPEI (MAGA1_HUMAN)
YQHCFPEL

SEQ ID NO: 41701 - protein, 10 aa, Artificial Sequence
  Description of Artificial Sequence: Synthetic peptide
  Seed: KNYKHCFPEI (MAGA1_HUMAN)
KFYKHCFPEW

SEQ ID NO: 41702 - protein, 9 aa, Artificial Sequence
  Description of Artificial Sequence: Synthetic peptide
  Seed: AATSSSSPL (MAGA1_HUMAN)
AQTSSSSPI

SEQ ID NO: 41703 - protein, 11 aa, Artificial Sequence
  Description of Artificial Sequence: Synthetic peptide
  Seed: YEFLWGPRALA (MAGA1_HUMAN)
YQFLWGPRALI

SEQ ID NO: 41704 - protein, 9 aa, Artificial Sequence
  Description of Artificial Sequence: Synthetic peptide
  Seed: FPSLREAAL (MAGA1_HUMAN)
FQSLREAAL

SEQ ID NO: 41705 - protein, 9 aa, Artificial Sequence
  Description of Artificial Sequence: Synthetic peptide
  Seed: KTGFLIIVL (MAGA1_HUMAN)
KLGFLIIVW

SEQ ID NO: 41706 - protein, 9 aa, Artificial Sequence
  Description of Artificial Sequence: Synthetic peptide
  Seed: QDLVQEKYL (MAGA1_HUMAN)
QELVQEKYA

SEQ ID NO: 41707 - protein, 9 aa, Artificial Sequence
  Description of Artificial Sequence: Synthetic peptide
  Seed: STSCILESL (MAGA1_HUMAN)
SMSCILESM

SEQ ID NO: 41708 - protein, 9 aa, Artificial Sequence
  Description of Artificial Sequence: Synthetic peptide
  Seed: REPVTKAEM (MAGA1_HUMAN)
RQPVTKAEF

SEQ ID NO: 41709 - protein, 9 aa, Artificial Sequence
  Description of Artificial Sequence: Synthetic peptide
  Seed: QSPQGASAF (MAGA1_HUMAN)
QAPQGASAV

SEQ ID NO: 41710 - protein, 10 aa, Artificial Sequence
  Description of Artificial Sequence: Synthetic peptide
  Seed: KVADLVGFLL (MAGA1_HUMAN)
KAADLVGFLV

SEQ ID NO: 41711 - protein, 11 aa, Artificial Sequence
  Description of Artificial Sequence: Synthetic peptide
  Seed: RVRFFFPSLRE (MAGA1_HUMAN)
RFRFFFPSLRC

SEQ ID NO: 41712 - protein, 9 aa, Artificial Sequence
  Description of Artificial Sequence: Synthetic peptide
  Seed: STSCILESL (MAGA1_HUMAN)
SSSCILESV

SEQ ID NO: 41713 - protein, 9 aa, Artificial Sequence
  Description of Artificial Sequence: Synthetic peptide
  Seed: VSARVRFFF (MAGA1_HUMAN)
VQARVRFFM

SEQ ID NO: 41714 - protein, 10 aa, Artificial Sequence
  Description of Artificial Sequence: Synthetic peptide
  Seed: KEADPTGHSY (MAGA1_HUMAN)
KHADPTGHSY

SEQ ID NO: 41715 - protein, 9 aa, Artificial Sequence
  Description of Artificial Sequence: Synthetic peptide
  Seed: DSDPARYEF (MAGA1_HUMAN)
DFDPARYEM

SEQ ID NO: 41716 - protein, 9 aa, Artificial Sequence
  Description of Artificial Sequence: Synthetic peptide
  Seed: RVRFFFPSL (MAGA1_HUMAN)
RERFFFPSK

SEQ ID NO: 41717 - protein, 9 aa, Artificial Sequence
  Description of Artificial Sequence: Synthetic peptide
  Seed: STDPPQSPQ (MAGA1_HUMAN)
SADPPQSPA

SEQ ID NO: 41718 - protein, 10 aa, Artificial Sequence
  Description of Artificial Sequence: Synthetic peptide
  Seed: TQDLVQEKYL (MAGA1_HUMAN)
TADLVQEKYL

SEQ ID NO: 41719 - protein, 9 aa, Artificial Sequence
  Description of Artificial Sequence: Synthetic peptide
  Seed: DSDPARYEF (MAGA1_HUMAN)
DGDPARYEL

SEQ ID NO: 41720 - protein, 9 aa, Artificial Sequence
  Description of Artificial Sequence: Synthetic peptide
  Seed: VSARVRFFF (MAGA1_HUMAN)
VVARVRFFF

SEQ ID NO: 41721 - protein, 11 aa, Artificial Sequence
  Description of Artificial Sequence: Synthetic peptide
  Seed: RQVPDSDPARY (MAGA1_HUMAN)
RGVPDSDPARY

SEQ ID NO: 41722 - protein, 9 aa, Artificial Sequence
  Description of Artificial Sequence: Synthetic peptide
  Seed: REHSAYGEP (MAGA1_HUMAN)
REHSAYGEV

SEQ ID NO: 41723 - protein, 9 aa, Artificial Sequence
  Description of Artificial Sequence: Synthetic peptide
  Seed: TSSSSPLVL (MAGA1_HUMAN)
TFSSSPLVF

SEQ ID NO: 41724 - protein, 9 aa, Artificial Sequence
  Description of Artificial Sequence: Synthetic peptide
  Seed: VSARVRFFF (MAGA1_HUMAN)
VAARVRFFF

SEQ ID NO: 41725 - protein, 10 aa, Artificial Sequence
  Description of Artificial Sequence: Synthetic peptide
  Seed: RYEFLWGPRA (MAGA1_HUMAN)
RMEFLWGPRR

SEQ ID NO: 41726 - protein, 9 aa, Artificial Sequence
  Description of Artificial Sequence: Synthetic peptide
  Seed: VSARVRFFF (MAGA1_HUMAN)
VLARVRFFY

SEQ ID NO: 41727 - protein, 9 aa, Artificial Sequence
  Description of Artificial Sequence: Synthetic peptide
  Seed: TQDLVQEKY (MAGA1_HUMAN)
TFDLVQEKY

SEQ ID NO: 41728 - protein, 9 aa, Artificial Sequence
  Description of Artificial Sequence: Synthetic peptide
  Seed: GLLGDNQIM (MAGA1_HUMAN)
GLLGDNQIY

SEQ ID NO: 41729 - protein, 9 aa, Artificial Sequence
  Description of Artificial Sequence: Synthetic peptide
  Seed: VYDGREHSA (MAGA1_HUMAN)
VRDGREHSL

SEQ ID NO: 41730 - protein, 10 aa, Artificial Sequence
  Description of Artificial Sequence: Synthetic peptide
  Seed: KVSARVRFFF (MAGA1_HUMAN)
KFSARVRFFF

SEQ ID NO: 41731 - protein, 10 aa, Artificial Sequence
  Description of Artificial Sequence: Synthetic peptide
  Seed: RVRFFFPSLR (MAGA1_HUMAN)
RDRFFFPSLI

SEQ ID NO: 41732 - protein, 10 aa, Artificial Sequence
  Description of Artificial Sequence: Synthetic peptide
  Seed: YEFLWGPRAL (MAGA1_HUMAN)
YEFLWGPRAA

SEQ ID NO: 41733 - protein, 9 aa, Artificial Sequence
  Description of Artificial Sequence: Synthetic peptide
  Seed: FLWGPRALA (MAGA1_HUMAN)
FVWGPRALK

SEQ ID NO: 41734 - protein, 9 aa, Artificial Sequence
  Description of Artificial Sequence: Synthetic peptide
  Seed: RVRFFFPSL (MAGA1_HUMAN)
RQRFFFPSY

SEQ ID NO: 41735 - protein, 9 aa, Artificial Sequence
  Description of Artificial Sequence: Synthetic peptide
  Seed: AATSSSSPL (MAGA1_HUMAN)
AMTSSSSPV

SEQ ID NO: 41736 - protein, 10 aa, Artificial Sequence
  Description of Artificial Sequence: Synthetic peptide
  Seed: KVADLVGFLL (MAGA1_HUMAN)
KTADLVGFLM

SEQ ID NO: 41737 - protein, 9 aa, Artificial Sequence
  Description of Artificial Sequence: Synthetic peptide
  Seed: RVRFFFPSL (MAGA1_HUMAN)
RWRFFFPSN

SEQ ID NO: 41738 - protein, 8 aa, Artificial Sequence
  Description of Artificial Sequence: Synthetic peptide
  Seed: FFPSLREA (MAGA1_HUMAN)
FYPSLREI

SEQ ID NO: 41739 - protein, 11 aa, Artificial Sequence
  Description of Artificial Sequence: Synthetic peptide
  Seed: RQVPDSDPARY (MAGA1_HUMAN)
RTVPDSDPARI

SEQ ID NO: 41740 - protein, 10 aa, Artificial Sequence
  Description of Artificial Sequence: Synthetic peptide
  Seed: SLFRAVITKK (MAGA1_HUMAN)
SCFRAVITKR

SEQ ID NO: 41741 - protein, 9 aa, Artificial Sequence
  Description of Artificial Sequence: Synthetic peptide
  Seed: HSAYGEPRK (MAGA1_HUMAN)
HVAYGEPRK

SEQ ID NO: 41742 - protein, 10 aa, Artificial Sequence
  Description of Artificial Sequence: Synthetic peptide
  Seed: LTQDLVQEKY (MAGA1_HUMAN)
LLQDLVQEKY

SEQ ID NO: 41743 - protein, 9 aa, Artificial Sequence
  Description of Artificial Sequence: Synthetic peptide
  Seed: RVRFFFPSL (MAGA1_HUMAN)
RTRFFFPSK

SEQ ID NO: 41744 - protein, 10 aa, Artificial Sequence
  Description of Artificial Sequence: Synthetic peptide
  Seed: ADLVGFLLLK (MAGA1_HUMAN)
AFLVGFLLLK

SEQ ID NO: 41745 - protein, 10 aa, Artificial Sequence
  Description of Artificial Sequence: Synthetic peptide
  Seed: SARVRFFFPS (MAGA1_HUMAN)
SWRVRFFFPV

SEQ ID NO: 41746 - protein, 10 aa, Artificial Sequence
  Description of Artificial Sequence: Synthetic peptide
  Seed: RVRFFFPSLR (MAGA1_HUMAN)
RIRFFFPSLV

SEQ ID NO: 41747 - protein, 10 aa, Artificial Sequence
  Description of Artificial Sequence: Synthetic peptide
  Seed: ASAFPTTINF (MAGA1_HUMAN)
AYAFPTTINF

SEQ ID NO: 41748 - protein, 9 aa, Artificial Sequence
  Description of Artificial Sequence: Synthetic peptide
  Seed: LVTCLGLSY (MAGA1_HUMAN)
LVTCLGLSK

SEQ ID NO: 41749 - protein, 11 aa, Artificial Sequence
  Description of Artificial Sequence: Synthetic peptide
  Seed: AREPVTKAEML (MAGA1_HUMAN)
AHEPVTKAEMF

SEQ ID NO: 41750 - protein, 9 aa, Artificial Sequence
  Description of Artificial Sequence: Synthetic peptide
  Seed: MSLEQRSLH (MAGA1_HUMAN)
MMLEQRSLY

SEQ ID NO: 41751 - protein, 11 aa, Artificial Sequence
  Description of Artificial Sequence: Synthetic peptide
  Seed: RVRFFFPSLRE (MAGA1_HUMAN)
RERFFFPSLRR

SEQ ID NO: 41752 - protein, 10 aa, Artificial Sequence
  Description of Artificial Sequence: Synthetic peptide
  Seed: RVRFFFPSLR (MAGA1_HUMAN)
RHRFFFPSLL

SEQ ID NO: 41753 - protein, 10 aa, Artificial Sequence
  Description of Artificial Sequence: Synthetic peptide
  Seed: ARVRFFFPSL (MAGA1_HUMAN)
ARVRFFFPSM

SEQ ID NO: 41754 - protein, 9 aa, Artificial Sequence
  Description of Artificial Sequence: Synthetic peptide
  Seed: GASAFPTTI (MAGA1_HUMAN)
GLSAFPTTL

SEQ ID NO: 41755 - protein, 10 aa, Artificial Sequence
  Description of Artificial Sequence: Synthetic peptide
  Seed: SCILESLFRA (MAGA1_HUMAN)
SLILESLFRL

SEQ ID NO: 41756 - protein, 9 aa, Artificial Sequence
  Description of Artificial Sequence: Synthetic peptide
  Seed: HCFPEIFGK (MAGA1_HUMAN)
HSFPEIFGL

SEQ ID NO: 41757 - protein, 10 aa, Artificial Sequence
  Description of Artificial Sequence: Synthetic peptide
  Seed: FFFPSLREAA (MAGA1_HUMAN)
FWFPSLREAM

SEQ ID NO: 41758 - protein, 9 aa, Artificial Sequence
  Description of Artificial Sequence: Synthetic peptide
  Seed: VADLVGFLL (MAGA1_HUMAN)
VYDLVGFLI

SEQ ID NO: 41759 - protein, 9 aa, Artificial Sequence
  Description of Artificial Sequence: Synthetic peptide
  Seed: EIWEELSVM (MAGA1_HUMAN)
EPWEELSVL

SEQ ID NO: 41760 - protein, 11 aa, Artificial Sequence
  Description of Artificial Sequence: Synthetic peptide
  Seed: YEFLWGPRALA (MAGA1_HUMAN)
YNFLWGPRALV

SEQ ID NO: 41761 - protein, 9 aa, Artificial Sequence
  Description of Artificial Sequence: Synthetic peptide
  Seed: VYDGREHSA (MAGA1_HUMAN)
VIDGREHSI

SEQ ID NO: 41762 - protein, 9 aa, Artificial Sequence
  Description of Artificial Sequence: Synthetic peptide
  Seed: SSSPLVLGT (MAGA1_HUMAN)
STSPLVLGM

SEQ ID NO: 41763 - protein, 9 aa, Artificial Sequence
  Description of Artificial Sequence: Synthetic peptide
  Seed: TQDLVQEKY (MAGA1_HUMAN)
TFDLVQEKV

SEQ ID NO: 41764 - protein, 9 aa, Artificial Sequence
  Description of Artificial Sequence: Synthetic peptide
  Seed: VADLVGFLL (MAGA1_HUMAN)
VVDLVGFLF

SEQ ID NO: 41765 - protein, 10 aa, Artificial Sequence
  Description of Artificial Sequence: Synthetic peptide
  Seed: RVRFFFPSLR (MAGA1_HUMAN)
RWRFFFPSLV

SEQ ID NO: 41766 - protein, 9 aa, Artificial Sequence
  Description of Artificial Sequence: Synthetic peptide
  Seed: FLWGPRALA (MAGA1_HUMAN)
FLWGPRALR

SEQ ID NO: 41767 - protein, 10 aa, Artificial Sequence
  Description of Artificial Sequence: Synthetic peptide
  Seed: RVRFFFPSLR (MAGA1_HUMAN)
RRRFFFPSLY

SEQ ID NO: 41768 - protein, 10 aa, Artificial Sequence
  Description of Artificial Sequence: Synthetic peptide
  Seed: ETSYVKVLEY (MAGA1_HUMAN)
EISYVKVLEK

SEQ ID NO: 41769 - protein, 9 aa, Artificial Sequence
  Description of Artificial Sequence: Synthetic peptide
  Seed: FFFPSLREA (MAGA1_HUMAN)
FCFPSLREF

SEQ ID NO: 41770 - protein, 10 aa, Artificial Sequence
  Description of Artificial Sequence: Synthetic peptide
  Seed: YEFLWGPRAL (MAGA1_HUMAN)
YEFLWGPRAI

SEQ ID NO: 41771 - protein, 11 aa, Artificial Sequence
  Description of Artificial Sequence: Synthetic peptide
  Seed: RQVPDSDPARY (MAGA1_HUMAN)
RAVPDSDPARW

SEQ ID NO: 41772 - protein, 10 aa, Artificial Sequence
  Description of Artificial Sequence: Synthetic peptide
  Seed: KNYKHCFPEI (MAGA1_HUMAN)
KWYKHCFPEM

SEQ ID NO: 41773 - protein, 9 aa, Artificial Sequence
  Description of Artificial Sequence: Synthetic peptide
  Seed: SARVRFFFP (MAGA1_HUMAN)
SFRVRFFFM

SEQ ID NO: 41774 - protein, 11 aa, Artificial Sequence
  Description of Artificial Sequence: Synthetic peptide
  Seed: VQAATSSSSPL (MAGA1_HUMAN)
VKAATSSSSPY

SEQ ID NO: 41775 - protein, 9 aa, Artificial Sequence
  Description of Artificial Sequence: Synthetic peptide
  Seed: AATSSSSPL (MAGA1_HUMAN)
AETSSSSPM

SEQ ID NO: 41776 - protein, 9 aa, Artificial Sequence
  Description of Artificial Sequence: Synthetic peptide
  Seed: SVMEVYDGR (MAGA1_HUMAN)
SIMEVYDGR

SEQ ID NO: 41777 - protein, 9 aa, Artificial Sequence
  Description of Artificial Sequence: Synthetic peptide
  Seed: YKHCFPEIF (MAGA1_HUMAN)
YIHCFPEIY

SEQ ID NO: 41778 - protein, 9 aa, Artificial Sequence
  Description of Artificial Sequence: Synthetic peptide
  Seed: MSLEQRSLH (MAGA1_HUMAN)
MYLEQRSLY

SEQ ID NO: 41779 - protein, 10 aa, Artificial Sequence
  Description of Artificial Sequence: Synthetic peptide
  Seed: ETSYVKVLEY (MAGA1_HUMAN)
ESSYVKVLER

SEQ ID NO: 41780 - protein, 11 aa, Artificial Sequence
  Description of Artificial Sequence: Synthetic peptide
  Seed: KNYKHCFPEIF (MAGA1_HUMAN)
KQYKHCFPEIY

SEQ ID NO: 41781 - protein, 9 aa, Artificial Sequence
  Description of Artificial Sequence: Synthetic peptide
  Seed: TQDLVQEKY (MAGA1_HUMAN)
TEDLVQEKY

SEQ ID NO: 41782 - protein, 9 aa, Artificial Sequence
  Description of Artificial Sequence: Synthetic peptide
  Seed: IAMEGGHAP (MAGA1_HUMAN)
IMMEGGHAL

SEQ ID NO: 41783 - protein, 10 aa, Artificial Sequence
  Description of Artificial Sequence: Synthetic peptide
  Seed: SAYGEPRKLL (MAGA1_HUMAN)
SAYGEPRKLW

SEQ ID NO: 41784 - protein, 9 aa, Artificial Sequence
  Description of Artificial Sequence: Synthetic peptide
  Seed: RVRFFFPSL (MAGA1_HUMAN)
RMRFFFPSD

SEQ ID NO: 41785 - protein, 9 aa, Artificial Sequence
  Description of Artificial Sequence: Synthetic peptide
  Seed: TSSSSPLVL (MAGA1_HUMAN)
TSSSSPLVY

SEQ ID NO: 41786 - protein, 8 aa, Artificial Sequence
  Description of Artificial Sequence: Synthetic peptide
  Seed: FFPSLREA (MAGA1_HUMAN)
FYPSLREL

SEQ ID NO: 41787 - protein, 9 aa, Artificial Sequence
  Description of Artificial Sequence: Synthetic peptide
  Seed: EADPTGHSY (MAGA1_HUMAN)
ELDPTGHSF

SEQ ID NO: 41788 - protein, 9 aa, Artificial Sequence
  Description of Artificial Sequence: Synthetic peptide
  Seed: RAREPVTKA (MAGA1_HUMAN)
RIREPVTKF

SEQ ID NO: 41789 - protein, 9 aa, Artificial Sequence
  Description of Artificial Sequence: Synthetic peptide
  Seed: SAFPTTINF (MAGA1_HUMAN)
SYFPTTINL

SEQ ID NO: 41790 - protein, 9 aa, Artificial Sequence
  Description of Artificial Sequence: Synthetic peptide
  Seed: LFRAVITKK (MAGA1_HUMAN)
LSRAVITKR

SEQ ID NO: 41791 - protein, 10 aa, Artificial Sequence
  Description of Artificial Sequence: Synthetic peptide
  Seed: ARYEFLWGPR (MAGA1_HUMAN)
AVYEFLWGPR

SEQ ID NO: 41792 - protein, 9 aa, Artificial Sequence
  Description of Artificial Sequence: Synthetic peptide
  Seed: LTQDLVQEK (MAGA1_HUMAN)
LTQDLVQEM

SEQ ID NO: 41793 - protein, 9 aa, Artificial Sequence
  Description of Artificial Sequence: Synthetic peptide
  Seed: KVLEYVIKV (MAGA1_HUMAN)
KILEYVIKK

SEQ ID NO: 41794 - protein, 9 aa, Artificial Sequence
  Description of Artificial Sequence: Synthetic peptide
  Seed: SAYGEPRKL (MAGA1_HUMAN)
SPYGEPRKV

SEQ ID NO: 41795 - protein, 10 aa, Artificial Sequence
  Description of Artificial Sequence: Synthetic peptide
  Seed: EVYDGREHSA (MAGA1_HUMAN)
EIYDGREHSY

SEQ ID NO: 41796 - protein, 9 aa, Artificial Sequence
  Description of Artificial Sequence: Synthetic peptide
  Seed: RVRFFFPSL (MAGA1_HUMAN)
RFRFFFPSH

SEQ ID NO: 41797 - protein, 9 aa, Artificial Sequence
  Description of Artificial Sequence: Synthetic peptide
  Seed: LVTCLGLSY (MAGA1_HUMAN)
LQTCLGLSM

SEQ ID NO: 41798 - protein, 11 aa, Artificial Sequence
  Description of Artificial Sequence: Synthetic peptide
  Seed: RVRFFFPSLRE (MAGA1_HUMAN)
RMRFFFPSLRA

SEQ ID NO: 41799 - protein, 9 aa, Artificial Sequence
  Description of Artificial Sequence: Synthetic peptide
  Seed: MLESVIKNY (MAGA1_HUMAN)
MMESVIKNF

SEQ ID NO: 41800 - protein, 9 aa, Artificial Sequence
  Description of Artificial Sequence: Synthetic peptide
  Seed: VYDGREHSA (MAGA1_HUMAN)
VWDGREHSI

SEQ ID NO: 41801 - protein, 9 aa, Artificial Sequence
  Description of Artificial Sequence: Synthetic peptide
  Seed: SSSPLVLGT (MAGA1_HUMAN)
STSPLVLGV

SEQ ID NO: 41802 - protein, 11 aa, Artificial Sequence
  Description of Artificial Sequence: Synthetic peptide
  Seed: STSCILESLFR (MAGA1_HUMAN)
STSCILESLFK

SEQ ID NO: 41803 - protein, 10 aa, Artificial Sequence
  Description of Artificial Sequence: Synthetic peptide
  Seed: KVADLVGFLL (MAGA1_HUMAN)
KFADLVGFLY

SEQ ID NO: 41804 - protein, 9 aa, Artificial Sequence
  Description of Artificial Sequence: Synthetic peptide
  Seed: SARVRFFFP (MAGA1_HUMAN)
SSRVRFFFL

SEQ ID NO: 41805 - protein, 10 aa, Artificial Sequence
  Description of Artificial Sequence: Synthetic peptide
  Seed: SCILESLFRA (MAGA1_HUMAN)
SRILESLFRV

SEQ ID NO: 41806 - protein, 10 aa, Artificial Sequence
  Description of Artificial Sequence: Synthetic peptide
  Seed: KVSARVRFFF (MAGA1_HUMAN)
KHSARVRFFW

SEQ ID NO: 41807 - protein, 9 aa, Artificial Sequence
  Description of Artificial Sequence: Synthetic peptide
  Seed: STDPPQSPQ (MAGA1_HUMAN)
SVDPPQSPY

SEQ ID NO: 41808 - protein, 9 aa, Artificial Sequence
  Description of Artificial Sequence: Synthetic peptide
  Seed: SSPLVLGTL (MAGA1_HUMAN)
SMPLVLGTA

SEQ ID NO: 41809 - protein, 11 aa, Artificial Sequence
  Description of Artificial Sequence: Synthetic peptide
  Seed: KYRAREPVTKA (MAGA1_HUMAN)
KTRAREPVTKA

SEQ ID NO: 41810 - protein, 10 aa, Artificial Sequence
  Description of Artificial Sequence: Synthetic peptide
  Seed: EIFGKASESL (MAGA1_HUMAN)
ELFGKASESW

SEQ ID NO: 41811 - protein, 9 aa, Artificial Sequence
  Description of Artificial Sequence: Synthetic peptide
  Seed: RVRFFFPSL (MAGA1_HUMAN)
RMRFFFPSP

SEQ ID NO: 41812 - protein, 11 aa, Artificial Sequence
  Description of Artificial Sequence: Synthetic peptide
  Seed: KVADLVGFLLL (MAGA1_HUMAN)
KTADLVGFLLK

SEQ ID NO: 41813 - protein, 10 aa, Artificial Sequence
  Description of Artificial Sequence: Synthetic peptide
  Seed: YEFLWGPRAL (MAGA1_HUMAN)
YEFLWGPRAV

SEQ ID NO: 41814 - protein, 10 aa, Artificial Sequence
  Description of Artificial Sequence: Synthetic peptide
  Seed: ARVRFFFPSL (MAGA1_HUMAN)
AIVRFFFPSA

SEQ ID NO: 41815 - protein, 9 aa, Artificial Sequence
  Description of Artificial Sequence: Synthetic peptide
  Seed: AATSSSSPL (MAGA1_HUMAN)
AQTSSSSPW

SEQ ID NO: 41816 - protein, 9 aa, Artificial Sequence
  Description of Artificial Sequence: Synthetic peptide
  Seed: KVADLVGFL (MAGA1_HUMAN)
KTADLVGFL

SEQ ID NO: 41817 - protein, 9 aa, Artificial Sequence
  Description of Artificial Sequence: Synthetic peptide
  Seed: RAREPVTKA (MAGA1_HUMAN)
RTREPVTKL

SEQ ID NO: 41818 - protein, 11 aa, Artificial Sequence
  Description of Artificial Sequence: Synthetic peptide
  Seed: RQVPDSDPARY (MAGA1_HUMAN)
RAVPDSDPARF

SEQ ID NO: 41819 - protein, 11 aa, Artificial Sequence
  Description of Artificial Sequence: Synthetic peptide
  Seed: FLWGPRALAET (MAGA1_HUMAN)
FLWGPRALAEV

SEQ ID NO: 41820 - protein, 11 aa, Artificial Sequence
  Description of Artificial Sequence: Synthetic peptide
  Seed: FFFPSLREAAL (MAGA1_HUMAN)
FFFPSLREAAF

SEQ ID NO: 41821 - protein, 9 aa, Artificial Sequence
  Description of Artificial Sequence: Synthetic peptide
  Seed: SLFRAVITK (MAGA1_HUMAN)
SGFRAVITK

SEQ ID NO: 41822 - protein, 9 aa, Artificial Sequence
  Description of Artificial Sequence: Synthetic peptide
  Seed: RQVPDSDPA (MAGA1_HUMAN)
RLVPDSDPL

SEQ ID NO: 41823 - protein, 9 aa, Artificial Sequence
  Description of Artificial Sequence: Synthetic peptide
  Seed: SESLQLVFG (MAGA1_HUMAN)
SESLQLVFI

SEQ ID NO: 41824 - protein, 9 aa, Artificial Sequence
  Description of Artificial Sequence: Synthetic peptide
  Seed: RQVPDSDPA (MAGA1_HUMAN)
RIVPDSDPV

SEQ ID NO: 41825 - protein, 10 aa, Artificial Sequence
  Description of Artificial Sequence: Synthetic peptide
  Seed: FLWGPRALAE (MAGA1_HUMAN)
FQWGPRALAI

SEQ ID NO: 41826 - protein, 9 aa, Artificial Sequence
  Description of Artificial Sequence: Synthetic peptide
  Seed: STSCILESL (MAGA1_HUMAN)
SVSCILESI

SEQ ID NO: 41827 - protein, 11 aa, Artificial Sequence
  Description of Artificial Sequence: Synthetic peptide
  Seed: GASAFPTTINF (MAGA1_HUMAN)
GTSAFPTTINF

SEQ ID NO: 41828 - protein, 11 aa, Artificial Sequence
  Description of Artificial Sequence: Synthetic peptide
  Seed: RVRFFFPSLRE (MAGA1_HUMAN)
RFRFFFPSLRV

SEQ ID NO: 41829 - protein, 11 aa, Artificial Sequence
  Description of Artificial Sequence: Synthetic peptide
  Seed: YEFLWGPRALA (MAGA1_HUMAN)
YMFLWGPRALV

SEQ ID NO: 41830 - protein, 9 aa, Artificial Sequence
  Description of Artificial Sequence: Synthetic peptide
  Seed: SARVRFFFP (MAGA1_HUMAN)
SQRVRFFFI

SEQ ID NO: 41831 - protein, 9 aa, Artificial Sequence
  Description of Artificial Sequence: Synthetic peptide
  Seed: SAFPTTINF (MAGA1_HUMAN)
SAFPTTINV

SEQ ID NO: 41832 - protein, 11 aa, Artificial Sequence
  Description of Artificial Sequence: Synthetic peptide
  Seed: FPTTINFTRQR (MAGA1_HUMAN)
FATTINFTRQR

SEQ ID NO: 41833 - protein, 9 aa, Artificial Sequence
  Description of Artificial Sequence: Synthetic peptide
  Seed: STSCILESL (MAGA1_HUMAN)
SASCILESW

SEQ ID NO: 41834 - protein, 9 aa, Artificial Sequence
  Description of Artificial Sequence: Synthetic peptide
  Seed: EYVIKVSAR (MAGA1_HUMAN)
EFVIKVSAR

SEQ ID NO: 41835 - protein, 10 aa, Artificial Sequence
  Description of Artificial Sequence: Synthetic peptide
  Seed: ARVRFFFPSL (MAGA1_HUMAN)
ANVRFFFPSA

SEQ ID NO: 41836 - protein, 9 aa, Artificial Sequence
  Description of Artificial Sequence: Synthetic peptide
  Seed: STSCILESL (MAGA1_HUMAN)
SVSCILESR

SEQ ID NO: 41837 - protein, 10 aa, Artificial Sequence
  Description of Artificial Sequence: Synthetic peptide
  Seed: KNYKHCFPEI (MAGA1_HUMAN)
KLYKHCFPEF

SEQ ID NO: 41838 - protein, 9 aa, Artificial Sequence
  Description of Artificial Sequence: Synthetic peptide
  Seed: SCILESLFR (MAGA1_HUMAN)
SYILESLFR

SEQ ID NO: 41839 - protein, 10 aa, Artificial Sequence
  Description of Artificial Sequence: Synthetic peptide
  Seed: SARVRFFFPS (MAGA1_HUMAN)
SLRVRFFFPK

SEQ ID NO: 41840 - protein, 9 aa, Artificial Sequence
  Description of Artificial Sequence: Synthetic peptide
  Seed: FPSLREAAL (MAGA1_HUMAN)
FLSLREAAF

SEQ ID NO: 41841 - protein, 9 aa, Artificial Sequence
  Description of Artificial Sequence: Synthetic peptide
  Seed: SAYGEPRKL (MAGA1_HUMAN)
SAYGEPRKR

SEQ ID NO: 41842 - protein, 9 aa, Artificial Sequence
  Description of Artificial Sequence: Synthetic peptide
  Seed: YVIKVSARV (MAGA1_HUMAN)
YTIKVSARR

SEQ ID NO: 41843 - protein, 11 aa, Artificial Sequence
  Description of Artificial Sequence: Synthetic peptide
  Seed: RSLHCKPEEAL (MAGA1_HUMAN)
RTLHCKPEEAW

SEQ ID NO: 41844 - protein, 9 aa, Artificial Sequence
  Description of Artificial Sequence: Synthetic peptide
  Seed: KVADLVGFL (MAGA1_HUMAN)
KRADLVGFY

SEQ ID NO: 41845 - protein, 10 aa, Artificial Sequence
  Description of Artificial Sequence: Synthetic peptide
  Seed: RVRFFFPSLR (MAGA1_HUMAN)
RARFFFPSLM

SEQ ID NO: 41846 - protein, 9 aa, Artificial Sequence
  Description of Artificial Sequence: Synthetic peptide
  Seed: QQEALGLVC (MAGA1_HUMAN)
QEEALGLVA

SEQ ID NO: 41847 - protein, 10 aa, Artificial Sequence
  Description of Artificial Sequence: Synthetic peptide
  Seed: YEFLWGPRAL (MAGA1_HUMAN)
YSFLWGPRAY

SEQ ID NO: 41848 - protein, 9 aa, Artificial Sequence
  Description of Artificial Sequence: Synthetic peptide
  Seed: KYRAREPVT (MAGA1_HUMAN)
KYRAREPVM

SEQ ID NO: 41849 - protein, 11 aa, Artificial Sequence
  Description of Artificial Sequence: Synthetic peptide
  Seed: KEADPTGHSYV (MAGA1_HUMAN)
KEADPTGHSYC

SEQ ID NO: 41850 - protein, 9 aa, Artificial Sequence
  Description of Artificial Sequence: Synthetic peptide
  Seed: YVIKVSARV (MAGA1_HUMAN)
YAIKVSARL

SEQ ID NO: 41851 - protein, 9 aa, Artificial Sequence
  Description of Artificial Sequence: Synthetic peptide
  Seed: RVRFFFPSL (MAGA1_HUMAN)
RMRFFFPSH

SEQ ID NO: 41852 - protein, 11 aa, Artificial Sequence
  Description of Artificial Sequence: Synthetic peptide
  Seed: RVRFFFPSLRE (MAGA1_HUMAN)
RYRFFFPSLRA

SEQ ID NO: 41853 - protein, 11 aa, Artificial Sequence
  Description of Artificial Sequence: Synthetic peptide
  Seed: YEFLWGPRALA (MAGA1_HUMAN)
YQFLWGPRALV

SEQ ID NO: 41854 - protein, 9 aa, Artificial Sequence
  Description of Artificial Sequence: Synthetic peptide
  Seed: AATSSSSPL (MAGA1_HUMAN)
ATTSSSSPY

SEQ ID NO: 41855 - protein, 9 aa, Artificial Sequence
  Description of Artificial Sequence: Synthetic peptide
  Seed: ITKKVADLV (MAGA1_HUMAN)
IAKKVADLF

SEQ ID NO: 41856 - protein, 10 aa, Artificial Sequence
  Description of Artificial Sequence: Synthetic peptide
  Seed: KEADPTGHSY (MAGA1_HUMAN)
KQADPTGHSF

SEQ ID NO: 41857 - protein, 10 aa, Artificial Sequence
  Description of Artificial Sequence: Synthetic peptide
  Seed: ARVRFFFPSL (MAGA1_HUMAN)
AYVRFFFPSA

SEQ ID NO: 41858 - protein, 9 aa, Artificial Sequence
  Description of Artificial Sequence: Synthetic peptide
  Seed: KEADPTGHS (MAGA1_HUMAN)
KEADPTGHV

SEQ ID NO: 41859 - protein, 9 aa, Artificial Sequence
  Description of Artificial Sequence: Synthetic peptide
  Seed: REPVTKAEM (MAGA1_HUMAN)
REPVTKAEW

SEQ ID NO: 41860 - protein, 9 aa, Artificial Sequence
  Description of Artificial Sequence: Synthetic peptide
  Seed: RQRQPSEGS (MAGA1_HUMAN)
RIRQPSEGV

SEQ ID NO: 41861 - protein, 10 aa, Artificial Sequence
  Description of Artificial Sequence: Synthetic peptide
  Seed: KVSARVRFFF (MAGA1_HUMAN)
KTSARVRFFA

SEQ ID NO: 41862 - protein, 10 aa, Artificial Sequence
  Description of Artificial Sequence: Synthetic peptide
  Seed: SVMEVYDGRE (MAGA1_HUMAN)
SVMEVYDGRR

SEQ ID NO: 41863 - protein, 11 aa, Artificial Sequence
  Description of Artificial Sequence: Synthetic peptide
  Seed: VPDSDPARYEF (MAGA1_HUMAN)
VTDSDPARYEL

SEQ ID NO: 41864 - protein, 10 aa, Artificial Sequence
  Description of Artificial Sequence: Synthetic peptide
  Seed: FFFPSLREAA (MAGA1_HUMAN)
FYFPSLREAV

SEQ ID NO: 41865 - protein, 10 aa, Artificial Sequence
  Description of Artificial Sequence: Synthetic peptide
  Seed: EALEAQQEAL (MAGA1_HUMAN)
EILEAQQEAF

SEQ ID NO: 41866 - protein, 10 aa, Artificial Sequence
  Description of Artificial Sequence: Synthetic peptide
  Seed: EVYDGREHSA (MAGA1_HUMAN)
EMYDGREHSR

SEQ ID NO: 41867 - protein, 10 aa, Artificial Sequence
  Description of Artificial Sequence: Synthetic peptide
  Seed: SAFPTTINFT (MAGA1_HUMAN)
SVFPTTINFI

SEQ ID NO: 41868 - protein, 9 aa, Artificial Sequence
  Description of Artificial Sequence: Synthetic peptide
  Seed: TSYVKVLEY (MAGA1_HUMAN)
TKYVKVLEF

SEQ ID NO: 41869 - protein, 11 aa, Artificial Sequence
  Description of Artificial Sequence: Synthetic peptide
  Seed: SCILESLFRAV (MAGA1_HUMAN)
SMILESLFRAV

SEQ ID NO: 41870 - protein, 9 aa, Artificial Sequence
  Description of Artificial Sequence: Synthetic peptide
  Seed: VADLVGFLL (MAGA1_HUMAN)
VQDLVGFLW

SEQ ID NO: 41871 - protein, 10 aa, Artificial Sequence
  Description of Artificial Sequence: Synthetic peptide
  Seed: KVADLVGFLL (MAGA1_HUMAN)
KTADLVGFLV

SEQ ID NO: 41872 - protein, 10 aa, Artificial Sequence
  Description of Artificial Sequence: Synthetic peptide
  Seed: SARVRFFFPS (MAGA1_HUMAN)
SHRVRFFFPI

SEQ ID NO: 41873 - protein, 9 aa, Artificial Sequence
  Description of Artificial Sequence: Synthetic peptide
  Seed: EELSVMEVY (MAGA1_HUMAN)
ELLSVMEVY

SEQ ID NO: 41874 - protein, 9 aa, Artificial Sequence
  Description of Artificial Sequence: Synthetic peptide
  Seed: KVADLVGFL (MAGA1_HUMAN)
KMADLVGFW

SEQ ID NO: 41875 - protein, 9 aa, Artificial Sequence
  Description of Artificial Sequence: Synthetic peptide
  Seed: IIVLVMIAM (MAGA1_HUMAN)
IAVLVMIAY

SEQ ID NO: 41876 - protein, 9 aa, Artificial Sequence
  Description of Artificial Sequence: Synthetic peptide
  Seed: LVTCLGLSY (MAGA1_HUMAN)
LLTCLGLSF

SEQ ID NO: 41877 - protein, 9 aa, Artificial Sequence
  Description of Artificial Sequence: Synthetic peptide
  Seed: SARVRFFFP (MAGA1_HUMAN)
STRVRFFFE

SEQ ID NO: 41878 - protein, 9 aa, Artificial Sequence
  Description of Artificial Sequence: Synthetic peptide
  Seed: TSYVKVLEY (MAGA1_HUMAN)
TWYVKVLEL

SEQ ID NO: 41879 - protein, 9 aa, Artificial Sequence
  Description of Artificial Sequence: Synthetic peptide
  Seed: EHSAYGEPR (MAGA1_HUMAN)
ESSAYGEPR

SEQ ID NO: 41880 - protein, 9 aa, Artificial Sequence
  Description of Artificial Sequence: Synthetic peptide
  Seed: STSCILESL (MAGA1_HUMAN)
SSSCILESA

SEQ ID NO: 41881 - protein, 9 aa, Artificial Sequence
  Description of Artificial Sequence: Synthetic peptide
  Seed: TGFLIIVLV (MAGA1_HUMAN)
TTFLIIVLL

SEQ ID NO: 41882 - protein, 11 aa, Artificial Sequence
  Description of Artificial Sequence: Synthetic peptide
  Seed: KVLEYVIKVSA (MAGA1_HUMAN)
KMLEYVIKVSL

SEQ ID NO: 41883 - protein, 9 aa, Artificial Sequence
  Description of Artificial Sequence: Synthetic peptide
  Seed: STSCILESL (MAGA1_HUMAN)
SASCILESR

SEQ ID NO: 41884 - protein, 10 aa, Artificial Sequence
  Description of Artificial Sequence: Synthetic peptide
  Seed: KAEMLESVIK (MAGA1_HUMAN)
KVEMLESVIK

SEQ ID NO: 41885 - protein, 9 aa, Artificial Sequence
  Description of Artificial Sequence: Synthetic peptide
  Seed: SAYGEPRKL (MAGA1_HUMAN)
SPYGEPRKW

SEQ ID NO: 41886 - protein, 9 aa, Artificial Sequence
  Description of Artificial Sequence: Synthetic peptide
  Seed: FFFPSLREA (MAGA1_HUMAN)
FIFPSLREA

SEQ ID NO: 41887 - protein, 9 aa, Artificial Sequence
  Description of Artificial Sequence: Synthetic peptide
  Seed: KVLEYVIKV (MAGA1_HUMAN)
KALEYVIKW

SEQ ID NO: 41888 - protein, 9 aa, Artificial Sequence
  Description of Artificial Sequence: Synthetic peptide
  Seed: DPTGHSYVL (MAGA1_HUMAN)
DRTGHSYVM

SEQ ID NO: 41889 - protein, 10 aa, Artificial Sequence
  Description of Artificial Sequence: Synthetic peptide
  Seed: YEFLWGPRAL (MAGA1_HUMAN)
YYFLWGPRAI

SEQ ID NO: 41890 - protein, 10 aa, Artificial Sequence
  Description of Artificial Sequence: Synthetic peptide
  Seed: ARVRFFFPSL (MAGA1_HUMAN)
AQVRFFFPSK

SEQ ID NO: 41891 - protein, 10 aa, Artificial Sequence
  Description of Artificial Sequence: Synthetic peptide
  Seed: RVRFFFPSLR (MAGA1_HUMAN)
RHRFFFPSLV

SEQ ID NO: 41892 - protein, 10 aa, Artificial Sequence
  Description of Artificial Sequence: Synthetic peptide
  Seed: ETSYVKVLEY (MAGA1_HUMAN)
EMSYVKVLEK

SEQ ID NO: 41893 - protein, 9 aa, Artificial Sequence
  Description of Artificial Sequence: Synthetic peptide
  Seed: YDGREHSAY (MAGA1_HUMAN)
YQGREHSAY

SEQ ID NO: 41894 - protein, 11 aa, Artificial Sequence
  Description of Artificial Sequence: Synthetic peptide
  Seed: GLLGDNQIMPK (MAGA1_HUMAN)
GTLGDNQIMPK

SEQ ID NO: 41895 - protein, 9 aa, Artificial Sequence
  Description of Artificial Sequence: Synthetic peptide
  Seed: EHSAYGEPR (MAGA1_HUMAN)
ETSAYGEPR

SEQ ID NO: 41896 - protein, 9 aa, Artificial Sequence
  Description of Artificial Sequence: Synthetic peptide
  Seed: TQDLVQEKY (MAGA1_HUMAN)
TMDLVQEKI

SEQ ID NO: 41897 - protein, 9 aa, Artificial Sequence
  Description of Artificial Sequence: Synthetic peptide
  Seed: FLWGPRALA (MAGA1_HUMAN)
FMWGPRALC

SEQ ID NO: 41898 - protein, 10 aa, Artificial Sequence
  Description of Artificial Sequence: Synthetic peptide
  Seed: SCILESLFRA (MAGA1_HUMAN)
SWILESLFRI

SEQ ID NO: 41899 - protein, 9 aa, Artificial Sequence
  Description of Artificial Sequence: Synthetic peptide
  Seed: KVLEYVIKV (MAGA1_HUMAN)
KTLEYVIKR

SEQ ID NO: 41900 - protein, 9 aa, Artificial Sequence
  Description of Artificial Sequence: Synthetic peptide
  Seed: ALEAQQEAL (MAGA1_HUMAN)
AQEAQQEAF

SEQ ID NO: 41901 - protein, 10 aa, Artificial Sequence
  Description of Artificial Sequence: Synthetic peptide
  Seed: SARVRFFFPS (MAGA1_HUMAN)
SKRVRFFFPK

SEQ ID NO: 41902 - protein, 9 aa, Artificial Sequence
  Description of Artificial Sequence: Synthetic peptide
  Seed: AYGEPRKLL (MAGA1_HUMAN)
ATGEPRKLM

SEQ ID NO: 41903 - protein, 11 aa, Artificial Sequence
  Description of Artificial Sequence: Synthetic peptide
  Seed: ARVRFFFPSLR (MAGA1_HUMAN)
AIVRFFFPSLR

SEQ ID NO: 41904 - protein, 9 aa, Artificial Sequence
  Description of Artificial Sequence: Synthetic peptide
  Seed: REAALREEE (MAGA1_HUMAN)
REAALREEP

SEQ ID NO: 41905 - protein, 10 aa, Artificial Sequence
  Description of Artificial Sequence: Synthetic peptide
  Seed: SAFPTTINFT (MAGA1_HUMAN)
SVFPTTINFV

SEQ ID NO: 41906 - protein, 9 aa, Artificial Sequence
  Description of Artificial Sequence: Synthetic peptide
  Seed: LVTCLGLSY (MAGA1_HUMAN)
LETCLGLSF

SEQ ID NO: 41907 - protein, 9 aa, Artificial Sequence
  Description of Artificial Sequence: Synthetic peptide
  Seed: RALAETSYV (MAGA1_HUMAN)
RALAETSYL

SEQ ID NO: 41908 - protein, 10 aa, Artificial Sequence
  Description of Artificial Sequence: Synthetic peptide
  Seed: TSYVKVLEYV (MAGA1_HUMAN)
TSYVKVLEYL

SEQ ID NO: 41909 - protein, 9 aa, Artificial Sequence
  Description of Artificial Sequence: Synthetic peptide
  Seed: RAREPVTKA (MAGA1_HUMAN)
RSREPVTKL

SEQ ID NO: 41910 - protein, 9 aa, Artificial Sequence
  Description of Artificial Sequence: Synthetic peptide
  Seed: SAYGEPRKL (MAGA1_HUMAN)
SFYGEPRKI

SEQ ID NO: 41911 - protein, 11 aa, Artificial Sequence
  Description of Artificial Sequence: Synthetic peptide
  Seed: GASAFPTTINF (MAGA1_HUMAN)
GQSAFPTTINY

SEQ ID NO: 41912 - protein, 9 aa, Artificial Sequence
  Description of Artificial Sequence: Synthetic peptide
  Seed: TSYVKVLEY (MAGA1_HUMAN)
TVYVKVLEM

SEQ ID NO: 41913 - protein, 9 aa, Artificial Sequence
  Description of Artificial Sequence: Synthetic peptide
  Seed: AATSSSSPL (MAGA1_HUMAN)
AYTSSSSPM

SEQ ID NO: 41914 - protein, 9 aa, Artificial Sequence
  Description of Artificial Sequence: Synthetic peptide
  Seed: TQDLVQEKY (MAGA1_HUMAN)
TLDLVQEKY

SEQ ID NO: 41915 - protein, 10 aa, Artificial Sequence
  Description of Artificial Sequence: Synthetic peptide
  Seed: KASESLQLVF (MAGA1_HUMAN)
KHSESLQLVW

SEQ ID NO: 41916 - protein, 9 aa, Artificial Sequence
  Description of Artificial Sequence: Synthetic peptide
  Seed: SARVRFFFP (MAGA1_HUMAN)
SQRVRFFFS

SEQ ID NO: 41917 - protein, 9 aa, Artificial Sequence
  Description of Artificial Sequence: Synthetic peptide
  Seed: RVRFFFPSL (MAGA1_HUMAN)
RERFFFPSL

SEQ ID NO: 41918 - protein, 9 aa, Artificial Sequence
  Description of Artificial Sequence: Synthetic peptide
  Seed: SLFRAVITK (MAGA1_HUMAN)
SVFRAVITK

SEQ ID NO: 41919 - protein, 10 aa, Artificial Sequence
  Description of Artificial Sequence: Synthetic peptide
  Seed: FFFPSLREAA (MAGA1_HUMAN)
FYFPSLREAM

SEQ ID NO: 41920 - protein, 9 aa, Artificial Sequence
  Description of Artificial Sequence: Synthetic peptide
  Seed: LESLFRAVI (MAGA1_HUMAN)
LKSLFRAVF

SEQ ID NO: 41921 - protein, 9 aa, Artificial Sequence
  Description of Artificial Sequence: Synthetic peptide
  Seed: RVRFFFPSL (MAGA1_HUMAN)
RFRFFFPSY

SEQ ID NO: 41922 - protein, 9 aa, Artificial Sequence
  Description of Artificial Sequence: Synthetic peptide
  Seed: LESLFRAVI (MAGA1_HUMAN)
LLSLFRAVY

SEQ ID NO: 41923 - protein, 11 aa, Artificial Sequence
  Description of Artificial Sequence: Synthetic peptide
  Seed: AREPVTKAEML (MAGA1_HUMAN)
AHEPVTKAEMM

SEQ ID NO: 41924 - protein, 9 aa, Artificial Sequence
  Description of Artificial Sequence: Synthetic peptide
  Seed: QSPQGASAF (MAGA1_HUMAN)
QSPQGASAM

SEQ ID NO: 41925 - protein, 10 aa, Artificial Sequence
  Description of Artificial Sequence: Synthetic peptide
  Seed: KVLEYVIKVS (MAGA1_HUMAN)
KLLEYVIKVP

SEQ ID NO: 41926 - protein, 9 aa, Artificial Sequence
  Description of Artificial Sequence: Synthetic peptide
  Seed: RVRFFFPSL (MAGA1_HUMAN)
RMRFFFPST

SEQ ID NO: 41927 - protein, 8 aa, Artificial Sequence
  Description of Artificial Sequence: Synthetic peptide
  Seed: SARVRFFF (MAGA1_HUMAN)
SPRVRFFL

SEQ ID NO: 41928 - protein, 11 aa, Artificial Sequence
  Description of Artificial Sequence: Synthetic peptide
  Seed: EVYDGREHSAY (MAGA1_HUMAN)
ELYDGREHSAY

SEQ ID NO: 41929 - protein, 9 aa, Artificial Sequence
  Description of Artificial Sequence: Synthetic peptide
  Seed: SAYGEPRKL (MAGA1_HUMAN)
SVYGEPRKF

SEQ ID NO: 41930 - protein, 9 aa, Artificial Sequence
  Description of Artificial Sequence: Synthetic peptide
  Seed: REHSAYGEP (MAGA1_HUMAN)
REHSAYGEA

SEQ ID NO: 41931 - protein, 9 aa, Artificial Sequence
  Description of Artificial Sequence: Synthetic peptide
  Seed: TSSSSPLVL (MAGA1_HUMAN)
TYSSSPLVL

SEQ ID NO: 41932 - protein, 9 aa, Artificial Sequence
  Description of Artificial Sequence: Synthetic peptide
  Seed: VRFFFPSLR (MAGA1_HUMAN)
VRFFFPSLY

SEQ ID NO: 41933 - protein, 9 aa, Artificial Sequence
  Description of Artificial Sequence: Synthetic peptide
  Seed: KASESLQLV (MAGA1_HUMAN)
KISESLQLA

SEQ ID NO: 41934 - protein, 10 aa, Artificial Sequence
  Description of Artificial Sequence: Synthetic peptide
  Seed: RAREPVTKAE (MAGA1_HUMAN)
RGREPVTKAK

SEQ ID NO: 41935 - protein, 9 aa, Artificial Sequence
  Description of Artificial Sequence: Synthetic peptide
  Seed: SAFPTTINF (MAGA1_HUMAN)
SMFPTTINW

SEQ ID NO: 41936 - protein, 11 aa, Artificial Sequence
  Description of Artificial Sequence: Synthetic peptide
  Seed: ELSVMEVYDGR (MAGA1_HUMAN)
ETSVMEVYDGK

SEQ ID NO: 41937 - protein, 9 aa, Artificial Sequence
  Description of Artificial Sequence: Synthetic peptide
  Seed: QIMPKTGFL (MAGA1_HUMAN)
QSMPKTGFV

SEQ ID NO: 41938 - protein, 9 aa, Artificial Sequence
  Description of Artificial Sequence: Synthetic peptide
  Seed: REEEGPSTS (MAGA1_HUMAN)
REEEGPSTA

SEQ ID NO: 41939 - protein, 9 aa, Artificial Sequence
  Description of Artificial Sequence: Synthetic peptide
  Seed: KYRAREPVT (MAGA1_HUMAN)
KVRAREPVK

SEQ ID NO: 41940 - protein, 9 aa, Artificial Sequence
  Description of Artificial Sequence: Synthetic peptide
  Seed: RALAETSYV (MAGA1_HUMAN)
RILAETSYK

SEQ ID NO: 41941 - protein, 10 aa, Artificial Sequence
  Description of Artificial Sequence: Synthetic peptide
  Seed: KHCFPEIFGK (MAGA1_HUMAN)
KVCFPEIFGR

SEQ ID NO: 41942 - protein, 10 aa, Artificial Sequence
  Description of Artificial Sequence: Synthetic peptide
  Seed: SAFPTTINFT (MAGA1_HUMAN)
SVFPTTINFY

SEQ ID NO: 41943 - protein, 9 aa, Artificial Sequence
  Description of Artificial Sequence: Synthetic peptide
  Seed: TSSSSPLVL (MAGA1_HUMAN)
TMSSSPLVY

SEQ ID NO: 41944 - protein, 10 aa, Artificial Sequence
  Description of Artificial Sequence: Synthetic peptide
  Seed: SARVRFFFPS (MAGA1_HUMAN)
SPRVRFFFPL

SEQ ID NO: 41945 - protein, 9 aa, Artificial Sequence
  Description of Artificial Sequence: Synthetic peptide
  Seed: LTQDLVQEK (MAGA1_HUMAN)
LMQDLVQEF

SEQ ID NO: 41946 - protein, 9 aa, Artificial Sequence
  Description of Artificial Sequence: Synthetic peptide
  Seed: YVIKVSARV (MAGA1_HUMAN)
YTIKVSARV

SEQ ID NO: 41947 - protein, 9 aa, Artificial Sequence
  Description of Artificial Sequence: Synthetic peptide
  Seed: YKHCFPEIF (MAGA1_HUMAN)
YMHCFPEIM

SEQ ID NO: 41948 - protein, 10 aa, Artificial Sequence
  Description of Artificial Sequence: Synthetic peptide
  Seed: FFPSLREAAL (MAGA1_HUMAN)
FTPSLREAAY

SEQ ID NO: 41949 - protein, 9 aa, Artificial Sequence
  Description of Artificial Sequence: Synthetic peptide
  Seed: SYVKVLEYV (MAGA1_HUMAN)
SIVKVLEYT

SEQ ID NO: 41950 - protein, 10 aa, Artificial Sequence
  Description of Artificial Sequence: Synthetic peptide
  Seed: TSYVKVLEYV (MAGA1_HUMAN)
TGYVKVLEYF

SEQ ID NO: 41951 - protein, 10 aa, Artificial Sequence
  Description of Artificial Sequence: Synthetic peptide
  Seed: ARVRFFFPSL (MAGA1_HUMAN)
AAVRFFFPSI

SEQ ID NO: 41952 - protein, 9 aa, Artificial Sequence
  Description of Artificial Sequence: Synthetic peptide
  Seed: VIKNYKHCF (MAGA1_HUMAN)
VMKNYKHCY

SEQ ID NO: 41953 - protein, 8 aa, Artificial Sequence
  Description of Artificial Sequence: Synthetic peptide
  Seed: FLWGPRAL (MAGA1_HUMAN)
FSWGPRAM

SEQ ID NO: 41954 - protein, 9 aa, Artificial Sequence
  Description of Artificial Sequence: Synthetic peptide
  Seed: RAREPVTKA (MAGA1_HUMAN)
RAREPVTKH

SEQ ID NO: 41955 - protein, 9 aa, Artificial Sequence
  Description of Artificial Sequence: Synthetic peptide
  Seed: SSPLVLGTL (MAGA1_HUMAN)
SMPLVLGTM

SEQ ID NO: 41956 - protein, 9 aa, Artificial Sequence
  Description of Artificial Sequence: Synthetic peptide
  Seed: QSPQGASAF (MAGA1_HUMAN)
QMPQGASAF

SEQ ID NO: 41957 - protein, 10 aa, Artificial Sequence
  Description of Artificial Sequence: Synthetic peptide
  Seed: SCILESLFRA (MAGA1_HUMAN)
SFILESLFRA

SEQ ID NO: 41958 - protein, 10 aa, Artificial Sequence
  Description of Artificial Sequence: Synthetic peptide
  Seed: AQQEALGLVC (MAGA1_HUMAN)
AQQEALGLVV

SEQ ID NO: 41959 - protein, 9 aa, Artificial Sequence
  Description of Artificial Sequence: Synthetic peptide
  Seed: KYRAREPVT (MAGA1_HUMAN)
KVRAREPVI

SEQ ID NO: 41960 - protein, 10 aa, Artificial Sequence
  Description of Artificial Sequence: Synthetic peptide
  Seed: KHCFPEIFGK (MAGA1_HUMAN)
KQCFPEIFGR

SEQ ID NO: 41961 - protein, 11 aa, Artificial Sequence
  Description of Artificial Sequence: Synthetic peptide
  Seed: GASAFPTTINF (MAGA1_HUMAN)
GSSAFPTTINW

SEQ ID NO: 41962 - protein, 10 aa, Artificial Sequence
  Description of Artificial Sequence: Synthetic peptide
  Seed: TSYVKVLEYV (MAGA1_HUMAN)
TWYVKVLEYL

SEQ ID NO: 41963 - protein, 9 aa, Artificial Sequence
  Description of Artificial Sequence: Synthetic peptide
  Seed: RVRFFFPSL (MAGA1_HUMAN)
RPRFFFPSG

SEQ ID NO: 41964 - protein, 9 aa, Artificial Sequence
  Description of Artificial Sequence: Synthetic peptide
  Seed: YKHCFPEIF (MAGA1_HUMAN)
YSHCFPEIY

SEQ ID NO: 41965 - protein, 10 aa, Artificial Sequence
  Description of Artificial Sequence: Synthetic peptide
  Seed: KVADLVGFLL (MAGA1_HUMAN)
KPADLVGFLW

SEQ ID NO: 41966 - protein, 9 aa, Artificial Sequence
  Description of Artificial Sequence: Synthetic peptide
  Seed: SAYGEPRKL (MAGA1_HUMAN)
STYGEPRKV

SEQ ID NO: 41967 - protein, 9 aa, Artificial Sequence
  Description of Artificial Sequence: Synthetic peptide
  Seed: EFLWGPRAL (MAGA1_HUMAN)
EFLWGPRAF

SEQ ID NO: 41968 - protein, 10 aa, Artificial Sequence
  Description of Artificial Sequence: Synthetic peptide
  Seed: RVRFFFPSLR (MAGA1_HUMAN)
RDRFFFPSLK

SEQ ID NO: 41969 - protein, 10 aa, Artificial Sequence
  Description of Artificial Sequence: Synthetic peptide
  Seed: LTQDLVQEKY (MAGA1_HUMAN)
LQQDLVQEKY

SEQ ID NO: 41970 - protein, 10 aa, Artificial Sequence
  Description of Artificial Sequence: Synthetic peptide
  Seed: YEFLWGPRAL (MAGA1_HUMAN)
YWFLWGPRAY

SEQ ID NO: 41971 - protein, 10 aa, Artificial Sequence
  Description of Artificial Sequence: Synthetic peptide
  Seed: ARVRFFFPSL (MAGA1_HUMAN)
ATVRFFFPSV

SEQ ID NO: 41972 - protein, 9 aa, Artificial Sequence
  Description of Artificial Sequence: Synthetic peptide
  Seed: KVADLVGFL (MAGA1_HUMAN)
KLADLVGFC

SEQ ID NO: 41973 - protein, 10 aa, Artificial Sequence
  Description of Artificial Sequence: Synthetic peptide
  Seed: KKVADLVGFL (MAGA1_HUMAN)
KFVADLVGFL

SEQ ID NO: 41974 - protein, 9 aa, Artificial Sequence
  Description of Artificial Sequence: Synthetic peptide
  Seed: LVQEKYLEY (MAGA1_HUMAN)
LYQEKYLEI

SEQ ID NO: 41975 - protein, 9 aa, Artificial Sequence
  Description of Artificial Sequence: Synthetic peptide
  Seed: EADPTGHSY (MAGA1_HUMAN)
ESDPTGHSF

SEQ ID NO: 41976 - protein, 10 aa, Artificial Sequence
  Description of Artificial Sequence: Synthetic peptide
  Seed: ARYEFLWGPR (MAGA1_HUMAN)
AWYEFLWGPR

SEQ ID NO: 41977 - protein, 11 aa, Artificial Sequence
  Description of Artificial Sequence: Synthetic peptide
  Seed: EVYDGREHSAY (MAGA1_HUMAN)
EIYDGREHSAY

SEQ ID NO: 41978 - protein, 9 aa, Artificial Sequence
  Description of Artificial Sequence: Synthetic peptide
  Seed: DLVGFLLLK (MAGA1_HUMAN)
DTVGFLLLR

SEQ ID NO: 41979 - protein, 9 aa, Artificial Sequence
  Description of Artificial Sequence: Synthetic peptide
  Seed: YVIKVSARV (MAGA1_HUMAN)
YAIKVSARR

SEQ ID NO: 41980 - protein, 9 aa, Artificial Sequence
  Description of Artificial Sequence: Synthetic peptide
  Seed: FLIIVLVMI (MAGA1_HUMAN)
FMIIVLVMV

SEQ ID NO: 41981 - protein, 9 aa, Artificial Sequence
  Description of Artificial Sequence: Synthetic peptide
  Seed: KVSARVRFF (MAGA1_HUMAN)
KMSARVRFV

SEQ ID NO: 41982 - protein, 11 aa, Artificial Sequence
  Description of Artificial Sequence: Synthetic peptide
  Seed: RVRFFFPSLRE (MAGA1_HUMAN)
RVRFFFPSLRD

SEQ ID NO: 41983 - protein, 9 aa, Artificial Sequence
  Description of Artificial Sequence: Synthetic peptide
  Seed: VSARVRFFF (MAGA1_HUMAN)
VWARVRFFI

SEQ ID NO: 41984 - protein, 9 aa, Artificial Sequence
  Description of Artificial Sequence: Synthetic peptide
  Seed: RAREPVTKA (MAGA1_HUMAN)
RMREPVTKL

SEQ ID NO: 41985 - protein, 9 aa, Artificial Sequence
  Description of Artificial Sequence: Synthetic peptide
  Seed: FLWGPRALA (MAGA1_HUMAN)
FTWGPRALV

SEQ ID NO: 41986 - protein, 10 aa, Artificial Sequence
  Description of Artificial Sequence: Synthetic peptide
  Seed: EMLESVIKNY (MAGA1_HUMAN)
ETLESVIKNR

SEQ ID NO: 41987 - protein, 9 aa, Artificial Sequence
  Description of Artificial Sequence: Synthetic peptide
  Seed: EEEGPSTSC (MAGA1_HUMAN)
EEEGPSTSF

SEQ ID NO: 41988 - protein, 11 aa, Artificial Sequence
  Description of Artificial Sequence: Synthetic peptide
  Seed: STDPPQSPQGA (MAGA1_HUMAN)
SVDPPQSPQGY

SEQ ID NO: 41989 - protein, 9 aa, Artificial Sequence
  Description of Artificial Sequence: Synthetic peptide
  Seed: FFFPSLREA (MAGA1_HUMAN)
FMFPSLREW

SEQ ID NO: 41990 - protein, 10 aa, Artificial Sequence
  Description of Artificial Sequence: Synthetic peptide
  Seed: RALAETSYVK (MAGA1_HUMAN)
RSLAETSYVR

SEQ ID NO: 41991 - protein, 11 aa, Artificial Sequence
  Description of Artificial Sequence: Synthetic peptide
  Seed: RVRFFFPSLRE (MAGA1_HUMAN)
RVRFFFPSLRH

SEQ ID NO: 41992 - protein, 10 aa, Artificial Sequence
  Description of Artificial Sequence: Synthetic peptide
  Seed: TQDLVQEKYL (MAGA1_HUMAN)
THDLVQEKYL

SEQ ID NO: 41993 - protein, 9 aa, Artificial Sequence
  Description of Artificial Sequence: Synthetic peptide
  Seed: ALGLVCVQA (MAGA1_HUMAN)
AMGLVCVQI

SEQ ID NO: 41994 - protein, 9 aa, Artificial Sequence
  Description of Artificial Sequence: Synthetic peptide
  Seed: SAFPTTINF (MAGA1_HUMAN)
SHFPTTINL

SEQ ID NO: 41995 - protein, 10 aa, Artificial Sequence
  Description of Artificial Sequence: Synthetic peptide
  Seed: KNYKHCFPEI (MAGA1_HUMAN)
KGYKHCFPEF

SEQ ID NO: 41996 - protein, 9 aa, Artificial Sequence
  Description of Artificial Sequence: Synthetic peptide
  Seed: YVIKVSARV (MAGA1_HUMAN)
YTIKVSARF

SEQ ID NO: 41997 - protein, 9 aa, Artificial Sequence
  Description of Artificial Sequence: Synthetic peptide
  Seed: RQRQPSEGS (MAGA1_HUMAN)
RMRQPSEGA

SEQ ID NO: 41998 - protein, 9 aa, Artificial Sequence
  Description of Artificial Sequence: Synthetic peptide
  Seed: VQAATSSSS (MAGA1_HUMAN)
VKAATSSSV

SEQ ID NO: 41999 - protein, 9 aa, Artificial Sequence
  Description of Artificial Sequence: Synthetic peptide
  Seed: MPKTGFLII (MAGA1_HUMAN)
MMKTGFLIF

SEQ ID NO: 42000 - protein, 8 aa, Artificial Sequence
  Description of Artificial Sequence: Synthetic peptide
  Seed: RVRFFFPS (MAGA1_HUMAN)
RSRFFFPV

SEQ ID NO: 42001 - protein, 9 aa, Artificial Sequence
  Description of Artificial Sequence: Synthetic peptide
  Seed: KVSARVRFF (MAGA1_HUMAN)
KRSARVRFM

SEQ ID NO: 42002 - protein, 10 aa, Artificial Sequence
  Description of Artificial Sequence: Synthetic peptide
  Seed: RVRFFFPSLR (MAGA1_HUMAN)
RYRFFFPSLF

SEQ ID NO: 42003 - protein, 9 aa, Artificial Sequence
  Description of Artificial Sequence: Synthetic peptide
  Seed: LFRAVITKK (MAGA1_HUMAN)
LSRAVITKA

SEQ ID NO: 42004 - protein, 9 aa, Artificial Sequence
  Description of Artificial Sequence: Synthetic peptide
  Seed: DSDPARYEF (MAGA1_HUMAN)
DMDPARYEM

SEQ ID NO: 42005 - protein, 10 aa, Artificial Sequence
  Description of Artificial Sequence: Synthetic peptide
  Seed: SPQGASAFPT (MAGA1_HUMAN)
SPQGASAFPV

SEQ ID NO: 42006 - protein, 9 aa, Artificial Sequence
  Description of Artificial Sequence: Synthetic peptide
  Seed: RQRQPSEGS (MAGA1_HUMAN)
RTRQPSEGY

SEQ ID NO: 42007 - protein, 9 aa, Artificial Sequence
  Description of Artificial Sequence: Synthetic peptide
  Seed: LKYRAREPV (MAGA1_HUMAN)
LTYRAREPY

SEQ ID NO: 42008 - protein, 9 aa, Artificial Sequence
  Description of Artificial Sequence: Synthetic peptide
  Seed: SARVRFFFP (MAGA1_HUMAN)
SIRVRFFFG

SEQ ID NO: 42009 - protein, 10 aa, Artificial Sequence
  Description of Artificial Sequence: Synthetic peptide
  Seed: TSYVKVLEYV (MAGA1_HUMAN)
TQYVKVLEYV

SEQ ID NO: 42010 - protein, 10 aa, Artificial Sequence
  Description of Artificial Sequence: Synthetic peptide
  Seed: LSVMEVYDGR (MAGA1_HUMAN)
LPVMEVYDGR

SEQ ID NO: 42011 - protein, 10 aa, Artificial Sequence
  Description of Artificial Sequence: Synthetic peptide
  Seed: KVADLVGFLL (MAGA1_HUMAN)
KVADLVGFLK

SEQ ID NO: 42012 - protein, 9 aa, Artificial Sequence
  Description of Artificial Sequence: Synthetic peptide
  Seed: ADLVGFLLL (MAGA1_HUMAN)
AELVGFLLM

SEQ ID NO: 42013 - protein, 9 aa, Artificial Sequence
  Description of Artificial Sequence: Synthetic peptide
  Seed: YVIKVSARV (MAGA1_HUMAN)
YTIKVSARL

SEQ ID NO: 42014 - protein, 9 aa, Artificial Sequence
  Description of Artificial Sequence: Synthetic peptide
  Seed: RALAETSYV (MAGA1_HUMAN)
RMLAETSYW

SEQ ID NO: 42015 - protein, 11 aa, Artificial Sequence
  Description of Artificial Sequence: Synthetic peptide
  Seed: SARVRFFFPSL (MAGA1_HUMAN)
SYRVRFFFPSA

SEQ ID NO: 42016 - protein, 11 aa, Artificial Sequence
  Description of Artificial Sequence: Synthetic peptide
  Seed: RVRFFFPSLRE (MAGA1_HUMAN)
RRRFFFPSLRF

SEQ ID NO: 42017 - protein, 11 aa, Artificial Sequence
  Description of Artificial Sequence: Synthetic peptide
  Seed: YEFLWGPRALA (MAGA1_HUMAN)
YMFLWGPRALA

SEQ ID NO: 42018 - protein, 10 aa, Artificial Sequence
  Description of Artificial Sequence: Synthetic peptide
  Seed: RVRFFFPSLR (MAGA1_HUMAN)
RSRFFFPSLN

SEQ ID NO: 42019 - protein, 10 aa, Artificial Sequence
  Description of Artificial Sequence: Synthetic peptide
  Seed: EIFGKASESL (MAGA1_HUMAN)
EMFGKASESR

SEQ ID NO: 42020 - protein, 11 aa, Artificial Sequence
  Description of Artificial Sequence: Synthetic peptide
  Seed: KVADLVGFLLL (MAGA1_HUMAN)
KIADLVGFLLR

SEQ ID NO: 42021 - protein, 9 aa, Artificial Sequence
  Description of Artificial Sequence: Synthetic peptide
  Seed: TSSSSPLVL (MAGA1_HUMAN)
TTSSSPLVI

SEQ ID NO: 42022 - protein, 10 aa, Artificial Sequence
  Description of Artificial Sequence: Synthetic peptide
  Seed: AQQEALGLVC (MAGA1_HUMAN)
ALQEALGLVF

SEQ ID NO: 42023 - protein, 9 aa, Artificial Sequence
  Description of Artificial Sequence: Synthetic peptide
  Seed: YKHCFPEIF (MAGA1_HUMAN)
YQHCFPEIH

SEQ ID NO: 42024 - protein, 9 aa, Artificial Sequence
  Description of Artificial Sequence: Synthetic peptide
  Seed: SLHCKPEEA (MAGA1_HUMAN)
SIHCKPEEV

SEQ ID NO: 42025 - protein, 9 aa, Artificial Sequence
  Description of Artificial Sequence: Synthetic peptide
  Seed: LVLGTLEEV (MAGA1_HUMAN)
LQLGTLEEV

SEQ ID NO: 42026 - protein, 9 aa, Artificial Sequence
  Description of Artificial Sequence: Synthetic peptide
  Seed: RALAETSYV (MAGA1_HUMAN)
RLLAETSYC

SEQ ID NO: 42027 - protein, 9 aa, Artificial Sequence
  Description of Artificial Sequence: Synthetic peptide
  Seed: SYVKVLEYV (MAGA1_HUMAN)
SFVKVLEYW

SEQ ID NO: 42028 - protein, 9 aa, Artificial Sequence
  Description of Artificial Sequence: Synthetic peptide
  Seed: GLVCVQAAT (MAGA1_HUMAN)
GLVCVQAAA

SEQ ID NO: 42029 - protein, 10 aa, Artificial Sequence
  Description of Artificial Sequence: Synthetic peptide
  Seed: QVPDSDPARY (MAGA1_HUMAN)
QVPDSDPARK

SEQ ID NO: 42030 - protein, 10 aa, Artificial Sequence
  Description of Artificial Sequence: Synthetic peptide
  Seed: CILESLFRAV (MAGA1_HUMAN)
CLLESLFRAI

SEQ ID NO: 42031 - protein, 9 aa, Artificial Sequence
  Description of Artificial Sequence: Synthetic peptide
  Seed: SAFPTTINF (MAGA1_HUMAN)
SSFPTTINL

SEQ ID NO: 42032 - protein, 10 aa, Artificial Sequence
  Description of Artificial Sequence: Synthetic peptide
  Seed: KVLEYVIKVS (MAGA1_HUMAN)
KMLEYVIKVM

SEQ ID NO: 42033 - protein, 9 aa, Artificial Sequence
  Description of Artificial Sequence: Synthetic peptide
  Seed: SARVRFFFP (MAGA1_HUMAN)
SVRVRFFFM

SEQ ID NO: 42034 - protein, 9 aa, Artificial Sequence
  Description of Artificial Sequence: Synthetic peptide
  Seed: FLWGPRALA (MAGA1_HUMAN)
FVWGPRALL

SEQ ID NO: 42035 - protein, 11 aa, Artificial Sequence
  Description of Artificial Sequence: Synthetic peptide
  Seed: RQVPDSDPARY (MAGA1_HUMAN)
RMVPDSDPARM

SEQ ID NO: 42036 - protein, 9 aa, Artificial Sequence
  Description of Artificial Sequence: Synthetic peptide
  Seed: SARVRFFFP (MAGA1_HUMAN)
SARVRFFFI

SEQ ID NO: 42037 - protein, 9 aa, Artificial Sequence
  Description of Artificial Sequence: Synthetic peptide
  Seed: ATSSSSPLV (MAGA1_HUMAN)
ALSSSSPLM

SEQ ID NO: 42038 - protein, 10 aa, Artificial Sequence
  Description of Artificial Sequence: Synthetic peptide
  Seed: KASESLQLVF (MAGA1_HUMAN)
KQSESLQLVI

SEQ ID NO: 42039 - protein, 9 aa, Artificial Sequence
  Description of Artificial Sequence: Synthetic peptide
  Seed: MSLEQRSLH (MAGA1_HUMAN)
MVLEQRSLY

SEQ ID NO: 42040 - protein, 9 aa, Artificial Sequence
  Description of Artificial Sequence: Synthetic peptide
  Seed: YDGREHSAY (MAGA1_HUMAN)
YLGREHSAF

SEQ ID NO: 42041 - protein, 11 aa, Artificial Sequence
  Description of Artificial Sequence: Synthetic peptide
  Seed: SARVRFFFPSL (MAGA1_HUMAN)
SFRVRFFFPSK

SEQ ID NO: 42042 - protein, 9 aa, Artificial Sequence
  Description of Artificial Sequence: Synthetic peptide
  Seed: HSYVLVTCL (MAGA1_HUMAN)
HSYVLVTCY

SEQ ID NO: 42043 - protein, 9 aa, Artificial Sequence
  Description of Artificial Sequence: Synthetic peptide
  Seed: SVMEVYDGR (MAGA1_HUMAN)
SVMEVYDGY

SEQ ID NO: 42044 - protein, 10 aa, Artificial Sequence
  Description of Artificial Sequence: Synthetic peptide
  Seed: SESLQLVFGI (MAGA1_HUMAN)
SVSLQLVFGW

SEQ ID NO: 42045 - protein, 10 aa, Artificial Sequence
  Description of Artificial Sequence: Synthetic peptide
  Seed: KEADPTGHSY (MAGA1_HUMAN)
KYADPTGHSF

SEQ ID NO: 42046 - protein, 9 aa, Artificial Sequence
  Description of Artificial Sequence: Synthetic peptide
  Seed: FLWGPRALA (MAGA1_HUMAN)
FQWGPRALR

SEQ ID NO: 42047 - protein, 9 aa, Artificial Sequence
  Description of Artificial Sequence: Synthetic peptide
  Seed: LVQEKYLEY (MAGA1_HUMAN)
LIQEKYLEL

SEQ ID NO: 42048 - protein, 10 aa, Artificial Sequence
  Description of Artificial Sequence: Synthetic peptide
  Seed: ARYEFLWGPR (MAGA1_HUMAN)
ANYEFLWGPR

SEQ ID NO: 42049 - protein, 9 aa, Artificial Sequence
  Description of Artificial Sequence: Synthetic peptide
  Seed: ALREEEEGV (MAGA1_HUMAN)
ALREEEEGL

SEQ ID NO: 42050 - protein, 9 aa, Artificial Sequence
  Description of Artificial Sequence: Synthetic peptide
  Seed: MPKTGFLII (MAGA1_HUMAN)
MHKTGFLIA

SEQ ID NO: 42051 - protein, 10 aa, Artificial Sequence
  Description of Artificial Sequence: Synthetic peptide
  Seed: EEIWEELSVM (MAGA1_HUMAN)
EEIWEELSVF

SEQ ID NO: 42052 - protein, 9 aa, Artificial Sequence
  Description of Artificial Sequence: Synthetic peptide
  Seed: TSYVKVLEY (MAGA1_HUMAN)
TVYVKVLEI

SEQ ID NO: 42053 - protein, 9 aa, Artificial Sequence
  Description of Artificial Sequence: Synthetic peptide
  Seed: RVRFFFPSL (MAGA1_HUMAN)
RQRFFFPSN

SEQ ID NO: 42054 - protein, 9 aa, Artificial Sequence
  Description of Artificial Sequence: Synthetic peptide
  Seed: SLFRAVITK (MAGA1_HUMAN)
SMFRAVITV

SEQ ID NO: 42055 - protein, 9 aa, Artificial Sequence
  Description of Artificial Sequence: Synthetic peptide
  Seed: SARVRFFFP (MAGA1_HUMAN)
STRVRFFFL

SEQ ID NO: 42056 - protein, 11 aa, Artificial Sequence
  Description of Artificial Sequence: Synthetic peptide
  Seed: YEFLWGPRALA (MAGA1_HUMAN)
YWFLWGPRALL

SEQ ID NO: 42057 - protein, 9 aa, Artificial Sequence
  Description of Artificial Sequence: Synthetic peptide
  Seed: ATSSSSPLV (MAGA1_HUMAN)
AVSSSSPLK

SEQ ID NO: 42058 - protein, 9 aa, Artificial Sequence
  Description of Artificial Sequence: Synthetic peptide
  Seed: RQRQPSEGS (MAGA1_HUMAN)
RARQPSEGK

SEQ ID NO: 42059 - protein, 9 aa, Artificial Sequence
  Description of Artificial Sequence: Synthetic peptide
  Seed: SSSPLVLGT (MAGA1_HUMAN)
SSSPLVLGL

SEQ ID NO: 42060 - protein, 10 aa, Artificial Sequence
  Description of Artificial Sequence: Synthetic peptide
  Seed: EALEAQQEAL (MAGA1_HUMAN)
EILEAQQEAK

SEQ ID NO: 42061 - protein, 9 aa, Artificial Sequence
  Description of Artificial Sequence: Synthetic peptide
  Seed: STSCILESL (MAGA1_HUMAN)
SLSCILESI

SEQ ID NO: 42062 - protein, 9 aa, Artificial Sequence
  Description of Artificial Sequence: Synthetic peptide
  Seed: KVADLVGFL (MAGA1_HUMAN)
KLADLVGFW

SEQ ID NO: 42063 - protein, 10 aa, Artificial Sequence
  Description of Artificial Sequence: Synthetic peptide
  Seed: RVRFFFPSLR (MAGA1_HUMAN)
RLRFFFPSLM

SEQ ID NO: 42064 - protein, 9 aa, Artificial Sequence
  Description of Artificial Sequence: Synthetic peptide
  Seed: IMPKTGFLI (MAGA1_HUMAN)
ILPKTGFLV

SEQ ID NO: 42065 - protein, 9 aa, Artificial Sequence
  Description of Artificial Sequence: Synthetic peptide
  Seed: RVRFFFPSL (MAGA1_HUMAN)
RCRFFFPSK

SEQ ID NO: 42066 - protein, 9 aa, Artificial Sequence
  Description of Artificial Sequence: Synthetic peptide
  Seed: FRAVITKKV (MAGA1_HUMAN)
FRAVITKKY

SEQ ID NO: 42067 - protein, 9 aa, Artificial Sequence
  Description of Artificial Sequence: Synthetic peptide
  Seed: KYRAREPVT (MAGA1_HUMAN)
KYRAREPVI

SEQ ID NO: 42068 - protein, 9 aa, Artificial Sequence
  Description of Artificial Sequence: Synthetic peptide
  Seed: KVADLVGFL (MAGA1_HUMAN)
KMADLVGFR

SEQ ID NO: 42069 - protein, 10 aa, Artificial Sequence
  Description of Artificial Sequence: Synthetic peptide
  Seed: KVADLVGFLL (MAGA1_HUMAN)
KMADLVGFLY

SEQ ID NO: 42070 - protein, 11 aa, Artificial Sequence
  Description of Artificial Sequence: Synthetic peptide
  Seed: RVRFFFPSLRE (MAGA1_HUMAN)
RGRFFFPSLRR

SEQ ID NO: 42071 - protein, 10 aa, Artificial Sequence
  Description of Artificial Sequence: Synthetic peptide
  Seed: TSCILESLFR (MAGA1_HUMAN)
TICILESLFK

SEQ ID NO: 42072 - protein, 9 aa, Artificial Sequence
  Description of Artificial Sequence: Synthetic peptide
  Seed: LESLFRAVI (MAGA1_HUMAN)
LESLFRAVV

SEQ ID NO: 42073 - protein, 9 aa, Artificial Sequence
  Description of Artificial Sequence: Synthetic peptide
  Seed: SARVRFFFP (MAGA1_HUMAN)
SIRVRFFFV

SEQ ID NO: 42074 - protein, 9 aa, Artificial Sequence
  Description of Artificial Sequence: Synthetic peptide
  Seed: REEEGPSTS (MAGA1_HUMAN)
REEEGPSTI

SEQ ID NO: 42075 - protein, 9 aa, Artificial Sequence
  Description of Artificial Sequence: Synthetic peptide
  Seed: EADPTGHSY (MAGA1_HUMAN)
ETDPTGHSM

SEQ ID NO: 42076 - protein, 9 aa, Artificial Sequence
  Description of Artificial Sequence: Synthetic peptide
  Seed: FPSLREAAL (MAGA1_HUMAN)
FPSLREAAW

SEQ ID NO: 42077 - protein, 9 aa, Artificial Sequence
  Description of Artificial Sequence: Synthetic peptide
  Seed: AQQEALGLV (MAGA1_HUMAN)
AVQEALGLV

SEQ ID NO: 42078 - protein, 10 aa, Artificial Sequence
  Description of Artificial Sequence: Synthetic peptide
  Seed: KVADLVGFLL (MAGA1_HUMAN)
KMADLVGFLH

SEQ ID NO: 42079 - protein, 10 aa, Artificial Sequence
  Description of Artificial Sequence: Synthetic peptide
  Seed: QVPDSDPARY (MAGA1_HUMAN)
QIPDSDPARK

SEQ ID NO: 42080 - protein, 9 aa, Artificial Sequence
  Description of Artificial Sequence: Synthetic peptide
  Seed: ETSYVKVLE (MAGA1_HUMAN)
ESSYVKVLR

SEQ ID NO: 42081 - protein, 8 aa, Artificial Sequence
  Description of Artificial Sequence: Synthetic peptide
  Seed: HSYVLVTC (MAGA1_HUMAN)
HAYVLVTV

SEQ ID NO: 42082 - protein, 9 aa, Artificial Sequence
  Description of Artificial Sequence: Synthetic peptide
  Seed: TTINFTRQR (MAGA1_HUMAN)
TSINFTRQL

SEQ ID NO: 42083 - protein, 9 aa, Artificial Sequence
  Description of Artificial Sequence: Synthetic peptide
  Seed: VIKNYKHCF (MAGA1_HUMAN)
VYKNYKHCF

SEQ ID NO: 42084 - protein, 9 aa, Artificial Sequence
  Description of Artificial Sequence: Synthetic peptide
  Seed: SARVRFFFP (MAGA1_HUMAN)
SIRVRFFFA

SEQ ID NO: 42085 - protein, 9 aa, Artificial Sequence
  Description of Artificial Sequence: Synthetic peptide
  Seed: STDPPQSPQ (MAGA1_HUMAN)
SSDPPQSPM

SEQ ID NO: 42086 - protein, 9 aa, Artificial Sequence
  Description of Artificial Sequence: Synthetic peptide
  Seed: TKAEMLESV (MAGA1_HUMAN)
TTAEMLESA

SEQ ID NO: 42087 - protein, 9 aa, Artificial Sequence
  Description of Artificial Sequence: Synthetic peptide
  Seed: VADLVGFLL (MAGA1_HUMAN)
VQDLVGFLF

SEQ ID NO: 42088 - protein, 8 aa, Artificial Sequence
  Description of Artificial Sequence: Synthetic peptide
  Seed: FLWGPRAL (MAGA1_HUMAN)
FQWGPRAI

SEQ ID NO: 42089 - protein, 9 aa, Artificial Sequence
  Description of Artificial Sequence: Synthetic peptide
  Seed: FLIIVLVMI (MAGA1_HUMAN)
FIIIVLVML

SEQ ID NO: 42090 - protein, 10 aa, Artificial Sequence
  Description of Artificial Sequence: Synthetic peptide
  Seed: TSYVKVLEYV (MAGA1_HUMAN)
THYVKVLEYF

SEQ ID NO: 42091 - protein, 11 aa, Artificial Sequence
  Description of Artificial Sequence: Synthetic peptide
  Seed: YEFLWGPRALA (MAGA1_HUMAN)
YDFLWGPRALL

SEQ ID NO: 42092 - protein, 9 aa, Artificial Sequence
  Description of Artificial Sequence: Synthetic peptide
  Seed: SAYGEPRKL (MAGA1_HUMAN)
SLYGEPRKM

SEQ ID NO: 42093 - protein, 10 aa, Artificial Sequence
  Description of Artificial Sequence: Synthetic peptide
  Seed: SCILESLFRA (MAGA1_HUMAN)
SSILESLFRI

SEQ ID NO: 42094 - protein, 9 aa, Artificial Sequence
  Description of Artificial Sequence: Synthetic peptide
  Seed: KVLEYVIKV (MAGA1_HUMAN)
KFLEYVIKR

SEQ ID NO: 42095 - protein, 10 aa, Artificial Sequence
  Description of Artificial Sequence: Synthetic peptide
  Seed: MLESVIKNYK (MAGA1_HUMAN)
MYESVIKNYK

SEQ ID NO: 42096 - protein, 10 aa, Artificial Sequence
  Description of Artificial Sequence: Synthetic peptide
  Seed: TSYVKVLEYV (MAGA1_HUMAN)
TWYVKVLEYW

SEQ ID NO: 42097 - protein, 11 aa, Artificial Sequence
  Description of Artificial Sequence: Synthetic peptide
  Seed: RQVPDSDPARY (MAGA1_HUMAN)
RLVPDSDPARI

SEQ ID NO: 42098 - protein, 9 aa, Artificial Sequence
  Description of Artificial Sequence: Synthetic peptide
  Seed: TSSSSPLVL (MAGA1_HUMAN)
TMSSSPLVI

SEQ ID NO: 42099 - protein, 9 aa, Artificial Sequence
  Description of Artificial Sequence: Synthetic peptide
  Seed: TSYVKVLEY (MAGA1_HUMAN)
TMYVKVLEF

SEQ ID NO: 42100 - protein, 8 aa, Artificial Sequence
  Description of Artificial Sequence: Synthetic peptide
  Seed: HSYVLVTC (MAGA1_HUMAN)
HQYVLVTI

SEQ ID NO: 42101 - protein, 9 aa, Artificial Sequence
  Description of Artificial Sequence: Synthetic peptide
  Seed: RVRFFFPSL (MAGA1_HUMAN)
RVRFFFPSS

SEQ ID NO: 42102 - protein, 9 aa, Artificial Sequence
  Description of Artificial Sequence: Synthetic peptide
  Seed: ATSSSSPLV (MAGA1_HUMAN)
AASSSSPLK

SEQ ID NO: 42103 - protein, 9 aa, Artificial Sequence
  Description of Artificial Sequence: Synthetic peptide
  Seed: SAYGEPRKL (MAGA1_HUMAN)
SVYGEPRKR

SEQ ID NO: 42104 - protein, 9 aa, Artificial Sequence
  Description of Artificial Sequence: Synthetic peptide
  Seed: SLFRAVITK (MAGA1_HUMAN)
SSFRAVITR

SEQ ID NO: 42105 - protein, 9 aa, Artificial Sequence
  Description of Artificial Sequence: Synthetic peptide
  Seed: RQRQPSEGS (MAGA1_HUMAN)
RTRQPSEGV

SEQ ID NO: 42106 - protein, 9 aa, Artificial Sequence
  Description of Artificial Sequence: Synthetic peptide
  Seed: YVLVTCLGL (MAGA1_HUMAN)
YTLVTCLGV

SEQ ID NO: 42107 - protein, 10 aa, Artificial Sequence
  Description of Artificial Sequence: Synthetic peptide
  Seed: EIFGKASESL (MAGA1_HUMAN)
EVFGKASESF

SEQ ID NO: 42108 - protein, 10 aa, Artificial Sequence
  Description of Artificial Sequence: Synthetic peptide
  Seed: MLESVIKNYK (MAGA1_HUMAN)
MVESVIKNYY

SEQ ID NO: 42109 - protein, 9 aa, Artificial Sequence
  Description of Artificial Sequence: Synthetic peptide
  Seed: SVMEVYDGR (MAGA1_HUMAN)
SAMEVYDGR

SEQ ID NO: 42110 - protein, 9 aa, Artificial Sequence
  Description of Artificial Sequence: Synthetic peptide
  Seed: SARVRFFFP (MAGA1_HUMAN)
SQRVRFFFV

SEQ ID NO: 42111 - protein, 9 aa, Artificial Sequence
  Description of Artificial Sequence: Synthetic peptide
  Seed: EYVIKVSAR (MAGA1_HUMAN)
ESVIKVSAR

SEQ ID NO: 42112 - protein, 11 aa, Artificial Sequence
  Description of Artificial Sequence: Synthetic peptide
  Seed: CILESLFRAVI (MAGA1_HUMAN)
CMLESLFRAVV

SEQ ID NO: 42113 - protein, 9 aa, Artificial Sequence
  Description of Artificial Sequence: Synthetic peptide
  Seed: GASAFPTTI (MAGA1_HUMAN)
GQSAFPTTV

SEQ ID NO: 42114 - protein, 9 aa, Artificial Sequence
  Description of Artificial Sequence: Synthetic peptide
  Seed: SAYGEPRKL (MAGA1_HUMAN)
SGYGEPRKW

SEQ ID NO: 42115 - protein, 9 aa, Artificial Sequence
  Description of Artificial Sequence: Synthetic peptide
  Seed: YVLVTCLGL (MAGA1_HUMAN)
YMLVTCLGA

SEQ ID NO: 42116 - protein, 9 aa, Artificial Sequence
  Description of Artificial Sequence: Synthetic peptide
  Seed: QVPDSDPAR (MAGA1_HUMAN)
QAPDSDPAL

SEQ ID NO: 42117 - protein, 10 aa, Artificial Sequence
  Description of Artificial Sequence: Synthetic peptide
  Seed: RVRFFFPSLR (MAGA1_HUMAN)
RRRFFFPSLA

SEQ ID NO: 42118 - protein, 10 aa, Artificial Sequence
  Description of Artificial Sequence: Synthetic peptide
  Seed: SCILESLFRA (MAGA1_HUMAN)
SCILESLFRL

SEQ ID NO: 42119 - protein, 9 aa, Artificial Sequence
  Description of Artificial Sequence: Synthetic peptide
  Seed: LKYRAREPV (MAGA1_HUMAN)
LQYRAREPA

SEQ ID NO: 42120 - protein, 9 aa, Artificial Sequence
  Description of Artificial Sequence: Synthetic peptide
  Seed: ETSYVKVLE (MAGA1_HUMAN)
ETSYVKVLY

SEQ ID NO: 42121 - protein, 9 aa, Artificial Sequence
  Description of Artificial Sequence: Synthetic peptide
  Seed: STDPPQSPQ (MAGA1_HUMAN)
SGDPPQSPI

SEQ ID NO: 42122 - protein, 11 aa, Artificial Sequence
  Description of Artificial Sequence: Synthetic peptide
  Seed: GASAFPTTINF (MAGA1_HUMAN)
GTSAFPTTINW

SEQ ID NO: 42123 - protein, 10 aa, Artificial Sequence
  Description of Artificial Sequence: Synthetic peptide
  Seed: KVSARVRFFF (MAGA1_HUMAN)
KYSARVRFFF

SEQ ID NO: 42124 - protein, 9 aa, Artificial Sequence
  Description of Artificial Sequence: Synthetic peptide
  Seed: SAYGEPRKL (MAGA1_HUMAN)
SQYGEPRKF

SEQ ID NO: 42125 - protein, 10 aa, Artificial Sequence
  Description of Artificial Sequence: Synthetic peptide
  Seed: SYVKVLEYVI (MAGA1_HUMAN)
SYVKVLEYVF

SEQ ID NO: 42126 - protein, 10 aa, Artificial Sequence
  Description of Artificial Sequence: Synthetic peptide
  Seed: LSVMEVYDGR (MAGA1_HUMAN)
LYVMEVYDGR

SEQ ID NO: 42127 - protein, 9 aa, Artificial Sequence
  Description of Artificial Sequence: Synthetic peptide
  Seed: KVSARVRFF (MAGA1_HUMAN)
KASARVRFF

SEQ ID NO: 42128 - protein, 10 aa, Artificial Sequence
  Description of Artificial Sequence: Synthetic peptide
  Seed: SARVRFFFPS (MAGA1_HUMAN)
SWRVRFFFPR

SEQ ID NO: 42129 - protein, 8 aa, Artificial Sequence
  Description of Artificial Sequence: Synthetic peptide
  Seed: YEFLWGPR (MAGA1_HUMAN)
YEFLWGPL

SEQ ID NO: 42130 - protein, 9 aa, Artificial Sequence
  Description of Artificial Sequence: Synthetic peptide
  Seed: KKVADLVGF (MAGA1_HUMAN)
KIVADLVGY

SEQ ID NO: 42131 - protein, 9 aa, Artificial Sequence
  Description of Artificial Sequence: Synthetic peptide
  Seed: KVLEYVIKV (MAGA1_HUMAN)
KVLEYVIKT

SEQ ID NO: 42132 - protein, 9 aa, Artificial Sequence
  Description of Artificial Sequence: Synthetic peptide
  Seed: ITKKVADLV (MAGA1_HUMAN)
ISKKVADLF

SEQ ID NO: 42133 - protein, 10 aa, Artificial Sequence
  Description of Artificial Sequence: Synthetic peptide
  Seed: RVRFFFPSLR (MAGA1_HUMAN)
RRRFFFPSLF

SEQ ID NO: 42134 - protein, 11 aa, Artificial Sequence
  Description of Artificial Sequence: Synthetic peptide
  Seed: TKKVADLVGFL (MAGA1_HUMAN)
TVKVADLVGFV

SEQ ID NO: 42135 - protein, 10 aa, Artificial Sequence
  Description of Artificial Sequence: Synthetic peptide
  Seed: YEFLWGPRAL (MAGA1_HUMAN)
YLFLWGPRAF

SEQ ID NO: 42136 - protein, 11 aa, Artificial Sequence
  Description of Artificial Sequence: Synthetic peptide
  Seed: RQVPDSDPARY (MAGA1_HUMAN)
RSVPDSDPARF

SEQ ID NO: 42137 - protein, 10 aa, Artificial Sequence
  Description of Artificial Sequence: Synthetic peptide
  Seed: SARVRFFFPS (MAGA1_HUMAN)
SYRVRFFFPV

SEQ ID NO: 42138 - protein, 9 aa, Artificial Sequence
  Description of Artificial Sequence: Synthetic peptide
  Seed: ATSSSSPLV (MAGA1_HUMAN)
AMSSSSPLA

SEQ ID NO: 42139 - protein, 9 aa, Artificial Sequence
  Description of Artificial Sequence: Synthetic peptide
  Seed: SLHCKPEEA (MAGA1_HUMAN)
SLHCKPEEI

SEQ ID NO: 42140 - protein, 10 aa, Artificial Sequence
  Description of Artificial Sequence: Synthetic peptide
  Seed: KYRAREPVTK (MAGA1_HUMAN)
KTRAREPVTK

SEQ ID NO: 42141 - protein, 9 aa, Artificial Sequence
  Description of Artificial Sequence: Synthetic peptide
  Seed: GDNQIMPKT (MAGA1_HUMAN)
GENQIMPKI

SEQ ID NO: 42142 - protein, 9 aa, Artificial Sequence
  Description of Artificial Sequence: Synthetic peptide
  Seed: TQDLVQEKY (MAGA1_HUMAN)
TLDLVQEKL

SEQ ID NO: 42143 - protein, 10 aa, Artificial Sequence
  Description of Artificial Sequence: Synthetic peptide
  Seed: KTGFLIIVLV (MAGA1_HUMAN)
KLGFLIIVLV

SEQ ID NO: 42144 - protein, 9 aa, Artificial Sequence
  Description of Artificial Sequence: Synthetic peptide
  Seed: KVLEYVIKV (MAGA1_HUMAN)
KSLEYVIKV

SEQ ID NO: 42145 - protein, 9 aa, Artificial Sequence
  Description of Artificial Sequence: Synthetic peptide
  Seed: HCFPEIFGK (MAGA1_HUMAN)
HHFPEIFGR

SEQ ID NO: 42146 - protein, 11 aa, Artificial Sequence
  Description of Artificial Sequence: Synthetic peptide
  Seed: RVRFFFPSLRE (MAGA1_HUMAN)
RVRFFFPSLRY

SEQ ID NO: 42147 - protein, 11 aa, Artificial Sequence
  Description of Artificial Sequence: Synthetic peptide
  Seed: VLGTLEEVPTA (MAGA1_HUMAN)
VLGTLEEVPTI

SEQ ID NO: 42148 - protein, 9 aa, Artificial Sequence
  Description of Artificial Sequence: Synthetic peptide
  Seed: TSSSSPLVL (MAGA1_HUMAN)
TVSSSPLVM

SEQ ID NO: 42149 - protein, 9 aa, Artificial Sequence
  Description of Artificial Sequence: Synthetic peptide
  Seed: YVKVLEYVI (MAGA1_HUMAN)
YQKVLEYVV

SEQ ID NO: 42150 - protein, 10 aa, Artificial Sequence
  Description of Artificial Sequence: Synthetic peptide
  Seed: KVADLVGFLL (MAGA1_HUMAN)
KQADLVGFLA

SEQ ID NO: 42151 - protein, 9 aa, Artificial Sequence
  Description of Artificial Sequence: Synthetic peptide
  Seed: RALAETSYV (MAGA1_HUMAN)
RVLAETSYF

SEQ ID NO: 42152 - protein, 9 aa, Artificial Sequence
  Description of Artificial Sequence: Synthetic peptide
  Seed: VYDGREHSA (MAGA1_HUMAN)
VMDGREHSF

SEQ ID NO: 42153 - protein, 10 aa, Artificial Sequence
  Description of Artificial Sequence: Synthetic peptide
  Seed: KNYKHCFPEI (MAGA1_HUMAN)
KQYKHCFPEK

SEQ ID NO: 42154 - protein, 9 aa, Artificial Sequence
  Description of Artificial Sequence: Synthetic peptide
  Seed: KVADLVGFL (MAGA1_HUMAN)
KVADLVGFY

SEQ ID NO: 42155 - protein, 9 aa, Artificial Sequence
  Description of Artificial Sequence: Synthetic peptide
  Seed: RAREPVTKA (MAGA1_HUMAN)
RSREPVTKT

SEQ ID NO: 42156 - protein, 9 aa, Artificial Sequence
  Description of Artificial Sequence: Synthetic peptide
  Seed: SYVKVLEYV (MAGA1_HUMAN)
SMVKVLEYF

SEQ ID NO: 42157 - protein, 9 aa, Artificial Sequence
  Description of Artificial Sequence: Synthetic peptide
  Seed: ALREEEEGV (MAGA1_HUMAN)
AQREEEEGF

SEQ ID NO: 42158 - protein, 11 aa, Artificial Sequence
  Description of Artificial Sequence: Synthetic peptide
  Seed: YEFLWGPRALA (MAGA1_HUMAN)
YVFLWGPRALI

SEQ ID NO: 42159 - protein, 9 aa, Artificial Sequence
  Description of Artificial Sequence: Synthetic peptide
  Seed: REAALREEE (MAGA1_HUMAN)
REAALREEC

SEQ ID NO: 42160 - protein, 10 aa, Artificial Sequence
  Description of Artificial Sequence: Synthetic peptide
  Seed: HSAYGEPRKL (MAGA1_HUMAN)
HAAYGEPRKY

SEQ ID NO: 42161 - protein, 10 aa, Artificial Sequence
  Description of Artificial Sequence: Synthetic peptide
  Seed: KEADPTGHSY (MAGA1_HUMAN)
KMADPTGHSI

SEQ ID NO: 42162 - protein, 9 aa, Artificial Sequence
  Description of Artificial Sequence: Synthetic peptide
  Seed: EADPTGHSY (MAGA1_HUMAN)
ESDPTGHSI

SEQ ID NO: 42163 - protein, 8 aa, Artificial Sequence
  Description of Artificial Sequence: Synthetic peptide
  Seed: SYVKVLEY (MAGA1_HUMAN)
SYVKVLEL

SEQ ID NO: 42164 - protein, 11 aa, Artificial Sequence
  Description of Artificial Sequence: Synthetic peptide
  Seed: YEFLWGPRALA (MAGA1_HUMAN)
YGFLWGPRALV

SEQ ID NO: 42165 - protein, 10 aa, Artificial Sequence
  Description of Artificial Sequence: Synthetic peptide
  Seed: REAALREEEE (MAGA1_HUMAN)
REAALREEEA

SEQ ID NO: 42166 - protein, 9 aa, Artificial Sequence
  Description of Artificial Sequence: Synthetic peptide
  Seed: IAMEGGHAP (MAGA1_HUMAN)
IGMEGGHAM

SEQ ID NO: 42167 - protein, 9 aa, Artificial Sequence
  Description of Artificial Sequence: Synthetic peptide
  Seed: LVTCLGLSY (MAGA1_HUMAN)
LTTCLGLSK

SEQ ID NO: 42168 - protein, 10 aa, Artificial Sequence
  Description of Artificial Sequence: Synthetic peptide
  Seed: RYEFLWGPRA (MAGA1_HUMAN)
RAEFLWGPRR

SEQ ID NO: 42169 - protein, 9 aa, Artificial Sequence
  Description of Artificial Sequence: Synthetic peptide
  Seed: STDPPQSPQ (MAGA1_HUMAN)
SLDPPQSPM

SEQ ID NO: 42170 - protein, 10 aa, Artificial Sequence
  Description of Artificial Sequence: Synthetic peptide
  Seed: YEFLWGPRAL (MAGA1_HUMAN)
YKFLWGPRAM

SEQ ID NO: 42171 - protein, 9 aa, Artificial Sequence
  Description of Artificial Sequence: Synthetic peptide
  Seed: YVIKVSARV (MAGA1_HUMAN)
YVIKVSARL

SEQ ID NO: 42172 - protein, 9 aa, Artificial Sequence
  Description of Artificial Sequence: Synthetic peptide
  Seed: MIAMEGGHA (MAGA1_HUMAN)
MLAMEGGHV

SEQ ID NO: 42173 - protein, 10 aa, Artificial Sequence
  Description of Artificial Sequence: Synthetic peptide
  Seed: TTINFTRQRQ (MAGA1_HUMAN)
TTINFTRQRK

SEQ ID NO: 42174 - protein, 9 aa, Artificial Sequence
  Description of Artificial Sequence: Synthetic peptide
  Seed: LKYRAREPV (MAGA1_HUMAN)
LQYRAREPW

SEQ ID NO: 42175 - protein, 10 aa, Artificial Sequence
  Description of Artificial Sequence: Synthetic peptide
  Seed: KVSARVRFFF (MAGA1_HUMAN)
KQSARVRFFY

SEQ ID NO: 42176 - protein, 11 aa, Artificial Sequence
  Description of Artificial Sequence: Synthetic peptide
  Seed: RVRFFFPSLRE (MAGA1_HUMAN)
RFRFFFPSLRR

SEQ ID NO: 42177 - protein, 9 aa, Artificial Sequence
  Description of Artificial Sequence: Synthetic peptide
  Seed: RVRFFFPSL (MAGA1_HUMAN)
RPRFFFPSF

SEQ ID NO: 42178 - protein, 10 aa, Artificial Sequence
  Description of Artificial Sequence: Synthetic peptide
  Seed: TSYVKVLEYV (MAGA1_HUMAN)
TPYVKVLEYW

SEQ ID NO: 42179 - protein, 9 aa, Artificial Sequence
  Description of Artificial Sequence: Synthetic peptide
  Seed: CILESLFRA (MAGA1_HUMAN)
CQLESLFRA

SEQ ID NO: 42180 - protein, 9 aa, Artificial Sequence
  Description of Artificial Sequence: Synthetic peptide
  Seed: AQQEALGLV (MAGA1_HUMAN)
ALQEALGLM

SEQ ID NO: 42181 - protein, 10 aa, Artificial Sequence
  Description of Artificial Sequence: Synthetic peptide
  Seed: RVRFFFPSLR (MAGA1_HUMAN)
RGRFFFPSLH

SEQ ID NO: 42182 - protein, 9 aa, Artificial Sequence
  Description of Artificial Sequence: Synthetic peptide
  Seed: KASESLQLV (MAGA1_HUMAN)
KGSESLQLL

SEQ ID NO: 42183 - protein, 11 aa, Artificial Sequence
  Description of Artificial Sequence: Synthetic peptide
  Seed: RVRFFFPSLRE (MAGA1_HUMAN)
RVRFFFPSLRW

SEQ ID NO: 42184 - protein, 9 aa, Artificial Sequence
  Description of Artificial Sequence: Synthetic peptide
  Seed: IAMEGGHAP (MAGA1_HUMAN)
IGMEGGHAL

SEQ ID NO: 42185 - protein, 9 aa, Artificial Sequence
  Description of Artificial Sequence: Synthetic peptide
  Seed: DPTGHSYVL (MAGA1_HUMAN)
DPTGHSYVF

SEQ ID NO: 42186 - protein, 9 aa, Artificial Sequence
  Description of Artificial Sequence: Synthetic peptide
  Seed: FLWGPRALA (MAGA1_HUMAN)
FAWGPRALR

SEQ ID NO: 42187 - protein, 9 aa, Artificial Sequence
  Description of Artificial Sequence: Synthetic peptide
  Seed: VRFFFPSLR (MAGA1_HUMAN)
VFFFFPSLK

SEQ ID NO: 42188 - protein, 10 aa, Artificial Sequence
  Description of Artificial Sequence: Synthetic peptide
  Seed: RVRFFFPSLR (MAGA1_HUMAN)
RGRFFFPSLR

SEQ ID NO: 42189 - protein, 10 aa, Artificial Sequence
  Description of Artificial Sequence: Synthetic peptide
  Seed: KVSARVRFFF (MAGA1_HUMAN)
KCSARVRFFK

SEQ ID NO: 42190 - protein, 9 aa, Artificial Sequence
  Description of Artificial Sequence: Synthetic peptide
  Seed: KVLEYVIKV (MAGA1_HUMAN)
KLLEYVIKY

SEQ ID NO: 42191 - protein, 9 aa, Artificial Sequence
  Description of Artificial Sequence: Synthetic peptide
  Seed: SAFPTTINF (MAGA1_HUMAN)
SVFPTTINV

SEQ ID NO: 42192 - protein, 10 aa, Artificial Sequence
  Description of Artificial Sequence: Synthetic peptide
  Seed: GPRALAETSY (MAGA1_HUMAN)
GPRALAETSL

SEQ ID NO: 42193 - protein, 9 aa, Artificial Sequence
  Description of Artificial Sequence: Synthetic peptide
  Seed: SAFPTTINF (MAGA1_HUMAN)
SLFPTTINM

SEQ ID NO: 42194 - protein, 10 aa, Artificial Sequence
  Description of Artificial Sequence: Synthetic peptide
  Seed: KASESLQLVF (MAGA1_HUMAN)
KSSESLQLVY

SEQ ID NO: 42195 - protein, 10 aa, Artificial Sequence
  Description of Artificial Sequence: Synthetic peptide
  Seed: RYEFLWGPRA (MAGA1_HUMAN)
REEFLWGPRA

SEQ ID NO: 42196 - protein, 9 aa, Artificial Sequence
  Description of Artificial Sequence: Synthetic peptide
  Seed: FFFPSLREA (MAGA1_HUMAN)
FYFPSLREL

SEQ ID NO: 42197 - protein, 10 aa, Artificial Sequence
  Description of Artificial Sequence: Synthetic peptide
  Seed: KNYKHCFPEI (MAGA1_HUMAN)
KTYKHCFPEM

SEQ ID NO: 42198 - protein, 9 aa, Artificial Sequence
  Description of Artificial Sequence: Synthetic peptide
  Seed: LVTCLGLSY (MAGA1_HUMAN)
LYTCLGLSY

SEQ ID NO: 42199 - protein, 9 aa, Artificial Sequence
  Description of Artificial Sequence: Synthetic peptide
  Seed: KVLEYVIKV (MAGA1_HUMAN)
KNLEYVIKV

SEQ ID NO: 42200 - protein, 9 aa, Artificial Sequence
  Description of Artificial Sequence: Synthetic peptide
  Seed: EYVIKVSAR (MAGA1_HUMAN)
ESVIKVSAK

SEQ ID NO: 42201 - protein, 9 aa, Artificial Sequence
  Description of Artificial Sequence: Synthetic peptide
  Seed: EADPTGHSY (MAGA1_HUMAN)
EQDPTGHSM

SEQ ID NO: 42202 - protein, 9 aa, Artificial Sequence
  Description of Artificial Sequence: Synthetic peptide
  Seed: IAMEGGHAP (MAGA1_HUMAN)
IVMEGGHAY

SEQ ID NO: 42203 - protein, 10 aa, Artificial Sequence
  Description of Artificial Sequence: Synthetic peptide
  Seed: KVADLVGFLL (MAGA1_HUMAN)
KLADLVGFLK

SEQ ID NO: 42204 - protein, 11 aa, Artificial Sequence
  Description of Artificial Sequence: Synthetic peptide
  Seed: FLWGPRALAET (MAGA1_HUMAN)
FQWGPRALAEI

SEQ ID NO: 42205 - protein, 11 aa, Artificial Sequence
  Description of Artificial Sequence: Synthetic peptide
  Seed: SAFPTTINFTR (MAGA1_HUMAN)
SMFPTTINFTR

SEQ ID NO: 42206 - protein, 9 aa, Artificial Sequence
  Description of Artificial Sequence: Synthetic peptide
  Seed: KASESLQLV (MAGA1_HUMAN)
KMSESLQLT

SEQ ID NO: 42207 - protein, 9 aa, Artificial Sequence
  Description of Artificial Sequence: Synthetic peptide
  Seed: SAFPTTINF (MAGA1_HUMAN)
SYFPTTINI

SEQ ID NO: 42208 - protein, 8 aa, Artificial Sequence
  Description of Artificial Sequence: Synthetic peptide
  Seed: SESLQLVF (MAGA1_HUMAN)
SESLQLVL

SEQ ID NO: 42209 - protein, 11 aa, Artificial Sequence
  Description of Artificial Sequence: Synthetic peptide
  Seed: YEFLWGPRALA (MAGA1_HUMAN)
YLFLWGPRALV

SEQ ID NO: 42210 - protein, 10 aa, Artificial Sequence
  Description of Artificial Sequence: Synthetic peptide
  Seed: EALGLVCVQA (MAGA1_HUMAN)
ETLGLVCVQI

SEQ ID NO: 42211 - protein, 9 aa, Artificial Sequence
  Description of Artificial Sequence: Synthetic peptide
  Seed: CILESLFRA (MAGA1_HUMAN)
CQLESLFRV

SEQ ID NO: 42212 - protein, 9 aa, Artificial Sequence
  Description of Artificial Sequence: Synthetic peptide
  Seed: TSYVKVLEY (MAGA1_HUMAN)
TRYVKVLEY

SEQ ID NO: 42213 - protein, 11 aa, Artificial Sequence
  Description of Artificial Sequence: Synthetic peptide
  Seed: STDPPQSPQGA (MAGA1_HUMAN)
SIDPPQSPQGM

SEQ ID NO: 42214 - protein, 9 aa, Artificial Sequence
  Description of Artificial Sequence: Synthetic peptide
  Seed: EADPTGHSY (MAGA1_HUMAN)
EPDPTGHSF

SEQ ID NO: 42215 - protein, 9 aa, Artificial Sequence
  Description of Artificial Sequence: Synthetic peptide
  Seed: RVRFFFPSL (MAGA1_HUMAN)
RLRFFFPSA

SEQ ID NO: 42216 - protein, 9 aa, Artificial Sequence
  Description of Artificial Sequence: Synthetic peptide
  Seed: CILESLFRA (MAGA1_HUMAN)
CTLESLFRI

SEQ ID NO: 42217 - protein, 10 aa, Artificial Sequence
  Description of Artificial Sequence: Synthetic peptide
  Seed: EIFGKASESL (MAGA1_HUMAN)
EVFGKASESI

SEQ ID NO: 42218 - protein, 10 aa, Artificial Sequence
  Description of Artificial Sequence: Synthetic peptide
  Seed: YEFLWGPRAL (MAGA1_HUMAN)
YQFLWGPRAV

SEQ ID NO: 42219 - protein, 9 aa, Artificial Sequence
  Description of Artificial Sequence: Synthetic peptide
  Seed: STSCILESL (MAGA1_HUMAN)
SISCILESY

SEQ ID NO: 42220 - protein, 9 aa, Artificial Sequence
  Description of Artificial Sequence: Synthetic peptide
  Seed: EADPTGHSY (MAGA1_HUMAN)
EGDPTGHSF

SEQ ID NO: 42221 - protein, 9 aa, Artificial Sequence
  Description of Artificial Sequence: Synthetic peptide
  Seed: QSPQGASAF (MAGA1_HUMAN)
QPPQGASAF

SEQ ID NO: 42222 - protein, 9 aa, Artificial Sequence
  Description of Artificial Sequence: Synthetic peptide
  Seed: ATSSSSPLV (MAGA1_HUMAN)
AVSSSSPLY

SEQ ID NO: 42223 - protein, 9 aa, Artificial Sequence
  Description of Artificial Sequence: Synthetic peptide
  Seed: GLVCVQAAT (MAGA1_HUMAN)
GMVCVQAAA

SEQ ID NO: 42224 - protein, 9 aa, Artificial Sequence
  Description of Artificial Sequence: Synthetic peptide
  Seed: ETSYVKVLE (MAGA1_HUMAN)
EFSYVKVLK

SEQ ID NO: 42225 - protein, 9 aa, Artificial Sequence
  Description of Artificial Sequence: Synthetic peptide
  Seed: LTQDLVQEK (MAGA1_HUMAN)
LFQDLVQEM

SEQ ID NO: 42226 - protein, 9 aa, Artificial Sequence
  Description of Artificial Sequence: Synthetic peptide
  Seed: EELSVMEVY (MAGA1_HUMAN)
EMLSVMEVY

SEQ ID NO: 42227 - protein, 9 aa, Artificial Sequence
  Description of Artificial Sequence: Synthetic peptide
  Seed: FFFPSLREA (MAGA1_HUMAN)
FNFPSLREY

SEQ ID NO: 42228 - protein, 9 aa, Artificial Sequence
  Description of Artificial Sequence: Synthetic peptide
  Seed: TSSSSPLVL (MAGA1_HUMAN)
TQSSSPLVM

SEQ ID NO: 42229 - protein, 8 aa, Artificial Sequence
  Description of Artificial Sequence: Synthetic peptide
  Seed: YEFLWGPR (MAGA1_HUMAN)
YEFLWGPW

SEQ ID NO: 42230 - protein, 9 aa, Artificial Sequence
  Description of Artificial Sequence: Synthetic peptide
  Seed: VRFFFPSLR (MAGA1_HUMAN)
VIFFFPSLR

SEQ ID NO: 42231 - protein, 9 aa, Artificial Sequence
  Description of Artificial Sequence: Synthetic peptide
  Seed: QIMPKTGFL (MAGA1_HUMAN)
QTMPKTGFY

SEQ ID NO: 42232 - protein, 9 aa, Artificial Sequence
  Description of Artificial Sequence: Synthetic peptide
  Seed: RAREPVTKA (MAGA1_HUMAN)
RYREPVTKV

SEQ ID NO: 42233 - protein, 11 aa, Artificial Sequence
  Description of Artificial Sequence: Synthetic peptide
  Seed: RQVPDSDPARY (MAGA1_HUMAN)
REVPDSDPARY

SEQ ID NO: 42234 - protein, 9 aa, Artificial Sequence
  Description of Artificial Sequence: Synthetic peptide
  Seed: FFFPSLREA (MAGA1_HUMAN)
FIFPSLREM

SEQ ID NO: 42235 - protein, 10 aa, Artificial Sequence
  Description of Artificial Sequence: Synthetic peptide
  Seed: KYRAREPVTK (MAGA1_HUMAN)
KVRAREPVTK

SEQ ID NO: 42236 - protein, 10 aa, Artificial Sequence
  Description of Artificial Sequence: Synthetic peptide
  Seed: LVLGTLEEVP (MAGA1_HUMAN)
LVLGTLEEVV

SEQ ID NO: 42237 - protein, 9 aa, Artificial Sequence
  Description of Artificial Sequence: Synthetic peptide
  Seed: LKYRAREPV (MAGA1_HUMAN)
LMYRAREPY

SEQ ID NO: 42238 - protein, 9 aa, Artificial Sequence
  Description of Artificial Sequence: Synthetic peptide
  Seed: LKYRAREPV (MAGA1_HUMAN)
LTYRAREPF

SEQ ID NO: 42239 - protein, 10 aa, Artificial Sequence
  Description of Artificial Sequence: Synthetic peptide
  Seed: SAFPTTINFT (MAGA1_HUMAN)
SAFPTTINFM

SEQ ID NO: 42240 - protein, 9 aa, Artificial Sequence
  Description of Artificial Sequence: Synthetic peptide
  Seed: TSYVKVLEY (MAGA1_HUMAN)
TAYVKVLEK

SEQ ID NO: 42241 - protein, 10 aa, Artificial Sequence
  Description of Artificial Sequence: Synthetic peptide
  Seed: RVRFFFPSLR (MAGA1_HUMAN)
RTRFFFPSLW

SEQ ID NO: 42242 - protein, 9 aa, Artificial Sequence
  Description of Artificial Sequence: Synthetic peptide
  Seed: HSAYGEPRK (MAGA1_HUMAN)
HAAYGEPRR

SEQ ID NO: 42243 - protein, 10 aa, Artificial Sequence
  Description of Artificial Sequence: Synthetic peptide
  Seed: SCILESLFRA (MAGA1_HUMAN)
SLILESLFRM

SEQ ID NO: 42244 - protein, 9 aa, Artificial Sequence
  Description of Artificial Sequence: Synthetic peptide
  Seed: VQAATSSSS (MAGA1_HUMAN)
VQAATSSSW

SEQ ID NO: 42245 - protein, 9 aa, Artificial Sequence
  Description of Artificial Sequence: Synthetic peptide
  Seed: DLVGFLLLK (MAGA1_HUMAN)
DIVGFLLLR

SEQ ID NO: 42246 - protein, 9 aa, Artificial Sequence
  Description of Artificial Sequence: Synthetic peptide
  Seed: AQQEALGLV (MAGA1_HUMAN)
AEQEALGLV

SEQ ID NO: 42247 - protein, 10 aa, Artificial Sequence
  Description of Artificial Sequence: Synthetic peptide
  Seed: ESLFRAVITK (MAGA1_HUMAN)
EPLFRAVITR

SEQ ID NO: 42248 - protein, 9 aa, Artificial Sequence
  Description of Artificial Sequence: Synthetic peptide
  Seed: EADPTGHSY (MAGA1_HUMAN)
EMDPTGHSM

SEQ ID NO: 42249 - protein, 11 aa, Artificial Sequence
  Description of Artificial Sequence: Synthetic peptide
  Seed: EVYDGREHSAY (MAGA1_HUMAN)
EVYDGREHSAW

SEQ ID NO: 42250 - protein, 11 aa, Artificial Sequence
  Description of Artificial Sequence: Synthetic peptide
  Seed: EVYDGREHSAY (MAGA1_HUMAN)
EQYDGREHSAY

SEQ ID NO: 42251 - protein, 9 aa, Artificial Sequence
  Description of Artificial Sequence: Synthetic peptide
  Seed: RVRFFFPSL (MAGA1_HUMAN)
RARFFFPSW

SEQ ID NO: 42252 - protein, 10 aa, Artificial Sequence
  Description of Artificial Sequence: Synthetic peptide
  Seed: TSYVKVLEYV (MAGA1_HUMAN)
TKYVKVLEYW

SEQ ID NO: 42253 - protein, 11 aa, Artificial Sequence
  Description of Artificial Sequence: Synthetic peptide
  Seed: SSSSPLVLGTL (MAGA1_HUMAN)
SSSSPLVLGTF

SEQ ID NO: 42254 - protein, 9 aa, Artificial Sequence
  Description of Artificial Sequence: Synthetic peptide
  Seed: KVADLVGFL (MAGA1_HUMAN)
KIADLVGFF

SEQ ID NO: 42255 - protein, 11 aa, Artificial Sequence
  Description of Artificial Sequence: Synthetic peptide
  Seed: AEMLESVIKNY (MAGA1_HUMAN)
AEMLESVIKNI

SEQ ID NO: 42256 - protein, 10 aa, Artificial Sequence
  Description of Artificial Sequence: Synthetic peptide
  Seed: ATSSSSPLVL (MAGA1_HUMAN)
AASSSSPLVW

SEQ ID NO: 42257 - protein, 10 aa, Artificial Sequence
  Description of Artificial Sequence: Synthetic peptide
  Seed: RVRFFFPSLR (MAGA1_HUMAN)
RVRFFFPSLL

SEQ ID NO: 42258 - protein, 10 aa, Artificial Sequence
  Description of Artificial Sequence: Synthetic peptide
  Seed: LVFGIDVKEA (MAGA1_HUMAN)
LLFGIDVKEL

SEQ ID NO: 42259 - protein, 9 aa, Artificial Sequence
  Description of Artificial Sequence: Synthetic peptide
  Seed: SVMEVYDGR (MAGA1_HUMAN)
SLMEVYDGR

SEQ ID NO: 42260 - protein, 10 aa, Artificial Sequence
  Description of Artificial Sequence: Synthetic peptide
  Seed: EHSAYGEPRK (MAGA1_HUMAN)
EVSAYGEPRR

SEQ ID NO: 42261 - protein, 9 aa, Artificial Sequence
  Description of Artificial Sequence: Synthetic peptide
  Seed: TSSSSPLVL (MAGA1_HUMAN)
TVSSSPLVL

SEQ ID NO: 42262 - protein, 9 aa, Artificial Sequence
  Description of Artificial Sequence: Synthetic peptide
  Seed: LFRAVITKK (MAGA1_HUMAN)
LWRAVITKR

SEQ ID NO: 42263 - protein, 9 aa, Artificial Sequence
  Description of Artificial Sequence: Synthetic peptide
  Seed: RALAETSYV (MAGA1_HUMAN)
RILAETSYL

SEQ ID NO: 42264 - protein, 9 aa, Artificial Sequence
  Description of Artificial Sequence: Synthetic peptide
  Seed: KVADLVGFL (MAGA1_HUMAN)
KIADLVGFL

SEQ ID NO: 42265 - protein, 11 aa, Artificial Sequence
  Description of Artificial Sequence: Synthetic peptide
  Seed: YEFLWGPRALA (MAGA1_HUMAN)
YIFLWGPRALL

SEQ ID NO: 42266 - protein, 9 aa, Artificial Sequence
  Description of Artificial Sequence: Synthetic peptide
  Seed: SARVRFFFP (MAGA1_HUMAN)
SIRVRFFFY

SEQ ID NO: 42267 - protein, 11 aa, Artificial Sequence
  Description of Artificial Sequence: Synthetic peptide
  Seed: KVSARVRFFFP (MAGA1_HUMAN)
KQSARVRFFFK

SEQ ID NO: 42268 - protein, 9 aa, Artificial Sequence
  Description of Artificial Sequence: Synthetic peptide
  Seed: LTQDLVQEK (MAGA1_HUMAN)
LRQDLVQEI

SEQ ID NO: 42269 - protein, 10 aa, Artificial Sequence
  Description of Artificial Sequence: Synthetic peptide
  Seed: KNYKHCFPEI (MAGA1_HUMAN)
KFYKHCFPEL

SEQ ID NO: 42270 - protein, 11 aa, Artificial Sequence
  Description of Artificial Sequence: Synthetic peptide
  Seed: FLWGPRALAET (MAGA1_HUMAN)
FIWGPRALAEI

SEQ ID NO: 42271 - protein, 9 aa, Artificial Sequence
  Description of Artificial Sequence: Synthetic peptide
  Seed: RVRFFFPSL (MAGA1_HUMAN)
RYRFFFPSS

SEQ ID NO: 42272 - protein, 11 aa, Artificial Sequence
  Description of Artificial Sequence: Synthetic peptide
  Seed: SYDGLLGDNQI (MAGA1_HUMAN)
SYDGLLGDNQF

SEQ ID NO: 42273 - protein, 9 aa, Artificial Sequence
  Description of Artificial Sequence: Synthetic peptide
  Seed: EYVIKVSAR (MAGA1_HUMAN)
ETVIKVSAR

SEQ ID NO: 42274 - protein, 9 aa, Artificial Sequence
  Description of Artificial Sequence: Synthetic peptide
  Seed: RVRFFFPSL (MAGA1_HUMAN)
RVRFFFPSW

SEQ ID NO: 42275 - protein, 9 aa, Artificial Sequence
  Description of Artificial Sequence: Synthetic peptide
  Seed: KVSARVRFF (MAGA1_HUMAN)
KTSARVRFS

SEQ ID NO: 42276 - protein, 9 aa, Artificial Sequence
  Description of Artificial Sequence: Synthetic peptide
  Seed: MLESVIKNY (MAGA1_HUMAN)
MTESVIKNY

SEQ ID NO: 42277 - protein, 11 aa, Artificial Sequence
  Description of Artificial Sequence: Synthetic peptide
  Seed: IKVSARVRFFF (MAGA1_HUMAN)
IKVSARVRFFW

SEQ ID NO: 42278 - protein, 9 aa, Artificial Sequence
  Description of Artificial Sequence: Synthetic peptide
  Seed: LKYRAREPV (MAGA1_HUMAN)
LEYRAREPY

SEQ ID NO: 42279 - protein, 9 aa, Artificial Sequence
  Description of Artificial Sequence: Synthetic peptide
  Seed: ADLVGFLLL (MAGA1_HUMAN)
AELVGFLLF

SEQ ID NO: 42280 - protein, 9 aa, Artificial Sequence
  Description of Artificial Sequence: Synthetic peptide
  Seed: HSYVLVTCL (MAGA1_HUMAN)
HMYVLVTCM

SEQ ID NO: 42281 - protein, 11 aa, Artificial Sequence
  Description of Artificial Sequence: Synthetic peptide
  Seed: EMLESVIKNYK (MAGA1_HUMAN)
EVLESVIKNYK

SEQ ID NO: 42282 - protein, 9 aa, Artificial Sequence
  Description of Artificial Sequence: Synthetic peptide
  Seed: NQIMPKTGF (MAGA1_HUMAN)
NVIMPKTGY

SEQ ID NO: 42283 - protein, 8 aa, Artificial Sequence
  Description of Artificial Sequence: Synthetic peptide
  Seed: AYGEPRKL (MAGA1_HUMAN)
AFGEPRKL

SEQ ID NO: 42284 - protein, 9 aa, Artificial Sequence
  Description of Artificial Sequence: Synthetic peptide
  Seed: GASAFPTTI (MAGA1_HUMAN)
GQSAFPTTI

SEQ ID NO: 42285 - protein, 11 aa, Artificial Sequence
  Description of Artificial Sequence: Synthetic peptide
  Seed: SSSSPLVLGTL (MAGA1_HUMAN)
STSSPLVLGTF

SEQ ID NO: 42286 - protein, 10 aa, Artificial Sequence
  Description of Artificial Sequence: Synthetic peptide
  Seed: RVRFFFPSLR (MAGA1_HUMAN)
RNRFFFPSLY

SEQ ID NO: 42287 - protein, 10 aa, Artificial Sequence
  Description of Artificial Sequence: Synthetic peptide
  Seed: EIFGKASESL (MAGA1_HUMAN)
EVFGKASESW

SEQ ID NO: 42288 - protein, 9 aa, Artificial Sequence
  Description of Artificial Sequence: Synthetic peptide
  Seed: RVRFFFPSL (MAGA1_HUMAN)
RGRFFFPST

SEQ ID NO: 42289 - protein, 9 aa, Artificial Sequence
  Description of Artificial Sequence: Synthetic peptide
  Seed: FPTTINFTR (MAGA1_HUMAN)
FTTTINFTR

SEQ ID NO: 42290 - protein, 9 aa, Artificial Sequence
  Description of Artificial Sequence: Synthetic peptide
  Seed: AATSSSSPL (MAGA1_HUMAN)
ASTSSSSPY

SEQ ID NO: 42291 - protein, 10 aa, Artificial Sequence
  Description of Artificial Sequence: Synthetic peptide
  Seed: TSYVKVLEYV (MAGA1_HUMAN)
TYYVKVLEYW

SEQ ID NO: 42292 - protein, 10 aa, Artificial Sequence
  Description of Artificial Sequence: Synthetic peptide
  Seed: RVRFFFPSLR (MAGA1_HUMAN)
RFRFFFPSLS

SEQ ID NO: 42293 - protein, 9 aa, Artificial Sequence
  Description of Artificial Sequence: Synthetic peptide
  Seed: REPVTKAEM (MAGA1_HUMAN)
RVPVTKAEY

SEQ ID NO: 42294 - protein, 9 aa, Artificial Sequence
  Description of Artificial Sequence: Synthetic peptide
  Seed: LESLFRAVI (MAGA1_HUMAN)
LMSLFRAVF

SEQ ID NO: 42295 - protein, 9 aa, Artificial Sequence
  Description of Artificial Sequence: Synthetic peptide
  Seed: SSPLVLGTL (MAGA1_HUMAN)
SIPLVLGTL

SEQ ID NO: 42296 - protein, 9 aa, Artificial Sequence
  Description of Artificial Sequence: Synthetic peptide
  Seed: FFFPSLREA (MAGA1_HUMAN)
FYFPSLREF

SEQ ID NO: 42297 - protein, 10 aa, Artificial Sequence
  Description of Artificial Sequence: Synthetic peptide
  Seed: TSYVKVLEYV (MAGA1_HUMAN)
TDYVKVLEYW

SEQ ID NO: 42298 - protein, 9 aa, Artificial Sequence
  Description of Artificial Sequence: Synthetic peptide
  Seed: VSARVRFFF (MAGA1_HUMAN)
VLARVRFFF

SEQ ID NO: 42299 - protein, 11 aa, Artificial Sequence
  Description of Artificial Sequence: Synthetic peptide
  Seed: KVADLVGFLLL (MAGA1_HUMAN)
KMADLVGFLLH

SEQ ID NO: 42300 - protein, 11 aa, Artificial Sequence
  Description of Artificial Sequence: Synthetic peptide
  Seed: STDPPQSPQGA (MAGA1_HUMAN)
STDPPQSPQGL

SEQ ID NO: 42301 - protein, 9 aa, Artificial Sequence
  Description of Artificial Sequence: Synthetic peptide
  Seed: VYDGREHSA (MAGA1_HUMAN)
VADGREHSI

SEQ ID NO: 42302 - protein, 9 aa, Artificial Sequence
  Description of Artificial Sequence: Synthetic peptide
  Seed: TQDLVQEKY (MAGA1_HUMAN)
TWDLVQEKL

SEQ ID NO: 42303 - protein, 9 aa, Artificial Sequence
  Description of Artificial Sequence: Synthetic peptide
  Seed: ATSSSSPLV (MAGA1_HUMAN)
AASSSSPLW

SEQ ID NO: 42304 - protein, 8 aa, Artificial Sequence
  Description of Artificial Sequence: Synthetic peptide
  Seed: RAVITKKV (MAGA1_HUMAN)
RQVITKKI

SEQ ID NO: 42305 - protein, 11 aa, Artificial Sequence
  Description of Artificial Sequence: Synthetic peptide
  Seed: EIFGKASESLQ (MAGA1_HUMAN)
EIFGKASESLR

SEQ ID NO: 42306 - protein, 10 aa, Artificial Sequence
  Description of Artificial Sequence: Synthetic peptide
  Seed: SAFPTTINFT (MAGA1_HUMAN)
SIFPTTINFV

SEQ ID NO: 42307 - protein, 10 aa, Artificial Sequence
  Description of Artificial Sequence: Synthetic peptide
  Seed: SARVRFFFPS (MAGA1_HUMAN)
SNRVRFFFPK

SEQ ID NO: 42308 - protein, 10 aa, Artificial Sequence
  Description of Artificial Sequence: Synthetic peptide
  Seed: EIFGKASESL (MAGA1_HUMAN)
EVFGKASESV

SEQ ID NO: 42309 - protein, 10 aa, Artificial Sequence
  Description of Artificial Sequence: Synthetic peptide
  Seed: ARVRFFFPSL (MAGA1_HUMAN)
ACVRFFFPSA

SEQ ID NO: 42310 - protein, 9 aa, Artificial Sequence
  Description of Artificial Sequence: Synthetic peptide
  Seed: RVRFFFPSL (MAGA1_HUMAN)
RVRFFFPSP

SEQ ID NO: 42311 - protein, 10 aa, Artificial Sequence
  Description of Artificial Sequence: Synthetic peptide
  Seed: SARVRFFFPS (MAGA1_HUMAN)
SDRVRFFFPR

SEQ ID NO: 42312 - protein, 9 aa, Artificial Sequence
  Description of Artificial Sequence: Synthetic peptide
  Seed: SAFPTTINF (MAGA1_HUMAN)
SVFPTTINY

SEQ ID NO: 42313 - protein, 9 aa, Artificial Sequence
  Description of Artificial Sequence: Synthetic peptide
  Seed: TSSSSPLVL (MAGA1_HUMAN)
TLSSSPLVF

SEQ ID NO: 42314 - protein, 9 aa, Artificial Sequence
  Description of Artificial Sequence: Synthetic peptide
  Seed: LGDNQIMPK (MAGA1_HUMAN)
LTDNQIMPM

SEQ ID NO: 42315 - protein, 10 aa, Artificial Sequence
  Description of Artificial Sequence: Synthetic peptide
  Seed: RVRFFFPSLR (MAGA1_HUMAN)
RKRFFFPSLR

SEQ ID NO: 42316 - protein, 9 aa, Artificial Sequence
  Description of Artificial Sequence: Synthetic peptide
  Seed: QSPQGASAF (MAGA1_HUMAN)
QAPQGASAR

SEQ ID NO: 42317 - protein, 9 aa, Artificial Sequence
  Description of Artificial Sequence: Synthetic peptide
  Seed: SARVRFFFP (MAGA1_HUMAN)
SWRVRFFFI

SEQ ID NO: 42318 - protein, 11 aa, Artificial Sequence
  Description of Artificial Sequence: Synthetic peptide
  Seed: TKKVADLVGFL (MAGA1_HUMAN)
TGKVADLVGFV

SEQ ID NO: 42319 - protein, 10 aa, Artificial Sequence
  Description of Artificial Sequence: Synthetic peptide
  Seed: SCILESLFRA (MAGA1_HUMAN)
SAILESLFRI

SEQ ID NO: 42320 - protein, 11 aa, Artificial Sequence
  Description of Artificial Sequence: Synthetic peptide
  Seed: SPQGASAFPTT (MAGA1_HUMAN)
SPQGASAFPTV

SEQ ID NO: 42321 - protein, 9 aa, Artificial Sequence
  Description of Artificial Sequence: Synthetic peptide
  Seed: KTGFLIIVL (MAGA1_HUMAN)
KQGFLIIVL

SEQ ID NO: 42322 - protein, 9 aa, Artificial Sequence
  Description of Artificial Sequence: Synthetic peptide
  Seed: FFFPSLREA (MAGA1_HUMAN)
FKFPSLREI

SEQ ID NO: 42323 - protein, 11 aa, Artificial Sequence
  Description of Artificial Sequence: Synthetic peptide
  Seed: KVSARVRFFFP (MAGA1_HUMAN)
KRSARVRFFFK

SEQ ID NO: 42324 - protein, 9 aa, Artificial Sequence
  Description of Artificial Sequence: Synthetic peptide
  Seed: KVADLVGFL (MAGA1_HUMAN)
KIADLVGFR

SEQ ID NO: 42325 - protein, 9 aa, Artificial Sequence
  Description of Artificial Sequence: Synthetic peptide
  Seed: LESLFRAVI (MAGA1_HUMAN)
LVSLFRAVF

SEQ ID NO: 42326 - protein, 10 aa, Artificial Sequence
  Description of Artificial Sequence: Synthetic peptide
  Seed: REEEGPSTSC (MAGA1_HUMAN)
RQEEGPSTSW

SEQ ID NO: 42327 - protein, 9 aa, Artificial Sequence
  Description of Artificial Sequence: Synthetic peptide
  Seed: ESLQLVFGI (MAGA1_HUMAN)
ETLQLVFGM

SEQ ID NO: 42328 - protein, 10 aa, Artificial Sequence
  Description of Artificial Sequence: Synthetic peptide
  Seed: SARVRFFFPS (MAGA1_HUMAN)
SSRVRFFFPF

SEQ ID NO: 42329 - protein, 11 aa, Artificial Sequence
  Description of Artificial Sequence: Synthetic peptide
  Seed: KVLEYVIKVSA (MAGA1_HUMAN)
KMLEYVIKVST

SEQ ID NO: 42330 - protein, 9 aa, Artificial Sequence
  Description of Artificial Sequence: Synthetic peptide
  Seed: SYVKVLEYV (MAGA1_HUMAN)
SFVKVLEYM

SEQ ID NO: 42331 - protein, 11 aa, Artificial Sequence
  Description of Artificial Sequence: Synthetic peptide
  Seed: REEEGPSTSCI (MAGA1_HUMAN)
REEEGPSTSCA

SEQ ID NO: 42332 - protein, 10 aa, Artificial Sequence
  Description of Artificial Sequence: Synthetic peptide
  Seed: FPSLREAALR (MAGA1_HUMAN)
FYSLREAALR

SEQ ID NO: 42333 - protein, 11 aa, Artificial Sequence
  Description of Artificial Sequence: Synthetic peptide
  Seed: STSCILESLFR (MAGA1_HUMAN)
SQSCILESLFK

SEQ ID NO: 42334 - protein, 10 aa, Artificial Sequence
  Description of Artificial Sequence: Synthetic peptide
  Seed: TSYVKVLEYV (MAGA1_HUMAN)
TKYVKVLEYI

SEQ ID NO: 42335 - protein, 9 aa, Artificial Sequence
  Description of Artificial Sequence: Synthetic peptide
  Seed: SAYGEPRKL (MAGA1_HUMAN)
SFYGEPRKY

SEQ ID NO: 42336 - protein, 9 aa, Artificial Sequence
  Description of Artificial Sequence: Synthetic peptide
  Seed: FLWGPRALA (MAGA1_HUMAN)
FQWGPRALA

SEQ ID NO: 42337 - protein, 9 aa, Artificial Sequence
  Description of Artificial Sequence: Synthetic peptide
  Seed: ETSYVKVLE (MAGA1_HUMAN)
ENSYVKVLR

SEQ ID NO: 42338 - protein, 10 aa, Artificial Sequence
  Description of Artificial Sequence: Synthetic peptide
  Seed: SARVRFFFPS (MAGA1_HUMAN)
SRRVRFFFPM

SEQ ID NO: 42339 - protein, 11 aa, Artificial Sequence
  Description of Artificial Sequence: Synthetic peptide
  Seed: YEFLWGPRALA (MAGA1_HUMAN)
YLFLWGPRALM

SEQ ID NO: 42340 - protein, 10 aa, Artificial Sequence
  Description of Artificial Sequence: Synthetic peptide
  Seed: RVRFFFPSLR (MAGA1_HUMAN)
RLRFFFPSLK

SEQ ID NO: 42341 - protein, 9 aa, Artificial Sequence
  Description of Artificial Sequence: Synthetic peptide
  Seed: FFFPSLREA (MAGA1_HUMAN)
FMFPSLREC

SEQ ID NO: 42342 - protein, 10 aa, Artificial Sequence
  Description of Artificial Sequence: Synthetic peptide
  Seed: TSYVKVLEYV (MAGA1_HUMAN)
TEYVKVLEYL

SEQ ID NO: 42343 - protein, 9 aa, Artificial Sequence
  Description of Artificial Sequence: Synthetic peptide
  Seed: SSPLVLGTL (MAGA1_HUMAN)
SRPLVLGTL

SEQ ID NO: 42344 - protein, 9 aa, Artificial Sequence
  Description of Artificial Sequence: Synthetic peptide
  Seed: IKVSARVRF (MAGA1_HUMAN)
IHVSARVRY

SEQ ID NO: 42345 - protein, 10 aa, Artificial Sequence
  Description of Artificial Sequence: Synthetic peptide
  Seed: SARVRFFFPS (MAGA1_HUMAN)
SGRVRFFFPR

SEQ ID NO: 42346 - protein, 9 aa, Artificial Sequence
  Description of Artificial Sequence: Synthetic peptide
  Seed: LQLVFGIDV (MAGA1_HUMAN)
LQLVFGIDF

SEQ ID NO: 42347 - protein, 10 aa, Artificial Sequence
  Description of Artificial Sequence: Synthetic peptide
  Seed: SVMEVYDGRE (MAGA1_HUMAN)
STMEVYDGRR

SEQ ID NO: 42348 - protein, 9 aa, Artificial Sequence
  Description of Artificial Sequence: Synthetic peptide
  Seed: RQVPDSDPA (MAGA1_HUMAN)
RVVPDSDPL

SEQ ID NO: 42349 - protein, 8 aa, Artificial Sequence
  Description of Artificial Sequence: Synthetic peptide
  Seed: VADLVGFL (MAGA1_HUMAN)
VFDLVGFM

SEQ ID NO: 42350 - protein, 10 aa, Artificial Sequence
  Description of Artificial Sequence: Synthetic peptide
  Seed: DLVGFLLLKY (MAGA1_HUMAN)
DIVGFLLLKK

SEQ ID NO: 42351 - protein, 10 aa, Artificial Sequence
  Description of Artificial Sequence: Synthetic peptide
  Seed: ETSYVKVLEY (MAGA1_HUMAN)
ETSYVKVLEK

SEQ ID NO: 42352 - protein, 10 aa, Artificial Sequence
  Description of Artificial Sequence: Synthetic peptide
  Seed: KVSARVRFFF (MAGA1_HUMAN)
KFSARVRFFW

SEQ ID NO: 42353 - protein, 9 aa, Artificial Sequence
  Description of Artificial Sequence: Synthetic peptide
  Seed: IAMEGGHAP (MAGA1_HUMAN)
IPMEGGHAM

SEQ ID NO: 42354 - protein, 11 aa, Artificial Sequence
  Description of Artificial Sequence: Synthetic peptide
  Seed: FLWGPRALAET (MAGA1_HUMAN)
FLWGPRALAEA

SEQ ID NO: 42355 - protein, 10 aa, Artificial Sequence
  Description of Artificial Sequence: Synthetic peptide
  Seed: RVRFFFPSLR (MAGA1_HUMAN)
RGRFFFPSLV

SEQ ID NO: 42356 - protein, 9 aa, Artificial Sequence
  Description of Artificial Sequence: Synthetic peptide
  Seed: KVLEYVIKV (MAGA1_HUMAN)
KVLEYVIKI

SEQ ID NO: 42357 - protein, 9 aa, Artificial Sequence
  Description of Artificial Sequence: Synthetic peptide
  Seed: STSCILESL (MAGA1_HUMAN)
SASCILESA

SEQ ID NO: 42358 - protein, 9 aa, Artificial Sequence
  Description of Artificial Sequence: Synthetic peptide
  Seed: VYDGREHSA (MAGA1_HUMAN)
VGDGREHSV

SEQ ID NO: 42359 - protein, 10 aa, Artificial Sequence
  Description of Artificial Sequence: Synthetic peptide
  Seed: RVRFFFPSLR (MAGA1_HUMAN)
RMRFFFPSLA

SEQ ID NO: 42360 - protein, 9 aa, Artificial Sequence
  Description of Artificial Sequence: Synthetic peptide
  Seed: FFPSLREAA (MAGA1_HUMAN)
FFPSLREAY

SEQ ID NO: 42361 - protein, 9 aa, Artificial Sequence
  Description of Artificial Sequence: Synthetic peptide
  Seed: RVRFFFPSL (MAGA1_HUMAN)
RFRFFFPSN

SEQ ID NO: 42362 - protein, 11 aa, Artificial Sequence
  Description of Artificial Sequence: Synthetic peptide
  Seed: STSCILESLFR (MAGA1_HUMAN)
SLSCILESLFK

SEQ ID NO: 42363 - protein, 8 aa, Artificial Sequence
  Description of Artificial Sequence: Synthetic peptide
  Seed: ASAFPTTI (MAGA1_HUMAN)
AAAFPTTY

SEQ ID NO: 42364 - protein, 9 aa, Artificial Sequence
  Description of Artificial Sequence: Synthetic peptide
  Seed: AQQEALGLV (MAGA1_HUMAN)
AEQEALGLM

SEQ ID NO: 42365 - protein, 10 aa, Artificial Sequence
  Description of Artificial Sequence: Synthetic peptide
  Seed: KEADPTGHSY (MAGA1_HUMAN)
KIADPTGHSY

SEQ ID NO: 42366 - protein, 10 aa, Artificial Sequence
  Description of Artificial Sequence: Synthetic peptide
  Seed: RVRFFFPSLR (MAGA1_HUMAN)
RRRFFFPSLM

SEQ ID NO: 42367 - protein, 9 aa, Artificial Sequence
  Description of Artificial Sequence: Synthetic peptide
  Seed: RQVPDSDPA (MAGA1_HUMAN)
RIVPDSDPL

SEQ ID NO: 42368 - protein, 9 aa, Artificial Sequence
  Description of Artificial Sequence: Synthetic peptide
  Seed: HCFPEIFGK (MAGA1_HUMAN)
HAFPEIFGR

SEQ ID NO: 42369 - protein, 10 aa, Artificial Sequence
  Description of Artificial Sequence: Synthetic peptide
  Seed: FFPSLREAAL (MAGA1_HUMAN)
FCPSLREAAF

SEQ ID NO: 42370 - protein, 9 aa, Artificial Sequence
  Description of Artificial Sequence: Synthetic peptide
  Seed: VSARVRFFF (MAGA1_HUMAN)
VQARVRFFF

SEQ ID NO: 42371 - protein, 11 aa, Artificial Sequence
  Description of Artificial Sequence: Synthetic peptide
  Seed: SARVRFFFPSL (MAGA1_HUMAN)
STRVRFFFPSV

SEQ ID NO: 42372 - protein, 11 aa, Artificial Sequence
  Description of Artificial Sequence: Synthetic peptide
  Seed: YEFLWGPRALA (MAGA1_HUMAN)
YMFLWGPRALL

SEQ ID NO: 42373 - protein, 9 aa, Artificial Sequence
  Description of Artificial Sequence: Synthetic peptide
  Seed: LGDNQIMPK (MAGA1_HUMAN)
LADNQIMPM

SEQ ID NO: 42374 - protein, 9 aa, Artificial Sequence
  Description of Artificial Sequence: Synthetic peptide
  Seed: KVLEYVIKV (MAGA1_HUMAN)
KALEYVIKK

SEQ ID NO: 42375 - protein, 10 aa, Artificial Sequence
  Description of Artificial Sequence: Synthetic peptide
  Seed: TSCILESLFR (MAGA1_HUMAN)
TACILESLFR

SEQ ID NO: 42376 - protein, 9 aa, Artificial Sequence
  Description of Artificial Sequence: Synthetic peptide
  Seed: LKYRAREPV (MAGA1_HUMAN)
LIYRAREPM

SEQ ID NO: 42377 - protein, 9 aa, Artificial Sequence
  Description of Artificial Sequence: Synthetic peptide
  Seed: FFFPSLREA (MAGA1_HUMAN)
FCFPSLREI

SEQ ID NO: 42378 - protein, 9 aa, Artificial Sequence
  Description of Artificial Sequence: Synthetic peptide
  Seed: LVTCLGLSY (MAGA1_HUMAN)
LATCLGLSY

SEQ ID NO: 42379 - protein, 9 aa, Artificial Sequence
  Description of Artificial Sequence: Synthetic peptide
  Seed: GASAFPTTI (MAGA1_HUMAN)
GISAFPTTL

SEQ ID NO: 42380 - protein, 10 aa, Artificial Sequence
  Description of Artificial Sequence: Synthetic peptide
  Seed: SAFPTTINFT (MAGA1_HUMAN)
SMFPTTINFL

SEQ ID NO: 42381 - protein, 10 aa, Artificial Sequence
  Description of Artificial Sequence: Synthetic peptide
  Seed: SCILESLFRA (MAGA1_HUMAN)
SMILESLFRA

SEQ ID NO: 42382 - protein, 10 aa, Artificial Sequence
  Description of Artificial Sequence: Synthetic peptide
  Seed: KYRAREPVTK (MAGA1_HUMAN)
KYRAREPVTR

SEQ ID NO: 42383 - protein, 10 aa, Artificial Sequence
  Description of Artificial Sequence: Synthetic peptide
  Seed: SARVRFFFPS (MAGA1_HUMAN)
SQRVRFFFPV

SEQ ID NO: 42384 - protein, 10 aa, Artificial Sequence
  Description of Artificial Sequence: Synthetic peptide
  Seed: YVIKVSARVR (MAGA1_HUMAN)
YAIKVSARVR

SEQ ID NO: 42385 - protein, 11 aa, Artificial Sequence
  Description of Artificial Sequence: Synthetic peptide
  Seed: RALAETSYVKV (MAGA1_HUMAN)
RFLAETSYVKV

SEQ ID NO: 42386 - protein, 11 aa, Artificial Sequence
  Description of Artificial Sequence: Synthetic peptide
  Seed: YEFLWGPRALA (MAGA1_HUMAN)
YSFLWGPRALV

SEQ ID NO: 42387 - protein, 10 aa, Artificial Sequence
  Description of Artificial Sequence: Synthetic peptide
  Seed: IMPKTGFLII (MAGA1_HUMAN)
IWPKTGFLIW

SEQ ID NO: 42388 - protein, 9 aa, Artificial Sequence
  Description of Artificial Sequence: Synthetic peptide
  Seed: YVIKVSARV (MAGA1_HUMAN)
YSIKVSARL

SEQ ID NO: 42389 - protein, 10 aa, Artificial Sequence
  Description of Artificial Sequence: Synthetic peptide
  Seed: SARVRFFFPS (MAGA1_HUMAN)
SLRVRFFFPV

SEQ ID NO: 42390 - protein, 9 aa, Artificial Sequence
  Description of Artificial Sequence: Synthetic peptide
  Seed: ASESLQLVF (MAGA1_HUMAN)
AAESLQLVW

SEQ ID NO: 42391 - protein, 9 aa, Artificial Sequence
  Description of Artificial Sequence: Synthetic peptide
  Seed: RQVPDSDPA (MAGA1_HUMAN)
RLVPDSDPI

SEQ ID NO: 42392 - protein, 9 aa, Artificial Sequence
  Description of Artificial Sequence: Synthetic peptide
  Seed: RVRFFFPSL (MAGA1_HUMAN)
RNRFFFPSG

SEQ ID NO: 42393 - protein, 9 aa, Artificial Sequence
  Description of Artificial Sequence: Synthetic peptide
  Seed: SAYGEPRKL (MAGA1_HUMAN)
SDYGEPRKL

SEQ ID NO: 42394 - protein, 9 aa, Artificial Sequence
  Description of Artificial Sequence: Synthetic peptide
  Seed: TSYVKVLEY (MAGA1_HUMAN)
TTYVKVLEI

SEQ ID NO: 42395 - protein, 8 aa, Artificial Sequence
  Description of Artificial Sequence: Synthetic peptide
  Seed: HSYVLVTC (MAGA1_HUMAN)
HGYVLVTI

SEQ ID NO: 42396 - protein, 9 aa, Artificial Sequence
  Description of Artificial Sequence: Synthetic peptide
  Seed: YKHCFPEIF (MAGA1_HUMAN)
YSHCFPEIM

SEQ ID NO: 42397 - protein, 10 aa, Artificial Sequence
  Description of Artificial Sequence: Synthetic peptide
  Seed: RFFFPSLREA (MAGA1_HUMAN)
RWFFPSLREK

SEQ ID NO: 42398 - protein, 10 aa, Artificial Sequence
  Description of Artificial Sequence: Synthetic peptide
  Seed: KNYKHCFPEI (MAGA1_HUMAN)
KYYKHCFPEW

SEQ ID NO: 42399 - protein, 9 aa, Artificial Sequence
  Description of Artificial Sequence: Synthetic peptide
  Seed: IAMEGGHAP (MAGA1_HUMAN)
IPMEGGHAG

SEQ ID NO: 42400 - protein, 11 aa, Artificial Sequence
  Description of Artificial Sequence: Synthetic peptide
  Seed: SAFPTTINFTR (MAGA1_HUMAN)
SIFPTTINFTK

SEQ ID NO: 42401 - protein, 9 aa, Artificial Sequence
  Description of Artificial Sequence: Synthetic peptide
  Seed: YVKVLEYVI (MAGA1_HUMAN)
YMKVLEYVV

SEQ ID NO: 42402 - protein, 9 aa, Artificial Sequence
  Description of Artificial Sequence: Synthetic peptide
  Seed: VYDGREHSA (MAGA1_HUMAN)
VVDGREHSL

SEQ ID NO: 42403 - protein, 9 aa, Artificial Sequence
  Description of Artificial Sequence: Synthetic peptide
  Seed: SAFPTTINF (MAGA1_HUMAN)
SEFPTTINF

SEQ ID NO: 42404 - protein, 10 aa, Artificial Sequence
  Description of Artificial Sequence: Synthetic peptide
  Seed: ASAFPTTINF (MAGA1_HUMAN)
AAAFPTTINY

SEQ ID NO: 42405 - protein, 9 aa, Artificial Sequence
  Description of Artificial Sequence: Synthetic peptide
  Seed: TSYVKVLEY (MAGA1_HUMAN)
TTYVKVLEH

SEQ ID NO: 42406 - protein, 9 aa, Artificial Sequence
  Description of Artificial Sequence: Synthetic peptide
  Seed: LTQDLVQEK (MAGA1_HUMAN)
LVQDLVQEK

SEQ ID NO: 42407 - protein, 11 aa, Artificial Sequence
  Description of Artificial Sequence: Synthetic peptide
  Seed: RQVPDSDPARY (MAGA1_HUMAN)
RVVPDSDPARK

SEQ ID NO: 42408 - protein, 9 aa, Artificial Sequence
  Description of Artificial Sequence: Synthetic peptide
  Seed: LGDNQIMPK (MAGA1_HUMAN)
LTDNQIMPY

SEQ ID NO: 42409 - protein, 9 aa, Artificial Sequence
  Description of Artificial Sequence: Synthetic peptide
  Seed: ATSSSSPLV (MAGA1_HUMAN)
AASSSSPLL

SEQ ID NO: 42410 - protein, 10 aa, Artificial Sequence
  Description of Artificial Sequence: Synthetic peptide
  Seed: FFFPSLREAA (MAGA1_HUMAN)
FFFPSLREAY

SEQ ID NO: 42411 - protein, 11 aa, Artificial Sequence
  Description of Artificial Sequence: Synthetic peptide
  Seed: GASAFPTTINF (MAGA1_HUMAN)
GVSAFPTTINW

SEQ ID NO: 42412 - protein, 10 aa, Artificial Sequence
  Description of Artificial Sequence: Synthetic peptide
  Seed: KEADPTGHSY (MAGA1_HUMAN)
KEADPTGHST

SEQ ID NO: 42413 - protein, 9 aa, Artificial Sequence
  Description of Artificial Sequence: Synthetic peptide
  Seed: ALREEEEGV (MAGA1_HUMAN)
AQREEEEGV

SEQ ID NO: 42414 - protein, 9 aa, Artificial Sequence
  Description of Artificial Sequence: Synthetic peptide
  Seed: KYRAREPVT (MAGA1_HUMAN)
KVRAREPVA

SEQ ID NO: 42415 - protein, 9 aa, Artificial Sequence
  Description of Artificial Sequence: Synthetic peptide
  Seed: RVRFFFPSL (MAGA1_HUMAN)
RMRFFFPSF

SEQ ID NO: 42416 - protein, 10 aa, Artificial Sequence
  Description of Artificial Sequence: Synthetic peptide
  Seed: KVLEYVIKVS (MAGA1_HUMAN)
KMLEYVIKVS

SEQ ID NO: 42417 - protein, 11 aa, Artificial Sequence
  Description of Artificial Sequence: Synthetic peptide
  Seed: YVLVTCLGLSY (MAGA1_HUMAN)
YMLVTCLGLSY

SEQ ID NO: 42418 - protein, 9 aa, Artificial Sequence
  Description of Artificial Sequence: Synthetic peptide
  Seed: RVRFFFPSL (MAGA1_HUMAN)
RSRFFFPSF

SEQ ID NO: 42419 - protein, 11 aa, Artificial Sequence
  Description of Artificial Sequence: Synthetic peptide
  Seed: RVRFFFPSLRE (MAGA1_HUMAN)
RQRFFFPSLRR

SEQ ID NO: 42420 - protein, 9 aa, Artificial Sequence
  Description of Artificial Sequence: Synthetic peptide
  Seed: FFFPSLREA (MAGA1_HUMAN)
FYFPSLREI

SEQ ID NO: 42421 - protein, 9 aa, Artificial Sequence
  Description of Artificial Sequence: Synthetic peptide
  Seed: SARVRFFFP (MAGA1_HUMAN)
SLRVRFFFA

SEQ ID NO: 42422 - protein, 9 aa, Artificial Sequence
  Description of Artificial Sequence: Synthetic peptide
  Seed: SARVRFFFP (MAGA1_HUMAN)
STRVRFFFS

SEQ ID NO: 42423 - protein, 10 aa, Artificial Sequence
  Description of Artificial Sequence: Synthetic peptide
  Seed: EFLWGPRALA (MAGA1_HUMAN)
EYLWGPRALV

SEQ ID NO: 42424 - protein, 9 aa, Artificial Sequence
  Description of Artificial Sequence: Synthetic peptide
  Seed: VQAATSSSS (MAGA1_HUMAN)
VLAATSSSY

SEQ ID NO: 42425 - protein, 9 aa, Artificial Sequence
  Description of Artificial Sequence: Synthetic peptide
  Seed: DSDPARYEF (MAGA1_HUMAN)
DYDPARYEL

SEQ ID NO: 42426 - protein, 10 aa, Artificial Sequence
  Description of Artificial Sequence: Synthetic peptide
  Seed: KKVADLVGFL (MAGA1_HUMAN)
KQVADLVGFV

SEQ ID NO: 42427 - protein, 9 aa, Artificial Sequence
  Description of Artificial Sequence: Synthetic peptide
  Seed: VRFFFPSLR (MAGA1_HUMAN)
VYFFFPSLR

SEQ ID NO: 42428 - protein, 9 aa, Artificial Sequence
  Description of Artificial Sequence: Synthetic peptide
  Seed: IAMEGGHAP (MAGA1_HUMAN)
ISMEGGHAF

SEQ ID NO: 42429 - protein, 9 aa, Artificial Sequence
  Description of Artificial Sequence: Synthetic peptide
  Seed: RAREPVTKA (MAGA1_HUMAN)
RMREPVTKY

SEQ ID NO: 42430 - protein, 11 aa, Artificial Sequence
  Description of Artificial Sequence: Synthetic peptide
  Seed: TKKVADLVGFL (MAGA1_HUMAN)
TQKVADLVGFV

SEQ ID NO: 42431 - protein, 9 aa, Artificial Sequence
  Description of Artificial Sequence: Synthetic peptide
  Seed: KVLEYVIKV (MAGA1_HUMAN)
KMLEYVIKS

SEQ ID NO: 42432 - protein, 9 aa, Artificial Sequence
  Description of Artificial Sequence: Synthetic peptide
  Seed: FLIIVLVMI (MAGA1_HUMAN)
FTIIVLVMV

SEQ ID NO: 42433 - protein, 9 aa, Artificial Sequence
  Description of Artificial Sequence: Synthetic peptide
  Seed: KTGFLIIVL (MAGA1_HUMAN)
KSGFLIIVY

SEQ ID NO: 42434 - protein, 10 aa, Artificial Sequence
  Description of Artificial Sequence: Synthetic peptide
  Seed: SSSPLVLGTL (MAGA1_HUMAN)
STSPLVLGTI

SEQ ID NO: 42435 - protein, 9 aa, Artificial Sequence
  Description of Artificial Sequence: Synthetic peptide
  Seed: SSSPLVLGT (MAGA1_HUMAN)
SVSPLVLGA

SEQ ID NO: 42436 - protein, 9 aa, Artificial Sequence
  Description of Artificial Sequence: Synthetic peptide
  Seed: SAYGEPRKL (MAGA1_HUMAN)
SWYGEPRKM

SEQ ID NO: 42437 - protein, 11 aa, Artificial Sequence
  Description of Artificial Sequence: Synthetic peptide
  Seed: TKKVADLVGFL (MAGA1_HUMAN)
TYKVADLVGFV

SEQ ID NO: 42438 - protein, 9 aa, Artificial Sequence
  Description of Artificial Sequence: Synthetic peptide
  Seed: VYDGREHSA (MAGA1_HUMAN)
VYDGREHSM

SEQ ID NO: 42439 - protein, 11 aa, Artificial Sequence
  Description of Artificial Sequence: Synthetic peptide
  Seed: RALAETSYVKV (MAGA1_HUMAN)
RYLAETSYVKV

SEQ ID NO: 42440 - protein, 8 aa, Artificial Sequence
  Description of Artificial Sequence: Synthetic peptide
  Seed: SYVKVLEY (MAGA1_HUMAN)
SQVKVLEY

SEQ ID NO: 42441 - protein, 10 aa, Artificial Sequence
  Description of Artificial Sequence: Synthetic peptide
  Seed: HSAYGEPRKL (MAGA1_HUMAN)
HTAYGEPRKW

SEQ ID NO: 42442 - protein, 9 aa, Artificial Sequence
  Description of Artificial Sequence: Synthetic peptide
  Seed: AYGEPRKLL (MAGA1_HUMAN)
AFGEPRKLL

SEQ ID NO: 42443 - protein, 9 aa, Artificial Sequence
  Description of Artificial Sequence: Synthetic peptide
  Seed: KASESLQLV (MAGA1_HUMAN)
KRSESLQLV

SEQ ID NO: 42444 - protein, 10 aa, Artificial Sequence
  Description of Artificial Sequence: Synthetic peptide
  Seed: RVRFFFPSLR (MAGA1_HUMAN)
RVRFFFPSLP

SEQ ID NO: 42445 - protein, 10 aa, Artificial Sequence
  Description of Artificial Sequence: Synthetic peptide
  Seed: KVADLVGFLL (MAGA1_HUMAN)
KMADLVGFLN

SEQ ID NO: 42446 - protein, 10 aa, Artificial Sequence
  Description of Artificial Sequence: Synthetic peptide
  Seed: VKVLEYVIKV (MAGA1_HUMAN)
VLVLEYVIKV

SEQ ID NO: 42447 - protein, 9 aa, Artificial Sequence
  Description of Artificial Sequence: Synthetic peptide
  Seed: FLWGPRALA (MAGA1_HUMAN)
FMWGPRALR

SEQ ID NO: 42448 - protein, 9 aa, Artificial Sequence
  Description of Artificial Sequence: Synthetic peptide
  Seed: LKYRAREPV (MAGA1_HUMAN)
LQYRAREPM

SEQ ID NO: 42449 - protein, 11 aa, Artificial Sequence
  Description of Artificial Sequence: Synthetic peptide
  Seed: EIFGKASESLQ (MAGA1_HUMAN)
EVFGKASESLR

SEQ ID NO: 42450 - protein, 10 aa, Artificial Sequence
  Description of Artificial Sequence: Synthetic peptide
  Seed: CILESLFRAV (MAGA1_HUMAN)
CVLESLFRAI

SEQ ID NO: 42451 - protein, 9 aa, Artificial Sequence
  Description of Artificial Sequence: Synthetic peptide
  Seed: TSSSSPLVL (MAGA1_HUMAN)
TQSSSPLVI

SEQ ID NO: 42452 - protein, 9 aa, Artificial Sequence
  Description of Artificial Sequence: Synthetic peptide
  Seed: RQRQPSEGS (MAGA1_HUMAN)
RFRQPSEGK

SEQ ID NO: 42453 - protein, 9 aa, Artificial Sequence
  Description of Artificial Sequence: Synthetic peptide
  Seed: QSPQGASAF (MAGA1_HUMAN)
QIPQGASAF

SEQ ID NO: 42454 - protein, 9 aa, Artificial Sequence
  Description of Artificial Sequence: Synthetic peptide
  Seed: RVRFFFPSL (MAGA1_HUMAN)
RYRFFFPSI

SEQ ID NO: 42455 - protein, 9 aa, Artificial Sequence
  Description of Artificial Sequence: Synthetic peptide
  Seed: TGFLIIVLV (MAGA1_HUMAN)
TMFLIIVLV

SEQ ID NO: 42456 - protein, 8 aa, Artificial Sequence
  Description of Artificial Sequence: Synthetic peptide
  Seed: ASAFPTTI (MAGA1_HUMAN)
AAAFPTTM

SEQ ID NO: 42457 - protein, 10 aa, Artificial Sequence
  Description of Artificial Sequence: Synthetic peptide
  Seed: VYDGREHSAY (MAGA1_HUMAN)
VFDGREHSAL

SEQ ID NO: 42458 - protein, 10 aa, Artificial Sequence
  Description of Artificial Sequence: Synthetic peptide
  Seed: RYEFLWGPRA (MAGA1_HUMAN)
RAEFLWGPRL

SEQ ID NO: 42459 - protein, 9 aa, Artificial Sequence
  Description of Artificial Sequence: Synthetic peptide
  Seed: DSDPARYEF (MAGA1_HUMAN)
DIDPARYEY

SEQ ID NO: 42460 - protein, 9 aa, Artificial Sequence
  Description of Artificial Sequence: Synthetic peptide
  Seed: YVLVTCLGL (MAGA1_HUMAN)
YQLVTCLGI

SEQ ID NO: 42461 - protein, 9 aa, Artificial Sequence
  Description of Artificial Sequence: Synthetic peptide
  Seed: FLWGPRALA (MAGA1_HUMAN)
FAWGPRALV

SEQ ID NO: 42462 - protein, 11 aa, Artificial Sequence
  Description of Artificial Sequence: Synthetic peptide
  Seed: RVRFFFPSLRE (MAGA1_HUMAN)
RFRFFFPSLRP

SEQ ID NO: 42463 - protein, 9 aa, Artificial Sequence
  Description of Artificial Sequence: Synthetic peptide
  Seed: KVLEYVIKV (MAGA1_HUMAN)
KHLEYVIKY

SEQ ID NO: 42464 - protein, 10 aa, Artificial Sequence
  Description of Artificial Sequence: Synthetic peptide
  Seed: RVRFFFPSLR (MAGA1_HUMAN)
RNRFFFPSLV

SEQ ID NO: 42465 - protein, 10 aa, Artificial Sequence
  Description of Artificial Sequence: Synthetic peptide
  Seed: KEADPTGHSY (MAGA1_HUMAN)
KIADPTGHSK

SEQ ID NO: 42466 - protein, 10 aa, Artificial Sequence
  Description of Artificial Sequence: Synthetic peptide
  Seed: YEFLWGPRAL (MAGA1_HUMAN)
YFFLWGPRAF

SEQ ID NO: 42467 - protein, 9 aa, Artificial Sequence
  Description of Artificial Sequence: Synthetic peptide
  Seed: SVMEVYDGR (MAGA1_HUMAN)
SQMEVYDGK

SEQ ID NO: 42468 - protein, 10 aa, Artificial Sequence
  Description of Artificial Sequence: Synthetic peptide
  Seed: RVRFFFPSLR (MAGA1_HUMAN)
RCRFFFPSLA

SEQ ID NO: 42469 - protein, 9 aa, Artificial Sequence
  Description of Artificial Sequence: Synthetic peptide
  Seed: IAMEGGHAP (MAGA1_HUMAN)
IIMEGGHAH

SEQ ID NO: 42470 - protein, 10 aa, Artificial Sequence
  Description of Artificial Sequence: Synthetic peptide
  Seed: KVLEYVIKVS (MAGA1_HUMAN)
KLLEYVIKVN

SEQ ID NO: 42471 - protein, 9 aa, Artificial Sequence
  Description of Artificial Sequence: Synthetic peptide
  Seed: TSYVKVLEY (MAGA1_HUMAN)
TYYVKVLEL

SEQ ID NO: 42472 - protein, 10 aa, Artificial Sequence
  Description of Artificial Sequence: Synthetic peptide
  Seed: RALAETSYVK (MAGA1_HUMAN)
RVLAETSYVK

SEQ ID NO: 42473 - protein, 9 aa, Artificial Sequence
  Description of Artificial Sequence: Synthetic peptide
  Seed: RALAETSYV (MAGA1_HUMAN)
RVLAETSYM

SEQ ID NO: 42474 - protein, 9 aa, Artificial Sequence
  Description of Artificial Sequence: Synthetic peptide
  Seed: TKAEMLESV (MAGA1_HUMAN)
TIAEMLESI

SEQ ID NO: 42475 - protein, 9 aa, Artificial Sequence
  Description of Artificial Sequence: Synthetic peptide
  Seed: RAREPVTKA (MAGA1_HUMAN)
RRREPVTKL

SEQ ID NO: 42476 - protein, 11 aa, Artificial Sequence
  Description of Artificial Sequence: Synthetic peptide
  Seed: VPDSDPARYEF (MAGA1_HUMAN)
VADSDPARYEW

SEQ ID NO: 42477 - protein, 9 aa, Artificial Sequence
  Description of Artificial Sequence: Synthetic peptide
  Seed: TSYVKVLEY (MAGA1_HUMAN)
TKYVKVLEY

SEQ ID NO: 42478 - protein, 10 aa, Artificial Sequence
  Description of Artificial Sequence: Synthetic peptide
  Seed: TSYVKVLEYV (MAGA1_HUMAN)
TTYVKVLEYV

SEQ ID NO: 42479 - protein, 10 aa, Artificial Sequence
  Description of Artificial Sequence: Synthetic peptide
  Seed: KVADLVGFLL (MAGA1_HUMAN)
KAADLVGFLI

SEQ ID NO: 42480 - protein, 9 aa, Artificial Sequence
  Description of Artificial Sequence: Synthetic peptide
  Seed: RVRFFFPSL (MAGA1_HUMAN)
RSRFFFPSG

SEQ ID NO: 42481 - protein, 9 aa, Artificial Sequence
  Description of Artificial Sequence: Synthetic peptide
  Seed: KASESLQLV (MAGA1_HUMAN)
KSSESLQLV

SEQ ID NO: 42482 - protein, 9 aa, Artificial Sequence
  Description of Artificial Sequence: Synthetic peptide
  Seed: KASESLQLV (MAGA1_HUMAN)
KLSESLQLC

SEQ ID NO: 42483 - protein, 9 aa, Artificial Sequence
  Description of Artificial Sequence: Synthetic peptide
  Seed: AYGEPRKLL (MAGA1_HUMAN)
AFGEPRKLY

SEQ ID NO: 42484 - protein, 10 aa, Artificial Sequence
  Description of Artificial Sequence: Synthetic peptide
  Seed: FFFPSLREAA (MAGA1_HUMAN)
FYFPSLREAY

SEQ ID NO: 42485 - protein, 10 aa, Artificial Sequence
  Description of Artificial Sequence: Synthetic peptide
  Seed: IKVSARVRFF (MAGA1_HUMAN)
IMVSARVRFY

SEQ ID NO: 42486 - protein, 10 aa, Artificial Sequence
  Description of Artificial Sequence: Synthetic peptide
  Seed: EVYDGREHSA (MAGA1_HUMAN)
ETYDGREHSL

SEQ ID NO: 42487 - protein, 9 aa, Artificial Sequence
  Description of Artificial Sequence: Synthetic peptide
  Seed: AQQEALGLV (MAGA1_HUMAN)
AMQEALGLF

SEQ ID NO: 42488 - protein, 11 aa, Artificial Sequence
  Description of Artificial Sequence: Synthetic peptide
  Seed: STDPPQSPQGA (MAGA1_HUMAN)
SLDPPQSPQGL

SEQ ID NO: 42489 - protein, 9 aa, Artificial Sequence
  Description of Artificial Sequence: Synthetic peptide
  Seed: TSSSSPLVL (MAGA1_HUMAN)
TSSSSPLVI

SEQ ID NO: 42490 - protein, 11 aa, Artificial Sequence
  Description of Artificial Sequence: Synthetic peptide
  Seed: KEADPTGHSYV (MAGA1_HUMAN)
KQADPTGHSYW

SEQ ID NO: 42491 - protein, 10 aa, Artificial Sequence
  Description of Artificial Sequence: Synthetic peptide
  Seed: EVYDGREHSA (MAGA1_HUMAN)
EAYDGREHSM

SEQ ID NO: 42492 - protein, 9 aa, Artificial Sequence
  Description of Artificial Sequence: Synthetic peptide
  Seed: SSPLVLGTL (MAGA1_HUMAN)
SAPLVLGTI

SEQ ID NO: 42493 - protein, 9 aa, Artificial Sequence
  Description of Artificial Sequence: Synthetic peptide
  Seed: WEELSVMEV (MAGA1_HUMAN)
WEELSVMEM

SEQ ID NO: 42494 - protein, 9 aa, Artificial Sequence
  Description of Artificial Sequence: Synthetic peptide
  Seed: KVLEYVIKV (MAGA1_HUMAN)
KMLEYVIKF

SEQ ID NO: 42495 - protein, 10 aa, Artificial Sequence
  Description of Artificial Sequence: Synthetic peptide
  Seed: SSSPLVLGTL (MAGA1_HUMAN)
STSPLVLGTL

SEQ ID NO: 42496 - protein, 9 aa, Artificial Sequence
  Description of Artificial Sequence: Synthetic peptide
  Seed: YDGREHSAY (MAGA1_HUMAN)
YIGREHSAY

SEQ ID NO: 42497 - protein, 11 aa, Artificial Sequence
  Description of Artificial Sequence: Synthetic peptide
  Seed: GASAFPTTINF (MAGA1_HUMAN)
GSSAFPTTINF

SEQ ID NO: 42498 - protein, 9 aa, Artificial Sequence
  Description of Artificial Sequence: Synthetic peptide
  Seed: VPDSDPARY (MAGA1_HUMAN)
VPDSDPARW

SEQ ID NO: 42499 - protein, 10 aa, Artificial Sequence
  Description of Artificial Sequence: Synthetic peptide
  Seed: SARVRFFFPS (MAGA1_HUMAN)
SKRVRFFFPY

SEQ ID NO: 42500 - protein, 9 aa, Artificial Sequence
  Description of Artificial Sequence: Synthetic peptide
  Seed: FPSLREAAL (MAGA1_HUMAN)
FHSLREAAV

SEQ ID NO: 42501 - protein, 8 aa, Artificial Sequence
  Description of Artificial Sequence: Synthetic peptide
  Seed: RVRFFFPS (MAGA1_HUMAN)
RVRFFFPM

SEQ ID NO: 42502 - protein, 9 aa, Artificial Sequence
  Description of Artificial Sequence: Synthetic peptide
  Seed: KVSARVRFF (MAGA1_HUMAN)
KFSARVRFY

SEQ ID NO: 42503 - protein, 9 aa, Artificial Sequence
  Description of Artificial Sequence: Synthetic peptide
  Seed: EIWEELSVM (MAGA1_HUMAN)
ETWEELSVM

SEQ ID NO: 42504 - protein, 9 aa, Artificial Sequence
  Description of Artificial Sequence: Synthetic peptide
  Seed: LESLFRAVI (MAGA1_HUMAN)
LMSLFRAVW

SEQ ID NO: 42505 - protein, 9 aa, Artificial Sequence
  Description of Artificial Sequence: Synthetic peptide
  Seed: FFPSLREAA (MAGA1_HUMAN)
FMPSLREAY

SEQ ID NO: 42506 - protein, 10 aa, Artificial Sequence
  Description of Artificial Sequence: Synthetic peptide
  Seed: KNYKHCFPEI (MAGA1_HUMAN)
KYYKHCFPEV

SEQ ID NO: 42507 - protein, 10 aa, Artificial Sequence
  Description of Artificial Sequence: Synthetic peptide
  Seed: KNYKHCFPEI (MAGA1_HUMAN)
KMYKHCFPEK

SEQ ID NO: 42508 - protein, 10 aa, Artificial Sequence
  Description of Artificial Sequence: Synthetic peptide
  Seed: LTQDLVQEKY (MAGA1_HUMAN)
LGQDLVQEKW

SEQ ID NO: 42509 - protein, 9 aa, Artificial Sequence
  Description of Artificial Sequence: Synthetic peptide
  Seed: TKAEMLESV (MAGA1_HUMAN)
TSAEMLESV

SEQ ID NO: 42510 - protein, 10 aa, Artificial Sequence
  Description of Artificial Sequence: Synthetic peptide
  Seed: KASESLQLVF (MAGA1_HUMAN)
KLSESLQLVW

SEQ ID NO: 42511 - protein, 10 aa, Artificial Sequence
  Description of Artificial Sequence: Synthetic peptide
  Seed: KVADLVGFLL (MAGA1_HUMAN)
KMADLVGFLP

SEQ ID NO: 42512 - protein, 9 aa, Artificial Sequence
  Description of Artificial Sequence: Synthetic peptide
  Seed: TTINFTRQR (MAGA1_HUMAN)
TSINFTRQK

SEQ ID NO: 42513 - protein, 10 aa, Artificial Sequence
  Description of Artificial Sequence: Synthetic peptide
  Seed: KYRAREPVTK (MAGA1_HUMAN)
KSRAREPVTK

SEQ ID NO: 42514 - protein, 9 aa, Artificial Sequence
  Description of Artificial Sequence: Synthetic peptide
  Seed: RQVPDSDPA (MAGA1_HUMAN)
RVVPDSDPF

SEQ ID NO: 42515 - protein, 10 aa, Artificial Sequence
  Description of Artificial Sequence: Synthetic peptide
  Seed: AFPTTINFTR (MAGA1_HUMAN)
AVPTTINFTR

SEQ ID NO: 42516 - protein, 9 aa, Artificial Sequence
  Description of Artificial Sequence: Synthetic peptide
  Seed: VYDGREHSA (MAGA1_HUMAN)
VNDGREHSM

SEQ ID NO: 42517 - protein, 11 aa, Artificial Sequence
  Description of Artificial Sequence: Synthetic peptide
  Seed: YVKVLEYVIKV (MAGA1_HUMAN)
YNKVLEYVIKV

SEQ ID NO: 42518 - protein, 9 aa, Artificial Sequence
  Description of Artificial Sequence: Synthetic peptide
  Seed: SAYGEPRKL (MAGA1_HUMAN)
SEYGEPRKM

SEQ ID NO: 42519 - protein, 9 aa, Artificial Sequence
  Description of Artificial Sequence: Synthetic peptide
  Seed: RALAETSYV (MAGA1_HUMAN)
RLLAETSYI

SEQ ID NO: 42520 - protein, 9 aa, Artificial Sequence
  Description of Artificial Sequence: Synthetic peptide
  Seed: TSYVKVLEY (MAGA1_HUMAN)
TAYVKVLEH

SEQ ID NO: 42521 - protein, 11 aa, Artificial Sequence
  Description of Artificial Sequence: Synthetic peptide
  Seed: IKVSARVRFFF (MAGA1_HUMAN)
IVVSARVRFFW

SEQ ID NO: 42522 - protein, 11 aa, Artificial Sequence
  Description of Artificial Sequence: Synthetic peptide
  Seed: EEALEAQQEAL (MAGA1_HUMAN)
EEALEAQQEAF

SEQ ID NO: 42523 - protein, 9 aa, Artificial Sequence
  Description of Artificial Sequence: Synthetic peptide
  Seed: RQRQPSEGS (MAGA1_HUMAN)
RGRQPSEGK

SEQ ID NO: 42524 - protein, 11 aa, Artificial Sequence
  Description of Artificial Sequence: Synthetic peptide
  Seed: KVSARVRFFFP (MAGA1_HUMAN)
KYSARVRFFFK

SEQ ID NO: 42525 - protein, 11 aa, Artificial Sequence
  Description of Artificial Sequence: Synthetic peptide
  Seed: FLWGPRALAET (MAGA1_HUMAN)
FIWGPRALAEV

SEQ ID NO: 42526 - protein, 10 aa, Artificial Sequence
  Description of Artificial Sequence: Synthetic peptide
  Seed: CILESLFRAV (MAGA1_HUMAN)
CMLESLFRAL

SEQ ID NO: 42527 - protein, 9 aa, Artificial Sequence
  Description of Artificial Sequence: Synthetic peptide
  Seed: SLFRAVITK (MAGA1_HUMAN)
SMFRAVITK

SEQ ID NO: 42528 - protein, 10 aa, Artificial Sequence
  Description of Artificial Sequence: Synthetic peptide
  Seed: ALAETSYVKV (MAGA1_HUMAN)
AQAETSYVKW

SEQ ID NO: 42529 - protein, 10 aa, Artificial Sequence
  Description of Artificial Sequence: Synthetic peptide
  Seed: AQQEALGLVC (MAGA1_HUMAN)
AEQEALGLVP

SEQ ID NO: 42530 - protein, 9 aa, Artificial Sequence
  Description of Artificial Sequence: Synthetic peptide
  Seed: AQQEALGLV (MAGA1_HUMAN)
ALQEALGLI

SEQ ID NO: 42531 - protein, 11 aa, Artificial Sequence
  Description of Artificial Sequence: Synthetic peptide
  Seed: VPDSDPARYEF (MAGA1_HUMAN)
VTDSDPARYEW

SEQ ID NO: 42532 - protein, 11 aa, Artificial Sequence
  Description of Artificial Sequence: Synthetic peptide
  Seed: RVRFFFPSLRE (MAGA1_HUMAN)
RVRFFFPSLRA

SEQ ID NO: 42533 - protein, 8 aa, Artificial Sequence
  Description of Artificial Sequence: Synthetic peptide
  Seed: HSYVLVTC (MAGA1_HUMAN)
HAYVLVTI

SEQ ID NO: 42534 - protein, 10 aa, Artificial Sequence
  Description of Artificial Sequence: Synthetic peptide
  Seed: KVSARVRFFF (MAGA1_HUMAN)
KASARVRFFM

SEQ ID NO: 42535 - protein, 9 aa, Artificial Sequence
  Description of Artificial Sequence: Synthetic peptide
  Seed: VSARVRFFF (MAGA1_HUMAN)
VSARVRFFL

SEQ ID NO: 42536 - protein, 10 aa, Artificial Sequence
  Description of Artificial Sequence: Synthetic peptide
  Seed: RVRFFFPSLR (MAGA1_HUMAN)
RRRFFFPSLW

SEQ ID NO: 42537 - protein, 9 aa, Artificial Sequence
  Description of Artificial Sequence: Synthetic peptide
  Seed: AATSSSSPL (MAGA1_HUMAN)
AATSSSSPY

SEQ ID NO: 42538 - protein, 10 aa, Artificial Sequence
  Description of Artificial Sequence: Synthetic peptide
  Seed: ATSSSSPLVL (MAGA1_HUMAN)
AYSSSSPLVF

SEQ ID NO: 42539 - protein, 9 aa, Artificial Sequence
  Description of Artificial Sequence: Synthetic peptide
  Seed: TSYVKVLEY (MAGA1_HUMAN)
TVYVKVLEW

SEQ ID NO: 42540 - protein, 10 aa, Artificial Sequence
  Description of Artificial Sequence: Synthetic peptide
  Seed: EFLWGPRALA (MAGA1_HUMAN)
EMLWGPRALV

SEQ ID NO: 42541 - protein, 9 aa, Artificial Sequence
  Description of Artificial Sequence: Synthetic peptide
  Seed: SAFPTTINF (MAGA1_HUMAN)
SQFPTTINI

SEQ ID NO: 42542 - protein, 10 aa, Artificial Sequence
  Description of Artificial Sequence: Synthetic peptide
  Seed: SARVRFFFPS (MAGA1_HUMAN)
SFRVRFFFPR

SEQ ID NO: 42543 - protein, 9 aa, Artificial Sequence
  Description of Artificial Sequence: Synthetic peptide
  Seed: KVADLVGFL (MAGA1_HUMAN)
KAADLVGFW

SEQ ID NO: 42544 - protein, 9 aa, Artificial Sequence
  Description of Artificial Sequence: Synthetic peptide
  Seed: RVRFFFPSL (MAGA1_HUMAN)
RSRFFFPSS

SEQ ID NO: 42545 - protein, 10 aa, Artificial Sequence
  Description of Artificial Sequence: Synthetic peptide
  Seed: YEFLWGPRAL (MAGA1_HUMAN)
YRFLWGPRAF

SEQ ID NO: 42546 - protein, 10 aa, Artificial Sequence
  Description of Artificial Sequence: Synthetic peptide
  Seed: SARVRFFFPS (MAGA1_HUMAN)
SRRVRFFFPV

SEQ ID NO: 42547 - protein, 9 aa, Artificial Sequence
  Description of Artificial Sequence: Synthetic peptide
  Seed: SAYGEPRKL (MAGA1_HUMAN)
SQYGEPRKL

SEQ ID NO: 42548 - protein, 10 aa, Artificial Sequence
  Description of Artificial Sequence: Synthetic peptide
  Seed: KVADLVGFLL (MAGA1_HUMAN)
KLADLVGFLP

SEQ ID NO: 42549 - protein, 9 aa, Artificial Sequence
  Description of Artificial Sequence: Synthetic peptide
  Seed: SARVRFFFP (MAGA1_HUMAN)
STRVRFFFP

SEQ ID NO: 42550 - protein, 9 aa, Artificial Sequence
  Description of Artificial Sequence: Synthetic peptide
  Seed: FLWGPRALA (MAGA1_HUMAN)
FQWGPRALI

SEQ ID NO: 42551 - protein, 9 aa, Artificial Sequence
  Description of Artificial Sequence: Synthetic peptide
  Seed: GASAFPTTI (MAGA1_HUMAN)
GASAFPTTH

SEQ ID NO: 42552 - protein, 10 aa, Artificial Sequence
  Description of Artificial Sequence: Synthetic peptide
  Seed: RVRFFFPSLR (MAGA1_HUMAN)
RFRFFFPSLM

SEQ ID NO: 42553 - protein, 10 aa, Artificial Sequence
  Description of Artificial Sequence: Synthetic peptide
  Seed: RAREPVTKAE (MAGA1_HUMAN)
RAREPVTKAA

SEQ ID NO: 42554 - protein, 9 aa, Artificial Sequence
  Description of Artificial Sequence: Synthetic peptide
  Seed: STDPPQSPQ (MAGA1_HUMAN)
SYDPPQSPL

SEQ ID NO: 42555 - protein, 9 aa, Artificial Sequence
  Description of Artificial Sequence: Synthetic peptide
  Seed: IMPKTGFLI (MAGA1_HUMAN)
IFPKTGFLF

SEQ ID NO: 42556 - protein, 10 aa, Artificial Sequence
  Description of Artificial Sequence: Synthetic peptide
  Seed: SCILESLFRA (MAGA1_HUMAN)
SSILESLFRL

SEQ ID NO: 42557 - protein, 9 aa, Artificial Sequence
  Description of Artificial Sequence: Synthetic peptide
  Seed: QIMPKTGFL (MAGA1_HUMAN)
QVMPKTGFR

SEQ ID NO: 42558 - protein, 10 aa, Artificial Sequence
  Description of Artificial Sequence: Synthetic peptide
  Seed: KVADLVGFLL (MAGA1_HUMAN)
KAADLVGFLK

SEQ ID NO: 42559 - protein, 10 aa, Artificial Sequence
  Description of Artificial Sequence: Synthetic peptide
  Seed: RVRFFFPSLR (MAGA1_HUMAN)
RRRFFFPSLL

SEQ ID NO: 42560 - protein, 9 aa, Artificial Sequence
  Description of Artificial Sequence: Synthetic peptide
  Seed: RVRFFFPSL (MAGA1_HUMAN)
RTRFFFPSA

SEQ ID NO: 42561 - protein, 9 aa, Artificial Sequence
  Description of Artificial Sequence: Synthetic peptide
  Seed: IMPKTGFLI (MAGA1_HUMAN)
IWPKTGFLL

SEQ ID NO: 42562 - protein, 11 aa, Artificial Sequence
  Description of Artificial Sequence: Synthetic peptide
  Seed: RVRFFFPSLRE (MAGA1_HUMAN)
RVRFFFPSLRN

SEQ ID NO: 42563 - protein, 9 aa, Artificial Sequence
  Description of Artificial Sequence: Synthetic peptide
  Seed: LVTCLGLSY (MAGA1_HUMAN)
LTTCLGLSI

SEQ ID NO: 42564 - protein, 9 aa, Artificial Sequence
  Description of Artificial Sequence: Synthetic peptide
  Seed: LVTCLGLSY (MAGA1_HUMAN)
LQTCLGLSY

SEQ ID NO: 42565 - protein, 10 aa, Artificial Sequence
  Description of Artificial Sequence: Synthetic peptide
  Seed: KHCFPEIFGK (MAGA1_HUMAN)
KFCFPEIFGK

SEQ ID NO: 42566 - protein, 10 aa, Artificial Sequence
  Description of Artificial Sequence: Synthetic peptide
  Seed: ESLFRAVITK (MAGA1_HUMAN)
EQLFRAVITR

SEQ ID NO: 42567 - protein, 9 aa, Artificial Sequence
  Description of Artificial Sequence: Synthetic peptide
  Seed: RAREPVTKA (MAGA1_HUMAN)
RSREPVTKM

SEQ ID NO: 42568 - protein, 10 aa, Artificial Sequence
  Description of Artificial Sequence: Synthetic peptide
  Seed: RAREPVTKAE (MAGA1_HUMAN)
RSREPVTKAS

SEQ ID NO: 42569 - protein, 9 aa, Artificial Sequence
  Description of Artificial Sequence: Synthetic peptide
  Seed: QIMPKTGFL (MAGA1_HUMAN)
QQMPKTGFR

SEQ ID NO: 42570 - protein, 10 aa, Artificial Sequence
  Description of Artificial Sequence: Synthetic peptide
  Seed: ARVRFFFPSL (MAGA1_HUMAN)
ASVRFFFPSA

SEQ ID NO: 42571 - protein, 9 aa, Artificial Sequence
  Description of Artificial Sequence: Synthetic peptide
  Seed: KVLEYVIKV (MAGA1_HUMAN)
KQLEYVIKL

SEQ ID NO: 42572 - protein, 10 aa, Artificial Sequence
  Description of Artificial Sequence: Synthetic peptide
  Seed: EYVIKVSARV (MAGA1_HUMAN)
ENVIKVSARV

SEQ ID NO: 42573 - protein, 9 aa, Artificial Sequence
  Description of Artificial Sequence: Synthetic peptide
  Seed: TQDLVQEKY (MAGA1_HUMAN)
TYDLVQEKY

SEQ ID NO: 42574 - protein, 9 aa, Artificial Sequence
  Description of Artificial Sequence: Synthetic peptide
  Seed: VIKVSARVR (MAGA1_HUMAN)
VMKVSARVR

SEQ ID NO: 42575 - protein, 10 aa, Artificial Sequence
  Description of Artificial Sequence: Synthetic peptide
  Seed: SCILESLFRA (MAGA1_HUMAN)
SVILESLFRA

SEQ ID NO: 42576 - protein, 9 aa, Artificial Sequence
  Description of Artificial Sequence: Synthetic peptide
  Seed: FFFPSLREA (MAGA1_HUMAN)
FFFPSLREV

SEQ ID NO: 42577 - protein, 9 aa, Artificial Sequence
  Description of Artificial Sequence: Synthetic peptide
  Seed: SSPLVLGTL (MAGA1_HUMAN)
STPLVLGTI

SEQ ID NO: 42578 - protein, 9 aa, Artificial Sequence
  Description of Artificial Sequence: Synthetic peptide
  Seed: VYDGREHSA (MAGA1_HUMAN)
VFDGREHSC

SEQ ID NO: 42579 - protein, 9 aa, Artificial Sequence
  Description of Artificial Sequence: Synthetic peptide
  Seed: VRFFFPSLR (MAGA1_HUMAN)
VMFFFPSLK

SEQ ID NO: 42580 - protein, 11 aa, Artificial Sequence
  Description of Artificial Sequence: Synthetic peptide
  Seed: YEFLWGPRALA (MAGA1_HUMAN)
YAFLWGPRALL

SEQ ID NO: 42581 - protein, 9 aa, Artificial Sequence
  Description of Artificial Sequence: Synthetic peptide
  Seed: VQAATSSSS (MAGA1_HUMAN)
VAAATSSSF

SEQ ID NO: 42582 - protein, 9 aa, Artificial Sequence
  Description of Artificial Sequence: Synthetic peptide
  Seed: VADLVGFLL (MAGA1_HUMAN)
VLDLVGFLF

SEQ ID NO: 42583 - protein, 9 aa, Artificial Sequence
  Description of Artificial Sequence: Synthetic peptide
  Seed: SAFPTTINF (MAGA1_HUMAN)
SWFPTTINW

SEQ ID NO: 42584 - protein, 9 aa, Artificial Sequence
  Description of Artificial Sequence: Synthetic peptide
  Seed: SARVRFFFP (MAGA1_HUMAN)
SQRVRFFFR

SEQ ID NO: 42585 - protein, 9 aa, Artificial Sequence
  Description of Artificial Sequence: Synthetic peptide
  Seed: RAREPVTKA (MAGA1_HUMAN)
RMREPVTKI

SEQ ID NO: 42586 - protein, 11 aa, Artificial Sequence
  Description of Artificial Sequence: Synthetic peptide
  Seed: KVSARVRFFFP (MAGA1_HUMAN)
KSSARVRFFFK

SEQ ID NO: 42587 - protein, 10 aa, Artificial Sequence
  Description of Artificial Sequence: Synthetic peptide
  Seed: RVRFFFPSLR (MAGA1_HUMAN)
RGRFFFPSLM

SEQ ID NO: 42588 - protein, 9 aa, Artificial Sequence
  Description of Artificial Sequence: Synthetic peptide
  Seed: VYDGREHSA (MAGA1_HUMAN)
VNDGREHSF

SEQ ID NO: 42589 - protein, 9 aa, Artificial Sequence
  Description of Artificial Sequence: Synthetic peptide
  Seed: STSCILESL (MAGA1_HUMAN)
SISCILESM

SEQ ID NO: 42590 - protein, 9 aa, Artificial Sequence
  Description of Artificial Sequence: Synthetic peptide
  Seed: SLFRAVITK (MAGA1_HUMAN)
SVFRAVITR

SEQ ID NO: 42591 - protein, 9 aa, Artificial Sequence
  Description of Artificial Sequence: Synthetic peptide
  Seed: YKHCFPEIF (MAGA1_HUMAN)
YIHCFPEIF

SEQ ID NO: 42592 - protein, 10 aa, Artificial Sequence
  Description of Artificial Sequence: Synthetic peptide
  Seed: TSYVKVLEYV (MAGA1_HUMAN)
TMYVKVLEYV

SEQ ID NO: 42593 - protein, 11 aa, Artificial Sequence
  Description of Artificial Sequence: Synthetic peptide
  Seed: ETSYVKVLEYV (MAGA1_HUMAN)
ETSYVKVLEYI

SEQ ID NO: 42594 - protein, 10 aa, Artificial Sequence
  Description of Artificial Sequence: Synthetic peptide
  Seed: SSSPLVLGTL (MAGA1_HUMAN)
SISPLVLGTA

SEQ ID NO: 42595 - protein, 9 aa, Artificial Sequence
  Description of Artificial Sequence: Synthetic peptide
  Seed: TSSSSPLVL (MAGA1_HUMAN)
TQSSSPLVL

SEQ ID NO: 42596 - protein, 10 aa, Artificial Sequence
  Description of Artificial Sequence: Synthetic peptide
  Seed: KVSARVRFFF (MAGA1_HUMAN)
KTSARVRFFW

SEQ ID NO: 42597 - protein, 10 aa, Artificial Sequence
  Description of Artificial Sequence: Synthetic peptide
  Seed: KVADLVGFLL (MAGA1_HUMAN)
KSADLVGFLW

SEQ ID NO: 42598 - protein, 10 aa, Artificial Sequence
  Description of Artificial Sequence: Synthetic peptide
  Seed: SARVRFFFPS (MAGA1_HUMAN)
SYRVRFFFPI

SEQ ID NO: 42599 - protein, 9 aa, Artificial Sequence
  Description of Artificial Sequence: Synthetic peptide
  Seed: EHSAYGEPR (MAGA1_HUMAN)
EISAYGEPR

SEQ ID NO: 42600 - protein, 10 aa, Artificial Sequence
  Description of Artificial Sequence: Synthetic peptide
  Seed: KEADPTGHSY (MAGA1_HUMAN)
KVADPTGHSI

SEQ ID NO: 42601 - protein, 9 aa, Artificial Sequence
  Description of Artificial Sequence: Synthetic peptide
  Seed: TQDLVQEKY (MAGA1_HUMAN)
TVDLVQEKV

SEQ ID NO: 42602 - protein, 10 aa, Artificial Sequence
  Description of Artificial Sequence: Synthetic peptide
  Seed: AQQEALGLVC (MAGA1_HUMAN)
AEQEALGLVV

SEQ ID NO: 42603 - protein, 9 aa, Artificial Sequence
  Description of Artificial Sequence: Synthetic peptide
  Seed: RVRFFFPSL (MAGA1_HUMAN)
RLRFFFPSG

SEQ ID NO: 42604 - protein, 9 aa, Artificial Sequence
  Description of Artificial Sequence: Synthetic peptide
  Seed: KVADLVGFL (MAGA1_HUMAN)
KIADLVGFT

SEQ ID NO: 42605 - protein, 8 aa, Artificial Sequence
  Description of Artificial Sequence: Synthetic peptide
  Seed: FLWGPRAL (MAGA1_HUMAN)
FAWGPRAF

SEQ ID NO: 42606 - protein, 10 aa, Artificial Sequence
  Description of Artificial Sequence: Synthetic peptide
  Seed: MLESVIKNYK (MAGA1_HUMAN)
MAESVIKNYY

SEQ ID NO: 42607 - protein, 11 aa, Artificial Sequence
  Description of Artificial Sequence: Synthetic peptide
  Seed: CILESLFRAVI (MAGA1_HUMAN)
CMLESLFRAVA

SEQ ID NO: 42608 - protein, 10 aa, Artificial Sequence
  Description of Artificial Sequence: Synthetic peptide
  Seed: RVRFFFPSLR (MAGA1_HUMAN)
RARFFFPSLA

SEQ ID NO: 42609 - protein, 8 aa, Artificial Sequence
  Description of Artificial Sequence: Synthetic peptide
  Seed: AETSYVKV (MAGA1_HUMAN)
AETSYVKL

SEQ ID NO: 42610 - protein, 10 aa, Artificial Sequence
  Description of Artificial Sequence: Synthetic peptide
  Seed: AQQEALGLVC (MAGA1_HUMAN)
AEQEALGLVL

SEQ ID NO: 42611 - protein, 9 aa, Artificial Sequence
  Description of Artificial Sequence: Synthetic peptide
  Seed: LVQEKYLEY (MAGA1_HUMAN)
LYQEKYLEY

SEQ ID NO: 42612 - protein, 10 aa, Artificial Sequence
  Description of Artificial Sequence: Synthetic peptide
  Seed: YEFLWGPRAL (MAGA1_HUMAN)
YRFLWGPRAM

SEQ ID NO: 42613 - protein, 9 aa, Artificial Sequence
  Description of Artificial Sequence: Synthetic peptide
  Seed: LVTCLGLSY (MAGA1_HUMAN)
LATCLGLSL

SEQ ID NO: 42614 - protein, 10 aa, Artificial Sequence
  Description of Artificial Sequence: Synthetic peptide
  Seed: FFFPSLREAA (MAGA1_HUMAN)
FMFPSLREAY

SEQ ID NO: 42615 - protein, 10 aa, Artificial Sequence
  Description of Artificial Sequence: Synthetic peptide
  Seed: ETSYVKVLEY (MAGA1_HUMAN)
EASYVKVLEK

SEQ ID NO: 42616 - protein, 9 aa, Artificial Sequence
  Description of Artificial Sequence: Synthetic peptide
  Seed: MSLEQRSLH (MAGA1_HUMAN)
MALEQRSLF

SEQ ID NO: 42617 - protein, 11 aa, Artificial Sequence
  Description of Artificial Sequence: Synthetic peptide
  Seed: DLVGFLLLKYR (MAGA1_HUMAN)
DVVGFLLLKYR

SEQ ID NO: 42618 - protein, 8 aa, Artificial Sequence
  Description of Artificial Sequence: Synthetic peptide
  Seed: VADLVGFL (MAGA1_HUMAN)
VWDLVGFL

SEQ ID NO: 42619 - protein, 9 aa, Artificial Sequence
  Description of Artificial Sequence: Synthetic peptide
  Seed: GHSYVLVTC (MAGA1_HUMAN)
GHSYVLVTI

SEQ ID NO: 42620 - protein, 9 aa, Artificial Sequence
  Description of Artificial Sequence: Synthetic peptide
  Seed: HCFPEIFGK (MAGA1_HUMAN)
HIFPEIFGR

SEQ ID NO: 42621 - protein, 9 aa, Artificial Sequence
  Description of Artificial Sequence: Synthetic peptide
  Seed: STDPPQSPQ (MAGA1_HUMAN)
SSDPPQSPY

SEQ ID NO: 42622 - protein, 10 aa, Artificial Sequence
  Description of Artificial Sequence: Synthetic peptide
  Seed: TTINFTRQRQ (MAGA1_HUMAN)
TVINFTRQRK

SEQ ID NO: 42623 - protein, 9 aa, Artificial Sequence
  Description of Artificial Sequence: Synthetic peptide
  Seed: QIMPKTGFL (MAGA1_HUMAN)
QNMPKTGFY

SEQ ID NO: 42624 - protein, 9 aa, Artificial Sequence
  Description of Artificial Sequence: Synthetic peptide
  Seed: RQVPDSDPA (MAGA1_HUMAN)
RIVPDSDPY

SEQ ID NO: 42625 - protein, 9 aa, Artificial Sequence
  Description of Artificial Sequence: Synthetic peptide
  Seed: RQRQPSEGS (MAGA1_HUMAN)
RVRQPSEGG

SEQ ID NO: 42626 - protein, 9 aa, Artificial Sequence
  Description of Artificial Sequence: Synthetic peptide
  Seed: TGFLIIVLV (MAGA1_HUMAN)
TPFLIIVLI

SEQ ID NO: 42627 - protein, 9 aa, Artificial Sequence
  Description of Artificial Sequence: Synthetic peptide
  Seed: RAREPVTKA (MAGA1_HUMAN)
RIREPVTKY

SEQ ID NO: 42628 - protein, 9 aa, Artificial Sequence
  Description of Artificial Sequence: Synthetic peptide
  Seed: RYEFLWGPR (MAGA1_HUMAN)
RMEFLWGPK

SEQ ID NO: 42629 - protein, 9 aa, Artificial Sequence
  Description of Artificial Sequence: Synthetic peptide
  Seed: MLESVIKNY (MAGA1_HUMAN)
MAESVIKNL

SEQ ID NO: 42630 - protein, 9 aa, Artificial Sequence
  Description of Artificial Sequence: Synthetic peptide
  Seed: ARVRFFFPS (MAGA1_HUMAN)
ARVRFFFPT

SEQ ID NO: 42631 - protein, 9 aa, Artificial Sequence
  Description of Artificial Sequence: Synthetic peptide
  Seed: RQVPDSDPA (MAGA1_HUMAN)
REVPDSDPV

SEQ ID NO: 42632 - protein, 9 aa, Artificial Sequence
  Description of Artificial Sequence: Synthetic peptide
  Seed: KVADLVGFL (MAGA1_HUMAN)
KSADLVGFR

SEQ ID NO: 42633 - protein, 9 aa, Artificial Sequence
  Description of Artificial Sequence: Synthetic peptide
  Seed: SAYGEPRKL (MAGA1_HUMAN)
STYGEPRKL

SEQ ID NO: 42634 - protein, 9 aa, Artificial Sequence
  Description of Artificial Sequence: Synthetic peptide
  Seed: GTLEEVPTA (MAGA1_HUMAN)
GVLEEVPTA

SEQ ID NO: 42635 - protein, 10 aa, Artificial Sequence
  Description of Artificial Sequence: Synthetic peptide
  Seed: VKVLEYVIKV (MAGA1_HUMAN)
VNVLEYVIKV

SEQ ID NO: 42636 - protein, 9 aa, Artificial Sequence
  Description of Artificial Sequence: Synthetic peptide
  Seed: STDPPQSPQ (MAGA1_HUMAN)
SNDPPQSPV

SEQ ID NO: 42637 - protein, 9 aa, Artificial Sequence
  Description of Artificial Sequence: Synthetic peptide
  Seed: GPRALAETS (MAGA1_HUMAN)
GPRALAETV

SEQ ID NO: 42638 - protein, 9 aa, Artificial Sequence
  Description of Artificial Sequence: Synthetic peptide
  Seed: SYVKVLEYV (MAGA1_HUMAN)
SIVKVLEYM

SEQ ID NO: 42639 - protein, 10 aa, Artificial Sequence
  Description of Artificial Sequence: Synthetic peptide
  Seed: LVFGIDVKEA (MAGA1_HUMAN)
LTFGIDVKEV

SEQ ID NO: 42640 - protein, 9 aa, Artificial Sequence
  Description of Artificial Sequence: Synthetic peptide
  Seed: DLVGFLLLK (MAGA1_HUMAN)
DSVGFLLLR

SEQ ID NO: 42641 - protein, 10 aa, Artificial Sequence
  Description of Artificial Sequence: Synthetic peptide
  Seed: ADLVGFLLLK (MAGA1_HUMAN)
ASLVGFLLLR

SEQ ID NO: 42642 - protein, 10 aa, Artificial Sequence
  Description of Artificial Sequence: Synthetic peptide
  Seed: KASESLQLVF (MAGA1_HUMAN)
KASESLQLVY

SEQ ID NO: 42643 - protein, 9 aa, Artificial Sequence
  Description of Artificial Sequence: Synthetic peptide
  Seed: KASESLQLV (MAGA1_HUMAN)
KVSESLQLF

SEQ ID NO: 42644 - protein, 10 aa, Artificial Sequence
  Description of Artificial Sequence: Synthetic peptide
  Seed: ADPTGHSYVL (MAGA1_HUMAN)
AVPTGHSYVM

SEQ ID NO: 42645 - protein, 11 aa, Artificial Sequence
  Description of Artificial Sequence: Synthetic peptide
  Seed: KVADLVGFLLL (MAGA1_HUMAN)
KLADLVGFLLH

SEQ ID NO: 42646 - protein, 9 aa, Artificial Sequence
  Description of Artificial Sequence: Synthetic peptide
  Seed: RVRFFFPSL (MAGA1_HUMAN)
RWRFFFPSR

SEQ ID NO: 42647 - protein, 9 aa, Artificial Sequence
  Description of Artificial Sequence: Synthetic peptide
  Seed: QIMPKTGFL (MAGA1_HUMAN)
QPMPKTGFF

SEQ ID NO: 42648 - protein, 10 aa, Artificial Sequence
  Description of Artificial Sequence: Synthetic peptide
  Seed: ALAETSYVKV (MAGA1_HUMAN)
AQAETSYVKF

SEQ ID NO: 42649 - protein, 10 aa, Artificial Sequence
  Description of Artificial Sequence: Synthetic peptide
  Seed: IMPKTGFLII (MAGA1_HUMAN)
ILPKTGFLIV

SEQ ID NO: 42650 - protein, 9 aa, Artificial Sequence
  Description of Artificial Sequence: Synthetic peptide
  Seed: KTGFLIIVL (MAGA1_HUMAN)
KSGFLIIVF

SEQ ID NO: 42651 - protein, 9 aa, Artificial Sequence
  Description of Artificial Sequence: Synthetic peptide
  Seed: DLVGFLLLK (MAGA1_HUMAN)
DVVGFLLLR

SEQ ID NO: 42652 - protein, 9 aa, Artificial Sequence
  Description of Artificial Sequence: Synthetic peptide
  Seed: IAMEGGHAP (MAGA1_HUMAN)
ILMEGGHAY

SEQ ID NO: 42653 - protein, 9 aa, Artificial Sequence
  Description of Artificial Sequence: Synthetic peptide
  Seed: RYEFLWGPR (MAGA1_HUMAN)
RWEFLWGPR

SEQ ID NO: 42654 - protein, 8 aa, Artificial Sequence
  Description of Artificial Sequence: Synthetic peptide
  Seed: FFPSLREA (MAGA1_HUMAN)
FFPSLREM

SEQ ID NO: 42655 - protein, 10 aa, Artificial Sequence
  Description of Artificial Sequence: Synthetic peptide
  Seed: EVYDGREHSA (MAGA1_HUMAN)
ETYDGREHSR

SEQ ID NO: 42656 - protein, 9 aa, Artificial Sequence
  Description of Artificial Sequence: Synthetic peptide
  Seed: YKHCFPEIF (MAGA1_HUMAN)
YRHCFPEIL

SEQ ID NO: 42657 - protein, 11 aa, Artificial Sequence
  Description of Artificial Sequence: Synthetic peptide
  Seed: YVIKVSARVRF (MAGA1_HUMAN)
YQIKVSARVRY

SEQ ID NO: 42658 - protein, 9 aa, Artificial Sequence
  Description of Artificial Sequence: Synthetic peptide
  Seed: DLVGFLLLK (MAGA1_HUMAN)
DAVGFLLLR

SEQ ID NO: 42659 - protein, 11 aa, Artificial Sequence
  Description of Artificial Sequence: Synthetic peptide
  Seed: ETSYVKVLEYV (MAGA1_HUMAN)
EASYVKVLEYV

SEQ ID NO: 42660 - protein, 10 aa, Artificial Sequence
  Description of Artificial Sequence: Synthetic peptide
  Seed: FFPSLREAAL (MAGA1_HUMAN)
FMPSLREAAY

SEQ ID NO: 42661 - protein, 9 aa, Artificial Sequence
  Description of Artificial Sequence: Synthetic peptide
  Seed: MSLEQRSLH (MAGA1_HUMAN)
MQLEQRSLY

SEQ ID NO: 42662 - protein, 10 aa, Artificial Sequence
  Description of Artificial Sequence: Synthetic peptide
  Seed: SARVRFFFPS (MAGA1_HUMAN)
SGRVRFFFPK

SEQ ID NO: 42663 - protein, 9 aa, Artificial Sequence
  Description of Artificial Sequence: Synthetic peptide
  Seed: IAMEGGHAP (MAGA1_HUMAN)
ISMEGGHAY

SEQ ID NO: 42664 - protein, 9 aa, Artificial Sequence
  Description of Artificial Sequence: Synthetic peptide
  Seed: LVLGTLEEV (MAGA1_HUMAN)
LVLGTLEEM

SEQ ID NO: 42665 - protein, 10 aa, Artificial Sequence
  Description of Artificial Sequence: Synthetic peptide
  Seed: KKVADLVGFL (MAGA1_HUMAN)
KVVADLVGFV

SEQ ID NO: 42666 - protein, 10 aa, Artificial Sequence
  Description of Artificial Sequence: Synthetic peptide
  Seed: LVFGIDVKEA (MAGA1_HUMAN)
LMFGIDVKEV

SEQ ID NO: 42667 - protein, 9 aa, Artificial Sequence
  Description of Artificial Sequence: Synthetic peptide
  Seed: LVQEKYLEY (MAGA1_HUMAN)
LWQEKYLEF

SEQ ID NO: 42668 - protein, 9 aa, Artificial Sequence
  Description of Artificial Sequence: Synthetic peptide
  Seed: LESLFRAVI (MAGA1_HUMAN)
LHSLFRAVF

SEQ ID NO: 42669 - protein, 10 aa, Artificial Sequence
  Description of Artificial Sequence: Synthetic peptide
  Seed: QIMPKTGFLI (MAGA1_HUMAN)
QQMPKTGFLL

SEQ ID NO: 42670 - protein, 10 aa, Artificial Sequence
  Description of Artificial Sequence: Synthetic peptide
  Seed: KNYKHCFPEI (MAGA1_HUMAN)
KWYKHCFPEK

SEQ ID NO: 42671 - protein, 9 aa, Artificial Sequence
  Description of Artificial Sequence: Synthetic peptide
  Seed: LFRAVITKK (MAGA1_HUMAN)
LGRAVITKK

SEQ ID NO: 42672 - protein, 9 aa, Artificial Sequence
  Description of Artificial Sequence: Synthetic peptide
  Seed: CILESLFRA (MAGA1_HUMAN)
CLLESLFRM

SEQ ID NO: 42673 - protein, 9 aa, Artificial Sequence
  Description of Artificial Sequence: Synthetic peptide
  Seed: EIWEELSVM (MAGA1_HUMAN)
EMWEELSVV

SEQ ID NO: 42674 - protein, 10 aa, Artificial Sequence
  Description of Artificial Sequence: Synthetic peptide
  Seed: EHSAYGEPRK (MAGA1_HUMAN)
EVSAYGEPRK

SEQ ID NO: 42675 - protein, 8 aa, Artificial Sequence
  Description of Artificial Sequence: Synthetic peptide
  Seed: FLWGPRAL (MAGA1_HUMAN)
FMWGPRAV

SEQ ID NO: 42676 - protein, 9 aa, Artificial Sequence
  Description of Artificial Sequence: Synthetic peptide
  Seed: RVRFFFPSL (MAGA1_HUMAN)
RARFFFPSG

SEQ ID NO: 42677 - protein, 10 aa, Artificial Sequence
  Description of Artificial Sequence: Synthetic peptide
  Seed: SARVRFFFPS (MAGA1_HUMAN)
SQRVRFFFPY

SEQ ID NO: 42678 - protein, 9 aa, Artificial Sequence
  Description of Artificial Sequence: Synthetic peptide
  Seed: RQVPDSDPA (MAGA1_HUMAN)
RHVPDSDPF

SEQ ID NO: 42679 - protein, 10 aa, Artificial Sequence
  Description of Artificial Sequence: Synthetic peptide
  Seed: KEADPTGHSY (MAGA1_HUMAN)
KTADPTGHSF

SEQ ID NO: 42680 - protein, 8 aa, Artificial Sequence
  Description of Artificial Sequence: Synthetic peptide
  Seed: FLWGPRAL (MAGA1_HUMAN)
FFWGPRAY

SEQ ID NO: 42681 - protein, 9 aa, Artificial Sequence
  Description of Artificial Sequence: Synthetic peptide
  Seed: FFFPSLREA (MAGA1_HUMAN)
FRFPSLREI

SEQ ID NO: 42682 - protein, 9 aa, Artificial Sequence
  Description of Artificial Sequence: Synthetic peptide
  Seed: GLVCVQAAT (MAGA1_HUMAN)
GVVCVQAAV

SEQ ID NO: 42683 - protein, 8 aa, Artificial Sequence
  Description of Artificial Sequence: Synthetic peptide
  Seed: SARVRFFF (MAGA1_HUMAN)
SMRVRFFL

SEQ ID NO: 42684 - protein, 11 aa, Artificial Sequence
  Description of Artificial Sequence: Synthetic peptide
  Seed: ITKKVADLVGF (MAGA1_HUMAN)
ITKKVADLVGW

SEQ ID NO: 42685 - protein, 10 aa, Artificial Sequence
  Description of Artificial Sequence: Synthetic peptide
  Seed: YEFLWGPRAL (MAGA1_HUMAN)
YSFLWGPRAM

SEQ ID NO: 42686 - protein, 9 aa, Artificial Sequence
  Description of Artificial Sequence: Synthetic peptide
  Seed: HSYVLVTCL (MAGA1_HUMAN)
HMYVLVTCF

SEQ ID NO: 42687 - protein, 10 aa, Artificial Sequence
  Description of Artificial Sequence: Synthetic peptide
  Seed: WEELSVMEVY (MAGA1_HUMAN)
WFELSVMEVW

SEQ ID NO: 42688 - protein, 10 aa, Artificial Sequence
  Description of Artificial Sequence: Synthetic peptide
  Seed: RVRFFFPSLR (MAGA1_HUMAN)
RKRFFFPSLL

SEQ ID NO: 42689 - protein, 10 aa, Artificial Sequence
  Description of Artificial Sequence: Synthetic peptide
  Seed: ARVRFFFPSL (MAGA1_HUMAN)
ARVRFFFPSK

SEQ ID NO: 42690 - protein, 9 aa, Artificial Sequence
  Description of Artificial Sequence: Synthetic peptide
  Seed: REPVTKAEM (MAGA1_HUMAN)
RIPVTKAEY

SEQ ID NO: 42691 - protein, 11 aa, Artificial Sequence
  Description of Artificial Sequence: Synthetic peptide
  Seed: ELSVMEVYDGR (MAGA1_HUMAN)
EESVMEVYDGR

SEQ ID NO: 42692 - protein, 9 aa, Artificial Sequence
  Description of Artificial Sequence: Synthetic peptide
  Seed: RVRFFFPSL (MAGA1_HUMAN)
RMRFFFPSL

SEQ ID NO: 42693 - protein, 10 aa, Artificial Sequence
  Description of Artificial Sequence: Synthetic peptide
  Seed: KVLEYVIKVS (MAGA1_HUMAN)
KLLEYVIKVR

SEQ ID NO: 42694 - protein, 9 aa, Artificial Sequence
  Description of Artificial Sequence: Synthetic peptide
  Seed: AEMLESVIK (MAGA1_HUMAN)
AEMLESVIT

SEQ ID NO: 42695 - protein, 9 aa, Artificial Sequence
  Description of Artificial Sequence: Synthetic peptide
  Seed: VADLVGFLL (MAGA1_HUMAN)
VTDLVGFLW

SEQ ID NO: 42696 - protein, 9 aa, Artificial Sequence
  Description of Artificial Sequence: Synthetic peptide
  Seed: QSPQGASAF (MAGA1_HUMAN)
QFPQGASAM

SEQ ID NO: 42697 - protein, 9 aa, Artificial Sequence
  Description of Artificial Sequence: Synthetic peptide
  Seed: KVSARVRFF (MAGA1_HUMAN)
KMSARVRFA

SEQ ID NO: 42698 - protein, 9 aa, Artificial Sequence
  Description of Artificial Sequence: Synthetic peptide
  Seed: STDPPQSPQ (MAGA1_HUMAN)
SSDPPQSPV

SEQ ID NO: 42699 - protein, 9 aa, Artificial Sequence
  Description of Artificial Sequence: Synthetic peptide
  Seed: SAFPTTINF (MAGA1_HUMAN)
SGFPTTINV

SEQ ID NO: 42700 - protein, 9 aa, Artificial Sequence
  Description of Artificial Sequence: Synthetic peptide
  Seed: QIMPKTGFL (MAGA1_HUMAN)
QPMPKTGFV

SEQ ID NO: 42701 - protein, 11 aa, Artificial Sequence
  Description of Artificial Sequence: Synthetic peptide
  Seed: ARVRFFFPSLR (MAGA1_HUMAN)
AAVRFFFPSLR

SEQ ID NO: 42702 - protein, 10 aa, Artificial Sequence
  Description of Artificial Sequence: Synthetic peptide
  Seed: RAREPVTKAE (MAGA1_HUMAN)
RTREPVTKAM

SEQ ID NO: 42703 - protein, 10 aa, Artificial Sequence
  Description of Artificial Sequence: Synthetic peptide
  Seed: RYEFLWGPRA (MAGA1_HUMAN)
RTEFLWGPRK

SEQ ID NO: 42704 - protein, 9 aa, Artificial Sequence
  Description of Artificial Sequence: Synthetic peptide
  Seed: SARVRFFFP (MAGA1_HUMAN)
SWRVRFFFL

SEQ ID NO: 42705 - protein, 9 aa, Artificial Sequence
  Description of Artificial Sequence: Synthetic peptide
  Seed: GLVCVQAAT (MAGA1_HUMAN)
GLVCVQAAV

SEQ ID NO: 42706 - protein, 11 aa, Artificial Sequence
  Description of Artificial Sequence: Synthetic peptide
  Seed: RQVPDSDPARY (MAGA1_HUMAN)
RMVPDSDPARY

SEQ ID NO: 42707 - protein, 9 aa, Artificial Sequence
  Description of Artificial Sequence: Synthetic peptide
  Seed: SARVRFFFP (MAGA1_HUMAN)
SLRVRFFFK

SEQ ID NO: 42708 - protein, 9 aa, Artificial Sequence
  Description of Artificial Sequence: Synthetic peptide
  Seed: VPDSDPARY (MAGA1_HUMAN)
VMDSDPARY

SEQ ID NO: 42709 - protein, 10 aa, Artificial Sequence
  Description of Artificial Sequence: Synthetic peptide
  Seed: ARVRFFFPSL (MAGA1_HUMAN)
ARVRFFFPSV

SEQ ID NO: 42710 - protein, 9 aa, Artificial Sequence
  Description of Artificial Sequence: Synthetic peptide
  Seed: KVLEYVIKV (MAGA1_HUMAN)
KILEYVIKI

SEQ ID NO: 42711 - protein, 9 aa, Artificial Sequence
  Description of Artificial Sequence: Synthetic peptide
  Seed: LKYRAREPV (MAGA1_HUMAN)
LQYRAREPL

SEQ ID NO: 42712 - protein, 10 aa, Artificial Sequence
  Description of Artificial Sequence: Synthetic peptide
  Seed: DLVGFLLLKY (MAGA1_HUMAN)
DSVGFLLLKR

SEQ ID NO: 42713 - protein, 10 aa, Artificial Sequence
  Description of Artificial Sequence: Synthetic peptide
  Seed: RVRFFFPSLR (MAGA1_HUMAN)
RMRFFFPSLL

SEQ ID NO: 42714 - protein, 9 aa, Artificial Sequence
  Description of Artificial Sequence: Synthetic peptide
  Seed: LVGFLLLKY (MAGA1_HUMAN)
LFGFLLLKY

SEQ ID NO: 42715 - protein, 9 aa, Artificial Sequence
  Description of Artificial Sequence: Synthetic peptide
  Seed: RVRFFFPSL (MAGA1_HUMAN)
RLRFFFPSS

SEQ ID NO: 42716 - protein, 9 aa, Artificial Sequence
  Description of Artificial Sequence: Synthetic peptide
  Seed: VQAATSSSS (MAGA1_HUMAN)
VMAATSSSV

SEQ ID NO: 42717 - protein, 9 aa, Artificial Sequence
  Description of Artificial Sequence: Synthetic peptide
  Seed: SARVRFFFP (MAGA1_HUMAN)
SQRVRFFFA

SEQ ID NO: 42718 - protein, 9 aa, Artificial Sequence
  Description of Artificial Sequence: Synthetic peptide
  Seed: AATSSSSPL (MAGA1_HUMAN)
ARTSSSSPM

SEQ ID NO: 42719 - protein, 9 aa, Artificial Sequence
  Description of Artificial Sequence: Synthetic peptide
  Seed: FLWGPRALA (MAGA1_HUMAN)
FVWGPRALI

SEQ ID NO: 42720 - protein, 9 aa, Artificial Sequence
  Description of Artificial Sequence: Synthetic peptide
  Seed: LVLGTLEEV (MAGA1_HUMAN)
LALGTLEEF

SEQ ID NO: 42721 - protein, 9 aa, Artificial Sequence
  Description of Artificial Sequence: Synthetic peptide
  Seed: RQRQPSEGS (MAGA1_HUMAN)
RVRQPSEGL

SEQ ID NO: 42722 - protein, 10 aa, Artificial Sequence
  Description of Artificial Sequence: Synthetic peptide
  Seed: ADLVGFLLLK (MAGA1_HUMAN)
ALLVGFLLLR

SEQ ID NO: 42723 - protein, 9 aa, Artificial Sequence
  Description of Artificial Sequence: Synthetic peptide
  Seed: IMPKTGFLI (MAGA1_HUMAN)
IVPKTGFLL

SEQ ID NO: 42724 - protein, 9 aa, Artificial Sequence
  Description of Artificial Sequence: Synthetic peptide
  Seed: ARVRFFFPS (MAGA1_HUMAN)
ARVRFFFPI

SEQ ID NO: 42725 - protein, 10 aa, Artificial Sequence
  Description of Artificial Sequence: Synthetic peptide
  Seed: RVRFFFPSLR (MAGA1_HUMAN)
RSRFFFPSLK

SEQ ID NO: 42726 - protein, 11 aa, Artificial Sequence
  Description of Artificial Sequence: Synthetic peptide
  Seed: YVKVLEYVIKV (MAGA1_HUMAN)
YIKVLEYVIKV

SEQ ID NO: 42727 - protein, 10 aa, Artificial Sequence
  Description of Artificial Sequence: Synthetic peptide
  Seed: QIMPKTGFLI (MAGA1_HUMAN)
QMMPKTGFLV

SEQ ID NO: 42728 - protein, 10 aa, Artificial Sequence
  Description of Artificial Sequence: Synthetic peptide
  Seed: TSYVKVLEYV (MAGA1_HUMAN)
TSYVKVLEYW

SEQ ID NO: 42729 - protein, 8 aa, Artificial Sequence
  Description of Artificial Sequence: Synthetic peptide
  Seed: ADLVGFLL (MAGA1_HUMAN)
AELVGFLL

SEQ ID NO: 42730 - protein, 10 aa, Artificial Sequence
  Description of Artificial Sequence: Synthetic peptide
  Seed: SARVRFFFPS (MAGA1_HUMAN)
SQRVRFFFPM

SEQ ID NO: 42731 - protein, 10 aa, Artificial Sequence
  Description of Artificial Sequence: Synthetic peptide
  Seed: ATSSSSPLVL (MAGA1_HUMAN)
ASSSSSPLVW

SEQ ID NO: 42732 - protein, 8 aa, Artificial Sequence
  Description of Artificial Sequence: Synthetic peptide
  Seed: HSYVLVTC (MAGA1_HUMAN)
HQYVLVTM

SEQ ID NO: 42733 - protein, 9 aa, Artificial Sequence
  Description of Artificial Sequence: Synthetic peptide
  Seed: TSYVKVLEY (MAGA1_HUMAN)
TPYVKVLEM

SEQ ID NO: 42734 - protein, 10 aa, Artificial Sequence
  Description of Artificial Sequence: Synthetic peptide
  Seed: EIFGKASESL (MAGA1_HUMAN)
EIFGKASESK

SEQ ID NO: 42735 - protein, 9 aa, Artificial Sequence
  Description of Artificial Sequence: Synthetic peptide
  Seed: LVTCLGLSY (MAGA1_HUMAN)
LITCLGLSF

SEQ ID NO: 42736 - protein, 10 aa, Artificial Sequence
  Description of Artificial Sequence: Synthetic peptide
  Seed: RVRFFFPSLR (MAGA1_HUMAN)
RQRFFFPSLV

SEQ ID NO: 42737 - protein, 9 aa, Artificial Sequence
  Description of Artificial Sequence: Synthetic peptide
  Seed: RVRFFFPSL (MAGA1_HUMAN)
RQRFFFPSG

SEQ ID NO: 42738 - protein, 9 aa, Artificial Sequence
  Description of Artificial Sequence: Synthetic peptide
  Seed: KYRAREPVT (MAGA1_HUMAN)
KSRAREPVT

SEQ ID NO: 42739 - protein, 9 aa, Artificial Sequence
  Description of Artificial Sequence: Synthetic peptide
  Seed: LEYVIKVSA (MAGA1_HUMAN)
LEYVIKVSI

SEQ ID NO: 42740 - protein, 9 aa, Artificial Sequence
  Description of Artificial Sequence: Synthetic peptide
  Seed: HCFPEIFGK (MAGA1_HUMAN)
HAFPEIFGF

SEQ ID NO: 42741 - protein, 10 aa, Artificial Sequence
  Description of Artificial Sequence: Synthetic peptide
  Seed: VYDGREHSAY (MAGA1_HUMAN)
VIDGREHSAY

SEQ ID NO: 42742 - protein, 8 aa, Artificial Sequence
  Description of Artificial Sequence: Synthetic peptide
  Seed: MSLEQRSL (MAGA1_HUMAN)
MQLEQRSL

SEQ ID NO: 42743 - protein, 8 aa, Artificial Sequence
  Description of Artificial Sequence: Synthetic peptide
  Seed: FLWGPRAL (MAGA1_HUMAN)
FAWGPRAY

SEQ ID NO: 42744 - protein, 10 aa, Artificial Sequence
  Description of Artificial Sequence: Synthetic peptide
  Seed: SAFPTTINFT (MAGA1_HUMAN)
STFPTTINFL

SEQ ID NO: 42745 - protein, 9 aa, Artificial Sequence
  Description of Artificial Sequence: Synthetic peptide
  Seed: EIWEELSVM (MAGA1_HUMAN)
EVWEELSVI

SEQ ID NO: 42746 - protein, 9 aa, Artificial Sequence
  Description of Artificial Sequence: Synthetic peptide
  Seed: STDPPQSPQ (MAGA1_HUMAN)
STDPPQSPI

SEQ ID NO: 42747 - protein, 9 aa, Artificial Sequence
  Description of Artificial Sequence: Synthetic peptide
  Seed: RQVPDSDPA (MAGA1_HUMAN)
RAVPDSDPY

SEQ ID NO: 42748 - protein, 9 aa, Artificial Sequence
  Description of Artificial Sequence: Synthetic peptide
  Seed: TSYVKVLEY (MAGA1_HUMAN)
TTYVKVLEV

SEQ ID NO: 42749 - protein, 11 aa, Artificial Sequence
  Description of Artificial Sequence: Synthetic peptide
  Seed: EVYDGREHSAY (MAGA1_HUMAN)
ELYDGREHSAR

SEQ ID NO: 42750 - protein, 9 aa, Artificial Sequence
  Description of Artificial Sequence: Synthetic peptide
  Seed: ETSYVKVLE (MAGA1_HUMAN)
ETSYVKVLK

SEQ ID NO: 42751 - protein, 9 aa, Artificial Sequence
  Description of Artificial Sequence: Synthetic peptide
  Seed: HSYVLVTCL (MAGA1_HUMAN)
HKYVLVTCF

SEQ ID NO: 42752 - protein, 10 aa, Artificial Sequence
  Description of Artificial Sequence: Synthetic peptide
  Seed: RVRFFFPSLR (MAGA1_HUMAN)
RIRFFFPSLP

SEQ ID NO: 42753 - protein, 9 aa, Artificial Sequence
  Description of Artificial Sequence: Synthetic peptide
  Seed: TTINFTRQR (MAGA1_HUMAN)
TTINFTRQY

SEQ ID NO: 42754 - protein, 9 aa, Artificial Sequence
  Description of Artificial Sequence: Synthetic peptide
  Seed: FFFPSLREA (MAGA1_HUMAN)
FMFPSLREA

SEQ ID NO: 42755 - protein, 9 aa, Artificial Sequence
  Description of Artificial Sequence: Synthetic peptide
  Seed: RAREPVTKA (MAGA1_HUMAN)
RYREPVTKF

SEQ ID NO: 42756 - protein, 10 aa, Artificial Sequence
  Description of Artificial Sequence: Synthetic peptide
  Seed: KEADPTGHSY (MAGA1_HUMAN)
KVADPTGHSV

SEQ ID NO: 42757 - protein, 8 aa, Artificial Sequence
  Description of Artificial Sequence: Synthetic peptide
  Seed: ADPTGHSY (MAGA1_HUMAN)
AAPTGHSY

SEQ ID NO: 42758 - protein, 10 aa, Artificial Sequence
  Description of Artificial Sequence: Synthetic peptide
  Seed: RVRFFFPSLR (MAGA1_HUMAN)
RGRFFFPSLI

SEQ ID NO: 42759 - protein, 9 aa, Artificial Sequence
  Description of Artificial Sequence: Synthetic peptide
  Seed: EYVIKVSAR (MAGA1_HUMAN)
EAVIKVSAK

SEQ ID NO: 42760 - protein, 9 aa, Artificial Sequence
  Description of Artificial Sequence: Synthetic peptide
  Seed: EIWEELSVM (MAGA1_HUMAN)
EAWEELSVF

SEQ ID NO: 42761 - protein, 9 aa, Artificial Sequence
  Description of Artificial Sequence: Synthetic peptide
  Seed: TTINFTRQR (MAGA1_HUMAN)
TSINFTRQM

SEQ ID NO: 42762 - protein, 10 aa, Artificial Sequence
  Description of Artificial Sequence: Synthetic peptide
  Seed: SAFPTTINFT (MAGA1_HUMAN)
STFPTTINFI

SEQ ID NO: 42763 - protein, 10 aa, Artificial Sequence
  Description of Artificial Sequence: Synthetic peptide
  Seed: WEELSVMEVY (MAGA1_HUMAN)
WEELSVMEVW

SEQ ID NO: 42764 - protein, 10 aa, Artificial Sequence
  Description of Artificial Sequence: Synthetic peptide
  Seed: FFPSLREAAL (MAGA1_HUMAN)
FDPSLREAAY

SEQ ID NO: 42765 - protein, 11 aa, Artificial Sequence
  Description of Artificial Sequence: Synthetic peptide
  Seed: SCILESLFRAV (MAGA1_HUMAN)
SFILESLFRAV

SEQ ID NO: 42766 - protein, 9 aa, Artificial Sequence
  Description of Artificial Sequence: Synthetic peptide
  Seed: AATSSSSPL (MAGA1_HUMAN)
AKTSSSSPY

SEQ ID NO: 42767 - protein, 9 aa, Artificial Sequence
  Description of Artificial Sequence: Synthetic peptide
  Seed: TSYVKVLEY (MAGA1_HUMAN)
THYVKVLEM

SEQ ID NO: 42768 - protein, 9 aa, Artificial Sequence
  Description of Artificial Sequence: Synthetic peptide
  Seed: QSPQGASAF (MAGA1_HUMAN)
QYPQGASAF

SEQ ID NO: 42769 - protein, 9 aa, Artificial Sequence
  Description of Artificial Sequence: Synthetic peptide
  Seed: AQQEALGLV (MAGA1_HUMAN)
ALQEALGLF

SEQ ID NO: 42770 - protein, 10 aa, Artificial Sequence
  Description of Artificial Sequence: Synthetic peptide
  Seed: EEEGPSTSCI (MAGA1_HUMAN)
EEEGPSTSCW

SEQ ID NO: 42771 - protein, 9 aa, Artificial Sequence
  Description of Artificial Sequence: Synthetic peptide
  Seed: CILESLFRA (MAGA1_HUMAN)
CTLESLFRA

SEQ ID NO: 42772 - protein, 10 aa, Artificial Sequence
  Description of Artificial Sequence: Synthetic peptide
  Seed: RVRFFFPSLR (MAGA1_HUMAN)
RIRFFFPSLF

SEQ ID NO: 42773 - protein, 10 aa, Artificial Sequence
  Description of Artificial Sequence: Synthetic peptide
  Seed: ARVRFFFPSL (MAGA1_HUMAN)
ACVRFFFPSK

SEQ ID NO: 42774 - protein, 10 aa, Artificial Sequence
  Description of Artificial Sequence: Synthetic peptide
  Seed: SARVRFFFPS (MAGA1_HUMAN)
SDRVRFFFPY

SEQ ID NO: 42775 - protein, 10 aa, Artificial Sequence
  Description of Artificial Sequence: Synthetic peptide
  Seed: SARVRFFFPS (MAGA1_HUMAN)
SSRVRFFFPK

SEQ ID NO: 42776 - protein, 9 aa, Artificial Sequence
  Description of Artificial Sequence: Synthetic peptide
  Seed: FPSLREAAL (MAGA1_HUMAN)
FSSLREAAV

SEQ ID NO: 42777 - protein, 9 aa, Artificial Sequence
  Description of Artificial Sequence: Synthetic peptide
  Seed: KYRAREPVT (MAGA1_HUMAN)
KVRAREPVS

SEQ ID NO: 42778 - protein, 9 aa, Artificial Sequence
  Description of Artificial Sequence: Synthetic peptide
  Seed: YVIKVSARV (MAGA1_HUMAN)
YMIKVSARC

SEQ ID NO: 42779 - protein, 9 aa, Artificial Sequence
  Description of Artificial Sequence: Synthetic peptide
  Seed: TSYVKVLEY (MAGA1_HUMAN)
TQYVKVLEW

SEQ ID NO: 42780 - protein, 10 aa, Artificial Sequence
  Description of Artificial Sequence: Synthetic peptide
  Seed: EVYDGREHSA (MAGA1_HUMAN)
EQYDGREHSY

SEQ ID NO: 42781 - protein, 9 aa, Artificial Sequence
  Description of Artificial Sequence: Synthetic peptide
  Seed: SAYGEPRKL (MAGA1_HUMAN)
SVYGEPRKM

SEQ ID NO: 42782 - protein, 10 aa, Artificial Sequence
  Description of Artificial Sequence: Synthetic peptide
  Seed: FFPSLREAAL (MAGA1_HUMAN)
FIPSLREAAF

SEQ ID NO: 42783 - protein, 11 aa, Artificial Sequence
  Description of Artificial Sequence: Synthetic peptide
  Seed: EEEGPSTSCIL (MAGA1_HUMAN)
EEEGPSTSCIW

SEQ ID NO: 42784 - protein, 9 aa, Artificial Sequence
  Description of Artificial Sequence: Synthetic peptide
  Seed: KVLEYVIKV (MAGA1_HUMAN)
KNLEYVIKL

SEQ ID NO: 42785 - protein, 10 aa, Artificial Sequence
  Description of Artificial Sequence: Synthetic peptide
  Seed: SAFPTTINFT (MAGA1_HUMAN)
SMFPTTINFA

SEQ ID NO: 42786 - protein, 10 aa, Artificial Sequence
  Description of Artificial Sequence: Synthetic peptide
  Seed: STSCILESLF (MAGA1_HUMAN)
SWSCILESLW

SEQ ID NO: 42787 - protein, 9 aa, Artificial Sequence
  Description of Artificial Sequence: Synthetic peptide
  Seed: VQAATSSSS (MAGA1_HUMAN)
VIAATSSSF

SEQ ID NO: 42788 - protein, 10 aa, Artificial Sequence
  Description of Artificial Sequence: Synthetic peptide
  Seed: RAREPVTKAE (MAGA1_HUMAN)
RFREPVTKAK

SEQ ID NO: 42789 - protein, 10 aa, Artificial Sequence
  Description of Artificial Sequence: Synthetic peptide
  Seed: IMPKTGFLII (MAGA1_HUMAN)
IWPKTGFLII

SEQ ID NO: 42790 - protein, 9 aa, Artificial Sequence
  Description of Artificial Sequence: Synthetic peptide
  Seed: MPKTGFLII (MAGA1_HUMAN)
MTKTGFLIY

SEQ ID NO: 42791 - protein, 10 aa, Artificial Sequence
  Description of Artificial Sequence: Synthetic peptide
  Seed: KVADLVGFLL (MAGA1_HUMAN)
KVADLVGFLV

SEQ ID NO: 42792 - protein, 11 aa, Artificial Sequence
  Description of Artificial Sequence: Synthetic peptide
  Seed: MEGGHAPEEEI (MAGA1_HUMAN)
MEGGHAPEEEW

SEQ ID NO: 42793 - protein, 9 aa, Artificial Sequence
  Description of Artificial Sequence: Synthetic peptide
  Seed: KYRAREPVT (MAGA1_HUMAN)
KTRAREPVI

SEQ ID NO: 42794 - protein, 11 aa, Artificial Sequence
  Description of Artificial Sequence: Synthetic peptide
  Seed: IKVSARVRFFF (MAGA1_HUMAN)
ITVSARVRFFW

SEQ ID NO: 42795 - protein, 10 aa, Artificial Sequence
  Description of Artificial Sequence: Synthetic peptide
  Seed: ASAFPTTINF (MAGA1_HUMAN)
AKAFPTTINY

SEQ ID NO: 42796 - protein, 11 aa, Artificial Sequence
  Description of Artificial Sequence: Synthetic peptide
  Seed: AEMLESVIKNY (MAGA1_HUMAN)
AEMLESVIKNL

SEQ ID NO: 42797 - protein, 11 aa, Artificial Sequence
  Description of Artificial Sequence: Synthetic peptide
  Seed: STSCILESLFR (MAGA1_HUMAN)
SISCILESLFK

SEQ ID NO: 42798 - protein, 9 aa, Artificial Sequence
  Description of Artificial Sequence: Synthetic peptide
  Seed: HSYVLVTCL (MAGA1_HUMAN)
HKYVLVTCL

SEQ ID NO: 42799 - protein, 9 aa, Artificial Sequence
  Description of Artificial Sequence: Synthetic peptide
  Seed: IMPKTGFLI (MAGA1_HUMAN)
ITPKTGFLF

SEQ ID NO: 42800 - protein, 10 aa, Artificial Sequence
  Description of Artificial Sequence: Synthetic peptide
  Seed: KVADLVGFLL (MAGA1_HUMAN)
KMADLVGFLL

SEQ ID NO: 42801 - protein, 11 aa, Artificial Sequence
  Description of Artificial Sequence: Synthetic peptide
  Seed: VQAATSSSSPL (MAGA1_HUMAN)
VQAATSSSSPM

SEQ ID NO: 42802 - protein, 9 aa, Artificial Sequence
  Description of Artificial Sequence: Synthetic peptide
  Seed: LEEVPTAGS (MAGA1_HUMAN)
LEEVPTAGV

SEQ ID NO: 42803 - protein, 10 aa, Artificial Sequence
  Description of Artificial Sequence: Synthetic peptide
  Seed: RVRFFFPSLR (MAGA1_HUMAN)
RFRFFFPSLA

SEQ ID NO: 42804 - protein, 9 aa, Artificial Sequence
  Description of Artificial Sequence: Synthetic peptide
  Seed: FFFPSLREA (MAGA1_HUMAN)
FWFPSLREF

SEQ ID NO: 42805 - protein, 9 aa, Artificial Sequence
  Description of Artificial Sequence: Synthetic peptide
  Seed: LESLFRAVI (MAGA1_HUMAN)
LTSLFRAVY

SEQ ID NO: 42806 - protein, 9 aa, Artificial Sequence
  Description of Artificial Sequence: Synthetic peptide
  Seed: TQDLVQEKY (MAGA1_HUMAN)
TCDLVQEKL

SEQ ID NO: 42807 - protein, 9 aa, Artificial Sequence
  Description of Artificial Sequence: Synthetic peptide
  Seed: EADPTGHSY (MAGA1_HUMAN)
EIDPTGHSY

SEQ ID NO: 42808 - protein, 9 aa, Artificial Sequence
  Description of Artificial Sequence: Synthetic peptide
  Seed: SSPLVLGTL (MAGA1_HUMAN)
STPLVLGTV

SEQ ID NO: 42809 - protein, 9 aa, Artificial Sequence
  Description of Artificial Sequence: Synthetic peptide
  Seed: SARVRFFFP (MAGA1_HUMAN)
SWRVRFFFK

SEQ ID NO: 42810 - protein, 9 aa, Artificial Sequence
  Description of Artificial Sequence: Synthetic peptide
  Seed: VQAATSSSS (MAGA1_HUMAN)
VLAATSSSF

SEQ ID NO: 42811 - protein, 9 aa, Artificial Sequence
  Description of Artificial Sequence: Synthetic peptide
  Seed: RQRQPSEGS (MAGA1_HUMAN)
RSRQPSEGK

SEQ ID NO: 42812 - protein, 9 aa, Artificial Sequence
  Description of Artificial Sequence: Synthetic peptide
  Seed: RALAETSYV (MAGA1_HUMAN)
RGLAETSYW

SEQ ID NO: 42813 - protein, 9 aa, Artificial Sequence
  Description of Artificial Sequence: Synthetic peptide
  Seed: EADPTGHSY (MAGA1_HUMAN)
EGDPTGHSL

SEQ ID NO: 42814 - protein, 10 aa, Artificial Sequence
  Description of Artificial Sequence: Synthetic peptide
  Seed: SDPARYEFLW (MAGA1_HUMAN)
SHPARYEFLW

SEQ ID NO: 42815 - protein, 9 aa, Artificial Sequence
  Description of Artificial Sequence: Synthetic peptide
  Seed: YVIKVSARV (MAGA1_HUMAN)
YTIKVSARI

SEQ ID NO: 42816 - protein, 9 aa, Artificial Sequence
  Description of Artificial Sequence: Synthetic peptide
  Seed: FFFPSLREA (MAGA1_HUMAN)
FVFPSLREW

SEQ ID NO: 42817 - protein, 9 aa, Artificial Sequence
  Description of Artificial Sequence: Synthetic peptide
  Seed: RVRFFFPSL (MAGA1_HUMAN)
RTRFFFPSF

SEQ ID NO: 42818 - protein, 10 aa, Artificial Sequence
  Description of Artificial Sequence: Synthetic peptide
  Seed: RVRFFFPSLR (MAGA1_HUMAN)
RIRFFFPSLL

SEQ ID NO: 42819 - protein, 8 aa, Artificial Sequence
  Description of Artificial Sequence: Synthetic peptide
  Seed: LESLFRAV (MAGA1_HUMAN)
LQSLFRAI

SEQ ID NO: 42820 - protein, 9 aa, Artificial Sequence
  Description of Artificial Sequence: Synthetic peptide
  Seed: ARVRFFFPS (MAGA1_HUMAN)
AQVRFFFPI

SEQ ID NO: 42821 - protein, 10 aa, Artificial Sequence
  Description of Artificial Sequence: Synthetic peptide
  Seed: ASAFPTTINF (MAGA1_HUMAN)
AWAFPTTINW

SEQ ID NO: 42822 - protein, 9 aa, Artificial Sequence
  Description of Artificial Sequence: Synthetic peptide
  Seed: RALAETSYV (MAGA1_HUMAN)
RSLAETSYL

SEQ ID NO: 42823 - protein, 9 aa, Artificial Sequence
  Description of Artificial Sequence: Synthetic peptide
  Seed: YDGREHSAY (MAGA1_HUMAN)
YLGREHSAY

SEQ ID NO: 42824 - protein, 11 aa, Artificial Sequence
  Description of Artificial Sequence: Synthetic peptide
  Seed: ELSVMEVYDGR (MAGA1_HUMAN)
EGSVMEVYDGR

SEQ ID NO: 42825 - protein, 9 aa, Artificial Sequence
  Description of Artificial Sequence: Synthetic peptide
  Seed: VYDGREHSA (MAGA1_HUMAN)
VTDGREHSI

SEQ ID NO: 42826 - protein, 10 aa, Artificial Sequence
  Description of Artificial Sequence: Synthetic peptide
  Seed: VLVTCLGLSY (MAGA1_HUMAN)
VLVTCLGLSF

SEQ ID NO: 42827 - protein, 9 aa, Artificial Sequence
  Description of Artificial Sequence: Synthetic peptide
  Seed: QSPQGASAF (MAGA1_HUMAN)
QAPQGASAF

SEQ ID NO: 42828 - protein, 11 aa, Artificial Sequence
  Description of Artificial Sequence: Synthetic peptide
  Seed: SARVRFFFPSL (MAGA1_HUMAN)
SPRVRFFFPSM

SEQ ID NO: 42829 - protein, 8 aa, Artificial Sequence
  Description of Artificial Sequence: Synthetic peptide
  Seed: TGFLIIVL (MAGA1_HUMAN)
TQFLIIVL

SEQ ID NO: 42830 - protein, 9 aa, Artificial Sequence
  Description of Artificial Sequence: Synthetic peptide
  Seed: GKASESLQL (MAGA1_HUMAN)
GQASESLQF

SEQ ID NO: 42831 - protein, 9 aa, Artificial Sequence
  Description of Artificial Sequence: Synthetic peptide
  Seed: LVTCLGLSY (MAGA1_HUMAN)
LRTCLGLSY

SEQ ID NO: 42832 - protein, 9 aa, Artificial Sequence
  Description of Artificial Sequence: Synthetic peptide
  Seed: FPSLREAAL (MAGA1_HUMAN)
FTSLREAAF

SEQ ID NO: 42833 - protein, 10 aa, Artificial Sequence
  Description of Artificial Sequence: Synthetic peptide
  Seed: KVLEYVIKVS (MAGA1_HUMAN)
KMLEYVIKVR

SEQ ID NO: 42834 - protein, 9 aa, Artificial Sequence
  Description of Artificial Sequence: Synthetic peptide
  Seed: LVQEKYLEY (MAGA1_HUMAN)
LSQEKYLEF

SEQ ID NO: 42835 - protein, 9 aa, Artificial Sequence
  Description of Artificial Sequence: Synthetic peptide
  Seed: LFRAVITKK (MAGA1_HUMAN)
LYRAVITKK

SEQ ID NO: 42836 - protein, 9 aa, Artificial Sequence
  Description of Artificial Sequence: Synthetic peptide
  Seed: RVRFFFPSL (MAGA1_HUMAN)
RFRFFFPSR

SEQ ID NO: 42837 - protein, 10 aa, Artificial Sequence
  Description of Artificial Sequence: Synthetic peptide
  Seed: RVRFFFPSLR (MAGA1_HUMAN)
RERFFFPSLF

SEQ ID NO: 42838 - protein, 9 aa, Artificial Sequence
  Description of Artificial Sequence: Synthetic peptide
  Seed: RVRFFFPSL (MAGA1_HUMAN)
RFRFFFPSS

SEQ ID NO: 42839 - protein, 9 aa, Artificial Sequence
  Description of Artificial Sequence: Synthetic peptide
  Seed: LVLGTLEEV (MAGA1_HUMAN)
LVLGTLEEA

SEQ ID NO: 42840 - protein, 9 aa, Artificial Sequence
  Description of Artificial Sequence: Synthetic peptide
  Seed: LTQDLVQEK (MAGA1_HUMAN)
LAQDLVQEF

SEQ ID NO: 42841 - protein, 11 aa, Artificial Sequence
  Description of Artificial Sequence: Synthetic peptide
  Seed: KVADLVGFLLL (MAGA1_HUMAN)
KLADLVGFLLP

SEQ ID NO: 42842 - protein, 11 aa, Artificial Sequence
  Description of Artificial Sequence: Synthetic peptide
  Seed: RVRFFFPSLRE (MAGA1_HUMAN)
RVRFFFPSLRS

SEQ ID NO: 42843 - protein, 9 aa, Artificial Sequence
  Description of Artificial Sequence: Synthetic peptide
  Seed: SAFPTTINF (MAGA1_HUMAN)
SLFPTTINR

SEQ ID NO: 42844 - protein, 11 aa, Artificial Sequence
  Description of Artificial Sequence: Synthetic peptide
  Seed: EVYDGREHSAY (MAGA1_HUMAN)
ETYDGREHSAW

SEQ ID NO: 42845 - protein, 9 aa, Artificial Sequence
  Description of Artificial Sequence: Synthetic peptide
  Seed: RVRFFFPSL (MAGA1_HUMAN)
RNRFFFPST

SEQ ID NO: 42846 - protein, 9 aa, Artificial Sequence
  Description of Artificial Sequence: Synthetic peptide
  Seed: YVLVTCLGL (MAGA1_HUMAN)
YILVTCLGY

SEQ ID NO: 42847 - protein, 9 aa, Artificial Sequence
  Description of Artificial Sequence: Synthetic peptide
  Seed: HCFPEIFGK (MAGA1_HUMAN)
HIFPEIFGY

SEQ ID NO: 42848 - protein, 9 aa, Artificial Sequence
  Description of Artificial Sequence: Synthetic peptide
  Seed: SAFPTTINF (MAGA1_HUMAN)
SDFPTTINV

SEQ ID NO: 42849 - protein, 9 aa, Artificial Sequence
  Description of Artificial Sequence: Synthetic peptide
  Seed: ITKKVADLV (MAGA1_HUMAN)
ISKKVADLY

SEQ ID NO: 42850 - protein, 9 aa, Artificial Sequence
  Description of Artificial Sequence: Synthetic peptide
  Seed: AETSYVKVL (MAGA1_HUMAN)
AMTSYVKVF

SEQ ID NO: 42851 - protein, 9 aa, Artificial Sequence
  Description of Artificial Sequence: Synthetic peptide
  Seed: RAREPVTKA (MAGA1_HUMAN)
RSREPVTKR

SEQ ID NO: 42852 - protein, 10 aa, Artificial Sequence
  Description of Artificial Sequence: Synthetic peptide
  Seed: WEELSVMEVY (MAGA1_HUMAN)
WCELSVMEVW

SEQ ID NO: 42853 - protein, 10 aa, Artificial Sequence
  Description of Artificial Sequence: Synthetic peptide
  Seed: LVFGIDVKEA (MAGA1_HUMAN)
LVFGIDVKEV

SEQ ID NO: 42854 - protein, 9 aa, Artificial Sequence
  Description of Artificial Sequence: Synthetic peptide
  Seed: RVRFFFPSL (MAGA1_HUMAN)
RCRFFFPSI

SEQ ID NO: 42855 - protein, 9 aa, Artificial Sequence
  Description of Artificial Sequence: Synthetic peptide
  Seed: DLVGFLLLK (MAGA1_HUMAN)
DAVGFLLLK

SEQ ID NO: 42856 - protein, 10 aa, Artificial Sequence
  Description of Artificial Sequence: Synthetic peptide
  Seed: FFFPSLREAA (MAGA1_HUMAN)
FWFPSLREAL

SEQ ID NO: 42857 - protein, 10 aa, Artificial Sequence
  Description of Artificial Sequence: Synthetic peptide
  Seed: ESLFRAVITK (MAGA1_HUMAN)
EHLFRAVITR

SEQ ID NO: 42858 - protein, 10 aa, Artificial Sequence
  Description of Artificial Sequence: Synthetic peptide
  Seed: RAREPVTKAE (MAGA1_HUMAN)
RSREPVTKAI

SEQ ID NO: 42859 - protein, 10 aa, Artificial Sequence
  Description of Artificial Sequence: Synthetic peptide
  Seed: SLFRAVITKK (MAGA1_HUMAN)
SDFRAVITKR

SEQ ID NO: 42860 - protein, 11 aa, Artificial Sequence
  Description of Artificial Sequence: Synthetic peptide
  Seed: KVADLVGFLLL (MAGA1_HUMAN)
KLADLVGFLLT

SEQ ID NO: 42861 - protein, 10 aa, Artificial Sequence
  Description of Artificial Sequence: Synthetic peptide
  Seed: QIMPKTGFLI (MAGA1_HUMAN)
QLMPKTGFLM

SEQ ID NO: 42862 - protein, 9 aa, Artificial Sequence
  Description of Artificial Sequence: Synthetic peptide
  Seed: SVMEVYDGR (MAGA1_HUMAN)
SYMEVYDGR

SEQ ID NO: 42863 - protein, 8 aa, Artificial Sequence
  Description of Artificial Sequence: Synthetic peptide
  Seed: AFPTTINF (MAGA1_HUMAN)
AYPTTINF

SEQ ID NO: 42864 - protein, 10 aa, Artificial Sequence
  Description of Artificial Sequence: Synthetic peptide
  Seed: FFPSLREAAL (MAGA1_HUMAN)
FCPSLREAAM

SEQ ID NO: 42865 - protein, 10 aa, Artificial Sequence
  Description of Artificial Sequence: Synthetic peptide
  Seed: RQPSEGSSSR (MAGA1_HUMAN)
RVPSEGSSSR

SEQ ID NO: 42866 - protein, 10 aa, Artificial Sequence
  Description of Artificial Sequence: Synthetic peptide
  Seed: KYRAREPVTK (MAGA1_HUMAN)
KMRAREPVTR

SEQ ID NO: 42867 - protein, 9 aa, Artificial Sequence
  Description of Artificial Sequence: Synthetic peptide
  Seed: TSSSSPLVL (MAGA1_HUMAN)
TQSSSPLVW

SEQ ID NO: 42868 - protein, 10 aa, Artificial Sequence
  Description of Artificial Sequence: Synthetic peptide
  Seed: ASAFPTTINF (MAGA1_HUMAN)
ARAFPTTINW

SEQ ID NO: 42869 - protein, 9 aa, Artificial Sequence
  Description of Artificial Sequence: Synthetic peptide
  Seed: YVIKVSARV (MAGA1_HUMAN)
YMIKVSARL

SEQ ID NO: 42870 - protein, 9 aa, Artificial Sequence
  Description of Artificial Sequence: Synthetic peptide
  Seed: QPSEGSSSR (MAGA1_HUMAN)
QSSEGSSSR

SEQ ID NO: 42871 - protein, 9 aa, Artificial Sequence
  Description of Artificial Sequence: Synthetic peptide
  Seed: FFFPSLREA (MAGA1_HUMAN)
FCFPSLREL

SEQ ID NO: 42872 - protein, 10 aa, Artificial Sequence
  Description of Artificial Sequence: Synthetic peptide
  Seed: RYEFLWGPRA (MAGA1_HUMAN)
RVEFLWGPRL

SEQ ID NO: 42873 - protein, 9 aa, Artificial Sequence
  Description of Artificial Sequence: Synthetic peptide
  Seed: YKHCFPEIF (MAGA1_HUMAN)
YLHCFPEIM

SEQ ID NO: 42874 - protein, 10 aa, Artificial Sequence
  Description of Artificial Sequence: Synthetic peptide
  Seed: LSVMEVYDGR (MAGA1_HUMAN)
LQVMEVYDGR

SEQ ID NO: 42875 - protein, 9 aa, Artificial Sequence
  Description of Artificial Sequence: Synthetic peptide
  Seed: RQRQPSEGS (MAGA1_HUMAN)
RIRQPSEGA

SEQ ID NO: 42876 - protein, 10 aa, Artificial Sequence
  Description of Artificial Sequence: Synthetic peptide
  Seed: KVADLVGFLL (MAGA1_HUMAN)
KLADLVGFLF

SEQ ID NO: 42877 - protein, 10 aa, Artificial Sequence
  Description of Artificial Sequence: Synthetic peptide
  Seed: TTINFTRQRQ (MAGA1_HUMAN)
TVINFTRQRR

SEQ ID NO: 42878 - protein, 9 aa, Artificial Sequence
  Description of Artificial Sequence: Synthetic peptide
  Seed: FPSLREAAL (MAGA1_HUMAN)
FASLREAAM

SEQ ID NO: 42879 - protein, 10 aa, Artificial Sequence
  Description of Artificial Sequence: Synthetic peptide
  Seed: ADLVGFLLLK (MAGA1_HUMAN)
AALVGFLLLK

SEQ ID NO: 42880 - protein, 10 aa, Artificial Sequence
  Description of Artificial Sequence: Synthetic peptide
  Seed: SARVRFFFPS (MAGA1_HUMAN)
SERVRFFFPR

SEQ ID NO: 42881 - protein, 10 aa, Artificial Sequence
  Description of Artificial Sequence: Synthetic peptide
  Seed: KEADPTGHSY (MAGA1_HUMAN)
KEADPTGHSP

SEQ ID NO: 42882 - protein, 10 aa, Artificial Sequence
  Description of Artificial Sequence: Synthetic peptide
  Seed: RVRFFFPSLR (MAGA1_HUMAN)
RARFFFPSLG

SEQ ID NO: 42883 - protein, 9 aa, Artificial Sequence
  Description of Artificial Sequence: Synthetic peptide
  Seed: FPTTINFTR (MAGA1_HUMAN)
FVTTINFTY

SEQ ID NO: 42884 - protein, 9 aa, Artificial Sequence
  Description of Artificial Sequence: Synthetic peptide
  Seed: GKASESLQL (MAGA1_HUMAN)
GQASESLQM

SEQ ID NO: 42885 - protein, 9 aa, Artificial Sequence
  Description of Artificial Sequence: Synthetic peptide
  Seed: SAFPTTINF (MAGA1_HUMAN)
SQFPTTINM

SEQ ID NO: 42886 - protein, 10 aa, Artificial Sequence
  Description of Artificial Sequence: Synthetic peptide
  Seed: RALAETSYVK (MAGA1_HUMAN)
RTLAETSYVR

SEQ ID NO: 42887 - protein, 10 aa, Artificial Sequence
  Description of Artificial Sequence: Synthetic peptide
  Seed: KVADLVGFLL (MAGA1_HUMAN)
KIADLVGFLM

SEQ ID NO: 42888 - protein, 9 aa, Artificial Sequence
  Description of Artificial Sequence: Synthetic peptide
  Seed: RVRFFFPSL (MAGA1_HUMAN)
RVRFFFPSC

SEQ ID NO: 42889 - protein, 9 aa, Artificial Sequence
  Description of Artificial Sequence: Synthetic peptide
  Seed: SSPLVLGTL (MAGA1_HUMAN)
SQPLVLGTF

SEQ ID NO: 42890 - protein, 11 aa, Artificial Sequence
  Description of Artificial Sequence: Synthetic peptide
  Seed: YVKVLEYVIKV (MAGA1_HUMAN)
YLKVLEYVIKA

SEQ ID NO: 42891 - protein, 9 aa, Artificial Sequence
  Description of Artificial Sequence: Synthetic peptide
  Seed: LVLGTLEEV (MAGA1_HUMAN)
LALGTLEEI

SEQ ID NO: 42892 - protein, 9 aa, Artificial Sequence
  Description of Artificial Sequence: Synthetic peptide
  Seed: FFFPSLREA (MAGA1_HUMAN)
FMFPSLREV

SEQ ID NO: 42893 - protein, 9 aa, Artificial Sequence
  Description of Artificial Sequence: Synthetic peptide
  Seed: LESLFRAVI (MAGA1_HUMAN)
LVSLFRAVY

SEQ ID NO: 42894 - protein, 9 aa, Artificial Sequence
  Description of Artificial Sequence: Synthetic peptide
  Seed: KKVADLVGF (MAGA1_HUMAN)
KIVADLVGF

SEQ ID NO: 42895 - protein, 8 aa, Artificial Sequence
  Description of Artificial Sequence: Synthetic peptide
  Seed: VADLVGFL (MAGA1_HUMAN)
VFDLVGFL

SEQ ID NO: 42896 - protein, 10 aa, Artificial Sequence
  Description of Artificial Sequence: Synthetic peptide
  Seed: KEADPTGHSY (MAGA1_HUMAN)
KTADPTGHSM

SEQ ID NO: 42897 - protein, 9 aa, Artificial Sequence
  Description of Artificial Sequence: Synthetic peptide
  Seed: QVPDSDPAR (MAGA1_HUMAN)
QAPDSDPAM

SEQ ID NO: 42898 - protein, 11 aa, Artificial Sequence
  Description of Artificial Sequence: Synthetic peptide
  Seed: YVKVLEYVIKV (MAGA1_HUMAN)
YLKVLEYVIKI

SEQ ID NO: 42899 - protein, 9 aa, Artificial Sequence
  Description of Artificial Sequence: Synthetic peptide
  Seed: SLFRAVITK (MAGA1_HUMAN)
STFRAVITY

SEQ ID NO: 42900 - protein, 9 aa, Artificial Sequence
  Description of Artificial Sequence: Synthetic peptide
  Seed: TQDLVQEKY (MAGA1_HUMAN)
TTDLVQEKV

SEQ ID NO: 42901 - protein, 9 aa, Artificial Sequence
  Description of Artificial Sequence: Synthetic peptide
  Seed: TQDLVQEKY (MAGA1_HUMAN)
TADLVQEKF

SEQ ID NO: 42902 - protein, 11 aa, Artificial Sequence
  Description of Artificial Sequence: Synthetic peptide
  Seed: RVRFFFPSLRE (MAGA1_HUMAN)
RVRFFFPSLRQ

SEQ ID NO: 42903 - protein, 9 aa, Artificial Sequence
  Description of Artificial Sequence: Synthetic peptide
  Seed: GLLGDNQIM (MAGA1_HUMAN)
GQLGDNQIY

SEQ ID NO: 42904 - protein, 10 aa, Artificial Sequence
  Description of Artificial Sequence: Synthetic peptide
  Seed: ASAFPTTINF (MAGA1_HUMAN)
AIAFPTTINY

SEQ ID NO: 42905 - protein, 8 aa, Artificial Sequence
  Description of Artificial Sequence: Synthetic peptide
  Seed: QDLVQEKY (MAGA1_HUMAN)
QELVQEKY

SEQ ID NO: 42906 - protein, 11 aa, Artificial Sequence
  Description of Artificial Sequence: Synthetic peptide
  Seed: RVRFFFPSLRE (MAGA1_HUMAN)
RMRFFFPSLRR

SEQ ID NO: 42907 - protein, 10 aa, Artificial Sequence
  Description of Artificial Sequence: Synthetic peptide
  Seed: ESLFRAVITK (MAGA1_HUMAN)
ENLFRAVITR

SEQ ID NO: 42908 - protein, 8 aa, Artificial Sequence
  Description of Artificial Sequence: Synthetic peptide
  Seed: TQDLVQEK (MAGA1_HUMAN)
TSDLVQEY

SEQ ID NO: 42909 - protein, 10 aa, Artificial Sequence
  Description of Artificial Sequence: Synthetic peptide
  Seed: AQQEALGLVC (MAGA1_HUMAN)
AEQEALGLVF

SEQ ID NO: 42910 - protein, 11 aa, Artificial Sequence
  Description of Artificial Sequence: Synthetic peptide
  Seed: EEALEAQQEAL (MAGA1_HUMAN)
EEALEAQQEAY

SEQ ID NO: 42911 - protein, 9 aa, Artificial Sequence
  Description of Artificial Sequence: Synthetic peptide
  Seed: ATSSSSPLV (MAGA1_HUMAN)
ATSSSSPLK

SEQ ID NO: 42912 - protein, 9 aa, Artificial Sequence
  Description of Artificial Sequence: Synthetic peptide
  Seed: LVLGTLEEV (MAGA1_HUMAN)
LSLGTLEEV

SEQ ID NO: 42913 - protein, 9 aa, Artificial Sequence
  Description of Artificial Sequence: Synthetic peptide
  Seed: FPTTINFTR (MAGA1_HUMAN)
FATTINFTK

SEQ ID NO: 42914 - protein, 9 aa, Artificial Sequence
  Description of Artificial Sequence: Synthetic peptide
  Seed: RALAETSYV (MAGA1_HUMAN)
RLLAETSYF

SEQ ID NO: 42915 - protein, 10 aa, Artificial Sequence
  Description of Artificial Sequence: Synthetic peptide
  Seed: SAFPTTINFT (MAGA1_HUMAN)
SAFPTTINFF

SEQ ID NO: 42916 - protein, 9 aa, Artificial Sequence
  Description of Artificial Sequence: Synthetic peptide
  Seed: TQDLVQEKY (MAGA1_HUMAN)
TSDLVQEKL

SEQ ID NO: 42917 - protein, 9 aa, Artificial Sequence
  Description of Artificial Sequence: Synthetic peptide
  Seed: ASESLQLVF (MAGA1_HUMAN)
AIESLQLVY

SEQ ID NO: 42918 - protein, 10 aa, Artificial Sequence
  Description of Artificial Sequence: Synthetic peptide
  Seed: SAFPTTINFT (MAGA1_HUMAN)
SMFPTTINFT

SEQ ID NO: 42919 - protein, 10 aa, Artificial Sequence
  Description of Artificial Sequence: Synthetic peptide
  Seed: KEADPTGHSY (MAGA1_HUMAN)
KTADPTGHSR

SEQ ID NO: 42920 - protein, 9 aa, Artificial Sequence
  Description of Artificial Sequence: Synthetic peptide
  Seed: TGFLIIVLV (MAGA1_HUMAN)
TQFLIIVLI

SEQ ID NO: 42921 - protein, 9 aa, Artificial Sequence
  Description of Artificial Sequence: Synthetic peptide
  Seed: TSYVKVLEY (MAGA1_HUMAN)
TQYVKVLEF

SEQ ID NO: 42922 - protein, 9 aa, Artificial Sequence
  Description of Artificial Sequence: Synthetic peptide
  Seed: SSPLVLGTL (MAGA1_HUMAN)
SGPLVLGTM

SEQ ID NO: 42923 - protein, 9 aa, Artificial Sequence
  Description of Artificial Sequence: Synthetic peptide
  Seed: LVTCLGLSY (MAGA1_HUMAN)
LHTCLGLSF

SEQ ID NO: 42924 - protein, 10 aa, Artificial Sequence
  Description of Artificial Sequence: Synthetic peptide
  Seed: SARVRFFFPS (MAGA1_HUMAN)
SARVRFFFPL

SEQ ID NO: 42925 - protein, 11 aa, Artificial Sequence
  Description of Artificial Sequence: Synthetic peptide
  Seed: EVYDGREHSAY (MAGA1_HUMAN)
EAYDGREHSAW

SEQ ID NO: 42926 - protein, 9 aa, Artificial Sequence
  Description of Artificial Sequence: Synthetic peptide
  Seed: GASAFPTTI (MAGA1_HUMAN)
GTSAFPTTW

SEQ ID NO: 42927 - protein, 10 aa, Artificial Sequence
  Description of Artificial Sequence: Synthetic peptide
  Seed: YEFLWGPRAL (MAGA1_HUMAN)
YYFLWGPRAV

SEQ ID NO: 42928 - protein, 11 aa, Artificial Sequence
  Description of Artificial Sequence: Synthetic peptide
  Seed: KVADLVGFLLL (MAGA1_HUMAN)
KMADLVGFLLF

SEQ ID NO: 42929 - protein, 10 aa, Artificial Sequence
  Description of Artificial Sequence: Synthetic peptide
  Seed: VKVLEYVIKV (MAGA1_HUMAN)
VIVLEYVIKV

SEQ ID NO: 42930 - protein, 9 aa, Artificial Sequence
  Description of Artificial Sequence: Synthetic peptide
  Seed: RVRFFFPSL (MAGA1_HUMAN)
RWRFFFPSE

SEQ ID NO: 42931 - protein, 10 aa, Artificial Sequence
  Description of Artificial Sequence: Synthetic peptide
  Seed: KASESLQLVF (MAGA1_HUMAN)
KASESLQLVL

SEQ ID NO: 42932 - protein, 9 aa, Artificial Sequence
  Description of Artificial Sequence: Synthetic peptide
  Seed: SARVRFFFP (MAGA1_HUMAN)
SLRVRFFFS

SEQ ID NO: 42933 - protein, 11 aa, Artificial Sequence
  Description of Artificial Sequence: Synthetic peptide
  Seed: TKKVADLVGFL (MAGA1_HUMAN)
THKVADLVGFV

SEQ ID NO: 42934 - protein, 9 aa, Artificial Sequence
  Description of Artificial Sequence: Synthetic peptide
  Seed: FPSLREAAL (MAGA1_HUMAN)
FQSLREAAY

SEQ ID NO: 42935 - protein, 10 aa, Artificial Sequence
  Description of Artificial Sequence: Synthetic peptide
  Seed: KVADLVGFLL (MAGA1_HUMAN)
KMADLVGFLQ

SEQ ID NO: 42936 - protein, 9 aa, Artificial Sequence
  Description of Artificial Sequence: Synthetic peptide
  Seed: KYRAREPVT (MAGA1_HUMAN)
KTRAREPVG

SEQ ID NO: 42937 - protein, 9 aa, Artificial Sequence
  Description of Artificial Sequence: Synthetic peptide
  Seed: KYRAREPVT (MAGA1_HUMAN)
KTRAREPVR

SEQ ID NO: 42938 - protein, 8 aa, Artificial Sequence
  Description of Artificial Sequence: Synthetic peptide
  Seed: MPKTGFLI (MAGA1_HUMAN)
MPKTGFLA

SEQ ID NO: 42939 - protein, 11 aa, Artificial Sequence
  Description of Artificial Sequence: Synthetic peptide
  Seed: KVADLVGFLLL (MAGA1_HUMAN)
KAADLVGFLLW

SEQ ID NO: 42940 - protein, 9 aa, Artificial Sequence
  Description of Artificial Sequence: Synthetic peptide
  Seed: REPVTKAEM (MAGA1_HUMAN)
REPVTKAEI

SEQ ID NO: 42941 - protein, 9 aa, Artificial Sequence
  Description of Artificial Sequence: Synthetic peptide
  Seed: RAREPVTKA (MAGA1_HUMAN)
RHREPVTKY

SEQ ID NO: 42942 - protein, 9 aa, Artificial Sequence
  Description of Artificial Sequence: Synthetic peptide
  Seed: SSPLVLGTL (MAGA1_HUMAN)
SSPLVLGTW

SEQ ID NO: 42943 - protein, 9 aa, Artificial Sequence
  Description of Artificial Sequence: Synthetic peptide
  Seed: TKAEMLESV (MAGA1_HUMAN)
TAAEMLESI

SEQ ID NO: 42944 - protein, 10 aa, Artificial Sequence
  Description of Artificial Sequence: Synthetic peptide
  Seed: EIFGKASESL (MAGA1_HUMAN)
EIFGKASESR

SEQ ID NO: 42945 - protein, 8 aa, Artificial Sequence
  Description of Artificial Sequence: Synthetic peptide
  Seed: AYGEPRKL (MAGA1_HUMAN)
ASGEPRKL

SEQ ID NO: 42946 - protein, 9 aa, Artificial Sequence
  Description of Artificial Sequence: Synthetic peptide
  Seed: LESLFRAVI (MAGA1_HUMAN)
LQSLFRAVF

SEQ ID NO: 42947 - protein, 9 aa, Artificial Sequence
  Description of Artificial Sequence: Synthetic peptide
  Seed: FPTTINFTR (MAGA1_HUMAN)
FWTTINFTR

SEQ ID NO: 42948 - protein, 9 aa, Artificial Sequence
  Description of Artificial Sequence: Synthetic peptide
  Seed: VYDGREHSA (MAGA1_HUMAN)
VSDGREHSI

SEQ ID NO: 42949 - protein, 9 aa, Artificial Sequence
  Description of Artificial Sequence: Synthetic peptide
  Seed: SARVRFFFP (MAGA1_HUMAN)
SSRVRFFFA

SEQ ID NO: 42950 - protein, 10 aa, Artificial Sequence
  Description of Artificial Sequence: Synthetic peptide
  Seed: TSYVKVLEYV (MAGA1_HUMAN)
TAYVKVLEYI

SEQ ID NO: 42951 - protein, 9 aa, Artificial Sequence
  Description of Artificial Sequence: Synthetic peptide
  Seed: TGFLIIVLV (MAGA1_HUMAN)
TLFLIIVLV

SEQ ID NO: 42952 - protein, 9 aa, Artificial Sequence
  Description of Artificial Sequence: Synthetic peptide
  Seed: FPSLREAAL (MAGA1_HUMAN)
FASLREAAY

SEQ ID NO: 42953 - protein, 11 aa, Artificial Sequence
  Description of Artificial Sequence: Synthetic peptide
  Seed: KVADLVGFLLL (MAGA1_HUMAN)
KVADLVGFLLR

SEQ ID NO: 42954 - protein, 9 aa, Artificial Sequence
  Description of Artificial Sequence: Synthetic peptide
  Seed: VIKNYKHCF (MAGA1_HUMAN)
VYKNYKHCY

SEQ ID NO: 42955 - protein, 10 aa, Artificial Sequence
  Description of Artificial Sequence: Synthetic peptide
  Seed: SCILESLFRA (MAGA1_HUMAN)
SKILESLFRL

SEQ ID NO: 42956 - protein, 10 aa, Artificial Sequence
  Description of Artificial Sequence: Synthetic peptide
  Seed: KEADPTGHSY (MAGA1_HUMAN)
KTADPTGHSV

SEQ ID NO: 42957 - protein, 11 aa, Artificial Sequence
  Description of Artificial Sequence: Synthetic peptide
  Seed: YEFLWGPRALA (MAGA1_HUMAN)
YFFLWGPRALV

SEQ ID NO: 42958 - protein, 11 aa, Artificial Sequence
  Description of Artificial Sequence: Synthetic peptide
  Seed: FLWGPRALAET (MAGA1_HUMAN)
FMWGPRALAEI

SEQ ID NO: 42959 - protein, 10 aa, Artificial Sequence
  Description of Artificial Sequence: Synthetic peptide
  Seed: KEADPTGHSY (MAGA1_HUMAN)
KMADPTGHSW

SEQ ID NO: 42960 - protein, 9 aa, Artificial Sequence
  Description of Artificial Sequence: Synthetic peptide
  Seed: VQAATSSSS (MAGA1_HUMAN)
VVAATSSSY

SEQ ID NO: 42961 - protein, 10 aa, Artificial Sequence
  Description of Artificial Sequence: Synthetic peptide
  Seed: MPKTGFLIIV (MAGA1_HUMAN)
MPKTGFLIIL

SEQ ID NO: 42962 - protein, 8 aa, Artificial Sequence
  Description of Artificial Sequence: Synthetic peptide
  Seed: FLWGPRAL (MAGA1_HUMAN)
FFWGPRAI

SEQ ID NO: 42963 - protein, 10 aa, Artificial Sequence
  Description of Artificial Sequence: Synthetic peptide
  Seed: AQQEALGLVC (MAGA1_HUMAN)
AQQEALGLVW

SEQ ID NO: 42964 - protein, 11 aa, Artificial Sequence
  Description of Artificial Sequence: Synthetic peptide
  Seed: SARVRFFFPSL (MAGA1_HUMAN)
SSRVRFFFPSV

SEQ ID NO: 42965 - protein, 9 aa, Artificial Sequence
  Description of Artificial Sequence: Synthetic peptide
  Seed: QPSEGSSSR (MAGA1_HUMAN)
QISEGSSSR

SEQ ID NO: 42966 - protein, 9 aa, Artificial Sequence
  Description of Artificial Sequence: Synthetic peptide
  Seed: KYRAREPVT (MAGA1_HUMAN)
KWRAREPVK

SEQ ID NO: 42967 - protein, 9 aa, Artificial Sequence
  Description of Artificial Sequence: Synthetic peptide
  Seed: SAFPTTINF (MAGA1_HUMAN)
SFFPTTINM

SEQ ID NO: 42968 - protein, 10 aa, Artificial Sequence
  Description of Artificial Sequence: Synthetic peptide
  Seed: KYRAREPVTK (MAGA1_HUMAN)
KVRAREPVTL

SEQ ID NO: 42969 - protein, 9 aa, Artificial Sequence
  Description of Artificial Sequence: Synthetic peptide
  Seed: KTGFLIIVL (MAGA1_HUMAN)
KMGFLIIVL

SEQ ID NO: 42970 - protein, 9 aa, Artificial Sequence
  Description of Artificial Sequence: Synthetic peptide
  Seed: IMPKTGFLI (MAGA1_HUMAN)
IYPKTGFLL

SEQ ID NO: 42971 - protein, 11 aa, Artificial Sequence
  Description of Artificial Sequence: Synthetic peptide
  Seed: RALAETSYVKV (MAGA1_HUMAN)
RLLAETSYVKI

SEQ ID NO: 42972 - protein, 8 aa, Artificial Sequence
  Description of Artificial Sequence: Synthetic peptide
  Seed: RVRFFFPS (MAGA1_HUMAN)
RTRFFFPS

SEQ ID NO: 42973 - protein, 9 aa, Artificial Sequence
  Description of Artificial Sequence: Synthetic peptide
  Seed: GLVCVQAAT (MAGA1_HUMAN)
GVVCVQAAI

SEQ ID NO: 42974 - protein, 9 aa, Artificial Sequence
  Description of Artificial Sequence: Synthetic peptide
  Seed: LEYRQVPDS (MAGA1_HUMAN)
LEYRQVPDA

SEQ ID NO: 42975 - protein, 9 aa, Artificial Sequence
  Description of Artificial Sequence: Synthetic peptide
  Seed: TSYVKVLEY (MAGA1_HUMAN)
TRYVKVLEV

SEQ ID NO: 42976 - protein, 9 aa, Artificial Sequence
  Description of Artificial Sequence: Synthetic peptide
  Seed: SAFPTTINF (MAGA1_HUMAN)
SLFPTTINF

SEQ ID NO: 42977 - protein, 9 aa, Artificial Sequence
  Description of Artificial Sequence: Synthetic peptide
  Seed: STSCILESL (MAGA1_HUMAN)
SSSCILESY

SEQ ID NO: 42978 - protein, 11 aa, Artificial Sequence
  Description of Artificial Sequence: Synthetic peptide
  Seed: FPTTINFTRQR (MAGA1_HUMAN)
FSTTINFTRQR

SEQ ID NO: 42979 - protein, 11 aa, Artificial Sequence
  Description of Artificial Sequence: Synthetic peptide
  Seed: REEEGPSTSCI (MAGA1_HUMAN)
REEEGPSTSCF

SEQ ID NO: 42980 - protein, 10 aa, Artificial Sequence
  Description of Artificial Sequence: Synthetic peptide
  Seed: SAFPTTINFT (MAGA1_HUMAN)
SQFPTTINFL

SEQ ID NO: 42981 - protein, 10 aa, Artificial Sequence
  Description of Artificial Sequence: Synthetic peptide
  Seed: RFFFPSLREA (MAGA1_HUMAN)
RTFFPSLREA

SEQ ID NO: 42982 - protein, 10 aa, Artificial Sequence
  Description of Artificial Sequence: Synthetic peptide
  Seed: LTQDLVQEKY (MAGA1_HUMAN)
LVQDLVQEKY

SEQ ID NO: 42983 - protein, 9 aa, Artificial Sequence
  Description of Artificial Sequence: Synthetic peptide
  Seed: LESLFRAVI (MAGA1_HUMAN)
LMSLFRAVM

SEQ ID NO: 42984 - protein, 10 aa, Artificial Sequence
  Description of Artificial Sequence: Synthetic peptide
  Seed: EIFGKASESL (MAGA1_HUMAN)
EMFGKASESW

SEQ ID NO: 42985 - protein, 9 aa, Artificial Sequence
  Description of Artificial Sequence: Synthetic peptide
  Seed: FFFPSLREA (MAGA1_HUMAN)
FFFPSLREF

SEQ ID NO: 42986 - protein, 9 aa, Artificial Sequence
  Description of Artificial Sequence: Synthetic peptide
  Seed: KYRAREPVT (MAGA1_HUMAN)
KFRAREPVI

SEQ ID NO: 42987 - protein, 9 aa, Artificial Sequence
  Description of Artificial Sequence: Synthetic peptide
  Seed: EADPTGHSY (MAGA1_HUMAN)
ELDPTGHSI

SEQ ID NO: 42988 - protein, 10 aa, Artificial Sequence
  Description of Artificial Sequence: Synthetic peptide
  Seed: IMPKTGFLII (MAGA1_HUMAN)
IYPKTGFLIM

SEQ ID NO: 42989 - protein, 9 aa, Artificial Sequence
  Description of Artificial Sequence: Synthetic peptide
  Seed: STSCILESL (MAGA1_HUMAN)
STSCILESI

SEQ ID NO: 42990 - protein, 9 aa, Artificial Sequence
  Description of Artificial Sequence: Synthetic peptide
  Seed: CILESLFRA (MAGA1_HUMAN)
CLLESLFRA

SEQ ID NO: 42991 - protein, 9 aa, Artificial Sequence
  Description of Artificial Sequence: Synthetic peptide
  Seed: ALEAQQEAL (MAGA1_HUMAN)
ASEAQQEAL

SEQ ID NO: 42992 - protein, 10 aa, Artificial Sequence
  Description of Artificial Sequence: Synthetic peptide
  Seed: CILESLFRAV (MAGA1_HUMAN)
CLLESLFRAL

SEQ ID NO: 42993 - protein, 9 aa, Artificial Sequence
  Description of Artificial Sequence: Synthetic peptide
  Seed: EIWEELSVM (MAGA1_HUMAN)
ELWEELSVR

SEQ ID NO: 42994 - protein, 9 aa, Artificial Sequence
  Description of Artificial Sequence: Synthetic peptide
  Seed: TSYVKVLEY (MAGA1_HUMAN)
TEYVKVLEY

SEQ ID NO: 42995 - protein, 9 aa, Artificial Sequence
  Description of Artificial Sequence: Synthetic peptide
  Seed: DSDPARYEF (MAGA1_HUMAN)
DPDPARYEY

SEQ ID NO: 42996 - protein, 9 aa, Artificial Sequence
  Description of Artificial Sequence: Synthetic peptide
  Seed: KVLEYVIKV (MAGA1_HUMAN)
KELEYVIKL

SEQ ID NO: 42997 - protein, 10 aa, Artificial Sequence
  Description of Artificial Sequence: Synthetic peptide
  Seed: RALAETSYVK (MAGA1_HUMAN)
RWLAETSYVR

SEQ ID NO: 42998 - protein, 9 aa, Artificial Sequence
  Description of Artificial Sequence: Synthetic peptide
  Seed: ALAETSYVK (MAGA1_HUMAN)
AVAETSYVR

SEQ ID NO: 42999 - protein, 9 aa, Artificial Sequence
  Description of Artificial Sequence: Synthetic peptide
  Seed: SAFPTTINF (MAGA1_HUMAN)
SLFPTTINK

SEQ ID NO: 43000 - protein, 11 aa, Artificial Sequence
  Description of Artificial Sequence: Synthetic peptide
  Seed: KEADPTGHSYV (MAGA1_HUMAN)
KLADPTGHSYL

SEQ ID NO: 43001 - protein, 9 aa, Artificial Sequence
  Description of Artificial Sequence: Synthetic peptide
  Seed: VSARVRFFF (MAGA1_HUMAN)
VFARVRFFY

SEQ ID NO: 43002 - protein, 11 aa, Artificial Sequence
  Description of Artificial Sequence: Synthetic peptide
  Seed: YEFLWGPRALA (MAGA1_HUMAN)
YCFLWGPRALI

SEQ ID NO: 43003 - protein, 9 aa, Artificial Sequence
  Description of Artificial Sequence: Synthetic peptide
  Seed: VADLVGFLL (MAGA1_HUMAN)
VNDLVGFLY

SEQ ID NO: 43004 - protein, 9 aa, Artificial Sequence
  Description of Artificial Sequence: Synthetic peptide
  Seed: KASESLQLV (MAGA1_HUMAN)
KISESLQLI

SEQ ID NO: 43005 - protein, 9 aa, Artificial Sequence
  Description of Artificial Sequence: Synthetic peptide
  Seed: KVADLVGFL (MAGA1_HUMAN)
KLADLVGFL

SEQ ID NO: 43006 - protein, 9 aa, Artificial Sequence
  Description of Artificial Sequence: Synthetic peptide
  Seed: QEALGLVCV (MAGA1_HUMAN)
QEALGLVCL

SEQ ID NO: 43007 - protein, 10 aa, Artificial Sequence
  Description of Artificial Sequence: Synthetic peptide
  Seed: ARVRFFFPSL (MAGA1_HUMAN)
AFVRFFFPSK

SEQ ID NO: 43008 - protein, 10 aa, Artificial Sequence
  Description of Artificial Sequence: Synthetic peptide
  Seed: RYEFLWGPRA (MAGA1_HUMAN)
RQEFLWGPRL

SEQ ID NO: 43009 - protein, 9 aa, Artificial Sequence
  Description of Artificial Sequence: Synthetic peptide
  Seed: TTINFTRQR (MAGA1_HUMAN)
TVINFTRQK

SEQ ID NO: 43010 - protein, 9 aa, Artificial Sequence
  Description of Artificial Sequence: Synthetic peptide
  Seed: FFPSLREAA (MAGA1_HUMAN)
FYPSLREAI

SEQ ID NO: 43011 - protein, 9 aa, Artificial Sequence
  Description of Artificial Sequence: Synthetic peptide
  Seed: ESLQLVFGI (MAGA1_HUMAN)
ETLQLVFGI

SEQ ID NO: 43012 - protein, 9 aa, Artificial Sequence
  Description of Artificial Sequence: Synthetic peptide
  Seed: LESVIKNYK (MAGA1_HUMAN)
LVSVIKNYK

SEQ ID NO: 43013 - protein, 8 aa, Artificial Sequence
  Description of Artificial Sequence: Synthetic peptide
  Seed: RAREPVTK (MAGA1_HUMAN)
RSREPVTK

SEQ ID NO: 43014 - protein, 9 aa, Artificial Sequence
  Description of Artificial Sequence: Synthetic peptide
  Seed: SAFPTTINF (MAGA1_HUMAN)
SKFPTTINM

SEQ ID NO: 43015 - protein, 10 aa, Artificial Sequence
  Description of Artificial Sequence: Synthetic peptide
  Seed: TSYVKVLEYV (MAGA1_HUMAN)
TRYVKVLEYW

SEQ ID NO: 43016 - protein, 9 aa, Artificial Sequence
  Description of Artificial Sequence: Synthetic peptide
  Seed: VIKNYKHCF (MAGA1_HUMAN)
VQKNYKHCY

SEQ ID NO: 43017 - protein, 9 aa, Artificial Sequence
  Description of Artificial Sequence: Synthetic peptide
  Seed: FPSLREAAL (MAGA1_HUMAN)
FMSLREAAF

SEQ ID NO: 43018 - protein, 10 aa, Artificial Sequence
  Description of Artificial Sequence: Synthetic peptide
  Seed: LVGFLLLKYR (MAGA1_HUMAN)
LLGFLLLKYR

SEQ ID NO: 43019 - protein, 11 aa, Artificial Sequence
  Description of Artificial Sequence: Synthetic peptide
  Seed: VQAATSSSSPL (MAGA1_HUMAN)
VVAATSSSSPY

SEQ ID NO: 43020 - protein, 9 aa, Artificial Sequence
  Description of Artificial Sequence: Synthetic peptide
  Seed: NYKHCFPEI (MAGA1_HUMAN)
NFKHCFPEY

SEQ ID NO: 43021 - protein, 9 aa, Artificial Sequence
  Description of Artificial Sequence: Synthetic peptide
  Seed: QIMPKTGFL (MAGA1_HUMAN)
QVMPKTGFL

SEQ ID NO: 43022 - protein, 10 aa, Artificial Sequence
  Description of Artificial Sequence: Synthetic peptide
  Seed: ADPTGHSYVL (MAGA1_HUMAN)
AHPTGHSYVM

SEQ ID NO: 43023 - protein, 9 aa, Artificial Sequence
  Description of Artificial Sequence: Synthetic peptide
  Seed: SARVRFFFP (MAGA1_HUMAN)
SFRVRFFFI

SEQ ID NO: 43024 - protein, 9 aa, Artificial Sequence
  Description of Artificial Sequence: Synthetic peptide
  Seed: YVIKVSARV (MAGA1_HUMAN)
YLIKVSART

SEQ ID NO: 43025 - protein, 11 aa, Artificial Sequence
  Description of Artificial Sequence: Synthetic peptide
  Seed: YVKVLEYVIKV (MAGA1_HUMAN)
YDKVLEYVIKV

SEQ ID NO: 43026 - protein, 9 aa, Artificial Sequence
  Description of Artificial Sequence: Synthetic peptide
  Seed: STDPPQSPQ (MAGA1_HUMAN)
SSDPPQSPI

SEQ ID NO: 43027 - protein, 9 aa, Artificial Sequence
  Description of Artificial Sequence: Synthetic peptide
  Seed: SARVRFFFP (MAGA1_HUMAN)
SARVRFFFV

SEQ ID NO: 43028 - protein, 10 aa, Artificial Sequence
  Description of Artificial Sequence: Synthetic peptide
  Seed: ASAFPTTINF (MAGA1_HUMAN)
AEAFPTTINW

SEQ ID NO: 43029 - protein, 10 aa, Artificial Sequence
  Description of Artificial Sequence: Synthetic peptide
  Seed: LSVMEVYDGR (MAGA1_HUMAN)
LIVMEVYDGR

SEQ ID NO: 43030 - protein, 10 aa, Artificial Sequence
  Description of Artificial Sequence: Synthetic peptide
  Seed: SLFRAVITKK (MAGA1_HUMAN)
STFRAVITKR

SEQ ID NO: 43031 - protein, 10 aa, Artificial Sequence
  Description of Artificial Sequence: Synthetic peptide
  Seed: RFFFPSLREA (MAGA1_HUMAN)
RTFFPSLREK

SEQ ID NO: 43032 - protein, 10 aa, Artificial Sequence
  Description of Artificial Sequence: Synthetic peptide
  Seed: KVSARVRFFF (MAGA1_HUMAN)
KWSARVRFFW

SEQ ID NO: 43033 - protein, 9 aa, Artificial Sequence
  Description of Artificial Sequence: Synthetic peptide
  Seed: LVQEKYLEY (MAGA1_HUMAN)
LMQEKYLEF

SEQ ID NO: 43034 - protein, 9 aa, Artificial Sequence
  Description of Artificial Sequence: Synthetic peptide
  Seed: VYDGREHSA (MAGA1_HUMAN)
VWDGREHSL

SEQ ID NO: 43035 - protein, 10 aa, Artificial Sequence
  Description of Artificial Sequence: Synthetic peptide
  Seed: ARYEFLWGPR (MAGA1_HUMAN)
ARYEFLWGPY

SEQ ID NO: 43036 - protein, 9 aa, Artificial Sequence
  Description of Artificial Sequence: Synthetic peptide
  Seed: SSSPLVLGT (MAGA1_HUMAN)
SSSPLVLGM

SEQ ID NO: 43037 - protein, 9 aa, Artificial Sequence
  Description of Artificial Sequence: Synthetic peptide
  Seed: KYRAREPVT (MAGA1_HUMAN)
KTRAREPVY

SEQ ID NO: 43038 - protein, 9 aa, Artificial Sequence
  Description of Artificial Sequence: Synthetic peptide
  Seed: KVADLVGFL (MAGA1_HUMAN)
KMADLVGFV

SEQ ID NO: 43039 - protein, 9 aa, Artificial Sequence
  Description of Artificial Sequence: Synthetic peptide
  Seed: SAFPTTINF (MAGA1_HUMAN)
SPFPTTINV

SEQ ID NO: 43040 - protein, 10 aa, Artificial Sequence
  Description of Artificial Sequence: Synthetic peptide
  Seed: SLFRAVITKK (MAGA1_HUMAN)
SKFRAVITKR

SEQ ID NO: 43041 - protein, 9 aa, Artificial Sequence
  Description of Artificial Sequence: Synthetic peptide
  Seed: RQRQPSEGS (MAGA1_HUMAN)
RTRQPSEGT

SEQ ID NO: 43042 - protein, 9 aa, Artificial Sequence
  Description of Artificial Sequence: Synthetic peptide
  Seed: VYDGREHSA (MAGA1_HUMAN)
VMDGREHSM

SEQ ID NO: 43043 - protein, 11 aa, Artificial Sequence
  Description of Artificial Sequence: Synthetic peptide
  Seed: SPLVLGTLEEV (MAGA1_HUMAN)
SYLVLGTLEEV

SEQ ID NO: 43044 - protein, 10 aa, Artificial Sequence
  Description of Artificial Sequence: Synthetic peptide
  Seed: EIFGKASESL (MAGA1_HUMAN)
ESFGKASESW

SEQ ID NO: 43045 - protein, 9 aa, Artificial Sequence
  Description of Artificial Sequence: Synthetic peptide
  Seed: TTINFTRQR (MAGA1_HUMAN)
TAINFTRQI

SEQ ID NO: 43046 - protein, 10 aa, Artificial Sequence
  Description of Artificial Sequence: Synthetic peptide
  Seed: RYEFLWGPRA (MAGA1_HUMAN)
RMEFLWGPRL

SEQ ID NO: 43047 - protein, 9 aa, Artificial Sequence
  Description of Artificial Sequence: Synthetic peptide
  Seed: HCFPEIFGK (MAGA1_HUMAN)
HLFPEIFGK

SEQ ID NO: 43048 - protein, 8 aa, Artificial Sequence
  Description of Artificial Sequence: Synthetic peptide
  Seed: RALAETSY (MAGA1_HUMAN)
RMLAETSY

SEQ ID NO: 43049 - protein, 10 aa, Artificial Sequence
  Description of Artificial Sequence: Synthetic peptide
  Seed: EIFGKASESL (MAGA1_HUMAN)
EAFGKASESR

SEQ ID NO: 43050 - protein, 10 aa, Artificial Sequence
  Description of Artificial Sequence: Synthetic peptide
  Seed: ARVRFFFPSL (MAGA1_HUMAN)
ATVRFFFPSL

SEQ ID NO: 43051 - protein, 9 aa, Artificial Sequence
  Description of Artificial Sequence: Synthetic peptide
  Seed: ADLVGFLLL (MAGA1_HUMAN)
AELVGFLLV

SEQ ID NO: 43052 - protein, 9 aa, Artificial Sequence
  Description of Artificial Sequence: Synthetic peptide
  Seed: RAREPVTKA (MAGA1_HUMAN)
RFREPVTKA

SEQ ID NO: 43053 - protein, 9 aa, Artificial Sequence
  Description of Artificial Sequence: Synthetic peptide
  Seed: SYVKVLEYV (MAGA1_HUMAN)
SAVKVLEYV

SEQ ID NO: 43054 - protein, 9 aa, Artificial Sequence
  Description of Artificial Sequence: Synthetic peptide
  Seed: LVLGTLEEV (MAGA1_HUMAN)
LQLGTLEEW

SEQ ID NO: 43055 - protein, 11 aa, Artificial Sequence
  Description of Artificial Sequence: Synthetic peptide
  Seed: AREPVTKAEML (MAGA1_HUMAN)
AHEPVTKAEMI

SEQ ID NO: 43056 - protein, 9 aa, Artificial Sequence
  Description of Artificial Sequence: Synthetic peptide
  Seed: REPVTKAEM (MAGA1_HUMAN)
REPVTKAEA

SEQ ID NO: 43057 - protein, 9 aa, Artificial Sequence
  Description of Artificial Sequence: Synthetic peptide
  Seed: TKAEMLESV (MAGA1_HUMAN)
TLAEMLESV

SEQ ID NO: 43058 - protein, 9 aa, Artificial Sequence
  Description of Artificial Sequence: Synthetic peptide
  Seed: RVRFFFPSL (MAGA1_HUMAN)
RTRFFFPSM

SEQ ID NO: 43059 - protein, 9 aa, Artificial Sequence
  Description of Artificial Sequence: Synthetic peptide
  Seed: LTQDLVQEK (MAGA1_HUMAN)
LQQDLVQEY

SEQ ID NO: 43060 - protein, 10 aa, Artificial Sequence
  Description of Artificial Sequence: Synthetic peptide
  Seed: RQPSEGSSSR (MAGA1_HUMAN)
RMPSEGSSSR

SEQ ID NO: 43061 - protein, 10 aa, Artificial Sequence
  Description of Artificial Sequence: Synthetic peptide
  Seed: ARVRFFFPSL (MAGA1_HUMAN)
AWVRFFFPSI

SEQ ID NO: 43062 - protein, 10 aa, Artificial Sequence
  Description of Artificial Sequence: Synthetic peptide
  Seed: SARVRFFFPS (MAGA1_HUMAN)
STRVRFFFPA

SEQ ID NO: 43063 - protein, 11 aa, Artificial Sequence
  Description of Artificial Sequence: Synthetic peptide
  Seed: KYRAREPVTKA (MAGA1_HUMAN)
KMRAREPVTKK

SEQ ID NO: 43064 - protein, 11 aa, Artificial Sequence
  Description of Artificial Sequence: Synthetic peptide
  Seed: YEFLWGPRALA (MAGA1_HUMAN)
YLFLWGPRALI

SEQ ID NO: 43065 - protein, 10 aa, Artificial Sequence
  Description of Artificial Sequence: Synthetic peptide
  Seed: SAFPTTINFT (MAGA1_HUMAN)
STFPTTINFY

SEQ ID NO: 43066 - protein, 10 aa, Artificial Sequence
  Description of Artificial Sequence: Synthetic peptide
  Seed: SAFPTTINFT (MAGA1_HUMAN)
SIFPTTINFM

SEQ ID NO: 43067 - protein, 9 aa, Artificial Sequence
  Description of Artificial Sequence: Synthetic peptide
  Seed: AATSSSSPL (MAGA1_HUMAN)
ARTSSSSPF

SEQ ID NO: 43068 - protein, 11 aa, Artificial Sequence
  Description of Artificial Sequence: Synthetic peptide
  Seed: EVYDGREHSAY (MAGA1_HUMAN)
ELYDGREHSAW

SEQ ID NO: 43069 - protein, 11 aa, Artificial Sequence
  Description of Artificial Sequence: Synthetic peptide
  Seed: FFFPSLREAAL (MAGA1_HUMAN)
FFFPSLREAAM

SEQ ID NO: 43070 - protein, 11 aa, Artificial Sequence
  Description of Artificial Sequence: Synthetic peptide
  Seed: FFFPSLREAAL (MAGA1_HUMAN)
FYFPSLREAAF

SEQ ID NO: 43071 - protein, 10 aa, Artificial Sequence
  Description of Artificial Sequence: Synthetic peptide
  Seed: ADPTGHSYVL (MAGA1_HUMAN)
ARPTGHSYVL

SEQ ID NO: 43072 - protein, 10 aa, Artificial Sequence
  Description of Artificial Sequence: Synthetic peptide
  Seed: FFPSLREAAL (MAGA1_HUMAN)
FYPSLREAAL

SEQ ID NO: 43073 - protein, 9 aa, Artificial Sequence
  Description of Artificial Sequence: Synthetic peptide
  Seed: EEVPTAGST (MAGA1_HUMAN)
EEVPTAGSP

SEQ ID NO: 43074 - protein, 9 aa, Artificial Sequence
  Description of Artificial Sequence: Synthetic peptide
  Seed: LVGFLLLKY (MAGA1_HUMAN)
LSGFLLLKW

SEQ ID NO: 43075 - protein, 9 aa, Artificial Sequence
  Description of Artificial Sequence: Synthetic peptide
  Seed: VYDGREHSA (MAGA1_HUMAN)
VCDGREHSI

SEQ ID NO: 43076 - protein, 9 aa, Artificial Sequence
  Description of Artificial Sequence: Synthetic peptide
  Seed: HSYVLVTCL (MAGA1_HUMAN)
HAYVLVTCY

SEQ ID NO: 43077 - protein, 10 aa, Artificial Sequence
  Description of Artificial Sequence: Synthetic peptide
  Seed: RVRFFFPSLR (MAGA1_HUMAN)
RHRFFFPSLH

SEQ ID NO: 43078 - protein, 10 aa, Artificial Sequence
  Description of Artificial Sequence: Synthetic peptide
  Seed: SCILESLFRA (MAGA1_HUMAN)
SLILESLFRI

SEQ ID NO: 43079 - protein, 10 aa, Artificial Sequence
  Description of Artificial Sequence: Synthetic peptide
  Seed: TSYVKVLEYV (MAGA1_HUMAN)
TTYVKVLEYL

SEQ ID NO: 43080 - protein, 10 aa, Artificial Sequence
  Description of Artificial Sequence: Synthetic peptide
  Seed: VTKAEMLESV (MAGA1_HUMAN)
VMKAEMLESV

SEQ ID NO: 43081 - protein, 9 aa, Artificial Sequence
  Description of Artificial Sequence: Synthetic peptide
  Seed: KASESLQLV (MAGA1_HUMAN)
KASESLQLK

SEQ ID NO: 43082 - protein, 10 aa, Artificial Sequence
  Description of Artificial Sequence: Synthetic peptide
  Seed: TSYVKVLEYV (MAGA1_HUMAN)
TAYVKVLEYW

SEQ ID NO: 43083 - protein, 9 aa, Artificial Sequence
  Description of Artificial Sequence: Synthetic peptide
  Seed: RYEFLWGPR (MAGA1_HUMAN)
RSEFLWGPR

SEQ ID NO: 43084 - protein, 10 aa, Artificial Sequence
  Description of Artificial Sequence: Synthetic peptide
  Seed: STSCILESLF (MAGA1_HUMAN)
SISCILESLW

SEQ ID NO: 43085 - protein, 9 aa, Artificial Sequence
  Description of Artificial Sequence: Synthetic peptide
  Seed: KVLEYVIKV (MAGA1_HUMAN)
KLLEYVIKR

SEQ ID NO: 43086 - protein, 9 aa, Artificial Sequence
  Description of Artificial Sequence: Synthetic peptide
  Seed: SSPLVLGTL (MAGA1_HUMAN)
SFPLVLGTL

SEQ ID NO: 43087 - protein, 9 aa, Artificial Sequence
  Description of Artificial Sequence: Synthetic peptide
  Seed: FFPSLREAA (MAGA1_HUMAN)
FFPSLREAL

SEQ ID NO: 43088 - protein, 10 aa, Artificial Sequence
  Description of Artificial Sequence: Synthetic peptide
  Seed: KNYKHCFPEI (MAGA1_HUMAN)
KFYKHCFPEK

SEQ ID NO: 43089 - protein, 9 aa, Artificial Sequence
  Description of Artificial Sequence: Synthetic peptide
  Seed: RVRFFFPSL (MAGA1_HUMAN)
RTRFFFPSS

SEQ ID NO: 43090 - protein, 10 aa, Artificial Sequence
  Description of Artificial Sequence: Synthetic peptide
  Seed: LSVMEVYDGR (MAGA1_HUMAN)
LKVMEVYDGR

SEQ ID NO: 43091 - protein, 9 aa, Artificial Sequence
  Description of Artificial Sequence: Synthetic peptide
  Seed: QSPQGASAF (MAGA1_HUMAN)
QGPQGASAL

SEQ ID NO: 43092 - protein, 10 aa, Artificial Sequence
  Description of Artificial Sequence: Synthetic peptide
  Seed: ESLFRAVITK (MAGA1_HUMAN)
EELFRAVITR

SEQ ID NO: 43093 - protein, 9 aa, Artificial Sequence
  Description of Artificial Sequence: Synthetic peptide
  Seed: IFGKASESL (MAGA1_HUMAN)
IYGKASESM

SEQ ID NO: 43094 - protein, 11 aa, Artificial Sequence
  Description of Artificial Sequence: Synthetic peptide
  Seed: SARVRFFFPSL (MAGA1_HUMAN)
SERVRFFFPSK

SEQ ID NO: 43095 - protein, 10 aa, Artificial Sequence
  Description of Artificial Sequence: Synthetic peptide
  Seed: SARVRFFFPS (MAGA1_HUMAN)
SKRVRFFFPR

SEQ ID NO: 43096 - protein, 10 aa, Artificial Sequence
  Description of Artificial Sequence: Synthetic peptide
  Seed: KYRAREPVTK (MAGA1_HUMAN)
KVRAREPVTI

SEQ ID NO: 43097 - protein, 9 aa, Artificial Sequence
  Description of Artificial Sequence: Synthetic peptide
  Seed: SAYGEPRKL (MAGA1_HUMAN)
SMYGEPRKL

SEQ ID NO: 43098 - protein, 9 aa, Artificial Sequence
  Description of Artificial Sequence: Synthetic peptide
  Seed: VSARVRFFF (MAGA1_HUMAN)
VFARVRFFI

SEQ ID NO: 43099 - protein, 9 aa, Artificial Sequence
  Description of Artificial Sequence: Synthetic peptide
  Seed: GHAPEEEIW (MAGA1_HUMAN)
GHAPEEEIM

SEQ ID NO: 43100 - protein, 10 aa, Artificial Sequence
  Description of Artificial Sequence: Synthetic peptide
  Seed: RVRFFFPSLR (MAGA1_HUMAN)
RSRFFFPSLC

SEQ ID NO: 43101 - protein, 11 aa, Artificial Sequence
  Description of Artificial Sequence: Synthetic peptide
  Seed: SARVRFFFPSL (MAGA1_HUMAN)
SIRVRFFFPSK

SEQ ID NO: 43102 - protein, 10 aa, Artificial Sequence
  Description of Artificial Sequence: Synthetic peptide
  Seed: TSCILESLFR (MAGA1_HUMAN)
TSCILESLFK

SEQ ID NO: 43103 - protein, 10 aa, Artificial Sequence
  Description of Artificial Sequence: Synthetic peptide
  Seed: EEIWEELSVM (MAGA1_HUMAN)
EEIWEELSVW

SEQ ID NO: 43104 - protein, 9 aa, Artificial Sequence
  Description of Artificial Sequence: Synthetic peptide
  Seed: DSDPARYEF (MAGA1_HUMAN)
DSDPARYEV

SEQ ID NO: 43105 - protein, 9 aa, Artificial Sequence
  Description of Artificial Sequence: Synthetic peptide
  Seed: SAFPTTINF (MAGA1_HUMAN)
SHFPTTINF

SEQ ID NO: 43106 - protein, 10 aa, Artificial Sequence
  Description of Artificial Sequence: Synthetic peptide
  Seed: YVIKVSARVR (MAGA1_HUMAN)
YSIKVSARVR

SEQ ID NO: 43107 - protein, 9 aa, Artificial Sequence
  Description of Artificial Sequence: Synthetic peptide
  Seed: KASESLQLV (MAGA1_HUMAN)
KLSESLQLT

SEQ ID NO: 43108 - protein, 9 aa, Artificial Sequence
  Description of Artificial Sequence: Synthetic peptide
  Seed: RQVPDSDPA (MAGA1_HUMAN)
RHVPDSDPY

SEQ ID NO: 43109 - protein, 9 aa, Artificial Sequence
  Description of Artificial Sequence: Synthetic peptide
  Seed: REAALREEE (MAGA1_HUMAN)
REAALREEV

SEQ ID NO: 43110 - protein, 11 aa, Artificial Sequence
  Description of Artificial Sequence: Synthetic peptide
  Seed: RQVPDSDPARY (MAGA1_HUMAN)
RQVPDSDPARW

SEQ ID NO: 43111 - protein, 10 aa, Artificial Sequence
  Description of Artificial Sequence: Synthetic peptide
  Seed: SSSPLVLGTL (MAGA1_HUMAN)
SQSPLVLGTV

SEQ ID NO: 43112 - protein, 9 aa, Artificial Sequence
  Description of Artificial Sequence: Synthetic peptide
  Seed: KVADLVGFL (MAGA1_HUMAN)
KIADLVGFY

SEQ ID NO: 43113 - protein, 9 aa, Artificial Sequence
  Description of Artificial Sequence: Synthetic peptide
  Seed: EADPTGHSY (MAGA1_HUMAN)
ENDPTGHSM

SEQ ID NO: 43114 - protein, 9 aa, Artificial Sequence
  Description of Artificial Sequence: Synthetic peptide
  Seed: STSCILESL (MAGA1_HUMAN)
SISCILEST

SEQ ID NO: 43115 - protein, 9 aa, Artificial Sequence
  Description of Artificial Sequence: Synthetic peptide
  Seed: RVRFFFPSL (MAGA1_HUMAN)
RHRFFFPSK

SEQ ID NO: 43116 - protein, 9 aa, Artificial Sequence
  Description of Artificial Sequence: Synthetic peptide
  Seed: SARVRFFFP (MAGA1_HUMAN)
STRVRFFFY

SEQ ID NO: 43117 - protein, 10 aa, Artificial Sequence
  Description of Artificial Sequence: Synthetic peptide
  Seed: TSYVKVLEYV (MAGA1_HUMAN)
TLYVKVLEYV

SEQ ID NO: 43118 - protein, 9 aa, Artificial Sequence
  Description of Artificial Sequence: Synthetic peptide
  Seed: GASAFPTTI (MAGA1_HUMAN)
GASAFPTTL

SEQ ID NO: 43119 - protein, 10 aa, Artificial Sequence
  Description of Artificial Sequence: Synthetic peptide
  Seed: SARVRFFFPS (MAGA1_HUMAN)
SYRVRFFFPK

SEQ ID NO: 43120 - protein, 9 aa, Artificial Sequence
  Description of Artificial Sequence: Synthetic peptide
  Seed: FFFPSLREA (MAGA1_HUMAN)
FTFPSLREA

SEQ ID NO: 43121 - protein, 11 aa, Artificial Sequence
  Description of Artificial Sequence: Synthetic peptide
  Seed: IKVSARVRFFF (MAGA1_HUMAN)
IPVSARVRFFW

SEQ ID NO: 43122 - protein, 9 aa, Artificial Sequence
  Description of Artificial Sequence: Synthetic peptide
  Seed: VYDGREHSA (MAGA1_HUMAN)
VLDGREHSL

SEQ ID NO: 43123 - protein, 9 aa, Artificial Sequence
  Description of Artificial Sequence: Synthetic peptide
  Seed: EADPTGHSY (MAGA1_HUMAN)
ECDPTGHSF

SEQ ID NO: 43124 - protein, 11 aa, Artificial Sequence
  Description of Artificial Sequence: Synthetic peptide
  Seed: ARVRFFFPSLR (MAGA1_HUMAN)
ADVRFFFPSLL

SEQ ID NO: 43125 - protein, 10 aa, Artificial Sequence
  Description of Artificial Sequence: Synthetic peptide
  Seed: VTKAEMLESV (MAGA1_HUMAN)
VIKAEMLESV

SEQ ID NO: 43126 - protein, 9 aa, Artificial Sequence
  Description of Artificial Sequence: Synthetic peptide
  Seed: IAMEGGHAP (MAGA1_HUMAN)
IAMEGGHAV

SEQ ID NO: 43127 - protein, 9 aa, Artificial Sequence
  Description of Artificial Sequence: Synthetic peptide
  Seed: QIMPKTGFL (MAGA1_HUMAN)
QAMPKTGFM

SEQ ID NO: 43128 - protein, 9 aa, Artificial Sequence
  Description of Artificial Sequence: Synthetic peptide
  Seed: KVADLVGFL (MAGA1_HUMAN)
KYADLVGFY

SEQ ID NO: 43129 - protein, 9 aa, Artificial Sequence
  Description of Artificial Sequence: Synthetic peptide
  Seed: FFFPSLREA (MAGA1_HUMAN)
FIFPSLREF

SEQ ID NO: 43130 - protein, 9 aa, Artificial Sequence
  Description of Artificial Sequence: Synthetic peptide
  Seed: EALEAQQEA (MAGA1_HUMAN)
EALEAQQEV

SEQ ID NO: 43131 - protein, 9 aa, Artificial Sequence
  Description of Artificial Sequence: Synthetic peptide
  Seed: SAYGEPRKL (MAGA1_HUMAN)
SSYGEPRKY

SEQ ID NO: 43132 - protein, 9 aa, Artificial Sequence
  Description of Artificial Sequence: Synthetic peptide
  Seed: VIKNYKHCF (MAGA1_HUMAN)
VYKNYKHCM

SEQ ID NO: 43133 - protein, 10 aa, Artificial Sequence
  Description of Artificial Sequence: Synthetic peptide
  Seed: KYRAREPVTK (MAGA1_HUMAN)
KARAREPVTA

SEQ ID NO: 43134 - protein, 10 aa, Artificial Sequence
  Description of Artificial Sequence: Synthetic peptide
  Seed: VYDGREHSAY (MAGA1_HUMAN)
VWDGREHSAL

SEQ ID NO: 43135 - protein, 9 aa, Artificial Sequence
  Description of Artificial Sequence: Synthetic peptide
  Seed: LTQDLVQEK (MAGA1_HUMAN)
LYQDLVQEL

SEQ ID NO: 43136 - protein, 11 aa, Artificial Sequence
  Description of Artificial Sequence: Synthetic peptide
  Seed: EEALEAQQEAL (MAGA1_HUMAN)
EEALEAQQEAW

SEQ ID NO: 43137 - protein, 9 aa, Artificial Sequence
  Description of Artificial Sequence: Synthetic peptide
  Seed: KVLEYVIKV (MAGA1_HUMAN)
KMLEYVIKW

SEQ ID NO: 43138 - protein, 11 aa, Artificial Sequence
  Description of Artificial Sequence: Synthetic peptide
  Seed: RAREPVTKAEM (MAGA1_HUMAN)
RPREPVTKAEI

SEQ ID NO: 43139 - protein, 9 aa, Artificial Sequence
  Description of Artificial Sequence: Synthetic peptide
  Seed: SYVKVLEYV (MAGA1_HUMAN)
SIVKVLEYV

SEQ ID NO: 43140 - protein, 10 aa, Artificial Sequence
  Description of Artificial Sequence: Synthetic peptide
  Seed: SYVKVLEYVI (MAGA1_HUMAN)
SWVKVLEYVF

SEQ ID NO: 43141 - protein, 10 aa, Artificial Sequence
  Description of Artificial Sequence: Synthetic peptide
  Seed: KKVADLVGFL (MAGA1_HUMAN)
KHVADLVGFV

SEQ ID NO: 43142 - protein, 10 aa, Artificial Sequence
  Description of Artificial Sequence: Synthetic peptide
  Seed: KVSARVRFFF (MAGA1_HUMAN)
KMSARVRFFA

SEQ ID NO: 43143 - protein, 9 aa, Artificial Sequence
  Description of Artificial Sequence: Synthetic peptide
  Seed: KVADLVGFL (MAGA1_HUMAN)
KNADLVGFY

SEQ ID NO: 43144 - protein, 10 aa, Artificial Sequence
  Description of Artificial Sequence: Synthetic peptide
  Seed: SARVRFFFPS (MAGA1_HUMAN)
SPRVRFFFPV

SEQ ID NO: 43145 - protein, 9 aa, Artificial Sequence
  Description of Artificial Sequence: Synthetic peptide
  Seed: LTQDLVQEK (MAGA1_HUMAN)
LRQDLVQEY

SEQ ID NO: 43146 - protein, 9 aa, Artificial Sequence
  Description of Artificial Sequence: Synthetic peptide
  Seed: YKHCFPEIF (MAGA1_HUMAN)
YRHCFPEII

SEQ ID NO: 43147 - protein, 9 aa, Artificial Sequence
  Description of Artificial Sequence: Synthetic peptide
  Seed: FFFPSLREA (MAGA1_HUMAN)
FGFPSLREF

SEQ ID NO: 43148 - protein, 9 aa, Artificial Sequence
  Description of Artificial Sequence: Synthetic peptide
  Seed: QSPQGASAF (MAGA1_HUMAN)
QAPQGASAM

SEQ ID NO: 43149 - protein, 10 aa, Artificial Sequence
  Description of Artificial Sequence: Synthetic peptide
  Seed: RVRFFFPSLR (MAGA1_HUMAN)
RFRFFFPSLK

SEQ ID NO: 43150 - protein, 9 aa, Artificial Sequence
  Description of Artificial Sequence: Synthetic peptide
  Seed: KVLEYVIKV (MAGA1_HUMAN)
KLLEYVIKA

SEQ ID NO: 43151 - protein, 9 aa, Artificial Sequence
  Description of Artificial Sequence: Synthetic peptide
  Seed: SAYGEPRKL (MAGA1_HUMAN)
SFYGEPRKF

SEQ ID NO: 43152 - protein, 10 aa, Artificial Sequence
  Description of Artificial Sequence: Synthetic peptide
  Seed: VTKAEMLESV (MAGA1_HUMAN)
VMKAEMLESM

SEQ ID NO: 43153 - protein, 10 aa, Artificial Sequence
  Description of Artificial Sequence: Synthetic peptide
  Seed: EVYDGREHSA (MAGA1_HUMAN)
ETYDGREHSA

SEQ ID NO: 43154 - protein, 9 aa, Artificial Sequence
  Description of Artificial Sequence: Synthetic peptide
  Seed: LQLVFGIDV (MAGA1_HUMAN)
LLLVFGIDV

SEQ ID NO: 43155 - protein, 9 aa, Artificial Sequence
  Description of Artificial Sequence: Synthetic peptide
  Seed: TKAEMLESV (MAGA1_HUMAN)
TAAEMLESL

SEQ ID NO: 43156 - protein, 10 aa, Artificial Sequence
  Description of Artificial Sequence: Synthetic peptide
  Seed: KYRAREPVTK (MAGA1_HUMAN)
KFRAREPVTK

SEQ ID NO: 43157 - protein, 10 aa, Artificial Sequence
  Description of Artificial Sequence: Synthetic peptide
  Seed: KASESLQLVF (MAGA1_HUMAN)
KISESLQLVY

SEQ ID NO: 43158 - protein, 11 aa, Artificial Sequence
  Description of Artificial Sequence: Synthetic peptide
  Seed: KVLEYVIKVSA (MAGA1_HUMAN)
KVLEYVIKVSV

SEQ ID NO: 43159 - protein, 10 aa, Artificial Sequence
  Description of Artificial Sequence: Synthetic peptide
  Seed: EMLESVIKNY (MAGA1_HUMAN)
EVLESVIKNY

SEQ ID NO: 43160 - protein, 9 aa, Artificial Sequence
  Description of Artificial Sequence: Synthetic peptide
  Seed: IFGKASESL (MAGA1_HUMAN)
IFGKASESM

SEQ ID NO: 43161 - protein, 9 aa, Artificial Sequence
  Description of Artificial Sequence: Synthetic peptide
  Seed: VGFLLLKYR (MAGA1_HUMAN)
VAFLLLKYR

SEQ ID NO: 43162 - protein, 10 aa, Artificial Sequence
  Description of Artificial Sequence: Synthetic peptide
  Seed: KASESLQLVF (MAGA1_HUMAN)
KLSESLQLVY

SEQ ID NO: 43163 - protein, 9 aa, Artificial Sequence
  Description of Artificial Sequence: Synthetic peptide
  Seed: RVRFFFPSL (MAGA1_HUMAN)
RRRFFFPSL

SEQ ID NO: 43164 - protein, 10 aa, Artificial Sequence
  Description of Artificial Sequence: Synthetic peptide
  Seed: KASESLQLVF (MAGA1_HUMAN)
KHSESLQLVF

SEQ ID NO: 43165 - protein, 10 aa, Artificial Sequence
  Description of Artificial Sequence: Synthetic peptide
  Seed: KVADLVGFLL (MAGA1_HUMAN)
KSADLVGFLI

SEQ ID NO: 43166 - protein, 10 aa, Artificial Sequence
  Description of Artificial Sequence: Synthetic peptide
  Seed: SARVRFFFPS (MAGA1_HUMAN)
SMRVRFFFPY

SEQ ID NO: 43167 - protein, 9 aa, Artificial Sequence
  Description of Artificial Sequence: Synthetic peptide
  Seed: YKHCFPEIF (MAGA1_HUMAN)
YPHCFPEIY

SEQ ID NO: 43168 - protein, 9 aa, Artificial Sequence
  Description of Artificial Sequence: Synthetic peptide
  Seed: HSYVLVTCL (MAGA1_HUMAN)
HIYVLVTCY

SEQ ID NO: 43169 - protein, 10 aa, Artificial Sequence
  Description of Artificial Sequence: Synthetic peptide
  Seed: ARVRFFFPSL (MAGA1_HUMAN)
AFVRFFFPSA

SEQ ID NO: 43170 - protein, 10 aa, Artificial Sequence
  Description of Artificial Sequence: Synthetic peptide
  Seed: FLWGPRALAE (MAGA1_HUMAN)
FMWGPRALAA

SEQ ID NO: 43171 - protein, 9 aa, Artificial Sequence
  Description of Artificial Sequence: Synthetic peptide
  Seed: VRFFFPSLR (MAGA1_HUMAN)
VYFFFPSLK

SEQ ID NO: 43172 - protein, 9 aa, Artificial Sequence
  Description of Artificial Sequence: Synthetic peptide
  Seed: VRFFFPSLR (MAGA1_HUMAN)
VLFFFPSLK

SEQ ID NO: 43173 - protein, 9 aa, Artificial Sequence
  Description of Artificial Sequence: Synthetic peptide
  Seed: TQDLVQEKY (MAGA1_HUMAN)
TEDLVQEKL

SEQ ID NO: 43174 - protein, 9 aa, Artificial Sequence
  Description of Artificial Sequence: Synthetic peptide
  Seed: QIMPKTGFL (MAGA1_HUMAN)
QMMPKTGFF

SEQ ID NO: 43175 - protein, 10 aa, Artificial Sequence
  Description of Artificial Sequence: Synthetic peptide
  Seed: FLWGPRALAE (MAGA1_HUMAN)
FMWGPRALAL

SEQ ID NO: 43176 - protein, 9 aa, Artificial Sequence
  Description of Artificial Sequence: Synthetic peptide
  Seed: DSDPARYEF (MAGA1_HUMAN)
DYDPARYEM

SEQ ID NO: 43177 - protein, 10 aa, Artificial Sequence
  Description of Artificial Sequence: Synthetic peptide
  Seed: ARVRFFFPSL (MAGA1_HUMAN)
AYVRFFFPSI

SEQ ID NO: 43178 - protein, 9 aa, Artificial Sequence
  Description of Artificial Sequence: Synthetic peptide
  Seed: KVSARVRFF (MAGA1_HUMAN)
KTSARVRFM

SEQ ID NO: 43179 - protein, 10 aa, Artificial Sequence
  Description of Artificial Sequence: Synthetic peptide
  Seed: SCILESLFRA (MAGA1_HUMAN)
SNILESLFRI

SEQ ID NO: 43180 - protein, 10 aa, Artificial Sequence
  Description of Artificial Sequence: Synthetic peptide
  Seed: FLWGPRALAE (MAGA1_HUMAN)
FAWGPRALAV

SEQ ID NO: 43181 - protein, 10 aa, Artificial Sequence
  Description of Artificial Sequence: Synthetic peptide
  Seed: SCILESLFRA (MAGA1_HUMAN)
SIILESLFRL

SEQ ID NO: 43182 - protein, 9 aa, Artificial Sequence
  Description of Artificial Sequence: Synthetic peptide
  Seed: EADPTGHSY (MAGA1_HUMAN)
EPDPTGHSL

SEQ ID NO: 43183 - protein, 10 aa, Artificial Sequence
  Description of Artificial Sequence: Synthetic peptide
  Seed: KHCFPEIFGK (MAGA1_HUMAN)
KNCFPEIFGR

SEQ ID NO: 43184 - protein, 9 aa, Artificial Sequence
  Description of Artificial Sequence: Synthetic peptide
  Seed: FPSLREAAL (MAGA1_HUMAN)
FGSLREAAM

SEQ ID NO: 43185 - protein, 10 aa, Artificial Sequence
  Description of Artificial Sequence: Synthetic peptide
  Seed: KASESLQLVF (MAGA1_HUMAN)
KVSESLQLVF

SEQ ID NO: 43186 - protein, 9 aa, Artificial Sequence
  Description of Artificial Sequence: Synthetic peptide
  Seed: FLWGPRALA (MAGA1_HUMAN)
FMWGPRALL

SEQ ID NO: 43187 - protein, 10 aa, Artificial Sequence
  Description of Artificial Sequence: Synthetic peptide
  Seed: RVRFFFPSLR (MAGA1_HUMAN)
RSRFFFPSLH

SEQ ID NO: 43188 - protein, 9 aa, Artificial Sequence
  Description of Artificial Sequence: Synthetic peptide
  Seed: AQQEALGLV (MAGA1_HUMAN)
ALQEALGLA

SEQ ID NO: 43189 - protein, 9 aa, Artificial Sequence
  Description of Artificial Sequence: Synthetic peptide
  Seed: KVSARVRFF (MAGA1_HUMAN)
KSSARVRFI

SEQ ID NO: 43190 - protein, 10 aa, Artificial Sequence
  Description of Artificial Sequence: Synthetic peptide
  Seed: RVRFFFPSLR (MAGA1_HUMAN)
RCRFFFPSLR

SEQ ID NO: 43191 - protein, 10 aa, Artificial Sequence
  Description of Artificial Sequence: Synthetic peptide
  Seed: LVQEKYLEYR (MAGA1_HUMAN)
LTQEKYLEYR

SEQ ID NO: 43192 - protein, 9 aa, Artificial Sequence
  Description of Artificial Sequence: Synthetic peptide
  Seed: YKHCFPEIF (MAGA1_HUMAN)
YHHCFPEIL

SEQ ID NO: 43193 - protein, 9 aa, Artificial Sequence
  Description of Artificial Sequence: Synthetic peptide
  Seed: RALAETSYV (MAGA1_HUMAN)
RQLAETSYV

SEQ ID NO: 43194 - protein, 11 aa, Artificial Sequence
  Description of Artificial Sequence: Synthetic peptide
  Seed: ARVRFFFPSLR (MAGA1_HUMAN)
AYVRFFFPSLL

SEQ ID NO: 43195 - protein, 9 aa, Artificial Sequence
  Description of Artificial Sequence: Synthetic peptide
  Seed: EEIWEELSV (MAGA1_HUMAN)
EEIWEELSW

SEQ ID NO: 43196 - protein, 9 aa, Artificial Sequence
  Description of Artificial Sequence: Synthetic peptide
  Seed: TSYVKVLEY (MAGA1_HUMAN)
TGYVKVLEY

SEQ ID NO: 43197 - protein, 10 aa, Artificial Sequence
  Description of Artificial Sequence: Synthetic peptide
  Seed: TSYVKVLEYV (MAGA1_HUMAN)
TLYVKVLEYF

SEQ ID NO: 43198 - protein, 10 aa, Artificial Sequence
  Description of Artificial Sequence: Synthetic peptide
  Seed: QIMPKTGFLI (MAGA1_HUMAN)
QMMPKTGFLL

SEQ ID NO: 43199 - protein, 9 aa, Artificial Sequence
  Description of Artificial Sequence: Synthetic peptide
  Seed: KYRAREPVT (MAGA1_HUMAN)
KSRAREPVY

SEQ ID NO: 43200 - protein, 11 aa, Artificial Sequence
  Description of Artificial Sequence: Synthetic peptide
  Seed: RVRFFFPSLRE (MAGA1_HUMAN)
RTRFFFPSLRS

SEQ ID NO: 43201 - protein, 9 aa, Artificial Sequence
  Description of Artificial Sequence: Synthetic peptide
  Seed: STSCILESL (MAGA1_HUMAN)
SISCILESI

SEQ ID NO: 43202 - protein, 11 aa, Artificial Sequence
  Description of Artificial Sequence: Synthetic peptide
  Seed: IKVSARVRFFF (MAGA1_HUMAN)
IDVSARVRFFW

SEQ ID NO: 43203 - protein, 9 aa, Artificial Sequence
  Description of Artificial Sequence: Synthetic peptide
  Seed: KVSARVRFF (MAGA1_HUMAN)
KMSARVRFI

SEQ ID NO: 43204 - protein, 10 aa, Artificial Sequence
  Description of Artificial Sequence: Synthetic peptide
  Seed: RVRFFFPSLR (MAGA1_HUMAN)
RARFFFPSLS

SEQ ID NO: 43205 - protein, 9 aa, Artificial Sequence
  Description of Artificial Sequence: Synthetic peptide
  Seed: RAREPVTKA (MAGA1_HUMAN)
RVREPVTKS

SEQ ID NO: 43206 - protein, 10 aa, Artificial Sequence
  Description of Artificial Sequence: Synthetic peptide
  Seed: KEADPTGHSY (MAGA1_HUMAN)
KSADPTGHSF

SEQ ID NO: 43207 - protein, 10 aa, Artificial Sequence
  Description of Artificial Sequence: Synthetic peptide
  Seed: LEYVIKVSAR (MAGA1_HUMAN)
LMYVIKVSAR

SEQ ID NO: 43208 - protein, 9 aa, Artificial Sequence
  Description of Artificial Sequence: Synthetic peptide
  Seed: SLFRAVITK (MAGA1_HUMAN)
SAFRAVITR

SEQ ID NO: 43209 - protein, 9 aa, Artificial Sequence
  Description of Artificial Sequence: Synthetic peptide
  Seed: EELSVMEVY (MAGA1_HUMAN)
EELSVMEVV

SEQ ID NO: 43210 - protein, 9 aa, Artificial Sequence
  Description of Artificial Sequence: Synthetic peptide
  Seed: SLHCKPEEA (MAGA1_HUMAN)
SLHCKPEEV

SEQ ID NO: 43211 - protein, 9 aa, Artificial Sequence
  Description of Artificial Sequence: Synthetic peptide
  Seed: EHSAYGEPR (MAGA1_HUMAN)
EMSAYGEPR

SEQ ID NO: 43212 - protein, 9 aa, Artificial Sequence
  Description of Artificial Sequence: Synthetic peptide
  Seed: RVRFFFPSL (MAGA1_HUMAN)
RYRFFFPSF

SEQ ID NO: 43213 - protein, 10 aa, Artificial Sequence
  Description of Artificial Sequence: Synthetic peptide
  Seed: SLFRAVITKK (MAGA1_HUMAN)
STFRAVITKK

SEQ ID NO: 43214 - protein, 9 aa, Artificial Sequence
  Description of Artificial Sequence: Synthetic peptide
  Seed: KASESLQLV (MAGA1_HUMAN)
KASESLQLA

SEQ ID NO: 43215 - protein, 11 aa, Artificial Sequence
  Description of Artificial Sequence: Synthetic peptide
  Seed: DLVGFLLLKYR (MAGA1_HUMAN)
DAVGFLLLKYR

SEQ ID NO: 43216 - protein, 10 aa, Artificial Sequence
  Description of Artificial Sequence: Synthetic peptide
  Seed: KVLEYVIKVS (MAGA1_HUMAN)
KMLEYVIKVA

SEQ ID NO: 43217 - protein, 9 aa, Artificial Sequence
  Description of Artificial Sequence: Synthetic peptide
  Seed: STDPPQSPQ (MAGA1_HUMAN)
SNDPPQSPM

SEQ ID NO: 43218 - protein, 11 aa, Artificial Sequence
  Description of Artificial Sequence: Synthetic peptide
  Seed: SARVRFFFPSL (MAGA1_HUMAN)
SARVRFFFPSA

SEQ ID NO: 43219 - protein, 11 aa, Artificial Sequence
  Description of Artificial Sequence: Synthetic peptide
  Seed: TKKVADLVGFL (MAGA1_HUMAN)
TPKVADLVGFV

SEQ ID NO: 43220 - protein, 11 aa, Artificial Sequence
  Description of Artificial Sequence: Synthetic peptide
  Seed: KVADLVGFLLL (MAGA1_HUMAN)
KVADLVGFLLF

SEQ ID NO: 43221 - protein, 9 aa, Artificial Sequence
  Description of Artificial Sequence: Synthetic peptide
  Seed: MLESVIKNY (MAGA1_HUMAN)
MIESVIKNY

SEQ ID NO: 43222 - protein, 9 aa, Artificial Sequence
  Description of Artificial Sequence: Synthetic peptide
  Seed: CILESLFRA (MAGA1_HUMAN)
CALESLFRA

SEQ ID NO: 43223 - protein, 9 aa, Artificial Sequence
  Description of Artificial Sequence: Synthetic peptide
  Seed: FFFPSLREA (MAGA1_HUMAN)
FIFPSLRET

SEQ ID NO: 43224 - protein, 9 aa, Artificial Sequence
  Description of Artificial Sequence: Synthetic peptide
  Seed: VADLVGFLL (MAGA1_HUMAN)
VIDLVGFLV

SEQ ID NO: 43225 - protein, 9 aa, Artificial Sequence
  Description of Artificial Sequence: Synthetic peptide
  Seed: RVRFFFPSL (MAGA1_HUMAN)
RLRFFFPSV

SEQ ID NO: 43226 - protein, 10 aa, Artificial Sequence
  Description of Artificial Sequence: Synthetic peptide
  Seed: KASESLQLVF (MAGA1_HUMAN)
KQSESLQLVW

SEQ ID NO: 43227 - protein, 10 aa, Artificial Sequence
  Description of Artificial Sequence: Synthetic peptide
  Seed: ADLVGFLLLK (MAGA1_HUMAN)
ARLVGFLLLK

SEQ ID NO: 43228 - protein, 8 aa, Artificial Sequence
  Description of Artificial Sequence: Synthetic peptide
  Seed: TQDLVQEK (MAGA1_HUMAN)
TADLVQEL

SEQ ID NO: 43229 - protein, 10 aa, Artificial Sequence
  Description of Artificial Sequence: Synthetic peptide
  Seed: KVADLVGFLL (MAGA1_HUMAN)
KSADLVGFLY

SEQ ID NO: 43230 - protein, 10 aa, Artificial Sequence
  Description of Artificial Sequence: Synthetic peptide
  Seed: SYVKVLEYVI (MAGA1_HUMAN)
SYVKVLEYVW

SEQ ID NO: 43231 - protein, 9 aa, Artificial Sequence
  Description of Artificial Sequence: Synthetic peptide
  Seed: TSYVKVLEY (MAGA1_HUMAN)
TSYVKVLEV

SEQ ID NO: 43232 - protein, 10 aa, Artificial Sequence
  Description of Artificial Sequence: Synthetic peptide
  Seed: FLWGPRALAE (MAGA1_HUMAN)
FLWGPRALAI

SEQ ID NO: 43233 - protein, 9 aa, Artificial Sequence
  Description of Artificial Sequence: Synthetic peptide
  Seed: ALGLVCVQA (MAGA1_HUMAN)
AMGLVCVQL

SEQ ID NO: 43234 - protein, 9 aa, Artificial Sequence
  Description of Artificial Sequence: Synthetic peptide
  Seed: KKVADLVGF (MAGA1_HUMAN)
KLVADLVGY

SEQ ID NO: 43235 - protein, 9 aa, Artificial Sequence
  Description of Artificial Sequence: Synthetic peptide
  Seed: SAYGEPRKL (MAGA1_HUMAN)
SLYGEPRKF

SEQ ID NO: 43236 - protein, 9 aa, Artificial Sequence
  Description of Artificial Sequence: Synthetic peptide
  Seed: AQQEALGLV (MAGA1_HUMAN)
AEQEALGLL

SEQ ID NO: 43237 - protein, 10 aa, Artificial Sequence
  Description of Artificial Sequence: Synthetic peptide
  Seed: SCILESLFRA (MAGA1_HUMAN)
SMILESLFRC

SEQ ID NO: 43238 - protein, 9 aa, Artificial Sequence
  Description of Artificial Sequence: Synthetic peptide
  Seed: ATSSSSPLV (MAGA1_HUMAN)
AISSSSPLI

SEQ ID NO: 43239 - protein, 11 aa, Artificial Sequence
  Description of Artificial Sequence: Synthetic peptide
  Seed: SARVRFFFPSL (MAGA1_HUMAN)
SPRVRFFFPSK

SEQ ID NO: 43240 - protein, 10 aa, Artificial Sequence
  Description of Artificial Sequence: Synthetic peptide
  Seed: ASAFPTTINF (MAGA1_HUMAN)
ADAFPTTINW

SEQ ID NO: 43241 - protein, 9 aa, Artificial Sequence
  Description of Artificial Sequence: Synthetic peptide
  Seed: RQRQPSEGS (MAGA1_HUMAN)
RSRQPSEGA

SEQ ID NO: 43242 - protein, 10 aa, Artificial Sequence
  Description of Artificial Sequence: Synthetic peptide
  Seed: ARYEFLWGPR (MAGA1_HUMAN)
ARYEFLWGPM

SEQ ID NO: 43243 - protein, 9 aa, Artificial Sequence
  Description of Artificial Sequence: Synthetic peptide
  Seed: VIKNYKHCF (MAGA1_HUMAN)
VLKNYKHCY

SEQ ID NO: 43244 - protein, 10 aa, Artificial Sequence
  Description of Artificial Sequence: Synthetic peptide
  Seed: KVSARVRFFF (MAGA1_HUMAN)
KKSARVRFFW

SEQ ID NO: 43245 - protein, 10 aa, Artificial Sequence
  Description of Artificial Sequence: Synthetic peptide
  Seed: LLKYRAREPV (MAGA1_HUMAN)
LMKYRAREPM

SEQ ID NO: 43246 - protein, 11 aa, Artificial Sequence
  Description of Artificial Sequence: Synthetic peptide
  Seed: SAFPTTINFTR (MAGA1_HUMAN)
SLFPTTINFTR

SEQ ID NO: 43247 - protein, 9 aa, Artificial Sequence
  Description of Artificial Sequence: Synthetic peptide
  Seed: HCFPEIFGK (MAGA1_HUMAN)
HLFPEIFGV

SEQ ID NO: 43248 - protein, 9 aa, Artificial Sequence
  Description of Artificial Sequence: Synthetic peptide
  Seed: AETSYVKVL (MAGA1_HUMAN)
AETSYVKVW

SEQ ID NO: 43249 - protein, 10 aa, Artificial Sequence
  Description of Artificial Sequence: Synthetic peptide
  Seed: FFPSLREAAL (MAGA1_HUMAN)
FHPSLREAAL

SEQ ID NO: 43250 - protein, 9 aa, Artificial Sequence
  Description of Artificial Sequence: Synthetic peptide
  Seed: GTLEEVPTA (MAGA1_HUMAN)
GTLEEVPTV

SEQ ID NO: 43251 - protein, 9 aa, Artificial Sequence
  Description of Artificial Sequence: Synthetic peptide
  Seed: RAREPVTKA (MAGA1_HUMAN)
RQREPVTKL

SEQ ID NO: 43252 - protein, 10 aa, Artificial Sequence
  Description of Artificial Sequence: Synthetic peptide
  Seed: FFPSLREAAL (MAGA1_HUMAN)
FLPSLREAAL

SEQ ID NO: 43253 - protein, 10 aa, Artificial Sequence
  Description of Artificial Sequence: Synthetic peptide
  Seed: RALAETSYVK (MAGA1_HUMAN)
RMLAETSYVK

SEQ ID NO: 43254 - protein, 9 aa, Artificial Sequence
  Description of Artificial Sequence: Synthetic peptide
  Seed: LFRAVITKK (MAGA1_HUMAN)
LQRAVITKR

SEQ ID NO: 43255 - protein, 9 aa, Artificial Sequence
  Description of Artificial Sequence: Synthetic peptide
  Seed: IIVLVMIAM (MAGA1_HUMAN)
IAVLVMIAF

SEQ ID NO: 43256 - protein, 9 aa, Artificial Sequence
  Description of Artificial Sequence: Synthetic peptide
  Seed: VPTAGSTDP (MAGA1_HUMAN)
VPTAGSTDA

SEQ ID NO: 43257 - protein, 9 aa, Artificial Sequence
  Description of Artificial Sequence: Synthetic peptide
  Seed: VSARVRFFF (MAGA1_HUMAN)
VFARVRFFL

SEQ ID NO: 43258 - protein, 9 aa, Artificial Sequence
  Description of Artificial Sequence: Synthetic peptide
  Seed: ATSSSSPLV (MAGA1_HUMAN)
AISSSSPLV

SEQ ID NO: 43259 - protein, 10 aa, Artificial Sequence
  Description of Artificial Sequence: Synthetic peptide
  Seed: KASESLQLVF (MAGA1_HUMAN)
KISESLQLVW

SEQ ID NO: 43260 - protein, 9 aa, Artificial Sequence
  Description of Artificial Sequence: Synthetic peptide
  Seed: RVRFFFPSL (MAGA1_HUMAN)
RARFFFPSV

SEQ ID NO: 43261 - protein, 10 aa, Artificial Sequence
  Description of Artificial Sequence: Synthetic peptide
  Seed: RVRFFFPSLR (MAGA1_HUMAN)
RDRFFFPSLR

SEQ ID NO: 43262 - protein, 9 aa, Artificial Sequence
  Description of Artificial Sequence: Synthetic peptide
  Seed: RVRFFFPSL (MAGA1_HUMAN)
RMRFFFPSR

SEQ ID NO: 43263 - protein, 10 aa, Artificial Sequence
  Description of Artificial Sequence: Synthetic peptide
  Seed: SCILESLFRA (MAGA1_HUMAN)
SMILESLFRL

SEQ ID NO: 43264 - protein, 10 aa, Artificial Sequence
  Description of Artificial Sequence: Synthetic peptide
  Seed: SARVRFFFPS (MAGA1_HUMAN)
SMRVRFFFPR

SEQ ID NO: 43265 - protein, 11 aa, Artificial Sequence
  Description of Artificial Sequence: Synthetic peptide
  Seed: RVRFFFPSLRE (MAGA1_HUMAN)
RLRFFFPSLRH

SEQ ID NO: 43266 - protein, 9 aa, Artificial Sequence
  Description of Artificial Sequence: Synthetic peptide
  Seed: MPKTGFLII (MAGA1_HUMAN)
MLKTGFLIY

SEQ ID NO: 43267 - protein, 10 aa, Artificial Sequence
  Description of Artificial Sequence: Synthetic peptide
  Seed: RALAETSYVK (MAGA1_HUMAN)
RFLAETSYVK

SEQ ID NO: 43268 - protein, 9 aa, Artificial Sequence
  Description of Artificial Sequence: Synthetic peptide
  Seed: RVRFFFPSL (MAGA1_HUMAN)
RNRFFFPSP

SEQ ID NO: 43269 - protein, 11 aa, Artificial Sequence
  Description of Artificial Sequence: Synthetic peptide
  Seed: KVSARVRFFFP (MAGA1_HUMAN)
KTSARVRFFFA

SEQ ID NO: 43270 - protein, 9 aa, Artificial Sequence
  Description of Artificial Sequence: Synthetic peptide
  Seed: IKVSARVRF (MAGA1_HUMAN)
IKVSARVRY

SEQ ID NO: 43271 - protein, 10 aa, Artificial Sequence
  Description of Artificial Sequence: Synthetic peptide
  Seed: FFPSLREAAL (MAGA1_HUMAN)
FLPSLREAAF

SEQ ID NO: 43272 - protein, 9 aa, Artificial Sequence
  Description of Artificial Sequence: Synthetic peptide
  Seed: AQQEALGLV (MAGA1_HUMAN)
AQQEALGLY

SEQ ID NO: 43273 - protein, 9 aa, Artificial Sequence
  Description of Artificial Sequence: Synthetic peptide
  Seed: SSSPLVLGT (MAGA1_HUMAN)
SASPLVLGV

SEQ ID NO: 43274 - protein, 9 aa, Artificial Sequence
  Description of Artificial Sequence: Synthetic peptide
  Seed: AETSYVKVL (MAGA1_HUMAN)
AQTSYVKVM

SEQ ID NO: 43275 - protein, 9 aa, Artificial Sequence
  Description of Artificial Sequence: Synthetic peptide
  Seed: KYRAREPVT (MAGA1_HUMAN)
KTRAREPVT

SEQ ID NO: 43276 - protein, 9 aa, Artificial Sequence
  Description of Artificial Sequence: Synthetic peptide
  Seed: HSYVLVTCL (MAGA1_HUMAN)
HVYVLVTCF

SEQ ID NO: 43277 - protein, 11 aa, Artificial Sequence
  Description of Artificial Sequence: Synthetic peptide
  Seed: RQVPDSDPARY (MAGA1_HUMAN)
RVVPDSDPARL

SEQ ID NO: 43278 - protein, 10 aa, Artificial Sequence
  Description of Artificial Sequence: Synthetic peptide
  Seed: KVSARVRFFF (MAGA1_HUMAN)
KWSARVRFFY

SEQ ID NO: 43279 - protein, 9 aa, Artificial Sequence
  Description of Artificial Sequence: Synthetic peptide
  Seed: EADPTGHSY (MAGA1_HUMAN)
ESDPTGHSL

SEQ ID NO: 43280 - protein, 9 aa, Artificial Sequence
  Description of Artificial Sequence: Synthetic peptide
  Seed: ATSSSSPLV (MAGA1_HUMAN)
AMSSSSPLL

SEQ ID NO: 43281 - protein, 10 aa, Artificial Sequence
  Description of Artificial Sequence: Synthetic peptide
  Seed: RVRFFFPSLR (MAGA1_HUMAN)
RHRFFFPSLA

SEQ ID NO: 43282 - protein, 10 aa, Artificial Sequence
  Description of Artificial Sequence: Synthetic peptide
  Seed: DLVGFLLLKY (MAGA1_HUMAN)
DVVGFLLLKR

SEQ ID NO: 43283 - protein, 9 aa, Artificial Sequence
  Description of Artificial Sequence: Synthetic peptide
  Seed: EALEAQQEA (MAGA1_HUMAN)
ESLEAQQEV

SEQ ID NO: 43284 - protein, 9 aa, Artificial Sequence
  Description of Artificial Sequence: Synthetic peptide
  Seed: GASAFPTTI (MAGA1_HUMAN)
GQSAFPTTY

SEQ ID NO: 43285 - protein, 9 aa, Artificial Sequence
  Description of Artificial Sequence: Synthetic peptide
  Seed: TSYVKVLEY (MAGA1_HUMAN)
TTYVKVLEM

SEQ ID NO: 43286 - protein, 10 aa, Artificial Sequence
  Description of Artificial Sequence: Synthetic peptide
  Seed: KEADPTGHSY (MAGA1_HUMAN)
KGADPTGHSW

SEQ ID NO: 43287 - protein, 11 aa, Artificial Sequence
  Description of Artificial Sequence: Synthetic peptide
  Seed: ITKKVADLVGF (MAGA1_HUMAN)
IVKKVADLVGW

SEQ ID NO: 43288 - protein, 10 aa, Artificial Sequence
  Description of Artificial Sequence: Synthetic peptide
  Seed: REEEGPSTSC (MAGA1_HUMAN)
REEEGPSTSF

SEQ ID NO: 43289 - protein, 9 aa, Artificial Sequence
  Description of Artificial Sequence: Synthetic peptide
  Seed: KVSARVRFF (MAGA1_HUMAN)
KFSARVRFA

SEQ ID NO: 43290 - protein, 9 aa, Artificial Sequence
  Description of Artificial Sequence: Synthetic peptide
  Seed: SAFPTTINF (MAGA1_HUMAN)
SHFPTTINM

SEQ ID NO: 43291 - protein, 9 aa, Artificial Sequence
  Description of Artificial Sequence: Synthetic peptide
  Seed: TQDLVQEKY (MAGA1_HUMAN)
TVDLVQEKM

SEQ ID NO: 43292 - protein, 9 aa, Artificial Sequence
  Description of Artificial Sequence: Synthetic peptide
  Seed: FFFPSLREA (MAGA1_HUMAN)
FNFPSLREV

SEQ ID NO: 43293 - protein, 10 aa, Artificial Sequence
  Description of Artificial Sequence: Synthetic peptide
  Seed: RVRFFFPSLR (MAGA1_HUMAN)
RLRFFFPSLL

SEQ ID NO: 43294 - protein, 9 aa, Artificial Sequence
  Description of Artificial Sequence: Synthetic peptide
  Seed: LVQEKYLEY (MAGA1_HUMAN)
LLQEKYLEW

SEQ ID NO: 43295 - protein, 10 aa, Artificial Sequence
  Description of Artificial Sequence: Synthetic peptide
  Seed: FLWGPRALAE (MAGA1_HUMAN)
FSWGPRALAV

SEQ ID NO: 43296 - protein, 9 aa, Artificial Sequence
  Description of Artificial Sequence: Synthetic peptide
  Seed: VIKNYKHCF (MAGA1_HUMAN)
VAKNYKHCL

SEQ ID NO: 43297 - protein, 11 aa, Artificial Sequence
  Description of Artificial Sequence: Synthetic peptide
  Seed: SAFPTTINFTR (MAGA1_HUMAN)
SYFPTTINFTR

SEQ ID NO: 43298 - protein, 10 aa, Artificial Sequence
  Description of Artificial Sequence: Synthetic peptide
  Seed: FFPSLREAAL (MAGA1_HUMAN)
FDPSLREAAM

SEQ ID NO: 43299 - protein, 10 aa, Artificial Sequence
  Description of Artificial Sequence: Synthetic peptide
  Seed: AQQEALGLVC (MAGA1_HUMAN)
AQQEALGLVI

SEQ ID NO: 43300 - protein, 11 aa, Artificial Sequence
  Description of Artificial Sequence: Synthetic peptide
  Seed: EIFGKASESLQ (MAGA1_HUMAN)
EIFGKASESLK

SEQ ID NO: 43301 - protein, 9 aa, Artificial Sequence
  Description of Artificial Sequence: Synthetic peptide
  Seed: FFPSLREAA (MAGA1_HUMAN)
FYPSLREAY

SEQ ID NO: 43302 - protein, 10 aa, Artificial Sequence
  Description of Artificial Sequence: Synthetic peptide
  Seed: SLFRAVITKK (MAGA1_HUMAN)
SWFRAVITKR

SEQ ID NO: 43303 - protein, 9 aa, Artificial Sequence
  Description of Artificial Sequence: Synthetic peptide
  Seed: KVLEYVIKV (MAGA1_HUMAN)
KQLEYVIKF

SEQ ID NO: 43304 - protein, 11 aa, Artificial Sequence
  Description of Artificial Sequence: Synthetic peptide
  Seed: RVRFFFPSLRE (MAGA1_HUMAN)
RPRFFFPSLRR

SEQ ID NO: 43305 - protein, 9 aa, Artificial Sequence
  Description of Artificial Sequence: Synthetic peptide
  Seed: TQDLVQEKY (MAGA1_HUMAN)
TADLVQEKI

SEQ ID NO: 43306 - protein, 9 aa, Artificial Sequence
  Description of Artificial Sequence: Synthetic peptide
  Seed: HCFPEIFGK (MAGA1_HUMAN)
HMFPEIFGK

SEQ ID NO: 43307 - protein, 9 aa, Artificial Sequence
  Description of Artificial Sequence: Synthetic peptide
  Seed: QIMPKTGFL (MAGA1_HUMAN)
QAMPKTGFK

SEQ ID NO: 43308 - protein, 10 aa, Artificial Sequence
  Description of Artificial Sequence: Synthetic peptide
  Seed: SDPARYEFLW (MAGA1_HUMAN)
SVPARYEFLW

SEQ ID NO: 43309 - protein, 9 aa, Artificial Sequence
  Description of Artificial Sequence: Synthetic peptide
  Seed: STDPPQSPQ (MAGA1_HUMAN)
SLDPPQSPV

SEQ ID NO: 43310 - protein, 10 aa, Artificial Sequence
  Description of Artificial Sequence: Synthetic peptide
  Seed: KTGFLIIVLV (MAGA1_HUMAN)
KMGFLIIVLL

SEQ ID NO: 43311 - protein, 9 aa, Artificial Sequence
  Description of Artificial Sequence: Synthetic peptide
  Seed: GPRALAETS (MAGA1_HUMAN)
GPRALAETM

SEQ ID NO: 43312 - protein, 10 aa, Artificial Sequence
  Description of Artificial Sequence: Synthetic peptide
  Seed: SESLQLVFGI (MAGA1_HUMAN)
SISLQLVFGW

SEQ ID NO: 43313 - protein, 10 aa, Artificial Sequence
  Description of Artificial Sequence: Synthetic peptide
  Seed: RVRFFFPSLR (MAGA1_HUMAN)
RFRFFFPSLH

SEQ ID NO: 43314 - protein, 9 aa, Artificial Sequence
  Description of Artificial Sequence: Synthetic peptide
  Seed: RVRFFFPSL (MAGA1_HUMAN)
RFRFFFPSE

SEQ ID NO: 43315 - protein, 9 aa, Artificial Sequence
  Description of Artificial Sequence: Synthetic peptide
  Seed: TQDLVQEKY (MAGA1_HUMAN)
TTDLVQEKL

SEQ ID NO: 43316 - protein, 10 aa, Artificial Sequence
  Description of Artificial Sequence: Synthetic peptide
  Seed: TSYVKVLEYV (MAGA1_HUMAN)
TPYVKVLEYF

SEQ ID NO: 43317 - protein, 9 aa, Artificial Sequence
  Description of Artificial Sequence: Synthetic peptide
  Seed: SAFPTTINF (MAGA1_HUMAN)
SRFPTTINM

SEQ ID NO: 43318 - protein, 10 aa, Artificial Sequence
  Description of Artificial Sequence: Synthetic peptide
  Seed: EVYDGREHSA (MAGA1_HUMAN)
ELYDGREHSK

SEQ ID NO: 43319 - protein, 9 aa, Artificial Sequence
  Description of Artificial Sequence: Synthetic peptide
  Seed: SVMEVYDGR (MAGA1_HUMAN)
SNMEVYDGR

SEQ ID NO: 43320 - protein, 10 aa, Artificial Sequence
  Description of Artificial Sequence: Synthetic peptide
  Seed: EIFGKASESL (MAGA1_HUMAN)
EIFGKASESF

SEQ ID NO: 43321 - protein, 10 aa, Artificial Sequence
  Description of Artificial Sequence: Synthetic peptide
  Seed: VKVLEYVIKV (MAGA1_HUMAN)
VMVLEYVIKA

SEQ ID NO: 43322 - protein, 9 aa, Artificial Sequence
  Description of Artificial Sequence: Synthetic peptide
  Seed: RQRQPSEGS (MAGA1_HUMAN)
RVRQPSEGI

SEQ ID NO: 43323 - protein, 9 aa, Artificial Sequence
  Description of Artificial Sequence: Synthetic peptide
  Seed: TGFLIIVLV (MAGA1_HUMAN)
TLFLIIVLL

SEQ ID NO: 43324 - protein, 11 aa, Artificial Sequence
  Description of Artificial Sequence: Synthetic peptide
  Seed: RVRFFFPSLRE (MAGA1_HUMAN)
RIRFFFPSLRI

SEQ ID NO: 43325 - protein, 9 aa, Artificial Sequence
  Description of Artificial Sequence: Synthetic peptide
  Seed: RVRFFFPSL (MAGA1_HUMAN)
RGRFFFPSQ

SEQ ID NO: 43326 - protein, 10 aa, Artificial Sequence
  Description of Artificial Sequence: Synthetic peptide
  Seed: FFPSLREAAL (MAGA1_HUMAN)
FCPSLREAAL

SEQ ID NO: 43327 - protein, 9 aa, Artificial Sequence
  Description of Artificial Sequence: Synthetic peptide
  Seed: LKYRAREPV (MAGA1_HUMAN)
LKYRAREPY

SEQ ID NO: 43328 - protein, 10 aa, Artificial Sequence
  Description of Artificial Sequence: Synthetic peptide
  Seed: RVRFFFPSLR (MAGA1_HUMAN)
RFRFFFPSLT

SEQ ID NO: 43329 - protein, 9 aa, Artificial Sequence
  Description of Artificial Sequence: Synthetic peptide
  Seed: AETSYVKVL (MAGA1_HUMAN)
AETSYVKVC

SEQ ID NO: 43330 - protein, 10 aa, Artificial Sequence
  Description of Artificial Sequence: Synthetic peptide
  Seed: YVIKVSARVR (MAGA1_HUMAN)
YTIKVSARVR

SEQ ID NO: 43331 - protein, 8 aa, Artificial Sequence
  Description of Artificial Sequence: Synthetic peptide
  Seed: RVRFFFPS (MAGA1_HUMAN)
RSRFFFPA

SEQ ID NO: 43332 - protein, 10 aa, Artificial Sequence
  Description of Artificial Sequence: Synthetic peptide
  Seed: RVRFFFPSLR (MAGA1_HUMAN)
RARFFFPSLH

SEQ ID NO: 43333 - protein, 9 aa, Artificial Sequence
  Description of Artificial Sequence: Synthetic peptide
  Seed: YEFLWGPRA (MAGA1_HUMAN)
YEFLWGPRL

SEQ ID NO: 43334 - protein, 10 aa, Artificial Sequence
  Description of Artificial Sequence: Synthetic peptide
  Seed: VKVLEYVIKV (MAGA1_HUMAN)
VDVLEYVIKV

SEQ ID NO: 43335 - protein, 9 aa, Artificial Sequence
  Description of Artificial Sequence: Synthetic peptide
  Seed: AATSSSSPL (MAGA1_HUMAN)
APTSSSSPV

SEQ ID NO: 43336 - protein, 9 aa, Artificial Sequence
  Description of Artificial Sequence: Synthetic peptide
  Seed: HSYVLVTCL (MAGA1_HUMAN)
HKYVLVTCY

SEQ ID NO: 43337 - protein, 10 aa, Artificial Sequence
  Description of Artificial Sequence: Synthetic peptide
  Seed: SSSPLVLGTL (MAGA1_HUMAN)
SLSPLVLGTW

SEQ ID NO: 43338 - protein, 9 aa, Artificial Sequence
  Description of Artificial Sequence: Synthetic peptide
  Seed: CILESLFRA (MAGA1_HUMAN)
CMLESLFRI

SEQ ID NO: 43339 - protein, 11 aa, Artificial Sequence
  Description of Artificial Sequence: Synthetic peptide
  Seed: YEFLWGPRALA (MAGA1_HUMAN)
YAFLWGPRALI

SEQ ID NO: 43340 - protein, 10 aa, Artificial Sequence
  Description of Artificial Sequence: Synthetic peptide
  Seed: SDPARYEFLW (MAGA1_HUMAN)
SAPARYEFLW

SEQ ID NO: 43341 - protein, 9 aa, Artificial Sequence
  Description of Artificial Sequence: Synthetic peptide
  Seed: YKHCFPEIF (MAGA1_HUMAN)
YTHCFPEIY

SEQ ID NO: 43342 - protein, 10 aa, Artificial Sequence
  Description of Artificial Sequence: Synthetic peptide
  Seed: RAREPVTKAE (MAGA1_HUMAN)
RTREPVTKAK

SEQ ID NO: 43343 - protein, 9 aa, Artificial Sequence
  Description of Artificial Sequence: Synthetic peptide
  Seed: ASESLQLVF (MAGA1_HUMAN)
AAESLQLVY

SEQ ID NO: 43344 - protein, 10 aa, Artificial Sequence
  Description of Artificial Sequence: Synthetic peptide
  Seed: KVADLVGFLL (MAGA1_HUMAN)
KLADLVGFLT

SEQ ID NO: 43345 - protein, 9 aa, Artificial Sequence
  Description of Artificial Sequence: Synthetic peptide
  Seed: SAFPTTINF (MAGA1_HUMAN)
SPFPTTINA

SEQ ID NO: 43346 - protein, 9 aa, Artificial Sequence
  Description of Artificial Sequence: Synthetic peptide
  Seed: EHSAYGEPR (MAGA1_HUMAN)
EVSAYGEPR

SEQ ID NO: 43347 - protein, 11 aa, Artificial Sequence
  Description of Artificial Sequence: Synthetic peptide
  Seed: SARVRFFFPSL (MAGA1_HUMAN)
SPRVRFFFPSL

SEQ ID NO: 43348 - protein, 9 aa, Artificial Sequence
  Description of Artificial Sequence: Synthetic peptide
  Seed: KYRAREPVT (MAGA1_HUMAN)
KLRAREPVK

SEQ ID NO: 43349 - protein, 9 aa, Artificial Sequence
  Description of Artificial Sequence: Synthetic peptide
  Seed: RVRFFFPSL (MAGA1_HUMAN)
RVRFFFPSI

SEQ ID NO: 43350 - protein, 10 aa, Artificial Sequence
  Description of Artificial Sequence: Synthetic peptide
  Seed: KVADLVGFLL (MAGA1_HUMAN)
KQADLVGFLW

SEQ ID NO: 43351 - protein, 10 aa, Artificial Sequence
  Description of Artificial Sequence: Synthetic peptide
  Seed: VYDGREHSAY (MAGA1_HUMAN)
VLDGREHSAY

SEQ ID NO: 43352 - protein, 10 aa, Artificial Sequence
  Description of Artificial Sequence: Synthetic peptide
  Seed: MLESVIKNYK (MAGA1_HUMAN)
MWESVIKNYR

SEQ ID NO: 43353 - protein, 10 aa, Artificial Sequence
  Description of Artificial Sequence: Synthetic peptide
  Seed: STSCILESLF (MAGA1_HUMAN)
SSSCILESLF

SEQ ID NO: 43354 - protein, 9 aa, Artificial Sequence
  Description of Artificial Sequence: Synthetic peptide
  Seed: DLVGFLLLK (MAGA1_HUMAN)
DGVGFLLLR

SEQ ID NO: 43355 - protein, 10 aa, Artificial Sequence
  Description of Artificial Sequence: Synthetic peptide
  Seed: SSSPLVLGTL (MAGA1_HUMAN)
SASPLVLGTM

SEQ ID NO: 43356 - protein, 11 aa, Artificial Sequence
  Description of Artificial Sequence: Synthetic peptide
  Seed: EVYDGREHSAY (MAGA1_HUMAN)
EAYDGREHSAR

SEQ ID NO: 43357 - protein, 10 aa, Artificial Sequence
  Description of Artificial Sequence: Synthetic peptide
  Seed: ASAFPTTINF (MAGA1_HUMAN)
AKAFPTTINF

SEQ ID NO: 43358 - protein, 11 aa, Artificial Sequence
  Description of Artificial Sequence: Synthetic peptide
  Seed: RVRFFFPSLRE (MAGA1_HUMAN)
RHRFFFPSLRR

SEQ ID NO: 43359 - protein, 10 aa, Artificial Sequence
  Description of Artificial Sequence: Synthetic peptide
  Seed: RVRFFFPSLR (MAGA1_HUMAN)
RTRFFFPSLF

SEQ ID NO: 43360 - protein, 9 aa, Artificial Sequence
  Description of Artificial Sequence: Synthetic peptide
  Seed: FPTTINFTR (MAGA1_HUMAN)
FQTTINFTY

SEQ ID NO: 43361 - protein, 10 aa, Artificial Sequence
  Description of Artificial Sequence: Synthetic peptide
  Seed: KEADPTGHSY (MAGA1_HUMAN)
KAADPTGHSA

SEQ ID NO: 43362 - protein, 9 aa, Artificial Sequence
  Description of Artificial Sequence: Synthetic peptide
  Seed: RALAETSYV (MAGA1_HUMAN)
RTLAETSYV

SEQ ID NO: 43363 - protein, 9 aa, Artificial Sequence
  Description of Artificial Sequence: Synthetic peptide
  Seed: SAYGEPRKL (MAGA1_HUMAN)
SRYGEPRKY

SEQ ID NO: 43364 - protein, 10 aa, Artificial Sequence
  Description of Artificial Sequence: Synthetic peptide
  Seed: RVRFFFPSLR (MAGA1_HUMAN)
RVRFFFPSLS

SEQ ID NO: 43365 - protein, 9 aa, Artificial Sequence
  Description of Artificial Sequence: Synthetic peptide
  Seed: FLWGPRALA (MAGA1_HUMAN)
FSWGPRALK

SEQ ID NO: 43366 - protein, 9 aa, Artificial Sequence
  Description of Artificial Sequence: Synthetic peptide
  Seed: DLVGFLLLK (MAGA1_HUMAN)
DNVGFLLLR

SEQ ID NO: 43367 - protein, 11 aa, Artificial Sequence
  Description of Artificial Sequence: Synthetic peptide
  Seed: CILESLFRAVI (MAGA1_HUMAN)
CMLESLFRAVI

SEQ ID NO: 43368 - protein, 9 aa, Artificial Sequence
  Description of Artificial Sequence: Synthetic peptide
  Seed: HSYVLVTCL (MAGA1_HUMAN)
HEYVLVTCF

SEQ ID NO: 43369 - protein, 10 aa, Artificial Sequence
  Description of Artificial Sequence: Synthetic peptide
  Seed: SARVRFFFPS (MAGA1_HUMAN)
SPRVRFFFPR

SEQ ID NO: 43370 - protein, 9 aa, Artificial Sequence
  Description of Artificial Sequence: Synthetic peptide
  Seed: VADLVGFLL (MAGA1_HUMAN)
VVDLVGFLI

SEQ ID NO: 43371 - protein, 9 aa, Artificial Sequence
  Description of Artificial Sequence: Synthetic peptide
  Seed: RAREPVTKA (MAGA1_HUMAN)
RQREPVTKK

SEQ ID NO: 43372 - protein, 9 aa, Artificial Sequence
  Description of Artificial Sequence: Synthetic peptide
  Seed: LVQEKYLEY (MAGA1_HUMAN)
LTQEKYLEI

SEQ ID NO: 43373 - protein, 10 aa, Artificial Sequence
  Description of Artificial Sequence: Synthetic peptide
  Seed: ADPTGHSYVL (MAGA1_HUMAN)
AVPTGHSYVL

SEQ ID NO: 43374 - protein, 9 aa, Artificial Sequence
  Description of Artificial Sequence: Synthetic peptide
  Seed: LEYVIKVSA (MAGA1_HUMAN)
LEYVIKVST

SEQ ID NO: 43375 - protein, 9 aa, Artificial Sequence
  Description of Artificial Sequence: Synthetic peptide
  Seed: SAYGEPRKL (MAGA1_HUMAN)
SFYGEPRKL

SEQ ID NO: 43376 - protein, 9 aa, Artificial Sequence
  Description of Artificial Sequence: Synthetic peptide
  Seed: EIWEELSVM (MAGA1_HUMAN)
EMWEELSVM

SEQ ID NO: 43377 - protein, 11 aa, Artificial Sequence
  Description of Artificial Sequence: Synthetic peptide
  Seed: YVKVLEYVIKV (MAGA1_HUMAN)
YSKVLEYVIKV

SEQ ID NO: 43378 - protein, 9 aa, Artificial Sequence
  Description of Artificial Sequence: Synthetic peptide
  Seed: SVMEVYDGR (MAGA1_HUMAN)
SSMEVYDGY

SEQ ID NO: 43379 - protein, 10 aa, Artificial Sequence
  Description of Artificial Sequence: Synthetic peptide
  Seed: VYDGREHSAY (MAGA1_HUMAN)
VFDGREHSAM

SEQ ID NO: 43380 - protein, 10 aa, Artificial Sequence
  Description of Artificial Sequence: Synthetic peptide
  Seed: SARVRFFFPS (MAGA1_HUMAN)
SCRVRFFFPV

SEQ ID NO: 43381 - protein, 11 aa, Artificial Sequence
  Description of Artificial Sequence: Synthetic peptide
  Seed: TKKVADLVGFL (MAGA1_HUMAN)
TWKVADLVGFV

SEQ ID NO: 43382 - protein, 10 aa, Artificial Sequence
  Description of Artificial Sequence: Synthetic peptide
  Seed: ARVRFFFPSL (MAGA1_HUMAN)
AMVRFFFPSK

SEQ ID NO: 43383 - protein, 9 aa, Artificial Sequence
  Description of Artificial Sequence: Synthetic peptide
  Seed: KASESLQLV (MAGA1_HUMAN)
KTSESLQLY

SEQ ID NO: 43384 - protein, 10 aa, Artificial Sequence
  Description of Artificial Sequence: Synthetic peptide
  Seed: SDPARYEFLW (MAGA1_HUMAN)
SYPARYEFLW

SEQ ID NO: 43385 - protein, 9 aa, Artificial Sequence
  Description of Artificial Sequence: Synthetic peptide
  Seed: GTLEEVPTA (MAGA1_HUMAN)
GALEEVPTI

SEQ ID NO: 43386 - protein, 9 aa, Artificial Sequence
  Description of Artificial Sequence: Synthetic peptide
  Seed: HCFPEIFGK (MAGA1_HUMAN)
HNFPEIFGR

SEQ ID NO: 43387 - protein, 9 aa, Artificial Sequence
  Description of Artificial Sequence: Synthetic peptide
  Seed: ARVRFFFPS (MAGA1_HUMAN)
ARVRFFFPV

SEQ ID NO: 43388 - protein, 10 aa, Artificial Sequence
  Description of Artificial Sequence: Synthetic peptide
  Seed: DVKEADPTGH (MAGA1_HUMAN)
DMKEADPTGR

SEQ ID NO: 43389 - protein, 11 aa, Artificial Sequence
  Description of Artificial Sequence: Synthetic peptide
  Seed: FLWGPRALAET (MAGA1_HUMAN)
FLWGPRALAEM

SEQ ID NO: 43390 - protein, 9 aa, Artificial Sequence
  Description of Artificial Sequence: Synthetic peptide
  Seed: IKVSARVRF (MAGA1_HUMAN)
IAVSARVRF

SEQ ID NO: 43391 - protein, 9 aa, Artificial Sequence
  Description of Artificial Sequence: Synthetic peptide
  Seed: RVRFFFPSL (MAGA1_HUMAN)
RMRFFFPSE

SEQ ID NO: 43392 - protein, 9 aa, Artificial Sequence
  Description of Artificial Sequence: Synthetic peptide
  Seed: ATSSSSPLV (MAGA1_HUMAN)
ATSSSSPLM

SEQ ID NO: 43393 - protein, 11 aa, Artificial Sequence
  Description of Artificial Sequence: Synthetic peptide
  Seed: STDPPQSPQGA (MAGA1_HUMAN)
SVDPPQSPQGI

SEQ ID NO: 43394 - protein, 10 aa, Artificial Sequence
  Description of Artificial Sequence: Synthetic peptide
  Seed: ADLVGFLLLK (MAGA1_HUMAN)
APLVGFLLLK

SEQ ID NO: 43395 - protein, 9 aa, Artificial Sequence
  Description of Artificial Sequence: Synthetic peptide
  Seed: AETSYVKVL (MAGA1_HUMAN)
AMTSYVKVY

SEQ ID NO: 43396 - protein, 9 aa, Artificial Sequence
  Description of Artificial Sequence: Synthetic peptide
  Seed: TSSSSPLVL (MAGA1_HUMAN)
TPSSSPLVI

SEQ ID NO: 43397 - protein, 9 aa, Artificial Sequence
  Description of Artificial Sequence: Synthetic peptide
  Seed: EADPTGHSY (MAGA1_HUMAN)
EQDPTGHSL

SEQ ID NO: 43398 - protein, 10 aa, Artificial Sequence
  Description of Artificial Sequence: Synthetic peptide
  Seed: AQQEALGLVC (MAGA1_HUMAN)
AEQEALGLVI

SEQ ID NO: 43399 - protein, 9 aa, Artificial Sequence
  Description of Artificial Sequence: Synthetic peptide
  Seed: SARVRFFFP (MAGA1_HUMAN)
SLRVRFFFI

SEQ ID NO: 43400 - protein, 9 aa, Artificial Sequence
  Description of Artificial Sequence: Synthetic peptide
  Seed: RAREPVTKA (MAGA1_HUMAN)
RMREPVTKA

SEQ ID NO: 43401 - protein, 11 aa, Artificial Sequence
  Description of Artificial Sequence: Synthetic peptide
  Seed: FLWGPRALAET (MAGA1_HUMAN)
FQWGPRALAEV

SEQ ID NO: 43402 - protein, 8 aa, Artificial Sequence
  Description of Artificial Sequence: Synthetic peptide
  Seed: RFFFPSLR (MAGA1_HUMAN)
RTFFPSLR

SEQ ID NO: 43403 - protein, 10 aa, Artificial Sequence
  Description of Artificial Sequence: Synthetic peptide
  Seed: KASESLQLVF (MAGA1_HUMAN)
KQSESLQLVM

SEQ ID NO: 43404 - protein, 9 aa, Artificial Sequence
  Description of Artificial Sequence: Synthetic peptide
  Seed: KVLEYVIKV (MAGA1_HUMAN)
KLLEYVIKM

SEQ ID NO: 43405 - protein, 9 aa, Artificial Sequence
  Description of Artificial Sequence: Synthetic peptide
  Seed: FPTTINFTR (MAGA1_HUMAN)
FFTTINFTK

SEQ ID NO: 43406 - protein, 10 aa, Artificial Sequence
  Description of Artificial Sequence: Synthetic peptide
  Seed: KVSARVRFFF (MAGA1_HUMAN)
KSSARVRFFA

SEQ ID NO: 43407 - protein, 9 aa, Artificial Sequence
  Description of Artificial Sequence: Synthetic peptide
  Seed: KEADPTGHS (MAGA1_HUMAN)
KEADPTGHA

SEQ ID NO: 43408 - protein, 11 aa, Artificial Sequence
  Description of Artificial Sequence: Synthetic peptide
  Seed: KEADPTGHSYV (MAGA1_HUMAN)
KLADPTGHSYF

SEQ ID NO: 43409 - protein, 9 aa, Artificial Sequence
  Description of Artificial Sequence: Synthetic peptide
  Seed: LVLGTLEEV (MAGA1_HUMAN)
LILGTLEEM

SEQ ID NO: 43410 - protein, 11 aa, Artificial Sequence
  Description of Artificial Sequence: Synthetic peptide
  Seed: VQAATSSSSPL (MAGA1_HUMAN)
VIAATSSSSPY

SEQ ID NO: 43411 - protein, 9 aa, Artificial Sequence
  Description of Artificial Sequence: Synthetic peptide
  Seed: VADLVGFLL (MAGA1_HUMAN)
VFDLVGFLM

SEQ ID NO: 43412 - protein, 9 aa, Artificial Sequence
  Description of Artificial Sequence: Synthetic peptide
  Seed: VSARVRFFF (MAGA1_HUMAN)
VIARVRFFY

SEQ ID NO: 43413 - protein, 9 aa, Artificial Sequence
  Description of Artificial Sequence: Synthetic peptide
  Seed: SAYGEPRKL (MAGA1_HUMAN)
SDYGEPRKI

SEQ ID NO: 43414 - protein, 9 aa, Artificial Sequence
  Description of Artificial Sequence: Synthetic peptide
  Seed: RVRFFFPSL (MAGA1_HUMAN)
RIRFFFPSE

SEQ ID NO: 43415 - protein, 10 aa, Artificial Sequence
  Description of Artificial Sequence: Synthetic peptide
  Seed: KEADPTGHSY (MAGA1_HUMAN)
KEADPTGHSG

SEQ ID NO: 43416 - protein, 10 aa, Artificial Sequence
  Description of Artificial Sequence: Synthetic peptide
  Seed: KVLEYVIKVS (MAGA1_HUMAN)
KQLEYVIKVL

SEQ ID NO: 43417 - protein, 9 aa, Artificial Sequence
  Description of Artificial Sequence: Synthetic peptide
  Seed: RQVPDSDPA (MAGA1_HUMAN)
RMVPDSDPV

SEQ ID NO: 43418 - protein, 9 aa, Artificial Sequence
  Description of Artificial Sequence: Synthetic peptide
  Seed: GASAFPTTI (MAGA1_HUMAN)
GASAFPTTF

SEQ ID NO: 43419 - protein, 10 aa, Artificial Sequence
  Description of Artificial Sequence: Synthetic peptide
  Seed: KVSARVRFFF (MAGA1_HUMAN)
KGSARVRFFK

SEQ ID NO: 43420 - protein, 9 aa, Artificial Sequence
  Description of Artificial Sequence: Synthetic peptide
  Seed: HCFPEIFGK (MAGA1_HUMAN)
HSFPEIFGR

SEQ ID NO: 43421 - protein, 11 aa, Artificial Sequence
  Description of Artificial Sequence: Synthetic peptide
  Seed: TKKVADLVGFL (MAGA1_HUMAN)
TDKVADLVGFV

SEQ ID NO: 43422 - protein, 9 aa, Artificial Sequence
  Description of Artificial Sequence: Synthetic peptide
  Seed: EADPTGHSY (MAGA1_HUMAN)
EMDPTGHSF

SEQ ID NO: 43423 - protein, 9 aa, Artificial Sequence
  Description of Artificial Sequence: Synthetic peptide
  Seed: TGFLIIVLV (MAGA1_HUMAN)
TMFLIIVLM

SEQ ID NO: 43424 - protein, 10 aa, Artificial Sequence
  Description of Artificial Sequence: Synthetic peptide
  Seed: KNYKHCFPEI (MAGA1_HUMAN)
KSYKHCFPEK

SEQ ID NO: 43425 - protein, 9 aa, Artificial Sequence
  Description of Artificial Sequence: Synthetic peptide
  Seed: DSDPARYEF (MAGA1_HUMAN)
DYDPARYEF

SEQ ID NO: 43426 - protein, 10 aa, Artificial Sequence
  Description of Artificial Sequence: Synthetic peptide
  Seed: KVADLVGFLL (MAGA1_HUMAN)
KAADLVGFLL

SEQ ID NO: 43427 - protein, 9 aa, Artificial Sequence
  Description of Artificial Sequence: Synthetic peptide
  Seed: EIWEELSVM (MAGA1_HUMAN)
ESWEELSVV

SEQ ID NO: 43428 - protein, 9 aa, Artificial Sequence
  Description of Artificial Sequence: Synthetic peptide
  Seed: FPSLREAAL (MAGA1_HUMAN)
FSSLREAAY

SEQ ID NO: 43429 - protein, 10 aa, Artificial Sequence
  Description of Artificial Sequence: Synthetic peptide
  Seed: RYEFLWGPRA (MAGA1_HUMAN)
REEFLWGPRL

SEQ ID NO: 43430 - protein, 10 aa, Artificial Sequence
  Description of Artificial Sequence: Synthetic peptide
  Seed: REEEGPSTSC (MAGA1_HUMAN)
REEEGPSTSM

SEQ ID NO: 43431 - protein, 11 aa, Artificial Sequence
  Description of Artificial Sequence: Synthetic peptide
  Seed: RQVPDSDPARY (MAGA1_HUMAN)
RIVPDSDPARF

SEQ ID NO: 43432 - protein, 9 aa, Artificial Sequence
  Description of Artificial Sequence: Synthetic peptide
  Seed: YVLVTCLGL (MAGA1_HUMAN)
YSLVTCLGF

SEQ ID NO: 43433 - protein, 9 aa, Artificial Sequence
  Description of Artificial Sequence: Synthetic peptide
  Seed: IIVLVMIAM (MAGA1_HUMAN)
ILVLVMIAY

SEQ ID NO: 43434 - protein, 10 aa, Artificial Sequence
  Description of Artificial Sequence: Synthetic peptide
  Seed: SCILESLFRA (MAGA1_HUMAN)
SAILESLFRV

SEQ ID NO: 43435 - protein, 9 aa, Artificial Sequence
  Description of Artificial Sequence: Synthetic peptide
  Seed: SYVKVLEYV (MAGA1_HUMAN)
SSVKVLEYL

SEQ ID NO: 43436 - protein, 9 aa, Artificial Sequence
  Description of Artificial Sequence: Synthetic peptide
  Seed: FFFPSLREA (MAGA1_HUMAN)
FKFPSLREV

SEQ ID NO: 43437 - protein, 10 aa, Artificial Sequence
  Description of Artificial Sequence: Synthetic peptide
  Seed: EVYDGREHSA (MAGA1_HUMAN)
EVYDGREHSK

SEQ ID NO: 43438 - protein, 10 aa, Artificial Sequence
  Description of Artificial Sequence: Synthetic peptide
  Seed: LEEVPTAGST (MAGA1_HUMAN)
LEEVPTAGSA

SEQ ID NO: 43439 - protein, 10 aa, Artificial Sequence
  Description of Artificial Sequence: Synthetic peptide
  Seed: TSYVKVLEYV (MAGA1_HUMAN)
TQYVKVLEYF

SEQ ID NO: 43440 - protein, 9 aa, Artificial Sequence
  Description of Artificial Sequence: Synthetic peptide
  Seed: FLWGPRALA (MAGA1_HUMAN)
FMWGPRALA

SEQ ID NO: 43441 - protein, 11 aa, Artificial Sequence
  Description of Artificial Sequence: Synthetic peptide
  Seed: RVRFFFPSLRE (MAGA1_HUMAN)
RMRFFFPSLRD

SEQ ID NO: 43442 - protein, 9 aa, Artificial Sequence
  Description of Artificial Sequence: Synthetic peptide
  Seed: KVLEYVIKV (MAGA1_HUMAN)
KILEYVIKT

SEQ ID NO: 43443 - protein, 11 aa, Artificial Sequence
  Description of Artificial Sequence: Synthetic peptide
  Seed: YVKVLEYVIKV (MAGA1_HUMAN)
YEKVLEYVIKV

SEQ ID NO: 43444 - protein, 10 aa, Artificial Sequence
  Description of Artificial Sequence: Synthetic peptide
  Seed: FPSLREAALR (MAGA1_HUMAN)
FPSLREAALL

SEQ ID NO: 43445 - protein, 10 aa, Artificial Sequence
  Description of Artificial Sequence: Synthetic peptide
  Seed: ARVRFFFPSL (MAGA1_HUMAN)
AHVRFFFPSK

SEQ ID NO: 43446 - protein, 9 aa, Artificial Sequence
  Description of Artificial Sequence: Synthetic peptide
  Seed: LVQEKYLEY (MAGA1_HUMAN)
LAQEKYLEL

SEQ ID NO: 43447 - protein, 9 aa, Artificial Sequence
  Description of Artificial Sequence: Synthetic peptide
  Seed: VQAATSSSS (MAGA1_HUMAN)
VKAATSSSW

SEQ ID NO: 43448 - protein, 9 aa, Artificial Sequence
  Description of Artificial Sequence: Synthetic peptide
  Seed: ESVIKNYKH (MAGA1_HUMAN)
EVVIKNYKK

SEQ ID NO: 43449 - protein, 9 aa, Artificial Sequence
  Description of Artificial Sequence: Synthetic peptide
  Seed: QIMPKTGFL (MAGA1_HUMAN)
QIMPKTGFY

SEQ ID NO: 43450 - protein, 8 aa, Artificial Sequence
  Description of Artificial Sequence: Synthetic peptide
  Seed: RVRFFFPS (MAGA1_HUMAN)
RTRFFFPT

SEQ ID NO: 43451 - protein, 10 aa, Artificial Sequence
  Description of Artificial Sequence: Synthetic peptide
  Seed: YEFLWGPRAL (MAGA1_HUMAN)
YYFLWGPRAW

SEQ ID NO: 43452 - protein, 10 aa, Artificial Sequence
  Description of Artificial Sequence: Synthetic peptide
  Seed: ETSYVKVLEY (MAGA1_HUMAN)
EVSYVKVLER

SEQ ID NO: 43453 - protein, 9 aa, Artificial Sequence
  Description of Artificial Sequence: Synthetic peptide
  Seed: LVTCLGLSY (MAGA1_HUMAN)
LWTCLGLSY

SEQ ID NO: 43454 - protein, 11 aa, Artificial Sequence
  Description of Artificial Sequence: Synthetic peptide
  Seed: KEADPTGHSYV (MAGA1_HUMAN)
KEADPTGHSYM

SEQ ID NO: 43455 - protein, 9 aa, Artificial Sequence
  Description of Artificial Sequence: Synthetic peptide
  Seed: EIWEELSVM (MAGA1_HUMAN)
EIWEELSVK

SEQ ID NO: 43456 - protein, 9 aa, Artificial Sequence
  Description of Artificial Sequence: Synthetic peptide
  Seed: VQAATSSSS (MAGA1_HUMAN)
VQAATSSSL

SEQ ID NO: 43457 - protein, 9 aa, Artificial Sequence
  Description of Artificial Sequence: Synthetic peptide
  Seed: VADLVGFLL (MAGA1_HUMAN)
VMDLVGFLF

SEQ ID NO: 43458 - protein, 11 aa, Artificial Sequence
  Description of Artificial Sequence: Synthetic peptide
  Seed: VPDSDPARYEF (MAGA1_HUMAN)
VPDSDPARYEW

SEQ ID NO: 43459 - protein, 10 aa, Artificial Sequence
  Description of Artificial Sequence: Synthetic peptide
  Seed: ESLFRAVITK (MAGA1_HUMAN)
EGLFRAVITR

SEQ ID NO: 43460 - protein, 9 aa, Artificial Sequence
  Description of Artificial Sequence: Synthetic peptide
  Seed: SARVRFFFP (MAGA1_HUMAN)
SARVRFFFK

SEQ ID NO: 43461 - protein, 10 aa, Artificial Sequence
  Description of Artificial Sequence: Synthetic peptide
  Seed: CILESLFRAV (MAGA1_HUMAN)
CLLESLFRAM

SEQ ID NO: 43462 - protein, 9 aa, Artificial Sequence
  Description of Artificial Sequence: Synthetic peptide
  Seed: FLWGPRALA (MAGA1_HUMAN)
FLWGPRALL

SEQ ID NO: 43463 - protein, 10 aa, Artificial Sequence
  Description of Artificial Sequence: Synthetic peptide
  Seed: KVSARVRFFF (MAGA1_HUMAN)
KVSARVRFFY

SEQ ID NO: 43464 - protein, 10 aa, Artificial Sequence
  Description of Artificial Sequence: Synthetic peptide
  Seed: ALAETSYVKV (MAGA1_HUMAN)
AIAETSYVKV

SEQ ID NO: 43465 - protein, 9 aa, Artificial Sequence
  Description of Artificial Sequence: Synthetic peptide
  Seed: KASESLQLV (MAGA1_HUMAN)
KSSESLQLI

SEQ ID NO: 43466 - protein, 9 aa, Artificial Sequence
  Description of Artificial Sequence: Synthetic peptide
  Seed: FFFPSLREA (MAGA1_HUMAN)
FYFPSLREW

SEQ ID NO: 43467 - protein, 8 aa, Artificial Sequence
  Description of Artificial Sequence: Synthetic peptide
  Seed: FLWGPRAL (MAGA1_HUMAN)
FYWGPRAM

SEQ ID NO: 43468 - protein, 11 aa, Artificial Sequence
  Description of Artificial Sequence: Synthetic peptide
  Seed: KVADLVGFLLL (MAGA1_HUMAN)
KLADLVGFLLG

SEQ ID NO: 43469 - protein, 9 aa, Artificial Sequence
  Description of Artificial Sequence: Synthetic peptide
  Seed: RVRFFFPSL (MAGA1_HUMAN)
RWRFFFPSP

SEQ ID NO: 43470 - protein, 9 aa, Artificial Sequence
  Description of Artificial Sequence: Synthetic peptide
  Seed: ITKKVADLV (MAGA1_HUMAN)
IMKKVADLV

SEQ ID NO: 43471 - protein, 11 aa, Artificial Sequence
  Description of Artificial Sequence: Synthetic peptide
  Seed: KVADLVGFLLL (MAGA1_HUMAN)
KQADLVGFLLF

SEQ ID NO: 43472 - protein, 11 aa, Artificial Sequence
  Description of Artificial Sequence: Synthetic peptide
  Seed: RVRFFFPSLRE (MAGA1_HUMAN)
RTRFFFPSLRN

SEQ ID NO: 43473 - protein, 9 aa, Artificial Sequence
  Description of Artificial Sequence: Synthetic peptide
  Seed: KVLEYVIKV (MAGA1_HUMAN)
KRLEYVIKL

SEQ ID NO: 43474 - protein, 9 aa, Artificial Sequence
  Description of Artificial Sequence: Synthetic peptide
  Seed: MSLEQRSLH (MAGA1_HUMAN)
MTLEQRSLR

SEQ ID NO: 43475 - protein, 8 aa, Artificial Sequence
  Description of Artificial Sequence: Synthetic peptide
  Seed: FFPSLREA (MAGA1_HUMAN)
FFPSLREY

SEQ ID NO: 43476 - protein, 10 aa, Artificial Sequence
  Description of Artificial Sequence: Synthetic peptide
  Seed: RVRFFFPSLR (MAGA1_HUMAN)
RCRFFFPSLK

SEQ ID NO: 43477 - protein, 9 aa, Artificial Sequence
  Description of Artificial Sequence: Synthetic peptide
  Seed: KASESLQLV (MAGA1_HUMAN)
KVSESLQLY

SEQ ID NO: 43478 - protein, 11 aa, Artificial Sequence
  Description of Artificial Sequence: Synthetic peptide
  Seed: ELSVMEVYDGR (MAGA1_HUMAN)
EHSVMEVYDGR

SEQ ID NO: 43479 - protein, 9 aa, Artificial Sequence
  Description of Artificial Sequence: Synthetic peptide
  Seed: LVTCLGLSY (MAGA1_HUMAN)
LFTCLGLSY

SEQ ID NO: 43480 - protein, 9 aa, Artificial Sequence
  Description of Artificial Sequence: Synthetic peptide
  Seed: SAFPTTINF (MAGA1_HUMAN)
SDFPTTINL

SEQ ID NO: 43481 - protein, 10 aa, Artificial Sequence
  Description of Artificial Sequence: Synthetic peptide
  Seed: SCILESLFRA (MAGA1_HUMAN)
SQILESLFRM

SEQ ID NO: 43482 - protein, 9 aa, Artificial Sequence
  Description of Artificial Sequence: Synthetic peptide
  Seed: QSPQGASAF (MAGA1_HUMAN)
QLPQGASAL

SEQ ID NO: 43483 - protein, 10 aa, Artificial Sequence
  Description of Artificial Sequence: Synthetic peptide
  Seed: VKVLEYVIKV (MAGA1_HUMAN)
VAVLEYVIKV

SEQ ID NO: 43484 - protein, 10 aa, Artificial Sequence
  Description of Artificial Sequence: Synthetic peptide
  Seed: KHCFPEIFGK (MAGA1_HUMAN)
KFCFPEIFGR

SEQ ID NO: 43485 - protein, 9 aa, Artificial Sequence
  Description of Artificial Sequence: Synthetic peptide
  Seed: TSYVKVLEY (MAGA1_HUMAN)
TWYVKVLEF

SEQ ID NO: 43486 - protein, 11 aa, Artificial Sequence
  Description of Artificial Sequence: Synthetic peptide
  Seed: KVADLVGFLLL (MAGA1_HUMAN)
KMADLVGFLLI

SEQ ID NO: 43487 - protein, 10 aa, Artificial Sequence
  Description of Artificial Sequence: Synthetic peptide
  Seed: KYRAREPVTK (MAGA1_HUMAN)
KIRAREPVTA

SEQ ID NO: 43488 - protein, 10 aa, Artificial Sequence
  Description of Artificial Sequence: Synthetic peptide
  Seed: WEELSVMEVY (MAGA1_HUMAN)
WKELSVMEVF

SEQ ID NO: 43489 - protein, 9 aa, Artificial Sequence
  Description of Artificial Sequence: Synthetic peptide
  Seed: FFFPSLREA (MAGA1_HUMAN)
FFFPSLREI

SEQ ID NO: 43490 - protein, 9 aa, Artificial Sequence
  Description of Artificial Sequence: Synthetic peptide
  Seed: SAFPTTINF (MAGA1_HUMAN)
SYFPTTINF

SEQ ID NO: 43491 - protein, 10 aa, Artificial Sequence
  Description of Artificial Sequence: Synthetic peptide
  Seed: SARVRFFFPS (MAGA1_HUMAN)
SGRVRFFFPF

SEQ ID NO: 43492 - protein, 10 aa, Artificial Sequence
  Description of Artificial Sequence: Synthetic peptide
  Seed: RVRFFFPSLR (MAGA1_HUMAN)
RYRFFFPSLY

SEQ ID NO: 43493 - protein, 9 aa, Artificial Sequence
  Description of Artificial Sequence: Synthetic peptide
  Seed: LESLFRAVI (MAGA1_HUMAN)
LESLFRAVL

SEQ ID NO: 43494 - protein, 9 aa, Artificial Sequence
  Description of Artificial Sequence: Synthetic peptide
  Seed: RQVPDSDPA (MAGA1_HUMAN)
RKVPDSDPM

SEQ ID NO: 43495 - protein, 9 aa, Artificial Sequence
  Description of Artificial Sequence: Synthetic peptide
  Seed: KASESLQLV (MAGA1_HUMAN)
KLSESLQLK

SEQ ID NO: 43496 - protein, 10 aa, Artificial Sequence
  Description of Artificial Sequence: Synthetic peptide
  Seed: FLWGPRALAE (MAGA1_HUMAN)
FMWGPRALAI

SEQ ID NO: 43497 - protein, 9 aa, Artificial Sequence
  Description of Artificial Sequence: Synthetic peptide
  Seed: RQVPDSDPA (MAGA1_HUMAN)
RKVPDSDPY

SEQ ID NO: 43498 - protein, 9 aa, Artificial Sequence
  Description of Artificial Sequence: Synthetic peptide
  Seed: KYRAREPVT (MAGA1_HUMAN)
KTRAREPVQ

SEQ ID NO: 43499 - protein, 9 aa, Artificial Sequence
  Description of Artificial Sequence: Synthetic peptide
  Seed: VGFLLLKYR (MAGA1_HUMAN)
VWFLLLKYR

SEQ ID NO: 43500 - protein, 10 aa, Artificial Sequence
  Description of Artificial Sequence: Synthetic peptide
  Seed: RVRFFFPSLR (MAGA1_HUMAN)
RIRFFFPSLG

SEQ ID NO: 43501 - protein, 10 aa, Artificial Sequence
  Description of Artificial Sequence: Synthetic peptide
  Seed: SSSPLVLGTL (MAGA1_HUMAN)
SLSPLVLGTA

SEQ ID NO: 43502 - protein, 9 aa, Artificial Sequence
  Description of Artificial Sequence: Synthetic peptide
  Seed: SAFPTTINF (MAGA1_HUMAN)
SQFPTTINW

SEQ ID NO: 43503 - protein, 9 aa, Artificial Sequence
  Description of Artificial Sequence: Synthetic peptide
  Seed: SLFRAVITK (MAGA1_HUMAN)
SNFRAVITK

SEQ ID NO: 43504 - protein, 9 aa, Artificial Sequence
  Description of Artificial Sequence: Synthetic peptide
  Seed: KVLEYVIKV (MAGA1_HUMAN)
KMLEYVIKL

SEQ ID NO: 43505 - protein, 10 aa, Artificial Sequence
  Description of Artificial Sequence: Synthetic peptide
  Seed: TSYVKVLEYV (MAGA1_HUMAN)
TVYVKVLEYW

SEQ ID NO: 43506 - protein, 9 aa, Artificial Sequence
  Description of Artificial Sequence: Synthetic peptide
  Seed: KVLEYVIKV (MAGA1_HUMAN)
KTLEYVIKW

SEQ ID NO: 43507 - protein, 9 aa, Artificial Sequence
  Description of Artificial Sequence: Synthetic peptide
  Seed: STDPPQSPQ (MAGA1_HUMAN)
SADPPQSPF

SEQ ID NO: 43508 - protein, 9 aa, Artificial Sequence
  Description of Artificial Sequence: Synthetic peptide
  Seed: FFFPSLREA (MAGA1_HUMAN)
FAFPSLRES

SEQ ID NO: 43509 - protein, 10 aa, Artificial Sequence
  Description of Artificial Sequence: Synthetic peptide
  Seed: LTQDLVQEKY (MAGA1_HUMAN)
LSQDLVQEKW

SEQ ID NO: 43510 - protein, 9 aa, Artificial Sequence
  Description of Artificial Sequence: Synthetic peptide
  Seed: TSYVKVLEY (MAGA1_HUMAN)
TFYVKVLEV

SEQ ID NO: 43511 - protein, 10 aa, Artificial Sequence
  Description of Artificial Sequence: Synthetic peptide
  Seed: ETSYVKVLEY (MAGA1_HUMAN)
ELSYVKVLER

SEQ ID NO: 43512 - protein, 10 aa, Artificial Sequence
  Description of Artificial Sequence: Synthetic peptide
  Seed: DLVGFLLLKY (MAGA1_HUMAN)
DSVGFLLLKK

SEQ ID NO: 43513 - protein, 9 aa, Artificial Sequence
  Description of Artificial Sequence: Synthetic peptide
  Seed: LVTCLGLSY (MAGA1_HUMAN)
LATCLGLSW

SEQ ID NO: 43514 - protein, 10 aa, Artificial Sequence
  Description of Artificial Sequence: Synthetic peptide
  Seed: TSYVKVLEYV (MAGA1_HUMAN)
TKYVKVLEYF

SEQ ID NO: 43515 - protein, 10 aa, Artificial Sequence
  Description of Artificial Sequence: Synthetic peptide
  Seed: RVRFFFPSLR (MAGA1_HUMAN)
RIRFFFPSLH

SEQ ID NO: 43516 - protein, 9 aa, Artificial Sequence
  Description of Artificial Sequence: Synthetic peptide
  Seed: LVLGTLEEV (MAGA1_HUMAN)
LQLGTLEEI

SEQ ID NO: 43517 - protein, 9 aa, Artificial Sequence
  Description of Artificial Sequence: Synthetic peptide
  Seed: QSPQGASAF (MAGA1_HUMAN)
QVPQGASAL

SEQ ID NO: 43518 - protein, 10 aa, Artificial Sequence
  Description of Artificial Sequence: Synthetic peptide
  Seed: EMLESVIKNY (MAGA1_HUMAN)
ESLESVIKNK

SEQ ID NO: 43519 - protein, 9 aa, Artificial Sequence
  Description of Artificial Sequence: Synthetic peptide
  Seed: STSCILESL (MAGA1_HUMAN)
SISCILESL

SEQ ID NO: 43520 - protein, 9 aa, Artificial Sequence
  Description of Artificial Sequence: Synthetic peptide
  Seed: QPSEGSSSR (MAGA1_HUMAN)
QLSEGSSSR

SEQ ID NO: 43521 - protein, 9 aa, Artificial Sequence
  Description of Artificial Sequence: Synthetic peptide
  Seed: TSCILESLF (MAGA1_HUMAN)
TTCILESLF

SEQ ID NO: 43522 - protein, 9 aa, Artificial Sequence
  Description of Artificial Sequence: Synthetic peptide
  Seed: RAREPVTKA (MAGA1_HUMAN)
RTREPVTKQ

SEQ ID NO: 43523 - protein, 9 aa, Artificial Sequence
  Description of Artificial Sequence: Synthetic peptide
  Seed: SSPLVLGTL (MAGA1_HUMAN)
STPLVLGTY

SEQ ID NO: 43524 - protein, 9 aa, Artificial Sequence
  Description of Artificial Sequence: Synthetic peptide
  Seed: HCFPEIFGK (MAGA1_HUMAN)
HSFPEIFGM

SEQ ID NO: 43525 - protein, 9 aa, Artificial Sequence
  Description of Artificial Sequence: Synthetic peptide
  Seed: RVRFFFPSL (MAGA1_HUMAN)
RPRFFFPSV

SEQ ID NO: 43526 - protein, 10 aa, Artificial Sequence
  Description of Artificial Sequence: Synthetic peptide
  Seed: RVRFFFPSLR (MAGA1_HUMAN)
RYRFFFPSLA

SEQ ID NO: 43527 - protein, 10 aa, Artificial Sequence
  Description of Artificial Sequence: Synthetic peptide
  Seed: QVPDSDPARY (MAGA1_HUMAN)
QIPDSDPARR

SEQ ID NO: 43528 - protein, 10 aa, Artificial Sequence
  Description of Artificial Sequence: Synthetic peptide
  Seed: RVRFFFPSLR (MAGA1_HUMAN)
RFRFFFPSLV

SEQ ID NO: 43529 - protein, 9 aa, Artificial Sequence
  Description of Artificial Sequence: Synthetic peptide
  Seed: RAREPVTKA (MAGA1_HUMAN)
RQREPVTKR

SEQ ID NO: 43530 - protein, 9 aa, Artificial Sequence
  Description of Artificial Sequence: Synthetic peptide
  Seed: IAMEGGHAP (MAGA1_HUMAN)
IVMEGGHAV

SEQ ID NO: 43531 - protein, 9 aa, Artificial Sequence
  Description of Artificial Sequence: Synthetic peptide
  Seed: EIWEELSVM (MAGA1_HUMAN)
EVWEELSVF

SEQ ID NO: 43532 - protein, 10 aa, Artificial Sequence
  Description of Artificial Sequence: Synthetic peptide
  Seed: EAQQEALGLV (MAGA1_HUMAN)
ETQQEALGLV

SEQ ID NO: 43533 - protein, 9 aa, Artificial Sequence
  Description of Artificial Sequence: Synthetic peptide
  Seed: RAREPVTKA (MAGA1_HUMAN)
RGREPVTKA

SEQ ID NO: 43534 - protein, 10 aa, Artificial Sequence
  Description of Artificial Sequence: Synthetic peptide
  Seed: QIMPKTGFLI (MAGA1_HUMAN)
QLMPKTGFLV

SEQ ID NO: 43535 - protein, 9 aa, Artificial Sequence
  Description of Artificial Sequence: Synthetic peptide
  Seed: SARVRFFFP (MAGA1_HUMAN)
SRRVRFFFK

SEQ ID NO: 43536 - protein, 9 aa, Artificial Sequence
  Description of Artificial Sequence: Synthetic peptide
  Seed: GASAFPTTI (MAGA1_HUMAN)
GSSAFPTTY

SEQ ID NO: 43537 - protein, 9 aa, Artificial Sequence
  Description of Artificial Sequence: Synthetic peptide
  Seed: AQQEALGLV (MAGA1_HUMAN)
AVQEALGLI

SEQ ID NO: 43538 - protein, 10 aa, Artificial Sequence
  Description of Artificial Sequence: Synthetic peptide
  Seed: EYVIKVSARV (MAGA1_HUMAN)
ETVIKVSARA

SEQ ID NO: 43539 - protein, 9 aa, Artificial Sequence
  Description of Artificial Sequence: Synthetic peptide
  Seed: MLESVIKNY (MAGA1_HUMAN)
MAESVIKNY

SEQ ID NO: 43540 - protein, 9 aa, Artificial Sequence
  Description of Artificial Sequence: Synthetic peptide
  Seed: YVIKVSARV (MAGA1_HUMAN)
YVIKVSARR

SEQ ID NO: 43541 - protein, 10 aa, Artificial Sequence
  Description of Artificial Sequence: Synthetic peptide
  Seed: KVSARVRFFF (MAGA1_HUMAN)
KHSARVRFFK

SEQ ID NO: 43542 - protein, 11 aa, Artificial Sequence
  Description of Artificial Sequence: Synthetic peptide
  Seed: EVYDGREHSAY (MAGA1_HUMAN)
EAYDGREHSAF

SEQ ID NO: 43543 - protein, 11 aa, Artificial Sequence
  Description of Artificial Sequence: Synthetic peptide
  Seed: FPTTINFTRQR (MAGA1_HUMAN)
FITTINFTRQR

SEQ ID NO: 43544 - protein, 9 aa, Artificial Sequence
  Description of Artificial Sequence: Synthetic peptide
  Seed: KASESLQLV (MAGA1_HUMAN)
KVSESLQLR

SEQ ID NO: 43545 - protein, 8 aa, Artificial Sequence
  Description of Artificial Sequence: Synthetic peptide
  Seed: FLWGPRAL (MAGA1_HUMAN)
FTWGPRAL

SEQ ID NO: 43546 - protein, 9 aa, Artificial Sequence
  Description of Artificial Sequence: Synthetic peptide
  Seed: SYVKVLEYV (MAGA1_HUMAN)
SSVKVLEYV

SEQ ID NO: 43547 - protein, 10 aa, Artificial Sequence
  Description of Artificial Sequence: Synthetic peptide
  Seed: SARVRFFFPS (MAGA1_HUMAN)
SWRVRFFFPK

SEQ ID NO: 43548 - protein, 9 aa, Artificial Sequence
  Description of Artificial Sequence: Synthetic peptide
  Seed: EIWEELSVM (MAGA1_HUMAN)
ETWEELSVV

SEQ ID NO: 43549 - protein, 9 aa, Artificial Sequence
  Description of Artificial Sequence: Synthetic peptide
  Seed: STSCILESL (MAGA1_HUMAN)
SMSCILESA

SEQ ID NO: 43550 - protein, 9 aa, Artificial Sequence
  Description of Artificial Sequence: Synthetic peptide
  Seed: SSSPLVLGT (MAGA1_HUMAN)
SASPLVLGL

SEQ ID NO: 43551 - protein, 9 aa, Artificial Sequence
  Description of Artificial Sequence: Synthetic peptide
  Seed: DSDPARYEF (MAGA1_HUMAN)
DADPARYEW

SEQ ID NO: 43552 - protein, 11 aa, Artificial Sequence
  Description of Artificial Sequence: Synthetic peptide
  Seed: VADLVGFLLLK (MAGA1_HUMAN)
VTDLVGFLLLY

SEQ ID NO: 43553 - protein, 9 aa, Artificial Sequence
  Description of Artificial Sequence: Synthetic peptide
  Seed: FFFPSLREA (MAGA1_HUMAN)
FVFPSLREL

SEQ ID NO: 43554 - protein, 9 aa, Artificial Sequence
  Description of Artificial Sequence: Synthetic peptide
  Seed: AEMLESVIK (MAGA1_HUMAN)
AEMLESVIW

SEQ ID NO: 43555 - protein, 10 aa, Artificial Sequence
  Description of Artificial Sequence: Synthetic peptide
  Seed: TSYVKVLEYV (MAGA1_HUMAN)
TPYVKVLEYL

SEQ ID NO: 43556 - protein, 10 aa, Artificial Sequence
  Description of Artificial Sequence: Synthetic peptide
  Seed: ILESLFRAVI (MAGA1_HUMAN)
IRESLFRAVL

SEQ ID NO: 43557 - protein, 11 aa, Artificial Sequence
  Description of Artificial Sequence: Synthetic peptide
  Seed: RQVPDSDPARY (MAGA1_HUMAN)
RRVPDSDPARF

SEQ ID NO: 43558 - protein, 9 aa, Artificial Sequence
  Description of Artificial Sequence: Synthetic peptide
  Seed: FLLLKYRAR (MAGA1_HUMAN)
FFLLKYRAR

SEQ ID NO: 43559 - protein, 9 aa, Artificial Sequence
  Description of Artificial Sequence: Synthetic peptide
  Seed: SVMEVYDGR (MAGA1_HUMAN)
SMMEVYDGY

SEQ ID NO: 43560 - protein, 10 aa, Artificial Sequence
  Description of Artificial Sequence: Synthetic peptide
  Seed: RAREPVTKAE (MAGA1_HUMAN)
RYREPVTKAA

SEQ ID NO: 43561 - protein, 9 aa, Artificial Sequence
  Description of Artificial Sequence: Synthetic peptide
  Seed: SARVRFFFP (MAGA1_HUMAN)
SMRVRFFFG

SEQ ID NO: 43562 - protein, 9 aa, Artificial Sequence
  Description of Artificial Sequence: Synthetic peptide
  Seed: RVRFFFPSL (MAGA1_HUMAN)
RKRFFFPSK

SEQ ID NO: 43563 - protein, 9 aa, Artificial Sequence
  Description of Artificial Sequence: Synthetic peptide
  Seed: KVADLVGFL (MAGA1_HUMAN)
KLADLVGFY

SEQ ID NO: 43564 - protein, 10 aa, Artificial Sequence
  Description of Artificial Sequence: Synthetic peptide
  Seed: RYEFLWGPRA (MAGA1_HUMAN)
RMEFLWGPRK

SEQ ID NO: 43565 - protein, 10 aa, Artificial Sequence
  Description of Artificial Sequence: Synthetic peptide
  Seed: VLVTCLGLSY (MAGA1_HUMAN)
VQVTCLGLSL

SEQ ID NO: 43566 - protein, 9 aa, Artificial Sequence
  Description of Artificial Sequence: Synthetic peptide
  Seed: FPTTINFTR (MAGA1_HUMAN)
FMTTINFTM

SEQ ID NO: 43567 - protein, 9 aa, Artificial Sequence
  Description of Artificial Sequence: Synthetic peptide
  Seed: KVSARVRFF (MAGA1_HUMAN)
KTSARVRFW

SEQ ID NO: 43568 - protein, 8 aa, Artificial Sequence
  Description of Artificial Sequence: Synthetic peptide
  Seed: SARVRFFF (MAGA1_HUMAN)
SMRVRFFI

SEQ ID NO: 43569 - protein, 9 aa, Artificial Sequence
  Description of Artificial Sequence: Synthetic peptide
  Seed: QIMPKTGFL (MAGA1_HUMAN)
QAMPKTGFR

SEQ ID NO: 43570 - protein, 9 aa, Artificial Sequence
  Description of Artificial Sequence: Synthetic peptide
  Seed: KVLEYVIKV (MAGA1_HUMAN)
KHLEYVIKM

SEQ ID NO: 43571 - protein, 11 aa, Artificial Sequence
  Description of Artificial Sequence: Synthetic peptide
  Seed: ELSVMEVYDGR (MAGA1_HUMAN)
ETSVMEVYDGR

SEQ ID NO: 43572 - protein, 9 aa, Artificial Sequence
  Description of Artificial Sequence: Synthetic peptide
  Seed: SSSPLVLGT (MAGA1_HUMAN)
SSSPLVLGV

SEQ ID NO: 43573 - protein, 9 aa, Artificial Sequence
  Description of Artificial Sequence: Synthetic peptide
  Seed: ALAETSYVK (MAGA1_HUMAN)
AIAETSYVR

SEQ ID NO: 43574 - protein, 9 aa, Artificial Sequence
  Description of Artificial Sequence: Synthetic peptide
  Seed: VADLVGFLL (MAGA1_HUMAN)
VYDLVGFLL

SEQ ID NO: 43575 - protein, 10 aa, Artificial Sequence
  Description of Artificial Sequence: Synthetic peptide
  Seed: RVRFFFPSLR (MAGA1_HUMAN)
RHRFFFPSLI

SEQ ID NO: 43576 - protein, 11 aa, Artificial Sequence
  Description of Artificial Sequence: Synthetic peptide
  Seed: STDPPQSPQGA (MAGA1_HUMAN)
SVDPPQSPQGF

SEQ ID NO: 43577 - protein, 11 aa, Artificial Sequence
  Description of Artificial Sequence: Synthetic peptide
  Seed: RVRFFFPSLRE (MAGA1_HUMAN)
RSRFFFPSLRK

SEQ ID NO: 43578 - protein, 9 aa, Artificial Sequence
  Description of Artificial Sequence: Synthetic peptide
  Seed: MSLEQRSLH (MAGA1_HUMAN)
MTLEQRSLY

SEQ ID NO: 43579 - protein, 9 aa, Artificial Sequence
  Description of Artificial Sequence: Synthetic peptide
  Seed: KVSARVRFF (MAGA1_HUMAN)
KTSARVRFT

SEQ ID NO: 43580 - protein, 11 aa, Artificial Sequence
  Description of Artificial Sequence: Synthetic peptide
  Seed: RVRFFFPSLRE (MAGA1_HUMAN)
RMRFFFPSLRW

SEQ ID NO: 43581 - protein, 9 aa, Artificial Sequence
  Description of Artificial Sequence: Synthetic peptide
  Seed: EIWEELSVM (MAGA1_HUMAN)
EAWEELSVM

SEQ ID NO: 43582 - protein, 9 aa, Artificial Sequence
  Description of Artificial Sequence: Synthetic peptide
  Seed: LVLGTLEEV (MAGA1_HUMAN)
LMLGTLEEL

SEQ ID NO: 43583 - protein, 9 aa, Artificial Sequence
  Description of Artificial Sequence: Synthetic peptide
  Seed: RAREPVTKA (MAGA1_HUMAN)
RVREPVTKT

SEQ ID NO: 43584 - protein, 10 aa, Artificial Sequence
  Description of Artificial Sequence: Synthetic peptide
  Seed: SSSPLVLGTL (MAGA1_HUMAN)
SMSPLVLGTW

SEQ ID NO: 43585 - protein, 9 aa, Artificial Sequence
  Description of Artificial Sequence: Synthetic peptide
  Seed: QSPQGASAF (MAGA1_HUMAN)
QGPQGASAM

SEQ ID NO: 43586 - protein, 10 aa, Artificial Sequence
  Description of Artificial Sequence: Synthetic peptide
  Seed: SAFPTTINFT (MAGA1_HUMAN)
STFPTTINFV

SEQ ID NO: 43587 - protein, 9 aa, Artificial Sequence
  Description of Artificial Sequence: Synthetic peptide
  Seed: YVLVTCLGL (MAGA1_HUMAN)
YLLVTCLGI

SEQ ID NO: 43588 - protein, 9 aa, Artificial Sequence
  Description of Artificial Sequence: Synthetic peptide
  Seed: FFFPSLREA (MAGA1_HUMAN)
FCFPSLREV

SEQ ID NO: 43589 - protein, 9 aa, Artificial Sequence
  Description of Artificial Sequence: Synthetic peptide
  Seed: DLVGFLLLK (MAGA1_HUMAN)
DYVGFLLLK

SEQ ID NO: 43590 - protein, 11 aa, Artificial Sequence
  Description of Artificial Sequence: Synthetic peptide
  Seed: SARVRFFFPSL (MAGA1_HUMAN)
SMRVRFFFPSL

SEQ ID NO: 43591 - protein, 8 aa, Artificial Sequence
  Description of Artificial Sequence: Synthetic peptide
  Seed: RALAETSY (MAGA1_HUMAN)
RMLAETSF

SEQ ID NO: 43592 - protein, 9 aa, Artificial Sequence
  Description of Artificial Sequence: Synthetic peptide
  Seed: SSPLVLGTL (MAGA1_HUMAN)
STPLVLGTR

SEQ ID NO: 43593 - protein, 11 aa, Artificial Sequence
  Description of Artificial Sequence: Synthetic peptide
  Seed: YVKVLEYVIKV (MAGA1_HUMAN)
YTKVLEYVIKV

SEQ ID NO: 43594 - protein, 10 aa, Artificial Sequence
  Description of Artificial Sequence: Synthetic peptide
  Seed: KVSARVRFFF (MAGA1_HUMAN)
KQSARVRFFF

SEQ ID NO: 43595 - protein, 9 aa, Artificial Sequence
  Description of Artificial Sequence: Synthetic peptide
  Seed: LVLGTLEEV (MAGA1_HUMAN)
LILGTLEEL

SEQ ID NO: 43596 - protein, 10 aa, Artificial Sequence
  Description of Artificial Sequence: Synthetic peptide
  Seed: SSSPLVLGTL (MAGA1_HUMAN)
SGSPLVLGTW

SEQ ID NO: 43597 - protein, 9 aa, Artificial Sequence
  Description of Artificial Sequence: Synthetic peptide
  Seed: LGDNQIMPK (MAGA1_HUMAN)
LIDNQIMPK

SEQ ID NO: 43598 - protein, 9 aa, Artificial Sequence
  Description of Artificial Sequence: Synthetic peptide
  Seed: CILESLFRA (MAGA1_HUMAN)
CTLESLFRV

SEQ ID NO: 43599 - protein, 9 aa, Artificial Sequence
  Description of Artificial Sequence: Synthetic peptide
  Seed: YRAREPVTK (MAGA1_HUMAN)
YRAREPVTM

SEQ ID NO: 43600 - protein, 9 aa, Artificial Sequence
  Description of Artificial Sequence: Synthetic peptide
  Seed: FPTTINFTR (MAGA1_HUMAN)
FTTTINFTY

SEQ ID NO: 43601 - protein, 10 aa, Artificial Sequence
  Description of Artificial Sequence: Synthetic peptide
  Seed: EALEAQQEAL (MAGA1_HUMAN)
ESLEAQQEAR

SEQ ID NO: 43602 - protein, 9 aa, Artificial Sequence
  Description of Artificial Sequence: Synthetic peptide
  Seed: YVIKVSARV (MAGA1_HUMAN)
YLIKVSARY

SEQ ID NO: 43603 - protein, 10 aa, Artificial Sequence
  Description of Artificial Sequence: Synthetic peptide
  Seed: SARVRFFFPS (MAGA1_HUMAN)
SLRVRFFFPM

SEQ ID NO: 43604 - protein, 11 aa, Artificial Sequence
  Description of Artificial Sequence: Synthetic peptide
  Seed: IKVSARVRFFF (MAGA1_HUMAN)
ILVSARVRFFW

SEQ ID NO: 43605 - protein, 11 aa, Artificial Sequence
  Description of Artificial Sequence: Synthetic peptide
  Seed: DLVGFLLLKYR (MAGA1_HUMAN)
DYVGFLLLKYR

SEQ ID NO: 43606 - protein, 10 aa, Artificial Sequence
  Description of Artificial Sequence: Synthetic peptide
  Seed: FFPSLREAAL (MAGA1_HUMAN)
FHPSLREAAM

SEQ ID NO: 43607 - protein, 9 aa, Artificial Sequence
  Description of Artificial Sequence: Synthetic peptide
  Seed: HCFPEIFGK (MAGA1_HUMAN)
HQFPEIFGK

SEQ ID NO: 43608 - protein, 8 aa, Artificial Sequence
  Description of Artificial Sequence: Synthetic peptide
  Seed: EELSVMEV (MAGA1_HUMAN)
EELSVMEY

SEQ ID NO: 43609 - protein, 10 aa, Artificial Sequence
  Description of Artificial Sequence: Synthetic peptide
  Seed: ASAFPTTINF (MAGA1_HUMAN)
ACAFPTTINW

SEQ ID NO: 43610 - protein, 9 aa, Artificial Sequence
  Description of Artificial Sequence: Synthetic peptide
  Seed: GLLGDNQIM (MAGA1_HUMAN)
GMLGDNQIY

SEQ ID NO: 43611 - protein, 9 aa, Artificial Sequence
  Description of Artificial Sequence: Synthetic peptide
  Seed: YVLVTCLGL (MAGA1_HUMAN)
YILVTCLGF

SEQ ID NO: 43612 - protein, 9 aa, Artificial Sequence
  Description of Artificial Sequence: Synthetic peptide
  Seed: RQRQPSEGS (MAGA1_HUMAN)
RVRQPSEGK

SEQ ID NO: 43613 - protein, 8 aa, Artificial Sequence
  Description of Artificial Sequence: Synthetic peptide
  Seed: RVRFFFPS (MAGA1_HUMAN)
RMRFFFPA

SEQ ID NO: 43614 - protein, 9 aa, Artificial Sequence
  Description of Artificial Sequence: Synthetic peptide
  Seed: VGFLLLKYR (MAGA1_HUMAN)
VMFLLLKYR

SEQ ID NO: 43615 - protein, 9 aa, Artificial Sequence
  Description of Artificial Sequence: Synthetic peptide
  Seed: IMPKTGFLI (MAGA1_HUMAN)
IYPKTGFLM

SEQ ID NO: 43616 - protein, 8 aa, Artificial Sequence
  Description of Artificial Sequence: Synthetic peptide
  Seed: AYGEPRKL (MAGA1_HUMAN)
AYGEPRKM

SEQ ID NO: 43617 - protein, 9 aa, Artificial Sequence
  Description of Artificial Sequence: Synthetic peptide
  Seed: TQDLVQEKY (MAGA1_HUMAN)
TYDLVQEKL

SEQ ID NO: 43618 - protein, 9 aa, Artificial Sequence
  Description of Artificial Sequence: Synthetic peptide
  Seed: IKVSARVRF (MAGA1_HUMAN)
IQVSARVRY

SEQ ID NO: 43619 - protein, 9 aa, Artificial Sequence
  Description of Artificial Sequence: Synthetic peptide
  Seed: KVSARVRFF (MAGA1_HUMAN)
KTSARVRFI

SEQ ID NO: 43620 - protein, 9 aa, Artificial Sequence
  Description of Artificial Sequence: Synthetic peptide
  Seed: FFFPSLREA (MAGA1_HUMAN)
FSFPSLREH

SEQ ID NO: 43621 - protein, 9 aa, Artificial Sequence
  Description of Artificial Sequence: Synthetic peptide
  Seed: SSSPLVLGT (MAGA1_HUMAN)
SASPLVLGM

SEQ ID NO: 43622 - protein, 9 aa, Artificial Sequence
  Description of Artificial Sequence: Synthetic peptide
  Seed: KVSARVRFF (MAGA1_HUMAN)
KASARVRFK

SEQ ID NO: 43623 - protein, 9 aa, Artificial Sequence
  Description of Artificial Sequence: Synthetic peptide
  Seed: NYKHCFPEI (MAGA1_HUMAN)
NYKHCFPEW

SEQ ID NO: 43624 - protein, 10 aa, Artificial Sequence
  Description of Artificial Sequence: Synthetic peptide
  Seed: RVRFFFPSLR (MAGA1_HUMAN)
RTRFFFPSLH

SEQ ID NO: 43625 - protein, 8 aa, Artificial Sequence
  Description of Artificial Sequence: Synthetic peptide
  Seed: SSSSPLVL (MAGA1_HUMAN)
SASSPLVM

SEQ ID NO: 43626 - protein, 9 aa, Artificial Sequence
  Description of Artificial Sequence: Synthetic peptide
  Seed: FPTTINFTR (MAGA1_HUMAN)
FSTTINFTM

SEQ ID NO: 43627 - protein, 9 aa, Artificial Sequence
  Description of Artificial Sequence: Synthetic peptide
  Seed: GLLGDNQIM (MAGA1_HUMAN)
GMLGDNQIF

SEQ ID NO: 43628 - protein, 9 aa, Artificial Sequence
  Description of Artificial Sequence: Synthetic peptide
  Seed: KASESLQLV (MAGA1_HUMAN)
KNSESLQLV

SEQ ID NO: 43629 - protein, 9 aa, Artificial Sequence
  Description of Artificial Sequence: Synthetic peptide
  Seed: TTINFTRQR (MAGA1_HUMAN)
TAINFTRQV

SEQ ID NO: 43630 - protein, 9 aa, Artificial Sequence
  Description of Artificial Sequence: Synthetic peptide
  Seed: FFFPSLREA (MAGA1_HUMAN)
FKFPSLREL

SEQ ID NO: 43631 - protein, 9 aa, Artificial Sequence
  Description of Artificial Sequence: Synthetic peptide
  Seed: SARVRFFFP (MAGA1_HUMAN)
SSRVRFFFP

SEQ ID NO: 43632 - protein, 10 aa, Artificial Sequence
  Description of Artificial Sequence: Synthetic peptide
  Seed: FLWGPRALAE (MAGA1_HUMAN)
FIWGPRALAV

SEQ ID NO: 43633 - protein, 11 aa, Artificial Sequence
  Description of Artificial Sequence: Synthetic peptide
  Seed: EVYDGREHSAY (MAGA1_HUMAN)
EMYDGREHSAY

SEQ ID NO: 43634 - protein, 8 aa, Artificial Sequence
  Description of Artificial Sequence: Synthetic peptide
  Seed: AYGEPRKL (MAGA1_HUMAN)
AAGEPRKM

SEQ ID NO: 43635 - protein, 9 aa, Artificial Sequence
  Description of Artificial Sequence: Synthetic peptide
  Seed: RVRFFFPSL (MAGA1_HUMAN)
RPRFFFPSC

SEQ ID NO: 43636 - protein, 10 aa, Artificial Sequence
  Description of Artificial Sequence: Synthetic peptide
  Seed: GPRALAETSY (MAGA1_HUMAN)
GMRALAETSY

SEQ ID NO: 43637 - protein, 9 aa, Artificial Sequence
  Description of Artificial Sequence: Synthetic peptide
  Seed: MSLEQRSLH (MAGA1_HUMAN)
MTLEQRSLK

SEQ ID NO: 43638 - protein, 9 aa, Artificial Sequence
  Description of Artificial Sequence: Synthetic peptide
  Seed: FPTTINFTR (MAGA1_HUMAN)
FNTTINFTR

SEQ ID NO: 43639 - protein, 10 aa, Artificial Sequence
  Description of Artificial Sequence: Synthetic peptide
  Seed: SARVRFFFPS (MAGA1_HUMAN)
SCRVRFFFPL

SEQ ID NO: 43640 - protein, 9 aa, Artificial Sequence
  Description of Artificial Sequence: Synthetic peptide
  Seed: SAFPTTINF (MAGA1_HUMAN)
SEFPTTINY

SEQ ID NO: 43641 - protein, 9 aa, Artificial Sequence
  Description of Artificial Sequence: Synthetic peptide
  Seed: RALAETSYV (MAGA1_HUMAN)
RQLAETSYM

SEQ ID NO: 43642 - protein, 9 aa, Artificial Sequence
  Description of Artificial Sequence: Synthetic peptide
  Seed: KVADLVGFL (MAGA1_HUMAN)
KQADLVGFF

SEQ ID NO: 43643 - protein, 10 aa, Artificial Sequence
  Description of Artificial Sequence: Synthetic peptide
  Seed: ETSYVKVLEY (MAGA1_HUMAN)
ELSYVKVLEK

SEQ ID NO: 43644 - protein, 9 aa, Artificial Sequence
  Description of Artificial Sequence: Synthetic peptide
  Seed: LVQEKYLEY (MAGA1_HUMAN)
LIQEKYLEY

SEQ ID NO: 43645 - protein, 9 aa, Artificial Sequence
  Description of Artificial Sequence: Synthetic peptide
  Seed: FFFPSLREA (MAGA1_HUMAN)
FAFPSLREC

SEQ ID NO: 43646 - protein, 9 aa, Artificial Sequence
  Description of Artificial Sequence: Synthetic peptide
  Seed: RQVPDSDPA (MAGA1_HUMAN)
RAVPDSDPM

SEQ ID NO: 43647 - protein, 11 aa, Artificial Sequence
  Description of Artificial Sequence: Synthetic peptide
  Seed: RVRFFFPSLRE (MAGA1_HUMAN)
RMRFFFPSLRL

SEQ ID NO: 43648 - protein, 10 aa, Artificial Sequence
  Description of Artificial Sequence: Synthetic peptide
  Seed: RVRFFFPSLR (MAGA1_HUMAN)
RERFFFPSLA

SEQ ID NO: 43649 - protein, 9 aa, Artificial Sequence
  Description of Artificial Sequence: Synthetic peptide
  Seed: SAYGEPRKL (MAGA1_HUMAN)
STYGEPRKF

SEQ ID NO: 43650 - protein, 9 aa, Artificial Sequence
  Description of Artificial Sequence: Synthetic peptide
  Seed: KASESLQLV (MAGA1_HUMAN)
KNSESLQLY

SEQ ID NO: 43651 - protein, 9 aa, Artificial Sequence
  Description of Artificial Sequence: Synthetic peptide
  Seed: TSYVKVLEY (MAGA1_HUMAN)
TGYVKVLEM

SEQ ID NO: 43652 - protein, 9 aa, Artificial Sequence
  Description of Artificial Sequence: Synthetic peptide
  Seed: KASESLQLV (MAGA1_HUMAN)
KQSESLQLW

SEQ ID NO: 43653 - protein, 10 aa, Artificial Sequence
  Description of Artificial Sequence: Synthetic peptide
  Seed: KEADPTGHSY (MAGA1_HUMAN)
KIADPTGHSW

SEQ ID NO: 43654 - protein, 9 aa, Artificial Sequence
  Description of Artificial Sequence: Synthetic peptide
  Seed: FFFPSLREA (MAGA1_HUMAN)
FSFPSLREV

SEQ ID NO: 43655 - protein, 9 aa, Artificial Sequence
  Description of Artificial Sequence: Synthetic peptide
  Seed: RVRFFFPSL (MAGA1_HUMAN)
RARFFFPST

SEQ ID NO: 43656 - protein, 10 aa, Artificial Sequence
  Description of Artificial Sequence: Synthetic peptide
  Seed: EIFGKASESL (MAGA1_HUMAN)
EIFGKASESV

SEQ ID NO: 43657 - protein, 10 aa, Artificial Sequence
  Description of Artificial Sequence: Synthetic peptide
  Seed: KASESLQLVF (MAGA1_HUMAN)
KHSESLQLVY

SEQ ID NO: 43658 - protein, 9 aa, Artificial Sequence
  Description of Artificial Sequence: Synthetic peptide
  Seed: STSCILESL (MAGA1_HUMAN)
SLSCILESV

SEQ ID NO: 43659 - protein, 9 aa, Artificial Sequence
  Description of Artificial Sequence: Synthetic peptide
  Seed: KVLEYVIKV (MAGA1_HUMAN)
KILEYVIKF

SEQ ID NO: 43660 - protein, 10 aa, Artificial Sequence
  Description of Artificial Sequence: Synthetic peptide
  Seed: ADLVGFLLLK (MAGA1_HUMAN)
ACLVGFLLLK

SEQ ID NO: 43661 - protein, 10 aa, Artificial Sequence
  Description of Artificial Sequence: Synthetic peptide
  Seed: KASESLQLVF (MAGA1_HUMAN)
KQSESLQLVL

SEQ ID NO: 43662 - protein, 9 aa, Artificial Sequence
  Description of Artificial Sequence: Synthetic peptide
  Seed: MPKTGFLII (MAGA1_HUMAN)
MGKTGFLIY

SEQ ID NO: 43663 - protein, 9 aa, Artificial Sequence
  Description of Artificial Sequence: Synthetic peptide
  Seed: VYDGREHSA (MAGA1_HUMAN)
VCDGREHSL

SEQ ID NO: 43664 - protein, 9 aa, Artificial Sequence
  Description of Artificial Sequence: Synthetic peptide
  Seed: KVADLVGFL (MAGA1_HUMAN)
KMADLVGFF

SEQ ID NO: 43665 - protein, 11 aa, Artificial Sequence
  Description of Artificial Sequence: Synthetic peptide
  Seed: EVYDGREHSAY (MAGA1_HUMAN)
ETYDGREHSAY

SEQ ID NO: 43666 - protein, 9 aa, Artificial Sequence
  Description of Artificial Sequence: Synthetic peptide
  Seed: TSYVKVLEY (MAGA1_HUMAN)
TKYVKVLEM

SEQ ID NO: 43667 - protein, 9 aa, Artificial Sequence
  Description of Artificial Sequence: Synthetic peptide
  Seed: VADLVGFLL (MAGA1_HUMAN)
VLDLVGFLM

SEQ ID NO: 43668 - protein, 10 aa, Artificial Sequence
  Description of Artificial Sequence: Synthetic peptide
  Seed: YVIKVSARVR (MAGA1_HUMAN)
YVIKVSARVK

SEQ ID NO: 43669 - protein, 10 aa, Artificial Sequence
  Description of Artificial Sequence: Synthetic peptide
  Seed: ALAETSYVKV (MAGA1_HUMAN)
AVAETSYVKV

SEQ ID NO: 43670 - protein, 9 aa, Artificial Sequence
  Description of Artificial Sequence: Synthetic peptide
  Seed: KASESLQLV (MAGA1_HUMAN)
KASESLQLW

SEQ ID NO: 43671 - protein, 10 aa, Artificial Sequence
  Description of Artificial Sequence: Synthetic peptide
  Seed: TSYVKVLEYV (MAGA1_HUMAN)
TMYVKVLEYW

SEQ ID NO: 43672 - protein, 9 aa, Artificial Sequence
  Description of Artificial Sequence: Synthetic peptide
  Seed: GASAFPTTI (MAGA1_HUMAN)
GTSAFPTTL

SEQ ID NO: 43673 - protein, 11 aa, Artificial Sequence
  Description of Artificial Sequence: Synthetic peptide
  Seed: SARVRFFFPSL (MAGA1_HUMAN)
SVRVRFFFPSK

SEQ ID NO: 43674 - protein, 9 aa, Artificial Sequence
  Description of Artificial Sequence: Synthetic peptide
  Seed: SYVKVLEYV (MAGA1_HUMAN)
SRVKVLEYY

SEQ ID NO: 43675 - protein, 11 aa, Artificial Sequence
  Description of Artificial Sequence: Synthetic peptide
  Seed: KVADLVGFLLL (MAGA1_HUMAN)
KLADLVGFLLK

SEQ ID NO: 43676 - protein, 10 aa, Artificial Sequence
  Description of Artificial Sequence: Synthetic peptide
  Seed: SLFRAVITKK (MAGA1_HUMAN)
STFRAVITKY

SEQ ID NO: 43677 - protein, 9 aa, Artificial Sequence
  Description of Artificial Sequence: Synthetic peptide
  Seed: SYVKVLEYV (MAGA1_HUMAN)
SVVKVLEYT

SEQ ID NO: 43678 - protein, 9 aa, Artificial Sequence
  Description of Artificial Sequence: Synthetic peptide
  Seed: KTGFLIIVL (MAGA1_HUMAN)
KMGFLIIVF

SEQ ID NO: 43679 - protein, 9 aa, Artificial Sequence
  Description of Artificial Sequence: Synthetic peptide
  Seed: LTQDLVQEK (MAGA1_HUMAN)
LTQDLVQEV

SEQ ID NO: 43680 - protein, 10 aa, Artificial Sequence
  Description of Artificial Sequence: Synthetic peptide
  Seed: RVRFFFPSLR (MAGA1_HUMAN)
RPRFFFPSLV

SEQ ID NO: 43681 - protein, 9 aa, Artificial Sequence
  Description of Artificial Sequence: Synthetic peptide
  Seed: EIWEELSVM (MAGA1_HUMAN)
EAWEELSVY

SEQ ID NO: 43682 - protein, 9 aa, Artificial Sequence
  Description of Artificial Sequence: Synthetic peptide
  Seed: IMPKTGFLI (MAGA1_HUMAN)
IAPKTGFLM

SEQ ID NO: 43683 - protein, 9 aa, Artificial Sequence
  Description of Artificial Sequence: Synthetic peptide
  Seed: STSCILESL (MAGA1_HUMAN)
SVSCILESL

SEQ ID NO: 43684 - protein, 9 aa, Artificial Sequence
  Description of Artificial Sequence: Synthetic peptide
  Seed: KVSARVRFF (MAGA1_HUMAN)
KQSARVRFM

SEQ ID NO: 43685 - protein, 10 aa, Artificial Sequence
  Description of Artificial Sequence: Synthetic peptide
  Seed: KKVADLVGFL (MAGA1_HUMAN)
KPVADLVGFV

SEQ ID NO: 43686 - protein, 9 aa, Artificial Sequence
  Description of Artificial Sequence: Synthetic peptide
  Seed: YVIKVSARV (MAGA1_HUMAN)
YMIKVSARY

SEQ ID NO: 43687 - protein, 10 aa, Artificial Sequence
  Description of Artificial Sequence: Synthetic peptide
  Seed: RVRFFFPSLR (MAGA1_HUMAN)
RGRFFFPSLY

SEQ ID NO: 43688 - protein, 10 aa, Artificial Sequence
  Description of Artificial Sequence: Synthetic peptide
  Seed: GPRALAETSY (MAGA1_HUMAN)
GPRALAETSF

SEQ ID NO: 43689 - protein, 8 aa, Artificial Sequence
  Description of Artificial Sequence: Synthetic peptide
  Seed: VRFFFPSL (MAGA1_HUMAN)
VQFFFPSL

SEQ ID NO: 43690 - protein, 9 aa, Artificial Sequence
  Description of Artificial Sequence: Synthetic peptide
  Seed: STSCILESL (MAGA1_HUMAN)
SMSCILESR

SEQ ID NO: 43691 - protein, 11 aa, Artificial Sequence
  Description of Artificial Sequence: Synthetic peptide
  Seed: EMLESVIKNYK (MAGA1_HUMAN)
EALESVIKNYK

SEQ ID NO: 43692 - protein, 10 aa, Artificial Sequence
  Description of Artificial Sequence: Synthetic peptide
  Seed: KVADLVGFLL (MAGA1_HUMAN)
KQADLVGFLY

SEQ ID NO: 43693 - protein, 11 aa, Artificial Sequence
  Description of Artificial Sequence: Synthetic peptide
  Seed: STSCILESLFR (MAGA1_HUMAN)
SASCILESLFK

SEQ ID NO: 43694 - protein, 9 aa, Artificial Sequence
  Description of Artificial Sequence: Synthetic peptide
  Seed: FFFPSLREA (MAGA1_HUMAN)
FYFPSLRET

SEQ ID NO: 43695 - protein, 10 aa, Artificial Sequence
  Description of Artificial Sequence: Synthetic peptide
  Seed: IMPKTGFLII (MAGA1_HUMAN)
IFPKTGFLIW

SEQ ID NO: 43696 - protein, 9 aa, Artificial Sequence
  Description of Artificial Sequence: Synthetic peptide
  Seed: ATSSSSPLV (MAGA1_HUMAN)
AMSSSSPLV

SEQ ID NO: 43697 - protein, 10 aa, Artificial Sequence
  Description of Artificial Sequence: Synthetic peptide
  Seed: KYRAREPVTK (MAGA1_HUMAN)
KARAREPVTK

SEQ ID NO: 43698 - protein, 10 aa, Artificial Sequence
  Description of Artificial Sequence: Synthetic peptide
  Seed: RVRFFFPSLR (MAGA1_HUMAN)
RTRFFFPSLK

SEQ ID NO: 43699 - protein, 10 aa, Artificial Sequence
  Description of Artificial Sequence: Synthetic peptide
  Seed: EVYDGREHSA (MAGA1_HUMAN)
EVYDGREHSR

SEQ ID NO: 43700 - protein, 9 aa, Artificial Sequence
  Description of Artificial Sequence: Synthetic peptide
  Seed: RALAETSYV (MAGA1_HUMAN)
RVLAETSYY

SEQ ID NO: 43701 - protein, 9 aa, Artificial Sequence
  Description of Artificial Sequence: Synthetic peptide
  Seed: IMPKTGFLI (MAGA1_HUMAN)
IFPKTGFLM

SEQ ID NO: 43702 - protein, 9 aa, Artificial Sequence
  Description of Artificial Sequence: Synthetic peptide
  Seed: ASESLQLVF (MAGA1_HUMAN)
ALESLQLVY

SEQ ID NO: 43703 - protein, 9 aa, Artificial Sequence
  Description of Artificial Sequence: Synthetic peptide
  Seed: TSYVKVLEY (MAGA1_HUMAN)
TAYVKVLEY

SEQ ID NO: 43704 - protein, 10 aa, Artificial Sequence
  Description of Artificial Sequence: Synthetic peptide
  Seed: KVSARVRFFF (MAGA1_HUMAN)
KWSARVRFFF

SEQ ID NO: 43705 - protein, 10 aa, Artificial Sequence
  Description of Artificial Sequence: Synthetic peptide
  Seed: STSCILESLF (MAGA1_HUMAN)
SGSCILESLW

SEQ ID NO: 43706 - protein, 9 aa, Artificial Sequence
  Description of Artificial Sequence: Synthetic peptide
  Seed: SAYGEPRKL (MAGA1_HUMAN)
STYGEPRKM

SEQ ID NO: 43707 - protein, 9 aa, Artificial Sequence
  Description of Artificial Sequence: Synthetic peptide
  Seed: ESVIKNYKH (MAGA1_HUMAN)
ETVIKNYKK

SEQ ID NO: 43708 - protein, 9 aa, Artificial Sequence
  Description of Artificial Sequence: Synthetic peptide
  Seed: SAYGEPRKL (MAGA1_HUMAN)
SPYGEPRKM

SEQ ID NO: 43709 - protein, 11 aa, Artificial Sequence
  Description of Artificial Sequence: Synthetic peptide
  Seed: RVRFFFPSLRE (MAGA1_HUMAN)
RFRFFFPSLRS

SEQ ID NO: 43710 - protein, 9 aa, Artificial Sequence
  Description of Artificial Sequence: Synthetic peptide
  Seed: SARVRFFFP (MAGA1_HUMAN)
SSRVRFFFC

SEQ ID NO: 43711 - protein, 9 aa, Artificial Sequence
  Description of Artificial Sequence: Synthetic peptide
  Seed: YVIKVSARV (MAGA1_HUMAN)
YQIKVSARV

SEQ ID NO: 43712 - protein, 9 aa, Artificial Sequence
  Description of Artificial Sequence: Synthetic peptide
  Seed: EYVIKVSAR (MAGA1_HUMAN)
EGVIKVSAR

SEQ ID NO: 43713 - protein, 10 aa, Artificial Sequence
  Description of Artificial Sequence: Synthetic peptide
  Seed: SARVRFFFPS (MAGA1_HUMAN)
SMRVRFFFPF

SEQ ID NO: 43714 - protein, 11 aa, Artificial Sequence
  Description of Artificial Sequence: Synthetic peptide
  Seed: STDPPQSPQGA (MAGA1_HUMAN)
SSDPPQSPQGF

SEQ ID NO: 43715 - protein, 9 aa, Artificial Sequence
  Description of Artificial Sequence: Synthetic peptide
  Seed: KYRAREPVT (MAGA1_HUMAN)
KTRAREPVK

SEQ ID NO: 43716 - protein, 9 aa, Artificial Sequence
  Description of Artificial Sequence: Synthetic peptide
  Seed: LTQDLVQEK (MAGA1_HUMAN)
LIQDLVQEM

SEQ ID NO: 43717 - protein, 9 aa, Artificial Sequence
  Description of Artificial Sequence: Synthetic peptide
  Seed: CILESLFRA (MAGA1_HUMAN)
CVLESLFRM

SEQ ID NO: 43718 - protein, 11 aa, Artificial Sequence
  Description of Artificial Sequence: Synthetic peptide
  Seed: YEFLWGPRALA (MAGA1_HUMAN)
YYFLWGPRALI

SEQ ID NO: 43719 - protein, 10 aa, Artificial Sequence
  Description of Artificial Sequence: Synthetic peptide
  Seed: AQQEALGLVC (MAGA1_HUMAN)
AQQEALGLVL

SEQ ID NO: 43720 - protein, 10 aa, Artificial Sequence
  Description of Artificial Sequence: Synthetic peptide
  Seed: SESLQLVFGI (MAGA1_HUMAN)
SESLQLVFGA

SEQ ID NO: 43721 - protein, 9 aa, Artificial Sequence
  Description of Artificial Sequence: Synthetic peptide
  Seed: LESLFRAVI (MAGA1_HUMAN)
LQSLFRAVH

SEQ ID NO: 43722 - protein, 11 aa, Artificial Sequence
  Description of Artificial Sequence: Synthetic peptide
  Seed: ARVRFFFPSLR (MAGA1_HUMAN)
AWVRFFFPSLL

SEQ ID NO: 43723 - protein, 9 aa, Artificial Sequence
  Description of Artificial Sequence: Synthetic peptide
  Seed: EIWEELSVM (MAGA1_HUMAN)
EIWEELSVR

SEQ ID NO: 43724 - protein, 10 aa, Artificial Sequence
  Description of Artificial Sequence: Synthetic peptide
  Seed: ATSSSSPLVL (MAGA1_HUMAN)
AFSSSSPLVF

SEQ ID NO: 43725 - protein, 9 aa, Artificial Sequence
  Description of Artificial Sequence: Synthetic peptide
  Seed: QIMPKTGFL (MAGA1_HUMAN)
QLMPKTGFW

SEQ ID NO: 43726 - protein, 9 aa, Artificial Sequence
  Description of Artificial Sequence: Synthetic peptide
  Seed: VPDSDPARY (MAGA1_HUMAN)
VPDSDPARF

SEQ ID NO: 43727 - protein, 11 aa, Artificial Sequence
  Description of Artificial Sequence: Synthetic peptide
  Seed: SARVRFFFPSL (MAGA1_HUMAN)
STRVRFFFPSK

SEQ ID NO: 43728 - protein, 9 aa, Artificial Sequence
  Description of Artificial Sequence: Synthetic peptide
  Seed: LVLGTLEEV (MAGA1_HUMAN)
LLLGTLEEA

SEQ ID NO: 43729 - protein, 10 aa, Artificial Sequence
  Description of Artificial Sequence: Synthetic peptide
  Seed: SAYGEPRKLL (MAGA1_HUMAN)
SSYGEPRKLW

SEQ ID NO: 43730 - protein, 10 aa, Artificial Sequence
  Description of Artificial Sequence: Synthetic peptide
  Seed: KASESLQLVF (MAGA1_HUMAN)
KKSESLQLVW

SEQ ID NO: 43731 - protein, 9 aa, Artificial Sequence
  Description of Artificial Sequence: Synthetic peptide
  Seed: ITKKVADLV (MAGA1_HUMAN)
IVKKVADLW

SEQ ID NO: 43732 - protein, 9 aa, Artificial Sequence
  Description of Artificial Sequence: Synthetic peptide
  Seed: GASAFPTTI (MAGA1_HUMAN)
GVSAFPTTI

SEQ ID NO: 43733 - protein, 10 aa, Artificial Sequence
  Description of Artificial Sequence: Synthetic peptide
  Seed: FFPSLREAAL (MAGA1_HUMAN)
FPPSLREAAF

SEQ ID NO: 43734 - protein, 9 aa, Artificial Sequence
  Description of Artificial Sequence: Synthetic peptide
  Seed: SAFPTTINF (MAGA1_HUMAN)
SDFPTTINM

SEQ ID NO: 43735 - protein, 10 aa, Artificial Sequence
  Description of Artificial Sequence: Synthetic peptide
  Seed: EIFGKASESL (MAGA1_HUMAN)
EAFGKASESK

SEQ ID NO: 43736 - protein, 9 aa, Artificial Sequence
  Description of Artificial Sequence: Synthetic peptide
  Seed: HSYVLVTCL (MAGA1_HUMAN)
HGYVLVTCY

SEQ ID NO: 43737 - protein, 9 aa, Artificial Sequence
  Description of Artificial Sequence: Synthetic peptide
  Seed: YKHCFPEIF (MAGA1_HUMAN)
YYHCFPEIF

SEQ ID NO: 43738 - protein, 10 aa, Artificial Sequence
  Description of Artificial Sequence: Synthetic peptide
  Seed: KVADLVGFLL (MAGA1_HUMAN)
KLADLVGFLG

SEQ ID NO: 43739 - protein, 10 aa, Artificial Sequence
  Description of Artificial Sequence: Synthetic peptide
  Seed: KNYKHCFPEI (MAGA1_HUMAN)
KGYKHCFPEK

SEQ ID NO: 43740 - protein, 9 aa, Artificial Sequence
  Description of Artificial Sequence: Synthetic peptide
  Seed: VSARVRFFF (MAGA1_HUMAN)
VIARVRFFW

SEQ ID NO: 43741 - protein, 10 aa, Artificial Sequence
  Description of Artificial Sequence: Synthetic peptide
  Seed: KVADLVGFLL (MAGA1_HUMAN)
KAADLVGFLW

SEQ ID NO: 43742 - protein, 10 aa, Artificial Sequence
  Description of Artificial Sequence: Synthetic peptide
  Seed: KNYKHCFPEI (MAGA1_HUMAN)
KSYKHCFPEM

SEQ ID NO: 43743 - protein, 9 aa, Artificial Sequence
  Description of Artificial Sequence: Synthetic peptide
  Seed: VSARVRFFF (MAGA1_HUMAN)
VQARVRFFY

SEQ ID NO: 43744 - protein, 9 aa, Artificial Sequence
  Description of Artificial Sequence: Synthetic peptide
  Seed: RVRFFFPSL (MAGA1_HUMAN)
RGRFFFPSM

SEQ ID NO: 43745 - protein, 9 aa, Artificial Sequence
  Description of Artificial Sequence: Synthetic peptide
  Seed: STSCILESL (MAGA1_HUMAN)
SLSCILESL

SEQ ID NO: 43746 - protein, 10 aa, Artificial Sequence
  Description of Artificial Sequence: Synthetic peptide
  Seed: AQQEALGLVC (MAGA1_HUMAN)
AEQEALGLVS

SEQ ID NO: 43747 - protein, 9 aa, Artificial Sequence
  Description of Artificial Sequence: Synthetic peptide
  Seed: CILESLFRA (MAGA1_HUMAN)
CLLESLFRI

SEQ ID NO: 43748 - protein, 10 aa, Artificial Sequence
  Description of Artificial Sequence: Synthetic peptide
  Seed: SCILESLFRA (MAGA1_HUMAN)
SVILESLFRI

SEQ ID NO: 43749 - protein, 9 aa, Artificial Sequence
  Description of Artificial Sequence: Synthetic peptide
  Seed: ARVRFFFPS (MAGA1_HUMAN)
ARVRFFFPA

SEQ ID NO: 43750 - protein, 10 aa, Artificial Sequence
  Description of Artificial Sequence: Synthetic peptide
  Seed: TSYVKVLEYV (MAGA1_HUMAN)
TDYVKVLEYL

SEQ ID NO: 43751 - protein, 9 aa, Artificial Sequence
  Description of Artificial Sequence: Synthetic peptide
  Seed: ESVIKNYKH (MAGA1_HUMAN)
EIVIKNYKK

SEQ ID NO: 43752 - protein, 9 aa, Artificial Sequence
  Description of Artificial Sequence: Synthetic peptide
  Seed: ASESLQLVF (MAGA1_HUMAN)
ATESLQLVW

SEQ ID NO: 43753 - protein, 10 aa, Artificial Sequence
  Description of Artificial Sequence: Synthetic peptide
  Seed: RQVPDSDPAR (MAGA1_HUMAN)
RAVPDSDPAM

SEQ ID NO: 43754 - protein, 11 aa, Artificial Sequence
  Description of Artificial Sequence: Synthetic peptide
  Seed: FFFPSLREAAL (MAGA1_HUMAN)
FPFPSLREAAM

SEQ ID NO: 43755 - protein, 9 aa, Artificial Sequence
  Description of Artificial Sequence: Synthetic peptide
  Seed: SLHCKPEEA (MAGA1_HUMAN)
SVHCKPEEV

SEQ ID NO: 43756 - protein, 10 aa, Artificial Sequence
  Description of Artificial Sequence: Synthetic peptide
  Seed: SARVRFFFPS (MAGA1_HUMAN)
SPRVRFFFPI

SEQ ID NO: 43757 - protein, 9 aa, Artificial Sequence
  Description of Artificial Sequence: Synthetic peptide
  Seed: TSYVKVLEY (MAGA1_HUMAN)
TTYVKVLEW

SEQ ID NO: 43758 - protein, 11 aa, Artificial Sequence
  Description of Artificial Sequence: Synthetic peptide
  Seed: RVRFFFPSLRE (MAGA1_HUMAN)
RARFFFPSLRA

SEQ ID NO: 43759 - protein, 10 aa, Artificial Sequence
  Description of Artificial Sequence: Synthetic peptide
  Seed: FFFPSLREAA (MAGA1_HUMAN)
FFFPSLREAL

SEQ ID NO: 43760 - protein, 9 aa, Artificial Sequence
  Description of Artificial Sequence: Synthetic peptide
  Seed: TSYVKVLEY (MAGA1_HUMAN)
TVYVKVLEY

SEQ ID NO: 43761 - protein, 10 aa, Artificial Sequence
  Description of Artificial Sequence: Synthetic peptide
  Seed: AQQEALGLVC (MAGA1_HUMAN)
AEQEALGLVT

SEQ ID NO: 43762 - protein, 9 aa, Artificial Sequence
  Description of Artificial Sequence: Synthetic peptide
  Seed: EALEAQQEA (MAGA1_HUMAN)
EVLEAQQEI

SEQ ID NO: 43763 - protein, 10 aa, Artificial Sequence
  Description of Artificial Sequence: Synthetic peptide
  Seed: FLWGPRALAE (MAGA1_HUMAN)
FIWGPRALAI

SEQ ID NO: 43764 - protein, 9 aa, Artificial Sequence
  Description of Artificial Sequence: Synthetic peptide
  Seed: RVRFFFPSL (MAGA1_HUMAN)
RGRFFFPSW

SEQ ID NO: 43765 - protein, 10 aa, Artificial Sequence
  Description of Artificial Sequence: Synthetic peptide
  Seed: SARVRFFFPS (MAGA1_HUMAN)
SQRVRFFFPF

SEQ ID NO: 43766 - protein, 9 aa, Artificial Sequence
  Description of Artificial Sequence: Synthetic peptide
  Seed: FFFPSLREA (MAGA1_HUMAN)
FCFPSLREM

SEQ ID NO: 43767 - protein, 11 aa, Artificial Sequence
  Description of Artificial Sequence: Synthetic peptide
  Seed: EVYDGREHSAY (MAGA1_HUMAN)
EQYDGREHSAF

SEQ ID NO: 43768 - protein, 9 aa, Artificial Sequence
  Description of Artificial Sequence: Synthetic peptide
  Seed: EFLWGPRAL (MAGA1_HUMAN)
EYLWGPRAY

SEQ ID NO: 43769 - protein, 9 aa, Artificial Sequence
  Description of Artificial Sequence: Synthetic peptide
  Seed: KVSARVRFF (MAGA1_HUMAN)
KLSARVRFF

SEQ ID NO: 43770 - protein, 9 aa, Artificial Sequence
  Description of Artificial Sequence: Synthetic peptide
  Seed: IMPKTGFLI (MAGA1_HUMAN)
IWPKTGFLW

SEQ ID NO: 43771 - protein, 9 aa, Artificial Sequence
  Description of Artificial Sequence: Synthetic peptide
  Seed: TKAEMLESV (MAGA1_HUMAN)
TMAEMLESV

SEQ ID NO: 43772 - protein, 9 aa, Artificial Sequence
  Description of Artificial Sequence: Synthetic peptide
  Seed: IIVLVMIAM (MAGA1_HUMAN)
IAVLVMIAL

SEQ ID NO: 43773 - protein, 10 aa, Artificial Sequence
  Description of Artificial Sequence: Synthetic peptide
  Seed: DPTGHSYVLV (MAGA1_HUMAN)
DTTGHSYVLV

SEQ ID NO: 43774 - protein, 10 aa, Artificial Sequence
  Description of Artificial Sequence: Synthetic peptide
  Seed: RVRFFFPSLR (MAGA1_HUMAN)
RRRFFFPSLR

SEQ ID NO: 43775 - protein, 9 aa, Artificial Sequence
  Description of Artificial Sequence: Synthetic peptide
  Seed: SAYGEPRKL (MAGA1_HUMAN)
SIYGEPRKW

SEQ ID NO: 43776 - protein, 9 aa, Artificial Sequence
  Description of Artificial Sequence: Synthetic peptide
  Seed: RQRQPSEGS (MAGA1_HUMAN)
RVRQPSEGV

SEQ ID NO: 43777 - protein, 10 aa, Artificial Sequence
  Description of Artificial Sequence: Synthetic peptide
  Seed: ARYEFLWGPR (MAGA1_HUMAN)
AFYEFLWGPR

SEQ ID NO: 43778 - protein, 9 aa, Artificial Sequence
  Description of Artificial Sequence: Synthetic peptide
  Seed: KVLEYVIKV (MAGA1_HUMAN)
KILEYVIKL

SEQ ID NO: 43779 - protein, 9 aa, Artificial Sequence
  Description of Artificial Sequence: Synthetic peptide
  Seed: SSPLVLGTL (MAGA1_HUMAN)
SLPLVLGTV

SEQ ID NO: 43780 - protein, 10 aa, Artificial Sequence
  Description of Artificial Sequence: Synthetic peptide
  Seed: RYEFLWGPRA (MAGA1_HUMAN)
RFEFLWGPRR

SEQ ID NO: 43781 - protein, 8 aa, Artificial Sequence
  Description of Artificial Sequence: Synthetic peptide
  Seed: MPKTGFLI (MAGA1_HUMAN)
MPKTGFLM

SEQ ID NO: 43782 - protein, 11 aa, Artificial Sequence
  Description of Artificial Sequence: Synthetic peptide
  Seed: STDPPQSPQGA (MAGA1_HUMAN)
SADPPQSPQGI

SEQ ID NO: 43783 - protein, 10 aa, Artificial Sequence
  Description of Artificial Sequence: Synthetic peptide
  Seed: SAFPTTINFT (MAGA1_HUMAN)
SQFPTTINFI

SEQ ID NO: 43784 - protein, 10 aa, Artificial Sequence
  Description of Artificial Sequence: Synthetic peptide
  Seed: EIFGKASESL (MAGA1_HUMAN)
EIFGKASESW

SEQ ID NO: 43785 - protein, 9 aa, Artificial Sequence
  Description of Artificial Sequence: Synthetic peptide
  Seed: SSPLVLGTL (MAGA1_HUMAN)
SAPLVLGTV

SEQ ID NO: 43786 - protein, 9 aa, Artificial Sequence
  Description of Artificial Sequence: Synthetic peptide
  Seed: QIMPKTGFL (MAGA1_HUMAN)
QVMPKTGFK

SEQ ID NO: 43787 - protein, 9 aa, Artificial Sequence
  Description of Artificial Sequence: Synthetic peptide
  Seed: ATSSSSPLV (MAGA1_HUMAN)
ASSSSSPLL

SEQ ID NO: 43788 - protein, 9 aa, Artificial Sequence
  Description of Artificial Sequence: Synthetic peptide
  Seed: MLESVIKNY (MAGA1_HUMAN)
MQESVIKNY

SEQ ID NO: 43789 - protein, 10 aa, Artificial Sequence
  Description of Artificial Sequence: Synthetic peptide
  Seed: FFPSLREAAL (MAGA1_HUMAN)
FMPSLREAAF

SEQ ID NO: 43790 - protein, 10 aa, Artificial Sequence
  Description of Artificial Sequence: Synthetic peptide
  Seed: ADPTGHSYVL (MAGA1_HUMAN)
AAPTGHSYVM

SEQ ID NO: 43791 - protein, 11 aa, Artificial Sequence
  Description of Artificial Sequence: Synthetic peptide
  Seed: KVLEYVIKVSA (MAGA1_HUMAN)
KMLEYVIKVSA

SEQ ID NO: 43792 - protein, 9 aa, Artificial Sequence
  Description of Artificial Sequence: Synthetic peptide
  Seed: GTLEEVPTA (MAGA1_HUMAN)
GILEEVPTA

SEQ ID NO: 43793 - protein, 10 aa, Artificial Sequence
  Description of Artificial Sequence: Synthetic peptide
  Seed: VLVTCLGLSY (MAGA1_HUMAN)
VQVTCLGLSY

SEQ ID NO: 43794 - protein, 9 aa, Artificial Sequence
  Description of Artificial Sequence: Synthetic peptide
  Seed: SAYGEPRKL (MAGA1_HUMAN)
SMYGEPRKF

SEQ ID NO: 43795 - protein, 9 aa, Artificial Sequence
  Description of Artificial Sequence: Synthetic peptide
  Seed: RVRFFFPSL (MAGA1_HUMAN)
RFRFFFPSQ

SEQ ID NO: 43796 - protein, 9 aa, Artificial Sequence
  Description of Artificial Sequence: Synthetic peptide
  Seed: FPSLREAAL (MAGA1_HUMAN)
FGSLREAAL

SEQ ID NO: 43797 - protein, 10 aa, Artificial Sequence
  Description of Artificial Sequence: Synthetic peptide
  Seed: SCILESLFRA (MAGA1_HUMAN)
SIILESLFRA

SEQ ID NO: 43798 - protein, 9 aa, Artificial Sequence
  Description of Artificial Sequence: Synthetic peptide
  Seed: EYVIKVSAR (MAGA1_HUMAN)
EMVIKVSAR

SEQ ID NO: 43799 - protein, 9 aa, Artificial Sequence
  Description of Artificial Sequence: Synthetic peptide
  Seed: ATSSSSPLV (MAGA1_HUMAN)
ASSSSSPLM

SEQ ID NO: 43800 - protein, 9 aa, Artificial Sequence
  Description of Artificial Sequence: Synthetic peptide
  Seed: STDPPQSPQ (MAGA1_HUMAN)
SWDPPQSPM

SEQ ID NO: 43801 - protein, 9 aa, Artificial Sequence
  Description of Artificial Sequence: Synthetic peptide
  Seed: RALAETSYV (MAGA1_HUMAN)
RQLAETSYI

SEQ ID NO: 43802 - protein, 9 aa, Artificial Sequence
  Description of Artificial Sequence: Synthetic peptide
  Seed: KVSARVRFF (MAGA1_HUMAN)
KTSARVRFF

SEQ ID NO: 43803 - protein, 10 aa, Artificial Sequence
  Description of Artificial Sequence: Synthetic peptide
  Seed: QIMPKTGFLI (MAGA1_HUMAN)
QTMPKTGFLV

SEQ ID NO: 43804 - protein, 9 aa, Artificial Sequence
  Description of Artificial Sequence: Synthetic peptide
  Seed: VSARVRFFF (MAGA1_HUMAN)
VYARVRFFL

SEQ ID NO: 43805 - protein, 10 aa, Artificial Sequence
  Description of Artificial Sequence: Synthetic peptide
  Seed: EADPTGHSYV (MAGA1_HUMAN)
ESDPTGHSYL

SEQ ID NO: 43806 - protein, 9 aa, Artificial Sequence
  Description of Artificial Sequence: Synthetic peptide
  Seed: LVQEKYLEY (MAGA1_HUMAN)
LKQEKYLEF

SEQ ID NO: 43807 - protein, 9 aa, Artificial Sequence
  Description of Artificial Sequence: Synthetic peptide
  Seed: STSCILESL (MAGA1_HUMAN)
SRSCILESY

SEQ ID NO: 43808 - protein, 9 aa, Artificial Sequence
  Description of Artificial Sequence: Synthetic peptide
  Seed: ALAETSYVK (MAGA1_HUMAN)
ATAETSYVY

SEQ ID NO: 43809 - protein, 9 aa, Artificial Sequence
  Description of Artificial Sequence: Synthetic peptide
  Seed: FPTTINFTR (MAGA1_HUMAN)
FTTTINFTM

SEQ ID NO: 43810 - protein, 10 aa, Artificial Sequence
  Description of Artificial Sequence: Synthetic peptide
  Seed: SDPARYEFLW (MAGA1_HUMAN)
SSPARYEFLW

SEQ ID NO: 43811 - protein, 9 aa, Artificial Sequence
  Description of Artificial Sequence: Synthetic peptide
  Seed: RVRFFFPSL (MAGA1_HUMAN)
RPRFFFPSL

SEQ ID NO: 43812 - protein, 10 aa, Artificial Sequence
  Description of Artificial Sequence: Synthetic peptide
  Seed: STSCILESLF (MAGA1_HUMAN)
SSSCILESLW

SEQ ID NO: 43813 - protein, 8 aa, Artificial Sequence
  Description of Artificial Sequence: Synthetic peptide
  Seed: RVRFFFPS (MAGA1_HUMAN)
RIRFFFPK

SEQ ID NO: 43814 - protein, 9 aa, Artificial Sequence
  Description of Artificial Sequence: Synthetic peptide
  Seed: LVQEKYLEY (MAGA1_HUMAN)
LLQEKYLEY

SEQ ID NO: 43815 - protein, 9 aa, Artificial Sequence
  Description of Artificial Sequence: Synthetic peptide
  Seed: SAFPTTINF (MAGA1_HUMAN)
SQFPTTINY

SEQ ID NO: 43816 - protein, 8 aa, Artificial Sequence
  Description of Artificial Sequence: Synthetic peptide
  Seed: SYVKVLEY (MAGA1_HUMAN)
SYVKVLEM

SEQ ID NO: 43817 - protein, 9 aa, Artificial Sequence
  Description of Artificial Sequence: Synthetic peptide
  Seed: SVMEVYDGR (MAGA1_HUMAN)
SVMEVYDGK

SEQ ID NO: 43818 - protein, 10 aa, Artificial Sequence
  Description of Artificial Sequence: Synthetic peptide
  Seed: TSYVKVLEYV (MAGA1_HUMAN)
TLYVKVLEYL

SEQ ID NO: 43819 - protein, 9 aa, Artificial Sequence
  Description of Artificial Sequence: Synthetic peptide
  Seed: VADLVGFLL (MAGA1_HUMAN)
VTDLVGFLI

SEQ ID NO: 43820 - protein, 10 aa, Artificial Sequence
  Description of Artificial Sequence: Synthetic peptide
  Seed: SAYGEPRKLL (MAGA1_HUMAN)
SAYGEPRKLY

SEQ ID NO: 43821 - protein, 11 aa, Artificial Sequence
  Description of Artificial Sequence: Synthetic peptide
  Seed: RVRFFFPSLRE (MAGA1_HUMAN)
RARFFFPSLRV

SEQ ID NO: 43822 - protein, 10 aa, Artificial Sequence
  Description of Artificial Sequence: Synthetic peptide
  Seed: RVRFFFPSLR (MAGA1_HUMAN)
RTRFFFPSLG

SEQ ID NO: 43823 - protein, 10 aa, Artificial Sequence
  Description of Artificial Sequence: Synthetic peptide
  Seed: TKKVADLVGF (MAGA1_HUMAN)
TQKVADLVGF

SEQ ID NO: 43824 - protein, 10 aa, Artificial Sequence
  Description of Artificial Sequence: Synthetic peptide
  Seed: KEADPTGHSY (MAGA1_HUMAN)
KVADPTGHSF

SEQ ID NO: 43825 - protein, 11 aa, Artificial Sequence
  Description of Artificial Sequence: Synthetic peptide
  Seed: YEFLWGPRALA (MAGA1_HUMAN)
YNFLWGPRALL

SEQ ID NO: 43826 - protein, 10 aa, Artificial Sequence
  Description of Artificial Sequence: Synthetic peptide
  Seed: SESLQLVFGI (MAGA1_HUMAN)
SKSLQLVFGW

SEQ ID NO: 43827 - protein, 9 aa, Artificial Sequence
  Description of Artificial Sequence: Synthetic peptide
  Seed: QSPQGASAF (MAGA1_HUMAN)
QIPQGASAI

SEQ ID NO: 43828 - protein, 9 aa, Artificial Sequence
  Description of Artificial Sequence: Synthetic peptide
  Seed: TQDLVQEKY (MAGA1_HUMAN)
TGDLVQEKL

SEQ ID NO: 43829 - protein, 9 aa, Artificial Sequence
  Description of Artificial Sequence: Synthetic peptide
  Seed: VYDGREHSA (MAGA1_HUMAN)
VTDGREHSL

SEQ ID NO: 43830 - protein, 9 aa, Artificial Sequence
  Description of Artificial Sequence: Synthetic peptide
  Seed: IAMEGGHAP (MAGA1_HUMAN)
ILMEGGHAL

SEQ ID NO: 43831 - protein, 9 aa, Artificial Sequence
  Description of Artificial Sequence: Synthetic peptide
  Seed: DSDPARYEF (MAGA1_HUMAN)
DVDPARYEL

SEQ ID NO: 43832 - protein, 8 aa, Artificial Sequence
  Description of Artificial Sequence: Synthetic peptide
  Seed: TGFLIIVL (MAGA1_HUMAN)
TQFLIIVI

SEQ ID NO: 43833 - protein, 10 aa, Artificial Sequence
  Description of Artificial Sequence: Synthetic peptide
  Seed: SARVRFFFPS (MAGA1_HUMAN)
SFRVRFFFPY

SEQ ID NO: 43834 - protein, 11 aa, Artificial Sequence
  Description of Artificial Sequence: Synthetic peptide
  Seed: KVADLVGFLLL (MAGA1_HUMAN)
KLADLVGFLLL

SEQ ID NO: 43835 - protein, 10 aa, Artificial Sequence
  Description of Artificial Sequence: Synthetic peptide
  Seed: GFLLLKYRAR (MAGA1_HUMAN)
GSLLLKYRAR

SEQ ID NO: 43836 - protein, 10 aa, Artificial Sequence
  Description of Artificial Sequence: Synthetic peptide
  Seed: YEFLWGPRAL (MAGA1_HUMAN)
YEFLWGPRAF

SEQ ID NO: 43837 - protein, 10 aa, Artificial Sequence
  Description of Artificial Sequence: Synthetic peptide
  Seed: ASAFPTTINF (MAGA1_HUMAN)
ALAFPTTINF

SEQ ID NO: 43838 - protein, 8 aa, Artificial Sequence
  Description of Artificial Sequence: Synthetic peptide
  Seed: RVRFFFPS (MAGA1_HUMAN)
RTRFFFPA

SEQ ID NO: 43839 - protein, 9 aa, Artificial Sequence
  Description of Artificial Sequence: Synthetic peptide
  Seed: LESLFRAVI (MAGA1_HUMAN)
LKSLFRAVL

SEQ ID NO: 43840 - protein, 9 aa, Artificial Sequence
  Description of Artificial Sequence: Synthetic peptide
  Seed: REPVTKAEM (MAGA1_HUMAN)
RQPVTKAEY

SEQ ID NO: 43841 - protein, 10 aa, Artificial Sequence
  Description of Artificial Sequence: Synthetic peptide
  Seed: KVADLVGFLL (MAGA1_HUMAN)
KLADLVGFLH

SEQ ID NO: 43842 - protein, 9 aa, Artificial Sequence
  Description of Artificial Sequence: Synthetic peptide
  Seed: AYGEPRKLL (MAGA1_HUMAN)
AAGEPRKLY

SEQ ID NO: 43843 - protein, 9 aa, Artificial Sequence
  Description of Artificial Sequence: Synthetic peptide
  Seed: SSPLVLGTL (MAGA1_HUMAN)
SFPLVLGTY

SEQ ID NO: 43844 - protein, 9 aa, Artificial Sequence
  Description of Artificial Sequence: Synthetic peptide
  Seed: SAFPTTINF (MAGA1_HUMAN)
SHFPTTINY

SEQ ID NO: 43845 - protein, 10 aa, Artificial Sequence
  Description of Artificial Sequence: Synthetic peptide
  Seed: RVRFFFPSLR (MAGA1_HUMAN)
RDRFFFPSLL

SEQ ID NO: 43846 - protein, 9 aa, Artificial Sequence
  Description of Artificial Sequence: Synthetic peptide
  Seed: KVADLVGFL (MAGA1_HUMAN)
KSADLVGFL

SEQ ID NO: 43847 - protein, 9 aa, Artificial Sequence
  Description of Artificial Sequence: Synthetic peptide
  Seed: VADLVGFLL (MAGA1_HUMAN)
VMDLVGFLL

SEQ ID NO: 43848 - protein, 9 aa, Artificial Sequence
  Description of Artificial Sequence: Synthetic peptide
  Seed: TGFLIIVLV (MAGA1_HUMAN)
TLFLIIVLI

SEQ ID NO: 43849 - protein, 9 aa, Artificial Sequence
  Description of Artificial Sequence: Synthetic peptide
  Seed: SAYGEPRKL (MAGA1_HUMAN)
SVYGEPRKI

SEQ ID NO: 43850 - protein, 9 aa, Artificial Sequence
  Description of Artificial Sequence: Synthetic peptide
  Seed: VYDGREHSA (MAGA1_HUMAN)
VWDGREHSM

SEQ ID NO: 43851 - protein, 9 aa, Artificial Sequence
  Description of Artificial Sequence: Synthetic peptide
  Seed: KASESLQLV (MAGA1_HUMAN)
KISESLQLW

SEQ ID NO: 43852 - protein, 9 aa, Artificial Sequence
  Description of Artificial Sequence: Synthetic peptide
  Seed: AATSSSSPL (MAGA1_HUMAN)
ANTSSSSPY

SEQ ID NO: 43853 - protein, 9 aa, Artificial Sequence
  Description of Artificial Sequence: Synthetic peptide
  Seed: RVRFFFPSL (MAGA1_HUMAN)
RWRFFFPSF

SEQ ID NO: 43854 - protein, 10 aa, Artificial Sequence
  Description of Artificial Sequence: Synthetic peptide
  Seed: VTKAEMLESV (MAGA1_HUMAN)
VLKAEMLESV

SEQ ID NO: 43855 - protein, 9 aa, Artificial Sequence
  Description of Artificial Sequence: Synthetic peptide
  Seed: NYKHCFPEI (MAGA1_HUMAN)
NYKHCFPEL

SEQ ID NO: 43856 - protein, 9 aa, Artificial Sequence
  Description of Artificial Sequence: Synthetic peptide
  Seed: RAREPVTKA (MAGA1_HUMAN)
RIREPVTKA

SEQ ID NO: 43857 - protein, 10 aa, Artificial Sequence
  Description of Artificial Sequence: Synthetic peptide
  Seed: SYVKVLEYVI (MAGA1_HUMAN)
SYVKVLEYVL

SEQ ID NO: 43858 - protein, 9 aa, Artificial Sequence
  Description of Artificial Sequence: Synthetic peptide
  Seed: RVRFFFPSL (MAGA1_HUMAN)
RYRFFFPSH

SEQ ID NO: 43859 - protein, 9 aa, Artificial Sequence
  Description of Artificial Sequence: Synthetic peptide
  Seed: GASAFPTTI (MAGA1_HUMAN)
GRSAFPTTM

SEQ ID NO: 43860 - protein, 10 aa, Artificial Sequence
  Description of Artificial Sequence: Synthetic peptide
  Seed: ARYEFLWGPR (MAGA1_HUMAN)
AMYEFLWGPR

SEQ ID NO: 43861 - protein, 10 aa, Artificial Sequence
  Description of Artificial Sequence: Synthetic peptide
  Seed: SARVRFFFPS (MAGA1_HUMAN)
SERVRFFFPY

SEQ ID NO: 43862 - protein, 9 aa, Artificial Sequence
  Description of Artificial Sequence: Synthetic peptide
  Seed: QIMPKTGFL (MAGA1_HUMAN)
QMMPKTGFM

SEQ ID NO: 43863 - protein, 10 aa, Artificial Sequence
  Description of Artificial Sequence: Synthetic peptide
  Seed: ATSSSSPLVL (MAGA1_HUMAN)
ALSSSSPLVV

SEQ ID NO: 43864 - protein, 10 aa, Artificial Sequence
  Description of Artificial Sequence: Synthetic peptide
  Seed: EADPTGHSYV (MAGA1_HUMAN)
ELDPTGHSYL

SEQ ID NO: 43865 - protein, 10 aa, Artificial Sequence
  Description of Artificial Sequence: Synthetic peptide
  Seed: ARVRFFFPSL (MAGA1_HUMAN)
ADVRFFFPSK

SEQ ID NO: 43866 - protein, 9 aa, Artificial Sequence
  Description of Artificial Sequence: Synthetic peptide
  Seed: AATSSSSPL (MAGA1_HUMAN)
AQTSSSSPH

SEQ ID NO: 43867 - protein, 11 aa, Artificial Sequence
  Description of Artificial Sequence: Synthetic peptide
  Seed: RYEFLWGPRAL (MAGA1_HUMAN)
REEFLWGPRAL

SEQ ID NO: 43868 - protein, 10 aa, Artificial Sequence
  Description of Artificial Sequence: Synthetic peptide
  Seed: QIMPKTGFLI (MAGA1_HUMAN)
QLMPKTGFLL

SEQ ID NO: 43869 - protein, 9 aa, Artificial Sequence
  Description of Artificial Sequence: Synthetic peptide
  Seed: KASESLQLV (MAGA1_HUMAN)
KASESLQLI

SEQ ID NO: 43870 - protein, 9 aa, Artificial Sequence
  Description of Artificial Sequence: Synthetic peptide
  Seed: KYRAREPVT (MAGA1_HUMAN)
KTRAREPVL

SEQ ID NO: 43871 - protein, 10 aa, Artificial Sequence
  Description of Artificial Sequence: Synthetic peptide
  Seed: KKVADLVGFL (MAGA1_HUMAN)
KQVADLVGFL

SEQ ID NO: 43872 - protein, 10 aa, Artificial Sequence
  Description of Artificial Sequence: Synthetic peptide
  Seed: KVSARVRFFF (MAGA1_HUMAN)
KMSARVRFFF

SEQ ID NO: 43873 - protein, 9 aa, Artificial Sequence
  Description of Artificial Sequence: Synthetic peptide
  Seed: EADPTGHSY (MAGA1_HUMAN)
EVDPTGHSF

SEQ ID NO: 43874 - protein, 11 aa, Artificial Sequence
  Description of Artificial Sequence: Synthetic peptide
  Seed: KEADPTGHSYV (MAGA1_HUMAN)
KQADPTGHSYF

SEQ ID NO: 43875 - protein, 8 aa, Artificial Sequence
  Description of Artificial Sequence: Synthetic peptide
  Seed: ASAFPTTI (MAGA1_HUMAN)
AAAFPTTL

SEQ ID NO: 43876 - protein, 10 aa, Artificial Sequence
  Description of Artificial Sequence: Synthetic peptide
  Seed: RVRFFFPSLR (MAGA1_HUMAN)
RTRFFFPSLL

SEQ ID NO: 43877 - protein, 10 aa, Artificial Sequence
  Description of Artificial Sequence: Synthetic peptide
  Seed: KEADPTGHSY (MAGA1_HUMAN)
KAADPTGHSL

SEQ ID NO: 43878 - protein, 10 aa, Artificial Sequence
  Description of Artificial Sequence: Synthetic peptide
  Seed: SESLQLVFGI (MAGA1_HUMAN)
SCSLQLVFGW

SEQ ID NO: 43879 - protein, 11 aa, Artificial Sequence
  Description of Artificial Sequence: Synthetic peptide
  Seed: SPLVLGTLEEV (MAGA1_HUMAN)
SLLVLGTLEEI

SEQ ID NO: 43880 - protein, 9 aa, Artificial Sequence
  Description of Artificial Sequence: Synthetic peptide
  Seed: KVSARVRFF (MAGA1_HUMAN)
KVSARVRFV

SEQ ID NO: 43881 - protein, 10 aa, Artificial Sequence
  Description of Artificial Sequence: Synthetic peptide
  Seed: YEFLWGPRAL (MAGA1_HUMAN)
YQFLWGPRAH

SEQ ID NO: 43882 - protein, 9 aa, Artificial Sequence
  Description of Artificial Sequence: Synthetic peptide
  Seed: FLWGPRALA (MAGA1_HUMAN)
FIWGPRALR

SEQ ID NO: 43883 - protein, 11 aa, Artificial Sequence
  Description of Artificial Sequence: Synthetic peptide
  Seed: ARVRFFFPSLR (MAGA1_HUMAN)
AMVRFFFPSLL

SEQ ID NO: 43884 - protein, 10 aa, Artificial Sequence
  Description of Artificial Sequence: Synthetic peptide
  Seed: FLWGPRALAE (MAGA1_HUMAN)
FMWGPRALAT

SEQ ID NO: 43885 - protein, 9 aa, Artificial Sequence
  Description of Artificial Sequence: Synthetic peptide
  Seed: SVMEVYDGR (MAGA1_HUMAN)
SIMEVYDGK

SEQ ID NO: 43886 - protein, 9 aa, Artificial Sequence
  Description of Artificial Sequence: Synthetic peptide
  Seed: KKVADLVGF (MAGA1_HUMAN)
KKVADLVGM

SEQ ID NO: 43887 - protein, 9 aa, Artificial Sequence
  Description of Artificial Sequence: Synthetic peptide
  Seed: TSYVKVLEY (MAGA1_HUMAN)
TMYVKVLER

SEQ ID NO: 43888 - protein, 10 aa, Artificial Sequence
  Description of Artificial Sequence: Synthetic peptide
  Seed: RVRFFFPSLR (MAGA1_HUMAN)
RARFFFPSLK

SEQ ID NO: 43889 - protein, 10 aa, Artificial Sequence
  Description of Artificial Sequence: Synthetic peptide
  Seed: LVFGIDVKEA (MAGA1_HUMAN)
LLFGIDVKEV

SEQ ID NO: 43890 - protein, 9 aa, Artificial Sequence
  Description of Artificial Sequence: Synthetic peptide
  Seed: WEELSVMEV (MAGA1_HUMAN)
WEELSVMEL

SEQ ID NO: 43891 - protein, 10 aa, Artificial Sequence
  Description of Artificial Sequence: Synthetic peptide
  Seed: ADLVGFLLLK (MAGA1_HUMAN)
AALVGFLLLR

SEQ ID NO: 43892 - protein, 11 aa, Artificial Sequence
  Description of Artificial Sequence: Synthetic peptide
  Seed: RQVPDSDPARY (MAGA1_HUMAN)
RQVPDSDPARL

SEQ ID NO: 43893 - protein, 9 aa, Artificial Sequence
  Description of Artificial Sequence: Synthetic peptide
  Seed: ASESLQLVF (MAGA1_HUMAN)
AQESLQLVY

SEQ ID NO: 43894 - protein, 11 aa, Artificial Sequence
  Description of Artificial Sequence: Synthetic peptide
  Seed: RQVPDSDPARY (MAGA1_HUMAN)
RTVPDSDPARF

SEQ ID NO: 43895 - protein, 9 aa, Artificial Sequence
  Description of Artificial Sequence: Synthetic peptide
  Seed: TTINFTRQR (MAGA1_HUMAN)
TTINFTRQM

SEQ ID NO: 43896 - protein, 10 aa, Artificial Sequence
  Description of Artificial Sequence: Synthetic peptide
  Seed: ARVRFFFPSL (MAGA1_HUMAN)
AIVRFFFPSK

SEQ ID NO: 43897 - protein, 9 aa, Artificial Sequence
  Description of Artificial Sequence: Synthetic peptide
  Seed: YVIKVSARV (MAGA1_HUMAN)
YIIKVSARL

SEQ ID NO: 43898 - protein, 9 aa, Artificial Sequence
  Description of Artificial Sequence: Synthetic peptide
  Seed: RYEFLWGPR (MAGA1_HUMAN)
RVEFLWGPR

SEQ ID NO: 43899 - protein, 8 aa, Artificial Sequence
  Description of Artificial Sequence: Synthetic peptide
  Seed: SPQGASAF (MAGA1_HUMAN)
SPQGASAI

SEQ ID NO: 43900 - protein, 9 aa, Artificial Sequence
  Description of Artificial Sequence: Synthetic peptide
  Seed: GASAFPTTI (MAGA1_HUMAN)
GQSAFPTTL

SEQ ID NO: 43901 - protein, 9 aa, Artificial Sequence
  Description of Artificial Sequence: Synthetic peptide
  Seed: LESLFRAVI (MAGA1_HUMAN)
LESLFRAVM

SEQ ID NO: 43902 - protein, 10 aa, Artificial Sequence
  Description of Artificial Sequence: Synthetic peptide
  Seed: RVRFFFPSLR (MAGA1_HUMAN)
RQRFFFPSLR

SEQ ID NO: 43903 - protein, 10 aa, Artificial Sequence
  Description of Artificial Sequence: Synthetic peptide
  Seed: SLFRAVITKK (MAGA1_HUMAN)
SPFRAVITKR

SEQ ID NO: 43904 - protein, 9 aa, Artificial Sequence
  Description of Artificial Sequence: Synthetic peptide
  Seed: SSPLVLGTL (MAGA1_HUMAN)
SWPLVLGTF

SEQ ID NO: 43905 - protein, 9 aa, Artificial Sequence
  Description of Artificial Sequence: Synthetic peptide
  Seed: FLWGPRALA (MAGA1_HUMAN)
FMWGPRALF

SEQ ID NO: 43906 - protein, 10 aa, Artificial Sequence
  Description of Artificial Sequence: Synthetic peptide
  Seed: TSYVKVLEYV (MAGA1_HUMAN)
TKYVKVLEYL

SEQ ID NO: 43907 - protein, 9 aa, Artificial Sequence
  Description of Artificial Sequence: Synthetic peptide
  Seed: AATSSSSPL (MAGA1_HUMAN)
AYTSSSSPL

SEQ ID NO: 43908 - protein, 10 aa, Artificial Sequence
  Description of Artificial Sequence: Synthetic peptide
  Seed: EHSAYGEPRK (MAGA1_HUMAN)
ETSAYGEPRR

SEQ ID NO: 43909 - protein, 9 aa, Artificial Sequence
  Description of Artificial Sequence: Synthetic peptide
  Seed: SARVRFFFP (MAGA1_HUMAN)
SFRVRFFFA

SEQ ID NO: 43910 - protein, 10 aa, Artificial Sequence
  Description of Artificial Sequence: Synthetic peptide
  Seed: MLESVIKNYK (MAGA1_HUMAN)
MMESVIKNYY

SEQ ID NO: 43911 - protein, 10 aa, Artificial Sequence
  Description of Artificial Sequence: Synthetic peptide
  Seed: TSYVKVLEYV (MAGA1_HUMAN)
TGYVKVLEYW

SEQ ID NO: 43912 - protein, 9 aa, Artificial Sequence
  Description of Artificial Sequence: Synthetic peptide
  Seed: SAFPTTINF (MAGA1_HUMAN)
SMFPTTINM

SEQ ID NO: 43913 - protein, 10 aa, Artificial Sequence
  Description of Artificial Sequence: Synthetic peptide
  Seed: RVRFFFPSLR (MAGA1_HUMAN)
RSRFFFPSLY

SEQ ID NO: 43914 - protein, 9 aa, Artificial Sequence
  Description of Artificial Sequence: Synthetic peptide
  Seed: LTQDLVQEK (MAGA1_HUMAN)
LAQDLVQEV

SEQ ID NO: 43915 - protein, 10 aa, Artificial Sequence
  Description of Artificial Sequence: Synthetic peptide
  Seed: RALAETSYVK (MAGA1_HUMAN)
RVLAETSYVR

SEQ ID NO: 43916 - protein, 9 aa, Artificial Sequence
  Description of Artificial Sequence: Synthetic peptide
  Seed: AATSSSSPL (MAGA1_HUMAN)
AITSSSSPF

SEQ ID NO: 43917 - protein, 9 aa, Artificial Sequence
  Description of Artificial Sequence: Synthetic peptide
  Seed: VADLVGFLL (MAGA1_HUMAN)
VTDLVGFLV

SEQ ID NO: 43918 - protein, 11 aa, Artificial Sequence
  Description of Artificial Sequence: Synthetic peptide
  Seed: STDPPQSPQGA (MAGA1_HUMAN)
SLDPPQSPQGI

SEQ ID NO: 43919 - protein, 9 aa, Artificial Sequence
  Description of Artificial Sequence: Synthetic peptide
  Seed: LVLGTLEEV (MAGA1_HUMAN)
LVLGTLEEY

SEQ ID NO: 43920 - protein, 9 aa, Artificial Sequence
  Description of Artificial Sequence: Synthetic peptide
  Seed: TKAEMLESV (MAGA1_HUMAN)
TTAEMLESM

SEQ ID NO: 43921 - protein, 10 aa, Artificial Sequence
  Description of Artificial Sequence: Synthetic peptide
  Seed: FFPSLREAAL (MAGA1_HUMAN)
FSPSLREAAY

SEQ ID NO: 43922 - protein, 10 aa, Artificial Sequence
  Description of Artificial Sequence: Synthetic peptide
  Seed: LLKYRAREPV (MAGA1_HUMAN)
LLKYRAREPM

SEQ ID NO: 43923 - protein, 9 aa, Artificial Sequence
  Description of Artificial Sequence: Synthetic peptide
  Seed: VYDGREHSA (MAGA1_HUMAN)
VSDGREHSF

SEQ ID NO: 43924 - protein, 9 aa, Artificial Sequence
  Description of Artificial Sequence: Synthetic peptide
  Seed: RALAETSYV (MAGA1_HUMAN)
RNLAETSYY

SEQ ID NO: 43925 - protein, 9 aa, Artificial Sequence
  Description of Artificial Sequence: Synthetic peptide
  Seed: SAFPTTINF (MAGA1_HUMAN)
SAFPTTINH

SEQ ID NO: 43926 - protein, 10 aa, Artificial Sequence
  Description of Artificial Sequence: Synthetic peptide
  Seed: RVRFFFPSLR (MAGA1_HUMAN)
RFRFFFPSLR

SEQ ID NO: 43927 - protein, 9 aa, Artificial Sequence
  Description of Artificial Sequence: Synthetic peptide
  Seed: VSARVRFFF (MAGA1_HUMAN)
VYARVRFFF

SEQ ID NO: 43928 - protein, 9 aa, Artificial Sequence
  Description of Artificial Sequence: Synthetic peptide
  Seed: QIMPKTGFL (MAGA1_HUMAN)
QTMPKTGFL

SEQ ID NO: 43929 - protein, 11 aa, Artificial Sequence
  Description of Artificial Sequence: Synthetic peptide
  Seed: REEEGPSTSCI (MAGA1_HUMAN)
REEEGPSTSCY

SEQ ID NO: 43930 - protein, 9 aa, Artificial Sequence
  Description of Artificial Sequence: Synthetic peptide
  Seed: RAREPVTKA (MAGA1_HUMAN)
RPREPVTKP

SEQ ID NO: 43931 - protein, 9 aa, Artificial Sequence
  Description of Artificial Sequence: Synthetic peptide
  Seed: RVRFFFPSL (MAGA1_HUMAN)
RERFFFPSF

SEQ ID NO: 43932 - protein, 10 aa, Artificial Sequence
  Description of Artificial Sequence: Synthetic peptide
  Seed: RYEFLWGPRA (MAGA1_HUMAN)
RHEFLWGPRL

SEQ ID NO: 43933 - protein, 9 aa, Artificial Sequence
  Description of Artificial Sequence: Synthetic peptide
  Seed: FPSLREAAL (MAGA1_HUMAN)
FTSLREAAM

SEQ ID NO: 43934 - protein, 9 aa, Artificial Sequence
  Description of Artificial Sequence: Synthetic peptide
  Seed: STDPPQSPQ (MAGA1_HUMAN)
SIDPPQSPM

SEQ ID NO: 43935 - protein, 9 aa, Artificial Sequence
  Description of Artificial Sequence: Synthetic peptide
  Seed: SAYGEPRKL (MAGA1_HUMAN)
SVYGEPRKY

SEQ ID NO: 43936 - protein, 10 aa, Artificial Sequence
  Description of Artificial Sequence: Synthetic peptide
  Seed: VRFFFPSLRE (MAGA1_HUMAN)
VRFFFPSLRF

SEQ ID NO: 43937 - protein, 9 aa, Artificial Sequence
  Description of Artificial Sequence: Synthetic peptide
  Seed: FPTTINFTR (MAGA1_HUMAN)
FLTTINFTK

SEQ ID NO: 43938 - protein, 10 aa, Artificial Sequence
  Description of Artificial Sequence: Synthetic peptide
  Seed: SVIKNYKHCF (MAGA1_HUMAN)
STIKNYKHCW

SEQ ID NO: 43939 - protein, 9 aa, Artificial Sequence
  Description of Artificial Sequence: Synthetic peptide
  Seed: LTQDLVQEK (MAGA1_HUMAN)
LIQDLVQEF

SEQ ID NO: 43940 - protein, 10 aa, Artificial Sequence
  Description of Artificial Sequence: Synthetic peptide
  Seed: RVRFFFPSLR (MAGA1_HUMAN)
RQRFFFPSLM

SEQ ID NO: 43941 - protein, 10 aa, Artificial Sequence
  Description of Artificial Sequence: Synthetic peptide
  Seed: LTQDLVQEKY (MAGA1_HUMAN)
LVQDLVQEKW

SEQ ID NO: 43942 - protein, 9 aa, Artificial Sequence
  Description of Artificial Sequence: Synthetic peptide
  Seed: SSPLVLGTL (MAGA1_HUMAN)
SSPLVLGTI

SEQ ID NO: 43943 - protein, 10 aa, Artificial Sequence
  Description of Artificial Sequence: Synthetic peptide
  Seed: KYRAREPVTK (MAGA1_HUMAN)
KMRAREPVTK

SEQ ID NO: 43944 - protein, 9 aa, Artificial Sequence
  Description of Artificial Sequence: Synthetic peptide
  Seed: KVADLVGFL (MAGA1_HUMAN)
KSADLVGFF

SEQ ID NO: 43945 - protein, 11 aa, Artificial Sequence
  Description of Artificial Sequence: Synthetic peptide
  Seed: KVADLVGFLLL (MAGA1_HUMAN)
KLADLVGFLLV

SEQ ID NO: 43946 - protein, 9 aa, Artificial Sequence
  Description of Artificial Sequence: Synthetic peptide
  Seed: ASESLQLVF (MAGA1_HUMAN)
AQESLQLVM

SEQ ID NO: 43947 - protein, 9 aa, Artificial Sequence
  Description of Artificial Sequence: Synthetic peptide
  Seed: DSDPARYEF (MAGA1_HUMAN)
DSDPARYEY

SEQ ID NO: 43948 - protein, 10 aa, Artificial Sequence
  Description of Artificial Sequence: Synthetic peptide
  Seed: SSSPLVLGTL (MAGA1_HUMAN)
SLSPLVLGTM

SEQ ID NO: 43949 - protein, 9 aa, Artificial Sequence
  Description of Artificial Sequence: Synthetic peptide
  Seed: LVQEKYLEY (MAGA1_HUMAN)
LFQEKYLEL

SEQ ID NO: 43950 - protein, 11 aa, Artificial Sequence
  Description of Artificial Sequence: Synthetic peptide
  Seed: STDPPQSPQGA (MAGA1_HUMAN)
SLDPPQSPQGM

SEQ ID NO: 43951 - protein, 10 aa, Artificial Sequence
  Description of Artificial Sequence: Synthetic peptide
  Seed: CILESLFRAV (MAGA1_HUMAN)
CQLESLFRAA

SEQ ID NO: 43952 - protein, 10 aa, Artificial Sequence
  Description of Artificial Sequence: Synthetic peptide
  Seed: DLVGFLLLKY (MAGA1_HUMAN)
DVVGFLLLKK

SEQ ID NO: 43953 - protein, 9 aa, Artificial Sequence
  Description of Artificial Sequence: Synthetic peptide
  Seed: LKYRAREPV (MAGA1_HUMAN)
LVYRAREPY

SEQ ID NO: 43954 - protein, 9 aa, Artificial Sequence
  Description of Artificial Sequence: Synthetic peptide
  Seed: SARVRFFFP (MAGA1_HUMAN)
SYRVRFFFA

SEQ ID NO: 43955 - protein, 11 aa, Artificial Sequence
  Description of Artificial Sequence: Synthetic peptide
  Seed: RVRFFFPSLRE (MAGA1_HUMAN)
RTRFFFPSLRQ

SEQ ID NO: 43956 - protein, 9 aa, Artificial Sequence
  Description of Artificial Sequence: Synthetic peptide
  Seed: VADLVGFLL (MAGA1_HUMAN)
VWDLVGFLL

SEQ ID NO: 43957 - protein, 9 aa, Artificial Sequence
  Description of Artificial Sequence: Synthetic peptide
  Seed: RQVPDSDPA (MAGA1_HUMAN)
RSVPDSDPY

SEQ ID NO: 43958 - protein, 10 aa, Artificial Sequence
  Description of Artificial Sequence: Synthetic peptide
  Seed: YEFLWGPRAL (MAGA1_HUMAN)
YFFLWGPRAI

SEQ ID NO: 43959 - protein, 10 aa, Artificial Sequence
  Description of Artificial Sequence: Synthetic peptide
  Seed: FFPSLREAAL (MAGA1_HUMAN)
FWPSLREAAM

SEQ ID NO: 43960 - protein, 9 aa, Artificial Sequence
  Description of Artificial Sequence: Synthetic peptide
  Seed: SARVRFFFP (MAGA1_HUMAN)
SSRVRFFFN

SEQ ID NO: 43961 - protein, 10 aa, Artificial Sequence
  Description of Artificial Sequence: Synthetic peptide
  Seed: SARVRFFFPS (MAGA1_HUMAN)
SERVRFFFPM

SEQ ID NO: 43962 - protein, 10 aa, Artificial Sequence
  Description of Artificial Sequence: Synthetic peptide
  Seed: TSYVKVLEYV (MAGA1_HUMAN)
THYVKVLEYI

SEQ ID NO: 43963 - protein, 9 aa, Artificial Sequence
  Description of Artificial Sequence: Synthetic peptide
  Seed: VADLVGFLL (MAGA1_HUMAN)
VSDLVGFLL

SEQ ID NO: 43964 - protein, 10 aa, Artificial Sequence
  Description of Artificial Sequence: Synthetic peptide
  Seed: QVPDSDPARY (MAGA1_HUMAN)
QSPDSDPARR

SEQ ID NO: 43965 - protein, 9 aa, Artificial Sequence
  Description of Artificial Sequence: Synthetic peptide
  Seed: VIKNYKHCF (MAGA1_HUMAN)
VYKNYKHCL

SEQ ID NO: 43966 - protein, 9 aa, Artificial Sequence
  Description of Artificial Sequence: Synthetic peptide
  Seed: TTINFTRQR (MAGA1_HUMAN)
TAINFTRQR

SEQ ID NO: 43967 - protein, 11 aa, Artificial Sequence
  Description of Artificial Sequence: Synthetic peptide
  Seed: RQVPDSDPARY (MAGA1_HUMAN)
RLVPDSDPARF

SEQ ID NO: 43968 - protein, 9 aa, Artificial Sequence
  Description of Artificial Sequence: Synthetic peptide
  Seed: STSCILESL (MAGA1_HUMAN)
SSSCILESR

SEQ ID NO: 43969 - protein, 10 aa, Artificial Sequence
  Description of Artificial Sequence: Synthetic peptide
  Seed: FFPSLREAAL (MAGA1_HUMAN)
FNPSLREAAM

SEQ ID NO: 43970 - protein, 9 aa, Artificial Sequence
  Description of Artificial Sequence: Synthetic peptide
  Seed: VSARVRFFF (MAGA1_HUMAN)
VGARVRFFW

SEQ ID NO: 43971 - protein, 9 aa, Artificial Sequence
  Description of Artificial Sequence: Synthetic peptide
  Seed: RALAETSYV (MAGA1_HUMAN)
RLLAETSYY

SEQ ID NO: 43972 - protein, 11 aa, Artificial Sequence
  Description of Artificial Sequence: Synthetic peptide
  Seed: EVYDGREHSAY (MAGA1_HUMAN)
EAYDGREHSAK

SEQ ID NO: 43973 - protein, 10 aa, Artificial Sequence
  Description of Artificial Sequence: Synthetic peptide
  Seed: ADPTGHSYVL (MAGA1_HUMAN)
ATPTGHSYVL

SEQ ID NO: 43974 - protein, 9 aa, Artificial Sequence
  Description of Artificial Sequence: Synthetic peptide
  Seed: IFGKASESL (MAGA1_HUMAN)
IYGKASESI

SEQ ID NO: 43975 - protein, 9 aa, Artificial Sequence
  Description of Artificial Sequence: Synthetic peptide
  Seed: SLFRAVITK (MAGA1_HUMAN)
SIFRAVITK

SEQ ID NO: 43976 - protein, 10 aa, Artificial Sequence
  Description of Artificial Sequence: Synthetic peptide
  Seed: KNYKHCFPEI (MAGA1_HUMAN)
KTYKHCFPES

SEQ ID NO: 43977 - protein, 9 aa, Artificial Sequence
  Description of Artificial Sequence: Synthetic peptide
  Seed: YKHCFPEIF (MAGA1_HUMAN)
YHHCFPEIV

SEQ ID NO: 43978 - protein, 9 aa, Artificial Sequence
  Description of Artificial Sequence: Synthetic peptide
  Seed: QSPQGASAF (MAGA1_HUMAN)
QIPQGASAL

SEQ ID NO: 43979 - protein, 9 aa, Artificial Sequence
  Description of Artificial Sequence: Synthetic peptide
  Seed: GDNQIMPKT (MAGA1_HUMAN)
GENQIMPKP

SEQ ID NO: 43980 - protein, 9 aa, Artificial Sequence
  Description of Artificial Sequence: Synthetic peptide
  Seed: LEYVIKVSA (MAGA1_HUMAN)
LQYVIKVSV

SEQ ID NO: 43981 - protein, 10 aa, Artificial Sequence
  Description of Artificial Sequence: Synthetic peptide
  Seed: RVRFFFPSLR (MAGA1_HUMAN)
RRRFFFPSLV

SEQ ID NO: 43982 - protein, 9 aa, Artificial Sequence
  Description of Artificial Sequence: Synthetic peptide
  Seed: RALAETSYV (MAGA1_HUMAN)
RQLAETSYK

SEQ ID NO: 43983 - protein, 9 aa, Artificial Sequence
  Description of Artificial Sequence: Synthetic peptide
  Seed: IFGKASESL (MAGA1_HUMAN)
IYGKASESY

SEQ ID NO: 43984 - protein, 9 aa, Artificial Sequence
  Description of Artificial Sequence: Synthetic peptide
  Seed: RALAETSYV (MAGA1_HUMAN)
RILAETSYI

SEQ ID NO: 43985 - protein, 9 aa, Artificial Sequence
  Description of Artificial Sequence: Synthetic peptide
  Seed: KVLEYVIKV (MAGA1_HUMAN)
KELEYVIKI

SEQ ID NO: 43986 - protein, 9 aa, Artificial Sequence
  Description of Artificial Sequence: Synthetic peptide
  Seed: ETSYVKVLE (MAGA1_HUMAN)
ENSYVKVLK

SEQ ID NO: 43987 - protein, 9 aa, Artificial Sequence
  Description of Artificial Sequence: Synthetic peptide
  Seed: RALAETSYV (MAGA1_HUMAN)
RVLAETSYK

SEQ ID NO: 43988 - protein, 11 aa, Artificial Sequence
  Description of Artificial Sequence: Synthetic peptide
  Seed: STDPPQSPQGA (MAGA1_HUMAN)
SADPPQSPQGV

SEQ ID NO: 43989 - protein, 9 aa, Artificial Sequence
  Description of Artificial Sequence: Synthetic peptide
  Seed: FPTTINFTR (MAGA1_HUMAN)
FATTINFTY

SEQ ID NO: 43990 - protein, 9 aa, Artificial Sequence
  Description of Artificial Sequence: Synthetic peptide
  Seed: LESLFRAVI (MAGA1_HUMAN)
LQSLFRAVY

SEQ ID NO: 43991 - protein, 9 aa, Artificial Sequence
  Description of Artificial Sequence: Synthetic peptide
  Seed: VSARVRFFF (MAGA1_HUMAN)
VGARVRFFY

SEQ ID NO: 43992 - protein, 11 aa, Artificial Sequence
  Description of Artificial Sequence: Synthetic peptide
  Seed: RVRFFFPSLRE (MAGA1_HUMAN)
RMRFFFPSLRN

SEQ ID NO: 43993 - protein, 9 aa, Artificial Sequence
  Description of Artificial Sequence: Synthetic peptide
  Seed: RALAETSYV (MAGA1_HUMAN)
RQLAETSYY

SEQ ID NO: 43994 - protein, 10 aa, Artificial Sequence
  Description of Artificial Sequence: Synthetic peptide
  Seed: KVSARVRFFF (MAGA1_HUMAN)
KQSARVRFFW

SEQ ID NO: 43995 - protein, 9 aa, Artificial Sequence
  Description of Artificial Sequence: Synthetic peptide
  Seed: TSYVKVLEY (MAGA1_HUMAN)
TSYVKVLEI

SEQ ID NO: 43996 - protein, 9 aa, Artificial Sequence
  Description of Artificial Sequence: Synthetic peptide
  Seed: YVIKVSARV (MAGA1_HUMAN)
YLIKVSARR

SEQ ID NO: 43997 - protein, 10 aa, Artificial Sequence
  Description of Artificial Sequence: Synthetic peptide
  Seed: STSCILESLF (MAGA1_HUMAN)
SNSCILESLW

SEQ ID NO: 43998 - protein, 10 aa, Artificial Sequence
  Description of Artificial Sequence: Synthetic peptide
  Seed: RVRFFFPSLR (MAGA1_HUMAN)
RMRFFFPSLQ

SEQ ID NO: 43999 - protein, 9 aa, Artificial Sequence
  Description of Artificial Sequence: Synthetic peptide
  Seed: SAFPTTINF (MAGA1_HUMAN)
SNFPTTINK

SEQ ID NO: 44000 - protein, 9 aa, Artificial Sequence
  Description of Artificial Sequence: Synthetic peptide
  Seed: IAMEGGHAP (MAGA1_HUMAN)
IPMEGGHAT

SEQ ID NO: 44001 - protein, 10 aa, Artificial Sequence
  Description of Artificial Sequence: Synthetic peptide
  Seed: KVSARVRFFF (MAGA1_HUMAN)
KPSARVRFFY

SEQ ID NO: 44002 - protein, 9 aa, Artificial Sequence
  Description of Artificial Sequence: Synthetic peptide
  Seed: KYRAREPVT (MAGA1_HUMAN)
KYRAREPVV

SEQ ID NO: 44003 - protein, 11 aa, Artificial Sequence
  Description of Artificial Sequence: Synthetic peptide
  Seed: RVRFFFPSLRE (MAGA1_HUMAN)
RKRFFFPSLRR

SEQ ID NO: 44004 - protein, 9 aa, Artificial Sequence
  Description of Artificial Sequence: Synthetic peptide
  Seed: RVRFFFPSL (MAGA1_HUMAN)
RMRFFFPSG

SEQ ID NO: 44005 - protein, 8 aa, Artificial Sequence
  Description of Artificial Sequence: Synthetic peptide
  Seed: VADLVGFL (MAGA1_HUMAN)
VYDLVGFL

SEQ ID NO: 44006 - protein, 9 aa, Artificial Sequence
  Description of Artificial Sequence: Synthetic peptide
  Seed: KVLEYVIKV (MAGA1_HUMAN)
KTLEYVIKY

SEQ ID NO: 44007 - protein, 10 aa, Artificial Sequence
  Description of Artificial Sequence: Synthetic peptide
  Seed: ADLVGFLLLK (MAGA1_HUMAN)
ARLVGFLLLR

SEQ ID NO: 44008 - protein, 11 aa, Artificial Sequence
  Description of Artificial Sequence: Synthetic peptide
  Seed: YVKVLEYVIKV (MAGA1_HUMAN)
YYKVLEYVIKV

SEQ ID NO: 44009 - protein, 10 aa, Artificial Sequence
  Description of Artificial Sequence: Synthetic peptide
  Seed: KEADPTGHSY (MAGA1_HUMAN)
KAADPTGHSV

SEQ ID NO: 44010 - protein, 9 aa, Artificial Sequence
  Description of Artificial Sequence: Synthetic peptide
  Seed: KVSARVRFF (MAGA1_HUMAN)
KTSARVRFG

SEQ ID NO: 44011 - protein, 9 aa, Artificial Sequence
  Description of Artificial Sequence: Synthetic peptide
  Seed: VADLVGFLL (MAGA1_HUMAN)
VGDLVGFLI

SEQ ID NO: 44012 - protein, 10 aa, Artificial Sequence
  Description of Artificial Sequence: Synthetic peptide
  Seed: GPRALAETSY (MAGA1_HUMAN)
GPRALAETSV

SEQ ID NO: 44013 - protein, 9 aa, Artificial Sequence
  Description of Artificial Sequence: Synthetic peptide
  Seed: RQVPDSDPA (MAGA1_HUMAN)
RQVPDSDPM

SEQ ID NO: 44014 - protein, 9 aa, Artificial Sequence
  Description of Artificial Sequence: Synthetic peptide
  Seed: SAFPTTINF (MAGA1_HUMAN)
SFFPTTINF

SEQ ID NO: 44015 - protein, 11 aa, Artificial Sequence
  Description of Artificial Sequence: Synthetic peptide
  Seed: STDPPQSPQGA (MAGA1_HUMAN)
SGDPPQSPQGL

SEQ ID NO: 44016 - protein, 11 aa, Artificial Sequence
  Description of Artificial Sequence: Synthetic peptide
  Seed: TKKVADLVGFL (MAGA1_HUMAN)
TCKVADLVGFV

SEQ ID NO: 44017 - protein, 10 aa, Artificial Sequence
  Description of Artificial Sequence: Synthetic peptide
  Seed: SARVRFFFPS (MAGA1_HUMAN)
SQRVRFFFPA

SEQ ID NO: 44018 - protein, 10 aa, Artificial Sequence
  Description of Artificial Sequence: Synthetic peptide
  Seed: VKVLEYVIKV (MAGA1_HUMAN)
VLVLEYVIKA

SEQ ID NO: 44019 - protein, 9 aa, Artificial Sequence
  Description of Artificial Sequence: Synthetic peptide
  Seed: SARVRFFFP (MAGA1_HUMAN)
SCRVRFFFK

SEQ ID NO: 44020 - protein, 11 aa, Artificial Sequence
  Description of Artificial Sequence: Synthetic peptide
  Seed: RVRFFFPSLRE (MAGA1_HUMAN)
RFRFFFPSLRF

SEQ ID NO: 44021 - protein, 10 aa, Artificial Sequence
  Description of Artificial Sequence: Synthetic peptide
  Seed: FPSLREAALR (MAGA1_HUMAN)
FTSLREAALR

SEQ ID NO: 44022 - protein, 11 aa, Artificial Sequence
  Description of Artificial Sequence: Synthetic peptide
  Seed: RVRFFFPSLRE (MAGA1_HUMAN)
RLRFFFPSLRR

SEQ ID NO: 44023 - protein, 9 aa, Artificial Sequence
  Description of Artificial Sequence: Synthetic peptide
  Seed: SYVKVLEYV (MAGA1_HUMAN)
STVKVLEYI

SEQ ID NO: 44024 - protein, 9 aa, Artificial Sequence
  Description of Artificial Sequence: Synthetic peptide
  Seed: VQAATSSSS (MAGA1_HUMAN)
VGAATSSSF

SEQ ID NO: 44025 - protein, 9 aa, Artificial Sequence
  Description of Artificial Sequence: Synthetic peptide
  Seed: QIMPKTGFL (MAGA1_HUMAN)
QTMPKTGFR

SEQ ID NO: 44026 - protein, 9 aa, Artificial Sequence
  Description of Artificial Sequence: Synthetic peptide
  Seed: LEYVIKVSA (MAGA1_HUMAN)
LHYVIKVSV

SEQ ID NO: 44027 - protein, 9 aa, Artificial Sequence
  Description of Artificial Sequence: Synthetic peptide
  Seed: DSDPARYEF (MAGA1_HUMAN)
DFDPARYEV

SEQ ID NO: 44028 - protein, 9 aa, Artificial Sequence
  Description of Artificial Sequence: Synthetic peptide
  Seed: GASAFPTTI (MAGA1_HUMAN)
GLSAFPTTY

SEQ ID NO: 44029 - protein, 9 aa, Artificial Sequence
  Description of Artificial Sequence: Synthetic peptide
  Seed: STSCILESL (MAGA1_HUMAN)
SMSCILESF

SEQ ID NO: 44030 - protein, 9 aa, Artificial Sequence
  Description of Artificial Sequence: Synthetic peptide
  Seed: DPTGHSYVL (MAGA1_HUMAN)
DATGHSYVV

SEQ ID NO: 44031 - protein, 10 aa, Artificial Sequence
  Description of Artificial Sequence: Synthetic peptide
  Seed: KVADLVGFLL (MAGA1_HUMAN)
KAADLVGFLM

SEQ ID NO: 44032 - protein, 9 aa, Artificial Sequence
  Description of Artificial Sequence: Synthetic peptide
  Seed: LVLGTLEEV (MAGA1_HUMAN)
LMLGTLEEM

SEQ ID NO: 44033 - protein, 9 aa, Artificial Sequence
  Description of Artificial Sequence: Synthetic peptide
  Seed: LKYRAREPV (MAGA1_HUMAN)
LYYRAREPF

SEQ ID NO: 44034 - protein, 10 aa, Artificial Sequence
  Description of Artificial Sequence: Synthetic peptide
  Seed: DLVQEKYLEY (MAGA1_HUMAN)
DVVQEKYLEF

SEQ ID NO: 44035 - protein, 9 aa, Artificial Sequence
  Description of Artificial Sequence: Synthetic peptide
  Seed: YVLVTCLGL (MAGA1_HUMAN)
YQLVTCLGF

SEQ ID NO: 44036 - protein, 10 aa, Artificial Sequence
  Description of Artificial Sequence: Synthetic peptide
  Seed: SARVRFFFPS (MAGA1_HUMAN)
SWRVRFFFPF

SEQ ID NO: 44037 - protein, 10 aa, Artificial Sequence
  Description of Artificial Sequence: Synthetic peptide
  Seed: YEFLWGPRAL (MAGA1_HUMAN)
YDFLWGPRAF

SEQ ID NO: 44038 - protein, 10 aa, Artificial Sequence
  Description of Artificial Sequence: Synthetic peptide
  Seed: ARVRFFFPSL (MAGA1_HUMAN)
ARVRFFFPSY

SEQ ID NO: 44039 - protein, 10 aa, Artificial Sequence
  Description of Artificial Sequence: Synthetic peptide
  Seed: KEADPTGHSY (MAGA1_HUMAN)
KEADPTGHSM

SEQ ID NO: 44040 - protein, 11 aa, Artificial Sequence
  Description of Artificial Sequence: Synthetic peptide
  Seed: KVADLVGFLLL (MAGA1_HUMAN)
KLADLVGFLLS

SEQ ID NO: 44041 - protein, 9 aa, Artificial Sequence
  Description of Artificial Sequence: Synthetic peptide
  Seed: KVSARVRFF (MAGA1_HUMAN)
KASARVRFV

SEQ ID NO: 44042 - protein, 10 aa, Artificial Sequence
  Description of Artificial Sequence: Synthetic peptide
  Seed: SAFPTTINFT (MAGA1_HUMAN)
SVFPTTINFA

SEQ ID NO: 44043 - protein, 10 aa, Artificial Sequence
  Description of Artificial Sequence: Synthetic peptide
  Seed: ALGLVCVQAA (MAGA1_HUMAN)
ALGLVCVQAV

SEQ ID NO: 44044 - protein, 9 aa, Artificial Sequence
  Description of Artificial Sequence: Synthetic peptide
  Seed: LFRAVITKK (MAGA1_HUMAN)
LARAVITKR

SEQ ID NO: 44045 - protein, 9 aa, Artificial Sequence
  Description of Artificial Sequence: Synthetic peptide
  Seed: EADPTGHSY (MAGA1_HUMAN)
EVDPTGHSK

SEQ ID NO: 44046 - protein, 9 aa, Artificial Sequence
  Description of Artificial Sequence: Synthetic peptide
  Seed: SARVRFFFP (MAGA1_HUMAN)
SQRVRFFFL

SEQ ID NO: 44047 - protein, 10 aa, Artificial Sequence
  Description of Artificial Sequence: Synthetic peptide
  Seed: EVYDGREHSA (MAGA1_HUMAN)
EVYDGREHSV

SEQ ID NO: 44048 - protein, 10 aa, Artificial Sequence
  Description of Artificial Sequence: Synthetic peptide
  Seed: YEFLWGPRAL (MAGA1_HUMAN)
YKFLWGPRAY

SEQ ID NO: 44049 - protein, 9 aa, Artificial Sequence
  Description of Artificial Sequence: Synthetic peptide
  Seed: YVIKVSARV (MAGA1_HUMAN)
YMIKVSARV

SEQ ID NO: 44050 - protein, 9 aa, Artificial Sequence
  Description of Artificial Sequence: Synthetic peptide
  Seed: FLWGPRALA (MAGA1_HUMAN)
FIWGPRALM

SEQ ID NO: 44051 - protein, 9 aa, Artificial Sequence
  Description of Artificial Sequence: Synthetic peptide
  Seed: EADPTGHSY (MAGA1_HUMAN)
EEDPTGHSF

SEQ ID NO: 44052 - protein, 10 aa, Artificial Sequence
  Description of Artificial Sequence: Synthetic peptide
  Seed: ARYEFLWGPR (MAGA1_HUMAN)
AVYEFLWGPK

SEQ ID NO: 44053 - protein, 10 aa, Artificial Sequence
  Description of Artificial Sequence: Synthetic peptide
  Seed: RVRFFFPSLR (MAGA1_HUMAN)
RWRFFFPSLA

SEQ ID NO: 44054 - protein, 9 aa, Artificial Sequence
  Description of Artificial Sequence: Synthetic peptide
  Seed: RVRFFFPSL (MAGA1_HUMAN)
RYRFFFPSQ

SEQ ID NO: 44055 - protein, 9 aa, Artificial Sequence
  Description of Artificial Sequence: Synthetic peptide
  Seed: RALAETSYV (MAGA1_HUMAN)
RSLAETSYY

SEQ ID NO: 44056 - protein, 9 aa, Artificial Sequence
  Description of Artificial Sequence: Synthetic peptide
  Seed: ESLQLVFGI (MAGA1_HUMAN)
EILQLVFGI

SEQ ID NO: 44057 - protein, 9 aa, Artificial Sequence
  Description of Artificial Sequence: Synthetic peptide
  Seed: EADPTGHSY (MAGA1_HUMAN)
ESDPTGHSW

SEQ ID NO: 44058 - protein, 11 aa, Artificial Sequence
  Description of Artificial Sequence: Synthetic peptide
  Seed: KVLEYVIKVSA (MAGA1_HUMAN)
KILEYVIKVSV

SEQ ID NO: 44059 - protein, 10 aa, Artificial Sequence
  Description of Artificial Sequence: Synthetic peptide
  Seed: KEADPTGHSY (MAGA1_HUMAN)
KYADPTGHSM

SEQ ID NO: 44060 - protein, 9 aa, Artificial Sequence
  Description of Artificial Sequence: Synthetic peptide
  Seed: ALREEEEGV (MAGA1_HUMAN)
AQREEEEGW

SEQ ID NO: 44061 - protein, 9 aa, Artificial Sequence
  Description of Artificial Sequence: Synthetic peptide
  Seed: RQRQPSEGS (MAGA1_HUMAN)
RSRQPSEGL

SEQ ID NO: 44062 - protein, 9 aa, Artificial Sequence
  Description of Artificial Sequence: Synthetic peptide
  Seed: EIWEELSVM (MAGA1_HUMAN)
EIWEELSVW

SEQ ID NO: 44063 - protein, 9 aa, Artificial Sequence
  Description of Artificial Sequence: Synthetic peptide
  Seed: ATSSSSPLV (MAGA1_HUMAN)
AASSSSPLF

SEQ ID NO: 44064 - protein, 9 aa, Artificial Sequence
  Description of Artificial Sequence: Synthetic peptide
  Seed: FFFPSLREA (MAGA1_HUMAN)
FSFPSLREY

SEQ ID NO: 44065 - protein, 10 aa, Artificial Sequence
  Description of Artificial Sequence: Synthetic peptide
  Seed: KVSARVRFFF (MAGA1_HUMAN)
KRSARVRFFY

SEQ ID NO: 44066 - protein, 9 aa, Artificial Sequence
  Description of Artificial Sequence: Synthetic peptide
  Seed: EADPTGHSY (MAGA1_HUMAN)
EIDPTGHSR

SEQ ID NO: 44067 - protein, 9 aa, Artificial Sequence
  Description of Artificial Sequence: Synthetic peptide
  Seed: ESLQLVFGI (MAGA1_HUMAN)
ETLQLVFGV

SEQ ID NO: 44068 - protein, 10 aa, Artificial Sequence
  Description of Artificial Sequence: Synthetic peptide
  Seed: KEADPTGHSY (MAGA1_HUMAN)
KHADPTGHSM

SEQ ID NO: 44069 - protein, 9 aa, Artificial Sequence
  Description of Artificial Sequence: Synthetic peptide
  Seed: SYVKVLEYV (MAGA1_HUMAN)
SAVKVLEYA

SEQ ID NO: 44070 - protein, 9 aa, Artificial Sequence
  Description of Artificial Sequence: Synthetic peptide
  Seed: TSSSSPLVL (MAGA1_HUMAN)
TESSSPLVF

SEQ ID NO: 44071 - protein, 9 aa, Artificial Sequence
  Description of Artificial Sequence: Synthetic peptide
  Seed: KVSARVRFF (MAGA1_HUMAN)
KGSARVRFK

SEQ ID NO: 44072 - protein, 9 aa, Artificial Sequence
  Description of Artificial Sequence: Synthetic peptide
  Seed: VPDSDPARY (MAGA1_HUMAN)
VSDSDPARY

SEQ ID NO: 44073 - protein, 9 aa, Artificial Sequence
  Description of Artificial Sequence: Synthetic peptide
  Seed: QSPQGASAF (MAGA1_HUMAN)
QYPQGASAM

SEQ ID NO: 44074 - protein, 11 aa, Artificial Sequence
  Description of Artificial Sequence: Synthetic peptide
  Seed: IKNYKHCFPEI (MAGA1_HUMAN)
IYNYKHCFPEF

SEQ ID NO: 44075 - protein, 10 aa, Artificial Sequence
  Description of Artificial Sequence: Synthetic peptide
  Seed: ARVRFFFPSL (MAGA1_HUMAN)
ATVRFFFPSM

SEQ ID NO: 44076 - protein, 9 aa, Artificial Sequence
  Description of Artificial Sequence: Synthetic peptide
  Seed: QPSEGSSSR (MAGA1_HUMAN)
QTSEGSSSR

SEQ ID NO: 44077 - protein, 9 aa, Artificial Sequence
  Description of Artificial Sequence: Synthetic peptide
  Seed: SSPLVLGTL (MAGA1_HUMAN)
SVPLVLGTR

SEQ ID NO: 44078 - protein, 10 aa, Artificial Sequence
  Description of Artificial Sequence: Synthetic peptide
  Seed: DLVGFLLLKY (MAGA1_HUMAN)
DVVGFLLLKY

SEQ ID NO: 44079 - protein, 11 aa, Artificial Sequence
  Description of Artificial Sequence: Synthetic peptide
  Seed: KVLEYVIKVSA (MAGA1_HUMAN)
KLLEYVIKVSL

SEQ ID NO: 44080 - protein, 8 aa, Artificial Sequence
  Description of Artificial Sequence: Synthetic peptide
  Seed: FLWGPRAL (MAGA1_HUMAN)
FYWGPRAI

SEQ ID NO: 44081 - protein, 9 aa, Artificial Sequence
  Description of Artificial Sequence: Synthetic peptide
  Seed: KYRAREPVT (MAGA1_HUMAN)
KMRAREPVA

SEQ ID NO: 44082 - protein, 9 aa, Artificial Sequence
  Description of Artificial Sequence: Synthetic peptide
  Seed: ESLQLVFGI (MAGA1_HUMAN)
EILQLVFGL

SEQ ID NO: 44083 - protein, 10 aa, Artificial Sequence
  Description of Artificial Sequence: Synthetic peptide
  Seed: SARVRFFFPS (MAGA1_HUMAN)
SDRVRFFFPL

SEQ ID NO: 44084 - protein, 9 aa, Artificial Sequence
  Description of Artificial Sequence: Synthetic peptide
  Seed: SARVRFFFP (MAGA1_HUMAN)
SVRVRFFFY

SEQ ID NO: 44085 - protein, 9 aa, Artificial Sequence
  Description of Artificial Sequence: Synthetic peptide
  Seed: TSYVKVLEY (MAGA1_HUMAN)
TLYVKVLER

SEQ ID NO: 44086 - protein, 9 aa, Artificial Sequence
  Description of Artificial Sequence: Synthetic peptide
  Seed: GLVCVQAAT (MAGA1_HUMAN)
GLVCVQAAM

SEQ ID NO: 44087 - protein, 9 aa, Artificial Sequence
  Description of Artificial Sequence: Synthetic peptide
  Seed: LVTCLGLSY (MAGA1_HUMAN)
LHTCLGLSY

SEQ ID NO: 44088 - protein, 9 aa, Artificial Sequence
  Description of Artificial Sequence: Synthetic peptide
  Seed: TSYVKVLEY (MAGA1_HUMAN)
TFYVKVLEL

SEQ ID NO: 44089 - protein, 10 aa, Artificial Sequence
  Description of Artificial Sequence: Synthetic peptide
  Seed: ALAETSYVKV (MAGA1_HUMAN)
AMAETSYVKI

SEQ ID NO: 44090 - protein, 10 aa, Artificial Sequence
  Description of Artificial Sequence: Synthetic peptide
  Seed: ADLVGFLLLK (MAGA1_HUMAN)
AYLVGFLLLR

SEQ ID NO: 44091 - protein, 10 aa, Artificial Sequence
  Description of Artificial Sequence: Synthetic peptide
  Seed: VTKAEMLESV (MAGA1_HUMAN)
VVKAEMLESV

SEQ ID NO: 44092 - protein, 11 aa, Artificial Sequence
  Description of Artificial Sequence: Synthetic peptide
  Seed: FPTTINFTRQR (MAGA1_HUMAN)
FTTTINFTRQK

SEQ ID NO: 44093 - protein, 9 aa, Artificial Sequence
  Description of Artificial Sequence: Synthetic peptide
  Seed: LKYRAREPV (MAGA1_HUMAN)
LKYRAREPL

SEQ ID NO: 44094 - protein, 9 aa, Artificial Sequence
  Description of Artificial Sequence: Synthetic peptide
  Seed: VGFLLLKYR (MAGA1_HUMAN)
VIFLLLKYR

SEQ ID NO: 44095 - protein, 10 aa, Artificial Sequence
  Description of Artificial Sequence: Synthetic peptide
  Seed: SARVRFFFPS (MAGA1_HUMAN)
SRRVRFFFPL

SEQ ID NO: 44096 - protein, 10 aa, Artificial Sequence
  Description of Artificial Sequence: Synthetic peptide
  Seed: ASAFPTTINF (MAGA1_HUMAN)
AIAFPTTINW

SEQ ID NO: 44097 - protein, 11 aa, Artificial Sequence
  Description of Artificial Sequence: Synthetic peptide
  Seed: SPLVLGTLEEV (MAGA1_HUMAN)
SFLVLGTLEEV

SEQ ID NO: 44098 - protein, 9 aa, Artificial Sequence
  Description of Artificial Sequence: Synthetic peptide
  Seed: RQVPDSDPA (MAGA1_HUMAN)
RAVPDSDPF

SEQ ID NO: 44099 - protein, 8 aa, Artificial Sequence
  Description of Artificial Sequence: Synthetic peptide
  Seed: ASAFPTTI (MAGA1_HUMAN)
AAAFPTTF

SEQ ID NO: 44100 - protein, 9 aa, Artificial Sequence
  Description of Artificial Sequence: Synthetic peptide
  Seed: RVRFFFPSL (MAGA1_HUMAN)
RARFFFPSM

SEQ ID NO: 44101 - protein, 9 aa, Artificial Sequence
  Description of Artificial Sequence: Synthetic peptide
  Seed: EALEAQQEA (MAGA1_HUMAN)
ETLEAQQEL

SEQ ID NO: 44102 - protein, 9 aa, Artificial Sequence
  Description of Artificial Sequence: Synthetic peptide
  Seed: SLFRAVITK (MAGA1_HUMAN)
SYFRAVITK

SEQ ID NO: 44103 - protein, 9 aa, Artificial Sequence
  Description of Artificial Sequence: Synthetic peptide
  Seed: KASESLQLV (MAGA1_HUMAN)
KMSESLQLC

SEQ ID NO: 44104 - protein, 10 aa, Artificial Sequence
  Description of Artificial Sequence: Synthetic peptide
  Seed: KVSARVRFFF (MAGA1_HUMAN)
KESARVRFFY

SEQ ID NO: 44105 - protein, 9 aa, Artificial Sequence
  Description of Artificial Sequence: Synthetic peptide
  Seed: ITKKVADLV (MAGA1_HUMAN)
IIKKVADLW

SEQ ID NO: 44106 - protein, 9 aa, Artificial Sequence
  Description of Artificial Sequence: Synthetic peptide
  Seed: FPSLREAAL (MAGA1_HUMAN)
FPSLREAAI

SEQ ID NO: 44107 - protein, 10 aa, Artificial Sequence
  Description of Artificial Sequence: Synthetic peptide
  Seed: FFPSLREAAL (MAGA1_HUMAN)
FQPSLREAAM

SEQ ID NO: 44108 - protein, 9 aa, Artificial Sequence
  Description of Artificial Sequence: Synthetic peptide
  Seed: FFFPSLREA (MAGA1_HUMAN)
FRFPSLREV

SEQ ID NO: 44109 - protein, 9 aa, Artificial Sequence
  Description of Artificial Sequence: Synthetic peptide
  Seed: KVLEYVIKV (MAGA1_HUMAN)
KRLEYVIKF

SEQ ID NO: 44110 - protein, 10 aa, Artificial Sequence
  Description of Artificial Sequence: Synthetic peptide
  Seed: ARVRFFFPSL (MAGA1_HUMAN)
ALVRFFFPSI

SEQ ID NO: 44111 - protein, 9 aa, Artificial Sequence
  Description of Artificial Sequence: Synthetic peptide
  Seed: KASESLQLV (MAGA1_HUMAN)
KTSESLQLF

SEQ ID NO: 44112 - protein, 9 aa, Artificial Sequence
  Description of Artificial Sequence: Synthetic peptide
  Seed: YVLVTCLGL (MAGA1_HUMAN)
YMLVTCLGI

SEQ ID NO: 44113 - protein, 9 aa, Artificial Sequence
  Description of Artificial Sequence: Synthetic peptide
  Seed: LHCKPEEAL (MAGA1_HUMAN)
LHCKPEEAI

SEQ ID NO: 44114 - protein, 9 aa, Artificial Sequence
  Description of Artificial Sequence: Synthetic peptide
  Seed: RAREPVTKA (MAGA1_HUMAN)
RYREPVTKM

SEQ ID NO: 44115 - protein, 9 aa, Artificial Sequence
  Description of Artificial Sequence: Synthetic peptide
  Seed: LGDNQIMPK (MAGA1_HUMAN)
LTDNQIMPK

SEQ ID NO: 44116 - protein, 11 aa, Artificial Sequence
  Description of Artificial Sequence: Synthetic peptide
  Seed: VQAATSSSSPL (MAGA1_HUMAN)
VMAATSSSSPY

SEQ ID NO: 44117 - protein, 9 aa, Artificial Sequence
  Description of Artificial Sequence: Synthetic peptide
  Seed: QSPQGASAF (MAGA1_HUMAN)
QTPQGASAM

SEQ ID NO: 44118 - protein, 9 aa, Artificial Sequence
  Description of Artificial Sequence: Synthetic peptide
  Seed: QIMPKTGFL (MAGA1_HUMAN)
QLMPKTGFY

SEQ ID NO: 44119 - protein, 10 aa, Artificial Sequence
  Description of Artificial Sequence: Synthetic peptide
  Seed: RVRFFFPSLR (MAGA1_HUMAN)
RFRFFFPSLG

SEQ ID NO: 44120 - protein, 9 aa, Artificial Sequence
  Description of Artificial Sequence: Synthetic peptide
  Seed: RAREPVTKA (MAGA1_HUMAN)
RTREPVTKC

SEQ ID NO: 44121 - protein, 10 aa, Artificial Sequence
  Description of Artificial Sequence: Synthetic peptide
  Seed: RVRFFFPSLR (MAGA1_HUMAN)
RTRFFFPSLE

SEQ ID NO: 44122 - protein, 9 aa, Artificial Sequence
  Description of Artificial Sequence: Synthetic peptide
  Seed: KVSARVRFF (MAGA1_HUMAN)
KISARVRFF

SEQ ID NO: 44123 - protein, 9 aa, Artificial Sequence
  Description of Artificial Sequence: Synthetic peptide
  Seed: TSYVKVLEY (MAGA1_HUMAN)
TIYVKVLEY

SEQ ID NO: 44124 - protein, 10 aa, Artificial Sequence
  Description of Artificial Sequence: Synthetic peptide
  Seed: ATSSSSPLVL (MAGA1_HUMAN)
AMSSSSPLVV

SEQ ID NO: 44125 - protein, 9 aa, Artificial Sequence
  Description of Artificial Sequence: Synthetic peptide
  Seed: SAYGEPRKL (MAGA1_HUMAN)
SIYGEPRKY

SEQ ID NO: 44126 - protein, 9 aa, Artificial Sequence
  Description of Artificial Sequence: Synthetic peptide
  Seed: SSPLVLGTL (MAGA1_HUMAN)
STPLVLGTM

SEQ ID NO: 44127 - protein, 9 aa, Artificial Sequence
  Description of Artificial Sequence: Synthetic peptide
  Seed: TSSSSPLVL (MAGA1_HUMAN)
TASSSPLVF

SEQ ID NO: 44128 - protein, 11 aa, Artificial Sequence
  Description of Artificial Sequence: Synthetic peptide
  Seed: KEADPTGHSYV (MAGA1_HUMAN)
KMADPTGHSYW

SEQ ID NO: 44129 - protein, 9 aa, Artificial Sequence
  Description of Artificial Sequence: Synthetic peptide
  Seed: STSCILESL (MAGA1_HUMAN)
SYSCILESY

SEQ ID NO: 44130 - protein, 9 aa, Artificial Sequence
  Description of Artificial Sequence: Synthetic peptide
  Seed: SAFPTTINF (MAGA1_HUMAN)
SGFPTTINY

SEQ ID NO: 44131 - protein, 10 aa, Artificial Sequence
  Description of Artificial Sequence: Synthetic peptide
  Seed: EVYDGREHSA (MAGA1_HUMAN)
EVYDGREHSF

SEQ ID NO: 44132 - protein, 9 aa, Artificial Sequence
  Description of Artificial Sequence: Synthetic peptide
  Seed: TSYVKVLEY (MAGA1_HUMAN)
TFYVKVLEY

SEQ ID NO: 44133 - protein, 9 aa, Artificial Sequence
  Description of Artificial Sequence: Synthetic peptide
  Seed: GASAFPTTI (MAGA1_HUMAN)
GVSAFPTTY

SEQ ID NO: 44134 - protein, 10 aa, Artificial Sequence
  Description of Artificial Sequence: Synthetic peptide
  Seed: KVLEYVIKVS (MAGA1_HUMAN)
KLLEYVIKVC

SEQ ID NO: 44135 - protein, 9 aa, Artificial Sequence
  Description of Artificial Sequence: Synthetic peptide
  Seed: EADPTGHSY (MAGA1_HUMAN)
EYDPTGHSV

SEQ ID NO: 44136 - protein, 11 aa, Artificial Sequence
  Description of Artificial Sequence: Synthetic peptide
  Seed: EVYDGREHSAY (MAGA1_HUMAN)
ETYDGREHSAF

SEQ ID NO: 44137 - protein, 9 aa, Artificial Sequence
  Description of Artificial Sequence: Synthetic peptide
  Seed: GTLEEVPTA (MAGA1_HUMAN)
GLLEEVPTM

SEQ ID NO: 44138 - protein, 10 aa, Artificial Sequence
  Description of Artificial Sequence: Synthetic peptide
  Seed: RVRFFFPSLR (MAGA1_HUMAN)
RFRFFFPSLP

SEQ ID NO: 44139 - protein, 9 aa, Artificial Sequence
  Description of Artificial Sequence: Synthetic peptide
  Seed: IAMEGGHAP (MAGA1_HUMAN)
IFMEGGHAY

SEQ ID NO: 44140 - protein, 11 aa, Artificial Sequence
  Description of Artificial Sequence: Synthetic peptide
  Seed: SPQGASAFPTT (MAGA1_HUMAN)
SPQGASAFPTA

SEQ ID NO: 44141 - protein, 9 aa, Artificial Sequence
  Description of Artificial Sequence: Synthetic peptide
  Seed: KASESLQLV (MAGA1_HUMAN)
KLSESLQLA

SEQ ID NO: 44142 - protein, 9 aa, Artificial Sequence
  Description of Artificial Sequence: Synthetic peptide
  Seed: KYRAREPVT (MAGA1_HUMAN)
KARAREPVA

SEQ ID NO: 44143 - protein, 9 aa, Artificial Sequence
  Description of Artificial Sequence: Synthetic peptide
  Seed: LVGFLLLKY (MAGA1_HUMAN)
LAGFLLLKY

SEQ ID NO: 44144 - protein, 9 aa, Artificial Sequence
  Description of Artificial Sequence: Synthetic peptide
  Seed: SAYGEPRKL (MAGA1_HUMAN)
SPYGEPRKI

SEQ ID NO: 44145 - protein, 10 aa, Artificial Sequence
  Description of Artificial Sequence: Synthetic peptide
  Seed: KASESLQLVF (MAGA1_HUMAN)
KFSESLQLVW

SEQ ID NO: 44146 - protein, 10 aa, Artificial Sequence
  Description of Artificial Sequence: Synthetic peptide
  Seed: FFPSLREAAL (MAGA1_HUMAN)
FNPSLREAAL

SEQ ID NO: 44147 - protein, 9 aa, Artificial Sequence
  Description of Artificial Sequence: Synthetic peptide
  Seed: KASESLQLV (MAGA1_HUMAN)
KASESLQLR

SEQ ID NO: 44148 - protein, 10 aa, Artificial Sequence
  Description of Artificial Sequence: Synthetic peptide
  Seed: ESLFRAVITK (MAGA1_HUMAN)
EVLFRAVITK

SEQ ID NO: 44149 - protein, 10 aa, Artificial Sequence
  Description of Artificial Sequence: Synthetic peptide
  Seed: SARVRFFFPS (MAGA1_HUMAN)
SPRVRFFFPK

SEQ ID NO: 44150 - protein, 10 aa, Artificial Sequence
  Description of Artificial Sequence: Synthetic peptide
  Seed: EMLESVIKNY (MAGA1_HUMAN)
EALESVIKNY

SEQ ID NO: 44151 - protein, 9 aa, Artificial Sequence
  Description of Artificial Sequence: Synthetic peptide
  Seed: ATSSSSPLV (MAGA1_HUMAN)
ASSSSSPLK

SEQ ID NO: 44152 - protein, 9 aa, Artificial Sequence
  Description of Artificial Sequence: Synthetic peptide
  Seed: FLWGPRALA (MAGA1_HUMAN)
FVWGPRALV

SEQ ID NO: 44153 - protein, 9 aa, Artificial Sequence
  Description of Artificial Sequence: Synthetic peptide
  Seed: SCILESLFR (MAGA1_HUMAN)
STILESLFK

SEQ ID NO: 44154 - protein, 9 aa, Artificial Sequence
  Description of Artificial Sequence: Synthetic peptide
  Seed: KASESLQLV (MAGA1_HUMAN)
KTSESLQLI

SEQ ID NO: 44155 - protein, 9 aa, Artificial Sequence
  Description of Artificial Sequence: Synthetic peptide
  Seed: RVRFFFPSL (MAGA1_HUMAN)
RVRFFFPSA

SEQ ID NO: 44156 - protein, 10 aa, Artificial Sequence
  Description of Artificial Sequence: Synthetic peptide
  Seed: KEADPTGHSY (MAGA1_HUMAN)
KFADPTGHSF

SEQ ID NO: 44157 - protein, 10 aa, Artificial Sequence
  Description of Artificial Sequence: Synthetic peptide
  Seed: RVRFFFPSLR (MAGA1_HUMAN)
RHRFFFPSLF

SEQ ID NO: 44158 - protein, 9 aa, Artificial Sequence
  Description of Artificial Sequence: Synthetic peptide
  Seed: RVRFFFPSL (MAGA1_HUMAN)
RSRFFFPSC

SEQ ID NO: 44159 - protein, 9 aa, Artificial Sequence
  Description of Artificial Sequence: Synthetic peptide
  Seed: KVADLVGFL (MAGA1_HUMAN)
KTADLVGFV

SEQ ID NO: 44160 - protein, 11 aa, Artificial Sequence
  Description of Artificial Sequence: Synthetic peptide
  Seed: AETSYVKVLEY (MAGA1_HUMAN)
AETSYVKVLEW

SEQ ID NO: 44161 - protein, 9 aa, Artificial Sequence
  Description of Artificial Sequence: Synthetic peptide
  Seed: DLVGFLLLK (MAGA1_HUMAN)
DVVGFLLLK

SEQ ID NO: 44162 - protein, 9 aa, Artificial Sequence
  Description of Artificial Sequence: Synthetic peptide
  Seed: EADPTGHSY (MAGA1_HUMAN)
EGDPTGHSI

SEQ ID NO: 44163 - protein, 9 aa, Artificial Sequence
  Description of Artificial Sequence: Synthetic peptide
  Seed: YKHCFPEIF (MAGA1_HUMAN)
YQHCFPEIF

SEQ ID NO: 44164 - protein, 9 aa, Artificial Sequence
  Description of Artificial Sequence: Synthetic peptide
  Seed: KYRAREPVT (MAGA1_HUMAN)
KSRAREPVI

SEQ ID NO: 44165 - protein, 9 aa, Artificial Sequence
  Description of Artificial Sequence: Synthetic peptide
  Seed: KYRAREPVT (MAGA1_HUMAN)
KTRAREPVS

SEQ ID NO: 44166 - protein, 9 aa, Artificial Sequence
  Description of Artificial Sequence: Synthetic peptide
  Seed: RAREPVTKA (MAGA1_HUMAN)
RSREPVTKA

SEQ ID NO: 44167 - protein, 9 aa, Artificial Sequence
  Description of Artificial Sequence: Synthetic peptide
  Seed: SAYGEPRKL (MAGA1_HUMAN)
SSYGEPRKL

SEQ ID NO: 44168 - protein, 10 aa, Artificial Sequence
  Description of Artificial Sequence: Synthetic peptide
  Seed: FFFPSLREAA (MAGA1_HUMAN)
FYFPSLREAF

SEQ ID NO: 44169 - protein, 9 aa, Artificial Sequence
  Description of Artificial Sequence: Synthetic peptide
  Seed: HCFPEIFGK (MAGA1_HUMAN)
HSFPEIFGF

SEQ ID NO: 44170 - protein, 9 aa, Artificial Sequence
  Description of Artificial Sequence: Synthetic peptide
  Seed: TSYVKVLEY (MAGA1_HUMAN)
TAYVKVLEA

SEQ ID NO: 44171 - protein, 10 aa, Artificial Sequence
  Description of Artificial Sequence: Synthetic peptide
  Seed: RQVPDSDPAR (MAGA1_HUMAN)
RMVPDSDPAR

SEQ ID NO: 44172 - protein, 9 aa, Artificial Sequence
  Description of Artificial Sequence: Synthetic peptide
  Seed: NQIMPKTGF (MAGA1_HUMAN)
NHIMPKTGF

SEQ ID NO: 44173 - protein, 9 aa, Artificial Sequence
  Description of Artificial Sequence: Synthetic peptide
  Seed: IAMEGGHAP (MAGA1_HUMAN)
IPMEGGHAI

SEQ ID NO: 44174 - protein, 9 aa, Artificial Sequence
  Description of Artificial Sequence: Synthetic peptide
  Seed: RQRQPSEGS (MAGA1_HUMAN)
RTRQPSEGR

SEQ ID NO: 44175 - protein, 9 aa, Artificial Sequence
  Description of Artificial Sequence: Synthetic peptide
  Seed: VSARVRFFF (MAGA1_HUMAN)
VTARVRFFM

SEQ ID NO: 44176 - protein, 9 aa, Artificial Sequence
  Description of Artificial Sequence: Synthetic peptide
  Seed: GTLEEVPTA (MAGA1_HUMAN)
GALEEVPTL

SEQ ID NO: 44177 - protein, 8 aa, Artificial Sequence
  Description of Artificial Sequence: Synthetic peptide
  Seed: SARVRFFF (MAGA1_HUMAN)
SLRVRFFM

SEQ ID NO: 44178 - protein, 9 aa, Artificial Sequence
  Description of Artificial Sequence: Synthetic peptide
  Seed: QIMPKTGFL (MAGA1_HUMAN)
QVMPKTGFV

SEQ ID NO: 44179 - protein, 9 aa, Artificial Sequence
  Description of Artificial Sequence: Synthetic peptide
  Seed: VYDGREHSA (MAGA1_HUMAN)
VFDGREHSF

SEQ ID NO: 44180 - protein, 10 aa, Artificial Sequence
  Description of Artificial Sequence: Synthetic peptide
  Seed: MLESVIKNYK (MAGA1_HUMAN)
MTESVIKNYR

SEQ ID NO: 44181 - protein, 10 aa, Artificial Sequence
  Description of Artificial Sequence: Synthetic peptide
  Seed: YEFLWGPRAL (MAGA1_HUMAN)
YAFLWGPRAF

SEQ ID NO: 44182 - protein, 10 aa, Artificial Sequence
  Description of Artificial Sequence: Synthetic peptide
  Seed: KEADPTGHSY (MAGA1_HUMAN)
KCADPTGHSY

SEQ ID NO: 44183 - protein, 10 aa, Artificial Sequence
  Description of Artificial Sequence: Synthetic peptide
  Seed: RVRFFFPSLR (MAGA1_HUMAN)
RPRFFFPSLF

SEQ ID NO: 44184 - protein, 9 aa, Artificial Sequence
  Description of Artificial Sequence: Synthetic peptide
  Seed: FFFPSLREA (MAGA1_HUMAN)
FVFPSLREY

SEQ ID NO: 44185 - protein, 9 aa, Artificial Sequence
  Description of Artificial Sequence: Synthetic peptide
  Seed: YVIKVSARV (MAGA1_HUMAN)
YVIKVSARF

SEQ ID NO: 44186 - protein, 9 aa, Artificial Sequence
  Description of Artificial Sequence: Synthetic peptide
  Seed: KASESLQLV (MAGA1_HUMAN)
KGSESLQLW

SEQ ID NO: 44187 - protein, 9 aa, Artificial Sequence
  Description of Artificial Sequence: Synthetic peptide
  Seed: RVRFFFPSL (MAGA1_HUMAN)
RQRFFFPSP

SEQ ID NO: 44188 - protein, 9 aa, Artificial Sequence
  Description of Artificial Sequence: Synthetic peptide
  Seed: KKVADLVGF (MAGA1_HUMAN)
KSVADLVGY

SEQ ID NO: 44189 - protein, 9 aa, Artificial Sequence
  Description of Artificial Sequence: Synthetic peptide
  Seed: SAYGEPRKL (MAGA1_HUMAN)
SDYGEPRKF

SEQ ID NO: 44190 - protein, 9 aa, Artificial Sequence
  Description of Artificial Sequence: Synthetic peptide
  Seed: SESLQLVFG (MAGA1_HUMAN)
SESLQLVFC

SEQ ID NO: 44191 - protein, 9 aa, Artificial Sequence
  Description of Artificial Sequence: Synthetic peptide
  Seed: FPTTINFTR (MAGA1_HUMAN)
FTTTINFTF

SEQ ID NO: 44192 - protein, 10 aa, Artificial Sequence
  Description of Artificial Sequence: Synthetic peptide
  Seed: ARVRFFFPSL (MAGA1_HUMAN)
AMVRFFFPSV

SEQ ID NO: 44193 - protein, 9 aa, Artificial Sequence
  Description of Artificial Sequence: Synthetic peptide
  Seed: DSDPARYEF (MAGA1_HUMAN)
DLDPARYEL

SEQ ID NO: 44194 - protein, 9 aa, Artificial Sequence
  Description of Artificial Sequence: Synthetic peptide
  Seed: TKAEMLESV (MAGA1_HUMAN)
THAEMLESV

SEQ ID NO: 44195 - protein, 11 aa, Artificial Sequence
  Description of Artificial Sequence: Synthetic peptide
  Seed: KVSARVRFFFP (MAGA1_HUMAN)
KKSARVRFFFK

SEQ ID NO: 44196 - protein, 9 aa, Artificial Sequence
  Description of Artificial Sequence: Synthetic peptide
  Seed: SARVRFFFP (MAGA1_HUMAN)
SKRVRFFFK

SEQ ID NO: 44197 - protein, 10 aa, Artificial Sequence
  Description of Artificial Sequence: Synthetic peptide
  Seed: KVSARVRFFF (MAGA1_HUMAN)
KSSARVRFFM

SEQ ID NO: 44198 - protein, 10 aa, Artificial Sequence
  Description of Artificial Sequence: Synthetic peptide
  Seed: RVRFFFPSLR (MAGA1_HUMAN)
RLRFFFPSLF

SEQ ID NO: 44199 - protein, 9 aa, Artificial Sequence
  Description of Artificial Sequence: Synthetic peptide
  Seed: GASAFPTTI (MAGA1_HUMAN)
GLSAFPTTF

SEQ ID NO: 44200 - protein, 10 aa, Artificial Sequence
  Description of Artificial Sequence: Synthetic peptide
  Seed: KKVADLVGFL (MAGA1_HUMAN)
KEVADLVGFV

SEQ ID NO: 44201 - protein, 11 aa, Artificial Sequence
  Description of Artificial Sequence: Synthetic peptide
  Seed: KVADLVGFLLL (MAGA1_HUMAN)
KLADLVGFLLA

SEQ ID NO: 44202 - protein, 10 aa, Artificial Sequence
  Description of Artificial Sequence: Synthetic peptide
  Seed: SLEQRSLHCK (MAGA1_HUMAN)
SMEQRSLHCR

SEQ ID NO: 44203 - protein, 10 aa, Artificial Sequence
  Description of Artificial Sequence: Synthetic peptide
  Seed: WEELSVMEVY (MAGA1_HUMAN)
WWELSVMEVW

SEQ ID NO: 44204 - protein, 10 aa, Artificial Sequence
  Description of Artificial Sequence: Synthetic peptide
  Seed: TSYVKVLEYV (MAGA1_HUMAN)
TIYVKVLEYL

SEQ ID NO: 44205 - protein, 9 aa, Artificial Sequence
  Description of Artificial Sequence: Synthetic peptide
  Seed: YKHCFPEIF (MAGA1_HUMAN)
YHHCFPEIY

SEQ ID NO: 44206 - protein, 9 aa, Artificial Sequence
  Description of Artificial Sequence: Synthetic peptide
  Seed: KKVADLVGF (MAGA1_HUMAN)
KMVADLVGM

SEQ ID NO: 44207 - protein, 11 aa, Artificial Sequence
  Description of Artificial Sequence: Synthetic peptide
  Seed: RALAETSYVKV (MAGA1_HUMAN)
RYLAETSYVKL

SEQ ID NO: 44208 - protein, 9 aa, Artificial Sequence
  Description of Artificial Sequence: Synthetic peptide
  Seed: SESLQLVFG (MAGA1_HUMAN)
SESLQLVFA

SEQ ID NO: 44209 - protein, 9 aa, Artificial Sequence
  Description of Artificial Sequence: Synthetic peptide
  Seed: LVQEKYLEY (MAGA1_HUMAN)
LVQEKYLEV

SEQ ID NO: 44210 - protein, 9 aa, Artificial Sequence
  Description of Artificial Sequence: Synthetic peptide
  Seed: QSPQGASAF (MAGA1_HUMAN)
QQPQGASAY

SEQ ID NO: 44211 - protein, 9 aa, Artificial Sequence
  Description of Artificial Sequence: Synthetic peptide
  Seed: KVLEYVIKV (MAGA1_HUMAN)
KTLEYVIKI

SEQ ID NO: 44212 - protein, 9 aa, Artificial Sequence
  Description of Artificial Sequence: Synthetic peptide
  Seed: RVRFFFPSL (MAGA1_HUMAN)
RLRFFFPST

SEQ ID NO: 44213 - protein, 9 aa, Artificial Sequence
  Description of Artificial Sequence: Synthetic peptide
  Seed: EADPTGHSY (MAGA1_HUMAN)
EMDPTGHSY

SEQ ID NO: 44214 - protein, 11 aa, Artificial Sequence
  Description of Artificial Sequence: Synthetic peptide
  Seed: SAFPTTINFTR (MAGA1_HUMAN)
SWFPTTINFTR

SEQ ID NO: 44215 - protein, 9 aa, Artificial Sequence
  Description of Artificial Sequence: Synthetic peptide
  Seed: STDPPQSPQ (MAGA1_HUMAN)
SADPPQSPL

SEQ ID NO: 44216 - protein, 9 aa, Artificial Sequence
  Description of Artificial Sequence: Synthetic peptide
  Seed: TQDLVQEKY (MAGA1_HUMAN)
TIDLVQEKF

SEQ ID NO: 44217 - protein, 10 aa, Artificial Sequence
  Description of Artificial Sequence: Synthetic peptide
  Seed: RVRFFFPSLR (MAGA1_HUMAN)
RMRFFFPSLV

SEQ ID NO: 44218 - protein, 9 aa, Artificial Sequence
  Description of Artificial Sequence: Synthetic peptide
  Seed: DSDPARYEF (MAGA1_HUMAN)
DTDPARYEY

SEQ ID NO: 44219 - protein, 9 aa, Artificial Sequence
  Description of Artificial Sequence: Synthetic peptide
  Seed: FPTTINFTR (MAGA1_HUMAN)
FFTTINFTR

SEQ ID NO: 44220 - protein, 10 aa, Artificial Sequence
  Description of Artificial Sequence: Synthetic peptide
  Seed: KVLEYVIKVS (MAGA1_HUMAN)
KMLEYVIKVK

SEQ ID NO: 44221 - protein, 9 aa, Artificial Sequence
  Description of Artificial Sequence: Synthetic peptide
  Seed: VYDGREHSA (MAGA1_HUMAN)
VMDGREHSL

SEQ ID NO: 44222 - protein, 9 aa, Artificial Sequence
  Description of Artificial Sequence: Synthetic peptide
  Seed: LKYRAREPV (MAGA1_HUMAN)
LSYRAREPM

SEQ ID NO: 44223 - protein, 11 aa, Artificial Sequence
  Description of Artificial Sequence: Synthetic peptide
  Seed: EVYDGREHSAY (MAGA1_HUMAN)
EIYDGREHSAF

SEQ ID NO: 44224 - protein, 9 aa, Artificial Sequence
  Description of Artificial Sequence: Synthetic peptide
  Seed: RVRFFFPSL (MAGA1_HUMAN)
RSRFFFPSM

SEQ ID NO: 44225 - protein, 9 aa, Artificial Sequence
  Description of Artificial Sequence: Synthetic peptide
  Seed: FLIIVLVMI (MAGA1_HUMAN)
FAIIVLVMV

SEQ ID NO: 44226 - protein, 10 aa, Artificial Sequence
  Description of Artificial Sequence: Synthetic peptide
  Seed: LSVMEVYDGR (MAGA1_HUMAN)
LDVMEVYDGR

SEQ ID NO: 44227 - protein, 11 aa, Artificial Sequence
  Description of Artificial Sequence: Synthetic peptide
  Seed: RVRFFFPSLRE (MAGA1_HUMAN)
RMRFFFPSLRG

SEQ ID NO: 44228 - protein, 9 aa, Artificial Sequence
  Description of Artificial Sequence: Synthetic peptide
  Seed: VQAATSSSS (MAGA1_HUMAN)
VFAATSSSY

SEQ ID NO: 44229 - protein, 9 aa, Artificial Sequence
  Description of Artificial Sequence: Synthetic peptide
  Seed: VYDGREHSA (MAGA1_HUMAN)
VADGREHSC

SEQ ID NO: 44230 - protein, 10 aa, Artificial Sequence
  Description of Artificial Sequence: Synthetic peptide
  Seed: DLVGFLLLKY (MAGA1_HUMAN)
DAVGFLLLKK

SEQ ID NO: 44231 - protein, 9 aa, Artificial Sequence
  Description of Artificial Sequence: Synthetic peptide
  Seed: FFFPSLREA (MAGA1_HUMAN)
FLFPSLRET

SEQ ID NO: 44232 - protein, 9 aa, Artificial Sequence
  Description of Artificial Sequence: Synthetic peptide
  Seed: AEMLESVIK (MAGA1_HUMAN)
AEMLESVII

SEQ ID NO: 44233 - protein, 9 aa, Artificial Sequence
  Description of Artificial Sequence: Synthetic peptide
  Seed: DSDPARYEF (MAGA1_HUMAN)
DADPARYEI

SEQ ID NO: 44234 - protein, 9 aa, Artificial Sequence
  Description of Artificial Sequence: Synthetic peptide
  Seed: KVSARVRFF (MAGA1_HUMAN)
KRSARVRFY

SEQ ID NO: 44235 - protein, 10 aa, Artificial Sequence
  Description of Artificial Sequence: Synthetic peptide
  Seed: KVADLVGFLL (MAGA1_HUMAN)
KVADLVGFLW

SEQ ID NO: 44236 - protein, 9 aa, Artificial Sequence
  Description of Artificial Sequence: Synthetic peptide
  Seed: VYDGREHSA (MAGA1_HUMAN)
VYDGREHSY

SEQ ID NO: 44237 - protein, 10 aa, Artificial Sequence
  Description of Artificial Sequence: Synthetic peptide
  Seed: KASESLQLVF (MAGA1_HUMAN)
KTSESLQLVM

SEQ ID NO: 44238 - protein, 9 aa, Artificial Sequence
  Description of Artificial Sequence: Synthetic peptide
  Seed: SSPLVLGTL (MAGA1_HUMAN)
SFPLVLGTM

SEQ ID NO: 44239 - protein, 11 aa, Artificial Sequence
  Description of Artificial Sequence: Synthetic peptide
  Seed: ELSVMEVYDGR (MAGA1_HUMAN)
EDSVMEVYDGR

SEQ ID NO: 44240 - protein, 10 aa, Artificial Sequence
  Description of Artificial Sequence: Synthetic peptide
  Seed: FFPSLREAAL (MAGA1_HUMAN)
FFPSLREAAY

SEQ ID NO: 44241 - protein, 9 aa, Artificial Sequence
  Description of Artificial Sequence: Synthetic peptide
  Seed: SARVRFFFP (MAGA1_HUMAN)
SVRVRFFFT

SEQ ID NO: 44242 - protein, 11 aa, Artificial Sequence
  Description of Artificial Sequence: Synthetic peptide
  Seed: VQAATSSSSPL (MAGA1_HUMAN)
VMAATSSSSPF

SEQ ID NO: 44243 - protein, 9 aa, Artificial Sequence
  Description of Artificial Sequence: Synthetic peptide
  Seed: ASESLQLVF (MAGA1_HUMAN)
ATESLQLVY

SEQ ID NO: 44244 - protein, 10 aa, Artificial Sequence
  Description of Artificial Sequence: Synthetic peptide
  Seed: ARYEFLWGPR (MAGA1_HUMAN)
AIYEFLWGPK

SEQ ID NO: 44245 - protein, 9 aa, Artificial Sequence
  Description of Artificial Sequence: Synthetic peptide
  Seed: FFPSLREAA (MAGA1_HUMAN)
FWPSLREAY

SEQ ID NO: 44246 - protein, 10 aa, Artificial Sequence
  Description of Artificial Sequence: Synthetic peptide
  Seed: YEFLWGPRAL (MAGA1_HUMAN)
YYFLWGPRAY

SEQ ID NO: 44247 - protein, 9 aa, Artificial Sequence
  Description of Artificial Sequence: Synthetic peptide
  Seed: FPSLREAAL (MAGA1_HUMAN)
FLSLREAAM

SEQ ID NO: 44248 - protein, 9 aa, Artificial Sequence
  Description of Artificial Sequence: Synthetic peptide
  Seed: TSSSSPLVL (MAGA1_HUMAN)
TMSSSPLVF

SEQ ID NO: 44249 - protein, 9 aa, Artificial Sequence
  Description of Artificial Sequence: Synthetic peptide
  Seed: YVIKVSARV (MAGA1_HUMAN)
YVIKVSARI

SEQ ID NO: 44250 - protein, 9 aa, Artificial Sequence
  Description of Artificial Sequence: Synthetic peptide
  Seed: QPSEGSSSR (MAGA1_HUMAN)
QFSEGSSSR

SEQ ID NO: 44251 - protein, 9 aa, Artificial Sequence
  Description of Artificial Sequence: Synthetic peptide
  Seed: TQDLVQEKY (MAGA1_HUMAN)
TTDLVQEKY

SEQ ID NO: 44252 - protein, 10 aa, Artificial Sequence
  Description of Artificial Sequence: Synthetic peptide
  Seed: MLESVIKNYK (MAGA1_HUMAN)
MFESVIKNYK

SEQ ID NO: 44253 - protein, 11 aa, Artificial Sequence
  Description of Artificial Sequence: Synthetic peptide
  Seed: SSSSPLVLGTL (MAGA1_HUMAN)
SSSSPLVLGTW

SEQ ID NO: 44254 - protein, 9 aa, Artificial Sequence
  Description of Artificial Sequence: Synthetic peptide
  Seed: RALAETSYV (MAGA1_HUMAN)
RGLAETSYK

SEQ ID NO: 44255 - protein, 10 aa, Artificial Sequence
  Description of Artificial Sequence: Synthetic peptide
  Seed: SESLQLVFGI (MAGA1_HUMAN)
SQSLQLVFGW

SEQ ID NO: 44256 - protein, 9 aa, Artificial Sequence
  Description of Artificial Sequence: Synthetic peptide
  Seed: LVQEKYLEY (MAGA1_HUMAN)
LVQEKYLEF

SEQ ID NO: 44257 - protein, 10 aa, Artificial Sequence
  Description of Artificial Sequence: Synthetic peptide
  Seed: RVRFFFPSLR (MAGA1_HUMAN)
RQRFFFPSLF

SEQ ID NO: 44258 - protein, 9 aa, Artificial Sequence
  Description of Artificial Sequence: Synthetic peptide
  Seed: FFFPSLREA (MAGA1_HUMAN)
FLFPSLREF

SEQ ID NO: 44259 - protein, 9 aa, Artificial Sequence
  Description of Artificial Sequence: Synthetic peptide
  Seed: EELSVMEVY (MAGA1_HUMAN)
EELSVMEVA

SEQ ID NO: 44260 - protein, 9 aa, Artificial Sequence
  Description of Artificial Sequence: Synthetic peptide
  Seed: FPSLREAAL (MAGA1_HUMAN)
FHSLREAAA

SEQ ID NO: 44261 - protein, 9 aa, Artificial Sequence
  Description of Artificial Sequence: Synthetic peptide
  Seed: GLLGDNQIM (MAGA1_HUMAN)
GLLGDNQIV

SEQ ID NO: 44262 - protein, 9 aa, Artificial Sequence
  Description of Artificial Sequence: Synthetic peptide
  Seed: YVIKVSARV (MAGA1_HUMAN)
YGIKVSARY

SEQ ID NO: 44263 - protein, 9 aa, Artificial Sequence
  Description of Artificial Sequence: Synthetic peptide
  Seed: LVTCLGLSY (MAGA1_HUMAN)
LATCLGLSM

SEQ ID NO: 44264 - protein, 9 aa, Artificial Sequence
  Description of Artificial Sequence: Synthetic peptide
  Seed: EELSVMEVY (MAGA1_HUMAN)
EELSVMEVF

SEQ ID NO: 44265 - protein, 10 aa, Artificial Sequence
  Description of Artificial Sequence: Synthetic peptide
  Seed: SARVRFFFPS (MAGA1_HUMAN)
SDRVRFFFPK

SEQ ID NO: 44266 - protein, 10 aa, Artificial Sequence
  Description of Artificial Sequence: Synthetic peptide
  Seed: KVSARVRFFF (MAGA1_HUMAN)
KNSARVRFFF

SEQ ID NO: 44267 - protein, 9 aa, Artificial Sequence
  Description of Artificial Sequence: Synthetic peptide
  Seed: TSSSSPLVL (MAGA1_HUMAN)
TISSSPLVW

SEQ ID NO: 44268 - protein, 10 aa, Artificial Sequence
  Description of Artificial Sequence: Synthetic peptide
  Seed: EALEAQQEAL (MAGA1_HUMAN)
EVLEAQQEAY

SEQ ID NO: 44269 - protein, 9 aa, Artificial Sequence
  Description of Artificial Sequence: Synthetic peptide
  Seed: LTQDLVQEK (MAGA1_HUMAN)
LAQDLVQEM

SEQ ID NO: 44270 - protein, 9 aa, Artificial Sequence
  Description of Artificial Sequence: Synthetic peptide
  Seed: KVLEYVIKV (MAGA1_HUMAN)
KYLEYVIKK

SEQ ID NO: 44271 - protein, 9 aa, Artificial Sequence
  Description of Artificial Sequence: Synthetic peptide
  Seed: SAFPTTINF (MAGA1_HUMAN)
SWFPTTINM

SEQ ID NO: 44272 - protein, 11 aa, Artificial Sequence
  Description of Artificial Sequence: Synthetic peptide
  Seed: SARVRFFFPSL (MAGA1_HUMAN)
SSRVRFFFPSK

SEQ ID NO: 44273 - protein, 10 aa, Artificial Sequence
  Description of Artificial Sequence: Synthetic peptide
  Seed: SARVRFFFPS (MAGA1_HUMAN)
SERVRFFFPF

SEQ ID NO: 44274 - protein, 9 aa, Artificial Sequence
  Description of Artificial Sequence: Synthetic peptide
  Seed: SARVRFFFP (MAGA1_HUMAN)
STRVRFFFQ

SEQ ID NO: 44275 - protein, 9 aa, Artificial Sequence
  Description of Artificial Sequence: Synthetic peptide
  Seed: GHAPEEEIW (MAGA1_HUMAN)
GHAPEEEIL

SEQ ID NO: 44276 - protein, 9 aa, Artificial Sequence
  Description of Artificial Sequence: Synthetic peptide
  Seed: LKYRAREPV (MAGA1_HUMAN)
LFYRAREPY

SEQ ID NO: 44277 - protein, 10 aa, Artificial Sequence
  Description of Artificial Sequence: Synthetic peptide
  Seed: MLESVIKNYK (MAGA1_HUMAN)
MFESVIKNYR

SEQ ID NO: 44278 - protein, 9 aa, Artificial Sequence
  Description of Artificial Sequence: Synthetic peptide
  Seed: ITKKVADLV (MAGA1_HUMAN)
IQKKVADLI

SEQ ID NO: 44279 - protein, 9 aa, Artificial Sequence
  Description of Artificial Sequence: Synthetic peptide
  Seed: EADPTGHSY (MAGA1_HUMAN)
EADPTGHSI

SEQ ID NO: 44280 - protein, 9 aa, Artificial Sequence
  Description of Artificial Sequence: Synthetic peptide
  Seed: SSPLVLGTL (MAGA1_HUMAN)
SQPLVLGTY

SEQ ID NO: 44281 - protein, 9 aa, Artificial Sequence
  Description of Artificial Sequence: Synthetic peptide
  Seed: SYVKVLEYV (MAGA1_HUMAN)
SYVKVLEYI

SEQ ID NO: 44282 - protein, 11 aa, Artificial Sequence
  Description of Artificial Sequence: Synthetic peptide
  Seed: VPDSDPARYEF (MAGA1_HUMAN)
VSDSDPARYEL

SEQ ID NO: 44283 - protein, 10 aa, Artificial Sequence
  Description of Artificial Sequence: Synthetic peptide
  Seed: SAFPTTINFT (MAGA1_HUMAN)
SSFPTTINFY

SEQ ID NO: 44284 - protein, 9 aa, Artificial Sequence
  Description of Artificial Sequence: Synthetic peptide
  Seed: VPDSDPARY (MAGA1_HUMAN)
VTDSDPARY

SEQ ID NO: 44285 - protein, 9 aa, Artificial Sequence
  Description of Artificial Sequence: Synthetic peptide
  Seed: LVLGTLEEV (MAGA1_HUMAN)
LSLGTLEEL

SEQ ID NO: 44286 - protein, 10 aa, Artificial Sequence
  Description of Artificial Sequence: Synthetic peptide
  Seed: LLKYRAREPV (MAGA1_HUMAN)
LMKYRAREPL

SEQ ID NO: 44287 - protein, 9 aa, Artificial Sequence
  Description of Artificial Sequence: Synthetic peptide
  Seed: RAREPVTKA (MAGA1_HUMAN)
RGREPVTKK

SEQ ID NO: 44288 - protein, 9 aa, Artificial Sequence
  Description of Artificial Sequence: Synthetic peptide
  Seed: VRFFFPSLR (MAGA1_HUMAN)
VRFFFPSLM

SEQ ID NO: 44289 - protein, 11 aa, Artificial Sequence
  Description of Artificial Sequence: Synthetic peptide
  Seed: RVRFFFPSLRE (MAGA1_HUMAN)
RRRFFFPSLRM

SEQ ID NO: 44290 - protein, 9 aa, Artificial Sequence
  Description of Artificial Sequence: Synthetic peptide
  Seed: LTQDLVQEK (MAGA1_HUMAN)
LMQDLVQEL

SEQ ID NO: 44291 - protein, 11 aa, Artificial Sequence
  Description of Artificial Sequence: Synthetic peptide
  Seed: EIFGKASESLQ (MAGA1_HUMAN)
ETFGKASESLK

SEQ ID NO: 44292 - protein, 9 aa, Artificial Sequence
  Description of Artificial Sequence: Synthetic peptide
  Seed: KVLEYVIKV (MAGA1_HUMAN)
KNLEYVIKY

SEQ ID NO: 44293 - protein, 9 aa, Artificial Sequence
  Description of Artificial Sequence: Synthetic peptide
  Seed: KVSARVRFF (MAGA1_HUMAN)
KQSARVRFF

SEQ ID NO: 44294 - protein, 9 aa, Artificial Sequence
  Description of Artificial Sequence: Synthetic peptide
  Seed: RVRFFFPSL (MAGA1_HUMAN)
RWRFFFPSG

SEQ ID NO: 44295 - protein, 9 aa, Artificial Sequence
  Description of Artificial Sequence: Synthetic peptide
  Seed: FFFPSLREA (MAGA1_HUMAN)
FTFPSLREY

SEQ ID NO: 44296 - protein, 10 aa, Artificial Sequence
  Description of Artificial Sequence: Synthetic peptide
  Seed: KYRAREPVTK (MAGA1_HUMAN)
KLRAREPVTK

SEQ ID NO: 44297 - protein, 10 aa, Artificial Sequence
  Description of Artificial Sequence: Synthetic peptide
  Seed: FFPSLREAAL (MAGA1_HUMAN)
FRPSLREAAM

SEQ ID NO: 44298 - protein, 9 aa, Artificial Sequence
  Description of Artificial Sequence: Synthetic peptide
  Seed: YVLVTCLGL (MAGA1_HUMAN)
YQLVTCLGL

SEQ ID NO: 44299 - protein, 10 aa, Artificial Sequence
  Description of Artificial Sequence: Synthetic peptide
  Seed: ALAETSYVKV (MAGA1_HUMAN)
AVAETSYVKR

SEQ ID NO: 44300 - protein, 9 aa, Artificial Sequence
  Description of Artificial Sequence: Synthetic peptide
  Seed: VSARVRFFF (MAGA1_HUMAN)
VMARVRFFY

SEQ ID NO: 44301 - protein, 10 aa, Artificial Sequence
  Description of Artificial Sequence: Synthetic peptide
  Seed: EADPTGHSYV (MAGA1_HUMAN)
EMDPTGHSYL

SEQ ID NO: 44302 - protein, 10 aa, Artificial Sequence
  Description of Artificial Sequence: Synthetic peptide
  Seed: KVADLVGFLL (MAGA1_HUMAN)
KQADLVGFLM

SEQ ID NO: 44303 - protein, 9 aa, Artificial Sequence
  Description of Artificial Sequence: Synthetic peptide
  Seed: SAYGEPRKL (MAGA1_HUMAN)
SMYGEPRKM

SEQ ID NO: 44304 - protein, 9 aa, Artificial Sequence
  Description of Artificial Sequence: Synthetic peptide
  Seed: SSPLVLGTL (MAGA1_HUMAN)
SAPLVLGTY

SEQ ID NO: 44305 - protein, 9 aa, Artificial Sequence
  Description of Artificial Sequence: Synthetic peptide
  Seed: TSSSSPLVL (MAGA1_HUMAN)
TLSSSPLVW

SEQ ID NO: 44306 - protein, 10 aa, Artificial Sequence
  Description of Artificial Sequence: Synthetic peptide
  Seed: RVRFFFPSLR (MAGA1_HUMAN)
RYRFFFPSLP

SEQ ID NO: 44307 - protein, 9 aa, Artificial Sequence
  Description of Artificial Sequence: Synthetic peptide
  Seed: HCFPEIFGK (MAGA1_HUMAN)
HMFPEIFGY

SEQ ID NO: 44308 - protein, 10 aa, Artificial Sequence
  Description of Artificial Sequence: Synthetic peptide
  Seed: SCILESLFRA (MAGA1_HUMAN)
SSILESLFRV

SEQ ID NO: 44309 - protein, 9 aa, Artificial Sequence
  Description of Artificial Sequence: Synthetic peptide
  Seed: ATSSSSPLV (MAGA1_HUMAN)
AASSSSPLI

SEQ ID NO: 44310 - protein, 9 aa, Artificial Sequence
  Description of Artificial Sequence: Synthetic peptide
  Seed: KASESLQLV (MAGA1_HUMAN)
KTSESLQLV

SEQ ID NO: 44311 - protein, 10 aa, Artificial Sequence
  Description of Artificial Sequence: Synthetic peptide
  Seed: EVYDGREHSA (MAGA1_HUMAN)
ESYDGREHSY

SEQ ID NO: 44312 - protein, 10 aa, Artificial Sequence
  Description of Artificial Sequence: Synthetic peptide
  Seed: ASAFPTTINF (MAGA1_HUMAN)
AQAFPTTINW

SEQ ID NO: 44313 - protein, 10 aa, Artificial Sequence
  Description of Artificial Sequence: Synthetic peptide
  Seed: SAYGEPRKLL (MAGA1_HUMAN)
STYGEPRKLW

SEQ ID NO: 44314 - protein, 9 aa, Artificial Sequence
  Description of Artificial Sequence: Synthetic peptide
  Seed: IIVLVMIAM (MAGA1_HUMAN)
IMVLVMIAY

SEQ ID NO: 44315 - protein, 10 aa, Artificial Sequence
  Description of Artificial Sequence: Synthetic peptide
  Seed: RAREPVTKAE (MAGA1_HUMAN)
RYREPVTKAV

SEQ ID NO: 44316 - protein, 9 aa, Artificial Sequence
  Description of Artificial Sequence: Synthetic peptide
  Seed: AATSSSSPL (MAGA1_HUMAN)
AMTSSSSPF

SEQ ID NO: 44317 - protein, 11 aa, Artificial Sequence
  Description of Artificial Sequence: Synthetic peptide
  Seed: KEADPTGHSYV (MAGA1_HUMAN)
KEADPTGHSYY

SEQ ID NO: 44318 - protein, 10 aa, Artificial Sequence
  Description of Artificial Sequence: Synthetic peptide
  Seed: LSVMEVYDGR (MAGA1_HUMAN)
LRVMEVYDGR

SEQ ID NO: 44319 - protein, 9 aa, Artificial Sequence
  Description of Artificial Sequence: Synthetic peptide
  Seed: MLESVIKNY (MAGA1_HUMAN)
MYESVIKNY

SEQ ID NO: 44320 - protein, 9 aa, Artificial Sequence
  Description of Artificial Sequence: Synthetic peptide
  Seed: ADLVGFLLL (MAGA1_HUMAN)
AQLVGFLLV

SEQ ID NO: 44321 - protein, 9 aa, Artificial Sequence
  Description of Artificial Sequence: Synthetic peptide
  Seed: LEYVIKVSA (MAGA1_HUMAN)
LEYVIKVSC

SEQ ID NO: 44322 - protein, 10 aa, Artificial Sequence
  Description of Artificial Sequence: Synthetic peptide
  Seed: RAREPVTKAE (MAGA1_HUMAN)
RSREPVTKAK

SEQ ID NO: 44323 - protein, 11 aa, Artificial Sequence
  Description of Artificial Sequence: Synthetic peptide
  Seed: KVADLVGFLLL (MAGA1_HUMAN)
KMADLVGFLLA

SEQ ID NO: 44324 - protein, 9 aa, Artificial Sequence
  Description of Artificial Sequence: Synthetic peptide
  Seed: EKYLEYRQV (MAGA1_HUMAN)
EQYLEYRQI

SEQ ID NO: 44325 - protein, 10 aa, Artificial Sequence
  Description of Artificial Sequence: Synthetic peptide
  Seed: KVLEYVIKVS (MAGA1_HUMAN)
KLLEYVIKVG

SEQ ID NO: 44326 - protein, 9 aa, Artificial Sequence
  Description of Artificial Sequence: Synthetic peptide
  Seed: TKAEMLESV (MAGA1_HUMAN)
THAEMLESA

SEQ ID NO: 44327 - protein, 9 aa, Artificial Sequence
  Description of Artificial Sequence: Synthetic peptide
  Seed: FFFPSLREA (MAGA1_HUMAN)
FGFPSLREL

SEQ ID NO: 44328 - protein, 10 aa, Artificial Sequence
  Description of Artificial Sequence: Synthetic peptide
  Seed: YEFLWGPRAL (MAGA1_HUMAN)
YRFLWGPRAY

SEQ ID NO: 44329 - protein, 11 aa, Artificial Sequence
  Description of Artificial Sequence: Synthetic peptide
  Seed: KVADLVGFLLL (MAGA1_HUMAN)
KIADLVGFLLV

SEQ ID NO: 44330 - protein, 9 aa, Artificial Sequence
  Description of Artificial Sequence: Synthetic peptide
  Seed: TQDLVQEKY (MAGA1_HUMAN)
TEDLVQEKF

SEQ ID NO: 44331 - protein, 10 aa, Artificial Sequence
  Description of Artificial Sequence: Synthetic peptide
  Seed: RVRFFFPSLR (MAGA1_HUMAN)
RWRFFFPSLS

SEQ ID NO: 44332 - protein, 10 aa, Artificial Sequence
  Description of Artificial Sequence: Synthetic peptide
  Seed: RAREPVTKAE (MAGA1_HUMAN)
RVREPVTKAK

SEQ ID NO: 44333 - protein, 9 aa, Artificial Sequence
  Description of Artificial Sequence: Synthetic peptide
  Seed: AATSSSSPL (MAGA1_HUMAN)
AQTSSSSPL

SEQ ID NO: 44334 - protein, 11 aa, Artificial Sequence
  Description of Artificial Sequence: Synthetic peptide
  Seed: RVRFFFPSLRE (MAGA1_HUMAN)
RIRFFFPSLRA

SEQ ID NO: 44335 - protein, 10 aa, Artificial Sequence
  Description of Artificial Sequence: Synthetic peptide
  Seed: EALGLVCVQA (MAGA1_HUMAN)
ETLGLVCVQL

SEQ ID NO: 44336 - protein, 10 aa, Artificial Sequence
  Description of Artificial Sequence: Synthetic peptide
  Seed: ADPTGHSYVL (MAGA1_HUMAN)
AGPTGHSYVL

SEQ ID NO: 44337 - protein, 9 aa, Artificial Sequence
  Description of Artificial Sequence: Synthetic peptide
  Seed: LVGFLLLKY (MAGA1_HUMAN)
LIGFLLLKY

SEQ ID NO: 44338 - protein, 9 aa, Artificial Sequence
  Description of Artificial Sequence: Synthetic peptide
  Seed: RVRFFFPSL (MAGA1_HUMAN)
RYRFFFPSL

SEQ ID NO: 44339 - protein, 9 aa, Artificial Sequence
  Description of Artificial Sequence: Synthetic peptide
  Seed: RAREPVTKA (MAGA1_HUMAN)
RQREPVTKF

SEQ ID NO: 44340 - protein, 9 aa, Artificial Sequence
  Description of Artificial Sequence: Synthetic peptide
  Seed: LESLFRAVI (MAGA1_HUMAN)
LGSLFRAVY

SEQ ID NO: 44341 - protein, 9 aa, Artificial Sequence
  Description of Artificial Sequence: Synthetic peptide
  Seed: SSSPLVLGT (MAGA1_HUMAN)
SVSPLVLGI

SEQ ID NO: 44342 - protein, 9 aa, Artificial Sequence
  Description of Artificial Sequence: Synthetic peptide
  Seed: AETSYVKVL (MAGA1_HUMAN)
AQTSYVKVV

SEQ ID NO: 44343 - protein, 10 aa, Artificial Sequence
  Description of Artificial Sequence: Synthetic peptide
  Seed: SARVRFFFPS (MAGA1_HUMAN)
SRRVRFFFPY

SEQ ID NO: 44344 - protein, 9 aa, Artificial Sequence
  Description of Artificial Sequence: Synthetic peptide
  Seed: AQQEALGLV (MAGA1_HUMAN)
ALQEALGLY

SEQ ID NO: 44345 - protein, 9 aa, Artificial Sequence
  Description of Artificial Sequence: Synthetic peptide
  Seed: LVTCLGLSY (MAGA1_HUMAN)
LNTCLGLSF

SEQ ID NO: 44346 - protein, 9 aa, Artificial Sequence
  Description of Artificial Sequence: Synthetic peptide
  Seed: AQQEALGLV (MAGA1_HUMAN)
AQQEALGLI

SEQ ID NO: 44347 - protein, 9 aa, Artificial Sequence
  Description of Artificial Sequence: Synthetic peptide
  Seed: LVQEKYLEY (MAGA1_HUMAN)
LWQEKYLEL

SEQ ID NO: 44348 - protein, 9 aa, Artificial Sequence
  Description of Artificial Sequence: Synthetic peptide
  Seed: FPTTINFTR (MAGA1_HUMAN)
FATTINFTM

SEQ ID NO: 44349 - protein, 10 aa, Artificial Sequence
  Description of Artificial Sequence: Synthetic peptide
  Seed: RVRFFFPSLR (MAGA1_HUMAN)
RTRFFFPSLS

SEQ ID NO: 44350 - protein, 9 aa, Artificial Sequence
  Description of Artificial Sequence: Synthetic peptide
  Seed: VSARVRFFF (MAGA1_HUMAN)
VYARVRFFM

SEQ ID NO: 44351 - protein, 9 aa, Artificial Sequence
  Description of Artificial Sequence: Synthetic peptide
  Seed: DLVGFLLLK (MAGA1_HUMAN)
DLVGFLLLR

SEQ ID NO: 44352 - protein, 9 aa, Artificial Sequence
  Description of Artificial Sequence: Synthetic peptide
  Seed: GKASESLQL (MAGA1_HUMAN)
GKASESLQF

SEQ ID NO: 44353 - protein, 10 aa, Artificial Sequence
  Description of Artificial Sequence: Synthetic peptide
  Seed: ADPTGHSYVL (MAGA1_HUMAN)
AMPTGHSYVM

SEQ ID NO: 44354 - protein, 10 aa, Artificial Sequence
  Description of Artificial Sequence: Synthetic peptide
  Seed: PLVLGTLEEV (MAGA1_HUMAN)
PFVLGTLEEV

SEQ ID NO: 44355 - protein, 10 aa, Artificial Sequence
  Description of Artificial Sequence: Synthetic peptide
  Seed: SSSPLVLGTL (MAGA1_HUMAN)
SSSPLVLGTY

SEQ ID NO: 44356 - protein, 8 aa, Artificial Sequence
  Description of Artificial Sequence: Synthetic peptide
  Seed: ILESLFRA (MAGA1_HUMAN)
ILESLFRV

SEQ ID NO: 44357 - protein, 9 aa, Artificial Sequence
  Description of Artificial Sequence: Synthetic peptide
  Seed: TTINFTRQR (MAGA1_HUMAN)
TMINFTRQK

SEQ ID NO: 44358 - protein, 10 aa, Artificial Sequence
  Description of Artificial Sequence: Synthetic peptide
  Seed: KEADPTGHSY (MAGA1_HUMAN)
KDADPTGHSL

SEQ ID NO: 44359 - protein, 10 aa, Artificial Sequence
  Description of Artificial Sequence: Synthetic peptide
  Seed: ARYEFLWGPR (MAGA1_HUMAN)
ARYEFLWGPF

SEQ ID NO: 44360 - protein, 11 aa, Artificial Sequence
  Description of Artificial Sequence: Synthetic peptide
  Seed: ARVRFFFPSLR (MAGA1_HUMAN)
ATVRFFFPSLL

SEQ ID NO: 44361 - protein, 10 aa, Artificial Sequence
  Description of Artificial Sequence: Synthetic peptide
  Seed: ETSYVKVLEY (MAGA1_HUMAN)
EMSYVKVLER

SEQ ID NO: 44362 - protein, 9 aa, Artificial Sequence
  Description of Artificial Sequence: Synthetic peptide
  Seed: KKVADLVGF (MAGA1_HUMAN)
KQVADLVGM

SEQ ID NO: 44363 - protein, 10 aa, Artificial Sequence
  Description of Artificial Sequence: Synthetic peptide
  Seed: SSSPLVLGTL (MAGA1_HUMAN)
SISPLVLGTL

SEQ ID NO: 44364 - protein, 9 aa, Artificial Sequence
  Description of Artificial Sequence: Synthetic peptide
  Seed: STSCILESL (MAGA1_HUMAN)
SQSCILESI

SEQ ID NO: 44365 - protein, 9 aa, Artificial Sequence
  Description of Artificial Sequence: Synthetic peptide
  Seed: SAFPTTINF (MAGA1_HUMAN)
SVFPTTINL

SEQ ID NO: 44366 - protein, 9 aa, Artificial Sequence
  Description of Artificial Sequence: Synthetic peptide
  Seed: VYDGREHSA (MAGA1_HUMAN)
VIDGREHSV

SEQ ID NO: 44367 - protein, 9 aa, Artificial Sequence
  Description of Artificial Sequence: Synthetic peptide
  Seed: RVRFFFPSL (MAGA1_HUMAN)
RLRFFFPSL

SEQ ID NO: 44368 - protein, 9 aa, Artificial Sequence
  Description of Artificial Sequence: Synthetic peptide
  Seed: TSSSSPLVL (MAGA1_HUMAN)
TISSSPLVF

SEQ ID NO: 44369 - protein, 8 aa, Artificial Sequence
  Description of Artificial Sequence: Synthetic peptide
  Seed: HSYVLVTC (MAGA1_HUMAN)
HSYVLVTL

SEQ ID NO: 44370 - protein, 10 aa, Artificial Sequence
  Description of Artificial Sequence: Synthetic peptide
  Seed: WEELSVMEVY (MAGA1_HUMAN)
WVELSVMEVW

SEQ ID NO: 44371 - protein, 9 aa, Artificial Sequence
  Description of Artificial Sequence: Synthetic peptide
  Seed: TQDLVQEKY (MAGA1_HUMAN)
TTDLVQEKM

SEQ ID NO: 44372 - protein, 9 aa, Artificial Sequence
  Description of Artificial Sequence: Synthetic peptide
  Seed: STDPPQSPQ (MAGA1_HUMAN)
SIDPPQSPL

SEQ ID NO: 44373 - protein, 9 aa, Artificial Sequence
  Description of Artificial Sequence: Synthetic peptide
  Seed: YVIKVSARV (MAGA1_HUMAN)
YQIKVSARY

SEQ ID NO: 44374 - protein, 10 aa, Artificial Sequence
  Description of Artificial Sequence: Synthetic peptide
  Seed: SSSPLVLGTL (MAGA1_HUMAN)
SSSPLVLGTM

SEQ ID NO: 44375 - protein, 10 aa, Artificial Sequence
  Description of Artificial Sequence: Synthetic peptide
  Seed: FFPSLREAAL (MAGA1_HUMAN)
FEPSLREAAL

SEQ ID NO: 44376 - protein, 10 aa, Artificial Sequence
  Description of Artificial Sequence: Synthetic peptide
  Seed: TSYVKVLEYV (MAGA1_HUMAN)
TQYVKVLEYI

SEQ ID NO: 44377 - protein, 9 aa, Artificial Sequence
  Description of Artificial Sequence: Synthetic peptide
  Seed: EADPTGHSY (MAGA1_HUMAN)
EFDPTGHSM

SEQ ID NO: 44378 - protein, 9 aa, Artificial Sequence
  Description of Artificial Sequence: Synthetic peptide
  Seed: RVRFFFPSL (MAGA1_HUMAN)
RVRFFFPSM

SEQ ID NO: 44379 - protein, 10 aa, Artificial Sequence
  Description of Artificial Sequence: Synthetic peptide
  Seed: SCILESLFRA (MAGA1_HUMAN)
SLILESLFRV

SEQ ID NO: 44380 - protein, 9 aa, Artificial Sequence
  Description of Artificial Sequence: Synthetic peptide
  Seed: IAMEGGHAP (MAGA1_HUMAN)
IIMEGGHAL

SEQ ID NO: 44381 - protein, 10 aa, Artificial Sequence
  Description of Artificial Sequence: Synthetic peptide
  Seed: EVYDGREHSA (MAGA1_HUMAN)
EQYDGREHSR

SEQ ID NO: 44382 - protein, 9 aa, Artificial Sequence
  Description of Artificial Sequence: Synthetic peptide
  Seed: TSSSSPLVL (MAGA1_HUMAN)
TPSSSPLVV

SEQ ID NO: 44383 - protein, 9 aa, Artificial Sequence
  Description of Artificial Sequence: Synthetic peptide
  Seed: ARYEFLWGP (MAGA1_HUMAN)
ARYEFLWGM

SEQ ID NO: 44384 - protein, 9 aa, Artificial Sequence
  Description of Artificial Sequence: Synthetic peptide
  Seed: KVSARVRFF (MAGA1_HUMAN)
KVSARVRFA

SEQ ID NO: 44385 - protein, 10 aa, Artificial Sequence
  Description of Artificial Sequence: Synthetic peptide
  Seed: KVSARVRFFF (MAGA1_HUMAN)
KASARVRFFW

SEQ ID NO: 44386 - protein, 11 aa, Artificial Sequence
  Description of Artificial Sequence: Synthetic peptide
  Seed: RVRFFFPSLRE (MAGA1_HUMAN)
RARFFFPSLRK

SEQ ID NO: 44387 - protein, 10 aa, Artificial Sequence
  Description of Artificial Sequence: Synthetic peptide
  Seed: LVFGIDVKEA (MAGA1_HUMAN)
LMFGIDVKEL

SEQ ID NO: 44388 - protein, 10 aa, Artificial Sequence
  Description of Artificial Sequence: Synthetic peptide
  Seed: EHSAYGEPRK (MAGA1_HUMAN)
EISAYGEPRR

SEQ ID NO: 44389 - protein, 10 aa, Artificial Sequence
  Description of Artificial Sequence: Synthetic peptide
  Seed: VKVLEYVIKV (MAGA1_HUMAN)
VYVLEYVIKV

SEQ ID NO: 44390 - protein, 9 aa, Artificial Sequence
  Description of Artificial Sequence: Synthetic peptide
  Seed: NQIMPKTGF (MAGA1_HUMAN)
NHIMPKTGL

SEQ ID NO: 44391 - protein, 9 aa, Artificial Sequence
  Description of Artificial Sequence: Synthetic peptide
  Seed: KVSARVRFF (MAGA1_HUMAN)
KMSARVRFK

SEQ ID NO: 44392 - protein, 9 aa, Artificial Sequence
  Description of Artificial Sequence: Synthetic peptide
  Seed: EYVIKVSAR (MAGA1_HUMAN)
EWVIKVSAR

SEQ ID NO: 44393 - protein, 10 aa, Artificial Sequence
  Description of Artificial Sequence: Synthetic peptide
  Seed: DLVGFLLLKY (MAGA1_HUMAN)
DLVGFLLLKK

SEQ ID NO: 44394 - protein, 10 aa, Artificial Sequence
  Description of Artificial Sequence: Synthetic peptide
  Seed: RVRFFFPSLR (MAGA1_HUMAN)
RKRFFFPSLA

SEQ ID NO: 44395 - protein, 9 aa, Artificial Sequence
  Description of Artificial Sequence: Synthetic peptide
  Seed: STSCILESL (MAGA1_HUMAN)
SMSCILESY

SEQ ID NO: 44396 - protein, 10 aa, Artificial Sequence
  Description of Artificial Sequence: Synthetic peptide
  Seed: EALEAQQEAL (MAGA1_HUMAN)
EILEAQQEAW

SEQ ID NO: 44397 - protein, 9 aa, Artificial Sequence
  Description of Artificial Sequence: Synthetic peptide
  Seed: FFPSLREAA (MAGA1_HUMAN)
FMPSLREAM

SEQ ID NO: 44398 - protein, 9 aa, Artificial Sequence
  Description of Artificial Sequence: Synthetic peptide
  Seed: MPKTGFLII (MAGA1_HUMAN)
MLKTGFLIL

SEQ ID NO: 44399 - protein, 10 aa, Artificial Sequence
  Description of Artificial Sequence: Synthetic peptide
  Seed: YVIKVSARVR (MAGA1_HUMAN)
YSIKVSARVK

SEQ ID NO: 44400 - protein, 9 aa, Artificial Sequence
  Description of Artificial Sequence: Synthetic peptide
  Seed: HSYVLVTCL (MAGA1_HUMAN)
HVYVLVTCY

SEQ ID NO: 44401 - protein, 11 aa, Artificial Sequence
  Description of Artificial Sequence: Synthetic peptide
  Seed: YEFLWGPRALA (MAGA1_HUMAN)
YPFLWGPRALV

SEQ ID NO: 44402 - protein, 10 aa, Artificial Sequence
  Description of Artificial Sequence: Synthetic peptide
  Seed: KVADLVGFLL (MAGA1_HUMAN)
KIADLVGFLI

SEQ ID NO: 44403 - protein, 9 aa, Artificial Sequence
  Description of Artificial Sequence: Synthetic peptide
  Seed: EEEGPSTSC (MAGA1_HUMAN)
EEEGPSTSW

SEQ ID NO: 44404 - protein, 9 aa, Artificial Sequence
  Description of Artificial Sequence: Synthetic peptide
  Seed: KVLEYVIKV (MAGA1_HUMAN)
KILEYVIKR

SEQ ID NO: 44405 - protein, 9 aa, Artificial Sequence
  Description of Artificial Sequence: Synthetic peptide
  Seed: AATSSSSPL (MAGA1_HUMAN)
AFTSSSSPF

SEQ ID NO: 44406 - protein, 11 aa, Artificial Sequence
  Description of Artificial Sequence: Synthetic peptide
  Seed: KVADLVGFLLL (MAGA1_HUMAN)
KMADLVGFLLN

SEQ ID NO: 44407 - protein, 9 aa, Artificial Sequence
  Description of Artificial Sequence: Synthetic peptide
  Seed: STSCILESL (MAGA1_HUMAN)
STSCILESK

SEQ ID NO: 44408 - protein, 9 aa, Artificial Sequence
  Description of Artificial Sequence: Synthetic peptide
  Seed: ESLQLVFGI (MAGA1_HUMAN)
EALQLVFGI

SEQ ID NO: 44409 - protein, 9 aa, Artificial Sequence
  Description of Artificial Sequence: Synthetic peptide
  Seed: ESLQLVFGI (MAGA1_HUMAN)
EVLQLVFGI

SEQ ID NO: 44410 - protein, 9 aa, Artificial Sequence
  Description of Artificial Sequence: Synthetic peptide
  Seed: SARVRFFFP (MAGA1_HUMAN)
SSRVRFFFY

SEQ ID NO: 44411 - protein, 10 aa, Artificial Sequence
  Description of Artificial Sequence: Synthetic peptide
  Seed: KEADPTGHSY (MAGA1_HUMAN)
KQADPTGHSL

SEQ ID NO: 44412 - protein, 9 aa, Artificial Sequence
  Description of Artificial Sequence: Synthetic peptide
  Seed: FPSLREAAL (MAGA1_HUMAN)
FPSLREAAA

SEQ ID NO: 44413 - protein, 10 aa, Artificial Sequence
  Description of Artificial Sequence: Synthetic peptide
  Seed: RAREPVTKAE (MAGA1_HUMAN)
RIREPVTKAA

SEQ ID NO: 44414 - protein, 10 aa, Artificial Sequence
  Description of Artificial Sequence: Synthetic peptide
  Seed: KVSARVRFFF (MAGA1_HUMAN)
KASARVRFFA

SEQ ID NO: 44415 - protein, 9 aa, Artificial Sequence
  Description of Artificial Sequence: Synthetic peptide
  Seed: KVADLVGFL (MAGA1_HUMAN)
KLADLVGFK

SEQ ID NO: 44416 - protein, 10 aa, Artificial Sequence
  Description of Artificial Sequence: Synthetic peptide
  Seed: SCILESLFRA (MAGA1_HUMAN)
STILESLFRA

SEQ ID NO: 44417 - protein, 9 aa, Artificial Sequence
  Description of Artificial Sequence: Synthetic peptide
  Seed: IMPKTGFLI (MAGA1_HUMAN)
IHPKTGFLF

SEQ ID NO: 44418 - protein, 9 aa, Artificial Sequence
  Description of Artificial Sequence: Synthetic peptide
  Seed: SSPLVLGTL (MAGA1_HUMAN)
SCPLVLGTL

SEQ ID NO: 44419 - protein, 9 aa, Artificial Sequence
  Description of Artificial Sequence: Synthetic peptide
  Seed: TSSSSPLVL (MAGA1_HUMAN)
TTSSSPLVY

SEQ ID NO: 44420 - protein, 8 aa, Artificial Sequence
  Description of Artificial Sequence: Synthetic peptide
  Seed: HSYVLVTC (MAGA1_HUMAN)
HNYVLVTV

SEQ ID NO: 44421 - protein, 9 aa, Artificial Sequence
  Description of Artificial Sequence: Synthetic peptide
  Seed: IAMEGGHAP (MAGA1_HUMAN)
IIMEGGHAM

SEQ ID NO: 44422 - protein, 9 aa, Artificial Sequence
  Description of Artificial Sequence: Synthetic peptide
  Seed: IFGKASESL (MAGA1_HUMAN)
IYGKASESV

SEQ ID NO: 44423 - protein, 10 aa, Artificial Sequence
  Description of Artificial Sequence: Synthetic peptide
  Seed: ILESLFRAVI (MAGA1_HUMAN)
IMESLFRAVV

SEQ ID NO: 44424 - protein, 10 aa, Artificial Sequence
  Description of Artificial Sequence: Synthetic peptide
  Seed: KASESLQLVF (MAGA1_HUMAN)
KYSESLQLVW

SEQ ID NO: 44425 - protein, 9 aa, Artificial Sequence
  Description of Artificial Sequence: Synthetic peptide
  Seed: IKVSARVRF (MAGA1_HUMAN)
IAVSARVRY

SEQ ID NO: 44426 - protein, 9 aa, Artificial Sequence
  Description of Artificial Sequence: Synthetic peptide
  Seed: GKASESLQL (MAGA1_HUMAN)
GMASESLQY

SEQ ID NO: 44427 - protein, 9 aa, Artificial Sequence
  Description of Artificial Sequence: Synthetic peptide
  Seed: RVRFFFPSL (MAGA1_HUMAN)
RARFFFPSS

SEQ ID NO: 44428 - protein, 9 aa, Artificial Sequence
  Description of Artificial Sequence: Synthetic peptide
  Seed: SSPLVLGTL (MAGA1_HUMAN)
SRPLVLGTM

SEQ ID NO: 44429 - protein, 10 aa, Artificial Sequence
  Description of Artificial Sequence: Synthetic peptide
  Seed: RVRFFFPSLR (MAGA1_HUMAN)
RARFFFPSLV

SEQ ID NO: 44430 - protein, 9 aa, Artificial Sequence
  Description of Artificial Sequence: Synthetic peptide
  Seed: EADPTGHSY (MAGA1_HUMAN)
EVDPTGHSM

SEQ ID NO: 44431 - protein, 10 aa, Artificial Sequence
  Description of Artificial Sequence: Synthetic peptide
  Seed: QVPDSDPARY (MAGA1_HUMAN)
QLPDSDPARR

SEQ ID NO: 44432 - protein, 9 aa, Artificial Sequence
  Description of Artificial Sequence: Synthetic peptide
  Seed: SARVRFFFP (MAGA1_HUMAN)
SNRVRFFFK

SEQ ID NO: 44433 - protein, 10 aa, Artificial Sequence
  Description of Artificial Sequence: Synthetic peptide
  Seed: RVRFFFPSLR (MAGA1_HUMAN)
RMRFFFPSLI

SEQ ID NO: 44434 - protein, 9 aa, Artificial Sequence
  Description of Artificial Sequence: Synthetic peptide
  Seed: RVRFFFPSL (MAGA1_HUMAN)
RVRFFFPSK

SEQ ID NO: 44435 - protein, 10 aa, Artificial Sequence
  Description of Artificial Sequence: Synthetic peptide
  Seed: RAREPVTKAE (MAGA1_HUMAN)
RWREPVTKAK

SEQ ID NO: 44436 - protein, 9 aa, Artificial Sequence
  Description of Artificial Sequence: Synthetic peptide
  Seed: EELSVMEVY (MAGA1_HUMAN)
EALSVMEVY

SEQ ID NO: 44437 - protein, 10 aa, Artificial Sequence
  Description of Artificial Sequence: Synthetic peptide
  Seed: RVRFFFPSLR (MAGA1_HUMAN)
RIRFFFPSLK

SEQ ID NO: 44438 - protein, 9 aa, Artificial Sequence
  Description of Artificial Sequence: Synthetic peptide
  Seed: VYDGREHSA (MAGA1_HUMAN)
VQDGREHSI

SEQ ID NO: 44439 - protein, 9 aa, Artificial Sequence
  Description of Artificial Sequence: Synthetic peptide
  Seed: RVRFFFPSL (MAGA1_HUMAN)
RPRFFFPSS

SEQ ID NO: 44440 - protein, 9 aa, Artificial Sequence
  Description of Artificial Sequence: Synthetic peptide
  Seed: YVLVTCLGL (MAGA1_HUMAN)
YQLVTCLGV

SEQ ID NO: 44441 - protein, 10 aa, Artificial Sequence
  Description of Artificial Sequence: Synthetic peptide
  Seed: TSYVKVLEYV (MAGA1_HUMAN)
TTYVKVLEYA

SEQ ID NO: 44442 - protein, 9 aa, Artificial Sequence
  Description of Artificial Sequence: Synthetic peptide
  Seed: FPTTINFTR (MAGA1_HUMAN)
FITTINFTM

SEQ ID NO: 44443 - protein, 10 aa, Artificial Sequence
  Description of Artificial Sequence: Synthetic peptide
  Seed: KVSARVRFFF (MAGA1_HUMAN)
KYSARVRFFY

SEQ ID NO: 44444 - protein, 9 aa, Artificial Sequence
  Description of Artificial Sequence: Synthetic peptide
  Seed: SCILESLFR (MAGA1_HUMAN)
SVILESLFR

SEQ ID NO: 44445 - protein, 10 aa, Artificial Sequence
  Description of Artificial Sequence: Synthetic peptide
  Seed: KVLEYVIKVS (MAGA1_HUMAN)
KMLEYVIKVQ

SEQ ID NO: 44446 - protein, 11 aa, Artificial Sequence
  Description of Artificial Sequence: Synthetic peptide
  Seed: RVRFFFPSLRE (MAGA1_HUMAN)
RDRFFFPSLRR

SEQ ID NO: 44447 - protein, 9 aa, Artificial Sequence
  Description of Artificial Sequence: Synthetic peptide
  Seed: SSSPLVLGT (MAGA1_HUMAN)
SISPLVLGV

SEQ ID NO: 44448 - protein, 11 aa, Artificial Sequence
  Description of Artificial Sequence: Synthetic peptide
  Seed: TKKVADLVGFL (MAGA1_HUMAN)
TKKVADLVGFV

SEQ ID NO: 44449 - protein, 10 aa, Artificial Sequence
  Description of Artificial Sequence: Synthetic peptide
  Seed: REEEGPSTSC (MAGA1_HUMAN)
REEEGPSTSV

SEQ ID NO: 44450 - protein, 9 aa, Artificial Sequence
  Description of Artificial Sequence: Synthetic peptide
  Seed: FFFPSLREA (MAGA1_HUMAN)
FKFPSLREY

SEQ ID NO: 44451 - protein, 9 aa, Artificial Sequence
  Description of Artificial Sequence: Synthetic peptide
  Seed: KTGFLIIVL (MAGA1_HUMAN)
KIGFLIIVV

SEQ ID NO: 44452 - protein, 11 aa, Artificial Sequence
  Description of Artificial Sequence: Synthetic peptide
  Seed: YEFLWGPRALA (MAGA1_HUMAN)
YGFLWGPRALI

SEQ ID NO: 44453 - protein, 9 aa, Artificial Sequence
  Description of Artificial Sequence: Synthetic peptide
  Seed: MPKTGFLII (MAGA1_HUMAN)
MGKTGFLIF

SEQ ID NO: 44454 - protein, 10 aa, Artificial Sequence
  Description of Artificial Sequence: Synthetic peptide
  Seed: EFLWGPRALA (MAGA1_HUMAN)
EYLWGPRALI

SEQ ID NO: 44455 - protein, 10 aa, Artificial Sequence
  Description of Artificial Sequence: Synthetic peptide
  Seed: KVLEYVIKVS (MAGA1_HUMAN)
KQLEYVIKVV

SEQ ID NO: 44456 - protein, 10 aa, Artificial Sequence
  Description of Artificial Sequence: Synthetic peptide
  Seed: RYEFLWGPRA (MAGA1_HUMAN)
RFEFLWGPRK

SEQ ID NO: 44457 - protein, 9 aa, Artificial Sequence
  Description of Artificial Sequence: Synthetic peptide
  Seed: KVLEYVIKV (MAGA1_HUMAN)
KTLEYVIKF

SEQ ID NO: 44458 - protein, 9 aa, Artificial Sequence
  Description of Artificial Sequence: Synthetic peptide
  Seed: EEIWEELSV (MAGA1_HUMAN)
EEIWEELSA

SEQ ID NO: 44459 - protein, 9 aa, Artificial Sequence
  Description of Artificial Sequence: Synthetic peptide
  Seed: SYVKVLEYV (MAGA1_HUMAN)
SIVKVLEYL

SEQ ID NO: 44460 - protein, 9 aa, Artificial Sequence
  Description of Artificial Sequence: Synthetic peptide
  Seed: GTLEEVPTA (MAGA1_HUMAN)
GQLEEVPTV

SEQ ID NO: 44461 - protein, 10 aa, Artificial Sequence
  Description of Artificial Sequence: Synthetic peptide
  Seed: DVKEADPTGH (MAGA1_HUMAN)
DIKEADPTGK

SEQ ID NO: 44462 - protein, 9 aa, Artificial Sequence
  Description of Artificial Sequence: Synthetic peptide
  Seed: KVSARVRFF (MAGA1_HUMAN)
KKSARVRFY

SEQ ID NO: 44463 - protein, 8 aa, Artificial Sequence
  Description of Artificial Sequence: Synthetic peptide
  Seed: FLWGPRAL (MAGA1_HUMAN)
FLWGPRAV

SEQ ID NO: 44464 - protein, 9 aa, Artificial Sequence
  Description of Artificial Sequence: Synthetic peptide
  Seed: LVLGTLEEV (MAGA1_HUMAN)
LMLGTLEEI

SEQ ID NO: 44465 - protein, 9 aa, Artificial Sequence
  Description of Artificial Sequence: Synthetic peptide
  Seed: AATSSSSPL (MAGA1_HUMAN)
AYTSSSSPF

SEQ ID NO: 44466 - protein, 9 aa, Artificial Sequence
  Description of Artificial Sequence: Synthetic peptide
  Seed: RQRQPSEGS (MAGA1_HUMAN)
RFRQPSEGA

SEQ ID NO: 44467 - protein, 10 aa, Artificial Sequence
  Description of Artificial Sequence: Synthetic peptide
  Seed: YEFLWGPRAL (MAGA1_HUMAN)
YCFLWGPRAM

SEQ ID NO: 44468 - protein, 11 aa, Artificial Sequence
  Description of Artificial Sequence: Synthetic peptide
  Seed: KEADPTGHSYV (MAGA1_HUMAN)
KEADPTGHSYI

SEQ ID NO: 44469 - protein, 9 aa, Artificial Sequence
  Description of Artificial Sequence: Synthetic peptide
  Seed: LTQDLVQEK (MAGA1_HUMAN)
LSQDLVQEL

SEQ ID NO: 44470 - protein, 11 aa, Artificial Sequence
  Description of Artificial Sequence: Synthetic peptide
  Seed: GASAFPTTINF (MAGA1_HUMAN)
GMSAFPTTINW

SEQ ID NO: 44471 - protein, 11 aa, Artificial Sequence
  Description of Artificial Sequence: Synthetic peptide
  Seed: STDPPQSPQGA (MAGA1_HUMAN)
SSDPPQSPQGY

SEQ ID NO: 44472 - protein, 9 aa, Artificial Sequence
  Description of Artificial Sequence: Synthetic peptide
  Seed: GTLEEVPTA (MAGA1_HUMAN)
GQLEEVPTA

SEQ ID NO: 44473 - protein, 11 aa, Artificial Sequence
  Description of Artificial Sequence: Synthetic peptide
  Seed: STDPPQSPQGA (MAGA1_HUMAN)
SMDPPQSPQGL

SEQ ID NO: 44474 - protein, 9 aa, Artificial Sequence
  Description of Artificial Sequence: Synthetic peptide
  Seed: VQAATSSSS (MAGA1_HUMAN)
VNAATSSSF

SEQ ID NO: 44475 - protein, 10 aa, Artificial Sequence
  Description of Artificial Sequence: Synthetic peptide
  Seed: KKVADLVGFL (MAGA1_HUMAN)
KQVADLVGFI

SEQ ID NO: 44476 - protein, 10 aa, Artificial Sequence
  Description of Artificial Sequence: Synthetic peptide
  Seed: ATSSSSPLVL (MAGA1_HUMAN)
ATSSSSPLVF

SEQ ID NO: 44477 - protein, 8 aa, Artificial Sequence
  Description of Artificial Sequence: Synthetic peptide
  Seed: AYGEPRKL (MAGA1_HUMAN)
AYGEPRKF

SEQ ID NO: 44478 - protein, 9 aa, Artificial Sequence
  Description of Artificial Sequence: Synthetic peptide
  Seed: GASAFPTTI (MAGA1_HUMAN)
GTSAFPTTY

SEQ ID NO: 44479 - protein, 11 aa, Artificial Sequence
  Description of Artificial Sequence: Synthetic peptide
  Seed: RQVPDSDPARY (MAGA1_HUMAN)
RLVPDSDPARR

SEQ ID NO: 44480 - protein, 9 aa, Artificial Sequence
  Description of Artificial Sequence: Synthetic peptide
  Seed: MEGGHAPEE (MAGA1_HUMAN)
MEGGHAPEI

SEQ ID NO: 44481 - protein, 10 aa, Artificial Sequence
  Description of Artificial Sequence: Synthetic peptide
  Seed: RVRFFFPSLR (MAGA1_HUMAN)
RTRFFFPSLQ

SEQ ID NO: 44482 - protein, 10 aa, Artificial Sequence
  Description of Artificial Sequence: Synthetic peptide
  Seed: SARVRFFFPS (MAGA1_HUMAN)
SVRVRFFFPR

SEQ ID NO: 44483 - protein, 9 aa, Artificial Sequence
  Description of Artificial Sequence: Synthetic peptide
  Seed: REHSAYGEP (MAGA1_HUMAN)
REHSAYGEI

SEQ ID NO: 44484 - protein, 9 aa, Artificial Sequence
  Description of Artificial Sequence: Synthetic peptide
  Seed: AQQEALGLV (MAGA1_HUMAN)
AEQEALGLI

SEQ ID NO: 44485 - protein, 9 aa, Artificial Sequence
  Description of Artificial Sequence: Synthetic peptide
  Seed: FLWGPRALA (MAGA1_HUMAN)
FQWGPRALL

SEQ ID NO: 44486 - protein, 9 aa, Artificial Sequence
  Description of Artificial Sequence: Synthetic peptide
  Seed: GASAFPTTI (MAGA1_HUMAN)
GVSAFPTTF

SEQ ID NO: 44487 - protein, 9 aa, Artificial Sequence
  Description of Artificial Sequence: Synthetic peptide
  Seed: GLVCVQAAT (MAGA1_HUMAN)
GLVCVQAAI

SEQ ID NO: 44488 - protein, 10 aa, Artificial Sequence
  Description of Artificial Sequence: Synthetic peptide
  Seed: KNYKHCFPEI (MAGA1_HUMAN)
KAYKHCFPEA

SEQ ID NO: 44489 - protein, 9 aa, Artificial Sequence
  Description of Artificial Sequence: Synthetic peptide
  Seed: STDPPQSPQ (MAGA1_HUMAN)
SQDPPQSPL

SEQ ID NO: 44490 - protein, 9 aa, Artificial Sequence
  Description of Artificial Sequence: Synthetic peptide
  Seed: SSPLVLGTL (MAGA1_HUMAN)
SVPLVLGTY

SEQ ID NO: 44491 - protein, 10 aa, Artificial Sequence
  Description of Artificial Sequence: Synthetic peptide
  Seed: KEADPTGHSY (MAGA1_HUMAN)
KTADPTGHSW

SEQ ID NO: 44492 - protein, 9 aa, Artificial Sequence
  Description of Artificial Sequence: Synthetic peptide
  Seed: QIMPKTGFL (MAGA1_HUMAN)
QQMPKTGFV

SEQ ID NO: 44493 - protein, 10 aa, Artificial Sequence
  Description of Artificial Sequence: Synthetic peptide
  Seed: KNYKHCFPEI (MAGA1_HUMAN)
KDYKHCFPEK

SEQ ID NO: 44494 - protein, 9 aa, Artificial Sequence
  Description of Artificial Sequence: Synthetic peptide
  Seed: RVRFFFPSL (MAGA1_HUMAN)
RQRFFFPSR

SEQ ID NO: 44495 - protein, 10 aa, Artificial Sequence
  Description of Artificial Sequence: Synthetic peptide
  Seed: SARVRFFFPS (MAGA1_HUMAN)
SVRVRFFFPY

SEQ ID NO: 44496 - protein, 9 aa, Artificial Sequence
  Description of Artificial Sequence: Synthetic peptide
  Seed: SAFPTTINF (MAGA1_HUMAN)
SFFPTTINI

SEQ ID NO: 44497 - protein, 11 aa, Artificial Sequence
  Description of Artificial Sequence: Synthetic peptide
  Seed: EIFGKASESLQ (MAGA1_HUMAN)
ESFGKASESLR

SEQ ID NO: 44498 - protein, 10 aa, Artificial Sequence
  Description of Artificial Sequence: Synthetic peptide
  Seed: ASAFPTTINF (MAGA1_HUMAN)
AGAFPTTINW

SEQ ID NO: 44499 - protein, 9 aa, Artificial Sequence
  Description of Artificial Sequence: Synthetic peptide
  Seed: FPSLREAAL (MAGA1_HUMAN)
FTSLREAAY

SEQ ID NO: 44500 - protein, 11 aa, Artificial Sequence
  Description of Artificial Sequence: Synthetic peptide
  Seed: RVRFFFPSLRE (MAGA1_HUMAN)
RRRFFFPSLRL

SEQ ID NO: 44501 - protein, 9 aa, Artificial Sequence
  Description of Artificial Sequence: Synthetic peptide
  Seed: VQAATSSSS (MAGA1_HUMAN)
VEAATSSSM

SEQ ID NO: 44502 - protein, 11 aa, Artificial Sequence
  Description of Artificial Sequence: Synthetic peptide
  Seed: KVLEYVIKVSA (MAGA1_HUMAN)
KLLEYVIKVSV

SEQ ID NO: 44503 - protein, 10 aa, Artificial Sequence
  Description of Artificial Sequence: Synthetic peptide
  Seed: ADPTGHSYVL (MAGA1_HUMAN)
AHPTGHSYVL

SEQ ID NO: 44504 - protein, 9 aa, Artificial Sequence
  Description of Artificial Sequence: Synthetic peptide
  Seed: LKYRAREPV (MAGA1_HUMAN)
LMYRAREPH

SEQ ID NO: 44505 - protein, 10 aa, Artificial Sequence
  Description of Artificial Sequence: Synthetic peptide
  Seed: KEADPTGHSY (MAGA1_HUMAN)
KIADPTGHSL

SEQ ID NO: 44506 - protein, 10 aa, Artificial Sequence
  Description of Artificial Sequence: Synthetic peptide
  Seed: SARVRFFFPS (MAGA1_HUMAN)
SHRVRFFFPK

SEQ ID NO: 44507 - protein, 9 aa, Artificial Sequence
  Description of Artificial Sequence: Synthetic peptide
  Seed: TKAEMLESV (MAGA1_HUMAN)
TMAEMLESI

SEQ ID NO: 44508 - protein, 9 aa, Artificial Sequence
  Description of Artificial Sequence: Synthetic peptide
  Seed: EIWEELSVM (MAGA1_HUMAN)
EPWEELSVM

SEQ ID NO: 44509 - protein, 9 aa, Artificial Sequence
  Description of Artificial Sequence: Synthetic peptide
  Seed: ASESLQLVF (MAGA1_HUMAN)
ASESLQLVW

SEQ ID NO: 44510 - protein, 11 aa, Artificial Sequence
  Description of Artificial Sequence: Synthetic peptide
  Seed: RQVPDSDPARY (MAGA1_HUMAN)
RVVPDSDPARY

SEQ ID NO: 44511 - protein, 10 aa, Artificial Sequence
  Description of Artificial Sequence: Synthetic peptide
  Seed: ATSSSSPLVL (MAGA1_HUMAN)
AISSSSPLVW

SEQ ID NO: 44512 - protein, 11 aa, Artificial Sequence
  Description of Artificial Sequence: Synthetic peptide
  Seed: YEFLWGPRALA (MAGA1_HUMAN)
YNFLWGPRALI

SEQ ID NO: 44513 - protein, 10 aa, Artificial Sequence
  Description of Artificial Sequence: Synthetic peptide
  Seed: SARVRFFFPS (MAGA1_HUMAN)
SARVRFFFPK

SEQ ID NO: 44514 - protein, 9 aa, Artificial Sequence
  Description of Artificial Sequence: Synthetic peptide
  Seed: LEYVIKVSA (MAGA1_HUMAN)
LEYVIKVSY

SEQ ID NO: 44515 - protein, 9 aa, Artificial Sequence
  Description of Artificial Sequence: Synthetic peptide
  Seed: IKVSARVRF (MAGA1_HUMAN)
IMVSARVRM

SEQ ID NO: 44516 - protein, 9 aa, Artificial Sequence
  Description of Artificial Sequence: Synthetic peptide
  Seed: VADLVGFLL (MAGA1_HUMAN)
VMDLVGFLV

SEQ ID NO: 44517 - protein, 9 aa, Artificial Sequence
  Description of Artificial Sequence: Synthetic peptide
  Seed: IMPKTGFLI (MAGA1_HUMAN)
IIPKTGFLV

SEQ ID NO: 44518 - protein, 10 aa, Artificial Sequence
  Description of Artificial Sequence: Synthetic peptide
  Seed: ARVRFFFPSL (MAGA1_HUMAN)
ANVRFFFPSI

SEQ ID NO: 44519 - protein, 8 aa, Artificial Sequence
  Description of Artificial Sequence: Synthetic peptide
  Seed: MSLEQRSL (MAGA1_HUMAN)
MQLEQRSV

SEQ ID NO: 44520 - protein, 9 aa, Artificial Sequence
  Description of Artificial Sequence: Synthetic peptide
  Seed: KASESLQLV (MAGA1_HUMAN)
KRSESLQLM

SEQ ID NO: 44521 - protein, 10 aa, Artificial Sequence
  Description of Artificial Sequence: Synthetic peptide
  Seed: SCILESLFRA (MAGA1_HUMAN)
SGILESLFRI

SEQ ID NO: 44522 - protein, 9 aa, Artificial Sequence
  Description of Artificial Sequence: Synthetic peptide
  Seed: RVRFFFPSL (MAGA1_HUMAN)
RMRFFFPSM

SEQ ID NO: 44523 - protein, 10 aa, Artificial Sequence
  Description of Artificial Sequence: Synthetic peptide
  Seed: YEFLWGPRAL (MAGA1_HUMAN)
YTFLWGPRAY

SEQ ID NO: 44524 - protein, 9 aa, Artificial Sequence
  Description of Artificial Sequence: Synthetic peptide
  Seed: SAFPTTINF (MAGA1_HUMAN)
SPFPTTINI

SEQ ID NO: 44525 - protein, 9 aa, Artificial Sequence
  Description of Artificial Sequence: Synthetic peptide
  Seed: FPSLREAAL (MAGA1_HUMAN)
FISLREAAL

SEQ ID NO: 44526 - protein, 9 aa, Artificial Sequence
  Description of Artificial Sequence: Synthetic peptide
  Seed: RAREPVTKA (MAGA1_HUMAN)
RYREPVTKA

SEQ ID NO: 44527 - protein, 10 aa, Artificial Sequence
  Description of Artificial Sequence: Synthetic peptide
  Seed: RAREPVTKAE (MAGA1_HUMAN)
RQREPVTKAK

SEQ ID NO: 44528 - protein, 9 aa, Artificial Sequence
  Description of Artificial Sequence: Synthetic peptide
  Seed: YKHCFPEIF (MAGA1_HUMAN)
YRHCFPEIY

SEQ ID NO: 44529 - protein, 11 aa, Artificial Sequence
  Description of Artificial Sequence: Synthetic peptide
  Seed: RVRFFFPSLRE (MAGA1_HUMAN)
RSRFFFPSLRR

SEQ ID NO: 44530 - protein, 9 aa, Artificial Sequence
  Description of Artificial Sequence: Synthetic peptide
  Seed: AQQEALGLV (MAGA1_HUMAN)
AIQEALGLI

SEQ ID NO: 44531 - protein, 9 aa, Artificial Sequence
  Description of Artificial Sequence: Synthetic peptide
  Seed: LEYVIKVSA (MAGA1_HUMAN)
LHYVIKVSA

SEQ ID NO: 44532 - protein, 9 aa, Artificial Sequence
  Description of Artificial Sequence: Synthetic peptide
  Seed: MPKTGFLII (MAGA1_HUMAN)
MIKTGFLIY

SEQ ID NO: 44533 - protein, 11 aa, Artificial Sequence
  Description of Artificial Sequence: Synthetic peptide
  Seed: RQVPDSDPARY (MAGA1_HUMAN)
RKVPDSDPARF

SEQ ID NO: 44534 - protein, 11 aa, Artificial Sequence
  Description of Artificial Sequence: Synthetic peptide
  Seed: CILESLFRAVI (MAGA1_HUMAN)
CLLESLFRAVV

SEQ ID NO: 44535 - protein, 9 aa, Artificial Sequence
  Description of Artificial Sequence: Synthetic peptide
  Seed: KVSARVRFF (MAGA1_HUMAN)
KASARVRFY

SEQ ID NO: 44536 - protein, 9 aa, Artificial Sequence
  Description of Artificial Sequence: Synthetic peptide
  Seed: KYRAREPVT (MAGA1_HUMAN)
KMRAREPVI

SEQ ID NO: 44537 - protein, 9 aa, Artificial Sequence
  Description of Artificial Sequence: Synthetic peptide
  Seed: RVRFFFPSL (MAGA1_HUMAN)
RTRFFFPSH

SEQ ID NO: 44538 - protein, 10 aa, Artificial Sequence
  Description of Artificial Sequence: Synthetic peptide
  Seed: SARVRFFFPS (MAGA1_HUMAN)
SRRVRFFFPR

SEQ ID NO: 44539 - protein, 9 aa, Artificial Sequence
  Description of Artificial Sequence: Synthetic peptide
  Seed: NQIMPKTGF (MAGA1_HUMAN)
NEIMPKTGY

SEQ ID NO: 44540 - protein, 9 aa, Artificial Sequence
  Description of Artificial Sequence: Synthetic peptide
  Seed: LVQEKYLEY (MAGA1_HUMAN)
LRQEKYLEM

SEQ ID NO: 44541 - protein, 9 aa, Artificial Sequence
  Description of Artificial Sequence: Synthetic peptide
  Seed: IKVSARVRF (MAGA1_HUMAN)
ILVSARVRF

SEQ ID NO: 44542 - protein, 9 aa, Artificial Sequence
  Description of Artificial Sequence: Synthetic peptide
  Seed: RQVPDSDPA (MAGA1_HUMAN)
RQVPDSDPF

SEQ ID NO: 44543 - protein, 10 aa, Artificial Sequence
  Description of Artificial Sequence: Synthetic peptide
  Seed: KNYKHCFPEI (MAGA1_HUMAN)
KMYKHCFPEW

SEQ ID NO: 44544 - protein, 9 aa, Artificial Sequence
  Description of Artificial Sequence: Synthetic peptide
  Seed: LVQEKYLEY (MAGA1_HUMAN)
LTQEKYLEK

SEQ ID NO: 44545 - protein, 9 aa, Artificial Sequence
  Description of Artificial Sequence: Synthetic peptide
  Seed: QSPQGASAF (MAGA1_HUMAN)
QAPQGASAY

SEQ ID NO: 44546 - protein, 9 aa, Artificial Sequence
  Description of Artificial Sequence: Synthetic peptide
  Seed: FFFPSLREA (MAGA1_HUMAN)
FLFPSLREC

SEQ ID NO: 44547 - protein, 10 aa, Artificial Sequence
  Description of Artificial Sequence: Synthetic peptide
  Seed: ARVRFFFPSL (MAGA1_HUMAN)
ATVRFFFPSK

SEQ ID NO: 44548 - protein, 10 aa, Artificial Sequence
  Description of Artificial Sequence: Synthetic peptide
  Seed: TSYVKVLEYV (MAGA1_HUMAN)
TIYVKVLEYV

SEQ ID NO: 44549 - protein, 9 aa, Artificial Sequence
  Description of Artificial Sequence: Synthetic peptide
  Seed: FPSLREAAL (MAGA1_HUMAN)
FPSLREAAY

SEQ ID NO: 44550 - protein, 10 aa, Artificial Sequence
  Description of Artificial Sequence: Synthetic peptide
  Seed: KVSARVRFFF (MAGA1_HUMAN)
KVSARVRFFA

SEQ ID NO: 44551 - protein, 10 aa, Artificial Sequence
  Description of Artificial Sequence: Synthetic peptide
  Seed: ARVRFFFPSL (MAGA1_HUMAN)
AHVRFFFPSI

SEQ ID NO: 44552 - protein, 10 aa, Artificial Sequence
  Description of Artificial Sequence: Synthetic peptide
  Seed: RALAETSYVK (MAGA1_HUMAN)
RGLAETSYVR

SEQ ID NO: 44553 - protein, 9 aa, Artificial Sequence
  Description of Artificial Sequence: Synthetic peptide
  Seed: KVLEYVIKV (MAGA1_HUMAN)
KVLEYVIKR

SEQ ID NO: 44554 - protein, 11 aa, Artificial Sequence
  Description of Artificial Sequence: Synthetic peptide
  Seed: ARVRFFFPSLR (MAGA1_HUMAN)
AMVRFFFPSLR

SEQ ID NO: 44555 - protein, 11 aa, Artificial Sequence
  Description of Artificial Sequence: Synthetic peptide
  Seed: VQAATSSSSPL (MAGA1_HUMAN)
VMAATSSSSPM

SEQ ID NO: 44556 - protein, 11 aa, Artificial Sequence
  Description of Artificial Sequence: Synthetic peptide
  Seed: REAALREEEEG (MAGA1_HUMAN)
REAALREEEEA

SEQ ID NO: 44557 - protein, 9 aa, Artificial Sequence
  Description of Artificial Sequence: Synthetic peptide
  Seed: RVRFFFPSL (MAGA1_HUMAN)
RIRFFFPSK

SEQ ID NO: 44558 - protein, 11 aa, Artificial Sequence
  Description of Artificial Sequence: Synthetic peptide
  Seed: YVKVLEYVIKV (MAGA1_HUMAN)
YKKVLEYVIKV

SEQ ID NO: 44559 - protein, 10 aa, Artificial Sequence
  Description of Artificial Sequence: Synthetic peptide
  Seed: QIMPKTGFLI (MAGA1_HUMAN)
QLMPKTGFLI

SEQ ID NO: 44560 - protein, 11 aa, Artificial Sequence
  Description of Artificial Sequence: Synthetic peptide
  Seed: STDPPQSPQGA (MAGA1_HUMAN)
SIDPPQSPQGY

SEQ ID NO: 44561 - protein, 9 aa, Artificial Sequence
  Description of Artificial Sequence: Synthetic peptide
  Seed: KASESLQLV (MAGA1_HUMAN)
KESESLQLV

SEQ ID NO: 44562 - protein, 9 aa, Artificial Sequence
  Description of Artificial Sequence: Synthetic peptide
  Seed: GTLEEVPTA (MAGA1_HUMAN)
GMLEEVPTV

SEQ ID NO: 44563 - protein, 10 aa, Artificial Sequence
  Description of Artificial Sequence: Synthetic peptide
  Seed: KNYKHCFPEI (MAGA1_HUMAN)
KPYKHCFPEK

SEQ ID NO: 44564 - protein, 9 aa, Artificial Sequence
  Description of Artificial Sequence: Synthetic peptide
  Seed: FLWGPRALA (MAGA1_HUMAN)
FMWGPRALV

SEQ ID NO: 44565 - protein, 9 aa, Artificial Sequence
  Description of Artificial Sequence: Synthetic peptide
  Seed: TTINFTRQR (MAGA1_HUMAN)
TAINFTRQM

SEQ ID NO: 44566 - protein, 10 aa, Artificial Sequence
  Description of Artificial Sequence: Synthetic peptide
  Seed: RYEFLWGPRA (MAGA1_HUMAN)
RTEFLWGPRL

SEQ ID NO: 44567 - protein, 9 aa, Artificial Sequence
  Description of Artificial Sequence: Synthetic peptide
  Seed: LVTCLGLSY (MAGA1_HUMAN)
LQTCLGLSW

SEQ ID NO: 44568 - protein, 10 aa, Artificial Sequence
  Description of Artificial Sequence: Synthetic peptide
  Seed: RVRFFFPSLR (MAGA1_HUMAN)
RSRFFFPSLT

SEQ ID NO: 44569 - protein, 9 aa, Artificial Sequence
  Description of Artificial Sequence: Synthetic peptide
  Seed: ATSSSSPLV (MAGA1_HUMAN)
AMSSSSPLW

SEQ ID NO: 44570 - protein, 11 aa, Artificial Sequence
  Description of Artificial Sequence: Synthetic peptide
  Seed: STSCILESLFR (MAGA1_HUMAN)
SSSCILESLFR

SEQ ID NO: 44571 - protein, 10 aa, Artificial Sequence
  Description of Artificial Sequence: Synthetic peptide
  Seed: ADPTGHSYVL (MAGA1_HUMAN)
AQPTGHSYVM

SEQ ID NO: 44572 - protein, 9 aa, Artificial Sequence
  Description of Artificial Sequence: Synthetic peptide
  Seed: ADPTGHSYV (MAGA1_HUMAN)
AEPTGHSYA

SEQ ID NO: 44573 - protein, 9 aa, Artificial Sequence
  Description of Artificial Sequence: Synthetic peptide
  Seed: IMPKTGFLI (MAGA1_HUMAN)
ISPKTGFLL

SEQ ID NO: 44574 - protein, 9 aa, Artificial Sequence
  Description of Artificial Sequence: Synthetic peptide
  Seed: RVRFFFPSL (MAGA1_HUMAN)
RTRFFFPSN

SEQ ID NO: 44575 - protein, 9 aa, Artificial Sequence
  Description of Artificial Sequence: Synthetic peptide
  Seed: TKAEMLESV (MAGA1_HUMAN)
TMAEMLESM

SEQ ID NO: 44576 - protein, 10 aa, Artificial Sequence
  Description of Artificial Sequence: Synthetic peptide
  Seed: ATSSSSPLVL (MAGA1_HUMAN)
AQSSSSPLVW

SEQ ID NO: 44577 - protein, 9 aa, Artificial Sequence
  Description of Artificial Sequence: Synthetic peptide
  Seed: DSDPARYEF (MAGA1_HUMAN)
DWDPARYEL

SEQ ID NO: 44578 - protein, 9 aa, Artificial Sequence
  Description of Artificial Sequence: Synthetic peptide
  Seed: EADPTGHSY (MAGA1_HUMAN)
EFDPTGHSV

SEQ ID NO: 44579 - protein, 9 aa, Artificial Sequence
  Description of Artificial Sequence: Synthetic peptide
  Seed: TKAEMLESV (MAGA1_HUMAN)
TLAEMLESI

SEQ ID NO: 44580 - protein, 9 aa, Artificial Sequence
  Description of Artificial Sequence: Synthetic peptide
  Seed: FLIIVLVMI (MAGA1_HUMAN)
FTIIVLVMI

SEQ ID NO: 44581 - protein, 10 aa, Artificial Sequence
  Description of Artificial Sequence: Synthetic peptide
  Seed: SAFPTTINFT (MAGA1_HUMAN)
SLFPTTINFI

SEQ ID NO: 44582 - protein, 11 aa, Artificial Sequence
  Description of Artificial Sequence: Synthetic peptide
  Seed: RQVPDSDPARY (MAGA1_HUMAN)
RYVPDSDPARY

SEQ ID NO: 44583 - protein, 10 aa, Artificial Sequence
  Description of Artificial Sequence: Synthetic peptide
  Seed: ADPTGHSYVL (MAGA1_HUMAN)
AQPTGHSYVL

SEQ ID NO: 44584 - protein, 9 aa, Artificial Sequence
  Description of Artificial Sequence: Synthetic peptide
  Seed: IMPKTGFLI (MAGA1_HUMAN)
ITPKTGFLL

SEQ ID NO: 44585 - protein, 9 aa, Artificial Sequence
  Description of Artificial Sequence: Synthetic peptide
  Seed: RVRFFFPSL (MAGA1_HUMAN)
RQRFFFPSS

SEQ ID NO: 44586 - protein, 10 aa, Artificial Sequence
  Description of Artificial Sequence: Synthetic peptide
  Seed: EVYDGREHSA (MAGA1_HUMAN)
EMYDGREHSI

SEQ ID NO: 44587 - protein, 11 aa, Artificial Sequence
  Description of Artificial Sequence: Synthetic peptide
  Seed: SPLVLGTLEEV (MAGA1_HUMAN)
SMLVLGTLEEV

SEQ ID NO: 44588 - protein, 10 aa, Artificial Sequence
  Description of Artificial Sequence: Synthetic peptide
  Seed: KASESLQLVF (MAGA1_HUMAN)
KWSESLQLVW

SEQ ID NO: 44589 - protein, 9 aa, Artificial Sequence
  Description of Artificial Sequence: Synthetic peptide
  Seed: ALAETSYVK (MAGA1_HUMAN)
AAAETSYVK

SEQ ID NO: 44590 - protein, 9 aa, Artificial Sequence
  Description of Artificial Sequence: Synthetic peptide
  Seed: QQEALGLVC (MAGA1_HUMAN)
QEEALGLVT

SEQ ID NO: 44591 - protein, 8 aa, Artificial Sequence
  Description of Artificial Sequence: Synthetic peptide
  Seed: FGKASESL (MAGA1_HUMAN)
FAKASESL

SEQ ID NO: 44592 - protein, 9 aa, Artificial Sequence
  Description of Artificial Sequence: Synthetic peptide
  Seed: TSSSSPLVL (MAGA1_HUMAN)
TVSSSPLVF

SEQ ID NO: 44593 - protein, 9 aa, Artificial Sequence
  Description of Artificial Sequence: Synthetic peptide
  Seed: VRFFFPSLR (MAGA1_HUMAN)
VFFFFPSLR

SEQ ID NO: 44594 - protein, 9 aa, Artificial Sequence
  Description of Artificial Sequence: Synthetic peptide
  Seed: SAYGEPRKL (MAGA1_HUMAN)
SKYGEPRKY

SEQ ID NO: 44595 - protein, 11 aa, Artificial Sequence
  Description of Artificial Sequence: Synthetic peptide
  Seed: ARVRFFFPSLR (MAGA1_HUMAN)
AYVRFFFPSLR

SEQ ID NO: 44596 - protein, 9 aa, Artificial Sequence
  Description of Artificial Sequence: Synthetic peptide
  Seed: RVRFFFPSL (MAGA1_HUMAN)
RLRFFFPSM

SEQ ID NO: 44597 - protein, 9 aa, Artificial Sequence
  Description of Artificial Sequence: Synthetic peptide
  Seed: IKVSARVRF (MAGA1_HUMAN)
IQVSARVRL

SEQ ID NO: 44598 - protein, 9 aa, Artificial Sequence
  Description of Artificial Sequence: Synthetic peptide
  Seed: HSYVLVTCL (MAGA1_HUMAN)
HMYVLVTCL

SEQ ID NO: 44599 - protein, 9 aa, Artificial Sequence
  Description of Artificial Sequence: Synthetic peptide
  Seed: TSCILESLF (MAGA1_HUMAN)
TQCILESLY

SEQ ID NO: 44600 - protein, 9 aa, Artificial Sequence
  Description of Artificial Sequence: Synthetic peptide
  Seed: RVRFFFPSL (MAGA1_HUMAN)
RRRFFFPSM

SEQ ID NO: 44601 - protein, 9 aa, Artificial Sequence
  Description of Artificial Sequence: Synthetic peptide
  Seed: ALGLVCVQA (MAGA1_HUMAN)
AMGLVCVQA

SEQ ID NO: 44602 - protein, 10 aa, Artificial Sequence
  Description of Artificial Sequence: Synthetic peptide
  Seed: ATSSSSPLVL (MAGA1_HUMAN)
ASSSSSPLVF

SEQ ID NO: 44603 - protein, 10 aa, Artificial Sequence
  Description of Artificial Sequence: Synthetic peptide
  Seed: RVRFFFPSLR (MAGA1_HUMAN)
RARFFFPSLT

SEQ ID NO: 44604 - protein, 11 aa, Artificial Sequence
  Description of Artificial Sequence: Synthetic peptide
  Seed: IKVSARVRFFF (MAGA1_HUMAN)
IFVSARVRFFW

SEQ ID NO: 44605 - protein, 9 aa, Artificial Sequence
  Description of Artificial Sequence: Synthetic peptide
  Seed: LGDNQIMPK (MAGA1_HUMAN)
LVDNQIMPY

SEQ ID NO: 44606 - protein, 10 aa, Artificial Sequence
  Description of Artificial Sequence: Synthetic peptide
  Seed: SARVRFFFPS (MAGA1_HUMAN)
SIRVRFFFPY

SEQ ID NO: 44607 - protein, 9 aa, Artificial Sequence
  Description of Artificial Sequence: Synthetic peptide
  Seed: VGFLLLKYR (MAGA1_HUMAN)
VMFLLLKYK

SEQ ID NO: 44608 - protein, 9 aa, Artificial Sequence
  Description of Artificial Sequence: Synthetic peptide
  Seed: KVLEYVIKV (MAGA1_HUMAN)
KQLEYVIKC

SEQ ID NO: 44609 - protein, 9 aa, Artificial Sequence
  Description of Artificial Sequence: Synthetic peptide
  Seed: QIMPKTGFL (MAGA1_HUMAN)
QLMPKTGFA

SEQ ID NO: 44610 - protein, 9 aa, Artificial Sequence
  Description of Artificial Sequence: Synthetic peptide
  Seed: GASAFPTTI (MAGA1_HUMAN)
GSSAFPTTM

SEQ ID NO: 44611 - protein, 9 aa, Artificial Sequence
  Description of Artificial Sequence: Synthetic peptide
  Seed: IAMEGGHAP (MAGA1_HUMAN)
IVMEGGHAL

SEQ ID NO: 44612 - protein, 8 aa, Artificial Sequence
  Description of Artificial Sequence: Synthetic peptide
  Seed: RAREPVTK (MAGA1_HUMAN)
RAREPVTY

SEQ ID NO: 44613 - protein, 9 aa, Artificial Sequence
  Description of Artificial Sequence: Synthetic peptide
  Seed: EADPTGHSY (MAGA1_HUMAN)
EYDPTGHSM

SEQ ID NO: 44614 - protein, 9 aa, Artificial Sequence
  Description of Artificial Sequence: Synthetic peptide
  Seed: QIMPKTGFL (MAGA1_HUMAN)
QVMPKTGFI

SEQ ID NO: 44615 - protein, 9 aa, Artificial Sequence
  Description of Artificial Sequence: Synthetic peptide
  Seed: ARYEFLWGP (MAGA1_HUMAN)
AQYEFLWGI

SEQ ID NO: 44616 - protein, 9 aa, Artificial Sequence
  Description of Artificial Sequence: Synthetic peptide
  Seed: TSSSSPLVL (MAGA1_HUMAN)
TPSSSPLVL

SEQ ID NO: 44617 - protein, 10 aa, Artificial Sequence
  Description of Artificial Sequence: Synthetic peptide
  Seed: MLESVIKNYK (MAGA1_HUMAN)
MGESVIKNYR

SEQ ID NO: 44618 - protein, 11 aa, Artificial Sequence
  Description of Artificial Sequence: Synthetic peptide
  Seed: EIFGKASESLQ (MAGA1_HUMAN)
ETFGKASESLR

SEQ ID NO: 44619 - protein, 10 aa, Artificial Sequence
  Description of Artificial Sequence: Synthetic peptide
  Seed: SLFRAVITKK (MAGA1_HUMAN)
SSFRAVITKK

SEQ ID NO: 44620 - protein, 11 aa, Artificial Sequence
  Description of Artificial Sequence: Synthetic peptide
  Seed: RVRFFFPSLRE (MAGA1_HUMAN)
RVRFFFPSLRI

SEQ ID NO: 44621 - protein, 10 aa, Artificial Sequence
  Description of Artificial Sequence: Synthetic peptide
  Seed: SARVRFFFPS (MAGA1_HUMAN)
SMRVRFFFPM

SEQ ID NO: 44622 - protein, 9 aa, Artificial Sequence
  Description of Artificial Sequence: Synthetic peptide
  Seed: QPSEGSSSR (MAGA1_HUMAN)
QISEGSSSK

SEQ ID NO: 44623 - protein, 9 aa, Artificial Sequence
  Description of Artificial Sequence: Synthetic peptide
  Seed: YVLVTCLGL (MAGA1_HUMAN)
YALVTCLGF

SEQ ID NO: 44624 - protein, 9 aa, Artificial Sequence
  Description of Artificial Sequence: Synthetic peptide
  Seed: LVLGTLEEV (MAGA1_HUMAN)
LALGTLEEM

SEQ ID NO: 44625 - protein, 9 aa, Artificial Sequence
  Description of Artificial Sequence: Synthetic peptide
  Seed: VQAATSSSS (MAGA1_HUMAN)
VIAATSSSY

SEQ ID NO: 44626 - protein, 9 aa, Artificial Sequence
  Description of Artificial Sequence: Synthetic peptide
  Seed: HSYVLVTCL (MAGA1_HUMAN)
HPYVLVTCY

SEQ ID NO: 44627 - protein, 8 aa, Artificial Sequence
  Description of Artificial Sequence: Synthetic peptide
  Seed: RVRFFFPS (MAGA1_HUMAN)
RQRFFFPK

SEQ ID NO: 44628 - protein, 10 aa, Artificial Sequence
  Description of Artificial Sequence: Synthetic peptide
  Seed: RVRFFFPSLR (MAGA1_HUMAN)
RNRFFFPSLR

SEQ ID NO: 44629 - protein, 9 aa, Artificial Sequence
  Description of Artificial Sequence: Synthetic peptide
  Seed: RAREPVTKA (MAGA1_HUMAN)
RAREPVTKR

SEQ ID NO: 44630 - protein, 10 aa, Artificial Sequence
  Description of Artificial Sequence: Synthetic peptide
  Seed: GFLLLKYRAR (MAGA1_HUMAN)
GTLLLKYRAR

SEQ ID NO: 44631 - protein, 9 aa, Artificial Sequence
  Description of Artificial Sequence: Synthetic peptide
  Seed: TSYVKVLEY (MAGA1_HUMAN)
TQYVKVLEK

SEQ ID NO: 44632 - protein, 10 aa, Artificial Sequence
  Description of Artificial Sequence: Synthetic peptide
  Seed: AQQEALGLVC (MAGA1_HUMAN)
ALQEALGLVW

SEQ ID NO: 44633 - protein, 9 aa, Artificial Sequence
  Description of Artificial Sequence: Synthetic peptide
  Seed: SLFRAVITK (MAGA1_HUMAN)
STFRAVITK

SEQ ID NO: 44634 - protein, 10 aa, Artificial Sequence
  Description of Artificial Sequence: Synthetic peptide
  Seed: SLFRAVITKK (MAGA1_HUMAN)
SSFRAVITKR

SEQ ID NO: 44635 - protein, 10 aa, Artificial Sequence
  Description of Artificial Sequence: Synthetic peptide
  Seed: KYRAREPVTK (MAGA1_HUMAN)
KVRAREPVTV

SEQ ID NO: 44636 - protein, 9 aa, Artificial Sequence
  Description of Artificial Sequence: Synthetic peptide
  Seed: ETSYVKVLE (MAGA1_HUMAN)
ELSYVKVLK

SEQ ID NO: 44637 - protein, 10 aa, Artificial Sequence
  Description of Artificial Sequence: Synthetic peptide
  Seed: SCILESLFRA (MAGA1_HUMAN)
SPILESLFRI

SEQ ID NO: 44638 - protein, 10 aa, Artificial Sequence
  Description of Artificial Sequence: Synthetic peptide
  Seed: WEELSVMEVY (MAGA1_HUMAN)
WSELSVMEVW

SEQ ID NO: 44639 - protein, 9 aa, Artificial Sequence
  Description of Artificial Sequence: Synthetic peptide
  Seed: KVLEYVIKV (MAGA1_HUMAN)
KLLEYVIKL

SEQ ID NO: 44640 - protein, 11 aa, Artificial Sequence
  Description of Artificial Sequence: Synthetic peptide
  Seed: YVKVLEYVIKV (MAGA1_HUMAN)
YHKVLEYVIKV

SEQ ID NO: 44641 - protein, 10 aa, Artificial Sequence
  Description of Artificial Sequence: Synthetic peptide
  Seed: CILESLFRAV (MAGA1_HUMAN)
CILESLFRAI

SEQ ID NO: 44642 - protein, 9 aa, Artificial Sequence
  Description of Artificial Sequence: Synthetic peptide
  Seed: ALGLVCVQA (MAGA1_HUMAN)
AMGLVCVQV

SEQ ID NO: 44643 - protein, 10 aa, Artificial Sequence
  Description of Artificial Sequence: Synthetic peptide
  Seed: ADPTGHSYVL (MAGA1_HUMAN)
ACPTGHSYVM

SEQ ID NO: 44644 - protein, 11 aa, Artificial Sequence
  Description of Artificial Sequence: Synthetic peptide
  Seed: SARVRFFFPSL (MAGA1_HUMAN)
SMRVRFFFPSM

SEQ ID NO: 44645 - protein, 9 aa, Artificial Sequence
  Description of Artificial Sequence: Synthetic peptide
  Seed: TSCILESLF (MAGA1_HUMAN)
TACILESLW

SEQ ID NO: 44646 - protein, 9 aa, Artificial Sequence
  Description of Artificial Sequence: Synthetic peptide
  Seed: AYGEPRKLL (MAGA1_HUMAN)
ARGEPRKLF

SEQ ID NO: 44647 - protein, 9 aa, Artificial Sequence
  Description of Artificial Sequence: Synthetic peptide
  Seed: RAREPVTKA (MAGA1_HUMAN)
RRREPVTKM

SEQ ID NO: 44648 - protein, 9 aa, Artificial Sequence
  Description of Artificial Sequence: Synthetic peptide
  Seed: VADLVGFLL (MAGA1_HUMAN)
VLDLVGFLY

SEQ ID NO: 44649 - protein, 9 aa, Artificial Sequence
  Description of Artificial Sequence: Synthetic peptide
  Seed: QSPQGASAF (MAGA1_HUMAN)
QYPQGASAY

SEQ ID NO: 44650 - protein, 10 aa, Artificial Sequence
  Description of Artificial Sequence: Synthetic peptide
  Seed: KYRAREPVTK (MAGA1_HUMAN)
KGRAREPVTK

SEQ ID NO: 44651 - protein, 9 aa, Artificial Sequence
  Description of Artificial Sequence: Synthetic peptide
  Seed: TSSSSPLVL (MAGA1_HUMAN)
TTSSSPLVV

SEQ ID NO: 44652 - protein, 9 aa, Artificial Sequence
  Description of Artificial Sequence: Synthetic peptide
  Seed: KASESLQLV (MAGA1_HUMAN)
KSSESLQLW

SEQ ID NO: 44653 - protein, 9 aa, Artificial Sequence
  Description of Artificial Sequence: Synthetic peptide
  Seed: SAFPTTINF (MAGA1_HUMAN)
SPFPTTINW

SEQ ID NO: 44654 - protein, 9 aa, Artificial Sequence
  Description of Artificial Sequence: Synthetic peptide
  Seed: ATSSSSPLV (MAGA1_HUMAN)
ATSSSSPLL

SEQ ID NO: 44655 - protein, 11 aa, Artificial Sequence
  Description of Artificial Sequence: Synthetic peptide
  Seed: IKVSARVRFFF (MAGA1_HUMAN)
ICVSARVRFFW

SEQ ID NO: 44656 - protein, 11 aa, Artificial Sequence
  Description of Artificial Sequence: Synthetic peptide
  Seed: IKVSARVRFFF (MAGA1_HUMAN)
INVSARVRFFW

SEQ ID NO: 44657 - protein, 9 aa, Artificial Sequence
  Description of Artificial Sequence: Synthetic peptide
  Seed: VIKNYKHCF (MAGA1_HUMAN)
VFKNYKHCM

SEQ ID NO: 44658 - protein, 10 aa, Artificial Sequence
  Description of Artificial Sequence: Synthetic peptide
  Seed: SARVRFFFPS (MAGA1_HUMAN)
SPRVRFFFPM

SEQ ID NO: 44659 - protein, 10 aa, Artificial Sequence
  Description of Artificial Sequence: Synthetic peptide
  Seed: ARVRFFFPSL (MAGA1_HUMAN)
AAVRFFFPSV

SEQ ID NO: 44660 - protein, 9 aa, Artificial Sequence
  Description of Artificial Sequence: Synthetic peptide
  Seed: QIMPKTGFL (MAGA1_HUMAN)
QPMPKTGFM

SEQ ID NO: 44661 - protein, 9 aa, Artificial Sequence
  Description of Artificial Sequence: Synthetic peptide
  Seed: SSPLVLGTL (MAGA1_HUMAN)
SMPLVLGTF

SEQ ID NO: 44662 - protein, 10 aa, Artificial Sequence
  Description of Artificial Sequence: Synthetic peptide
  Seed: SARVRFFFPS (MAGA1_HUMAN)
SYRVRFFFPM

SEQ ID NO: 44663 - protein, 10 aa, Artificial Sequence
  Description of Artificial Sequence: Synthetic peptide
  Seed: RVRFFFPSLR (MAGA1_HUMAN)
RQRFFFPSLL

SEQ ID NO: 44664 - protein, 10 aa, Artificial Sequence
  Description of Artificial Sequence: Synthetic peptide
  Seed: KAEMLESVIK (MAGA1_HUMAN)
KTEMLESVIK

SEQ ID NO: 44665 - protein, 10 aa, Artificial Sequence
  Description of Artificial Sequence: Synthetic peptide
  Seed: RVRFFFPSLR (MAGA1_HUMAN)
RDRFFFPSLY

SEQ ID NO: 44666 - protein, 9 aa, Artificial Sequence
  Description of Artificial Sequence: Synthetic peptide
  Seed: TQDLVQEKY (MAGA1_HUMAN)
TCDLVQEKM

SEQ ID NO: 44667 - protein, 10 aa, Artificial Sequence
  Description of Artificial Sequence: Synthetic peptide
  Seed: KASESLQLVF (MAGA1_HUMAN)
KPSESLQLVW

SEQ ID NO: 44668 - protein, 9 aa, Artificial Sequence
  Description of Artificial Sequence: Synthetic peptide
  Seed: WEELSVMEV (MAGA1_HUMAN)
WEELSVMEI

SEQ ID NO: 44669 - protein, 10 aa, Artificial Sequence
  Description of Artificial Sequence: Synthetic peptide
  Seed: EIFGKASESL (MAGA1_HUMAN)
ETFGKASESI

SEQ ID NO: 44670 - protein, 9 aa, Artificial Sequence
  Description of Artificial Sequence: Synthetic peptide
  Seed: SYVKVLEYV (MAGA1_HUMAN)
SWVKVLEYI

SEQ ID NO: 44671 - protein, 8 aa, Artificial Sequence
  Description of Artificial Sequence: Synthetic peptide
  Seed: VADLVGFL (MAGA1_HUMAN)
VVDLVGFL

SEQ ID NO: 44672 - protein, 9 aa, Artificial Sequence
  Description of Artificial Sequence: Synthetic peptide
  Seed: SAYGEPRKL (MAGA1_HUMAN)
SEYGEPRKY

SEQ ID NO: 44673 - protein, 11 aa, Artificial Sequence
  Description of Artificial Sequence: Synthetic peptide
  Seed: KVLEYVIKVSA (MAGA1_HUMAN)
KLLEYVIKVST

SEQ ID NO: 44674 - protein, 9 aa, Artificial Sequence
  Description of Artificial Sequence: Synthetic peptide
  Seed: KYRAREPVT (MAGA1_HUMAN)
KSRAREPVS

SEQ ID NO: 44675 - protein, 9 aa, Artificial Sequence
  Description of Artificial Sequence: Synthetic peptide
  Seed: TSSSSPLVL (MAGA1_HUMAN)
TYSSSPLVF

SEQ ID NO: 44676 - protein, 9 aa, Artificial Sequence
  Description of Artificial Sequence: Synthetic peptide
  Seed: SARVRFFFP (MAGA1_HUMAN)
SLRVRFFFG

SEQ ID NO: 44677 - protein, 9 aa, Artificial Sequence
  Description of Artificial Sequence: Synthetic peptide
  Seed: IAMEGGHAP (MAGA1_HUMAN)
IMMEGGHAM

SEQ ID NO: 44678 - protein, 10 aa, Artificial Sequence
  Description of Artificial Sequence: Synthetic peptide
  Seed: SARVRFFFPS (MAGA1_HUMAN)
SERVRFFFPV

SEQ ID NO: 44679 - protein, 9 aa, Artificial Sequence
  Description of Artificial Sequence: Synthetic peptide
  Seed: AYGEPRKLL (MAGA1_HUMAN)
AVGEPRKLL

SEQ ID NO: 44680 - protein, 9 aa, Artificial Sequence
  Description of Artificial Sequence: Synthetic peptide
  Seed: TSSSSPLVL (MAGA1_HUMAN)
TASSSPLVH

SEQ ID NO: 44681 - protein, 10 aa, Artificial Sequence
  Description of Artificial Sequence: Synthetic peptide
  Seed: VYDGREHSAY (MAGA1_HUMAN)
VSDGREHSAY

SEQ ID NO: 44682 - protein, 9 aa, Artificial Sequence
  Description of Artificial Sequence: Synthetic peptide
  Seed: KVSARVRFF (MAGA1_HUMAN)
KLSARVRFY

SEQ ID NO: 44683 - protein, 9 aa, Artificial Sequence
  Description of Artificial Sequence: Synthetic peptide
  Seed: SARVRFFFP (MAGA1_HUMAN)
STRVRFFFV

SEQ ID NO: 44684 - protein, 10 aa, Artificial Sequence
  Description of Artificial Sequence: Synthetic peptide
  Seed: KEADPTGHSY (MAGA1_HUMAN)
KFADPTGHSL

SEQ ID NO: 44685 - protein, 11 aa, Artificial Sequence
  Description of Artificial Sequence: Synthetic peptide
  Seed: CILESLFRAVI (MAGA1_HUMAN)
CLLESLFRAVL

SEQ ID NO: 44686 - protein, 9 aa, Artificial Sequence
  Description of Artificial Sequence: Synthetic peptide
  Seed: ADLVGFLLL (MAGA1_HUMAN)
AELVGFLLT

SEQ ID NO: 44687 - protein, 10 aa, Artificial Sequence
  Description of Artificial Sequence: Synthetic peptide
  Seed: MLESVIKNYK (MAGA1_HUMAN)
MVESVIKNYR

SEQ ID NO: 44688 - protein, 10 aa, Artificial Sequence
  Description of Artificial Sequence: Synthetic peptide
  Seed: FFPSLREAAL (MAGA1_HUMAN)
FFPSLREAAF

SEQ ID NO: 44689 - protein, 9 aa, Artificial Sequence
  Description of Artificial Sequence: Synthetic peptide
  Seed: RVRFFFPSL (MAGA1_HUMAN)
RWRFFFPSM

SEQ ID NO: 44690 - protein, 9 aa, Artificial Sequence
  Description of Artificial Sequence: Synthetic peptide
  Seed: SSPLVLGTL (MAGA1_HUMAN)
SMPLVLGTI

SEQ ID NO: 44691 - protein, 9 aa, Artificial Sequence
  Description of Artificial Sequence: Synthetic peptide
  Seed: ETSYVKVLE (MAGA1_HUMAN)
ELSYVKVLR

SEQ ID NO: 44692 - protein, 9 aa, Artificial Sequence
  Description of Artificial Sequence: Synthetic peptide
  Seed: RVRFFFPSL (MAGA1_HUMAN)
RQRFFFPSW

SEQ ID NO: 44693 - protein, 9 aa, Artificial Sequence
  Description of Artificial Sequence: Synthetic peptide
  Seed: RVRFFFPSL (MAGA1_HUMAN)
RYRFFFPSP

SEQ ID NO: 44694 - protein, 9 aa, Artificial Sequence
  Description of Artificial Sequence: Synthetic peptide
  Seed: VQAATSSSS (MAGA1_HUMAN)
VFAATSSSF

SEQ ID NO: 44695 - protein, 9 aa, Artificial Sequence
  Description of Artificial Sequence: Synthetic peptide
  Seed: SARVRFFFP (MAGA1_HUMAN)
SVRVRFFFN

SEQ ID NO: 44696 - protein, 10 aa, Artificial Sequence
  Description of Artificial Sequence: Synthetic peptide
  Seed: RAREPVTKAE (MAGA1_HUMAN)
RTREPVTKAG

SEQ ID NO: 44697 - protein, 9 aa, Artificial Sequence
  Description of Artificial Sequence: Synthetic peptide
  Seed: SYVKVLEYV (MAGA1_HUMAN)
SMVKVLEYT

SEQ ID NO: 44698 - protein, 10 aa, Artificial Sequence
  Description of Artificial Sequence: Synthetic peptide
  Seed: EIFGKASESL (MAGA1_HUMAN)
EAFGKASESY

SEQ ID NO: 44699 - protein, 9 aa, Artificial Sequence
  Description of Artificial Sequence: Synthetic peptide
  Seed: SAYGEPRKL (MAGA1_HUMAN)
SLYGEPRKV

SEQ ID NO: 44700 - protein, 10 aa, Artificial Sequence
  Description of Artificial Sequence: Synthetic peptide
  Seed: SCILESLFRA (MAGA1_HUMAN)
SIILESLFRI

SEQ ID NO: 44701 - protein, 9 aa, Artificial Sequence
  Description of Artificial Sequence: Synthetic peptide
  Seed: KEADPTGHS (MAGA1_HUMAN)
KEADPTGHL

SEQ ID NO: 44702 - protein, 9 aa, Artificial Sequence
  Description of Artificial Sequence: Synthetic peptide
  Seed: GDNQIMPKT (MAGA1_HUMAN)
GENQIMPKL

SEQ ID NO: 44703 - protein, 9 aa, Artificial Sequence
  Description of Artificial Sequence: Synthetic peptide
  Seed: DSDPARYEF (MAGA1_HUMAN)
DSDPARYEI

SEQ ID NO: 44704 - protein, 9 aa, Artificial Sequence
  Description of Artificial Sequence: Synthetic peptide
  Seed: VRFFFPSLR (MAGA1_HUMAN)
VGFFFPSLR

SEQ ID NO: 44705 - protein, 10 aa, Artificial Sequence
  Description of Artificial Sequence: Synthetic peptide
  Seed: EVYDGREHSA (MAGA1_HUMAN)
ELYDGREHSI

SEQ ID NO: 44706 - protein, 10 aa, Artificial Sequence
  Description of Artificial Sequence: Synthetic peptide
  Seed: FFPSLREAAL (MAGA1_HUMAN)
FAPSLREAAF

SEQ ID NO: 44707 - protein, 9 aa, Artificial Sequence
  Description of Artificial Sequence: Synthetic peptide
  Seed: RVRFFFPSL (MAGA1_HUMAN)
RYRFFFPSA

SEQ ID NO: 44708 - protein, 11 aa, Artificial Sequence
  Description of Artificial Sequence: Synthetic peptide
  Seed: FFFPSLREAAL (MAGA1_HUMAN)
FFFPSLREAAY

SEQ ID NO: 44709 - protein, 11 aa, Artificial Sequence
  Description of Artificial Sequence: Synthetic peptide
  Seed: RQVPDSDPARY (MAGA1_HUMAN)
RQVPDSDPARV

SEQ ID NO: 44710 - protein, 9 aa, Artificial Sequence
  Description of Artificial Sequence: Synthetic peptide
  Seed: RAREPVTKA (MAGA1_HUMAN)
RRREPVTKI

SEQ ID NO: 44711 - protein, 9 aa, Artificial Sequence
  Description of Artificial Sequence: Synthetic peptide
  Seed: ADLVGFLLL (MAGA1_HUMAN)
AELVGFLLA

SEQ ID NO: 44712 - protein, 8 aa, Artificial Sequence
  Description of Artificial Sequence: Synthetic peptide
  Seed: RVRFFFPS (MAGA1_HUMAN)
RMRFFFPK

SEQ ID NO: 44713 - protein, 10 aa, Artificial Sequence
  Description of Artificial Sequence: Synthetic peptide
  Seed: ARYEFLWGPR (MAGA1_HUMAN)
AMYEFLWGPK

SEQ ID NO: 44714 - protein, 9 aa, Artificial Sequence
  Description of Artificial Sequence: Synthetic peptide
  Seed: VADLVGFLL (MAGA1_HUMAN)
VYDLVGFLF

SEQ ID NO: 44715 - protein, 9 aa, Artificial Sequence
  Description of Artificial Sequence: Synthetic peptide
  Seed: VGFLLLKYR (MAGA1_HUMAN)
VFFLLLKYR

SEQ ID NO: 44716 - protein, 9 aa, Artificial Sequence
  Description of Artificial Sequence: Synthetic peptide
  Seed: TSYVKVLEY (MAGA1_HUMAN)
TAYVKVLEW

SEQ ID NO: 44717 - protein, 9 aa, Artificial Sequence
  Description of Artificial Sequence: Synthetic peptide
  Seed: VSARVRFFF (MAGA1_HUMAN)
VTARVRFFW

SEQ ID NO: 44718 - protein, 9 aa, Artificial Sequence
  Description of Artificial Sequence: Synthetic peptide
  Seed: TQDLVQEKY (MAGA1_HUMAN)
TQDLVQEKW

SEQ ID NO: 44719 - protein, 9 aa, Artificial Sequence
  Description of Artificial Sequence: Synthetic peptide
  Seed: FPTTINFTR (MAGA1_HUMAN)
FPTTINFTG

SEQ ID NO: 44720 - protein, 9 aa, Artificial Sequence
  Description of Artificial Sequence: Synthetic peptide
  Seed: KVLEYVIKV (MAGA1_HUMAN)
KGLEYVIKK

SEQ ID NO: 44721 - protein, 10 aa, Artificial Sequence
  Description of Artificial Sequence: Synthetic peptide
  Seed: ESLFRAVITK (MAGA1_HUMAN)
EWLFRAVITR

SEQ ID NO: 44722 - protein, 11 aa, Artificial Sequence
  Description of Artificial Sequence: Synthetic peptide
  Seed: YEFLWGPRALA (MAGA1_HUMAN)
YRFLWGPRALI

SEQ ID NO: 44723 - protein, 9 aa, Artificial Sequence
  Description of Artificial Sequence: Synthetic peptide
  Seed: KVLEYVIKV (MAGA1_HUMAN)
KKLEYVIKL

SEQ ID NO: 44724 - protein, 11 aa, Artificial Sequence
  Description of Artificial Sequence: Synthetic peptide
  Seed: ARVRFFFPSLR (MAGA1_HUMAN)
ARVRFFFPSLL

SEQ ID NO: 44725 - protein, 10 aa, Artificial Sequence
  Description of Artificial Sequence: Synthetic peptide
  Seed: VKVLEYVIKV (MAGA1_HUMAN)
VPVLEYVIKV

SEQ ID NO: 44726 - protein, 10 aa, Artificial Sequence
  Description of Artificial Sequence: Synthetic peptide
  Seed: KVSARVRFFF (MAGA1_HUMAN)
KHSARVRFFY

SEQ ID NO: 44727 - protein, 9 aa, Artificial Sequence
  Description of Artificial Sequence: Synthetic peptide
  Seed: IAMEGGHAP (MAGA1_HUMAN)
ILMEGGHAM

SEQ ID NO: 44728 - protein, 9 aa, Artificial Sequence
  Description of Artificial Sequence: Synthetic peptide
  Seed: VYDGREHSA (MAGA1_HUMAN)
VYDGREHSL

SEQ ID NO: 44729 - protein, 10 aa, Artificial Sequence
  Description of Artificial Sequence: Synthetic peptide
  Seed: RVRFFFPSLR (MAGA1_HUMAN)
RYRFFFPSLI

SEQ ID NO: 44730 - protein, 9 aa, Artificial Sequence
  Description of Artificial Sequence: Synthetic peptide
  Seed: FLWGPRALA (MAGA1_HUMAN)
FMWGPRALT

SEQ ID NO: 44731 - protein, 11 aa, Artificial Sequence
  Description of Artificial Sequence: Synthetic peptide
  Seed: VQAATSSSSPL (MAGA1_HUMAN)
VLAATSSSSPF

SEQ ID NO: 44732 - protein, 10 aa, Artificial Sequence
  Description of Artificial Sequence: Synthetic peptide
  Seed: RVRFFFPSLR (MAGA1_HUMAN)
RQRFFFPSLS

SEQ ID NO: 44733 - protein, 9 aa, Artificial Sequence
  Description of Artificial Sequence: Synthetic peptide
  Seed: STDPPQSPQ (MAGA1_HUMAN)
SADPPQSPY

SEQ ID NO: 44734 - protein, 9 aa, Artificial Sequence
  Description of Artificial Sequence: Synthetic peptide
  Seed: QIMPKTGFL (MAGA1_HUMAN)
QVMPKTGFY

SEQ ID NO: 44735 - protein, 10 aa, Artificial Sequence
  Description of Artificial Sequence: Synthetic peptide
  Seed: SARVRFFFPS (MAGA1_HUMAN)
SARVRFFFPR

SEQ ID NO: 44736 - protein, 11 aa, Artificial Sequence
  Description of Artificial Sequence: Synthetic peptide
  Seed: SARVRFFFPSL (MAGA1_HUMAN)
SWRVRFFFPSK

SEQ ID NO: 44737 - protein, 10 aa, Artificial Sequence
  Description of Artificial Sequence: Synthetic peptide
  Seed: ADLVGFLLLK (MAGA1_HUMAN)
AWLVGFLLLR

SEQ ID NO: 44738 - protein, 9 aa, Artificial Sequence
  Description of Artificial Sequence: Synthetic peptide
  Seed: TSSSSPLVL (MAGA1_HUMAN)
TASSSPLVL

SEQ ID NO: 44739 - protein, 9 aa, Artificial Sequence
  Description of Artificial Sequence: Synthetic peptide
  Seed: LVQEKYLEY (MAGA1_HUMAN)
LYQEKYLEL

SEQ ID NO: 44740 - protein, 10 aa, Artificial Sequence
  Description of Artificial Sequence: Synthetic peptide
  Seed: SARVRFFFPS (MAGA1_HUMAN)
SRRVRFFFPI

SEQ ID NO: 44741 - protein, 9 aa, Artificial Sequence
  Description of Artificial Sequence: Synthetic peptide
  Seed: RQRQPSEGS (MAGA1_HUMAN)
RARQPSEGA

SEQ ID NO: 44742 - protein, 10 aa, Artificial Sequence
  Description of Artificial Sequence: Synthetic peptide
  Seed: KVADLVGFLL (MAGA1_HUMAN)
KMADLVGFLM

SEQ ID NO: 44743 - protein, 11 aa, Artificial Sequence
  Description of Artificial Sequence: Synthetic peptide
  Seed: VPDSDPARYEF (MAGA1_HUMAN)
VVDSDPARYEW

SEQ ID NO: 44744 - protein, 9 aa, Artificial Sequence
  Description of Artificial Sequence: Synthetic peptide
  Seed: GTLEEVPTA (MAGA1_HUMAN)
GILEEVPTV

SEQ ID NO: 44745 - protein, 9 aa, Artificial Sequence
  Description of Artificial Sequence: Synthetic peptide
  Seed: MIAMEGGHA (MAGA1_HUMAN)
MLAMEGGHI

SEQ ID NO: 44746 - protein, 9 aa, Artificial Sequence
  Description of Artificial Sequence: Synthetic peptide
  Seed: LVQEKYLEY (MAGA1_HUMAN)
LLQEKYLER

SEQ ID NO: 44747 - protein, 9 aa, Artificial Sequence
  Description of Artificial Sequence: Synthetic peptide
  Seed: RQRQPSEGS (MAGA1_HUMAN)
RLRQPSEGK

SEQ ID NO: 44748 - protein, 9 aa, Artificial Sequence
  Description of Artificial Sequence: Synthetic peptide
  Seed: LVQEKYLEY (MAGA1_HUMAN)
LRQEKYLEY

SEQ ID NO: 44749 - protein, 9 aa, Artificial Sequence
  Description of Artificial Sequence: Synthetic peptide
  Seed: VADLVGFLL (MAGA1_HUMAN)
VFDLVGFLI

SEQ ID NO: 44750 - protein, 10 aa, Artificial Sequence
  Description of Artificial Sequence: Synthetic peptide
  Seed: KVADLVGFLL (MAGA1_HUMAN)
KMADLVGFLV

SEQ ID NO: 44751 - protein, 11 aa, Artificial Sequence
  Description of Artificial Sequence: Synthetic peptide
  Seed: ARVRFFFPSLR (MAGA1_HUMAN)
AGVRFFFPSLL

SEQ ID NO: 44752 - protein, 10 aa, Artificial Sequence
  Description of Artificial Sequence: Synthetic peptide
  Seed: KVLEYVIKVS (MAGA1_HUMAN)
KLLEYVIKVE

SEQ ID NO: 44753 - protein, 9 aa, Artificial Sequence
  Description of Artificial Sequence: Synthetic peptide
  Seed: SAYGEPRKL (MAGA1_HUMAN)
SIYGEPRKR

SEQ ID NO: 44754 - protein, 9 aa, Artificial Sequence
  Description of Artificial Sequence: Synthetic peptide
  Seed: TSYVKVLEY (MAGA1_HUMAN)
TGYVKVLEL

SEQ ID NO: 44755 - protein, 9 aa, Artificial Sequence
  Description of Artificial Sequence: Synthetic peptide
  Seed: RAREPVTKA (MAGA1_HUMAN)
RMREPVTKV

SEQ ID NO: 44756 - protein, 9 aa, Artificial Sequence
  Description of Artificial Sequence: Synthetic peptide
  Seed: IFGKASESL (MAGA1_HUMAN)
IFGKASESY

SEQ ID NO: 44757 - protein, 10 aa, Artificial Sequence
  Description of Artificial Sequence: Synthetic peptide
  Seed: KVLEYVIKVS (MAGA1_HUMAN)
KLLEYVIKVF

SEQ ID NO: 44758 - protein, 10 aa, Artificial Sequence
  Description of Artificial Sequence: Synthetic peptide
  Seed: KVLEYVIKVS (MAGA1_HUMAN)
KILEYVIKVA

SEQ ID NO: 44759 - protein, 9 aa, Artificial Sequence
  Description of Artificial Sequence: Synthetic peptide
  Seed: TQDLVQEKY (MAGA1_HUMAN)
TEDLVQEKM

SEQ ID NO: 44760 - protein, 9 aa, Artificial Sequence
  Description of Artificial Sequence: Synthetic peptide
  Seed: KVLEYVIKV (MAGA1_HUMAN)
KCLEYVIKY

SEQ ID NO: 44761 - protein, 10 aa, Artificial Sequence
  Description of Artificial Sequence: Synthetic peptide
  Seed: KVLEYVIKVS (MAGA1_HUMAN)
KQLEYVIKVI

SEQ ID NO: 44762 - protein, 9 aa, Artificial Sequence
  Description of Artificial Sequence: Synthetic peptide
  Seed: RALAETSYV (MAGA1_HUMAN)
RMLAETSYY

SEQ ID NO: 44763 - protein, 9 aa, Artificial Sequence
  Description of Artificial Sequence: Synthetic peptide
  Seed: QQEALGLVC (MAGA1_HUMAN)
QEEALGLVP

SEQ ID NO: 44764 - protein, 9 aa, Artificial Sequence
  Description of Artificial Sequence: Synthetic peptide
  Seed: KASESLQLV (MAGA1_HUMAN)
KLSESLQLY

SEQ ID NO: 44765 - protein, 9 aa, Artificial Sequence
  Description of Artificial Sequence: Synthetic peptide
  Seed: SAFPTTINF (MAGA1_HUMAN)
STFPTTINF

SEQ ID NO: 44766 - protein, 9 aa, Artificial Sequence
  Description of Artificial Sequence: Synthetic peptide
  Seed: DLVGFLLLK (MAGA1_HUMAN)
DWVGFLLLR

SEQ ID NO: 44767 - protein, 10 aa, Artificial Sequence
  Description of Artificial Sequence: Synthetic peptide
  Seed: ARVRFFFPSL (MAGA1_HUMAN)
AQVRFFFPSI

SEQ ID NO: 44768 - protein, 10 aa, Artificial Sequence
  Description of Artificial Sequence: Synthetic peptide
  Seed: QVPDSDPARY (MAGA1_HUMAN)
QTPDSDPARR

SEQ ID NO: 44769 - protein, 11 aa, Artificial Sequence
  Description of Artificial Sequence: Synthetic peptide
  Seed: SARVRFFFPSL (MAGA1_HUMAN)
SRRVRFFFPSK

SEQ ID NO: 44770 - protein, 9 aa, Artificial Sequence
  Description of Artificial Sequence: Synthetic peptide
  Seed: FLLLKYRAR (MAGA1_HUMAN)
FYLLKYRAR

SEQ ID NO: 44771 - protein, 9 aa, Artificial Sequence
  Description of Artificial Sequence: Synthetic peptide
  Seed: SAFPTTINF (MAGA1_HUMAN)
SMFPTTINL

SEQ ID NO: 44772 - protein, 10 aa, Artificial Sequence
  Description of Artificial Sequence: Synthetic peptide
  Seed: PTTINFTRQR (MAGA1_HUMAN)
PETINFTRQR

SEQ ID NO: 44773 - protein, 10 aa, Artificial Sequence
  Description of Artificial Sequence: Synthetic peptide
  Seed: YEFLWGPRAL (MAGA1_HUMAN)
YIFLWGPRAY

SEQ ID NO: 44774 - protein, 10 aa, Artificial Sequence
  Description of Artificial Sequence: Synthetic peptide
  Seed: ASAFPTTINF (MAGA1_HUMAN)
AFAFPTTINF

SEQ ID NO: 44775 - protein, 9 aa, Artificial Sequence
  Description of Artificial Sequence: Synthetic peptide
  Seed: YKHCFPEIF (MAGA1_HUMAN)
YQHCFPEII

SEQ ID NO: 44776 - protein, 10 aa, Artificial Sequence
  Description of Artificial Sequence: Synthetic peptide
  Seed: SARVRFFFPS (MAGA1_HUMAN)
SGRVRFFFPV

SEQ ID NO: 44777 - protein, 10 aa, Artificial Sequence
  Description of Artificial Sequence: Synthetic peptide
  Seed: KVSARVRFFF (MAGA1_HUMAN)
KMSARVRFFK

SEQ ID NO: 44778 - protein, 9 aa, Artificial Sequence
  Description of Artificial Sequence: Synthetic peptide
  Seed: ESLQLVFGI (MAGA1_HUMAN)
EVLQLVFGW

SEQ ID NO: 44779 - protein, 10 aa, Artificial Sequence
  Description of Artificial Sequence: Synthetic peptide
  Seed: SARVRFFFPS (MAGA1_HUMAN)
SNRVRFFFPF

SEQ ID NO: 44780 - protein, 10 aa, Artificial Sequence
  Description of Artificial Sequence: Synthetic peptide
  Seed: CILESLFRAV (MAGA1_HUMAN)
CTLESLFRAV

SEQ ID NO: 44781 - protein, 9 aa, Artificial Sequence
  Description of Artificial Sequence: Synthetic peptide
  Seed: ETSYVKVLE (MAGA1_HUMAN)
EVSYVKVLK

SEQ ID NO: 44782 - protein, 9 aa, Artificial Sequence
  Description of Artificial Sequence: Synthetic peptide
  Seed: TQDLVQEKY (MAGA1_HUMAN)
TSDLVQEKF

SEQ ID NO: 44783 - protein, 9 aa, Artificial Sequence
  Description of Artificial Sequence: Synthetic peptide
  Seed: REPVTKAEM (MAGA1_HUMAN)
REPVTKAEL

SEQ ID NO: 44784 - protein, 9 aa, Artificial Sequence
  Description of Artificial Sequence: Synthetic peptide
  Seed: VADLVGFLL (MAGA1_HUMAN)
VLDLVGFLI

SEQ ID NO: 44785 - protein, 11 aa, Artificial Sequence
  Description of Artificial Sequence: Synthetic peptide
  Seed: KVADLVGFLLL (MAGA1_HUMAN)
KSADLVGFLLF

SEQ ID NO: 44786 - protein, 11 aa, Artificial Sequence
  Description of Artificial Sequence: Synthetic peptide
  Seed: EVYDGREHSAY (MAGA1_HUMAN)
ELYDGREHSAK

SEQ ID NO: 44787 - protein, 10 aa, Artificial Sequence
  Description of Artificial Sequence: Synthetic peptide
  Seed: ESLFRAVITK (MAGA1_HUMAN)
EALFRAVITR

SEQ ID NO: 44788 - protein, 9 aa, Artificial Sequence
  Description of Artificial Sequence: Synthetic peptide
  Seed: VRFFFPSLR (MAGA1_HUMAN)
VAFFFPSLK

SEQ ID NO: 44789 - protein, 11 aa, Artificial Sequence
  Description of Artificial Sequence: Synthetic peptide
  Seed: SCILESLFRAV (MAGA1_HUMAN)
SLILESLFRAV

SEQ ID NO: 44790 - protein, 9 aa, Artificial Sequence
  Description of Artificial Sequence: Synthetic peptide
  Seed: EALEAQQEA (MAGA1_HUMAN)
EALEAQQEL

SEQ ID NO: 44791 - protein, 9 aa, Artificial Sequence
  Description of Artificial Sequence: Synthetic peptide
  Seed: LVQEKYLEY (MAGA1_HUMAN)
LQQEKYLEF

SEQ ID NO: 44792 - protein, 10 aa, Artificial Sequence
  Description of Artificial Sequence: Synthetic peptide
  Seed: TTINFTRQRQ (MAGA1_HUMAN)
TIINFTRQRR

SEQ ID NO: 44793 - protein, 9 aa, Artificial Sequence
  Description of Artificial Sequence: Synthetic peptide
  Seed: VQAATSSSS (MAGA1_HUMAN)
VQAATSSSY

SEQ ID NO: 44794 - protein, 9 aa, Artificial Sequence
  Description of Artificial Sequence: Synthetic peptide
  Seed: ARYEFLWGP (MAGA1_HUMAN)
ARYEFLWGV

SEQ ID NO: 44795 - protein, 9 aa, Artificial Sequence
  Description of Artificial Sequence: Synthetic peptide
  Seed: TTINFTRQR (MAGA1_HUMAN)
TAINFTRQF

SEQ ID NO: 44796 - protein, 9 aa, Artificial Sequence
  Description of Artificial Sequence: Synthetic peptide
  Seed: FFFPSLREA (MAGA1_HUMAN)
FIFPSLREL

SEQ ID NO: 44797 - protein, 9 aa, Artificial Sequence
  Description of Artificial Sequence: Synthetic peptide
  Seed: LKYRAREPV (MAGA1_HUMAN)
LQYRAREPH

SEQ ID NO: 44798 - protein, 9 aa, Artificial Sequence
  Description of Artificial Sequence: Synthetic peptide
  Seed: STDPPQSPQ (MAGA1_HUMAN)
SQDPPQSPV

SEQ ID NO: 44799 - protein, 10 aa, Artificial Sequence
  Description of Artificial Sequence: Synthetic peptide
  Seed: DVKEADPTGH (MAGA1_HUMAN)
DSKEADPTGR

SEQ ID NO: 44800 - protein, 9 aa, Artificial Sequence
  Description of Artificial Sequence: Synthetic peptide
  Seed: QSPQGASAF (MAGA1_HUMAN)
QFPQGASAV

SEQ ID NO: 44801 - protein, 10 aa, Artificial Sequence
  Description of Artificial Sequence: Synthetic peptide
  Seed: FFPSLREAAL (MAGA1_HUMAN)
FSPSLREAAF

SEQ ID NO: 44802 - protein, 9 aa, Artificial Sequence
  Description of Artificial Sequence: Synthetic peptide
  Seed: SARVRFFFP (MAGA1_HUMAN)
SLRVRFFFY

SEQ ID NO: 44803 - protein, 10 aa, Artificial Sequence
  Description of Artificial Sequence: Synthetic peptide
  Seed: LVLGTLEEVP (MAGA1_HUMAN)
LLLGTLEEVV

SEQ ID NO: 44804 - protein, 10 aa, Artificial Sequence
  Description of Artificial Sequence: Synthetic peptide
  Seed: RVRFFFPSLR (MAGA1_HUMAN)
RNRFFFPSLL

SEQ ID NO: 44805 - protein, 9 aa, Artificial Sequence
  Description of Artificial Sequence: Synthetic peptide
  Seed: LKYRAREPV (MAGA1_HUMAN)
LRYRAREPF

SEQ ID NO: 44806 - protein, 11 aa, Artificial Sequence
  Description of Artificial Sequence: Synthetic peptide
  Seed: EIWEELSVMEV (MAGA1_HUMAN)
ETWEELSVMEV

SEQ ID NO: 44807 - protein, 9 aa, Artificial Sequence
  Description of Artificial Sequence: Synthetic peptide
  Seed: ASESLQLVF (MAGA1_HUMAN)
AMESLQLVF

SEQ ID NO: 44808 - protein, 9 aa, Artificial Sequence
  Description of Artificial Sequence: Synthetic peptide
  Seed: GASAFPTTI (MAGA1_HUMAN)
GISAFPTTA

SEQ ID NO: 44809 - protein, 10 aa, Artificial Sequence
  Description of Artificial Sequence: Synthetic peptide
  Seed: RVRFFFPSLR (MAGA1_HUMAN)
RVRFFFPSLN

SEQ ID NO: 44810 - protein, 10 aa, Artificial Sequence
  Description of Artificial Sequence: Synthetic peptide
  Seed: VYDGREHSAY (MAGA1_HUMAN)
VYDGREHSAL

SEQ ID NO: 44811 - protein, 9 aa, Artificial Sequence
  Description of Artificial Sequence: Synthetic peptide
  Seed: TSCILESLF (MAGA1_HUMAN)
TSCILESLW

SEQ ID NO: 44812 - protein, 9 aa, Artificial Sequence
  Description of Artificial Sequence: Synthetic peptide
  Seed: HSYVLVTCL (MAGA1_HUMAN)
HSYVLVTCM

SEQ ID NO: 44813 - protein, 9 aa, Artificial Sequence
  Description of Artificial Sequence: Synthetic peptide
  Seed: VITKKVADL (MAGA1_HUMAN)
VATKKVADF

SEQ ID NO: 44814 - protein, 9 aa, Artificial Sequence
  Description of Artificial Sequence: Synthetic peptide
  Seed: HSYVLVTCL (MAGA1_HUMAN)
HHYVLVTCM

SEQ ID NO: 44815 - protein, 9 aa, Artificial Sequence
  Description of Artificial Sequence: Synthetic peptide
  Seed: AQQEALGLV (MAGA1_HUMAN)
AMQEALGLL

SEQ ID NO: 44816 - protein, 10 aa, Artificial Sequence
  Description of Artificial Sequence: Synthetic peptide
  Seed: SAFPTTINFT (MAGA1_HUMAN)
SIFPTTINFI

SEQ ID NO: 44817 - protein, 10 aa, Artificial Sequence
  Description of Artificial Sequence: Synthetic peptide
  Seed: WEELSVMEVY (MAGA1_HUMAN)
WDELSVMEVW

SEQ ID NO: 44818 - protein, 10 aa, Artificial Sequence
  Description of Artificial Sequence: Synthetic peptide
  Seed: SLFRAVITKK (MAGA1_HUMAN)
SRFRAVITKR

SEQ ID NO: 44819 - protein, 10 aa, Artificial Sequence
  Description of Artificial Sequence: Synthetic peptide
  Seed: RVRFFFPSLR (MAGA1_HUMAN)
RCRFFFPSLM

SEQ ID NO: 44820 - protein, 9 aa, Artificial Sequence
  Description of Artificial Sequence: Synthetic peptide
  Seed: SARVRFFFP (MAGA1_HUMAN)
SMRVRFFFV

SEQ ID NO: 44821 - protein, 9 aa, Artificial Sequence
  Description of Artificial Sequence: Synthetic peptide
  Seed: KVADLVGFL (MAGA1_HUMAN)
KQADLVGFA

SEQ ID NO: 44822 - protein, 9 aa, Artificial Sequence
  Description of Artificial Sequence: Synthetic peptide
  Seed: KYRAREPVT (MAGA1_HUMAN)
KQRAREPVK

SEQ ID NO: 44823 - protein, 10 aa, Artificial Sequence
  Description of Artificial Sequence: Synthetic peptide
  Seed: KHCFPEIFGK (MAGA1_HUMAN)
KTCFPEIFGR

SEQ ID NO: 44824 - protein, 9 aa, Artificial Sequence
  Description of Artificial Sequence: Synthetic peptide
  Seed: TSSSSPLVL (MAGA1_HUMAN)
TTSSSPLVL

SEQ ID NO: 44825 - protein, 10 aa, Artificial Sequence
  Description of Artificial Sequence: Synthetic peptide
  Seed: KEADPTGHSY (MAGA1_HUMAN)
KLADPTGHSM

SEQ ID NO: 44826 - protein, 11 aa, Artificial Sequence
  Description of Artificial Sequence: Synthetic peptide
  Seed: STDPPQSPQGA (MAGA1_HUMAN)
SGDPPQSPQGM

SEQ ID NO: 44827 - protein, 9 aa, Artificial Sequence
  Description of Artificial Sequence: Synthetic peptide
  Seed: QIMPKTGFL (MAGA1_HUMAN)
QSMPKTGFY

SEQ ID NO: 44828 - protein, 9 aa, Artificial Sequence
  Description of Artificial Sequence: Synthetic peptide
  Seed: KYRAREPVT (MAGA1_HUMAN)
KSRAREPVK

SEQ ID NO: 44829 - protein, 10 aa, Artificial Sequence
  Description of Artificial Sequence: Synthetic peptide
  Seed: ASAFPTTINF (MAGA1_HUMAN)
AMAFPTTINF

SEQ ID NO: 44830 - protein, 9 aa, Artificial Sequence
  Description of Artificial Sequence: Synthetic peptide
  Seed: KYRAREPVT (MAGA1_HUMAN)
KNRAREPVK

SEQ ID NO: 44831 - protein, 10 aa, Artificial Sequence
  Description of Artificial Sequence: Synthetic peptide
  Seed: EIFGKASESL (MAGA1_HUMAN)
EVFGKASESY

SEQ ID NO: 44832 - protein, 10 aa, Artificial Sequence
  Description of Artificial Sequence: Synthetic peptide
  Seed: KYRAREPVTK (MAGA1_HUMAN)
KQRAREPVTK

SEQ ID NO: 44833 - protein, 9 aa, Artificial Sequence
  Description of Artificial Sequence: Synthetic peptide
  Seed: HSYVLVTCL (MAGA1_HUMAN)
HAYVLVTCW

SEQ ID NO: 44834 - protein, 9 aa, Artificial Sequence
  Description of Artificial Sequence: Synthetic peptide
  Seed: FPSLREAAL (MAGA1_HUMAN)
FGSLREAAY

SEQ ID NO: 44835 - protein, 11 aa, Artificial Sequence
  Description of Artificial Sequence: Synthetic peptide
  Seed: SARVRFFFPSL (MAGA1_HUMAN)
SDRVRFFFPSK

SEQ ID NO: 44836 - protein, 9 aa, Artificial Sequence
  Description of Artificial Sequence: Synthetic peptide
  Seed: MLESVIKNY (MAGA1_HUMAN)
MMESVIKNY

SEQ ID NO: 44837 - protein, 9 aa, Artificial Sequence
  Description of Artificial Sequence: Synthetic peptide
  Seed: GASAFPTTI (MAGA1_HUMAN)
GRSAFPTTF

SEQ ID NO: 44838 - protein, 10 aa, Artificial Sequence
  Description of Artificial Sequence: Synthetic peptide
  Seed: EIFGKASESL (MAGA1_HUMAN)
ETFGKASESF

SEQ ID NO: 44839 - protein, 9 aa, Artificial Sequence
  Description of Artificial Sequence: Synthetic peptide
  Seed: STSCILESL (MAGA1_HUMAN)
SRSCILESL

SEQ ID NO: 44840 - protein, 9 aa, Artificial Sequence
  Description of Artificial Sequence: Synthetic peptide
  Seed: RVRFFFPSL (MAGA1_HUMAN)
RTRFFFPSV

SEQ ID NO: 44841 - protein, 8 aa, Artificial Sequence
  Description of Artificial Sequence: Synthetic peptide
  Seed: SARVRFFF (MAGA1_HUMAN)
SARVRFFL

SEQ ID NO: 44842 - protein, 9 aa, Artificial Sequence
  Description of Artificial Sequence: Synthetic peptide
  Seed: YVIKVSARV (MAGA1_HUMAN)
YSIKVSARM

SEQ ID NO: 44843 - protein, 9 aa, Artificial Sequence
  Description of Artificial Sequence: Synthetic peptide
  Seed: IAMEGGHAP (MAGA1_HUMAN)
IIMEGGHAF

SEQ ID NO: 44844 - protein, 10 aa, Artificial Sequence
  Description of Artificial Sequence: Synthetic peptide
  Seed: ARVRFFFPSL (MAGA1_HUMAN)
APVRFFFPSK

SEQ ID NO: 44845 - protein, 9 aa, Artificial Sequence
  Description of Artificial Sequence: Synthetic peptide
  Seed: LTQDLVQEK (MAGA1_HUMAN)
LTQDLVQEL

SEQ ID NO: 44846 - protein, 9 aa, Artificial Sequence
  Description of Artificial Sequence: Synthetic peptide
  Seed: SCILESLFR (MAGA1_HUMAN)
SVILESLFK

SEQ ID NO: 44847 - protein, 9 aa, Artificial Sequence
  Description of Artificial Sequence: Synthetic peptide
  Seed: SAFPTTINF (MAGA1_HUMAN)
SEFPTTINL

SEQ ID NO: 44848 - protein, 9 aa, Artificial Sequence
  Description of Artificial Sequence: Synthetic peptide
  Seed: RVRFFFPSL (MAGA1_HUMAN)
RVRFFFPSQ

SEQ ID NO: 44849 - protein, 11 aa, Artificial Sequence
  Description of Artificial Sequence: Synthetic peptide
  Seed: RVRFFFPSLRE (MAGA1_HUMAN)
RFRFFFPSLRQ

SEQ ID NO: 44850 - protein, 10 aa, Artificial Sequence
  Description of Artificial Sequence: Synthetic peptide
  Seed: EFLWGPRALA (MAGA1_HUMAN)
EYLWGPRALL

SEQ ID NO: 44851 - protein, 9 aa, Artificial Sequence
  Description of Artificial Sequence: Synthetic peptide
  Seed: KVSARVRFF (MAGA1_HUMAN)
KKSARVRFF

SEQ ID NO: 44852 - protein, 9 aa, Artificial Sequence
  Description of Artificial Sequence: Synthetic peptide
  Seed: RAREPVTKA (MAGA1_HUMAN)
RSREPVTKG

SEQ ID NO: 44853 - protein, 10 aa, Artificial Sequence
  Description of Artificial Sequence: Synthetic peptide
  Seed: KASESLQLVF (MAGA1_HUMAN)
KQSESLQLVY

SEQ ID NO: 44854 - protein, 9 aa, Artificial Sequence
  Description of Artificial Sequence: Synthetic peptide
  Seed: GLLGDNQIM (MAGA1_HUMAN)
GMLGDNQIV

SEQ ID NO: 44855 - protein, 9 aa, Artificial Sequence
  Description of Artificial Sequence: Synthetic peptide
  Seed: FFFPSLREA (MAGA1_HUMAN)
FQFPSLRET

SEQ ID NO: 44856 - protein, 9 aa, Artificial Sequence
  Description of Artificial Sequence: Synthetic peptide
  Seed: VSARVRFFF (MAGA1_HUMAN)
VYARVRFFV

SEQ ID NO: 44857 - protein, 9 aa, Artificial Sequence
  Description of Artificial Sequence: Synthetic peptide
  Seed: EIWEELSVM (MAGA1_HUMAN)
ETWEELSVL

SEQ ID NO: 44858 - protein, 9 aa, Artificial Sequence
  Description of Artificial Sequence: Synthetic peptide
  Seed: ALREEEEGV (MAGA1_HUMAN)
AMREEEEGL

SEQ ID NO: 44859 - protein, 9 aa, Artificial Sequence
  Description of Artificial Sequence: Synthetic peptide
  Seed: KVSARVRFF (MAGA1_HUMAN)
KTSARVRFL

SEQ ID NO: 44860 - protein, 9 aa, Artificial Sequence
  Description of Artificial Sequence: Synthetic peptide
  Seed: VGFLLLKYR (MAGA1_HUMAN)
VLFLLLKYR

SEQ ID NO: 44861 - protein, 10 aa, Artificial Sequence
  Description of Artificial Sequence: Synthetic peptide
  Seed: LSVMEVYDGR (MAGA1_HUMAN)
LVVMEVYDGR

SEQ ID NO: 44862 - protein, 9 aa, Artificial Sequence
  Description of Artificial Sequence: Synthetic peptide
  Seed: TSYVKVLEY (MAGA1_HUMAN)
TYYVKVLEY

SEQ ID NO: 44863 - protein, 9 aa, Artificial Sequence
  Description of Artificial Sequence: Synthetic peptide
  Seed: VQAATSSSS (MAGA1_HUMAN)
VQAATSSSM

SEQ ID NO: 44864 - protein, 10 aa, Artificial Sequence
  Description of Artificial Sequence: Synthetic peptide
  Seed: EIFGKASESL (MAGA1_HUMAN)
ESFGKASESY

SEQ ID NO: 44865 - protein, 9 aa, Artificial Sequence
  Description of Artificial Sequence: Synthetic peptide
  Seed: SARVRFFFP (MAGA1_HUMAN)
SVRVRFFFQ

SEQ ID NO: 44866 - protein, 10 aa, Artificial Sequence
  Description of Artificial Sequence: Synthetic peptide
  Seed: LLKYRAREPV (MAGA1_HUMAN)
LPKYRAREPL

SEQ ID NO: 44867 - protein, 9 aa, Artificial Sequence
  Description of Artificial Sequence: Synthetic peptide
  Seed: FPSLREAAL (MAGA1_HUMAN)
FASLREAAV

SEQ ID NO: 44868 - protein, 9 aa, Artificial Sequence
  Description of Artificial Sequence: Synthetic peptide
  Seed: STSCILESL (MAGA1_HUMAN)
SVSCILESF

SEQ ID NO: 44869 - protein, 10 aa, Artificial Sequence
  Description of Artificial Sequence: Synthetic peptide
  Seed: RVRFFFPSLR (MAGA1_HUMAN)
RKRFFFPSLH

SEQ ID NO: 44870 - protein, 9 aa, Artificial Sequence
  Description of Artificial Sequence: Synthetic peptide
  Seed: KVSARVRFF (MAGA1_HUMAN)
KMSARVRFY

SEQ ID NO: 44871 - protein, 9 aa, Artificial Sequence
  Description of Artificial Sequence: Synthetic peptide
  Seed: FFFPSLREA (MAGA1_HUMAN)
FTFPSLREL

SEQ ID NO: 44872 - protein, 9 aa, Artificial Sequence
  Description of Artificial Sequence: Synthetic peptide
  Seed: MPKTGFLII (MAGA1_HUMAN)
MPKTGFLIM

SEQ ID NO: 44873 - protein, 11 aa, Artificial Sequence
  Description of Artificial Sequence: Synthetic peptide
  Seed: RALAETSYVKV (MAGA1_HUMAN)
RMLAETSYVKL

SEQ ID NO: 44874 - protein, 9 aa, Artificial Sequence
  Description of Artificial Sequence: Synthetic peptide
  Seed: RALAETSYV (MAGA1_HUMAN)
RLLAETSYA

SEQ ID NO: 44875 - protein, 9 aa, Artificial Sequence
  Description of Artificial Sequence: Synthetic peptide
  Seed: RALAETSYV (MAGA1_HUMAN)
RVLAETSYW

SEQ ID NO: 44876 - protein, 10 aa, Artificial Sequence
  Description of Artificial Sequence: Synthetic peptide
  Seed: VLVTCLGLSY (MAGA1_HUMAN)
VKVTCLGLSY

SEQ ID NO: 44877 - protein, 10 aa, Artificial Sequence
  Description of Artificial Sequence: Synthetic peptide
  Seed: RYEFLWGPRA (MAGA1_HUMAN)
RIEFLWGPRL

SEQ ID NO: 44878 - protein, 10 aa, Artificial Sequence
  Description of Artificial Sequence: Synthetic peptide
  Seed: EMLESVIKNY (MAGA1_HUMAN)
EALESVIKNR

SEQ ID NO: 44879 - protein, 10 aa, Artificial Sequence
  Description of Artificial Sequence: Synthetic peptide
  Seed: ARVRFFFPSL (MAGA1_HUMAN)
AFVRFFFPSI

SEQ ID NO: 44880 - protein, 9 aa, Artificial Sequence
  Description of Artificial Sequence: Synthetic peptide
  Seed: FPTTINFTR (MAGA1_HUMAN)
FMTTINFTR

SEQ ID NO: 44881 - protein, 9 aa, Artificial Sequence
  Description of Artificial Sequence: Synthetic peptide
  Seed: REEEGPSTS (MAGA1_HUMAN)
REEEGPSTM

SEQ ID NO: 44882 - protein, 9 aa, Artificial Sequence
  Description of Artificial Sequence: Synthetic peptide
  Seed: VRFFFPSLR (MAGA1_HUMAN)
VAFFFPSLR

SEQ ID NO: 44883 - protein, 9 aa, Artificial Sequence
  Description of Artificial Sequence: Synthetic peptide
  Seed: AATSSSSPL (MAGA1_HUMAN)
AKTSSSSPF

SEQ ID NO: 44884 - protein, 9 aa, Artificial Sequence
  Description of Artificial Sequence: Synthetic peptide
  Seed: QSPQGASAF (MAGA1_HUMAN)
QIPQGASAM

SEQ ID NO: 44885 - protein, 9 aa, Artificial Sequence
  Description of Artificial Sequence: Synthetic peptide
  Seed: KASESLQLV (MAGA1_HUMAN)
KMSESLQLR

SEQ ID NO: 44886 - protein, 9 aa, Artificial Sequence
  Description of Artificial Sequence: Synthetic peptide
  Seed: SYVKVLEYV (MAGA1_HUMAN)
SFVKVLEYL

SEQ ID NO: 44887 - protein, 10 aa, Artificial Sequence
  Description of Artificial Sequence: Synthetic peptide
  Seed: GGHAPEEEIW (MAGA1_HUMAN)
GTHAPEEEIW

SEQ ID NO: 44888 - protein, 10 aa, Artificial Sequence
  Description of Artificial Sequence: Synthetic peptide
  Seed: VLVTCLGLSY (MAGA1_HUMAN)
VKVTCLGLSF

SEQ ID NO: 44889 - protein, 10 aa, Artificial Sequence
  Description of Artificial Sequence: Synthetic peptide
  Seed: TSYVKVLEYV (MAGA1_HUMAN)
TNYVKVLEYL

SEQ ID NO: 44890 - protein, 9 aa, Artificial Sequence
  Description of Artificial Sequence: Synthetic peptide
  Seed: EIWEELSVM (MAGA1_HUMAN)
ETWEELSVK

SEQ ID NO: 44891 - protein, 9 aa, Artificial Sequence
  Description of Artificial Sequence: Synthetic peptide
  Seed: FLIIVLVMI (MAGA1_HUMAN)
FQIIVLVMV

SEQ ID NO: 44892 - protein, 9 aa, Artificial Sequence
  Description of Artificial Sequence: Synthetic peptide
  Seed: HCFPEIFGK (MAGA1_HUMAN)
HMFPEIFGL

SEQ ID NO: 44893 - protein, 9 aa, Artificial Sequence
  Description of Artificial Sequence: Synthetic peptide
  Seed: SAYGEPRKL (MAGA1_HUMAN)
SYYGEPRKM

SEQ ID NO: 44894 - protein, 9 aa, Artificial Sequence
  Description of Artificial Sequence: Synthetic peptide
  Seed: LTQDLVQEK (MAGA1_HUMAN)
LLQDLVQEY

SEQ ID NO: 44895 - protein, 9 aa, Artificial Sequence
  Description of Artificial Sequence: Synthetic peptide
  Seed: HSYVLVTCL (MAGA1_HUMAN)
HQYVLVTCI

SEQ ID NO: 44896 - protein, 10 aa, Artificial Sequence
  Description of Artificial Sequence: Synthetic peptide
  Seed: ESLFRAVITK (MAGA1_HUMAN)
ECLFRAVITR

SEQ ID NO: 44897 - protein, 9 aa, Artificial Sequence
  Description of Artificial Sequence: Synthetic peptide
  Seed: GTLEEVPTA (MAGA1_HUMAN)
GQLEEVPTI

SEQ ID NO: 44898 - protein, 9 aa, Artificial Sequence
  Description of Artificial Sequence: Synthetic peptide
  Seed: KYRAREPVT (MAGA1_HUMAN)
KSRAREPVF

SEQ ID NO: 44899 - protein, 9 aa, Artificial Sequence
  Description of Artificial Sequence: Synthetic peptide
  Seed: GKASESLQL (MAGA1_HUMAN)
GKASESLQM

SEQ ID NO: 44900 - protein, 9 aa, Artificial Sequence
  Description of Artificial Sequence: Synthetic peptide
  Seed: RAREPVTKA (MAGA1_HUMAN)
RQREPVTKM

SEQ ID NO: 44901 - protein, 11 aa, Artificial Sequence
  Description of Artificial Sequence: Synthetic peptide
  Seed: KVLEYVIKVSA (MAGA1_HUMAN)
KLLEYVIKVSM

SEQ ID NO: 44902 - protein, 10 aa, Artificial Sequence
  Description of Artificial Sequence: Synthetic peptide
  Seed: FFPSLREAAL (MAGA1_HUMAN)
FQPSLREAAF

SEQ ID NO: 44903 - protein, 11 aa, Artificial Sequence
  Description of Artificial Sequence: Synthetic peptide
  Seed: RVRFFFPSLRE (MAGA1_HUMAN)
RQRFFFPSLRK

SEQ ID NO: 44904 - protein, 9 aa, Artificial Sequence
  Description of Artificial Sequence: Synthetic peptide
  Seed: KVLEYVIKV (MAGA1_HUMAN)
KMLEYVIKI

SEQ ID NO: 44905 - protein, 9 aa, Artificial Sequence
  Description of Artificial Sequence: Synthetic peptide
  Seed: VYDGREHSA (MAGA1_HUMAN)
VMDGREHSV

SEQ ID NO: 44906 - protein, 9 aa, Artificial Sequence
  Description of Artificial Sequence: Synthetic peptide
  Seed: KVLEYVIKV (MAGA1_HUMAN)
KNLEYVIKR

SEQ ID NO: 44907 - protein, 9 aa, Artificial Sequence
  Description of Artificial Sequence: Synthetic peptide
  Seed: REPVTKAEM (MAGA1_HUMAN)
RQPVTKAEL

SEQ ID NO: 44908 - protein, 11 aa, Artificial Sequence
  Description of Artificial Sequence: Synthetic peptide
  Seed: GPRALAETSYV (MAGA1_HUMAN)
GPRALAETSYL

SEQ ID NO: 44909 - protein, 8 aa, Artificial Sequence
  Description of Artificial Sequence: Synthetic peptide
  Seed: RFFFPSLR (MAGA1_HUMAN)
RMFFPSLK

SEQ ID NO: 44910 - protein, 9 aa, Artificial Sequence
  Description of Artificial Sequence: Synthetic peptide
  Seed: VQAATSSSS (MAGA1_HUMAN)
VRAATSSSY

SEQ ID NO: 44911 - protein, 9 aa, Artificial Sequence
  Description of Artificial Sequence: Synthetic peptide
  Seed: SAYGEPRKL (MAGA1_HUMAN)
SWYGEPRKL

SEQ ID NO: 44912 - protein, 10 aa, Artificial Sequence
  Description of Artificial Sequence: Synthetic peptide
  Seed: KVSARVRFFF (MAGA1_HUMAN)
KRSARVRFFF

SEQ ID NO: 44913 - protein, 9 aa, Artificial Sequence
  Description of Artificial Sequence: Synthetic peptide
  Seed: YVLVTCLGL (MAGA1_HUMAN)
YLLVTCLGY

SEQ ID NO: 44914 - protein, 9 aa, Artificial Sequence
  Description of Artificial Sequence: Synthetic peptide
  Seed: FPSLREAAL (MAGA1_HUMAN)
FPSLREAAH

SEQ ID NO: 44915 - protein, 9 aa, Artificial Sequence
  Description of Artificial Sequence: Synthetic peptide
  Seed: YVIKVSARV (MAGA1_HUMAN)
YLIKVSARL

SEQ ID NO: 44916 - protein, 11 aa, Artificial Sequence
  Description of Artificial Sequence: Synthetic peptide
  Seed: ELSVMEVYDGR (MAGA1_HUMAN)
EMSVMEVYDGR

SEQ ID NO: 44917 - protein, 11 aa, Artificial Sequence
  Description of Artificial Sequence: Synthetic peptide
  Seed: EIFGKASESLQ (MAGA1_HUMAN)
ELFGKASESLR

SEQ ID NO: 44918 - protein, 10 aa, Artificial Sequence
  Description of Artificial Sequence: Synthetic peptide
  Seed: EIFGKASESL (MAGA1_HUMAN)
ESFGKASESK

SEQ ID NO: 44919 - protein, 9 aa, Artificial Sequence
  Description of Artificial Sequence: Synthetic peptide
  Seed: KASESLQLV (MAGA1_HUMAN)
KQSESLQLR

SEQ ID NO: 44920 - protein, 9 aa, Artificial Sequence
  Description of Artificial Sequence: Synthetic peptide
  Seed: TKAEMLESV (MAGA1_HUMAN)
TTAEMLESI

SEQ ID NO: 44921 - protein, 9 aa, Artificial Sequence
  Description of Artificial Sequence: Synthetic peptide
  Seed: LFRAVITKK (MAGA1_HUMAN)
LLRAVITKR

SEQ ID NO: 44922 - protein, 9 aa, Artificial Sequence
  Description of Artificial Sequence: Synthetic peptide
  Seed: ESLQLVFGI (MAGA1_HUMAN)
EALQLVFGA

SEQ ID NO: 44923 - protein, 9 aa, Artificial Sequence
  Description of Artificial Sequence: Synthetic peptide
  Seed: KVLEYVIKV (MAGA1_HUMAN)
KVLEYVIKM

SEQ ID NO: 44924 - protein, 9 aa, Artificial Sequence
  Description of Artificial Sequence: Synthetic peptide
  Seed: RVRFFFPSL (MAGA1_HUMAN)
RFRFFFPSC

SEQ ID NO: 44925 - protein, 8 aa, Artificial Sequence
  Description of Artificial Sequence: Synthetic peptide
  Seed: ADPTGHSY (MAGA1_HUMAN)
AAPTGHSF

SEQ ID NO: 44926 - protein, 10 aa, Artificial Sequence
  Description of Artificial Sequence: Synthetic peptide
  Seed: FFPSLREAAL (MAGA1_HUMAN)
FYPSLREAAF

SEQ ID NO: 44927 - protein, 10 aa, Artificial Sequence
  Description of Artificial Sequence: Synthetic peptide
  Seed: KEADPTGHSY (MAGA1_HUMAN)
KKADPTGHSF

SEQ ID NO: 44928 - protein, 9 aa, Artificial Sequence
  Description of Artificial Sequence: Synthetic peptide
  Seed: GASAFPTTI (MAGA1_HUMAN)
GQSAFPTTW

SEQ ID NO: 44929 - protein, 9 aa, Artificial Sequence
  Description of Artificial Sequence: Synthetic peptide
  Seed: SSSPLVLGT (MAGA1_HUMAN)
STSPLVLGI

SEQ ID NO: 44930 - protein, 10 aa, Artificial Sequence
  Description of Artificial Sequence: Synthetic peptide
  Seed: FFPSLREAAL (MAGA1_HUMAN)
FIPSLREAAM

SEQ ID NO: 44931 - protein, 10 aa, Artificial Sequence
  Description of Artificial Sequence: Synthetic peptide
  Seed: SARVRFFFPS (MAGA1_HUMAN)
SLRVRFFFPL

SEQ ID NO: 44932 - protein, 10 aa, Artificial Sequence
  Description of Artificial Sequence: Synthetic peptide
  Seed: SARVRFFFPS (MAGA1_HUMAN)
SIRVRFFFPF

SEQ ID NO: 44933 - protein, 9 aa, Artificial Sequence
  Description of Artificial Sequence: Synthetic peptide
  Seed: RAREPVTKA (MAGA1_HUMAN)
RFREPVTKV

SEQ ID NO: 44934 - protein, 10 aa, Artificial Sequence
  Description of Artificial Sequence: Synthetic peptide
  Seed: KASESLQLVF (MAGA1_HUMAN)
KTSESLQLVW

SEQ ID NO: 44935 - protein, 11 aa, Artificial Sequence
  Description of Artificial Sequence: Synthetic peptide
  Seed: SSSSPLVLGTL (MAGA1_HUMAN)
SVSSPLVLGTW

SEQ ID NO: 44936 - protein, 9 aa, Artificial Sequence
  Description of Artificial Sequence: Synthetic peptide
  Seed: FFFPSLREA (MAGA1_HUMAN)
FHFPSLREV

SEQ ID NO: 44937 - protein, 11 aa, Artificial Sequence
  Description of Artificial Sequence: Synthetic peptide
  Seed: KVADLVGFLLL (MAGA1_HUMAN)
KVADLVGFLLV

SEQ ID NO: 44938 - protein, 9 aa, Artificial Sequence
  Description of Artificial Sequence: Synthetic peptide
  Seed: KKVADLVGF (MAGA1_HUMAN)
KVVADLVGF

SEQ ID NO: 44939 - protein, 10 aa, Artificial Sequence
  Description of Artificial Sequence: Synthetic peptide
  Seed: EADPTGHSYV (MAGA1_HUMAN)
ETDPTGHSYV

SEQ ID NO: 44940 - protein, 8 aa, Artificial Sequence
  Description of Artificial Sequence: Synthetic peptide
  Seed: FGKASESL (MAGA1_HUMAN)
FAKASESY

SEQ ID NO: 44941 - protein, 9 aa, Artificial Sequence
  Description of Artificial Sequence: Synthetic peptide
  Seed: MIAMEGGHA (MAGA1_HUMAN)
MMAMEGGHV

SEQ ID NO: 44942 - protein, 9 aa, Artificial Sequence
  Description of Artificial Sequence: Synthetic peptide
  Seed: KVLEYVIKV (MAGA1_HUMAN)
KYLEYVIKF

SEQ ID NO: 44943 - protein, 9 aa, Artificial Sequence
  Description of Artificial Sequence: Synthetic peptide
  Seed: RQVPDSDPA (MAGA1_HUMAN)
REVPDSDPF

SEQ ID NO: 44944 - protein, 9 aa, Artificial Sequence
  Description of Artificial Sequence: Synthetic peptide
  Seed: RQRQPSEGS (MAGA1_HUMAN)
RTRQPSEGI

SEQ ID NO: 44945 - protein, 9 aa, Artificial Sequence
  Description of Artificial Sequence: Synthetic peptide
  Seed: STSCILESL (MAGA1_HUMAN)
SASCILESL

SEQ ID NO: 44946 - protein, 9 aa, Artificial Sequence
  Description of Artificial Sequence: Synthetic peptide
  Seed: KASESLQLV (MAGA1_HUMAN)
KVSESLQLI

SEQ ID NO: 44947 - protein, 10 aa, Artificial Sequence
  Description of Artificial Sequence: Synthetic peptide
  Seed: SESLQLVFGI (MAGA1_HUMAN)
SGSLQLVFGW

SEQ ID NO: 44948 - protein, 9 aa, Artificial Sequence
  Description of Artificial Sequence: Synthetic peptide
  Seed: IAMEGGHAP (MAGA1_HUMAN)
IGMEGGHAI

SEQ ID NO: 44949 - protein, 9 aa, Artificial Sequence
  Description of Artificial Sequence: Synthetic peptide
  Seed: KVSARVRFF (MAGA1_HUMAN)
KYSARVRFA

SEQ ID NO: 44950 - protein, 8 aa, Artificial Sequence
  Description of Artificial Sequence: Synthetic peptide
  Seed: REEEGPST (MAGA1_HUMAN)
REEEGPSL

SEQ ID NO: 44951 - protein, 10 aa, Artificial Sequence
  Description of Artificial Sequence: Synthetic peptide
  Seed: ARVRFFFPSL (MAGA1_HUMAN)
ARVRFFFPSI

SEQ ID NO: 44952 - protein, 9 aa, Artificial Sequence
  Description of Artificial Sequence: Synthetic peptide
  Seed: KVSARVRFF (MAGA1_HUMAN)
KRSARVRFL

SEQ ID NO: 44953 - protein, 9 aa, Artificial Sequence
  Description of Artificial Sequence: Synthetic peptide
  Seed: MSLEQRSLH (MAGA1_HUMAN)
MSLEQRSLK

SEQ ID NO: 44954 - protein, 9 aa, Artificial Sequence
  Description of Artificial Sequence: Synthetic peptide
  Seed: SVMEVYDGR (MAGA1_HUMAN)
SIMEVYDGY

SEQ ID NO: 44955 - protein, 9 aa, Artificial Sequence
  Description of Artificial Sequence: Synthetic peptide
  Seed: RALAETSYV (MAGA1_HUMAN)
RMLAETSYI

SEQ ID NO: 44956 - protein, 10 aa, Artificial Sequence
  Description of Artificial Sequence: Synthetic peptide
  Seed: RVRFFFPSLR (MAGA1_HUMAN)
RDRFFFPSLA

SEQ ID NO: 44957 - protein, 10 aa, Artificial Sequence
  Description of Artificial Sequence: Synthetic peptide
  Seed: RFFFPSLREA (MAGA1_HUMAN)
RSFFPSLREA

SEQ ID NO: 44958 - protein, 10 aa, Artificial Sequence
  Description of Artificial Sequence: Synthetic peptide
  Seed: ASAFPTTINF (MAGA1_HUMAN)
ATAFPTTINF

SEQ ID NO: 44959 - protein, 9 aa, Artificial Sequence
  Description of Artificial Sequence: Synthetic peptide
  Seed: SARVRFFFP (MAGA1_HUMAN)
SFRVRFFFG

SEQ ID NO: 44960 - protein, 9 aa, Artificial Sequence
  Description of Artificial Sequence: Synthetic peptide
  Seed: LVLGTLEEV (MAGA1_HUMAN)
LMLGTLEEA

SEQ ID NO: 44961 - protein, 11 aa, Artificial Sequence
  Description of Artificial Sequence: Synthetic peptide
  Seed: YVKVLEYVIKV (MAGA1_HUMAN)
YMKVLEYVIKL

SEQ ID NO: 44962 - protein, 9 aa, Artificial Sequence
  Description of Artificial Sequence: Synthetic peptide
  Seed: KASESLQLV (MAGA1_HUMAN)
KRSESLQLL

SEQ ID NO: 44963 - protein, 9 aa, Artificial Sequence
  Description of Artificial Sequence: Synthetic peptide
  Seed: KVLEYVIKV (MAGA1_HUMAN)
KCLEYVIKW

SEQ ID NO: 44964 - protein, 9 aa, Artificial Sequence
  Description of Artificial Sequence: Synthetic peptide
  Seed: QQEALGLVC (MAGA1_HUMAN)
QEEALGLVL

SEQ ID NO: 44965 - protein, 9 aa, Artificial Sequence
  Description of Artificial Sequence: Synthetic peptide
  Seed: VYDGREHSA (MAGA1_HUMAN)
VGDGREHSF

SEQ ID NO: 44966 - protein, 9 aa, Artificial Sequence
  Description of Artificial Sequence: Synthetic peptide
  Seed: FPSLREAAL (MAGA1_HUMAN)
FISLREAAY

SEQ ID NO: 44967 - protein, 9 aa, Artificial Sequence
  Description of Artificial Sequence: Synthetic peptide
  Seed: SAYGEPRKL (MAGA1_HUMAN)
SEYGEPRKV

SEQ ID NO: 44968 - protein, 9 aa, Artificial Sequence
  Description of Artificial Sequence: Synthetic peptide
  Seed: KASESLQLV (MAGA1_HUMAN)
KQSESLQLV

SEQ ID NO: 44969 - protein, 9 aa, Artificial Sequence
  Description of Artificial Sequence: Synthetic peptide
  Seed: FLIIVLVMI (MAGA1_HUMAN)
FMIIVLVML

SEQ ID NO: 44970 - protein, 10 aa, Artificial Sequence
  Description of Artificial Sequence: Synthetic peptide
  Seed: KVLEYVIKVS (MAGA1_HUMAN)
KLLEYVIKVY

SEQ ID NO: 44971 - protein, 11 aa, Artificial Sequence
  Description of Artificial Sequence: Synthetic peptide
  Seed: ALAETSYVKVL (MAGA1_HUMAN)
AMAETSYVKVV

SEQ ID NO: 44972 - protein, 9 aa, Artificial Sequence
  Description of Artificial Sequence: Synthetic peptide
  Seed: HSYVLVTCL (MAGA1_HUMAN)
HPYVLVTCV

SEQ ID NO: 44973 - protein, 10 aa, Artificial Sequence
  Description of Artificial Sequence: Synthetic peptide
  Seed: KVSARVRFFF (MAGA1_HUMAN)
KFSARVRFFY

SEQ ID NO: 44974 - protein, 9 aa, Artificial Sequence
  Description of Artificial Sequence: Synthetic peptide
  Seed: VADLVGFLL (MAGA1_HUMAN)
VFDLVGFLV

SEQ ID NO: 44975 - protein, 10 aa, Artificial Sequence
  Description of Artificial Sequence: Synthetic peptide
  Seed: EVYDGREHSA (MAGA1_HUMAN)
EAYDGREHSR

SEQ ID NO: 44976 - protein, 10 aa, Artificial Sequence
  Description of Artificial Sequence: Synthetic peptide
  Seed: GPRALAETSY (MAGA1_HUMAN)
GPRALAETSI

SEQ ID NO: 44977 - protein, 9 aa, Artificial Sequence
  Description of Artificial Sequence: Synthetic peptide
  Seed: GASAFPTTI (MAGA1_HUMAN)
GSSAFPTTF

SEQ ID NO: 44978 - protein, 10 aa, Artificial Sequence
  Description of Artificial Sequence: Synthetic peptide
  Seed: VTKAEMLESV (MAGA1_HUMAN)
VLKAEMLESA

SEQ ID NO: 44979 - protein, 10 aa, Artificial Sequence
  Description of Artificial Sequence: Synthetic peptide
  Seed: SSSPLVLGTL (MAGA1_HUMAN)
STSPLVLGTW

SEQ ID NO: 44980 - protein, 9 aa, Artificial Sequence
  Description of Artificial Sequence: Synthetic peptide
  Seed: RVRFFFPSL (MAGA1_HUMAN)
RQRFFFPSA

SEQ ID NO: 44981 - protein, 9 aa, Artificial Sequence
  Description of Artificial Sequence: Synthetic peptide
  Seed: FFFPSLREA (MAGA1_HUMAN)
FFFPSLREL

SEQ ID NO: 44982 - protein, 9 aa, Artificial Sequence
  Description of Artificial Sequence: Synthetic peptide
  Seed: SAFPTTINF (MAGA1_HUMAN)
SIFPTTINL

SEQ ID NO: 44983 - protein, 9 aa, Artificial Sequence
  Description of Artificial Sequence: Synthetic peptide
  Seed: VQAATSSSS (MAGA1_HUMAN)
VMAATSSSF

SEQ ID NO: 44984 - protein, 10 aa, Artificial Sequence
  Description of Artificial Sequence: Synthetic peptide
  Seed: RVRFFFPSLR (MAGA1_HUMAN)
RARFFFPSLY

SEQ ID NO: 44985 - protein, 8 aa, Artificial Sequence
  Description of Artificial Sequence: Synthetic peptide
  Seed: VADLVGFL (MAGA1_HUMAN)
VADLVGFM

SEQ ID NO: 44986 - protein, 9 aa, Artificial Sequence
  Description of Artificial Sequence: Synthetic peptide
  Seed: RAREPVTKA (MAGA1_HUMAN)
RAREPVTKK

SEQ ID NO: 44987 - protein, 9 aa, Artificial Sequence
  Description of Artificial Sequence: Synthetic peptide
  Seed: SYVKVLEYV (MAGA1_HUMAN)
SIVKVLEYI

SEQ ID NO: 44988 - protein, 10 aa, Artificial Sequence
  Description of Artificial Sequence: Synthetic peptide
  Seed: SAFPTTINFT (MAGA1_HUMAN)
SSFPTTINFF

SEQ ID NO: 44989 - protein, 11 aa, Artificial Sequence
  Description of Artificial Sequence: Synthetic peptide
  Seed: RQVPDSDPARY (MAGA1_HUMAN)
RTVPDSDPARW

SEQ ID NO: 44990 - protein, 8 aa, Artificial Sequence
  Description of Artificial Sequence: Synthetic peptide
  Seed: VADLVGFL (MAGA1_HUMAN)
VGDLVGFL

SEQ ID NO: 44991 - protein, 9 aa, Artificial Sequence
  Description of Artificial Sequence: Synthetic peptide
  Seed: EIWEELSVM (MAGA1_HUMAN)
EVWEELSVK

SEQ ID NO: 44992 - protein, 9 aa, Artificial Sequence
  Description of Artificial Sequence: Synthetic peptide
  Seed: IAMEGGHAP (MAGA1_HUMAN)
ITMEGGHAI

SEQ ID NO: 44993 - protein, 9 aa, Artificial Sequence
  Description of Artificial Sequence: Synthetic peptide
  Seed: RQRQPSEGS (MAGA1_HUMAN)
RTRQPSEGK

SEQ ID NO: 44994 - protein, 11 aa, Artificial Sequence
  Description of Artificial Sequence: Synthetic peptide
  Seed: RVRFFFPSLRE (MAGA1_HUMAN)
RTRFFFPSLRI

SEQ ID NO: 44995 - protein, 9 aa, Artificial Sequence
  Description of Artificial Sequence: Synthetic peptide
  Seed: CILESLFRA (MAGA1_HUMAN)
CMLESLFRM

SEQ ID NO: 44996 - protein, 10 aa, Artificial Sequence
  Description of Artificial Sequence: Synthetic peptide
  Seed: IMPKTGFLII (MAGA1_HUMAN)
IFPKTGFLII

SEQ ID NO: 44997 - protein, 10 aa, Artificial Sequence
  Description of Artificial Sequence: Synthetic peptide
  Seed: VYDGREHSAY (MAGA1_HUMAN)
VTDGREHSAY

SEQ ID NO: 44998 - protein, 9 aa, Artificial Sequence
  Description of Artificial Sequence: Synthetic peptide
  Seed: IAMEGGHAP (MAGA1_HUMAN)
IQMEGGHAY

SEQ ID NO: 44999 - protein, 9 aa, Artificial Sequence
  Description of Artificial Sequence: Synthetic peptide
  Seed: ATSSSSPLV (MAGA1_HUMAN)
ASSSSSPLF

SEQ ID NO: 45000 - protein, 10 aa, Artificial Sequence
  Description of Artificial Sequence: Synthetic peptide
  Seed: SDPARYEFLW (MAGA1_HUMAN)
SFPARYEFLW

SEQ ID NO: 45001 - protein, 10 aa, Artificial Sequence
  Description of Artificial Sequence: Synthetic peptide
  Seed: EIFGKASESL (MAGA1_HUMAN)
ETFGKASESV

SEQ ID NO: 45002 - protein, 9 aa, Artificial Sequence
  Description of Artificial Sequence: Synthetic peptide
  Seed: RQRQPSEGS (MAGA1_HUMAN)
RTRQPSEGS

SEQ ID NO: 45003 - protein, 9 aa, Artificial Sequence
  Description of Artificial Sequence: Synthetic peptide
  Seed: RAREPVTKA (MAGA1_HUMAN)
RIREPVTKG

SEQ ID NO: 45004 - protein, 9 aa, Artificial Sequence
  Description of Artificial Sequence: Synthetic peptide
  Seed: IAMEGGHAP (MAGA1_HUMAN)
ITMEGGHAH

SEQ ID NO: 45005 - protein, 10 aa, Artificial Sequence
  Description of Artificial Sequence: Synthetic peptide
  Seed: RVRFFFPSLR (MAGA1_HUMAN)
RCRFFFPSLY

SEQ ID NO: 45006 - protein, 9 aa, Artificial Sequence
  Description of Artificial Sequence: Synthetic peptide
  Seed: KVADLVGFL (MAGA1_HUMAN)
KVADLVGFF

SEQ ID NO: 45007 - protein, 9 aa, Artificial Sequence
  Description of Artificial Sequence: Synthetic peptide
  Seed: RAREPVTKA (MAGA1_HUMAN)
RLREPVTKA

SEQ ID NO: 45008 - protein, 8 aa, Artificial Sequence
  Description of Artificial Sequence: Synthetic peptide
  Seed: LESLFRAV (MAGA1_HUMAN)
LESLFRAI

SEQ ID NO: 45009 - protein, 9 aa, Artificial Sequence
  Description of Artificial Sequence: Synthetic peptide
  Seed: RAREPVTKA (MAGA1_HUMAN)
RPREPVTKL

SEQ ID NO: 45010 - protein, 10 aa, Artificial Sequence
  Description of Artificial Sequence: Synthetic peptide
  Seed: RFFFPSLREA (MAGA1_HUMAN)
RSFFPSLREK

SEQ ID NO: 45011 - protein, 11 aa, Artificial Sequence
  Description of Artificial Sequence: Synthetic peptide
  Seed: RQVPDSDPARY (MAGA1_HUMAN)
REVPDSDPARM

SEQ ID NO: 45012 - protein, 9 aa, Artificial Sequence
  Description of Artificial Sequence: Synthetic peptide
  Seed: REPVTKAEM (MAGA1_HUMAN)
REPVTKAEV

SEQ ID NO: 45013 - protein, 9 aa, Artificial Sequence
  Description of Artificial Sequence: Synthetic peptide
  Seed: STDPPQSPQ (MAGA1_HUMAN)
SVDPPQSPF

SEQ ID NO: 45014 - protein, 9 aa, Artificial Sequence
  Description of Artificial Sequence: Synthetic peptide
  Seed: LVLGTLEEV (MAGA1_HUMAN)
LLLGTLEET

SEQ ID NO: 45015 - protein, 10 aa, Artificial Sequence
  Description of Artificial Sequence: Synthetic peptide
  Seed: TSYVKVLEYV (MAGA1_HUMAN)
TIYVKVLEYW

SEQ ID NO: 45016 - protein, 9 aa, Artificial Sequence
  Description of Artificial Sequence: Synthetic peptide
  Seed: LKYRAREPV (MAGA1_HUMAN)
LVYRAREPF

SEQ ID NO: 45017 - protein, 9 aa, Artificial Sequence
  Description of Artificial Sequence: Synthetic peptide
  Seed: STDPPQSPQ (MAGA1_HUMAN)
SQDPPQSPI

SEQ ID NO: 45018 - protein, 10 aa, Artificial Sequence
  Description of Artificial Sequence: Synthetic peptide
  Seed: SESLQLVFGI (MAGA1_HUMAN)
SWSLQLVFGW

SEQ ID NO: 45019 - protein, 10 aa, Artificial Sequence
  Description of Artificial Sequence: Synthetic peptide
  Seed: KASESLQLVF (MAGA1_HUMAN)
KSSESLQLVW

SEQ ID NO: 45020 - protein, 9 aa, Artificial Sequence
  Description of Artificial Sequence: Synthetic peptide
  Seed: KVLEYVIKV (MAGA1_HUMAN)
KTLEYVIKA

SEQ ID NO: 45021 - protein, 10 aa, Artificial Sequence
  Description of Artificial Sequence: Synthetic peptide
  Seed: RVRFFFPSLR (MAGA1_HUMAN)
RARFFFPSLQ

SEQ ID NO: 45022 - protein, 9 aa, Artificial Sequence
  Description of Artificial Sequence: Synthetic peptide
  Seed: LVQEKYLEY (MAGA1_HUMAN)
LIQEKYLEK

SEQ ID NO: 45023 - protein, 10 aa, Artificial Sequence
  Description of Artificial Sequence: Synthetic peptide
  Seed: ADLVGFLLLK (MAGA1_HUMAN)
AGLVGFLLLR

SEQ ID NO: 45024 - protein, 8 aa, Artificial Sequence
  Description of Artificial Sequence: Synthetic peptide
  Seed: ADLVGFLL (MAGA1_HUMAN)
AELVGFLA

SEQ ID NO: 45025 - protein, 10 aa, Artificial Sequence
  Description of Artificial Sequence: Synthetic peptide
  Seed: KEADPTGHSY (MAGA1_HUMAN)
KYADPTGHSL

SEQ ID NO: 45026 - protein, 10 aa, Artificial Sequence
  Description of Artificial Sequence: Synthetic peptide
  Seed: ATSSSSPLVL (MAGA1_HUMAN)
AQSSSSPLVF

SEQ ID NO: 45027 - protein, 11 aa, Artificial Sequence
  Description of Artificial Sequence: Synthetic peptide
  Seed: YEFLWGPRALA (MAGA1_HUMAN)
YVFLWGPRALL

SEQ ID NO: 45028 - protein, 9 aa, Artificial Sequence
  Description of Artificial Sequence: Synthetic peptide
  Seed: HSYVLVTCL (MAGA1_HUMAN)
HLYVLVTCY

SEQ ID NO: 45029 - protein, 10 aa, Artificial Sequence
  Description of Artificial Sequence: Synthetic peptide
  Seed: STSCILESLF (MAGA1_HUMAN)
SFSCILESLW

SEQ ID NO: 45030 - protein, 9 aa, Artificial Sequence
  Description of Artificial Sequence: Synthetic peptide
  Seed: LTQDLVQEK (MAGA1_HUMAN)
LAQDLVQEY

SEQ ID NO: 45031 - protein, 10 aa, Artificial Sequence
  Description of Artificial Sequence: Synthetic peptide
  Seed: RAREPVTKAE (MAGA1_HUMAN)
RSREPVTKAL

SEQ ID NO: 45032 - protein, 9 aa, Artificial Sequence
  Description of Artificial Sequence: Synthetic peptide
  Seed: RVRFFFPSL (MAGA1_HUMAN)
RTRFFFPSG

SEQ ID NO: 45033 - protein, 10 aa, Artificial Sequence
  Description of Artificial Sequence: Synthetic peptide
  Seed: KVSARVRFFF (MAGA1_HUMAN)
KCSARVRFFY

SEQ ID NO: 45034 - protein, 9 aa, Artificial Sequence
  Description of Artificial Sequence: Synthetic peptide
  Seed: KTGFLIIVL (MAGA1_HUMAN)
KQGFLIIVF

SEQ ID NO: 45035 - protein, 9 aa, Artificial Sequence
  Description of Artificial Sequence: Synthetic peptide
  Seed: ATSSSSPLV (MAGA1_HUMAN)
ALSSSSPLA

SEQ ID NO: 45036 - protein, 9 aa, Artificial Sequence
  Description of Artificial Sequence: Synthetic peptide
  Seed: LKYRAREPV (MAGA1_HUMAN)
LRYRAREPY

SEQ ID NO: 45037 - protein, 10 aa, Artificial Sequence
  Description of Artificial Sequence: Synthetic peptide
  Seed: FFFPSLREAA (MAGA1_HUMAN)
FYFPSLREAL

SEQ ID NO: 45038 - protein, 9 aa, Artificial Sequence
  Description of Artificial Sequence: Synthetic peptide
  Seed: FPSLREAAL (MAGA1_HUMAN)
FMSLREAAV

SEQ ID NO: 45039 - protein, 8 aa, Artificial Sequence
  Description of Artificial Sequence: Synthetic peptide
  Seed: RVRFFFPS (MAGA1_HUMAN)
RVRFFFPV

SEQ ID NO: 45040 - protein, 9 aa, Artificial Sequence
  Description of Artificial Sequence: Synthetic peptide
  Seed: SARVRFFFP (MAGA1_HUMAN)
SFRVRFFFS

SEQ ID NO: 45041 - protein, 9 aa, Artificial Sequence
  Description of Artificial Sequence: Synthetic peptide
  Seed: STDPPQSPQ (MAGA1_HUMAN)
SVDPPQSPM

SEQ ID NO: 45042 - protein, 9 aa, Artificial Sequence
  Description of Artificial Sequence: Synthetic peptide
  Seed: TSCILESLF (MAGA1_HUMAN)
TTCILESLW

SEQ ID NO: 45043 - protein, 9 aa, Artificial Sequence
  Description of Artificial Sequence: Synthetic peptide
  Seed: LVLGTLEEV (MAGA1_HUMAN)
LSLGTLEEY

SEQ ID NO: 45044 - protein, 9 aa, Artificial Sequence
  Description of Artificial Sequence: Synthetic peptide
  Seed: RAREPVTKA (MAGA1_HUMAN)
RIREPVTKI

SEQ ID NO: 45045 - protein, 9 aa, Artificial Sequence
  Description of Artificial Sequence: Synthetic peptide
  Seed: RQRQPSEGS (MAGA1_HUMAN)
RQRQPSEGK

SEQ ID NO: 45046 - protein, 10 aa, Artificial Sequence
  Description of Artificial Sequence: Synthetic peptide
  Seed: LSVMEVYDGR (MAGA1_HUMAN)
LHVMEVYDGR

SEQ ID NO: 45047 - protein, 10 aa, Artificial Sequence
  Description of Artificial Sequence: Synthetic peptide
  Seed: EMLESVIKNY (MAGA1_HUMAN)
EILESVIKNF

SEQ ID NO: 45048 - protein, 10 aa, Artificial Sequence
  Description of Artificial Sequence: Synthetic peptide
  Seed: REAALREEEE (MAGA1_HUMAN)
REAALREEEC

SEQ ID NO: 45049 - protein, 10 aa, Artificial Sequence
  Description of Artificial Sequence: Synthetic peptide
  Seed: STSCILESLF (MAGA1_HUMAN)
STSCILESLY

SEQ ID NO: 45050 - protein, 9 aa, Artificial Sequence
  Description of Artificial Sequence: Synthetic peptide
  Seed: LEYVIKVSA (MAGA1_HUMAN)
LEYVIKVSM

SEQ ID NO: 45051 - protein, 9 aa, Artificial Sequence
  Description of Artificial Sequence: Synthetic peptide
  Seed: VQAATSSSS (MAGA1_HUMAN)
VKAATSSSL

SEQ ID NO: 45052 - protein, 9 aa, Artificial Sequence
  Description of Artificial Sequence: Synthetic peptide
  Seed: VADLVGFLL (MAGA1_HUMAN)
VIDLVGFLL

SEQ ID NO: 45053 - protein, 8 aa, Artificial Sequence
  Description of Artificial Sequence: Synthetic peptide
  Seed: RVRFFFPS (MAGA1_HUMAN)
RVRFFFPF

SEQ ID NO: 45054 - protein, 10 aa, Artificial Sequence
  Description of Artificial Sequence: Synthetic peptide
  Seed: SSSPLVLGTL (MAGA1_HUMAN)
STSPLVLGTM

SEQ ID NO: 45055 - protein, 9 aa, Artificial Sequence
  Description of Artificial Sequence: Synthetic peptide
  Seed: FLIIVLVMI (MAGA1_HUMAN)
FVIIVLVMI

SEQ ID NO: 45056 - protein, 10 aa, Artificial Sequence
  Description of Artificial Sequence: Synthetic peptide
  Seed: STSCILESLF (MAGA1_HUMAN)
SASCILESLW

SEQ ID NO: 45057 - protein, 10 aa, Artificial Sequence
  Description of Artificial Sequence: Synthetic peptide
  Seed: SAFPTTINFT (MAGA1_HUMAN)
SVFPTTINFL

SEQ ID NO: 45058 - protein, 9 aa, Artificial Sequence
  Description of Artificial Sequence: Synthetic peptide
  Seed: VRFFFPSLR (MAGA1_HUMAN)
VRFFFPSLF

SEQ ID NO: 45059 - protein, 9 aa, Artificial Sequence
  Description of Artificial Sequence: Synthetic peptide
  Seed: MSLEQRSLH (MAGA1_HUMAN)
MALEQRSLL

SEQ ID NO: 45060 - protein, 10 aa, Artificial Sequence
  Description of Artificial Sequence: Synthetic peptide
  Seed: ARYEFLWGPR (MAGA1_HUMAN)
ASYEFLWGPR

SEQ ID NO: 45061 - protein, 11 aa, Artificial Sequence
  Description of Artificial Sequence: Synthetic peptide
  Seed: RVRFFFPSLRE (MAGA1_HUMAN)
RRRFFFPSLRI

SEQ ID NO: 45062 - protein, 9 aa, Artificial Sequence
  Description of Artificial Sequence: Synthetic peptide
  Seed: RALAETSYV (MAGA1_HUMAN)
RMLAETSYL

SEQ ID NO: 45063 - protein, 9 aa, Artificial Sequence
  Description of Artificial Sequence: Synthetic peptide
  Seed: VRFFFPSLR (MAGA1_HUMAN)
VMFFFPSLR

SEQ ID NO: 45064 - protein, 9 aa, Artificial Sequence
  Description of Artificial Sequence: Synthetic peptide
  Seed: VRFFFPSLR (MAGA1_HUMAN)
VLFFFPSLR

SEQ ID NO: 45065 - protein, 11 aa, Artificial Sequence
  Description of Artificial Sequence: Synthetic peptide
  Seed: AQQEALGLVCV (MAGA1_HUMAN)
AQQEALGLVCF

SEQ ID NO: 45066 - protein, 10 aa, Artificial Sequence
  Description of Artificial Sequence: Synthetic peptide
  Seed: KHCFPEIFGK (MAGA1_HUMAN)
KLCFPEIFGR

SEQ ID NO: 45067 - protein, 9 aa, Artificial Sequence
  Description of Artificial Sequence: Synthetic peptide
  Seed: YKHCFPEIF (MAGA1_HUMAN)
YYHCFPEIM

SEQ ID NO: 45068 - protein, 10 aa, Artificial Sequence
  Description of Artificial Sequence: Synthetic peptide
  Seed: KNYKHCFPEI (MAGA1_HUMAN)
KLYKHCFPEK

SEQ ID NO: 45069 - protein, 10 aa, Artificial Sequence
  Description of Artificial Sequence: Synthetic peptide
  Seed: ARVRFFFPSL (MAGA1_HUMAN)
APVRFFFPSA

SEQ ID NO: 45070 - protein, 9 aa, Artificial Sequence
  Description of Artificial Sequence: Synthetic peptide
  Seed: SAYGEPRKL (MAGA1_HUMAN)
SAYGEPRKF

SEQ ID NO: 45071 - protein, 11 aa, Artificial Sequence
  Description of Artificial Sequence: Synthetic peptide
  Seed: GLLGDNQIMPK (MAGA1_HUMAN)
GVLGDNQIMPK

SEQ ID NO: 45072 - protein, 9 aa, Artificial Sequence
  Description of Artificial Sequence: Synthetic peptide
  Seed: AATSSSSPL (MAGA1_HUMAN)
AVTSSSSPV

SEQ ID NO: 45073 - protein, 9 aa, Artificial Sequence
  Description of Artificial Sequence: Synthetic peptide
  Seed: IAMEGGHAP (MAGA1_HUMAN)
IAMEGGHAY

SEQ ID NO: 45074 - protein, 9 aa, Artificial Sequence
  Description of Artificial Sequence: Synthetic peptide
  Seed: SVMEVYDGR (MAGA1_HUMAN)
SMMEVYDGL

SEQ ID NO: 45075 - protein, 9 aa, Artificial Sequence
  Description of Artificial Sequence: Synthetic peptide
  Seed: VRFFFPSLR (MAGA1_HUMAN)
VWFFFPSLR

SEQ ID NO: 45076 - protein, 9 aa, Artificial Sequence
  Description of Artificial Sequence: Synthetic peptide
  Seed: SYVKVLEYV (MAGA1_HUMAN)
STVKVLEYV

SEQ ID NO: 45077 - protein, 10 aa, Artificial Sequence
  Description of Artificial Sequence: Synthetic peptide
  Seed: RAREPVTKAE (MAGA1_HUMAN)
RMREPVTKAK

SEQ ID NO: 45078 - protein, 9 aa, Artificial Sequence
  Description of Artificial Sequence: Synthetic peptide
  Seed: AQQEALGLV (MAGA1_HUMAN)
AAQEALGLY

SEQ ID NO: 45079 - protein, 9 aa, Artificial Sequence
  Description of Artificial Sequence: Synthetic peptide
  Seed: TSYVKVLEY (MAGA1_HUMAN)
TIYVKVLEW

SEQ ID NO: 45080 - protein, 9 aa, Artificial Sequence
  Description of Artificial Sequence: Synthetic peptide
  Seed: TKAEMLESV (MAGA1_HUMAN)
TRAEMLESM

SEQ ID NO: 45081 - protein, 9 aa, Artificial Sequence
  Description of Artificial Sequence: Synthetic peptide
  Seed: KTGFLIIVL (MAGA1_HUMAN)
KSGFLIIVW

SEQ ID NO: 45082 - protein, 10 aa, Artificial Sequence
  Description of Artificial Sequence: Synthetic peptide
  Seed: SARVRFFFPS (MAGA1_HUMAN)
SSRVRFFFPY

SEQ ID NO: 45083 - protein, 11 aa, Artificial Sequence
  Description of Artificial Sequence: Synthetic peptide
  Seed: YVKVLEYVIKV (MAGA1_HUMAN)
YMKVLEYVIKA

SEQ ID NO: 45084 - protein, 9 aa, Artificial Sequence
  Description of Artificial Sequence: Synthetic peptide
  Seed: TQDLVQEKY (MAGA1_HUMAN)
TNDLVQEKM

SEQ ID NO: 45085 - protein, 10 aa, Artificial Sequence
  Description of Artificial Sequence: Synthetic peptide
  Seed: RVRFFFPSLR (MAGA1_HUMAN)
RPRFFFPSLK

SEQ ID NO: 45086 - protein, 9 aa, Artificial Sequence
  Description of Artificial Sequence: Synthetic peptide
  Seed: GTLEEVPTA (MAGA1_HUMAN)
GMLEEVPTL

SEQ ID NO: 45087 - protein, 9 aa, Artificial Sequence
  Description of Artificial Sequence: Synthetic peptide
  Seed: RVRFFFPSL (MAGA1_HUMAN)
RLRFFFPSK

SEQ ID NO: 45088 - protein, 10 aa, Artificial Sequence
  Description of Artificial Sequence: Synthetic peptide
  Seed: KNYKHCFPEI (MAGA1_HUMAN)
KTYKHCFPEL

SEQ ID NO: 45089 - protein, 9 aa, Artificial Sequence
  Description of Artificial Sequence: Synthetic peptide
  Seed: VQAATSSSS (MAGA1_HUMAN)
VTAATSSSF

SEQ ID NO: 45090 - protein, 10 aa, Artificial Sequence
  Description of Artificial Sequence: Synthetic peptide
  Seed: KVSARVRFFF (MAGA1_HUMAN)
KASARVRFFY

SEQ ID NO: 45091 - protein, 10 aa, Artificial Sequence
  Description of Artificial Sequence: Synthetic peptide
  Seed: RFFFPSLREA (MAGA1_HUMAN)
RVFFPSLREK

SEQ ID NO: 45092 - protein, 10 aa, Artificial Sequence
  Description of Artificial Sequence: Synthetic peptide
  Seed: KEADPTGHSY (MAGA1_HUMAN)
KMADPTGHSM

SEQ ID NO: 45093 - protein, 9 aa, Artificial Sequence
  Description of Artificial Sequence: Synthetic peptide
  Seed: KVADLVGFL (MAGA1_HUMAN)
KVADLVGFM

SEQ ID NO: 45094 - protein, 10 aa, Artificial Sequence
  Description of Artificial Sequence: Synthetic peptide
  Seed: EIFGKASESL (MAGA1_HUMAN)
ETFGKASESL

SEQ ID NO: 45095 - protein, 10 aa, Artificial Sequence
  Description of Artificial Sequence: Synthetic peptide
  Seed: YEFLWGPRAL (MAGA1_HUMAN)
YHFLWGPRAL

SEQ ID NO: 45096 - protein, 10 aa, Artificial Sequence
  Description of Artificial Sequence: Synthetic peptide
  Seed: KHCFPEIFGK (MAGA1_HUMAN)
KWCFPEIFGR

SEQ ID NO: 45097 - protein, 11 aa, Artificial Sequence
  Description of Artificial Sequence: Synthetic peptide
  Seed: RVRFFFPSLRE (MAGA1_HUMAN)
RMRFFFPSLRP

SEQ ID NO: 45098 - protein, 10 aa, Artificial Sequence
  Description of Artificial Sequence: Synthetic peptide
  Seed: IMPKTGFLII (MAGA1_HUMAN)
IYPKTGFLIL

SEQ ID NO: 45099 - protein, 10 aa, Artificial Sequence
  Description of Artificial Sequence: Synthetic peptide
  Seed: SPQGASAFPT (MAGA1_HUMAN)
SPQGASAFPM

SEQ ID NO: 45100 - protein, 9 aa, Artificial Sequence
  Description of Artificial Sequence: Synthetic peptide
  Seed: SVMEVYDGR (MAGA1_HUMAN)
STMEVYDGY

SEQ ID NO: 45101 - protein, 9 aa, Artificial Sequence
  Description of Artificial Sequence: Synthetic peptide
  Seed: AATSSSSPL (MAGA1_HUMAN)
AKTSSSSPM

SEQ ID NO: 45102 - protein, 10 aa, Artificial Sequence
  Description of Artificial Sequence: Synthetic peptide
  Seed: CILESLFRAV (MAGA1_HUMAN)
CLLESLFRAA

SEQ ID NO: 45103 - protein, 9 aa, Artificial Sequence
  Description of Artificial Sequence: Synthetic peptide
  Seed: QEALGLVCV (MAGA1_HUMAN)
QEALGLVCW

SEQ ID NO: 45104 - protein, 10 aa, Artificial Sequence
  Description of Artificial Sequence: Synthetic peptide
  Seed: SLFRAVITKK (MAGA1_HUMAN)
SEFRAVITKR

SEQ ID NO: 45105 - protein, 9 aa, Artificial Sequence
  Description of Artificial Sequence: Synthetic peptide
  Seed: GLVCVQAAT (MAGA1_HUMAN)
GMVCVQAAL

SEQ ID NO: 45106 - protein, 10 aa, Artificial Sequence
  Description of Artificial Sequence: Synthetic peptide
  Seed: DVKEADPTGH (MAGA1_HUMAN)
DAKEADPTGR

SEQ ID NO: 45107 - protein, 9 aa, Artificial Sequence
  Description of Artificial Sequence: Synthetic peptide
  Seed: YVIKVSARV (MAGA1_HUMAN)
YTIKVSARK

SEQ ID NO: 45108 - protein, 9 aa, Artificial Sequence
  Description of Artificial Sequence: Synthetic peptide
  Seed: IMPKTGFLI (MAGA1_HUMAN)
IYPKTGFLY

SEQ ID NO: 45109 - protein, 9 aa, Artificial Sequence
  Description of Artificial Sequence: Synthetic peptide
  Seed: RVRFFFPSL (MAGA1_HUMAN)
RIRFFFPSI

SEQ ID NO: 45110 - protein, 10 aa, Artificial Sequence
  Description of Artificial Sequence: Synthetic peptide
  Seed: WEELSVMEVY (MAGA1_HUMAN)
WAELSVMEVW

SEQ ID NO: 45111 - protein, 9 aa, Artificial Sequence
  Description of Artificial Sequence: Synthetic peptide
  Seed: TSYVKVLEY (MAGA1_HUMAN)
TYYVKVLEF

SEQ ID NO: 45112 - protein, 9 aa, Artificial Sequence
  Description of Artificial Sequence: Synthetic peptide
  Seed: EIWEELSVM (MAGA1_HUMAN)
EAWEELSVW

SEQ ID NO: 45113 - protein, 9 aa, Artificial Sequence
  Description of Artificial Sequence: Synthetic peptide
  Seed: LVLGTLEEV (MAGA1_HUMAN)
LTLGTLEEV

SEQ ID NO: 45114 - protein, 9 aa, Artificial Sequence
  Description of Artificial Sequence: Synthetic peptide
  Seed: RVRFFFPSL (MAGA1_HUMAN)
RPRFFFPSY

SEQ ID NO: 45115 - protein, 9 aa, Artificial Sequence
  Description of Artificial Sequence: Synthetic peptide
  Seed: EYVIKVSAR (MAGA1_HUMAN)
EAVIKVSAR

SEQ ID NO: 45116 - protein, 9 aa, Artificial Sequence
  Description of Artificial Sequence: Synthetic peptide
  Seed: STSCILESL (MAGA1_HUMAN)
SVSCILESW

SEQ ID NO: 45117 - protein, 9 aa, Artificial Sequence
  Description of Artificial Sequence: Synthetic peptide
  Seed: AYGEPRKLL (MAGA1_HUMAN)
ARGEPRKLM

SEQ ID NO: 45118 - protein, 10 aa, Artificial Sequence
  Description of Artificial Sequence: Synthetic peptide
  Seed: LTQDLVQEKY (MAGA1_HUMAN)
LLQDLVQEKW

SEQ ID NO: 45119 - protein, 10 aa, Artificial Sequence
  Description of Artificial Sequence: Synthetic peptide
  Seed: RVRFFFPSLR (MAGA1_HUMAN)
RERFFFPSLL

SEQ ID NO: 45120 - protein, 10 aa, Artificial Sequence
  Description of Artificial Sequence: Synthetic peptide
  Seed: KKVADLVGFL (MAGA1_HUMAN)
KDVADLVGFV

SEQ ID NO: 45121 - protein, 10 aa, Artificial Sequence
  Description of Artificial Sequence: Synthetic peptide
  Seed: KVSARVRFFF (MAGA1_HUMAN)
KISARVRFFW

SEQ ID NO: 45122 - protein, 9 aa, Artificial Sequence
  Description of Artificial Sequence: Synthetic peptide
  Seed: LVGFLLLKY (MAGA1_HUMAN)
LTGFLLLKF

SEQ ID NO: 45123 - protein, 10 aa, Artificial Sequence
  Description of Artificial Sequence: Synthetic peptide
  Seed: FLWGPRALAE (MAGA1_HUMAN)
FLWGPRALAL

SEQ ID NO: 45124 - protein, 10 aa, Artificial Sequence
  Description of Artificial Sequence: Synthetic peptide
  Seed: TSYVKVLEYV (MAGA1_HUMAN)
TMYVKVLEYL

SEQ ID NO: 45125 - protein, 10 aa, Artificial Sequence
  Description of Artificial Sequence: Synthetic peptide
  Seed: KKVADLVGFL (MAGA1_HUMAN)
KMVADLVGFV

SEQ ID NO: 45126 - protein, 11 aa, Artificial Sequence
  Description of Artificial Sequence: Synthetic peptide
  Seed: YEFLWGPRALA (MAGA1_HUMAN)
YPFLWGPRALL

SEQ ID NO: 45127 - protein, 9 aa, Artificial Sequence
  Description of Artificial Sequence: Synthetic peptide
  Seed: YVLVTCLGL (MAGA1_HUMAN)
YLLVTCLGV

SEQ ID NO: 45128 - protein, 9 aa, Artificial Sequence
  Description of Artificial Sequence: Synthetic peptide
  Seed: RVRFFFPSL (MAGA1_HUMAN)
RNRFFFPSR

SEQ ID NO: 45129 - protein, 9 aa, Artificial Sequence
  Description of Artificial Sequence: Synthetic peptide
  Seed: LESLFRAVI (MAGA1_HUMAN)
LMSLFRAVL

SEQ ID NO: 45130 - protein, 10 aa, Artificial Sequence
  Description of Artificial Sequence: Synthetic peptide
  Seed: KVSARVRFFF (MAGA1_HUMAN)
KSSARVRFFW

SEQ ID NO: 45131 - protein, 9 aa, Artificial Sequence
  Description of Artificial Sequence: Synthetic peptide
  Seed: RQRQPSEGS (MAGA1_HUMAN)
RYRQPSEGA

SEQ ID NO: 45132 - protein, 9 aa, Artificial Sequence
  Description of Artificial Sequence: Synthetic peptide
  Seed: FLWGPRALA (MAGA1_HUMAN)
FIWGPRALL

SEQ ID NO: 45133 - protein, 10 aa, Artificial Sequence
  Description of Artificial Sequence: Synthetic peptide
  Seed: SARVRFFFPS (MAGA1_HUMAN)
SVRVRFFFPL

SEQ ID NO: 45134 - protein, 9 aa, Artificial Sequence
  Description of Artificial Sequence: Synthetic peptide
  Seed: LTQDLVQEK (MAGA1_HUMAN)
LGQDLVQEM

SEQ ID NO: 45135 - protein, 11 aa, Artificial Sequence
  Description of Artificial Sequence: Synthetic peptide
  Seed: YEFLWGPRALA (MAGA1_HUMAN)
YDFLWGPRALI

SEQ ID NO: 45136 - protein, 11 aa, Artificial Sequence
  Description of Artificial Sequence: Synthetic peptide
  Seed: SAFPTTINFTR (MAGA1_HUMAN)
SMFPTTINFTK

SEQ ID NO: 45137 - protein, 10 aa, Artificial Sequence
  Description of Artificial Sequence: Synthetic peptide
  Seed: LVQEKYLEYR (MAGA1_HUMAN)
LFQEKYLEYR

SEQ ID NO: 45138 - protein, 9 aa, Artificial Sequence
  Description of Artificial Sequence: Synthetic peptide
  Seed: YVLVTCLGL (MAGA1_HUMAN)
YILVTCLGL

SEQ ID NO: 45139 - protein, 10 aa, Artificial Sequence
  Description of Artificial Sequence: Synthetic peptide
  Seed: YEFLWGPRAL (MAGA1_HUMAN)
YYFLWGPRAM

SEQ ID NO: 45140 - protein, 11 aa, Artificial Sequence
  Description of Artificial Sequence: Synthetic peptide
  Seed: SVMEVYDGREH (MAGA1_HUMAN)
SAMEVYDGREF

SEQ ID NO: 45141 - protein, 9 aa, Artificial Sequence
  Description of Artificial Sequence: Synthetic peptide
  Seed: DLVGFLLLK (MAGA1_HUMAN)
DSVGFLLLK

SEQ ID NO: 45142 - protein, 11 aa, Artificial Sequence
  Description of Artificial Sequence: Synthetic peptide
  Seed: YVKVLEYVIKV (MAGA1_HUMAN)
YLKVLEYVIKL

SEQ ID NO: 45143 - protein, 10 aa, Artificial Sequence
  Description of Artificial Sequence: Synthetic peptide
  Seed: KYRAREPVTK (MAGA1_HUMAN)
KTRAREPVTA

SEQ ID NO: 45144 - protein, 10 aa, Artificial Sequence
  Description of Artificial Sequence: Synthetic peptide
  Seed: VKVLEYVIKV (MAGA1_HUMAN)
VGVLEYVIKV

SEQ ID NO: 45145 - protein, 10 aa, Artificial Sequence
  Description of Artificial Sequence: Synthetic peptide
  Seed: SSSPLVLGTL (MAGA1_HUMAN)
SQSPLVLGTI

SEQ ID NO: 45146 - protein, 11 aa, Artificial Sequence
  Description of Artificial Sequence: Synthetic peptide
  Seed: RQVPDSDPARY (MAGA1_HUMAN)
RMVPDSDPARW

SEQ ID NO: 45147 - protein, 10 aa, Artificial Sequence
  Description of Artificial Sequence: Synthetic peptide
  Seed: ATSSSSPLVL (MAGA1_HUMAN)
ATSSSSPLVW

SEQ ID NO: 45148 - protein, 10 aa, Artificial Sequence
  Description of Artificial Sequence: Synthetic peptide
  Seed: KVADLVGFLL (MAGA1_HUMAN)
KMADLVGFLW

SEQ ID NO: 45149 - protein, 10 aa, Artificial Sequence
  Description of Artificial Sequence: Synthetic peptide
  Seed: ARVRFFFPSL (MAGA1_HUMAN)
AVVRFFFPSA

SEQ ID NO: 45150 - protein, 9 aa, Artificial Sequence
  Description of Artificial Sequence: Synthetic peptide
  Seed: HSYVLVTCL (MAGA1_HUMAN)
HTYVLVTCF

SEQ ID NO: 45151 - protein, 10 aa, Artificial Sequence
  Description of Artificial Sequence: Synthetic peptide
  Seed: MLESVIKNYK (MAGA1_HUMAN)
MTESVIKNYY

SEQ ID NO: 45152 - protein, 10 aa, Artificial Sequence
  Description of Artificial Sequence: Synthetic peptide
  Seed: ADLVGFLLLK (MAGA1_HUMAN)
ALLVGFLLLK

SEQ ID NO: 45153 - protein, 9 aa, Artificial Sequence
  Description of Artificial Sequence: Synthetic peptide
  Seed: SARVRFFFP (MAGA1_HUMAN)
SGRVRFFFV

SEQ ID NO: 45154 - protein, 9 aa, Artificial Sequence
  Description of Artificial Sequence: Synthetic peptide
  Seed: LTQDLVQEK (MAGA1_HUMAN)
LIQDLVQEL

SEQ ID NO: 45155 - protein, 8 aa, Artificial Sequence
  Description of Artificial Sequence: Synthetic peptide
  Seed: VADLVGFL (MAGA1_HUMAN)
VADLVGFF

SEQ ID NO: 45156 - protein, 9 aa, Artificial Sequence
  Description of Artificial Sequence: Synthetic peptide
  Seed: LFRAVITKK (MAGA1_HUMAN)
LTRAVITKR

SEQ ID NO: 45157 - protein, 10 aa, Artificial Sequence
  Description of Artificial Sequence: Synthetic peptide
  Seed: EYVIKVSARV (MAGA1_HUMAN)
EFVIKVSARV

SEQ ID NO: 45158 - protein, 11 aa, Artificial Sequence
  Description of Artificial Sequence: Synthetic peptide
  Seed: KEADPTGHSYV (MAGA1_HUMAN)
KLADPTGHSYW

SEQ ID NO: 45159 - protein, 9 aa, Artificial Sequence
  Description of Artificial Sequence: Synthetic peptide
  Seed: REPVTKAEM (MAGA1_HUMAN)
RAPVTKAEY

SEQ ID NO: 45160 - protein, 9 aa, Artificial Sequence
  Description of Artificial Sequence: Synthetic peptide
  Seed: HCFPEIFGK (MAGA1_HUMAN)
HVFPEIFGR

SEQ ID NO: 45161 - protein, 9 aa, Artificial Sequence
  Description of Artificial Sequence: Synthetic peptide
  Seed: STDPPQSPQ (MAGA1_HUMAN)
SCDPPQSPV

SEQ ID NO: 45162 - protein, 9 aa, Artificial Sequence
  Description of Artificial Sequence: Synthetic peptide
  Seed: LVQEKYLEY (MAGA1_HUMAN)
LSQEKYLEM

SEQ ID NO: 45163 - protein, 9 aa, Artificial Sequence
  Description of Artificial Sequence: Synthetic peptide
  Seed: SYVKVLEYV (MAGA1_HUMAN)
SLVKVLEYM

SEQ ID NO: 45164 - protein, 10 aa, Artificial Sequence
  Description of Artificial Sequence: Synthetic peptide
  Seed: KEADPTGHSY (MAGA1_HUMAN)
KEADPTGHSA

SEQ ID NO: 45165 - protein, 11 aa, Artificial Sequence
  Description of Artificial Sequence: Synthetic peptide
  Seed: KVADLVGFLLL (MAGA1_HUMAN)
KTADLVGFLLL

SEQ ID NO: 45166 - protein, 10 aa, Artificial Sequence
  Description of Artificial Sequence: Synthetic peptide
  Seed: LTQDLVQEKY (MAGA1_HUMAN)
LTQDLVQEKW

SEQ ID NO: 45167 - protein, 11 aa, Artificial Sequence
  Description of Artificial Sequence: Synthetic peptide
  Seed: VPDSDPARYEF (MAGA1_HUMAN)
VSDSDPARYEW

SEQ ID NO: 45168 - protein, 9 aa, Artificial Sequence
  Description of Artificial Sequence: Synthetic peptide
  Seed: DPTGHSYVL (MAGA1_HUMAN)
DPTGHSYVW

SEQ ID NO: 45169 - protein, 9 aa, Artificial Sequence
  Description of Artificial Sequence: Synthetic peptide
  Seed: IAMEGGHAP (MAGA1_HUMAN)
IAMEGGHAL

SEQ ID NO: 45170 - protein, 10 aa, Artificial Sequence
  Description of Artificial Sequence: Synthetic peptide
  Seed: KEADPTGHSY (MAGA1_HUMAN)
KVADPTGHSM

SEQ ID NO: 45171 - protein, 9 aa, Artificial Sequence
  Description of Artificial Sequence: Synthetic peptide
  Seed: STSCILESL (MAGA1_HUMAN)
SASCILESI

SEQ ID NO: 45172 - protein, 10 aa, Artificial Sequence
  Description of Artificial Sequence: Synthetic peptide
  Seed: RVRFFFPSLR (MAGA1_HUMAN)
RSRFFFPSLG

SEQ ID NO: 45173 - protein, 9 aa, Artificial Sequence
  Description of Artificial Sequence: Synthetic peptide
  Seed: STDPPQSPQ (MAGA1_HUMAN)
SCDPPQSPL

SEQ ID NO: 45174 - protein, 9 aa, Artificial Sequence
  Description of Artificial Sequence: Synthetic peptide
  Seed: EADPTGHSY (MAGA1_HUMAN)
EADPTGHSW

SEQ ID NO: 45175 - protein, 9 aa, Artificial Sequence
  Description of Artificial Sequence: Synthetic peptide
  Seed: SAFPTTINF (MAGA1_HUMAN)
SGFPTTINK

SEQ ID NO: 45176 - protein, 9 aa, Artificial Sequence
  Description of Artificial Sequence: Synthetic peptide
  Seed: GASAFPTTI (MAGA1_HUMAN)
GASAFPTTY

SEQ ID NO: 45177 - protein, 9 aa, Artificial Sequence
  Description of Artificial Sequence: Synthetic peptide
  Seed: KYRAREPVT (MAGA1_HUMAN)
KVRAREPVG

SEQ ID NO: 45178 - protein, 9 aa, Artificial Sequence
  Description of Artificial Sequence: Synthetic peptide
  Seed: VSARVRFFF (MAGA1_HUMAN)
VNARVRFFW

SEQ ID NO: 45179 - protein, 9 aa, Artificial Sequence
  Description of Artificial Sequence: Synthetic peptide
  Seed: EEVPTAGST (MAGA1_HUMAN)
EEVPTAGSI

SEQ ID NO: 45180 - protein, 9 aa, Artificial Sequence
  Description of Artificial Sequence: Synthetic peptide
  Seed: QIMPKTGFL (MAGA1_HUMAN)
QQMPKTGFL

SEQ ID NO: 45181 - protein, 10 aa, Artificial Sequence
  Description of Artificial Sequence: Synthetic peptide
  Seed: LSVMEVYDGR (MAGA1_HUMAN)
LTVMEVYDGK

SEQ ID NO: 45182 - protein, 9 aa, Artificial Sequence
  Description of Artificial Sequence: Synthetic peptide
  Seed: MEVYDGREH (MAGA1_HUMAN)
MEVYDGREW

SEQ ID NO: 45183 - protein, 11 aa, Artificial Sequence
  Description of Artificial Sequence: Synthetic peptide
  Seed: KVSARVRFFFP (MAGA1_HUMAN)
KISARVRFFFK

SEQ ID NO: 45184 - protein, 9 aa, Artificial Sequence
  Description of Artificial Sequence: Synthetic peptide
  Seed: SARVRFFFP (MAGA1_HUMAN)
SMRVRFFFF

SEQ ID NO: 45185 - protein, 9 aa, Artificial Sequence
  Description of Artificial Sequence: Synthetic peptide
  Seed: SAYGEPRKL (MAGA1_HUMAN)
SAYGEPRKH

SEQ ID NO: 45186 - protein, 10 aa, Artificial Sequence
  Description of Artificial Sequence: Synthetic peptide
  Seed: KKVADLVGFL (MAGA1_HUMAN)
KNVADLVGFV

SEQ ID NO: 45187 - protein, 9 aa, Artificial Sequence
  Description of Artificial Sequence: Synthetic peptide
  Seed: SARVRFFFP (MAGA1_HUMAN)
SVRVRFFFR

SEQ ID NO: 45188 - protein, 10 aa, Artificial Sequence
  Description of Artificial Sequence: Synthetic peptide
  Seed: SCILESLFRA (MAGA1_HUMAN)
SHILESLFRV

SEQ ID NO: 45189 - protein, 9 aa, Artificial Sequence
  Description of Artificial Sequence: Synthetic peptide
  Seed: DPARYEFLW (MAGA1_HUMAN)
DAARYEFLW

SEQ ID NO: 45190 - protein, 9 aa, Artificial Sequence
  Description of Artificial Sequence: Synthetic peptide
  Seed: CILESLFRA (MAGA1_HUMAN)
CLLESLFRS

SEQ ID NO: 45191 - protein, 11 aa, Artificial Sequence
  Description of Artificial Sequence: Synthetic peptide
  Seed: ITKKVADLVGF (MAGA1_HUMAN)
ISKKVADLVGW

SEQ ID NO: 45192 - protein, 9 aa, Artificial Sequence
  Description of Artificial Sequence: Synthetic peptide
  Seed: VIKNYKHCF (MAGA1_HUMAN)
VFKNYKHCF

SEQ ID NO: 45193 - protein, 9 aa, Artificial Sequence
  Description of Artificial Sequence: Synthetic peptide
  Seed: QSPQGASAF (MAGA1_HUMAN)
QSPQGASAY

SEQ ID NO: 45194 - protein, 10 aa, Artificial Sequence
  Description of Artificial Sequence: Synthetic peptide
  Seed: DLVQEKYLEY (MAGA1_HUMAN)
DTVQEKYLEW

SEQ ID NO: 45195 - protein, 9 aa, Artificial Sequence
  Description of Artificial Sequence: Synthetic peptide
  Seed: AEMLESVIK (MAGA1_HUMAN)
AEMLESVIM

SEQ ID NO: 45196 - protein, 9 aa, Artificial Sequence
  Description of Artificial Sequence: Synthetic peptide
  Seed: SAYGEPRKL (MAGA1_HUMAN)
SQYGEPRKY

SEQ ID NO: 45197 - protein, 10 aa, Artificial Sequence
  Description of Artificial Sequence: Synthetic peptide
  Seed: YEFLWGPRAL (MAGA1_HUMAN)
YMFLWGPRAL

SEQ ID NO: 45198 - protein, 9 aa, Artificial Sequence
  Description of Artificial Sequence: Synthetic peptide
  Seed: TQDLVQEKY (MAGA1_HUMAN)
TVDLVQEKI

SEQ ID NO: 45199 - protein, 9 aa, Artificial Sequence
  Description of Artificial Sequence: Synthetic peptide
  Seed: EALEAQQEA (MAGA1_HUMAN)
EILEAQQEV

SEQ ID NO: 45200 - protein, 9 aa, Artificial Sequence
  Description of Artificial Sequence: Synthetic peptide
  Seed: ETSYVKVLE (MAGA1_HUMAN)
EVSYVKVLR

SEQ ID NO: 45201 - protein, 9 aa, Artificial Sequence
  Description of Artificial Sequence: Synthetic peptide
  Seed: IKVSARVRF (MAGA1_HUMAN)
IQVSARVRM

SEQ ID NO: 45202 - protein, 10 aa, Artificial Sequence
  Description of Artificial Sequence: Synthetic peptide
  Seed: KVLEYVIKVS (MAGA1_HUMAN)
KMLEYVIKVG

SEQ ID NO: 45203 - protein, 9 aa, Artificial Sequence
  Description of Artificial Sequence: Synthetic peptide
  Seed: QIMPKTGFL (MAGA1_HUMAN)
QPMPKTGFA

SEQ ID NO: 45204 - protein, 9 aa, Artificial Sequence
  Description of Artificial Sequence: Synthetic peptide
  Seed: RQVPDSDPA (MAGA1_HUMAN)
RRVPDSDPY

SEQ ID NO: 45205 - protein, 9 aa, Artificial Sequence
  Description of Artificial Sequence: Synthetic peptide
  Seed: KVADLVGFL (MAGA1_HUMAN)
KSADLVGFI

SEQ ID NO: 45206 - protein, 10 aa, Artificial Sequence
  Description of Artificial Sequence: Synthetic peptide
  Seed: FFPSLREAAL (MAGA1_HUMAN)
FKPSLREAAM

SEQ ID NO: 45207 - protein, 10 aa, Artificial Sequence
  Description of Artificial Sequence: Synthetic peptide
  Seed: RVRFFFPSLR (MAGA1_HUMAN)
RWRFFFPSLR

SEQ ID NO: 45208 - protein, 10 aa, Artificial Sequence
  Description of Artificial Sequence: Synthetic peptide
  Seed: KKVADLVGFL (MAGA1_HUMAN)
KLVADLVGFI

SEQ ID NO: 45209 - protein, 9 aa, Artificial Sequence
  Description of Artificial Sequence: Synthetic peptide
  Seed: FFPSLREAA (MAGA1_HUMAN)
FFPSLREAM

SEQ ID NO: 45210 - protein, 9 aa, Artificial Sequence
  Description of Artificial Sequence: Synthetic peptide
  Seed: TSSSSPLVL (MAGA1_HUMAN)
TLSSSPLVL

SEQ ID NO: 45211 - protein, 9 aa, Artificial Sequence
  Description of Artificial Sequence: Synthetic peptide
  Seed: AATSSSSPL (MAGA1_HUMAN)
APTSSSSPI

SEQ ID NO: 45212 - protein, 10 aa, Artificial Sequence
  Description of Artificial Sequence: Synthetic peptide
  Seed: ASAFPTTINF (MAGA1_HUMAN)
AHAFPTTINW

SEQ ID NO: 45213 - protein, 9 aa, Artificial Sequence
  Description of Artificial Sequence: Synthetic peptide
  Seed: SARVRFFFP (MAGA1_HUMAN)
SARVRFFFT

SEQ ID NO: 45214 - protein, 11 aa, Artificial Sequence
  Description of Artificial Sequence: Synthetic peptide
  Seed: RQVPDSDPARY (MAGA1_HUMAN)
RVVPDSDPARI

SEQ ID NO: 45215 - protein, 9 aa, Artificial Sequence
  Description of Artificial Sequence: Synthetic peptide
  Seed: AQQEALGLV (MAGA1_HUMAN)
AMQEALGLA

SEQ ID NO: 45216 - protein, 9 aa, Artificial Sequence
  Description of Artificial Sequence: Synthetic peptide
  Seed: RQVPDSDPA (MAGA1_HUMAN)
RMVPDSDPF

SEQ ID NO: 45217 - protein, 9 aa, Artificial Sequence
  Description of Artificial Sequence: Synthetic peptide
  Seed: HSYVLVTCL (MAGA1_HUMAN)
HSYVLVTCV

SEQ ID NO: 45218 - protein, 11 aa, Artificial Sequence
  Description of Artificial Sequence: Synthetic peptide
  Seed: RQVPDSDPARY (MAGA1_HUMAN)
RQVPDSDPARF

SEQ ID NO: 45219 - protein, 9 aa, Artificial Sequence
  Description of Artificial Sequence: Synthetic peptide
  Seed: RAREPVTKA (MAGA1_HUMAN)
RMREPVTKR

SEQ ID NO: 45220 - protein, 9 aa, Artificial Sequence
  Description of Artificial Sequence: Synthetic peptide
  Seed: QIMPKTGFL (MAGA1_HUMAN)
QTMPKTGFW

SEQ ID NO: 45221 - protein, 9 aa, Artificial Sequence
  Description of Artificial Sequence: Synthetic peptide
  Seed: YKHCFPEIF (MAGA1_HUMAN)
YKHCFPEIM

SEQ ID NO: 45222 - protein, 10 aa, Artificial Sequence
  Description of Artificial Sequence: Synthetic peptide
  Seed: SSSPLVLGTL (MAGA1_HUMAN)
SASPLVLGTW

SEQ ID NO: 45223 - protein, 9 aa, Artificial Sequence
  Description of Artificial Sequence: Synthetic peptide
  Seed: QSPQGASAF (MAGA1_HUMAN)
QVPQGASAW

SEQ ID NO: 45224 - protein, 9 aa, Artificial Sequence
  Description of Artificial Sequence: Synthetic peptide
  Seed: VYDGREHSA (MAGA1_HUMAN)
VGDGREHSL

SEQ ID NO: 45225 - protein, 9 aa, Artificial Sequence
  Description of Artificial Sequence: Synthetic peptide
  Seed: QSPQGASAF (MAGA1_HUMAN)
QFPQGASAL

SEQ ID NO: 45226 - protein, 9 aa, Artificial Sequence
  Description of Artificial Sequence: Synthetic peptide
  Seed: KVLEYVIKV (MAGA1_HUMAN)
KVLEYVIKF

SEQ ID NO: 45227 - protein, 9 aa, Artificial Sequence
  Description of Artificial Sequence: Synthetic peptide
  Seed: SSPLVLGTL (MAGA1_HUMAN)
SYPLVLGTI

SEQ ID NO: 45228 - protein, 9 aa, Artificial Sequence
  Description of Artificial Sequence: Synthetic peptide
  Seed: RAREPVTKA (MAGA1_HUMAN)
RTREPVTKR

SEQ ID NO: 45229 - protein, 9 aa, Artificial Sequence
  Description of Artificial Sequence: Synthetic peptide
  Seed: KASESLQLV (MAGA1_HUMAN)
KTSESLQLR

SEQ ID NO: 45230 - protein, 11 aa, Artificial Sequence
  Description of Artificial Sequence: Synthetic peptide
  Seed: KVADLVGFLLL (MAGA1_HUMAN)
KLADLVGFLLY

SEQ ID NO: 45231 - protein, 9 aa, Artificial Sequence
  Description of Artificial Sequence: Synthetic peptide
  Seed: GHSYVLVTC (MAGA1_HUMAN)
GHSYVLVTL

SEQ ID NO: 45232 - protein, 10 aa, Artificial Sequence
  Description of Artificial Sequence: Synthetic peptide
  Seed: KEADPTGHSY (MAGA1_HUMAN)
KEADPTGHSF

SEQ ID NO: 45233 - protein, 9 aa, Artificial Sequence
  Description of Artificial Sequence: Synthetic peptide
  Seed: FPSLREAAL (MAGA1_HUMAN)
FSSLREAAF

SEQ ID NO: 45234 - protein, 9 aa, Artificial Sequence
  Description of Artificial Sequence: Synthetic peptide
  Seed: KVLEYVIKV (MAGA1_HUMAN)
KGLEYVIKV

SEQ ID NO: 45235 - protein, 9 aa, Artificial Sequence
  Description of Artificial Sequence: Synthetic peptide
  Seed: RVRFFFPSL (MAGA1_HUMAN)
RGRFFFPSH

SEQ ID NO: 45236 - protein, 11 aa, Artificial Sequence
  Description of Artificial Sequence: Synthetic peptide
  Seed: STDPPQSPQGA (MAGA1_HUMAN)
SADPPQSPQGY

SEQ ID NO: 45237 - protein, 11 aa, Artificial Sequence
  Description of Artificial Sequence: Synthetic peptide
  Seed: MEVYDGREHSA (MAGA1_HUMAN)
MEVYDGREHSL

SEQ ID NO: 45238 - protein, 10 aa, Artificial Sequence
  Description of Artificial Sequence: Synthetic peptide
  Seed: KVADLVGFLL (MAGA1_HUMAN)
KSADLVGFLL

SEQ ID NO: 45239 - protein, 10 aa, Artificial Sequence
  Description of Artificial Sequence: Synthetic peptide
  Seed: FPSLREAALR (MAGA1_HUMAN)
FTSLREAALK

SEQ ID NO: 45240 - protein, 10 aa, Artificial Sequence
  Description of Artificial Sequence: Synthetic peptide
  Seed: EVYDGREHSA (MAGA1_HUMAN)
ETYDGREHSH

SEQ ID NO: 45241 - protein, 9 aa, Artificial Sequence
  Description of Artificial Sequence: Synthetic peptide
  Seed: EADPTGHSY (MAGA1_HUMAN)
ETDPTGHSF

SEQ ID NO: 45242 - protein, 9 aa, Artificial Sequence
  Description of Artificial Sequence: Synthetic peptide
  Seed: SARVRFFFP (MAGA1_HUMAN)
STRVRFFFN

SEQ ID NO: 45243 - protein, 9 aa, Artificial Sequence
  Description of Artificial Sequence: Synthetic peptide
  Seed: KASESLQLV (MAGA1_HUMAN)
KYSESLQLY

SEQ ID NO: 45244 - protein, 9 aa, Artificial Sequence
  Description of Artificial Sequence: Synthetic peptide
  Seed: YVLVTCLGL (MAGA1_HUMAN)
YMLVTCLGF

SEQ ID NO: 45245 - protein, 9 aa, Artificial Sequence
  Description of Artificial Sequence: Synthetic peptide
  Seed: DLVGFLLLK (MAGA1_HUMAN)
DYVGFLLLR

SEQ ID NO: 45246 - protein, 10 aa, Artificial Sequence
  Description of Artificial Sequence: Synthetic peptide
  Seed: RVRFFFPSLR (MAGA1_HUMAN)
RTRFFFPSLD

SEQ ID NO: 45247 - protein, 10 aa, Artificial Sequence
  Description of Artificial Sequence: Synthetic peptide
  Seed: SARVRFFFPS (MAGA1_HUMAN)
STRVRFFFPM

SEQ ID NO: 45248 - protein, 9 aa, Artificial Sequence
  Description of Artificial Sequence: Synthetic peptide
  Seed: FLIIVLVMI (MAGA1_HUMAN)
FQIIVLVML

SEQ ID NO: 45249 - protein, 9 aa, Artificial Sequence
  Description of Artificial Sequence: Synthetic peptide
  Seed: VQAATSSSS (MAGA1_HUMAN)
VHAATSSSY

SEQ ID NO: 45250 - protein, 11 aa, Artificial Sequence
  Description of Artificial Sequence: Synthetic peptide
  Seed: KVADLVGFLLL (MAGA1_HUMAN)
KTADLVGFLLR

SEQ ID NO: 45251 - protein, 9 aa, Artificial Sequence
  Description of Artificial Sequence: Synthetic peptide
  Seed: QSPQGASAF (MAGA1_HUMAN)
QYPQGASAV

SEQ ID NO: 45252 - protein, 9 aa, Artificial Sequence
  Description of Artificial Sequence: Synthetic peptide
  Seed: VSARVRFFF (MAGA1_HUMAN)
VQARVRFFW

SEQ ID NO: 45253 - protein, 9 aa, Artificial Sequence
  Description of Artificial Sequence: Synthetic peptide
  Seed: SAFPTTINF (MAGA1_HUMAN)
STFPTTINR

SEQ ID NO: 45254 - protein, 11 aa, Artificial Sequence
  Description of Artificial Sequence: Synthetic peptide
  Seed: KVADLVGFLLL (MAGA1_HUMAN)
KVADLVGFLLW

SEQ ID NO: 45255 - protein, 9 aa, Artificial Sequence
  Description of Artificial Sequence: Synthetic peptide
  Seed: TKAEMLESV (MAGA1_HUMAN)
THAEMLESL

SEQ ID NO: 45256 - protein, 9 aa, Artificial Sequence
  Description of Artificial Sequence: Synthetic peptide
  Seed: VQAATSSSS (MAGA1_HUMAN)
VEAATSSSY

SEQ ID NO: 45257 - protein, 9 aa, Artificial Sequence
  Description of Artificial Sequence: Synthetic peptide
  Seed: FPSLREAAL (MAGA1_HUMAN)
FLSLREAAY

SEQ ID NO: 45258 - protein, 10 aa, Artificial Sequence
  Description of Artificial Sequence: Synthetic peptide
  Seed: RVRFFFPSLR (MAGA1_HUMAN)
RLRFFFPSLH

SEQ ID NO: 45259 - protein, 9 aa, Artificial Sequence
  Description of Artificial Sequence: Synthetic peptide
  Seed: RVRFFFPSL (MAGA1_HUMAN)
RPRFFFPSI

SEQ ID NO: 45260 - protein, 9 aa, Artificial Sequence
  Description of Artificial Sequence: Synthetic peptide
  Seed: AEMLESVIK (MAGA1_HUMAN)
AEMLESVIV

SEQ ID NO: 45261 - protein, 9 aa, Artificial Sequence
  Description of Artificial Sequence: Synthetic peptide
  Seed: EADPTGHSY (MAGA1_HUMAN)
EEDPTGHSW

SEQ ID NO: 45262 - protein, 9 aa, Artificial Sequence
  Description of Artificial Sequence: Synthetic peptide
  Seed: RALAETSYV (MAGA1_HUMAN)
RTLAETSYM

SEQ ID NO: 45263 - protein, 11 aa, Artificial Sequence
  Description of Artificial Sequence: Synthetic peptide
  Seed: KNYKHCFPEIF (MAGA1_HUMAN)
KQYKHCFPEIF

SEQ ID NO: 45264 - protein, 9 aa, Artificial Sequence
  Description of Artificial Sequence: Synthetic peptide
  Seed: RVRFFFPSL (MAGA1_HUMAN)
RQRFFFPSF

SEQ ID NO: 45265 - protein, 9 aa, Artificial Sequence
  Description of Artificial Sequence: Synthetic peptide
  Seed: STSCILESL (MAGA1_HUMAN)
SQSCILESA

SEQ ID NO: 45266 - protein, 9 aa, Artificial Sequence
  Description of Artificial Sequence: Synthetic peptide
  Seed: KVSARVRFF (MAGA1_HUMAN)
KVSARVRFY

SEQ ID NO: 45267 - protein, 10 aa, Artificial Sequence
  Description of Artificial Sequence: Synthetic peptide
  Seed: QIMPKTGFLI (MAGA1_HUMAN)
QVMPKTGFLV

SEQ ID NO: 45268 - protein, 9 aa, Artificial Sequence
  Description of Artificial Sequence: Synthetic peptide
  Seed: SAFPTTINF (MAGA1_HUMAN)
SGFPTTINF

SEQ ID NO: 45269 - protein, 10 aa, Artificial Sequence
  Description of Artificial Sequence: Synthetic peptide
  Seed: KVSARVRFFF (MAGA1_HUMAN)
KFSARVRFFA

SEQ ID NO: 45270 - protein, 9 aa, Artificial Sequence
  Description of Artificial Sequence: Synthetic peptide
  Seed: FRAVITKKV (MAGA1_HUMAN)
FRAVITKKL

SEQ ID NO: 45271 - protein, 9 aa, Artificial Sequence
  Description of Artificial Sequence: Synthetic peptide
  Seed: STDPPQSPQ (MAGA1_HUMAN)
SVDPPQSPI

SEQ ID NO: 45272 - protein, 9 aa, Artificial Sequence
  Description of Artificial Sequence: Synthetic peptide
  Seed: ALEAQQEAL (MAGA1_HUMAN)
AFEAQQEAL

SEQ ID NO: 45273 - protein, 9 aa, Artificial Sequence
  Description of Artificial Sequence: Synthetic peptide
  Seed: QSPQGASAF (MAGA1_HUMAN)
QLPQGASAM

SEQ ID NO: 45274 - protein, 9 aa, Artificial Sequence
  Description of Artificial Sequence: Synthetic peptide
  Seed: TTINFTRQR (MAGA1_HUMAN)
TIINFTRQK

SEQ ID NO: 45275 - protein, 9 aa, Artificial Sequence
  Description of Artificial Sequence: Synthetic peptide
  Seed: KVADLVGFL (MAGA1_HUMAN)
KLADLVGFR

SEQ ID NO: 45276 - protein, 10 aa, Artificial Sequence
  Description of Artificial Sequence: Synthetic peptide
  Seed: IKVSARVRFF (MAGA1_HUMAN)
IMVSARVRFF

SEQ ID NO: 45277 - protein, 9 aa, Artificial Sequence
  Description of Artificial Sequence: Synthetic peptide
  Seed: KASESLQLV (MAGA1_HUMAN)
KASESLQLY

SEQ ID NO: 45278 - protein, 11 aa, Artificial Sequence
  Description of Artificial Sequence: Synthetic peptide
  Seed: EIWEELSVMEV (MAGA1_HUMAN)
EMWEELSVMEV

SEQ ID NO: 45279 - protein, 10 aa, Artificial Sequence
  Description of Artificial Sequence: Synthetic peptide
  Seed: KVADLVGFLL (MAGA1_HUMAN)
KMADLVGFLF

SEQ ID NO: 45280 - protein, 11 aa, Artificial Sequence
  Description of Artificial Sequence: Synthetic peptide
  Seed: KLLTQDLVQEK (MAGA1_HUMAN)
KLLTQDLVQER

SEQ ID NO: 45281 - protein, 10 aa, Artificial Sequence
  Description of Artificial Sequence: Synthetic peptide
  Seed: QQEALGLVCV (MAGA1_HUMAN)
QEEALGLVCA

SEQ ID NO: 45282 - protein, 10 aa, Artificial Sequence
  Description of Artificial Sequence: Synthetic peptide
  Seed: ALGLVCVQAA (MAGA1_HUMAN)
AMGLVCVQAV

SEQ ID NO: 45283 - protein, 10 aa, Artificial Sequence
  Description of Artificial Sequence: Synthetic peptide
  Seed: ARVRFFFPSL (MAGA1_HUMAN)
AAVRFFFPSA

SEQ ID NO: 45284 - protein, 9 aa, Artificial Sequence
  Description of Artificial Sequence: Synthetic peptide
  Seed: CILESLFRA (MAGA1_HUMAN)
CQLESLFRT

SEQ ID NO: 45285 - protein, 10 aa, Artificial Sequence
  Description of Artificial Sequence: Synthetic peptide
  Seed: ARVRFFFPSL (MAGA1_HUMAN)
AMVRFFFPSI

SEQ ID NO: 45286 - protein, 9 aa, Artificial Sequence
  Description of Artificial Sequence: Synthetic peptide
  Seed: VSARVRFFF (MAGA1_HUMAN)
VYARVRFFI

SEQ ID NO: 45287 - protein, 11 aa, Artificial Sequence
  Description of Artificial Sequence: Synthetic peptide
  Seed: SSSSPLVLGTL (MAGA1_HUMAN)
SISSPLVLGTW

SEQ ID NO: 45288 - protein, 10 aa, Artificial Sequence
  Description of Artificial Sequence: Synthetic peptide
  Seed: SYVKVLEYVI (MAGA1_HUMAN)
SYVKVLEYVM

SEQ ID NO: 45289 - protein, 10 aa, Artificial Sequence
  Description of Artificial Sequence: Synthetic peptide
  Seed: KASESLQLVF (MAGA1_HUMAN)
KESESLQLVW

SEQ ID NO: 45290 - protein, 9 aa, Artificial Sequence
  Description of Artificial Sequence: Synthetic peptide
  Seed: LVQEKYLEY (MAGA1_HUMAN)
LPQEKYLEM

SEQ ID NO: 45291 - protein, 9 aa, Artificial Sequence
  Description of Artificial Sequence: Synthetic peptide
  Seed: SLFRAVITK (MAGA1_HUMAN)
STFRAVITR

SEQ ID NO: 45292 - protein, 10 aa, Artificial Sequence
  Description of Artificial Sequence: Synthetic peptide
  Seed: ALAETSYVKV (MAGA1_HUMAN)
AQAETSYVKI

SEQ ID NO: 45293 - protein, 9 aa, Artificial Sequence
  Description of Artificial Sequence: Synthetic peptide
  Seed: RQRQPSEGS (MAGA1_HUMAN)
RWRQPSEGK

SEQ ID NO: 45294 - protein, 9 aa, Artificial Sequence
  Description of Artificial Sequence: Synthetic peptide
  Seed: LTQDLVQEK (MAGA1_HUMAN)
LQQDLVQEF

SEQ ID NO: 45295 - protein, 9 aa, Artificial Sequence
  Description of Artificial Sequence: Synthetic peptide
  Seed: LTQDLVQEK (MAGA1_HUMAN)
LRQDLVQEL

SEQ ID NO: 45296 - protein, 9 aa, Artificial Sequence
  Description of Artificial Sequence: Synthetic peptide
  Seed: LESLFRAVI (MAGA1_HUMAN)
LNSLFRAVF

SEQ ID NO: 45297 - protein, 10 aa, Artificial Sequence
  Description of Artificial Sequence: Synthetic peptide
  Seed: SSSPLVLGTL (MAGA1_HUMAN)
SMSPLVLGTL

SEQ ID NO: 45298 - protein, 9 aa, Artificial Sequence
  Description of Artificial Sequence: Synthetic peptide
  Seed: IKVSARVRF (MAGA1_HUMAN)
IKVSARVRM

SEQ ID NO: 45299 - protein, 10 aa, Artificial Sequence
  Description of Artificial Sequence: Synthetic peptide
  Seed: MLESVIKNYK (MAGA1_HUMAN)
MSESVIKNYR

SEQ ID NO: 45300 - protein, 11 aa, Artificial Sequence
  Description of Artificial Sequence: Synthetic peptide
  Seed: SPQGASAFPTT (MAGA1_HUMAN)
SPQGASAFPTL

SEQ ID NO: 45301 - protein, 10 aa, Artificial Sequence
  Description of Artificial Sequence: Synthetic peptide
  Seed: RVRFFFPSLR (MAGA1_HUMAN)
RKRFFFPSLY

SEQ ID NO: 45302 - protein, 11 aa, Artificial Sequence
  Description of Artificial Sequence: Synthetic peptide
  Seed: YVLVTCLGLSY (MAGA1_HUMAN)
YFLVTCLGLSY

SEQ ID NO: 45303 - protein, 9 aa, Artificial Sequence
  Description of Artificial Sequence: Synthetic peptide
  Seed: SAFPTTINF (MAGA1_HUMAN)
SPFPTTINR

SEQ ID NO: 45304 - protein, 9 aa, Artificial Sequence
  Description of Artificial Sequence: Synthetic peptide
  Seed: TSSSSPLVL (MAGA1_HUMAN)
TPSSSPLVM

SEQ ID NO: 45305 - protein, 9 aa, Artificial Sequence
  Description of Artificial Sequence: Synthetic peptide
  Seed: KASESLQLV (MAGA1_HUMAN)
KTSESLQLW

SEQ ID NO: 45306 - protein, 10 aa, Artificial Sequence
  Description of Artificial Sequence: Synthetic peptide
  Seed: RALAETSYVK (MAGA1_HUMAN)
RLLAETSYVR

SEQ ID NO: 45307 - protein, 10 aa, Artificial Sequence
  Description of Artificial Sequence: Synthetic peptide
  Seed: TSYVKVLEYV (MAGA1_HUMAN)
TVYVKVLEYF

SEQ ID NO: 45308 - protein, 8 aa, Artificial Sequence
  Description of Artificial Sequence: Synthetic peptide
  Seed: ILESLFRA (MAGA1_HUMAN)
IMESLFRV

SEQ ID NO: 45309 - protein, 9 aa, Artificial Sequence
  Description of Artificial Sequence: Synthetic peptide
  Seed: SYVKVLEYV (MAGA1_HUMAN)
SRVKVLEYF

SEQ ID NO: 45310 - protein, 11 aa, Artificial Sequence
  Description of Artificial Sequence: Synthetic peptide
  Seed: ARVRFFFPSLR (MAGA1_HUMAN)
AFVRFFFPSLL

SEQ ID NO: 45311 - protein, 9 aa, Artificial Sequence
  Description of Artificial Sequence: Synthetic peptide
  Seed: SPQGASAFP (MAGA1_HUMAN)
SPQGASAFA

SEQ ID NO: 45312 - protein, 9 aa, Artificial Sequence
  Description of Artificial Sequence: Synthetic peptide
  Seed: TSSSSPLVL (MAGA1_HUMAN)
TSSSSPLVM

SEQ ID NO: 45313 - protein, 9 aa, Artificial Sequence
  Description of Artificial Sequence: Synthetic peptide
  Seed: EALEAQQEA (MAGA1_HUMAN)
EALEAQQEI

SEQ ID NO: 45314 - protein, 9 aa, Artificial Sequence
  Description of Artificial Sequence: Synthetic peptide
  Seed: TSYVKVLEY (MAGA1_HUMAN)
TIYVKVLEK

SEQ ID NO: 45315 - protein, 9 aa, Artificial Sequence
  Description of Artificial Sequence: Synthetic peptide
  Seed: RVRFFFPSL (MAGA1_HUMAN)
RYRFFFPSY

SEQ ID NO: 45316 - protein, 10 aa, Artificial Sequence
  Description of Artificial Sequence: Synthetic peptide
  Seed: KEADPTGHSY (MAGA1_HUMAN)
KTADPTGHSI

SEQ ID NO: 45317 - protein, 9 aa, Artificial Sequence
  Description of Artificial Sequence: Synthetic peptide
  Seed: STDPPQSPQ (MAGA1_HUMAN)
SIDPPQSPV

SEQ ID NO: 45318 - protein, 11 aa, Artificial Sequence
  Description of Artificial Sequence: Synthetic peptide
  Seed: YVIKVSARVRF (MAGA1_HUMAN)
YQIKVSARVRF

SEQ ID NO: 45319 - protein, 11 aa, Artificial Sequence
  Description of Artificial Sequence: Synthetic peptide
  Seed: RVRFFFPSLRE (MAGA1_HUMAN)
RTRFFFPSLRK

SEQ ID NO: 45320 - protein, 9 aa, Artificial Sequence
  Description of Artificial Sequence: Synthetic peptide
  Seed: KVLEYVIKV (MAGA1_HUMAN)
KLLEYVIKF

SEQ ID NO: 45321 - protein, 11 aa, Artificial Sequence
  Description of Artificial Sequence: Synthetic peptide
  Seed: KVADLVGFLLL (MAGA1_HUMAN)
KLADLVGFLLC

SEQ ID NO: 45322 - protein, 8 aa, Artificial Sequence
  Description of Artificial Sequence: Synthetic peptide
  Seed: RFFFPSLR (MAGA1_HUMAN)
RYFFPSLR

SEQ ID NO: 45323 - protein, 9 aa, Artificial Sequence
  Description of Artificial Sequence: Synthetic peptide
  Seed: RAREPVTKA (MAGA1_HUMAN)
RLREPVTKI

SEQ ID NO: 45324 - protein, 9 aa, Artificial Sequence
  Description of Artificial Sequence: Synthetic peptide
  Seed: KVSARVRFF (MAGA1_HUMAN)
KASARVRFI

SEQ ID NO: 45325 - protein, 9 aa, Artificial Sequence
  Description of Artificial Sequence: Synthetic peptide
  Seed: CILESLFRA (MAGA1_HUMAN)
CMLESLFRL

SEQ ID NO: 45326 - protein, 10 aa, Artificial Sequence
  Description of Artificial Sequence: Synthetic peptide
  Seed: KEADPTGHSY (MAGA1_HUMAN)
KIADPTGHSV

SEQ ID NO: 45327 - protein, 10 aa, Artificial Sequence
  Description of Artificial Sequence: Synthetic peptide
  Seed: SARVRFFFPS (MAGA1_HUMAN)
SHRVRFFFPV

SEQ ID NO: 45328 - protein, 9 aa, Artificial Sequence
  Description of Artificial Sequence: Synthetic peptide
  Seed: LFRAVITKK (MAGA1_HUMAN)
LVRAVITKR

SEQ ID NO: 45329 - protein, 10 aa, Artificial Sequence
  Description of Artificial Sequence: Synthetic peptide
  Seed: RAREPVTKAE (MAGA1_HUMAN)
RVREPVTKAS

SEQ ID NO: 45330 - protein, 9 aa, Artificial Sequence
  Description of Artificial Sequence: Synthetic peptide
  Seed: SARVRFFFP (MAGA1_HUMAN)
SLRVRFFFV

SEQ ID NO: 45331 - protein, 11 aa, Artificial Sequence
  Description of Artificial Sequence: Synthetic peptide
  Seed: KVADLVGFLLL (MAGA1_HUMAN)
KMADLVGFLLE

SEQ ID NO: 45332 - protein, 9 aa, Artificial Sequence
  Description of Artificial Sequence: Synthetic peptide
  Seed: ALEAQQEAL (MAGA1_HUMAN)
AQEAQQEAI

SEQ ID NO: 45333 - protein, 10 aa, Artificial Sequence
  Description of Artificial Sequence: Synthetic peptide
  Seed: EVYDGREHSA (MAGA1_HUMAN)
EIYDGREHSR

SEQ ID NO: 45334 - protein, 10 aa, Artificial Sequence
  Description of Artificial Sequence: Synthetic peptide
  Seed: KVADLVGFLL (MAGA1_HUMAN)
KQADLVGFLR

SEQ ID NO: 45335 - protein, 9 aa, Artificial Sequence
  Description of Artificial Sequence: Synthetic peptide
  Seed: FFFPSLREA (MAGA1_HUMAN)
FVFPSLRET

SEQ ID NO: 45336 - protein, 9 aa, Artificial Sequence
  Description of Artificial Sequence: Synthetic peptide
  Seed: LVQEKYLEY (MAGA1_HUMAN)
LSQEKYLEW

SEQ ID NO: 45337 - protein, 9 aa, Artificial Sequence
  Description of Artificial Sequence: Synthetic peptide
  Seed: REHSAYGEP (MAGA1_HUMAN)
REHSAYGET

SEQ ID NO: 45338 - protein, 9 aa, Artificial Sequence
  Description of Artificial Sequence: Synthetic peptide
  Seed: FFFPSLREA (MAGA1_HUMAN)
FTFPSLREM

SEQ ID NO: 45339 - protein, 9 aa, Artificial Sequence
  Description of Artificial Sequence: Synthetic peptide
  Seed: FFFPSLREA (MAGA1_HUMAN)
FYFPSLREH

SEQ ID NO: 45340 - protein, 10 aa, Artificial Sequence
  Description of Artificial Sequence: Synthetic peptide
  Seed: EVYDGREHSA (MAGA1_HUMAN)
ETYDGREHSM

SEQ ID NO: 45341 - protein, 9 aa, Artificial Sequence
  Description of Artificial Sequence: Synthetic peptide
  Seed: FPSLREAAL (MAGA1_HUMAN)
FMSLREAAY

SEQ ID NO: 45342 - protein, 9 aa, Artificial Sequence
  Description of Artificial Sequence: Synthetic peptide
  Seed: KVLEYVIKV (MAGA1_HUMAN)
KVLEYVIKL

SEQ ID NO: 45343 - protein, 9 aa, Artificial Sequence
  Description of Artificial Sequence: Synthetic peptide
  Seed: KVLEYVIKV (MAGA1_HUMAN)
KNLEYVIKW

SEQ ID NO: 45344 - protein, 9 aa, Artificial Sequence
  Description of Artificial Sequence: Synthetic peptide
  Seed: AQQEALGLV (MAGA1_HUMAN)
AMQEALGLI

SEQ ID NO: 45345 - protein, 10 aa, Artificial Sequence
  Description of Artificial Sequence: Synthetic peptide
  Seed: MLESVIKNYK (MAGA1_HUMAN)
MVESVIKNYK

SEQ ID NO: 45346 - protein, 9 aa, Artificial Sequence
  Description of Artificial Sequence: Synthetic peptide
  Seed: FFFPSLREA (MAGA1_HUMAN)
FNFPSLREM

SEQ ID NO: 45347 - protein, 10 aa, Artificial Sequence
  Description of Artificial Sequence: Synthetic peptide
  Seed: ASAFPTTINF (MAGA1_HUMAN)
ATAFPTTINW

SEQ ID NO: 45348 - protein, 9 aa, Artificial Sequence
  Description of Artificial Sequence: Synthetic peptide
  Seed: STSCILESL (MAGA1_HUMAN)
SLSCILESM

SEQ ID NO: 45349 - protein, 9 aa, Artificial Sequence
  Description of Artificial Sequence: Synthetic peptide
  Seed: STDPPQSPQ (MAGA1_HUMAN)
SFDPPQSPM

SEQ ID NO: 45350 - protein, 10 aa, Artificial Sequence
  Description of Artificial Sequence: Synthetic peptide
  Seed: KEADPTGHSY (MAGA1_HUMAN)
KKADPTGHSY

SEQ ID NO: 45351 - protein, 9 aa, Artificial Sequence
  Description of Artificial Sequence: Synthetic peptide
  Seed: KYRAREPVT (MAGA1_HUMAN)
KWRAREPVA

SEQ ID NO: 45352 - protein, 9 aa, Artificial Sequence
  Description of Artificial Sequence: Synthetic peptide
  Seed: EELSVMEVY (MAGA1_HUMAN)
EELSVMEVT

SEQ ID NO: 45353 - protein, 10 aa, Artificial Sequence
  Description of Artificial Sequence: Synthetic peptide
  Seed: KVLEYVIKVS (MAGA1_HUMAN)
KMLEYVIKVE

SEQ ID NO: 45354 - protein, 11 aa, Artificial Sequence
  Description of Artificial Sequence: Synthetic peptide
  Seed: RVRFFFPSLRE (MAGA1_HUMAN)
RVRFFFPSLRM

SEQ ID NO: 45355 - protein, 10 aa, Artificial Sequence
  Description of Artificial Sequence: Synthetic peptide
  Seed: KNYKHCFPEI (MAGA1_HUMAN)
KVYKHCFPEF

SEQ ID NO: 45356 - protein, 9 aa, Artificial Sequence
  Description of Artificial Sequence: Synthetic peptide
  Seed: SARVRFFFP (MAGA1_HUMAN)
SYRVRFFFK

SEQ ID NO: 45357 - protein, 10 aa, Artificial Sequence
  Description of Artificial Sequence: Synthetic peptide
  Seed: MLESVIKNYK (MAGA1_HUMAN)
MIESVIKNYK

SEQ ID NO: 45358 - protein, 10 aa, Artificial Sequence
  Description of Artificial Sequence: Synthetic peptide
  Seed: TSYVKVLEYV (MAGA1_HUMAN)
TTYVKVLEYF

SEQ ID NO: 45359 - protein, 8 aa, Artificial Sequence
  Description of Artificial Sequence: Synthetic peptide
  Seed: RVRFFFPS (MAGA1_HUMAN)
RVRFFFPK

SEQ ID NO: 45360 - protein, 10 aa, Artificial Sequence
  Description of Artificial Sequence: Synthetic peptide
  Seed: KVSARVRFFF (MAGA1_HUMAN)
KTSARVRFFK

SEQ ID NO: 45361 - protein, 9 aa, Artificial Sequence
  Description of Artificial Sequence: Synthetic peptide
  Seed: SYVKVLEYV (MAGA1_HUMAN)
SIVKVLEYA

SEQ ID NO: 45362 - protein, 10 aa, Artificial Sequence
  Description of Artificial Sequence: Synthetic peptide
  Seed: EVYDGREHSA (MAGA1_HUMAN)
EIYDGREHSK

SEQ ID NO: 45363 - protein, 10 aa, Artificial Sequence
  Description of Artificial Sequence: Synthetic peptide
  Seed: LSVMEVYDGR (MAGA1_HUMAN)
LNVMEVYDGR

SEQ ID NO: 45364 - protein, 9 aa, Artificial Sequence
  Description of Artificial Sequence: Synthetic peptide
  Seed: HSYVLVTCL (MAGA1_HUMAN)
HSYVLVTCW

SEQ ID NO: 45365 - protein, 9 aa, Artificial Sequence
  Description of Artificial Sequence: Synthetic peptide
  Seed: STSCILESL (MAGA1_HUMAN)
SLSCILESW

SEQ ID NO: 45366 - protein, 10 aa, Artificial Sequence
  Description of Artificial Sequence: Synthetic peptide
  Seed: KVSARVRFFF (MAGA1_HUMAN)
KTSARVRFFV

SEQ ID NO: 45367 - protein, 10 aa, Artificial Sequence
  Description of Artificial Sequence: Synthetic peptide
  Seed: YVIKVSARVR (MAGA1_HUMAN)
YTIKVSARVK

SEQ ID NO: 45368 - protein, 9 aa, Artificial Sequence
  Description of Artificial Sequence: Synthetic peptide
  Seed: TGFLIIVLV (MAGA1_HUMAN)
TQFLIIVLV

SEQ ID NO: 45369 - protein, 9 aa, Artificial Sequence
  Description of Artificial Sequence: Synthetic peptide
  Seed: TKAEMLESV (MAGA1_HUMAN)
TMAEMLEST

SEQ ID NO: 45370 - protein, 9 aa, Artificial Sequence
  Description of Artificial Sequence: Synthetic peptide
  Seed: NQIMPKTGF (MAGA1_HUMAN)
NHIMPKTGM

SEQ ID NO: 45371 - protein, 9 aa, Artificial Sequence
  Description of Artificial Sequence: Synthetic peptide
  Seed: KVADLVGFL (MAGA1_HUMAN)
KQADLVGFR

SEQ ID NO: 45372 - protein, 10 aa, Artificial Sequence
  Description of Artificial Sequence: Synthetic peptide
  Seed: CILESLFRAV (MAGA1_HUMAN)
CMLESLFRAM

SEQ ID NO: 45373 - protein, 9 aa, Artificial Sequence
  Description of Artificial Sequence: Synthetic peptide
  Seed: EADPTGHSY (MAGA1_HUMAN)
ENDPTGHSL

SEQ ID NO: 45374 - protein, 9 aa, Artificial Sequence
  Description of Artificial Sequence: Synthetic peptide
  Seed: SAFPTTINF (MAGA1_HUMAN)
SYFPTTINM

SEQ ID NO: 45375 - protein, 9 aa, Artificial Sequence
  Description of Artificial Sequence: Synthetic peptide
  Seed: SAFPTTINF (MAGA1_HUMAN)
SAFPTTINI

SEQ ID NO: 45376 - protein, 9 aa, Artificial Sequence
  Description of Artificial Sequence: Synthetic peptide
  Seed: SAYGEPRKL (MAGA1_HUMAN)
SHYGEPRKI

SEQ ID NO: 45377 - protein, 9 aa, Artificial Sequence
  Description of Artificial Sequence: Synthetic peptide
  Seed: RVRFFFPSL (MAGA1_HUMAN)
RYRFFFPST

SEQ ID NO: 45378 - protein, 10 aa, Artificial Sequence
  Description of Artificial Sequence: Synthetic peptide
  Seed: RAREPVTKAE (MAGA1_HUMAN)
RSREPVTKAA

SEQ ID NO: 45379 - protein, 9 aa, Artificial Sequence
  Description of Artificial Sequence: Synthetic peptide
  Seed: HCFPEIFGK (MAGA1_HUMAN)
HAFPEIFGL

SEQ ID NO: 45380 - protein, 9 aa, Artificial Sequence
  Description of Artificial Sequence: Synthetic peptide
  Seed: ETSYVKVLE (MAGA1_HUMAN)
EQSYVKVLR

SEQ ID NO: 45381 - protein, 9 aa, Artificial Sequence
  Description of Artificial Sequence: Synthetic peptide
  Seed: TQDLVQEKY (MAGA1_HUMAN)
TMDLVQEKW

SEQ ID NO: 45382 - protein, 9 aa, Artificial Sequence
  Description of Artificial Sequence: Synthetic peptide
  Seed: LESLFRAVI (MAGA1_HUMAN)
LHSLFRAVY

SEQ ID NO: 45383 - protein, 9 aa, Artificial Sequence
  Description of Artificial Sequence: Synthetic peptide
  Seed: YKHCFPEIF (MAGA1_HUMAN)
YSHCFPEIF

SEQ ID NO: 45384 - protein, 9 aa, Artificial Sequence
  Description of Artificial Sequence: Synthetic peptide
  Seed: IMPKTGFLI (MAGA1_HUMAN)
ILPKTGFLA

SEQ ID NO: 45385 - protein, 10 aa, Artificial Sequence
  Description of Artificial Sequence: Synthetic peptide
  Seed: RYEFLWGPRA (MAGA1_HUMAN)
RFEFLWGPRL

SEQ ID NO: 45386 - protein, 9 aa, Artificial Sequence
  Description of Artificial Sequence: Synthetic peptide
  Seed: EYVIKVSAR (MAGA1_HUMAN)
EIVIKVSAR

SEQ ID NO: 45387 - protein, 10 aa, Artificial Sequence
  Description of Artificial Sequence: Synthetic peptide
  Seed: RVRFFFPSLR (MAGA1_HUMAN)
RFRFFFPSLL

SEQ ID NO: 45388 - protein, 9 aa, Artificial Sequence
  Description of Artificial Sequence: Synthetic peptide
  Seed: VYDGREHSA (MAGA1_HUMAN)
VADGREHSA

SEQ ID NO: 45389 - protein, 11 aa, Artificial Sequence
  Description of Artificial Sequence: Synthetic peptide
  Seed: YEFLWGPRALA (MAGA1_HUMAN)
YPFLWGPRALI

SEQ ID NO: 45390 - protein, 10 aa, Artificial Sequence
  Description of Artificial Sequence: Synthetic peptide
  Seed: SARVRFFFPS (MAGA1_HUMAN)
SKRVRFFFPV

SEQ ID NO: 45391 - protein, 9 aa, Artificial Sequence
  Description of Artificial Sequence: Synthetic peptide
  Seed: LEYRQVPDS (MAGA1_HUMAN)
LEYRQVPDV

SEQ ID NO: 45392 - protein, 9 aa, Artificial Sequence
  Description of Artificial Sequence: Synthetic peptide
  Seed: TSSSSPLVL (MAGA1_HUMAN)
TASSSPLVY

SEQ ID NO: 45393 - protein, 10 aa, Artificial Sequence
  Description of Artificial Sequence: Synthetic peptide
  Seed: ARVRFFFPSL (MAGA1_HUMAN)
AYVRFFFPSM

SEQ ID NO: 45394 - protein, 9 aa, Artificial Sequence
  Description of Artificial Sequence: Synthetic peptide
  Seed: YDGREHSAY (MAGA1_HUMAN)
YAGREHSAY

SEQ ID NO: 45395 - protein, 10 aa, Artificial Sequence
  Description of Artificial Sequence: Synthetic peptide
  Seed: ADPTGHSYVL (MAGA1_HUMAN)
AMPTGHSYVL

SEQ ID NO: 45396 - protein, 10 aa, Artificial Sequence
  Description of Artificial Sequence: Synthetic peptide
  Seed: RVRFFFPSLR (MAGA1_HUMAN)
RARFFFPSLL

SEQ ID NO: 45397 - protein, 9 aa, Artificial Sequence
  Description of Artificial Sequence: Synthetic peptide
  Seed: HCFPEIFGK (MAGA1_HUMAN)
HLFPEIFGY

SEQ ID NO: 45398 - protein, 9 aa, Artificial Sequence
  Description of Artificial Sequence: Synthetic peptide
  Seed: IFGKASESL (MAGA1_HUMAN)
IYGKASESL

SEQ ID NO: 45399 - protein, 9 aa, Artificial Sequence
  Description of Artificial Sequence: Synthetic peptide
  Seed: FFFPSLREA (MAGA1_HUMAN)
FTFPSLREV

SEQ ID NO: 45400 - protein, 8 aa, Artificial Sequence
  Description of Artificial Sequence: Synthetic peptide
  Seed: ADPTGHSY (MAGA1_HUMAN)
AAPTGHSL

SEQ ID NO: 45401 - protein, 10 aa, Artificial Sequence
  Description of Artificial Sequence: Synthetic peptide
  Seed: KVADLVGFLL (MAGA1_HUMAN)
KVADLVGFLM

SEQ ID NO: 45402 - protein, 9 aa, Artificial Sequence
  Description of Artificial Sequence: Synthetic peptide
  Seed: GHAPEEEIW (MAGA1_HUMAN)
GHAPEEEIV

SEQ ID NO: 45403 - protein, 9 aa, Artificial Sequence
  Description of Artificial Sequence: Synthetic peptide
  Seed: KVSARVRFF (MAGA1_HUMAN)
KASARVRFA

SEQ ID NO: 45404 - protein, 10 aa, Artificial Sequence
  Description of Artificial Sequence: Synthetic peptide
  Seed: MLESVIKNYK (MAGA1_HUMAN)
MIESVIKNYR

SEQ ID NO: 45405 - protein, 10 aa, Artificial Sequence
  Description of Artificial Sequence: Synthetic peptide
  Seed: SAFPTTINFT (MAGA1_HUMAN)
SLFPTTINFT

SEQ ID NO: 45406 - protein, 9 aa, Artificial Sequence
  Description of Artificial Sequence: Synthetic peptide
  Seed: VADLVGFLL (MAGA1_HUMAN)
VFDLVGFLF

SEQ ID NO: 45407 - protein, 10 aa, Artificial Sequence
  Description of Artificial Sequence: Synthetic peptide
  Seed: CILESLFRAV (MAGA1_HUMAN)
CQLESLFRAM

SEQ ID NO: 45408 - protein, 9 aa, Artificial Sequence
  Description of Artificial Sequence: Synthetic peptide
  Seed: GASAFPTTI (MAGA1_HUMAN)
GLSAFPTTA

SEQ ID NO: 45409 - protein, 9 aa, Artificial Sequence
  Description of Artificial Sequence: Synthetic peptide
  Seed: RALAETSYV (MAGA1_HUMAN)
RLLAETSYM

SEQ ID NO: 45410 - protein, 9 aa, Artificial Sequence
  Description of Artificial Sequence: Synthetic peptide
  Seed: ESLQLVFGI (MAGA1_HUMAN)
EVLQLVFGL

SEQ ID NO: 45411 - protein, 11 aa, Artificial Sequence
  Description of Artificial Sequence: Synthetic peptide
  Seed: EVYDGREHSAY (MAGA1_HUMAN)
EAYDGREHSAY

SEQ ID NO: 45412 - protein, 9 aa, Artificial Sequence
  Description of Artificial Sequence: Synthetic peptide
  Seed: GTLEEVPTA (MAGA1_HUMAN)
GSLEEVPTI

SEQ ID NO: 45413 - protein, 9 aa, Artificial Sequence
  Description of Artificial Sequence: Synthetic peptide
  Seed: LKYRAREPV (MAGA1_HUMAN)
LRYRAREPM

SEQ ID NO: 45414 - protein, 10 aa, Artificial Sequence
  Description of Artificial Sequence: Synthetic peptide
  Seed: KTGFLIIVLV (MAGA1_HUMAN)
KMGFLIIVLI

SEQ ID NO: 45415 - protein, 9 aa, Artificial Sequence
  Description of Artificial Sequence: Synthetic peptide
  Seed: STDPPQSPQ (MAGA1_HUMAN)
SVDPPQSPL

SEQ ID NO: 45416 - protein, 10 aa, Artificial Sequence
  Description of Artificial Sequence: Synthetic peptide
  Seed: ARVRFFFPSL (MAGA1_HUMAN)
AVVRFFFPSV

SEQ ID NO: 45417 - protein, 9 aa, Artificial Sequence
  Description of Artificial Sequence: Synthetic peptide
  Seed: FLLLKYRAR (MAGA1_HUMAN)
FMLLKYRAR

SEQ ID NO: 45418 - protein, 9 aa, Artificial Sequence
  Description of Artificial Sequence: Synthetic peptide
  Seed: AATSSSSPL (MAGA1_HUMAN)
AKTSSSSPL

SEQ ID NO: 45419 - protein, 9 aa, Artificial Sequence
  Description of Artificial Sequence: Synthetic peptide
  Seed: KVADLVGFL (MAGA1_HUMAN)
KIADLVGFA

SEQ ID NO: 45420 - protein, 9 aa, Artificial Sequence
  Description of Artificial Sequence: Synthetic peptide
  Seed: SAFPTTINF (MAGA1_HUMAN)
SGFPTTINL

SEQ ID NO: 45421 - protein, 9 aa, Artificial Sequence
  Description of Artificial Sequence: Synthetic peptide
  Seed: TTINFTRQR (MAGA1_HUMAN)
TWINFTRQR

SEQ ID NO: 45422 - protein, 9 aa, Artificial Sequence
  Description of Artificial Sequence: Synthetic peptide
  Seed: SLHCKPEEA (MAGA1_HUMAN)
SMHCKPEEA

SEQ ID NO: 45423 - protein, 10 aa, Artificial Sequence
  Description of Artificial Sequence: Synthetic peptide
  Seed: KEADPTGHSY (MAGA1_HUMAN)
KLADPTGHSI

SEQ ID NO: 45424 - protein, 10 aa, Artificial Sequence
  Description of Artificial Sequence: Synthetic peptide
  Seed: SARVRFFFPS (MAGA1_HUMAN)
SLRVRFFFPF

SEQ ID NO: 45425 - protein, 11 aa, Artificial Sequence
  Description of Artificial Sequence: Synthetic peptide
  Seed: RVRFFFPSLRE (MAGA1_HUMAN)
RARFFFPSLRR

SEQ ID NO: 45426 - protein, 9 aa, Artificial Sequence
  Description of Artificial Sequence: Synthetic peptide
  Seed: YVIKVSARV (MAGA1_HUMAN)
YSIKVSARY

SEQ ID NO: 45427 - protein, 9 aa, Artificial Sequence
  Description of Artificial Sequence: Synthetic peptide
  Seed: LVLGTLEEV (MAGA1_HUMAN)
LQLGTLEEA

SEQ ID NO: 45428 - protein, 9 aa, Artificial Sequence
  Description of Artificial Sequence: Synthetic peptide
  Seed: TGFLIIVLV (MAGA1_HUMAN)
TIFLIIVLV

SEQ ID NO: 45429 - protein, 11 aa, Artificial Sequence
  Description of Artificial Sequence: Synthetic peptide
  Seed: RVRFFFPSLRE (MAGA1_HUMAN)
RIRFFFPSLRK

SEQ ID NO: 45430 - protein, 9 aa, Artificial Sequence
  Description of Artificial Sequence: Synthetic peptide
  Seed: CILESLFRA (MAGA1_HUMAN)
CILESLFRV

SEQ ID NO: 45431 - protein, 9 aa, Artificial Sequence
  Description of Artificial Sequence: Synthetic peptide
  Seed: AQQEALGLV (MAGA1_HUMAN)
AEQEALGLC

SEQ ID NO: 45432 - protein, 10 aa, Artificial Sequence
  Description of Artificial Sequence: Synthetic peptide
  Seed: LTQDLVQEKY (MAGA1_HUMAN)
LMQDLVQEKW

SEQ ID NO: 45433 - protein, 9 aa, Artificial Sequence
  Description of Artificial Sequence: Synthetic peptide
  Seed: SSSPLVLGT (MAGA1_HUMAN)
SASPLVLGA

SEQ ID NO: 45434 - protein, 11 aa, Artificial Sequence
  Description of Artificial Sequence: Synthetic peptide
  Seed: ARVRFFFPSLR (MAGA1_HUMAN)
AEVRFFFPSLL

SEQ ID NO: 45435 - protein, 9 aa, Artificial Sequence
  Description of Artificial Sequence: Synthetic peptide
  Seed: EADPTGHSY (MAGA1_HUMAN)
EWDPTGHSL

SEQ ID NO: 45436 - protein, 9 aa, Artificial Sequence
  Description of Artificial Sequence: Synthetic peptide
  Seed: KASESLQLV (MAGA1_HUMAN)
KFSESLQLY

SEQ ID NO: 45437 - protein, 10 aa, Artificial Sequence
  Description of Artificial Sequence: Synthetic peptide
  Seed: KVSARVRFFF (MAGA1_HUMAN)
KDSARVRFFW

SEQ ID NO: 45438 - protein, 10 aa, Artificial Sequence
  Description of Artificial Sequence: Synthetic peptide
  Seed: ARYEFLWGPR (MAGA1_HUMAN)
AQYEFLWGPR

SEQ ID NO: 45439 - protein, 9 aa, Artificial Sequence
  Description of Artificial Sequence: Synthetic peptide
  Seed: EADPTGHSY (MAGA1_HUMAN)
EWDPTGHSV

SEQ ID NO: 45440 - protein, 9 aa, Artificial Sequence
  Description of Artificial Sequence: Synthetic peptide
  Seed: TSSSSPLVL (MAGA1_HUMAN)
TMSSSPLVW

SEQ ID NO: 45441 - protein, 9 aa, Artificial Sequence
  Description of Artificial Sequence: Synthetic peptide
  Seed: SYVKVLEYV (MAGA1_HUMAN)
SQVKVLEYM

SEQ ID NO: 45442 - protein, 10 aa, Artificial Sequence
  Description of Artificial Sequence: Synthetic peptide
  Seed: TSYVKVLEYV (MAGA1_HUMAN)
TYYVKVLEYM

SEQ ID NO: 45443 - protein, 10 aa, Artificial Sequence
  Description of Artificial Sequence: Synthetic peptide
  Seed: EMLESVIKNY (MAGA1_HUMAN)
EILESVIKNW

SEQ ID NO: 45444 - protein, 10 aa, Artificial Sequence
  Description of Artificial Sequence: Synthetic peptide
  Seed: ETSYVKVLEY (MAGA1_HUMAN)
EGSYVKVLER

SEQ ID NO: 45445 - protein, 10 aa, Artificial Sequence
  Description of Artificial Sequence: Synthetic peptide
  Seed: SARVRFFFPS (MAGA1_HUMAN)
SLRVRFFFPI

SEQ ID NO: 45446 - protein, 11 aa, Artificial Sequence
  Description of Artificial Sequence: Synthetic peptide
  Seed: RVRFFFPSLRE (MAGA1_HUMAN)
RSRFFFPSLRL

SEQ ID NO: 45447 - protein, 9 aa, Artificial Sequence
  Description of Artificial Sequence: Synthetic peptide
  Seed: RVRFFFPSL (MAGA1_HUMAN)
RFRFFFPSP

SEQ ID NO: 45448 - protein, 10 aa, Artificial Sequence
  Description of Artificial Sequence: Synthetic peptide
  Seed: KVADLVGFLL (MAGA1_HUMAN)
KLADLVGFLA

SEQ ID NO: 45449 - protein, 9 aa, Artificial Sequence
  Description of Artificial Sequence: Synthetic peptide
  Seed: LESLFRAVI (MAGA1_HUMAN)
LESLFRAVA

SEQ ID NO: 45450 - protein, 10 aa, Artificial Sequence
  Description of Artificial Sequence: Synthetic peptide
  Seed: RYEFLWGPRA (MAGA1_HUMAN)
RTEFLWGPRR

SEQ ID NO: 45451 - protein, 9 aa, Artificial Sequence
  Description of Artificial Sequence: Synthetic peptide
  Seed: TSYVKVLEY (MAGA1_HUMAN)
TVYVKVLER

SEQ ID NO: 45452 - protein, 9 aa, Artificial Sequence
  Description of Artificial Sequence: Synthetic peptide
  Seed: QIMPKTGFL (MAGA1_HUMAN)
QAMPKTGFV

SEQ ID NO: 45453 - protein, 8 aa, Artificial Sequence
  Description of Artificial Sequence: Synthetic peptide
  Seed: HSYVLVTC (MAGA1_HUMAN)
HQYVLVTV

SEQ ID NO: 45454 - protein, 11 aa, Artificial Sequence
  Description of Artificial Sequence: Synthetic peptide
  Seed: KVADLVGFLLL (MAGA1_HUMAN)
KMADLVGFLLP

SEQ ID NO: 45455 - protein, 9 aa, Artificial Sequence
  Description of Artificial Sequence: Synthetic peptide
  Seed: RAREPVTKA (MAGA1_HUMAN)
RLREPVTKY

SEQ ID NO: 45456 - protein, 10 aa, Artificial Sequence
  Description of Artificial Sequence: Synthetic peptide
  Seed: SCILESLFRA (MAGA1_HUMAN)
SIILESLFRV

SEQ ID NO: 45457 - protein, 9 aa, Artificial Sequence
  Description of Artificial Sequence: Synthetic peptide
  Seed: KYRAREPVT (MAGA1_HUMAN)
KYRAREPVS

SEQ ID NO: 45458 - protein, 9 aa, Artificial Sequence
  Description of Artificial Sequence: Synthetic peptide
  Seed: SAYGEPRKL (MAGA1_HUMAN)
SAYGEPRKW

SEQ ID NO: 45459 - protein, 9 aa, Artificial Sequence
  Description of Artificial Sequence: Synthetic peptide
  Seed: MEGGHAPEE (MAGA1_HUMAN)
MEGGHAPET

SEQ ID NO: 45460 - protein, 10 aa, Artificial Sequence
  Description of Artificial Sequence: Synthetic peptide
  Seed: KVSARVRFFF (MAGA1_HUMAN)
KTSARVRFFF

SEQ ID NO: 45461 - protein, 9 aa, Artificial Sequence
  Description of Artificial Sequence: Synthetic peptide
  Seed: VQAATSSSS (MAGA1_HUMAN)
VNAATSSSY

SEQ ID NO: 45462 - protein, 8 aa, Artificial Sequence
  Description of Artificial Sequence: Synthetic peptide
  Seed: RVRFFFPS (MAGA1_HUMAN)
RTRFFFPQ

SEQ ID NO: 45463 - protein, 10 aa, Artificial Sequence
  Description of Artificial Sequence: Synthetic peptide
  Seed: EALGLVCVQA (MAGA1_HUMAN)
EVLGLVCVQV

SEQ ID NO: 45464 - protein, 10 aa, Artificial Sequence
  Description of Artificial Sequence: Synthetic peptide
  Seed: SCILESLFRA (MAGA1_HUMAN)
SVILESLFRV

SEQ ID NO: 45465 - protein, 9 aa, Artificial Sequence
  Description of Artificial Sequence: Synthetic peptide
  Seed: KVLEYVIKV (MAGA1_HUMAN)
KALEYVIKA

SEQ ID NO: 45466 - protein, 8 aa, Artificial Sequence
  Description of Artificial Sequence: Synthetic peptide
  Seed: MPKTGFLI (MAGA1_HUMAN)
MPKTGFLL

SEQ ID NO: 45467 - protein, 10 aa, Artificial Sequence
  Description of Artificial Sequence: Synthetic peptide
  Seed: RAREPVTKAE (MAGA1_HUMAN)
RTREPVTKAY

SEQ ID NO: 45468 - protein, 10 aa, Artificial Sequence
  Description of Artificial Sequence: Synthetic peptide
  Seed: STSCILESLF (MAGA1_HUMAN)
SCSCILESLW

SEQ ID NO: 45469 - protein, 9 aa, Artificial Sequence
  Description of Artificial Sequence: Synthetic peptide
  Seed: TSSSSPLVL (MAGA1_HUMAN)
TRSSSPLVY

SEQ ID NO: 45470 - protein, 8 aa, Artificial Sequence
  Description of Artificial Sequence: Synthetic peptide
  Seed: HSYVLVTC (MAGA1_HUMAN)
HQYVLVTL

SEQ ID NO: 45471 - protein, 9 aa, Artificial Sequence
  Description of Artificial Sequence: Synthetic peptide
  Seed: RVRFFFPSL (MAGA1_HUMAN)
RWRFFFPSS

SEQ ID NO: 45472 - protein, 11 aa, Artificial Sequence
  Description of Artificial Sequence: Synthetic peptide
  Seed: ARVRFFFPSLR (MAGA1_HUMAN)
AWVRFFFPSLR

SEQ ID NO: 45473 - protein, 9 aa, Artificial Sequence
  Description of Artificial Sequence: Synthetic peptide
  Seed: SSPLVLGTL (MAGA1_HUMAN)
SQPLVLGTI

SEQ ID NO: 45474 - protein, 9 aa, Artificial Sequence
  Description of Artificial Sequence: Synthetic peptide
  Seed: AATSSSSPL (MAGA1_HUMAN)
APTSSSSPA

SEQ ID NO: 45475 - protein, 11 aa, Artificial Sequence
  Description of Artificial Sequence: Synthetic peptide
  Seed: KVADLVGFLLL (MAGA1_HUMAN)
KLADLVGFLLE

SEQ ID NO: 45476 - protein, 9 aa, Artificial Sequence
  Description of Artificial Sequence: Synthetic peptide
  Seed: SAYGEPRKL (MAGA1_HUMAN)
SHYGEPRKY

SEQ ID NO: 45477 - protein, 9 aa, Artificial Sequence
  Description of Artificial Sequence: Synthetic peptide
  Seed: NQIMPKTGF (MAGA1_HUMAN)
NRIMPKTGL

SEQ ID NO: 45478 - protein, 9 aa, Artificial Sequence
  Description of Artificial Sequence: Synthetic peptide
  Seed: FLWGPRALA (MAGA1_HUMAN)
FLWGPRALI

SEQ ID NO: 45479 - protein, 11 aa, Artificial Sequence
  Description of Artificial Sequence: Synthetic peptide
  Seed: STSCILESLFR (MAGA1_HUMAN)
SFSCILESLFR

SEQ ID NO: 45480 - protein, 9 aa, Artificial Sequence
  Description of Artificial Sequence: Synthetic peptide
  Seed: TSYVKVLEY (MAGA1_HUMAN)
TAYVKVLER

SEQ ID NO: 45481 - protein, 10 aa, Artificial Sequence
  Description of Artificial Sequence: Synthetic peptide
  Seed: QVPDSDPARY (MAGA1_HUMAN)
QTPDSDPARY

SEQ ID NO: 45482 - protein, 10 aa, Artificial Sequence
  Description of Artificial Sequence: Synthetic peptide
  Seed: KVSARVRFFF (MAGA1_HUMAN)
KESARVRFFF

SEQ ID NO: 45483 - protein, 9 aa, Artificial Sequence
  Description of Artificial Sequence: Synthetic peptide
  Seed: RVRFFFPSL (MAGA1_HUMAN)
RERFFFPSM

SEQ ID NO: 45484 - protein, 9 aa, Artificial Sequence
  Description of Artificial Sequence: Synthetic peptide
  Seed: FRAVITKKV (MAGA1_HUMAN)
FHAVITKKA

SEQ ID NO: 45485 - protein, 9 aa, Artificial Sequence
  Description of Artificial Sequence: Synthetic peptide
  Seed: RALAETSYV (MAGA1_HUMAN)
RLLAETSYT

SEQ ID NO: 45486 - protein, 9 aa, Artificial Sequence
  Description of Artificial Sequence: Synthetic peptide
  Seed: SAYGEPRKL (MAGA1_HUMAN)
SRYGEPRKV

SEQ ID NO: 45487 - protein, 11 aa, Artificial Sequence
  Description of Artificial Sequence: Synthetic peptide
  Seed: RVRFFFPSLRE (MAGA1_HUMAN)
RMRFFFPSLRK

SEQ ID NO: 45488 - protein, 10 aa, Artificial Sequence
  Description of Artificial Sequence: Synthetic peptide
  Seed: KKVADLVGFL (MAGA1_HUMAN)
KMVADLVGFA

SEQ ID NO: 45489 - protein, 9 aa, Artificial Sequence
  Description of Artificial Sequence: Synthetic peptide
  Seed: RQVPDSDPA (MAGA1_HUMAN)
RLVPDSDPM

SEQ ID NO: 45490 - protein, 10 aa, Artificial Sequence
  Description of Artificial Sequence: Synthetic peptide
  Seed: RALAETSYVK (MAGA1_HUMAN)
RMLAETSYVR

SEQ ID NO: 45491 - protein, 11 aa, Artificial Sequence
  Description of Artificial Sequence: Synthetic peptide
  Seed: RQVPDSDPARY (MAGA1_HUMAN)
RQVPDSDPARM

SEQ ID NO: 45492 - protein, 9 aa, Artificial Sequence
  Description of Artificial Sequence: Synthetic peptide
  Seed: RVRFFFPSL (MAGA1_HUMAN)
RLRFFFPSN

SEQ ID NO: 45493 - protein, 10 aa, Artificial Sequence
  Description of Artificial Sequence: Synthetic peptide
  Seed: CILESLFRAV (MAGA1_HUMAN)
CQLESLFRAL

SEQ ID NO: 45494 - protein, 9 aa, Artificial Sequence
  Description of Artificial Sequence: Synthetic peptide
  Seed: SARVRFFFP (MAGA1_HUMAN)
SSRVRFFFI

SEQ ID NO: 45495 - protein, 8 aa, Artificial Sequence
  Description of Artificial Sequence: Synthetic peptide
  Seed: ADPTGHSY (MAGA1_HUMAN)
AAPTGHSM

SEQ ID NO: 45496 - protein, 9 aa, Artificial Sequence
  Description of Artificial Sequence: Synthetic peptide
  Seed: TTINFTRQR (MAGA1_HUMAN)
TTINFTRQL

SEQ ID NO: 45497 - protein, 9 aa, Artificial Sequence
  Description of Artificial Sequence: Synthetic peptide
  Seed: SAYGEPRKL (MAGA1_HUMAN)
STYGEPRKR

SEQ ID NO: 45498 - protein, 9 aa, Artificial Sequence
  Description of Artificial Sequence: Synthetic peptide
  Seed: SYVKVLEYV (MAGA1_HUMAN)
SVVKVLEYV

SEQ ID NO: 45499 - protein, 10 aa, Artificial Sequence
  Description of Artificial Sequence: Synthetic peptide
  Seed: STSCILESLF (MAGA1_HUMAN)
SYSCILESLW

SEQ ID NO: 45500 - protein, 9 aa, Artificial Sequence
  Description of Artificial Sequence: Synthetic peptide
  Seed: VADLVGFLL (MAGA1_HUMAN)
VADLVGFLF

SEQ ID NO: 45501 - protein, 10 aa, Artificial Sequence
  Description of Artificial Sequence: Synthetic peptide
  Seed: MPKTGFLIIV (MAGA1_HUMAN)
MPKTGFLIIM

SEQ ID NO: 45502 - protein, 9 aa, Artificial Sequence
  Description of Artificial Sequence: Synthetic peptide
  Seed: TKAEMLESV (MAGA1_HUMAN)
TAAEMLESA

SEQ ID NO: 45503 - protein, 9 aa, Artificial Sequence
  Description of Artificial Sequence: Synthetic peptide
  Seed: IAMEGGHAP (MAGA1_HUMAN)
IVMEGGHAF

SEQ ID NO: 45504 - protein, 10 aa, Artificial Sequence
  Description of Artificial Sequence: Synthetic peptide
  Seed: SARVRFFFPS (MAGA1_HUMAN)
SFRVRFFFPK

SEQ ID NO: 45505 - protein, 10 aa, Artificial Sequence
  Description of Artificial Sequence: Synthetic peptide
  Seed: EMLESVIKNY (MAGA1_HUMAN)
EVLESVIKNK

SEQ ID NO: 45506 - protein, 9 aa, Artificial Sequence
  Description of Artificial Sequence: Synthetic peptide
  Seed: GTLEEVPTA (MAGA1_HUMAN)
GSLEEVPTL

SEQ ID NO: 45507 - protein, 11 aa, Artificial Sequence
  Description of Artificial Sequence: Synthetic peptide
  Seed: KEADPTGHSYV (MAGA1_HUMAN)
KQADPTGHSYI

SEQ ID NO: 45508 - protein, 9 aa, Artificial Sequence
  Description of Artificial Sequence: Synthetic peptide
  Seed: HSYVLVTCL (MAGA1_HUMAN)
HHYVLVTCL

SEQ ID NO: 45509 - protein, 10 aa, Artificial Sequence
  Description of Artificial Sequence: Synthetic peptide
  Seed: KVADLVGFLL (MAGA1_HUMAN)
KSADLVGFLV

SEQ ID NO: 45510 - protein, 9 aa, Artificial Sequence
  Description of Artificial Sequence: Synthetic peptide
  Seed: ATSSSSPLV (MAGA1_HUMAN)
ALSSSSPLV

SEQ ID NO: 45511 - protein, 9 aa, Artificial Sequence
  Description of Artificial Sequence: Synthetic peptide
  Seed: VSARVRFFF (MAGA1_HUMAN)
VTARVRFFY

SEQ ID NO: 45512 - protein, 9 aa, Artificial Sequence
  Description of Artificial Sequence: Synthetic peptide
  Seed: IMPKTGFLI (MAGA1_HUMAN)
IWPKTGFLY

SEQ ID NO: 45513 - protein, 9 aa, Artificial Sequence
  Description of Artificial Sequence: Synthetic peptide
  Seed: RQVPDSDPA (MAGA1_HUMAN)
RMVPDSDPL

SEQ ID NO: 45514 - protein, 9 aa, Artificial Sequence
  Description of Artificial Sequence: Synthetic peptide
  Seed: QSPQGASAF (MAGA1_HUMAN)
QVPQGASAI

SEQ ID NO: 45515 - protein, 9 aa, Artificial Sequence
  Description of Artificial Sequence: Synthetic peptide
  Seed: LVQEKYLEY (MAGA1_HUMAN)
LVQEKYLEM

SEQ ID NO: 45516 - protein, 9 aa, Artificial Sequence
  Description of Artificial Sequence: Synthetic peptide
  Seed: TKAEMLESV (MAGA1_HUMAN)
TIAEMLEST

SEQ ID NO: 45517 - protein, 9 aa, Artificial Sequence
  Description of Artificial Sequence: Synthetic peptide
  Seed: RVRFFFPSL (MAGA1_HUMAN)
RLRFFFPSI

SEQ ID NO: 45518 - protein, 9 aa, Artificial Sequence
  Description of Artificial Sequence: Synthetic peptide
  Seed: IAMEGGHAP (MAGA1_HUMAN)
IPMEGGHAS

SEQ ID NO: 45519 - protein, 9 aa, Artificial Sequence
  Description of Artificial Sequence: Synthetic peptide
  Seed: ARYEFLWGP (MAGA1_HUMAN)
AKYEFLWGL

SEQ ID NO: 45520 - protein, 10 aa, Artificial Sequence
  Description of Artificial Sequence: Synthetic peptide
  Seed: RALAETSYVK (MAGA1_HUMAN)
RYLAETSYVR

SEQ ID NO: 45521 - protein, 10 aa, Artificial Sequence
  Description of Artificial Sequence: Synthetic peptide
  Seed: KVADLVGFLL (MAGA1_HUMAN)
KLADLVGFLL

SEQ ID NO: 45522 - protein, 9 aa, Artificial Sequence
  Description of Artificial Sequence: Synthetic peptide
  Seed: SARVRFFFP (MAGA1_HUMAN)
SARVRFFFY

SEQ ID NO: 45523 - protein, 11 aa, Artificial Sequence
  Description of Artificial Sequence: Synthetic peptide
  Seed: AEMLESVIKNY (MAGA1_HUMAN)
AEMLESVIKNF

SEQ ID NO: 45524 - protein, 9 aa, Artificial Sequence
  Description of Artificial Sequence: Synthetic peptide
  Seed: LESLFRAVI (MAGA1_HUMAN)
LASLFRAVM

SEQ ID NO: 45525 - protein, 9 aa, Artificial Sequence
  Description of Artificial Sequence: Synthetic peptide
  Seed: RVRFFFPSL (MAGA1_HUMAN)
RARFFFPSK

SEQ ID NO: 45526 - protein, 9 aa, Artificial Sequence
  Description of Artificial Sequence: Synthetic peptide
  Seed: RVRFFFPSL (MAGA1_HUMAN)
RGRFFFPSG

SEQ ID NO: 45527 - protein, 9 aa, Artificial Sequence
  Description of Artificial Sequence: Synthetic peptide
  Seed: EYVIKVSAR (MAGA1_HUMAN)
EVVIKVSAK

SEQ ID NO: 45528 - protein, 10 aa, Artificial Sequence
  Description of Artificial Sequence: Synthetic peptide
  Seed: KNYKHCFPEI (MAGA1_HUMAN)
KVYKHCFPEV

SEQ ID NO: 45529 - protein, 10 aa, Artificial Sequence
  Description of Artificial Sequence: Synthetic peptide
  Seed: ADLVGFLLLK (MAGA1_HUMAN)
ATLVGFLLLR

SEQ ID NO: 45530 - protein, 10 aa, Artificial Sequence
  Description of Artificial Sequence: Synthetic peptide
  Seed: YEFLWGPRAL (MAGA1_HUMAN)
YWFLWGPRAL

SEQ ID NO: 45531 - protein, 9 aa, Artificial Sequence
  Description of Artificial Sequence: Synthetic peptide
  Seed: LESLFRAVI (MAGA1_HUMAN)
LLSLFRAVM

SEQ ID NO: 45532 - protein, 10 aa, Artificial Sequence
  Description of Artificial Sequence: Synthetic peptide
  Seed: ADLVGFLLLK (MAGA1_HUMAN)
ASLVGFLLLK

SEQ ID NO: 45533 - protein, 11 aa, Artificial Sequence
  Description of Artificial Sequence: Synthetic peptide
  Seed: LTQDLVQEKYL (MAGA1_HUMAN)
LTQDLVQEKYW

SEQ ID NO: 45534 - protein, 11 aa, Artificial Sequence
  Description of Artificial Sequence: Synthetic peptide
  Seed: RQVPDSDPARY (MAGA1_HUMAN)
RLVPDSDPARK

SEQ ID NO: 45535 - protein, 9 aa, Artificial Sequence
  Description of Artificial Sequence: Synthetic peptide
  Seed: SSPLVLGTL (MAGA1_HUMAN)
SSPLVLGTY

SEQ ID NO: 45536 - protein, 9 aa, Artificial Sequence
  Description of Artificial Sequence: Synthetic peptide
  Seed: EADPTGHSY (MAGA1_HUMAN)
EQDPTGHSF

SEQ ID NO: 45537 - protein, 9 aa, Artificial Sequence
  Description of Artificial Sequence: Synthetic peptide
  Seed: EEIWEELSV (MAGA1_HUMAN)
EEIWEELSI

SEQ ID NO: 45538 - protein, 9 aa, Artificial Sequence
  Description of Artificial Sequence: Synthetic peptide
  Seed: SLFRAVITK (MAGA1_HUMAN)
SNFRAVITR

SEQ ID NO: 45539 - protein, 11 aa, Artificial Sequence
  Description of Artificial Sequence: Synthetic peptide
  Seed: RVRFFFPSLRE (MAGA1_HUMAN)
RSRFFFPSLRV

SEQ ID NO: 45540 - protein, 9 aa, Artificial Sequence
  Description of Artificial Sequence: Synthetic peptide
  Seed: YVIKVSARV (MAGA1_HUMAN)
YAIKVSARF

SEQ ID NO: 45541 - protein, 9 aa, Artificial Sequence
  Description of Artificial Sequence: Synthetic peptide
  Seed: GPRALAETS (MAGA1_HUMAN)
GPRALAETA

SEQ ID NO: 45542 - protein, 10 aa, Artificial Sequence
  Description of Artificial Sequence: Synthetic peptide
  Seed: CILESLFRAV (MAGA1_HUMAN)
CALESLFRAV

SEQ ID NO: 45543 - protein, 9 aa, Artificial Sequence
  Description of Artificial Sequence: Synthetic peptide
  Seed: SYVKVLEYV (MAGA1_HUMAN)
SLVKVLEYT

SEQ ID NO: 45544 - protein, 9 aa, Artificial Sequence
  Description of Artificial Sequence: Synthetic peptide
  Seed: YKHCFPEIF (MAGA1_HUMAN)
YKHCFPEIY

SEQ ID NO: 45545 - protein, 9 aa, Artificial Sequence
  Description of Artificial Sequence: Synthetic peptide
  Seed: VQAATSSSS (MAGA1_HUMAN)
VVAATSSSM

SEQ ID NO: 45546 - protein, 9 aa, Artificial Sequence
  Description of Artificial Sequence: Synthetic peptide
  Seed: ASESLQLVF (MAGA1_HUMAN)
AQESLQLVF

SEQ ID NO: 45547 - protein, 9 aa, Artificial Sequence
  Description of Artificial Sequence: Synthetic peptide
  Seed: IAMEGGHAP (MAGA1_HUMAN)
IAMEGGHAM

SEQ ID NO: 45548 - protein, 9 aa, Artificial Sequence
  Description of Artificial Sequence: Synthetic peptide
  Seed: STSCILESL (MAGA1_HUMAN)
SSSCILESL

SEQ ID NO: 45549 - protein, 11 aa, Artificial Sequence
  Description of Artificial Sequence: Synthetic peptide
  Seed: GKASESLQLVF (MAGA1_HUMAN)
GQASESLQLVY

SEQ ID NO: 45550 - protein, 10 aa, Artificial Sequence
  Description of Artificial Sequence: Synthetic peptide
  Seed: FFPSLREAAL (MAGA1_HUMAN)
FGPSLREAAL

SEQ ID NO: 45551 - protein, 11 aa, Artificial Sequence
  Description of Artificial Sequence: Synthetic peptide
  Seed: SARVRFFFPSL (MAGA1_HUMAN)
SCRVRFFFPSK

SEQ ID NO: 45552 - protein, 9 aa, Artificial Sequence
  Description of Artificial Sequence: Synthetic peptide
  Seed: TSYVKVLEY (MAGA1_HUMAN)
TIYVKVLEF

SEQ ID NO: 45553 - protein, 10 aa, Artificial Sequence
  Description of Artificial Sequence: Synthetic peptide
  Seed: ARVRFFFPSL (MAGA1_HUMAN)
ALVRFFFPSV

SEQ ID NO: 45554 - protein, 9 aa, Artificial Sequence
  Description of Artificial Sequence: Synthetic peptide
  Seed: YDGREHSAY (MAGA1_HUMAN)
YAGREHSAM

SEQ ID NO: 45555 - protein, 9 aa, Artificial Sequence
  Description of Artificial Sequence: Synthetic peptide
  Seed: VADLVGFLL (MAGA1_HUMAN)
VIDLVGFLY

SEQ ID NO: 45556 - protein, 10 aa, Artificial Sequence
  Description of Artificial Sequence: Synthetic peptide
  Seed: RYEFLWGPRA (MAGA1_HUMAN)
RVEFLWGPRR

SEQ ID NO: 45557 - protein, 10 aa, Artificial Sequence
  Description of Artificial Sequence: Synthetic peptide
  Seed: SARVRFFFPS (MAGA1_HUMAN)
SVRVRFFFPV

SEQ ID NO: 45558 - protein, 9 aa, Artificial Sequence
  Description of Artificial Sequence: Synthetic peptide
  Seed: FPTTINFTR (MAGA1_HUMAN)
FPTTINFTL

SEQ ID NO: 45559 - protein, 9 aa, Artificial Sequence
  Description of Artificial Sequence: Synthetic peptide
  Seed: STDPPQSPQ (MAGA1_HUMAN)
SYDPPQSPM

SEQ ID NO: 45560 - protein, 10 aa, Artificial Sequence
  Description of Artificial Sequence: Synthetic peptide
  Seed: KNYKHCFPEI (MAGA1_HUMAN)
KYYKHCFPEA

SEQ ID NO: 45561 - protein, 9 aa, Artificial Sequence
  Description of Artificial Sequence: Synthetic peptide
  Seed: SAYGEPRKL (MAGA1_HUMAN)
STYGEPRKI

SEQ ID NO: 45562 - protein, 9 aa, Artificial Sequence
  Description of Artificial Sequence: Synthetic peptide
  Seed: FLWGPRALA (MAGA1_HUMAN)
FSWGPRALR

SEQ ID NO: 45563 - protein, 9 aa, Artificial Sequence
  Description of Artificial Sequence: Synthetic peptide
  Seed: RALAETSYV (MAGA1_HUMAN)
RMLAETSYA

SEQ ID NO: 45564 - protein, 10 aa, Artificial Sequence
  Description of Artificial Sequence: Synthetic peptide
  Seed: KVADLVGFLL (MAGA1_HUMAN)
KNADLVGFLW

SEQ ID NO: 45565 - protein, 9 aa, Artificial Sequence
  Description of Artificial Sequence: Synthetic peptide
  Seed: REPVTKAEM (MAGA1_HUMAN)
RMPVTKAEF

SEQ ID NO: 45566 - protein, 9 aa, Artificial Sequence
  Description of Artificial Sequence: Synthetic peptide
  Seed: LESLFRAVI (MAGA1_HUMAN)
LASLFRAVF

SEQ ID NO: 45567 - protein, 11 aa, Artificial Sequence
  Description of Artificial Sequence: Synthetic peptide
  Seed: RQVPDSDPARY (MAGA1_HUMAN)
RNVPDSDPARW

SEQ ID NO: 45568 - protein, 9 aa, Artificial Sequence
  Description of Artificial Sequence: Synthetic peptide
  Seed: RALAETSYV (MAGA1_HUMAN)
RMLAETSYK

SEQ ID NO: 45569 - protein, 10 aa, Artificial Sequence
  Description of Artificial Sequence: Synthetic peptide
  Seed: EMLESVIKNY (MAGA1_HUMAN)
ETLESVIKNW

SEQ ID NO: 45570 - protein, 10 aa, Artificial Sequence
  Description of Artificial Sequence: Synthetic peptide
  Seed: EALEAQQEAL (MAGA1_HUMAN)
EVLEAQQEAK

SEQ ID NO: 45571 - protein, 9 aa, Artificial Sequence
  Description of Artificial Sequence: Synthetic peptide
  Seed: SAFPTTINF (MAGA1_HUMAN)
SIFPTTINK

SEQ ID NO: 45572 - protein, 10 aa, Artificial Sequence
  Description of Artificial Sequence: Synthetic peptide
  Seed: LSVMEVYDGR (MAGA1_HUMAN)
LEVMEVYDGR

SEQ ID NO: 45573 - protein, 9 aa, Artificial Sequence
  Description of Artificial Sequence: Synthetic peptide
  Seed: RQVPDSDPA (MAGA1_HUMAN)
RKVPDSDPF

SEQ ID NO: 45574 - protein, 11 aa, Artificial Sequence
  Description of Artificial Sequence: Synthetic peptide
  Seed: RVRFFFPSLRE (MAGA1_HUMAN)
RTRFFFPSLRT

SEQ ID NO: 45575 - protein, 11 aa, Artificial Sequence
  Description of Artificial Sequence: Synthetic peptide
  Seed: EMLESVIKNYK (MAGA1_HUMAN)
ESLESVIKNYR

SEQ ID NO: 45576 - protein, 10 aa, Artificial Sequence
  Description of Artificial Sequence: Synthetic peptide
  Seed: EMLESVIKNY (MAGA1_HUMAN)
ETLESVIKNY

SEQ ID NO: 45577 - protein, 9 aa, Artificial Sequence
  Description of Artificial Sequence: Synthetic peptide
  Seed: ARYEFLWGP (MAGA1_HUMAN)
ARYEFLWGA

SEQ ID NO: 45578 - protein, 9 aa, Artificial Sequence
  Description of Artificial Sequence: Synthetic peptide
  Seed: IMPKTGFLI (MAGA1_HUMAN)
IFPKTGFLV

SEQ ID NO: 45579 - protein, 9 aa, Artificial Sequence
  Description of Artificial Sequence: Synthetic peptide
  Seed: ITKKVADLV (MAGA1_HUMAN)
ITKKVADLW

SEQ ID NO: 45580 - protein, 10 aa, Artificial Sequence
  Description of Artificial Sequence: Synthetic peptide
  Seed: RYEFLWGPRA (MAGA1_HUMAN)
RPEFLWGPRL

SEQ ID NO: 45581 - protein, 9 aa, Artificial Sequence
  Description of Artificial Sequence: Synthetic peptide
  Seed: LVTCLGLSY (MAGA1_HUMAN)
LTTCLGLSW

SEQ ID NO: 45582 - protein, 9 aa, Artificial Sequence
  Description of Artificial Sequence: Synthetic peptide
  Seed: SYVKVLEYV (MAGA1_HUMAN)
SMVKVLEYL

SEQ ID NO: 45583 - protein, 9 aa, Artificial Sequence
  Description of Artificial Sequence: Synthetic peptide
  Seed: RAREPVTKA (MAGA1_HUMAN)
RVREPVTKK

SEQ ID NO: 45584 - protein, 10 aa, Artificial Sequence
  Description of Artificial Sequence: Synthetic peptide
  Seed: YEFLWGPRAL (MAGA1_HUMAN)
YQFLWGPRAM

SEQ ID NO: 45585 - protein, 9 aa, Artificial Sequence
  Description of Artificial Sequence: Synthetic peptide
  Seed: KVSARVRFF (MAGA1_HUMAN)
KISARVRFA

SEQ ID NO: 45586 - protein, 10 aa, Artificial Sequence
  Description of Artificial Sequence: Synthetic peptide
  Seed: SSSPLVLGTL (MAGA1_HUMAN)
SISPLVLGTV

SEQ ID NO: 45587 - protein, 9 aa, Artificial Sequence
  Description of Artificial Sequence: Synthetic peptide
  Seed: FPSLREAAL (MAGA1_HUMAN)
FVSLREAAM

SEQ ID NO: 45588 - protein, 9 aa, Artificial Sequence
  Description of Artificial Sequence: Synthetic peptide
  Seed: TSYVKVLEY (MAGA1_HUMAN)
TGYVKVLEF

SEQ ID NO: 45589 - protein, 9 aa, Artificial Sequence
  Description of Artificial Sequence: Synthetic peptide
  Seed: SAYGEPRKL (MAGA1_HUMAN)
SSYGEPRKV

SEQ ID NO: 45590 - protein, 9 aa, Artificial Sequence
  Description of Artificial Sequence: Synthetic peptide
  Seed: TTINFTRQR (MAGA1_HUMAN)
TSINFTRQY

SEQ ID NO: 45591 - protein, 9 aa, Artificial Sequence
  Description of Artificial Sequence: Synthetic peptide
  Seed: GASAFPTTI (MAGA1_HUMAN)
GMSAFPTTM

SEQ ID NO: 45592 - protein, 9 aa, Artificial Sequence
  Description of Artificial Sequence: Synthetic peptide
  Seed: TQDLVQEKY (MAGA1_HUMAN)
TQDLVQEKF

SEQ ID NO: 45593 - protein, 9 aa, Artificial Sequence
  Description of Artificial Sequence: Synthetic peptide
  Seed: TQDLVQEKY (MAGA1_HUMAN)
TQDLVQEKM

SEQ ID NO: 45594 - protein, 9 aa, Artificial Sequence
  Description of Artificial Sequence: Synthetic peptide
  Seed: SSPLVLGTL (MAGA1_HUMAN)
SRPLVLGTF

SEQ ID NO: 45595 - protein, 8 aa, Artificial Sequence
  Description of Artificial Sequence: Synthetic peptide
  Seed: FLWGPRAL (MAGA1_HUMAN)
FVWGPRAL

SEQ ID NO: 45596 - protein, 9 aa, Artificial Sequence
  Description of Artificial Sequence: Synthetic peptide
  Seed: REPVTKAEM (MAGA1_HUMAN)
RRPVTKAEM

SEQ ID NO: 45597 - protein, 9 aa, Artificial Sequence
  Description of Artificial Sequence: Synthetic peptide
  Seed: DSDPARYEF (MAGA1_HUMAN)
DTDPARYEM

SEQ ID NO: 45598 - protein, 9 aa, Artificial Sequence
  Description of Artificial Sequence: Synthetic peptide
  Seed: SVMEVYDGR (MAGA1_HUMAN)
SMMEVYDGR

SEQ ID NO: 45599 - protein, 10 aa, Artificial Sequence
  Description of Artificial Sequence: Synthetic peptide
  Seed: RYEFLWGPRA (MAGA1_HUMAN)
RLEFLWGPRR

SEQ ID NO: 45600 - protein, 9 aa, Artificial Sequence
  Description of Artificial Sequence: Synthetic peptide
  Seed: QIMPKTGFL (MAGA1_HUMAN)
QMMPKTGFR

SEQ ID NO: 45601 - protein, 9 aa, Artificial Sequence
  Description of Artificial Sequence: Synthetic peptide
  Seed: LFRAVITKK (MAGA1_HUMAN)
LYRAVITKR

SEQ ID NO: 45602 - protein, 9 aa, Artificial Sequence
  Description of Artificial Sequence: Synthetic peptide
  Seed: SARVRFFFP (MAGA1_HUMAN)
SMRVRFFFL

SEQ ID NO: 45603 - protein, 9 aa, Artificial Sequence
  Description of Artificial Sequence: Synthetic peptide
  Seed: DLVGFLLLK (MAGA1_HUMAN)
DTVGFLLLK

SEQ ID NO: 45604 - protein, 10 aa, Artificial Sequence
  Description of Artificial Sequence: Synthetic peptide
  Seed: KVLEYVIKVS (MAGA1_HUMAN)
KLLEYVIKVK

SEQ ID NO: 45605 - protein, 9 aa, Artificial Sequence
  Description of Artificial Sequence: Synthetic peptide
  Seed: SAYGEPRKL (MAGA1_HUMAN)
SRYGEPRKL

SEQ ID NO: 45606 - protein, 10 aa, Artificial Sequence
  Description of Artificial Sequence: Synthetic peptide
  Seed: TSYVKVLEYV (MAGA1_HUMAN)
TNYVKVLEYI

SEQ ID NO: 45607 - protein, 9 aa, Artificial Sequence
  Description of Artificial Sequence: Synthetic peptide
  Seed: TSYVKVLEY (MAGA1_HUMAN)
TFYVKVLEI

SEQ ID NO: 45608 - protein, 9 aa, Artificial Sequence
  Description of Artificial Sequence: Synthetic peptide
  Seed: KYRAREPVT (MAGA1_HUMAN)
KIRAREPVK

SEQ ID NO: 45609 - protein, 9 aa, Artificial Sequence
  Description of Artificial Sequence: Synthetic peptide
  Seed: FFFPSLREA (MAGA1_HUMAN)
FYFPSLREA

SEQ ID NO: 45610 - protein, 9 aa, Artificial Sequence
  Description of Artificial Sequence: Synthetic peptide
  Seed: FLIIVLVMI (MAGA1_HUMAN)
FVIIVLVML

SEQ ID NO: 45611 - protein, 9 aa, Artificial Sequence
  Description of Artificial Sequence: Synthetic peptide
  Seed: SAYGEPRKL (MAGA1_HUMAN)
STYGEPRKY

SEQ ID NO: 45612 - protein, 9 aa, Artificial Sequence
  Description of Artificial Sequence: Synthetic peptide
  Seed: YRAREPVTK (MAGA1_HUMAN)
YRAREPVTL

SEQ ID NO: 45613 - protein, 9 aa, Artificial Sequence
  Description of Artificial Sequence: Synthetic peptide
  Seed: SAFPTTINF (MAGA1_HUMAN)
SSFPTTINI

SEQ ID NO: 45614 - protein, 9 aa, Artificial Sequence
  Description of Artificial Sequence: Synthetic peptide
  Seed: LVQEKYLEY (MAGA1_HUMAN)
LFQEKYLEM

SEQ ID NO: 45615 - protein, 11 aa, Artificial Sequence
  Description of Artificial Sequence: Synthetic peptide
  Seed: RVRFFFPSLRE (MAGA1_HUMAN)
RMRFFFPSLRY

SEQ ID NO: 45616 - protein, 9 aa, Artificial Sequence
  Description of Artificial Sequence: Synthetic peptide
  Seed: RAREPVTKA (MAGA1_HUMAN)
RLREPVTKM

SEQ ID NO: 45617 - protein, 9 aa, Artificial Sequence
  Description of Artificial Sequence: Synthetic peptide
  Seed: EHSAYGEPR (MAGA1_HUMAN)
EASAYGEPR

SEQ ID NO: 45618 - protein, 9 aa, Artificial Sequence
  Description of Artificial Sequence: Synthetic peptide
  Seed: VSARVRFFF (MAGA1_HUMAN)
VAARVRFFY

SEQ ID NO: 45619 - protein, 10 aa, Artificial Sequence
  Description of Artificial Sequence: Synthetic peptide
  Seed: ADPTGHSYVL (MAGA1_HUMAN)
ASPTGHSYVL

SEQ ID NO: 45620 - protein, 10 aa, Artificial Sequence
  Description of Artificial Sequence: Synthetic peptide
  Seed: ADPTGHSYVL (MAGA1_HUMAN)
AGPTGHSYVM

SEQ ID NO: 45621 - protein, 9 aa, Artificial Sequence
  Description of Artificial Sequence: Synthetic peptide
  Seed: FPSLREAAL (MAGA1_HUMAN)
FASLREAAW

SEQ ID NO: 45622 - protein, 8 aa, Artificial Sequence
  Description of Artificial Sequence: Synthetic peptide
  Seed: RVRFFFPS (MAGA1_HUMAN)
RTRFFFPP

SEQ ID NO: 45623 - protein, 9 aa, Artificial Sequence
  Description of Artificial Sequence: Synthetic peptide
  Seed: STSCILESL (MAGA1_HUMAN)
STSCILESY

SEQ ID NO: 45624 - protein, 9 aa, Artificial Sequence
  Description of Artificial Sequence: Synthetic peptide
  Seed: ESLQLVFGI (MAGA1_HUMAN)
EVLQLVFGY

SEQ ID NO: 45625 - protein, 11 aa, Artificial Sequence
  Description of Artificial Sequence: Synthetic peptide
  Seed: IKVSARVRFFF (MAGA1_HUMAN)
IYVSARVRFFW

SEQ ID NO: 45626 - protein, 9 aa, Artificial Sequence
  Description of Artificial Sequence: Synthetic peptide
  Seed: GASAFPTTI (MAGA1_HUMAN)
GVSAFPTTL

SEQ ID NO: 45627 - protein, 9 aa, Artificial Sequence
  Description of Artificial Sequence: Synthetic peptide
  Seed: KYRAREPVT (MAGA1_HUMAN)
KYRAREPVA

SEQ ID NO: 45628 - protein, 9 aa, Artificial Sequence
  Description of Artificial Sequence: Synthetic peptide
  Seed: LTQDLVQEK (MAGA1_HUMAN)
LIQDLVQEY

SEQ ID NO: 45629 - protein, 9 aa, Artificial Sequence
  Description of Artificial Sequence: Synthetic peptide
  Seed: VADLVGFLL (MAGA1_HUMAN)
VIDLVGFLI

SEQ ID NO: 45630 - protein, 9 aa, Artificial Sequence
  Description of Artificial Sequence: Synthetic peptide
  Seed: TKAEMLESV (MAGA1_HUMAN)
TTAEMLESV

SEQ ID NO: 45631 - protein, 11 aa, Artificial Sequence
  Description of Artificial Sequence: Synthetic peptide
  Seed: SARVRFFFPSL (MAGA1_HUMAN)
SSRVRFFFPSA

SEQ ID NO: 45632 - protein, 9 aa, Artificial Sequence
  Description of Artificial Sequence: Synthetic peptide
  Seed: YVLVTCLGL (MAGA1_HUMAN)
YLLVTCLGL

SEQ ID NO: 45633 - protein, 9 aa, Artificial Sequence
  Description of Artificial Sequence: Synthetic peptide
  Seed: YVIKVSARV (MAGA1_HUMAN)
YLIKVSARC

SEQ ID NO: 45634 - protein, 9 aa, Artificial Sequence
  Description of Artificial Sequence: Synthetic peptide
  Seed: AYGEPRKLL (MAGA1_HUMAN)
AFGEPRKLF

SEQ ID NO: 45635 - protein, 9 aa, Artificial Sequence
  Description of Artificial Sequence: Synthetic peptide
  Seed: STSCILESL (MAGA1_HUMAN)
SVSCILESK

SEQ ID NO: 45636 - protein, 9 aa, Artificial Sequence
  Description of Artificial Sequence: Synthetic peptide
  Seed: DPTGHSYVL (MAGA1_HUMAN)
DATGHSYVF

SEQ ID NO: 45637 - protein, 9 aa, Artificial Sequence
  Description of Artificial Sequence: Synthetic peptide
  Seed: RVRFFFPSL (MAGA1_HUMAN)
RNRFFFPSS

SEQ ID NO: 45638 - protein, 9 aa, Artificial Sequence
  Description of Artificial Sequence: Synthetic peptide
  Seed: IAMEGGHAP (MAGA1_HUMAN)
INMEGGHAL

SEQ ID NO: 45639 - protein, 9 aa, Artificial Sequence
  Description of Artificial Sequence: Synthetic peptide
  Seed: LVLGTLEEV (MAGA1_HUMAN)
LPLGTLEEV

SEQ ID NO: 45640 - protein, 9 aa, Artificial Sequence
  Description of Artificial Sequence: Synthetic peptide
  Seed: FFFPSLREA (MAGA1_HUMAN)
FAFPSLREF

SEQ ID NO: 45641 - protein, 10 aa, Artificial Sequence
  Description of Artificial Sequence: Synthetic peptide
  Seed: KVADLVGFLL (MAGA1_HUMAN)
KQADLVGFLF

SEQ ID NO: 45642 - protein, 9 aa, Artificial Sequence
  Description of Artificial Sequence: Synthetic peptide
  Seed: DLVGFLLLK (MAGA1_HUMAN)
DIVGFLLLK

SEQ ID NO: 45643 - protein, 9 aa, Artificial Sequence
  Description of Artificial Sequence: Synthetic peptide
  Seed: TKAEMLESV (MAGA1_HUMAN)
TLAEMLESA

SEQ ID NO: 45644 - protein, 9 aa, Artificial Sequence
  Description of Artificial Sequence: Synthetic peptide
  Seed: LESLFRAVI (MAGA1_HUMAN)
LRSLFRAVY

SEQ ID NO: 45645 - protein, 11 aa, Artificial Sequence
  Description of Artificial Sequence: Synthetic peptide
  Seed: RVRFFFPSLRE (MAGA1_HUMAN)
RTRFFFPSLRH

SEQ ID NO: 45646 - protein, 9 aa, Artificial Sequence
  Description of Artificial Sequence: Synthetic peptide
  Seed: RVRFFFPSL (MAGA1_HUMAN)
RRRFFFPSK

SEQ ID NO: 45647 - protein, 9 aa, Artificial Sequence
  Description of Artificial Sequence: Synthetic peptide
  Seed: KVADLVGFL (MAGA1_HUMAN)
KAADLVGFA

SEQ ID NO: 45648 - protein, 9 aa, Artificial Sequence
  Description of Artificial Sequence: Synthetic peptide
  Seed: KVLEYVIKV (MAGA1_HUMAN)
KRLEYVIKM

SEQ ID NO: 45649 - protein, 10 aa, Artificial Sequence
  Description of Artificial Sequence: Synthetic peptide
  Seed: IMPKTGFLII (MAGA1_HUMAN)
IYPKTGFLIF

SEQ ID NO: 45650 - protein, 9 aa, Artificial Sequence
  Description of Artificial Sequence: Synthetic peptide
  Seed: SYVKVLEYV (MAGA1_HUMAN)
SQVKVLEYA

SEQ ID NO: 45651 - protein, 9 aa, Artificial Sequence
  Description of Artificial Sequence: Synthetic peptide
  Seed: AYGEPRKLL (MAGA1_HUMAN)
AFGEPRKLM

SEQ ID NO: 45652 - protein, 10 aa, Artificial Sequence
  Description of Artificial Sequence: Synthetic peptide
  Seed: SSSPLVLGTL (MAGA1_HUMAN)
SVSPLVLGTI

SEQ ID NO: 45653 - protein, 11 aa, Artificial Sequence
  Description of Artificial Sequence: Synthetic peptide
  Seed: YEFLWGPRALA (MAGA1_HUMAN)
YRFLWGPRALL

SEQ ID NO: 45654 - protein, 9 aa, Artificial Sequence
  Description of Artificial Sequence: Synthetic peptide
  Seed: KVLEYVIKV (MAGA1_HUMAN)
KNLEYVIKI

SEQ ID NO: 45655 - protein, 9 aa, Artificial Sequence
  Description of Artificial Sequence: Synthetic peptide
  Seed: TGFLIIVLV (MAGA1_HUMAN)
TTFLIIVLA

SEQ ID NO: 45656 - protein, 10 aa, Artificial Sequence
  Description of Artificial Sequence: Synthetic peptide
  Seed: RVRFFFPSLR (MAGA1_HUMAN)
RTRFFFPSLN

SEQ ID NO: 45657 - protein, 9 aa, Artificial Sequence
  Description of Artificial Sequence: Synthetic peptide
  Seed: LFRAVITKK (MAGA1_HUMAN)
LTRAVITKA

SEQ ID NO: 45658 - protein, 11 aa, Artificial Sequence
  Description of Artificial Sequence: Synthetic peptide
  Seed: EVYDGREHSAY (MAGA1_HUMAN)
EMYDGREHSAR

SEQ ID NO: 45659 - protein, 10 aa, Artificial Sequence
  Description of Artificial Sequence: Synthetic peptide
  Seed: ARVRFFFPSL (MAGA1_HUMAN)
AKVRFFFPSK

SEQ ID NO: 45660 - protein, 10 aa, Artificial Sequence
  Description of Artificial Sequence: Synthetic peptide
  Seed: SSSPLVLGTL (MAGA1_HUMAN)
SLSPLVLGTL

SEQ ID NO: 45661 - protein, 9 aa, Artificial Sequence
  Description of Artificial Sequence: Synthetic peptide
  Seed: QIMPKTGFL (MAGA1_HUMAN)
QGMPKTGFY

SEQ ID NO: 45662 - protein, 9 aa, Artificial Sequence
  Description of Artificial Sequence: Synthetic peptide
  Seed: VADLVGFLL (MAGA1_HUMAN)
VWDLVGFLV

SEQ ID NO: 45663 - protein, 9 aa, Artificial Sequence
  Description of Artificial Sequence: Synthetic peptide
  Seed: VYDGREHSA (MAGA1_HUMAN)
VFDGREHSM

SEQ ID NO: 45664 - protein, 9 aa, Artificial Sequence
  Description of Artificial Sequence: Synthetic peptide
  Seed: VRFFFPSLR (MAGA1_HUMAN)
VQFFFPSLR

SEQ ID NO: 45665 - protein, 10 aa, Artificial Sequence
  Description of Artificial Sequence: Synthetic peptide
  Seed: EEGPSTSCIL (MAGA1_HUMAN)
EEGPSTSCIW

SEQ ID NO: 45666 - protein, 11 aa, Artificial Sequence
  Description of Artificial Sequence: Synthetic peptide
  Seed: YEFLWGPRALA (MAGA1_HUMAN)
YHFLWGPRALL

SEQ ID NO: 45667 - protein, 10 aa, Artificial Sequence
  Description of Artificial Sequence: Synthetic peptide
  Seed: YEFLWGPRAL (MAGA1_HUMAN)
YVFLWGPRAL

SEQ ID NO: 45668 - protein, 10 aa, Artificial Sequence
  Description of Artificial Sequence: Synthetic peptide
  Seed: SCILESLFRA (MAGA1_HUMAN)
SQILESLFRV

SEQ ID NO: 45669 - protein, 10 aa, Artificial Sequence
  Description of Artificial Sequence: Synthetic peptide
  Seed: KVADLVGFLL (MAGA1_HUMAN)
KAADLVGFLF

SEQ ID NO: 45670 - protein, 10 aa, Artificial Sequence
  Description of Artificial Sequence: Synthetic peptide
  Seed: SARVRFFFPS (MAGA1_HUMAN)
SHRVRFFFPR

SEQ ID NO: 45671 - protein, 9 aa, Artificial Sequence
  Description of Artificial Sequence: Synthetic peptide
  Seed: RVRFFFPSL (MAGA1_HUMAN)
RYRFFFPSK

SEQ ID NO: 45672 - protein, 9 aa, Artificial Sequence
  Description of Artificial Sequence: Synthetic peptide
  Seed: GTLEEVPTA (MAGA1_HUMAN)
GVLEEVPTV

SEQ ID NO: 45673 - protein, 9 aa, Artificial Sequence
  Description of Artificial Sequence: Synthetic peptide
  Seed: QIMPKTGFL (MAGA1_HUMAN)
QLMPKTGFI

SEQ ID NO: 45674 - protein, 9 aa, Artificial Sequence
  Description of Artificial Sequence: Synthetic peptide
  Seed: STDPPQSPQ (MAGA1_HUMAN)
SFDPPQSPI

SEQ ID NO: 45675 - protein, 11 aa, Artificial Sequence
  Description of Artificial Sequence: Synthetic peptide
  Seed: FLWGPRALAET (MAGA1_HUMAN)
FTWGPRALAEV

SEQ ID NO: 45676 - protein, 11 aa, Artificial Sequence
  Description of Artificial Sequence: Synthetic peptide
  Seed: STDPPQSPQGA (MAGA1_HUMAN)
SVDPPQSPQGM

SEQ ID NO: 45677 - protein, 9 aa, Artificial Sequence
  Description of Artificial Sequence: Synthetic peptide
  Seed: MPKTGFLII (MAGA1_HUMAN)
MIKTGFLIF

SEQ ID NO: 45678 - protein, 10 aa, Artificial Sequence
  Description of Artificial Sequence: Synthetic peptide
  Seed: KAEMLESVIK (MAGA1_HUMAN)
KTEMLESVIY

SEQ ID NO: 45679 - protein, 9 aa, Artificial Sequence
  Description of Artificial Sequence: Synthetic peptide
  Seed: LTQDLVQEK (MAGA1_HUMAN)
LMQDLVQEY

SEQ ID NO: 45680 - protein, 9 aa, Artificial Sequence
  Description of Artificial Sequence: Synthetic peptide
  Seed: EFLWGPRAL (MAGA1_HUMAN)
EYLWGPRAL

SEQ ID NO: 45681 - protein, 9 aa, Artificial Sequence
  Description of Artificial Sequence: Synthetic peptide
  Seed: GTLEEVPTA (MAGA1_HUMAN)
GLLEEVPTA

SEQ ID NO: 45682 - protein, 9 aa, Artificial Sequence
  Description of Artificial Sequence: Synthetic peptide
  Seed: ESLQLVFGI (MAGA1_HUMAN)
ETLQLVFGA

SEQ ID NO: 45683 - protein, 9 aa, Artificial Sequence
  Description of Artificial Sequence: Synthetic peptide
  Seed: NQIMPKTGF (MAGA1_HUMAN)
NEIMPKTGF

SEQ ID NO: 45684 - protein, 9 aa, Artificial Sequence
  Description of Artificial Sequence: Synthetic peptide
  Seed: STDPPQSPQ (MAGA1_HUMAN)
SNDPPQSPL

SEQ ID NO: 45685 - protein, 11 aa, Artificial Sequence
  Description of Artificial Sequence: Synthetic peptide
  Seed: RQVPDSDPARY (MAGA1_HUMAN)
RIVPDSDPARV

SEQ ID NO: 45686 - protein, 9 aa, Artificial Sequence
  Description of Artificial Sequence: Synthetic peptide
  Seed: FFFPSLREA (MAGA1_HUMAN)
FMFPSLREI

SEQ ID NO: 45687 - protein, 9 aa, Artificial Sequence
  Description of Artificial Sequence: Synthetic peptide
  Seed: LVTCLGLSY (MAGA1_HUMAN)
LRTCLGLSF

SEQ ID NO: 45688 - protein, 10 aa, Artificial Sequence
  Description of Artificial Sequence: Synthetic peptide
  Seed: RVRFFFPSLR (MAGA1_HUMAN)
RIRFFFPSLT

SEQ ID NO: 45689 - protein, 9 aa, Artificial Sequence
  Description of Artificial Sequence: Synthetic peptide
  Seed: KASESLQLV (MAGA1_HUMAN)
KESESLQLL

SEQ ID NO: 45690 - protein, 9 aa, Artificial Sequence
  Description of Artificial Sequence: Synthetic peptide
  Seed: FPSLREAAL (MAGA1_HUMAN)
FRSLREAAM

SEQ ID NO: 45691 - protein, 11 aa, Artificial Sequence
  Description of Artificial Sequence: Synthetic peptide
  Seed: TKKVADLVGFL (MAGA1_HUMAN)
TMKVADLVGFV

SEQ ID NO: 45692 - protein, 9 aa, Artificial Sequence
  Description of Artificial Sequence: Synthetic peptide
  Seed: KKVADLVGF (MAGA1_HUMAN)
KAVADLVGF

SEQ ID NO: 45693 - protein, 9 aa, Artificial Sequence
  Description of Artificial Sequence: Synthetic peptide
  Seed: YVIKVSARV (MAGA1_HUMAN)
YSIKVSARV

SEQ ID NO: 45694 - protein, 9 aa, Artificial Sequence
  Description of Artificial Sequence: Synthetic peptide
  Seed: SYVKVLEYV (MAGA1_HUMAN)
STVKVLEYL

SEQ ID NO: 45695 - protein, 9 aa, Artificial Sequence
  Description of Artificial Sequence: Synthetic peptide
  Seed: ASESLQLVF (MAGA1_HUMAN)
AMESLQLVY

SEQ ID NO: 45696 - protein, 9 aa, Artificial Sequence
  Description of Artificial Sequence: Synthetic peptide
  Seed: RVRFFFPSL (MAGA1_HUMAN)
RCRFFFPSV

SEQ ID NO: 45697 - protein, 11 aa, Artificial Sequence
  Description of Artificial Sequence: Synthetic peptide
  Seed: YEFLWGPRALA (MAGA1_HUMAN)
YWFLWGPRALV

SEQ ID NO: 45698 - protein, 9 aa, Artificial Sequence
  Description of Artificial Sequence: Synthetic peptide
  Seed: AYGEPRKLL (MAGA1_HUMAN)
ARGEPRKLL

SEQ ID NO: 45699 - protein, 10 aa, Artificial Sequence
  Description of Artificial Sequence: Synthetic peptide
  Seed: GPRALAETSY (MAGA1_HUMAN)
GPRALAETSA

SEQ ID NO: 45700 - protein, 9 aa, Artificial Sequence
  Description of Artificial Sequence: Synthetic peptide
  Seed: QSPQGASAF (MAGA1_HUMAN)
QMPQGASAL

SEQ ID NO: 45701 - protein, 9 aa, Artificial Sequence
  Description of Artificial Sequence: Synthetic peptide
  Seed: GLVCVQAAT (MAGA1_HUMAN)
GMVCVQAAM

SEQ ID NO: 45702 - protein, 9 aa, Artificial Sequence
  Description of Artificial Sequence: Synthetic peptide
  Seed: AATSSSSPL (MAGA1_HUMAN)
AQTSSSSPF

SEQ ID NO: 45703 - protein, 10 aa, Artificial Sequence
  Description of Artificial Sequence: Synthetic peptide
  Seed: RVRFFFPSLR (MAGA1_HUMAN)
RMRFFFPSLH

SEQ ID NO: 45704 - protein, 10 aa, Artificial Sequence
  Description of Artificial Sequence: Synthetic peptide
  Seed: ATSSSSPLVL (MAGA1_HUMAN)
AFSSSSPLVW

SEQ ID NO: 45705 - protein, 10 aa, Artificial Sequence
  Description of Artificial Sequence: Synthetic peptide
  Seed: KYRAREPVTK (MAGA1_HUMAN)
KVRAREPVTM

SEQ ID NO: 45706 - protein, 9 aa, Artificial Sequence
  Description of Artificial Sequence: Synthetic peptide
  Seed: VADLVGFLL (MAGA1_HUMAN)
VMDLVGFLY

SEQ ID NO: 45707 - protein, 9 aa, Artificial Sequence
  Description of Artificial Sequence: Synthetic peptide
  Seed: SARVRFFFP (MAGA1_HUMAN)
SYRVRFFFG

SEQ ID NO: 45708 - protein, 11 aa, Artificial Sequence
  Description of Artificial Sequence: Synthetic peptide
  Seed: YVKVLEYVIKV (MAGA1_HUMAN)
YMKVLEYVIKV

SEQ ID NO: 45709 - protein, 9 aa, Artificial Sequence
  Description of Artificial Sequence: Synthetic peptide
  Seed: KVSARVRFF (MAGA1_HUMAN)
KVSARVRFG

SEQ ID NO: 45710 - protein, 9 aa, Artificial Sequence
  Description of Artificial Sequence: Synthetic peptide
  Seed: REPVTKAEM (MAGA1_HUMAN)
RRPVTKAEF

SEQ ID NO: 45711 - protein, 9 aa, Artificial Sequence
  Description of Artificial Sequence: Synthetic peptide
  Seed: TSYVKVLEY (MAGA1_HUMAN)
TYYVKVLEM

SEQ ID NO: 45712 - protein, 9 aa, Artificial Sequence
  Description of Artificial Sequence: Synthetic peptide
  Seed: QSPQGASAF (MAGA1_HUMAN)
QFPQGASAY

SEQ ID NO: 45713 - protein, 9 aa, Artificial Sequence
  Description of Artificial Sequence: Synthetic peptide
  Seed: EADPTGHSY (MAGA1_HUMAN)
EVDPTGHSY

SEQ ID NO: 45714 - protein, 9 aa, Artificial Sequence
  Description of Artificial Sequence: Synthetic peptide
  Seed: YVLVTCLGL (MAGA1_HUMAN)
YSLVTCLGV

SEQ ID NO: 45715 - protein, 10 aa, Artificial Sequence
  Description of Artificial Sequence: Synthetic peptide
  Seed: STSCILESLF (MAGA1_HUMAN)
SRSCILESLW

SEQ ID NO: 45716 - protein, 11 aa, Artificial Sequence
  Description of Artificial Sequence: Synthetic peptide
  Seed: RVRFFFPSLRE (MAGA1_HUMAN)
RIRFFFPSLRV

SEQ ID NO: 45717 - protein, 10 aa, Artificial Sequence
  Description of Artificial Sequence: Synthetic peptide
  Seed: DLVGFLLLKY (MAGA1_HUMAN)
DTVGFLLLKK

SEQ ID NO: 45718 - protein, 10 aa, Artificial Sequence
  Description of Artificial Sequence: Synthetic peptide
  Seed: EIFGKASESL (MAGA1_HUMAN)
EMFGKASESV

SEQ ID NO: 45719 - protein, 9 aa, Artificial Sequence
  Description of Artificial Sequence: Synthetic peptide
  Seed: TSSSSPLVL (MAGA1_HUMAN)
TASSSPLVM

SEQ ID NO: 45720 - protein, 9 aa, Artificial Sequence
  Description of Artificial Sequence: Synthetic peptide
  Seed: SAFPTTINF (MAGA1_HUMAN)
SEFPTTINV

SEQ ID NO: 45721 - protein, 9 aa, Artificial Sequence
  Description of Artificial Sequence: Synthetic peptide
  Seed: KVADLVGFL (MAGA1_HUMAN)
KTADLVGFM

SEQ ID NO: 45722 - protein, 10 aa, Artificial Sequence
  Description of Artificial Sequence: Synthetic peptide
  Seed: RAREPVTKAE (MAGA1_HUMAN)
RFREPVTKAA

SEQ ID NO: 45723 - protein, 9 aa, Artificial Sequence
  Description of Artificial Sequence: Synthetic peptide
  Seed: QSPQGASAF (MAGA1_HUMAN)
QPPQGASAY

SEQ ID NO: 45724 - protein, 9 aa, Artificial Sequence
  Description of Artificial Sequence: Synthetic peptide
  Seed: TSSSSPLVL (MAGA1_HUMAN)
TISSSPLVL

SEQ ID NO: 45725 - protein, 9 aa, Artificial Sequence
  Description of Artificial Sequence: Synthetic peptide
  Seed: TQDLVQEKY (MAGA1_HUMAN)
TSDLVQEKI

SEQ ID NO: 45726 - protein, 9 aa, Artificial Sequence
  Description of Artificial Sequence: Synthetic peptide
  Seed: MPKTGFLII (MAGA1_HUMAN)
MLKTGFLIM

SEQ ID NO: 45727 - protein, 10 aa, Artificial Sequence
  Description of Artificial Sequence: Synthetic peptide
  Seed: KVSARVRFFF (MAGA1_HUMAN)
KSSARVRFFF

SEQ ID NO: 45728 - protein, 10 aa, Artificial Sequence
  Description of Artificial Sequence: Synthetic peptide
  Seed: QIMPKTGFLI (MAGA1_HUMAN)
QMMPKTGFLA

SEQ ID NO: 45729 - protein, 10 aa, Artificial Sequence
  Description of Artificial Sequence: Synthetic peptide
  Seed: KVSARVRFFF (MAGA1_HUMAN)
KSSARVRFFK

SEQ ID NO: 45730 - protein, 9 aa, Artificial Sequence
  Description of Artificial Sequence: Synthetic peptide
  Seed: RVRFFFPSL (MAGA1_HUMAN)
RNRFFFPSK

SEQ ID NO: 45731 - protein, 9 aa, Artificial Sequence
  Description of Artificial Sequence: Synthetic peptide
  Seed: KTGFLIIVL (MAGA1_HUMAN)
KTGFLIIVW

SEQ ID NO: 45732 - protein, 10 aa, Artificial Sequence
  Description of Artificial Sequence: Synthetic peptide
  Seed: SAFPTTINFT (MAGA1_HUMAN)
SMFPTTINFM

SEQ ID NO: 45733 - protein, 10 aa, Artificial Sequence
  Description of Artificial Sequence: Synthetic peptide
  Seed: WEELSVMEVY (MAGA1_HUMAN)
WNELSVMEVW

SEQ ID NO: 45734 - protein, 9 aa, Artificial Sequence
  Description of Artificial Sequence: Synthetic peptide
  Seed: YVIKVSARV (MAGA1_HUMAN)
YAIKVSARY

SEQ ID NO: 45735 - protein, 9 aa, Artificial Sequence
  Description of Artificial Sequence: Synthetic peptide
  Seed: TQDLVQEKY (MAGA1_HUMAN)
TYDLVQEKM

SEQ ID NO: 45736 - protein, 9 aa, Artificial Sequence
  Description of Artificial Sequence: Synthetic peptide
  Seed: LGDNQIMPK (MAGA1_HUMAN)
LVDNQIMPK

SEQ ID NO: 45737 - protein, 11 aa, Artificial Sequence
  Description of Artificial Sequence: Synthetic peptide
  Seed: SARVRFFFPSL (MAGA1_HUMAN)
SYRVRFFFPSK

SEQ ID NO: 45738 - protein, 8 aa, Artificial Sequence
  Description of Artificial Sequence: Synthetic peptide
  Seed: AYGEPRKL (MAGA1_HUMAN)
AYGEPRKY

SEQ ID NO: 45739 - protein, 11 aa, Artificial Sequence
  Description of Artificial Sequence: Synthetic peptide
  Seed: STDPPQSPQGA (MAGA1_HUMAN)
SQDPPQSPQGY

SEQ ID NO: 45740 - protein, 9 aa, Artificial Sequence
  Description of Artificial Sequence: Synthetic peptide
  Seed: TTINFTRQR (MAGA1_HUMAN)
TMINFTRQR

SEQ ID NO: 45741 - protein, 10 aa, Artificial Sequence
  Description of Artificial Sequence: Synthetic peptide
  Seed: ASAFPTTINF (MAGA1_HUMAN)
ALAFPTTINW

SEQ ID NO: 45742 - protein, 9 aa, Artificial Sequence
  Description of Artificial Sequence: Synthetic peptide
  Seed: RAREPVTKA (MAGA1_HUMAN)
RVREPVTKV

SEQ ID NO: 45743 - protein, 10 aa, Artificial Sequence
  Description of Artificial Sequence: Synthetic peptide
  Seed: KVSARVRFFF (MAGA1_HUMAN)
KPSARVRFFW

SEQ ID NO: 45744 - protein, 10 aa, Artificial Sequence
  Description of Artificial Sequence: Synthetic peptide
  Seed: TSYVKVLEYV (MAGA1_HUMAN)
TTYVKVLEYI

SEQ ID NO: 45745 - protein, 10 aa, Artificial Sequence
  Description of Artificial Sequence: Synthetic peptide
  Seed: ADPTGHSYVL (MAGA1_HUMAN)
ALPTGHSYVM

SEQ ID NO: 45746 - protein, 9 aa, Artificial Sequence
  Description of Artificial Sequence: Synthetic peptide
  Seed: FLWGPRALA (MAGA1_HUMAN)
FIWGPRALI

SEQ ID NO: 45747 - protein, 10 aa, Artificial Sequence
  Description of Artificial Sequence: Synthetic peptide
  Seed: KEADPTGHSY (MAGA1_HUMAN)
KGADPTGHSM

SEQ ID NO: 45748 - protein, 11 aa, Artificial Sequence
  Description of Artificial Sequence: Synthetic peptide
  Seed: KLLTQDLVQEK (MAGA1_HUMAN)
KILTQDLVQER

SEQ ID NO: 45749 - protein, 9 aa, Artificial Sequence
  Description of Artificial Sequence: Synthetic peptide
  Seed: KASESLQLV (MAGA1_HUMAN)
KQSESLQLA

SEQ ID NO: 45750 - protein, 10 aa, Artificial Sequence
  Description of Artificial Sequence: Synthetic peptide
  Seed: QVPDSDPARY (MAGA1_HUMAN)
QAPDSDPARR

SEQ ID NO: 45751 - protein, 9 aa, Artificial Sequence
  Description of Artificial Sequence: Synthetic peptide
  Seed: YVIKVSARV (MAGA1_HUMAN)
YMIKVSARF

SEQ ID NO: 45752 - protein, 10 aa, Artificial Sequence
  Description of Artificial Sequence: Synthetic peptide
  Seed: KKVADLVGFL (MAGA1_HUMAN)
KYVADLVGFL

SEQ ID NO: 45753 - protein, 9 aa, Artificial Sequence
  Description of Artificial Sequence: Synthetic peptide
  Seed: FFFPSLREA (MAGA1_HUMAN)
FRFPSLREL

SEQ ID NO: 45754 - protein, 9 aa, Artificial Sequence
  Description of Artificial Sequence: Synthetic peptide
  Seed: GASAFPTTI (MAGA1_HUMAN)
GISAFPTTV

SEQ ID NO: 45755 - protein, 9 aa, Artificial Sequence
  Description of Artificial Sequence: Synthetic peptide
  Seed: SSPLVLGTL (MAGA1_HUMAN)
SLPLVLGTI

SEQ ID NO: 45756 - protein, 11 aa, Artificial Sequence
  Description of Artificial Sequence: Synthetic peptide
  Seed: ELSVMEVYDGR (MAGA1_HUMAN)
EYSVMEVYDGR

SEQ ID NO: 45757 - protein, 10 aa, Artificial Sequence
  Description of Artificial Sequence: Synthetic peptide
  Seed: SLFRAVITKK (MAGA1_HUMAN)
SYFRAVITKR

SEQ ID NO: 45758 - protein, 9 aa, Artificial Sequence
  Description of Artificial Sequence: Synthetic peptide
  Seed: KKVADLVGF (MAGA1_HUMAN)
KRVADLVGF

SEQ ID NO: 45759 - protein, 9 aa, Artificial Sequence
  Description of Artificial Sequence: Synthetic peptide
  Seed: LVQEKYLEY (MAGA1_HUMAN)
LLQEKYLEF

SEQ ID NO: 45760 - protein, 10 aa, Artificial Sequence
  Description of Artificial Sequence: Synthetic peptide
  Seed: LEYVIKVSAR (MAGA1_HUMAN)
LYYVIKVSAR

SEQ ID NO: 45761 - protein, 9 aa, Artificial Sequence
  Description of Artificial Sequence: Synthetic peptide
  Seed: SSSPLVLGT (MAGA1_HUMAN)
SISPLVLGL

SEQ ID NO: 45762 - protein, 9 aa, Artificial Sequence
  Description of Artificial Sequence: Synthetic peptide
  Seed: AQQEALGLV (MAGA1_HUMAN)
AEQEALGLP

SEQ ID NO: 45763 - protein, 9 aa, Artificial Sequence
  Description of Artificial Sequence: Synthetic peptide
  Seed: EALEAQQEA (MAGA1_HUMAN)
EVLEAQQEV

SEQ ID NO: 45764 - protein, 10 aa, Artificial Sequence
  Description of Artificial Sequence: Synthetic peptide
  Seed: SARVRFFFPS (MAGA1_HUMAN)
SKRVRFFFPL

SEQ ID NO: 45765 - protein, 9 aa, Artificial Sequence
  Description of Artificial Sequence: Synthetic peptide
  Seed: YEFLWGPRA (MAGA1_HUMAN)
YEFLWGPRF

SEQ ID NO: 45766 - protein, 9 aa, Artificial Sequence
  Description of Artificial Sequence: Synthetic peptide
  Seed: KVLEYVIKV (MAGA1_HUMAN)
KMLEYVIKC

SEQ ID NO: 45767 - protein, 10 aa, Artificial Sequence
  Description of Artificial Sequence: Synthetic peptide
  Seed: KNYKHCFPEI (MAGA1_HUMAN)
KNYKHCFPEF

SEQ ID NO: 45768 - protein, 9 aa, Artificial Sequence
  Description of Artificial Sequence: Synthetic peptide
  Seed: RVRFFFPSL (MAGA1_HUMAN)
RMRFFFPSW

SEQ ID NO: 45769 - protein, 9 aa, Artificial Sequence
  Description of Artificial Sequence: Synthetic peptide
  Seed: REEEGPSTS (MAGA1_HUMAN)
REEEGPSTF

SEQ ID NO: 45770 - protein, 9 aa, Artificial Sequence
  Description of Artificial Sequence: Synthetic peptide
  Seed: STSCILESL (MAGA1_HUMAN)
SVSCILEST

SEQ ID NO: 45771 - protein, 10 aa, Artificial Sequence
  Description of Artificial Sequence: Synthetic peptide
  Seed: SSSPLVLGTL (MAGA1_HUMAN)
SVSPLVLGTL

SEQ ID NO: 45772 - protein, 9 aa, Artificial Sequence
  Description of Artificial Sequence: Synthetic peptide
  Seed: TSYVKVLEY (MAGA1_HUMAN)
TLYVKVLEW

SEQ ID NO: 45773 - protein, 9 aa, Artificial Sequence
  Description of Artificial Sequence: Synthetic peptide
  Seed: KTGFLIIVL (MAGA1_HUMAN)
KSGFLIIVV

SEQ ID NO: 45774 - protein, 10 aa, Artificial Sequence
  Description of Artificial Sequence: Synthetic peptide
  Seed: ESLFRAVITK (MAGA1_HUMAN)
EFLFRAVITR

SEQ ID NO: 45775 - protein, 10 aa, Artificial Sequence
  Description of Artificial Sequence: Synthetic peptide
  Seed: KEADPTGHSY (MAGA1_HUMAN)
KSADPTGHSH

SEQ ID NO: 45776 - protein, 9 aa, Artificial Sequence
  Description of Artificial Sequence: Synthetic peptide
  Seed: FRAVITKKV (MAGA1_HUMAN)
FHAVITKKL

SEQ ID NO: 45777 - protein, 10 aa, Artificial Sequence
  Description of Artificial Sequence: Synthetic peptide
  Seed: AQQEALGLVC (MAGA1_HUMAN)
AQQEALGLVF

SEQ ID NO: 45778 - protein, 10 aa, Artificial Sequence
  Description of Artificial Sequence: Synthetic peptide
  Seed: MLESVIKNYK (MAGA1_HUMAN)
MYESVIKNYR

SEQ ID NO: 45779 - protein, 9 aa, Artificial Sequence
  Description of Artificial Sequence: Synthetic peptide
  Seed: ALEAQQEAL (MAGA1_HUMAN)
ALEAQQEAW

SEQ ID NO: 45780 - protein, 10 aa, Artificial Sequence
  Description of Artificial Sequence: Synthetic peptide
  Seed: ADPTGHSYVL (MAGA1_HUMAN)
AFPTGHSYVM

SEQ ID NO: 45781 - protein, 9 aa, Artificial Sequence
  Description of Artificial Sequence: Synthetic peptide
  Seed: KVADLVGFL (MAGA1_HUMAN)
KQADLVGFW

SEQ ID NO: 45782 - protein, 10 aa, Artificial Sequence
  Description of Artificial Sequence: Synthetic peptide
  Seed: KVSARVRFFF (MAGA1_HUMAN)
KLSARVRFFK

SEQ ID NO: 45783 - protein, 9 aa, Artificial Sequence
  Description of Artificial Sequence: Synthetic peptide
  Seed: KASESLQLV (MAGA1_HUMAN)
KSSESLQLL

SEQ ID NO: 45784 - protein, 9 aa, Artificial Sequence
  Description of Artificial Sequence: Synthetic peptide
  Seed: HSAYGEPRK (MAGA1_HUMAN)
HVAYGEPRR

SEQ ID NO: 45785 - protein, 9 aa, Artificial Sequence
  Description of Artificial Sequence: Synthetic peptide
  Seed: IMPKTGFLI (MAGA1_HUMAN)
IWPKTGFLF

SEQ ID NO: 45786 - protein, 9 aa, Artificial Sequence
  Description of Artificial Sequence: Synthetic peptide
  Seed: KVLEYVIKV (MAGA1_HUMAN)
KTLEYVIKL

SEQ ID NO: 45787 - protein, 9 aa, Artificial Sequence
  Description of Artificial Sequence: Synthetic peptide
  Seed: AETSYVKVL (MAGA1_HUMAN)
AQTSYVKVY

SEQ ID NO: 45788 - protein, 9 aa, Artificial Sequence
  Description of Artificial Sequence: Synthetic peptide
  Seed: SARVRFFFP (MAGA1_HUMAN)
SMRVRFFFR

SEQ ID NO: 45789 - protein, 10 aa, Artificial Sequence
  Description of Artificial Sequence: Synthetic peptide
  Seed: ARVRFFFPSL (MAGA1_HUMAN)
AKVRFFFPSM

SEQ ID NO: 45790 - protein, 11 aa, Artificial Sequence
  Description of Artificial Sequence: Synthetic peptide
  Seed: STDPPQSPQGA (MAGA1_HUMAN)
SCDPPQSPQGL

SEQ ID NO: 45791 - protein, 11 aa, Artificial Sequence
  Description of Artificial Sequence: Synthetic peptide
  Seed: EIWEELSVMEV (MAGA1_HUMAN)
ELWEELSVMEV

SEQ ID NO: 45792 - protein, 11 aa, Artificial Sequence
  Description of Artificial Sequence: Synthetic peptide
  Seed: KVLEYVIKVSA (MAGA1_HUMAN)
KMLEYVIKVSV

SEQ ID NO: 45793 - protein, 9 aa, Artificial Sequence
  Description of Artificial Sequence: Synthetic peptide
  Seed: RALAETSYV (MAGA1_HUMAN)
RALAETSYF

SEQ ID NO: 45794 - protein, 9 aa, Artificial Sequence
  Description of Artificial Sequence: Synthetic peptide
  Seed: SARVRFFFP (MAGA1_HUMAN)
SSRVRFFFR

SEQ ID NO: 45795 - protein, 9 aa, Artificial Sequence
  Description of Artificial Sequence: Synthetic peptide
  Seed: HCFPEIFGK (MAGA1_HUMAN)
HAFPEIFGV

SEQ ID NO: 45796 - protein, 9 aa, Artificial Sequence
  Description of Artificial Sequence: Synthetic peptide
  Seed: KKVADLVGF (MAGA1_HUMAN)
KTVADLVGY

SEQ ID NO: 45797 - protein, 10 aa, Artificial Sequence
  Description of Artificial Sequence: Synthetic peptide
  Seed: KVADLVGFLL (MAGA1_HUMAN)
KIADLVGFLK

SEQ ID NO: 45798 - protein, 9 aa, Artificial Sequence
  Description of Artificial Sequence: Synthetic peptide
  Seed: GLVCVQAAT (MAGA1_HUMAN)
GMVCVQAAI

SEQ ID NO: 45799 - protein, 9 aa, Artificial Sequence
  Description of Artificial Sequence: Synthetic peptide
  Seed: RVRFFFPSL (MAGA1_HUMAN)
RGRFFFPSS

SEQ ID NO: 45800 - protein, 10 aa, Artificial Sequence
  Description of Artificial Sequence: Synthetic peptide
  Seed: VLVTCLGLSY (MAGA1_HUMAN)
VHVTCLGLSY

SEQ ID NO: 45801 - protein, 10 aa, Artificial Sequence
  Description of Artificial Sequence: Synthetic peptide
  Seed: ARVRFFFPSL (MAGA1_HUMAN)
AGVRFFFPSA

SEQ ID NO: 45802 - protein, 9 aa, Artificial Sequence
  Description of Artificial Sequence: Synthetic peptide
  Seed: MPKTGFLII (MAGA1_HUMAN)
MAKTGFLIY

SEQ ID NO: 45803 - protein, 9 aa, Artificial Sequence
  Description of Artificial Sequence: Synthetic peptide
  Seed: GKASESLQL (MAGA1_HUMAN)
GQASESLQY

SEQ ID NO: 45804 - protein, 10 aa, Artificial Sequence
  Description of Artificial Sequence: Synthetic peptide
  Seed: CILESLFRAV (MAGA1_HUMAN)
CQLESLFRAI

SEQ ID NO: 45805 - protein, 9 aa, Artificial Sequence
  Description of Artificial Sequence: Synthetic peptide
  Seed: ARVRFFFPS (MAGA1_HUMAN)
AKVRFFFPL

SEQ ID NO: 45806 - protein, 9 aa, Artificial Sequence
  Description of Artificial Sequence: Synthetic peptide
  Seed: IAMEGGHAP (MAGA1_HUMAN)
IVMEGGHAM

SEQ ID NO: 45807 - protein, 11 aa, Artificial Sequence
  Description of Artificial Sequence: Synthetic peptide
  Seed: ARVRFFFPSLR (MAGA1_HUMAN)
ACVRFFFPSLL

SEQ ID NO: 45808 - protein, 9 aa, Artificial Sequence
  Description of Artificial Sequence: Synthetic peptide
  Seed: YRAREPVTK (MAGA1_HUMAN)
YYAREPVTF

SEQ ID NO: 45809 - protein, 8 aa, Artificial Sequence
  Description of Artificial Sequence: Synthetic peptide
  Seed: RVRFFFPS (MAGA1_HUMAN)
RSRFFFPS

SEQ ID NO: 45810 - protein, 11 aa, Artificial Sequence
  Description of Artificial Sequence: Synthetic peptide
  Seed: KVADLVGFLLL (MAGA1_HUMAN)
KLADLVGFLLD

SEQ ID NO: 45811 - protein, 9 aa, Artificial Sequence
  Description of Artificial Sequence: Synthetic peptide
  Seed: YVIKVSARV (MAGA1_HUMAN)
YIIKVSARA

SEQ ID NO: 45812 - protein, 9 aa, Artificial Sequence
  Description of Artificial Sequence: Synthetic peptide
  Seed: FFFPSLREA (MAGA1_HUMAN)
FTFPSLREW

SEQ ID NO: 45813 - protein, 9 aa, Artificial Sequence
  Description of Artificial Sequence: Synthetic peptide
  Seed: TGFLIIVLV (MAGA1_HUMAN)
TTFLIIVLV

SEQ ID NO: 45814 - protein, 10 aa, Artificial Sequence
  Description of Artificial Sequence: Synthetic peptide
  Seed: RVRFFFPSLR (MAGA1_HUMAN)
RARFFFPSLF

SEQ ID NO: 45815 - protein, 10 aa, Artificial Sequence
  Description of Artificial Sequence: Synthetic peptide
  Seed: KVSARVRFFF (MAGA1_HUMAN)
KCSARVRFFW

SEQ ID NO: 45816 - protein, 10 aa, Artificial Sequence
  Description of Artificial Sequence: Synthetic peptide
  Seed: RVRFFFPSLR (MAGA1_HUMAN)
RQRFFFPSLA

SEQ ID NO: 45817 - protein, 10 aa, Artificial Sequence
  Description of Artificial Sequence: Synthetic peptide
  Seed: SARVRFFFPS (MAGA1_HUMAN)
SVRVRFFFPF

SEQ ID NO: 45818 - protein, 10 aa, Artificial Sequence
  Description of Artificial Sequence: Synthetic peptide
  Seed: FLWGPRALAE (MAGA1_HUMAN)
FMWGPRALAM

SEQ ID NO: 45819 - protein, 9 aa, Artificial Sequence
  Description of Artificial Sequence: Synthetic peptide
  Seed: EIWEELSVM (MAGA1_HUMAN)
EVWEELSVL

SEQ ID NO: 45820 - protein, 10 aa, Artificial Sequence
  Description of Artificial Sequence: Synthetic peptide
  Seed: KVADLVGFLL (MAGA1_HUMAN)
KLADLVGFLR

SEQ ID NO: 45821 - protein, 9 aa, Artificial Sequence
  Description of Artificial Sequence: Synthetic peptide
  Seed: YKHCFPEIF (MAGA1_HUMAN)
YMHCFPEIW

SEQ ID NO: 45822 - protein, 9 aa, Artificial Sequence
  Description of Artificial Sequence: Synthetic peptide
  Seed: KVLEYVIKV (MAGA1_HUMAN)
KLLEYVIKW

SEQ ID NO: 45823 - protein, 11 aa, Artificial Sequence
  Description of Artificial Sequence: Synthetic peptide
  Seed: KEADPTGHSYV (MAGA1_HUMAN)
KQADPTGHSYM

SEQ ID NO: 45824 - protein, 9 aa, Artificial Sequence
  Description of Artificial Sequence: Synthetic peptide
  Seed: SYVKVLEYV (MAGA1_HUMAN)
SRVKVLEYV

SEQ ID NO: 45825 - protein, 10 aa, Artificial Sequence
  Description of Artificial Sequence: Synthetic peptide
  Seed: SARVRFFFPS (MAGA1_HUMAN)
STRVRFFFPG

SEQ ID NO: 45826 - protein, 9 aa, Artificial Sequence
  Description of Artificial Sequence: Synthetic peptide
  Seed: TSYVKVLEY (MAGA1_HUMAN)
TSYVKVLEL

SEQ ID NO: 45827 - protein, 9 aa, Artificial Sequence
  Description of Artificial Sequence: Synthetic peptide
  Seed: QIMPKTGFL (MAGA1_HUMAN)
QTMPKTGFI

SEQ ID NO: 45828 - protein, 10 aa, Artificial Sequence
  Description of Artificial Sequence: Synthetic peptide
  Seed: KEADPTGHSY (MAGA1_HUMAN)
KMADPTGHSV

SEQ ID NO: 45829 - protein, 10 aa, Artificial Sequence
  Description of Artificial Sequence: Synthetic peptide
  Seed: RYEFLWGPRA (MAGA1_HUMAN)
RREFLWGPRL

SEQ ID NO: 45830 - protein, 11 aa, Artificial Sequence
  Description of Artificial Sequence: Synthetic peptide
  Seed: YEFLWGPRALA (MAGA1_HUMAN)
YWFLWGPRALI

SEQ ID NO: 45831 - protein, 9 aa, Artificial Sequence
  Description of Artificial Sequence: Synthetic peptide
  Seed: TSSSSPLVL (MAGA1_HUMAN)
TVSSSPLVY

SEQ ID NO: 45832 - protein, 10 aa, Artificial Sequence
  Description of Artificial Sequence: Synthetic peptide
  Seed: TSYVKVLEYV (MAGA1_HUMAN)
TFYVKVLEYI

SEQ ID NO: 45833 - protein, 9 aa, Artificial Sequence
  Description of Artificial Sequence: Synthetic peptide
  Seed: HSYVLVTCL (MAGA1_HUMAN)
HRYVLVTCI

SEQ ID NO: 45834 - protein, 9 aa, Artificial Sequence
  Description of Artificial Sequence: Synthetic peptide
  Seed: TTINFTRQR (MAGA1_HUMAN)
TSINFTRQF

SEQ ID NO: 45835 - protein, 9 aa, Artificial Sequence
  Description of Artificial Sequence: Synthetic peptide
  Seed: RALAETSYV (MAGA1_HUMAN)
RSLAETSYV

SEQ ID NO: 45836 - protein, 11 aa, Artificial Sequence
  Description of Artificial Sequence: Synthetic peptide
  Seed: CILESLFRAVI (MAGA1_HUMAN)
CMLESLFRAVL

SEQ ID NO: 45837 - protein, 9 aa, Artificial Sequence
  Description of Artificial Sequence: Synthetic peptide
  Seed: AETSYVKVL (MAGA1_HUMAN)
AETSYVKVY

SEQ ID NO: 45838 - protein, 10 aa, Artificial Sequence
  Description of Artificial Sequence: Synthetic peptide
  Seed: ATSSSSPLVL (MAGA1_HUMAN)
AYSSSSPLVW

SEQ ID NO: 45839 - protein, 9 aa, Artificial Sequence
  Description of Artificial Sequence: Synthetic peptide
  Seed: SSPLVLGTL (MAGA1_HUMAN)
SVPLVLGTL

SEQ ID NO: 45840 - protein, 9 aa, Artificial Sequence
  Description of Artificial Sequence: Synthetic peptide
  Seed: GLLGDNQIM (MAGA1_HUMAN)
GQLGDNQIV

SEQ ID NO: 45841 - protein, 9 aa, Artificial Sequence
  Description of Artificial Sequence: Synthetic peptide
  Seed: LKYRAREPV (MAGA1_HUMAN)
LGYRAREPF

SEQ ID NO: 45842 - protein, 9 aa, Artificial Sequence
  Description of Artificial Sequence: Synthetic peptide
  Seed: KTGFLIIVL (MAGA1_HUMAN)
KTGFLIIVF

SEQ ID NO: 45843 - protein, 9 aa, Artificial Sequence
  Description of Artificial Sequence: Synthetic peptide
  Seed: ADLVGFLLL (MAGA1_HUMAN)
AQLVGFLLI

SEQ ID NO: 45844 - protein, 11 aa, Artificial Sequence
  Description of Artificial Sequence: Synthetic peptide
  Seed: RVRFFFPSLRE (MAGA1_HUMAN)
RVRFFFPSLRG

SEQ ID NO: 45845 - protein, 9 aa, Artificial Sequence
  Description of Artificial Sequence: Synthetic peptide
  Seed: KVADLVGFL (MAGA1_HUMAN)
KLADLVGFI

SEQ ID NO: 45846 - protein, 9 aa, Artificial Sequence
  Description of Artificial Sequence: Synthetic peptide
  Seed: LVTCLGLSY (MAGA1_HUMAN)
LPTCLGLSF

SEQ ID NO: 45847 - protein, 9 aa, Artificial Sequence
  Description of Artificial Sequence: Synthetic peptide
  Seed: TSYVKVLEY (MAGA1_HUMAN)
TWYVKVLEY

SEQ ID NO: 45848 - protein, 9 aa, Artificial Sequence
  Description of Artificial Sequence: Synthetic peptide
  Seed: RVRFFFPSL (MAGA1_HUMAN)
RVRFFFPSE

SEQ ID NO: 45849 - protein, 10 aa, Artificial Sequence
  Description of Artificial Sequence: Synthetic peptide
  Seed: VLVTCLGLSY (MAGA1_HUMAN)
VTVTCLGLSY

SEQ ID NO: 45850 - protein, 10 aa, Artificial Sequence
  Description of Artificial Sequence: Synthetic peptide
  Seed: ATSSSSPLVL (MAGA1_HUMAN)
AMSSSSPLVW

SEQ ID NO: 45851 - protein, 9 aa, Artificial Sequence
  Description of Artificial Sequence: Synthetic peptide
  Seed: RVRFFFPSL (MAGA1_HUMAN)
RTRFFFPSP

SEQ ID NO: 45852 - protein, 9 aa, Artificial Sequence
  Description of Artificial Sequence: Synthetic peptide
  Seed: HCFPEIFGK (MAGA1_HUMAN)
HVFPEIFGH

SEQ ID NO: 45853 - protein, 10 aa, Artificial Sequence
  Description of Artificial Sequence: Synthetic peptide
  Seed: SSSPLVLGTL (MAGA1_HUMAN)
SLSPLVLGTV

SEQ ID NO: 45854 - protein, 9 aa, Artificial Sequence
  Description of Artificial Sequence: Synthetic peptide
  Seed: RVRFFFPSL (MAGA1_HUMAN)
RFRFFFPSA

SEQ ID NO: 45855 - protein, 9 aa, Artificial Sequence
  Description of Artificial Sequence: Synthetic peptide
  Seed: FPTTINFTR (MAGA1_HUMAN)
FYTTINFTR

SEQ ID NO: 45856 - protein, 9 aa, Artificial Sequence
  Description of Artificial Sequence: Synthetic peptide
  Seed: RVRFFFPSL (MAGA1_HUMAN)
RARFFFPSY

SEQ ID NO: 45857 - protein, 10 aa, Artificial Sequence
  Description of Artificial Sequence: Synthetic peptide
  Seed: TSCILESLFR (MAGA1_HUMAN)
TYCILESLFR

SEQ ID NO: 45858 - protein, 9 aa, Artificial Sequence
  Description of Artificial Sequence: Synthetic peptide
  Seed: EEVPTAGST (MAGA1_HUMAN)
EEVPTAGSA

SEQ ID NO: 45859 - protein, 10 aa, Artificial Sequence
  Description of Artificial Sequence: Synthetic peptide
  Seed: RALAETSYVK (MAGA1_HUMAN)
RALAETSYVR

SEQ ID NO: 45860 - protein, 9 aa, Artificial Sequence
  Description of Artificial Sequence: Synthetic peptide
  Seed: SARVRFFFP (MAGA1_HUMAN)
STRVRFFFM

SEQ ID NO: 45861 - protein, 9 aa, Artificial Sequence
  Description of Artificial Sequence: Synthetic peptide
  Seed: TGFLIIVLV (MAGA1_HUMAN)
TMFLIIVLL

SEQ ID NO: 45862 - protein, 11 aa, Artificial Sequence
  Description of Artificial Sequence: Synthetic peptide
  Seed: SPLVLGTLEEV (MAGA1_HUMAN)
SLLVLGTLEEV

SEQ ID NO: 45863 - protein, 9 aa, Artificial Sequence
  Description of Artificial Sequence: Synthetic peptide
  Seed: IMPKTGFLI (MAGA1_HUMAN)
IYPKTGFLW

SEQ ID NO: 45864 - protein, 11 aa, Artificial Sequence
  Description of Artificial Sequence: Synthetic peptide
  Seed: RVRFFFPSLRE (MAGA1_HUMAN)
RNRFFFPSLRR

SEQ ID NO: 45865 - protein, 9 aa, Artificial Sequence
  Description of Artificial Sequence: Synthetic peptide
  Seed: QIMPKTGFL (MAGA1_HUMAN)
QTMPKTGFV

SEQ ID NO: 45866 - protein, 9 aa, Artificial Sequence
  Description of Artificial Sequence: Synthetic peptide
  Seed: WEELSVMEV (MAGA1_HUMAN)
WEELSVMEF

SEQ ID NO: 45867 - protein, 10 aa, Artificial Sequence
  Description of Artificial Sequence: Synthetic peptide
  Seed: EVYDGREHSA (MAGA1_HUMAN)
EMYDGREHSV

SEQ ID NO: 45868 - protein, 11 aa, Artificial Sequence
  Description of Artificial Sequence: Synthetic peptide
  Seed: STSCILESLFR (MAGA1_HUMAN)
SSSCILESLFK

SEQ ID NO: 45869 - protein, 9 aa, Artificial Sequence
  Description of Artificial Sequence: Synthetic peptide
  Seed: ATSSSSPLV (MAGA1_HUMAN)
ATSSSSPLY

SEQ ID NO: 45870 - protein, 9 aa, Artificial Sequence
  Description of Artificial Sequence: Synthetic peptide
  Seed: RVRFFFPSL (MAGA1_HUMAN)
RIRFFFPSL

SEQ ID NO: 45871 - protein, 9 aa, Artificial Sequence
  Description of Artificial Sequence: Synthetic peptide
  Seed: TKAEMLESV (MAGA1_HUMAN)
THAEMLESI

SEQ ID NO: 45872 - protein, 10 aa, Artificial Sequence
  Description of Artificial Sequence: Synthetic peptide
  Seed: SSSPLVLGTL (MAGA1_HUMAN)
SSSPLVLGTW

SEQ ID NO: 45873 - protein, 10 aa, Artificial Sequence
  Description of Artificial Sequence: Synthetic peptide
  Seed: SPQGASAFPT (MAGA1_HUMAN)
SPQGASAFPL

SEQ ID NO: 45874 - protein, 10 aa, Artificial Sequence
  Description of Artificial Sequence: Synthetic peptide
  Seed: KVADLVGFLL (MAGA1_HUMAN)
KIADLVGFLV

SEQ ID NO: 45875 - protein, 9 aa, Artificial Sequence
  Description of Artificial Sequence: Synthetic peptide
  Seed: EEIWEELSV (MAGA1_HUMAN)
EEIWEELSY

SEQ ID NO: 45876 - protein, 10 aa, Artificial Sequence
  Description of Artificial Sequence: Synthetic peptide
  Seed: ADPTGHSYVL (MAGA1_HUMAN)
ASPTGHSYVM

SEQ ID NO: 45877 - protein, 9 aa, Artificial Sequence
  Description of Artificial Sequence: Synthetic peptide
  Seed: ATSSSSPLV (MAGA1_HUMAN)
ATSSSSPLF

SEQ ID NO: 45878 - protein, 9 aa, Artificial Sequence
  Description of Artificial Sequence: Synthetic peptide
  Seed: KVSARVRFF (MAGA1_HUMAN)
KFSARVRFK

SEQ ID NO: 45879 - protein, 9 aa, Artificial Sequence
  Description of Artificial Sequence: Synthetic peptide
  Seed: GTLEEVPTA (MAGA1_HUMAN)
GMLEEVPTC

SEQ ID NO: 45880 - protein, 9 aa, Artificial Sequence
  Description of Artificial Sequence: Synthetic peptide
  Seed: EIWEELSVM (MAGA1_HUMAN)
EMWEELSVY

SEQ ID NO: 45881 - protein, 10 aa, Artificial Sequence
  Description of Artificial Sequence: Synthetic peptide
  Seed: EYVIKVSARV (MAGA1_HUMAN)
EDVIKVSARV

SEQ ID NO: 45882 - protein, 10 aa, Artificial Sequence
  Description of Artificial Sequence: Synthetic peptide
  Seed: KVADLVGFLL (MAGA1_HUMAN)
KSADLVGFLF

SEQ ID NO: 45883 - protein, 9 aa, Artificial Sequence
  Description of Artificial Sequence: Synthetic peptide
  Seed: TSYVKVLEY (MAGA1_HUMAN)
TRYVKVLEF

SEQ ID NO: 45884 - protein, 9 aa, Artificial Sequence
  Description of Artificial Sequence: Synthetic peptide
  Seed: TQDLVQEKY (MAGA1_HUMAN)
TGDLVQEKF

SEQ ID NO: 45885 - protein, 9 aa, Artificial Sequence
  Description of Artificial Sequence: Synthetic peptide
  Seed: RALAETSYV (MAGA1_HUMAN)
RSLAETSYA

SEQ ID NO: 45886 - protein, 9 aa, Artificial Sequence
  Description of Artificial Sequence: Synthetic peptide
  Seed: ESVIKNYKH (MAGA1_HUMAN)
ESVIKNYKK

SEQ ID NO: 45887 - protein, 10 aa, Artificial Sequence
  Description of Artificial Sequence: Synthetic peptide
  Seed: SAFPTTINFT (MAGA1_HUMAN)
SAFPTTINFV

SEQ ID NO: 45888 - protein, 9 aa, Artificial Sequence
  Description of Artificial Sequence: Synthetic peptide
  Seed: TSSSSPLVL (MAGA1_HUMAN)
TKSSSPLVL

SEQ ID NO: 45889 - protein, 8 aa, Artificial Sequence
  Description of Artificial Sequence: Synthetic peptide
  Seed: RAVITKKV (MAGA1_HUMAN)
RQVITKKV

SEQ ID NO: 45890 - protein, 9 aa, Artificial Sequence
  Description of Artificial Sequence: Synthetic peptide
  Seed: QPSEGSSSR (MAGA1_HUMAN)
QYSEGSSSR

SEQ ID NO: 45891 - protein, 10 aa, Artificial Sequence
  Description of Artificial Sequence: Synthetic peptide
  Seed: TTINFTRQRQ (MAGA1_HUMAN)
TSINFTRQRR

SEQ ID NO: 45892 - protein, 9 aa, Artificial Sequence
  Description of Artificial Sequence: Synthetic peptide
  Seed: MPKTGFLII (MAGA1_HUMAN)
MMKTGFLII

SEQ ID NO: 45893 - protein, 10 aa, Artificial Sequence
  Description of Artificial Sequence: Synthetic peptide
  Seed: FFPSLREAAL (MAGA1_HUMAN)
FAPSLREAAY

SEQ ID NO: 45894 - protein, 10 aa, Artificial Sequence
  Description of Artificial Sequence: Synthetic peptide
  Seed: RYEFLWGPRA (MAGA1_HUMAN)
RSEFLWGPRR

SEQ ID NO: 45895 - protein, 9 aa, Artificial Sequence
  Description of Artificial Sequence: Synthetic peptide
  Seed: TSCILESLF (MAGA1_HUMAN)
TVCILESLW

SEQ ID NO: 45896 - protein, 9 aa, Artificial Sequence
  Description of Artificial Sequence: Synthetic peptide
  Seed: RAREPVTKA (MAGA1_HUMAN)
RMREPVTKS

SEQ ID NO: 45897 - protein, 9 aa, Artificial Sequence
  Description of Artificial Sequence: Synthetic peptide
  Seed: YKHCFPEIF (MAGA1_HUMAN)
YEHCFPEIY

SEQ ID NO: 45898 - protein, 9 aa, Artificial Sequence
  Description of Artificial Sequence: Synthetic peptide
  Seed: ASESLQLVF (MAGA1_HUMAN)
AQESLQLVI

SEQ ID NO: 45899 - protein, 11 aa, Artificial Sequence
  Description of Artificial Sequence: Synthetic peptide
  Seed: KVADLVGFLLL (MAGA1_HUMAN)
KAADLVGFLLF

SEQ ID NO: 45900 - protein, 9 aa, Artificial Sequence
  Description of Artificial Sequence: Synthetic peptide
  Seed: RVRFFFPSL (MAGA1_HUMAN)
RFRFFFPSV

SEQ ID NO: 45901 - protein, 10 aa, Artificial Sequence
  Description of Artificial Sequence: Synthetic peptide
  Seed: SARVRFFFPS (MAGA1_HUMAN)
SQRVRFFFPI

SEQ ID NO: 45902 - protein, 10 aa, Artificial Sequence
  Description of Artificial Sequence: Synthetic peptide
  Seed: VTKAEMLESV (MAGA1_HUMAN)
VLKAEMLESI

SEQ ID NO: 45903 - protein, 10 aa, Artificial Sequence
  Description of Artificial Sequence: Synthetic peptide
  Seed: KVADLVGFLL (MAGA1_HUMAN)
KNADLVGFLY

SEQ ID NO: 45904 - protein, 10 aa, Artificial Sequence
  Description of Artificial Sequence: Synthetic peptide
  Seed: YEFLWGPRAL (MAGA1_HUMAN)
YEFLWGPRAW

SEQ ID NO: 45905 - protein, 9 aa, Artificial Sequence
  Description of Artificial Sequence: Synthetic peptide
  Seed: RAREPVTKA (MAGA1_HUMAN)
RGREPVTKY

SEQ ID NO: 45906 - protein, 10 aa, Artificial Sequence
  Description of Artificial Sequence: Synthetic peptide
  Seed: EIFGKASESL (MAGA1_HUMAN)
EAFGKASESF

SEQ ID NO: 45907 - protein, 8 aa, Artificial Sequence
  Description of Artificial Sequence: Synthetic peptide
  Seed: VADLVGFL (MAGA1_HUMAN)
VADLVGFI

SEQ ID NO: 45908 - protein, 10 aa, Artificial Sequence
  Description of Artificial Sequence: Synthetic peptide
  Seed: VLVTCLGLSY (MAGA1_HUMAN)
VMVTCLGLSY

SEQ ID NO: 45909 - protein, 10 aa, Artificial Sequence
  Description of Artificial Sequence: Synthetic peptide
  Seed: SARVRFFFPS (MAGA1_HUMAN)
SVRVRFFFPI

SEQ ID NO: 45910 - protein, 9 aa, Artificial Sequence
  Description of Artificial Sequence: Synthetic peptide
  Seed: LESLFRAVI (MAGA1_HUMAN)
LQSLFRAVV

SEQ ID NO: 45911 - protein, 10 aa, Artificial Sequence
  Description of Artificial Sequence: Synthetic peptide
  Seed: SYVLVTCLGL (MAGA1_HUMAN)
SYVLVTCLGI

SEQ ID NO: 45912 - protein, 9 aa, Artificial Sequence
  Description of Artificial Sequence: Synthetic peptide
  Seed: QPSEGSSSR (MAGA1_HUMAN)
QVSEGSSSR

SEQ ID NO: 45913 - protein, 10 aa, Artificial Sequence
  Description of Artificial Sequence: Synthetic peptide
  Seed: SESLQLVFGI (MAGA1_HUMAN)
SRSLQLVFGW

SEQ ID NO: 45914 - protein, 9 aa, Artificial Sequence
  Description of Artificial Sequence: Synthetic peptide
  Seed: FFFPSLREA (MAGA1_HUMAN)
FGFPSLREI

SEQ ID NO: 45915 - protein, 10 aa, Artificial Sequence
  Description of Artificial Sequence: Synthetic peptide
  Seed: YEFLWGPRAL (MAGA1_HUMAN)
YHFLWGPRAF

SEQ ID NO: 45916 - protein, 9 aa, Artificial Sequence
  Description of Artificial Sequence: Synthetic peptide
  Seed: VQAATSSSS (MAGA1_HUMAN)
VHAATSSSF

SEQ ID NO: 45917 - protein, 9 aa, Artificial Sequence
  Description of Artificial Sequence: Synthetic peptide
  Seed: KKVADLVGF (MAGA1_HUMAN)
KQVADLVGY

SEQ ID NO: 45918 - protein, 9 aa, Artificial Sequence
  Description of Artificial Sequence: Synthetic peptide
  Seed: TGFLIIVLV (MAGA1_HUMAN)
TMFLIIVLI

SEQ ID NO: 45919 - protein, 10 aa, Artificial Sequence
  Description of Artificial Sequence: Synthetic peptide
  Seed: ARVRFFFPSL (MAGA1_HUMAN)
APVRFFFPSV

SEQ ID NO: 45920 - protein, 10 aa, Artificial Sequence
  Description of Artificial Sequence: Synthetic peptide
  Seed: KVADLVGFLL (MAGA1_HUMAN)
KMADLVGFLT

SEQ ID NO: 45921 - protein, 10 aa, Artificial Sequence
  Description of Artificial Sequence: Synthetic peptide
  Seed: REEEGPSTSC (MAGA1_HUMAN)
REEEGPSTSY

SEQ ID NO: 45922 - protein, 9 aa, Artificial Sequence
  Description of Artificial Sequence: Synthetic peptide
  Seed: AATSSSSPL (MAGA1_HUMAN)
AKTSSSSPI

SEQ ID NO: 45923 - protein, 9 aa, Artificial Sequence
  Description of Artificial Sequence: Synthetic peptide
  Seed: TSYVKVLEY (MAGA1_HUMAN)
THYVKVLEY

SEQ ID NO: 45924 - protein, 11 aa, Artificial Sequence
  Description of Artificial Sequence: Synthetic peptide
  Seed: RQVPDSDPARY (MAGA1_HUMAN)
RSVPDSDPARW

SEQ ID NO: 45925 - protein, 10 aa, Artificial Sequence
  Description of Artificial Sequence: Synthetic peptide
  Seed: SCILESLFRA (MAGA1_HUMAN)
SDILESLFRI

SEQ ID NO: 45926 - protein, 11 aa, Artificial Sequence
  Description of Artificial Sequence: Synthetic peptide
  Seed: KVADLVGFLLL (MAGA1_HUMAN)
KMADLVGFLLG

SEQ ID NO: 45927 - protein, 11 aa, Artificial Sequence
  Description of Artificial Sequence: Synthetic peptide
  Seed: VPDSDPARYEF (MAGA1_HUMAN)
VADSDPARYEI

SEQ ID NO: 45928 - protein, 9 aa, Artificial Sequence
  Description of Artificial Sequence: Synthetic peptide
  Seed: FPTTINFTR (MAGA1_HUMAN)
FATTINFTH

SEQ ID NO: 45929 - protein, 9 aa, Artificial Sequence
  Description of Artificial Sequence: Synthetic peptide
  Seed: IAMEGGHAP (MAGA1_HUMAN)
IGMEGGHAY

SEQ ID NO: 45930 - protein, 9 aa, Artificial Sequence
  Description of Artificial Sequence: Synthetic peptide
  Seed: RALAETSYV (MAGA1_HUMAN)
RMLAETSYV

SEQ ID NO: 45931 - protein, 11 aa, Artificial Sequence
  Description of Artificial Sequence: Synthetic peptide
  Seed: YVKVLEYVIKV (MAGA1_HUMAN)
YCKVLEYVIKV

SEQ ID NO: 45932 - protein, 9 aa, Artificial Sequence
  Description of Artificial Sequence: Synthetic peptide
  Seed: VYDGREHSA (MAGA1_HUMAN)
VIDGREHSF

SEQ ID NO: 45933 - protein, 9 aa, Artificial Sequence
  Description of Artificial Sequence: Synthetic peptide
  Seed: KVADLVGFL (MAGA1_HUMAN)
KAADLVGFY

SEQ ID NO: 45934 - protein, 9 aa, Artificial Sequence
  Description of Artificial Sequence: Synthetic peptide
  Seed: STDPPQSPQ (MAGA1_HUMAN)
STDPPQSPL

SEQ ID NO: 45935 - protein, 9 aa, Artificial Sequence
  Description of Artificial Sequence: Synthetic peptide
  Seed: SAFPTTINF (MAGA1_HUMAN)
SVFPTTINW

SEQ ID NO: 45936 - protein, 9 aa, Artificial Sequence
  Description of Artificial Sequence: Synthetic peptide
  Seed: FPTTINFTR (MAGA1_HUMAN)
FATTINFTR

SEQ ID NO: 45937 - protein, 10 aa, Artificial Sequence
  Description of Artificial Sequence: Synthetic peptide
  Seed: ADPTGHSYVL (MAGA1_HUMAN)
ANPTGHSYVL

SEQ ID NO: 45938 - protein, 9 aa, Artificial Sequence
  Description of Artificial Sequence: Synthetic peptide
  Seed: RALAETSYV (MAGA1_HUMAN)
RMLAETSYC

SEQ ID NO: 45939 - protein, 9 aa, Artificial Sequence
  Description of Artificial Sequence: Synthetic peptide
  Seed: LVLGTLEEV (MAGA1_HUMAN)
LPLGTLEEI

SEQ ID NO: 45940 - protein, 10 aa, Artificial Sequence
  Description of Artificial Sequence: Synthetic peptide
  Seed: KYRAREPVTK (MAGA1_HUMAN)
KFRAREPVTR

SEQ ID NO: 45941 - protein, 9 aa, Artificial Sequence
  Description of Artificial Sequence: Synthetic peptide
  Seed: REPVTKAEM (MAGA1_HUMAN)
RYPVTKAEF

SEQ ID NO: 45942 - protein, 9 aa, Artificial Sequence
  Description of Artificial Sequence: Synthetic peptide
  Seed: RAREPVTKA (MAGA1_HUMAN)
RRREPVTKV

SEQ ID NO: 45943 - protein, 9 aa, Artificial Sequence
  Description of Artificial Sequence: Synthetic peptide
  Seed: LKYRAREPV (MAGA1_HUMAN)
LGYRAREPY

SEQ ID NO: 45944 - protein, 9 aa, Artificial Sequence
  Description of Artificial Sequence: Synthetic peptide
  Seed: RQRQPSEGS (MAGA1_HUMAN)
RMRQPSEGK

SEQ ID NO: 45945 - protein, 9 aa, Artificial Sequence
  Description of Artificial Sequence: Synthetic peptide
  Seed: RAREPVTKA (MAGA1_HUMAN)
RTREPVTKN

SEQ ID NO: 45946 - protein, 10 aa, Artificial Sequence
  Description of Artificial Sequence: Synthetic peptide
  Seed: KVADLVGFLL (MAGA1_HUMAN)
KTADLVGFLY

SEQ ID NO: 45947 - protein, 9 aa, Artificial Sequence
  Description of Artificial Sequence: Synthetic peptide
  Seed: YVIKVSARV (MAGA1_HUMAN)
YAIKVSARV

SEQ ID NO: 45948 - protein, 9 aa, Artificial Sequence
  Description of Artificial Sequence: Synthetic peptide
  Seed: VADLVGFLL (MAGA1_HUMAN)
VLDLVGFLL

SEQ ID NO: 45949 - protein, 9 aa, Artificial Sequence
  Description of Artificial Sequence: Synthetic peptide
  Seed: LVQEKYLEY (MAGA1_HUMAN)
LTQEKYLEW

SEQ ID NO: 45950 - protein, 10 aa, Artificial Sequence
  Description of Artificial Sequence: Synthetic peptide
  Seed: LEAQQEALGL (MAGA1_HUMAN)
LEAQQEALGW

SEQ ID NO: 45951 - protein, 11 aa, Artificial Sequence
  Description of Artificial Sequence: Synthetic peptide
  Seed: FGKASESLQLV (MAGA1_HUMAN)
FMKASESLQLV

SEQ ID NO: 45952 - protein, 10 aa, Artificial Sequence
  Description of Artificial Sequence: Synthetic peptide
  Seed: RVRFFFPSLR (MAGA1_HUMAN)
RTRFFFPSLV

SEQ ID NO: 45953 - protein, 9 aa, Artificial Sequence
  Description of Artificial Sequence: Synthetic peptide
  Seed: RVRFFFPSL (MAGA1_HUMAN)
RHRFFFPSR

SEQ ID NO: 45954 - protein, 9 aa, Artificial Sequence
  Description of Artificial Sequence: Synthetic peptide
  Seed: TQDLVQEKY (MAGA1_HUMAN)
TADLVQEKL

SEQ ID NO: 45955 - protein, 9 aa, Artificial Sequence
  Description of Artificial Sequence: Synthetic peptide
  Seed: EADPTGHSY (MAGA1_HUMAN)
ETDPTGHSV

SEQ ID NO: 45956 - protein, 10 aa, Artificial Sequence
  Description of Artificial Sequence: Synthetic peptide
  Seed: SARVRFFFPS (MAGA1_HUMAN)
SFRVRFFFPV

SEQ ID NO: 45957 - protein, 9 aa, Artificial Sequence
  Description of Artificial Sequence: Synthetic peptide
  Seed: QDLVQEKYL (MAGA1_HUMAN)
QELVQEKYV

SEQ ID NO: 45958 - protein, 9 aa, Artificial Sequence
  Description of Artificial Sequence: Synthetic peptide
  Seed: KYRAREPVT (MAGA1_HUMAN)
KSRAREPVL

SEQ ID NO: 45959 - protein, 9 aa, Artificial Sequence
  Description of Artificial Sequence: Synthetic peptide
  Seed: ETSYVKVLE (MAGA1_HUMAN)
EMSYVKVLR

SEQ ID NO: 45960 - protein, 9 aa, Artificial Sequence
  Description of Artificial Sequence: Synthetic peptide
  Seed: KVLEYVIKV (MAGA1_HUMAN)
KSLEYVIKK

SEQ ID NO: 45961 - protein, 9 aa, Artificial Sequence
  Description of Artificial Sequence: Synthetic peptide
  Seed: GLVCVQAAT (MAGA1_HUMAN)
GQVCVQAAV

SEQ ID NO: 45962 - protein, 9 aa, Artificial Sequence
  Description of Artificial Sequence: Synthetic peptide
  Seed: RQVPDSDPA (MAGA1_HUMAN)
RVVPDSDPI

SEQ ID NO: 45963 - protein, 10 aa, Artificial Sequence
  Description of Artificial Sequence: Synthetic peptide
  Seed: EADPTGHSYV (MAGA1_HUMAN)
EIDPTGHSYL

SEQ ID NO: 45964 - protein, 10 aa, Artificial Sequence
  Description of Artificial Sequence: Synthetic peptide
  Seed: WEELSVMEVY (MAGA1_HUMAN)
WMELSVMEVW

SEQ ID NO: 45965 - protein, 9 aa, Artificial Sequence
  Description of Artificial Sequence: Synthetic peptide
  Seed: EIWEELSVM (MAGA1_HUMAN)
ETWEELSVW

SEQ ID NO: 45966 - protein, 9 aa, Artificial Sequence
  Description of Artificial Sequence: Synthetic peptide
  Seed: EYVIKVSAR (MAGA1_HUMAN)
ETVIKVSAY

SEQ ID NO: 45967 - protein, 9 aa, Artificial Sequence
  Description of Artificial Sequence: Synthetic peptide
  Seed: YVIKVSARV (MAGA1_HUMAN)
YAIKVSARI

SEQ ID NO: 45968 - protein, 10 aa, Artificial Sequence
  Description of Artificial Sequence: Synthetic peptide
  Seed: KKVADLVGFL (MAGA1_HUMAN)
KKVADLVGFV

SEQ ID NO: 45969 - protein, 9 aa, Artificial Sequence
  Description of Artificial Sequence: Synthetic peptide
  Seed: EADPTGHSY (MAGA1_HUMAN)
EFDPTGHSF

SEQ ID NO: 45970 - protein, 9 aa, Artificial Sequence
  Description of Artificial Sequence: Synthetic peptide
  Seed: TSSSSPLVL (MAGA1_HUMAN)
TSSSSPLVW

SEQ ID NO: 45971 - protein, 10 aa, Artificial Sequence
  Description of Artificial Sequence: Synthetic peptide
  Seed: EYVIKVSARV (MAGA1_HUMAN)
ELVIKVSARV

SEQ ID NO: 45972 - protein, 10 aa, Artificial Sequence
  Description of Artificial Sequence: Synthetic peptide
  Seed: WEELSVMEVY (MAGA1_HUMAN)
WIELSVMEVW

SEQ ID NO: 45973 - protein, 9 aa, Artificial Sequence
  Description of Artificial Sequence: Synthetic peptide
  Seed: SARVRFFFP (MAGA1_HUMAN)
SSRVRFFFF

SEQ ID NO: 45974 - protein, 9 aa, Artificial Sequence
  Description of Artificial Sequence: Synthetic peptide
  Seed: VGFLLLKYR (MAGA1_HUMAN)
VTFLLLKYK

SEQ ID NO: 45975 - protein, 9 aa, Artificial Sequence
  Description of Artificial Sequence: Synthetic peptide
  Seed: STDPPQSPQ (MAGA1_HUMAN)
SWDPPQSPL

SEQ ID NO: 45976 - protein, 9 aa, Artificial Sequence
  Description of Artificial Sequence: Synthetic peptide
  Seed: VIKNYKHCF (MAGA1_HUMAN)
VFKNYKHCY

SEQ ID NO: 45977 - protein, 9 aa, Artificial Sequence
  Description of Artificial Sequence: Synthetic peptide
  Seed: RAREPVTKA (MAGA1_HUMAN)
RIREPVTKL

SEQ ID NO: 45978 - protein, 9 aa, Artificial Sequence
  Description of Artificial Sequence: Synthetic peptide
  Seed: EADPTGHSY (MAGA1_HUMAN)
EVDPTGHSR

SEQ ID NO: 45979 - protein, 9 aa, Artificial Sequence
  Description of Artificial Sequence: Synthetic peptide
  Seed: RVRFFFPSL (MAGA1_HUMAN)
RARFFFPSA

SEQ ID NO: 45980 - protein, 10 aa, Artificial Sequence
  Description of Artificial Sequence: Synthetic peptide
  Seed: LTQDLVQEKY (MAGA1_HUMAN)
LAQDLVQEKY

SEQ ID NO: 45981 - protein, 10 aa, Artificial Sequence
  Description of Artificial Sequence: Synthetic peptide
  Seed: SARVRFFFPS (MAGA1_HUMAN)
SCRVRFFFPF

SEQ ID NO: 45982 - protein, 9 aa, Artificial Sequence
  Description of Artificial Sequence: Synthetic peptide
  Seed: RVRFFFPSL (MAGA1_HUMAN)
RHRFFFPSM

SEQ ID NO: 45983 - protein, 8 aa, Artificial Sequence
  Description of Artificial Sequence: Synthetic peptide
  Seed: FLWGPRAL (MAGA1_HUMAN)
FYWGPRAV

SEQ ID NO: 45984 - protein, 10 aa, Artificial Sequence
  Description of Artificial Sequence: Synthetic peptide
  Seed: KVSARVRFFF (MAGA1_HUMAN)
KQSARVRFFK

SEQ ID NO: 45985 - protein, 9 aa, Artificial Sequence
  Description of Artificial Sequence: Synthetic peptide
  Seed: KVADLVGFL (MAGA1_HUMAN)
KVADLVGFT

SEQ ID NO: 45986 - protein, 9 aa, Artificial Sequence
  Description of Artificial Sequence: Synthetic peptide
  Seed: TSSSSPLVL (MAGA1_HUMAN)
TMSSSPLVM

SEQ ID NO: 45987 - protein, 11 aa, Artificial Sequence
  Description of Artificial Sequence: Synthetic peptide
  Seed: RVRFFFPSLRE (MAGA1_HUMAN)
RVRFFFPSLRV

SEQ ID NO: 45988 - protein, 11 aa, Artificial Sequence
  Description of Artificial Sequence: Synthetic peptide
  Seed: RVRFFFPSLRE (MAGA1_HUMAN)
RYRFFFPSLRV

SEQ ID NO: 45989 - protein, 10 aa, Artificial Sequence
  Description of Artificial Sequence: Synthetic peptide
  Seed: SLFRAVITKK (MAGA1_HUMAN)
SNFRAVITKR

SEQ ID NO: 45990 - protein, 10 aa, Artificial Sequence
  Description of Artificial Sequence: Synthetic peptide
  Seed: SCILESLFRA (MAGA1_HUMAN)
SKILESLFRI

SEQ ID NO: 45991 - protein, 9 aa, Artificial Sequence
  Description of Artificial Sequence: Synthetic peptide
  Seed: DPTGHSYVL (MAGA1_HUMAN)
DVTGHSYVY

SEQ ID NO: 45992 - protein, 9 aa, Artificial Sequence
  Description of Artificial Sequence: Synthetic peptide
  Seed: RAREPVTKA (MAGA1_HUMAN)
RSREPVTKS

SEQ ID NO: 45993 - protein, 9 aa, Artificial Sequence
  Description of Artificial Sequence: Synthetic peptide
  Seed: STDPPQSPQ (MAGA1_HUMAN)
SLDPPQSPL

SEQ ID NO: 45994 - protein, 10 aa, Artificial Sequence
  Description of Artificial Sequence: Synthetic peptide
  Seed: KNYKHCFPEI (MAGA1_HUMAN)
KRYKHCFPEF

SEQ ID NO: 45995 - protein, 10 aa, Artificial Sequence
  Description of Artificial Sequence: Synthetic peptide
  Seed: SCILESLFRA (MAGA1_HUMAN)
SMILESLFRI

SEQ ID NO: 45996 - protein, 9 aa, Artificial Sequence
  Description of Artificial Sequence: Synthetic peptide
  Seed: KASESLQLV (MAGA1_HUMAN)
KVSESLQLM

SEQ ID NO: 45997 - protein, 11 aa, Artificial Sequence
  Description of Artificial Sequence: Synthetic peptide
  Seed: KVADLVGFLLL (MAGA1_HUMAN)
KMADLVGFLLR

SEQ ID NO: 45998 - protein, 9 aa, Artificial Sequence
  Description of Artificial Sequence: Synthetic peptide
  Seed: LVQEKYLEY (MAGA1_HUMAN)
LVQEKYLER

SEQ ID NO: 45999 - protein, 9 aa, Artificial Sequence
  Description of Artificial Sequence: Synthetic peptide
  Seed: STSCILESL (MAGA1_HUMAN)
SRSCILESF

SEQ ID NO: 46000 - protein, 10 aa, Artificial Sequence
  Description of Artificial Sequence: Synthetic peptide
  Seed: EVYDGREHSA (MAGA1_HUMAN)
EVYDGREHSI

SEQ ID NO: 46001 - protein, 9 aa, Artificial Sequence
  Description of Artificial Sequence: Synthetic peptide
  Seed: SAFPTTINF (MAGA1_HUMAN)
SYFPTTINR

SEQ ID NO: 46002 - protein, 9 aa, Artificial Sequence
  Description of Artificial Sequence: Synthetic peptide
  Seed: KASESLQLV (MAGA1_HUMAN)
KFSESLQLK

SEQ ID NO: 46003 - protein, 9 aa, Artificial Sequence
  Description of Artificial Sequence: Synthetic peptide
  Seed: VQEKYLEYR (MAGA1_HUMAN)
VLEKYLEYY

SEQ ID NO: 46004 - protein, 10 aa, Artificial Sequence
  Description of Artificial Sequence: Synthetic peptide
  Seed: RVRFFFPSLR (MAGA1_HUMAN)
RLRFFFPSLI

SEQ ID NO: 46005 - protein, 9 aa, Artificial Sequence
  Description of Artificial Sequence: Synthetic peptide
  Seed: GASAFPTTI (MAGA1_HUMAN)
GTSAFPTTV

SEQ ID NO: 46006 - protein, 11 aa, Artificial Sequence
  Description of Artificial Sequence: Synthetic peptide
  Seed: YEFLWGPRALA (MAGA1_HUMAN)
YTFLWGPRALV

SEQ ID NO: 46007 - protein, 11 aa, Artificial Sequence
  Description of Artificial Sequence: Synthetic peptide
  Seed: KVADLVGFLLL (MAGA1_HUMAN)
KMADLVGFLLW

SEQ ID NO: 46008 - protein, 9 aa, Artificial Sequence
  Description of Artificial Sequence: Synthetic peptide
  Seed: LVQEKYLEY (MAGA1_HUMAN)
LAQEKYLEY

SEQ ID NO: 46009 - protein, 10 aa, Artificial Sequence
  Description of Artificial Sequence: Synthetic peptide
  Seed: SARVRFFFPS (MAGA1_HUMAN)
SDRVRFFFPV

SEQ ID NO: 46010 - protein, 11 aa, Artificial Sequence
  Description of Artificial Sequence: Synthetic peptide
  Seed: RVRFFFPSLRE (MAGA1_HUMAN)
RTRFFFPSLRC

SEQ ID NO: 46011 - protein, 11 aa, Artificial Sequence
  Description of Artificial Sequence: Synthetic peptide
  Seed: ALAETSYVKVL (MAGA1_HUMAN)
ALAETSYVKVV

SEQ ID NO: 46012 - protein, 10 aa, Artificial Sequence
  Description of Artificial Sequence: Synthetic peptide
  Seed: LLKYRAREPV (MAGA1_HUMAN)
LLKYRAREPL

SEQ ID NO: 46013 - protein, 9 aa, Artificial Sequence
  Description of Artificial Sequence: Synthetic peptide
  Seed: FPSLREAAL (MAGA1_HUMAN)
FMSLREAAI

SEQ ID NO: 46014 - protein, 9 aa, Artificial Sequence
  Description of Artificial Sequence: Synthetic peptide
  Seed: RALAETSYV (MAGA1_HUMAN)
RMLAETSYM

SEQ ID NO: 46015 - protein, 10 aa, Artificial Sequence
  Description of Artificial Sequence: Synthetic peptide
  Seed: ADPTGHSYVL (MAGA1_HUMAN)
AKPTGHSYVM

SEQ ID NO: 46016 - protein, 9 aa, Artificial Sequence
  Description of Artificial Sequence: Synthetic peptide
  Seed: IAMEGGHAP (MAGA1_HUMAN)
IMMEGGHAY

SEQ ID NO: 46017 - protein, 10 aa, Artificial Sequence
  Description of Artificial Sequence: Synthetic peptide
  Seed: RVRFFFPSLR (MAGA1_HUMAN)
RQRFFFPSLY

SEQ ID NO: 46018 - protein, 9 aa, Artificial Sequence
  Description of Artificial Sequence: Synthetic peptide
  Seed: YRAREPVTK (MAGA1_HUMAN)
YYAREPVTM

SEQ ID NO: 46019 - protein, 9 aa, Artificial Sequence
  Description of Artificial Sequence: Synthetic peptide
  Seed: SSPLVLGTL (MAGA1_HUMAN)
SQPLVLGTV

SEQ ID NO: 46020 - protein, 9 aa, Artificial Sequence
  Description of Artificial Sequence: Synthetic peptide
  Seed: YKHCFPEIF (MAGA1_HUMAN)
YGHCFPEIY

SEQ ID NO: 46021 - protein, 11 aa, Artificial Sequence
  Description of Artificial Sequence: Synthetic peptide
  Seed: GLLGDNQIMPK (MAGA1_HUMAN)
GSLGDNQIMPK

SEQ ID NO: 46022 - protein, 10 aa, Artificial Sequence
  Description of Artificial Sequence: Synthetic peptide
  Seed: KASESLQLVF (MAGA1_HUMAN)
KMSESLQLVW

SEQ ID NO: 46023 - protein, 9 aa, Artificial Sequence
  Description of Artificial Sequence: Synthetic peptide
  Seed: YKHCFPEIF (MAGA1_HUMAN)
YYHCFPEIL

SEQ ID NO: 46024 - protein, 10 aa, Artificial Sequence
  Description of Artificial Sequence: Synthetic peptide
  Seed: SARVRFFFPS (MAGA1_HUMAN)
SQRVRFFFPR

SEQ ID NO: 46025 - protein, 10 aa, Artificial Sequence
  Description of Artificial Sequence: Synthetic peptide
  Seed: KVADLVGFLL (MAGA1_HUMAN)
KIADLVGFLL

SEQ ID NO: 46026 - protein, 9 aa, Artificial Sequence
  Description of Artificial Sequence: Synthetic peptide
  Seed: SARVRFFFP (MAGA1_HUMAN)
SYRVRFFFS

SEQ ID NO: 46027 - protein, 11 aa, Artificial Sequence
  Description of Artificial Sequence: Synthetic peptide
  Seed: KVSARVRFFFP (MAGA1_HUMAN)
KDSARVRFFFK

SEQ ID NO: 46028 - protein, 11 aa, Artificial Sequence
  Description of Artificial Sequence: Synthetic peptide
  Seed: YVKVLEYVIKV (MAGA1_HUMAN)
YMKVLEYVIKM

SEQ ID NO: 46029 - protein, 10 aa, Artificial Sequence
  Description of Artificial Sequence: Synthetic peptide
  Seed: REEEGPSTSC (MAGA1_HUMAN)
REEEGPSTSW

SEQ ID NO: 46030 - protein, 10 aa, Artificial Sequence
  Description of Artificial Sequence: Synthetic peptide
  Seed: SVIKNYKHCF (MAGA1_HUMAN)
SSIKNYKHCW

SEQ ID NO: 46031 - protein, 10 aa, Artificial Sequence
  Description of Artificial Sequence: Synthetic peptide
  Seed: MLESVIKNYK (MAGA1_HUMAN)
MSESVIKNYY

SEQ ID NO: 46032 - protein, 9 aa, Artificial Sequence
  Description of Artificial Sequence: Synthetic peptide
  Seed: CILESLFRA (MAGA1_HUMAN)
CTLESLFRL

SEQ ID NO: 46033 - protein, 9 aa, Artificial Sequence
  Description of Artificial Sequence: Synthetic peptide
  Seed: AYGEPRKLL (MAGA1_HUMAN)
AAGEPRKLL

SEQ ID NO: 46034 - protein, 10 aa, Artificial Sequence
  Description of Artificial Sequence: Synthetic peptide
  Seed: ASAFPTTINF (MAGA1_HUMAN)
AMAFPTTINY

SEQ ID NO: 46035 - protein, 10 aa, Artificial Sequence
  Description of Artificial Sequence: Synthetic peptide
  Seed: KVADLVGFLL (MAGA1_HUMAN)
KDADLVGFLW

SEQ ID NO: 46036 - protein, 9 aa, Artificial Sequence
  Description of Artificial Sequence: Synthetic peptide
  Seed: QIMPKTGFL (MAGA1_HUMAN)
QMMPKTGFI

SEQ ID NO: 46037 - protein, 9 aa, Artificial Sequence
  Description of Artificial Sequence: Synthetic peptide
  Seed: RAREPVTKA (MAGA1_HUMAN)
RAREPVTKF

SEQ ID NO: 46038 - protein, 9 aa, Artificial Sequence
  Description of Artificial Sequence: Synthetic peptide
  Seed: LKYRAREPV (MAGA1_HUMAN)
LAYRAREPY

SEQ ID NO: 46039 - protein, 11 aa, Artificial Sequence
  Description of Artificial Sequence: Synthetic peptide
  Seed: CILESLFRAVI (MAGA1_HUMAN)
CLLESLFRAVI

SEQ ID NO: 46040 - protein, 10 aa, Artificial Sequence
  Description of Artificial Sequence: Synthetic peptide
  Seed: TSYVKVLEYV (MAGA1_HUMAN)
TAYVKVLEYV

SEQ ID NO: 46041 - protein, 9 aa, Artificial Sequence
  Description of Artificial Sequence: Synthetic peptide
  Seed: TSYVKVLEY (MAGA1_HUMAN)
TRYVKVLEL

SEQ ID NO: 46042 - protein, 9 aa, Artificial Sequence
  Description of Artificial Sequence: Synthetic peptide
  Seed: VQAATSSSS (MAGA1_HUMAN)
VMAATSSSY

SEQ ID NO: 46043 - protein, 9 aa, Artificial Sequence
  Description of Artificial Sequence: Synthetic peptide
  Seed: ARVRFFFPS (MAGA1_HUMAN)
AQVRFFFPM

SEQ ID NO: 46044 - protein, 10 aa, Artificial Sequence
  Description of Artificial Sequence: Synthetic peptide
  Seed: ARYEFLWGPR (MAGA1_HUMAN)
ASYEFLWGPK

SEQ ID NO: 46045 - protein, 9 aa, Artificial Sequence
  Description of Artificial Sequence: Synthetic peptide
  Seed: EADPTGHSY (MAGA1_HUMAN)
EYDPTGHSI

SEQ ID NO: 46046 - protein, 10 aa, Artificial Sequence
  Description of Artificial Sequence: Synthetic peptide
  Seed: RVRFFFPSLR (MAGA1_HUMAN)
RSRFFFPSLL

SEQ ID NO: 46047 - protein, 9 aa, Artificial Sequence
  Description of Artificial Sequence: Synthetic peptide
  Seed: RVRFFFPSL (MAGA1_HUMAN)
RYRFFFPSM

SEQ ID NO: 46048 - protein, 10 aa, Artificial Sequence
  Description of Artificial Sequence: Synthetic peptide
  Seed: TSYVKVLEYV (MAGA1_HUMAN)
TDYVKVLEYI

SEQ ID NO: 46049 - protein, 9 aa, Artificial Sequence
  Description of Artificial Sequence: Synthetic peptide
  Seed: LVTCLGLSY (MAGA1_HUMAN)
LITCLGLSY

SEQ ID NO: 46050 - protein, 8 aa, Artificial Sequence
  Description of Artificial Sequence: Synthetic peptide
  Seed: FFPSLREA (MAGA1_HUMAN)
FYPSLREY

SEQ ID NO: 46051 - protein, 9 aa, Artificial Sequence
  Description of Artificial Sequence: Synthetic peptide
  Seed: SARVRFFFP (MAGA1_HUMAN)
SVRVRFFFA

SEQ ID NO: 46052 - protein, 10 aa, Artificial Sequence
  Description of Artificial Sequence: Synthetic peptide
  Seed: LVFGIDVKEA (MAGA1_HUMAN)
LLFGIDVKEI

SEQ ID NO: 46053 - protein, 11 aa, Artificial Sequence
  Description of Artificial Sequence: Synthetic peptide
  Seed: FPTTINFTRQR (MAGA1_HUMAN)
FMTTINFTRQR

SEQ ID NO: 46054 - protein, 9 aa, Artificial Sequence
  Description of Artificial Sequence: Synthetic peptide
  Seed: IFGKASESL (MAGA1_HUMAN)
IFGKASESF

SEQ ID NO: 46055 - protein, 8 aa, Artificial Sequence
  Description of Artificial Sequence: Synthetic peptide
  Seed: RVRFFFPS (MAGA1_HUMAN)
RSRFFFPF

SEQ ID NO: 46056 - protein, 8 aa, Artificial Sequence
  Description of Artificial Sequence: Synthetic peptide
  Seed: ASAFPTTI (MAGA1_HUMAN)
ASAFPTTL

SEQ ID NO: 46057 - protein, 9 aa, Artificial Sequence
  Description of Artificial Sequence: Synthetic peptide
  Seed: YVIKVSARV (MAGA1_HUMAN)
YLIKVSARA

SEQ ID NO: 46058 - protein, 8 aa, Artificial Sequence
  Description of Artificial Sequence: Synthetic peptide
  Seed: FLWGPRAL (MAGA1_HUMAN)
FMWGPRAM

SEQ ID NO: 46059 - protein, 9 aa, Artificial Sequence
  Description of Artificial Sequence: Synthetic peptide
  Seed: FPSLREAAL (MAGA1_HUMAN)
FPSLREAAV

SEQ ID NO: 46060 - protein, 9 aa, Artificial Sequence
  Description of Artificial Sequence: Synthetic peptide
  Seed: KASESLQLV (MAGA1_HUMAN)
KSSESLQLK

SEQ ID NO: 46061 - protein, 9 aa, Artificial Sequence
  Description of Artificial Sequence: Synthetic peptide
  Seed: HCFPEIFGK (MAGA1_HUMAN)
HMFPEIFGM

SEQ ID NO: 46062 - protein, 9 aa, Artificial Sequence
  Description of Artificial Sequence: Synthetic peptide
  Seed: FFFPSLREA (MAGA1_HUMAN)
FHFPSLREL

SEQ ID NO: 46063 - protein, 11 aa, Artificial Sequence
  Description of Artificial Sequence: Synthetic peptide
  Seed: RALAETSYVKV (MAGA1_HUMAN)
RMLAETSYVKV

SEQ ID NO: 46064 - protein, 10 aa, Artificial Sequence
  Description of Artificial Sequence: Synthetic peptide
  Seed: QVPDSDPARY (MAGA1_HUMAN)
QMPDSDPARY

SEQ ID NO: 46065 - protein, 9 aa, Artificial Sequence
  Description of Artificial Sequence: Synthetic peptide
  Seed: CILESLFRA (MAGA1_HUMAN)
CVLESLFRV

SEQ ID NO: 46066 - protein, 8 aa, Artificial Sequence
  Description of Artificial Sequence: Synthetic peptide
  Seed: VADLVGFL (MAGA1_HUMAN)
VIDLVGFL

SEQ ID NO: 46067 - protein, 9 aa, Artificial Sequence
  Description of Artificial Sequence: Synthetic peptide
  Seed: FFPSLREAA (MAGA1_HUMAN)
FMPSLREAF

SEQ ID NO: 46068 - protein, 9 aa, Artificial Sequence
  Description of Artificial Sequence: Synthetic peptide
  Seed: LVQEKYLEY (MAGA1_HUMAN)
LPQEKYLEY

SEQ ID NO: 46069 - protein, 10 aa, Artificial Sequence
  Description of Artificial Sequence: Synthetic peptide
  Seed: KVADLVGFLL (MAGA1_HUMAN)
KIADLVGFLA

SEQ ID NO: 46070 - protein, 9 aa, Artificial Sequence
  Description of Artificial Sequence: Synthetic peptide
  Seed: RVRFFFPSL (MAGA1_HUMAN)
RGRFFFPSV

SEQ ID NO: 46071 - protein, 11 aa, Artificial Sequence
  Description of Artificial Sequence: Synthetic peptide
  Seed: YEFLWGPRALA (MAGA1_HUMAN)
YKFLWGPRALL

SEQ ID NO: 46072 - protein, 9 aa, Artificial Sequence
  Description of Artificial Sequence: Synthetic peptide
  Seed: LVQEKYLEY (MAGA1_HUMAN)
LTQEKYLEF

SEQ ID NO: 46073 - protein, 9 aa, Artificial Sequence
  Description of Artificial Sequence: Synthetic peptide
  Seed: KVSARVRFF (MAGA1_HUMAN)
KSSARVRFV

SEQ ID NO: 46074 - protein, 10 aa, Artificial Sequence
  Description of Artificial Sequence: Synthetic peptide
  Seed: KEADPTGHSY (MAGA1_HUMAN)
KEADPTGHSI

SEQ ID NO: 46075 - protein, 9 aa, Artificial Sequence
  Description of Artificial Sequence: Synthetic peptide
  Seed: STSCILESL (MAGA1_HUMAN)
SISCILESV

SEQ ID NO: 46076 - protein, 9 aa, Artificial Sequence
  Description of Artificial Sequence: Synthetic peptide
  Seed: FFFPSLREA (MAGA1_HUMAN)
FRFPSLREF

SEQ ID NO: 46077 - protein, 9 aa, Artificial Sequence
  Description of Artificial Sequence: Synthetic peptide
  Seed: GPRALAETS (MAGA1_HUMAN)
GPRALAETF

SEQ ID NO: 46078 - protein, 10 aa, Artificial Sequence
  Description of Artificial Sequence: Synthetic peptide
  Seed: KKVADLVGFL (MAGA1_HUMAN)
KRVADLVGFV

SEQ ID NO: 46079 - protein, 9 aa, Artificial Sequence
  Description of Artificial Sequence: Synthetic peptide
  Seed: ASESLQLVF (MAGA1_HUMAN)
AMESLQLVM

SEQ ID NO: 46080 - protein, 10 aa, Artificial Sequence
  Description of Artificial Sequence: Synthetic peptide
  Seed: KTGFLIIVLV (MAGA1_HUMAN)
KMGFLIIVLV

SEQ ID NO: 46081 - protein, 9 aa, Artificial Sequence
  Description of Artificial Sequence: Synthetic peptide
  Seed: VADLVGFLL (MAGA1_HUMAN)
VPDLVGFLY

SEQ ID NO: 46082 - protein, 9 aa, Artificial Sequence
  Description of Artificial Sequence: Synthetic peptide
  Seed: GLLGDNQIM (MAGA1_HUMAN)
GQLGDNQIF

SEQ ID NO: 46083 - protein, 9 aa, Artificial Sequence
  Description of Artificial Sequence: Synthetic peptide
  Seed: KVLEYVIKV (MAGA1_HUMAN)
KILEYVIKW

SEQ ID NO: 46084 - protein, 9 aa, Artificial Sequence
  Description of Artificial Sequence: Synthetic peptide
  Seed: EIWEELSVM (MAGA1_HUMAN)
EQWEELSVF

SEQ ID NO: 46085 - protein, 9 aa, Artificial Sequence
  Description of Artificial Sequence: Synthetic peptide
  Seed: FFPSLREAA (MAGA1_HUMAN)
FLPSLREAL

SEQ ID NO: 46086 - protein, 10 aa, Artificial Sequence
  Description of Artificial Sequence: Synthetic peptide
  Seed: RVRFFFPSLR (MAGA1_HUMAN)
RIRFFFPSLY

SEQ ID NO: 46087 - protein, 10 aa, Artificial Sequence
  Description of Artificial Sequence: Synthetic peptide
  Seed: KEADPTGHSY (MAGA1_HUMAN)
KGADPTGHSF

SEQ ID NO: 46088 - protein, 10 aa, Artificial Sequence
  Description of Artificial Sequence: Synthetic peptide
  Seed: VLVTCLGLSY (MAGA1_HUMAN)
VVVTCLGLSY

SEQ ID NO: 46089 - protein, 11 aa, Artificial Sequence
  Description of Artificial Sequence: Synthetic peptide
  Seed: VPDSDPARYEF (MAGA1_HUMAN)
VADSDPARYEL

SEQ ID NO: 46090 - protein, 9 aa, Artificial Sequence
  Description of Artificial Sequence: Synthetic peptide
  Seed: FPTTINFTR (MAGA1_HUMAN)
FPTTINFTH

SEQ ID NO: 46091 - protein, 9 aa, Artificial Sequence
  Description of Artificial Sequence: Synthetic peptide
  Seed: KVADLVGFL (MAGA1_HUMAN)
KQADLVGFY

SEQ ID NO: 46092 - protein, 11 aa, Artificial Sequence
  Description of Artificial Sequence: Synthetic peptide
  Seed: DLVGFLLLKYR (MAGA1_HUMAN)
DTVGFLLLKYK

SEQ ID NO: 46093 - protein, 9 aa, Artificial Sequence
  Description of Artificial Sequence: Synthetic peptide
  Seed: NQIMPKTGF (MAGA1_HUMAN)
NLIMPKTGY

SEQ ID NO: 46094 - protein, 9 aa, Artificial Sequence
  Description of Artificial Sequence: Synthetic peptide
  Seed: LKYRAREPV (MAGA1_HUMAN)
LLYRAREPY

SEQ ID NO: 46095 - protein, 9 aa, Artificial Sequence
  Description of Artificial Sequence: Synthetic peptide
  Seed: VYDGREHSA (MAGA1_HUMAN)
VQDGREHSM

SEQ ID NO: 46096 - protein, 9 aa, Artificial Sequence
  Description of Artificial Sequence: Synthetic peptide
  Seed: FLWGPRALA (MAGA1_HUMAN)
FLWGPRALS

SEQ ID NO: 46097 - protein, 11 aa, Artificial Sequence
  Description of Artificial Sequence: Synthetic peptide
  Seed: RVRFFFPSLRE (MAGA1_HUMAN)
RTRFFFPSLRA

SEQ ID NO: 46098 - protein, 9 aa, Artificial Sequence
  Description of Artificial Sequence: Synthetic peptide
  Seed: KVLEYVIKV (MAGA1_HUMAN)
KALEYVIKI

SEQ ID NO: 46099 - protein, 9 aa, Artificial Sequence
  Description of Artificial Sequence: Synthetic peptide
  Seed: NQIMPKTGF (MAGA1_HUMAN)
NHIMPKTGY

SEQ ID NO: 46100 - protein, 10 aa, Artificial Sequence
  Description of Artificial Sequence: Synthetic peptide
  Seed: SSSPLVLGTL (MAGA1_HUMAN)
SASPLVLGTV

SEQ ID NO: 46101 - protein, 11 aa, Artificial Sequence
  Description of Artificial Sequence: Synthetic peptide
  Seed: YVKVLEYVIKV (MAGA1_HUMAN)
YQKVLEYVIKV

SEQ ID NO: 46102 - protein, 9 aa, Artificial Sequence
  Description of Artificial Sequence: Synthetic peptide
  Seed: RAREPVTKA (MAGA1_HUMAN)
RQREPVTKY

SEQ ID NO: 46103 - protein, 9 aa, Artificial Sequence
  Description of Artificial Sequence: Synthetic peptide
  Seed: LVTCLGLSY (MAGA1_HUMAN)
LSTCLGLSF

SEQ ID NO: 46104 - protein, 9 aa, Artificial Sequence
  Description of Artificial Sequence: Synthetic peptide
  Seed: EADPTGHSY (MAGA1_HUMAN)
ESDPTGHSV

SEQ ID NO: 46105 - protein, 9 aa, Artificial Sequence
  Description of Artificial Sequence: Synthetic peptide
  Seed: MPKTGFLII (MAGA1_HUMAN)
MPKTGFLIV

SEQ ID NO: 46106 - protein, 9 aa, Artificial Sequence
  Description of Artificial Sequence: Synthetic peptide
  Seed: SAYGEPRKL (MAGA1_HUMAN)
SHYGEPRKL

SEQ ID NO: 46107 - protein, 10 aa, Artificial Sequence
  Description of Artificial Sequence: Synthetic peptide
  Seed: EMLESVIKNY (MAGA1_HUMAN)
EILESVIKNY

SEQ ID NO: 46108 - protein, 10 aa, Artificial Sequence
  Description of Artificial Sequence: Synthetic peptide
  Seed: YEFLWGPRAL (MAGA1_HUMAN)
YLFLWGPRAL

SEQ ID NO: 46109 - protein, 10 aa, Artificial Sequence
  Description of Artificial Sequence: Synthetic peptide
  Seed: RAREPVTKAE (MAGA1_HUMAN)
RTREPVTKAS

SEQ ID NO: 46110 - protein, 11 aa, Artificial Sequence
  Description of Artificial Sequence: Synthetic peptide
  Seed: FLWGPRALAET (MAGA1_HUMAN)
FVWGPRALAEL

SEQ ID NO: 46111 - protein, 10 aa, Artificial Sequence
  Description of Artificial Sequence: Synthetic peptide
  Seed: KEADPTGHSY (MAGA1_HUMAN)
KEADPTGHSS

SEQ ID NO: 46112 - protein, 11 aa, Artificial Sequence
  Description of Artificial Sequence: Synthetic peptide
  Seed: FFFPSLREAAL (MAGA1_HUMAN)
FYFPSLREAAL

SEQ ID NO: 46113 - protein, 9 aa, Artificial Sequence
  Description of Artificial Sequence: Synthetic peptide
  Seed: RVRFFFPSL (MAGA1_HUMAN)
RGRFFFPSY

SEQ ID NO: 46114 - protein, 9 aa, Artificial Sequence
  Description of Artificial Sequence: Synthetic peptide
  Seed: SARVRFFFP (MAGA1_HUMAN)
STRVRFFFK

SEQ ID NO: 46115 - protein, 9 aa, Artificial Sequence
  Description of Artificial Sequence: Synthetic peptide
  Seed: VYDGREHSA (MAGA1_HUMAN)
VADGREHSV

SEQ ID NO: 46116 - protein, 9 aa, Artificial Sequence
  Description of Artificial Sequence: Synthetic peptide
  Seed: KVSARVRFF (MAGA1_HUMAN)
KVSARVRFI

SEQ ID NO: 46117 - protein, 9 aa, Artificial Sequence
  Description of Artificial Sequence: Synthetic peptide
  Seed: VSARVRFFF (MAGA1_HUMAN)
VAARVRFFM

SEQ ID NO: 46118 - protein, 9 aa, Artificial Sequence
  Description of Artificial Sequence: Synthetic peptide
  Seed: SLFRAVITK (MAGA1_HUMAN)
SVFRAVITY

SEQ ID NO: 46119 - protein, 9 aa, Artificial Sequence
  Description of Artificial Sequence: Synthetic peptide
  Seed: KASESLQLV (MAGA1_HUMAN)
KVSESLQLA

SEQ ID NO: 46120 - protein, 9 aa, Artificial Sequence
  Description of Artificial Sequence: Synthetic peptide
  Seed: KVLEYVIKV (MAGA1_HUMAN)
KVLEYVIKW

SEQ ID NO: 46121 - protein, 10 aa, Artificial Sequence
  Description of Artificial Sequence: Synthetic peptide
  Seed: KVADLVGFLL (MAGA1_HUMAN)
KQADLVGFLI

SEQ ID NO: 46122 - protein, 9 aa, Artificial Sequence
  Description of Artificial Sequence: Synthetic peptide
  Seed: KYRAREPVT (MAGA1_HUMAN)
KMRAREPVY

SEQ ID NO: 46123 - protein, 9 aa, Artificial Sequence
  Description of Artificial Sequence: Synthetic peptide
  Seed: SAFPTTINF (MAGA1_HUMAN)
SSFPTTINW

SEQ ID NO: 46124 - protein, 8 aa, Artificial Sequence
  Description of Artificial Sequence: Synthetic peptide
  Seed: YKHCFPEI (MAGA1_HUMAN)
YQHCFPEI

SEQ ID NO: 46125 - protein, 9 aa, Artificial Sequence
  Description of Artificial Sequence: Synthetic peptide
  Seed: FLWGPRALA (MAGA1_HUMAN)
FSWGPRALV

SEQ ID NO: 46126 - protein, 9 aa, Artificial Sequence
  Description of Artificial Sequence: Synthetic peptide
  Seed: KASESLQLV (MAGA1_HUMAN)
KMSESLQLI

SEQ ID NO: 46127 - protein, 9 aa, Artificial Sequence
  Description of Artificial Sequence: Synthetic peptide
  Seed: HCFPEIFGK (MAGA1_HUMAN)
HAFPEIFGY

SEQ ID NO: 46128 - protein, 9 aa, Artificial Sequence
  Description of Artificial Sequence: Synthetic peptide
  Seed: GASAFPTTI (MAGA1_HUMAN)
GLSAFPTTV

SEQ ID NO: 46129 - protein, 10 aa, Artificial Sequence
  Description of Artificial Sequence: Synthetic peptide
  Seed: LEYVIKVSAR (MAGA1_HUMAN)
LFYVIKVSAR

SEQ ID NO: 46130 - protein, 10 aa, Artificial Sequence
  Description of Artificial Sequence: Synthetic peptide
  Seed: FFPSLREAAL (MAGA1_HUMAN)
FHPSLREAAF

SEQ ID NO: 46131 - protein, 10 aa, Artificial Sequence
  Description of Artificial Sequence: Synthetic peptide
  Seed: EADPTGHSYV (MAGA1_HUMAN)
EADPTGHSYL

SEQ ID NO: 46132 - protein, 9 aa, Artificial Sequence
  Description of Artificial Sequence: Synthetic peptide
  Seed: TSSSSPLVL (MAGA1_HUMAN)
TYSSSPLVM

SEQ ID NO: 46133 - protein, 10 aa, Artificial Sequence
  Description of Artificial Sequence: Synthetic peptide
  Seed: YEFLWGPRAL (MAGA1_HUMAN)
YWFLWGPRAW

SEQ ID NO: 46134 - protein, 9 aa, Artificial Sequence
  Description of Artificial Sequence: Synthetic peptide
  Seed: REPVTKAEM (MAGA1_HUMAN)
RKPVTKAEY

SEQ ID NO: 46135 - protein, 10 aa, Artificial Sequence
  Description of Artificial Sequence: Synthetic peptide
  Seed: AQQEALGLVC (MAGA1_HUMAN)
AMQEALGLVW

SEQ ID NO: 46136 - protein, 9 aa, Artificial Sequence
  Description of Artificial Sequence: Synthetic peptide
  Seed: KASESLQLV (MAGA1_HUMAN)
KISESLQLM

SEQ ID NO: 46137 - protein, 9 aa, Artificial Sequence
  Description of Artificial Sequence: Synthetic peptide
  Seed: CILESLFRA (MAGA1_HUMAN)
CVLESLFRI

SEQ ID NO: 46138 - protein, 9 aa, Artificial Sequence
  Description of Artificial Sequence: Synthetic peptide
  Seed: SYVKVLEYV (MAGA1_HUMAN)
SRVKVLEYI

SEQ ID NO: 46139 - protein, 9 aa, Artificial Sequence
  Description of Artificial Sequence: Synthetic peptide
  Seed: AYGEPRKLL (MAGA1_HUMAN)
AAGEPRKLF

SEQ ID NO: 46140 - protein, 9 aa, Artificial Sequence
  Description of Artificial Sequence: Synthetic peptide
  Seed: EIWEELSVM (MAGA1_HUMAN)
EVWEELSVW

SEQ ID NO: 46141 - protein, 10 aa, Artificial Sequence
  Description of Artificial Sequence: Synthetic peptide
  Seed: LTQDLVQEKY (MAGA1_HUMAN)
LYQDLVQEKY

SEQ ID NO: 46142 - protein, 9 aa, Artificial Sequence
  Description of Artificial Sequence: Synthetic peptide
  Seed: EADPTGHSY (MAGA1_HUMAN)
ETDPTGHSW

SEQ ID NO: 46143 - protein, 10 aa, Artificial Sequence
  Description of Artificial Sequence: Synthetic peptide
  Seed: ARVRFFFPSL (MAGA1_HUMAN)
AHVRFFFPSA

SEQ ID NO: 46144 - protein, 9 aa, Artificial Sequence
  Description of Artificial Sequence: Synthetic peptide
  Seed: FFPSLREAA (MAGA1_HUMAN)
FMPSLREAL

SEQ ID NO: 46145 - protein, 10 aa, Artificial Sequence
  Description of Artificial Sequence: Synthetic peptide
  Seed: TSCILESLFR (MAGA1_HUMAN)
TTCILESLFR

SEQ ID NO: 46146 - protein, 9 aa, Artificial Sequence
  Description of Artificial Sequence: Synthetic peptide
  Seed: LKYRAREPV (MAGA1_HUMAN)
LMYRAREPI

SEQ ID NO: 46147 - protein, 10 aa, Artificial Sequence
  Description of Artificial Sequence: Synthetic peptide
  Seed: SARVRFFFPS (MAGA1_HUMAN)
SIRVRFFFPR

SEQ ID NO: 46148 - protein, 9 aa, Artificial Sequence
  Description of Artificial Sequence: Synthetic peptide
  Seed: FPTTINFTR (MAGA1_HUMAN)
FPTTINFTQ

SEQ ID NO: 46149 - protein, 10 aa, Artificial Sequence
  Description of Artificial Sequence: Synthetic peptide
  Seed: SAFPTTINFT (MAGA1_HUMAN)
SAFPTTINFI

SEQ ID NO: 46150 - protein, 9 aa, Artificial Sequence
  Description of Artificial Sequence: Synthetic peptide
  Seed: EIWEELSVM (MAGA1_HUMAN)
ELWEELSVY

SEQ ID NO: 46151 - protein, 9 aa, Artificial Sequence
  Description of Artificial Sequence: Synthetic peptide
  Seed: AATSSSSPL (MAGA1_HUMAN)
AYTSSSSPI

SEQ ID NO: 46152 - protein, 9 aa, Artificial Sequence
  Description of Artificial Sequence: Synthetic peptide
  Seed: LESLFRAVI (MAGA1_HUMAN)
LHSLFRAVM

SEQ ID NO: 46153 - protein, 10 aa, Artificial Sequence
  Description of Artificial Sequence: Synthetic peptide
  Seed: KTGFLIIVLV (MAGA1_HUMAN)
KLGFLIIVLI

SEQ ID NO: 46154 - protein, 9 aa, Artificial Sequence
  Description of Artificial Sequence: Synthetic peptide
  Seed: ITKKVADLV (MAGA1_HUMAN)
IMKKVADLW

SEQ ID NO: 46155 - protein, 9 aa, Artificial Sequence
  Description of Artificial Sequence: Synthetic peptide
  Seed: VYDGREHSA (MAGA1_HUMAN)
VSDGREHSL

SEQ ID NO: 46156 - protein, 9 aa, Artificial Sequence
  Description of Artificial Sequence: Synthetic peptide
  Seed: HSAYGEPRK (MAGA1_HUMAN)
HSAYGEPRR

SEQ ID NO: 46157 - protein, 9 aa, Artificial Sequence
  Description of Artificial Sequence: Synthetic peptide
  Seed: EIWEELSVM (MAGA1_HUMAN)
ETWEELSVF

SEQ ID NO: 46158 - protein, 10 aa, Artificial Sequence
  Description of Artificial Sequence: Synthetic peptide
  Seed: KHCFPEIFGK (MAGA1_HUMAN)
KICFPEIFGR

SEQ ID NO: 46159 - protein, 9 aa, Artificial Sequence
  Description of Artificial Sequence: Synthetic peptide
  Seed: RAREPVTKA (MAGA1_HUMAN)
RSREPVTKF

SEQ ID NO: 46160 - protein, 9 aa, Artificial Sequence
  Description of Artificial Sequence: Synthetic peptide
  Seed: FPTTINFTR (MAGA1_HUMAN)
FVTTINFTF

SEQ ID NO: 46161 - protein, 10 aa, Artificial Sequence
  Description of Artificial Sequence: Synthetic peptide
  Seed: WEELSVMEVY (MAGA1_HUMAN)
WYELSVMEVW

SEQ ID NO: 46162 - protein, 11 aa, Artificial Sequence
  Description of Artificial Sequence: Synthetic peptide
  Seed: KVADLVGFLLL (MAGA1_HUMAN)
KMADLVGFLLV

SEQ ID NO: 46163 - protein, 11 aa, Artificial Sequence
  Description of Artificial Sequence: Synthetic peptide
  Seed: KLLTQDLVQEK (MAGA1_HUMAN)
KMLTQDLVQER

SEQ ID NO: 46164 - protein, 10 aa, Artificial Sequence
  Description of Artificial Sequence: Synthetic peptide
  Seed: ESLFRAVITK (MAGA1_HUMAN)
EDLFRAVITR

SEQ ID NO: 46165 - protein, 9 aa, Artificial Sequence
  Description of Artificial Sequence: Synthetic peptide
  Seed: STDPPQSPQ (MAGA1_HUMAN)
SMDPPQSPM

SEQ ID NO: 46166 - protein, 9 aa, Artificial Sequence
  Description of Artificial Sequence: Synthetic peptide
  Seed: FFFPSLREA (MAGA1_HUMAN)
FFFPSLREM

SEQ ID NO: 46167 - protein, 9 aa, Artificial Sequence
  Description of Artificial Sequence: Synthetic peptide
  Seed: SYVKVLEYV (MAGA1_HUMAN)
SVVKVLEYI

SEQ ID NO: 46168 - protein, 10 aa, Artificial Sequence
  Description of Artificial Sequence: Synthetic peptide
  Seed: SARVRFFFPS (MAGA1_HUMAN)
SIRVRFFFPM

SEQ ID NO: 46169 - protein, 9 aa, Artificial Sequence
  Description of Artificial Sequence: Synthetic peptide
  Seed: SAFPTTINF (MAGA1_HUMAN)
SEFPTTINI

SEQ ID NO: 46170 - protein, 9 aa, Artificial Sequence
  Description of Artificial Sequence: Synthetic peptide
  Seed: LVTCLGLSY (MAGA1_HUMAN)
LTTCLGLSM

SEQ ID NO: 46171 - protein, 9 aa, Artificial Sequence
  Description of Artificial Sequence: Synthetic peptide
  Seed: RALAETSYV (MAGA1_HUMAN)
RYLAETSYY

SEQ ID NO: 46172 - protein, 9 aa, Artificial Sequence
  Description of Artificial Sequence: Synthetic peptide
  Seed: SCILESLFR (MAGA1_HUMAN)
SIILESLFR

SEQ ID NO: 46173 - protein, 9 aa, Artificial Sequence
  Description of Artificial Sequence: Synthetic peptide
  Seed: EADPTGHSY (MAGA1_HUMAN)
EPDPTGHSI

SEQ ID NO: 46174 - protein, 9 aa, Artificial Sequence
  Description of Artificial Sequence: Synthetic peptide
  Seed: HSYVLVTCL (MAGA1_HUMAN)
HAYVLVTCV

SEQ ID NO: 46175 - protein, 9 aa, Artificial Sequence
  Description of Artificial Sequence: Synthetic peptide
  Seed: FRAVITKKV (MAGA1_HUMAN)
FRAVITKKF

SEQ ID NO: 46176 - protein, 11 aa, Artificial Sequence
  Description of Artificial Sequence: Synthetic peptide
  Seed: RQVPDSDPARY (MAGA1_HUMAN)
REVPDSDPARL

SEQ ID NO: 46177 - protein, 9 aa, Artificial Sequence
  Description of Artificial Sequence: Synthetic peptide
  Seed: RAREPVTKA (MAGA1_HUMAN)
RAREPVTKL

SEQ ID NO: 46178 - protein, 10 aa, Artificial Sequence
  Description of Artificial Sequence: Synthetic peptide
  Seed: EVYDGREHSA (MAGA1_HUMAN)
EAYDGREHSF

SEQ ID NO: 46179 - protein, 9 aa, Artificial Sequence
  Description of Artificial Sequence: Synthetic peptide
  Seed: RVRFFFPSL (MAGA1_HUMAN)
RYRFFFPSG

SEQ ID NO: 46180 - protein, 11 aa, Artificial Sequence
  Description of Artificial Sequence: Synthetic peptide
  Seed: TKKVADLVGFL (MAGA1_HUMAN)
TEKVADLVGFV

SEQ ID NO: 46181 - protein, 9 aa, Artificial Sequence
  Description of Artificial Sequence: Synthetic peptide
  Seed: FFFPSLREA (MAGA1_HUMAN)
FQFPSLREC

SEQ ID NO: 46182 - protein, 10 aa, Artificial Sequence
  Description of Artificial Sequence: Synthetic peptide
  Seed: RAREPVTKAE (MAGA1_HUMAN)
RTREPVTKAA

SEQ ID NO: 46183 - protein, 9 aa, Artificial Sequence
  Description of Artificial Sequence: Synthetic peptide
  Seed: LVLGTLEEV (MAGA1_HUMAN)
LTLGTLEEY

SEQ ID NO: 46184 - protein, 10 aa, Artificial Sequence
  Description of Artificial Sequence: Synthetic peptide
  Seed: WEELSVMEVY (MAGA1_HUMAN)
WQELSVMEVF

SEQ ID NO: 46185 - protein, 9 aa, Artificial Sequence
  Description of Artificial Sequence: Synthetic peptide
  Seed: SAFPTTINF (MAGA1_HUMAN)
SIFPTTINW

SEQ ID NO: 46186 - protein, 9 aa, Artificial Sequence
  Description of Artificial Sequence: Synthetic peptide
  Seed: ADLVGFLLL (MAGA1_HUMAN)
AELVGFLLI

SEQ ID NO: 46187 - protein, 10 aa, Artificial Sequence
  Description of Artificial Sequence: Synthetic peptide
  Seed: SARVRFFFPS (MAGA1_HUMAN)
SRRVRFFFPK

SEQ ID NO: 46188 - protein, 9 aa, Artificial Sequence
  Description of Artificial Sequence: Synthetic peptide
  Seed: YRAREPVTK (MAGA1_HUMAN)
YRAREPVTI

SEQ ID NO: 46189 - protein, 10 aa, Artificial Sequence
  Description of Artificial Sequence: Synthetic peptide
  Seed: TTINFTRQRQ (MAGA1_HUMAN)
TMINFTRQRR

SEQ ID NO: 46190 - protein, 10 aa, Artificial Sequence
  Description of Artificial Sequence: Synthetic peptide
  Seed: IMPKTGFLII (MAGA1_HUMAN)
IYPKTGFLIW

SEQ ID NO: 46191 - protein, 9 aa, Artificial Sequence
  Description of Artificial Sequence: Synthetic peptide
  Seed: KVSARVRFF (MAGA1_HUMAN)
KSSARVRFS

SEQ ID NO: 46192 - protein, 10 aa, Artificial Sequence
  Description of Artificial Sequence: Synthetic peptide
  Seed: SSSPLVLGTL (MAGA1_HUMAN)
SISPLVLGTI

SEQ ID NO: 46193 - protein, 10 aa, Artificial Sequence
  Description of Artificial Sequence: Synthetic peptide
  Seed: KEADPTGHSY (MAGA1_HUMAN)
KAADPTGHSM

SEQ ID NO: 46194 - protein, 11 aa, Artificial Sequence
  Description of Artificial Sequence: Synthetic peptide
  Seed: ARVRFFFPSLR (MAGA1_HUMAN)
ARVRFFFPSLM

SEQ ID NO: 46195 - protein, 10 aa, Artificial Sequence
  Description of Artificial Sequence: Synthetic peptide
  Seed: FLWGPRALAE (MAGA1_HUMAN)
FLWGPRALAT

SEQ ID NO: 46196 - protein, 9 aa, Artificial Sequence
  Description of Artificial Sequence: Synthetic peptide
  Seed: SARVRFFFP (MAGA1_HUMAN)
SQRVRFFFY

SEQ ID NO: 46197 - protein, 11 aa, Artificial Sequence
  Description of Artificial Sequence: Synthetic peptide
  Seed: AEMLESVIKNY (MAGA1_HUMAN)
AEMLESVIKNM

SEQ ID NO: 46198 - protein, 9 aa, Artificial Sequence
  Description of Artificial Sequence: Synthetic peptide
  Seed: RVRFFFPSL (MAGA1_HUMAN)
RLRFFFPSC

SEQ ID NO: 46199 - protein, 9 aa, Artificial Sequence
  Description of Artificial Sequence: Synthetic peptide
  Seed: HCFPEIFGK (MAGA1_HUMAN)
HQFPEIFGR

SEQ ID NO: 46200 - protein, 10 aa, Artificial Sequence
  Description of Artificial Sequence: Synthetic peptide
  Seed: VYDGREHSAY (MAGA1_HUMAN)
VFDGREHSAF

SEQ ID NO: 46201 - protein, 11 aa, Artificial Sequence
  Description of Artificial Sequence: Synthetic peptide
  Seed: SARVRFFFPSL (MAGA1_HUMAN)
SLRVRFFFPSK

SEQ ID NO: 46202 - protein, 11 aa, Artificial Sequence
  Description of Artificial Sequence: Synthetic peptide
  Seed: KYRAREPVTKA (MAGA1_HUMAN)
KYRAREPVTKK

SEQ ID NO: 46203 - protein, 10 aa, Artificial Sequence
  Description of Artificial Sequence: Synthetic peptide
  Seed: LVGFLLLKYR (MAGA1_HUMAN)
LIGFLLLKYR

SEQ ID NO: 46204 - protein, 9 aa, Artificial Sequence
  Description of Artificial Sequence: Synthetic peptide
  Seed: SARVRFFFP (MAGA1_HUMAN)
SIRVRFFFS

SEQ ID NO: 46205 - protein, 10 aa, Artificial Sequence
  Description of Artificial Sequence: Synthetic peptide
  Seed: TSYVKVLEYV (MAGA1_HUMAN)
TGYVKVLEYI

SEQ ID NO: 46206 - protein, 9 aa, Artificial Sequence
  Description of Artificial Sequence: Synthetic peptide
  Seed: CILESLFRA (MAGA1_HUMAN)
CALESLFRV

SEQ ID NO: 46207 - protein, 11 aa, Artificial Sequence
  Description of Artificial Sequence: Synthetic peptide
  Seed: RQVPDSDPARY (MAGA1_HUMAN)
RMVPDSDPARR

SEQ ID NO: 46208 - protein, 9 aa, Artificial Sequence
  Description of Artificial Sequence: Synthetic peptide
  Seed: RALAETSYV (MAGA1_HUMAN)
RGLAETSYY

SEQ ID NO: 46209 - protein, 10 aa, Artificial Sequence
  Description of Artificial Sequence: Synthetic peptide
  Seed: SVIKNYKHCF (MAGA1_HUMAN)
SQIKNYKHCY

SEQ ID NO: 46210 - protein, 9 aa, Artificial Sequence
  Description of Artificial Sequence: Synthetic peptide
  Seed: SYVKVLEYV (MAGA1_HUMAN)
SVVKVLEYM

SEQ ID NO: 46211 - protein, 9 aa, Artificial Sequence
  Description of Artificial Sequence: Synthetic peptide
  Seed: TSYVKVLEY (MAGA1_HUMAN)
TMYVKVLEM

SEQ ID NO: 46212 - protein, 11 aa, Artificial Sequence
  Description of Artificial Sequence: Synthetic peptide
  Seed: FLWGPRALAET (MAGA1_HUMAN)
FMWGPRALAEV

SEQ ID NO: 46213 - protein, 9 aa, Artificial Sequence
  Description of Artificial Sequence: Synthetic peptide
  Seed: LVQEKYLEY (MAGA1_HUMAN)
LKQEKYLEM

SEQ ID NO: 46214 - protein, 10 aa, Artificial Sequence
  Description of Artificial Sequence: Synthetic peptide
  Seed: PLVLGTLEEV (MAGA1_HUMAN)
PYVLGTLEEV

SEQ ID NO: 46215 - protein, 10 aa, Artificial Sequence
  Description of Artificial Sequence: Synthetic peptide
  Seed: WEELSVMEVY (MAGA1_HUMAN)
WHELSVMEVW

SEQ ID NO: 46216 - protein, 9 aa, Artificial Sequence
  Description of Artificial Sequence: Synthetic peptide
  Seed: ATSSSSPLV (MAGA1_HUMAN)
ASSSSSPLW

SEQ ID NO: 46217 - protein, 9 aa, Artificial Sequence
  Description of Artificial Sequence: Synthetic peptide
  Seed: SCILESLFR (MAGA1_HUMAN)
SAILESLFR

SEQ ID NO: 46218 - protein, 9 aa, Artificial Sequence
  Description of Artificial Sequence: Synthetic peptide
  Seed: MPKTGFLII (MAGA1_HUMAN)
MPKTGFLIA

SEQ ID NO: 46219 - protein, 10 aa, Artificial Sequence
  Description of Artificial Sequence: Synthetic peptide
  Seed: YEFLWGPRAL (MAGA1_HUMAN)
YEFLWGPRAP

SEQ ID NO: 46220 - protein, 9 aa, Artificial Sequence
  Description of Artificial Sequence: Synthetic peptide
  Seed: SSPLVLGTL (MAGA1_HUMAN)
SAPLVLGTM

SEQ ID NO: 46221 - protein, 10 aa, Artificial Sequence
  Description of Artificial Sequence: Synthetic peptide
  Seed: SSSPLVLGTL (MAGA1_HUMAN)
SVSPLVLGTV

SEQ ID NO: 46222 - protein, 10 aa, Artificial Sequence
  Description of Artificial Sequence: Synthetic peptide
  Seed: EALEAQQEAL (MAGA1_HUMAN)
ETLEAQQEAW

SEQ ID NO: 46223 - protein, 9 aa, Artificial Sequence
  Description of Artificial Sequence: Synthetic peptide
  Seed: FPSLREAAL (MAGA1_HUMAN)
FQSLREAAF

SEQ ID NO: 46224 - protein, 11 aa, Artificial Sequence
  Description of Artificial Sequence: Synthetic peptide
  Seed: KVSARVRFFFP (MAGA1_HUMAN)
KASARVRFFFK

SEQ ID NO: 46225 - protein, 9 aa, Artificial Sequence
  Description of Artificial Sequence: Synthetic peptide
  Seed: KVLEYVIKV (MAGA1_HUMAN)
KGLEYVIKL

SEQ ID NO: 46226 - protein, 9 aa, Artificial Sequence
  Description of Artificial Sequence: Synthetic peptide
  Seed: ARYEFLWGP (MAGA1_HUMAN)
ARYEFLWGF

SEQ ID NO: 46227 - protein, 9 aa, Artificial Sequence
  Description of Artificial Sequence: Synthetic peptide
  Seed: SVMEVYDGR (MAGA1_HUMAN)
SLMEVYDGK

SEQ ID NO: 46228 - protein, 10 aa, Artificial Sequence
  Description of Artificial Sequence: Synthetic peptide
  Seed: SARVRFFFPS (MAGA1_HUMAN)
SCRVRFFFPI

SEQ ID NO: 46229 - protein, 10 aa, Artificial Sequence
  Description of Artificial Sequence: Synthetic peptide
  Seed: ATSSSSPLVL (MAGA1_HUMAN)
AASSSSPLVY

SEQ ID NO: 46230 - protein, 9 aa, Artificial Sequence
  Description of Artificial Sequence: Synthetic peptide
  Seed: VYDGREHSA (MAGA1_HUMAN)
VLDGREHSF

SEQ ID NO: 46231 - protein, 9 aa, Artificial Sequence
  Description of Artificial Sequence: Synthetic peptide
  Seed: VRFFFPSLR (MAGA1_HUMAN)
VTFFFPSLR

SEQ ID NO: 46232 - protein, 11 aa, Artificial Sequence
  Description of Artificial Sequence: Synthetic peptide
  Seed: RQVPDSDPARY (MAGA1_HUMAN)
RGVPDSDPARW

SEQ ID NO: 46233 - protein, 9 aa, Artificial Sequence
  Description of Artificial Sequence: Synthetic peptide
  Seed: TSYVKVLEY (MAGA1_HUMAN)
TWYVKVLEM

SEQ ID NO: 46234 - protein, 9 aa, Artificial Sequence
  Description of Artificial Sequence: Synthetic peptide
  Seed: AETSYVKVL (MAGA1_HUMAN)
AETSYVKVM

SEQ ID NO: 46235 - protein, 10 aa, Artificial Sequence
  Description of Artificial Sequence: Synthetic peptide
  Seed: ETSYVKVLEY (MAGA1_HUMAN)
EMSYVKVLEF

SEQ ID NO: 46236 - protein, 10 aa, Artificial Sequence
  Description of Artificial Sequence: Synthetic peptide
  Seed: FLWGPRALAE (MAGA1_HUMAN)
FMWGPRALAS

SEQ ID NO: 46237 - protein, 10 aa, Artificial Sequence
  Description of Artificial Sequence: Synthetic peptide
  Seed: IMPKTGFLII (MAGA1_HUMAN)
IFPKTGFLIL

SEQ ID NO: 46238 - protein, 9 aa, Artificial Sequence
  Description of Artificial Sequence: Synthetic peptide
  Seed: LFRAVITKK (MAGA1_HUMAN)
LSRAVITKV

SEQ ID NO: 46239 - protein, 9 aa, Artificial Sequence
  Description of Artificial Sequence: Synthetic peptide
  Seed: EADPTGHSY (MAGA1_HUMAN)
EIDPTGHSM

SEQ ID NO: 46240 - protein, 10 aa, Artificial Sequence
  Description of Artificial Sequence: Synthetic peptide
  Seed: KVADLVGFLL (MAGA1_HUMAN)
KTADLVGFLF

SEQ ID NO: 46241 - protein, 11 aa, Artificial Sequence
  Description of Artificial Sequence: Synthetic peptide
  Seed: EMLESVIKNYK (MAGA1_HUMAN)
EMLESVIKNYR

SEQ ID NO: 46242 - protein, 10 aa, Artificial Sequence
  Description of Artificial Sequence: Synthetic peptide
  Seed: SAFPTTINFT (MAGA1_HUMAN)
SLFPTTINFL

SEQ ID NO: 46243 - protein, 9 aa, Artificial Sequence
  Description of Artificial Sequence: Synthetic peptide
  Seed: SAYGEPRKL (MAGA1_HUMAN)
SRYGEPRKI

SEQ ID NO: 46244 - protein, 10 aa, Artificial Sequence
  Description of Artificial Sequence: Synthetic peptide
  Seed: KEADPTGHSY (MAGA1_HUMAN)
KIADPTGHSR

SEQ ID NO: 46245 - protein, 11 aa, Artificial Sequence
  Description of Artificial Sequence: Synthetic peptide
  Seed: KVSARVRFFFP (MAGA1_HUMAN)
KVSARVRFFFA

SEQ ID NO: 46246 - protein, 9 aa, Artificial Sequence
  Description of Artificial Sequence: Synthetic peptide
  Seed: RAREPVTKA (MAGA1_HUMAN)
RNREPVTKK

SEQ ID NO: 46247 - protein, 9 aa, Artificial Sequence
  Description of Artificial Sequence: Synthetic peptide
  Seed: KVADLVGFL (MAGA1_HUMAN)
KMADLVGFT

SEQ ID NO: 46248 - protein, 10 aa, Artificial Sequence
  Description of Artificial Sequence: Synthetic peptide
  Seed: EVYDGREHSA (MAGA1_HUMAN)
ETYDGREHSI

SEQ ID NO: 46249 - protein, 9 aa, Artificial Sequence
  Description of Artificial Sequence: Synthetic peptide
  Seed: YRAREPVTK (MAGA1_HUMAN)
YRAREPVTY

SEQ ID NO: 46250 - protein, 11 aa, Artificial Sequence
  Description of Artificial Sequence: Synthetic peptide
  Seed: ETSYVKVLEYV (MAGA1_HUMAN)
EISYVKVLEYV

SEQ ID NO: 46251 - protein, 9 aa, Artificial Sequence
  Description of Artificial Sequence: Synthetic peptide
  Seed: SAFPTTINF (MAGA1_HUMAN)
SCFPTTINW

SEQ ID NO: 46252 - protein, 9 aa, Artificial Sequence
  Description of Artificial Sequence: Synthetic peptide
  Seed: KVADLVGFL (MAGA1_HUMAN)
KLADLVGFT

SEQ ID NO: 46253 - protein, 10 aa, Artificial Sequence
  Description of Artificial Sequence: Synthetic peptide
  Seed: KEADPTGHSY (MAGA1_HUMAN)
KAADPTGHSH

SEQ ID NO: 46254 - protein, 10 aa, Artificial Sequence
  Description of Artificial Sequence: Synthetic peptide
  Seed: ADPTGHSYVL (MAGA1_HUMAN)
ADPTGHSYVM

SEQ ID NO: 46255 - protein, 9 aa, Artificial Sequence
  Description of Artificial Sequence: Synthetic peptide
  Seed: KASESLQLV (MAGA1_HUMAN)
KQSESLQLY

SEQ ID NO: 46256 - protein, 10 aa, Artificial Sequence
  Description of Artificial Sequence: Synthetic peptide
  Seed: RVRFFFPSLR (MAGA1_HUMAN)
RERFFFPSLM

SEQ ID NO: 46257 - protein, 9 aa, Artificial Sequence
  Description of Artificial Sequence: Synthetic peptide
  Seed: SAFPTTINF (MAGA1_HUMAN)
SRFPTTINL

SEQ ID NO: 46258 - protein, 9 aa, Artificial Sequence
  Description of Artificial Sequence: Synthetic peptide
  Seed: SAYGEPRKL (MAGA1_HUMAN)
SSYGEPRKF

SEQ ID NO: 46259 - protein, 9 aa, Artificial Sequence
  Description of Artificial Sequence: Synthetic peptide
  Seed: AATSSSSPL (MAGA1_HUMAN)
ALTSSSSPL

SEQ ID NO: 46260 - protein, 11 aa, Artificial Sequence
  Description of Artificial Sequence: Synthetic peptide
  Seed: RVRFFFPSLRE (MAGA1_HUMAN)
RMRFFFPSLRH

SEQ ID NO: 46261 - protein, 10 aa, Artificial Sequence
  Description of Artificial Sequence: Synthetic peptide
  Seed: SDPARYEFLW (MAGA1_HUMAN)
SGPARYEFLW

SEQ ID NO: 46262 - protein, 9 aa, Artificial Sequence
  Description of Artificial Sequence: Synthetic peptide
  Seed: SAFPTTINF (MAGA1_HUMAN)
SYFPTTINV

SEQ ID NO: 46263 - protein, 9 aa, Artificial Sequence
  Description of Artificial Sequence: Synthetic peptide
  Seed: IMPKTGFLI (MAGA1_HUMAN)
IFPKTGFLW

SEQ ID NO: 46264 - protein, 10 aa, Artificial Sequence
  Description of Artificial Sequence: Synthetic peptide
  Seed: RVRFFFPSLR (MAGA1_HUMAN)
RWRFFFPSLL

SEQ ID NO: 46265 - protein, 9 aa, Artificial Sequence
  Description of Artificial Sequence: Synthetic peptide
  Seed: EADPTGHSY (MAGA1_HUMAN)
EMDPTGHSI

SEQ ID NO: 46266 - protein, 10 aa, Artificial Sequence
  Description of Artificial Sequence: Synthetic peptide
  Seed: FFPSLREAAL (MAGA1_HUMAN)
FSPSLREAAL

SEQ ID NO: 46267 - protein, 9 aa, Artificial Sequence
  Description of Artificial Sequence: Synthetic peptide
  Seed: GASAFPTTI (MAGA1_HUMAN)
GGSAFPTTY

SEQ ID NO: 46268 - protein, 10 aa, Artificial Sequence
  Description of Artificial Sequence: Synthetic peptide
  Seed: SARVRFFFPS (MAGA1_HUMAN)
SSRVRFFFPR

SEQ ID NO: 46269 - protein, 9 aa, Artificial Sequence
  Description of Artificial Sequence: Synthetic peptide
  Seed: CILESLFRA (MAGA1_HUMAN)
CMLESLFRT

SEQ ID NO: 46270 - protein, 11 aa, Artificial Sequence
  Description of Artificial Sequence: Synthetic peptide
  Seed: YEFLWGPRALA (MAGA1_HUMAN)
YCFLWGPRALV

SEQ ID NO: 46271 - protein, 10 aa, Artificial Sequence
  Description of Artificial Sequence: Synthetic peptide
  Seed: EIFGKASESL (MAGA1_HUMAN)
ETFGKASESK

SEQ ID NO: 46272 - protein, 9 aa, Artificial Sequence
  Description of Artificial Sequence: Synthetic peptide
  Seed: STDPPQSPQ (MAGA1_HUMAN)
SGDPPQSPF

SEQ ID NO: 46273 - protein, 10 aa, Artificial Sequence
  Description of Artificial Sequence: Synthetic peptide
  Seed: RYEFLWGPRA (MAGA1_HUMAN)
RGEFLWGPRL

SEQ ID NO: 46274 - protein, 10 aa, Artificial Sequence
  Description of Artificial Sequence: Synthetic peptide
  Seed: KVADLVGFLL (MAGA1_HUMAN)
KVADLVGFLR

SEQ ID NO: 46275 - protein, 10 aa, Artificial Sequence
  Description of Artificial Sequence: Synthetic peptide
  Seed: ALAETSYVKV (MAGA1_HUMAN)
AMAETSYVKA

SEQ ID NO: 46276 - protein, 10 aa, Artificial Sequence
  Description of Artificial Sequence: Synthetic peptide
  Seed: KVADLVGFLL (MAGA1_HUMAN)
KSADLVGFLK

SEQ ID NO: 46277 - protein, 9 aa, Artificial Sequence
  Description of Artificial Sequence: Synthetic peptide
  Seed: STSCILESL (MAGA1_HUMAN)
SSSCILESI

SEQ ID NO: 46278 - protein, 11 aa, Artificial Sequence
  Description of Artificial Sequence: Synthetic peptide
  Seed: KVLEYVIKVSA (MAGA1_HUMAN)
KQLEYVIKVSI

SEQ ID NO: 46279 - protein, 10 aa, Artificial Sequence
  Description of Artificial Sequence: Synthetic peptide
  Seed: RAREPVTKAE (MAGA1_HUMAN)
RMREPVTKAA

SEQ ID NO: 46280 - protein, 9 aa, Artificial Sequence
  Description of Artificial Sequence: Synthetic peptide
  Seed: RQVPDSDPA (MAGA1_HUMAN)
RSVPDSDPF

SEQ ID NO: 46281 - protein, 9 aa, Artificial Sequence
  Description of Artificial Sequence: Synthetic peptide
  Seed: LEYVIKVSA (MAGA1_HUMAN)
LEYVIKVSV

SEQ ID NO: 46282 - protein, 9 aa, Artificial Sequence
  Description of Artificial Sequence: Synthetic peptide
  Seed: TSYVKVLEY (MAGA1_HUMAN)
TQYVKVLEV

SEQ ID NO: 46283 - protein, 9 aa, Artificial Sequence
  Description of Artificial Sequence: Synthetic peptide
  Seed: STSCILESL (MAGA1_HUMAN)
SLSCILESR

SEQ ID NO: 46284 - protein, 9 aa, Artificial Sequence
  Description of Artificial Sequence: Synthetic peptide
  Seed: EADPTGHSY (MAGA1_HUMAN)
EHDPTGHSY

SEQ ID NO: 46285 - protein, 9 aa, Artificial Sequence
  Description of Artificial Sequence: Synthetic peptide
  Seed: RVRFFFPSL (MAGA1_HUMAN)
RFRFFFPSI

SEQ ID NO: 46286 - protein, 9 aa, Artificial Sequence
  Description of Artificial Sequence: Synthetic peptide
  Seed: AQQEALGLV (MAGA1_HUMAN)
ALQEALGLV

SEQ ID NO: 46287 - protein, 8 aa, Artificial Sequence
  Description of Artificial Sequence: Synthetic peptide
  Seed: EELSVMEV (MAGA1_HUMAN)
EELSVMEF

SEQ ID NO: 46288 - protein, 8 aa, Artificial Sequence
  Description of Artificial Sequence: Synthetic peptide
  Seed: FFPSLREA (MAGA1_HUMAN)
FFPSLREF

SEQ ID NO: 46289 - protein, 10 aa, Artificial Sequence
  Description of Artificial Sequence: Synthetic peptide
  Seed: KVADLVGFLL (MAGA1_HUMAN)
KLADLVGFLC

SEQ ID NO: 46290 - protein, 10 aa, Artificial Sequence
  Description of Artificial Sequence: Synthetic peptide
  Seed: SARVRFFFPS (MAGA1_HUMAN)
SGRVRFFFPI

SEQ ID NO: 46291 - protein, 8 aa, Artificial Sequence
  Description of Artificial Sequence: Synthetic peptide
  Seed: SARVRFFF (MAGA1_HUMAN)
SLRVRFFL

SEQ ID NO: 46292 - protein, 9 aa, Artificial Sequence
  Description of Artificial Sequence: Synthetic peptide
  Seed: LVQEKYLEY (MAGA1_HUMAN)
LMQEKYLEY

SEQ ID NO: 46293 - protein, 9 aa, Artificial Sequence
  Description of Artificial Sequence: Synthetic peptide
  Seed: YKHCFPEIF (MAGA1_HUMAN)
YQHCFPEIW

SEQ ID NO: 46294 - protein, 9 aa, Artificial Sequence
  Description of Artificial Sequence: Synthetic peptide
  Seed: RVRFFFPSL (MAGA1_HUMAN)
RNRFFFPSA

SEQ ID NO: 46295 - protein, 9 aa, Artificial Sequence
  Description of Artificial Sequence: Synthetic peptide
  Seed: SCILESLFR (MAGA1_HUMAN)
SSILESLFR

SEQ ID NO: 46296 - protein, 10 aa, Artificial Sequence
  Description of Artificial Sequence: Synthetic peptide
  Seed: ARVRFFFPSL (MAGA1_HUMAN)
ANVRFFFPSK

SEQ ID NO: 46297 - protein, 11 aa, Artificial Sequence
  Description of Artificial Sequence: Synthetic peptide
  Seed: YVKVLEYVIKV (MAGA1_HUMAN)
YRKVLEYVIKV

SEQ ID NO: 46298 - protein, 9 aa, Artificial Sequence
  Description of Artificial Sequence: Synthetic peptide
  Seed: KVSARVRFF (MAGA1_HUMAN)
KLSARVRFK

SEQ ID NO: 46299 - protein, 10 aa, Artificial Sequence
  Description of Artificial Sequence: Synthetic peptide
  Seed: SARVRFFFPS (MAGA1_HUMAN)
SHRVRFFFPL

SEQ ID NO: 46300 - protein, 10 aa, Artificial Sequence
  Description of Artificial Sequence: Synthetic peptide
  Seed: SARVRFFFPS (MAGA1_HUMAN)
SWRVRFFFPL

SEQ ID NO: 46301 - protein, 9 aa, Artificial Sequence
  Description of Artificial Sequence: Synthetic peptide
  Seed: KASESLQLV (MAGA1_HUMAN)
KISESLQLY

SEQ ID NO: 46302 - protein, 9 aa, Artificial Sequence
  Description of Artificial Sequence: Synthetic peptide
  Seed: TKAEMLESV (MAGA1_HUMAN)
TRAEMLESL

SEQ ID NO: 46303 - protein, 10 aa, Artificial Sequence
  Description of Artificial Sequence: Synthetic peptide
  Seed: ESLFRAVITK (MAGA1_HUMAN)
EMLFRAVITK

SEQ ID NO: 46304 - protein, 9 aa, Artificial Sequence
  Description of Artificial Sequence: Synthetic peptide
  Seed: SVMEVYDGR (MAGA1_HUMAN)
SSMEVYDGR

SEQ ID NO: 46305 - protein, 10 aa, Artificial Sequence
  Description of Artificial Sequence: Synthetic peptide
  Seed: KASESLQLVF (MAGA1_HUMAN)
KQSESLQLVV

SEQ ID NO: 46306 - protein, 10 aa, Artificial Sequence
  Description of Artificial Sequence: Synthetic peptide
  Seed: SSSPLVLGTL (MAGA1_HUMAN)
SQSPLVLGTL

SEQ ID NO: 46307 - protein, 10 aa, Artificial Sequence
  Description of Artificial Sequence: Synthetic peptide
  Seed: SCILESLFRA (MAGA1_HUMAN)
SQILESLFRI

SEQ ID NO: 46308 - protein, 9 aa, Artificial Sequence
  Description of Artificial Sequence: Synthetic peptide
  Seed: FPTTINFTR (MAGA1_HUMAN)
FMTTINFTK

SEQ ID NO: 46309 - protein, 10 aa, Artificial Sequence
  Description of Artificial Sequence: Synthetic peptide
  Seed: TSYVKVLEYV (MAGA1_HUMAN)
TLYVKVLEYA

SEQ ID NO: 46310 - protein, 9 aa, Artificial Sequence
  Description of Artificial Sequence: Synthetic peptide
  Seed: SSSPLVLGT (MAGA1_HUMAN)
SISPLVLGM

SEQ ID NO: 46311 - protein, 11 aa, Artificial Sequence
  Description of Artificial Sequence: Synthetic peptide
  Seed: EVYDGREHSAY (MAGA1_HUMAN)
EIYDGREHSAW

SEQ ID NO: 46312 - protein, 9 aa, Artificial Sequence
  Description of Artificial Sequence: Synthetic peptide
  Seed: KYRAREPVT (MAGA1_HUMAN)
KTRAREPVM

SEQ ID NO: 46313 - protein, 9 aa, Artificial Sequence
  Description of Artificial Sequence: Synthetic peptide
  Seed: RQVPDSDPA (MAGA1_HUMAN)
RLVPDSDPV

SEQ ID NO: 46314 - protein, 10 aa, Artificial Sequence
  Description of Artificial Sequence: Synthetic peptide
  Seed: VKVLEYVIKV (MAGA1_HUMAN)
VLVLEYVIKL

SEQ ID NO: 46315 - protein, 8 aa, Artificial Sequence
  Description of Artificial Sequence: Synthetic peptide
  Seed: RVRFFFPS (MAGA1_HUMAN)
RYRFFFPK

SEQ ID NO: 46316 - protein, 10 aa, Artificial Sequence
  Description of Artificial Sequence: Synthetic peptide
  Seed: MPKTGFLIIV (MAGA1_HUMAN)
MPKTGFLIII

SEQ ID NO: 46317 - protein, 9 aa, Artificial Sequence
  Description of Artificial Sequence: Synthetic peptide
  Seed: ADLVGFLLL (MAGA1_HUMAN)
AELVGFLLL

SEQ ID NO: 46318 - protein, 9 aa, Artificial Sequence
  Description of Artificial Sequence: Synthetic peptide
  Seed: SAFPTTINF (MAGA1_HUMAN)
SDFPTTINI

SEQ ID NO: 46319 - protein, 10 aa, Artificial Sequence
  Description of Artificial Sequence: Synthetic peptide
  Seed: EIFGKASESL (MAGA1_HUMAN)
ETFGKASESA

SEQ ID NO: 46320 - protein, 9 aa, Artificial Sequence
  Description of Artificial Sequence: Synthetic peptide
  Seed: AATSSSSPL (MAGA1_HUMAN)
AFTSSSSPY

SEQ ID NO: 46321 - protein, 9 aa, Artificial Sequence
  Description of Artificial Sequence: Synthetic peptide
  Seed: RQVPDSDPA (MAGA1_HUMAN)
RQVPDSDPY

SEQ ID NO: 46322 - protein, 11 aa, Artificial Sequence
  Description of Artificial Sequence: Synthetic peptide
  Seed: SARVRFFFPSL (MAGA1_HUMAN)
SHRVRFFFPSK

SEQ ID NO: 46323 - protein, 9 aa, Artificial Sequence
  Description of Artificial Sequence: Synthetic peptide
  Seed: FFFPSLREA (MAGA1_HUMAN)
FQFPSLREA

SEQ ID NO: 46324 - protein, 10 aa, Artificial Sequence
  Description of Artificial Sequence: Synthetic peptide
  Seed: ASAFPTTINF (MAGA1_HUMAN)
AKAFPTTINW

SEQ ID NO: 46325 - protein, 9 aa, Artificial Sequence
  Description of Artificial Sequence: Synthetic peptide
  Seed: FPSLREAAL (MAGA1_HUMAN)
FSSLREAAI

SEQ ID NO: 46326 - protein, 9 aa, Artificial Sequence
  Description of Artificial Sequence: Synthetic peptide
  Seed: FFFPSLREA (MAGA1_HUMAN)
FMFPSLREM

SEQ ID NO: 46327 - protein, 10 aa, Artificial Sequence
  Description of Artificial Sequence: Synthetic peptide
  Seed: SARVRFFFPS (MAGA1_HUMAN)
SWRVRFFFPY

SEQ ID NO: 46328 - protein, 11 aa, Artificial Sequence
  Description of Artificial Sequence: Synthetic peptide
  Seed: YVKVLEYVIKV (MAGA1_HUMAN)
YFKVLEYVIKV

SEQ ID NO: 46329 - protein, 9 aa, Artificial Sequence
  Description of Artificial Sequence: Synthetic peptide
  Seed: VQAATSSSS (MAGA1_HUMAN)
VKAATSSSM

SEQ ID NO: 46330 - protein, 10 aa, Artificial Sequence
  Description of Artificial Sequence: Synthetic peptide
  Seed: KHCFPEIFGK (MAGA1_HUMAN)
KSCFPEIFGR

SEQ ID NO: 46331 - protein, 9 aa, Artificial Sequence
  Description of Artificial Sequence: Synthetic peptide
  Seed: STDPPQSPQ (MAGA1_HUMAN)
SNDPPQSPI

SEQ ID NO: 46332 - protein, 9 aa, Artificial Sequence
  Description of Artificial Sequence: Synthetic peptide
  Seed: EIWEELSVM (MAGA1_HUMAN)
EVWEELSVY

SEQ ID NO: 46333 - protein, 9 aa, Artificial Sequence
  Description of Artificial Sequence: Synthetic peptide
  Seed: IIVLVMIAM (MAGA1_HUMAN)
IMVLVMIAF

SEQ ID NO: 46334 - protein, 9 aa, Artificial Sequence
  Description of Artificial Sequence: Synthetic peptide
  Seed: DSDPARYEF (MAGA1_HUMAN)
DFDPARYEI

SEQ ID NO: 46335 - protein, 9 aa, Artificial Sequence
  Description of Artificial Sequence: Synthetic peptide
  Seed: KVSARVRFF (MAGA1_HUMAN)
KMSARVRFW

SEQ ID NO: 46336 - protein, 11 aa, Artificial Sequence
  Description of Artificial Sequence: Synthetic peptide
  Seed: RQVPDSDPARY (MAGA1_HUMAN)
RIVPDSDPARR

SEQ ID NO: 46337 - protein, 9 aa, Artificial Sequence
  Description of Artificial Sequence: Synthetic peptide
  Seed: FFFPSLREA (MAGA1_HUMAN)
FSFPSLREA

SEQ ID NO: 46338 - protein, 10 aa, Artificial Sequence
  Description of Artificial Sequence: Synthetic peptide
  Seed: TSYVKVLEYV (MAGA1_HUMAN)
TNYVKVLEYW

SEQ ID NO: 46339 - protein, 8 aa, Artificial Sequence
  Description of Artificial Sequence: Synthetic peptide
  Seed: FLWGPRAL (MAGA1_HUMAN)
FYWGPRAL

SEQ ID NO: 46340 - protein, 10 aa, Artificial Sequence
  Description of Artificial Sequence: Synthetic peptide
  Seed: ASAFPTTINF (MAGA1_HUMAN)
ASAFPTTINY

SEQ ID NO: 46341 - protein, 10 aa, Artificial Sequence
  Description of Artificial Sequence: Synthetic peptide
  Seed: TSCILESLFR (MAGA1_HUMAN)
TICILESLFR

SEQ ID NO: 46342 - protein, 9 aa, Artificial Sequence
  Description of Artificial Sequence: Synthetic peptide
  Seed: AATSSSSPL (MAGA1_HUMAN)
AHTSSSSPY

SEQ ID NO: 46343 - protein, 9 aa, Artificial Sequence
  Description of Artificial Sequence: Synthetic peptide
  Seed: FPTTINFTR (MAGA1_HUMAN)
FGTTINFTY

SEQ ID NO: 46344 - protein, 9 aa, Artificial Sequence
  Description of Artificial Sequence: Synthetic peptide
  Seed: SARVRFFFP (MAGA1_HUMAN)
SIRVRFFFI

SEQ ID NO: 46345 - protein, 9 aa, Artificial Sequence
  Description of Artificial Sequence: Synthetic peptide
  Seed: QIMPKTGFL (MAGA1_HUMAN)
QIMPKTGFW

SEQ ID NO: 46346 - protein, 10 aa, Artificial Sequence
  Description of Artificial Sequence: Synthetic peptide
  Seed: VKVLEYVIKV (MAGA1_HUMAN)
VEVLEYVIKV

SEQ ID NO: 46347 - protein, 10 aa, Artificial Sequence
  Description of Artificial Sequence: Synthetic peptide
  Seed: EYVIKVSARV (MAGA1_HUMAN)
EGVIKVSARV

SEQ ID NO: 46348 - protein, 10 aa, Artificial Sequence
  Description of Artificial Sequence: Synthetic peptide
  Seed: KVADLVGFLL (MAGA1_HUMAN)
KWADLVGFLY

SEQ ID NO: 46349 - protein, 10 aa, Artificial Sequence
  Description of Artificial Sequence: Synthetic peptide
  Seed: EHSAYGEPRK (MAGA1_HUMAN)
ESSAYGEPRR

SEQ ID NO: 46350 - protein, 10 aa, Artificial Sequence
  Description of Artificial Sequence: Synthetic peptide
  Seed: KVSARVRFFF (MAGA1_HUMAN)
KHSARVRFFF

SEQ ID NO: 46351 - protein, 9 aa, Artificial Sequence
  Description of Artificial Sequence: Synthetic peptide
  Seed: KVLEYVIKV (MAGA1_HUMAN)
KSLEYVIKI

SEQ ID NO: 46352 - protein, 9 aa, Artificial Sequence
  Description of Artificial Sequence: Synthetic peptide
  Seed: RVRFFFPSL (MAGA1_HUMAN)
RLRFFFPSR

SEQ ID NO: 46353 - protein, 10 aa, Artificial Sequence
  Description of Artificial Sequence: Synthetic peptide
  Seed: RVRFFFPSLR (MAGA1_HUMAN)
RVRFFFPSLC

SEQ ID NO: 46354 - protein, 9 aa, Artificial Sequence
  Description of Artificial Sequence: Synthetic peptide
  Seed: ITKKVADLV (MAGA1_HUMAN)
ILKKVADLV

SEQ ID NO: 46355 - protein, 11 aa, Artificial Sequence
  Description of Artificial Sequence: Synthetic peptide
  Seed: STSCILESLFR (MAGA1_HUMAN)
SQSCILESLFR

SEQ ID NO: 46356 - protein, 9 aa, Artificial Sequence
  Description of Artificial Sequence: Synthetic peptide
  Seed: KVSARVRFF (MAGA1_HUMAN)
KMSARVRFF

SEQ ID NO: 46357 - protein, 10 aa, Artificial Sequence
  Description of Artificial Sequence: Synthetic peptide
  Seed: VKVLEYVIKV (MAGA1_HUMAN)
VWVLEYVIKV

SEQ ID NO: 46358 - protein, 11 aa, Artificial Sequence
  Description of Artificial Sequence: Synthetic peptide
  Seed: RQVPDSDPARY (MAGA1_HUMAN)
RLVPDSDPARM

SEQ ID NO: 46359 - protein, 11 aa, Artificial Sequence
  Description of Artificial Sequence: Synthetic peptide
  Seed: EVYDGREHSAY (MAGA1_HUMAN)
EIYDGREHSAK

SEQ ID NO: 46360 - protein, 9 aa, Artificial Sequence
  Description of Artificial Sequence: Synthetic peptide
  Seed: TSSSSPLVL (MAGA1_HUMAN)
TDSSSPLVL

SEQ ID NO: 46361 - protein, 10 aa, Artificial Sequence
  Description of Artificial Sequence: Synthetic peptide
  Seed: TSCILESLFR (MAGA1_HUMAN)
TMCILESLFR

SEQ ID NO: 46362 - protein, 9 aa, Artificial Sequence
  Description of Artificial Sequence: Synthetic peptide
  Seed: YKHCFPEIF (MAGA1_HUMAN)
YRHCFPEIV

SEQ ID NO: 46363 - protein, 9 aa, Artificial Sequence
  Description of Artificial Sequence: Synthetic peptide
  Seed: TQDLVQEKY (MAGA1_HUMAN)
TIDLVQEKL

SEQ ID NO: 46364 - protein, 9 aa, Artificial Sequence
  Description of Artificial Sequence: Synthetic peptide
  Seed: LVTCLGLSY (MAGA1_HUMAN)
LSTCLGLSW

SEQ ID NO: 46365 - protein, 9 aa, Artificial Sequence
  Description of Artificial Sequence: Synthetic peptide
  Seed: LVQEKYLEY (MAGA1_HUMAN)
LTQEKYLEM

SEQ ID NO: 46366 - protein, 10 aa, Artificial Sequence
  Description of Artificial Sequence: Synthetic peptide
  Seed: RVRFFFPSLR (MAGA1_HUMAN)
RTRFFFPSLI

SEQ ID NO: 46367 - protein, 9 aa, Artificial Sequence
  Description of Artificial Sequence: Synthetic peptide
  Seed: SAFPTTINF (MAGA1_HUMAN)
STFPTTINH

SEQ ID NO: 46368 - protein, 10 aa, Artificial Sequence
  Description of Artificial Sequence: Synthetic peptide
  Seed: KVSARVRFFF (MAGA1_HUMAN)
KKSARVRFFF

SEQ ID NO: 46369 - protein, 9 aa, Artificial Sequence
  Description of Artificial Sequence: Synthetic peptide
  Seed: YKHCFPEIF (MAGA1_HUMAN)
YVHCFPEIY

SEQ ID NO: 46370 - protein, 9 aa, Artificial Sequence
  Description of Artificial Sequence: Synthetic peptide
  Seed: KVLEYVIKV (MAGA1_HUMAN)
KQLEYVIKI

SEQ ID NO: 46371 - protein, 9 aa, Artificial Sequence
  Description of Artificial Sequence: Synthetic peptide
  Seed: FFFPSLREA (MAGA1_HUMAN)
FYFPSLREM

SEQ ID NO: 46372 - protein, 9 aa, Artificial Sequence
  Description of Artificial Sequence: Synthetic peptide
  Seed: RQRQPSEGS (MAGA1_HUMAN)
RYRQPSEGK

SEQ ID NO: 46373 - protein, 10 aa, Artificial Sequence
  Description of Artificial Sequence: Synthetic peptide
  Seed: KEADPTGHSY (MAGA1_HUMAN)
KTADPTGHSL

SEQ ID NO: 46374 - protein, 9 aa, Artificial Sequence
  Description of Artificial Sequence: Synthetic peptide
  Seed: IKVSARVRF (MAGA1_HUMAN)
IQVSARVRF

SEQ ID NO: 46375 - protein, 10 aa, Artificial Sequence
  Description of Artificial Sequence: Synthetic peptide
  Seed: SARVRFFFPS (MAGA1_HUMAN)
SVRVRFFFPM

SEQ ID NO: 46376 - protein, 9 aa, Artificial Sequence
  Description of Artificial Sequence: Synthetic peptide
  Seed: ALAETSYVK (MAGA1_HUMAN)
AMAETSYVK

SEQ ID NO: 46377 - protein, 9 aa, Artificial Sequence
  Description of Artificial Sequence: Synthetic peptide
  Seed: FFFPSLREA (MAGA1_HUMAN)
FSFPSLREM

SEQ ID NO: 46378 - protein, 10 aa, Artificial Sequence
  Description of Artificial Sequence: Synthetic peptide
  Seed: RAREPVTKAE (MAGA1_HUMAN)
RVREPVTKAI

SEQ ID NO: 46379 - protein, 11 aa, Artificial Sequence
  Description of Artificial Sequence: Synthetic peptide
  Seed: DLVGFLLLKYR (MAGA1_HUMAN)
DTVGFLLLKYR

SEQ ID NO: 46380 - protein, 10 aa, Artificial Sequence
  Description of Artificial Sequence: Synthetic peptide
  Seed: KVSARVRFFF (MAGA1_HUMAN)
KISARVRFFK

SEQ ID NO: 46381 - protein, 9 aa, Artificial Sequence
  Description of Artificial Sequence: Synthetic peptide
  Seed: SAYGEPRKL (MAGA1_HUMAN)
SSYGEPRKW

SEQ ID NO: 46382 - protein, 10 aa, Artificial Sequence
  Description of Artificial Sequence: Synthetic peptide
  Seed: RVRFFFPSLR (MAGA1_HUMAN)
RFRFFFPSLI

SEQ ID NO: 46383 - protein, 9 aa, Artificial Sequence
  Description of Artificial Sequence: Synthetic peptide
  Seed: AATSSSSPL (MAGA1_HUMAN)
ASTSSSSPM

SEQ ID NO: 46384 - protein, 9 aa, Artificial Sequence
  Description of Artificial Sequence: Synthetic peptide
  Seed: VYDGREHSA (MAGA1_HUMAN)
VQDGREHSV

SEQ ID NO: 46385 - protein, 9 aa, Artificial Sequence
  Description of Artificial Sequence: Synthetic peptide
  Seed: KASESLQLV (MAGA1_HUMAN)
KISESLQLL

SEQ ID NO: 46386 - protein, 9 aa, Artificial Sequence
  Description of Artificial Sequence: Synthetic peptide
  Seed: ESLQLVFGI (MAGA1_HUMAN)
EALQLVFGF

SEQ ID NO: 46387 - protein, 9 aa, Artificial Sequence
  Description of Artificial Sequence: Synthetic peptide
  Seed: RVRFFFPSL (MAGA1_HUMAN)
RTRFFFPSI

SEQ ID NO: 46388 - protein, 10 aa, Artificial Sequence
  Description of Artificial Sequence: Synthetic peptide
  Seed: ARVRFFFPSL (MAGA1_HUMAN)
AEVRFFFPSV

SEQ ID NO: 46389 - protein, 9 aa, Artificial Sequence
  Description of Artificial Sequence: Synthetic peptide
  Seed: LEYVIKVSA (MAGA1_HUMAN)
LQYVIKVSL

SEQ ID NO: 46390 - protein, 9 aa, Artificial Sequence
  Description of Artificial Sequence: Synthetic peptide
  Seed: RVRFFFPSL (MAGA1_HUMAN)
RGRFFFPSN

SEQ ID NO: 46391 - protein, 9 aa, Artificial Sequence
  Description of Artificial Sequence: Synthetic peptide
  Seed: HSYVLVTCL (MAGA1_HUMAN)
HQYVLVTCF

SEQ ID NO: 46392 - protein, 8 aa, Artificial Sequence
  Description of Artificial Sequence: Synthetic peptide
  Seed: AYGEPRKL (MAGA1_HUMAN)
ATGEPRKL

SEQ ID NO: 46393 - protein, 10 aa, Artificial Sequence
  Description of Artificial Sequence: Synthetic peptide
  Seed: SCILESLFRA (MAGA1_HUMAN)
SFILESLFRL

SEQ ID NO: 46394 - protein, 9 aa, Artificial Sequence
  Description of Artificial Sequence: Synthetic peptide
  Seed: REEEGPSTS (MAGA1_HUMAN)
REEEGPSTP

SEQ ID NO: 46395 - protein, 10 aa, Artificial Sequence
  Description of Artificial Sequence: Synthetic peptide
  Seed: SLFRAVITKK (MAGA1_HUMAN)
SVFRAVITKR

SEQ ID NO: 46396 - protein, 10 aa, Artificial Sequence
  Description of Artificial Sequence: Synthetic peptide
  Seed: TSYVKVLEYV (MAGA1_HUMAN)
TVYVKVLEYL

SEQ ID NO: 46397 - protein, 9 aa, Artificial Sequence
  Description of Artificial Sequence: Synthetic peptide
  Seed: SARVRFFFP (MAGA1_HUMAN)
SVRVRFFFI

SEQ ID NO: 46398 - protein, 9 aa, Artificial Sequence
  Description of Artificial Sequence: Synthetic peptide
  Seed: HCFPEIFGK (MAGA1_HUMAN)
HNFPEIFGK

SEQ ID NO: 46399 - protein, 9 aa, Artificial Sequence
  Description of Artificial Sequence: Synthetic peptide
  Seed: SAYGEPRKL (MAGA1_HUMAN)
STYGEPRKW

SEQ ID NO: 46400 - protein, 10 aa, Artificial Sequence
  Description of Artificial Sequence: Synthetic peptide
  Seed: RYEFLWGPRA (MAGA1_HUMAN)
RQEFLWGPRR

SEQ ID NO: 46401 - protein, 9 aa, Artificial Sequence
  Description of Artificial Sequence: Synthetic peptide
  Seed: YVLVTCLGL (MAGA1_HUMAN)
YALVTCLGY

SEQ ID NO: 46402 - protein, 10 aa, Artificial Sequence
  Description of Artificial Sequence: Synthetic peptide
  Seed: KVSARVRFFF (MAGA1_HUMAN)
KLSARVRFFF

SEQ ID NO: 46403 - protein, 9 aa, Artificial Sequence
  Description of Artificial Sequence: Synthetic peptide
  Seed: LVQEKYLEY (MAGA1_HUMAN)
LTQEKYLEL

SEQ ID NO: 46404 - protein, 11 aa, Artificial Sequence
  Description of Artificial Sequence: Synthetic peptide
  Seed: RQVPDSDPARY (MAGA1_HUMAN)
RIVPDSDPARW

SEQ ID NO: 46405 - protein, 9 aa, Artificial Sequence
  Description of Artificial Sequence: Synthetic peptide
  Seed: DLVGFLLLK (MAGA1_HUMAN)
DGVGFLLLK

SEQ ID NO: 46406 - protein, 9 aa, Artificial Sequence
  Description of Artificial Sequence: Synthetic peptide
  Seed: SYVKVLEYV (MAGA1_HUMAN)
SRVKVLEYL

SEQ ID NO: 46407 - protein, 10 aa, Artificial Sequence
  Description of Artificial Sequence: Synthetic peptide
  Seed: SARVRFFFPS (MAGA1_HUMAN)
SNRVRFFFPV

SEQ ID NO: 46408 - protein, 9 aa, Artificial Sequence
  Description of Artificial Sequence: Synthetic peptide
  Seed: SAFPTTINF (MAGA1_HUMAN)
SQFPTTINK

SEQ ID NO: 46409 - protein, 9 aa, Artificial Sequence
  Description of Artificial Sequence: Synthetic peptide
  Seed: VADLVGFLL (MAGA1_HUMAN)
VGDLVGFLL

SEQ ID NO: 46410 - protein, 9 aa, Artificial Sequence
  Description of Artificial Sequence: Synthetic peptide
  Seed: AATSSSSPL (MAGA1_HUMAN)
AATSSSSPM

SEQ ID NO: 46411 - protein, 11 aa, Artificial Sequence
  Description of Artificial Sequence: Synthetic peptide
  Seed: EMLESVIKNYK (MAGA1_HUMAN)
EYLESVIKNYR

SEQ ID NO: 46412 - protein, 10 aa, Artificial Sequence
  Description of Artificial Sequence: Synthetic peptide
  Seed: KVADLVGFLL (MAGA1_HUMAN)
KTADLVGFLL

SEQ ID NO: 46413 - protein, 10 aa, Artificial Sequence
  Description of Artificial Sequence: Synthetic peptide
  Seed: RVRFFFPSLR (MAGA1_HUMAN)
RTRFFFPSLR

SEQ ID NO: 46414 - protein, 10 aa, Artificial Sequence
  Description of Artificial Sequence: Synthetic peptide
  Seed: SESLQLVFGI (MAGA1_HUMAN)
SESLQLVFGF

SEQ ID NO: 46415 - protein, 9 aa, Artificial Sequence
  Description of Artificial Sequence: Synthetic peptide
  Seed: AATSSSSPL (MAGA1_HUMAN)
AMTSSSSPY

SEQ ID NO: 46416 - protein, 8 aa, Artificial Sequence
  Description of Artificial Sequence: Synthetic peptide
  Seed: RFFFPSLR (MAGA1_HUMAN)
RMFFPSLR

SEQ ID NO: 46417 - protein, 10 aa, Artificial Sequence
  Description of Artificial Sequence: Synthetic peptide
  Seed: REAALREEEE (MAGA1_HUMAN)
REAALREEEI

SEQ ID NO: 46418 - protein, 11 aa, Artificial Sequence
  Description of Artificial Sequence: Synthetic peptide
  Seed: RVRFFFPSLRE (MAGA1_HUMAN)
RFRFFFPSLRG

SEQ ID NO: 46419 - protein, 9 aa, Artificial Sequence
  Description of Artificial Sequence: Synthetic peptide
  Seed: CILESLFRA (MAGA1_HUMAN)
CQLESLFRI

SEQ ID NO: 46420 - protein, 10 aa, Artificial Sequence
  Description of Artificial Sequence: Synthetic peptide
  Seed: SARVRFFFPS (MAGA1_HUMAN)
SFRVRFFFPF

SEQ ID NO: 46421 - protein, 9 aa, Artificial Sequence
  Description of Artificial Sequence: Synthetic peptide
  Seed: RYEFLWGPR (MAGA1_HUMAN)
RGEFLWGPR

SEQ ID NO: 46422 - protein, 9 aa, Artificial Sequence
  Description of Artificial Sequence: Synthetic peptide
  Seed: RALAETSYV (MAGA1_HUMAN)
RLLAETSYL

SEQ ID NO: 46423 - protein, 9 aa, Artificial Sequence
  Description of Artificial Sequence: Synthetic peptide
  Seed: STSCILESL (MAGA1_HUMAN)
SMSCILESL

SEQ ID NO: 46424 - protein, 9 aa, Artificial Sequence
  Description of Artificial Sequence: Synthetic peptide
  Seed: SSSPLVLGT (MAGA1_HUMAN)
SVSPLVLGL

SEQ ID NO: 46425 - protein, 9 aa, Artificial Sequence
  Description of Artificial Sequence: Synthetic peptide
  Seed: VRFFFPSLR (MAGA1_HUMAN)
VSFFFPSLR

SEQ ID NO: 46426 - protein, 10 aa, Artificial Sequence
  Description of Artificial Sequence: Synthetic peptide
  Seed: EALEAQQEAL (MAGA1_HUMAN)
EALEAQQEAR

SEQ ID NO: 46427 - protein, 8 aa, Artificial Sequence
  Description of Artificial Sequence: Synthetic peptide
  Seed: FPSLREAA (MAGA1_HUMAN)
FPSLREAM

SEQ ID NO: 46428 - protein, 11 aa, Artificial Sequence
  Description of Artificial Sequence: Synthetic peptide
  Seed: RVRFFFPSLRE (MAGA1_HUMAN)
RVRFFFPSLRK

SEQ ID NO: 46429 - protein, 9 aa, Artificial Sequence
  Description of Artificial Sequence: Synthetic peptide
  Seed: KASESLQLV (MAGA1_HUMAN)
KYSESLQLL

SEQ ID NO: 46430 - protein, 11 aa, Artificial Sequence
  Description of Artificial Sequence: Synthetic peptide
  Seed: YVKVLEYVIKV (MAGA1_HUMAN)
YPKVLEYVIKV

SEQ ID NO: 46431 - protein, 10 aa, Artificial Sequence
  Description of Artificial Sequence: Synthetic peptide
  Seed: KNYKHCFPEI (MAGA1_HUMAN)
KEYKHCFPEF

SEQ ID NO: 46432 - protein, 9 aa, Artificial Sequence
  Description of Artificial Sequence: Synthetic peptide
  Seed: AQQEALGLV (MAGA1_HUMAN)
ALQEALGLL

SEQ ID NO: 46433 - protein, 10 aa, Artificial Sequence
  Description of Artificial Sequence: Synthetic peptide
  Seed: ARYEFLWGPR (MAGA1_HUMAN)
AFYEFLWGPK

SEQ ID NO: 46434 - protein, 9 aa, Artificial Sequence
  Description of Artificial Sequence: Synthetic peptide
  Seed: SAYGEPRKL (MAGA1_HUMAN)
SIYGEPRKF

SEQ ID NO: 46435 - protein, 9 aa, Artificial Sequence
  Description of Artificial Sequence: Synthetic peptide
  Seed: SSPLVLGTL (MAGA1_HUMAN)
SYPLVLGTM

SEQ ID NO: 46436 - protein, 9 aa, Artificial Sequence
  Description of Artificial Sequence: Synthetic peptide
  Seed: SAYGEPRKL (MAGA1_HUMAN)
SAYGEPRKA

SEQ ID NO: 46437 - protein, 11 aa, Artificial Sequence
  Description of Artificial Sequence: Synthetic peptide
  Seed: KVLEYVIKVSA (MAGA1_HUMAN)
KILEYVIKVSL

SEQ ID NO: 46438 - protein, 9 aa, Artificial Sequence
  Description of Artificial Sequence: Synthetic peptide
  Seed: KVADLVGFL (MAGA1_HUMAN)
KQADLVGFM

SEQ ID NO: 46439 - protein, 9 aa, Artificial Sequence
  Description of Artificial Sequence: Synthetic peptide
  Seed: LVGFLLLKY (MAGA1_HUMAN)
LSGFLLLKF

SEQ ID NO: 46440 - protein, 10 aa, Artificial Sequence
  Description of Artificial Sequence: Synthetic peptide
  Seed: KVLEYVIKVS (MAGA1_HUMAN)
KLLEYVIKVL

SEQ ID NO: 46441 - protein, 11 aa, Artificial Sequence
  Description of Artificial Sequence: Synthetic peptide
  Seed: IKVSARVRFFF (MAGA1_HUMAN)
IRVSARVRFFW

SEQ ID NO: 46442 - protein, 9 aa, Artificial Sequence
  Description of Artificial Sequence: Synthetic peptide
  Seed: EKYLEYRQV (MAGA1_HUMAN)
EQYLEYRQL

SEQ ID NO: 46443 - protein, 9 aa, Artificial Sequence
  Description of Artificial Sequence: Synthetic peptide
  Seed: RALAETSYV (MAGA1_HUMAN)
RMLAETSYR

SEQ ID NO: 46444 - protein, 10 aa, Artificial Sequence
  Description of Artificial Sequence: Synthetic peptide
  Seed: EVYDGREHSA (MAGA1_HUMAN)
EAYDGREHSV

SEQ ID NO: 46445 - protein, 9 aa, Artificial Sequence
  Description of Artificial Sequence: Synthetic peptide
  Seed: ARVRFFFPS (MAGA1_HUMAN)
AQVRFFFPL

SEQ ID NO: 46446 - protein, 11 aa, Artificial Sequence
  Description of Artificial Sequence: Synthetic peptide
  Seed: YEFLWGPRALA (MAGA1_HUMAN)
YHFLWGPRALI

SEQ ID NO: 46447 - protein, 9 aa, Artificial Sequence
  Description of Artificial Sequence: Synthetic peptide
  Seed: TSSSSPLVL (MAGA1_HUMAN)
TTSSSPLVW

SEQ ID NO: 46448 - protein, 9 aa, Artificial Sequence
  Description of Artificial Sequence: Synthetic peptide
  Seed: KVSARVRFF (MAGA1_HUMAN)
KSSARVRFL

SEQ ID NO: 46449 - protein, 10 aa, Artificial Sequence
  Description of Artificial Sequence: Synthetic peptide
  Seed: LTQDLVQEKY (MAGA1_HUMAN)
LMQDLVQEKY

SEQ ID NO: 46450 - protein, 9 aa, Artificial Sequence
  Description of Artificial Sequence: Synthetic peptide
  Seed: KVSARVRFF (MAGA1_HUMAN)
KSSARVRFW

SEQ ID NO: 46451 - protein, 9 aa, Artificial Sequence
  Description of Artificial Sequence: Synthetic peptide
  Seed: FPSLREAAL (MAGA1_HUMAN)
FLSLREAAL

SEQ ID NO: 46452 - protein, 8 aa, Artificial Sequence
  Description of Artificial Sequence: Synthetic peptide
  Seed: FLWGPRAL (MAGA1_HUMAN)
FFWGPRAM

SEQ ID NO: 46453 - protein, 10 aa, Artificial Sequence
  Description of Artificial Sequence: Synthetic peptide
  Seed: SDPARYEFLW (MAGA1_HUMAN)
SWPARYEFLW

SEQ ID NO: 46454 - protein, 11 aa, Artificial Sequence
  Description of Artificial Sequence: Synthetic peptide
  Seed: YEFLWGPRALA (MAGA1_HUMAN)
YMFLWGPRALM

SEQ ID NO: 46455 - protein, 9 aa, Artificial Sequence
  Description of Artificial Sequence: Synthetic peptide
  Seed: DPTGHSYVL (MAGA1_HUMAN)
DATGHSYVY

SEQ ID NO: 46456 - protein, 9 aa, Artificial Sequence
  Description of Artificial Sequence: Synthetic peptide
  Seed: SAYGEPRKL (MAGA1_HUMAN)
SFYGEPRKV

SEQ ID NO: 46457 - protein, 9 aa, Artificial Sequence
  Description of Artificial Sequence: Synthetic peptide
  Seed: YEFLWGPRA (MAGA1_HUMAN)
YEFLWGPRY

SEQ ID NO: 46458 - protein, 11 aa, Artificial Sequence
  Description of Artificial Sequence: Synthetic peptide
  Seed: ARVRFFFPSLR (MAGA1_HUMAN)
AFVRFFFPSLR

SEQ ID NO: 46459 - protein, 9 aa, Artificial Sequence
  Description of Artificial Sequence: Synthetic peptide
  Seed: RYEFLWGPR (MAGA1_HUMAN)
RLEFLWGPR

SEQ ID NO: 46460 - protein, 9 aa, Artificial Sequence
  Description of Artificial Sequence: Synthetic peptide
  Seed: DSDPARYEF (MAGA1_HUMAN)
DSDPARYEM

SEQ ID NO: 46461 - protein, 9 aa, Artificial Sequence
  Description of Artificial Sequence: Synthetic peptide
  Seed: RVRFFFPSL (MAGA1_HUMAN)
RVRFFFPSF

SEQ ID NO: 46462 - protein, 10 aa, Artificial Sequence
  Description of Artificial Sequence: Synthetic peptide
  Seed: SDPARYEFLW (MAGA1_HUMAN)
SMPARYEFLW

SEQ ID NO: 46463 - protein, 11 aa, Artificial Sequence
  Description of Artificial Sequence: Synthetic peptide
  Seed: RQVPDSDPARY (MAGA1_HUMAN)
RWVPDSDPARY

SEQ ID NO: 46464 - protein, 9 aa, Artificial Sequence
  Description of Artificial Sequence: Synthetic peptide
  Seed: HSYVLVTCL (MAGA1_HUMAN)
HKYVLVTCM

SEQ ID NO: 46465 - protein, 10 aa, Artificial Sequence
  Description of Artificial Sequence: Synthetic peptide
  Seed: FLWGPRALAE (MAGA1_HUMAN)
FIWGPRALAA

SEQ ID NO: 46466 - protein, 9 aa, Artificial Sequence
  Description of Artificial Sequence: Synthetic peptide
  Seed: RQRQPSEGS (MAGA1_HUMAN)
RSRQPSEGS

SEQ ID NO: 46467 - protein, 9 aa, Artificial Sequence
  Description of Artificial Sequence: Synthetic peptide
  Seed: KVADLVGFL (MAGA1_HUMAN)
KTADLVGFK

SEQ ID NO: 46468 - protein, 11 aa, Artificial Sequence
  Description of Artificial Sequence: Synthetic peptide
  Seed: SAFPTTINFTR (MAGA1_HUMAN)
SQFPTTINFTK

SEQ ID NO: 46469 - protein, 11 aa, Artificial Sequence
  Description of Artificial Sequence: Synthetic peptide
  Seed: RQVPDSDPARY (MAGA1_HUMAN)
RMVPDSDPARF

SEQ ID NO: 46470 - protein, 10 aa, Artificial Sequence
  Description of Artificial Sequence: Synthetic peptide
  Seed: SARVRFFFPS (MAGA1_HUMAN)
SNRVRFFFPR

SEQ ID NO: 46471 - protein, 9 aa, Artificial Sequence
  Description of Artificial Sequence: Synthetic peptide
  Seed: SARVRFFFP (MAGA1_HUMAN)
SSRVRFFFK

SEQ ID NO: 46472 - protein, 10 aa, Artificial Sequence
  Description of Artificial Sequence: Synthetic peptide
  Seed: CILESLFRAV (MAGA1_HUMAN)
CLLESLFRAV

SEQ ID NO: 46473 - protein, 9 aa, Artificial Sequence
  Description of Artificial Sequence: Synthetic peptide
  Seed: EYVIKVSAR (MAGA1_HUMAN)
ELVIKVSAR

SEQ ID NO: 46474 - protein, 9 aa, Artificial Sequence
  Description of Artificial Sequence: Synthetic peptide
  Seed: VADLVGFLL (MAGA1_HUMAN)
VTDLVGFLM

SEQ ID NO: 46475 - protein, 9 aa, Artificial Sequence
  Description of Artificial Sequence: Synthetic peptide
  Seed: SARVRFFFP (MAGA1_HUMAN)
SQRVRFFFK

SEQ ID NO: 46476 - protein, 9 aa, Artificial Sequence
  Description of Artificial Sequence: Synthetic peptide
  Seed: LESLFRAVI (MAGA1_HUMAN)
LLSLFRAVF

SEQ ID NO: 46477 - protein, 11 aa, Artificial Sequence
  Description of Artificial Sequence: Synthetic peptide
  Seed: VQAATSSSSPL (MAGA1_HUMAN)
VLAATSSSSPY

SEQ ID NO: 46478 - protein, 9 aa, Artificial Sequence
  Description of Artificial Sequence: Synthetic peptide
  Seed: EFLWGPRAL (MAGA1_HUMAN)
EFLWGPRAM

SEQ ID NO: 46479 - protein, 10 aa, Artificial Sequence
  Description of Artificial Sequence: Synthetic peptide
  Seed: EIFGKASESL (MAGA1_HUMAN)
ESFGKASESR

SEQ ID NO: 46480 - protein, 9 aa, Artificial Sequence
  Description of Artificial Sequence: Synthetic peptide
  Seed: YDGREHSAY (MAGA1_HUMAN)
YIGREHSAF

SEQ ID NO: 46481 - protein, 10 aa, Artificial Sequence
  Description of Artificial Sequence: Synthetic peptide
  Seed: TSYVKVLEYV (MAGA1_HUMAN)
TFYVKVLEYF

SEQ ID NO: 46482 - protein, 9 aa, Artificial Sequence
  Description of Artificial Sequence: Synthetic peptide
  Seed: VQAATSSSS (MAGA1_HUMAN)
VKAATSSSF

SEQ ID NO: 46483 - protein, 10 aa, Artificial Sequence
  Description of Artificial Sequence: Synthetic peptide
  Seed: KVLEYVIKVS (MAGA1_HUMAN)
KMLEYVIKVY

SEQ ID NO: 46484 - protein, 10 aa, Artificial Sequence
  Description of Artificial Sequence: Synthetic peptide
  Seed: YEFLWGPRAL (MAGA1_HUMAN)
YTFLWGPRAF

SEQ ID NO: 46485 - protein, 10 aa, Artificial Sequence
  Description of Artificial Sequence: Synthetic peptide
  Seed: FFPSLREAAL (MAGA1_HUMAN)
FVPSLREAAM

SEQ ID NO: 46486 - protein, 11 aa, Artificial Sequence
  Description of Artificial Sequence: Synthetic peptide
  Seed: RAREPVTKAEM (MAGA1_HUMAN)
RPREPVTKAEF

SEQ ID NO: 46487 - protein, 10 aa, Artificial Sequence
  Description of Artificial Sequence: Synthetic peptide
  Seed: LSVMEVYDGR (MAGA1_HUMAN)
LWVMEVYDGR

SEQ ID NO: 46488 - protein, 9 aa, Artificial Sequence
  Description of Artificial Sequence: Synthetic peptide
  Seed: FPSLREAAL (MAGA1_HUMAN)
FPSLREAAT

SEQ ID NO: 46489 - protein, 9 aa, Artificial Sequence
  Description of Artificial Sequence: Synthetic peptide
  Seed: ALAETSYVK (MAGA1_HUMAN)
AMAETSYVR

SEQ ID NO: 46490 - protein, 10 aa, Artificial Sequence
  Description of Artificial Sequence: Synthetic peptide
  Seed: KEADPTGHSY (MAGA1_HUMAN)
KLADPTGHSF

SEQ ID NO: 46491 - protein, 9 aa, Artificial Sequence
  Description of Artificial Sequence: Synthetic peptide
  Seed: LKYRAREPV (MAGA1_HUMAN)
LVYRAREPM

SEQ ID NO: 46492 - protein, 10 aa, Artificial Sequence
  Description of Artificial Sequence: Synthetic peptide
  Seed: KKVADLVGFL (MAGA1_HUMAN)
KYVADLVGFV

SEQ ID NO: 46493 - protein, 9 aa, Artificial Sequence
  Description of Artificial Sequence: Synthetic peptide
  Seed: STSCILESL (MAGA1_HUMAN)
SSSCILESF

SEQ ID NO: 46494 - protein, 9 aa, Artificial Sequence
  Description of Artificial Sequence: Synthetic peptide
  Seed: YKHCFPEIF (MAGA1_HUMAN)
YPHCFPEIF

SEQ ID NO: 46495 - protein, 9 aa, Artificial Sequence
  Description of Artificial Sequence: Synthetic peptide
  Seed: KASESLQLV (MAGA1_HUMAN)
KLSESLQLV

SEQ ID NO: 46496 - protein, 9 aa, Artificial Sequence
  Description of Artificial Sequence: Synthetic peptide
  Seed: IMPKTGFLI (MAGA1_HUMAN)
IIPKTGFLF

SEQ ID NO: 46497 - protein, 9 aa, Artificial Sequence
  Description of Artificial Sequence: Synthetic peptide
  Seed: SARVRFFFP (MAGA1_HUMAN)
SYRVRFFFV

SEQ ID NO: 46498 - protein, 10 aa, Artificial Sequence
  Description of Artificial Sequence: Synthetic peptide
  Seed: SCILESLFRA (MAGA1_HUMAN)
SPILESLFRL

SEQ ID NO: 46499 - protein, 9 aa, Artificial Sequence
  Description of Artificial Sequence: Synthetic peptide
  Seed: TSYVKVLEY (MAGA1_HUMAN)
TIYVKVLEM

SEQ ID NO: 46500 - protein, 9 aa, Artificial Sequence
  Description of Artificial Sequence: Synthetic peptide
  Seed: VSARVRFFF (MAGA1_HUMAN)
VSARVRFFI

SEQ ID NO: 46501 - protein, 8 aa, Artificial Sequence
  Description of Artificial Sequence: Synthetic peptide
  Seed: FFPSLREA (MAGA1_HUMAN)
FYPSLREM

SEQ ID NO: 46502 - protein, 9 aa, Artificial Sequence
  Description of Artificial Sequence: Synthetic peptide
  Seed: KVADLVGFL (MAGA1_HUMAN)
KSADLVGFK

SEQ ID NO: 46503 - protein, 10 aa, Artificial Sequence
  Description of Artificial Sequence: Synthetic peptide
  Seed: REEEGPSTSC (MAGA1_HUMAN)
REEEGPSTSL

SEQ ID NO: 46504 - protein, 10 aa, Artificial Sequence
  Description of Artificial Sequence: Synthetic peptide
  Seed: STSCILESLF (MAGA1_HUMAN)
SQSCILESLW

SEQ ID NO: 46505 - protein, 9 aa, Artificial Sequence
  Description of Artificial Sequence: Synthetic peptide
  Seed: VSARVRFFF (MAGA1_HUMAN)
VVARVRFFY

SEQ ID NO: 46506 - protein, 9 aa, Artificial Sequence
  Description of Artificial Sequence: Synthetic peptide
  Seed: GLLGDNQIM (MAGA1_HUMAN)
GQLGDNQIW

SEQ ID NO: 46507 - protein, 8 aa, Artificial Sequence
  Description of Artificial Sequence: Synthetic peptide
  Seed: RVRFFFPS (MAGA1_HUMAN)
RVRFFFPA

SEQ ID NO: 46508 - protein, 9 aa, Artificial Sequence
  Description of Artificial Sequence: Synthetic peptide
  Seed: LTQDLVQEK (MAGA1_HUMAN)
LLQDLVQEF

SEQ ID NO: 46509 - protein, 10 aa, Artificial Sequence
  Description of Artificial Sequence: Synthetic peptide
  Seed: ADLVGFLLLK (MAGA1_HUMAN)
AILVGFLLLR

SEQ ID NO: 46510 - protein, 9 aa, Artificial Sequence
  Description of Artificial Sequence: Synthetic peptide
  Seed: ESLQLVFGI (MAGA1_HUMAN)
ESLQLVFGL

SEQ ID NO: 46511 - protein, 9 aa, Artificial Sequence
  Description of Artificial Sequence: Synthetic peptide
  Seed: KVLEYVIKV (MAGA1_HUMAN)
KSLEYVIKR

SEQ ID NO: 46512 - protein, 11 aa, Artificial Sequence
  Description of Artificial Sequence: Synthetic peptide
  Seed: YEFLWGPRALA (MAGA1_HUMAN)
YSFLWGPRALI

SEQ ID NO: 46513 - protein, 10 aa, Artificial Sequence
  Description of Artificial Sequence: Synthetic peptide
  Seed: PLVLGTLEEV (MAGA1_HUMAN)
PMVLGTLEEV

SEQ ID NO: 46514 - protein, 8 aa, Artificial Sequence
  Description of Artificial Sequence: Synthetic peptide
  Seed: HSYVLVTC (MAGA1_HUMAN)
HEYVLVTV

SEQ ID NO: 46515 - protein, 10 aa, Artificial Sequence
  Description of Artificial Sequence: Synthetic peptide
  Seed: KASESLQLVF (MAGA1_HUMAN)
KVSESLQLVY

SEQ ID NO: 46516 - protein, 10 aa, Artificial Sequence
  Description of Artificial Sequence: Synthetic peptide
  Seed: ASAFPTTINF (MAGA1_HUMAN)
AFAFPTTINW

SEQ ID NO: 46517 - protein, 10 aa, Artificial Sequence
  Description of Artificial Sequence: Synthetic peptide
  Seed: KYRAREPVTK (MAGA1_HUMAN)
KIRAREPVTR

SEQ ID NO: 46518 - protein, 9 aa, Artificial Sequence
  Description of Artificial Sequence: Synthetic peptide
  Seed: SAYGEPRKL (MAGA1_HUMAN)
SAYGEPRKV

SEQ ID NO: 46519 - protein, 9 aa, Artificial Sequence
  Description of Artificial Sequence: Synthetic peptide
  Seed: AATSSSSPL (MAGA1_HUMAN)
AQTSSSSPV

SEQ ID NO: 46520 - protein, 9 aa, Artificial Sequence
  Description of Artificial Sequence: Synthetic peptide
  Seed: LESLFRAVI (MAGA1_HUMAN)
LQSLFRAVM

SEQ ID NO: 46521 - protein, 9 aa, Artificial Sequence
  Description of Artificial Sequence: Synthetic peptide
  Seed: YVLVTCLGL (MAGA1_HUMAN)
YVLVTCLGF

SEQ ID NO: 46522 - protein, 9 aa, Artificial Sequence
  Description of Artificial Sequence: Synthetic peptide
  Seed: YKHCFPEIF (MAGA1_HUMAN)
YAHCFPEIF

SEQ ID NO: 46523 - protein, 9 aa, Artificial Sequence
  Description of Artificial Sequence: Synthetic peptide
  Seed: KASESLQLV (MAGA1_HUMAN)
KVSESLQLV

SEQ ID NO: 46524 - protein, 10 aa, Artificial Sequence
  Description of Artificial Sequence: Synthetic peptide
  Seed: EALEAQQEAL (MAGA1_HUMAN)
EVLEAQQEAF

SEQ ID NO: 46525 - protein, 10 aa, Artificial Sequence
  Description of Artificial Sequence: Synthetic peptide
  Seed: PTTINFTRQR (MAGA1_HUMAN)
PMTINFTRQR

SEQ ID NO: 46526 - protein, 9 aa, Artificial Sequence
  Description of Artificial Sequence: Synthetic peptide
  Seed: KVADLVGFL (MAGA1_HUMAN)
KAADLVGFK

SEQ ID NO: 46527 - protein, 10 aa, Artificial Sequence
  Description of Artificial Sequence: Synthetic peptide
  Seed: SLFRAVITKK (MAGA1_HUMAN)
SFFRAVITKR

SEQ ID NO: 46528 - protein, 9 aa, Artificial Sequence
  Description of Artificial Sequence: Synthetic peptide
  Seed: SLFRAVITK (MAGA1_HUMAN)
SQFRAVITK

SEQ ID NO: 46529 - protein, 9 aa, Artificial Sequence
  Description of Artificial Sequence: Synthetic peptide
  Seed: GASAFPTTI (MAGA1_HUMAN)
GSSAFPTTI

SEQ ID NO: 46530 - protein, 10 aa, Artificial Sequence
  Description of Artificial Sequence: Synthetic peptide
  Seed: EFLWGPRALA (MAGA1_HUMAN)
EFLWGPRALL

SEQ ID NO: 46531 - protein, 10 aa, Artificial Sequence
  Description of Artificial Sequence: Synthetic peptide
  Seed: KVADLVGFLL (MAGA1_HUMAN)
KMADLVGFLC

SEQ ID NO: 46532 - protein, 9 aa, Artificial Sequence
  Description of Artificial Sequence: Synthetic peptide
  Seed: KVADLVGFL (MAGA1_HUMAN)
KVADLVGFI

SEQ ID NO: 46533 - protein, 10 aa, Artificial Sequence
  Description of Artificial Sequence: Synthetic peptide
  Seed: RVRFFFPSLR (MAGA1_HUMAN)
RCRFFFPSLL

SEQ ID NO: 46534 - protein, 11 aa, Artificial Sequence
  Description of Artificial Sequence: Synthetic peptide
  Seed: RAREPVTKAEM (MAGA1_HUMAN)
RPREPVTKAEV

SEQ ID NO: 46535 - protein, 9 aa, Artificial Sequence
  Description of Artificial Sequence: Synthetic peptide
  Seed: SAYGEPRKL (MAGA1_HUMAN)
SQYGEPRKW

SEQ ID NO: 46536 - protein, 11 aa, Artificial Sequence
  Description of Artificial Sequence: Synthetic peptide
  Seed: RALAETSYVKV (MAGA1_HUMAN)
RFLAETSYVKL

SEQ ID NO: 46537 - protein, 9 aa, Artificial Sequence
  Description of Artificial Sequence: Synthetic peptide
  Seed: KASESLQLV (MAGA1_HUMAN)
KLSESLQLF

SEQ ID NO: 46538 - protein, 9 aa, Artificial Sequence
  Description of Artificial Sequence: Synthetic peptide
  Seed: KTGFLIIVL (MAGA1_HUMAN)
KMGFLIIVW

SEQ ID NO: 46539 - protein, 9 aa, Artificial Sequence
  Description of Artificial Sequence: Synthetic peptide
  Seed: STDPPQSPQ (MAGA1_HUMAN)
SFDPPQSPV

SEQ ID NO: 46540 - protein, 9 aa, Artificial Sequence
  Description of Artificial Sequence: Synthetic peptide
  Seed: HSYVLVTCL (MAGA1_HUMAN)
HHYVLVTCY

SEQ ID NO: 46541 - protein, 9 aa, Artificial Sequence
  Description of Artificial Sequence: Synthetic peptide
  Seed: SAYGEPRKL (MAGA1_HUMAN)
SVYGEPRKL

SEQ ID NO: 46542 - protein, 9 aa, Artificial Sequence
  Description of Artificial Sequence: Synthetic peptide
  Seed: KASESLQLV (MAGA1_HUMAN)
KSSESLQLR

SEQ ID NO: 46543 - protein, 9 aa, Artificial Sequence
  Description of Artificial Sequence: Synthetic peptide
  Seed: KASESLQLV (MAGA1_HUMAN)
KLSESLQLI

SEQ ID NO: 46544 - protein, 10 aa, Artificial Sequence
  Description of Artificial Sequence: Synthetic peptide
  Seed: SLFRAVITKK (MAGA1_HUMAN)
SQFRAVITKK

SEQ ID NO: 46545 - protein, 10 aa, Artificial Sequence
  Description of Artificial Sequence: Synthetic peptide
  Seed: RFFFPSLREA (MAGA1_HUMAN)
RAFFPSLREK

SEQ ID NO: 46546 - protein, 8 aa, Artificial Sequence
  Description of Artificial Sequence: Synthetic peptide
  Seed: YVKVLEYV (MAGA1_HUMAN)
YLKVLEYL

SEQ ID NO: 46547 - protein, 10 aa, Artificial Sequence
  Description of Artificial Sequence: Synthetic peptide
  Seed: MLESVIKNYK (MAGA1_HUMAN)
MAESVIKNYK

SEQ ID NO: 46548 - protein, 10 aa, Artificial Sequence
  Description of Artificial Sequence: Synthetic peptide
  Seed: SARVRFFFPS (MAGA1_HUMAN)
SCRVRFFFPR

SEQ ID NO: 46549 - protein, 11 aa, Artificial Sequence
  Description of Artificial Sequence: Synthetic peptide
  Seed: ITKKVADLVGF (MAGA1_HUMAN)
IAKKVADLVGW

SEQ ID NO: 46550 - protein, 10 aa, Artificial Sequence
  Description of Artificial Sequence: Synthetic peptide
  Seed: KNYKHCFPEI (MAGA1_HUMAN)
KTYKHCFPEV

SEQ ID NO: 46551 - protein, 9 aa, Artificial Sequence
  Description of Artificial Sequence: Synthetic peptide
  Seed: ARVRFFFPS (MAGA1_HUMAN)
ARVRFFFPM

SEQ ID NO: 46552 - protein, 9 aa, Artificial Sequence
  Description of Artificial Sequence: Synthetic peptide
  Seed: YKHCFPEIF (MAGA1_HUMAN)
YHHCFPEIM

SEQ ID NO: 46553 - protein, 9 aa, Artificial Sequence
  Description of Artificial Sequence: Synthetic peptide
  Seed: ESLQLVFGI (MAGA1_HUMAN)
EALQLVFGL

SEQ ID NO: 46554 - protein, 10 aa, Artificial Sequence
  Description of Artificial Sequence: Synthetic peptide
  Seed: KNYKHCFPEI (MAGA1_HUMAN)
KYYKHCFPEL

SEQ ID NO: 46555 - protein, 9 aa, Artificial Sequence
  Description of Artificial Sequence: Synthetic peptide
  Seed: RVRFFFPSL (MAGA1_HUMAN)
RFRFFFPSK

SEQ ID NO: 46556 - protein, 9 aa, Artificial Sequence
  Description of Artificial Sequence: Synthetic peptide
  Seed: RAREPVTKA (MAGA1_HUMAN)
RAREPVTKM

SEQ ID NO: 46557 - protein, 10 aa, Artificial Sequence
  Description of Artificial Sequence: Synthetic peptide
  Seed: RVRFFFPSLR (MAGA1_HUMAN)
RDRFFFPSLV

SEQ ID NO: 46558 - protein, 9 aa, Artificial Sequence
  Description of Artificial Sequence: Synthetic peptide
  Seed: TKAEMLESV (MAGA1_HUMAN)
TVAEMLESM

SEQ ID NO: 46559 - protein, 9 aa, Artificial Sequence
  Description of Artificial Sequence: Synthetic peptide
  Seed: IAMEGGHAP (MAGA1_HUMAN)
ISMEGGHAV

SEQ ID NO: 46560 - protein, 10 aa, Artificial Sequence
  Description of Artificial Sequence: Synthetic peptide
  Seed: ARYEFLWGPR (MAGA1_HUMAN)
ALYEFLWGPR

SEQ ID NO: 46561 - protein, 9 aa, Artificial Sequence
  Description of Artificial Sequence: Synthetic peptide
  Seed: EADPTGHSY (MAGA1_HUMAN)
EADPTGHSM

SEQ ID NO: 46562 - protein, 9 aa, Artificial Sequence
  Description of Artificial Sequence: Synthetic peptide
  Seed: FFFPSLREA (MAGA1_HUMAN)
FFFPSLREH

SEQ ID NO: 46563 - protein, 9 aa, Artificial Sequence
  Description of Artificial Sequence: Synthetic peptide
  Seed: VADLVGFLL (MAGA1_HUMAN)
VIDLVGFLF

SEQ ID NO: 46564 - protein, 11 aa, Artificial Sequence
  Description of Artificial Sequence: Synthetic peptide
  Seed: YEFLWGPRALA (MAGA1_HUMAN)
YSFLWGPRALL

SEQ ID NO: 46565 - protein, 9 aa, Artificial Sequence
  Description of Artificial Sequence: Synthetic peptide
  Seed: RQVPDSDPA (MAGA1_HUMAN)
RKVPDSDPL

SEQ ID NO: 46566 - protein, 9 aa, Artificial Sequence
  Description of Artificial Sequence: Synthetic peptide
  Seed: KTGFLIIVL (MAGA1_HUMAN)
KLGFLIIVL

SEQ ID NO: 46567 - protein, 9 aa, Artificial Sequence
  Description of Artificial Sequence: Synthetic peptide
  Seed: SLFRAVITK (MAGA1_HUMAN)
SIFRAVITR

SEQ ID NO: 46568 - protein, 10 aa, Artificial Sequence
  Description of Artificial Sequence: Synthetic peptide
  Seed: EMLESVIKNY (MAGA1_HUMAN)
ESLESVIKNR

SEQ ID NO: 46569 - protein, 10 aa, Artificial Sequence
  Description of Artificial Sequence: Synthetic peptide
  Seed: KNYKHCFPEI (MAGA1_HUMAN)
KTYKHCFPEI

SEQ ID NO: 46570 - protein, 11 aa, Artificial Sequence
  Description of Artificial Sequence: Synthetic peptide
  Seed: FLWGPRALAET (MAGA1_HUMAN)
FAWGPRALAEV

SEQ ID NO: 46571 - protein, 9 aa, Artificial Sequence
  Description of Artificial Sequence: Synthetic peptide
  Seed: ALGLVCVQA (MAGA1_HUMAN)
ALGLVCVQI

SEQ ID NO: 46572 - protein, 9 aa, Artificial Sequence
  Description of Artificial Sequence: Synthetic peptide
  Seed: QSPQGASAF (MAGA1_HUMAN)
QVPQGASAM

SEQ ID NO: 46573 - protein, 9 aa, Artificial Sequence
  Description of Artificial Sequence: Synthetic peptide
  Seed: IAMEGGHAP (MAGA1_HUMAN)
ICMEGGHAL

SEQ ID NO: 46574 - protein, 10 aa, Artificial Sequence
  Description of Artificial Sequence: Synthetic peptide
  Seed: ASAFPTTINF (MAGA1_HUMAN)
AHAFPTTINF

SEQ ID NO: 46575 - protein, 9 aa, Artificial Sequence
  Description of Artificial Sequence: Synthetic peptide
  Seed: AETSYVKVL (MAGA1_HUMAN)
AQTSYVKVF

SEQ ID NO: 46576 - protein, 9 aa, Artificial Sequence
  Description of Artificial Sequence: Synthetic peptide
  Seed: AATSSSSPL (MAGA1_HUMAN)
APTSSSSPF

SEQ ID NO: 46577 - protein, 11 aa, Artificial Sequence
  Description of Artificial Sequence: Synthetic peptide
  Seed: FFFPSLREAAL (MAGA1_HUMAN)
FPFPSLREAAL

SEQ ID NO: 46578 - protein, 9 aa, Artificial Sequence
  Description of Artificial Sequence: Synthetic peptide
  Seed: SVMEVYDGR (MAGA1_HUMAN)
SWMEVYDGR

SEQ ID NO: 46579 - protein, 9 aa, Artificial Sequence
  Description of Artificial Sequence: Synthetic peptide
  Seed: LVTCLGLSY (MAGA1_HUMAN)
LVTCLGLSF

SEQ ID NO: 46580 - protein, 9 aa, Artificial Sequence
  Description of Artificial Sequence: Synthetic peptide
  Seed: IAMEGGHAP (MAGA1_HUMAN)
ILMEGGHAF

SEQ ID NO: 46581 - protein, 11 aa, Artificial Sequence
  Description of Artificial Sequence: Synthetic peptide
  Seed: SSSSPLVLGTL (MAGA1_HUMAN)
SMSSPLVLGTW

SEQ ID NO: 46582 - protein, 10 aa, Artificial Sequence
  Description of Artificial Sequence: Synthetic peptide
  Seed: KNYKHCFPEI (MAGA1_HUMAN)
KIYKHCFPEA

SEQ ID NO: 46583 - protein, 10 aa, Artificial Sequence
  Description of Artificial Sequence: Synthetic peptide
  Seed: ARVRFFFPSL (MAGA1_HUMAN)
ASVRFFFPSV

SEQ ID NO: 46584 - protein, 10 aa, Artificial Sequence
  Description of Artificial Sequence: Synthetic peptide
  Seed: ADLVGFLLLK (MAGA1_HUMAN)
AVLVGFLLLR

SEQ ID NO: 46585 - protein, 9 aa, Artificial Sequence
  Description of Artificial Sequence: Synthetic peptide
  Seed: LEAQQEALG (MAGA1_HUMAN)
LEAQQEALA

SEQ ID NO: 46586 - protein, 9 aa, Artificial Sequence
  Description of Artificial Sequence: Synthetic peptide
  Seed: LVTCLGLSY (MAGA1_HUMAN)
LKTCLGLSM

SEQ ID NO: 46587 - protein, 11 aa, Artificial Sequence
  Description of Artificial Sequence: Synthetic peptide
  Seed: RQVPDSDPARY (MAGA1_HUMAN)
RFVPDSDPARY

SEQ ID NO: 46588 - protein, 9 aa, Artificial Sequence
  Description of Artificial Sequence: Synthetic peptide
  Seed: RVRFFFPSL (MAGA1_HUMAN)
RSRFFFPSA

SEQ ID NO: 46589 - protein, 9 aa, Artificial Sequence
  Description of Artificial Sequence: Synthetic peptide
  Seed: FPSLREAAL (MAGA1_HUMAN)
FHSLREAAM

SEQ ID NO: 46590 - protein, 9 aa, Artificial Sequence
  Description of Artificial Sequence: Synthetic peptide
  Seed: SARVRFFFP (MAGA1_HUMAN)
STRVRFFFF

SEQ ID NO: 46591 - protein, 9 aa, Artificial Sequence
  Description of Artificial Sequence: Synthetic peptide
  Seed: HCFPEIFGK (MAGA1_HUMAN)
HVFPEIFGK

SEQ ID NO: 46592 - protein, 9 aa, Artificial Sequence
  Description of Artificial Sequence: Synthetic peptide
  Seed: REAALREEE (MAGA1_HUMAN)
REAALREEM

SEQ ID NO: 46593 - protein, 10 aa, Artificial Sequence
  Description of Artificial Sequence: Synthetic peptide
  Seed: FFPSLREAAL (MAGA1_HUMAN)
FLPSLREAAY

SEQ ID NO: 46594 - protein, 9 aa, Artificial Sequence
  Description of Artificial Sequence: Synthetic peptide
  Seed: YKHCFPEIF (MAGA1_HUMAN)
YRHCFPEIM

SEQ ID NO: 46595 - protein, 9 aa, Artificial Sequence
  Description of Artificial Sequence: Synthetic peptide
  Seed: LVLGTLEEV (MAGA1_HUMAN)
LLLGTLEEL

SEQ ID NO: 46596 - protein, 10 aa, Artificial Sequence
  Description of Artificial Sequence: Synthetic peptide
  Seed: SESLQLVFGI (MAGA1_HUMAN)
SSSLQLVFGW

SEQ ID NO: 46597 - protein, 9 aa, Artificial Sequence
  Description of Artificial Sequence: Synthetic peptide
  Seed: SARVRFFFP (MAGA1_HUMAN)
SMRVRFFFP

SEQ ID NO: 46598 - protein, 9 aa, Artificial Sequence
  Description of Artificial Sequence: Synthetic peptide
  Seed: QEALGLVCV (MAGA1_HUMAN)
QEALGLVCA

SEQ ID NO: 46599 - protein, 10 aa, Artificial Sequence
  Description of Artificial Sequence: Synthetic peptide
  Seed: EVYDGREHSA (MAGA1_HUMAN)
ELYDGREHSY

SEQ ID NO: 46600 - protein, 11 aa, Artificial Sequence
  Description of Artificial Sequence: Synthetic peptide
  Seed: ARVRFFFPSLR (MAGA1_HUMAN)
AQVRFFFPSLL

SEQ ID NO: 46601 - protein, 10 aa, Artificial Sequence
  Description of Artificial Sequence: Synthetic peptide
  Seed: ARVRFFFPSL (MAGA1_HUMAN)
ALVRFFFPSK

SEQ ID NO: 46602 - protein, 10 aa, Artificial Sequence
  Description of Artificial Sequence: Synthetic peptide
  Seed: YEFLWGPRAL (MAGA1_HUMAN)
YIFLWGPRAM

SEQ ID NO: 46603 - protein, 9 aa, Artificial Sequence
  Description of Artificial Sequence: Synthetic peptide
  Seed: TQDLVQEKY (MAGA1_HUMAN)
TSDLVQEKV

SEQ ID NO: 46604 - protein, 9 aa, Artificial Sequence
  Description of Artificial Sequence: Synthetic peptide
  Seed: RVRFFFPSL (MAGA1_HUMAN)
RQRFFFPST

SEQ ID NO: 46605 - protein, 10 aa, Artificial Sequence
  Description of Artificial Sequence: Synthetic peptide
  Seed: ARVRFFFPSL (MAGA1_HUMAN)
ADVRFFFPSV

SEQ ID NO: 46606 - protein, 8 aa, Artificial Sequence
  Description of Artificial Sequence: Synthetic peptide
  Seed: VADLVGFL (MAGA1_HUMAN)
VYDLVGFM

SEQ ID NO: 46607 - protein, 10 aa, Artificial Sequence
  Description of Artificial Sequence: Synthetic peptide
  Seed: FFPSLREAAL (MAGA1_HUMAN)
FVPSLREAAF

SEQ ID NO: 46608 - protein, 9 aa, Artificial Sequence
  Description of Artificial Sequence: Synthetic peptide
  Seed: DSDPARYEF (MAGA1_HUMAN)
DADPARYEF

SEQ ID NO: 46609 - protein, 10 aa, Artificial Sequence
  Description of Artificial Sequence: Synthetic peptide
  Seed: KNYKHCFPEI (MAGA1_HUMAN)
KKYKHCFPEF

SEQ ID NO: 46610 - protein, 10 aa, Artificial Sequence
  Description of Artificial Sequence: Synthetic peptide
  Seed: SARVRFFFPS (MAGA1_HUMAN)
STRVRFFFPI

SEQ ID NO: 46611 - protein, 10 aa, Artificial Sequence
  Description of Artificial Sequence: Synthetic peptide
  Seed: IMPKTGFLII (MAGA1_HUMAN)
IFPKTGFLIF

SEQ ID NO: 46612 - protein, 10 aa, Artificial Sequence
  Description of Artificial Sequence: Synthetic peptide
  Seed: DLVQEKYLEY (MAGA1_HUMAN)
DVVQEKYLEW

SEQ ID NO: 46613 - protein, 9 aa, Artificial Sequence
  Description of Artificial Sequence: Synthetic peptide
  Seed: TSYVKVLEY (MAGA1_HUMAN)
TVYVKVLEV

SEQ ID NO: 46614 - protein, 9 aa, Artificial Sequence
  Description of Artificial Sequence: Synthetic peptide
  Seed: SSPLVLGTL (MAGA1_HUMAN)
SIPLVLGTV

SEQ ID NO: 46615 - protein, 10 aa, Artificial Sequence
  Description of Artificial Sequence: Synthetic peptide
  Seed: KNYKHCFPEI (MAGA1_HUMAN)
KDYKHCFPEF

SEQ ID NO: 46616 - protein, 10 aa, Artificial Sequence
  Description of Artificial Sequence: Synthetic peptide
  Seed: ARYEFLWGPR (MAGA1_HUMAN)
AIYEFLWGPR

SEQ ID NO: 46617 - protein, 9 aa, Artificial Sequence
  Description of Artificial Sequence: Synthetic peptide
  Seed: REAALREEE (MAGA1_HUMAN)
REAALREET

SEQ ID NO: 46618 - protein, 9 aa, Artificial Sequence
  Description of Artificial Sequence: Synthetic peptide
  Seed: SAYGEPRKL (MAGA1_HUMAN)
SHYGEPRKM

SEQ ID NO: 46619 - protein, 9 aa, Artificial Sequence
  Description of Artificial Sequence: Synthetic peptide
  Seed: VYDGREHSA (MAGA1_HUMAN)
VYDGREHSV

SEQ ID NO: 46620 - protein, 10 aa, Artificial Sequence
  Description of Artificial Sequence: Synthetic peptide
  Seed: KNYKHCFPEI (MAGA1_HUMAN)
KSYKHCFPEA

SEQ ID NO: 46621 - protein, 9 aa, Artificial Sequence
  Description of Artificial Sequence: Synthetic peptide
  Seed: LVTCLGLSY (MAGA1_HUMAN)
LPTCLGLSM

SEQ ID NO: 46622 - protein, 9 aa, Artificial Sequence
  Description of Artificial Sequence: Synthetic peptide
  Seed: STDPPQSPQ (MAGA1_HUMAN)
SMDPPQSPV

SEQ ID NO: 46623 - protein, 9 aa, Artificial Sequence
  Description of Artificial Sequence: Synthetic peptide
  Seed: KVSARVRFF (MAGA1_HUMAN)
KISARVRFI

SEQ ID NO: 46624 - protein, 9 aa, Artificial Sequence
  Description of Artificial Sequence: Synthetic peptide
  Seed: EIWEELSVM (MAGA1_HUMAN)
EMWEELSVF

SEQ ID NO: 46625 - protein, 11 aa, Artificial Sequence
  Description of Artificial Sequence: Synthetic peptide
  Seed: SARVRFFFPSL (MAGA1_HUMAN)
SKRVRFFFPSK

SEQ ID NO: 46626 - protein, 10 aa, Artificial Sequence
  Description of Artificial Sequence: Synthetic peptide
  Seed: EYVIKVSARV (MAGA1_HUMAN)
ECVIKVSARV

SEQ ID NO: 46627 - protein, 9 aa, Artificial Sequence
  Description of Artificial Sequence: Synthetic peptide
  Seed: SAYGEPRKL (MAGA1_HUMAN)
SAYGEPRKM

SEQ ID NO: 46628 - protein, 9 aa, Artificial Sequence
  Description of Artificial Sequence: Synthetic peptide
  Seed: RALAETSYV (MAGA1_HUMAN)
RALAETSYI

SEQ ID NO: 46629 - protein, 11 aa, Artificial Sequence
  Description of Artificial Sequence: Synthetic peptide
  Seed: RVRFFFPSLRE (MAGA1_HUMAN)
RMRFFFPSLRI

SEQ ID NO: 46630 - protein, 9 aa, Artificial Sequence
  Description of Artificial Sequence: Synthetic peptide
  Seed: SSSPLVLGT (MAGA1_HUMAN)
SMSPLVLGL

SEQ ID NO: 46631 - protein, 9 aa, Artificial Sequence
  Description of Artificial Sequence: Synthetic peptide
  Seed: FFFPSLREA (MAGA1_HUMAN)
FAFPSLRET

SEQ ID NO: 46632 - protein, 10 aa, Artificial Sequence
  Description of Artificial Sequence: Synthetic peptide
  Seed: KVADLVGFLL (MAGA1_HUMAN)
KYADLVGFLW

SEQ ID NO: 46633 - protein, 10 aa, Artificial Sequence
  Description of Artificial Sequence: Synthetic peptide
  Seed: VKVLEYVIKV (MAGA1_HUMAN)
VMVLEYVIKL

SEQ ID NO: 46634 - protein, 9 aa, Artificial Sequence
  Description of Artificial Sequence: Synthetic peptide
  Seed: LVQEKYLEY (MAGA1_HUMAN)
LTQEKYLER

SEQ ID NO: 46635 - protein, 9 aa, Artificial Sequence
  Description of Artificial Sequence: Synthetic peptide
  Seed: RAREPVTKA (MAGA1_HUMAN)
RTREPVTKK

SEQ ID NO: 46636 - protein, 9 aa, Artificial Sequence
  Description of Artificial Sequence: Synthetic peptide
  Seed: RVRFFFPSL (MAGA1_HUMAN)
RTRFFFPSY

SEQ ID NO: 46637 - protein, 9 aa, Artificial Sequence
  Description of Artificial Sequence: Synthetic peptide
  Seed: LVTCLGLSY (MAGA1_HUMAN)
LQTCLGLSV

SEQ ID NO: 46638 - protein, 10 aa, Artificial Sequence
  Description of Artificial Sequence: Synthetic peptide
  Seed: FFPSLREAAL (MAGA1_HUMAN)
FPPSLREAAY

SEQ ID NO: 46639 - protein, 9 aa, Artificial Sequence
  Description of Artificial Sequence: Synthetic peptide
  Seed: AATSSSSPL (MAGA1_HUMAN)
APTSSSSPM

SEQ ID NO: 46640 - protein, 11 aa, Artificial Sequence
  Description of Artificial Sequence: Synthetic peptide
  Seed: KVLEYVIKVSA (MAGA1_HUMAN)
KTLEYVIKVSV

SEQ ID NO: 46641 - protein, 10 aa, Artificial Sequence
  Description of Artificial Sequence: Synthetic peptide
  Seed: ARVRFFFPSL (MAGA1_HUMAN)
ALVRFFFPSA

SEQ ID NO: 46642 - protein, 8 aa, Artificial Sequence
  Description of Artificial Sequence: Synthetic peptide
  Seed: YGEPRKLL (MAGA1_HUMAN)
YAEPRKLL

SEQ ID NO: 46643 - protein, 9 aa, Artificial Sequence
  Description of Artificial Sequence: Synthetic peptide
  Seed: ARVRFFFPS (MAGA1_HUMAN)
ARVRFFFPR

SEQ ID NO: 46644 - protein, 9 aa, Artificial Sequence
  Description of Artificial Sequence: Synthetic peptide
  Seed: TKAEMLESV (MAGA1_HUMAN)
TVAEMLESL

SEQ ID NO: 46645 - protein, 10 aa, Artificial Sequence
  Description of Artificial Sequence: Synthetic peptide
  Seed: SCILESLFRA (MAGA1_HUMAN)
SVILESLFRL

SEQ ID NO: 46646 - protein, 10 aa, Artificial Sequence
  Description of Artificial Sequence: Synthetic peptide
  Seed: EIFGKASESL (MAGA1_HUMAN)
ELFGKASESR

SEQ ID NO: 46647 - protein, 9 aa, Artificial Sequence
  Description of Artificial Sequence: Synthetic peptide
  Seed: SARVRFFFP (MAGA1_HUMAN)
SNRVRFFFA

SEQ ID NO: 46648 - protein, 9 aa, Artificial Sequence
  Description of Artificial Sequence: Synthetic peptide
  Seed: ATSSSSPLV (MAGA1_HUMAN)
ALSSSSPLI

SEQ ID NO: 46649 - protein, 11 aa, Artificial Sequence
  Description of Artificial Sequence: Synthetic peptide
  Seed: RVRFFFPSLRE (MAGA1_HUMAN)
RMRFFFPSLRC

SEQ ID NO: 46650 - protein, 10 aa, Artificial Sequence
  Description of Artificial Sequence: Synthetic peptide
  Seed: ARVRFFFPSL (MAGA1_HUMAN)
AHVRFFFPSV

SEQ ID NO: 46651 - protein, 9 aa, Artificial Sequence
  Description of Artificial Sequence: Synthetic peptide
  Seed: IAMEGGHAP (MAGA1_HUMAN)
IPMEGGHAF

SEQ ID NO: 46652 - protein, 9 aa, Artificial Sequence
  Description of Artificial Sequence: Synthetic peptide
  Seed: YVLVTCLGL (MAGA1_HUMAN)
YTLVTCLGL

SEQ ID NO: 46653 - protein, 10 aa, Artificial Sequence
  Description of Artificial Sequence: Synthetic peptide
  Seed: RVRFFFPSLR (MAGA1_HUMAN)
RFRFFFPSLF

SEQ ID NO: 46654 - protein, 10 aa, Artificial Sequence
  Description of Artificial Sequence: Synthetic peptide
  Seed: KVSARVRFFF (MAGA1_HUMAN)
KDSARVRFFF

SEQ ID NO: 46655 - protein, 9 aa, Artificial Sequence
  Description of Artificial Sequence: Synthetic peptide
  Seed: TSYVKVLEY (MAGA1_HUMAN)
TQYVKVLEY

SEQ ID NO: 46656 - protein, 9 aa, Artificial Sequence
  Description of Artificial Sequence: Synthetic peptide
  Seed: LKYRAREPV (MAGA1_HUMAN)
LQYRAREPF

SEQ ID NO: 46657 - protein, 10 aa, Artificial Sequence
  Description of Artificial Sequence: Synthetic peptide
  Seed: LTQDLVQEKY (MAGA1_HUMAN)
LIQDLVQEKY

SEQ ID NO: 46658 - protein, 9 aa, Artificial Sequence
  Description of Artificial Sequence: Synthetic peptide
  Seed: RAREPVTKA (MAGA1_HUMAN)
REREPVTKF

SEQ ID NO: 46659 - protein, 9 aa, Artificial Sequence
  Description of Artificial Sequence: Synthetic peptide
  Seed: VYDGREHSA (MAGA1_HUMAN)
VCDGREHSF

SEQ ID NO: 46660 - protein, 9 aa, Artificial Sequence
  Description of Artificial Sequence: Synthetic peptide
  Seed: YVLVTCLGL (MAGA1_HUMAN)
YLLVTCLGA

SEQ ID NO: 46661 - protein, 10 aa, Artificial Sequence
  Description of Artificial Sequence: Synthetic peptide
  Seed: MLESVIKNYK (MAGA1_HUMAN)
MSESVIKNYK

SEQ ID NO: 46662 - protein, 9 aa, Artificial Sequence
  Description of Artificial Sequence: Synthetic peptide
  Seed: STDPPQSPQ (MAGA1_HUMAN)
SADPPQSPI

SEQ ID NO: 46663 - protein, 9 aa, Artificial Sequence
  Description of Artificial Sequence: Synthetic peptide
  Seed: RALAETSYV (MAGA1_HUMAN)
RTLAETSYA

SEQ ID NO: 46664 - protein, 9 aa, Artificial Sequence
  Description of Artificial Sequence: Synthetic peptide
  Seed: LTQDLVQEK (MAGA1_HUMAN)
LRQDLVQEF

SEQ ID NO: 46665 - protein, 9 aa, Artificial Sequence
  Description of Artificial Sequence: Synthetic peptide
  Seed: QSPQGASAF (MAGA1_HUMAN)
QVPQGASAV

SEQ ID NO: 46666 - protein, 10 aa, Artificial Sequence
  Description of Artificial Sequence: Synthetic peptide
  Seed: YEFLWGPRAL (MAGA1_HUMAN)
YVFLWGPRAF

SEQ ID NO: 46667 - protein, 9 aa, Artificial Sequence
  Description of Artificial Sequence: Synthetic peptide
  Seed: SLHCKPEEA (MAGA1_HUMAN)
SMHCKPEEV

SEQ ID NO: 46668 - protein, 10 aa, Artificial Sequence
  Description of Artificial Sequence: Synthetic peptide
  Seed: SARVRFFFPS (MAGA1_HUMAN)
STRVRFFFPR

SEQ ID NO: 46669 - protein, 10 aa, Artificial Sequence
  Description of Artificial Sequence: Synthetic peptide
  Seed: FFPSLREAAL (MAGA1_HUMAN)
FQPSLREAAY

SEQ ID NO: 46670 - protein, 9 aa, Artificial Sequence
  Description of Artificial Sequence: Synthetic peptide
  Seed: VYDGREHSA (MAGA1_HUMAN)
VVDGREHSM

SEQ ID NO: 46671 - protein, 10 aa, Artificial Sequence
  Description of Artificial Sequence: Synthetic peptide
  Seed: KNYKHCFPEI (MAGA1_HUMAN)
KCYKHCFPEK

SEQ ID NO: 46672 - protein, 11 aa, Artificial Sequence
  Description of Artificial Sequence: Synthetic peptide
  Seed: STDPPQSPQGA (MAGA1_HUMAN)
STDPPQSPQGF

SEQ ID NO: 46673 - protein, 10 aa, Artificial Sequence
  Description of Artificial Sequence: Synthetic peptide
  Seed: SARVRFFFPS (MAGA1_HUMAN)
SARVRFFFPA

SEQ ID NO: 46674 - protein, 9 aa, Artificial Sequence
  Description of Artificial Sequence: Synthetic peptide
  Seed: SSPLVLGTL (MAGA1_HUMAN)
SLPLVLGTM

SEQ ID NO: 46675 - protein, 11 aa, Artificial Sequence
  Description of Artificial Sequence: Synthetic peptide
  Seed: RQVPDSDPARY (MAGA1_HUMAN)
REVPDSDPARW

SEQ ID NO: 46676 - protein, 9 aa, Artificial Sequence
  Description of Artificial Sequence: Synthetic peptide
  Seed: FLWGPRALA (MAGA1_HUMAN)
FTWGPRALL

SEQ ID NO: 46677 - protein, 9 aa, Artificial Sequence
  Description of Artificial Sequence: Synthetic peptide
  Seed: LVGFLLLKY (MAGA1_HUMAN)
LLGFLLLKY

SEQ ID NO: 46678 - protein, 10 aa, Artificial Sequence
  Description of Artificial Sequence: Synthetic peptide
  Seed: RYEFLWGPRA (MAGA1_HUMAN)
RYEFLWGPRL

SEQ ID NO: 46679 - protein, 9 aa, Artificial Sequence
  Description of Artificial Sequence: Synthetic peptide
  Seed: FLWGPRALA (MAGA1_HUMAN)
FTWGPRALI

SEQ ID NO: 46680 - protein, 9 aa, Artificial Sequence
  Description of Artificial Sequence: Synthetic peptide
  Seed: FFFPSLREA (MAGA1_HUMAN)
FIFPSLREV

SEQ ID NO: 46681 - protein, 9 aa, Artificial Sequence
  Description of Artificial Sequence: Synthetic peptide
  Seed: STDPPQSPQ (MAGA1_HUMAN)
SGDPPQSPL

SEQ ID NO: 46682 - protein, 9 aa, Artificial Sequence
  Description of Artificial Sequence: Synthetic peptide
  Seed: TSYVKVLEY (MAGA1_HUMAN)
TVYVKVLEF

SEQ ID NO: 46683 - protein, 10 aa, Artificial Sequence
  Description of Artificial Sequence: Synthetic peptide
  Seed: KKVADLVGFL (MAGA1_HUMAN)
KAVADLVGFV

SEQ ID NO: 46684 - protein, 9 aa, Artificial Sequence
  Description of Artificial Sequence: Synthetic peptide
  Seed: VYDGREHSA (MAGA1_HUMAN)
VFDGREHSV

SEQ ID NO: 46685 - protein, 9 aa, Artificial Sequence
  Description of Artificial Sequence: Synthetic peptide
  Seed: QSPQGASAF (MAGA1_HUMAN)
QLPQGASAY

SEQ ID NO: 46686 - protein, 9 aa, Artificial Sequence
  Description of Artificial Sequence: Synthetic peptide
  Seed: VADLVGFLL (MAGA1_HUMAN)
VIDLVGFLM

SEQ ID NO: 46687 - protein, 10 aa, Artificial Sequence
  Description of Artificial Sequence: Synthetic peptide
  Seed: LTQDLVQEKY (MAGA1_HUMAN)
LAQDLVQEKF

SEQ ID NO: 46688 - protein, 9 aa, Artificial Sequence
  Description of Artificial Sequence: Synthetic peptide
  Seed: AYGEPRKLL (MAGA1_HUMAN)
AAGEPRKLM

SEQ ID NO: 46689 - protein, 10 aa, Artificial Sequence
  Description of Artificial Sequence: Synthetic peptide
  Seed: YEFLWGPRAL (MAGA1_HUMAN)
YQFLWGPRAF

SEQ ID NO: 46690 - protein, 10 aa, Artificial Sequence
  Description of Artificial Sequence: Synthetic peptide
  Seed: CILESLFRAV (MAGA1_HUMAN)
CVLESLFRAV

SEQ ID NO: 46691 - protein, 9 aa, Artificial Sequence
  Description of Artificial Sequence: Synthetic peptide
  Seed: FFFPSLREA (MAGA1_HUMAN)
FSFPSLREI

SEQ ID NO: 46692 - protein, 9 aa, Artificial Sequence
  Description of Artificial Sequence: Synthetic peptide
  Seed: HCFPEIFGK (MAGA1_HUMAN)
HYFPEIFGR

SEQ ID NO: 46693 - protein, 10 aa, Artificial Sequence
  Description of Artificial Sequence: Synthetic peptide
  Seed: ARVRFFFPSL (MAGA1_HUMAN)
ASVRFFFPSK

SEQ ID NO: 46694 - protein, 10 aa, Artificial Sequence
  Description of Artificial Sequence: Synthetic peptide
  Seed: KVLEYVIKVS (MAGA1_HUMAN)
KLLEYVIKVT

SEQ ID NO: 46695 - protein, 11 aa, Artificial Sequence
  Description of Artificial Sequence: Synthetic peptide
  Seed: RVRFFFPSLRE (MAGA1_HUMAN)
RVRFFFPSLRC

SEQ ID NO: 46696 - protein, 9 aa, Artificial Sequence
  Description of Artificial Sequence: Synthetic peptide
  Seed: EIWEELSVM (MAGA1_HUMAN)
ETWEELSVY

SEQ ID NO: 46697 - protein, 11 aa, Artificial Sequence
  Description of Artificial Sequence: Synthetic peptide
  Seed: SAFPTTINFTR (MAGA1_HUMAN)
SVFPTTINFTR

SEQ ID NO: 46698 - protein, 9 aa, Artificial Sequence
  Description of Artificial Sequence: Synthetic peptide
  Seed: CILESLFRA (MAGA1_HUMAN)
CLLESLFRV

SEQ ID NO: 46699 - protein, 11 aa, Artificial Sequence
  Description of Artificial Sequence: Synthetic peptide
  Seed: KNYKHCFPEIF (MAGA1_HUMAN)
KMYKHCFPEIY

SEQ ID NO: 46700 - protein, 9 aa, Artificial Sequence
  Description of Artificial Sequence: Synthetic peptide
  Seed: IKVSARVRF (MAGA1_HUMAN)
ILVSARVRY

SEQ ID NO: 46701 - protein, 10 aa, Artificial Sequence
  Description of Artificial Sequence: Synthetic peptide
  Seed: KNYKHCFPEI (MAGA1_HUMAN)
KRYKHCFPEK

SEQ ID NO: 46702 - protein, 10 aa, Artificial Sequence
  Description of Artificial Sequence: Synthetic peptide
  Seed: SARVRFFFPS (MAGA1_HUMAN)
SCRVRFFFPY

SEQ ID NO: 46703 - protein, 11 aa, Artificial Sequence
  Description of Artificial Sequence: Synthetic peptide
  Seed: AEMLESVIKNY (MAGA1_HUMAN)
AQMLESVIKNY

SEQ ID NO: 46704 - protein, 9 aa, Artificial Sequence
  Description of Artificial Sequence: Synthetic peptide
  Seed: MPKTGFLII (MAGA1_HUMAN)
MAKTGFLIW

SEQ ID NO: 46705 - protein, 10 aa, Artificial Sequence
  Description of Artificial Sequence: Synthetic peptide
  Seed: REPVTKAEML (MAGA1_HUMAN)
REPVTKAEMW

SEQ ID NO: 46706 - protein, 9 aa, Artificial Sequence
  Description of Artificial Sequence: Synthetic peptide
  Seed: VIKNYKHCF (MAGA1_HUMAN)
VMKNYKHCF

SEQ ID NO: 46707 - protein, 9 aa, Artificial Sequence
  Description of Artificial Sequence: Synthetic peptide
  Seed: SAFPTTINF (MAGA1_HUMAN)
SGFPTTINM

SEQ ID NO: 46708 - protein, 9 aa, Artificial Sequence
  Description of Artificial Sequence: Synthetic peptide
  Seed: YKHCFPEIF (MAGA1_HUMAN)
YLHCFPEIY

SEQ ID NO: 46709 - protein, 10 aa, Artificial Sequence
  Description of Artificial Sequence: Synthetic peptide
  Seed: VLVTCLGLSY (MAGA1_HUMAN)
VWVTCLGLSY

SEQ ID NO: 46710 - protein, 9 aa, Artificial Sequence
  Description of Artificial Sequence: Synthetic peptide
  Seed: QIMPKTGFL (MAGA1_HUMAN)
QLMPKTGFR

SEQ ID NO: 46711 - protein, 10 aa, Artificial Sequence
  Description of Artificial Sequence: Synthetic peptide
  Seed: SARVRFFFPS (MAGA1_HUMAN)
STRVRFFFPV

SEQ ID NO: 46712 - protein, 11 aa, Artificial Sequence
  Description of Artificial Sequence: Synthetic peptide
  Seed: SARVRFFFPSL (MAGA1_HUMAN)
SQRVRFFFPSK

SEQ ID NO: 46713 - protein, 9 aa, Artificial Sequence
  Description of Artificial Sequence: Synthetic peptide
  Seed: QSPQGASAF (MAGA1_HUMAN)
QIPQGASAY

SEQ ID NO: 46714 - protein, 9 aa, Artificial Sequence
  Description of Artificial Sequence: Synthetic peptide
  Seed: RAVITKKVA (MAGA1_HUMAN)
RAVITKKVY

SEQ ID NO: 46715 - protein, 9 aa, Artificial Sequence
  Description of Artificial Sequence: Synthetic peptide
  Seed: QSPQGASAF (MAGA1_HUMAN)
QAPQGASAI

SEQ ID NO: 46716 - protein, 9 aa, Artificial Sequence
  Description of Artificial Sequence: Synthetic peptide
  Seed: SAFPTTINF (MAGA1_HUMAN)
SRFPTTINY

SEQ ID NO: 46717 - protein, 10 aa, Artificial Sequence
  Description of Artificial Sequence: Synthetic peptide
  Seed: QIMPKTGFLI (MAGA1_HUMAN)
QQMPKTGFLV

SEQ ID NO: 46718 - protein, 9 aa, Artificial Sequence
  Description of Artificial Sequence: Synthetic peptide
  Seed: ADLVGFLLL (MAGA1_HUMAN)
AELVGFLLP

SEQ ID NO: 46719 - protein, 9 aa, Artificial Sequence
  Description of Artificial Sequence: Synthetic peptide
  Seed: LESLFRAVI (MAGA1_HUMAN)
LQSLFRAVL

SEQ ID NO: 46720 - protein, 9 aa, Artificial Sequence
  Description of Artificial Sequence: Synthetic peptide
  Seed: VQAATSSSS (MAGA1_HUMAN)
VQAATSSSH

SEQ ID NO: 46721 - protein, 9 aa, Artificial Sequence
  Description of Artificial Sequence: Synthetic peptide
  Seed: RVRFFFPSL (MAGA1_HUMAN)
RKRFFFPSF

SEQ ID NO: 46722 - protein, 10 aa, Artificial Sequence
  Description of Artificial Sequence: Synthetic peptide
  Seed: ARVRFFFPSL (MAGA1_HUMAN)
ACVRFFFPSI

SEQ ID NO: 46723 - protein, 9 aa, Artificial Sequence
  Description of Artificial Sequence: Synthetic peptide
  Seed: VQAATSSSS (MAGA1_HUMAN)
VVAATSSSF

SEQ ID NO: 46724 - protein, 9 aa, Artificial Sequence
  Description of Artificial Sequence: Synthetic peptide
  Seed: RAREPVTKA (MAGA1_HUMAN)
RTREPVTKT

SEQ ID NO: 46725 - protein, 10 aa, Artificial Sequence
  Description of Artificial Sequence: Synthetic peptide
  Seed: KNYKHCFPEI (MAGA1_HUMAN)
KTYKHCFPEF

SEQ ID NO: 46726 - protein, 10 aa, Artificial Sequence
  Description of Artificial Sequence: Synthetic peptide
  Seed: ADLVGFLLLK (MAGA1_HUMAN)
ATLVGFLLLY

SEQ ID NO: 46727 - protein, 9 aa, Artificial Sequence
  Description of Artificial Sequence: Synthetic peptide
  Seed: RVRFFFPSL (MAGA1_HUMAN)
RTRFFFPSL

SEQ ID NO: 46728 - protein, 9 aa, Artificial Sequence
  Description of Artificial Sequence: Synthetic peptide
  Seed: KVLEYVIKV (MAGA1_HUMAN)
KSLEYVIKF

SEQ ID NO: 46729 - protein, 10 aa, Artificial Sequence
  Description of Artificial Sequence: Synthetic peptide
  Seed: SCILESLFRA (MAGA1_HUMAN)
SYILESLFRV

SEQ ID NO: 46730 - protein, 10 aa, Artificial Sequence
  Description of Artificial Sequence: Synthetic peptide
  Seed: KVADLVGFLL (MAGA1_HUMAN)
KAADLVGFLR

SEQ ID NO: 46731 - protein, 10 aa, Artificial Sequence
  Description of Artificial Sequence: Synthetic peptide
  Seed: TSYVKVLEYV (MAGA1_HUMAN)
TFYVKVLEYL

SEQ ID NO: 46732 - protein, 9 aa, Artificial Sequence
  Description of Artificial Sequence: Synthetic peptide
  Seed: RVRFFFPSL (MAGA1_HUMAN)
RARFFFPSN

SEQ ID NO: 46733 - protein, 10 aa, Artificial Sequence
  Description of Artificial Sequence: Synthetic peptide
  Seed: VIKVSARVRF (MAGA1_HUMAN)
VMKVSARVRY

SEQ ID NO: 46734 - protein, 9 aa, Artificial Sequence
  Description of Artificial Sequence: Synthetic peptide
  Seed: VADLVGFLL (MAGA1_HUMAN)
VVDLVGFLV

SEQ ID NO: 46735 - protein, 11 aa, Artificial Sequence
  Description of Artificial Sequence: Synthetic peptide
  Seed: STDPPQSPQGA (MAGA1_HUMAN)
SVDPPQSPQGL

SEQ ID NO: 46736 - protein, 9 aa, Artificial Sequence
  Description of Artificial Sequence: Synthetic peptide
  Seed: RALAETSYV (MAGA1_HUMAN)
RILAETSYY

SEQ ID NO: 46737 - protein, 10 aa, Artificial Sequence
  Description of Artificial Sequence: Synthetic peptide
  Seed: FFPSLREAAL (MAGA1_HUMAN)
FPPSLREAAI

SEQ ID NO: 46738 - protein, 9 aa, Artificial Sequence
  Description of Artificial Sequence: Synthetic peptide
  Seed: KYRAREPVT (MAGA1_HUMAN)
KSRAREPVM

SEQ ID NO: 46739 - protein, 9 aa, Artificial Sequence
  Description of Artificial Sequence: Synthetic peptide
  Seed: RALAETSYV (MAGA1_HUMAN)
RALAETSYM

SEQ ID NO: 46740 - protein, 10 aa, Artificial Sequence
  Description of Artificial Sequence: Synthetic peptide
  Seed: KVSARVRFFF (MAGA1_HUMAN)
KNSARVRFFY

SEQ ID NO: 46741 - protein, 10 aa, Artificial Sequence
  Description of Artificial Sequence: Synthetic peptide
  Seed: ARVRFFFPSL (MAGA1_HUMAN)
ANVRFFFPSV

SEQ ID NO: 46742 - protein, 11 aa, Artificial Sequence
  Description of Artificial Sequence: Synthetic peptide
  Seed: KVADLVGFLLL (MAGA1_HUMAN)
KLADLVGFLLN

SEQ ID NO: 46743 - protein, 10 aa, Artificial Sequence
  Description of Artificial Sequence: Synthetic peptide
  Seed: VLVTCLGLSY (MAGA1_HUMAN)
VAVTCLGLSY

SEQ ID NO: 46744 - protein, 10 aa, Artificial Sequence
  Description of Artificial Sequence: Synthetic peptide
  Seed: AFPTTINFTR (MAGA1_HUMAN)
AYPTTINFTR

SEQ ID NO: 46745 - protein, 11 aa, Artificial Sequence
  Description of Artificial Sequence: Synthetic peptide
  Seed: EVYDGREHSAY (MAGA1_HUMAN)
EVYDGREHSAK

SEQ ID NO: 46746 - protein, 9 aa, Artificial Sequence
  Description of Artificial Sequence: Synthetic peptide
  Seed: CILESLFRA (MAGA1_HUMAN)
CLLESLFRC

SEQ ID NO: 46747 - protein, 10 aa, Artificial Sequence
  Description of Artificial Sequence: Synthetic peptide
  Seed: RVRFFFPSLR (MAGA1_HUMAN)
RMRFFFPSLP

SEQ ID NO: 46748 - protein, 11 aa, Artificial Sequence
  Description of Artificial Sequence: Synthetic peptide
  Seed: RQVPDSDPARY (MAGA1_HUMAN)
RTVPDSDPARM

SEQ ID NO: 46749 - protein, 9 aa, Artificial Sequence
  Description of Artificial Sequence: Synthetic peptide
  Seed: RQRQPSEGS (MAGA1_HUMAN)
RVRQPSEGA

SEQ ID NO: 46750 - protein, 8 aa, Artificial Sequence
  Description of Artificial Sequence: Synthetic peptide
  Seed: EELSVMEV (MAGA1_HUMAN)
EELSVMEL

SEQ ID NO: 46751 - protein, 11 aa, Artificial Sequence
  Description of Artificial Sequence: Synthetic peptide
  Seed: KVADLVGFLLL (MAGA1_HUMAN)
KLADLVGFLLI

SEQ ID NO: 46752 - protein, 9 aa, Artificial Sequence
  Description of Artificial Sequence: Synthetic peptide
  Seed: KKVADLVGF (MAGA1_HUMAN)
KAVADLVGY

SEQ ID NO: 46753 - protein, 10 aa, Artificial Sequence
  Description of Artificial Sequence: Synthetic peptide
  Seed: KVLEYVIKVS (MAGA1_HUMAN)
KMLEYVIKVV

SEQ ID NO: 46754 - protein, 11 aa, Artificial Sequence
  Description of Artificial Sequence: Synthetic peptide
  Seed: RVRFFFPSLRE (MAGA1_HUMAN)
RVRFFFPSLRT

SEQ ID NO: 46755 - protein, 9 aa, Artificial Sequence
  Description of Artificial Sequence: Synthetic peptide
  Seed: SAFPTTINF (MAGA1_HUMAN)
SLFPTTINI

SEQ ID NO: 46756 - protein, 10 aa, Artificial Sequence
  Description of Artificial Sequence: Synthetic peptide
  Seed: FFPSLREAAL (MAGA1_HUMAN)
FTPSLREAAL

SEQ ID NO: 46757 - protein, 9 aa, Artificial Sequence
  Description of Artificial Sequence: Synthetic peptide
  Seed: LESLFRAVI (MAGA1_HUMAN)
LNSLFRAVY

SEQ ID NO: 46758 - protein, 10 aa, Artificial Sequence
  Description of Artificial Sequence: Synthetic peptide
  Seed: EALEAQQEAL (MAGA1_HUMAN)
EVLEAQQEAR

SEQ ID NO: 46759 - protein, 9 aa, Artificial Sequence
  Description of Artificial Sequence: Synthetic peptide
  Seed: MPKTGFLII (MAGA1_HUMAN)
MQKTGFLII

SEQ ID NO: 46760 - protein, 10 aa, Artificial Sequence
  Description of Artificial Sequence: Synthetic peptide
  Seed: ASAFPTTINF (MAGA1_HUMAN)
AQAFPTTINM

SEQ ID NO: 46761 - protein, 9 aa, Artificial Sequence
  Description of Artificial Sequence: Synthetic peptide
  Seed: AATSSSSPL (MAGA1_HUMAN)
AWTSSSSPL

SEQ ID NO: 46762 - protein, 10 aa, Artificial Sequence
  Description of Artificial Sequence: Synthetic peptide
  Seed: DVKEADPTGH (MAGA1_HUMAN)
DVKEADPTGK

SEQ ID NO: 46763 - protein, 9 aa, Artificial Sequence
  Description of Artificial Sequence: Synthetic peptide
  Seed: HCFPEIFGK (MAGA1_HUMAN)
HSFPEIFGY

SEQ ID NO: 46764 - protein, 9 aa, Artificial Sequence
  Description of Artificial Sequence: Synthetic peptide
  Seed: TSCILESLF (MAGA1_HUMAN)
TMCILESLY

SEQ ID NO: 46765 - protein, 9 aa, Artificial Sequence
  Description of Artificial Sequence: Synthetic peptide
  Seed: TQDLVQEKY (MAGA1_HUMAN)
TIDLVQEKM

SEQ ID NO: 46766 - protein, 10 aa, Artificial Sequence
  Description of Artificial Sequence: Synthetic peptide
  Seed: RVRFFFPSLR (MAGA1_HUMAN)
RKRFFFPSLM

SEQ ID NO: 46767 - protein, 9 aa, Artificial Sequence
  Description of Artificial Sequence: Synthetic peptide
  Seed: LKYRAREPV (MAGA1_HUMAN)
LHYRAREPM

SEQ ID NO: 46768 - protein, 9 aa, Artificial Sequence
  Description of Artificial Sequence: Synthetic peptide
  Seed: RVRFFFPSL (MAGA1_HUMAN)
RWRFFFPSY

SEQ ID NO: 46769 - protein, 9 aa, Artificial Sequence
  Description of Artificial Sequence: Synthetic peptide
  Seed: IKVSARVRF (MAGA1_HUMAN)
IMVSARVRF

SEQ ID NO: 46770 - protein, 11 aa, Artificial Sequence
  Description of Artificial Sequence: Synthetic peptide
  Seed: YEFLWGPRALA (MAGA1_HUMAN)
YEFLWGPRALI

SEQ ID NO: 46771 - protein, 9 aa, Artificial Sequence
  Description of Artificial Sequence: Synthetic peptide
  Seed: RVRFFFPSL (MAGA1_HUMAN)
RIRFFFPSH

SEQ ID NO: 46772 - protein, 9 aa, Artificial Sequence
  Description of Artificial Sequence: Synthetic peptide
  Seed: LVGFLLLKY (MAGA1_HUMAN)
LMGFLLLKY

SEQ ID NO: 46773 - protein, 9 aa, Artificial Sequence
  Description of Artificial Sequence: Synthetic peptide
  Seed: TQDLVQEKY (MAGA1_HUMAN)
TQDLVQEKI

SEQ ID NO: 46774 - protein, 9 aa, Artificial Sequence
  Description of Artificial Sequence: Synthetic peptide
  Seed: VRFFFPSLR (MAGA1_HUMAN)
VQFFFPSLK

SEQ ID NO: 46775 - protein, 9 aa, Artificial Sequence
  Description of Artificial Sequence: Synthetic peptide
  Seed: LVLGTLEEV (MAGA1_HUMAN)
LALGTLEEV

SEQ ID NO: 46776 - protein, 10 aa, Artificial Sequence
  Description of Artificial Sequence: Synthetic peptide
  Seed: RVRFFFPSLR (MAGA1_HUMAN)
RSRFFFPSLE

SEQ ID NO: 46777 - protein, 11 aa, Artificial Sequence
  Description of Artificial Sequence: Synthetic peptide
  Seed: RYEFLWGPRAL (MAGA1_HUMAN)
RYEFLWGPRAF

SEQ ID NO: 46778 - protein, 9 aa, Artificial Sequence
  Description of Artificial Sequence: Synthetic peptide
  Seed: LFRAVITKK (MAGA1_HUMAN)
LNRAVITKR

SEQ ID NO: 46779 - protein, 9 aa, Artificial Sequence
  Description of Artificial Sequence: Synthetic peptide
  Seed: KVADLVGFL (MAGA1_HUMAN)
KSADLVGFW

SEQ ID NO: 46780 - protein, 9 aa, Artificial Sequence
  Description of Artificial Sequence: Synthetic peptide
  Seed: MSLEQRSLH (MAGA1_HUMAN)
MVLEQRSLR

SEQ ID NO: 46781 - protein, 9 aa, Artificial Sequence
  Description of Artificial Sequence: Synthetic peptide
  Seed: KVLEYVIKV (MAGA1_HUMAN)
KQLEYVIKK

SEQ ID NO: 46782 - protein, 9 aa, Artificial Sequence
  Description of Artificial Sequence: Synthetic peptide
  Seed: VADLVGFLL (MAGA1_HUMAN)
VSDLVGFLW

SEQ ID NO: 46783 - protein, 10 aa, Artificial Sequence
  Description of Artificial Sequence: Synthetic peptide
  Seed: RVRFFFPSLR (MAGA1_HUMAN)
RHRFFFPSLM

SEQ ID NO: 46784 - protein, 10 aa, Artificial Sequence
  Description of Artificial Sequence: Synthetic peptide
  Seed: SSSPLVLGTL (MAGA1_HUMAN)
SCSPLVLGTW

SEQ ID NO: 46785 - protein, 9 aa, Artificial Sequence
  Description of Artificial Sequence: Synthetic peptide
  Seed: TSYVKVLEY (MAGA1_HUMAN)
TLYVKVLEF

SEQ ID NO: 46786 - protein, 10 aa, Artificial Sequence
  Description of Artificial Sequence: Synthetic peptide
  Seed: RVRFFFPSLR (MAGA1_HUMAN)
RKRFFFPSLK

SEQ ID NO: 46787 - protein, 11 aa, Artificial Sequence
  Description of Artificial Sequence: Synthetic peptide
  Seed: ARVRFFFPSLR (MAGA1_HUMAN)
AQVRFFFPSLR

SEQ ID NO: 46788 - protein, 10 aa, Artificial Sequence
  Description of Artificial Sequence: Synthetic peptide
  Seed: FFPSLREAAL (MAGA1_HUMAN)
FSPSLREAAM

SEQ ID NO: 46789 - protein, 9 aa, Artificial Sequence
  Description of Artificial Sequence: Synthetic peptide
  Seed: MEVYDGREH (MAGA1_HUMAN)
MEVYDGREY

SEQ ID NO: 46790 - protein, 9 aa, Artificial Sequence
  Description of Artificial Sequence: Synthetic peptide
  Seed: VADLVGFLL (MAGA1_HUMAN)
VSDLVGFLI

SEQ ID NO: 46791 - protein, 9 aa, Artificial Sequence
  Description of Artificial Sequence: Synthetic peptide
  Seed: AATSSSSPL (MAGA1_HUMAN)
AWTSSSSPM

SEQ ID NO: 46792 - protein, 11 aa, Artificial Sequence
  Description of Artificial Sequence: Synthetic peptide
  Seed: RQVPDSDPARY (MAGA1_HUMAN)
RVVPDSDPARW

SEQ ID NO: 46793 - protein, 9 aa, Artificial Sequence
  Description of Artificial Sequence: Synthetic peptide
  Seed: DSDPARYEF (MAGA1_HUMAN)
DADPARYEV

SEQ ID NO: 46794 - protein, 8 aa, Artificial Sequence
  Description of Artificial Sequence: Synthetic peptide
  Seed: RAREPVTK (MAGA1_HUMAN)
RMREPVTK

SEQ ID NO: 46795 - protein, 9 aa, Artificial Sequence
  Description of Artificial Sequence: Synthetic peptide
  Seed: YVIKVSARV (MAGA1_HUMAN)
YMIKVSARM

SEQ ID NO: 46796 - protein, 10 aa, Artificial Sequence
  Description of Artificial Sequence: Synthetic peptide
  Seed: KVLEYVIKVS (MAGA1_HUMAN)
KLLEYVIKVH

SEQ ID NO: 46797 - protein, 11 aa, Artificial Sequence
  Description of Artificial Sequence: Synthetic peptide
  Seed: RVRFFFPSLRE (MAGA1_HUMAN)
RNRFFFPSLRK

SEQ ID NO: 46798 - protein, 9 aa, Artificial Sequence
  Description of Artificial Sequence: Synthetic peptide
  Seed: GASAFPTTI (MAGA1_HUMAN)
GLSAFPTTW

SEQ ID NO: 46799 - protein, 10 aa, Artificial Sequence
  Description of Artificial Sequence: Synthetic peptide
  Seed: KVADLVGFLL (MAGA1_HUMAN)
KVADLVGFLF

SEQ ID NO: 46800 - protein, 9 aa, Artificial Sequence
  Description of Artificial Sequence: Synthetic peptide
  Seed: YVLVTCLGL (MAGA1_HUMAN)
YSLVTCLGY

SEQ ID NO: 46801 - protein, 10 aa, Artificial Sequence
  Description of Artificial Sequence: Synthetic peptide
  Seed: KVLEYVIKVS (MAGA1_HUMAN)
KLLEYVIKVM

SEQ ID NO: 46802 - protein, 9 aa, Artificial Sequence
  Description of Artificial Sequence: Synthetic peptide
  Seed: QDLVQEKYL (MAGA1_HUMAN)
QELVQEKYM

SEQ ID NO: 46803 - protein, 9 aa, Artificial Sequence
  Description of Artificial Sequence: Synthetic peptide
  Seed: STDPPQSPQ (MAGA1_HUMAN)
SQDPPQSPM

SEQ ID NO: 46804 - protein, 10 aa, Artificial Sequence
  Description of Artificial Sequence: Synthetic peptide
  Seed: VTKAEMLESV (MAGA1_HUMAN)
VLKAEMLESM

SEQ ID NO: 46805 - protein, 10 aa, Artificial Sequence
  Description of Artificial Sequence: Synthetic peptide
  Seed: SARVRFFFPS (MAGA1_HUMAN)
SCRVRFFFPK

SEQ ID NO: 46806 - protein, 10 aa, Artificial Sequence
  Description of Artificial Sequence: Synthetic peptide
  Seed: RVRFFFPSLR (MAGA1_HUMAN)
RLRFFFPSLG

SEQ ID NO: 46807 - protein, 9 aa, Artificial Sequence
  Description of Artificial Sequence: Synthetic peptide
  Seed: MPKTGFLII (MAGA1_HUMAN)
MIKTGFLIL

SEQ ID NO: 46808 - protein, 8 aa, Artificial Sequence
  Description of Artificial Sequence: Synthetic peptide
  Seed: HSYVLVTC (MAGA1_HUMAN)
HSYVLVTV

SEQ ID NO: 46809 - protein, 9 aa, Artificial Sequence
  Description of Artificial Sequence: Synthetic peptide
  Seed: KVLEYVIKV (MAGA1_HUMAN)
KLLEYVIKI

SEQ ID NO: 46810 - protein, 10 aa, Artificial Sequence
  Description of Artificial Sequence: Synthetic peptide
  Seed: AREPVTKAEM (MAGA1_HUMAN)
AQEPVTKAEY

SEQ ID NO: 46811 - protein, 9 aa, Artificial Sequence
  Description of Artificial Sequence: Synthetic peptide
  Seed: SESLQLVFG (MAGA1_HUMAN)
SESLQLVFV

SEQ ID NO: 46812 - protein, 9 aa, Artificial Sequence
  Description of Artificial Sequence: Synthetic peptide
  Seed: TQDLVQEKY (MAGA1_HUMAN)
TMDLVQEKY

SEQ ID NO: 46813 - protein, 10 aa, Artificial Sequence
  Description of Artificial Sequence: Synthetic peptide
  Seed: LVQEKYLEYR (MAGA1_HUMAN)
LLQEKYLEYR

SEQ ID NO: 46814 - protein, 9 aa, Artificial Sequence
  Description of Artificial Sequence: Synthetic peptide
  Seed: LVQEKYLEY (MAGA1_HUMAN)
LYQEKYLEF

SEQ ID NO: 46815 - protein, 9 aa, Artificial Sequence
  Description of Artificial Sequence: Synthetic peptide
  Seed: LVGFLLLKY (MAGA1_HUMAN)
LYGFLLLKY

SEQ ID NO: 46816 - protein, 9 aa, Artificial Sequence
  Description of Artificial Sequence: Synthetic peptide
  Seed: VSARVRFFF (MAGA1_HUMAN)
VKARVRFFY

SEQ ID NO: 46817 - protein, 9 aa, Artificial Sequence
  Description of Artificial Sequence: Synthetic peptide
  Seed: CILESLFRA (MAGA1_HUMAN)
CILESLFRM

SEQ ID NO: 46818 - protein, 11 aa, Artificial Sequence
  Description of Artificial Sequence: Synthetic peptide
  Seed: REEEGPSTSCI (MAGA1_HUMAN)
REEEGPSTSCM

SEQ ID NO: 46819 - protein, 9 aa, Artificial Sequence
  Description of Artificial Sequence: Synthetic peptide
  Seed: LKYRAREPV (MAGA1_HUMAN)
LKYRAREPF

SEQ ID NO: 46820 - protein, 9 aa, Artificial Sequence
  Description of Artificial Sequence: Synthetic peptide
  Seed: SLFRAVITK (MAGA1_HUMAN)
SSFRAVITK

SEQ ID NO: 46821 - protein, 9 aa, Artificial Sequence
  Description of Artificial Sequence: Synthetic peptide
  Seed: FPTTINFTR (MAGA1_HUMAN)
FPTTINFTY

SEQ ID NO: 46822 - protein, 9 aa, Artificial Sequence
  Description of Artificial Sequence: Synthetic peptide
  Seed: DSDPARYEF (MAGA1_HUMAN)
DMDPARYEY

SEQ ID NO: 46823 - protein, 9 aa, Artificial Sequence
  Description of Artificial Sequence: Synthetic peptide
  Seed: RALAETSYV (MAGA1_HUMAN)
RLLAETSYV

SEQ ID NO: 46824 - protein, 11 aa, Artificial Sequence
  Description of Artificial Sequence: Synthetic peptide
  Seed: YEFLWGPRALA (MAGA1_HUMAN)
YTFLWGPRALI

SEQ ID NO: 46825 - protein, 10 aa, Artificial Sequence
  Description of Artificial Sequence: Synthetic peptide
  Seed: GPRALAETSY (MAGA1_HUMAN)
GQRALAETSY

SEQ ID NO: 46826 - protein, 9 aa, Artificial Sequence
  Description of Artificial Sequence: Synthetic peptide
  Seed: NQIMPKTGF (MAGA1_HUMAN)
NAIMPKTGY

SEQ ID NO: 46827 - protein, 9 aa, Artificial Sequence
  Description of Artificial Sequence: Synthetic peptide
  Seed: VADLVGFLL (MAGA1_HUMAN)
VYDLVGFLV

SEQ ID NO: 46828 - protein, 9 aa, Artificial Sequence
  Description of Artificial Sequence: Synthetic peptide
  Seed: RQRQPSEGS (MAGA1_HUMAN)
RSRQPSEGI

SEQ ID NO: 46829 - protein, 10 aa, Artificial Sequence
  Description of Artificial Sequence: Synthetic peptide
  Seed: ASAFPTTINF (MAGA1_HUMAN)
AHAFPTTINY

SEQ ID NO: 46830 - protein, 9 aa, Artificial Sequence
  Description of Artificial Sequence: Synthetic peptide
  Seed: EADPTGHSY (MAGA1_HUMAN)
EFDPTGHSI

SEQ ID NO: 46831 - protein, 8 aa, Artificial Sequence
  Description of Artificial Sequence: Synthetic peptide
  Seed: FLWGPRAL (MAGA1_HUMAN)
FFWGPRAL

SEQ ID NO: 46832 - protein, 9 aa, Artificial Sequence
  Description of Artificial Sequence: Synthetic peptide
  Seed: QPSEGSSSR (MAGA1_HUMAN)
QASEGSSSK

SEQ ID NO: 46833 - protein, 10 aa, Artificial Sequence
  Description of Artificial Sequence: Synthetic peptide
  Seed: KASESLQLVF (MAGA1_HUMAN)
KASESLQLVW

SEQ ID NO: 46834 - protein, 9 aa, Artificial Sequence
  Description of Artificial Sequence: Synthetic peptide
  Seed: KVSARVRFF (MAGA1_HUMAN)
KTSARVRFA

SEQ ID NO: 46835 - protein, 10 aa, Artificial Sequence
  Description of Artificial Sequence: Synthetic peptide
  Seed: ADLVGFLLLK (MAGA1_HUMAN)
ANLVGFLLLR

SEQ ID NO: 46836 - protein, 10 aa, Artificial Sequence
  Description of Artificial Sequence: Synthetic peptide
  Seed: DLVGFLLLKY (MAGA1_HUMAN)
DVVGFLLLKF

SEQ ID NO: 46837 - protein, 10 aa, Artificial Sequence
  Description of Artificial Sequence: Synthetic peptide
  Seed: SARVRFFFPS (MAGA1_HUMAN)
STRVRFFFPT

SEQ ID NO: 46838 - protein, 9 aa, Artificial Sequence
  Description of Artificial Sequence: Synthetic peptide
  Seed: VYDGREHSA (MAGA1_HUMAN)
VVDGREHSF

SEQ ID NO: 46839 - protein, 11 aa, Artificial Sequence
  Description of Artificial Sequence: Synthetic peptide
  Seed: KVSARVRFFFP (MAGA1_HUMAN)
KYSARVRFFFA

SEQ ID NO: 46840 - protein, 10 aa, Artificial Sequence
  Description of Artificial Sequence: Synthetic peptide
  Seed: RVRFFFPSLR (MAGA1_HUMAN)
RDRFFFPSLF

SEQ ID NO: 46841 - protein, 9 aa, Artificial Sequence
  Description of Artificial Sequence: Synthetic peptide
  Seed: VQAATSSSS (MAGA1_HUMAN)
VKAATSSSI

SEQ ID NO: 46842 - protein, 10 aa, Artificial Sequence
  Description of Artificial Sequence: Synthetic peptide
  Seed: SSSPLVLGTL (MAGA1_HUMAN)
SMSPLVLGTV

SEQ ID NO: 46843 - protein, 9 aa, Artificial Sequence
  Description of Artificial Sequence: Synthetic peptide
  Seed: ATSSSSPLV (MAGA1_HUMAN)
ATSSSSPLI

SEQ ID NO: 46844 - protein, 9 aa, Artificial Sequence
  Description of Artificial Sequence: Synthetic peptide
  Seed: ARVRFFFPS (MAGA1_HUMAN)
ARVRFFFPY

SEQ ID NO: 46845 - protein, 10 aa, Artificial Sequence
  Description of Artificial Sequence: Synthetic peptide
  Seed: KASESLQLVF (MAGA1_HUMAN)
KGSESLQLVW

SEQ ID NO: 46846 - protein, 10 aa, Artificial Sequence
  Description of Artificial Sequence: Synthetic peptide
  Seed: SAFPTTINFT (MAGA1_HUMAN)
SMFPTTINFI

SEQ ID NO: 46847 - protein, 11 aa, Artificial Sequence
  Description of Artificial Sequence: Synthetic peptide
  Seed: STSCILESLFR (MAGA1_HUMAN)
SMSCILESLFK

SEQ ID NO: 46848 - protein, 9 aa, Artificial Sequence
  Description of Artificial Sequence: Synthetic peptide
  Seed: RVRFFFPSL (MAGA1_HUMAN)
RMRFFFPSK

SEQ ID NO: 46849 - protein, 10 aa, Artificial Sequence
  Description of Artificial Sequence: Synthetic peptide
  Seed: RAREPVTKAE (MAGA1_HUMAN)
RVREPVTKAL

SEQ ID NO: 46850 - protein, 10 aa, Artificial Sequence
  Description of Artificial Sequence: Synthetic peptide
  Seed: VKVLEYVIKV (MAGA1_HUMAN)
VCVLEYVIKV

SEQ ID NO: 46851 - protein, 9 aa, Artificial Sequence
  Description of Artificial Sequence: Synthetic peptide
  Seed: ESLQLVFGI (MAGA1_HUMAN)
EMLQLVFGV

SEQ ID NO: 46852 - protein, 10 aa, Artificial Sequence
  Description of Artificial Sequence: Synthetic peptide
  Seed: LVFGIDVKEA (MAGA1_HUMAN)
LIFGIDVKEV

SEQ ID NO: 46853 - protein, 11 aa, Artificial Sequence
  Description of Artificial Sequence: Synthetic peptide
  Seed: KVLEYVIKVSA (MAGA1_HUMAN)
KILEYVIKVSI

SEQ ID NO: 46854 - protein, 9 aa, Artificial Sequence
  Description of Artificial Sequence: Synthetic peptide
  Seed: KYRAREPVT (MAGA1_HUMAN)
KIRAREPVM

SEQ ID NO: 46855 - protein, 9 aa, Artificial Sequence
  Description of Artificial Sequence: Synthetic peptide
  Seed: FPTTINFTR (MAGA1_HUMAN)
FPTTINFTI

SEQ ID NO: 46856 - protein, 9 aa, Artificial Sequence
  Description of Artificial Sequence: Synthetic peptide
  Seed: MPKTGFLII (MAGA1_HUMAN)
MQKTGFLIF

SEQ ID NO: 46857 - protein, 10 aa, Artificial Sequence
  Description of Artificial Sequence: Synthetic peptide
  Seed: ASAFPTTINF (MAGA1_HUMAN)
AFAFPTTINY

SEQ ID NO: 46858 - protein, 10 aa, Artificial Sequence
  Description of Artificial Sequence: Synthetic peptide
  Seed: SARVRFFFPS (MAGA1_HUMAN)
SIRVRFFFPL

SEQ ID NO: 46859 - protein, 9 aa, Artificial Sequence
  Description of Artificial Sequence: Synthetic peptide
  Seed: KVSARVRFF (MAGA1_HUMAN)
KWSARVRFK

SEQ ID NO: 46860 - protein, 10 aa, Artificial Sequence
  Description of Artificial Sequence: Synthetic peptide
  Seed: KVLEYVIKVS (MAGA1_HUMAN)
KVLEYVIKVL

SEQ ID NO: 46861 - protein, 9 aa, Artificial Sequence
  Description of Artificial Sequence: Synthetic peptide
  Seed: VADLVGFLL (MAGA1_HUMAN)
VSDLVGFLM

SEQ ID NO: 46862 - protein, 9 aa, Artificial Sequence
  Description of Artificial Sequence: Synthetic peptide
  Seed: YKHCFPEIF (MAGA1_HUMAN)
YQHCFPEIM

SEQ ID NO: 46863 - protein, 11 aa, Artificial Sequence
  Description of Artificial Sequence: Synthetic peptide
  Seed: YVKVLEYVIKV (MAGA1_HUMAN)
YQKVLEYVIKI

SEQ ID NO: 46864 - protein, 10 aa, Artificial Sequence
  Description of Artificial Sequence: Synthetic peptide
  Seed: RVRFFFPSLR (MAGA1_HUMAN)
RLRFFFPSLS

SEQ ID NO: 46865 - protein, 9 aa, Artificial Sequence
  Description of Artificial Sequence: Synthetic peptide
  Seed: YVIKVSARV (MAGA1_HUMAN)
YIIKVSARV

SEQ ID NO: 46866 - protein, 9 aa, Artificial Sequence
  Description of Artificial Sequence: Synthetic peptide
  Seed: GTLEEVPTA (MAGA1_HUMAN)
GLLEEVPTL

SEQ ID NO: 46867 - protein, 10 aa, Artificial Sequence
  Description of Artificial Sequence: Synthetic peptide
  Seed: VKVLEYVIKV (MAGA1_HUMAN)
VHVLEYVIKV

SEQ ID NO: 46868 - protein, 9 aa, Artificial Sequence
  Description of Artificial Sequence: Synthetic peptide
  Seed: VQAATSSSS (MAGA1_HUMAN)
VQAATSSSV

SEQ ID NO: 46869 - protein, 10 aa, Artificial Sequence
  Description of Artificial Sequence: Synthetic peptide
  Seed: SARVRFFFPS (MAGA1_HUMAN)
SNRVRFFFPL

SEQ ID NO: 46870 - protein, 9 aa, Artificial Sequence
  Description of Artificial Sequence: Synthetic peptide
  Seed: REPVTKAEM (MAGA1_HUMAN)
RVPVTKAEF

SEQ ID NO: 46871 - protein, 9 aa, Artificial Sequence
  Description of Artificial Sequence: Synthetic peptide
  Seed: AATSSSSPL (MAGA1_HUMAN)
ATTSSSSPF

SEQ ID NO: 46872 - protein, 9 aa, Artificial Sequence
  Description of Artificial Sequence: Synthetic peptide
  Seed: ALAETSYVK (MAGA1_HUMAN)
ATAETSYVR

SEQ ID NO: 46873 - protein, 10 aa, Artificial Sequence
  Description of Artificial Sequence: Synthetic peptide
  Seed: SSSPLVLGTL (MAGA1_HUMAN)
SMSPLVLGTM

SEQ ID NO: 46874 - protein, 9 aa, Artificial Sequence
  Description of Artificial Sequence: Synthetic peptide
  Seed: SAFPTTINF (MAGA1_HUMAN)
STFPTTINW

SEQ ID NO: 46875 - protein, 9 aa, Artificial Sequence
  Description of Artificial Sequence: Synthetic peptide
  Seed: GKASESLQL (MAGA1_HUMAN)
GKASESLQY

SEQ ID NO: 46876 - protein, 11 aa, Artificial Sequence
  Description of Artificial Sequence: Synthetic peptide
  Seed: IKVSARVRFFF (MAGA1_HUMAN)
IIVSARVRFFW

SEQ ID NO: 46877 - protein, 9 aa, Artificial Sequence
  Description of Artificial Sequence: Synthetic peptide
  Seed: SAYGEPRKL (MAGA1_HUMAN)
SQYGEPRKM

SEQ ID NO: 46878 - protein, 9 aa, Artificial Sequence
  Description of Artificial Sequence: Synthetic peptide
  Seed: YDGREHSAY (MAGA1_HUMAN)
YVGREHSAF

SEQ ID NO: 46879 - protein, 10 aa, Artificial Sequence
  Description of Artificial Sequence: Synthetic peptide
  Seed: KASESLQLVF (MAGA1_HUMAN)
KLSESLQLVF

SEQ ID NO: 46880 - protein, 11 aa, Artificial Sequence
  Description of Artificial Sequence: Synthetic peptide
  Seed: YEFLWGPRALA (MAGA1_HUMAN)
YEFLWGPRALV

SEQ ID NO: 46881 - protein, 9 aa, Artificial Sequence
  Description of Artificial Sequence: Synthetic peptide
  Seed: LVLGTLEEV (MAGA1_HUMAN)
LALGTLEEL

SEQ ID NO: 46882 - protein, 10 aa, Artificial Sequence
  Description of Artificial Sequence: Synthetic peptide
  Seed: FFFPSLREAA (MAGA1_HUMAN)
FYFPSLREAI

SEQ ID NO: 46883 - protein, 10 aa, Artificial Sequence
  Description of Artificial Sequence: Synthetic peptide
  Seed: QVPDSDPARY (MAGA1_HUMAN)
QVPDSDPARR

SEQ ID NO: 46884 - protein, 10 aa, Artificial Sequence
  Description of Artificial Sequence: Synthetic peptide
  Seed: SARVRFFFPS (MAGA1_HUMAN)
SARVRFFFPV

SEQ ID NO: 46885 - protein, 9 aa, Artificial Sequence
  Description of Artificial Sequence: Synthetic peptide
  Seed: RVRFFFPSL (MAGA1_HUMAN)
RYRFFFPSE

SEQ ID NO: 46886 - protein, 9 aa, Artificial Sequence
  Description of Artificial Sequence: Synthetic peptide
  Seed: KASESLQLV (MAGA1_HUMAN)
KVSESLQLK

SEQ ID NO: 46887 - protein, 10 aa, Artificial Sequence
  Description of Artificial Sequence: Synthetic peptide
  Seed: KVLEYVIKVS (MAGA1_HUMAN)
KMLEYVIKVL

SEQ ID NO: 46888 - protein, 9 aa, Artificial Sequence
  Description of Artificial Sequence: Synthetic peptide
  Seed: HSYVLVTCL (MAGA1_HUMAN)
HQYVLVTCY

SEQ ID NO: 46889 - protein, 9 aa, Artificial Sequence
  Description of Artificial Sequence: Synthetic peptide
  Seed: EIWEELSVM (MAGA1_HUMAN)
EQWEELSVY

SEQ ID NO: 46890 - protein, 9 aa, Artificial Sequence
  Description of Artificial Sequence: Synthetic peptide
  Seed: RQRQPSEGS (MAGA1_HUMAN)
RTRQPSEGL

SEQ ID NO: 46891 - protein, 9 aa, Artificial Sequence
  Description of Artificial Sequence: Synthetic peptide
  Seed: FFFPSLREA (MAGA1_HUMAN)
FGFPSLREM

SEQ ID NO: 46892 - protein, 8 aa, Artificial Sequence
  Description of Artificial Sequence: Synthetic peptide
  Seed: RVRFFFPS (MAGA1_HUMAN)
RTRFFFPY

SEQ ID NO: 46893 - protein, 9 aa, Artificial Sequence
  Description of Artificial Sequence: Synthetic peptide
  Seed: LVGFLLLKY (MAGA1_HUMAN)
LTGFLLLKY

SEQ ID NO: 46894 - protein, 11 aa, Artificial Sequence
  Description of Artificial Sequence: Synthetic peptide
  Seed: SARVRFFFPSL (MAGA1_HUMAN)
SPRVRFFFPSI

SEQ ID NO: 46895 - protein, 9 aa, Artificial Sequence
  Description of Artificial Sequence: Synthetic peptide
  Seed: YVIKVSARV (MAGA1_HUMAN)
YQIKVSARM

SEQ ID NO: 46896 - protein, 9 aa, Artificial Sequence
  Description of Artificial Sequence: Synthetic peptide
  Seed: VADLVGFLL (MAGA1_HUMAN)
VYDLVGFLM

SEQ ID NO: 46897 - protein, 10 aa, Artificial Sequence
  Description of Artificial Sequence: Synthetic peptide
  Seed: RALAETSYVK (MAGA1_HUMAN)
RILAETSYVK

SEQ ID NO: 46898 - protein, 10 aa, Artificial Sequence
  Description of Artificial Sequence: Synthetic peptide
  Seed: KEADPTGHSY (MAGA1_HUMAN)
KGADPTGHSL

SEQ ID NO: 46899 - protein, 9 aa, Artificial Sequence
  Description of Artificial Sequence: Synthetic peptide
  Seed: LVQEKYLEY (MAGA1_HUMAN)
LTQEKYLEY

SEQ ID NO: 46900 - protein, 9 aa, Artificial Sequence
  Description of Artificial Sequence: Synthetic peptide
  Seed: SAFPTTINF (MAGA1_HUMAN)
SLFPTTINL

SEQ ID NO: 46901 - protein, 10 aa, Artificial Sequence
  Description of Artificial Sequence: Synthetic peptide
  Seed: EYVIKVSARV (MAGA1_HUMAN)
EIVIKVSARV

SEQ ID NO: 46902 - protein, 9 aa, Artificial Sequence
  Description of Artificial Sequence: Synthetic peptide
  Seed: SAFPTTINF (MAGA1_HUMAN)
SDFPTTINF

SEQ ID NO: 46903 - protein, 9 aa, Artificial Sequence
  Description of Artificial Sequence: Synthetic peptide
  Seed: LVLGTLEEV (MAGA1_HUMAN)
LQLGTLEEL

SEQ ID NO: 46904 - protein, 9 aa, Artificial Sequence
  Description of Artificial Sequence: Synthetic peptide
  Seed: EADPTGHSY (MAGA1_HUMAN)
EWDPTGHSF

SEQ ID NO: 46905 - protein, 9 aa, Artificial Sequence
  Description of Artificial Sequence: Synthetic peptide
  Seed: DSDPARYEF (MAGA1_HUMAN)
DMDPARYEL

SEQ ID NO: 46906 - protein, 8 aa, Artificial Sequence
  Description of Artificial Sequence: Synthetic peptide
  Seed: RVRFFFPS (MAGA1_HUMAN)
RTRFFFPM

SEQ ID NO: 46907 - protein, 9 aa, Artificial Sequence
  Description of Artificial Sequence: Synthetic peptide
  Seed: RVRFFFPSL (MAGA1_HUMAN)
RQRFFFPSE

SEQ ID NO: 46908 - protein, 9 aa, Artificial Sequence
  Description of Artificial Sequence: Synthetic peptide
  Seed: RVRFFFPSL (MAGA1_HUMAN)
RHRFFFPSY

SEQ ID NO: 46909 - protein, 9 aa, Artificial Sequence
  Description of Artificial Sequence: Synthetic peptide
  Seed: RVRFFFPSL (MAGA1_HUMAN)
RFRFFFPST

SEQ ID NO: 46910 - protein, 9 aa, Artificial Sequence
  Description of Artificial Sequence: Synthetic peptide
  Seed: RVRFFFPSL (MAGA1_HUMAN)
RGRFFFPSR

SEQ ID NO: 46911 - protein, 9 aa, Artificial Sequence
  Description of Artificial Sequence: Synthetic peptide
  Seed: YVIKVSARV (MAGA1_HUMAN)
YMIKVSARA

SEQ ID NO: 46912 - protein, 9 aa, Artificial Sequence
  Description of Artificial Sequence: Synthetic peptide
  Seed: FPTTINFTR (MAGA1_HUMAN)
FITTINFTF

SEQ ID NO: 46913 - protein, 9 aa, Artificial Sequence
  Description of Artificial Sequence: Synthetic peptide
  Seed: AEMLESVIK (MAGA1_HUMAN)
AEMLESVIA

SEQ ID NO: 46914 - protein, 11 aa, Artificial Sequence
  Description of Artificial Sequence: Synthetic peptide
  Seed: EMLESVIKNYK (MAGA1_HUMAN)
ETLESVIKNYK

SEQ ID NO: 46915 - protein, 11 aa, Artificial Sequence
  Description of Artificial Sequence: Synthetic peptide
  Seed: SARVRFFFPSL (MAGA1_HUMAN)
SARVRFFFPSK

SEQ ID NO: 46916 - protein, 11 aa, Artificial Sequence
  Description of Artificial Sequence: Synthetic peptide
  Seed: YEFLWGPRALA (MAGA1_HUMAN)
YQFLWGPRALL

SEQ ID NO: 46917 - protein, 9 aa, Artificial Sequence
  Description of Artificial Sequence: Synthetic peptide
  Seed: RVRFFFPSL (MAGA1_HUMAN)
RARFFFPSE

SEQ ID NO: 46918 - protein, 9 aa, Artificial Sequence
  Description of Artificial Sequence: Synthetic peptide
  Seed: FPTTINFTR (MAGA1_HUMAN)
FSTTINFTY

SEQ ID NO: 46919 - protein, 10 aa, Artificial Sequence
  Description of Artificial Sequence: Synthetic peptide
  Seed: KASESLQLVF (MAGA1_HUMAN)
KMSESLQLVF

SEQ ID NO: 46920 - protein, 9 aa, Artificial Sequence
  Description of Artificial Sequence: Synthetic peptide
  Seed: TSYVKVLEY (MAGA1_HUMAN)
TLYVKVLEY

SEQ ID NO: 46921 - protein, 9 aa, Artificial Sequence
  Description of Artificial Sequence: Synthetic peptide
  Seed: FFFPSLREA (MAGA1_HUMAN)
FLFPSLREM

SEQ ID NO: 46922 - protein, 10 aa, Artificial Sequence
  Description of Artificial Sequence: Synthetic peptide
  Seed: RVRFFFPSLR (MAGA1_HUMAN)
RCRFFFPSLF

SEQ ID NO: 46923 - protein, 10 aa, Artificial Sequence
  Description of Artificial Sequence: Synthetic peptide
  Seed: EVYDGREHSA (MAGA1_HUMAN)
EIYDGREHSM

SEQ ID NO: 46924 - protein, 10 aa, Artificial Sequence
  Description of Artificial Sequence: Synthetic peptide
  Seed: KEADPTGHSY (MAGA1_HUMAN)
KMADPTGHSR

SEQ ID NO: 46925 - protein, 11 aa, Artificial Sequence
  Description of Artificial Sequence: Synthetic peptide
  Seed: RQVPDSDPARY (MAGA1_HUMAN)
RCVPDSDPARW

SEQ ID NO: 46926 - protein, 9 aa, Artificial Sequence
  Description of Artificial Sequence: Synthetic peptide
  Seed: LTQDLVQEK (MAGA1_HUMAN)
LGQDLVQEF

SEQ ID NO: 46927 - protein, 9 aa, Artificial Sequence
  Description of Artificial Sequence: Synthetic peptide
  Seed: NYKHCFPEI (MAGA1_HUMAN)
NFKHCFPEF

SEQ ID NO: 46928 - protein, 10 aa, Artificial Sequence
  Description of Artificial Sequence: Synthetic peptide
  Seed: ARYEFLWGPR (MAGA1_HUMAN)
ARYEFLWGPI

SEQ ID NO: 46929 - protein, 9 aa, Artificial Sequence
  Description of Artificial Sequence: Synthetic peptide
  Seed: FRAVITKKV (MAGA1_HUMAN)
FRAVITKKI

SEQ ID NO: 46930 - protein, 10 aa, Artificial Sequence
  Description of Artificial Sequence: Synthetic peptide
  Seed: RVRFFFPSLR (MAGA1_HUMAN)
RIRFFFPSLI

SEQ ID NO: 46931 - protein, 9 aa, Artificial Sequence
  Description of Artificial Sequence: Synthetic peptide
  Seed: EADPTGHSY (MAGA1_HUMAN)
EQDPTGHSW

SEQ ID NO: 46932 - protein, 10 aa, Artificial Sequence
  Description of Artificial Sequence: Synthetic peptide
  Seed: KEADPTGHSY (MAGA1_HUMAN)
KPADPTGHSY

SEQ ID NO: 46933 - protein, 11 aa, Artificial Sequence
  Description of Artificial Sequence: Synthetic peptide
  Seed: RQVPDSDPARY (MAGA1_HUMAN)
RSVPDSDPARY

SEQ ID NO: 46934 - protein, 10 aa, Artificial Sequence
  Description of Artificial Sequence: Synthetic peptide
  Seed: LVFGIDVKEA (MAGA1_HUMAN)
LMFGIDVKEI

SEQ ID NO: 46935 - protein, 10 aa, Artificial Sequence
  Description of Artificial Sequence: Synthetic peptide
  Seed: LLGDNQIMPK (MAGA1_HUMAN)
LVGDNQIMPK

SEQ ID NO: 46936 - protein, 9 aa, Artificial Sequence
  Description of Artificial Sequence: Synthetic peptide
  Seed: KVLEYVIKV (MAGA1_HUMAN)
KALEYVIKR

SEQ ID NO: 46937 - protein, 9 aa, Artificial Sequence
  Description of Artificial Sequence: Synthetic peptide
  Seed: YVLVTCLGL (MAGA1_HUMAN)
YMLVTCLGL

SEQ ID NO: 46938 - protein, 9 aa, Artificial Sequence
  Description of Artificial Sequence: Synthetic peptide
  Seed: YVIKVSARV (MAGA1_HUMAN)
YMIKVSARI

SEQ ID NO: 46939 - protein, 9 aa, Artificial Sequence
  Description of Artificial Sequence: Synthetic peptide
  Seed: REPVTKAEM (MAGA1_HUMAN)
RRPVTKAEL

SEQ ID NO: 46940 - protein, 9 aa, Artificial Sequence
  Description of Artificial Sequence: Synthetic peptide
  Seed: FPSLREAAL (MAGA1_HUMAN)
FASLREAAF

SEQ ID NO: 46941 - protein, 9 aa, Artificial Sequence
  Description of Artificial Sequence: Synthetic peptide
  Seed: EADPTGHSY (MAGA1_HUMAN)
ETDPTGHSY

SEQ ID NO: 46942 - protein, 10 aa, Artificial Sequence
  Description of Artificial Sequence: Synthetic peptide
  Seed: ASAFPTTINF (MAGA1_HUMAN)
AVAFPTTINW

SEQ ID NO: 46943 - protein, 9 aa, Artificial Sequence
  Description of Artificial Sequence: Synthetic peptide
  Seed: REEEGPSTS (MAGA1_HUMAN)
REEEGPSTT

SEQ ID NO: 46944 - protein, 9 aa, Artificial Sequence
  Description of Artificial Sequence: Synthetic peptide
  Seed: KYRAREPVT (MAGA1_HUMAN)
KTRAREPVA

SEQ ID NO: 46945 - protein, 10 aa, Artificial Sequence
  Description of Artificial Sequence: Synthetic peptide
  Seed: SARVRFFFPS (MAGA1_HUMAN)
SDRVRFFFPF

SEQ ID NO: 46946 - protein, 11 aa, Artificial Sequence
  Description of Artificial Sequence: Synthetic peptide
  Seed: RVRFFFPSLRE (MAGA1_HUMAN)
RFRFFFPSLRA

SEQ ID NO: 46947 - protein, 9 aa, Artificial Sequence
  Description of Artificial Sequence: Synthetic peptide
  Seed: TSYVKVLEY (MAGA1_HUMAN)
TMYVKVLEW

SEQ ID NO: 46948 - protein, 10 aa, Artificial Sequence
  Description of Artificial Sequence: Synthetic peptide
  Seed: SAFPTTINFT (MAGA1_HUMAN)
SIFPTTINFA

SEQ ID NO: 46949 - protein, 11 aa, Artificial Sequence
  Description of Artificial Sequence: Synthetic peptide
  Seed: STDPPQSPQGA (MAGA1_HUMAN)
SIDPPQSPQGV

SEQ ID NO: 46950 - protein, 9 aa, Artificial Sequence
  Description of Artificial Sequence: Synthetic peptide
  Seed: RALAETSYV (MAGA1_HUMAN)
RMLAETSYT

SEQ ID NO: 46951 - protein, 10 aa, Artificial Sequence
  Description of Artificial Sequence: Synthetic peptide
  Seed: RFFFPSLREA (MAGA1_HUMAN)
RGFFPSLREK

SEQ ID NO: 46952 - protein, 9 aa, Artificial Sequence
  Description of Artificial Sequence: Synthetic peptide
  Seed: FFFPSLREA (MAGA1_HUMAN)
FAFPSLREY

SEQ ID NO: 46953 - protein, 9 aa, Artificial Sequence
  Description of Artificial Sequence: Synthetic peptide
  Seed: TSSSSPLVL (MAGA1_HUMAN)
TFSSSPLVL

SEQ ID NO: 46954 - protein, 11 aa, Artificial Sequence
  Description of Artificial Sequence: Synthetic peptide
  Seed: KVSARVRFFFP (MAGA1_HUMAN)
KTSARVRFFFK

SEQ ID NO: 46955 - protein, 9 aa, Artificial Sequence
  Description of Artificial Sequence: Synthetic peptide
  Seed: SARVRFFFP (MAGA1_HUMAN)
STRVRFFFA

SEQ ID NO: 46956 - protein, 10 aa, Artificial Sequence
  Description of Artificial Sequence: Synthetic peptide
  Seed: EVYDGREHSA (MAGA1_HUMAN)
EVYDGREHSM

SEQ ID NO: 46957 - protein, 10 aa, Artificial Sequence
  Description of Artificial Sequence: Synthetic peptide
  Seed: MLESVIKNYK (MAGA1_HUMAN)
MIESVIKNYY

SEQ ID NO: 46958 - protein, 9 aa, Artificial Sequence
  Description of Artificial Sequence: Synthetic peptide
  Seed: KYRAREPVT (MAGA1_HUMAN)
KVRAREPVT

SEQ ID NO: 46959 - protein, 9 aa, Artificial Sequence
  Description of Artificial Sequence: Synthetic peptide
  Seed: KVADLVGFL (MAGA1_HUMAN)
KRADLVGFM

SEQ ID NO: 46960 - protein, 10 aa, Artificial Sequence
  Description of Artificial Sequence: Synthetic peptide
  Seed: KVLEYVIKVS (MAGA1_HUMAN)
KMLEYVIKVT

SEQ ID NO: 46961 - protein, 9 aa, Artificial Sequence
  Description of Artificial Sequence: Synthetic peptide
  Seed: GASAFPTTI (MAGA1_HUMAN)
GGSAFPTTW

SEQ ID NO: 46962 - protein, 9 aa, Artificial Sequence
  Description of Artificial Sequence: Synthetic peptide
  Seed: STDPPQSPQ (MAGA1_HUMAN)
STDPPQSPF

SEQ ID NO: 46963 - protein, 9 aa, Artificial Sequence
  Description of Artificial Sequence: Synthetic peptide
  Seed: FPTTINFTR (MAGA1_HUMAN)
FATTINFTF

SEQ ID NO: 46964 - protein, 9 aa, Artificial Sequence
  Description of Artificial Sequence: Synthetic peptide
  Seed: LKYRAREPV (MAGA1_HUMAN)
LQYRAREPY

SEQ ID NO: 46965 - protein, 11 aa, Artificial Sequence
  Description of Artificial Sequence: Synthetic peptide
  Seed: VLGTLEEVPTA (MAGA1_HUMAN)
VLGTLEEVPTV

SEQ ID NO: 46966 - protein, 9 aa, Artificial Sequence
  Description of Artificial Sequence: Synthetic peptide
  Seed: LVQEKYLEY (MAGA1_HUMAN)
LWQEKYLEY

SEQ ID NO: 46967 - protein, 9 aa, Artificial Sequence
  Description of Artificial Sequence: Synthetic peptide
  Seed: KYRAREPVT (MAGA1_HUMAN)
KFRAREPVA

SEQ ID NO: 46968 - protein, 10 aa, Artificial Sequence
  Description of Artificial Sequence: Synthetic peptide
  Seed: SARVRFFFPS (MAGA1_HUMAN)
SARVRFFFPI

SEQ ID NO: 46969 - protein, 10 aa, Artificial Sequence
  Description of Artificial Sequence: Synthetic peptide
  Seed: KEADPTGHSY (MAGA1_HUMAN)
KVADPTGHSR

SEQ ID NO: 46970 - protein, 10 aa, Artificial Sequence
  Description of Artificial Sequence: Synthetic peptide
  Seed: STSCILESLF (MAGA1_HUMAN)
SMSCILESLW

SEQ ID NO: 46971 - protein, 9 aa, Artificial Sequence
  Description of Artificial Sequence: Synthetic peptide
  Seed: VYDGREHSA (MAGA1_HUMAN)
VVDGREHSV

SEQ ID NO: 46972 - protein, 10 aa, Artificial Sequence
  Description of Artificial Sequence: Synthetic peptide
  Seed: TSCILESLFR (MAGA1_HUMAN)
TVCILESLFK

SEQ ID NO: 46973 - protein, 10 aa, Artificial Sequence
  Description of Artificial Sequence: Synthetic peptide
  Seed: SARVRFFFPS (MAGA1_HUMAN)
STRVRFFFPK

SEQ ID NO: 46974 - protein, 9 aa, Artificial Sequence
  Description of Artificial Sequence: Synthetic peptide
  Seed: MSLEQRSLH (MAGA1_HUMAN)
MILEQRSLY

SEQ ID NO: 46975 - protein, 9 aa, Artificial Sequence
  Description of Artificial Sequence: Synthetic peptide
  Seed: LEYVIKVSA (MAGA1_HUMAN)
LEYVIKVSL

SEQ ID NO: 46976 - protein, 10 aa, Artificial Sequence
  Description of Artificial Sequence: Synthetic peptide
  Seed: SPQGASAFPT (MAGA1_HUMAN)
SPQGASAFPA

SEQ ID NO: 46977 - protein, 9 aa, Artificial Sequence
  Description of Artificial Sequence: Synthetic peptide
  Seed: RVRFFFPSL (MAGA1_HUMAN)
RMRFFFPSI

SEQ ID NO: 46978 - protein, 11 aa, Artificial Sequence
  Description of Artificial Sequence: Synthetic peptide
  Seed: YEFLWGPRALA (MAGA1_HUMAN)
YDFLWGPRALV

SEQ ID NO: 46979 - protein, 9 aa, Artificial Sequence
  Description of Artificial Sequence: Synthetic peptide
  Seed: QIMPKTGFL (MAGA1_HUMAN)
QLMPKTGFL

SEQ ID NO: 46980 - protein, 9 aa, Artificial Sequence
  Description of Artificial Sequence: Synthetic peptide
  Seed: TQDLVQEKY (MAGA1_HUMAN)
TFDLVQEKM

SEQ ID NO: 46981 - protein, 9 aa, Artificial Sequence
  Description of Artificial Sequence: Synthetic peptide
  Seed: RYEFLWGPR (MAGA1_HUMAN)
RFEFLWGPR

SEQ ID NO: 46982 - protein, 10 aa, Artificial Sequence
  Description of Artificial Sequence: Synthetic peptide
  Seed: TSYVKVLEYV (MAGA1_HUMAN)
TGYVKVLEYL

SEQ ID NO: 46983 - protein, 9 aa, Artificial Sequence
  Description of Artificial Sequence: Synthetic peptide
  Seed: LVTCLGLSY (MAGA1_HUMAN)
LSTCLGLSM

SEQ ID NO: 46984 - protein, 9 aa, Artificial Sequence
  Description of Artificial Sequence: Synthetic peptide
  Seed: SYVKVLEYV (MAGA1_HUMAN)
SQVKVLEYL

SEQ ID NO: 46985 - protein, 9 aa, Artificial Sequence
  Description of Artificial Sequence: Synthetic peptide
  Seed: LVQEKYLEY (MAGA1_HUMAN)
LQQEKYLEY

SEQ ID NO: 46986 - protein, 9 aa, Artificial Sequence
  Description of Artificial Sequence: Synthetic peptide
  Seed: LVQEKYLEY (MAGA1_HUMAN)
LTQEKYLEV

SEQ ID NO: 46987 - protein, 10 aa, Artificial Sequence
  Description of Artificial Sequence: Synthetic peptide
  Seed: RAREPVTKAE (MAGA1_HUMAN)
RSREPVTKAM

SEQ ID NO: 46988 - protein, 10 aa, Artificial Sequence
  Description of Artificial Sequence: Synthetic peptide
  Seed: SLFRAVITKK (MAGA1_HUMAN)
SAFRAVITKR

SEQ ID NO: 46989 - protein, 11 aa, Artificial Sequence
  Description of Artificial Sequence: Synthetic peptide
  Seed: YEFLWGPRALA (MAGA1_HUMAN)
YLFLWGPRALA

SEQ ID NO: 46990 - protein, 9 aa, Artificial Sequence
  Description of Artificial Sequence: Synthetic peptide
  Seed: KASESLQLV (MAGA1_HUMAN)
KSSESLQLM

SEQ ID NO: 46991 - protein, 10 aa, Artificial Sequence
  Description of Artificial Sequence: Synthetic peptide
  Seed: YEFLWGPRAL (MAGA1_HUMAN)
YAFLWGPRAY

SEQ ID NO: 46992 - protein, 11 aa, Artificial Sequence
  Description of Artificial Sequence: Synthetic peptide
  Seed: VQAATSSSSPL (MAGA1_HUMAN)
VQAATSSSSPY

SEQ ID NO: 46993 - protein, 10 aa, Artificial Sequence
  Description of Artificial Sequence: Synthetic peptide
  Seed: YEFLWGPRAL (MAGA1_HUMAN)
YLFLWGPRAM

SEQ ID NO: 46994 - protein, 11 aa, Artificial Sequence
  Description of Artificial Sequence: Synthetic peptide
  Seed: ETSYVKVLEYV (MAGA1_HUMAN)
EVSYVKVLEYV

SEQ ID NO: 46995 - protein, 9 aa, Artificial Sequence
  Description of Artificial Sequence: Synthetic peptide
  Seed: STSCILESL (MAGA1_HUMAN)
STSCILESW

SEQ ID NO: 46996 - protein, 8 aa, Artificial Sequence
  Description of Artificial Sequence: Synthetic peptide
  Seed: MSLEQRSL (MAGA1_HUMAN)
MQLEQRSI

SEQ ID NO: 46997 - protein, 10 aa, Artificial Sequence
  Description of Artificial Sequence: Synthetic peptide
  Seed: VMIAMEGGHA (MAGA1_HUMAN)
VLIAMEGGHV

SEQ ID NO: 46998 - protein, 10 aa, Artificial Sequence
  Description of Artificial Sequence: Synthetic peptide
  Seed: FFFPSLREAA (MAGA1_HUMAN)
FWFPSLREAF

SEQ ID NO: 46999 - protein, 11 aa, Artificial Sequence
  Description of Artificial Sequence: Synthetic peptide
  Seed: EIFGKASESLQ (MAGA1_HUMAN)
EAFGKASESLK

SEQ ID NO: 47000 - protein, 9 aa, Artificial Sequence
  Description of Artificial Sequence: Synthetic peptide
  Seed: QIMPKTGFL (MAGA1_HUMAN)
QLMPKTGFK

SEQ ID NO: 47001 - protein, 10 aa, Artificial Sequence
  Description of Artificial Sequence: Synthetic peptide
  Seed: KNYKHCFPEI (MAGA1_HUMAN)
KTYKHCFPEA

SEQ ID NO: 47002 - protein, 9 aa, Artificial Sequence
  Description of Artificial Sequence: Synthetic peptide
  Seed: RVRFFFPSL (MAGA1_HUMAN)
RVRFFFPSD

SEQ ID NO: 47003 - protein, 9 aa, Artificial Sequence
  Description of Artificial Sequence: Synthetic peptide
  Seed: EEEGPSTSC (MAGA1_HUMAN)
EEEGPSTSA

SEQ ID NO: 47004 - protein, 9 aa, Artificial Sequence
  Description of Artificial Sequence: Synthetic peptide
  Seed: FFFPSLREA (MAGA1_HUMAN)
FSFPSLREL

SEQ ID NO: 47005 - protein, 9 aa, Artificial Sequence
  Description of Artificial Sequence: Synthetic peptide
  Seed: FFFPSLREA (MAGA1_HUMAN)
FCFPSLREY

SEQ ID NO: 47006 - protein, 10 aa, Artificial Sequence
  Description of Artificial Sequence: Synthetic peptide
  Seed: RALAETSYVK (MAGA1_HUMAN)
RYLAETSYVK

SEQ ID NO: 47007 - protein, 9 aa, Artificial Sequence
  Description of Artificial Sequence: Synthetic peptide
  Seed: RAREPVTKA (MAGA1_HUMAN)
RMREPVTKK

SEQ ID NO: 47008 - protein, 10 aa, Artificial Sequence
  Description of Artificial Sequence: Synthetic peptide
  Seed: KVSARVRFFF (MAGA1_HUMAN)
KNSARVRFFK

SEQ ID NO: 47009 - protein, 10 aa, Artificial Sequence
  Description of Artificial Sequence: Synthetic peptide
  Seed: SESLQLVFGI (MAGA1_HUMAN)
SESLQLVFGY

SEQ ID NO: 47010 - protein, 9 aa, Artificial Sequence
  Description of Artificial Sequence: Synthetic peptide
  Seed: LFRAVITKK (MAGA1_HUMAN)
LMRAVITKR

SEQ ID NO: 47011 - protein, 9 aa, Artificial Sequence
  Description of Artificial Sequence: Synthetic peptide
  Seed: SSPLVLGTL (MAGA1_HUMAN)
SRPLVLGTY

SEQ ID NO: 47012 - protein, 10 aa, Artificial Sequence
  Description of Artificial Sequence: Synthetic peptide
  Seed: KEADPTGHSY (MAGA1_HUMAN)
KWADPTGHSY

SEQ ID NO: 47013 - protein, 9 aa, Artificial Sequence
  Description of Artificial Sequence: Synthetic peptide
  Seed: KKVADLVGF (MAGA1_HUMAN)
KLVADLVGF

SEQ ID NO: 47014 - protein, 11 aa, Artificial Sequence
  Description of Artificial Sequence: Synthetic peptide
  Seed: RVRFFFPSLRE (MAGA1_HUMAN)
RTRFFFPSLRL

SEQ ID NO: 47015 - protein, 9 aa, Artificial Sequence
  Description of Artificial Sequence: Synthetic peptide
  Seed: STSCILESL (MAGA1_HUMAN)
SASCILESM

SEQ ID NO: 47016 - protein, 10 aa, Artificial Sequence
  Description of Artificial Sequence: Synthetic peptide
  Seed: KASESLQLVF (MAGA1_HUMAN)
KKSESLQLVM

SEQ ID NO: 47017 - protein, 11 aa, Artificial Sequence
  Description of Artificial Sequence: Synthetic peptide
  Seed: FLWGPRALAET (MAGA1_HUMAN)
FMWGPRALAET

SEQ ID NO: 47018 - protein, 9 aa, Artificial Sequence
  Description of Artificial Sequence: Synthetic peptide
  Seed: DPTGHSYVL (MAGA1_HUMAN)
DPTGHSYVY

SEQ ID NO: 47019 - protein, 10 aa, Artificial Sequence
  Description of Artificial Sequence: Synthetic peptide
  Seed: KNYKHCFPEI (MAGA1_HUMAN)
KIYKHCFPEF

SEQ ID NO: 47020 - protein, 10 aa, Artificial Sequence
  Description of Artificial Sequence: Synthetic peptide
  Seed: KASESLQLVF (MAGA1_HUMAN)
KTSESLQLVY

SEQ ID NO: 47021 - protein, 10 aa, Artificial Sequence
  Description of Artificial Sequence: Synthetic peptide
  Seed: SARVRFFFPS (MAGA1_HUMAN)
SHRVRFFFPM

SEQ ID NO: 47022 - protein, 9 aa, Artificial Sequence
  Description of Artificial Sequence: Synthetic peptide
  Seed: KVLEYVIKV (MAGA1_HUMAN)
KALEYVIKY

SEQ ID NO: 47023 - protein, 9 aa, Artificial Sequence
  Description of Artificial Sequence: Synthetic peptide
  Seed: RVRFFFPSL (MAGA1_HUMAN)
RNRFFFPSY

SEQ ID NO: 47024 - protein, 10 aa, Artificial Sequence
  Description of Artificial Sequence: Synthetic peptide
  Seed: SSSPLVLGTL (MAGA1_HUMAN)
SLSPLVLGTI

SEQ ID NO: 47025 - protein, 9 aa, Artificial Sequence
  Description of Artificial Sequence: Synthetic peptide
  Seed: QIMPKTGFL (MAGA1_HUMAN)
QAMPKTGFI

SEQ ID NO: 47026 - protein, 9 aa, Artificial Sequence
  Description of Artificial Sequence: Synthetic peptide
  Seed: FLIIVLVMI (MAGA1_HUMAN)
FMIIVLVMI

SEQ ID NO: 47027 - protein, 10 aa, Artificial Sequence
  Description of Artificial Sequence: Synthetic peptide
  Seed: KEADPTGHSY (MAGA1_HUMAN)
KPADPTGHSM

SEQ ID NO: 47028 - protein, 9 aa, Artificial Sequence
  Description of Artificial Sequence: Synthetic peptide
  Seed: LVTCLGLSY (MAGA1_HUMAN)
LQTCLGLSF

SEQ ID NO: 47029 - protein, 10 aa, Artificial Sequence
  Description of Artificial Sequence: Synthetic peptide
  Seed: SCILESLFRA (MAGA1_HUMAN)
SHILESLFRL

SEQ ID NO: 47030 - protein, 9 aa, Artificial Sequence
  Description of Artificial Sequence: Synthetic peptide
  Seed: LVLGTLEEV (MAGA1_HUMAN)
LQLGTLEEM

SEQ ID NO: 47031 - protein, 9 aa, Artificial Sequence
  Description of Artificial Sequence: Synthetic peptide
  Seed: RVRFFFPSL (MAGA1_HUMAN)
RNRFFFPSV

SEQ ID NO: 47032 - protein, 9 aa, Artificial Sequence
  Description of Artificial Sequence: Synthetic peptide
  Seed: SAYGEPRKL (MAGA1_HUMAN)
SPYGEPRKL

SEQ ID NO: 47033 - protein, 9 aa, Artificial Sequence
  Description of Artificial Sequence: Synthetic peptide
  Seed: TTINFTRQR (MAGA1_HUMAN)
TLINFTRQK

SEQ ID NO: 47034 - protein, 9 aa, Artificial Sequence
  Description of Artificial Sequence: Synthetic peptide
  Seed: RAREPVTKA (MAGA1_HUMAN)
RIREPVTKM

SEQ ID NO: 47035 - protein, 9 aa, Artificial Sequence
  Description of Artificial Sequence: Synthetic peptide
  Seed: VADLVGFLL (MAGA1_HUMAN)
VLDLVGFLV

SEQ ID NO: 47036 - protein, 10 aa, Artificial Sequence
  Description of Artificial Sequence: Synthetic peptide
  Seed: ASAFPTTINF (MAGA1_HUMAN)
AQAFPTTINF

SEQ ID NO: 47037 - protein, 9 aa, Artificial Sequence
  Description of Artificial Sequence: Synthetic peptide
  Seed: KYRAREPVT (MAGA1_HUMAN)
KVRAREPVV

SEQ ID NO: 47038 - protein, 10 aa, Artificial Sequence
  Description of Artificial Sequence: Synthetic peptide
  Seed: ADPTGHSYVL (MAGA1_HUMAN)
APPTGHSYVL

SEQ ID NO: 47039 - protein, 9 aa, Artificial Sequence
  Description of Artificial Sequence: Synthetic peptide
  Seed: SAYGEPRKL (MAGA1_HUMAN)
SMYGEPRKK

SEQ ID NO: 47040 - protein, 10 aa, Artificial Sequence
  Description of Artificial Sequence: Synthetic peptide
  Seed: EMLESVIKNY (MAGA1_HUMAN)
ELLESVIKNR

SEQ ID NO: 47041 - protein, 9 aa, Artificial Sequence
  Description of Artificial Sequence: Synthetic peptide
  Seed: ESVIKNYKH (MAGA1_HUMAN)
EAVIKNYKK

SEQ ID NO: 47042 - protein, 11 aa, Artificial Sequence
  Description of Artificial Sequence: Synthetic peptide
  Seed: FFFPSLREAAL (MAGA1_HUMAN)
FYFPSLREAAY

SEQ ID NO: 47043 - protein, 9 aa, Artificial Sequence
  Description of Artificial Sequence: Synthetic peptide
  Seed: IMPKTGFLI (MAGA1_HUMAN)
IMPKTGFLV

SEQ ID NO: 47044 - protein, 8 aa, Artificial Sequence
  Description of Artificial Sequence: Synthetic peptide
  Seed: SYVKVLEY (MAGA1_HUMAN)
SQVKVLEF

SEQ ID NO: 47045 - protein, 9 aa, Artificial Sequence
  Description of Artificial Sequence: Synthetic peptide
  Seed: YVLVTCLGL (MAGA1_HUMAN)
YMLVTCLGV

SEQ ID NO: 47046 - protein, 10 aa, Artificial Sequence
  Description of Artificial Sequence: Synthetic peptide
  Seed: RVRFFFPSLR (MAGA1_HUMAN)
RLRFFFPSLA

SEQ ID NO: 47047 - protein, 10 aa, Artificial Sequence
  Description of Artificial Sequence: Synthetic peptide
  Seed: YEFLWGPRAL (MAGA1_HUMAN)
YGFLWGPRAF

SEQ ID NO: 47048 - protein, 9 aa, Artificial Sequence
  Description of Artificial Sequence: Synthetic peptide
  Seed: AQQEALGLV (MAGA1_HUMAN)
ATQEALGLV

SEQ ID NO: 47049 - protein, 10 aa, Artificial Sequence
  Description of Artificial Sequence: Synthetic peptide
  Seed: EALEAQQEAL (MAGA1_HUMAN)
ETLEAQQEAK

SEQ ID NO: 47050 - protein, 9 aa, Artificial Sequence
  Description of Artificial Sequence: Synthetic peptide
  Seed: IAMEGGHAP (MAGA1_HUMAN)
ISMEGGHAH

SEQ ID NO: 47051 - protein, 10 aa, Artificial Sequence
  Description of Artificial Sequence: Synthetic peptide
  Seed: KEADPTGHSY (MAGA1_HUMAN)
KQADPTGHSV

SEQ ID NO: 47052 - protein, 10 aa, Artificial Sequence
  Description of Artificial Sequence: Synthetic peptide
  Seed: RVRFFFPSLR (MAGA1_HUMAN)
RYRFFFPSLR

SEQ ID NO: 47053 - protein, 9 aa, Artificial Sequence
  Description of Artificial Sequence: Synthetic peptide
  Seed: FFFPSLREA (MAGA1_HUMAN)
FQFPSLREF

SEQ ID NO: 47054 - protein, 9 aa, Artificial Sequence
  Description of Artificial Sequence: Synthetic peptide
  Seed: SAYGEPRKL (MAGA1_HUMAN)
SSYGEPRKM

SEQ ID NO: 47055 - protein, 11 aa, Artificial Sequence
  Description of Artificial Sequence: Synthetic peptide
  Seed: EVYDGREHSAY (MAGA1_HUMAN)
ESYDGREHSAR

SEQ ID NO: 47056 - protein, 9 aa, Artificial Sequence
  Description of Artificial Sequence: Synthetic peptide
  Seed: RVRFFFPSL (MAGA1_HUMAN)
RIRFFFPSQ

SEQ ID NO: 47057 - protein, 11 aa, Artificial Sequence
  Description of Artificial Sequence: Synthetic peptide
  Seed: YEFLWGPRALA (MAGA1_HUMAN)
YLFLWGPRALL

SEQ ID NO: 47058 - protein, 9 aa, Artificial Sequence
  Description of Artificial Sequence: Synthetic peptide
  Seed: SYVKVLEYV (MAGA1_HUMAN)
SLVKVLEYA

SEQ ID NO: 47059 - protein, 9 aa, Artificial Sequence
  Description of Artificial Sequence: Synthetic peptide
  Seed: TTINFTRQR (MAGA1_HUMAN)
TTINFTRQF

SEQ ID NO: 47060 - protein, 9 aa, Artificial Sequence
  Description of Artificial Sequence: Synthetic peptide
  Seed: TSYVKVLEY (MAGA1_HUMAN)
TYYVKVLEI

SEQ ID NO: 47061 - protein, 9 aa, Artificial Sequence
  Description of Artificial Sequence: Synthetic peptide
  Seed: KASESLQLV (MAGA1_HUMAN)
KMSESLQLK

SEQ ID NO: 47062 - protein, 9 aa, Artificial Sequence
  Description of Artificial Sequence: Synthetic peptide
  Seed: SSPLVLGTL (MAGA1_HUMAN)
SPPLVLGTY

SEQ ID NO: 47063 - protein, 11 aa, Artificial Sequence
  Description of Artificial Sequence: Synthetic peptide
  Seed: EVYDGREHSAY (MAGA1_HUMAN)
EMYDGREHSAK

SEQ ID NO: 47064 - protein, 9 aa, Artificial Sequence
  Description of Artificial Sequence: Synthetic peptide
  Seed: KVLEYVIKV (MAGA1_HUMAN)
KWLEYVIKY

SEQ ID NO: 47065 - protein, 10 aa, Artificial Sequence
  Description of Artificial Sequence: Synthetic peptide
  Seed: SARVRFFFPS (MAGA1_HUMAN)
SLRVRFFFPR

SEQ ID NO: 47066 - protein, 9 aa, Artificial Sequence
  Description of Artificial Sequence: Synthetic peptide
  Seed: KYRAREPVT (MAGA1_HUMAN)
KVRAREPVY

SEQ ID NO: 47067 - protein, 10 aa, Artificial Sequence
  Description of Artificial Sequence: Synthetic peptide
  Seed: RVRFFFPSLR (MAGA1_HUMAN)
RVRFFFPSLV

SEQ ID NO: 47068 - protein, 10 aa, Artificial Sequence
  Description of Artificial Sequence: Synthetic peptide
  Seed: REEEGPSTSC (MAGA1_HUMAN)
REEEGPSTSP

SEQ ID NO: 47069 - protein, 9 aa, Artificial Sequence
  Description of Artificial Sequence: Synthetic peptide
  Seed: GASAFPTTI (MAGA1_HUMAN)
GMSAFPTTL

SEQ ID NO: 47070 - protein, 10 aa, Artificial Sequence
  Description of Artificial Sequence: Synthetic peptide
  Seed: KVSARVRFFF (MAGA1_HUMAN)
KKSARVRFFY

SEQ ID NO: 47071 - protein, 9 aa, Artificial Sequence
  Description of Artificial Sequence: Synthetic peptide
  Seed: EADPTGHSY (MAGA1_HUMAN)
ELDPTGHSV

SEQ ID NO: 47072 - protein, 10 aa, Artificial Sequence
  Description of Artificial Sequence: Synthetic peptide
  Seed: KHCFPEIFGK (MAGA1_HUMAN)
KMCFPEIFGK

SEQ ID NO: 47073 - protein, 9 aa, Artificial Sequence
  Description of Artificial Sequence: Synthetic peptide
  Seed: KVSARVRFF (MAGA1_HUMAN)
KISARVRFY

SEQ ID NO: 47074 - protein, 9 aa, Artificial Sequence
  Description of Artificial Sequence: Synthetic peptide
  Seed: RVRFFFPSL (MAGA1_HUMAN)
RVRFFFPSG

SEQ ID NO: 47075 - protein, 10 aa, Artificial Sequence
  Description of Artificial Sequence: Synthetic peptide
  Seed: SARVRFFFPS (MAGA1_HUMAN)
STRVRFFFPY

SEQ ID NO: 47076 - protein, 11 aa, Artificial Sequence
  Description of Artificial Sequence: Synthetic peptide
  Seed: RVRFFFPSLRE (MAGA1_HUMAN)
RVRFFFPSLRP

SEQ ID NO: 47077 - protein, 9 aa, Artificial Sequence
  Description of Artificial Sequence: Synthetic peptide
  Seed: QEALGLVCV (MAGA1_HUMAN)
QEALGLVCY

SEQ ID NO: 47078 - protein, 11 aa, Artificial Sequence
  Description of Artificial Sequence: Synthetic peptide
  Seed: KVADLVGFLLL (MAGA1_HUMAN)
KMADLVGFLLS

SEQ ID NO: 47079 - protein, 9 aa, Artificial Sequence
  Description of Artificial Sequence: Synthetic peptide
  Seed: RALAETSYV (MAGA1_HUMAN)
RTLAETSYF

SEQ ID NO: 47080 - protein, 10 aa, Artificial Sequence
  Description of Artificial Sequence: Synthetic peptide
  Seed: FLWGPRALAE (MAGA1_HUMAN)
FQWGPRALAV

SEQ ID NO: 47081 - protein, 9 aa, Artificial Sequence
  Description of Artificial Sequence: Synthetic peptide
  Seed: TKAEMLESV (MAGA1_HUMAN)
TLAEMLEST

SEQ ID NO: 47082 - protein, 9 aa, Artificial Sequence
  Description of Artificial Sequence: Synthetic peptide
  Seed: TSYVKVLEY (MAGA1_HUMAN)
TMYVKVLEL

SEQ ID NO: 47083 - protein, 9 aa, Artificial Sequence
  Description of Artificial Sequence: Synthetic peptide
  Seed: AATSSSSPL (MAGA1_HUMAN)
AFTSSSSPI

SEQ ID NO: 47084 - protein, 10 aa, Artificial Sequence
  Description of Artificial Sequence: Synthetic peptide
  Seed: ASAFPTTINF (MAGA1_HUMAN)
AMAFPTTINM

SEQ ID NO: 47085 - protein, 9 aa, Artificial Sequence
  Description of Artificial Sequence: Synthetic peptide
  Seed: LESLFRAVI (MAGA1_HUMAN)
LQSLFRAVI

SEQ ID NO: 47086 - protein, 9 aa, Artificial Sequence
  Description of Artificial Sequence: Synthetic peptide
  Seed: KVSARVRFF (MAGA1_HUMAN)
KVSARVRFK

SEQ ID NO: 47087 - protein, 9 aa, Artificial Sequence
  Description of Artificial Sequence: Synthetic peptide
  Seed: IAMEGGHAP (MAGA1_HUMAN)
ITMEGGHAF

SEQ ID NO: 47088 - protein, 10 aa, Artificial Sequence
  Description of Artificial Sequence: Synthetic peptide
  Seed: CILESLFRAV (MAGA1_HUMAN)
CILESLFRAL

SEQ ID NO: 47089 - protein, 9 aa, Artificial Sequence
  Description of Artificial Sequence: Synthetic peptide
  Seed: TQDLVQEKY (MAGA1_HUMAN)
TVDLVQEKL

SEQ ID NO: 47090 - protein, 9 aa, Artificial Sequence
  Description of Artificial Sequence: Synthetic peptide
  Seed: FFFPSLREA (MAGA1_HUMAN)
FLFPSLREV

SEQ ID NO: 47091 - protein, 9 aa, Artificial Sequence
  Description of Artificial Sequence: Synthetic peptide
  Seed: FPTTINFTR (MAGA1_HUMAN)
FSTTINFTR

SEQ ID NO: 47092 - protein, 9 aa, Artificial Sequence
  Description of Artificial Sequence: Synthetic peptide
  Seed: SARVRFFFP (MAGA1_HUMAN)
SWRVRFFFM

SEQ ID NO: 47093 - protein, 10 aa, Artificial Sequence
  Description of Artificial Sequence: Synthetic peptide
  Seed: RVRFFFPSLR (MAGA1_HUMAN)
RPRFFFPSLI

SEQ ID NO: 47094 - protein, 9 aa, Artificial Sequence
  Description of Artificial Sequence: Synthetic peptide
  Seed: AYGEPRKLL (MAGA1_HUMAN)
AAGEPRKLV

SEQ ID NO: 47095 - protein, 9 aa, Artificial Sequence
  Description of Artificial Sequence: Synthetic peptide
  Seed: SAFPTTINF (MAGA1_HUMAN)
SSFPTTINR

SEQ ID NO: 47096 - protein, 10 aa, Artificial Sequence
  Description of Artificial Sequence: Synthetic peptide
  Seed: SESLQLVFGI (MAGA1_HUMAN)
SMSLQLVFGW

SEQ ID NO: 47097 - protein, 9 aa, Artificial Sequence
  Description of Artificial Sequence: Synthetic peptide
  Seed: ALEAQQEAL (MAGA1_HUMAN)
AMEAQQEAW

SEQ ID NO: 47098 - protein, 9 aa, Artificial Sequence
  Description of Artificial Sequence: Synthetic peptide
  Seed: LKYRAREPV (MAGA1_HUMAN)
LNYRAREPF

SEQ ID NO: 47099 - protein, 9 aa, Artificial Sequence
  Description of Artificial Sequence: Synthetic peptide
  Seed: AQQEALGLV (MAGA1_HUMAN)
ATQEALGLL

SEQ ID NO: 47100 - protein, 9 aa, Artificial Sequence
  Description of Artificial Sequence: Synthetic peptide
  Seed: LTQDLVQEK (MAGA1_HUMAN)
LSQDLVQEI

SEQ ID NO: 47101 - protein, 9 aa, Artificial Sequence
  Description of Artificial Sequence: Synthetic peptide
  Seed: KVLEYVIKV (MAGA1_HUMAN)
KTLEYVIKK

SEQ ID NO: 47102 - protein, 9 aa, Artificial Sequence
  Description of Artificial Sequence: Synthetic peptide
  Seed: SARVRFFFP (MAGA1_HUMAN)
SYRVRFFFL

SEQ ID NO: 47103 - protein, 9 aa, Artificial Sequence
  Description of Artificial Sequence: Synthetic peptide
  Seed: VYDGREHSA (MAGA1_HUMAN)
VTDGREHSF

SEQ ID NO: 47104 - protein, 9 aa, Artificial Sequence
  Description of Artificial Sequence: Synthetic peptide
  Seed: TSYVKVLEY (MAGA1_HUMAN)
TPYVKVLEF

SEQ ID NO: 47105 - protein, 9 aa, Artificial Sequence
  Description of Artificial Sequence: Synthetic peptide
  Seed: TQDLVQEKY (MAGA1_HUMAN)
TFDLVQEKL

SEQ ID NO: 47106 - protein, 9 aa, Artificial Sequence
  Description of Artificial Sequence: Synthetic peptide
  Seed: VYDGREHSA (MAGA1_HUMAN)
VRDGREHSF

SEQ ID NO: 47107 - protein, 9 aa, Artificial Sequence
  Description of Artificial Sequence: Synthetic peptide
  Seed: AATSSSSPL (MAGA1_HUMAN)
ALTSSSSPY

SEQ ID NO: 47108 - protein, 9 aa, Artificial Sequence
  Description of Artificial Sequence: Synthetic peptide
  Seed: EADPTGHSY (MAGA1_HUMAN)
EFDPTGHSY

SEQ ID NO: 47109 - protein, 9 aa, Artificial Sequence
  Description of Artificial Sequence: Synthetic peptide
  Seed: QIMPKTGFL (MAGA1_HUMAN)
QLMPKTGFV

SEQ ID NO: 47110 - protein, 10 aa, Artificial Sequence
  Description of Artificial Sequence: Synthetic peptide
  Seed: SARVRFFFPS (MAGA1_HUMAN)
SYRVRFFFPY

SEQ ID NO: 47111 - protein, 10 aa, Artificial Sequence
  Description of Artificial Sequence: Synthetic peptide
  Seed: FFPSLREAAL (MAGA1_HUMAN)
FIPSLREAAL

SEQ ID NO: 47112 - protein, 9 aa, Artificial Sequence
  Description of Artificial Sequence: Synthetic peptide
  Seed: KVSARVRFF (MAGA1_HUMAN)
KISARVRFV

SEQ ID NO: 47113 - protein, 11 aa, Artificial Sequence
  Description of Artificial Sequence: Synthetic peptide
  Seed: IKVSARVRFFF (MAGA1_HUMAN)
IAVSARVRFFW

SEQ ID NO: 47114 - protein, 10 aa, Artificial Sequence
  Description of Artificial Sequence: Synthetic peptide
  Seed: RALAETSYVK (MAGA1_HUMAN)
RILAETSYVR

SEQ ID NO: 47115 - protein, 11 aa, Artificial Sequence
  Description of Artificial Sequence: Synthetic peptide
  Seed: RVRFFFPSLRE (MAGA1_HUMAN)
RSRFFFPSLRM

SEQ ID NO: 47116 - protein, 9 aa, Artificial Sequence
  Description of Artificial Sequence: Synthetic peptide
  Seed: RVRFFFPSL (MAGA1_HUMAN)
RSRFFFPSN

SEQ ID NO: 47117 - protein, 9 aa, Artificial Sequence
  Description of Artificial Sequence: Synthetic peptide
  Seed: VQAATSSSS (MAGA1_HUMAN)
VMAATSSSL

SEQ ID NO: 47118 - protein, 9 aa, Artificial Sequence
  Description of Artificial Sequence: Synthetic peptide
  Seed: LQLVFGIDV (MAGA1_HUMAN)
LQLVFGIDM

SEQ ID NO: 47119 - protein, 9 aa, Artificial Sequence
  Description of Artificial Sequence: Synthetic peptide
  Seed: FLWGPRALA (MAGA1_HUMAN)
FIWGPRALA

SEQ ID NO: 47120 - protein, 10 aa, Artificial Sequence
  Description of Artificial Sequence: Synthetic peptide
  Seed: SSSPLVLGTL (MAGA1_HUMAN)
STSPLVLGTV

SEQ ID NO: 47121 - protein, 9 aa, Artificial Sequence
  Description of Artificial Sequence: Synthetic peptide
  Seed: FLIIVLVMI (MAGA1_HUMAN)
FSIIVLVMV

SEQ ID NO: 47122 - protein, 9 aa, Artificial Sequence
  Description of Artificial Sequence: Synthetic peptide
  Seed: RVRFFFPSL (MAGA1_HUMAN)
RQRFFFPSQ

SEQ ID NO: 47123 - protein, 11 aa, Artificial Sequence
  Description of Artificial Sequence: Synthetic peptide
  Seed: YEFLWGPRALA (MAGA1_HUMAN)
YTFLWGPRALL

SEQ ID NO: 47124 - protein, 10 aa, Artificial Sequence
  Description of Artificial Sequence: Synthetic peptide
  Seed: KVADLVGFLL (MAGA1_HUMAN)
KWADLVGFLW

SEQ ID NO: 47125 - protein, 10 aa, Artificial Sequence
  Description of Artificial Sequence: Synthetic peptide
  Seed: KEADPTGHSY (MAGA1_HUMAN)
KAADPTGHSY

SEQ ID NO: 47126 - protein, 11 aa, Artificial Sequence
  Description of Artificial Sequence: Synthetic peptide
  Seed: VPDSDPARYEF (MAGA1_HUMAN)
VVDSDPARYEL

SEQ ID NO: 47127 - protein, 9 aa, Artificial Sequence
  Description of Artificial Sequence: Synthetic peptide
  Seed: SYVKVLEYV (MAGA1_HUMAN)
SWVKVLEYM

SEQ ID NO: 47128 - protein, 9 aa, Artificial Sequence
  Description of Artificial Sequence: Synthetic peptide
  Seed: RQRQPSEGS (MAGA1_HUMAN)
RVRQPSEGS

SEQ ID NO: 47129 - protein, 9 aa, Artificial Sequence
  Description of Artificial Sequence: Synthetic peptide
  Seed: HSYVLVTCL (MAGA1_HUMAN)
HTYVLVTCW

SEQ ID NO: 47130 - protein, 9 aa, Artificial Sequence
  Description of Artificial Sequence: Synthetic peptide
  Seed: EADPTGHSY (MAGA1_HUMAN)
EMDPTGHSV

SEQ ID NO: 47131 - protein, 10 aa, Artificial Sequence
  Description of Artificial Sequence: Synthetic peptide
  Seed: KVADLVGFLL (MAGA1_HUMAN)
KSADLVGFLR

SEQ ID NO: 47132 - protein, 11 aa, Artificial Sequence
  Description of Artificial Sequence: Synthetic peptide
  Seed: KVADLVGFLLL (MAGA1_HUMAN)
KMADLVGFLLL

SEQ ID NO: 47133 - protein, 10 aa, Artificial Sequence
  Description of Artificial Sequence: Synthetic peptide
  Seed: EVYDGREHSA (MAGA1_HUMAN)
EVYDGREHSL

SEQ ID NO: 47134 - protein, 10 aa, Artificial Sequence
  Description of Artificial Sequence: Synthetic peptide
  Seed: SARVRFFFPS (MAGA1_HUMAN)
SARVRFFFPM

SEQ ID NO: 47135 - protein, 9 aa, Artificial Sequence
  Description of Artificial Sequence: Synthetic peptide
  Seed: LVQEKYLEY (MAGA1_HUMAN)
LYQEKYLEM

SEQ ID NO: 47136 - protein, 9 aa, Artificial Sequence
  Description of Artificial Sequence: Synthetic peptide
  Seed: LESVIKNYK (MAGA1_HUMAN)
LTSVIKNYK

SEQ ID NO: 47137 - protein, 9 aa, Artificial Sequence
  Description of Artificial Sequence: Synthetic peptide
  Seed: FLWGPRALA (MAGA1_HUMAN)
FAWGPRALK

SEQ ID NO: 47138 - protein, 10 aa, Artificial Sequence
  Description of Artificial Sequence: Synthetic peptide
  Seed: ALAETSYVKV (MAGA1_HUMAN)
ALAETSYVKL

SEQ ID NO: 47139 - protein, 11 aa, Artificial Sequence
  Description of Artificial Sequence: Synthetic peptide
  Seed: YEFLWGPRALA (MAGA1_HUMAN)
YCFLWGPRALL

SEQ ID NO: 47140 - protein, 9 aa, Artificial Sequence
  Description of Artificial Sequence: Synthetic peptide
  Seed: LESLFRAVI (MAGA1_HUMAN)
LESLFRAVY

SEQ ID NO: 47141 - protein, 9 aa, Artificial Sequence
  Description of Artificial Sequence: Synthetic peptide
  Seed: RVRFFFPSL (MAGA1_HUMAN)
RMRFFFPSV

SEQ ID NO: 47142 - protein, 10 aa, Artificial Sequence
  Description of Artificial Sequence: Synthetic peptide
  Seed: KVADLVGFLL (MAGA1_HUMAN)
KLADLVGFLD

SEQ ID NO: 47143 - protein, 9 aa, Artificial Sequence
  Description of Artificial Sequence: Synthetic peptide
  Seed: KYRAREPVT (MAGA1_HUMAN)
KYRAREPVR

SEQ ID NO: 47144 - protein, 9 aa, Artificial Sequence
  Description of Artificial Sequence: Synthetic peptide
  Seed: SAFPTTINF (MAGA1_HUMAN)
SNFPTTINL

SEQ ID NO: 47145 - protein, 9 aa, Artificial Sequence
  Description of Artificial Sequence: Synthetic peptide
  Seed: SSPLVLGTL (MAGA1_HUMAN)
SYPLVLGTL

SEQ ID NO: 47146 - protein, 10 aa, Artificial Sequence
  Description of Artificial Sequence: Synthetic peptide
  Seed: ARVRFFFPSL (MAGA1_HUMAN)
AYVRFFFPSK

SEQ ID NO: 47147 - protein, 10 aa, Artificial Sequence
  Description of Artificial Sequence: Synthetic peptide
  Seed: FFPSLREAAL (MAGA1_HUMAN)
FKPSLREAAY

SEQ ID NO: 47148 - protein, 10 aa, Artificial Sequence
  Description of Artificial Sequence: Synthetic peptide
  Seed: SLFRAVITKK (MAGA1_HUMAN)
SGFRAVITKR

SEQ ID NO: 47149 - protein, 11 aa, Artificial Sequence
  Description of Artificial Sequence: Synthetic peptide
  Seed: ARVRFFFPSLR (MAGA1_HUMAN)
AGVRFFFPSLR

SEQ ID NO: 47150 - protein, 9 aa, Artificial Sequence
  Description of Artificial Sequence: Synthetic peptide
  Seed: REPVTKAEM (MAGA1_HUMAN)
REPVTKAEF

SEQ ID NO: 47151 - protein, 10 aa, Artificial Sequence
  Description of Artificial Sequence: Synthetic peptide
  Seed: RYEFLWGPRA (MAGA1_HUMAN)
RNEFLWGPRL

SEQ ID NO: 47152 - protein, 9 aa, Artificial Sequence
  Description of Artificial Sequence: Synthetic peptide
  Seed: AQQEALGLV (MAGA1_HUMAN)
AAQEALGLL

SEQ ID NO: 47153 - protein, 9 aa, Artificial Sequence
  Description of Artificial Sequence: Synthetic peptide
  Seed: LTQDLVQEK (MAGA1_HUMAN)
LTQDLVQER

SEQ ID NO: 47154 - protein, 9 aa, Artificial Sequence
  Description of Artificial Sequence: Synthetic peptide
  Seed: DSDPARYEF (MAGA1_HUMAN)
DLDPARYEY

SEQ ID NO: 47155 - protein, 9 aa, Artificial Sequence
  Description of Artificial Sequence: Synthetic peptide
  Seed: LVQEKYLEY (MAGA1_HUMAN)
LSQEKYLEI

SEQ ID NO: 47156 - protein, 11 aa, Artificial Sequence
  Description of Artificial Sequence: Synthetic peptide
  Seed: ELSVMEVYDGR (MAGA1_HUMAN)
EVSVMEVYDGR

SEQ ID NO: 47157 - protein, 9 aa, Artificial Sequence
  Description of Artificial Sequence: Synthetic peptide
  Seed: KVLEYVIKV (MAGA1_HUMAN)
KSLEYVIKL

SEQ ID NO: 47158 - protein, 11 aa, Artificial Sequence
  Description of Artificial Sequence: Synthetic peptide
  Seed: YEFLWGPRALA (MAGA1_HUMAN)
YYFLWGPRALV

SEQ ID NO: 47159 - protein, 9 aa, Artificial Sequence
  Description of Artificial Sequence: Synthetic peptide
  Seed: HCFPEIFGK (MAGA1_HUMAN)
HAFPEIFGK

SEQ ID NO: 47160 - protein, 9 aa, Artificial Sequence
  Description of Artificial Sequence: Synthetic peptide
  Seed: EADPTGHSY (MAGA1_HUMAN)
EYDPTGHSY

SEQ ID NO: 47161 - protein, 10 aa, Artificial Sequence
  Description of Artificial Sequence: Synthetic peptide
  Seed: AREPVTKAEM (MAGA1_HUMAN)
AQEPVTKAEF

SEQ ID NO: 47162 - protein, 10 aa, Artificial Sequence
  Description of Artificial Sequence: Synthetic peptide
  Seed: EALEAQQEAL (MAGA1_HUMAN)
EMLEAQQEAR

SEQ ID NO: 47163 - protein, 9 aa, Artificial Sequence
  Description of Artificial Sequence: Synthetic peptide
  Seed: FFFPSLREA (MAGA1_HUMAN)
FNFPSLREF

SEQ ID NO: 47164 - protein, 11 aa, Artificial Sequence
  Description of Artificial Sequence: Synthetic peptide
  Seed: KLLTQDLVQEK (MAGA1_HUMAN)
KTLTQDLVQEK

SEQ ID NO: 47165 - protein, 11 aa, Artificial Sequence
  Description of Artificial Sequence: Synthetic peptide
  Seed: RVRFFFPSLRE (MAGA1_HUMAN)
RFRFFFPSLRL

SEQ ID NO: 47166 - protein, 9 aa, Artificial Sequence
  Description of Artificial Sequence: Synthetic peptide
  Seed: GASAFPTTI (MAGA1_HUMAN)
GISAFPTTY

SEQ ID NO: 47167 - protein, 9 aa, Artificial Sequence
  Description of Artificial Sequence: Synthetic peptide
  Seed: IFGKASESL (MAGA1_HUMAN)
IYGKASESF

SEQ ID NO: 47168 - protein, 9 aa, Artificial Sequence
  Description of Artificial Sequence: Synthetic peptide
  Seed: KVADLVGFL (MAGA1_HUMAN)
KLADLVGFM

SEQ ID NO: 47169 - protein, 9 aa, Artificial Sequence
  Description of Artificial Sequence: Synthetic peptide
  Seed: LVLGTLEEV (MAGA1_HUMAN)
LILGTLEEA

SEQ ID NO: 47170 - protein, 9 aa, Artificial Sequence
  Description of Artificial Sequence: Synthetic peptide
  Seed: REPVTKAEM (MAGA1_HUMAN)
RAPVTKAEL

SEQ ID NO: 47171 - protein, 10 aa, Artificial Sequence
  Description of Artificial Sequence: Synthetic peptide
  Seed: DVKEADPTGH (MAGA1_HUMAN)
DIKEADPTGR

SEQ ID NO: 47172 - protein, 9 aa, Artificial Sequence
  Description of Artificial Sequence: Synthetic peptide
  Seed: TSYVKVLEY (MAGA1_HUMAN)
TTYVKVLER

SEQ ID NO: 47173 - protein, 9 aa, Artificial Sequence
  Description of Artificial Sequence: Synthetic peptide
  Seed: TKAEMLESV (MAGA1_HUMAN)
TTAEMLESL

SEQ ID NO: 47174 - protein, 9 aa, Artificial Sequence
  Description of Artificial Sequence: Synthetic peptide
  Seed: TQDLVQEKY (MAGA1_HUMAN)
TMDLVQEKV

SEQ ID NO: 47175 - protein, 9 aa, Artificial Sequence
  Description of Artificial Sequence: Synthetic peptide
  Seed: SLFRAVITK (MAGA1_HUMAN)
SLFRAVITL

SEQ ID NO: 47176 - protein, 9 aa, Artificial Sequence
  Description of Artificial Sequence: Synthetic peptide
  Seed: FPSLREAAL (MAGA1_HUMAN)
FMSLREAAL

SEQ ID NO: 47177 - protein, 9 aa, Artificial Sequence
  Description of Artificial Sequence: Synthetic peptide
  Seed: RVRFFFPSL (MAGA1_HUMAN)
RIRFFFPSV

SEQ ID NO: 47178 - protein, 9 aa, Artificial Sequence
  Description of Artificial Sequence: Synthetic peptide
  Seed: ESLQLVFGI (MAGA1_HUMAN)
EILQLVFGV

SEQ ID NO: 47179 - protein, 10 aa, Artificial Sequence
  Description of Artificial Sequence: Synthetic peptide
  Seed: EYVIKVSARV (MAGA1_HUMAN)
ETVIKVSARV

SEQ ID NO: 47180 - protein, 9 aa, Artificial Sequence
  Description of Artificial Sequence: Synthetic peptide
  Seed: EYVIKVSAR (MAGA1_HUMAN)
EVVIKVSAR

SEQ ID NO: 47181 - protein, 10 aa, Artificial Sequence
  Description of Artificial Sequence: Synthetic peptide
  Seed: KYRAREPVTK (MAGA1_HUMAN)
KTRAREPVTI

SEQ ID NO: 47182 - protein, 9 aa, Artificial Sequence
  Description of Artificial Sequence: Synthetic peptide
  Seed: EHSAYGEPR (MAGA1_HUMAN)
ELSAYGEPR

SEQ ID NO: 47183 - protein, 9 aa, Artificial Sequence
  Description of Artificial Sequence: Synthetic peptide
  Seed: CILESLFRA (MAGA1_HUMAN)
CILESLFRL

SEQ ID NO: 47184 - protein, 9 aa, Artificial Sequence
  Description of Artificial Sequence: Synthetic peptide
  Seed: TQDLVQEKY (MAGA1_HUMAN)
TMDLVQEKM

SEQ ID NO: 47185 - protein, 10 aa, Artificial Sequence
  Description of Artificial Sequence: Synthetic peptide
  Seed: KVSARVRFFF (MAGA1_HUMAN)
KWSARVRFFK

SEQ ID NO: 47186 - protein, 9 aa, Artificial Sequence
  Description of Artificial Sequence: Synthetic peptide
  Seed: YVLVTCLGL (MAGA1_HUMAN)
YQLVTCLGY

SEQ ID NO: 47187 - protein, 10 aa, Artificial Sequence
  Description of Artificial Sequence: Synthetic peptide
  Seed: KEADPTGHSY (MAGA1_HUMAN)
KLADPTGHSK

SEQ ID NO: 47188 - protein, 10 aa, Artificial Sequence
  Description of Artificial Sequence: Synthetic peptide
  Seed: KASESLQLVF (MAGA1_HUMAN)
KMSESLQLVL

SEQ ID NO: 47189 - protein, 10 aa, Artificial Sequence
  Description of Artificial Sequence: Synthetic peptide
  Seed: VLVTCLGLSY (MAGA1_HUMAN)
VSVTCLGLSY

SEQ ID NO: 47190 - protein, 9 aa, Artificial Sequence
  Description of Artificial Sequence: Synthetic peptide
  Seed: LTQDLVQEK (MAGA1_HUMAN)
LRQDLVQEM

SEQ ID NO: 47191 - protein, 10 aa, Artificial Sequence
  Description of Artificial Sequence: Synthetic peptide
  Seed: ALAETSYVKV (MAGA1_HUMAN)
ALAETSYVKI

SEQ ID NO: 47192 - protein, 11 aa, Artificial Sequence
  Description of Artificial Sequence: Synthetic peptide
  Seed: SARVRFFFPSL (MAGA1_HUMAN)
STRVRFFFPSI

SEQ ID NO: 47193 - protein, 9 aa, Artificial Sequence
  Description of Artificial Sequence: Synthetic peptide
  Seed: SAFPTTINF (MAGA1_HUMAN)
SQFPTTINA

SEQ ID NO: 47194 - protein, 11 aa, Artificial Sequence
  Description of Artificial Sequence: Synthetic peptide
  Seed: RQVPDSDPARY (MAGA1_HUMAN)
RRVPDSDPARM

SEQ ID NO: 47195 - protein, 11 aa, Artificial Sequence
  Description of Artificial Sequence: Synthetic peptide
  Seed: KVADLVGFLLL (MAGA1_HUMAN)
KSADLVGFLLW

SEQ ID NO: 47196 - protein, 9 aa, Artificial Sequence
  Description of Artificial Sequence: Synthetic peptide
  Seed: AATSSSSPL (MAGA1_HUMAN)
AMTSSSSPI

SEQ ID NO: 47197 - protein, 9 aa, Artificial Sequence
  Description of Artificial Sequence: Synthetic peptide
  Seed: RAREPVTKA (MAGA1_HUMAN)
RCREPVTKK

SEQ ID NO: 47198 - protein, 10 aa, Artificial Sequence
  Description of Artificial Sequence: Synthetic peptide
  Seed: KVSARVRFFF (MAGA1_HUMAN)
KRSARVRFFK

SEQ ID NO: 47199 - protein, 10 aa, Artificial Sequence
  Description of Artificial Sequence: Synthetic peptide
  Seed: SYVKVLEYVI (MAGA1_HUMAN)
SWVKVLEYVW

SEQ ID NO: 47200 - protein, 9 aa, Artificial Sequence
  Description of Artificial Sequence: Synthetic peptide
  Seed: SSPLVLGTL (MAGA1_HUMAN)
SSPLVLGTM

SEQ ID NO: 47201 - protein, 9 aa, Artificial Sequence
  Description of Artificial Sequence: Synthetic peptide
  Seed: KVADLVGFL (MAGA1_HUMAN)
KIADLVGFV

SEQ ID NO: 47202 - protein, 10 aa, Artificial Sequence
  Description of Artificial Sequence: Synthetic peptide
  Seed: KASESLQLVF (MAGA1_HUMAN)
KSSESLQLVI

SEQ ID NO: 47203 - protein, 9 aa, Artificial Sequence
  Description of Artificial Sequence: Synthetic peptide
  Seed: VQAATSSSS (MAGA1_HUMAN)
VAAATSSSM

SEQ ID NO: 47204 - protein, 10 aa, Artificial Sequence
  Description of Artificial Sequence: Synthetic peptide
  Seed: SCILESLFRA (MAGA1_HUMAN)
SWILESLFRV

SEQ ID NO: 47205 - protein, 8 aa, Artificial Sequence
  Description of Artificial Sequence: Synthetic peptide
  Seed: HSYVLVTC (MAGA1_HUMAN)
HEYVLVTL

SEQ ID NO: 47206 - protein, 9 aa, Artificial Sequence
  Description of Artificial Sequence: Synthetic peptide
  Seed: ATSSSSPLV (MAGA1_HUMAN)
AISSSSPLL

SEQ ID NO: 47207 - protein, 9 aa, Artificial Sequence
  Description of Artificial Sequence: Synthetic peptide
  Seed: QIMPKTGFL (MAGA1_HUMAN)
QMMPKTGFV

SEQ ID NO: 47208 - protein, 10 aa, Artificial Sequence
  Description of Artificial Sequence: Synthetic peptide
  Seed: EVYDGREHSA (MAGA1_HUMAN)
EMYDGREHSF

SEQ ID NO: 47209 - protein, 9 aa, Artificial Sequence
  Description of Artificial Sequence: Synthetic peptide
  Seed: KYRAREPVT (MAGA1_HUMAN)
KVRAREPVL

SEQ ID NO: 47210 - protein, 9 aa, Artificial Sequence
  Description of Artificial Sequence: Synthetic peptide
  Seed: TQDLVQEKY (MAGA1_HUMAN)
TPDLVQEKY

SEQ ID NO: 47211 - protein, 9 aa, Artificial Sequence
  Description of Artificial Sequence: Synthetic peptide
  Seed: SAFPTTINF (MAGA1_HUMAN)
SYFPTTINW

SEQ ID NO: 47212 - protein, 9 aa, Artificial Sequence
  Description of Artificial Sequence: Synthetic peptide
  Seed: LTQDLVQEK (MAGA1_HUMAN)
LFQDLVQEL

SEQ ID NO: 47213 - protein, 9 aa, Artificial Sequence
  Description of Artificial Sequence: Synthetic peptide
  Seed: ARVRFFFPS (MAGA1_HUMAN)
ARVRFFFPL

SEQ ID NO: 47214 - protein, 9 aa, Artificial Sequence
  Description of Artificial Sequence: Synthetic peptide
  Seed: RVRFFFPSL (MAGA1_HUMAN)
RIRFFFPSC

SEQ ID NO: 47215 - protein, 10 aa, Artificial Sequence
  Description of Artificial Sequence: Synthetic peptide
  Seed: RVRFFFPSLR (MAGA1_HUMAN)
RGRFFFPSLA

SEQ ID NO: 47216 - protein, 10 aa, Artificial Sequence
  Description of Artificial Sequence: Synthetic peptide
  Seed: EVYDGREHSA (MAGA1_HUMAN)
EAYDGREHSK

SEQ ID NO: 47217 - protein, 8 aa, Artificial Sequence
  Description of Artificial Sequence: Synthetic peptide
  Seed: AEMLESVI (MAGA1_HUMAN)
AEMLESVA

SEQ ID NO: 47218 - protein, 10 aa, Artificial Sequence
  Description of Artificial Sequence: Synthetic peptide
  Seed: FFFPSLREAA (MAGA1_HUMAN)
FMFPSLREAM

SEQ ID NO: 47219 - protein, 9 aa, Artificial Sequence
  Description of Artificial Sequence: Synthetic peptide
  Seed: SAFPTTINF (MAGA1_HUMAN)
SWFPTTINY

SEQ ID NO: 47220 - protein, 9 aa, Artificial Sequence
  Description of Artificial Sequence: Synthetic peptide
  Seed: TSSSSPLVL (MAGA1_HUMAN)
TCSSSPLVW

SEQ ID NO: 47221 - protein, 11 aa, Artificial Sequence
  Description of Artificial Sequence: Synthetic peptide
  Seed: AEMLESVIKNY (MAGA1_HUMAN)
AEMLESVIKNW

SEQ ID NO: 47222 - protein, 9 aa, Artificial Sequence
  Description of Artificial Sequence: Synthetic peptide
  Seed: RVRFFFPSL (MAGA1_HUMAN)
RTRFFFPSQ

SEQ ID NO: 47223 - protein, 9 aa, Artificial Sequence
  Description of Artificial Sequence: Synthetic peptide
  Seed: RQVPDSDPA (MAGA1_HUMAN)
RQVPDSDPL

SEQ ID NO: 47224 - protein, 9 aa, Artificial Sequence
  Description of Artificial Sequence: Synthetic peptide
  Seed: RALAETSYV (MAGA1_HUMAN)
RWLAETSYY

SEQ ID NO: 47225 - protein, 10 aa, Artificial Sequence
  Description of Artificial Sequence: Synthetic peptide
  Seed: KVADLVGFLL (MAGA1_HUMAN)
KTADLVGFLK

SEQ ID NO: 47226 - protein, 9 aa, Artificial Sequence
  Description of Artificial Sequence: Synthetic peptide
  Seed: FPSLREAAL (MAGA1_HUMAN)
FSSLREAAL

SEQ ID NO: 47227 - protein, 9 aa, Artificial Sequence
  Description of Artificial Sequence: Synthetic peptide
  Seed: TSSSSPLVL (MAGA1_HUMAN)
TASSSPLVV

SEQ ID NO: 47228 - protein, 9 aa, Artificial Sequence
  Description of Artificial Sequence: Synthetic peptide
  Seed: LTQDLVQEK (MAGA1_HUMAN)
LSQDLVQEF

SEQ ID NO: 47229 - protein, 9 aa, Artificial Sequence
  Description of Artificial Sequence: Synthetic peptide
  Seed: SAFPTTINF (MAGA1_HUMAN)
SFFPTTINL

SEQ ID NO: 47230 - protein, 9 aa, Artificial Sequence
  Description of Artificial Sequence: Synthetic peptide
  Seed: FFFPSLREA (MAGA1_HUMAN)
FMFPSLREF

SEQ ID NO: 47231 - protein, 11 aa, Artificial Sequence
  Description of Artificial Sequence: Synthetic peptide
  Seed: RVRFFFPSLRE (MAGA1_HUMAN)
RTRFFFPSLRR

SEQ ID NO: 47232 - protein, 9 aa, Artificial Sequence
  Description of Artificial Sequence: Synthetic peptide
  Seed: EADPTGHSY (MAGA1_HUMAN)
ECDPTGHSV

SEQ ID NO: 47233 - protein, 9 aa, Artificial Sequence
  Description of Artificial Sequence: Synthetic peptide
  Seed: AQQEALGLV (MAGA1_HUMAN)
AMQEALGLV

SEQ ID NO: 47234 - protein, 9 aa, Artificial Sequence
  Description of Artificial Sequence: Synthetic peptide
  Seed: HSYVLVTCL (MAGA1_HUMAN)
HRYVLVTCL

SEQ ID NO: 47235 - protein, 9 aa, Artificial Sequence
  Description of Artificial Sequence: Synthetic peptide
  Seed: KVLEYVIKV (MAGA1_HUMAN)
KRLEYVIKI

SEQ ID NO: 47236 - protein, 9 aa, Artificial Sequence
  Description of Artificial Sequence: Synthetic peptide
  Seed: VITKKVADL (MAGA1_HUMAN)
VATKKVADY

SEQ ID NO: 47237 - protein, 10 aa, Artificial Sequence
  Description of Artificial Sequence: Synthetic peptide
  Seed: SARVRFFFPS (MAGA1_HUMAN)
SHRVRFFFPY

SEQ ID NO: 47238 - protein, 11 aa, Artificial Sequence
  Description of Artificial Sequence: Synthetic peptide
  Seed: KVADLVGFLLL (MAGA1_HUMAN)
KIADLVGFLLK

SEQ ID NO: 47239 - protein, 9 aa, Artificial Sequence
  Description of Artificial Sequence: Synthetic peptide
  Seed: YVIKVSARV (MAGA1_HUMAN)
YIIKVSARM

SEQ ID NO: 47240 - protein, 11 aa, Artificial Sequence
  Description of Artificial Sequence: Synthetic peptide
  Seed: RVRFFFPSLRE (MAGA1_HUMAN)
RMRFFFPSLRQ

SEQ ID NO: 47241 - protein, 9 aa, Artificial Sequence
  Description of Artificial Sequence: Synthetic peptide
  Seed: KVADLVGFL (MAGA1_HUMAN)
KMADLVGFY

SEQ ID NO: 47242 - protein, 11 aa, Artificial Sequence
  Description of Artificial Sequence: Synthetic peptide
  Seed: KVSARVRFFFP (MAGA1_HUMAN)
KTSARVRFFFV

SEQ ID NO: 47243 - protein, 9 aa, Artificial Sequence
  Description of Artificial Sequence: Synthetic peptide
  Seed: FFFPSLREA (MAGA1_HUMAN)
FKFPSLREM

SEQ ID NO: 47244 - protein, 10 aa, Artificial Sequence
  Description of Artificial Sequence: Synthetic peptide
  Seed: SCILESLFRA (MAGA1_HUMAN)
SGILESLFRL

SEQ ID NO: 47245 - protein, 9 aa, Artificial Sequence
  Description of Artificial Sequence: Synthetic peptide
  Seed: KASESLQLV (MAGA1_HUMAN)
KGSESLQLF

SEQ ID NO: 47246 - protein, 9 aa, Artificial Sequence
  Description of Artificial Sequence: Synthetic peptide
  Seed: VADLVGFLL (MAGA1_HUMAN)
VQDLVGFLL

SEQ ID NO: 47247 - protein, 9 aa, Artificial Sequence
  Description of Artificial Sequence: Synthetic peptide
  Seed: LTQDLVQEK (MAGA1_HUMAN)
LAQDLVQEH

SEQ ID NO: 47248 - protein, 9 aa, Artificial Sequence
  Description of Artificial Sequence: Synthetic peptide
  Seed: FFFPSLREA (MAGA1_HUMAN)
FYFPSLREY

SEQ ID NO: 47249 - protein, 9 aa, Artificial Sequence
  Description of Artificial Sequence: Synthetic peptide
  Seed: TKAEMLESV (MAGA1_HUMAN)
TIAEMLESL

SEQ ID NO: 47250 - protein, 9 aa, Artificial Sequence
  Description of Artificial Sequence: Synthetic peptide
  Seed: IAMEGGHAP (MAGA1_HUMAN)
IPMEGGHAA

SEQ ID NO: 47251 - protein, 10 aa, Artificial Sequence
  Description of Artificial Sequence: Synthetic peptide
  Seed: KNYKHCFPEI (MAGA1_HUMAN)
KWYKHCFPEF

SEQ ID NO: 47252 - protein, 9 aa, Artificial Sequence
  Description of Artificial Sequence: Synthetic peptide
  Seed: KASESLQLV (MAGA1_HUMAN)
KISESLQLV

SEQ ID NO: 47253 - protein, 9 aa, Artificial Sequence
  Description of Artificial Sequence: Synthetic peptide
  Seed: EADPTGHSY (MAGA1_HUMAN)
ECDPTGHSI

SEQ ID NO: 47254 - protein, 10 aa, Artificial Sequence
  Description of Artificial Sequence: Synthetic peptide
  Seed: KYRAREPVTK (MAGA1_HUMAN)
KSRAREPVTA

SEQ ID NO: 47255 - protein, 9 aa, Artificial Sequence
  Description of Artificial Sequence: Synthetic peptide
  Seed: QIMPKTGFL (MAGA1_HUMAN)
QIMPKTGFK

SEQ ID NO: 47256 - protein, 9 aa, Artificial Sequence
  Description of Artificial Sequence: Synthetic peptide
  Seed: TQDLVQEKY (MAGA1_HUMAN)
TPDLVQEKF

SEQ ID NO: 47257 - protein, 9 aa, Artificial Sequence
  Description of Artificial Sequence: Synthetic peptide
  Seed: DSDPARYEF (MAGA1_HUMAN)
DIDPARYEL

SEQ ID NO: 47258 - protein, 9 aa, Artificial Sequence
  Description of Artificial Sequence: Synthetic peptide
  Seed: STSCILESL (MAGA1_HUMAN)
STSCILESF

SEQ ID NO: 47259 - protein, 9 aa, Artificial Sequence
  Description of Artificial Sequence: Synthetic peptide
  Seed: YKHCFPEIF (MAGA1_HUMAN)
YYHCFPEIY

SEQ ID NO: 47260 - protein, 9 aa, Artificial Sequence
  Description of Artificial Sequence: Synthetic peptide
  Seed: VRFFFPSLR (MAGA1_HUMAN)
VRFFFPSLL

SEQ ID NO: 47261 - protein, 9 aa, Artificial Sequence
  Description of Artificial Sequence: Synthetic peptide
  Seed: VADLVGFLL (MAGA1_HUMAN)
VTDLVGFLY

SEQ ID NO: 47262 - protein, 9 aa, Artificial Sequence
  Description of Artificial Sequence: Synthetic peptide
  Seed: TKAEMLESV (MAGA1_HUMAN)
TVAEMLESV

SEQ ID NO: 47263 - protein, 9 aa, Artificial Sequence
  Description of Artificial Sequence: Synthetic peptide
  Seed: SSPLVLGTL (MAGA1_HUMAN)
SVPLVLGTV

SEQ ID NO: 47264 - protein, 9 aa, Artificial Sequence
  Description of Artificial Sequence: Synthetic peptide
  Seed: RVRFFFPSL (MAGA1_HUMAN)
RARFFFPSL

SEQ ID NO: 47265 - protein, 9 aa, Artificial Sequence
  Description of Artificial Sequence: Synthetic peptide
  Seed: RQVPDSDPA (MAGA1_HUMAN)
RMVPDSDPI

SEQ ID NO: 47266 - protein, 11 aa, Artificial Sequence
  Description of Artificial Sequence: Synthetic peptide
  Seed: RAREPVTKAEM (MAGA1_HUMAN)
RPREPVTKAEA

SEQ ID NO: 47267 - protein, 9 aa, Artificial Sequence
  Description of Artificial Sequence: Synthetic peptide
  Seed: STDPPQSPQ (MAGA1_HUMAN)
SADPPQSPC

SEQ ID NO: 47268 - protein, 10 aa, Artificial Sequence
  Description of Artificial Sequence: Synthetic peptide
  Seed: FFPSLREAAL (MAGA1_HUMAN)
FRPSLREAAY

SEQ ID NO: 47269 - protein, 10 aa, Artificial Sequence
  Description of Artificial Sequence: Synthetic peptide
  Seed: SCILESLFRA (MAGA1_HUMAN)
SCILESLFRI

SEQ ID NO: 47270 - protein, 9 aa, Artificial Sequence
  Description of Artificial Sequence: Synthetic peptide
  Seed: AQQEALGLV (MAGA1_HUMAN)
AMQEALGLM

SEQ ID NO: 47271 - protein, 10 aa, Artificial Sequence
  Description of Artificial Sequence: Synthetic peptide
  Seed: CILESLFRAV (MAGA1_HUMAN)
CMLESLFRAA

SEQ ID NO: 47272 - protein, 8 aa, Artificial Sequence
  Description of Artificial Sequence: Synthetic peptide
  Seed: RAREPVTK (MAGA1_HUMAN)
RTREPVTK

SEQ ID NO: 47273 - protein, 10 aa, Artificial Sequence
  Description of Artificial Sequence: Synthetic peptide
  Seed: VLVTCLGLSY (MAGA1_HUMAN)
VFVTCLGLSY

SEQ ID NO: 47274 - protein, 10 aa, Artificial Sequence
  Description of Artificial Sequence: Synthetic peptide
  Seed: VRFFFPSLRE (MAGA1_HUMAN)
VRFFFPSLRL

SEQ ID NO: 47275 - protein, 9 aa, Artificial Sequence
  Description of Artificial Sequence: Synthetic peptide
  Seed: FFFPSLREA (MAGA1_HUMAN)
FAFPSLREV

SEQ ID NO: 47276 - protein, 9 aa, Artificial Sequence
  Description of Artificial Sequence: Synthetic peptide
  Seed: DSDPARYEF (MAGA1_HUMAN)
DFDPARYEL

SEQ ID NO: 47277 - protein, 9 aa, Artificial Sequence
  Description of Artificial Sequence: Synthetic peptide
  Seed: FPTTINFTR (MAGA1_HUMAN)
FGTTINFTR

SEQ ID NO: 47278 - protein, 10 aa, Artificial Sequence
  Description of Artificial Sequence: Synthetic peptide
  Seed: KASESLQLVF (MAGA1_HUMAN)
KDSESLQLVW

SEQ ID NO: 47279 - protein, 9 aa, Artificial Sequence
  Description of Artificial Sequence: Synthetic peptide
  Seed: KASESLQLV (MAGA1_HUMAN)
KYSESLQLK

SEQ ID NO: 47280 - protein, 9 aa, Artificial Sequence
  Description of Artificial Sequence: Synthetic peptide
  Seed: KVSARVRFF (MAGA1_HUMAN)
KVSARVRFM

SEQ ID NO: 47281 - protein, 9 aa, Artificial Sequence
  Description of Artificial Sequence: Synthetic peptide
  Seed: TKAEMLESV (MAGA1_HUMAN)
TVAEMLEST

SEQ ID NO: 47282 - protein, 9 aa, Artificial Sequence
  Description of Artificial Sequence: Synthetic peptide
  Seed: KVADLVGFL (MAGA1_HUMAN)
KLADLVGFV

SEQ ID NO: 47283 - protein, 10 aa, Artificial Sequence
  Description of Artificial Sequence: Synthetic peptide
  Seed: KNYKHCFPEI (MAGA1_HUMAN)
KVYKHCFPEK

SEQ ID NO: 47284 - protein, 10 aa, Artificial Sequence
  Description of Artificial Sequence: Synthetic peptide
  Seed: TSYVKVLEYV (MAGA1_HUMAN)
TLYVKVLEYI

SEQ ID NO: 47285 - protein, 10 aa, Artificial Sequence
  Description of Artificial Sequence: Synthetic peptide
  Seed: RVRFFFPSLR (MAGA1_HUMAN)
RPRFFFPSLM

SEQ ID NO: 47286 - protein, 11 aa, Artificial Sequence
  Description of Artificial Sequence: Synthetic peptide
  Seed: SPQGASAFPTT (MAGA1_HUMAN)
SPQGASAFPTC

SEQ ID NO: 47287 - protein, 10 aa, Artificial Sequence
  Description of Artificial Sequence: Synthetic peptide
  Seed: KEADPTGHSY (MAGA1_HUMAN)
KQADPTGHSM

SEQ ID NO: 47288 - protein, 10 aa, Artificial Sequence
  Description of Artificial Sequence: Synthetic peptide
  Seed: RVRFFFPSLR (MAGA1_HUMAN)
RIRFFFPSLR

SEQ ID NO: 47289 - protein, 9 aa, Artificial Sequence
  Description of Artificial Sequence: Synthetic peptide
  Seed: FFFPSLREA (MAGA1_HUMAN)
FMFPSLRET

SEQ ID NO: 47290 - protein, 10 aa, Artificial Sequence
  Description of Artificial Sequence: Synthetic peptide
  Seed: EVYDGREHSA (MAGA1_HUMAN)
ESYDGREHSR

SEQ ID NO: 47291 - protein, 9 aa, Artificial Sequence
  Description of Artificial Sequence: Synthetic peptide
  Seed: RAREPVTKA (MAGA1_HUMAN)
RTREPVTKG

SEQ ID NO: 47292 - protein, 9 aa, Artificial Sequence
  Description of Artificial Sequence: Synthetic peptide
  Seed: SAFPTTINF (MAGA1_HUMAN)
SNFPTTINR

SEQ ID NO: 47293 - protein, 8 aa, Artificial Sequence
  Description of Artificial Sequence: Synthetic peptide
  Seed: AEMLESVI (MAGA1_HUMAN)
AEMLESVL

SEQ ID NO: 47294 - protein, 9 aa, Artificial Sequence
  Description of Artificial Sequence: Synthetic peptide
  Seed: FPTTINFTR (MAGA1_HUMAN)
FPTTINFTV

SEQ ID NO: 47295 - protein, 10 aa, Artificial Sequence
  Description of Artificial Sequence: Synthetic peptide
  Seed: EIFGKASESL (MAGA1_HUMAN)
EAFGKASESV

SEQ ID NO: 47296 - protein, 10 aa, Artificial Sequence
  Description of Artificial Sequence: Synthetic peptide
  Seed: WEELSVMEVY (MAGA1_HUMAN)
WDELSVMEVY

SEQ ID NO: 47297 - protein, 9 aa, Artificial Sequence
  Description of Artificial Sequence: Synthetic peptide
  Seed: KASESLQLV (MAGA1_HUMAN)
KQSESLQLK

SEQ ID NO: 47298 - protein, 8 aa, Artificial Sequence
  Description of Artificial Sequence: Synthetic peptide
  Seed: FLWGPRAL (MAGA1_HUMAN)
FAWGPRAM

SEQ ID NO: 47299 - protein, 9 aa, Artificial Sequence
  Description of Artificial Sequence: Synthetic peptide
  Seed: RVRFFFPSL (MAGA1_HUMAN)
RMRFFFPSN

SEQ ID NO: 47300 - protein, 9 aa, Artificial Sequence
  Description of Artificial Sequence: Synthetic peptide
  Seed: RAREPVTKA (MAGA1_HUMAN)
RPREPVTKV

SEQ ID NO: 47301 - protein, 10 aa, Artificial Sequence
  Description of Artificial Sequence: Synthetic peptide
  Seed: ARVRFFFPSL (MAGA1_HUMAN)
AKVRFFFPSA

SEQ ID NO: 47302 - protein, 10 aa, Artificial Sequence
  Description of Artificial Sequence: Synthetic peptide
  Seed: EALEAQQEAL (MAGA1_HUMAN)
ETLEAQQEAV

SEQ ID NO: 47303 - protein, 9 aa, Artificial Sequence
  Description of Artificial Sequence: Synthetic peptide
  Seed: SAFPTTINF (MAGA1_HUMAN)
SFFPTTINY

SEQ ID NO: 47304 - protein, 9 aa, Artificial Sequence
  Description of Artificial Sequence: Synthetic peptide
  Seed: RQRQPSEGS (MAGA1_HUMAN)
RIRQPSEGI

SEQ ID NO: 47305 - protein, 11 aa, Artificial Sequence
  Description of Artificial Sequence: Synthetic peptide
  Seed: SAFPTTINFTR (MAGA1_HUMAN)
SAFPTTINFTK

SEQ ID NO: 47306 - protein, 10 aa, Artificial Sequence
  Description of Artificial Sequence: Synthetic peptide
  Seed: TSYVKVLEYV (MAGA1_HUMAN)
TWYVKVLEYF

SEQ ID NO: 47307 - protein, 10 aa, Artificial Sequence
  Description of Artificial Sequence: Synthetic peptide
  Seed: KEADPTGHSY (MAGA1_HUMAN)
KAADPTGHSI

SEQ ID NO: 47308 - protein, 8 aa, Artificial Sequence
  Description of Artificial Sequence: Synthetic peptide
  Seed: RVRFFFPS (MAGA1_HUMAN)
RARFFFPK

SEQ ID NO: 47309 - protein, 11 aa, Artificial Sequence
  Description of Artificial Sequence: Synthetic peptide
  Seed: RQVPDSDPARY (MAGA1_HUMAN)
RSVPDSDPARL

SEQ ID NO: 47310 - protein, 9 aa, Artificial Sequence
  Description of Artificial Sequence: Synthetic peptide
  Seed: KKVADLVGF (MAGA1_HUMAN)
KQVADLVGF

SEQ ID NO: 47311 - protein, 10 aa, Artificial Sequence
  Description of Artificial Sequence: Synthetic peptide
  Seed: ADPTGHSYVL (MAGA1_HUMAN)
APPTGHSYVM

SEQ ID NO: 47312 - protein, 10 aa, Artificial Sequence
  Description of Artificial Sequence: Synthetic peptide
  Seed: KASESLQLVF (MAGA1_HUMAN)
KSSESLQLVL

SEQ ID NO: 47313 - protein, 11 aa, Artificial Sequence
  Description of Artificial Sequence: Synthetic peptide
  Seed: STDPPQSPQGA (MAGA1_HUMAN)
STDPPQSPQGV

SEQ ID NO: 47314 - protein, 9 aa, Artificial Sequence
  Description of Artificial Sequence: Synthetic peptide
  Seed: VYDGREHSA (MAGA1_HUMAN)
VQDGREHSL

SEQ ID NO: 47315 - protein, 11 aa, Artificial Sequence
  Description of Artificial Sequence: Synthetic peptide
  Seed: ARVRFFFPSLR (MAGA1_HUMAN)
ANVRFFFPSLL

SEQ ID NO: 47316 - protein, 9 aa, Artificial Sequence
  Description of Artificial Sequence: Synthetic peptide
  Seed: RALAETSYV (MAGA1_HUMAN)
RQLAETSYW

SEQ ID NO: 47317 - protein, 10 aa, Artificial Sequence
  Description of Artificial Sequence: Synthetic peptide
  Seed: SCILESLFRA (MAGA1_HUMAN)
SFILESLFRI

SEQ ID NO: 47318 - protein, 10 aa, Artificial Sequence
  Description of Artificial Sequence: Synthetic peptide
  Seed: SPQGASAFPT (MAGA1_HUMAN)
SPQGASAFPI

SEQ ID NO: 47319 - protein, 9 aa, Artificial Sequence
  Description of Artificial Sequence: Synthetic peptide
  Seed: RAREPVTKA (MAGA1_HUMAN)
RTREPVTKA

SEQ ID NO: 47320 - protein, 11 aa, Artificial Sequence
  Description of Artificial Sequence: Synthetic peptide
  Seed: KVSARVRFFFP (MAGA1_HUMAN)
KPSARVRFFFK

SEQ ID NO: 47321 - protein, 10 aa, Artificial Sequence
  Description of Artificial Sequence: Synthetic peptide
  Seed: SARVRFFFPS (MAGA1_HUMAN)
SWRVRFFFPI

SEQ ID NO: 47322 - protein, 9 aa, Artificial Sequence
  Description of Artificial Sequence: Synthetic peptide
  Seed: GASAFPTTI (MAGA1_HUMAN)
GSSAFPTTL

SEQ ID NO: 47323 - protein, 9 aa, Artificial Sequence
  Description of Artificial Sequence: Synthetic peptide
  Seed: RQRQPSEGS (MAGA1_HUMAN)
RIRQPSEGK

SEQ ID NO: 47324 - protein, 8 aa, Artificial Sequence
  Description of Artificial Sequence: Synthetic peptide
  Seed: YEFLWGPR (MAGA1_HUMAN)
YEFLWGPF

SEQ ID NO: 47325 - protein, 9 aa, Artificial Sequence
  Description of Artificial Sequence: Synthetic peptide
  Seed: SSSPLVLGT (MAGA1_HUMAN)
SGSPLVLGL

SEQ ID NO: 47326 - protein, 10 aa, Artificial Sequence
  Description of Artificial Sequence: Synthetic peptide
  Seed: KVSARVRFFF (MAGA1_HUMAN)
KVSARVRFFW

SEQ ID NO: 47327 - protein, 9 aa, Artificial Sequence
  Description of Artificial Sequence: Synthetic peptide
  Seed: RQVPDSDPA (MAGA1_HUMAN)
RQVPDSDPV

SEQ ID NO: 47328 - protein, 9 aa, Artificial Sequence
  Description of Artificial Sequence: Synthetic peptide
  Seed: KEADPTGHS (MAGA1_HUMAN)
KEADPTGHI

SEQ ID NO: 47329 - protein, 9 aa, Artificial Sequence
  Description of Artificial Sequence: Synthetic peptide
  Seed: SAYGEPRKL (MAGA1_HUMAN)
SLYGEPRKR

SEQ ID NO: 47330 - protein, 11 aa, Artificial Sequence
  Description of Artificial Sequence: Synthetic peptide
  Seed: RVRFFFPSLRE (MAGA1_HUMAN)
RYRFFFPSLRR

SEQ ID NO: 47331 - protein, 8 aa, Artificial Sequence
  Description of Artificial Sequence: Synthetic peptide
  Seed: FLWGPRAL (MAGA1_HUMAN)
FSWGPRAL

SEQ ID NO: 47332 - protein, 9 aa, Artificial Sequence
  Description of Artificial Sequence: Synthetic peptide
  Seed: FLWGPRALA (MAGA1_HUMAN)
FTWGPRALK

SEQ ID NO: 47333 - protein, 10 aa, Artificial Sequence
  Description of Artificial Sequence: Synthetic peptide
  Seed: KVSARVRFFF (MAGA1_HUMAN)
KTSARVRFFY

SEQ ID NO: 47334 - protein, 9 aa, Artificial Sequence
  Description of Artificial Sequence: Synthetic peptide
  Seed: NYKHCFPEI (MAGA1_HUMAN)
NYKHCFPEY

SEQ ID NO: 47335 - protein, 10 aa, Artificial Sequence
  Description of Artificial Sequence: Synthetic peptide
  Seed: GPRALAETSY (MAGA1_HUMAN)
GLRALAETSY

SEQ ID NO: 47336 - protein, 9 aa, Artificial Sequence
  Description of Artificial Sequence: Synthetic peptide
  Seed: VYDGREHSA (MAGA1_HUMAN)
VCDGREHSM

SEQ ID NO: 47337 - protein, 9 aa, Artificial Sequence
  Description of Artificial Sequence: Synthetic peptide
  Seed: FPSLREAAL (MAGA1_HUMAN)
FTSLREAAL

SEQ ID NO: 47338 - protein, 10 aa, Artificial Sequence
  Description of Artificial Sequence: Synthetic peptide
  Seed: KVADLVGFLL (MAGA1_HUMAN)
KTADLVGFLI

SEQ ID NO: 47339 - protein, 9 aa, Artificial Sequence
  Description of Artificial Sequence: Synthetic peptide
  Seed: EELSVMEVY (MAGA1_HUMAN)
EELSVMEVP

SEQ ID NO: 47340 - protein, 9 aa, Artificial Sequence
  Description of Artificial Sequence: Synthetic peptide
  Seed: EIWEELSVM (MAGA1_HUMAN)
EPWEELSVY

SEQ ID NO: 47341 - protein, 9 aa, Artificial Sequence
  Description of Artificial Sequence: Synthetic peptide
  Seed: FFFPSLREA (MAGA1_HUMAN)
FLFPSLREA

SEQ ID NO: 47342 - protein, 9 aa, Artificial Sequence
  Description of Artificial Sequence: Synthetic peptide
  Seed: VQAATSSSS (MAGA1_HUMAN)
VMAATSSSI

SEQ ID NO: 47343 - protein, 11 aa, Artificial Sequence
  Description of Artificial Sequence: Synthetic peptide
  Seed: SAFPTTINFTR (MAGA1_HUMAN)
SIFPTTINFTR

SEQ ID NO: 47344 - protein, 9 aa, Artificial Sequence
  Description of Artificial Sequence: Synthetic peptide
  Seed: MSLEQRSLH (MAGA1_HUMAN)
MWLEQRSLY

SEQ ID NO: 47345 - protein, 9 aa, Artificial Sequence
  Description of Artificial Sequence: Synthetic peptide
  Seed: VADLVGFLL (MAGA1_HUMAN)
VFDLVGFLL

SEQ ID NO: 47346 - protein, 10 aa, Artificial Sequence
  Description of Artificial Sequence: Synthetic peptide
  Seed: EIFGKASESL (MAGA1_HUMAN)
EIFGKASESY

SEQ ID NO: 47347 - protein, 9 aa, Artificial Sequence
  Description of Artificial Sequence: Synthetic peptide
  Seed: TSSSSPLVL (MAGA1_HUMAN)
TLSSSPLVM

SEQ ID NO: 47348 - protein, 9 aa, Artificial Sequence
  Description of Artificial Sequence: Synthetic peptide
  Seed: RVRFFFPSL (MAGA1_HUMAN)
RIRFFFPSP

SEQ ID NO: 47349 - protein, 9 aa, Artificial Sequence
  Description of Artificial Sequence: Synthetic peptide
  Seed: LTQDLVQEK (MAGA1_HUMAN)
LTQDLVQEI

SEQ ID NO: 47350 - protein, 9 aa, Artificial Sequence
  Description of Artificial Sequence: Synthetic peptide
  Seed: SLFRAVITK (MAGA1_HUMAN)
SMFRAVITR

SEQ ID NO: 47351 - protein, 10 aa, Artificial Sequence
  Description of Artificial Sequence: Synthetic peptide
  Seed: KVSARVRFFF (MAGA1_HUMAN)
KSSARVRFFY

SEQ ID NO: 47352 - protein, 9 aa, Artificial Sequence
  Description of Artificial Sequence: Synthetic peptide
  Seed: ATSSSSPLV (MAGA1_HUMAN)
ASSSSSPLI

SEQ ID NO: 47353 - protein, 9 aa, Artificial Sequence
  Description of Artificial Sequence: Synthetic peptide
  Seed: TQDLVQEKY (MAGA1_HUMAN)
TMDLVQEKL

SEQ ID NO: 47354 - protein, 9 aa, Artificial Sequence
  Description of Artificial Sequence: Synthetic peptide
  Seed: ALEAQQEAL (MAGA1_HUMAN)
AYEAQQEAM

SEQ ID NO: 47355 - protein, 10 aa, Artificial Sequence
  Description of Artificial Sequence: Synthetic peptide
  Seed: TTINFTRQRQ (MAGA1_HUMAN)
TAINFTRQRR

SEQ ID NO: 47356 - protein, 9 aa, Artificial Sequence
  Description of Artificial Sequence: Synthetic peptide
  Seed: IFGKASESL (MAGA1_HUMAN)
IYGKASESW

SEQ ID NO: 47357 - protein, 9 aa, Artificial Sequence
  Description of Artificial Sequence: Synthetic peptide
  Seed: LESLFRAVI (MAGA1_HUMAN)
LESLFRAVW

SEQ ID NO: 47358 - protein, 9 aa, Artificial Sequence
  Description of Artificial Sequence: Synthetic peptide
  Seed: FLWGPRALA (MAGA1_HUMAN)
FIWGPRALK

SEQ ID NO: 47359 - protein, 10 aa, Artificial Sequence
  Description of Artificial Sequence: Synthetic peptide
  Seed: ARVRFFFPSL (MAGA1_HUMAN)
AQVRFFFPSA

SEQ ID NO: 47360 - protein, 9 aa, Artificial Sequence
  Description of Artificial Sequence: Synthetic peptide
  Seed: AETSYVKVL (MAGA1_HUMAN)
AQTSYVKVL

SEQ ID NO: 47361 - protein, 10 aa, Artificial Sequence
  Description of Artificial Sequence: Synthetic peptide
  Seed: EFLWGPRALA (MAGA1_HUMAN)
EFLWGPRALI

SEQ ID NO: 47362 - protein, 9 aa, Artificial Sequence
  Description of Artificial Sequence: Synthetic peptide
  Seed: FFFPSLREA (MAGA1_HUMAN)
FTFPSLREI

SEQ ID NO: 47363 - protein, 10 aa, Artificial Sequence
  Description of Artificial Sequence: Synthetic peptide
  Seed: KEADPTGHSY (MAGA1_HUMAN)
KLADPTGHSW

SEQ ID NO: 47364 - protein, 9 aa, Artificial Sequence
  Description of Artificial Sequence: Synthetic peptide
  Seed: SAYGEPRKL (MAGA1_HUMAN)
SLYGEPRKW

SEQ ID NO: 47365 - protein, 9 aa, Artificial Sequence
  Description of Artificial Sequence: Synthetic peptide
  Seed: VADLVGFLL (MAGA1_HUMAN)
VADLVGFLW

SEQ ID NO: 47366 - protein, 10 aa, Artificial Sequence
  Description of Artificial Sequence: Synthetic peptide
  Seed: VKVLEYVIKV (MAGA1_HUMAN)
VVVLEYVIKV

SEQ ID NO: 47367 - protein, 11 aa, Artificial Sequence
  Description of Artificial Sequence: Synthetic peptide
  Seed: RVRFFFPSLRE (MAGA1_HUMAN)
RIRFFFPSLRR

SEQ ID NO: 47368 - protein, 8 aa, Artificial Sequence
  Description of Artificial Sequence: Synthetic peptide
  Seed: VRFFFPSL (MAGA1_HUMAN)
VQFFFPSV

SEQ ID NO: 47369 - protein, 10 aa, Artificial Sequence
  Description of Artificial Sequence: Synthetic peptide
  Seed: KASESLQLVF (MAGA1_HUMAN)
KMSESLQLVY

SEQ ID NO: 47370 - protein, 10 aa, Artificial Sequence
  Description of Artificial Sequence: Synthetic peptide
  Seed: EIFGKASESL (MAGA1_HUMAN)
ESFGKASESF

SEQ ID NO: 47371 - protein, 10 aa, Artificial Sequence
  Description of Artificial Sequence: Synthetic peptide
  Seed: KEADPTGHSY (MAGA1_HUMAN)
KFADPTGHSY

SEQ ID NO: 47372 - protein, 9 aa, Artificial Sequence
  Description of Artificial Sequence: Synthetic peptide
  Seed: NQIMPKTGF (MAGA1_HUMAN)
NEIMPKTGL

SEQ ID NO: 47373 - protein, 9 aa, Artificial Sequence
  Description of Artificial Sequence: Synthetic peptide
  Seed: FPSLREAAL (MAGA1_HUMAN)
FPSLREAAP

SEQ ID NO: 47374 - protein, 9 aa, Artificial Sequence
  Description of Artificial Sequence: Synthetic peptide
  Seed: LVQEKYLEY (MAGA1_HUMAN)
LSQEKYLEL

SEQ ID NO: 47375 - protein, 9 aa, Artificial Sequence
  Description of Artificial Sequence: Synthetic peptide
  Seed: AEMLESVIK (MAGA1_HUMAN)
AEMLESVIL

SEQ ID NO: 47376 - protein, 10 aa, Artificial Sequence
  Description of Artificial Sequence: Synthetic peptide
  Seed: VYDGREHSAY (MAGA1_HUMAN)
VADGREHSAY

SEQ ID NO: 47377 - protein, 9 aa, Artificial Sequence
  Description of Artificial Sequence: Synthetic peptide
  Seed: TSYVKVLEY (MAGA1_HUMAN)
TTYVKVLEK

SEQ ID NO: 47378 - protein, 9 aa, Artificial Sequence
  Description of Artificial Sequence: Synthetic peptide
  Seed: AETSYVKVL (MAGA1_HUMAN)
AKTSYVKVY

SEQ ID NO: 47379 - protein, 9 aa, Artificial Sequence
  Description of Artificial Sequence: Synthetic peptide
  Seed: LTQDLVQEK (MAGA1_HUMAN)
LVQDLVQEY

SEQ ID NO: 47380 - protein, 10 aa, Artificial Sequence
  Description of Artificial Sequence: Synthetic peptide
  Seed: RVRFFFPSLR (MAGA1_HUMAN)
RVRFFFPSLE

SEQ ID NO: 47381 - protein, 9 aa, Artificial Sequence
  Description of Artificial Sequence: Synthetic peptide
  Seed: RALAETSYV (MAGA1_HUMAN)
RMLAETSYF

SEQ ID NO: 47382 - protein, 9 aa, Artificial Sequence
  Description of Artificial Sequence: Synthetic peptide
  Seed: ESVIKNYKH (MAGA1_HUMAN)
EMVIKNYKK

SEQ ID NO: 47383 - protein, 10 aa, Artificial Sequence
  Description of Artificial Sequence: Synthetic peptide
  Seed: EYVIKVSARV (MAGA1_HUMAN)
EMVIKVSARV

SEQ ID NO: 47384 - protein, 10 aa, Artificial Sequence
  Description of Artificial Sequence: Synthetic peptide
  Seed: EMLESVIKNY (MAGA1_HUMAN)
EVLESVIKNR

SEQ ID NO: 47385 - protein, 10 aa, Artificial Sequence
  Description of Artificial Sequence: Synthetic peptide
  Seed: TTINFTRQRQ (MAGA1_HUMAN)
TTINFTRQRR

SEQ ID NO: 47386 - protein, 11 aa, Artificial Sequence
  Description of Artificial Sequence: Synthetic peptide
  Seed: STDPPQSPQGA (MAGA1_HUMAN)
SSDPPQSPQGL

SEQ ID NO: 47387 - protein, 9 aa, Artificial Sequence
  Description of Artificial Sequence: Synthetic peptide
  Seed: RVRFFFPSL (MAGA1_HUMAN)
RVRFFFPSY

SEQ ID NO: 47388 - protein, 10 aa, Artificial Sequence
  Description of Artificial Sequence: Synthetic peptide
  Seed: KVADLVGFLL (MAGA1_HUMAN)
KLADLVGFLS

SEQ ID NO: 47389 - protein, 9 aa, Artificial Sequence
  Description of Artificial Sequence: Synthetic peptide
  Seed: SAFPTTINF (MAGA1_HUMAN)
SMFPTTINI

SEQ ID NO: 47390 - protein, 9 aa, Artificial Sequence
  Description of Artificial Sequence: Synthetic peptide
  Seed: IMPKTGFLI (MAGA1_HUMAN)
ILPKTGFLF

SEQ ID NO: 47391 - protein, 9 aa, Artificial Sequence
  Description of Artificial Sequence: Synthetic peptide
  Seed: TTINFTRQR (MAGA1_HUMAN)
TAINFTRQL

SEQ ID NO: 47392 - protein, 9 aa, Artificial Sequence
  Description of Artificial Sequence: Synthetic peptide
  Seed: KTGFLIIVL (MAGA1_HUMAN)
KMGFLIIVI

SEQ ID NO: 47393 - protein, 9 aa, Artificial Sequence
  Description of Artificial Sequence: Synthetic peptide
  Seed: YRAREPVTK (MAGA1_HUMAN)
YFAREPVTM

SEQ ID NO: 47394 - protein, 9 aa, Artificial Sequence
  Description of Artificial Sequence: Synthetic peptide
  Seed: SAYGEPRKL (MAGA1_HUMAN)
SRYGEPRKM

SEQ ID NO: 47395 - protein, 10 aa, Artificial Sequence
  Description of Artificial Sequence: Synthetic peptide
  Seed: RVRFFFPSLR (MAGA1_HUMAN)
RRRFFFPSLG

SEQ ID NO: 47396 - protein, 11 aa, Artificial Sequence
  Description of Artificial Sequence: Synthetic peptide
  Seed: STDPPQSPQGA (MAGA1_HUMAN)
SIDPPQSPQGL

SEQ ID NO: 47397 - protein, 10 aa, Artificial Sequence
  Description of Artificial Sequence: Synthetic peptide
  Seed: SARVRFFFPS (MAGA1_HUMAN)
SIRVRFFFPV

SEQ ID NO: 47398 - protein, 9 aa, Artificial Sequence
  Description of Artificial Sequence: Synthetic peptide
  Seed: LTQDLVQEK (MAGA1_HUMAN)
LSQDLVQEY

SEQ ID NO: 47399 - protein, 9 aa, Artificial Sequence
  Description of Artificial Sequence: Synthetic peptide
  Seed: YVIKVSARV (MAGA1_HUMAN)
YMIKVSARR

SEQ ID NO: 47400 - protein, 9 aa, Artificial Sequence
  Description of Artificial Sequence: Synthetic peptide
  Seed: SAFPTTINF (MAGA1_HUMAN)
SGFPTTINW

SEQ ID NO: 47401 - protein, 9 aa, Artificial Sequence
  Description of Artificial Sequence: Synthetic peptide
  Seed: QIMPKTGFL (MAGA1_HUMAN)
QQMPKTGFY

SEQ ID NO: 47402 - protein, 9 aa, Artificial Sequence
  Description of Artificial Sequence: Synthetic peptide
  Seed: SSPLVLGTL (MAGA1_HUMAN)
STPLVLGTL

SEQ ID NO: 47403 - protein, 10 aa, Artificial Sequence
  Description of Artificial Sequence: Synthetic peptide
  Seed: VKVLEYVIKV (MAGA1_HUMAN)
VFVLEYVIKV

SEQ ID NO: 47404 - protein, 9 aa, Artificial Sequence
  Description of Artificial Sequence: Synthetic peptide
  Seed: GTLEEVPTA (MAGA1_HUMAN)
GTLEEVPTL

SEQ ID NO: 47405 - protein, 10 aa, Artificial Sequence
  Description of Artificial Sequence: Synthetic peptide
  Seed: SDPARYEFLW (MAGA1_HUMAN)
SSPARYEFLF

SEQ ID NO: 47406 - protein, 10 aa, Artificial Sequence
  Description of Artificial Sequence: Synthetic peptide
  Seed: KVADLVGFLL (MAGA1_HUMAN)
KGADLVGFLY

SEQ ID NO: 47407 - protein, 11 aa, Artificial Sequence
  Description of Artificial Sequence: Synthetic peptide
  Seed: KNYKHCFPEIF (MAGA1_HUMAN)
KMYKHCFPEIF

SEQ ID NO: 47408 - protein, 9 aa, Artificial Sequence
  Description of Artificial Sequence: Synthetic peptide
  Seed: ITKKVADLV (MAGA1_HUMAN)
IGKKVADLW

SEQ ID NO: 47409 - protein, 9 aa, Artificial Sequence
  Description of Artificial Sequence: Synthetic peptide
  Seed: LEYVIKVSA (MAGA1_HUMAN)
LEYVIKVSP

SEQ ID NO: 47410 - protein, 9 aa, Artificial Sequence
  Description of Artificial Sequence: Synthetic peptide
  Seed: KVADLVGFL (MAGA1_HUMAN)
KRADLVGFL

SEQ ID NO: 47411 - protein, 11 aa, Artificial Sequence
  Description of Artificial Sequence: Synthetic peptide
  Seed: STDPPQSPQGA (MAGA1_HUMAN)
SLDPPQSPQGF

SEQ ID NO: 47412 - protein, 9 aa, Artificial Sequence
  Description of Artificial Sequence: Synthetic peptide
  Seed: TSYVKVLEY (MAGA1_HUMAN)
TIYVKVLER

SEQ ID NO: 47413 - protein, 9 aa, Artificial Sequence
  Description of Artificial Sequence: Synthetic peptide
  Seed: HSAYGEPRK (MAGA1_HUMAN)
HTAYGEPRR

SEQ ID NO: 47414 - protein, 10 aa, Artificial Sequence
  Description of Artificial Sequence: Synthetic peptide
  Seed: KYRAREPVTK (MAGA1_HUMAN)
KSRAREPVTM

SEQ ID NO: 47415 - protein, 9 aa, Artificial Sequence
  Description of Artificial Sequence: Synthetic peptide
  Seed: HSYVLVTCL (MAGA1_HUMAN)
HQYVLVTCM

SEQ ID NO: 47416 - protein, 10 aa, Artificial Sequence
  Description of Artificial Sequence: Synthetic peptide
  Seed: YEFLWGPRAL (MAGA1_HUMAN)
YSFLWGPRAL

SEQ ID NO: 47417 - protein, 10 aa, Artificial Sequence
  Description of Artificial Sequence: Synthetic peptide
  Seed: SYVKVLEYVI (MAGA1_HUMAN)
SFVKVLEYVF

SEQ ID NO: 47418 - protein, 9 aa, Artificial Sequence
  Description of Artificial Sequence: Synthetic peptide
  Seed: RVRFFFPSL (MAGA1_HUMAN)
RNRFFFPSI

SEQ ID NO: 47419 - protein, 9 aa, Artificial Sequence
  Description of Artificial Sequence: Synthetic peptide
  Seed: EEVPTAGST (MAGA1_HUMAN)
EEVPTAGSY

SEQ ID NO: 47420 - protein, 10 aa, Artificial Sequence
  Description of Artificial Sequence: Synthetic peptide
  Seed: ADPTGHSYVL (MAGA1_HUMAN)
ARPTGHSYVM

SEQ ID NO: 47421 - protein, 9 aa, Artificial Sequence
  Description of Artificial Sequence: Synthetic peptide
  Seed: EEIWEELSV (MAGA1_HUMAN)
EEIWEELSL

SEQ ID NO: 47422 - protein, 9 aa, Artificial Sequence
  Description of Artificial Sequence: Synthetic peptide
  Seed: ETSYVKVLE (MAGA1_HUMAN)
EISYVKVLR

SEQ ID NO: 47423 - protein, 9 aa, Artificial Sequence
  Description of Artificial Sequence: Synthetic peptide
  Seed: FFFPSLREA (MAGA1_HUMAN)
FHFPSLREY

SEQ ID NO: 47424 - protein, 9 aa, Artificial Sequence
  Description of Artificial Sequence: Synthetic peptide
  Seed: SLFRAVITK (MAGA1_HUMAN)
STFRAVITH

SEQ ID NO: 47425 - protein, 9 aa, Artificial Sequence
  Description of Artificial Sequence: Synthetic peptide
  Seed: FLWGPRALA (MAGA1_HUMAN)
FVWGPRALA

SEQ ID NO: 47426 - protein, 9 aa, Artificial Sequence
  Description of Artificial Sequence: Synthetic peptide
  Seed: LQLVFGIDV (MAGA1_HUMAN)
LMLVFGIDV

SEQ ID NO: 47427 - protein, 9 aa, Artificial Sequence
  Description of Artificial Sequence: Synthetic peptide
  Seed: LVTCLGLSY (MAGA1_HUMAN)
LQTCLGLSI

SEQ ID NO: 47428 - protein, 10 aa, Artificial Sequence
  Description of Artificial Sequence: Synthetic peptide
  Seed: KKVADLVGFL (MAGA1_HUMAN)
KTVADLVGFV

SEQ ID NO: 47429 - protein, 9 aa, Artificial Sequence
  Description of Artificial Sequence: Synthetic peptide
  Seed: GASAFPTTI (MAGA1_HUMAN)
GVSAFPTTA

SEQ ID NO: 47430 - protein, 9 aa, Artificial Sequence
  Description of Artificial Sequence: Synthetic peptide
  Seed: SSPLVLGTL (MAGA1_HUMAN)
SMPLVLGTL

SEQ ID NO: 47431 - protein, 10 aa, Artificial Sequence
  Description of Artificial Sequence: Synthetic peptide
  Seed: RVRFFFPSLR (MAGA1_HUMAN)
RIRFFFPSLA

SEQ ID NO: 47432 - protein, 10 aa, Artificial Sequence
  Description of Artificial Sequence: Synthetic peptide
  Seed: YEFLWGPRAL (MAGA1_HUMAN)
YQFLWGPRAY

SEQ ID NO: 47433 - protein, 9 aa, Artificial Sequence
  Description of Artificial Sequence: Synthetic peptide
  Seed: FLWGPRALA (MAGA1_HUMAN)
FQWGPRALV

SEQ ID NO: 47434 - protein, 9 aa, Artificial Sequence
  Description of Artificial Sequence: Synthetic peptide
  Seed: TTINFTRQR (MAGA1_HUMAN)
TAINFTRQY

SEQ ID NO: 47435 - protein, 9 aa, Artificial Sequence
  Description of Artificial Sequence: Synthetic peptide
  Seed: LFRAVITKK (MAGA1_HUMAN)
LQRAVITKK

SEQ ID NO: 47436 - protein, 9 aa, Artificial Sequence
  Description of Artificial Sequence: Synthetic peptide
  Seed: KVSARVRFF (MAGA1_HUMAN)
KASARVRFM

SEQ ID NO: 47437 - protein, 9 aa, Artificial Sequence
  Description of Artificial Sequence: Synthetic peptide
  Seed: RVRFFFPSL (MAGA1_HUMAN)
RARFFFPSP

SEQ ID NO: 47438 - protein, 10 aa, Artificial Sequence
  Description of Artificial Sequence: Synthetic peptide
  Seed: SSSPLVLGTL (MAGA1_HUMAN)
STSPLVLGTY

SEQ ID NO: 47439 - protein, 10 aa, Artificial Sequence
  Description of Artificial Sequence: Synthetic peptide
  Seed: VMIAMEGGHA (MAGA1_HUMAN)
VMIAMEGGHV

SEQ ID NO: 47440 - protein, 9 aa, Artificial Sequence
  Description of Artificial Sequence: Synthetic peptide
  Seed: SAYGEPRKL (MAGA1_HUMAN)
SMYGEPRKW

SEQ ID NO: 47441 - protein, 10 aa, Artificial Sequence
  Description of Artificial Sequence: Synthetic peptide
  Seed: KNYKHCFPEI (MAGA1_HUMAN)
KTYKHCFPEK

SEQ ID NO: 47442 - protein, 9 aa, Artificial Sequence
  Description of Artificial Sequence: Synthetic peptide
  Seed: IAMEGGHAP (MAGA1_HUMAN)
ISMEGGHAL

SEQ ID NO: 47443 - protein, 9 aa, Artificial Sequence
  Description of Artificial Sequence: Synthetic peptide
  Seed: IAMEGGHAP (MAGA1_HUMAN)
ITMEGGHAY

SEQ ID NO: 47444 - protein, 9 aa, Artificial Sequence
  Description of Artificial Sequence: Synthetic peptide
  Seed: EEVPTAGST (MAGA1_HUMAN)
EEVPTAGSV

SEQ ID NO: 47445 - protein, 10 aa, Artificial Sequence
  Description of Artificial Sequence: Synthetic peptide
  Seed: ARYEFLWGPR (MAGA1_HUMAN)
ATYEFLWGPR

SEQ ID NO: 47446 - protein, 9 aa, Artificial Sequence
  Description of Artificial Sequence: Synthetic peptide
  Seed: IAMEGGHAP (MAGA1_HUMAN)
IAMEGGHAF

SEQ ID NO: 47447 - protein, 10 aa, Artificial Sequence
  Description of Artificial Sequence: Synthetic peptide
  Seed: QVPDSDPARY (MAGA1_HUMAN)
QVPDSDPARW

SEQ ID NO: 47448 - protein, 10 aa, Artificial Sequence
  Description of Artificial Sequence: Synthetic peptide
  Seed: RVRFFFPSLR (MAGA1_HUMAN)
RTRFFFPSLM

SEQ ID NO: 47449 - protein, 9 aa, Artificial Sequence
  Description of Artificial Sequence: Synthetic peptide
  Seed: LESLFRAVI (MAGA1_HUMAN)
LQSLFRAVW

SEQ ID NO: 47450 - protein, 10 aa, Artificial Sequence
  Description of Artificial Sequence: Synthetic peptide
  Seed: REEEGPSTSC (MAGA1_HUMAN)
REEEGPSTSA

SEQ ID NO: 47451 - protein, 9 aa, Artificial Sequence
  Description of Artificial Sequence: Synthetic peptide
  Seed: AETSYVKVL (MAGA1_HUMAN)
AETSYVKVT

SEQ ID NO: 47452 - protein, 9 aa, Artificial Sequence
  Description of Artificial Sequence: Synthetic peptide
  Seed: IAMEGGHAP (MAGA1_HUMAN)
IPMEGGHAP

SEQ ID NO: 47453 - protein, 10 aa, Artificial Sequence
  Description of Artificial Sequence: Synthetic peptide
  Seed: KYRAREPVTK (MAGA1_HUMAN)
KVRAREPVTA

SEQ ID NO: 47454 - protein, 9 aa, Artificial Sequence
  Description of Artificial Sequence: Synthetic peptide
  Seed: TTINFTRQR (MAGA1_HUMAN)
TAINFTRQK

SEQ ID NO: 47455 - protein, 9 aa, Artificial Sequence
  Description of Artificial Sequence: Synthetic peptide
  Seed: YDGREHSAY (MAGA1_HUMAN)
YAGREHSAF

SEQ ID NO: 47456 - protein, 10 aa, Artificial Sequence
  Description of Artificial Sequence: Synthetic peptide
  Seed: ASAFPTTINF (MAGA1_HUMAN)
AYAFPTTINY

SEQ ID NO: 47457 - protein, 9 aa, Artificial Sequence
  Description of Artificial Sequence: Synthetic peptide
  Seed: FFFPSLREA (MAGA1_HUMAN)
FIFPSLREI

SEQ ID NO: 47458 - protein, 10 aa, Artificial Sequence
  Description of Artificial Sequence: Synthetic peptide
  Seed: SARVRFFFPS (MAGA1_HUMAN)
SLRVRFFFPY

SEQ ID NO: 47459 - protein, 9 aa, Artificial Sequence
  Description of Artificial Sequence: Synthetic peptide
  Seed: STSCILESL (MAGA1_HUMAN)
STSCILESV

SEQ ID NO: 47460 - protein, 11 aa, Artificial Sequence
  Description of Artificial Sequence: Synthetic peptide
  Seed: YEFLWGPRALA (MAGA1_HUMAN)
YFFLWGPRALI

SEQ ID NO: 47461 - protein, 9 aa, Artificial Sequence
  Description of Artificial Sequence: Synthetic peptide
  Seed: FLLLKYRAR (MAGA1_HUMAN)
FVLLKYRAR

SEQ ID NO: 47462 - protein, 10 aa, Artificial Sequence
  Description of Artificial Sequence: Synthetic peptide
  Seed: RFFFPSLREA (MAGA1_HUMAN)
RFFFPSLREK

SEQ ID NO: 47463 - protein, 10 aa, Artificial Sequence
  Description of Artificial Sequence: Synthetic peptide
  Seed: KKVADLVGFL (MAGA1_HUMAN)
KIVADLVGFL

SEQ ID NO: 47464 - protein, 9 aa, Artificial Sequence
  Description of Artificial Sequence: Synthetic peptide
  Seed: RVRFFFPSL (MAGA1_HUMAN)
RQRFFFPSM

SEQ ID NO: 47465 - protein, 9 aa, Artificial Sequence
  Description of Artificial Sequence: Synthetic peptide
  Seed: HSYVLVTCL (MAGA1_HUMAN)
HRYVLVTCM

SEQ ID NO: 47466 - protein, 9 aa, Artificial Sequence
  Description of Artificial Sequence: Synthetic peptide
  Seed: REAALREEE (MAGA1_HUMAN)
RDAALREEL

SEQ ID NO: 47467 - protein, 9 aa, Artificial Sequence
  Description of Artificial Sequence: Synthetic peptide
  Seed: KTGFLIIVL (MAGA1_HUMAN)
KAGFLIIVW

SEQ ID NO: 47468 - protein, 11 aa, Artificial Sequence
  Description of Artificial Sequence: Synthetic peptide
  Seed: RVRFFFPSLRE (MAGA1_HUMAN)
RVRFFFPSLRR

SEQ ID NO: 47469 - protein, 9 aa, Artificial Sequence
  Description of Artificial Sequence: Synthetic peptide
  Seed: VSARVRFFF (MAGA1_HUMAN)
VKARVRFFF

SEQ ID NO: 47470 - protein, 11 aa, Artificial Sequence
  Description of Artificial Sequence: Synthetic peptide
  Seed: REEEGPSTSCI (MAGA1_HUMAN)
REEEGPSTSCV

SEQ ID NO: 47471 - protein, 9 aa, Artificial Sequence
  Description of Artificial Sequence: Synthetic peptide
  Seed: SYVKVLEYV (MAGA1_HUMAN)
STVKVLEYA

SEQ ID NO: 47472 - protein, 9 aa, Artificial Sequence
  Description of Artificial Sequence: Synthetic peptide
  Seed: KVADLVGFL (MAGA1_HUMAN)
KVADLVGFK

SEQ ID NO: 47473 - protein, 8 aa, Artificial Sequence
  Description of Artificial Sequence: Synthetic peptide
  Seed: QEALGLVC (MAGA1_HUMAN)
QEALGLVL

SEQ ID NO: 47474 - protein, 9 aa, Artificial Sequence
  Description of Artificial Sequence: Synthetic peptide
  Seed: SARVRFFFP (MAGA1_HUMAN)
STRVRFFFH

SEQ ID NO: 47475 - protein, 9 aa, Artificial Sequence
  Description of Artificial Sequence: Synthetic peptide
  Seed: VIKNYKHCF (MAGA1_HUMAN)
VFKNYKHCL

SEQ ID NO: 47476 - protein, 10 aa, Artificial Sequence
  Description of Artificial Sequence: Synthetic peptide
  Seed: SSSPLVLGTL (MAGA1_HUMAN)
SSSPLVLGTV

SEQ ID NO: 47477 - protein, 9 aa, Artificial Sequence
  Description of Artificial Sequence: Synthetic peptide
  Seed: RAREPVTKA (MAGA1_HUMAN)
RMREPVTKM

SEQ ID NO: 47478 - protein, 9 aa, Artificial Sequence
  Description of Artificial Sequence: Synthetic peptide
  Seed: GHAPEEEIW (MAGA1_HUMAN)
GHAPEEEIF

SEQ ID NO: 47479 - protein, 10 aa, Artificial Sequence
  Description of Artificial Sequence: Synthetic peptide
  Seed: RVRFFFPSLR (MAGA1_HUMAN)
RTRFFFPSLT

SEQ ID NO: 47480 - protein, 10 aa, Artificial Sequence
  Description of Artificial Sequence: Synthetic peptide
  Seed: LVLGTLEEVP (MAGA1_HUMAN)
LQLGTLEEVV

SEQ ID NO: 47481 - protein, 9 aa, Artificial Sequence
  Description of Artificial Sequence: Synthetic peptide
  Seed: KVSARVRFF (MAGA1_HUMAN)
KASARVRFL

SEQ ID NO: 47482 - protein, 9 aa, Artificial Sequence
  Description of Artificial Sequence: Synthetic peptide
  Seed: RALAETSYV (MAGA1_HUMAN)
RNLAETSYK

SEQ ID NO: 47483 - protein, 9 aa, Artificial Sequence
  Description of Artificial Sequence: Synthetic peptide
  Seed: LESLFRAVI (MAGA1_HUMAN)
LESLFRAVF

SEQ ID NO: 47484 - protein, 9 aa, Artificial Sequence
  Description of Artificial Sequence: Synthetic peptide
  Seed: YDGREHSAY (MAGA1_HUMAN)
YVGREHSAY

SEQ ID NO: 47485 - protein, 9 aa, Artificial Sequence
  Description of Artificial Sequence: Synthetic peptide
  Seed: SVMEVYDGR (MAGA1_HUMAN)
SMMEVYDGK

SEQ ID NO: 47486 - protein, 9 aa, Artificial Sequence
  Description of Artificial Sequence: Synthetic peptide
  Seed: SAFPTTINF (MAGA1_HUMAN)
SWFPTTINF

SEQ ID NO: 47487 - protein, 9 aa, Artificial Sequence
  Description of Artificial Sequence: Synthetic peptide
  Seed: REHSAYGEP (MAGA1_HUMAN)
REHSAYGEL

SEQ ID NO: 47488 - protein, 10 aa, Artificial Sequence
  Description of Artificial Sequence: Synthetic peptide
  Seed: FFPSLREAAL (MAGA1_HUMAN)
FPPSLREAAM

SEQ ID NO: 47489 - protein, 11 aa, Artificial Sequence
  Description of Artificial Sequence: Synthetic peptide
  Seed: STDPPQSPQGA (MAGA1_HUMAN)
SVDPPQSPQGV

SEQ ID NO: 47490 - protein, 9 aa, Artificial Sequence
  Description of Artificial Sequence: Synthetic peptide
  Seed: KVADLVGFL (MAGA1_HUMAN)
KIADLVGFW

SEQ ID NO: 47491 - protein, 9 aa, Artificial Sequence
  Description of Artificial Sequence: Synthetic peptide
  Seed: RALAETSYV (MAGA1_HUMAN)
RFLAETSYK

SEQ ID NO: 47492 - protein, 9 aa, Artificial Sequence
  Description of Artificial Sequence: Synthetic peptide
  Seed: YRAREPVTK (MAGA1_HUMAN)
YYAREPVTY

SEQ ID NO: 47493 - protein, 8 aa, Artificial Sequence
  Description of Artificial Sequence: Synthetic peptide
  Seed: RVRFFFPS (MAGA1_HUMAN)
RSRFFFPI

SEQ ID NO: 47494 - protein, 11 aa, Artificial Sequence
  Description of Artificial Sequence: Synthetic peptide
  Seed: MPKTGFLIIVL (MAGA1_HUMAN)
MPKTGFLIIVM

SEQ ID NO: 47495 - protein, 11 aa, Artificial Sequence
  Description of Artificial Sequence: Synthetic peptide
  Seed: KEADPTGHSYV (MAGA1_HUMAN)
KEADPTGHSYA

SEQ ID NO: 47496 - protein, 9 aa, Artificial Sequence
  Description of Artificial Sequence: Synthetic peptide
  Seed: LEYVIKVSA (MAGA1_HUMAN)
LQYVIKVSI

SEQ ID NO: 47497 - protein, 9 aa, Artificial Sequence
  Description of Artificial Sequence: Synthetic peptide
  Seed: GTLEEVPTA (MAGA1_HUMAN)
GILEEVPTL

SEQ ID NO: 47498 - protein, 9 aa, Artificial Sequence
  Description of Artificial Sequence: Synthetic peptide
  Seed: VYDGREHSA (MAGA1_HUMAN)
VYDGREHSF

SEQ ID NO: 47499 - protein, 11 aa, Artificial Sequence
  Description of Artificial Sequence: Synthetic peptide
  Seed: RVRFFFPSLRE (MAGA1_HUMAN)
RLRFFFPSLRK

SEQ ID NO: 47500 - protein, 9 aa, Artificial Sequence
  Description of Artificial Sequence: Synthetic peptide
  Seed: SSSPLVLGT (MAGA1_HUMAN)
SASPLVLGI

SEQ ID NO: 47501 - protein, 9 aa, Artificial Sequence
  Description of Artificial Sequence: Synthetic peptide
  Seed: SAYGEPRKL (MAGA1_HUMAN)
SQYGEPRKV

SEQ ID NO: 47502 - protein, 9 aa, Artificial Sequence
  Description of Artificial Sequence: Synthetic peptide
  Seed: VSARVRFFF (MAGA1_HUMAN)
VSARVRFFW

SEQ ID NO: 47503 - protein, 9 aa, Artificial Sequence
  Description of Artificial Sequence: Synthetic peptide
  Seed: TSSSSPLVL (MAGA1_HUMAN)
TRSSSPLVM

SEQ ID NO: 47504 - protein, 9 aa, Artificial Sequence
  Description of Artificial Sequence: Synthetic peptide
  Seed: FPTTINFTR (MAGA1_HUMAN)
FSTTINFTK

SEQ ID NO: 47505 - protein, 9 aa, Artificial Sequence
  Description of Artificial Sequence: Synthetic peptide
  Seed: KVADLVGFL (MAGA1_HUMAN)
KMADLVGFI

SEQ ID NO: 47506 - protein, 10 aa, Artificial Sequence
  Description of Artificial Sequence: Synthetic peptide
  Seed: KEADPTGHSY (MAGA1_HUMAN)
KQADPTGHSW

SEQ ID NO: 47507 - protein, 11 aa, Artificial Sequence
  Description of Artificial Sequence: Synthetic peptide
  Seed: GLLGDNQIMPK (MAGA1_HUMAN)
GMLGDNQIMPR

SEQ ID NO: 47508 - protein, 9 aa, Artificial Sequence
  Description of Artificial Sequence: Synthetic peptide
  Seed: TQDLVQEKY (MAGA1_HUMAN)
TVDLVQEKY

SEQ ID NO: 47509 - protein, 9 aa, Artificial Sequence
  Description of Artificial Sequence: Synthetic peptide
  Seed: FLWGPRALA (MAGA1_HUMAN)
FLWGPRALK

SEQ ID NO: 47510 - protein, 9 aa, Artificial Sequence
  Description of Artificial Sequence: Synthetic peptide
  Seed: RVRFFFPSL (MAGA1_HUMAN)
RSRFFFPSL

SEQ ID NO: 47511 - protein, 9 aa, Artificial Sequence
  Description of Artificial Sequence: Synthetic peptide
  Seed: ATSSSSPLV (MAGA1_HUMAN)
AVSSSSPLW

SEQ ID NO: 47512 - protein, 10 aa, Artificial Sequence
  Description of Artificial Sequence: Synthetic peptide
  Seed: FFPSLREAAL (MAGA1_HUMAN)
FWPSLREAAY

SEQ ID NO: 47513 - protein, 10 aa, Artificial Sequence
  Description of Artificial Sequence: Synthetic peptide
  Seed: LSVMEVYDGR (MAGA1_HUMAN)
LMVMEVYDGR

SEQ ID NO: 47514 - protein, 9 aa, Artificial Sequence
  Description of Artificial Sequence: Synthetic peptide
  Seed: RVRFFFPSL (MAGA1_HUMAN)
RIRFFFPSS

SEQ ID NO: 47515 - protein, 10 aa, Artificial Sequence
  Description of Artificial Sequence: Synthetic peptide
  Seed: EALEAQQEAL (MAGA1_HUMAN)
EVLEAQQEAW

SEQ ID NO: 47516 - protein, 9 aa, Artificial Sequence
  Description of Artificial Sequence: Synthetic peptide
  Seed: ETSYVKVLE (MAGA1_HUMAN)
EMSYVKVLK

SEQ ID NO: 47517 - protein, 9 aa, Artificial Sequence
  Description of Artificial Sequence: Synthetic peptide
  Seed: VSARVRFFF (MAGA1_HUMAN)
VIARVRFFF

SEQ ID NO: 47518 - protein, 9 aa, Artificial Sequence
  Description of Artificial Sequence: Synthetic peptide
  Seed: FFFPSLREA (MAGA1_HUMAN)
FLFPSLREI

SEQ ID NO: 47519 - protein, 10 aa, Artificial Sequence
  Description of Artificial Sequence: Synthetic peptide
  Seed: EIFGKASESL (MAGA1_HUMAN)
EAFGKASESW

SEQ ID NO: 47520 - protein, 10 aa, Artificial Sequence
  Description of Artificial Sequence: Synthetic peptide
  Seed: SARVRFFFPS (MAGA1_HUMAN)
SSRVRFFFPI

SEQ ID NO: 47521 - protein, 10 aa, Artificial Sequence
  Description of Artificial Sequence: Synthetic peptide
  Seed: KASESLQLVF (MAGA1_HUMAN)
KLSESLQLVL

SEQ ID NO: 47522 - protein, 9 aa, Artificial Sequence
  Description of Artificial Sequence: Synthetic peptide
  Seed: LFRAVITKK (MAGA1_HUMAN)
LMRAVITKK

SEQ ID NO: 47523 - protein, 10 aa, Artificial Sequence
  Description of Artificial Sequence: Synthetic peptide
  Seed: RVRFFFPSLR (MAGA1_HUMAN)
RMRFFFPSLT

SEQ ID NO: 47524 - protein, 9 aa, Artificial Sequence
  Description of Artificial Sequence: Synthetic peptide
  Seed: KASESLQLV (MAGA1_HUMAN)
KWSESLQLY

SEQ ID NO: 47525 - protein, 10 aa, Artificial Sequence
  Description of Artificial Sequence: Synthetic peptide
  Seed: STSCILESLF (MAGA1_HUMAN)
SSSCILESLY

SEQ ID NO: 47526 - protein, 9 aa, Artificial Sequence
  Description of Artificial Sequence: Synthetic peptide
  Seed: STSCILESL (MAGA1_HUMAN)
SLSCILESF

SEQ ID NO: 47527 - protein, 11 aa, Artificial Sequence
  Description of Artificial Sequence: Synthetic peptide
  Seed: KNYKHCFPEIF (MAGA1_HUMAN)
KQYKHCFPEIM

SEQ ID NO: 47528 - protein, 9 aa, Artificial Sequence
  Description of Artificial Sequence: Synthetic peptide
  Seed: SSPLVLGTL (MAGA1_HUMAN)
SQPLVLGTL

SEQ ID NO: 47529 - protein, 9 aa, Artificial Sequence
  Description of Artificial Sequence: Synthetic peptide
  Seed: FFPSLREAA (MAGA1_HUMAN)
FYPSLREAM

SEQ ID NO: 47530 - protein, 10 aa, Artificial Sequence
  Description of Artificial Sequence: Synthetic peptide
  Seed: VLVTCLGLSY (MAGA1_HUMAN)
VKVTCLGLSM

SEQ ID NO: 47531 - protein, 9 aa, Artificial Sequence
  Description of Artificial Sequence: Synthetic peptide
  Seed: SLHCKPEEA (MAGA1_HUMAN)
SLHCKPEEL

SEQ ID NO: 47532 - protein, 8 aa, Artificial Sequence
  Description of Artificial Sequence: Synthetic peptide
  Seed: SARVRFFF (MAGA1_HUMAN)
SPRVRFFM

SEQ ID NO: 47533 - protein, 9 aa, Artificial Sequence
  Description of Artificial Sequence: Synthetic peptide
  Seed: RALAETSYV (MAGA1_HUMAN)
RTLAETSYK

SEQ ID NO: 47534 - protein, 9 aa, Artificial Sequence
  Description of Artificial Sequence: Synthetic peptide
  Seed: LVTCLGLSY (MAGA1_HUMAN)
LETCLGLSY

SEQ ID NO: 47535 - protein, 11 aa, Artificial Sequence
  Description of Artificial Sequence: Synthetic peptide
  Seed: YEFLWGPRALA (MAGA1_HUMAN)
YMFLWGPRALI

SEQ ID NO: 47536 - protein, 10 aa, Artificial Sequence
  Description of Artificial Sequence: Synthetic peptide
  Seed: EVYDGREHSA (MAGA1_HUMAN)
EMYDGREHSY

SEQ ID NO: 47537 - protein, 9 aa, Artificial Sequence
  Description of Artificial Sequence: Synthetic peptide
  Seed: SYVKVLEYV (MAGA1_HUMAN)
SYVKVLEYY

SEQ ID NO: 47538 - protein, 11 aa, Artificial Sequence
  Description of Artificial Sequence: Synthetic peptide
  Seed: ARYEFLWGPRA (MAGA1_HUMAN)
ARYEFLWGPRL

SEQ ID NO: 47539 - protein, 9 aa, Artificial Sequence
  Description of Artificial Sequence: Synthetic peptide
  Seed: AETSYVKVL (MAGA1_HUMAN)
AQTSYVKVI

SEQ ID NO: 47540 - protein, 9 aa, Artificial Sequence
  Description of Artificial Sequence: Synthetic peptide
  Seed: VYDGREHSA (MAGA1_HUMAN)
VGDGREHSI

SEQ ID NO: 47541 - protein, 9 aa, Artificial Sequence
  Description of Artificial Sequence: Synthetic peptide
  Seed: HSYVLVTCL (MAGA1_HUMAN)
HVYVLVTCV

SEQ ID NO: 47542 - protein, 11 aa, Artificial Sequence
  Description of Artificial Sequence: Synthetic peptide
  Seed: STDPPQSPQGA (MAGA1_HUMAN)
SIDPPQSPQGI

SEQ ID NO: 47543 - protein, 9 aa, Artificial Sequence
  Description of Artificial Sequence: Synthetic peptide
  Seed: YVKVLEYVI (MAGA1_HUMAN)
YQKVLEYVI

SEQ ID NO: 47544 - protein, 10 aa, Artificial Sequence
  Description of Artificial Sequence: Synthetic peptide
  Seed: RQPSEGSSSR (MAGA1_HUMAN)
RAPSEGSSSL

SEQ ID NO: 47545 - protein, 9 aa, Artificial Sequence
  Description of Artificial Sequence: Synthetic peptide
  Seed: QIMPKTGFL (MAGA1_HUMAN)
QLMPKTGFM

SEQ ID NO: 47546 - protein, 9 aa, Artificial Sequence
  Description of Artificial Sequence: Synthetic peptide
  Seed: STDPPQSPQ (MAGA1_HUMAN)
SMDPPQSPL

SEQ ID NO: 47547 - protein, 9 aa, Artificial Sequence
  Description of Artificial Sequence: Synthetic peptide
  Seed: FFFPSLREA (MAGA1_HUMAN)
FMFPSLREY

SEQ ID NO: 47548 - protein, 9 aa, Artificial Sequence
  Description of Artificial Sequence: Synthetic peptide
  Seed: SAFPTTINF (MAGA1_HUMAN)
STFPTTINL

SEQ ID NO: 47549 - protein, 9 aa, Artificial Sequence
  Description of Artificial Sequence: Synthetic peptide
  Seed: LVQEKYLEY (MAGA1_HUMAN)
LFQEKYLEF

SEQ ID NO: 47550 - protein, 10 aa, Artificial Sequence
  Description of Artificial Sequence: Synthetic peptide
  Seed: SCILESLFRA (MAGA1_HUMAN)
SMILESLFRV

SEQ ID NO: 47551 - protein, 9 aa, Artificial Sequence
  Description of Artificial Sequence: Synthetic peptide
  Seed: ESLQLVFGI (MAGA1_HUMAN)
EVLQLVFGA

SEQ ID NO: 47552 - protein, 10 aa, Artificial Sequence
  Description of Artificial Sequence: Synthetic peptide
  Seed: KNYKHCFPEI (MAGA1_HUMAN)
KVYKHCFPEI

SEQ ID NO: 47553 - protein, 9 aa, Artificial Sequence
  Description of Artificial Sequence: Synthetic peptide
  Seed: VSARVRFFF (MAGA1_HUMAN)
VYARVRFFY

SEQ ID NO: 47554 - protein, 10 aa, Artificial Sequence
  Description of Artificial Sequence: Synthetic peptide
  Seed: ARVRFFFPSL (MAGA1_HUMAN)
ADVRFFFPSA

SEQ ID NO: 47555 - protein, 10 aa, Artificial Sequence
  Description of Artificial Sequence: Synthetic peptide
  Seed: ETSYVKVLEY (MAGA1_HUMAN)
EFSYVKVLER

SEQ ID NO: 47556 - protein, 9 aa, Artificial Sequence
  Description of Artificial Sequence: Synthetic peptide
  Seed: KYRAREPVT (MAGA1_HUMAN)
KVRAREPVM

SEQ ID NO: 47557 - protein, 9 aa, Artificial Sequence
  Description of Artificial Sequence: Synthetic peptide
  Seed: KYRAREPVT (MAGA1_HUMAN)
KTRAREPVV

SEQ ID NO: 47558 - protein, 9 aa, Artificial Sequence
  Description of Artificial Sequence: Synthetic peptide
  Seed: AYGEPRKLL (MAGA1_HUMAN)
AYGEPRKLY

SEQ ID NO: 47559 - protein, 10 aa, Artificial Sequence
  Description of Artificial Sequence: Synthetic peptide
  Seed: EMLESVIKNY (MAGA1_HUMAN)
ETLESVIKNF

SEQ ID NO: 47560 - protein, 10 aa, Artificial Sequence
  Description of Artificial Sequence: Synthetic peptide
  Seed: KEADPTGHSY (MAGA1_HUMAN)
KVADPTGHSW

SEQ ID NO: 47561 - protein, 9 aa, Artificial Sequence
  Description of Artificial Sequence: Synthetic peptide
  Seed: LVTCLGLSY (MAGA1_HUMAN)
LATCLGLSF

SEQ ID NO: 47562 - protein, 9 aa, Artificial Sequence
  Description of Artificial Sequence: Synthetic peptide
  Seed: DSDPARYEF (MAGA1_HUMAN)
DWDPARYEM

SEQ ID NO: 47563 - protein, 9 aa, Artificial Sequence
  Description of Artificial Sequence: Synthetic peptide
  Seed: HSYVLVTCL (MAGA1_HUMAN)
HMYVLVTCY

SEQ ID NO: 47564 - protein, 10 aa, Artificial Sequence
  Description of Artificial Sequence: Synthetic peptide
  Seed: KVADLVGFLL (MAGA1_HUMAN)
KMADLVGFLA

SEQ ID NO: 47565 - protein, 9 aa, Artificial Sequence
  Description of Artificial Sequence: Synthetic peptide
  Seed: SYVKVLEYV (MAGA1_HUMAN)
SVVKVLEYA

SEQ ID NO: 47566 - protein, 9 aa, Artificial Sequence
  Description of Artificial Sequence: Synthetic peptide
  Seed: SAFPTTINF (MAGA1_HUMAN)
SIFPTTINH

SEQ ID NO: 47567 - protein, 10 aa, Artificial Sequence
  Description of Artificial Sequence: Synthetic peptide
  Seed: QVPDSDPARY (MAGA1_HUMAN)
QPPDSDPARY

SEQ ID NO: 47568 - protein, 9 aa, Artificial Sequence
  Description of Artificial Sequence: Synthetic peptide
  Seed: LESLFRAVI (MAGA1_HUMAN)
LSSLFRAVM

SEQ ID NO: 47569 - protein, 9 aa, Artificial Sequence
  Description of Artificial Sequence: Synthetic peptide
  Seed: SVMEVYDGR (MAGA1_HUMAN)
SSMEVYDGK

SEQ ID NO: 47570 - protein, 10 aa, Artificial Sequence
  Description of Artificial Sequence: Synthetic peptide
  Seed: KVADLVGFLL (MAGA1_HUMAN)
KLADLVGFLW

SEQ ID NO: 47571 - protein, 9 aa, Artificial Sequence
  Description of Artificial Sequence: Synthetic peptide
  Seed: FFFPSLREA (MAGA1_HUMAN)
FLFPSLRES

SEQ ID NO: 47572 - protein, 9 aa, Artificial Sequence
  Description of Artificial Sequence: Synthetic peptide
  Seed: FFFPSLREA (MAGA1_HUMAN)
FSFPSLREW

SEQ ID NO: 47573 - protein, 9 aa, Artificial Sequence
  Description of Artificial Sequence: Synthetic peptide
  Seed: KVSARVRFF (MAGA1_HUMAN)
KSSARVRFA

SEQ ID NO: 47574 - protein, 9 aa, Artificial Sequence
  Description of Artificial Sequence: Synthetic peptide
  Seed: FFPSLREAA (MAGA1_HUMAN)
FYPSLREAF

SEQ ID NO: 47575 - protein, 10 aa, Artificial Sequence
  Description of Artificial Sequence: Synthetic peptide
  Seed: RALAETSYVK (MAGA1_HUMAN)
RQLAETSYVR

SEQ ID NO: 47576 - protein, 9 aa, Artificial Sequence
  Description of Artificial Sequence: Synthetic peptide
  Seed: YVLVTCLGL (MAGA1_HUMAN)
YVLVTCLGV

SEQ ID NO: 47577 - protein, 10 aa, Artificial Sequence
  Description of Artificial Sequence: Synthetic peptide
  Seed: FFPSLREAAL (MAGA1_HUMAN)
FEPSLREAAF

SEQ ID NO: 47578 - protein, 9 aa, Artificial Sequence
  Description of Artificial Sequence: Synthetic peptide
  Seed: LGDNQIMPK (MAGA1_HUMAN)
LTDNQIMPL

SEQ ID NO: 47579 - protein, 10 aa, Artificial Sequence
  Description of Artificial Sequence: Synthetic peptide
  Seed: RAREPVTKAE (MAGA1_HUMAN)
RTREPVTKAT

SEQ ID NO: 47580 - protein, 9 aa, Artificial Sequence
  Description of Artificial Sequence: Synthetic peptide
  Seed: FLIIVLVMI (MAGA1_HUMAN)
FQIIVLVMI

SEQ ID NO: 47581 - protein, 9 aa, Artificial Sequence
  Description of Artificial Sequence: Synthetic peptide
  Seed: VSARVRFFF (MAGA1_HUMAN)
VMARVRFFI

SEQ ID NO: 47582 - protein, 9 aa, Artificial Sequence
  Description of Artificial Sequence: Synthetic peptide
  Seed: IFGKASESL (MAGA1_HUMAN)
IWGKASESW

SEQ ID NO: 47583 - protein, 9 aa, Artificial Sequence
  Description of Artificial Sequence: Synthetic peptide
  Seed: SYVKVLEYV (MAGA1_HUMAN)
SMVKVLEYI

SEQ ID NO: 47584 - protein, 9 aa, Artificial Sequence
  Description of Artificial Sequence: Synthetic peptide
  Seed: MPKTGFLII (MAGA1_HUMAN)
MPKTGFLIW

SEQ ID NO: 47585 - protein, 10 aa, Artificial Sequence
  Description of Artificial Sequence: Synthetic peptide
  Seed: SAFPTTINFT (MAGA1_HUMAN)
SQFPTTINFA

SEQ ID NO: 47586 - protein, 8 aa, Artificial Sequence
  Description of Artificial Sequence: Synthetic peptide
  Seed: TGFLIIVL (MAGA1_HUMAN)
TQFLIIVV

SEQ ID NO: 47587 - protein, 9 aa, Artificial Sequence
  Description of Artificial Sequence: Synthetic peptide
  Seed: VADLVGFLL (MAGA1_HUMAN)
VTDLVGFLF

SEQ ID NO: 47588 - protein, 9 aa, Artificial Sequence
  Description of Artificial Sequence: Synthetic peptide
  Seed: GASAFPTTI (MAGA1_HUMAN)
GMSAFPTTY

SEQ ID NO: 47589 - protein, 9 aa, Artificial Sequence
  Description of Artificial Sequence: Synthetic peptide
  Seed: LVLGTLEEV (MAGA1_HUMAN)
LLLGTLEEF

SEQ ID NO: 47590 - protein, 11 aa, Artificial Sequence
  Description of Artificial Sequence: Synthetic peptide
  Seed: ARVRFFFPSLR (MAGA1_HUMAN)
ARVRFFFPSLK

SEQ ID NO: 47591 - protein, 9 aa, Artificial Sequence
  Description of Artificial Sequence: Synthetic peptide
  Seed: KYRAREPVT (MAGA1_HUMAN)
KTRAREPVF

SEQ ID NO: 47592 - protein, 9 aa, Artificial Sequence
  Description of Artificial Sequence: Synthetic peptide
  Seed: YEFLWGPRA (MAGA1_HUMAN)
YEFLWGPRI

SEQ ID NO: 47593 - protein, 9 aa, Artificial Sequence
  Description of Artificial Sequence: Synthetic peptide
  Seed: HCFPEIFGK (MAGA1_HUMAN)
HMFPEIFGR

SEQ ID NO: 47594 - protein, 9 aa, Artificial Sequence
  Description of Artificial Sequence: Synthetic peptide
  Seed: AATSSSSPL (MAGA1_HUMAN)
AHTSSSSPM

SEQ ID NO: 47595 - protein, 9 aa, Artificial Sequence
  Description of Artificial Sequence: Synthetic peptide
  Seed: VQAATSSSS (MAGA1_HUMAN)
VKAATSSSY

SEQ ID NO: 47596 - protein, 9 aa, Artificial Sequence
  Description of Artificial Sequence: Synthetic peptide
  Seed: HSAYGEPRK (MAGA1_HUMAN)
HIAYGEPRR

SEQ ID NO: 47597 - protein, 10 aa, Artificial Sequence
  Description of Artificial Sequence: Synthetic peptide
  Seed: LLGDNQIMPK (MAGA1_HUMAN)
LMGDNQIMPK

SEQ ID NO: 47598 - protein, 10 aa, Artificial Sequence
  Description of Artificial Sequence: Synthetic peptide
  Seed: ADPTGHSYVL (MAGA1_HUMAN)
AEPTGHSYVM

SEQ ID NO: 47599 - protein, 11 aa, Artificial Sequence
  Description of Artificial Sequence: Synthetic peptide
  Seed: RVRFFFPSLRE (MAGA1_HUMAN)
RFRFFFPSLRD

SEQ ID NO: 47600 - protein, 9 aa, Artificial Sequence
  Description of Artificial Sequence: Synthetic peptide
  Seed: RAREPVTKA (MAGA1_HUMAN)
RVREPVTKI

SEQ ID NO: 47601 - protein, 9 aa, Artificial Sequence
  Description of Artificial Sequence: Synthetic peptide
  Seed: KASESLQLV (MAGA1_HUMAN)
KMSESLQLF

SEQ ID NO: 47602 - protein, 10 aa, Artificial Sequence
  Description of Artificial Sequence: Synthetic peptide
  Seed: KEADPTGHSY (MAGA1_HUMAN)
KRADPTGHSL

SEQ ID NO: 47603 - protein, 10 aa, Artificial Sequence
  Description of Artificial Sequence: Synthetic peptide
  Seed: TSYVKVLEYV (MAGA1_HUMAN)
TYYVKVLEYL

SEQ ID NO: 47604 - protein, 9 aa, Artificial Sequence
  Description of Artificial Sequence: Synthetic peptide
  Seed: VYDGREHSA (MAGA1_HUMAN)
VVDGREHSI

SEQ ID NO: 47605 - protein, 11 aa, Artificial Sequence
  Description of Artificial Sequence: Synthetic peptide
  Seed: VQAATSSSSPL (MAGA1_HUMAN)
VQAATSSSSPF

SEQ ID NO: 47606 - protein, 10 aa, Artificial Sequence
  Description of Artificial Sequence: Synthetic peptide
  Seed: STSCILESLF (MAGA1_HUMAN)
SLSCILESLW

SEQ ID NO: 47607 - protein, 9 aa, Artificial Sequence
  Description of Artificial Sequence: Synthetic peptide
  Seed: SSSPLVLGT (MAGA1_HUMAN)
STSPLVLGL

SEQ ID NO: 47608 - protein, 9 aa, Artificial Sequence
  Description of Artificial Sequence: Synthetic peptide
  Seed: AATSSSSPL (MAGA1_HUMAN)
AMTSSSSPW

SEQ ID NO: 47609 - protein, 10 aa, Artificial Sequence
  Description of Artificial Sequence: Synthetic peptide
  Seed: FFPSLREAAL (MAGA1_HUMAN)
FGPSLREAAY

SEQ ID NO: 47610 - protein, 9 aa, Artificial Sequence
  Description of Artificial Sequence: Synthetic peptide
  Seed: RVRFFFPSL (MAGA1_HUMAN)
RMRFFFPSS

SEQ ID NO: 47611 - protein, 9 aa, Artificial Sequence
  Description of Artificial Sequence: Synthetic peptide
  Seed: SSPLVLGTL (MAGA1_HUMAN)
SLPLVLGTY

SEQ ID NO: 47612 - protein, 9 aa, Artificial Sequence
  Description of Artificial Sequence: Synthetic peptide
  Seed: LVQEKYLEY (MAGA1_HUMAN)
LPQEKYLEF

SEQ ID NO: 47613 - protein, 10 aa, Artificial Sequence
  Description of Artificial Sequence: Synthetic peptide
  Seed: ARVRFFFPSL (MAGA1_HUMAN)
AEVRFFFPSI

SEQ ID NO: 47614 - protein, 11 aa, Artificial Sequence
  Description of Artificial Sequence: Synthetic peptide
  Seed: YEFLWGPRALA (MAGA1_HUMAN)
YVFLWGPRALV

SEQ ID NO: 47615 - protein, 10 aa, Artificial Sequence
  Description of Artificial Sequence: Synthetic peptide
  Seed: ADPTGHSYVL (MAGA1_HUMAN)
AIPTGHSYVM

SEQ ID NO: 47616 - protein, 10 aa, Artificial Sequence
  Description of Artificial Sequence: Synthetic peptide
  Seed: KEADPTGHSY (MAGA1_HUMAN)
KEADPTGHSL

SEQ ID NO: 47617 - protein, 9 aa, Artificial Sequence
  Description of Artificial Sequence: Synthetic peptide
  Seed: MIAMEGGHA (MAGA1_HUMAN)
MMAMEGGHI

SEQ ID NO: 47618 - protein, 9 aa, Artificial Sequence
  Description of Artificial Sequence: Synthetic peptide
  Seed: TKAEMLESV (MAGA1_HUMAN)
TVAEMLESI

SEQ ID NO: 47619 - protein, 11 aa, Artificial Sequence
  Description of Artificial Sequence: Synthetic peptide
  Seed: ELSVMEVYDGR (MAGA1_HUMAN)
EWSVMEVYDGR

SEQ ID NO: 47620 - protein, 11 aa, Artificial Sequence
  Description of Artificial Sequence: Synthetic peptide
  Seed: KLLTQDLVQEK (MAGA1_HUMAN)
KTLTQDLVQER

SEQ ID NO: 47621 - protein, 9 aa, Artificial Sequence
  Description of Artificial Sequence: Synthetic peptide
  Seed: FPSLREAAL (MAGA1_HUMAN)
FHSLREAAL

SEQ ID NO: 47622 - protein, 10 aa, Artificial Sequence
  Description of Artificial Sequence: Synthetic peptide
  Seed: KNYKHCFPEI (MAGA1_HUMAN)
KNYKHCFPEK

SEQ ID NO: 47623 - protein, 11 aa, Artificial Sequence
  Description of Artificial Sequence: Synthetic peptide
  Seed: RSLHCKPEEAL (MAGA1_HUMAN)
RALHCKPEEAW

SEQ ID NO: 47624 - protein, 10 aa, Artificial Sequence
  Description of Artificial Sequence: Synthetic peptide
  Seed: MLESVIKNYK (MAGA1_HUMAN)
MMESVIKNYR

SEQ ID NO: 47625 - protein, 8 aa, Artificial Sequence
  Description of Artificial Sequence: Synthetic peptide
  Seed: SPQGASAF (MAGA1_HUMAN)
SPQGASAL

SEQ ID NO: 47626 - protein, 10 aa, Artificial Sequence
  Description of Artificial Sequence: Synthetic peptide
  Seed: SESLQLVFGI (MAGA1_HUMAN)
SASLQLVFGW

SEQ ID NO: 47627 - protein, 10 aa, Artificial Sequence
  Description of Artificial Sequence: Synthetic peptide
  Seed: EVYDGREHSA (MAGA1_HUMAN)
ESYDGREHSF

SEQ ID NO: 47628 - protein, 9 aa, Artificial Sequence
  Description of Artificial Sequence: Synthetic peptide
  Seed: KVADLVGFL (MAGA1_HUMAN)
KTADLVGFA

SEQ ID NO: 47629 - protein, 9 aa, Artificial Sequence
  Description of Artificial Sequence: Synthetic peptide
  Seed: RAREPVTKA (MAGA1_HUMAN)
RFREPVTKL

SEQ ID NO: 47630 - protein, 9 aa, Artificial Sequence
  Description of Artificial Sequence: Synthetic peptide
  Seed: IFGKASESL (MAGA1_HUMAN)
IWGKASESI

SEQ ID NO: 47631 - protein, 10 aa, Artificial Sequence
  Description of Artificial Sequence: Synthetic peptide
  Seed: WEELSVMEVY (MAGA1_HUMAN)
WGELSVMEVW

SEQ ID NO: 47632 - protein, 9 aa, Artificial Sequence
  Description of Artificial Sequence: Synthetic peptide
  Seed: LVQEKYLEY (MAGA1_HUMAN)
LVQEKYLEL

SEQ ID NO: 47633 - protein, 10 aa, Artificial Sequence
  Description of Artificial Sequence: Synthetic peptide
  Seed: FFPSLREAAL (MAGA1_HUMAN)
FGPSLREAAM

SEQ ID NO: 47634 - protein, 10 aa, Artificial Sequence
  Description of Artificial Sequence: Synthetic peptide
  Seed: GFLLLKYRAR (MAGA1_HUMAN)
GMLLLKYRAR

SEQ ID NO: 47635 - protein, 11 aa, Artificial Sequence
  Description of Artificial Sequence: Synthetic peptide
  Seed: KVADLVGFLLL (MAGA1_HUMAN)
KVADLVGFLLK

SEQ ID NO: 47636 - protein, 9 aa, Artificial Sequence
  Description of Artificial Sequence: Synthetic peptide
  Seed: VADLVGFLL (MAGA1_HUMAN)
VNDLVGFLL

SEQ ID NO: 47637 - protein, 9 aa, Artificial Sequence
  Description of Artificial Sequence: Synthetic peptide
  Seed: FLWGPRALA (MAGA1_HUMAN)
FVWGPRALR

SEQ ID NO: 47638 - protein, 9 aa, Artificial Sequence
  Description of Artificial Sequence: Synthetic peptide
  Seed: KVLEYVIKV (MAGA1_HUMAN)
KSLEYVIKA

SEQ ID NO: 47639 - protein, 9 aa, Artificial Sequence
  Description of Artificial Sequence: Synthetic peptide
  Seed: RAREPVTKA (MAGA1_HUMAN)
REREPVTKY

SEQ ID NO: 47640 - protein, 9 aa, Artificial Sequence
  Description of Artificial Sequence: Synthetic peptide
  Seed: SAYGEPRKL (MAGA1_HUMAN)
SKYGEPRKF

SEQ ID NO: 47641 - protein, 10 aa, Artificial Sequence
  Description of Artificial Sequence: Synthetic peptide
  Seed: IKVSARVRFF (MAGA1_HUMAN)
IQVSARVRFF

SEQ ID NO: 47642 - protein, 9 aa, Artificial Sequence
  Description of Artificial Sequence: Synthetic peptide
  Seed: SARVRFFFP (MAGA1_HUMAN)
SGRVRFFFA

SEQ ID NO: 47643 - protein, 8 aa, Artificial Sequence
  Description of Artificial Sequence: Synthetic peptide
  Seed: RALAETSY (MAGA1_HUMAN)
RQLAETSM

SEQ ID NO: 47644 - protein, 10 aa, Artificial Sequence
  Description of Artificial Sequence: Synthetic peptide
  Seed: KVADLVGFLL (MAGA1_HUMAN)
KCADLVGFLW

SEQ ID NO: 47645 - protein, 9 aa, Artificial Sequence
  Description of Artificial Sequence: Synthetic peptide
  Seed: SYVKVLEYV (MAGA1_HUMAN)
SYVKVLEYW

SEQ ID NO: 47646 - protein, 9 aa, Artificial Sequence
  Description of Artificial Sequence: Synthetic peptide
  Seed: ALGLVCVQA (MAGA1_HUMAN)
ALGLVCVQL

SEQ ID NO: 47647 - protein, 11 aa, Artificial Sequence
  Description of Artificial Sequence: Synthetic peptide
  Seed: YVKVLEYVIKV (MAGA1_HUMAN)
YWKVLEYVIKV

SEQ ID NO: 47648 - protein, 9 aa, Artificial Sequence
  Description of Artificial Sequence: Synthetic peptide
  Seed: VRFFFPSLR (MAGA1_HUMAN)
VWFFFPSLK

SEQ ID NO: 47649 - protein, 9 aa, Artificial Sequence
  Description of Artificial Sequence: Synthetic peptide
  Seed: RAREPVTKA (MAGA1_HUMAN)
RIREPVTKS

SEQ ID NO: 47650 - protein, 10 aa, Artificial Sequence
  Description of Artificial Sequence: Synthetic peptide
  Seed: SARVRFFFPS (MAGA1_HUMAN)
SSRVRFFFPA

SEQ ID NO: 47651 - protein, 10 aa, Artificial Sequence
  Description of Artificial Sequence: Synthetic peptide
  Seed: RVRFFFPSLR (MAGA1_HUMAN)
RCRFFFPSLV

SEQ ID NO: 47652 - protein, 9 aa, Artificial Sequence
  Description of Artificial Sequence: Synthetic peptide
  Seed: SAFPTTINF (MAGA1_HUMAN)
SKFPTTINF

SEQ ID NO: 47653 - protein, 9 aa, Artificial Sequence
  Description of Artificial Sequence: Synthetic peptide
  Seed: EIWEELSVM (MAGA1_HUMAN)
ELWEELSVV

SEQ ID NO: 47654 - protein, 11 aa, Artificial Sequence
  Description of Artificial Sequence: Synthetic peptide
  Seed: YVLVTCLGLSY (MAGA1_HUMAN)
YQLVTCLGLSF

SEQ ID NO: 47655 - protein, 9 aa, Artificial Sequence
  Description of Artificial Sequence: Synthetic peptide
  Seed: AATSSSSPL (MAGA1_HUMAN)
AHTSSSSPF

SEQ ID NO: 47656 - protein, 9 aa, Artificial Sequence
  Description of Artificial Sequence: Synthetic peptide
  Seed: AATSSSSPL (MAGA1_HUMAN)
ALTSSSSPV

SEQ ID NO: 47657 - protein, 10 aa, Artificial Sequence
  Description of Artificial Sequence: Synthetic peptide
  Seed: SARVRFFFPS (MAGA1_HUMAN)
STRVRFFFPS

SEQ ID NO: 47658 - protein, 9 aa, Artificial Sequence
  Description of Artificial Sequence: Synthetic peptide
  Seed: YVIKVSARV (MAGA1_HUMAN)
YLIKVSARM

SEQ ID NO: 47659 - protein, 9 aa, Artificial Sequence
  Description of Artificial Sequence: Synthetic peptide
  Seed: LVQEKYLEY (MAGA1_HUMAN)
LMQEKYLER

SEQ ID NO: 47660 - protein, 11 aa, Artificial Sequence
  Description of Artificial Sequence: Synthetic peptide
  Seed: RVRFFFPSLRE (MAGA1_HUMAN)
RYRFFFPSLRK

SEQ ID NO: 47661 - protein, 11 aa, Artificial Sequence
  Description of Artificial Sequence: Synthetic peptide
  Seed: STDPPQSPQGA (MAGA1_HUMAN)
SMDPPQSPQGM

SEQ ID NO: 47662 - protein, 9 aa, Artificial Sequence
  Description of Artificial Sequence: Synthetic peptide
  Seed: TKAEMLESV (MAGA1_HUMAN)
TAAEMLESV

SEQ ID NO: 47663 - protein, 9 aa, Artificial Sequence
  Description of Artificial Sequence: Synthetic peptide
  Seed: AATSSSSPL (MAGA1_HUMAN)
AQTSSSSPM

SEQ ID NO: 47664 - protein, 9 aa, Artificial Sequence
  Description of Artificial Sequence: Synthetic peptide
  Seed: RQRQPSEGS (MAGA1_HUMAN)
RTRQPSEGG

SEQ ID NO: 47665 - protein, 11 aa, Artificial Sequence
  Description of Artificial Sequence: Synthetic peptide
  Seed: KVADLVGFLLL (MAGA1_HUMAN)
KMADLVGFLLD

SEQ ID NO: 47666 - protein, 10 aa, Artificial Sequence
  Description of Artificial Sequence: Synthetic peptide
  Seed: KVSARVRFFF (MAGA1_HUMAN)
KLSARVRFFY

SEQ ID NO: 47667 - protein, 9 aa, Artificial Sequence
  Description of Artificial Sequence: Synthetic peptide
  Seed: KVSARVRFF (MAGA1_HUMAN)
KSSARVRFK

SEQ ID NO: 47668 - protein, 9 aa, Artificial Sequence
  Description of Artificial Sequence: Synthetic peptide
  Seed: VRFFFPSLR (MAGA1_HUMAN)
VPFFFPSLR

SEQ ID NO: 47669 - protein, 9 aa, Artificial Sequence
  Description of Artificial Sequence: Synthetic peptide
  Seed: LVLGTLEEV (MAGA1_HUMAN)
LSLGTLEEF

SEQ ID NO: 47670 - protein, 9 aa, Artificial Sequence
  Description of Artificial Sequence: Synthetic peptide
  Seed: SYVKVLEYV (MAGA1_HUMAN)
SAVKVLEYI

SEQ ID NO: 47671 - protein, 10 aa, Artificial Sequence
  Description of Artificial Sequence: Synthetic peptide
  Seed: KKVADLVGFL (MAGA1_HUMAN)
KLVADLVGFL

SEQ ID NO: 47672 - protein, 9 aa, Artificial Sequence
  Description of Artificial Sequence: Synthetic peptide
  Seed: RVRFFFPSL (MAGA1_HUMAN)
RKRFFFPSM

SEQ ID NO: 47673 - protein, 10 aa, Artificial Sequence
  Description of Artificial Sequence: Synthetic peptide
  Seed: RYEFLWGPRA (MAGA1_HUMAN)
RGEFLWGPRR

SEQ ID NO: 47674 - protein, 9 aa, Artificial Sequence
  Description of Artificial Sequence: Synthetic peptide
  Seed: KTGFLIIVL (MAGA1_HUMAN)
KMGFLIIVV

SEQ ID NO: 47675 - protein, 9 aa, Artificial Sequence
  Description of Artificial Sequence: Synthetic peptide
  Seed: FPSLREAAL (MAGA1_HUMAN)
FVSLREAAL

SEQ ID NO: 47676 - protein, 9 aa, Artificial Sequence
  Description of Artificial Sequence: Synthetic peptide
  Seed: QIMPKTGFL (MAGA1_HUMAN)
QAMPKTGFL

SEQ ID NO: 47677 - protein, 9 aa, Artificial Sequence
  Description of Artificial Sequence: Synthetic peptide
  Seed: MSLEQRSLH (MAGA1_HUMAN)
MVLEQRSLK

SEQ ID NO: 47678 - protein, 11 aa, Artificial Sequence
  Description of Artificial Sequence: Synthetic peptide
  Seed: RQVPDSDPARY (MAGA1_HUMAN)
RTVPDSDPARK

SEQ ID NO: 47679 - protein, 10 aa, Artificial Sequence
  Description of Artificial Sequence: Synthetic peptide
  Seed: ASAFPTTINF (MAGA1_HUMAN)
AVAFPTTINY

SEQ ID NO: 47680 - protein, 9 aa, Artificial Sequence
  Description of Artificial Sequence: Synthetic peptide
  Seed: RVRFFFPSL (MAGA1_HUMAN)
RKRFFFPSY

SEQ ID NO: 47681 - protein, 9 aa, Artificial Sequence
  Description of Artificial Sequence: Synthetic peptide
  Seed: EADPTGHSY (MAGA1_HUMAN)
EPDPTGHSM

SEQ ID NO: 47682 - protein, 11 aa, Artificial Sequence
  Description of Artificial Sequence: Synthetic peptide
  Seed: IKVSARVRFFF (MAGA1_HUMAN)
IMVSARVRFFW

SEQ ID NO: 47683 - protein, 11 aa, Artificial Sequence
  Description of Artificial Sequence: Synthetic peptide
  Seed: KVSARVRFFFP (MAGA1_HUMAN)
KHSARVRFFFK

SEQ ID NO: 47684 - protein, 10 aa, Artificial Sequence
  Description of Artificial Sequence: Synthetic peptide
  Seed: ARVRFFFPSL (MAGA1_HUMAN)
AGVRFFFPSV

SEQ ID NO: 47685 - protein, 9 aa, Artificial Sequence
  Description of Artificial Sequence: Synthetic peptide
  Seed: RVRFFFPSL (MAGA1_HUMAN)
RIRFFFPSN

SEQ ID NO: 47686 - protein, 9 aa, Artificial Sequence
  Description of Artificial Sequence: Synthetic peptide
  Seed: SAYGEPRKL (MAGA1_HUMAN)
SPYGEPRKY

SEQ ID NO: 47687 - protein, 9 aa, Artificial Sequence
  Description of Artificial Sequence: Synthetic peptide
  Seed: LVQEKYLEY (MAGA1_HUMAN)
LVQEKYLEW

SEQ ID NO: 47688 - protein, 10 aa, Artificial Sequence
  Description of Artificial Sequence: Synthetic peptide
  Seed: EMLESVIKNY (MAGA1_HUMAN)
EALESVIKNF

SEQ ID NO: 47689 - protein, 9 aa, Artificial Sequence
  Description of Artificial Sequence: Synthetic peptide
  Seed: EKYLEYRQV (MAGA1_HUMAN)
EQYLEYRQV

SEQ ID NO: 47690 - protein, 10 aa, Artificial Sequence
  Description of Artificial Sequence: Synthetic peptide
  Seed: KYRAREPVTK (MAGA1_HUMAN)
KTRAREPVTM

SEQ ID NO: 47691 - protein, 8 aa, Artificial Sequence
  Description of Artificial Sequence: Synthetic peptide
  Seed: VADLVGFL (MAGA1_HUMAN)
VSDLVGFM

SEQ ID NO: 47692 - protein, 10 aa, Artificial Sequence
  Description of Artificial Sequence: Synthetic peptide
  Seed: SCILESLFRA (MAGA1_HUMAN)
SAILESLFRL

SEQ ID NO: 47693 - protein, 9 aa, Artificial Sequence
  Description of Artificial Sequence: Synthetic peptide
  Seed: STSCILESL (MAGA1_HUMAN)
SASCILESY

SEQ ID NO: 47694 - protein, 11 aa, Artificial Sequence
  Description of Artificial Sequence: Synthetic peptide
  Seed: SSSSPLVLGTL (MAGA1_HUMAN)
SASSPLVLGTF

SEQ ID NO: 47695 - protein, 9 aa, Artificial Sequence
  Description of Artificial Sequence: Synthetic peptide
  Seed: SYVKVLEYV (MAGA1_HUMAN)
SFVKVLEYI

SEQ ID NO: 47696 - protein, 10 aa, Artificial Sequence
  Description of Artificial Sequence: Synthetic peptide
  Seed: KEADPTGHSY (MAGA1_HUMAN)
KWADPTGHSL

SEQ ID NO: 47697 - protein, 11 aa, Artificial Sequence
  Description of Artificial Sequence: Synthetic peptide
  Seed: KVSARVRFFFP (MAGA1_HUMAN)
KWSARVRFFFK

SEQ ID NO: 47698 - protein, 10 aa, Artificial Sequence
  Description of Artificial Sequence: Synthetic peptide
  Seed: FLWGPRALAE (MAGA1_HUMAN)
FVWGPRALAV

SEQ ID NO: 47699 - protein, 9 aa, Artificial Sequence
  Description of Artificial Sequence: Synthetic peptide
  Seed: EIWEELSVM (MAGA1_HUMAN)
ESWEELSVY

SEQ ID NO: 47700 - protein, 9 aa, Artificial Sequence
  Description of Artificial Sequence: Synthetic peptide
  Seed: HCFPEIFGK (MAGA1_HUMAN)
HGFPEIFGK

SEQ ID NO: 47701 - protein, 10 aa, Artificial Sequence
  Description of Artificial Sequence: Synthetic peptide
  Seed: ETSYVKVLEY (MAGA1_HUMAN)
ETSYVKVLER

SEQ ID NO: 47702 - protein, 10 aa, Artificial Sequence
  Description of Artificial Sequence: Synthetic peptide
  Seed: FFFPSLREAA (MAGA1_HUMAN)
FAFPSLREAM

SEQ ID NO: 47703 - protein, 9 aa, Artificial Sequence
  Description of Artificial Sequence: Synthetic peptide
  Seed: GASAFPTTI (MAGA1_HUMAN)
GLSAFPTTI

SEQ ID NO: 47704 - protein, 10 aa, Artificial Sequence
  Description of Artificial Sequence: Synthetic peptide
  Seed: ADPTGHSYVL (MAGA1_HUMAN)
AFPTGHSYVL

SEQ ID NO: 47705 - protein, 8 aa, Artificial Sequence
  Description of Artificial Sequence: Synthetic peptide
  Seed: VRFFFPSL (MAGA1_HUMAN)
VQFFFPSI

SEQ ID NO: 47706 - protein, 9 aa, Artificial Sequence
  Description of Artificial Sequence: Synthetic peptide
  Seed: GASAFPTTI (MAGA1_HUMAN)
GASAFPTTV

SEQ ID NO: 47707 - protein, 11 aa, Artificial Sequence
  Description of Artificial Sequence: Synthetic peptide
  Seed: STSCILESLFR (MAGA1_HUMAN)
SVSCILESLFR

SEQ ID NO: 47708 - protein, 9 aa, Artificial Sequence
  Description of Artificial Sequence: Synthetic peptide
  Seed: TSSSSPLVL (MAGA1_HUMAN)
THSSSPLVY

SEQ ID NO: 47709 - protein, 11 aa, Artificial Sequence
  Description of Artificial Sequence: Synthetic peptide
  Seed: ARVRFFFPSLR (MAGA1_HUMAN)
AKVRFFFPSLR

SEQ ID NO: 47710 - protein, 9 aa, Artificial Sequence
  Description of Artificial Sequence: Synthetic peptide
  Seed: SYVKVLEYV (MAGA1_HUMAN)
SFVKVLEYF

SEQ ID NO: 47711 - protein, 11 aa, Artificial Sequence
  Description of Artificial Sequence: Synthetic peptide
  Seed: RSLHCKPEEAL (MAGA1_HUMAN)
RTLHCKPEEAF

SEQ ID NO: 47712 - protein, 9 aa, Artificial Sequence
  Description of Artificial Sequence: Synthetic peptide
  Seed: REAALREEE (MAGA1_HUMAN)
REAALREEL

SEQ ID NO: 47713 - protein, 10 aa, Artificial Sequence
  Description of Artificial Sequence: Synthetic peptide
  Seed: RAREPVTKAE (MAGA1_HUMAN)
RVREPVTKAM

SEQ ID NO: 47714 - protein, 9 aa, Artificial Sequence
  Description of Artificial Sequence: Synthetic peptide
  Seed: SAYGEPRKL (MAGA1_HUMAN)
SEYGEPRKF

SEQ ID NO: 47715 - protein, 10 aa, Artificial Sequence
  Description of Artificial Sequence: Synthetic peptide
  Seed: SLFRAVITKK (MAGA1_HUMAN)
SIFRAVITKK

SEQ ID NO: 47716 - protein, 10 aa, Artificial Sequence
  Description of Artificial Sequence: Synthetic peptide
  Seed: ADPTGHSYVL (MAGA1_HUMAN)
AAPTGHSYVL

SEQ ID NO: 47717 - protein, 10 aa, Artificial Sequence
  Description of Artificial Sequence: Synthetic peptide
  Seed: KVSARVRFFF (MAGA1_HUMAN)
KESARVRFFW

SEQ ID NO: 47718 - protein, 9 aa, Artificial Sequence
  Description of Artificial Sequence: Synthetic peptide
  Seed: VQAATSSSS (MAGA1_HUMAN)
VSAATSSSM

SEQ ID NO: 47719 - protein, 10 aa, Artificial Sequence
  Description of Artificial Sequence: Synthetic peptide
  Seed: RVRFFFPSLR (MAGA1_HUMAN)
RHRFFFPSLR

SEQ ID NO: 47720 - protein, 9 aa, Artificial Sequence
  Description of Artificial Sequence: Synthetic peptide
  Seed: SARVRFFFP (MAGA1_HUMAN)
SSRVRFFFV

SEQ ID NO: 47721 - protein, 9 aa, Artificial Sequence
  Description of Artificial Sequence: Synthetic peptide
  Seed: TSYVKVLEY (MAGA1_HUMAN)
TNYVKVLEL

SEQ ID NO: 47722 - protein, 9 aa, Artificial Sequence
  Description of Artificial Sequence: Synthetic peptide
  Seed: TQDLVQEKY (MAGA1_HUMAN)
TLDLVQEKW

SEQ ID NO: 47723 - protein, 9 aa, Artificial Sequence
  Description of Artificial Sequence: Synthetic peptide
  Seed: FFFPSLREA (MAGA1_HUMAN)
FYFPSLREV

SEQ ID NO: 47724 - protein, 9 aa, Artificial Sequence
  Description of Artificial Sequence: Synthetic peptide
  Seed: GASAFPTTI (MAGA1_HUMAN)
GASAFPTTM

SEQ ID NO: 47725 - protein, 11 aa, Artificial Sequence
  Description of Artificial Sequence: Synthetic peptide
  Seed: RVRFFFPSLRE (MAGA1_HUMAN)
RTRFFFPSLRF

SEQ ID NO: 47726 - protein, 9 aa, Artificial Sequence
  Description of Artificial Sequence: Synthetic peptide
  Seed: AEMLESVIK (MAGA1_HUMAN)
AEMLESVIS

SEQ ID NO: 47727 - protein, 11 aa, Artificial Sequence
  Description of Artificial Sequence: Synthetic peptide
  Seed: FLWGPRALAET (MAGA1_HUMAN)
FIWGPRALAEL

SEQ ID NO: 47728 - protein, 9 aa, Artificial Sequence
  Description of Artificial Sequence: Synthetic peptide
  Seed: ESLQLVFGI (MAGA1_HUMAN)
ETLQLVFGL

SEQ ID NO: 47729 - protein, 10 aa, Artificial Sequence
  Description of Artificial Sequence: Synthetic peptide
  Seed: LSVMEVYDGR (MAGA1_HUMAN)
LCVMEVYDGR

SEQ ID NO: 47730 - protein, 8 aa, Artificial Sequence
  Description of Artificial Sequence: Synthetic peptide
  Seed: VADLVGFL (MAGA1_HUMAN)
VSDLVGFI

SEQ ID NO: 47731 - protein, 9 aa, Artificial Sequence
  Description of Artificial Sequence: Synthetic peptide
  Seed: FFFPSLREA (MAGA1_HUMAN)
FFFPSLREW

SEQ ID NO: 47732 - protein, 11 aa, Artificial Sequence
  Description of Artificial Sequence: Synthetic peptide
  Seed: KVADLVGFLLL (MAGA1_HUMAN)
KIADLVGFLLW

SEQ ID NO: 47733 - protein, 9 aa, Artificial Sequence
  Description of Artificial Sequence: Synthetic peptide
  Seed: LVLGTLEEV (MAGA1_HUMAN)
LVLGTLEEI

SEQ ID NO: 47734 - protein, 9 aa, Artificial Sequence
  Description of Artificial Sequence: Synthetic peptide
  Seed: FFPSLREAA (MAGA1_HUMAN)
FFPSLREAI

SEQ ID NO: 47735 - protein, 9 aa, Artificial Sequence
  Description of Artificial Sequence: Synthetic peptide
  Seed: FPTTINFTR (MAGA1_HUMAN)
FPTTINFTT

SEQ ID NO: 47736 - protein, 10 aa, Artificial Sequence
  Description of Artificial Sequence: Synthetic peptide
  Seed: KVSARVRFFF (MAGA1_HUMAN)
KRSARVRFFW

SEQ ID NO: 47737 - protein, 10 aa, Artificial Sequence
  Description of Artificial Sequence: Synthetic peptide
  Seed: EALGLVCVQA (MAGA1_HUMAN)
ETLGLVCVQV

SEQ ID NO: 47738 - protein, 9 aa, Artificial Sequence
  Description of Artificial Sequence: Synthetic peptide
  Seed: KASESLQLV (MAGA1_HUMAN)
KQSESLQLI

SEQ ID NO: 47739 - protein, 10 aa, Artificial Sequence
  Description of Artificial Sequence: Synthetic peptide
  Seed: SAFPTTINFT (MAGA1_HUMAN)
SSFPTTINFV

SEQ ID NO: 47740 - protein, 9 aa, Artificial Sequence
  Description of Artificial Sequence: Synthetic peptide
  Seed: SARVRFFFP (MAGA1_HUMAN)
STRVRFFFR

SEQ ID NO: 47741 - protein, 9 aa, Artificial Sequence
  Description of Artificial Sequence: Synthetic peptide
  Seed: EALEAQQEA (MAGA1_HUMAN)
ETLEAQQEI

SEQ ID NO: 47742 - protein, 11 aa, Artificial Sequence
  Description of Artificial Sequence: Synthetic peptide
  Seed: EIFGKASESLQ (MAGA1_HUMAN)
EMFGKASESLR

SEQ ID NO: 47743 - protein, 9 aa, Artificial Sequence
  Description of Artificial Sequence: Synthetic peptide
  Seed: IMPKTGFLI (MAGA1_HUMAN)
ILPKTGFLW

SEQ ID NO: 47744 - protein, 9 aa, Artificial Sequence
  Description of Artificial Sequence: Synthetic peptide
  Seed: DSDPARYEF (MAGA1_HUMAN)
DQDPARYEY

SEQ ID NO: 47745 - protein, 10 aa, Artificial Sequence
  Description of Artificial Sequence: Synthetic peptide
  Seed: YVIKVSARVR (MAGA1_HUMAN)
YAIKVSARVK

SEQ ID NO: 47746 - protein, 9 aa, Artificial Sequence
  Description of Artificial Sequence: Synthetic peptide
  Seed: FFFPSLREA (MAGA1_HUMAN)
FQFPSLREV

SEQ ID NO: 47747 - protein, 9 aa, Artificial Sequence
  Description of Artificial Sequence: Synthetic peptide
  Seed: EADPTGHSY (MAGA1_HUMAN)
EIDPTGHSF

SEQ ID NO: 47748 - protein, 9 aa, Artificial Sequence
  Description of Artificial Sequence: Synthetic peptide
  Seed: LVQEKYLEY (MAGA1_HUMAN)
LKQEKYLEY

SEQ ID NO: 47749 - protein, 9 aa, Artificial Sequence
  Description of Artificial Sequence: Synthetic peptide
  Seed: RALAETSYV (MAGA1_HUMAN)
RSLAETSYM

SEQ ID NO: 47750 - protein, 10 aa, Artificial Sequence
  Description of Artificial Sequence: Synthetic peptide
  Seed: KVLEYVIKVS (MAGA1_HUMAN)
KLLEYVIKVW

SEQ ID NO: 47751 - protein, 9 aa, Artificial Sequence
  Description of Artificial Sequence: Synthetic peptide
  Seed: LVGFLLLKY (MAGA1_HUMAN)
LTGFLLLKW

SEQ ID NO: 47752 - protein, 10 aa, Artificial Sequence
  Description of Artificial Sequence: Synthetic peptide
  Seed: EVYDGREHSA (MAGA1_HUMAN)
ETYDGREHSK

SEQ ID NO: 47753 - protein, 9 aa, Artificial Sequence
  Description of Artificial Sequence: Synthetic peptide
  Seed: TKAEMLESV (MAGA1_HUMAN)
TQAEMLESV

SEQ ID NO: 47754 - protein, 9 aa, Artificial Sequence
  Description of Artificial Sequence: Synthetic peptide
  Seed: SAFPTTINF (MAGA1_HUMAN)
SAFPTTINK

SEQ ID NO: 47755 - protein, 10 aa, Artificial Sequence
  Description of Artificial Sequence: Synthetic peptide
  Seed: KNYKHCFPEI (MAGA1_HUMAN)
KWYKHCFPEL

SEQ ID NO: 47756 - protein, 11 aa, Artificial Sequence
  Description of Artificial Sequence: Synthetic peptide
  Seed: ELSVMEVYDGR (MAGA1_HUMAN)
EPSVMEVYDGR

SEQ ID NO: 47757 - protein, 11 aa, Artificial Sequence
  Description of Artificial Sequence: Synthetic peptide
  Seed: IKVSARVRFFF (MAGA1_HUMAN)
IGVSARVRFFW

SEQ ID NO: 47758 - protein, 9 aa, Artificial Sequence
  Description of Artificial Sequence: Synthetic peptide
  Seed: AQQEALGLV (MAGA1_HUMAN)
AQQEALGLF

SEQ ID NO: 47759 - protein, 10 aa, Artificial Sequence
  Description of Artificial Sequence: Synthetic peptide
  Seed: RALAETSYVK (MAGA1_HUMAN)
RLLAETSYVK

SEQ ID NO: 47760 - protein, 9 aa, Artificial Sequence
  Description of Artificial Sequence: Synthetic peptide
  Seed: RALAETSYV (MAGA1_HUMAN)
RSLAETSYF

SEQ ID NO: 47761 - protein, 9 aa, Artificial Sequence
  Description of Artificial Sequence: Synthetic peptide
  Seed: REEEGPSTS (MAGA1_HUMAN)
REEEGPSTC

SEQ ID NO: 47762 - protein, 10 aa, Artificial Sequence
  Description of Artificial Sequence: Synthetic peptide
  Seed: EYVIKVSARV (MAGA1_HUMAN)
EPVIKVSARV

SEQ ID NO: 47763 - protein, 10 aa, Artificial Sequence
  Description of Artificial Sequence: Synthetic peptide
  Seed: KASESLQLVF (MAGA1_HUMAN)
KCSESLQLVW

SEQ ID NO: 47764 - protein, 9 aa, Artificial Sequence
  Description of Artificial Sequence: Synthetic peptide
  Seed: RVRFFFPSL (MAGA1_HUMAN)
RSRFFFPSR

SEQ ID NO: 47765 - protein, 9 aa, Artificial Sequence
  Description of Artificial Sequence: Synthetic peptide
  Seed: KTGFLIIVL (MAGA1_HUMAN)
KQGFLIIVI

SEQ ID NO: 47766 - protein, 9 aa, Artificial Sequence
  Description of Artificial Sequence: Synthetic peptide
  Seed: RAREPVTKA (MAGA1_HUMAN)
RNREPVTKY

SEQ ID NO: 47767 - protein, 9 aa, Artificial Sequence
  Description of Artificial Sequence: Synthetic peptide
  Seed: AETSYVKVL (MAGA1_HUMAN)
AETSYVKVP

SEQ ID NO: 47768 - protein, 9 aa, Artificial Sequence
  Description of Artificial Sequence: Synthetic peptide
  Seed: SAFPTTINF (MAGA1_HUMAN)
SSFPTTINF

SEQ ID NO: 47769 - protein, 9 aa, Artificial Sequence
  Description of Artificial Sequence: Synthetic peptide
  Seed: AATSSSSPL (MAGA1_HUMAN)
ASTSSSSPF

SEQ ID NO: 47770 - protein, 9 aa, Artificial Sequence
  Description of Artificial Sequence: Synthetic peptide
  Seed: IKVSARVRF (MAGA1_HUMAN)
IMVSARVRY

SEQ ID NO: 47771 - protein, 10 aa, Artificial Sequence
  Description of Artificial Sequence: Synthetic peptide
  Seed: KEADPTGHSY (MAGA1_HUMAN)
KNADPTGHSW

SEQ ID NO: 47772 - protein, 9 aa, Artificial Sequence
  Description of Artificial Sequence: Synthetic peptide
  Seed: KVLEYVIKV (MAGA1_HUMAN)
KYLEYVIKL

SEQ ID NO: 47773 - protein, 10 aa, Artificial Sequence
  Description of Artificial Sequence: Synthetic peptide
  Seed: FLWGPRALAE (MAGA1_HUMAN)
FLWGPRALAS

SEQ ID NO: 47774 - protein, 9 aa, Artificial Sequence
  Description of Artificial Sequence: Synthetic peptide
  Seed: RVRFFFPSL (MAGA1_HUMAN)
RKRFFFPSL

SEQ ID NO: 47775 - protein, 9 aa, Artificial Sequence
  Description of Artificial Sequence: Synthetic peptide
  Seed: EELSVMEVY (MAGA1_HUMAN)
EELSVMEVI

SEQ ID NO: 47776 - protein, 9 aa, Artificial Sequence
  Description of Artificial Sequence: Synthetic peptide
  Seed: GHAPEEEIW (MAGA1_HUMAN)
GHAPEEEII

SEQ ID NO: 47777 - protein, 9 aa, Artificial Sequence
  Description of Artificial Sequence: Synthetic peptide
  Seed: STSCILESL (MAGA1_HUMAN)
SASCILESF

SEQ ID NO: 47778 - protein, 9 aa, Artificial Sequence
  Description of Artificial Sequence: Synthetic peptide
  Seed: EADPTGHSY (MAGA1_HUMAN)
EFDPTGHSL

SEQ ID NO: 47779 - protein, 10 aa, Artificial Sequence
  Description of Artificial Sequence: Synthetic peptide
  Seed: KVLEYVIKVS (MAGA1_HUMAN)
KILEYVIKVL

SEQ ID NO: 47780 - protein, 9 aa, Artificial Sequence
  Description of Artificial Sequence: Synthetic peptide
  Seed: AATSSSSPL (MAGA1_HUMAN)
AMTSSSSPL

SEQ ID NO: 47781 - protein, 9 aa, Artificial Sequence
  Description of Artificial Sequence: Synthetic peptide
  Seed: LVQEKYLEY (MAGA1_HUMAN)
LMQEKYLEK

SEQ ID NO: 47782 - protein, 8 aa, Artificial Sequence
  Description of Artificial Sequence: Synthetic peptide
  Seed: RALAETSY (MAGA1_HUMAN)
RQLAETSF

SEQ ID NO: 47783 - protein, 10 aa, Artificial Sequence
  Description of Artificial Sequence: Synthetic peptide
  Seed: KVADLVGFLL (MAGA1_HUMAN)
KQADLVGFLL

SEQ ID NO: 47784 - protein, 10 aa, Artificial Sequence
  Description of Artificial Sequence: Synthetic peptide
  Seed: HSAYGEPRKL (MAGA1_HUMAN)
HSAYGEPRKW

SEQ ID NO: 47785 - protein, 9 aa, Artificial Sequence
  Description of Artificial Sequence: Synthetic peptide
  Seed: KKVADLVGF (MAGA1_HUMAN)
KVVADLVGY

SEQ ID NO: 47786 - protein, 11 aa, Artificial Sequence
  Description of Artificial Sequence: Synthetic peptide
  Seed: ESLFRAVITKK (MAGA1_HUMAN)
ETLFRAVITKR

SEQ ID NO: 47787 - protein, 9 aa, Artificial Sequence
  Description of Artificial Sequence: Synthetic peptide
  Seed: GLVCVQAAT (MAGA1_HUMAN)
GIVCVQAAV

SEQ ID NO: 47788 - protein, 10 aa, Artificial Sequence
  Description of Artificial Sequence: Synthetic peptide
  Seed: TSYVKVLEYV (MAGA1_HUMAN)
TFYVKVLEYW

SEQ ID NO: 47789 - protein, 9 aa, Artificial Sequence
  Description of Artificial Sequence: Synthetic peptide
  Seed: TSYVKVLEY (MAGA1_HUMAN)
TFYVKVLEM

SEQ ID NO: 47790 - protein, 9 aa, Artificial Sequence
  Description of Artificial Sequence: Synthetic peptide
  Seed: ALAETSYVK (MAGA1_HUMAN)
AIAETSYVK

SEQ ID NO: 47791 - protein, 9 aa, Artificial Sequence
  Description of Artificial Sequence: Synthetic peptide
  Seed: RVRFFFPSL (MAGA1_HUMAN)
RQRFFFPSL

SEQ ID NO: 47792 - protein, 10 aa, Artificial Sequence
  Description of Artificial Sequence: Synthetic peptide
  Seed: RVRFFFPSLR (MAGA1_HUMAN)
RPRFFFPSLL

SEQ ID NO: 47793 - protein, 9 aa, Artificial Sequence
  Description of Artificial Sequence: Synthetic peptide
  Seed: AETSYVKVL (MAGA1_HUMAN)
ADTSYVKVM

SEQ ID NO: 47794 - protein, 11 aa, Artificial Sequence
  Description of Artificial Sequence: Synthetic peptide
  Seed: SLFRAVITKKV (MAGA1_HUMAN)
SMFRAVITKKV

SEQ ID NO: 47795 - protein, 10 aa, Artificial Sequence
  Description of Artificial Sequence: Synthetic peptide
  Seed: STSCILESLF (MAGA1_HUMAN)
SKSCILESLW

SEQ ID NO: 47796 - protein, 9 aa, Artificial Sequence
  Description of Artificial Sequence: Synthetic peptide
  Seed: VSARVRFFF (MAGA1_HUMAN)
VWARVRFFY

SEQ ID NO: 47797 - protein, 9 aa, Artificial Sequence
  Description of Artificial Sequence: Synthetic peptide
  Seed: IMPKTGFLI (MAGA1_HUMAN)
IVPKTGFLV

SEQ ID NO: 47798 - protein, 9 aa, Artificial Sequence
  Description of Artificial Sequence: Synthetic peptide
  Seed: RQVPDSDPA (MAGA1_HUMAN)
RVVPDSDPY

SEQ ID NO: 47799 - protein, 9 aa, Artificial Sequence
  Description of Artificial Sequence: Synthetic peptide
  Seed: RALAETSYV (MAGA1_HUMAN)
RTLAETSYL

SEQ ID NO: 47800 - protein, 9 aa, Artificial Sequence
  Description of Artificial Sequence: Synthetic peptide
  Seed: SYVKVLEYV (MAGA1_HUMAN)
SYVKVLEYM

SEQ ID NO: 47801 - protein, 9 aa, Artificial Sequence
  Description of Artificial Sequence: Synthetic peptide
  Seed: LVQEKYLEY (MAGA1_HUMAN)
LQQEKYLEM

SEQ ID NO: 47802 - protein, 11 aa, Artificial Sequence
  Description of Artificial Sequence: Synthetic peptide
  Seed: SARVRFFFPSL (MAGA1_HUMAN)
SPRVRFFFPSV

SEQ ID NO: 47803 - protein, 9 aa, Artificial Sequence
  Description of Artificial Sequence: Synthetic peptide
  Seed: TSSSSPLVL (MAGA1_HUMAN)
TDSSSPLVM

SEQ ID NO: 47804 - protein, 9 aa, Artificial Sequence
  Description of Artificial Sequence: Synthetic peptide
  Seed: VYDGREHSA (MAGA1_HUMAN)
VYDGREHSC

SEQ ID NO: 47805 - protein, 9 aa, Artificial Sequence
  Description of Artificial Sequence: Synthetic peptide
  Seed: SAFPTTINF (MAGA1_HUMAN)
SSFPTTINK

SEQ ID NO: 47806 - protein, 9 aa, Artificial Sequence
  Description of Artificial Sequence: Synthetic peptide
  Seed: RALAETSYV (MAGA1_HUMAN)
RVLAETSYA

SEQ ID NO: 47807 - protein, 9 aa, Artificial Sequence
  Description of Artificial Sequence: Synthetic peptide
  Seed: GASAFPTTI (MAGA1_HUMAN)
GQSAFPTTF

SEQ ID NO: 47808 - protein, 11 aa, Artificial Sequence
  Description of Artificial Sequence: Synthetic peptide
  Seed: RQVPDSDPARY (MAGA1_HUMAN)
RIVPDSDPARY

SEQ ID NO: 47809 - protein, 9 aa, Artificial Sequence
  Description of Artificial Sequence: Synthetic peptide
  Seed: YVLVTCLGL (MAGA1_HUMAN)
YMLVTCLGM

SEQ ID NO: 47810 - protein, 9 aa, Artificial Sequence
  Description of Artificial Sequence: Synthetic peptide
  Seed: ITKKVADLV (MAGA1_HUMAN)
ITKKVADLL

SEQ ID NO: 47811 - protein, 9 aa, Artificial Sequence
  Description of Artificial Sequence: Synthetic peptide
  Seed: LVQEKYLEY (MAGA1_HUMAN)
LAQEKYLEF

SEQ ID NO: 47812 - protein, 11 aa, Artificial Sequence
  Description of Artificial Sequence: Synthetic peptide
  Seed: FPTTINFTRQR (MAGA1_HUMAN)
FFTTINFTRQR

SEQ ID NO: 47813 - protein, 10 aa, Artificial Sequence
  Description of Artificial Sequence: Synthetic peptide
  Seed: FFFPSLREAA (MAGA1_HUMAN)
FLFPSLREAM

SEQ ID NO: 47814 - protein, 8 aa, Artificial Sequence
  Description of Artificial Sequence: Synthetic peptide
  Seed: SLQLVFGI (MAGA1_HUMAN)
SMQLVFGV

SEQ ID NO: 47815 - protein, 9 aa, Artificial Sequence
  Description of Artificial Sequence: Synthetic peptide
  Seed: RAREPVTKA (MAGA1_HUMAN)
RMREPVTKG

SEQ ID NO: 47816 - protein, 9 aa, Artificial Sequence
  Description of Artificial Sequence: Synthetic peptide
  Seed: HSYVLVTCL (MAGA1_HUMAN)
HAYVLVTCI

SEQ ID NO: 47817 - protein, 9 aa, Artificial Sequence
  Description of Artificial Sequence: Synthetic peptide
  Seed: TQDLVQEKY (MAGA1_HUMAN)
TADLVQEKV

SEQ ID NO: 47818 - protein, 10 aa, Artificial Sequence
  Description of Artificial Sequence: Synthetic peptide
  Seed: KVADLVGFLL (MAGA1_HUMAN)
KYADLVGFLY

SEQ ID NO: 47819 - protein, 10 aa, Artificial Sequence
  Description of Artificial Sequence: Synthetic peptide
  Seed: KVLEYVIKVS (MAGA1_HUMAN)
KMLEYVIKVW

SEQ ID NO: 47820 - protein, 10 aa, Artificial Sequence
  Description of Artificial Sequence: Synthetic peptide
  Seed: SAFPTTINFT (MAGA1_HUMAN)
SLFPTTINFM

SEQ ID NO: 47821 - protein, 10 aa, Artificial Sequence
  Description of Artificial Sequence: Synthetic peptide
  Seed: RVRFFFPSLR (MAGA1_HUMAN)
RVRFFFPSLY

SEQ ID NO: 47822 - protein, 11 aa, Artificial Sequence
  Description of Artificial Sequence: Synthetic peptide
  Seed: EMLESVIKNYK (MAGA1_HUMAN)
EALESVIKNYR

SEQ ID NO: 47823 - protein, 11 aa, Artificial Sequence
  Description of Artificial Sequence: Synthetic peptide
  Seed: EVYDGREHSAY (MAGA1_HUMAN)
ESYDGREHSAW

SEQ ID NO: 47824 - protein, 9 aa, Artificial Sequence
  Description of Artificial Sequence: Synthetic peptide
  Seed: SAFPTTINF (MAGA1_HUMAN)
SMFPTTINY

SEQ ID NO: 47825 - protein, 9 aa, Artificial Sequence
  Description of Artificial Sequence: Synthetic peptide
  Seed: VQEKYLEYR (MAGA1_HUMAN)
VYEKYLEYR

SEQ ID NO: 47826 - protein, 11 aa, Artificial Sequence
  Description of Artificial Sequence: Synthetic peptide
  Seed: STDPPQSPQGA (MAGA1_HUMAN)
SADPPQSPQGF

SEQ ID NO: 47827 - protein, 9 aa, Artificial Sequence
  Description of Artificial Sequence: Synthetic peptide
  Seed: YRAREPVTK (MAGA1_HUMAN)
YFAREPVTF

SEQ ID NO: 47828 - protein, 9 aa, Artificial Sequence
  Description of Artificial Sequence: Synthetic peptide
  Seed: YKHCFPEIF (MAGA1_HUMAN)
YRHCFPEIF

SEQ ID NO: 47829 - protein, 11 aa, Artificial Sequence
  Description of Artificial Sequence: Synthetic peptide
  Seed: RQVPDSDPARY (MAGA1_HUMAN)
RMVPDSDPARV

SEQ ID NO: 47830 - protein, 9 aa, Artificial Sequence
  Description of Artificial Sequence: Synthetic peptide
  Seed: RVRFFFPSL (MAGA1_HUMAN)
RFRFFFPSL

SEQ ID NO: 47831 - protein, 10 aa, Artificial Sequence
  Description of Artificial Sequence: Synthetic peptide
  Seed: FFPSLREAAL (MAGA1_HUMAN)
FDPSLREAAF

SEQ ID NO: 47832 - protein, 8 aa, Artificial Sequence
  Description of Artificial Sequence: Synthetic peptide
  Seed: SARVRFFF (MAGA1_HUMAN)
SVRVRFFL

SEQ ID NO: 47833 - protein, 9 aa, Artificial Sequence
  Description of Artificial Sequence: Synthetic peptide
  Seed: GKASESLQL (MAGA1_HUMAN)
GRASESLQF

SEQ ID NO: 47834 - protein, 9 aa, Artificial Sequence
  Description of Artificial Sequence: Synthetic peptide
  Seed: ETSYVKVLE (MAGA1_HUMAN)
EFSYVKVLR

SEQ ID NO: 47835 - protein, 10 aa, Artificial Sequence
  Description of Artificial Sequence: Synthetic peptide
  Seed: ARVRFFFPSL (MAGA1_HUMAN)
AKVRFFFPSL

SEQ ID NO: 47836 - protein, 11 aa, Artificial Sequence
  Description of Artificial Sequence: Synthetic peptide
  Seed: EVYDGREHSAY (MAGA1_HUMAN)
EVYDGREHSAF

SEQ ID NO: 47837 - protein, 10 aa, Artificial Sequence
  Description of Artificial Sequence: Synthetic peptide
  Seed: KVADLVGFLL (MAGA1_HUMAN)
KHADLVGFLW

SEQ ID NO: 47838 - protein, 10 aa, Artificial Sequence
  Description of Artificial Sequence: Synthetic peptide
  Seed: KVADLVGFLL (MAGA1_HUMAN)
KMADLVGFLE

SEQ ID NO: 47839 - protein, 9 aa, Artificial Sequence
  Description of Artificial Sequence: Synthetic peptide
  Seed: SARVRFFFP (MAGA1_HUMAN)
SFRVRFFFL

SEQ ID NO: 47840 - protein, 10 aa, Artificial Sequence
  Description of Artificial Sequence: Synthetic peptide
  Seed: ARYEFLWGPR (MAGA1_HUMAN)
ARYEFLWGPK

SEQ ID NO: 47841 - protein, 9 aa, Artificial Sequence
  Description of Artificial Sequence: Synthetic peptide
  Seed: KVLEYVIKV (MAGA1_HUMAN)
KRLEYVIKY

SEQ ID NO: 47842 - protein, 10 aa, Artificial Sequence
  Description of Artificial Sequence: Synthetic peptide
  Seed: DLVGFLLLKY (MAGA1_HUMAN)
DTVGFLLLKY

SEQ ID NO: 47843 - protein, 9 aa, Artificial Sequence
  Description of Artificial Sequence: Synthetic peptide
  Seed: LEEVPTAGS (MAGA1_HUMAN)
LEEVPTAGA

SEQ ID NO: 47844 - protein, 8 aa, Artificial Sequence
  Description of Artificial Sequence: Synthetic peptide
  Seed: RALAETSY (MAGA1_HUMAN)
RQLAETSY

SEQ ID NO: 47845 - protein, 10 aa, Artificial Sequence
  Description of Artificial Sequence: Synthetic peptide
  Seed: KVADLVGFLL (MAGA1_HUMAN)
KMADLVGFLI

SEQ ID NO: 47846 - protein, 9 aa, Artificial Sequence
  Description of Artificial Sequence: Synthetic peptide
  Seed: RVRFFFPSL (MAGA1_HUMAN)
RPRFFFPST

SEQ ID NO: 47847 - protein, 9 aa, Artificial Sequence
  Description of Artificial Sequence: Synthetic peptide
  Seed: SYVKVLEYV (MAGA1_HUMAN)
STVKVLEYM

SEQ ID NO: 47848 - protein, 9 aa, Artificial Sequence
  Description of Artificial Sequence: Synthetic peptide
  Seed: QSPQGASAF (MAGA1_HUMAN)
QYPQGASAL

SEQ ID NO: 47849 - protein, 9 aa, Artificial Sequence
  Description of Artificial Sequence: Synthetic peptide
  Seed: RVRFFFPSL (MAGA1_HUMAN)
RARFFFPSH

SEQ ID NO: 47850 - protein, 9 aa, Artificial Sequence
  Description of Artificial Sequence: Synthetic peptide
  Seed: STDPPQSPQ (MAGA1_HUMAN)
SLDPPQSPY

SEQ ID NO: 47851 - protein, 9 aa, Artificial Sequence
  Description of Artificial Sequence: Synthetic peptide
  Seed: TSYVKVLEY (MAGA1_HUMAN)
TMYVKVLEI

SEQ ID NO: 47852 - protein, 10 aa, Artificial Sequence
  Description of Artificial Sequence: Synthetic peptide
  Seed: KYRAREPVTK (MAGA1_HUMAN)
KLRAREPVTR

SEQ ID NO: 47853 - protein, 9 aa, Artificial Sequence
  Description of Artificial Sequence: Synthetic peptide
  Seed: RAREPVTKA (MAGA1_HUMAN)
RRREPVTKY

SEQ ID NO: 47854 - protein, 11 aa, Artificial Sequence
  Description of Artificial Sequence: Synthetic peptide
  Seed: RQVPDSDPARY (MAGA1_HUMAN)
RRVPDSDPARW

SEQ ID NO: 47855 - protein, 10 aa, Artificial Sequence
  Description of Artificial Sequence: Synthetic peptide
  Seed: YEFLWGPRAL (MAGA1_HUMAN)
YNFLWGPRAL

SEQ ID NO: 47856 - protein, 9 aa, Artificial Sequence
  Description of Artificial Sequence: Synthetic peptide
  Seed: RVRFFFPSL (MAGA1_HUMAN)
RWRFFFPSV

SEQ ID NO: 47857 - protein, 9 aa, Artificial Sequence
  Description of Artificial Sequence: Synthetic peptide
  Seed: AQQEALGLV (MAGA1_HUMAN)
AEQEALGLF

SEQ ID NO: 47858 - protein, 11 aa, Artificial Sequence
  Description of Artificial Sequence: Synthetic peptide
  Seed: KEADPTGHSYV (MAGA1_HUMAN)
KQADPTGHSYV

SEQ ID NO: 47859 - protein, 9 aa, Artificial Sequence
  Description of Artificial Sequence: Synthetic peptide
  Seed: EADPTGHSY (MAGA1_HUMAN)
ELDPTGHSM

SEQ ID NO: 47860 - protein, 11 aa, Artificial Sequence
  Description of Artificial Sequence: Synthetic peptide
  Seed: RVRFFFPSLRE (MAGA1_HUMAN)
RSRFFFPSLRS

SEQ ID NO: 47861 - protein, 8 aa, Artificial Sequence
  Description of Artificial Sequence: Synthetic peptide
  Seed: RVRFFFPS (MAGA1_HUMAN)
RTRFFFPV

SEQ ID NO: 47862 - protein, 10 aa, Artificial Sequence
  Description of Artificial Sequence: Synthetic peptide
  Seed: RVRFFFPSLR (MAGA1_HUMAN)
RYRFFFPSLQ

SEQ ID NO: 47863 - protein, 11 aa, Artificial Sequence
  Description of Artificial Sequence: Synthetic peptide
  Seed: ARVRFFFPSLR (MAGA1_HUMAN)
AVVRFFFPSLL

SEQ ID NO: 47864 - protein, 9 aa, Artificial Sequence
  Description of Artificial Sequence: Synthetic peptide
  Seed: YVIKVSARV (MAGA1_HUMAN)
YIIKVSARI

SEQ ID NO: 47865 - protein, 10 aa, Artificial Sequence
  Description of Artificial Sequence: Synthetic peptide
  Seed: KEADPTGHSY (MAGA1_HUMAN)
KSADPTGHSY

SEQ ID NO: 47866 - protein, 9 aa, Artificial Sequence
  Description of Artificial Sequence: Synthetic peptide
  Seed: QPSEGSSSR (MAGA1_HUMAN)
QTSEGSSSK

SEQ ID NO: 47867 - protein, 9 aa, Artificial Sequence
  Description of Artificial Sequence: Synthetic peptide
  Seed: QSPQGASAF (MAGA1_HUMAN)
QVPQGASAY

SEQ ID NO: 47868 - protein, 10 aa, Artificial Sequence
  Description of Artificial Sequence: Synthetic peptide
  Seed: ADLVGFLLLK (MAGA1_HUMAN)
ANLVGFLLLK

SEQ ID NO: 47869 - protein, 9 aa, Artificial Sequence
  Description of Artificial Sequence: Synthetic peptide
  Seed: RVRFFFPSL (MAGA1_HUMAN)
RTRFFFPSD

SEQ ID NO: 47870 - protein, 9 aa, Artificial Sequence
  Description of Artificial Sequence: Synthetic peptide
  Seed: SLFRAVITK (MAGA1_HUMAN)
SMFRAVITH

SEQ ID NO: 47871 - protein, 10 aa, Artificial Sequence
  Description of Artificial Sequence: Synthetic peptide
  Seed: SESLQLVFGI (MAGA1_HUMAN)
SYSLQLVFGW

SEQ ID NO: 47872 - protein, 9 aa, Artificial Sequence
  Description of Artificial Sequence: Synthetic peptide
  Seed: KVADLVGFL (MAGA1_HUMAN)
KTADLVGFR

SEQ ID NO: 47873 - protein, 10 aa, Artificial Sequence
  Description of Artificial Sequence: Synthetic peptide
  Seed: FPSLREAALR (MAGA1_HUMAN)
FASLREAALK

SEQ ID NO: 47874 - protein, 10 aa, Artificial Sequence
  Description of Artificial Sequence: Synthetic peptide
  Seed: KNYKHCFPEI (MAGA1_HUMAN)
KYYKHCFPEK

SEQ ID NO: 47875 - protein, 11 aa, Artificial Sequence
  Description of Artificial Sequence: Synthetic peptide
  Seed: KYRAREPVTKA (MAGA1_HUMAN)
KTRAREPVTKV

SEQ ID NO: 47876 - protein, 9 aa, Artificial Sequence
  Description of Artificial Sequence: Synthetic peptide
  Seed: LGDNQIMPK (MAGA1_HUMAN)
LSDNQIMPY

SEQ ID NO: 47877 - protein, 9 aa, Artificial Sequence
  Description of Artificial Sequence: Synthetic peptide
  Seed: TSYVKVLEY (MAGA1_HUMAN)
TNYVKVLEY

SEQ ID NO: 47878 - protein, 9 aa, Artificial Sequence
  Description of Artificial Sequence: Synthetic peptide
  Seed: RVRFFFPSL (MAGA1_HUMAN)
RQRFFFPSC

SEQ ID NO: 47879 - protein, 9 aa, Artificial Sequence
  Description of Artificial Sequence: Synthetic peptide
  Seed: KTGFLIIVL (MAGA1_HUMAN)
KAGFLIIVL

SEQ ID NO: 47880 - protein, 11 aa, Artificial Sequence
  Description of Artificial Sequence: Synthetic peptide
  Seed: RVRFFFPSLRE (MAGA1_HUMAN)
RVRFFFPSLRL

SEQ ID NO: 47881 - protein, 9 aa, Artificial Sequence
  Description of Artificial Sequence: Synthetic peptide
  Seed: SAFPTTINF (MAGA1_HUMAN)
SNFPTTINV

SEQ ID NO: 47882 - protein, 9 aa, Artificial Sequence
  Description of Artificial Sequence: Synthetic peptide
  Seed: TQDLVQEKY (MAGA1_HUMAN)
TIDLVQEKI

SEQ ID NO: 47883 - protein, 10 aa, Artificial Sequence
  Description of Artificial Sequence: Synthetic peptide
  Seed: KEADPTGHSY (MAGA1_HUMAN)
KRADPTGHSM

SEQ ID NO: 47884 - protein, 9 aa, Artificial Sequence
  Description of Artificial Sequence: Synthetic peptide
  Seed: KASESLQLV (MAGA1_HUMAN)
KRSESLQLY

SEQ ID NO: 47885 - protein, 10 aa, Artificial Sequence
  Description of Artificial Sequence: Synthetic peptide
  Seed: KKVADLVGFL (MAGA1_HUMAN)
KCVADLVGFV

SEQ ID NO: 47886 - protein, 10 aa, Artificial Sequence
  Description of Artificial Sequence: Synthetic peptide
  Seed: KNYKHCFPEI (MAGA1_HUMAN)
KHYKHCFPEK

SEQ ID NO: 47887 - protein, 9 aa, Artificial Sequence
  Description of Artificial Sequence: Synthetic peptide
  Seed: LVLGTLEEV (MAGA1_HUMAN)
LMLGTLEER

SEQ ID NO: 47888 - protein, 9 aa, Artificial Sequence
  Description of Artificial Sequence: Synthetic peptide
  Seed: QIMPKTGFL (MAGA1_HUMAN)
QIMPKTGFV

SEQ ID NO: 47889 - protein, 10 aa, Artificial Sequence
  Description of Artificial Sequence: Synthetic peptide
  Seed: SARVRFFFPS (MAGA1_HUMAN)
STRVRFFFPF

SEQ ID NO: 47890 - protein, 9 aa, Artificial Sequence
  Description of Artificial Sequence: Synthetic peptide
  Seed: ALAETSYVK (MAGA1_HUMAN)
ATAETSYVK

SEQ ID NO: 47891 - protein, 9 aa, Artificial Sequence
  Description of Artificial Sequence: Synthetic peptide
  Seed: YRAREPVTK (MAGA1_HUMAN)
YFAREPVTL

SEQ ID NO: 47892 - protein, 9 aa, Artificial Sequence
  Description of Artificial Sequence: Synthetic peptide
  Seed: NYKHCFPEI (MAGA1_HUMAN)
NYKHCFPEM

SEQ ID NO: 47893 - protein, 10 aa, Artificial Sequence
  Description of Artificial Sequence: Synthetic peptide
  Seed: SCILESLFRA (MAGA1_HUMAN)
SKILESLFRV

SEQ ID NO: 47894 - protein, 9 aa, Artificial Sequence
  Description of Artificial Sequence: Synthetic peptide
  Seed: KVSARVRFF (MAGA1_HUMAN)
KRSARVRFF

SEQ ID NO: 47895 - protein, 10 aa, Artificial Sequence
  Description of Artificial Sequence: Synthetic peptide
  Seed: RYEFLWGPRA (MAGA1_HUMAN)
RWEFLWGPRR

SEQ ID NO: 47896 - protein, 9 aa, Artificial Sequence
  Description of Artificial Sequence: Synthetic peptide
  Seed: RAREPVTKA (MAGA1_HUMAN)
RIREPVTKR

SEQ ID NO: 47897 - protein, 9 aa, Artificial Sequence
  Description of Artificial Sequence: Synthetic peptide
  Seed: SARVRFFFP (MAGA1_HUMAN)
SSRVRFFFH

SEQ ID NO: 47898 - protein, 9 aa, Artificial Sequence
  Description of Artificial Sequence: Synthetic peptide
  Seed: VSARVRFFF (MAGA1_HUMAN)
VWARVRFFW

SEQ ID NO: 47899 - protein, 9 aa, Artificial Sequence
  Description of Artificial Sequence: Synthetic peptide
  Seed: RALAETSYV (MAGA1_HUMAN)
RALAETSYK

SEQ ID NO: 47900 - protein, 9 aa, Artificial Sequence
  Description of Artificial Sequence: Synthetic peptide
  Seed: NYKHCFPEI (MAGA1_HUMAN)
NYKHCFPEF

SEQ ID NO: 47901 - protein, 10 aa, Artificial Sequence
  Description of Artificial Sequence: Synthetic peptide
  Seed: EVYDGREHSA (MAGA1_HUMAN)
EIYDGREHSL

SEQ ID NO: 47902 - protein, 9 aa, Artificial Sequence
  Description of Artificial Sequence: Synthetic peptide
  Seed: ETSYVKVLE (MAGA1_HUMAN)
ESSYVKVLK

SEQ ID NO: 47903 - protein, 11 aa, Artificial Sequence
  Description of Artificial Sequence: Synthetic peptide
  Seed: SARVRFFFPSL (MAGA1_HUMAN)
SMRVRFFFPSK

SEQ ID NO: 47904 - protein, 9 aa, Artificial Sequence
  Description of Artificial Sequence: Synthetic peptide
  Seed: SYVKVLEYV (MAGA1_HUMAN)
SQVKVLEYV

SEQ ID NO: 47905 - protein, 8 aa, Artificial Sequence
  Description of Artificial Sequence: Synthetic peptide
  Seed: RVRFFFPS (MAGA1_HUMAN)
RVRFFFPY

SEQ ID NO: 47906 - protein, 9 aa, Artificial Sequence
  Description of Artificial Sequence: Synthetic peptide
  Seed: MEGGHAPEE (MAGA1_HUMAN)
MEGGHAPEL

SEQ ID NO: 47907 - protein, 10 aa, Artificial Sequence
  Description of Artificial Sequence: Synthetic peptide
  Seed: RVRFFFPSLR (MAGA1_HUMAN)
RKRFFFPSLV

SEQ ID NO: 47908 - protein, 9 aa, Artificial Sequence
  Description of Artificial Sequence: Synthetic peptide
  Seed: YKHCFPEIF (MAGA1_HUMAN)
YQHCFPEIY

SEQ ID NO: 47909 - protein, 9 aa, Artificial Sequence
  Description of Artificial Sequence: Synthetic peptide
  Seed: VYDGREHSA (MAGA1_HUMAN)
VLDGREHSI

SEQ ID NO: 47910 - protein, 11 aa, Artificial Sequence
  Description of Artificial Sequence: Synthetic peptide
  Seed: KVLEYVIKVSA (MAGA1_HUMAN)
KLLEYVIKVSA

SEQ ID NO: 47911 - protein, 10 aa, Artificial Sequence
  Description of Artificial Sequence: Synthetic peptide
  Seed: AFPTTINFTR (MAGA1_HUMAN)
AMPTTINFTR

SEQ ID NO: 47912 - protein, 8 aa, Artificial Sequence
  Description of Artificial Sequence: Synthetic peptide
  Seed: FFPSLREA (MAGA1_HUMAN)
FFPSLREL

SEQ ID NO: 47913 - protein, 10 aa, Artificial Sequence
  Description of Artificial Sequence: Synthetic peptide
  Seed: RVRFFFPSLR (MAGA1_HUMAN)
RVRFFFPSLM

SEQ ID NO: 47914 - protein, 11 aa, Artificial Sequence
  Description of Artificial Sequence: Synthetic peptide
  Seed: ARVRFFFPSLR (MAGA1_HUMAN)
APVRFFFPSLL

SEQ ID NO: 47915 - protein, 9 aa, Artificial Sequence
  Description of Artificial Sequence: Synthetic peptide
  Seed: KASESLQLV (MAGA1_HUMAN)
KMSESLQLV

SEQ ID NO: 47916 - protein, 11 aa, Artificial Sequence
  Description of Artificial Sequence: Synthetic peptide
  Seed: VPDSDPARYEF (MAGA1_HUMAN)
VTDSDPARYEF

SEQ ID NO: 47917 - protein, 9 aa, Artificial Sequence
  Description of Artificial Sequence: Synthetic peptide
  Seed: FPSLREAAL (MAGA1_HUMAN)
FMSLREAAM

SEQ ID NO: 47918 - protein, 9 aa, Artificial Sequence
  Description of Artificial Sequence: Synthetic peptide
  Seed: TSSSSPLVL (MAGA1_HUMAN)
TGSSSPLVW

SEQ ID NO: 47919 - protein, 9 aa, Artificial Sequence
  Description of Artificial Sequence: Synthetic peptide
  Seed: VQEKYLEYR (MAGA1_HUMAN)
VMEKYLEYY

SEQ ID NO: 47920 - protein, 10 aa, Artificial Sequence
  Description of Artificial Sequence: Synthetic peptide
  Seed: RVRFFFPSLR (MAGA1_HUMAN)
RVRFFFPSLF

SEQ ID NO: 47921 - protein, 10 aa, Artificial Sequence
  Description of Artificial Sequence: Synthetic peptide
  Seed: SCILESLFRA (MAGA1_HUMAN)
STILESLFRI

SEQ ID NO: 47922 - protein, 9 aa, Artificial Sequence
  Description of Artificial Sequence: Synthetic peptide
  Seed: RQVPDSDPA (MAGA1_HUMAN)
RQVPDSDPW

SEQ ID NO: 47923 - protein, 10 aa, Artificial Sequence
  Description of Artificial Sequence: Synthetic peptide
  Seed: ARYEFLWGPR (MAGA1_HUMAN)
AQYEFLWGPK

SEQ ID NO: 47924 - protein, 10 aa, Artificial Sequence
  Description of Artificial Sequence: Synthetic peptide
  Seed: FFPSLREAAL (MAGA1_HUMAN)
FTPSLREAAF

SEQ ID NO: 47925 - protein, 9 aa, Artificial Sequence
  Description of Artificial Sequence: Synthetic peptide
  Seed: VGFLLLKYR (MAGA1_HUMAN)
VQFLLLKYR

SEQ ID NO: 47926 - protein, 10 aa, Artificial Sequence
  Description of Artificial Sequence: Synthetic peptide
  Seed: EYVIKVSARV (MAGA1_HUMAN)
ETVIKVSARI

SEQ ID NO: 47927 - protein, 9 aa, Artificial Sequence
  Description of Artificial Sequence: Synthetic peptide
  Seed: LAETSYVKV (MAGA1_HUMAN)
LAETSYVKL

SEQ ID NO: 47928 - protein, 9 aa, Artificial Sequence
  Description of Artificial Sequence: Synthetic peptide
  Seed: SSSPLVLGT (MAGA1_HUMAN)
SISPLVLGI

SEQ ID NO: 47929 - protein, 11 aa, Artificial Sequence
  Description of Artificial Sequence: Synthetic peptide
  Seed: AREPVTKAEML (MAGA1_HUMAN)
AHEPVTKAEML

SEQ ID NO: 47930 - protein, 9 aa, Artificial Sequence
  Description of Artificial Sequence: Synthetic peptide
  Seed: QIMPKTGFL (MAGA1_HUMAN)
QMMPKTGFA

SEQ ID NO: 47931 - protein, 10 aa, Artificial Sequence
  Description of Artificial Sequence: Synthetic peptide
  Seed: ARVRFFFPSL (MAGA1_HUMAN)
AVVRFFFPSK

SEQ ID NO: 47932 - protein, 9 aa, Artificial Sequence
  Description of Artificial Sequence: Synthetic peptide
  Seed: LKYRAREPV (MAGA1_HUMAN)
LAYRAREPF

SEQ ID NO: 47933 - protein, 11 aa, Artificial Sequence
  Description of Artificial Sequence: Synthetic peptide
  Seed: RVRFFFPSLRE (MAGA1_HUMAN)
RWRFFFPSLRR

SEQ ID NO: 47934 - protein, 9 aa, Artificial Sequence
  Description of Artificial Sequence: Synthetic peptide
  Seed: AATSSSSPL (MAGA1_HUMAN)
AFTSSSSPM

SEQ ID NO: 47935 - protein, 9 aa, Artificial Sequence
  Description of Artificial Sequence: Synthetic peptide
  Seed: EADPTGHSY (MAGA1_HUMAN)
EADPTGHSR

SEQ ID NO: 47936 - protein, 10 aa, Artificial Sequence
  Description of Artificial Sequence: Synthetic peptide
  Seed: SSSPLVLGTL (MAGA1_HUMAN)
SMSPLVLGTT

SEQ ID NO: 47937 - protein, 9 aa, Artificial Sequence
  Description of Artificial Sequence: Synthetic peptide
  Seed: LFRAVITKK (MAGA1_HUMAN)
LIRAVITKR

SEQ ID NO: 47938 - protein, 8 aa, Artificial Sequence
  Description of Artificial Sequence: Synthetic peptide
  Seed: RFFFPSLR (MAGA1_HUMAN)
RWFFPSLR

SEQ ID NO: 47939 - protein, 9 aa, Artificial Sequence
  Description of Artificial Sequence: Synthetic peptide
  Seed: STSCILESL (MAGA1_HUMAN)
SQSCILESF

SEQ ID NO: 47940 - protein, 9 aa, Artificial Sequence
  Description of Artificial Sequence: Synthetic peptide
  Seed: SARVRFFFP (MAGA1_HUMAN)
STRVRFFFT

SEQ ID NO: 47941 - protein, 9 aa, Artificial Sequence
  Description of Artificial Sequence: Synthetic peptide
  Seed: VADLVGFLL (MAGA1_HUMAN)
VVDLVGFLL

SEQ ID NO: 47942 - protein, 9 aa, Artificial Sequence
  Description of Artificial Sequence: Synthetic peptide
  Seed: SARVRFFFP (MAGA1_HUMAN)
SFRVRFFFV

SEQ ID NO: 47943 - protein, 9 aa, Artificial Sequence
  Description of Artificial Sequence: Synthetic peptide
  Seed: FFPSLREAA (MAGA1_HUMAN)
FFPSLREAF

SEQ ID NO: 47944 - protein, 9 aa, Artificial Sequence
  Description of Artificial Sequence: Synthetic peptide
  Seed: AQQEALGLV (MAGA1_HUMAN)
AIQEALGLL

SEQ ID NO: 47945 - protein, 10 aa, Artificial Sequence
  Description of Artificial Sequence: Synthetic peptide
  Seed: KVSARVRFFF (MAGA1_HUMAN)
KDSARVRFFY

SEQ ID NO: 47946 - protein, 9 aa, Artificial Sequence
  Description of Artificial Sequence: Synthetic peptide
  Seed: ALEAQQEAL (MAGA1_HUMAN)
AYEAQQEAL

SEQ ID NO: 47947 - protein, 9 aa, Artificial Sequence
  Description of Artificial Sequence: Synthetic peptide
  Seed: CILESLFRA (MAGA1_HUMAN)
CMLESLFRA

SEQ ID NO: 47948 - protein, 9 aa, Artificial Sequence
  Description of Artificial Sequence: Synthetic peptide
  Seed: VYDGREHSA (MAGA1_HUMAN)
VTDGREHSV

SEQ ID NO: 47949 - protein, 11 aa, Artificial Sequence
  Description of Artificial Sequence: Synthetic peptide
  Seed: ARVRFFFPSLR (MAGA1_HUMAN)
AIVRFFFPSLL

SEQ ID NO: 47950 - protein, 9 aa, Artificial Sequence
  Description of Artificial Sequence: Synthetic peptide
  Seed: TKAEMLESV (MAGA1_HUMAN)
TLAEMLESL

SEQ ID NO: 47951 - protein, 9 aa, Artificial Sequence
  Description of Artificial Sequence: Synthetic peptide
  Seed: SARVRFFFP (MAGA1_HUMAN)
SARVRFFFA

SEQ ID NO: 47952 - protein, 10 aa, Artificial Sequence
  Description of Artificial Sequence: Synthetic peptide
  Seed: RVRFFFPSLR (MAGA1_HUMAN)
RWRFFFPSLM

SEQ ID NO: 47953 - protein, 9 aa, Artificial Sequence
  Description of Artificial Sequence: Synthetic peptide
  Seed: STSCILESL (MAGA1_HUMAN)
SMSCILEST

SEQ ID NO: 47954 - protein, 9 aa, Artificial Sequence
  Description of Artificial Sequence: Synthetic peptide
  Seed: SSPLVLGTL (MAGA1_HUMAN)
SMPLVLGTY

SEQ ID NO: 47955 - protein, 9 aa, Artificial Sequence
  Description of Artificial Sequence: Synthetic peptide
  Seed: DLVGFLLLK (MAGA1_HUMAN)
DQVGFLLLR

SEQ ID NO: 47956 - protein, 9 aa, Artificial Sequence
  Description of Artificial Sequence: Synthetic peptide
  Seed: RVRFFFPSL (MAGA1_HUMAN)
RGRFFFPSF

SEQ ID NO: 47957 - protein, 9 aa, Artificial Sequence
  Description of Artificial Sequence: Synthetic peptide
  Seed: GLVCVQAAT (MAGA1_HUMAN)
GMVCVQAAV

SEQ ID NO: 47958 - protein, 10 aa, Artificial Sequence
  Description of Artificial Sequence: Synthetic peptide
  Seed: QIMPKTGFLI (MAGA1_HUMAN)
QMMPKTGFLI

SEQ ID NO: 47959 - protein, 10 aa, Artificial Sequence
  Description of Artificial Sequence: Synthetic peptide
  Seed: ALAETSYVKV (MAGA1_HUMAN)
AQAETSYVKM

SEQ ID NO: 47960 - protein, 9 aa, Artificial Sequence
  Description of Artificial Sequence: Synthetic peptide
  Seed: RYEFLWGPR (MAGA1_HUMAN)
RAEFLWGPR

SEQ ID NO: 47961 - protein, 10 aa, Artificial Sequence
  Description of Artificial Sequence: Synthetic peptide
  Seed: KVADLVGFLL (MAGA1_HUMAN)
KSADLVGFLM

SEQ ID NO: 47962 - protein, 9 aa, Artificial Sequence
  Description of Artificial Sequence: Synthetic peptide
  Seed: KYRAREPVT (MAGA1_HUMAN)
KIRAREPVY

SEQ ID NO: 47963 - protein, 9 aa, Artificial Sequence
  Description of Artificial Sequence: Synthetic peptide
  Seed: LKYRAREPV (MAGA1_HUMAN)
LLYRAREPF

SEQ ID NO: 47964 - protein, 10 aa, Artificial Sequence
  Description of Artificial Sequence: Synthetic peptide
  Seed: YEFLWGPRAL (MAGA1_HUMAN)
YNFLWGPRAF

SEQ ID NO: 47965 - protein, 9 aa, Artificial Sequence
  Description of Artificial Sequence: Synthetic peptide
  Seed: RVRFFFPSL (MAGA1_HUMAN)
RNRFFFPSF

SEQ ID NO: 47966 - protein, 10 aa, Artificial Sequence
  Description of Artificial Sequence: Synthetic peptide
  Seed: KEADPTGHSY (MAGA1_HUMAN)
KVADPTGHSY

SEQ ID NO: 47967 - protein, 10 aa, Artificial Sequence
  Description of Artificial Sequence: Synthetic peptide
  Seed: RVRFFFPSLR (MAGA1_HUMAN)
RWRFFFPSLI

SEQ ID NO: 47968 - protein, 9 aa, Artificial Sequence
  Description of Artificial Sequence: Synthetic peptide
  Seed: RVRFFFPSL (MAGA1_HUMAN)
RERFFFPSY

SEQ ID NO: 47969 - protein, 9 aa, Artificial Sequence
  Description of Artificial Sequence: Synthetic peptide
  Seed: KASESLQLV (MAGA1_HUMAN)
KNSESLQLL

SEQ ID NO: 47970 - protein, 10 aa, Artificial Sequence
  Description of Artificial Sequence: Synthetic peptide
  Seed: ATSSSSPLVL (MAGA1_HUMAN)
ATSSSSPLVY

SEQ ID NO: 47971 - protein, 11 aa, Artificial Sequence
  Description of Artificial Sequence: Synthetic peptide
  Seed: EMLESVIKNYK (MAGA1_HUMAN)
EFLESVIKNYR

SEQ ID NO: 47972 - protein, 9 aa, Artificial Sequence
  Description of Artificial Sequence: Synthetic peptide
  Seed: RAREPVTKA (MAGA1_HUMAN)
RFREPVTKF

SEQ ID NO: 47973 - protein, 9 aa, Artificial Sequence
  Description of Artificial Sequence: Synthetic peptide
  Seed: VPDSDPARY (MAGA1_HUMAN)
VIDSDPARY

SEQ ID NO: 47974 - protein, 11 aa, Artificial Sequence
  Description of Artificial Sequence: Synthetic peptide
  Seed: KVADLVGFLLL (MAGA1_HUMAN)
KLADLVGFLLR

SEQ ID NO: 47975 - protein, 11 aa, Artificial Sequence
  Description of Artificial Sequence: Synthetic peptide
  Seed: KVSARVRFFFP (MAGA1_HUMAN)
KFSARVRFFFK

SEQ ID NO: 47976 - protein, 9 aa, Artificial Sequence
  Description of Artificial Sequence: Synthetic peptide
  Seed: IAMEGGHAP (MAGA1_HUMAN)
ITMEGGHAV

SEQ ID NO: 47977 - protein, 9 aa, Artificial Sequence
  Description of Artificial Sequence: Synthetic peptide
  Seed: ALREEEEGV (MAGA1_HUMAN)
AQREEEEGI

SEQ ID NO: 47978 - protein, 9 aa, Artificial Sequence
  Description of Artificial Sequence: Synthetic peptide
  Seed: STSCILESL (MAGA1_HUMAN)
SLSCILESA

SEQ ID NO: 47979 - protein, 9 aa, Artificial Sequence
  Description of Artificial Sequence: Synthetic peptide
  Seed: RYEFLWGPR (MAGA1_HUMAN)
RIEFLWGPR

SEQ ID NO: 47980 - protein, 10 aa, Artificial Sequence
  Description of Artificial Sequence: Synthetic peptide
  Seed: SARVRFFFPS (MAGA1_HUMAN)
SVRVRFFFPK

SEQ ID NO: 47981 - protein, 10 aa, Artificial Sequence
  Description of Artificial Sequence: Synthetic peptide
  Seed: WEELSVMEVY (MAGA1_HUMAN)
WKELSVMEVW

SEQ ID NO: 47982 - protein, 10 aa, Artificial Sequence
  Description of Artificial Sequence: Synthetic peptide
  Seed: KEADPTGHSY (MAGA1_HUMAN)
KNADPTGHSY

SEQ ID NO: 47983 - protein, 11 aa, Artificial Sequence
  Description of Artificial Sequence: Synthetic peptide
  Seed: SSSSPLVLGTL (MAGA1_HUMAN)
STSSPLVLGTW

SEQ ID NO: 47984 - protein, 10 aa, Artificial Sequence
  Description of Artificial Sequence: Synthetic peptide
  Seed: RYEFLWGPRA (MAGA1_HUMAN)
RCEFLWGPRL

SEQ ID NO: 47985 - protein, 9 aa, Artificial Sequence
  Description of Artificial Sequence: Synthetic peptide
  Seed: VADLVGFLL (MAGA1_HUMAN)
VMDLVGFLM

SEQ ID NO: 47986 - protein, 10 aa, Artificial Sequence
  Description of Artificial Sequence: Synthetic peptide
  Seed: ETSYVKVLEY (MAGA1_HUMAN)
EVSYVKVLEK

SEQ ID NO: 47987 - protein, 9 aa, Artificial Sequence
  Description of Artificial Sequence: Synthetic peptide
  Seed: FRAVITKKV (MAGA1_HUMAN)
FRAVITKKM

SEQ ID NO: 47988 - protein, 10 aa, Artificial Sequence
  Description of Artificial Sequence: Synthetic peptide
  Seed: CILESLFRAV (MAGA1_HUMAN)
CMLESLFRAT

SEQ ID NO: 47989 - protein, 9 aa, Artificial Sequence
  Description of Artificial Sequence: Synthetic peptide
  Seed: FFFPSLREA (MAGA1_HUMAN)
FAFPSLREH

SEQ ID NO: 47990 - protein, 9 aa, Artificial Sequence
  Description of Artificial Sequence: Synthetic peptide
  Seed: LVQEKYLEY (MAGA1_HUMAN)
LIQEKYLEF

SEQ ID NO: 47991 - protein, 9 aa, Artificial Sequence
  Description of Artificial Sequence: Synthetic peptide
  Seed: KVLEYVIKV (MAGA1_HUMAN)
KQLEYVIKM

SEQ ID NO: 47992 - protein, 11 aa, Artificial Sequence
  Description of Artificial Sequence: Synthetic peptide
  Seed: YVKVLEYVIKV (MAGA1_HUMAN)
YLKVLEYVIKV

SEQ ID NO: 47993 - protein, 10 aa, Artificial Sequence
  Description of Artificial Sequence: Synthetic peptide
  Seed: ARVRFFFPSL (MAGA1_HUMAN)
AIVRFFFPSV

SEQ ID NO: 47994 - protein, 9 aa, Artificial Sequence
  Description of Artificial Sequence: Synthetic peptide
  Seed: FFFPSLREA (MAGA1_HUMAN)
FFFPSLREY

SEQ ID NO: 47995 - protein, 10 aa, Artificial Sequence
  Description of Artificial Sequence: Synthetic peptide
  Seed: ARVRFFFPSL (MAGA1_HUMAN)
ARVRFFFPSR

SEQ ID NO: 47996 - protein, 9 aa, Artificial Sequence
  Description of Artificial Sequence: Synthetic peptide
  Seed: SAYGEPRKL (MAGA1_HUMAN)
SYYGEPRKI

SEQ ID NO: 47997 - protein, 9 aa, Artificial Sequence
  Description of Artificial Sequence: Synthetic peptide
  Seed: MEGGHAPEE (MAGA1_HUMAN)
MEGGHAPEP

SEQ ID NO: 47998 - protein, 9 aa, Artificial Sequence
  Description of Artificial Sequence: Synthetic peptide
  Seed: FLIIVLVMI (MAGA1_HUMAN)
FLIIVLVMM

SEQ ID NO: 47999 - protein, 9 aa, Artificial Sequence
  Description of Artificial Sequence: Synthetic peptide
  Seed: RAREPVTKA (MAGA1_HUMAN)
RAREPVTKV

SEQ ID NO: 48000 - protein, 10 aa, Artificial Sequence
  Description of Artificial Sequence: Synthetic peptide
  Seed: SARVRFFFPS (MAGA1_HUMAN)
SPRVRFFFPY

SEQ ID NO: 48001 - protein, 11 aa, Artificial Sequence
  Description of Artificial Sequence: Synthetic peptide
  Seed: EVYDGREHSAY (MAGA1_HUMAN)
ESYDGREHSAK

SEQ ID NO: 48002 - protein, 9 aa, Artificial Sequence
  Description of Artificial Sequence: Synthetic peptide
  Seed: VYDGREHSA (MAGA1_HUMAN)
VCDGREHSV

SEQ ID NO: 48003 - protein, 9 aa, Artificial Sequence
  Description of Artificial Sequence: Synthetic peptide
  Seed: SARVRFFFP (MAGA1_HUMAN)
SARVRFFFL

SEQ ID NO: 48004 - protein, 9 aa, Artificial Sequence
  Description of Artificial Sequence: Synthetic peptide
  Seed: REAALREEE (MAGA1_HUMAN)
REAALREEI

SEQ ID NO: 48005 - protein, 9 aa, Artificial Sequence
  Description of Artificial Sequence: Synthetic peptide
  Seed: KVLEYVIKV (MAGA1_HUMAN)
KQLEYVIKW

SEQ ID NO: 48006 - protein, 9 aa, Artificial Sequence
  Description of Artificial Sequence: Synthetic peptide
  Seed: FPTTINFTR (MAGA1_HUMAN)
FQTTINFTR

SEQ ID NO: 48007 - protein, 10 aa, Artificial Sequence
  Description of Artificial Sequence: Synthetic peptide
  Seed: FFPSLREAAL (MAGA1_HUMAN)
FVPSLREAAY

SEQ ID NO: 48008 - protein, 10 aa, Artificial Sequence
  Description of Artificial Sequence: Synthetic peptide
  Seed: KYRAREPVTK (MAGA1_HUMAN)
KTRAREPVTT

SEQ ID NO: 48009 - protein, 10 aa, Artificial Sequence
  Description of Artificial Sequence: Synthetic peptide
  Seed: EVYDGREHSA (MAGA1_HUMAN)
EIYDGREHSF

SEQ ID NO: 48010 - protein, 10 aa, Artificial Sequence
  Description of Artificial Sequence: Synthetic peptide
  Seed: KVLEYVIKVS (MAGA1_HUMAN)
KLLEYVIKVV

SEQ ID NO: 48011 - protein, 10 aa, Artificial Sequence
  Description of Artificial Sequence: Synthetic peptide
  Seed: EVYDGREHSA (MAGA1_HUMAN)
ETYDGREHSY

SEQ ID NO: 48012 - protein, 9 aa, Artificial Sequence
  Description of Artificial Sequence: Synthetic peptide
  Seed: RVRFFFPSL (MAGA1_HUMAN)
RRRFFFPSF

SEQ ID NO: 48013 - protein, 9 aa, Artificial Sequence
  Description of Artificial Sequence: Synthetic peptide
  Seed: TSSSSPLVL (MAGA1_HUMAN)
TVSSSPLVW

SEQ ID NO: 48014 - protein, 9 aa, Artificial Sequence
  Description of Artificial Sequence: Synthetic peptide
  Seed: HSYVLVTCL (MAGA1_HUMAN)
HAYVLVTCL

SEQ ID NO: 48015 - protein, 9 aa, Artificial Sequence
  Description of Artificial Sequence: Synthetic peptide
  Seed: MLESVIKNY (MAGA1_HUMAN)
MVESVIKNY

SEQ ID NO: 48016 - protein, 10 aa, Artificial Sequence
  Description of Artificial Sequence: Synthetic peptide
  Seed: TSYVKVLEYV (MAGA1_HUMAN)
TMYVKVLEYI

SEQ ID NO: 48017 - protein, 9 aa, Artificial Sequence
  Description of Artificial Sequence: Synthetic peptide
  Seed: SLHCKPEEA (MAGA1_HUMAN)
SMHCKPEEL

SEQ ID NO: 48018 - protein, 10 aa, Artificial Sequence
  Description of Artificial Sequence: Synthetic peptide
  Seed: ARVRFFFPSL (MAGA1_HUMAN)
ARVRFFFPSA

SEQ ID NO: 48019 - protein, 10 aa, Artificial Sequence
  Description of Artificial Sequence: Synthetic peptide
  Seed: RVRFFFPSLR (MAGA1_HUMAN)
RSRFFFPSLP

SEQ ID NO: 48020 - protein, 11 aa, Artificial Sequence
  Description of Artificial Sequence: Synthetic peptide
  Seed: RVRFFFPSLRE (MAGA1_HUMAN)
RGRFFFPSLRK

SEQ ID NO: 48021 - protein, 9 aa, Artificial Sequence
  Description of Artificial Sequence: Synthetic peptide
  Seed: FFFPSLREA (MAGA1_HUMAN)
FVFPSLREI

SEQ ID NO: 48022 - protein, 9 aa, Artificial Sequence
  Description of Artificial Sequence: Synthetic peptide
  Seed: STDPPQSPQ (MAGA1_HUMAN)
SADPPQSPM

SEQ ID NO: 48023 - protein, 10 aa, Artificial Sequence
  Description of Artificial Sequence: Synthetic peptide
  Seed: LVGFLLLKYR (MAGA1_HUMAN)
LMGFLLLKYR

SEQ ID NO: 48024 - protein, 9 aa, Artificial Sequence
  Description of Artificial Sequence: Synthetic peptide
  Seed: EIWEELSVM (MAGA1_HUMAN)
EMWEELSVR

SEQ ID NO: 48025 - protein, 10 aa, Artificial Sequence
  Description of Artificial Sequence: Synthetic peptide
  Seed: KASESLQLVF (MAGA1_HUMAN)
KKSESLQLVY

SEQ ID NO: 48026 - protein, 9 aa, Artificial Sequence
  Description of Artificial Sequence: Synthetic peptide
  Seed: EELSVMEVY (MAGA1_HUMAN)
EELSVMEVW

SEQ ID NO: 48027 - protein, 10 aa, Artificial Sequence
  Description of Artificial Sequence: Synthetic peptide
  Seed: VLVTCLGLSY (MAGA1_HUMAN)
VMVTCLGLSF

SEQ ID NO: 48028 - protein, 9 aa, Artificial Sequence
  Description of Artificial Sequence: Synthetic peptide
  Seed: LKYRAREPV (MAGA1_HUMAN)
LEYRAREPF

SEQ ID NO: 48029 - protein, 9 aa, Artificial Sequence
  Description of Artificial Sequence: Synthetic peptide
  Seed: GASAFPTTI (MAGA1_HUMAN)
GRSAFPTTY

SEQ ID NO: 48030 - protein, 9 aa, Artificial Sequence
  Description of Artificial Sequence: Synthetic peptide
  Seed: QSPQGASAF (MAGA1_HUMAN)
QLPQGASAI

SEQ ID NO: 48031 - protein, 9 aa, Artificial Sequence
  Description of Artificial Sequence: Synthetic peptide
  Seed: TSYVKVLEY (MAGA1_HUMAN)
TAYVKVLEL

SEQ ID NO: 48032 - protein, 9 aa, Artificial Sequence
  Description of Artificial Sequence: Synthetic peptide
  Seed: SARVRFFFP (MAGA1_HUMAN)
SMRVRFFFK

SEQ ID NO: 48033 - protein, 9 aa, Artificial Sequence
  Description of Artificial Sequence: Synthetic peptide
  Seed: KVLEYVIKV (MAGA1_HUMAN)
KMLEYVIKK

SEQ ID NO: 48034 - protein, 10 aa, Artificial Sequence
  Description of Artificial Sequence: Synthetic peptide
  Seed: YEFLWGPRAL (MAGA1_HUMAN)
YQFLWGPRAA

SEQ ID NO: 48035 - protein, 9 aa, Artificial Sequence
  Description of Artificial Sequence: Synthetic peptide
  Seed: LKYRAREPV (MAGA1_HUMAN)
LHYRAREPY

SEQ ID NO: 48036 - protein, 10 aa, Artificial Sequence
  Description of Artificial Sequence: Synthetic peptide
  Seed: KNYKHCFPEI (MAGA1_HUMAN)
KTYKHCFPEY

SEQ ID NO: 48037 - protein, 9 aa, Artificial Sequence
  Description of Artificial Sequence: Synthetic peptide
  Seed: LTQDLVQEK (MAGA1_HUMAN)
LTQDLVQEY

SEQ ID NO: 48038 - protein, 11 aa, Artificial Sequence
  Description of Artificial Sequence: Synthetic peptide
  Seed: RAREPVTKAEM (MAGA1_HUMAN)
RPREPVTKAEL

SEQ ID NO: 48039 - protein, 10 aa, Artificial Sequence
  Description of Artificial Sequence: Synthetic peptide
  Seed: KVADLVGFLL (MAGA1_HUMAN)
KMADLVGFLS

SEQ ID NO: 48040 - protein, 9 aa, Artificial Sequence
  Description of Artificial Sequence: Synthetic peptide
  Seed: SAYGEPRKL (MAGA1_HUMAN)
SWYGEPRKY

SEQ ID NO: 48041 - protein, 9 aa, Artificial Sequence
  Description of Artificial Sequence: Synthetic peptide
  Seed: RVRFFFPSL (MAGA1_HUMAN)
RCRFFFPSA

SEQ ID NO: 48042 - protein, 9 aa, Artificial Sequence
  Description of Artificial Sequence: Synthetic peptide
  Seed: VYDGREHSA (MAGA1_HUMAN)
VADGREHSM

SEQ ID NO: 48043 - protein, 9 aa, Artificial Sequence
  Description of Artificial Sequence: Synthetic peptide
  Seed: KVADLVGFL (MAGA1_HUMAN)
KMADLVGFC

SEQ ID NO: 48044 - protein, 8 aa, Artificial Sequence
  Description of Artificial Sequence: Synthetic peptide
  Seed: FPSLREAA (MAGA1_HUMAN)
FPSLREAI

SEQ ID NO: 48045 - protein, 11 aa, Artificial Sequence
  Description of Artificial Sequence: Synthetic peptide
  Seed: KEADPTGHSYV (MAGA1_HUMAN)
KMADPTGHSYF

SEQ ID NO: 48046 - protein, 9 aa, Artificial Sequence
  Description of Artificial Sequence: Synthetic peptide
  Seed: EIWEELSVM (MAGA1_HUMAN)
EMWEELSVL

SEQ ID NO: 48047 - protein, 10 aa, Artificial Sequence
  Description of Artificial Sequence: Synthetic peptide
  Seed: ARVRFFFPSL (MAGA1_HUMAN)
AMVRFFFPSA

SEQ ID NO: 48048 - protein, 9 aa, Artificial Sequence
  Description of Artificial Sequence: Synthetic peptide
  Seed: RVRFFFPSL (MAGA1_HUMAN)
RSRFFFPSQ

SEQ ID NO: 48049 - protein, 10 aa, Artificial Sequence
  Description of Artificial Sequence: Synthetic peptide
  Seed: TSYVKVLEYV (MAGA1_HUMAN)
TNYVKVLEYF

SEQ ID NO: 48050 - protein, 9 aa, Artificial Sequence
  Description of Artificial Sequence: Synthetic peptide
  Seed: AQQEALGLV (MAGA1_HUMAN)
AVQEALGLL

SEQ ID NO: 48051 - protein, 10 aa, Artificial Sequence
  Description of Artificial Sequence: Synthetic peptide
  Seed: KEADPTGHSY (MAGA1_HUMAN)
KRADPTGHSI

SEQ ID NO: 48052 - protein, 9 aa, Artificial Sequence
  Description of Artificial Sequence: Synthetic peptide
  Seed: TQDLVQEKY (MAGA1_HUMAN)
TEDLVQEKW

SEQ ID NO: 48053 - protein, 11 aa, Artificial Sequence
  Description of Artificial Sequence: Synthetic peptide
  Seed: RQVPDSDPARY (MAGA1_HUMAN)
RRVPDSDPARL

SEQ ID NO: 48054 - protein, 9 aa, Artificial Sequence
  Description of Artificial Sequence: Synthetic peptide
  Seed: SLFRAVITK (MAGA1_HUMAN)
SLFRAVITY

SEQ ID NO: 48055 - protein, 9 aa, Artificial Sequence
  Description of Artificial Sequence: Synthetic peptide
  Seed: EEEGPSTSC (MAGA1_HUMAN)
EEEGPSTSY

SEQ ID NO: 48056 - protein, 9 aa, Artificial Sequence
  Description of Artificial Sequence: Synthetic peptide
  Seed: RAREPVTKA (MAGA1_HUMAN)
RLREPVTKL

SEQ ID NO: 48057 - protein, 9 aa, Artificial Sequence
  Description of Artificial Sequence: Synthetic peptide
  Seed: KKVADLVGF (MAGA1_HUMAN)
KKVADLVGY

SEQ ID NO: 48058 - protein, 9 aa, Artificial Sequence
  Description of Artificial Sequence: Synthetic peptide
  Seed: VQAATSSSS (MAGA1_HUMAN)
VQAATSSSI

SEQ ID NO: 48059 - protein, 9 aa, Artificial Sequence
  Description of Artificial Sequence: Synthetic peptide
  Seed: LVTCLGLSY (MAGA1_HUMAN)
LMTCLGLSM

SEQ ID NO: 48060 - protein, 9 aa, Artificial Sequence
  Description of Artificial Sequence: Synthetic peptide
  Seed: RVRFFFPSL (MAGA1_HUMAN)
RQRFFFPSI

SEQ ID NO: 48061 - protein, 9 aa, Artificial Sequence
  Description of Artificial Sequence: Synthetic peptide
  Seed: RAREPVTKA (MAGA1_HUMAN)
RVREPVTKA

SEQ ID NO: 48062 - protein, 10 aa, Artificial Sequence
  Description of Artificial Sequence: Synthetic peptide
  Seed: TSYVKVLEYV (MAGA1_HUMAN)
TTYVKVLEYW

SEQ ID NO: 48063 - protein, 9 aa, Artificial Sequence
  Description of Artificial Sequence: Synthetic peptide
  Seed: FLIIVLVMI (MAGA1_HUMAN)
FLIIVLVML

SEQ ID NO: 48064 - protein, 10 aa, Artificial Sequence
  Description of Artificial Sequence: Synthetic peptide
  Seed: STSCILESLF (MAGA1_HUMAN)
SESCILESLW

SEQ ID NO: 48065 - protein, 9 aa, Artificial Sequence
  Description of Artificial Sequence: Synthetic peptide
  Seed: VYDGREHSA (MAGA1_HUMAN)
VQDGREHSF

SEQ ID NO: 48066 - protein, 9 aa, Artificial Sequence
  Description of Artificial Sequence: Synthetic peptide
  Seed: LKYRAREPV (MAGA1_HUMAN)
LQYRAREPI

SEQ ID NO: 48067 - protein, 9 aa, Artificial Sequence
  Description of Artificial Sequence: Synthetic peptide
  Seed: FPTTINFTR (MAGA1_HUMAN)
FPTTINFTS

SEQ ID NO: 48068 - protein, 9 aa, Artificial Sequence
  Description of Artificial Sequence: Synthetic peptide
  Seed: YVIKVSARV (MAGA1_HUMAN)
YAIKVSARM

SEQ ID NO: 48069 - protein, 9 aa, Artificial Sequence
  Description of Artificial Sequence: Synthetic peptide
  Seed: FLIIVLVMI (MAGA1_HUMAN)
FMIIVLVMM

SEQ ID NO: 48070 - protein, 9 aa, Artificial Sequence
  Description of Artificial Sequence: Synthetic peptide
  Seed: ASESLQLVF (MAGA1_HUMAN)
AQESLQLVL

SEQ ID NO: 48071 - protein, 9 aa, Artificial Sequence
  Description of Artificial Sequence: Synthetic peptide
  Seed: SAFPTTINF (MAGA1_HUMAN)
SVFPTTINR

SEQ ID NO: 48072 - protein, 9 aa, Artificial Sequence
  Description of Artificial Sequence: Synthetic peptide
  Seed: CILESLFRA (MAGA1_HUMAN)
CMLESLFRC

SEQ ID NO: 48073 - protein, 9 aa, Artificial Sequence
  Description of Artificial Sequence: Synthetic peptide
  Seed: EADPTGHSY (MAGA1_HUMAN)
EVDPTGHSV

SEQ ID NO: 48074 - protein, 10 aa, Artificial Sequence
  Description of Artificial Sequence: Synthetic peptide
  Seed: ESLFRAVITK (MAGA1_HUMAN)
ERLFRAVITR

SEQ ID NO: 48075 - protein, 10 aa, Artificial Sequence
  Description of Artificial Sequence: Synthetic peptide
  Seed: KVSARVRFFF (MAGA1_HUMAN)
KLSARVRFFW

SEQ ID NO: 48076 - protein, 10 aa, Artificial Sequence
  Description of Artificial Sequence: Synthetic peptide
  Seed: EALEAQQEAL (MAGA1_HUMAN)
EILEAQQEAR

SEQ ID NO: 48077 - protein, 10 aa, Artificial Sequence
  Description of Artificial Sequence: Synthetic peptide
  Seed: SAFPTTINFT (MAGA1_HUMAN)
STFPTTINFF

SEQ ID NO: 48078 - protein, 10 aa, Artificial Sequence
  Description of Artificial Sequence: Synthetic peptide
  Seed: SPQGASAFPT (MAGA1_HUMAN)
SPQGASAFPF

SEQ ID NO: 48079 - protein, 9 aa, Artificial Sequence
  Description of Artificial Sequence: Synthetic peptide
  Seed: SLFRAVITK (MAGA1_HUMAN)
SMFRAVITY

SEQ ID NO: 48080 - protein, 11 aa, Artificial Sequence
  Description of Artificial Sequence: Synthetic peptide
  Seed: RVRFFFPSLRE (MAGA1_HUMAN)
RSRFFFPSLRA

SEQ ID NO: 48081 - protein, 10 aa, Artificial Sequence
  Description of Artificial Sequence: Synthetic peptide
  Seed: KEADPTGHSY (MAGA1_HUMAN)
KAADPTGHSF

SEQ ID NO: 48082 - protein, 11 aa, Artificial Sequence
  Description of Artificial Sequence: Synthetic peptide
  Seed: MPKTGFLIIVL (MAGA1_HUMAN)
MPKTGFLIIVA

SEQ ID NO: 48083 - protein, 9 aa, Artificial Sequence
  Description of Artificial Sequence: Synthetic peptide
  Seed: SARVRFFFP (MAGA1_HUMAN)
SFRVRFFFK

SEQ ID NO: 48084 - protein, 9 aa, Artificial Sequence
  Description of Artificial Sequence: Synthetic peptide
  Seed: RQVPDSDPA (MAGA1_HUMAN)
REVPDSDPP

SEQ ID NO: 48085 - protein, 9 aa, Artificial Sequence
  Description of Artificial Sequence: Synthetic peptide
  Seed: IAMEGGHAP (MAGA1_HUMAN)
IGMEGGHAV

SEQ ID NO: 48086 - protein, 9 aa, Artificial Sequence
  Description of Artificial Sequence: Synthetic peptide
  Seed: CILESLFRA (MAGA1_HUMAN)
CVLESLFRL

SEQ ID NO: 48087 - protein, 9 aa, Artificial Sequence
  Description of Artificial Sequence: Synthetic peptide
  Seed: HSYVLVTCL (MAGA1_HUMAN)
HTYVLVTCY

SEQ ID NO: 48088 - protein, 9 aa, Artificial Sequence
  Description of Artificial Sequence: Synthetic peptide
  Seed: TKAEMLESV (MAGA1_HUMAN)
TSAEMLESI

SEQ ID NO: 48089 - protein, 9 aa, Artificial Sequence
  Description of Artificial Sequence: Synthetic peptide
  Seed: RVRFFFPSL (MAGA1_HUMAN)
RVRFFFPSV

SEQ ID NO: 48090 - protein, 9 aa, Artificial Sequence
  Description of Artificial Sequence: Synthetic peptide
  Seed: QIMPKTGFL (MAGA1_HUMAN)
QAMPKTGFF

SEQ ID NO: 48091 - protein, 9 aa, Artificial Sequence
  Description of Artificial Sequence: Synthetic peptide
  Seed: STDPPQSPQ (MAGA1_HUMAN)
SVDPPQSPV

SEQ ID NO: 48092 - protein, 10 aa, Artificial Sequence
  Description of Artificial Sequence: Synthetic peptide
  Seed: SARVRFFFPS (MAGA1_HUMAN)
SNRVRFFFPI

SEQ ID NO: 48093 - protein, 9 aa, Artificial Sequence
  Description of Artificial Sequence: Synthetic peptide
  Seed: ATSSSSPLV (MAGA1_HUMAN)
AQSSSSPLL

SEQ ID NO: 48094 - protein, 9 aa, Artificial Sequence
  Description of Artificial Sequence: Synthetic peptide
  Seed: NQIMPKTGF (MAGA1_HUMAN)
NMIMPKTGY

SEQ ID NO: 48095 - protein, 9 aa, Artificial Sequence
  Description of Artificial Sequence: Synthetic peptide
  Seed: RVRFFFPSL (MAGA1_HUMAN)
RTRFFFPST

SEQ ID NO: 48096 - protein, 9 aa, Artificial Sequence
  Description of Artificial Sequence: Synthetic peptide
  Seed: RVRFFFPSL (MAGA1_HUMAN)
RSRFFFPSW

SEQ ID NO: 48097 - protein, 10 aa, Artificial Sequence
  Description of Artificial Sequence: Synthetic peptide
  Seed: SCILESLFRA (MAGA1_HUMAN)
SHILESLFRI

SEQ ID NO: 48098 - protein, 9 aa, Artificial Sequence
  Description of Artificial Sequence: Synthetic peptide
  Seed: EELSVMEVY (MAGA1_HUMAN)
EELSVMEVL

SEQ ID NO: 48099 - protein, 11 aa, Artificial Sequence
  Description of Artificial Sequence: Synthetic peptide
  Seed: ELSVMEVYDGR (MAGA1_HUMAN)
ERSVMEVYDGR

SEQ ID NO: 48100 - protein, 10 aa, Artificial Sequence
  Description of Artificial Sequence: Synthetic peptide
  Seed: EMLESVIKNY (MAGA1_HUMAN)
EILESVIKNK

SEQ ID NO: 48101 - protein, 10 aa, Artificial Sequence
  Description of Artificial Sequence: Synthetic peptide
  Seed: SCILESLFRA (MAGA1_HUMAN)
SNILESLFRV

SEQ ID NO: 48102 - protein, 10 aa, Artificial Sequence
  Description of Artificial Sequence: Synthetic peptide
  Seed: SCILESLFRA (MAGA1_HUMAN)
SQILESLFRA

SEQ ID NO: 48103 - protein, 10 aa, Artificial Sequence
  Description of Artificial Sequence: Synthetic peptide
  Seed: LTQDLVQEKY (MAGA1_HUMAN)
LFQDLVQEKY

SEQ ID NO: 48104 - protein, 9 aa, Artificial Sequence
  Description of Artificial Sequence: Synthetic peptide
  Seed: KVSARVRFF (MAGA1_HUMAN)
KTSARVRFK

SEQ ID NO: 48105 - protein, 9 aa, Artificial Sequence
  Description of Artificial Sequence: Synthetic peptide
  Seed: KVSARVRFF (MAGA1_HUMAN)
KLSARVRFW

SEQ ID NO: 48106 - protein, 9 aa, Artificial Sequence
  Description of Artificial Sequence: Synthetic peptide
  Seed: LHCKPEEAL (MAGA1_HUMAN)
LHCKPEEAM

SEQ ID NO: 48107 - protein, 9 aa, Artificial Sequence
  Description of Artificial Sequence: Synthetic peptide
  Seed: LVTCLGLSY (MAGA1_HUMAN)
LQTCLGLSL

SEQ ID NO: 48108 - protein, 9 aa, Artificial Sequence
  Description of Artificial Sequence: Synthetic peptide
  Seed: TKAEMLESV (MAGA1_HUMAN)
TLAEMLESM

SEQ ID NO: 48109 - protein, 9 aa, Artificial Sequence
  Description of Artificial Sequence: Synthetic peptide
  Seed: REEEGPSTS (MAGA1_HUMAN)
REEEGPSTL

SEQ ID NO: 48110 - protein, 10 aa, Artificial Sequence
  Description of Artificial Sequence: Synthetic peptide
  Seed: VTKAEMLESV (MAGA1_HUMAN)
VMKAEMLESL

SEQ ID NO: 48111 - protein, 9 aa, Artificial Sequence
  Description of Artificial Sequence: Synthetic peptide
  Seed: KVLEYVIKV (MAGA1_HUMAN)
KALEYVIKM

SEQ ID NO: 48112 - protein, 9 aa, Artificial Sequence
  Description of Artificial Sequence: Synthetic peptide
  Seed: GTLEEVPTA (MAGA1_HUMAN)
GMLEEVPTT

SEQ ID NO: 48113 - protein, 9 aa, Artificial Sequence
  Description of Artificial Sequence: Synthetic peptide
  Seed: RYEFLWGPR (MAGA1_HUMAN)
RTEFLWGPR

SEQ ID NO: 48114 - protein, 11 aa, Artificial Sequence
  Description of Artificial Sequence: Synthetic peptide
  Seed: YVKVLEYVIKV (MAGA1_HUMAN)
YGKVLEYVIKV

SEQ ID NO: 48115 - protein, 9 aa, Artificial Sequence
  Description of Artificial Sequence: Synthetic peptide
  Seed: SAYGEPRKL (MAGA1_HUMAN)
SFYGEPRKM

SEQ ID NO: 48116 - protein, 9 aa, Artificial Sequence
  Description of Artificial Sequence: Synthetic peptide
  Seed: FFFPSLREA (MAGA1_HUMAN)
FVFPSLREF

SEQ ID NO: 48117 - protein, 9 aa, Artificial Sequence
  Description of Artificial Sequence: Synthetic peptide
  Seed: SAFPTTINF (MAGA1_HUMAN)
SLFPTTINW

SEQ ID NO: 48118 - protein, 10 aa, Artificial Sequence
  Description of Artificial Sequence: Synthetic peptide
  Seed: YEFLWGPRAL (MAGA1_HUMAN)
YQFLWGPRAL

SEQ ID NO: 48119 - protein, 10 aa, Artificial Sequence
  Description of Artificial Sequence: Synthetic peptide
  Seed: FFPSLREAAL (MAGA1_HUMAN)
FVPSLREAAL

SEQ ID NO: 48120 - protein, 10 aa, Artificial Sequence
  Description of Artificial Sequence: Synthetic peptide
  Seed: RAREPVTKAE (MAGA1_HUMAN)
RSREPVTKAV

SEQ ID NO: 48121 - protein, 9 aa, Artificial Sequence
  Description of Artificial Sequence: Synthetic peptide
  Seed: RALAETSYV (MAGA1_HUMAN)
RILAETSYA

SEQ ID NO: 48122 - protein, 9 aa, Artificial Sequence
  Description of Artificial Sequence: Synthetic peptide
  Seed: ASESLQLVF (MAGA1_HUMAN)
AVESLQLVY

SEQ ID NO: 48123 - protein, 10 aa, Artificial Sequence
  Description of Artificial Sequence: Synthetic peptide
  Seed: SCILESLFRA (MAGA1_HUMAN)
SDILESLFRV

SEQ ID NO: 48124 - protein, 9 aa, Artificial Sequence
  Description of Artificial Sequence: Synthetic peptide
  Seed: LESLFRAVI (MAGA1_HUMAN)
LKSLFRAVM

SEQ ID NO: 48125 - protein, 9 aa, Artificial Sequence
  Description of Artificial Sequence: Synthetic peptide
  Seed: SAYGEPRKL (MAGA1_HUMAN)
SVYGEPRKW

SEQ ID NO: 48126 - protein, 9 aa, Artificial Sequence
  Description of Artificial Sequence: Synthetic peptide
  Seed: YVIKVSARV (MAGA1_HUMAN)
YMIKVSART

SEQ ID NO: 48127 - protein, 9 aa, Artificial Sequence
  Description of Artificial Sequence: Synthetic peptide
  Seed: TSSSSPLVL (MAGA1_HUMAN)
TASSSPLVI

SEQ ID NO: 48128 - protein, 9 aa, Artificial Sequence
  Description of Artificial Sequence: Synthetic peptide
  Seed: SAFPTTINF (MAGA1_HUMAN)
SMFPTTINV

SEQ ID NO: 48129 - protein, 11 aa, Artificial Sequence
  Description of Artificial Sequence: Synthetic peptide
  Seed: YEFLWGPRALA (MAGA1_HUMAN)
YFFLWGPRALL

SEQ ID NO: 48130 - protein, 9 aa, Artificial Sequence
  Description of Artificial Sequence: Synthetic peptide
  Seed: RQVPDSDPA (MAGA1_HUMAN)
RLVPDSDPA

SEQ ID NO: 48131 - protein, 9 aa, Artificial Sequence
  Description of Artificial Sequence: Synthetic peptide
  Seed: QSPQGASAF (MAGA1_HUMAN)
QWPQGASAF

SEQ ID NO: 48132 - protein, 9 aa, Artificial Sequence
  Description of Artificial Sequence: Synthetic peptide
  Seed: SARVRFFFP (MAGA1_HUMAN)
SIRVRFFFM

SEQ ID NO: 48133 - protein, 11 aa, Artificial Sequence
  Description of Artificial Sequence: Synthetic peptide
  Seed: ARVRFFFPSLR (MAGA1_HUMAN)
ALVRFFFPSLR

SEQ ID NO: 48134 - protein, 9 aa, Artificial Sequence
  Description of Artificial Sequence: Synthetic peptide
  Seed: SAYGEPRKL (MAGA1_HUMAN)
SMYGEPRKA

SEQ ID NO: 48135 - protein, 9 aa, Artificial Sequence
  Description of Artificial Sequence: Synthetic peptide
  Seed: EIWEELSVM (MAGA1_HUMAN)
EVWEELSVR

SEQ ID NO: 48136 - protein, 9 aa, Artificial Sequence
  Description of Artificial Sequence: Synthetic peptide
  Seed: AATSSSSPL (MAGA1_HUMAN)
AITSSSSPV

SEQ ID NO: 48137 - protein, 9 aa, Artificial Sequence
  Description of Artificial Sequence: Synthetic peptide
  Seed: FFFPSLREA (MAGA1_HUMAN)
FGFPSLREY

SEQ ID NO: 48138 - protein, 9 aa, Artificial Sequence
  Description of Artificial Sequence: Synthetic peptide
  Seed: YVLVTCLGL (MAGA1_HUMAN)
YQLVTCLGM

SEQ ID NO: 48139 - protein, 10 aa, Artificial Sequence
  Description of Artificial Sequence: Synthetic peptide
  Seed: ALAETSYVKV (MAGA1_HUMAN)
AQAETSYVKL

SEQ ID NO: 48140 - protein, 9 aa, Artificial Sequence
  Description of Artificial Sequence: Synthetic peptide
  Seed: RAREPVTKA (MAGA1_HUMAN)
RMREPVTKF

SEQ ID NO: 48141 - protein, 9 aa, Artificial Sequence
  Description of Artificial Sequence: Synthetic peptide
  Seed: VADLVGFLL (MAGA1_HUMAN)
VGDLVGFLV

SEQ ID NO: 48142 - protein, 10 aa, Artificial Sequence
  Description of Artificial Sequence: Synthetic peptide
  Seed: KEADPTGHSY (MAGA1_HUMAN)
KAADPTGHSW

SEQ ID NO: 48143 - protein, 10 aa, Artificial Sequence
  Description of Artificial Sequence: Synthetic peptide
  Seed: KNYKHCFPEI (MAGA1_HUMAN)
KSYKHCFPEV

SEQ ID NO: 48144 - protein, 9 aa, Artificial Sequence
  Description of Artificial Sequence: Synthetic peptide
  Seed: LVTCLGLSY (MAGA1_HUMAN)
LMTCLGLSY

SEQ ID NO: 48145 - protein, 9 aa, Artificial Sequence
  Description of Artificial Sequence: Synthetic peptide
  Seed: YVIKVSARV (MAGA1_HUMAN)
YVIKVSARA

SEQ ID NO: 48146 - protein, 9 aa, Artificial Sequence
  Description of Artificial Sequence: Synthetic peptide
  Seed: RVRFFFPSL (MAGA1_HUMAN)
RIRFFFPST

SEQ ID NO: 48147 - protein, 10 aa, Artificial Sequence
  Description of Artificial Sequence: Synthetic peptide
  Seed: SAFPTTINFT (MAGA1_HUMAN)
SMFPTTINFV

SEQ ID NO: 48148 - protein, 9 aa, Artificial Sequence
  Description of Artificial Sequence: Synthetic peptide
  Seed: RAREPVTKA (MAGA1_HUMAN)
RSREPVTKI

SEQ ID NO: 48149 - protein, 9 aa, Artificial Sequence
  Description of Artificial Sequence: Synthetic peptide
  Seed: SAFPTTINF (MAGA1_HUMAN)
SMFPTTINF

SEQ ID NO: 48150 - protein, 10 aa, Artificial Sequence
  Description of Artificial Sequence: Synthetic peptide
  Seed: TSYVKVLEYV (MAGA1_HUMAN)
TSYVKVLEYF

SEQ ID NO: 48151 - protein, 9 aa, Artificial Sequence
  Description of Artificial Sequence: Synthetic peptide
  Seed: VADLVGFLL (MAGA1_HUMAN)
VSDLVGFLV

SEQ ID NO: 48152 - protein, 11 aa, Artificial Sequence
  Description of Artificial Sequence: Synthetic peptide
  Seed: FPTTINFTRQR (MAGA1_HUMAN)
FTTTINFTRQR

SEQ ID NO: 48153 - protein, 9 aa, Artificial Sequence
  Description of Artificial Sequence: Synthetic peptide
  Seed: KYRAREPVT (MAGA1_HUMAN)
KFRAREPVV

SEQ ID NO: 48154 - protein, 9 aa, Artificial Sequence
  Description of Artificial Sequence: Synthetic peptide
  Seed: RQRQPSEGS (MAGA1_HUMAN)
RVRQPSEGM

SEQ ID NO: 48155 - protein, 9 aa, Artificial Sequence
  Description of Artificial Sequence: Synthetic peptide
  Seed: SAFPTTINF (MAGA1_HUMAN)
SWFPTTINI

SEQ ID NO: 48156 - protein, 9 aa, Artificial Sequence
  Description of Artificial Sequence: Synthetic peptide
  Seed: KVSARVRFF (MAGA1_HUMAN)
KISARVRFW

SEQ ID NO: 48157 - protein, 10 aa, Artificial Sequence
  Description of Artificial Sequence: Synthetic peptide
  Seed: TSYVKVLEYV (MAGA1_HUMAN)
TEYVKVLEYW

SEQ ID NO: 48158 - protein, 9 aa, Artificial Sequence
  Description of Artificial Sequence: Synthetic peptide
  Seed: EEEGPSTSC (MAGA1_HUMAN)
EEEGPSTSI

SEQ ID NO: 48159 - protein, 10 aa, Artificial Sequence
  Description of Artificial Sequence: Synthetic peptide
  Seed: KYRAREPVTK (MAGA1_HUMAN)
KFRAREPVTA

SEQ ID NO: 48160 - protein, 10 aa, Artificial Sequence
  Description of Artificial Sequence: Synthetic peptide
  Seed: ARYEFLWGPR (MAGA1_HUMAN)
AGYEFLWGPR

SEQ ID NO: 48161 - protein, 9 aa, Artificial Sequence
  Description of Artificial Sequence: Synthetic peptide
  Seed: SAFPTTINF (MAGA1_HUMAN)
SRFPTTINF

SEQ ID NO: 48162 - protein, 10 aa, Artificial Sequence
  Description of Artificial Sequence: Synthetic peptide
  Seed: FLWGPRALAE (MAGA1_HUMAN)
FVWGPRALAI

SEQ ID NO: 48163 - protein, 10 aa, Artificial Sequence
  Description of Artificial Sequence: Synthetic peptide
  Seed: SESLQLVFGI (MAGA1_HUMAN)
SDSLQLVFGW

SEQ ID NO: 48164 - protein, 9 aa, Artificial Sequence
  Description of Artificial Sequence: Synthetic peptide
  Seed: EEGPSTSCI (MAGA1_HUMAN)
EEGPSTSCW

SEQ ID NO: 48165 - protein, 9 aa, Artificial Sequence
  Description of Artificial Sequence: Synthetic peptide
  Seed: EIWEELSVM (MAGA1_HUMAN)
EAWEELSVV

SEQ ID NO: 48166 - protein, 11 aa, Artificial Sequence
  Description of Artificial Sequence: Synthetic peptide
  Seed: RQVPDSDPARY (MAGA1_HUMAN)
RMVPDSDPARI

SEQ ID NO: 48167 - protein, 9 aa, Artificial Sequence
  Description of Artificial Sequence: Synthetic peptide
  Seed: RAREPVTKA (MAGA1_HUMAN)
RVREPVTKF

SEQ ID NO: 48168 - protein, 9 aa, Artificial Sequence
  Description of Artificial Sequence: Synthetic peptide
  Seed: KASESLQLV (MAGA1_HUMAN)
KSSESLQLF

SEQ ID NO: 48169 - protein, 9 aa, Artificial Sequence
  Description of Artificial Sequence: Synthetic peptide
  Seed: TGFLIIVLV (MAGA1_HUMAN)
TPFLIIVLV

SEQ ID NO: 48170 - protein, 9 aa, Artificial Sequence
  Description of Artificial Sequence: Synthetic peptide
  Seed: FPTTINFTR (MAGA1_HUMAN)
FVTTINFTR

SEQ ID NO: 48171 - protein, 9 aa, Artificial Sequence
  Description of Artificial Sequence: Synthetic peptide
  Seed: KVADLVGFL (MAGA1_HUMAN)
KWADLVGFY

SEQ ID NO: 48172 - protein, 9 aa, Artificial Sequence
  Description of Artificial Sequence: Synthetic peptide
  Seed: SSPLVLGTL (MAGA1_HUMAN)
SIPLVLGTY

SEQ ID NO: 48173 - protein, 10 aa, Artificial Sequence
  Description of Artificial Sequence: Synthetic peptide
  Seed: KNYKHCFPEI (MAGA1_HUMAN)
KKYKHCFPEK

SEQ ID NO: 48174 - protein, 9 aa, Artificial Sequence
  Description of Artificial Sequence: Synthetic peptide
  Seed: AATSSSSPL (MAGA1_HUMAN)
AYTSSSSPY

SEQ ID NO: 48175 - protein, 9 aa, Artificial Sequence
  Description of Artificial Sequence: Synthetic peptide
  Seed: IFGKASESL (MAGA1_HUMAN)
IWGKASESF

SEQ ID NO: 48176 - protein, 9 aa, Artificial Sequence
  Description of Artificial Sequence: Synthetic peptide
  Seed: KKVADLVGF (MAGA1_HUMAN)
KMVADLVGY

SEQ ID NO: 48177 - protein, 9 aa, Artificial Sequence
  Description of Artificial Sequence: Synthetic peptide
  Seed: SAFPTTINF (MAGA1_HUMAN)
SPFPTTINL

SEQ ID NO: 48178 - protein, 11 aa, Artificial Sequence
  Description of Artificial Sequence: Synthetic peptide
  Seed: KYRAREPVTKA (MAGA1_HUMAN)
KTRAREPVTKK

SEQ ID NO: 48179 - protein, 10 aa, Artificial Sequence
  Description of Artificial Sequence: Synthetic peptide
  Seed: SSSPLVLGTL (MAGA1_HUMAN)
SVSPLVLGTA

SEQ ID NO: 48180 - protein, 9 aa, Artificial Sequence
  Description of Artificial Sequence: Synthetic peptide
  Seed: RAREPVTKA (MAGA1_HUMAN)
RLREPVTKK

SEQ ID NO: 48181 - protein, 11 aa, Artificial Sequence
  Description of Artificial Sequence: Synthetic peptide
  Seed: ELSVMEVYDGR (MAGA1_HUMAN)
EQSVMEVYDGR

SEQ ID NO: 48182 - protein, 9 aa, Artificial Sequence
  Description of Artificial Sequence: Synthetic peptide
  Seed: VYDGREHSA (MAGA1_HUMAN)
VRDGREHSY

SEQ ID NO: 48183 - protein, 9 aa, Artificial Sequence
  Description of Artificial Sequence: Synthetic peptide
  Seed: HSYVLVTCL (MAGA1_HUMAN)
HIYVLVTCF

SEQ ID NO: 48184 - protein, 11 aa, Artificial Sequence
  Description of Artificial Sequence: Synthetic peptide
  Seed: RVRFFFPSLRE (MAGA1_HUMAN)
RSRFFFPSLRI

SEQ ID NO: 48185 - protein, 11 aa, Artificial Sequence
  Description of Artificial Sequence: Synthetic peptide
  Seed: KVSARVRFFFP (MAGA1_HUMAN)
KNSARVRFFFK

SEQ ID NO: 48186 - protein, 10 aa, Artificial Sequence
  Description of Artificial Sequence: Synthetic peptide
  Seed: YEFLWGPRAL (MAGA1_HUMAN)
YTFLWGPRAL

SEQ ID NO: 48187 - protein, 10 aa, Artificial Sequence
  Description of Artificial Sequence: Synthetic peptide
  Seed: FLIIVLVMIA (MAGA1_HUMAN)
FMIIVLVMIV

SEQ ID NO: 48188 - protein, 11 aa, Artificial Sequence
  Description of Artificial Sequence: Synthetic peptide
  Seed: TKKVADLVGFL (MAGA1_HUMAN)
TFKVADLVGFV

SEQ ID NO: 48189 - protein, 10 aa, Artificial Sequence
  Description of Artificial Sequence: Synthetic peptide
  Seed: SSSPLVLGTL (MAGA1_HUMAN)
SISPLVLGTW

SEQ ID NO: 48190 - protein, 9 aa, Artificial Sequence
  Description of Artificial Sequence: Synthetic peptide
  Seed: FPTTINFTR (MAGA1_HUMAN)
FPTTINFTF

SEQ ID NO: 48191 - protein, 9 aa, Artificial Sequence
  Description of Artificial Sequence: Synthetic peptide
  Seed: YVIKVSARV (MAGA1_HUMAN)
YVIKVSARM

SEQ ID NO: 48192 - protein, 11 aa, Artificial Sequence
  Description of Artificial Sequence: Synthetic peptide
  Seed: RQVPDSDPARY (MAGA1_HUMAN)
RVVPDSDPARF

SEQ ID NO: 48193 - protein, 10 aa, Artificial Sequence
  Description of Artificial Sequence: Synthetic peptide
  Seed: EALEAQQEAL (MAGA1_HUMAN)
ETLEAQQEAR

SEQ ID NO: 48194 - protein, 10 aa, Artificial Sequence
  Description of Artificial Sequence: Synthetic peptide
  Seed: SYVLVTCLGL (MAGA1_HUMAN)
SWVLVTCLGF

SEQ ID NO: 48195 - protein, 9 aa, Artificial Sequence
  Description of Artificial Sequence: Synthetic peptide
  Seed: MSLEQRSLH (MAGA1_HUMAN)
MMLEQRSLK

SEQ ID NO: 48196 - protein, 9 aa, Artificial Sequence
  Description of Artificial Sequence: Synthetic peptide
  Seed: RQVPDSDPA (MAGA1_HUMAN)
RLVPDSDPY

SEQ ID NO: 48197 - protein, 9 aa, Artificial Sequence
  Description of Artificial Sequence: Synthetic peptide
  Seed: SAFPTTINF (MAGA1_HUMAN)
SNFPTTINF

SEQ ID NO: 48198 - protein, 9 aa, Artificial Sequence
  Description of Artificial Sequence: Synthetic peptide
  Seed: RVRFFFPSL (MAGA1_HUMAN)
RIRFFFPSY

SEQ ID NO: 48199 - protein, 9 aa, Artificial Sequence
  Description of Artificial Sequence: Synthetic peptide
  Seed: QIMPKTGFL (MAGA1_HUMAN)
QMMPKTGFY

SEQ ID NO: 48200 - protein, 11 aa, Artificial Sequence
  Description of Artificial Sequence: Synthetic peptide
  Seed: SAFPTTINFTR (MAGA1_HUMAN)
SLFPTTINFTK

SEQ ID NO: 48201 - protein, 9 aa, Artificial Sequence
  Description of Artificial Sequence: Synthetic peptide
  Seed: TQDLVQEKY (MAGA1_HUMAN)
TLDLVQEKM

SEQ ID NO: 48202 - protein, 9 aa, Artificial Sequence
  Description of Artificial Sequence: Synthetic peptide
  Seed: QPSEGSSSR (MAGA1_HUMAN)
QVSEGSSSK

SEQ ID NO: 48203 - protein, 9 aa, Artificial Sequence
  Description of Artificial Sequence: Synthetic peptide
  Seed: LVTCLGLSY (MAGA1_HUMAN)
LMTCLGLSF

SEQ ID NO: 48204 - protein, 9 aa, Artificial Sequence
  Description of Artificial Sequence: Synthetic peptide
  Seed: YDGREHSAY (MAGA1_HUMAN)
YQGREHSAF

SEQ ID NO: 48205 - protein, 10 aa, Artificial Sequence
  Description of Artificial Sequence: Synthetic peptide
  Seed: YVIKVSARVR (MAGA1_HUMAN)
YFIKVSARVR

SEQ ID NO: 48206 - protein, 9 aa, Artificial Sequence
  Description of Artificial Sequence: Synthetic peptide
  Seed: STDPPQSPQ (MAGA1_HUMAN)
SMDPPQSPY

SEQ ID NO: 48207 - protein, 9 aa, Artificial Sequence
  Description of Artificial Sequence: Synthetic peptide
  Seed: VYDGREHSA (MAGA1_HUMAN)
VDDGREHSL

SEQ ID NO: 48208 - protein, 9 aa, Artificial Sequence
  Description of Artificial Sequence: Synthetic peptide
  Seed: SAFPTTINF (MAGA1_HUMAN)
SWFPTTINL

SEQ ID NO: 48209 - protein, 10 aa, Artificial Sequence
  Description of Artificial Sequence: Synthetic peptide
  Seed: YVKVLEYVIK (MAGA1_HUMAN)
YTKVLEYVIR

SEQ ID NO: 48210 - protein, 8 aa, Artificial Sequence
  Description of Artificial Sequence: Synthetic peptide
  Seed: ALAETSYV (MAGA1_HUMAN)
AMAETSYV

SEQ ID NO: 48211 - protein, 9 aa, Artificial Sequence
  Description of Artificial Sequence: Synthetic peptide
  Seed: SLFRAVITK (MAGA1_HUMAN)
SQFRAVITR

SEQ ID NO: 48212 - protein, 9 aa, Artificial Sequence
  Description of Artificial Sequence: Synthetic peptide
  Seed: ASESLQLVF (MAGA1_HUMAN)
ASESLQLVY

SEQ ID NO: 48213 - protein, 9 aa, Artificial Sequence
  Description of Artificial Sequence: Synthetic peptide
  Seed: LVTCLGLSY (MAGA1_HUMAN)
LSTCLGLSY

SEQ ID NO: 48214 - protein, 10 aa, Artificial Sequence
  Description of Artificial Sequence: Synthetic peptide
  Seed: TSCILESLFR (MAGA1_HUMAN)
TACILESLFK

SEQ ID NO: 48215 - protein, 9 aa, Artificial Sequence
  Description of Artificial Sequence: Synthetic peptide
  Seed: HCFPEIFGK (MAGA1_HUMAN)
HFFPEIFGR

SEQ ID NO: 48216 - protein, 9 aa, Artificial Sequence
  Description of Artificial Sequence: Synthetic peptide
  Seed: MSLEQRSLH (MAGA1_HUMAN)
MLLEQRSLY

SEQ ID NO: 48217 - protein, 9 aa, Artificial Sequence
  Description of Artificial Sequence: Synthetic peptide
  Seed: FPSLREAAL (MAGA1_HUMAN)
FSSLREAAM

SEQ ID NO: 48218 - protein, 8 aa, Artificial Sequence
  Description of Artificial Sequence: Synthetic peptide
  Seed: SLQLVFGI (MAGA1_HUMAN)
SLQLVFGV

SEQ ID NO: 48219 - protein, 10 aa, Artificial Sequence
  Description of Artificial Sequence: Synthetic peptide
  Seed: FFPSLREAAL (MAGA1_HUMAN)
FEPSLREAAM

SEQ ID NO: 48220 - protein, 10 aa, Artificial Sequence
  Description of Artificial Sequence: Synthetic peptide
  Seed: YEFLWGPRAL (MAGA1_HUMAN)
YIFLWGPRAL

SEQ ID NO: 48221 - protein, 9 aa, Artificial Sequence
  Description of Artificial Sequence: Synthetic peptide
  Seed: EEVPTAGST (MAGA1_HUMAN)
EEVPTAGSM

SEQ ID NO: 48222 - protein, 9 aa, Artificial Sequence
  Description of Artificial Sequence: Synthetic peptide
  Seed: LTQDLVQEK (MAGA1_HUMAN)
LQQDLVQEL

SEQ ID NO: 48223 - protein, 10 aa, Artificial Sequence
  Description of Artificial Sequence: Synthetic peptide
  Seed: FPSLREAALR (MAGA1_HUMAN)
FPSLREAALF

SEQ ID NO: 48224 - protein, 10 aa, Artificial Sequence
  Description of Artificial Sequence: Synthetic peptide
  Seed: FLWGPRALAE (MAGA1_HUMAN)
FTWGPRALAV

SEQ ID NO: 48225 - protein, 9 aa, Artificial Sequence
  Description of Artificial Sequence: Synthetic peptide
  Seed: EHSAYGEPR (MAGA1_HUMAN)
EYSAYGEPR

SEQ ID NO: 48226 - protein, 10 aa, Artificial Sequence
  Description of Artificial Sequence: Synthetic peptide
  Seed: LTQDLVQEKY (MAGA1_HUMAN)
LSQDLVQEKF

SEQ ID NO: 48227 - protein, 9 aa, Artificial Sequence
  Description of Artificial Sequence: Synthetic peptide
  Seed: STSCILESL (MAGA1_HUMAN)
SQSCILESY

SEQ ID NO: 48228 - protein, 9 aa, Artificial Sequence
  Description of Artificial Sequence: Synthetic peptide
  Seed: AQQEALGLV (MAGA1_HUMAN)
AMQEALGLY

SEQ ID NO: 48229 - protein, 9 aa, Artificial Sequence
  Description of Artificial Sequence: Synthetic peptide
  Seed: AETSYVKVL (MAGA1_HUMAN)
AETSYVKVF

SEQ ID NO: 48230 - protein, 9 aa, Artificial Sequence
  Description of Artificial Sequence: Synthetic peptide
  Seed: EADPTGHSY (MAGA1_HUMAN)
EVDPTGHSL

SEQ ID NO: 48231 - protein, 9 aa, Artificial Sequence
  Description of Artificial Sequence: Synthetic peptide
  Seed: RVRFFFPSL (MAGA1_HUMAN)
RIRFFFPSA

SEQ ID NO: 48232 - protein, 9 aa, Artificial Sequence
  Description of Artificial Sequence: Synthetic peptide
  Seed: FPTTINFTR (MAGA1_HUMAN)
FPTTINFTM

SEQ ID NO: 48233 - protein, 10 aa, Artificial Sequence
  Description of Artificial Sequence: Synthetic peptide
  Seed: RVRFFFPSLR (MAGA1_HUMAN)
RARFFFPSLP

SEQ ID NO: 48234 - protein, 10 aa, Artificial Sequence
  Description of Artificial Sequence: Synthetic peptide
  Seed: TSYVKVLEYV (MAGA1_HUMAN)
TRYVKVLEYL

SEQ ID NO: 48235 - protein, 9 aa, Artificial Sequence
  Description of Artificial Sequence: Synthetic peptide
  Seed: KVSARVRFF (MAGA1_HUMAN)
KTSARVRFV

SEQ ID NO: 48236 - protein, 10 aa, Artificial Sequence
  Description of Artificial Sequence: Synthetic peptide
  Seed: ASAFPTTINF (MAGA1_HUMAN)
ARAFPTTINF

SEQ ID NO: 48237 - protein, 10 aa, Artificial Sequence
  Description of Artificial Sequence: Synthetic peptide
  Seed: KVADLVGFLL (MAGA1_HUMAN)
KTADLVGFLW

SEQ ID NO: 48238 - protein, 10 aa, Artificial Sequence
  Description of Artificial Sequence: Synthetic peptide
  Seed: SCILESLFRA (MAGA1_HUMAN)
SEILESLFRV

SEQ ID NO: 48239 - protein, 9 aa, Artificial Sequence
  Description of Artificial Sequence: Synthetic peptide
  Seed: TSYVKVLEY (MAGA1_HUMAN)
TQYVKVLEI

SEQ ID NO: 48240 - protein, 9 aa, Artificial Sequence
  Description of Artificial Sequence: Synthetic peptide
  Seed: QPSEGSSSR (MAGA1_HUMAN)
QMSEGSSSR

SEQ ID NO: 48241 - protein, 11 aa, Artificial Sequence
  Description of Artificial Sequence: Synthetic peptide
  Seed: STDPPQSPQGA (MAGA1_HUMAN)
SIDPPQSPQGF

SEQ ID NO: 48242 - protein, 9 aa, Artificial Sequence
  Description of Artificial Sequence: Synthetic peptide
  Seed: VYDGREHSA (MAGA1_HUMAN)
VIDGREHSL

SEQ ID NO: 48243 - protein, 10 aa, Artificial Sequence
  Description of Artificial Sequence: Synthetic peptide
  Seed: MLESVIKNYK (MAGA1_HUMAN)
MTESVIKNYK

SEQ ID NO: 48244 - protein, 9 aa, Artificial Sequence
  Description of Artificial Sequence: Synthetic peptide
  Seed: IMPKTGFLI (MAGA1_HUMAN)
IAPKTGFLL

SEQ ID NO: 48245 - protein, 9 aa, Artificial Sequence
  Description of Artificial Sequence: Synthetic peptide
  Seed: KVADLVGFL (MAGA1_HUMAN)
KIADLVGFI

SEQ ID NO: 48246 - protein, 9 aa, Artificial Sequence
  Description of Artificial Sequence: Synthetic peptide
  Seed: RVRFFFPSL (MAGA1_HUMAN)
RSRFFFPSV

SEQ ID NO: 48247 - protein, 9 aa, Artificial Sequence
  Description of Artificial Sequence: Synthetic peptide
  Seed: NQIMPKTGF (MAGA1_HUMAN)
NHIMPKTGI

SEQ ID NO: 48248 - protein, 9 aa, Artificial Sequence
  Description of Artificial Sequence: Synthetic peptide
  Seed: IMPKTGFLI (MAGA1_HUMAN)
IYPKTGFLI

SEQ ID NO: 48249 - protein, 9 aa, Artificial Sequence
  Description of Artificial Sequence: Synthetic peptide
  Seed: YDGREHSAY (MAGA1_HUMAN)
YMGREHSAY

SEQ ID NO: 48250 - protein, 9 aa, Artificial Sequence
  Description of Artificial Sequence: Synthetic peptide
  Seed: GTLEEVPTA (MAGA1_HUMAN)
GMLEEVPTM

SEQ ID NO: 48251 - protein, 9 aa, Artificial Sequence
  Description of Artificial Sequence: Synthetic peptide
  Seed: YVIKVSARV (MAGA1_HUMAN)
YQIKVSARL

SEQ ID NO: 48252 - protein, 9 aa, Artificial Sequence
  Description of Artificial Sequence: Synthetic peptide
  Seed: MSLEQRSLH (MAGA1_HUMAN)
MILEQRSLK

SEQ ID NO: 48253 - protein, 9 aa, Artificial Sequence
  Description of Artificial Sequence: Synthetic peptide
  Seed: KASESLQLV (MAGA1_HUMAN)
KLSESLQLL

SEQ ID NO: 48254 - protein, 8 aa, Artificial Sequence
  Description of Artificial Sequence: Synthetic peptide
  Seed: VADLVGFL (MAGA1_HUMAN)
VMDLVGFL

SEQ ID NO: 48255 - protein, 9 aa, Artificial Sequence
  Description of Artificial Sequence: Synthetic peptide
  Seed: STDPPQSPQ (MAGA1_HUMAN)
SSDPPQSPF

SEQ ID NO: 48256 - protein, 10 aa, Artificial Sequence
  Description of Artificial Sequence: Synthetic peptide
  Seed: RVRFFFPSLR (MAGA1_HUMAN)
RERFFFPSLI

SEQ ID NO: 48257 - protein, 10 aa, Artificial Sequence
  Description of Artificial Sequence: Synthetic peptide
  Seed: KASESLQLVF (MAGA1_HUMAN)
KNSESLQLVW

SEQ ID NO: 48258 - protein, 10 aa, Artificial Sequence
  Description of Artificial Sequence: Synthetic peptide
  Seed: FLWGPRALAE (MAGA1_HUMAN)
FLWGPRALAV

SEQ ID NO: 48259 - protein, 11 aa, Artificial Sequence
  Description of Artificial Sequence: Synthetic peptide
  Seed: RVRFFFPSLRE (MAGA1_HUMAN)
RMRFFFPSLRM

SEQ ID NO: 48260 - protein, 8 aa, Artificial Sequence
  Description of Artificial Sequence: Synthetic peptide
  Seed: LESLFRAV (MAGA1_HUMAN)
LESLFRAY

SEQ ID NO: 48261 - protein, 9 aa, Artificial Sequence
  Description of Artificial Sequence: Synthetic peptide
  Seed: MPKTGFLII (MAGA1_HUMAN)
MPKTGFLIY

SEQ ID NO: 48262 - protein, 9 aa, Artificial Sequence
  Description of Artificial Sequence: Synthetic peptide
  Seed: SAYGEPRKL (MAGA1_HUMAN)
SEYGEPRKL

SEQ ID NO: 48263 - protein, 9 aa, Artificial Sequence
  Description of Artificial Sequence: Synthetic peptide
  Seed: KYRAREPVT (MAGA1_HUMAN)
KGRAREPVK

SEQ ID NO: 48264 - protein, 9 aa, Artificial Sequence
  Description of Artificial Sequence: Synthetic peptide
  Seed: TKAEMLESV (MAGA1_HUMAN)
TIAEMLESV

SEQ ID NO: 48265 - protein, 9 aa, Artificial Sequence
  Description of Artificial Sequence: Synthetic peptide
  Seed: VQEKYLEYR (MAGA1_HUMAN)
VAEKYLEYY

SEQ ID NO: 48266 - protein, 11 aa, Artificial Sequence
  Description of Artificial Sequence: Synthetic peptide
  Seed: FLWGPRALAET (MAGA1_HUMAN)
FLWGPRALAEL

SEQ ID NO: 48267 - protein, 9 aa, Artificial Sequence
  Description of Artificial Sequence: Synthetic peptide
  Seed: VADLVGFLL (MAGA1_HUMAN)
VQDLVGFLM

SEQ ID NO: 48268 - protein, 10 aa, Artificial Sequence
  Description of Artificial Sequence: Synthetic peptide
  Seed: FFPSLREAAL (MAGA1_HUMAN)
FWPSLREAAF

SEQ ID NO: 48269 - protein, 9 aa, Artificial Sequence
  Description of Artificial Sequence: Synthetic peptide
  Seed: SAFPTTINF (MAGA1_HUMAN)
SKFPTTINY

SEQ ID NO: 48270 - protein, 9 aa, Artificial Sequence
  Description of Artificial Sequence: Synthetic peptide
  Seed: VSARVRFFF (MAGA1_HUMAN)
VYARVRFFW

SEQ ID NO: 48271 - protein, 10 aa, Artificial Sequence
  Description of Artificial Sequence: Synthetic peptide
  Seed: FFPSLREAAL (MAGA1_HUMAN)
FRPSLREAAF

SEQ ID NO: 48272 - protein, 10 aa, Artificial Sequence
  Description of Artificial Sequence: Synthetic peptide
  Seed: KVADLVGFLL (MAGA1_HUMAN)
KIADLVGFLW

SEQ ID NO: 48273 - protein, 10 aa, Artificial Sequence
  Description of Artificial Sequence: Synthetic peptide
  Seed: ARYEFLWGPR (MAGA1_HUMAN)
ARYEFLWGPL

SEQ ID NO: 48274 - protein, 9 aa, Artificial Sequence
  Description of Artificial Sequence: Synthetic peptide
  Seed: SAFPTTINF (MAGA1_HUMAN)
STFPTTINI

SEQ ID NO: 48275 - protein, 10 aa, Artificial Sequence
  Description of Artificial Sequence: Synthetic peptide
  Seed: TSYVKVLEYV (MAGA1_HUMAN)
TPYVKVLEYI

SEQ ID NO: 48276 - protein, 10 aa, Artificial Sequence
  Description of Artificial Sequence: Synthetic peptide
  Seed: EADPTGHSYV (MAGA1_HUMAN)
EVDPTGHSYL

SEQ ID NO: 48277 - protein, 9 aa, Artificial Sequence
  Description of Artificial Sequence: Synthetic peptide
  Seed: SAFPTTINF (MAGA1_HUMAN)
SVFPTTINH

SEQ ID NO: 48278 - protein, 11 aa, Artificial Sequence
  Description of Artificial Sequence: Synthetic peptide
  Seed: KVADLVGFLLL (MAGA1_HUMAN)
KLADLVGFLLW

SEQ ID NO: 48279 - protein, 9 aa, Artificial Sequence
  Description of Artificial Sequence: Synthetic peptide
  Seed: EADPTGHSY (MAGA1_HUMAN)
EVDPTGHSI

SEQ ID NO: 48280 - protein, 9 aa, Artificial Sequence
  Description of Artificial Sequence: Synthetic peptide
  Seed: QSPQGASAF (MAGA1_HUMAN)
QLPQGASAF

SEQ ID NO: 48281 - protein, 10 aa, Artificial Sequence
  Description of Artificial Sequence: Synthetic peptide
  Seed: KASESLQLVF (MAGA1_HUMAN)
KMSESLQLVM

SEQ ID NO: 48282 - protein, 9 aa, Artificial Sequence
  Description of Artificial Sequence: Synthetic peptide
  Seed: LEYRQVPDS (MAGA1_HUMAN)
LEYRQVPDI

SEQ ID NO: 48283 - protein, 9 aa, Artificial Sequence
  Description of Artificial Sequence: Synthetic peptide
  Seed: RVRFFFPSL (MAGA1_HUMAN)
RQRFFFPSK

SEQ ID NO: 48284 - protein, 9 aa, Artificial Sequence
  Description of Artificial Sequence: Synthetic peptide
  Seed: KTGFLIIVL (MAGA1_HUMAN)
KSGFLIIVM

SEQ ID NO: 48285 - protein, 9 aa, Artificial Sequence
  Description of Artificial Sequence: Synthetic peptide
  Seed: YVIKVSARV (MAGA1_HUMAN)
YSIKVSARI

SEQ ID NO: 48286 - protein, 9 aa, Artificial Sequence
  Description of Artificial Sequence: Synthetic peptide
  Seed: FLWGPRALA (MAGA1_HUMAN)
FLWGPRALM

SEQ ID NO: 48287 - protein, 9 aa, Artificial Sequence
  Description of Artificial Sequence: Synthetic peptide
  Seed: LEAQQEALG (MAGA1_HUMAN)
LEAQQEALV

SEQ ID NO: 48288 - protein, 9 aa, Artificial Sequence
  Description of Artificial Sequence: Synthetic peptide
  Seed: VYDGREHSA (MAGA1_HUMAN)
VFDGREHSY

SEQ ID NO: 48289 - protein, 9 aa, Artificial Sequence
  Description of Artificial Sequence: Synthetic peptide
  Seed: TSSSSPLVL (MAGA1_HUMAN)
TESSSPLVM

SEQ ID NO: 48290 - protein, 10 aa, Artificial Sequence
  Description of Artificial Sequence: Synthetic peptide
  Seed: RVRFFFPSLR (MAGA1_HUMAN)
RPRFFFPSLR

SEQ ID NO: 48291 - protein, 10 aa, Artificial Sequence
  Description of Artificial Sequence: Synthetic peptide
  Seed: DLVQEKYLEY (MAGA1_HUMAN)
DTVQEKYLEF

SEQ ID NO: 48292 - protein, 10 aa, Artificial Sequence
  Description of Artificial Sequence: Synthetic peptide
  Seed: SARVRFFFPS (MAGA1_HUMAN)
SCRVRFFFPM

SEQ ID NO: 48293 - protein, 10 aa, Artificial Sequence
  Description of Artificial Sequence: Synthetic peptide
  Seed: RVRFFFPSLR (MAGA1_HUMAN)
RNRFFFPSLH

SEQ ID NO: 48294 - protein, 9 aa, Artificial Sequence
  Description of Artificial Sequence: Synthetic peptide
  Seed: RQRQPSEGS (MAGA1_HUMAN)
RSRQPSEGM

SEQ ID NO: 48295 - protein, 9 aa, Artificial Sequence
  Description of Artificial Sequence: Synthetic peptide
  Seed: LVTCLGLSY (MAGA1_HUMAN)
LSTCLGLSI

SEQ ID NO: 48296 - protein, 9 aa, Artificial Sequence
  Description of Artificial Sequence: Synthetic peptide
  Seed: FPSLREAAL (MAGA1_HUMAN)
FPSLREAAM

SEQ ID NO: 48297 - protein, 9 aa, Artificial Sequence
  Description of Artificial Sequence: Synthetic peptide
  Seed: VYDGREHSA (MAGA1_HUMAN)
VMDGREHSI

SEQ ID NO: 48298 - protein, 9 aa, Artificial Sequence
  Description of Artificial Sequence: Synthetic peptide
  Seed: STDPPQSPQ (MAGA1_HUMAN)
SGDPPQSPM

SEQ ID NO: 48299 - protein, 11 aa, Artificial Sequence
  Description of Artificial Sequence: Synthetic peptide
  Seed: SVMEVYDGREH (MAGA1_HUMAN)
SAMEVYDGREY

SEQ ID NO: 48300 - protein, 10 aa, Artificial Sequence
  Description of Artificial Sequence: Synthetic peptide
  Seed: YEFLWGPRAL (MAGA1_HUMAN)
YNFLWGPRAY

SEQ ID NO: 48301 - protein, 11 aa, Artificial Sequence
  Description of Artificial Sequence: Synthetic peptide
  Seed: FLWGPRALAET (MAGA1_HUMAN)
FLWGPRALAEI

SEQ ID NO: 48302 - protein, 9 aa, Artificial Sequence
  Description of Artificial Sequence: Synthetic peptide
  Seed: KASESLQLV (MAGA1_HUMAN)
KNSESLQLW

SEQ ID NO: 48303 - protein, 9 aa, Artificial Sequence
  Description of Artificial Sequence: Synthetic peptide
  Seed: CILESLFRA (MAGA1_HUMAN)
CILESLFRI

SEQ ID NO: 48304 - protein, 9 aa, Artificial Sequence
  Description of Artificial Sequence: Synthetic peptide
  Seed: FFFPSLREA (MAGA1_HUMAN)
FSFPSLRET

SEQ ID NO: 48305 - protein, 10 aa, Artificial Sequence
  Description of Artificial Sequence: Synthetic peptide
  Seed: ADLVGFLLLK (MAGA1_HUMAN)
AYLVGFLLLK

SEQ ID NO: 48306 - protein, 9 aa, Artificial Sequence
  Description of Artificial Sequence: Synthetic peptide
  Seed: YVLVTCLGL (MAGA1_HUMAN)
YTLVTCLGI

SEQ ID NO: 48307 - protein, 8 aa, Artificial Sequence
  Description of Artificial Sequence: Synthetic peptide
  Seed: FLWGPRAL (MAGA1_HUMAN)
FYWGPRAY

SEQ ID NO: 48308 - protein, 10 aa, Artificial Sequence
  Description of Artificial Sequence: Synthetic peptide
  Seed: ADLVGFLLLK (MAGA1_HUMAN)
AILVGFLLLK

SEQ ID NO: 48309 - protein, 10 aa, Artificial Sequence
  Description of Artificial Sequence: Synthetic peptide
  Seed: KVSARVRFFF (MAGA1_HUMAN)
KPSARVRFFK

SEQ ID NO: 48310 - protein, 8 aa, Artificial Sequence
  Description of Artificial Sequence: Synthetic peptide
  Seed: HSYVLVTC (MAGA1_HUMAN)
HGYVLVTV

SEQ ID NO: 48311 - protein, 10 aa, Artificial Sequence
  Description of Artificial Sequence: Synthetic peptide
  Seed: ARVRFFFPSL (MAGA1_HUMAN)
ASVRFFFPSL

SEQ ID NO: 48312 - protein, 10 aa, Artificial Sequence
  Description of Artificial Sequence: Synthetic peptide
  Seed: SSSPLVLGTL (MAGA1_HUMAN)
STSPLVLGTA

SEQ ID NO: 48313 - protein, 10 aa, Artificial Sequence
  Description of Artificial Sequence: Synthetic peptide
  Seed: ADLVGFLLLK (MAGA1_HUMAN)
AQLVGFLLLR

SEQ ID NO: 48314 - protein, 9 aa, Artificial Sequence
  Description of Artificial Sequence: Synthetic peptide
  Seed: RVRFFFPSL (MAGA1_HUMAN)
RYRFFFPSN

SEQ ID NO: 48315 - protein, 8 aa, Artificial Sequence
  Description of Artificial Sequence: Synthetic peptide
  Seed: FLWGPRAL (MAGA1_HUMAN)
FWWGPRAM

SEQ ID NO: 48316 - protein, 9 aa, Artificial Sequence
  Description of Artificial Sequence: Synthetic peptide
  Seed: LVLGTLEEV (MAGA1_HUMAN)
LMLGTLEEV

SEQ ID NO: 48317 - protein, 9 aa, Artificial Sequence
  Description of Artificial Sequence: Synthetic peptide
  Seed: VQAATSSSS (MAGA1_HUMAN)
VLAATSSSM

SEQ ID NO: 48318 - protein, 9 aa, Artificial Sequence
  Description of Artificial Sequence: Synthetic peptide
  Seed: TKAEMLESV (MAGA1_HUMAN)
TRAEMLESY

SEQ ID NO: 48319 - protein, 9 aa, Artificial Sequence
  Description of Artificial Sequence: Synthetic peptide
  Seed: SYVKVLEYV (MAGA1_HUMAN)
SSVKVLEYI

SEQ ID NO: 48320 - protein, 9 aa, Artificial Sequence
  Description of Artificial Sequence: Synthetic peptide
  Seed: SAFPTTINF (MAGA1_HUMAN)
SNFPTTINW

SEQ ID NO: 48321 - protein, 10 aa, Artificial Sequence
  Description of Artificial Sequence: Synthetic peptide
  Seed: KYRAREPVTK (MAGA1_HUMAN)
KVRAREPVTR

SEQ ID NO: 48322 - protein, 10 aa, Artificial Sequence
  Description of Artificial Sequence: Synthetic peptide
  Seed: ATSSSSPLVL (MAGA1_HUMAN)
AVSSSSPLVY

SEQ ID NO: 48323 - protein, 11 aa, Artificial Sequence
  Description of Artificial Sequence: Synthetic peptide
  Seed: FGKASESLQLV (MAGA1_HUMAN)
FQKASESLQLV

SEQ ID NO: 48324 - protein, 11 aa, Artificial Sequence
  Description of Artificial Sequence: Synthetic peptide
  Seed: STDPPQSPQGA (MAGA1_HUMAN)
SADPPQSPQGM

SEQ ID NO: 48325 - protein, 9 aa, Artificial Sequence
  Description of Artificial Sequence: Synthetic peptide
  Seed: SSPLVLGTL (MAGA1_HUMAN)
SLPLVLGTA

SEQ ID NO: 48326 - protein, 9 aa, Artificial Sequence
  Description of Artificial Sequence: Synthetic peptide
  Seed: HSYVLVTCL (MAGA1_HUMAN)
HLYVLVTCF

SEQ ID NO: 48327 - protein, 9 aa, Artificial Sequence
  Description of Artificial Sequence: Synthetic peptide
  Seed: EEIWEELSV (MAGA1_HUMAN)
EEIWEELSM

SEQ ID NO: 48328 - protein, 9 aa, Artificial Sequence
  Description of Artificial Sequence: Synthetic peptide
  Seed: VYDGREHSA (MAGA1_HUMAN)
VWDGREHSV

SEQ ID NO: 48329 - protein, 10 aa, Artificial Sequence
  Description of Artificial Sequence: Synthetic peptide
  Seed: FFFPSLREAA (MAGA1_HUMAN)
FFFPSLREAM

SEQ ID NO: 48330 - protein, 10 aa, Artificial Sequence
  Description of Artificial Sequence: Synthetic peptide
  Seed: KKVADLVGFL (MAGA1_HUMAN)
KMVADLVGFL

SEQ ID NO: 48331 - protein, 9 aa, Artificial Sequence
  Description of Artificial Sequence: Synthetic peptide
  Seed: SARVRFFFP (MAGA1_HUMAN)
SARVRFFFG

SEQ ID NO: 48332 - protein, 10 aa, Artificial Sequence
  Description of Artificial Sequence: Synthetic peptide
  Seed: SARVRFFFPS (MAGA1_HUMAN)
SHRVRFFFPF

SEQ ID NO: 48333 - protein, 8 aa, Artificial Sequence
  Description of Artificial Sequence: Synthetic peptide
  Seed: VADLVGFL (MAGA1_HUMAN)
VSDLVGFL

SEQ ID NO: 48334 - protein, 9 aa, Artificial Sequence
  Description of Artificial Sequence: Synthetic peptide
  Seed: MPKTGFLII (MAGA1_HUMAN)
MQKTGFLIV

SEQ ID NO: 48335 - protein, 10 aa, Artificial Sequence
  Description of Artificial Sequence: Synthetic peptide
  Seed: KHCFPEIFGK (MAGA1_HUMAN)
KMCFPEIFGR

SEQ ID NO: 48336 - protein, 10 aa, Artificial Sequence
  Description of Artificial Sequence: Synthetic peptide
  Seed: SAYGEPRKLL (MAGA1_HUMAN)
SAYGEPRKLF

SEQ ID NO: 48337 - protein, 9 aa, Artificial Sequence
  Description of Artificial Sequence: Synthetic peptide
  Seed: RVRFFFPSL (MAGA1_HUMAN)
RSRFFFPSE

SEQ ID NO: 48338 - protein, 10 aa, Artificial Sequence
  Description of Artificial Sequence: Synthetic peptide
  Seed: KYRAREPVTK (MAGA1_HUMAN)
KSRAREPVTI

SEQ ID NO: 48339 - protein, 9 aa, Artificial Sequence
  Description of Artificial Sequence: Synthetic peptide
  Seed: STSCILESL (MAGA1_HUMAN)
SMSCILESV

SEQ ID NO: 48340 - protein, 10 aa, Artificial Sequence
  Description of Artificial Sequence: Synthetic peptide
  Seed: RVRFFFPSLR (MAGA1_HUMAN)
RWRFFFPSLF

SEQ ID NO: 48341 - protein, 9 aa, Artificial Sequence
  Description of Artificial Sequence: Synthetic peptide
  Seed: RAREPVTKA (MAGA1_HUMAN)
RSREPVTKK

SEQ ID NO: 48342 - protein, 9 aa, Artificial Sequence
  Description of Artificial Sequence: Synthetic peptide
  Seed: RVRFFFPSL (MAGA1_HUMAN)
RARFFFPSQ

SEQ ID NO: 48343 - protein, 10 aa, Artificial Sequence
  Description of Artificial Sequence: Synthetic peptide
  Seed: KYRAREPVTK (MAGA1_HUMAN)
KTRAREPVTS

SEQ ID NO: 48344 - protein, 11 aa, Artificial Sequence
  Description of Artificial Sequence: Synthetic peptide
  Seed: KVSARVRFFFP (MAGA1_HUMAN)
KVSARVRFFFK

SEQ ID NO: 48345 - protein, 10 aa, Artificial Sequence
  Description of Artificial Sequence: Synthetic peptide
  Seed: KVADLVGFLL (MAGA1_HUMAN)
KFADLVGFLW

SEQ ID NO: 48346 - protein, 9 aa, Artificial Sequence
  Description of Artificial Sequence: Synthetic peptide
  Seed: VADLVGFLL (MAGA1_HUMAN)
VSDLVGFLY

SEQ ID NO: 48347 - protein, 9 aa, Artificial Sequence
  Description of Artificial Sequence: Synthetic peptide
  Seed: ARYEFLWGP (MAGA1_HUMAN)
AQYEFLWGV

SEQ ID NO: 48348 - protein, 9 aa, Artificial Sequence
  Description of Artificial Sequence: Synthetic peptide
  Seed: RVRFFFPSL (MAGA1_HUMAN)
RIRFFFPSR

SEQ ID NO: 48349 - protein, 9 aa, Artificial Sequence
  Description of Artificial Sequence: Synthetic peptide
  Seed: SAYGEPRKL (MAGA1_HUMAN)
SIYGEPRKM

SEQ ID NO: 48350 - protein, 8 aa, Artificial Sequence
  Description of Artificial Sequence: Synthetic peptide
  Seed: AYGEPRKL (MAGA1_HUMAN)
AAGEPRKL

SEQ ID NO: 48351 - protein, 11 aa, Artificial Sequence
  Description of Artificial Sequence: Synthetic peptide
  Seed: TKKVADLVGFL (MAGA1_HUMAN)
TTKVADLVGFV

SEQ ID NO: 48352 - protein, 10 aa, Artificial Sequence
  Description of Artificial Sequence: Synthetic peptide
  Seed: SARVRFFFPS (MAGA1_HUMAN)
SGRVRFFFPM

SEQ ID NO: 48353 - protein, 9 aa, Artificial Sequence
  Description of Artificial Sequence: Synthetic peptide
  Seed: QSPQGASAF (MAGA1_HUMAN)
QMPQGASAY

SEQ ID NO: 48354 - protein, 9 aa, Artificial Sequence
  Description of Artificial Sequence: Synthetic peptide
  Seed: LTQDLVQEK (MAGA1_HUMAN)
LSQDLVQEM

SEQ ID NO: 48355 - protein, 10 aa, Artificial Sequence
  Description of Artificial Sequence: Synthetic peptide
  Seed: SCILESLFRA (MAGA1_HUMAN)
SGILESLFRV

SEQ ID NO: 48356 - protein, 9 aa, Artificial Sequence
  Description of Artificial Sequence: Synthetic peptide
  Seed: GASAFPTTI (MAGA1_HUMAN)
GASAFPTTW

SEQ ID NO: 48357 - protein, 10 aa, Artificial Sequence
  Description of Artificial Sequence: Synthetic peptide
  Seed: SCILESLFRA (MAGA1_HUMAN)
SLILESLFRT

SEQ ID NO: 48358 - protein, 10 aa, Artificial Sequence
  Description of Artificial Sequence: Synthetic peptide
  Seed: YEFLWGPRAL (MAGA1_HUMAN)
YDFLWGPRAL

SEQ ID NO: 48359 - protein, 9 aa, Artificial Sequence
  Description of Artificial Sequence: Synthetic peptide
  Seed: VITKKVADL (MAGA1_HUMAN)
VATKKVADL

SEQ ID NO: 48360 - protein, 11 aa, Artificial Sequence
  Description of Artificial Sequence: Synthetic peptide
  Seed: STSCILESLFR (MAGA1_HUMAN)
SISCILESLFR

SEQ ID NO: 48361 - protein, 9 aa, Artificial Sequence
  Description of Artificial Sequence: Synthetic peptide
  Seed: TSYVKVLEY (MAGA1_HUMAN)
TSYVKVLEW

SEQ ID NO: 48362 - protein, 9 aa, Artificial Sequence
  Description of Artificial Sequence: Synthetic peptide
  Seed: KYRAREPVT (MAGA1_HUMAN)
KARAREPVY

SEQ ID NO: 48363 - protein, 11 aa, Artificial Sequence
  Description of Artificial Sequence: Synthetic peptide
  Seed: STSCILESLFR (MAGA1_HUMAN)
SYSCILESLFR

SEQ ID NO: 48364 - protein, 9 aa, Artificial Sequence
  Description of Artificial Sequence: Synthetic peptide
  Seed: RQVPDSDPA (MAGA1_HUMAN)
RMVPDSDPA

SEQ ID NO: 48365 - protein, 9 aa, Artificial Sequence
  Description of Artificial Sequence: Synthetic peptide
  Seed: IMPKTGFLI (MAGA1_HUMAN)
IMPKTGFLW

SEQ ID NO: 48366 - protein, 10 aa, Artificial Sequence
  Description of Artificial Sequence: Synthetic peptide
  Seed: YEFLWGPRAL (MAGA1_HUMAN)
YGFLWGPRAL

SEQ ID NO: 48367 - protein, 9 aa, Artificial Sequence
  Description of Artificial Sequence: Synthetic peptide
  Seed: TQDLVQEKY (MAGA1_HUMAN)
TNDLVQEKL

SEQ ID NO: 48368 - protein, 9 aa, Artificial Sequence
  Description of Artificial Sequence: Synthetic peptide
  Seed: LKYRAREPV (MAGA1_HUMAN)
LQYRAREPV

SEQ ID NO: 48369 - protein, 10 aa, Artificial Sequence
  Description of Artificial Sequence: Synthetic peptide
  Seed: SYVLVTCLGL (MAGA1_HUMAN)
SYVLVTCLGF

SEQ ID NO: 48370 - protein, 9 aa, Artificial Sequence
  Description of Artificial Sequence: Synthetic peptide
  Seed: FFFPSLREA (MAGA1_HUMAN)
FTFPSLRET

SEQ ID NO: 48371 - protein, 9 aa, Artificial Sequence
  Description of Artificial Sequence: Synthetic peptide
  Seed: LVTCLGLSY (MAGA1_HUMAN)
LTTCLGLSL

SEQ ID NO: 48372 - protein, 9 aa, Artificial Sequence
  Description of Artificial Sequence: Synthetic peptide
  Seed: SARVRFFFP (MAGA1_HUMAN)
SGRVRFFFI

SEQ ID NO: 48373 - protein, 9 aa, Artificial Sequence
  Description of Artificial Sequence: Synthetic peptide
  Seed: QIMPKTGFL (MAGA1_HUMAN)
QTMPKTGFK

SEQ ID NO: 48374 - protein, 10 aa, Artificial Sequence
  Description of Artificial Sequence: Synthetic peptide
  Seed: SARVRFFFPS (MAGA1_HUMAN)
SWRVRFFFPM

SEQ ID NO: 48375 - protein, 9 aa, Artificial Sequence
  Description of Artificial Sequence: Synthetic peptide
  Seed: TTINFTRQR (MAGA1_HUMAN)
TVINFTRQR

SEQ ID NO: 48376 - protein, 10 aa, Artificial Sequence
  Description of Artificial Sequence: Synthetic peptide
  Seed: SARVRFFFPS (MAGA1_HUMAN)
SNRVRFFFPM

SEQ ID NO: 48377 - protein, 9 aa, Artificial Sequence
  Description of Artificial Sequence: Synthetic peptide
  Seed: MIAMEGGHA (MAGA1_HUMAN)
MMAMEGGHL

SEQ ID NO: 48378 - protein, 9 aa, Artificial Sequence
  Description of Artificial Sequence: Synthetic peptide
  Seed: LFRAVITKK (MAGA1_HUMAN)
LIRAVITKK

SEQ ID NO: 48379 - protein, 9 aa, Artificial Sequence
  Description of Artificial Sequence: Synthetic peptide
  Seed: AETSYVKVL (MAGA1_HUMAN)
AETSYVKVA

SEQ ID NO: 48380 - protein, 9 aa, Artificial Sequence
  Description of Artificial Sequence: Synthetic peptide
  Seed: SAFPTTINF (MAGA1_HUMAN)
SFFPTTINV

SEQ ID NO: 48381 - protein, 10 aa, Artificial Sequence
  Description of Artificial Sequence: Synthetic peptide
  Seed: FPSLREAALR (MAGA1_HUMAN)
FASLREAALR

SEQ ID NO: 48382 - protein, 10 aa, Artificial Sequence
  Description of Artificial Sequence: Synthetic peptide
  Seed: ARVRFFFPSL (MAGA1_HUMAN)
AYVRFFFPSV

SEQ ID NO: 48383 - protein, 9 aa, Artificial Sequence
  Description of Artificial Sequence: Synthetic peptide
  Seed: VYDGREHSA (MAGA1_HUMAN)
VYDGREHSI

SEQ ID NO: 48384 - protein, 10 aa, Artificial Sequence
  Description of Artificial Sequence: Synthetic peptide
  Seed: SCILESLFRA (MAGA1_HUMAN)
SMILESLFRT

SEQ ID NO: 48385 - protein, 9 aa, Artificial Sequence
  Description of Artificial Sequence: Synthetic peptide
  Seed: IMPKTGFLI (MAGA1_HUMAN)
IYPKTGFLF

SEQ ID NO: 48386 - protein, 9 aa, Artificial Sequence
  Description of Artificial Sequence: Synthetic peptide
  Seed: LVLGTLEEV (MAGA1_HUMAN)
LTLGTLEEL

SEQ ID NO: 48387 - protein, 9 aa, Artificial Sequence
  Description of Artificial Sequence: Synthetic peptide
  Seed: RALAETSYV (MAGA1_HUMAN)
RTLAETSYY

SEQ ID NO: 48388 - protein, 9 aa, Artificial Sequence
  Description of Artificial Sequence: Synthetic peptide
  Seed: STDPPQSPQ (MAGA1_HUMAN)
SQDPPQSPF

SEQ ID NO: 48389 - protein, 9 aa, Artificial Sequence
  Description of Artificial Sequence: Synthetic peptide
  Seed: SAFPTTINF (MAGA1_HUMAN)
SQFPTTINV

SEQ ID NO: 48390 - protein, 9 aa, Artificial Sequence
  Description of Artificial Sequence: Synthetic peptide
  Seed: TKAEMLESV (MAGA1_HUMAN)
THAEMLEST

SEQ ID NO: 48391 - protein, 9 aa, Artificial Sequence
  Description of Artificial Sequence: Synthetic peptide
  Seed: SYVKVLEYV (MAGA1_HUMAN)
SMVKVLEYA

SEQ ID NO: 48392 - protein, 10 aa, Artificial Sequence
  Description of Artificial Sequence: Synthetic peptide
  Seed: SCILESLFRA (MAGA1_HUMAN)
STILESLFRL

SEQ ID NO: 48393 - protein, 9 aa, Artificial Sequence
  Description of Artificial Sequence: Synthetic peptide
  Seed: TKAEMLESV (MAGA1_HUMAN)
TRAEMLESV

SEQ ID NO: 48394 - protein, 9 aa, Artificial Sequence
  Description of Artificial Sequence: Synthetic peptide
  Seed: NQIMPKTGF (MAGA1_HUMAN)
NAIMPKTGF

SEQ ID NO: 48395 - protein, 9 aa, Artificial Sequence
  Description of Artificial Sequence: Synthetic peptide
  Seed: STDPPQSPQ (MAGA1_HUMAN)
SSDPPQSPL

SEQ ID NO: 48396 - protein, 9 aa, Artificial Sequence
  Description of Artificial Sequence: Synthetic peptide
  Seed: TQDLVQEKY (MAGA1_HUMAN)
TGDLVQEKM

SEQ ID NO: 48397 - protein, 9 aa, Artificial Sequence
  Description of Artificial Sequence: Synthetic peptide
  Seed: KVLEYVIKV (MAGA1_HUMAN)
KRLEYVIKV

SEQ ID NO: 48398 - protein, 9 aa, Artificial Sequence
  Description of Artificial Sequence: Synthetic peptide
  Seed: IKVSARVRF (MAGA1_HUMAN)
ISVSARVRF

SEQ ID NO: 48399 - protein, 10 aa, Artificial Sequence
  Description of Artificial Sequence: Synthetic peptide
  Seed: LVQEKYLEYR (MAGA1_HUMAN)
LIQEKYLEYR

SEQ ID NO: 48400 - protein, 11 aa, Artificial Sequence
  Description of Artificial Sequence: Synthetic peptide
  Seed: RALAETSYVKV (MAGA1_HUMAN)
RLLAETSYVKV

SEQ ID NO: 48401 - protein, 11 aa, Artificial Sequence
  Description of Artificial Sequence: Synthetic peptide
  Seed: RVRFFFPSLRE (MAGA1_HUMAN)
RFRFFFPSLRW

SEQ ID NO: 48402 - protein, 9 aa, Artificial Sequence
  Description of Artificial Sequence: Synthetic peptide
  Seed: TQDLVQEKY (MAGA1_HUMAN)
TFDLVQEKI

SEQ ID NO: 48403 - protein, 11 aa, Artificial Sequence
  Description of Artificial Sequence: Synthetic peptide
  Seed: KLLTQDLVQEK (MAGA1_HUMAN)
KVLTQDLVQER

SEQ ID NO: 48404 - protein, 9 aa, Artificial Sequence
  Description of Artificial Sequence: Synthetic peptide
  Seed: FFFPSLREA (MAGA1_HUMAN)
FSFPSLREC

SEQ ID NO: 48405 - protein, 9 aa, Artificial Sequence
  Description of Artificial Sequence: Synthetic peptide
  Seed: SARVRFFFP (MAGA1_HUMAN)
SVRVRFFFV

SEQ ID NO: 48406 - protein, 11 aa, Artificial Sequence
  Description of Artificial Sequence: Synthetic peptide
  Seed: STDPPQSPQGA (MAGA1_HUMAN)
SMDPPQSPQGF

SEQ ID NO: 48407 - protein, 9 aa, Artificial Sequence
  Description of Artificial Sequence: Synthetic peptide
  Seed: QIMPKTGFL (MAGA1_HUMAN)
QMMPKTGFK

SEQ ID NO: 48408 - protein, 9 aa, Artificial Sequence
  Description of Artificial Sequence: Synthetic peptide
  Seed: HSYVLVTCL (MAGA1_HUMAN)
HSYVLVTCF

SEQ ID NO: 48409 - protein, 10 aa, Artificial Sequence
  Description of Artificial Sequence: Synthetic peptide
  Seed: VIKVSARVRF (MAGA1_HUMAN)
VQKVSARVRF

SEQ ID NO: 48410 - protein, 11 aa, Artificial Sequence
  Description of Artificial Sequence: Synthetic peptide
  Seed: STDPPQSPQGA (MAGA1_HUMAN)
SSDPPQSPQGV

SEQ ID NO: 48411 - protein, 9 aa, Artificial Sequence
  Description of Artificial Sequence: Synthetic peptide
  Seed: LTQDLVQEK (MAGA1_HUMAN)
LVQDLVQEF

SEQ ID NO: 48412 - protein, 9 aa, Artificial Sequence
  Description of Artificial Sequence: Synthetic peptide
  Seed: MSLEQRSLH (MAGA1_HUMAN)
MALEQRSLK

SEQ ID NO: 48413 - protein, 9 aa, Artificial Sequence
  Description of Artificial Sequence: Synthetic peptide
  Seed: YKHCFPEIF (MAGA1_HUMAN)
YQHCFPEIL

SEQ ID NO: 48414 - protein, 9 aa, Artificial Sequence
  Description of Artificial Sequence: Synthetic peptide
  Seed: REAALREEE (MAGA1_HUMAN)
REAALREEF

SEQ ID NO: 48415 - protein, 9 aa, Artificial Sequence
  Description of Artificial Sequence: Synthetic peptide
  Seed: AETSYVKVL (MAGA1_HUMAN)
ADTSYVKVL

SEQ ID NO: 48416 - protein, 9 aa, Artificial Sequence
  Description of Artificial Sequence: Synthetic peptide
  Seed: EADPTGHSY (MAGA1_HUMAN)
EVDPTGHSW

SEQ ID NO: 48417 - protein, 10 aa, Artificial Sequence
  Description of Artificial Sequence: Synthetic peptide
  Seed: ARVRFFFPSL (MAGA1_HUMAN)
AAVRFFFPSK

SEQ ID NO: 48418 - protein, 8 aa, Artificial Sequence
  Description of Artificial Sequence: Synthetic peptide
  Seed: FLWGPRAL (MAGA1_HUMAN)
FYWGPRAF

SEQ ID NO: 48419 - protein, 9 aa, Artificial Sequence
  Description of Artificial Sequence: Synthetic peptide
  Seed: TSYVKVLEY (MAGA1_HUMAN)
TSYVKVLER

SEQ ID NO: 48420 - protein, 10 aa, Artificial Sequence
  Description of Artificial Sequence: Synthetic peptide
  Seed: ARVRFFFPSL (MAGA1_HUMAN)
AVVRFFFPSI

SEQ ID NO: 48421 - protein, 10 aa, Artificial Sequence
  Description of Artificial Sequence: Synthetic peptide
  Seed: ILESLFRAVI (MAGA1_HUMAN)
IWESLFRAVL

SEQ ID NO: 48422 - protein, 9 aa, Artificial Sequence
  Description of Artificial Sequence: Synthetic peptide
  Seed: VADLVGFLL (MAGA1_HUMAN)
VVDLVGFLY

SEQ ID NO: 48423 - protein, 9 aa, Artificial Sequence
  Description of Artificial Sequence: Synthetic peptide
  Seed: FFFPSLREA (MAGA1_HUMAN)
FHFPSLREM

SEQ ID NO: 48424 - protein, 9 aa, Artificial Sequence
  Description of Artificial Sequence: Synthetic peptide
  Seed: KVADLVGFL (MAGA1_HUMAN)
KIADLVGFK

SEQ ID NO: 48425 - protein, 9 aa, Artificial Sequence
  Description of Artificial Sequence: Synthetic peptide
  Seed: KKVADLVGF (MAGA1_HUMAN)
KQVADLVGL

SEQ ID NO: 48426 - protein, 9 aa, Artificial Sequence
  Description of Artificial Sequence: Synthetic peptide
  Seed: STSCILESL (MAGA1_HUMAN)
SISCILESF

SEQ ID NO: 48427 - protein, 11 aa, Artificial Sequence
  Description of Artificial Sequence: Synthetic peptide
  Seed: SPQGASAFPTT (MAGA1_HUMAN)
SPQGASAFPTF

SEQ ID NO: 48428 - protein, 9 aa, Artificial Sequence
  Description of Artificial Sequence: Synthetic peptide
  Seed: SARVRFFFP (MAGA1_HUMAN)
SVRVRFFFL

SEQ ID NO: 48429 - protein, 9 aa, Artificial Sequence
  Description of Artificial Sequence: Synthetic peptide
  Seed: CILESLFRA (MAGA1_HUMAN)
CLLESLFRL

SEQ ID NO: 48430 - protein, 9 aa, Artificial Sequence
  Description of Artificial Sequence: Synthetic peptide
  Seed: KVLEYVIKV (MAGA1_HUMAN)
KSLEYVIKY

SEQ ID NO: 48431 - protein, 10 aa, Artificial Sequence
  Description of Artificial Sequence: Synthetic peptide
  Seed: KYRAREPVTK (MAGA1_HUMAN)
KSRAREPVTV

SEQ ID NO: 48432 - protein, 10 aa, Artificial Sequence
  Description of Artificial Sequence: Synthetic peptide
  Seed: SARVRFFFPS (MAGA1_HUMAN)
SGRVRFFFPY

SEQ ID NO: 48433 - protein, 9 aa, Artificial Sequence
  Description of Artificial Sequence: Synthetic peptide
  Seed: AATSSSSPL (MAGA1_HUMAN)
AVTSSSSPF

SEQ ID NO: 48434 - protein, 9 aa, Artificial Sequence
  Description of Artificial Sequence: Synthetic peptide
  Seed: EEVPTAGST (MAGA1_HUMAN)
EEVPTAGSF

SEQ ID NO: 48435 - protein, 9 aa, Artificial Sequence
  Description of Artificial Sequence: Synthetic peptide
  Seed: RVRFFFPSL (MAGA1_HUMAN)
RSRFFFPSY

SEQ ID NO: 48436 - protein, 9 aa, Artificial Sequence
  Description of Artificial Sequence: Synthetic peptide
  Seed: YEFLWGPRA (MAGA1_HUMAN)
YEFLWGPRV

SEQ ID NO: 48437 - protein, 9 aa, Artificial Sequence
  Description of Artificial Sequence: Synthetic peptide
  Seed: RVRFFFPSL (MAGA1_HUMAN)
RVRFFFPSR

SEQ ID NO: 48438 - protein, 10 aa, Artificial Sequence
  Description of Artificial Sequence: Synthetic peptide
  Seed: YEFLWGPRAL (MAGA1_HUMAN)
YYFLWGPRAF

SEQ ID NO: 48439 - protein, 10 aa, Artificial Sequence
  Description of Artificial Sequence: Synthetic peptide
  Seed: ARYEFLWGPR (MAGA1_HUMAN)
AAYEFLWGPR

SEQ ID NO: 48440 - protein, 10 aa, Artificial Sequence
  Description of Artificial Sequence: Synthetic peptide
  Seed: FLWGPRALAE (MAGA1_HUMAN)
FLWGPRALAA

SEQ ID NO: 48441 - protein, 11 aa, Artificial Sequence
  Description of Artificial Sequence: Synthetic peptide
  Seed: DLVQEKYLEYR (MAGA1_HUMAN)
DTVQEKYLEYR

SEQ ID NO: 48442 - protein, 9 aa, Artificial Sequence
  Description of Artificial Sequence: Synthetic peptide
  Seed: RVRFFFPSL (MAGA1_HUMAN)
RMRFFFPSQ

SEQ ID NO: 48443 - protein, 9 aa, Artificial Sequence
  Description of Artificial Sequence: Synthetic peptide
  Seed: ETSYVKVLE (MAGA1_HUMAN)
EGSYVKVLR

SEQ ID NO: 48444 - protein, 9 aa, Artificial Sequence
  Description of Artificial Sequence: Synthetic peptide
  Seed: RAREPVTKA (MAGA1_HUMAN)
RAREPVTKI

SEQ ID NO: 48445 - protein, 10 aa, Artificial Sequence
  Description of Artificial Sequence: Synthetic peptide
  Seed: ADPTGHSYVL (MAGA1_HUMAN)
AEPTGHSYVL

SEQ ID NO: 48446 - protein, 9 aa, Artificial Sequence
  Description of Artificial Sequence: Synthetic peptide
  Seed: EADPTGHSY (MAGA1_HUMAN)
ECDPTGHSL

SEQ ID NO: 48447 - protein, 10 aa, Artificial Sequence
  Description of Artificial Sequence: Synthetic peptide
  Seed: KASESLQLVF (MAGA1_HUMAN)
KTSESLQLVF

SEQ ID NO: 48448 - protein, 9 aa, Artificial Sequence
  Description of Artificial Sequence: Synthetic peptide
  Seed: SCILESLFR (MAGA1_HUMAN)
SFILESLFR

SEQ ID NO: 48449 - protein, 9 aa, Artificial Sequence
  Description of Artificial Sequence: Synthetic peptide
  Seed: MLESVIKNY (MAGA1_HUMAN)
MAESVIKNF

SEQ ID NO: 48450 - protein, 9 aa, Artificial Sequence
  Description of Artificial Sequence: Synthetic peptide
  Seed: RAREPVTKA (MAGA1_HUMAN)
RYREPVTKL

SEQ ID NO: 48451 - protein, 10 aa, Artificial Sequence
  Description of Artificial Sequence: Synthetic peptide
  Seed: KVADLVGFLL (MAGA1_HUMAN)
KQADLVGFLK

SEQ ID NO: 48452 - protein, 10 aa, Artificial Sequence
  Description of Artificial Sequence: Synthetic peptide
  Seed: YEFLWGPRAL (MAGA1_HUMAN)
YFFLWGPRAY

SEQ ID NO: 48453 - protein, 9 aa, Artificial Sequence
  Description of Artificial Sequence: Synthetic peptide
  Seed: LKYRAREPV (MAGA1_HUMAN)
LFYRAREPF

SEQ ID NO: 48454 - protein, 10 aa, Artificial Sequence
  Description of Artificial Sequence: Synthetic peptide
  Seed: VLVTCLGLSY (MAGA1_HUMAN)
VHVTCLGLSF

SEQ ID NO: 48455 - protein, 9 aa, Artificial Sequence
  Description of Artificial Sequence: Synthetic peptide
  Seed: SAYGEPRKL (MAGA1_HUMAN)
SYYGEPRKV

SEQ ID NO: 48456 - protein, 10 aa, Artificial Sequence
  Description of Artificial Sequence: Synthetic peptide
  Seed: SARVRFFFPS (MAGA1_HUMAN)
SYRVRFFFPA

SEQ ID NO: 48457 - protein, 9 aa, Artificial Sequence
  Description of Artificial Sequence: Synthetic peptide
  Seed: YKHCFPEIF (MAGA1_HUMAN)
YAHCFPEIY

SEQ ID NO: 48458 - protein, 9 aa, Artificial Sequence
  Description of Artificial Sequence: Synthetic peptide
  Seed: RAREPVTKA (MAGA1_HUMAN)
RSREPVTKV

SEQ ID NO: 48459 - protein, 9 aa, Artificial Sequence
  Description of Artificial Sequence: Synthetic peptide
  Seed: KVLEYVIKV (MAGA1_HUMAN)
KGLEYVIKF

SEQ ID NO: 48460 - protein, 9 aa, Artificial Sequence
  Description of Artificial Sequence: Synthetic peptide
  Seed: FLIIVLVMI (MAGA1_HUMAN)
FIIIVLVMI

SEQ ID NO: 48461 - protein, 8 aa, Artificial Sequence
  Description of Artificial Sequence: Synthetic peptide
  Seed: YEFLWGPR (MAGA1_HUMAN)
YEFLWGPM

SEQ ID NO: 48462 - protein, 10 aa, Artificial Sequence
  Description of Artificial Sequence: Synthetic peptide
  Seed: YEFLWGPRAL (MAGA1_HUMAN)
YMFLWGPRAF

SEQ ID NO: 48463 - protein, 9 aa, Artificial Sequence
  Description of Artificial Sequence: Synthetic peptide
  Seed: TSYVKVLEY (MAGA1_HUMAN)
THYVKVLEF

SEQ ID NO: 48464 - protein, 10 aa, Artificial Sequence
  Description of Artificial Sequence: Synthetic peptide
  Seed: RVRFFFPSLR (MAGA1_HUMAN)
RARFFFPSLI

SEQ ID NO: 48465 - protein, 10 aa, Artificial Sequence
  Description of Artificial Sequence: Synthetic peptide
  Seed: ESLFRAVITK (MAGA1_HUMAN)
EALFRAVITK

SEQ ID NO: 48466 - protein, 9 aa, Artificial Sequence
  Description of Artificial Sequence: Synthetic peptide
  Seed: RALAETSYV (MAGA1_HUMAN)
RVLAETSYR

SEQ ID NO: 48467 - protein, 9 aa, Artificial Sequence
  Description of Artificial Sequence: Synthetic peptide
  Seed: FFFPSLREA (MAGA1_HUMAN)
FWFPSLREL

SEQ ID NO: 48468 - protein, 9 aa, Artificial Sequence
  Description of Artificial Sequence: Synthetic peptide
  Seed: SSPLVLGTL (MAGA1_HUMAN)
SYPLVLGTW

SEQ ID NO: 48469 - protein, 10 aa, Artificial Sequence
  Description of Artificial Sequence: Synthetic peptide
  Seed: RYEFLWGPRA (MAGA1_HUMAN)
RLEFLWGPRL

SEQ ID NO: 48470 - protein, 10 aa, Artificial Sequence
  Description of Artificial Sequence: Synthetic peptide
  Seed: ESLFRAVITK (MAGA1_HUMAN)
EILFRAVITK

SEQ ID NO: 48471 - protein, 9 aa, Artificial Sequence
  Description of Artificial Sequence: Synthetic peptide
  Seed: SSPLVLGTL (MAGA1_HUMAN)
SYPLVLGTF

SEQ ID NO: 48472 - protein, 10 aa, Artificial Sequence
  Description of Artificial Sequence: Synthetic peptide
  Seed: ATSSSSPLVL (MAGA1_HUMAN)
ASSSSSPLVY

SEQ ID NO: 48473 - protein, 9 aa, Artificial Sequence
  Description of Artificial Sequence: Synthetic peptide
  Seed: EEGPSTSCI (MAGA1_HUMAN)
EEGPSTSCA

SEQ ID NO: 48474 - protein, 9 aa, Artificial Sequence
  Description of Artificial Sequence: Synthetic peptide
  Seed: TSSSSPLVL (MAGA1_HUMAN)
TQSSSPLVV

SEQ ID NO: 48475 - protein, 10 aa, Artificial Sequence
  Description of Artificial Sequence: Synthetic peptide
  Seed: CILESLFRAV (MAGA1_HUMAN)
CLLESLFRAT

SEQ ID NO: 48476 - protein, 9 aa, Artificial Sequence
  Description of Artificial Sequence: Synthetic peptide
  Seed: CILESLFRA (MAGA1_HUMAN)
CMLESLFRV

SEQ ID NO: 48477 - protein, 9 aa, Artificial Sequence
  Description of Artificial Sequence: Synthetic peptide
  Seed: TGFLIIVLV (MAGA1_HUMAN)
TSFLIIVLV

SEQ ID NO: 48478 - protein, 10 aa, Artificial Sequence
  Description of Artificial Sequence: Synthetic peptide
  Seed: FFPSLREAAL (MAGA1_HUMAN)
FHPSLREAAY

SEQ ID NO: 48479 - protein, 10 aa, Artificial Sequence
  Description of Artificial Sequence: Synthetic peptide
  Seed: TSCILESLFR (MAGA1_HUMAN)
TFCILESLFR

SEQ ID NO: 48480 - protein, 9 aa, Artificial Sequence
  Description of Artificial Sequence: Synthetic peptide
  Seed: CILESLFRA (MAGA1_HUMAN)
CMLESLFRS

SEQ ID NO: 48481 - protein, 9 aa, Artificial Sequence
  Description of Artificial Sequence: Synthetic peptide
  Seed: VADLVGFLL (MAGA1_HUMAN)
VWDLVGFLI

SEQ ID NO: 48482 - protein, 8 aa, Artificial Sequence
  Description of Artificial Sequence: Synthetic peptide
  Seed: RVRFFFPS (MAGA1_HUMAN)
RTRFFFPF

SEQ ID NO: 48483 - protein, 10 aa, Artificial Sequence
  Description of Artificial Sequence: Synthetic peptide
  Seed: RVRFFFPSLR (MAGA1_HUMAN)
RRRFFFPSLK

SEQ ID NO: 48484 - protein, 9 aa, Artificial Sequence
  Description of Artificial Sequence: Synthetic peptide
  Seed: SAFPTTINF (MAGA1_HUMAN)
SIFPTTINY

SEQ ID NO: 48485 - protein, 9 aa, Artificial Sequence
  Description of Artificial Sequence: Synthetic peptide
  Seed: GLVCVQAAT (MAGA1_HUMAN)
GIVCVQAAL

SEQ ID NO: 48486 - protein, 10 aa, Artificial Sequence
  Description of Artificial Sequence: Synthetic peptide
  Seed: ADPTGHSYVL (MAGA1_HUMAN)
ATPTGHSYVM

SEQ ID NO: 48487 - protein, 10 aa, Artificial Sequence
  Description of Artificial Sequence: Synthetic peptide
  Seed: ARVRFFFPSL (MAGA1_HUMAN)
ASVRFFFPSM

SEQ ID NO: 48488 - protein, 10 aa, Artificial Sequence
  Description of Artificial Sequence: Synthetic peptide
  Seed: SARVRFFFPS (MAGA1_HUMAN)
SMRVRFFFPV

SEQ ID NO: 48489 - protein, 11 aa, Artificial Sequence
  Description of Artificial Sequence: Synthetic peptide
  Seed: RVRFFFPSLRE (MAGA1_HUMAN)
RMRFFFPSLRS

SEQ ID NO: 48490 - protein, 9 aa, Artificial Sequence
  Description of Artificial Sequence: Synthetic peptide
  Seed: KVLEYVIKV (MAGA1_HUMAN)
KQLEYVIKA

SEQ ID NO: 48491 - protein, 9 aa, Artificial Sequence
  Description of Artificial Sequence: Synthetic peptide
  Seed: GTLEEVPTA (MAGA1_HUMAN)
GVLEEVPTI

SEQ ID NO: 48492 - protein, 10 aa, Artificial Sequence
  Description of Artificial Sequence: Synthetic peptide
  Seed: KVSARVRFFF (MAGA1_HUMAN)
KPSARVRFFF

SEQ ID NO: 48493 - protein, 9 aa, Artificial Sequence
  Description of Artificial Sequence: Synthetic peptide
  Seed: LVLGTLEEV (MAGA1_HUMAN)
LALGTLEEY

SEQ ID NO: 48494 - protein, 9 aa, Artificial Sequence
  Description of Artificial Sequence: Synthetic peptide
  Seed: SLFRAVITK (MAGA1_HUMAN)
SYFRAVITR

SEQ ID NO: 48495 - protein, 9 aa, Artificial Sequence
  Description of Artificial Sequence: Synthetic peptide
  Seed: VADLVGFLL (MAGA1_HUMAN)
VPDLVGFLF

SEQ ID NO: 48496 - protein, 9 aa, Artificial Sequence
  Description of Artificial Sequence: Synthetic peptide
  Seed: EADPTGHSY (MAGA1_HUMAN)
ETDPTGHSL

SEQ ID NO: 48497 - protein, 11 aa, Artificial Sequence
  Description of Artificial Sequence: Synthetic peptide
  Seed: RVRFFFPSLRE (MAGA1_HUMAN)
RFRFFFPSLRK

SEQ ID NO: 48498 - protein, 9 aa, Artificial Sequence
  Description of Artificial Sequence: Synthetic peptide
  Seed: DSDPARYEF (MAGA1_HUMAN)
DVDPARYEM

SEQ ID NO: 48499 - protein, 11 aa, Artificial Sequence
  Description of Artificial Sequence: Synthetic peptide
  Seed: ELSVMEVYDGR (MAGA1_HUMAN)
EISVMEVYDGR

SEQ ID NO: 48500 - protein, 9 aa, Artificial Sequence
  Description of Artificial Sequence: Synthetic peptide
  Seed: TGFLIIVLV (MAGA1_HUMAN)
TTFLIIVLI

SEQ ID NO: 48501 - protein, 10 aa, Artificial Sequence
  Description of Artificial Sequence: Synthetic peptide
  Seed: ASAFPTTINF (MAGA1_HUMAN)
AAAFPTTINF

SEQ ID NO: 48502 - protein, 11 aa, Artificial Sequence
  Description of Artificial Sequence: Synthetic peptide
  Seed: STDPPQSPQGA (MAGA1_HUMAN)
SCDPPQSPQGM

SEQ ID NO: 48503 - protein, 9 aa, Artificial Sequence
  Description of Artificial Sequence: Synthetic peptide
  Seed: QIMPKTGFL (MAGA1_HUMAN)
QQMPKTGFI

SEQ ID NO: 48504 - protein, 10 aa, Artificial Sequence
  Description of Artificial Sequence: Synthetic peptide
  Seed: KVADLVGFLL (MAGA1_HUMAN)
KLADLVGFLI

SEQ ID NO: 48505 - protein, 10 aa, Artificial Sequence
  Description of Artificial Sequence: Synthetic peptide
  Seed: SARVRFFFPS (MAGA1_HUMAN)
SSRVRFFFPM

SEQ ID NO: 48506 - protein, 9 aa, Artificial Sequence
  Description of Artificial Sequence: Synthetic peptide
  Seed: HCFPEIFGK (MAGA1_HUMAN)
HGFPEIFGR

SEQ ID NO: 48507 - protein, 9 aa, Artificial Sequence
  Description of Artificial Sequence: Synthetic peptide
  Seed: RAREPVTKA (MAGA1_HUMAN)
RVREPVTKY

SEQ ID NO: 48508 - protein, 9 aa, Artificial Sequence
  Description of Artificial Sequence: Synthetic peptide
  Seed: RVRFFFPSL (MAGA1_HUMAN)
RVRFFFPSH

SEQ ID NO: 48509 - protein, 11 aa, Artificial Sequence
  Description of Artificial Sequence: Synthetic peptide
  Seed: KVLEYVIKVSA (MAGA1_HUMAN)
KMLEYVIKVSM

SEQ ID NO: 48510 - protein, 10 aa, Artificial Sequence
  Description of Artificial Sequence: Synthetic peptide
  Seed: DLVGFLLLKY (MAGA1_HUMAN)
DMVGFLLLKR

SEQ ID NO: 48511 - protein, 10 aa, Artificial Sequence
  Description of Artificial Sequence: Synthetic peptide
  Seed: RVRFFFPSLR (MAGA1_HUMAN)
RHRFFFPSLK

SEQ ID NO: 48512 - protein, 9 aa, Artificial Sequence
  Description of Artificial Sequence: Synthetic peptide
  Seed: KVADLVGFL (MAGA1_HUMAN)
KVADLVGFA

SEQ ID NO: 48513 - protein, 9 aa, Artificial Sequence
  Description of Artificial Sequence: Synthetic peptide
  Seed: LESLFRAVI (MAGA1_HUMAN)
LASLFRAVY

SEQ ID NO: 48514 - protein, 10 aa, Artificial Sequence
  Description of Artificial Sequence: Synthetic peptide
  Seed: RVRFFFPSLR (MAGA1_HUMAN)
RQRFFFPSLK

SEQ ID NO: 48515 - protein, 11 aa, Artificial Sequence
  Description of Artificial Sequence: Synthetic peptide
  Seed: ARVRFFFPSLR (MAGA1_HUMAN)
AKVRFFFPSLL

SEQ ID NO: 48516 - protein, 9 aa, Artificial Sequence
  Description of Artificial Sequence: Synthetic peptide
  Seed: RAREPVTKA (MAGA1_HUMAN)
RIREPVTKK

SEQ ID NO: 48517 - protein, 8 aa, Artificial Sequence
  Description of Artificial Sequence: Synthetic peptide
  Seed: LESLFRAV (MAGA1_HUMAN)
LQSLFRAL

SEQ ID NO: 48518 - protein, 11 aa, Artificial Sequence
  Description of Artificial Sequence: Synthetic peptide
  Seed: RSLHCKPEEAL (MAGA1_HUMAN)
RSLHCKPEEAW

SEQ ID NO: 48519 - protein, 9 aa, Artificial Sequence
  Description of Artificial Sequence: Synthetic peptide
  Seed: ARVRFFFPS (MAGA1_HUMAN)
ARVRFFFPF

SEQ ID NO: 48520 - protein, 9 aa, Artificial Sequence
  Description of Artificial Sequence: Synthetic peptide
  Seed: IFGKASESL (MAGA1_HUMAN)
IFGKASESW

SEQ ID NO: 48521 - protein, 9 aa, Artificial Sequence
  Description of Artificial Sequence: Synthetic peptide
  Seed: AATSSSSPL (MAGA1_HUMAN)
ALTSSSSPF

SEQ ID NO: 48522 - protein, 10 aa, Artificial Sequence
  Description of Artificial Sequence: Synthetic peptide
  Seed: KVSARVRFFF (MAGA1_HUMAN)
KASARVRFFF

SEQ ID NO: 48523 - protein, 9 aa, Artificial Sequence
  Description of Artificial Sequence: Synthetic peptide
  Seed: RVRFFFPSL (MAGA1_HUMAN)
RGRFFFPSK

SEQ ID NO: 48524 - protein, 9 aa, Artificial Sequence
  Description of Artificial Sequence: Synthetic peptide
  Seed: QIMPKTGFL (MAGA1_HUMAN)
QIMPKTGFR

SEQ ID NO: 48525 - protein, 9 aa, Artificial Sequence
  Description of Artificial Sequence: Synthetic peptide
  Seed: FFFPSLREA (MAGA1_HUMAN)
FVFPSLREV

SEQ ID NO: 48526 - protein, 9 aa, Artificial Sequence
  Description of Artificial Sequence: Synthetic peptide
  Seed: KKVADLVGF (MAGA1_HUMAN)
KMVADLVGF

SEQ ID NO: 48527 - protein, 9 aa, Artificial Sequence
  Description of Artificial Sequence: Synthetic peptide
  Seed: KYRAREPVT (MAGA1_HUMAN)
KYRAREPVK

SEQ ID NO: 48528 - protein, 9 aa, Artificial Sequence
  Description of Artificial Sequence: Synthetic peptide
  Seed: KVSARVRFF (MAGA1_HUMAN)
KYSARVRFK

SEQ ID NO: 48529 - protein, 8 aa, Artificial Sequence
  Description of Artificial Sequence: Synthetic peptide
  Seed: SARVRFFF (MAGA1_HUMAN)
SMRVRFFM

SEQ ID NO: 48530 - protein, 9 aa, Artificial Sequence
  Description of Artificial Sequence: Synthetic peptide
  Seed: YKHCFPEIF (MAGA1_HUMAN)
YKHCFPEIL

SEQ ID NO: 48531 - protein, 9 aa, Artificial Sequence
  Description of Artificial Sequence: Synthetic peptide
  Seed: FFFPSLREA (MAGA1_HUMAN)
FLFPSLREY

SEQ ID NO: 48532 - protein, 11 aa, Artificial Sequence
  Description of Artificial Sequence: Synthetic peptide
  Seed: KVADLVGFLLL (MAGA1_HUMAN)
KGADLVGFLLW

SEQ ID NO: 48533 - protein, 9 aa, Artificial Sequence
  Description of Artificial Sequence: Synthetic peptide
  Seed: QIMPKTGFL (MAGA1_HUMAN)
QIMPKTGFI

SEQ ID NO: 48534 - protein, 11 aa, Artificial Sequence
  Description of Artificial Sequence: Synthetic peptide
  Seed: RQVPDSDPARY (MAGA1_HUMAN)
RRVPDSDPARY

SEQ ID NO: 48535 - protein, 11 aa, Artificial Sequence
  Description of Artificial Sequence: Synthetic peptide
  Seed: ARVRFFFPSLR (MAGA1_HUMAN)
AMVRFFFPSLK

SEQ ID NO: 48536 - protein, 10 aa, Artificial Sequence
  Description of Artificial Sequence: Synthetic peptide
  Seed: ASAFPTTINF (MAGA1_HUMAN)
AYAFPTTINW

SEQ ID NO: 48537 - protein, 9 aa, Artificial Sequence
  Description of Artificial Sequence: Synthetic peptide
  Seed: ETSYVKVLE (MAGA1_HUMAN)
EASYVKVLK

SEQ ID NO: 48538 - protein, 10 aa, Artificial Sequence
  Description of Artificial Sequence: Synthetic peptide
  Seed: SARVRFFFPS (MAGA1_HUMAN)
SIRVRFFFPI

SEQ ID NO: 48539 - protein, 10 aa, Artificial Sequence
  Description of Artificial Sequence: Synthetic peptide
  Seed: SARVRFFFPS (MAGA1_HUMAN)
SRRVRFFFPF

SEQ ID NO: 48540 - protein, 10 aa, Artificial Sequence
  Description of Artificial Sequence: Synthetic peptide
  Seed: DVKEADPTGH (MAGA1_HUMAN)
DLKEADPTGR

SEQ ID NO: 48541 - protein, 10 aa, Artificial Sequence
  Description of Artificial Sequence: Synthetic peptide
  Seed: KEADPTGHSY (MAGA1_HUMAN)
KSADPTGHSM

SEQ ID NO: 48542 - protein, 9 aa, Artificial Sequence
  Description of Artificial Sequence: Synthetic peptide
  Seed: VQAATSSSS (MAGA1_HUMAN)
VMAATSSSM

SEQ ID NO: 48543 - protein, 9 aa, Artificial Sequence
  Description of Artificial Sequence: Synthetic peptide
  Seed: RQVPDSDPA (MAGA1_HUMAN)
RTVPDSDPY

SEQ ID NO: 48544 - protein, 9 aa, Artificial Sequence
  Description of Artificial Sequence: Synthetic peptide
  Seed: RVRFFFPSL (MAGA1_HUMAN)
RCRFFFPSM

SEQ ID NO: 48545 - protein, 10 aa, Artificial Sequence
  Description of Artificial Sequence: Synthetic peptide
  Seed: GPRALAETSY (MAGA1_HUMAN)
GMRALAETSF

SEQ ID NO: 48546 - protein, 10 aa, Artificial Sequence
  Description of Artificial Sequence: Synthetic peptide
  Seed: EIFGKASESL (MAGA1_HUMAN)
EVFGKASESK

SEQ ID NO: 48547 - protein, 9 aa, Artificial Sequence
  Description of Artificial Sequence: Synthetic peptide
  Seed: RQRQPSEGS (MAGA1_HUMAN)
RTRQPSEGA

SEQ ID NO: 48548 - protein, 10 aa, Artificial Sequence
  Description of Artificial Sequence: Synthetic peptide
  Seed: SESLQLVFGI (MAGA1_HUMAN)
SLSLQLVFGW

SEQ ID NO: 48549 - protein, 9 aa, Artificial Sequence
  Description of Artificial Sequence: Synthetic peptide
  Seed: QIMPKTGFL (MAGA1_HUMAN)
QTMPKTGFF

SEQ ID NO: 48550 - protein, 11 aa, Artificial Sequence
  Description of Artificial Sequence: Synthetic peptide
  Seed: ARVRFFFPSLR (MAGA1_HUMAN)
AHVRFFFPSLL

SEQ ID NO: 48551 - protein, 10 aa, Artificial Sequence
  Description of Artificial Sequence: Synthetic peptide
  Seed: KEADPTGHSY (MAGA1_HUMAN)
KQADPTGHSI

SEQ ID NO: 48552 - protein, 9 aa, Artificial Sequence
  Description of Artificial Sequence: Synthetic peptide
  Seed: SVMEVYDGR (MAGA1_HUMAN)
STMEVYDGK

SEQ ID NO: 48553 - protein, 9 aa, Artificial Sequence
  Description of Artificial Sequence: Synthetic peptide
  Seed: LVQEKYLEY (MAGA1_HUMAN)
LAQEKYLEW

SEQ ID NO: 48554 - protein, 9 aa, Artificial Sequence
  Description of Artificial Sequence: Synthetic peptide
  Seed: IMPKTGFLI (MAGA1_HUMAN)
IVPKTGFLF

SEQ ID NO: 48555 - protein, 9 aa, Artificial Sequence
  Description of Artificial Sequence: Synthetic peptide
  Seed: TKAEMLESV (MAGA1_HUMAN)
TRAEMLESI

SEQ ID NO: 48556 - protein, 11 aa, Artificial Sequence
  Description of Artificial Sequence: Synthetic peptide
  Seed: RVRFFFPSLRE (MAGA1_HUMAN)
RTRFFFPSLRY

SEQ ID NO: 48557 - protein, 10 aa, Artificial Sequence
  Description of Artificial Sequence: Synthetic peptide
  Seed: EYVIKVSARV (MAGA1_HUMAN)
EWVIKVSARV

SEQ ID NO: 48558 - protein, 10 aa, Artificial Sequence
  Description of Artificial Sequence: Synthetic peptide
  Seed: EALEAQQEAL (MAGA1_HUMAN)
ETLEAQQEAF

SEQ ID NO: 48559 - protein, 10 aa, Artificial Sequence
  Description of Artificial Sequence: Synthetic peptide
  Seed: KKVADLVGFL (MAGA1_HUMAN)
KLVADLVGFM

SEQ ID NO: 48560 - protein, 9 aa, Artificial Sequence
  Description of Artificial Sequence: Synthetic peptide
  Seed: RQRQPSEGS (MAGA1_HUMAN)
RMRQPSEGI

SEQ ID NO: 48561 - protein, 9 aa, Artificial Sequence
  Description of Artificial Sequence: Synthetic peptide
  Seed: VSARVRFFF (MAGA1_HUMAN)
VWARVRFFL

SEQ ID NO: 48562 - protein, 10 aa, Artificial Sequence
  Description of Artificial Sequence: Synthetic peptide
  Seed: FFFPSLREAA (MAGA1_HUMAN)
FWFPSLREAY

SEQ ID NO: 48563 - protein, 9 aa, Artificial Sequence
  Description of Artificial Sequence: Synthetic peptide
  Seed: YDGREHSAY (MAGA1_HUMAN)
YEGREHSAW

SEQ ID NO: 48564 - protein, 8 aa, Artificial Sequence
  Description of Artificial Sequence: Synthetic peptide
  Seed: RVRFFFPS (MAGA1_HUMAN)
RIRFFFPA

SEQ ID NO: 48565 - protein, 9 aa, Artificial Sequence
  Description of Artificial Sequence: Synthetic peptide
  Seed: RQVPDSDPA (MAGA1_HUMAN)
RLVPDSDPF

SEQ ID NO: 48566 - protein, 10 aa, Artificial Sequence
  Description of Artificial Sequence: Synthetic peptide
  Seed: KVSARVRFFF (MAGA1_HUMAN)
KISARVRFFA

SEQ ID NO: 48567 - protein, 9 aa, Artificial Sequence
  Description of Artificial Sequence: Synthetic peptide
  Seed: KYRAREPVT (MAGA1_HUMAN)
KSRAREPVA

SEQ ID NO: 48568 - protein, 10 aa, Artificial Sequence
  Description of Artificial Sequence: Synthetic peptide
  Seed: VKVLEYVIKV (MAGA1_HUMAN)
VLVLEYVIKI

SEQ ID NO: 48569 - protein, 10 aa, Artificial Sequence
  Description of Artificial Sequence: Synthetic peptide
  Seed: TSYVKVLEYV (MAGA1_HUMAN)
TLYVKVLEYW

SEQ ID NO: 48570 - protein, 10 aa, Artificial Sequence
  Description of Artificial Sequence: Synthetic peptide
  Seed: KVADLVGFLL (MAGA1_HUMAN)
KIADLVGFLY

SEQ ID NO: 48571 - protein, 9 aa, Artificial Sequence
  Description of Artificial Sequence: Synthetic peptide
  Seed: VQEKYLEYR (MAGA1_HUMAN)
VIEKYLEYY

SEQ ID NO: 48572 - protein, 10 aa, Artificial Sequence
  Description of Artificial Sequence: Synthetic peptide
  Seed: ESLFRAVITK (MAGA1_HUMAN)
ETLFRAVITR

SEQ ID NO: 48573 - protein, 10 aa, Artificial Sequence
  Description of Artificial Sequence: Synthetic peptide
  Seed: STSCILESLF (MAGA1_HUMAN)
SVSCILESLW

SEQ ID NO: 48574 - protein, 8 aa, Artificial Sequence
  Description of Artificial Sequence: Synthetic peptide
  Seed: YEFLWGPR (MAGA1_HUMAN)
YEFLWGPY

SEQ ID NO: 48575 - protein, 10 aa, Artificial Sequence
  Description of Artificial Sequence: Synthetic peptide
  Seed: KKVADLVGFL (MAGA1_HUMAN)
KIVADLVGFV

SEQ ID NO: 48576 - protein, 10 aa, Artificial Sequence
  Description of Artificial Sequence: Synthetic peptide
  Seed: YEFLWGPRAL (MAGA1_HUMAN)
YTFLWGPRAM

SEQ ID NO: 48577 - protein, 9 aa, Artificial Sequence
  Description of Artificial Sequence: Synthetic peptide
  Seed: EEEGPSTSC (MAGA1_HUMAN)
EEEGPSTSL

SEQ ID NO: 48578 - protein, 10 aa, Artificial Sequence
  Description of Artificial Sequence: Synthetic peptide
  Seed: YEFLWGPRAL (MAGA1_HUMAN)
YPFLWGPRAF

SEQ ID NO: 48579 - protein, 9 aa, Artificial Sequence
  Description of Artificial Sequence: Synthetic peptide
  Seed: KVADLVGFL (MAGA1_HUMAN)
KFADLVGFY

SEQ ID NO: 48580 - protein, 11 aa, Artificial Sequence
  Description of Artificial Sequence: Synthetic peptide
  Seed: EVYDGREHSAY (MAGA1_HUMAN)
ETYDGREHSAR

SEQ ID NO: 48581 - protein, 9 aa, Artificial Sequence
  Description of Artificial Sequence: Synthetic peptide
  Seed: SAFPTTINF (MAGA1_HUMAN)
SQFPTTINR

SEQ ID NO: 48582 - protein, 9 aa, Artificial Sequence
  Description of Artificial Sequence: Synthetic peptide
  Seed: RQVPDSDPA (MAGA1_HUMAN)
RIVPDSDPF

SEQ ID NO: 48583 - protein, 9 aa, Artificial Sequence
  Description of Artificial Sequence: Synthetic peptide
  Seed: SYVKVLEYV (MAGA1_HUMAN)
SSVKVLEYA

SEQ ID NO: 48584 - protein, 11 aa, Artificial Sequence
  Description of Artificial Sequence: Synthetic peptide
  Seed: SAFPTTINFTR (MAGA1_HUMAN)
SVFPTTINFTK

SEQ ID NO: 48585 - protein, 10 aa, Artificial Sequence
  Description of Artificial Sequence: Synthetic peptide
  Seed: SARVRFFFPS (MAGA1_HUMAN)
SFRVRFFFPL

SEQ ID NO: 48586 - protein, 10 aa, Artificial Sequence
  Description of Artificial Sequence: Synthetic peptide
  Seed: KKVADLVGFL (MAGA1_HUMAN)
KFVADLVGFV

SEQ ID NO: 48587 - protein, 9 aa, Artificial Sequence
  Description of Artificial Sequence: Synthetic peptide
  Seed: SAFPTTINF (MAGA1_HUMAN)
SSFPTTINY

SEQ ID NO: 48588 - protein, 9 aa, Artificial Sequence
  Description of Artificial Sequence: Synthetic peptide
  Seed: KVLEYVIKV (MAGA1_HUMAN)
KFLEYVIKF

SEQ ID NO: 48589 - protein, 9 aa, Artificial Sequence
  Description of Artificial Sequence: Synthetic peptide
  Seed: YVIKVSARV (MAGA1_HUMAN)
YTIKVSARA

SEQ ID NO: 48590 - protein, 10 aa, Artificial Sequence
  Description of Artificial Sequence: Synthetic peptide
  Seed: LVGFLLLKYR (MAGA1_HUMAN)
LTGFLLLKYR

SEQ ID NO: 48591 - protein, 9 aa, Artificial Sequence
  Description of Artificial Sequence: Synthetic peptide
  Seed: RVRFFFPSL (MAGA1_HUMAN)
RSRFFFPSD

SEQ ID NO: 48592 - protein, 10 aa, Artificial Sequence
  Description of Artificial Sequence: Synthetic peptide
  Seed: RFFFPSLREA (MAGA1_HUMAN)
RLFFPSLREK

SEQ ID NO: 48593 - protein, 10 aa, Artificial Sequence
  Description of Artificial Sequence: Synthetic peptide
  Seed: ESLFRAVITK (MAGA1_HUMAN)
EILFRAVITR

SEQ ID NO: 48594 - protein, 9 aa, Artificial Sequence
  Description of Artificial Sequence: Synthetic peptide
  Seed: FLWGPRALA (MAGA1_HUMAN)
FTWGPRALR

SEQ ID NO: 48595 - protein, 10 aa, Artificial Sequence
  Description of Artificial Sequence: Synthetic peptide
  Seed: RVRFFFPSLR (MAGA1_HUMAN)
RWRFFFPSLH

SEQ ID NO: 48596 - protein, 9 aa, Artificial Sequence
  Description of Artificial Sequence: Synthetic peptide
  Seed: TQDLVQEKY (MAGA1_HUMAN)
TIDLVQEKY

SEQ ID NO: 48597 - protein, 9 aa, Artificial Sequence
  Description of Artificial Sequence: Synthetic peptide
  Seed: GASAFPTTI (MAGA1_HUMAN)
GMSAFPTTF

SEQ ID NO: 48598 - protein, 10 aa, Artificial Sequence
  Description of Artificial Sequence: Synthetic peptide
  Seed: EYVIKVSARV (MAGA1_HUMAN)
EHVIKVSARV

SEQ ID NO: 48599 - protein, 10 aa, Artificial Sequence
  Description of Artificial Sequence: Synthetic peptide
  Seed: YEFLWGPRAL (MAGA1_HUMAN)
YFFLWGPRAL

SEQ ID NO: 48600 - protein, 8 aa, Artificial Sequence
  Description of Artificial Sequence: Synthetic peptide
  Seed: RFFFPSLR (MAGA1_HUMAN)
RVFFPSLR

SEQ ID NO: 48601 - protein, 10 aa, Artificial Sequence
  Description of Artificial Sequence: Synthetic peptide
  Seed: KNYKHCFPEI (MAGA1_HUMAN)
KHYKHCFPEF

SEQ ID NO: 48602 - protein, 9 aa, Artificial Sequence
  Description of Artificial Sequence: Synthetic peptide
  Seed: SAYGEPRKL (MAGA1_HUMAN)
SPYGEPRKF

SEQ ID NO: 48603 - protein, 10 aa, Artificial Sequence
  Description of Artificial Sequence: Synthetic peptide
  Seed: SVMEVYDGRE (MAGA1_HUMAN)
SVMEVYDGRK

SEQ ID NO: 48604 - protein, 9 aa, Artificial Sequence
  Description of Artificial Sequence: Synthetic peptide
  Seed: KVADLVGFL (MAGA1_HUMAN)
KAADLVGFF

SEQ ID NO: 48605 - protein, 10 aa, Artificial Sequence
  Description of Artificial Sequence: Synthetic peptide
  Seed: RVRFFFPSLR (MAGA1_HUMAN)
RNRFFFPSLI

SEQ ID NO: 48606 - protein, 9 aa, Artificial Sequence
  Description of Artificial Sequence: Synthetic peptide
  Seed: GASAFPTTI (MAGA1_HUMAN)
GMSAFPTTA

SEQ ID NO: 48607 - protein, 9 aa, Artificial Sequence
  Description of Artificial Sequence: Synthetic peptide
  Seed: KVLEYVIKV (MAGA1_HUMAN)
KILEYVIKY

SEQ ID NO: 48608 - protein, 9 aa, Artificial Sequence
  Description of Artificial Sequence: Synthetic peptide
  Seed: SAYGEPRKL (MAGA1_HUMAN)
SVYGEPRKV

SEQ ID NO: 48609 - protein, 9 aa, Artificial Sequence
  Description of Artificial Sequence: Synthetic peptide
  Seed: VIKNYKHCF (MAGA1_HUMAN)
VVKNYKHCY

SEQ ID NO: 48610 - protein, 9 aa, Artificial Sequence
  Description of Artificial Sequence: Synthetic peptide
  Seed: TKAEMLESV (MAGA1_HUMAN)
TQAEMLESA

SEQ ID NO: 48611 - protein, 10 aa, Artificial Sequence
  Description of Artificial Sequence: Synthetic peptide
  Seed: ESLFRAVITK (MAGA1_HUMAN)
ESLFRAVITR

SEQ ID NO: 48612 - protein, 10 aa, Artificial Sequence
  Description of Artificial Sequence: Synthetic peptide
  Seed: RAREPVTKAE (MAGA1_HUMAN)
RIREPVTKAK

SEQ ID NO: 48613 - protein, 10 aa, Artificial Sequence
  Description of Artificial Sequence: Synthetic peptide
  Seed: KVLEYVIKVS (MAGA1_HUMAN)
KLLEYVIKVD

SEQ ID NO: 48614 - protein, 11 aa, Artificial Sequence
  Description of Artificial Sequence: Synthetic peptide
  Seed: YEFLWGPRALA (MAGA1_HUMAN)
YAFLWGPRALV

SEQ ID NO: 48615 - protein, 10 aa, Artificial Sequence
  Description of Artificial Sequence: Synthetic peptide
  Seed: KVLEYVIKVS (MAGA1_HUMAN)
KTLEYVIKVV

SEQ ID NO: 48616 - protein, 9 aa, Artificial Sequence
  Description of Artificial Sequence: Synthetic peptide
  Seed: AYGEPRKLL (MAGA1_HUMAN)
AYGEPRKLF

SEQ ID NO: 48617 - protein, 9 aa, Artificial Sequence
  Description of Artificial Sequence: Synthetic peptide
  Seed: MEGGHAPEE (MAGA1_HUMAN)
MEGGHAPEV

SEQ ID NO: 48618 - protein, 10 aa, Artificial Sequence
  Description of Artificial Sequence: Synthetic peptide
  Seed: FFPSLREAAL (MAGA1_HUMAN)
FDPSLREAAL

SEQ ID NO: 48619 - protein, 10 aa, Artificial Sequence
  Description of Artificial Sequence: Synthetic peptide
  Seed: FPSLREAALR (MAGA1_HUMAN)
FPSLREAALM

SEQ ID NO: 48620 - protein, 10 aa, Artificial Sequence
  Description of Artificial Sequence: Synthetic peptide
  Seed: WEELSVMEVY (MAGA1_HUMAN)
WLELSVMEVW

SEQ ID NO: 48621 - protein, 10 aa, Artificial Sequence
  Description of Artificial Sequence: Synthetic peptide
  Seed: IMPKTGFLII (MAGA1_HUMAN)
IWPKTGFLIF

SEQ ID NO: 48622 - protein, 9 aa, Artificial Sequence
  Description of Artificial Sequence: Synthetic peptide
  Seed: MSLEQRSLH (MAGA1_HUMAN)
MALEQRSLY

SEQ ID NO: 48623 - protein, 8 aa, Artificial Sequence
  Description of Artificial Sequence: Synthetic peptide
  Seed: RAREPVTK (MAGA1_HUMAN)
RVREPVTK

SEQ ID NO: 48624 - protein, 10 aa, Artificial Sequence
  Description of Artificial Sequence: Synthetic peptide
  Seed: MLESVIKNYK (MAGA1_HUMAN)
MMESVIKNYK

SEQ ID NO: 48625 - protein, 9 aa, Artificial Sequence
  Description of Artificial Sequence: Synthetic peptide
  Seed: EADPTGHSY (MAGA1_HUMAN)
EGDPTGHSM

SEQ ID NO: 48626 - protein, 9 aa, Artificial Sequence
  Description of Artificial Sequence: Synthetic peptide
  Seed: RAREPVTKA (MAGA1_HUMAN)
RLREPVTKV

SEQ ID NO: 48627 - protein, 10 aa, Artificial Sequence
  Description of Artificial Sequence: Synthetic peptide
  Seed: FLWGPRALAE (MAGA1_HUMAN)
FIWGPRALAL

SEQ ID NO: 48628 - protein, 10 aa, Artificial Sequence
  Description of Artificial Sequence: Synthetic peptide
  Seed: DLVGFLLLKY (MAGA1_HUMAN)
DAVGFLLLKR

SEQ ID NO: 48629 - protein, 9 aa, Artificial Sequence
  Description of Artificial Sequence: Synthetic peptide
  Seed: SAYGEPRKL (MAGA1_HUMAN)
SIYGEPRKL

SEQ ID NO: 48630 - protein, 9 aa, Artificial Sequence
  Description of Artificial Sequence: Synthetic peptide
  Seed: LKYRAREPV (MAGA1_HUMAN)
LMYRAREPW

SEQ ID NO: 48631 - protein, 9 aa, Artificial Sequence
  Description of Artificial Sequence: Synthetic peptide
  Seed: KVLEYVIKV (MAGA1_HUMAN)
KILEYVIKA

SEQ ID NO: 48632 - protein, 10 aa, Artificial Sequence
  Description of Artificial Sequence: Synthetic peptide
  Seed: KEADPTGHSY (MAGA1_HUMAN)
KSADPTGHSI

SEQ ID NO: 48633 - protein, 9 aa, Artificial Sequence
  Description of Artificial Sequence: Synthetic peptide
  Seed: QSPQGASAF (MAGA1_HUMAN)
QYPQGASAI

SEQ ID NO: 48634 - protein, 11 aa, Artificial Sequence
  Description of Artificial Sequence: Synthetic peptide
  Seed: GASAFPTTINF (MAGA1_HUMAN)
GGSAFPTTINW

SEQ ID NO: 48635 - protein, 9 aa, Artificial Sequence
  Description of Artificial Sequence: Synthetic peptide
  Seed: FFPSLREAA (MAGA1_HUMAN)
FWPSLREAF

SEQ ID NO: 48636 - protein, 8 aa, Artificial Sequence
  Description of Artificial Sequence: Synthetic peptide
  Seed: YVKVLEYV (MAGA1_HUMAN)
YMKVLEYI

SEQ ID NO: 48637 - protein, 10 aa, Artificial Sequence
  Description of Artificial Sequence: Synthetic peptide
  Seed: RVRFFFPSLR (MAGA1_HUMAN)
RVRFFFPSLI

SEQ ID NO: 48638 - protein, 11 aa, Artificial Sequence
  Description of Artificial Sequence: Synthetic peptide
  Seed: KVADLVGFLLL (MAGA1_HUMAN)
KMADLVGFLLC

SEQ ID NO: 48639 - protein, 9 aa, Artificial Sequence
  Description of Artificial Sequence: Synthetic peptide
  Seed: LVLGTLEEV (MAGA1_HUMAN)
LSLGTLEEI

SEQ ID NO: 48640 - protein, 9 aa, Artificial Sequence
  Description of Artificial Sequence: Synthetic peptide
  Seed: QVPDSDPAR (MAGA1_HUMAN)
QTPDSDPAR

SEQ ID NO: 48641 - protein, 10 aa, Artificial Sequence
  Description of Artificial Sequence: Synthetic peptide
  Seed: KVLEYVIKVS (MAGA1_HUMAN)
KVLEYVIKVV

SEQ ID NO: 48642 - protein, 10 aa, Artificial Sequence
  Description of Artificial Sequence: Synthetic peptide
  Seed: YEFLWGPRAL (MAGA1_HUMAN)
YPFLWGPRAL

SEQ ID NO: 48643 - protein, 10 aa, Artificial Sequence
  Description of Artificial Sequence: Synthetic peptide
  Seed: DLVGFLLLKY (MAGA1_HUMAN)
DMVGFLLLKK

SEQ ID NO: 48644 - protein, 10 aa, Artificial Sequence
  Description of Artificial Sequence: Synthetic peptide
  Seed: LVGFLLLKYR (MAGA1_HUMAN)
LSGFLLLKYR

SEQ ID NO: 48645 - protein, 9 aa, Artificial Sequence
  Description of Artificial Sequence: Synthetic peptide
  Seed: VQAATSSSS (MAGA1_HUMAN)
VIAATSSSM

SEQ ID NO: 48646 - protein, 10 aa, Artificial Sequence
  Description of Artificial Sequence: Synthetic peptide
  Seed: EMLESVIKNY (MAGA1_HUMAN)
ETLESVIKNK

SEQ ID NO: 48647 - protein, 11 aa, Artificial Sequence
  Description of Artificial Sequence: Synthetic peptide
  Seed: RQVPDSDPARY (MAGA1_HUMAN)
RVVPDSDPARR

SEQ ID NO: 48648 - protein, 9 aa, Artificial Sequence
  Description of Artificial Sequence: Synthetic peptide
  Seed: FLWGPRALA (MAGA1_HUMAN)
FLWGPRALT

SEQ ID NO: 48649 - protein, 9 aa, Artificial Sequence
  Description of Artificial Sequence: Synthetic peptide
  Seed: KVSARVRFF (MAGA1_HUMAN)
KTSARVRFY

SEQ ID NO: 48650 - protein, 10 aa, Artificial Sequence
  Description of Artificial Sequence: Synthetic peptide
  Seed: KEADPTGHSY (MAGA1_HUMAN)
KTADPTGHSK

SEQ ID NO: 48651 - protein, 10 aa, Artificial Sequence
  Description of Artificial Sequence: Synthetic peptide
  Seed: SARVRFFFPS (MAGA1_HUMAN)
SERVRFFFPI

SEQ ID NO: 48652 - protein, 9 aa, Artificial Sequence
  Description of Artificial Sequence: Synthetic peptide
  Seed: SVMEVYDGR (MAGA1_HUMAN)
SAMEVYDGY

SEQ ID NO: 48653 - protein, 11 aa, Artificial Sequence
  Description of Artificial Sequence: Synthetic peptide
  Seed: KLLTQDLVQEK (MAGA1_HUMAN)
KMLTQDLVQEK

SEQ ID NO: 48654 - protein, 9 aa, Artificial Sequence
  Description of Artificial Sequence: Synthetic peptide
  Seed: LVTCLGLSY (MAGA1_HUMAN)
LVTCLGLSW

SEQ ID NO: 48655 - protein, 9 aa, Artificial Sequence
  Description of Artificial Sequence: Synthetic peptide
  Seed: VIKNYKHCF (MAGA1_HUMAN)
VTKNYKHCY

SEQ ID NO: 48656 - protein, 10 aa, Artificial Sequence
  Description of Artificial Sequence: Synthetic peptide
  Seed: YEFLWGPRAL (MAGA1_HUMAN)
YFFLWGPRAM

SEQ ID NO: 48657 - protein, 9 aa, Artificial Sequence
  Description of Artificial Sequence: Synthetic peptide
  Seed: ALEAQQEAL (MAGA1_HUMAN)
AAEAQQEAL

SEQ ID NO: 48658 - protein, 9 aa, Artificial Sequence
  Description of Artificial Sequence: Synthetic peptide
  Seed: LVGFLLLKY (MAGA1_HUMAN)
LQGFLLLKY

SEQ ID NO: 48659 - protein, 9 aa, Artificial Sequence
  Description of Artificial Sequence: Synthetic peptide
  Seed: RVRFFFPSL (MAGA1_HUMAN)
RARFFFPSI

SEQ ID NO: 48660 - protein, 9 aa, Artificial Sequence
  Description of Artificial Sequence: Synthetic peptide
  Seed: YVIKVSARV (MAGA1_HUMAN)
YQIKVSARI

SEQ ID NO: 48661 - protein, 9 aa, Artificial Sequence
  Description of Artificial Sequence: Synthetic peptide
  Seed: HSYVLVTCL (MAGA1_HUMAN)
HQYVLVTCL

SEQ ID NO: 48662 - protein, 11 aa, Artificial Sequence
  Description of Artificial Sequence: Synthetic peptide
  Seed: EIFGKASESLQ (MAGA1_HUMAN)
EAFGKASESLR

SEQ ID NO: 48663 - protein, 10 aa, Artificial Sequence
  Description of Artificial Sequence: Synthetic peptide
  Seed: RFFFPSLREA (MAGA1_HUMAN)
RQFFPSLREK

SEQ ID NO: 48664 - protein, 9 aa, Artificial Sequence
  Description of Artificial Sequence: Synthetic peptide
  Seed: EADPTGHSY (MAGA1_HUMAN)
ELDPTGHSL

SEQ ID NO: 48665 - protein, 10 aa, Artificial Sequence
  Description of Artificial Sequence: Synthetic peptide
  Seed: RVRFFFPSLR (MAGA1_HUMAN)
RNRFFFPSLF

SEQ ID NO: 48666 - protein, 9 aa, Artificial Sequence
  Description of Artificial Sequence: Synthetic peptide
  Seed: QSPQGASAF (MAGA1_HUMAN)
QIPQGASAR

SEQ ID NO: 48667 - protein, 9 aa, Artificial Sequence
  Description of Artificial Sequence: Synthetic peptide
  Seed: TKAEMLESV (MAGA1_HUMAN)
TQAEMLESL

SEQ ID NO: 48668 - protein, 9 aa, Artificial Sequence
  Description of Artificial Sequence: Synthetic peptide
  Seed: EADPTGHSY (MAGA1_HUMAN)
EQDPTGHSY

SEQ ID NO: 48669 - protein, 11 aa, Artificial Sequence
  Description of Artificial Sequence: Synthetic peptide
  Seed: RALAETSYVKV (MAGA1_HUMAN)
RLLAETSYVKL

SEQ ID NO: 48670 - protein, 10 aa, Artificial Sequence
  Description of Artificial Sequence: Synthetic peptide
  Seed: FLWGPRALAE (MAGA1_HUMAN)
FVWGPRALAL

SEQ ID NO: 48671 - protein, 9 aa, Artificial Sequence
  Description of Artificial Sequence: Synthetic peptide
  Seed: KVADLVGFL (MAGA1_HUMAN)
KTADLVGFI

SEQ ID NO: 48672 - protein, 9 aa, Artificial Sequence
  Description of Artificial Sequence: Synthetic peptide
  Seed: RVRFFFPSL (MAGA1_HUMAN)
RHRFFFPSF

SEQ ID NO: 48673 - protein, 9 aa, Artificial Sequence
  Description of Artificial Sequence: Synthetic peptide
  Seed: EADPTGHSY (MAGA1_HUMAN)
EADPTGHSV

SEQ ID NO: 48674 - protein, 10 aa, Artificial Sequence
  Description of Artificial Sequence: Synthetic peptide
  Seed: RALAETSYVK (MAGA1_HUMAN)
RTLAETSYVK

SEQ ID NO: 48675 - protein, 9 aa, Artificial Sequence
  Description of Artificial Sequence: Synthetic peptide
  Seed: SAYGEPRKL (MAGA1_HUMAN)
SSYGEPRKI

SEQ ID NO: 48676 - protein, 8 aa, Artificial Sequence
  Description of Artificial Sequence: Synthetic peptide
  Seed: SSSSPLVL (MAGA1_HUMAN)
SASSPLVL

SEQ ID NO: 48677 - protein, 9 aa, Artificial Sequence
  Description of Artificial Sequence: Synthetic peptide
  Seed: CILESLFRA (MAGA1_HUMAN)
CALESLFRL

SEQ ID NO: 48678 - protein, 9 aa, Artificial Sequence
  Description of Artificial Sequence: Synthetic peptide
  Seed: NQIMPKTGF (MAGA1_HUMAN)
NQIMPKTGY

SEQ ID NO: 48679 - protein, 10 aa, Artificial Sequence
  Description of Artificial Sequence: Synthetic peptide
  Seed: AQQEALGLVC (MAGA1_HUMAN)
AMQEALGLVF

SEQ ID NO: 48680 - protein, 10 aa, Artificial Sequence
  Description of Artificial Sequence: Synthetic peptide
  Seed: RYEFLWGPRA (MAGA1_HUMAN)
RYEFLWGPRK

SEQ ID NO: 48681 - protein, 9 aa, Artificial Sequence
  Description of Artificial Sequence: Synthetic peptide
  Seed: QSPQGASAF (MAGA1_HUMAN)
QIPQGASAV

SEQ ID NO: 48682 - protein, 9 aa, Artificial Sequence
  Description of Artificial Sequence: Synthetic peptide
  Seed: SARVRFFFP (MAGA1_HUMAN)
STRVRFFFI

SEQ ID NO: 48683 - protein, 9 aa, Artificial Sequence
  Description of Artificial Sequence: Synthetic peptide
  Seed: SYVKVLEYV (MAGA1_HUMAN)
SLVKVLEYI

SEQ ID NO: 48684 - protein, 9 aa, Artificial Sequence
  Description of Artificial Sequence: Synthetic peptide
  Seed: IFGKASESL (MAGA1_HUMAN)
IWGKASESL

SEQ ID NO: 48685 - protein, 9 aa, Artificial Sequence
  Description of Artificial Sequence: Synthetic peptide
  Seed: RVRFFFPSL (MAGA1_HUMAN)
RPRFFFPSM

SEQ ID NO: 48686 - protein, 9 aa, Artificial Sequence
  Description of Artificial Sequence: Synthetic peptide
  Seed: LVTCLGLSY (MAGA1_HUMAN)
LTTCLGLSY

SEQ ID NO: 48687 - protein, 9 aa, Artificial Sequence
  Description of Artificial Sequence: Synthetic peptide
  Seed: STSCILESL (MAGA1_HUMAN)
SQSCILESW

SEQ ID NO: 48688 - protein, 10 aa, Artificial Sequence
  Description of Artificial Sequence: Synthetic peptide
  Seed: ATSSSSPLVL (MAGA1_HUMAN)
AQSSSSPLVL

SEQ ID NO: 48689 - protein, 9 aa, Artificial Sequence
  Description of Artificial Sequence: Synthetic peptide
  Seed: VQAATSSSS (MAGA1_HUMAN)
VSAATSSSF

SEQ ID NO: 48690 - protein, 9 aa, Artificial Sequence
  Description of Artificial Sequence: Synthetic peptide
  Seed: EADPTGHSY (MAGA1_HUMAN)
ESDPTGHSM

SEQ ID NO: 48691 - protein, 9 aa, Artificial Sequence
  Description of Artificial Sequence: Synthetic peptide
  Seed: IAMEGGHAP (MAGA1_HUMAN)
IVMEGGHAH

SEQ ID NO: 48692 - protein, 10 aa, Artificial Sequence
  Description of Artificial Sequence: Synthetic peptide
  Seed: ALAETSYVKV (MAGA1_HUMAN)
AMAETSYVKL

SEQ ID NO: 48693 - protein, 9 aa, Artificial Sequence
  Description of Artificial Sequence: Synthetic peptide
  Seed: VQAATSSSS (MAGA1_HUMAN)
VAAATSSSY

SEQ ID NO: 48694 - protein, 9 aa, Artificial Sequence
  Description of Artificial Sequence: Synthetic peptide
  Seed: GASAFPTTI (MAGA1_HUMAN)
GSSAFPTTW

SEQ ID NO: 48695 - protein, 10 aa, Artificial Sequence
  Description of Artificial Sequence: Synthetic peptide
  Seed: TSYVKVLEYV (MAGA1_HUMAN)
TCYVKVLEYF

SEQ ID NO: 48696 - protein, 9 aa, Artificial Sequence
  Description of Artificial Sequence: Synthetic peptide
  Seed: STDPPQSPQ (MAGA1_HUMAN)
SWDPPQSPV

SEQ ID NO: 48697 - protein, 9 aa, Artificial Sequence
  Description of Artificial Sequence: Synthetic peptide
  Seed: FPSLREAAL (MAGA1_HUMAN)
FVSLREAAY

SEQ ID NO: 48698 - protein, 10 aa, Artificial Sequence
  Description of Artificial Sequence: Synthetic peptide
  Seed: KNYKHCFPEI (MAGA1_HUMAN)
KSYKHCFPEF

SEQ ID NO: 48699 - protein, 9 aa, Artificial Sequence
  Description of Artificial Sequence: Synthetic peptide
  Seed: FFFPSLREA (MAGA1_HUMAN)
FNFPSLREI

SEQ ID NO: 48700 - protein, 9 aa, Artificial Sequence
  Description of Artificial Sequence: Synthetic peptide
  Seed: SAFPTTINF (MAGA1_HUMAN)
SVFPTTINM

SEQ ID NO: 48701 - protein, 9 aa, Artificial Sequence
  Description of Artificial Sequence: Synthetic peptide
  Seed: QSPQGASAF (MAGA1_HUMAN)
QFPQGASAF

SEQ ID NO: 48702 - protein, 9 aa, Artificial Sequence
  Description of Artificial Sequence: Synthetic peptide
  Seed: DSDPARYEF (MAGA1_HUMAN)
DLDPARYEM

SEQ ID NO: 48703 - protein, 9 aa, Artificial Sequence
  Description of Artificial Sequence: Synthetic peptide
  Seed: EADPTGHSY (MAGA1_HUMAN)
EPDPTGHSY

SEQ ID NO: 48704 - protein, 9 aa, Artificial Sequence
  Description of Artificial Sequence: Synthetic peptide
  Seed: GLLGDNQIM (MAGA1_HUMAN)
GQLGDNQII

SEQ ID NO: 48705 - protein, 11 aa, Artificial Sequence
  Description of Artificial Sequence: Synthetic peptide
  Seed: YEFLWGPRALA (MAGA1_HUMAN)
YKFLWGPRALI

SEQ ID NO: 48706 - protein, 9 aa, Artificial Sequence
  Description of Artificial Sequence: Synthetic peptide
  Seed: LTQDLVQEK (MAGA1_HUMAN)
LSQDLVQEV

SEQ ID NO: 48707 - protein, 10 aa, Artificial Sequence
  Description of Artificial Sequence: Synthetic peptide
  Seed: KVLEYVIKVS (MAGA1_HUMAN)
KLLEYVIKVS

SEQ ID NO: 48708 - protein, 11 aa, Artificial Sequence
  Description of Artificial Sequence: Synthetic peptide
  Seed: KYRAREPVTKA (MAGA1_HUMAN)
KSRAREPVTKK

SEQ ID NO: 48709 - protein, 9 aa, Artificial Sequence
  Description of Artificial Sequence: Synthetic peptide
  Seed: AYGEPRKLL (MAGA1_HUMAN)
ARGEPRKLY

SEQ ID NO: 48710 - protein, 9 aa, Artificial Sequence
  Description of Artificial Sequence: Synthetic peptide
  Seed: LESLFRAVI (MAGA1_HUMAN)
LMSLFRAVY

SEQ ID NO: 48711 - protein, 9 aa, Artificial Sequence
  Description of Artificial Sequence: Synthetic peptide
  Seed: VSARVRFFF (MAGA1_HUMAN)
VWARVRFFF

SEQ ID NO: 48712 - protein, 11 aa, Artificial Sequence
  Description of Artificial Sequence: Synthetic peptide
  Seed: KLLTQDLVQEK (MAGA1_HUMAN)
KVLTQDLVQEK

SEQ ID NO: 48713 - protein, 9 aa, Artificial Sequence
  Description of Artificial Sequence: Synthetic peptide
  Seed: KASESLQLV (MAGA1_HUMAN)
KLSESLQLR

SEQ ID NO: 48714 - protein, 9 aa, Artificial Sequence
  Description of Artificial Sequence: Synthetic peptide
  Seed: GPRALAETS (MAGA1_HUMAN)
GPRALAETI

SEQ ID NO: 48715 - protein, 9 aa, Artificial Sequence
  Description of Artificial Sequence: Synthetic peptide
  Seed: SAYGEPRKL (MAGA1_HUMAN)
SYYGEPRKF

SEQ ID NO: 48716 - protein, 9 aa, Artificial Sequence
  Description of Artificial Sequence: Synthetic peptide
  Seed: RVRFFFPSL (MAGA1_HUMAN)
RWRFFFPSK

SEQ ID NO: 48717 - protein, 10 aa, Artificial Sequence
  Description of Artificial Sequence: Synthetic peptide
  Seed: GPRALAETSY (MAGA1_HUMAN)
GPRALAETSM

SEQ ID NO: 48718 - protein, 9 aa, Artificial Sequence
  Description of Artificial Sequence: Synthetic peptide
  Seed: FPTTINFTR (MAGA1_HUMAN)
FMTTINFTF

SEQ ID NO: 48719 - protein, 9 aa, Artificial Sequence
  Description of Artificial Sequence: Synthetic peptide
  Seed: FFFPSLREA (MAGA1_HUMAN)
FSFPSLREF

SEQ ID NO: 48720 - protein, 11 aa, Artificial Sequence
  Description of Artificial Sequence: Synthetic peptide
  Seed: ELSVMEVYDGR (MAGA1_HUMAN)
ECSVMEVYDGR

SEQ ID NO: 48721 - protein, 9 aa, Artificial Sequence
  Description of Artificial Sequence: Synthetic peptide
  Seed: SAYGEPRKL (MAGA1_HUMAN)
SNYGEPRKL

SEQ ID NO: 48722 - protein, 9 aa, Artificial Sequence
  Description of Artificial Sequence: Synthetic peptide
  Seed: EADPTGHSY (MAGA1_HUMAN)
EIDPTGHSV

SEQ ID NO: 48723 - protein, 10 aa, Artificial Sequence
  Description of Artificial Sequence: Synthetic peptide
  Seed: TSYVKVLEYV (MAGA1_HUMAN)
TVYVKVLEYV

SEQ ID NO: 48724 - protein, 11 aa, Artificial Sequence
  Description of Artificial Sequence: Synthetic peptide
  Seed: IKVSARVRFFF (MAGA1_HUMAN)
ISVSARVRFFW

SEQ ID NO: 48725 - protein, 10 aa, Artificial Sequence
  Description of Artificial Sequence: Synthetic peptide
  Seed: EIFGKASESL (MAGA1_HUMAN)
ESFGKASESV

SEQ ID NO: 48726 - protein, 9 aa, Artificial Sequence
  Description of Artificial Sequence: Synthetic peptide
  Seed: AYGEPRKLL (MAGA1_HUMAN)
AYGEPRKLM

SEQ ID NO: 48727 - protein, 10 aa, Artificial Sequence
  Description of Artificial Sequence: Synthetic peptide
  Seed: SARVRFFFPS (MAGA1_HUMAN)
SERVRFFFPL

SEQ ID NO: 48728 - protein, 10 aa, Artificial Sequence
  Description of Artificial Sequence: Synthetic peptide
  Seed: TSYVKVLEYV (MAGA1_HUMAN)
TAYVKVLEYF

SEQ ID NO: 48729 - protein, 11 aa, Artificial Sequence
  Description of Artificial Sequence: Synthetic peptide
  Seed: FGKASESLQLV (MAGA1_HUMAN)
FMKASESLQLL

SEQ ID NO: 48730 - protein, 9 aa, Artificial Sequence
  Description of Artificial Sequence: Synthetic peptide
  Seed: SVMEVYDGR (MAGA1_HUMAN)
SAMEVYDGF

SEQ ID NO: 48731 - protein, 10 aa, Artificial Sequence
  Description of Artificial Sequence: Synthetic peptide
  Seed: RVRFFFPSLR (MAGA1_HUMAN)
RDRFFFPSLM

SEQ ID NO: 48732 - protein, 10 aa, Artificial Sequence
  Description of Artificial Sequence: Synthetic peptide
  Seed: LVLGTLEEVP (MAGA1_HUMAN)
LILGTLEEVV

SEQ ID NO: 48733 - protein, 10 aa, Artificial Sequence
  Description of Artificial Sequence: Synthetic peptide
  Seed: ARVRFFFPSL (MAGA1_HUMAN)
ATVRFFFPSA

SEQ ID NO: 48734 - protein, 10 aa, Artificial Sequence
  Description of Artificial Sequence: Synthetic peptide
  Seed: ADLVGFLLLK (MAGA1_HUMAN)
AFLVGFLLLR

SEQ ID NO: 48735 - protein, 9 aa, Artificial Sequence
  Description of Artificial Sequence: Synthetic peptide
  Seed: TSYVKVLEY (MAGA1_HUMAN)
TVYVKVLEL

SEQ ID NO: 48736 - protein, 9 aa, Artificial Sequence
  Description of Artificial Sequence: Synthetic peptide
  Seed: GTLEEVPTA (MAGA1_HUMAN)
GVLEEVPTM

SEQ ID NO: 48737 - protein, 9 aa, Artificial Sequence
  Description of Artificial Sequence: Synthetic peptide
  Seed: VIKNYKHCF (MAGA1_HUMAN)
VQKNYKHCF

SEQ ID NO: 48738 - protein, 10 aa, Artificial Sequence
  Description of Artificial Sequence: Synthetic peptide
  Seed: RALAETSYVK (MAGA1_HUMAN)
RSLAETSYVK

SEQ ID NO: 48739 - protein, 10 aa, Artificial Sequence
  Description of Artificial Sequence: Synthetic peptide
  Seed: RAREPVTKAE (MAGA1_HUMAN)
RAREPVTKAK

SEQ ID NO: 48740 - protein, 10 aa, Artificial Sequence
  Description of Artificial Sequence: Synthetic peptide
  Seed: EVYDGREHSA (MAGA1_HUMAN)
EVYDGREHSY

SEQ ID NO: 48741 - protein, 9 aa, Artificial Sequence
  Description of Artificial Sequence: Synthetic peptide
  Seed: SARVRFFFP (MAGA1_HUMAN)
SARVRFFFM

SEQ ID NO: 48742 - protein, 9 aa, Artificial Sequence
  Description of Artificial Sequence: Synthetic peptide
  Seed: KVLEYVIKV (MAGA1_HUMAN)
KHLEYVIKL

SEQ ID NO: 48743 - protein, 9 aa, Artificial Sequence
  Description of Artificial Sequence: Synthetic peptide
  Seed: SSPLVLGTL (MAGA1_HUMAN)
SVPLVLGTM

SEQ ID NO: 48744 - protein, 10 aa, Artificial Sequence
  Description of Artificial Sequence: Synthetic peptide
  Seed: SARVRFFFPS (MAGA1_HUMAN)
SARVRFFFPF

SEQ ID NO: 48745 - protein, 9 aa, Artificial Sequence
  Description of Artificial Sequence: Synthetic peptide
  Seed: SARVRFFFP (MAGA1_HUMAN)
SMRVRFFFA

SEQ ID NO: 48746 - protein, 9 aa, Artificial Sequence
  Description of Artificial Sequence: Synthetic peptide
  Seed: KVADLVGFL (MAGA1_HUMAN)
KVADLVGFW

SEQ ID NO: 48747 - protein, 10 aa, Artificial Sequence
  Description of Artificial Sequence: Synthetic peptide
  Seed: AQQEALGLVC (MAGA1_HUMAN)
AEQEALGLVC

SEQ ID NO: 48748 - protein, 9 aa, Artificial Sequence
  Description of Artificial Sequence: Synthetic peptide
  Seed: SAFPTTINF (MAGA1_HUMAN)
SMFPTTINR

SEQ ID NO: 48749 - protein, 10 aa, Artificial Sequence
  Description of Artificial Sequence: Synthetic peptide
  Seed: YEFLWGPRAL (MAGA1_HUMAN)
YGFLWGPRAM

SEQ ID NO: 48750 - protein, 10 aa, Artificial Sequence
  Description of Artificial Sequence: Synthetic peptide
  Seed: VTKAEMLESV (MAGA1_HUMAN)
VLKAEMLESL

SEQ ID NO: 48751 - protein, 9 aa, Artificial Sequence
  Description of Artificial Sequence: Synthetic peptide
  Seed: RALAETSYV (MAGA1_HUMAN)
RALAETSYW

SEQ ID NO: 48752 - protein, 9 aa, Artificial Sequence
  Description of Artificial Sequence: Synthetic peptide
  Seed: REPVTKAEM (MAGA1_HUMAN)
RRPVTKAEY

SEQ ID NO: 48753 - protein, 9 aa, Artificial Sequence
  Description of Artificial Sequence: Synthetic peptide
  Seed: SARVRFFFP (MAGA1_HUMAN)
SSRVRFFFS

SEQ ID NO: 48754 - protein, 9 aa, Artificial Sequence
  Description of Artificial Sequence: Synthetic peptide
  Seed: LKYRAREPV (MAGA1_HUMAN)
LSYRAREPF

SEQ ID NO: 48755 - protein, 9 aa, Artificial Sequence
  Description of Artificial Sequence: Synthetic peptide
  Seed: MPKTGFLII (MAGA1_HUMAN)
MLKTGFLIF

SEQ ID NO: 48756 - protein, 9 aa, Artificial Sequence
  Description of Artificial Sequence: Synthetic peptide
  Seed: GDNQIMPKT (MAGA1_HUMAN)
GENQIMPKA

SEQ ID NO: 48757 - protein, 10 aa, Artificial Sequence
  Description of Artificial Sequence: Synthetic peptide
  Seed: ADLVGFLLLK (MAGA1_HUMAN)
AVLVGFLLLK

SEQ ID NO: 48758 - protein, 9 aa, Artificial Sequence
  Description of Artificial Sequence: Synthetic peptide
  Seed: RVRFFFPSL (MAGA1_HUMAN)
RGRFFFPSP

SEQ ID NO: 48759 - protein, 9 aa, Artificial Sequence
  Description of Artificial Sequence: Synthetic peptide
  Seed: SAFPTTINF (MAGA1_HUMAN)
SPFPTTINM

SEQ ID NO: 48760 - protein, 9 aa, Artificial Sequence
  Description of Artificial Sequence: Synthetic peptide
  Seed: IMPKTGFLI (MAGA1_HUMAN)
IAPKTGFLF

SEQ ID NO: 48761 - protein, 10 aa, Artificial Sequence
  Description of Artificial Sequence: Synthetic peptide
  Seed: RVRFFFPSLR (MAGA1_HUMAN)
RTRFFFPSLA

SEQ ID NO: 48762 - protein, 10 aa, Artificial Sequence
  Description of Artificial Sequence: Synthetic peptide
  Seed: KVADLVGFLL (MAGA1_HUMAN)
KMADLVGFLR

SEQ ID NO: 48763 - protein, 10 aa, Artificial Sequence
  Description of Artificial Sequence: Synthetic peptide
  Seed: SARVRFFFPS (MAGA1_HUMAN)
SMRVRFFFPK

SEQ ID NO: 48764 - protein, 9 aa, Artificial Sequence
  Description of Artificial Sequence: Synthetic peptide
  Seed: TSYVKVLEY (MAGA1_HUMAN)
TSYVKVLEM

SEQ ID NO: 48765 - protein, 9 aa, Artificial Sequence
  Description of Artificial Sequence: Synthetic peptide
  Seed: VADLVGFLL (MAGA1_HUMAN)
VGDLVGFLY

SEQ ID NO: 48766 - protein, 9 aa, Artificial Sequence
  Description of Artificial Sequence: Synthetic peptide
  Seed: HCFPEIFGK (MAGA1_HUMAN)
HLFPEIFGL

SEQ ID NO: 48767 - protein, 9 aa, Artificial Sequence
  Description of Artificial Sequence: Synthetic peptide
  Seed: GASAFPTTI (MAGA1_HUMAN)
GMSAFPTTV

SEQ ID NO: 48768 - protein, 9 aa, Artificial Sequence
  Description of Artificial Sequence: Synthetic peptide
  Seed: LVLGTLEEV (MAGA1_HUMAN)
LILGTLEEI

SEQ ID NO: 48769 - protein, 11 aa, Artificial Sequence
  Description of Artificial Sequence: Synthetic peptide
  Seed: FLWGPRALAET (MAGA1_HUMAN)
FMWGPRALAEM

SEQ ID NO: 48770 - protein, 10 aa, Artificial Sequence
  Description of Artificial Sequence: Synthetic peptide
  Seed: RVRFFFPSLR (MAGA1_HUMAN)
RTRFFFPSLY

SEQ ID NO: 48771 - protein, 9 aa, Artificial Sequence
  Description of Artificial Sequence: Synthetic peptide
  Seed: SAYGEPRKL (MAGA1_HUMAN)
SAYGEPRKI

SEQ ID NO: 48772 - protein, 9 aa, Artificial Sequence
  Description of Artificial Sequence: Synthetic peptide
  Seed: ASESLQLVF (MAGA1_HUMAN)
AKESLQLVF

SEQ ID NO: 48773 - protein, 9 aa, Artificial Sequence
  Description of Artificial Sequence: Synthetic peptide
  Seed: SARVRFFFP (MAGA1_HUMAN)
SMRVRFFFY

SEQ ID NO: 48774 - protein, 9 aa, Artificial Sequence
  Description of Artificial Sequence: Synthetic peptide
  Seed: TSYVKVLEY (MAGA1_HUMAN)
TGYVKVLEW

SEQ ID NO: 48775 - protein, 9 aa, Artificial Sequence
  Description of Artificial Sequence: Synthetic peptide
  Seed: EADPTGHSY (MAGA1_HUMAN)
ELDPTGHSY

SEQ ID NO: 48776 - protein, 9 aa, Artificial Sequence
  Description of Artificial Sequence: Synthetic peptide
  Seed: TSYVKVLEY (MAGA1_HUMAN)
THYVKVLEL

SEQ ID NO: 48777 - protein, 10 aa, Artificial Sequence
  Description of Artificial Sequence: Synthetic peptide
  Seed: ADLVGFLLLK (MAGA1_HUMAN)
AKLVGFLLLK

SEQ ID NO: 48778 - protein, 10 aa, Artificial Sequence
  Description of Artificial Sequence: Synthetic peptide
  Seed: RVRFFFPSLR (MAGA1_HUMAN)
RCRFFFPSLH

SEQ ID NO: 48779 - protein, 10 aa, Artificial Sequence
  Description of Artificial Sequence: Synthetic peptide
  Seed: WEELSVMEVY (MAGA1_HUMAN)
WQELSVMEVY

SEQ ID NO: 48780 - protein, 10 aa, Artificial Sequence
  Description of Artificial Sequence: Synthetic peptide
  Seed: KVLEYVIKVS (MAGA1_HUMAN)
KMLEYVIKVD

SEQ ID NO: 48781 - protein, 10 aa, Artificial Sequence
  Description of Artificial Sequence: Synthetic peptide
  Seed: WEELSVMEVY (MAGA1_HUMAN)
WPELSVMEVW

SEQ ID NO: 48782 - protein, 10 aa, Artificial Sequence
  Description of Artificial Sequence: Synthetic peptide
  Seed: REEEGPSTSC (MAGA1_HUMAN)
REEEGPSTST

SEQ ID NO: 48783 - protein, 11 aa, Artificial Sequence
  Description of Artificial Sequence: Synthetic peptide
  Seed: KVADLVGFLLL (MAGA1_HUMAN)
KTADLVGFLLF

SEQ ID NO: 48784 - protein, 9 aa, Artificial Sequence
  Description of Artificial Sequence: Synthetic peptide
  Seed: FFFPSLREA (MAGA1_HUMAN)
FRFPSLREY

SEQ ID NO: 48785 - protein, 10 aa, Artificial Sequence
  Description of Artificial Sequence: Synthetic peptide
  Seed: QIMPKTGFLI (MAGA1_HUMAN)
QMMPKTGFLM

SEQ ID NO: 48786 - protein, 9 aa, Artificial Sequence
  Description of Artificial Sequence: Synthetic peptide
  Seed: SYVKVLEYV (MAGA1_HUMAN)
SAVKVLEYM

SEQ ID NO: 48787 - protein, 9 aa, Artificial Sequence
  Description of Artificial Sequence: Synthetic peptide
  Seed: IMPKTGFLI (MAGA1_HUMAN)
IWPKTGFLV

SEQ ID NO: 48788 - protein, 9 aa, Artificial Sequence
  Description of Artificial Sequence: Synthetic peptide
  Seed: HCFPEIFGK (MAGA1_HUMAN)
HWFPEIFGR

SEQ ID NO: 48789 - protein, 10 aa, Artificial Sequence
  Description of Artificial Sequence: Synthetic peptide
  Seed: SARVRFFFPS (MAGA1_HUMAN)
SQRVRFFFPK

SEQ ID NO: 48790 - protein, 9 aa, Artificial Sequence
  Description of Artificial Sequence: Synthetic peptide
  Seed: STDPPQSPQ (MAGA1_HUMAN)
STDPPQSPM

SEQ ID NO: 48791 - protein, 9 aa, Artificial Sequence
  Description of Artificial Sequence: Synthetic peptide
  Seed: DSDPARYEF (MAGA1_HUMAN)
DWDPARYEF

SEQ ID NO: 48792 - protein, 10 aa, Artificial Sequence
  Description of Artificial Sequence: Synthetic peptide
  Seed: ARVRFFFPSL (MAGA1_HUMAN)
AGVRFFFPSK

SEQ ID NO: 48793 - protein, 9 aa, Artificial Sequence
  Description of Artificial Sequence: Synthetic peptide
  Seed: ALAETSYVK (MAGA1_HUMAN)
ALAETSYVR

SEQ ID NO: 48794 - protein, 10 aa, Artificial Sequence
  Description of Artificial Sequence: Synthetic peptide
  Seed: EVYDGREHSA (MAGA1_HUMAN)
ELYDGREHSV

SEQ ID NO: 48795 - protein, 9 aa, Artificial Sequence
  Description of Artificial Sequence: Synthetic peptide
  Seed: RQVPDSDPA (MAGA1_HUMAN)
RTVPDSDPV

SEQ ID NO: 48796 - protein, 10 aa, Artificial Sequence
  Description of Artificial Sequence: Synthetic peptide
  Seed: RYEFLWGPRA (MAGA1_HUMAN)
RDEFLWGPRL

SEQ ID NO: 48797 - protein, 11 aa, Artificial Sequence
  Description of Artificial Sequence: Synthetic peptide
  Seed: STDPPQSPQGA (MAGA1_HUMAN)
STDPPQSPQGI

SEQ ID NO: 48798 - protein, 9 aa, Artificial Sequence
  Description of Artificial Sequence: Synthetic peptide
  Seed: TTINFTRQR (MAGA1_HUMAN)
TVINFTRQL

SEQ ID NO: 48799 - protein, 9 aa, Artificial Sequence
  Description of Artificial Sequence: Synthetic peptide
  Seed: ARYEFLWGP (MAGA1_HUMAN)
ARYEFLWGL

SEQ ID NO: 48800 - protein, 9 aa, Artificial Sequence
  Description of Artificial Sequence: Synthetic peptide
  Seed: AETSYVKVL (MAGA1_HUMAN)
ADTSYVKVF

SEQ ID NO: 48801 - protein, 9 aa, Artificial Sequence
  Description of Artificial Sequence: Synthetic peptide
  Seed: VYDGREHSA (MAGA1_HUMAN)
VNDGREHSI

SEQ ID NO: 48802 - protein, 11 aa, Artificial Sequence
  Description of Artificial Sequence: Synthetic peptide
  Seed: YEFLWGPRALA (MAGA1_HUMAN)
YRFLWGPRALV

SEQ ID NO: 48803 - protein, 10 aa, Artificial Sequence
  Description of Artificial Sequence: Synthetic peptide
  Seed: ETSYVKVLEY (MAGA1_HUMAN)
ESSYVKVLEK

SEQ ID NO: 48804 - protein, 9 aa, Artificial Sequence
  Description of Artificial Sequence: Synthetic peptide
  Seed: LHCKPEEAL (MAGA1_HUMAN)
LHCKPEEAF

SEQ ID NO: 48805 - protein, 10 aa, Artificial Sequence
  Description of Artificial Sequence: Synthetic peptide
  Seed: LTQDLVQEKY (MAGA1_HUMAN)
LIQDLVQEKW

SEQ ID NO: 48806 - protein, 9 aa, Artificial Sequence
  Description of Artificial Sequence: Synthetic peptide
  Seed: KTGFLIIVL (MAGA1_HUMAN)
KVGFLIIVV

SEQ ID NO: 48807 - protein, 9 aa, Artificial Sequence
  Description of Artificial Sequence: Synthetic peptide
  Seed: TGFLIIVLV (MAGA1_HUMAN)
TVFLIIVLI

SEQ ID NO: 48808 - protein, 10 aa, Artificial Sequence
  Description of Artificial Sequence: Synthetic peptide
  Seed: KVADLVGFLL (MAGA1_HUMAN)
KLADLVGFLM

SEQ ID NO: 48809 - protein, 9 aa, Artificial Sequence
  Description of Artificial Sequence: Synthetic peptide
  Seed: HCFPEIFGK (MAGA1_HUMAN)
HSFPEIFGK

SEQ ID NO: 48810 - protein, 9 aa, Artificial Sequence
  Description of Artificial Sequence: Synthetic peptide
  Seed: HCFPEIFGK (MAGA1_HUMAN)
HIFPEIFGK

SEQ ID NO: 48811 - protein, 10 aa, Artificial Sequence
  Description of Artificial Sequence: Synthetic peptide
  Seed: KEADPTGHSY (MAGA1_HUMAN)
KIADPTGHSM

SEQ ID NO: 48812 - protein, 9 aa, Artificial Sequence
  Description of Artificial Sequence: Synthetic peptide
  Seed: KASESLQLV (MAGA1_HUMAN)
KISESLQLR

SEQ ID NO: 48813 - protein, 9 aa, Artificial Sequence
  Description of Artificial Sequence: Synthetic peptide
  Seed: EIWEELSVM (MAGA1_HUMAN)
EVWEELSVV

SEQ ID NO: 48814 - protein, 9 aa, Artificial Sequence
  Description of Artificial Sequence: Synthetic peptide
  Seed: VQEKYLEYR (MAGA1_HUMAN)
VMEKYLEYR

SEQ ID NO: 48815 - protein, 10 aa, Artificial Sequence
  Description of Artificial Sequence: Synthetic peptide
  Seed: TSYVKVLEYV (MAGA1_HUMAN)
THYVKVLEYL

SEQ ID NO: 48816 - protein, 9 aa, Artificial Sequence
  Description of Artificial Sequence: Synthetic peptide
  Seed: FLIIVLVMI (MAGA1_HUMAN)
FIIIVLVMV

SEQ ID NO: 48817 - protein, 9 aa, Artificial Sequence
  Description of Artificial Sequence: Synthetic peptide
  Seed: SARVRFFFP (MAGA1_HUMAN)
SMRVRFFFT

SEQ ID NO: 48818 - protein, 10 aa, Artificial Sequence
  Description of Artificial Sequence: Synthetic peptide
  Seed: FLWGPRALAE (MAGA1_HUMAN)
FMWGPRALAC

SEQ ID NO: 48819 - protein, 10 aa, Artificial Sequence
  Description of Artificial Sequence: Synthetic peptide
  Seed: KVSARVRFFF (MAGA1_HUMAN)
KDSARVRFFK

SEQ ID NO: 48820 - protein, 11 aa, Artificial Sequence
  Description of Artificial Sequence: Synthetic peptide
  Seed: AQQEALGLVCV (MAGA1_HUMAN)
AQQEALGLVCW

SEQ ID NO: 48821 - protein, 9 aa, Artificial Sequence
  Description of Artificial Sequence: Synthetic peptide
  Seed: RQRQPSEGS (MAGA1_HUMAN)
RSRQPSEGV

SEQ ID NO: 48822 - protein, 9 aa, Artificial Sequence
  Description of Artificial Sequence: Synthetic peptide
  Seed: EADPTGHSY (MAGA1_HUMAN)
EMDPTGHSL

SEQ ID NO: 48823 - protein, 10 aa, Artificial Sequence
  Description of Artificial Sequence: Synthetic peptide
  Seed: KASESLQLVF (MAGA1_HUMAN)
KTSESLQLVL

SEQ ID NO: 48824 - protein, 10 aa, Artificial Sequence
  Description of Artificial Sequence: Synthetic peptide
  Seed: KVADLVGFLL (MAGA1_HUMAN)
KMADLVGFLK

SEQ ID NO: 48825 - protein, 9 aa, Artificial Sequence
  Description of Artificial Sequence: Synthetic peptide
  Seed: LVLGTLEEV (MAGA1_HUMAN)
LVLGTLEEL

SEQ ID NO: 48826 - protein, 11 aa, Artificial Sequence
  Description of Artificial Sequence: Synthetic peptide
  Seed: STSCILESLFR (MAGA1_HUMAN)
SLSCILESLFR

SEQ ID NO: 48827 - protein, 9 aa, Artificial Sequence
  Description of Artificial Sequence: Synthetic peptide
  Seed: RVRFFFPSL (MAGA1_HUMAN)
RMRFFFPSC

SEQ ID NO: 48828 - protein, 9 aa, Artificial Sequence
  Description of Artificial Sequence: Synthetic peptide
  Seed: SYVKVLEYV (MAGA1_HUMAN)
SMVKVLEYV

SEQ ID NO: 48829 - protein, 9 aa, Artificial Sequence
  Description of Artificial Sequence: Synthetic peptide
  Seed: IAMEGGHAP (MAGA1_HUMAN)
IIMEGGHAY

SEQ ID NO: 48830 - protein, 9 aa, Artificial Sequence
  Description of Artificial Sequence: Synthetic peptide
  Seed: AATSSSSPL (MAGA1_HUMAN)
AMTSSSSPM

SEQ ID NO: 48831 - protein, 10 aa, Artificial Sequence
  Description of Artificial Sequence: Synthetic peptide
  Seed: TSYVKVLEYV (MAGA1_HUMAN)
TRYVKVLEYI

SEQ ID NO: 48832 - protein, 10 aa, Artificial Sequence
  Description of Artificial Sequence: Synthetic peptide
  Seed: YEFLWGPRAL (MAGA1_HUMAN)
YGFLWGPRAY

SEQ ID NO: 48833 - protein, 9 aa, Artificial Sequence
  Description of Artificial Sequence: Synthetic peptide
  Seed: SARVRFFFP (MAGA1_HUMAN)
SQRVRFFFG

SEQ ID NO: 48834 - protein, 11 aa, Artificial Sequence
  Description of Artificial Sequence: Synthetic peptide
  Seed: FLWGPRALAET (MAGA1_HUMAN)
FIWGPRALAEA

SEQ ID NO: 48835 - protein, 9 aa, Artificial Sequence
  Description of Artificial Sequence: Synthetic peptide
  Seed: VSARVRFFF (MAGA1_HUMAN)
VTARVRFFF

SEQ ID NO: 48836 - protein, 10 aa, Artificial Sequence
  Description of Artificial Sequence: Synthetic peptide
  Seed: TSYVKVLEYV (MAGA1_HUMAN)
TQYVKVLEYL

SEQ ID NO: 48837 - protein, 9 aa, Artificial Sequence
  Description of Artificial Sequence: Synthetic peptide
  Seed: STDPPQSPQ (MAGA1_HUMAN)
SIDPPQSPI

SEQ ID NO: 48838 - protein, 9 aa, Artificial Sequence
  Description of Artificial Sequence: Synthetic peptide
  Seed: RYEFLWGPR (MAGA1_HUMAN)
RYEFLWGPK

SEQ ID NO: 48839 - protein, 9 aa, Artificial Sequence
  Description of Artificial Sequence: Synthetic peptide
  Seed: STDPPQSPQ (MAGA1_HUMAN)
SMDPPQSPF

SEQ ID NO: 48840 - protein, 10 aa, Artificial Sequence
  Description of Artificial Sequence: Synthetic peptide
  Seed: LVQEKYLEYR (MAGA1_HUMAN)
LYQEKYLEYR

SEQ ID NO: 48841 - protein, 10 aa, Artificial Sequence
  Description of Artificial Sequence: Synthetic peptide
  Seed: SARVRFFFPS (MAGA1_HUMAN)
STRVRFFFPL

SEQ ID NO: 48842 - protein, 10 aa, Artificial Sequence
  Description of Artificial Sequence: Synthetic peptide
  Seed: SCILESLFRA (MAGA1_HUMAN)
SPILESLFRV

SEQ ID NO: 48843 - protein, 10 aa, Artificial Sequence
  Description of Artificial Sequence: Synthetic peptide
  Seed: SARVRFFFPS (MAGA1_HUMAN)
SKRVRFFFPM

SEQ ID NO: 48844 - protein, 10 aa, Artificial Sequence
  Description of Artificial Sequence: Synthetic peptide
  Seed: YVIKVSARVR (MAGA1_HUMAN)
YIIKVSARVR

SEQ ID NO: 48845 - protein, 10 aa, Artificial Sequence
  Description of Artificial Sequence: Synthetic peptide
  Seed: YEFLWGPRAL (MAGA1_HUMAN)
YHFLWGPRAM

SEQ ID NO: 48846 - protein, 9 aa, Artificial Sequence
  Description of Artificial Sequence: Synthetic peptide
  Seed: VADLVGFLL (MAGA1_HUMAN)
VCDLVGFLL

SEQ ID NO: 48847 - protein, 10 aa, Artificial Sequence
  Description of Artificial Sequence: Synthetic peptide
  Seed: KVADLVGFLL (MAGA1_HUMAN)
KTADLVGFLR

SEQ ID NO: 48848 - protein, 9 aa, Artificial Sequence
  Description of Artificial Sequence: Synthetic peptide
  Seed: MPKTGFLII (MAGA1_HUMAN)
MVKTGFLIY

SEQ ID NO: 48849 - protein, 11 aa, Artificial Sequence
  Description of Artificial Sequence: Synthetic peptide
  Seed: KVLEYVIKVSA (MAGA1_HUMAN)
KMLEYVIKVSI

SEQ ID NO: 48850 - protein, 9 aa, Artificial Sequence
  Description of Artificial Sequence: Synthetic peptide
  Seed: RAREPVTKA (MAGA1_HUMAN)
RWREPVTKA

SEQ ID NO: 48851 - protein, 9 aa, Artificial Sequence
  Description of Artificial Sequence: Synthetic peptide
  Seed: EADPTGHSY (MAGA1_HUMAN)
EWDPTGHSM

SEQ ID NO: 48852 - protein, 9 aa, Artificial Sequence
  Description of Artificial Sequence: Synthetic peptide
  Seed: LKYRAREPV (MAGA1_HUMAN)
LEYRAREPM

SEQ ID NO: 48853 - protein, 9 aa, Artificial Sequence
  Description of Artificial Sequence: Synthetic peptide
  Seed: IAMEGGHAP (MAGA1_HUMAN)
IAMEGGHAI

SEQ ID NO: 48854 - protein, 10 aa, Artificial Sequence
  Description of Artificial Sequence: Synthetic peptide
  Seed: AFPTTINFTR (MAGA1_HUMAN)
ALPTTINFTR

SEQ ID NO: 48855 - protein, 9 aa, Artificial Sequence
  Description of Artificial Sequence: Synthetic peptide
  Seed: VSARVRFFF (MAGA1_HUMAN)
VSARVRFFM

SEQ ID NO: 48856 - protein, 11 aa, Artificial Sequence
  Description of Artificial Sequence: Synthetic peptide
  Seed: YEFLWGPRALA (MAGA1_HUMAN)
YHFLWGPRALV

SEQ ID NO: 48857 - protein, 9 aa, Artificial Sequence
  Description of Artificial Sequence: Synthetic peptide
  Seed: HSYVLVTCL (MAGA1_HUMAN)
HHYVLVTCF

SEQ ID NO: 48858 - protein, 9 aa, Artificial Sequence
  Description of Artificial Sequence: Synthetic peptide
  Seed: KASESLQLV (MAGA1_HUMAN)
KMSESLQLL

SEQ ID NO: 48859 - protein, 8 aa, Artificial Sequence
  Description of Artificial Sequence: Synthetic peptide
  Seed: RVRFFFPS (MAGA1_HUMAN)
RVRFFFPI

SEQ ID NO: 48860 - protein, 9 aa, Artificial Sequence
  Description of Artificial Sequence: Synthetic peptide
  Seed: KASESLQLV (MAGA1_HUMAN)
KSSESLQLY

SEQ ID NO: 48861 - protein, 9 aa, Artificial Sequence
  Description of Artificial Sequence: Synthetic peptide
  Seed: QDLVQEKYL (MAGA1_HUMAN)
QELVQEKYL

SEQ ID NO: 48862 - protein, 9 aa, Artificial Sequence
  Description of Artificial Sequence: Synthetic peptide
  Seed: SCILESLFR (MAGA1_HUMAN)
SMILESLFR

SEQ ID NO: 48863 - protein, 11 aa, Artificial Sequence
  Description of Artificial Sequence: Synthetic peptide
  Seed: KVADLVGFLLL (MAGA1_HUMAN)
KMADLVGFLLQ

SEQ ID NO: 48864 - protein, 9 aa, Artificial Sequence
  Description of Artificial Sequence: Synthetic peptide
  Seed: ALGLVCVQA (MAGA1_HUMAN)
ALGLVCVQV

SEQ ID NO: 48865 - protein, 10 aa, Artificial Sequence
  Description of Artificial Sequence: Synthetic peptide
  Seed: AQQEALGLVC (MAGA1_HUMAN)
AEQEALGLVM

SEQ ID NO: 48866 - protein, 8 aa, Artificial Sequence
  Description of Artificial Sequence: Synthetic peptide
  Seed: YVKVLEYV (MAGA1_HUMAN)
YLKVLEYV

SEQ ID NO: 48867 - protein, 9 aa, Artificial Sequence
  Description of Artificial Sequence: Synthetic peptide
  Seed: VYDGREHSA (MAGA1_HUMAN)
VSDGREHSV

SEQ ID NO: 48868 - protein, 8 aa, Artificial Sequence
  Description of Artificial Sequence: Synthetic peptide
  Seed: RVRFFFPS (MAGA1_HUMAN)
RSRFFFPM

SEQ ID NO: 48869 - protein, 9 aa, Artificial Sequence
  Description of Artificial Sequence: Synthetic peptide
  Seed: STDPPQSPQ (MAGA1_HUMAN)
SIDPPQSPF

SEQ ID NO: 48870 - protein, 9 aa, Artificial Sequence
  Description of Artificial Sequence: Synthetic peptide
  Seed: LKYRAREPV (MAGA1_HUMAN)
LMYRAREPL

SEQ ID NO: 48871 - protein, 10 aa, Artificial Sequence
  Description of Artificial Sequence: Synthetic peptide
  Seed: RVRFFFPSLR (MAGA1_HUMAN)
RGRFFFPSLL

SEQ ID NO: 48872 - protein, 9 aa, Artificial Sequence
  Description of Artificial Sequence: Synthetic peptide
  Seed: ALGLVCVQA (MAGA1_HUMAN)
AIGLVCVQV

SEQ ID NO: 48873 - protein, 9 aa, Artificial Sequence
  Description of Artificial Sequence: Synthetic peptide
  Seed: GTLEEVPTA (MAGA1_HUMAN)
GLLEEVPTS

SEQ ID NO: 48874 - protein, 9 aa, Artificial Sequence
  Description of Artificial Sequence: Synthetic peptide
  Seed: EADPTGHSY (MAGA1_HUMAN)
ECDPTGHSM

SEQ ID NO: 48875 - protein, 11 aa, Artificial Sequence
  Description of Artificial Sequence: Synthetic peptide
  Seed: KVSARVRFFFP (MAGA1_HUMAN)
KCSARVRFFFK

SEQ ID NO: 48876 - protein, 10 aa, Artificial Sequence
  Description of Artificial Sequence: Synthetic peptide
  Seed: TSYVKVLEYV (MAGA1_HUMAN)
TRYVKVLEYF

SEQ ID NO: 48877 - protein, 9 aa, Artificial Sequence
  Description of Artificial Sequence: Synthetic peptide
  Seed: RYEFLWGPR (MAGA1_HUMAN)
RFEFLWGPK

SEQ ID NO: 48878 - protein, 9 aa, Artificial Sequence
  Description of Artificial Sequence: Synthetic peptide
  Seed: GTLEEVPTA (MAGA1_HUMAN)
GILEEVPTM

SEQ ID NO: 48879 - protein, 9 aa, Artificial Sequence
  Description of Artificial Sequence: Synthetic peptide
  Seed: VADLVGFLL (MAGA1_HUMAN)
VQDLVGFLI

SEQ ID NO: 48880 - protein, 9 aa, Artificial Sequence
  Description of Artificial Sequence: Synthetic peptide
  Seed: KVADLVGFL (MAGA1_HUMAN)
KAADLVGFR

SEQ ID NO: 48881 - protein, 10 aa, Artificial Sequence
  Description of Artificial Sequence: Synthetic peptide
  Seed: VIKVSARVRF (MAGA1_HUMAN)
VQKVSARVRY

SEQ ID NO: 48882 - protein, 10 aa, Artificial Sequence
  Description of Artificial Sequence: Synthetic peptide
  Seed: EVYDGREHSA (MAGA1_HUMAN)
EPYDGREHSA

SEQ ID NO: 48883 - protein, 10 aa, Artificial Sequence
  Description of Artificial Sequence: Synthetic peptide
  Seed: STSCILESLF (MAGA1_HUMAN)
STSCILESLW

SEQ ID NO: 48884 - protein, 9 aa, Artificial Sequence
  Description of Artificial Sequence: Synthetic peptide
  Seed: TSYVKVLEY (MAGA1_HUMAN)
TMYVKVLEK

SEQ ID NO: 48885 - protein, 8 aa, Artificial Sequence
  Description of Artificial Sequence: Synthetic peptide
  Seed: VADLVGFL (MAGA1_HUMAN)
VTDLVGFL

SEQ ID NO: 48886 - protein, 9 aa, Artificial Sequence
  Description of Artificial Sequence: Synthetic peptide
  Seed: KVADLVGFL (MAGA1_HUMAN)
KTADLVGFW

SEQ ID NO: 48887 - protein, 9 aa, Artificial Sequence
  Description of Artificial Sequence: Synthetic peptide
  Seed: MPKTGFLII (MAGA1_HUMAN)
MQKTGFLIY

SEQ ID NO: 48888 - protein, 9 aa, Artificial Sequence
  Description of Artificial Sequence: Synthetic peptide
  Seed: KYRAREPVT (MAGA1_HUMAN)
KARAREPVV

SEQ ID NO: 48889 - protein, 10 aa, Artificial Sequence
  Description of Artificial Sequence: Synthetic peptide
  Seed: RVRFFFPSLR (MAGA1_HUMAN)
RERFFFPSLY

SEQ ID NO: 48890 - protein, 9 aa, Artificial Sequence
  Description of Artificial Sequence: Synthetic peptide
  Seed: AEMLESVIK (MAGA1_HUMAN)
AEMLESVIY

SEQ ID NO: 48891 - protein, 10 aa, Artificial Sequence
  Description of Artificial Sequence: Synthetic peptide
  Seed: QIMPKTGFLI (MAGA1_HUMAN)
QLMPKTGFLA

SEQ ID NO: 48892 - protein, 10 aa, Artificial Sequence
  Description of Artificial Sequence: Synthetic peptide
  Seed: KHCFPEIFGK (MAGA1_HUMAN)
KTCFPEIFGK

SEQ ID NO: 48893 - protein, 10 aa, Artificial Sequence
  Description of Artificial Sequence: Synthetic peptide
  Seed: KVSARVRFFF (MAGA1_HUMAN)
KESARVRFFK

SEQ ID NO: 48894 - protein, 9 aa, Artificial Sequence
  Description of Artificial Sequence: Synthetic peptide
  Seed: SARVRFFFP (MAGA1_HUMAN)
SSRVRFFFQ

SEQ ID NO: 48895 - protein, 11 aa, Artificial Sequence
  Description of Artificial Sequence: Synthetic peptide
  Seed: KEADPTGHSYV (MAGA1_HUMAN)
KEADPTGHSYL

SEQ ID NO: 48896 - protein, 10 aa, Artificial Sequence
  Description of Artificial Sequence: Synthetic peptide
  Seed: EIFGKASESL (MAGA1_HUMAN)
EVFGKASESL

SEQ ID NO: 48897 - protein, 9 aa, Artificial Sequence
  Description of Artificial Sequence: Synthetic peptide
  Seed: SYVKVLEYV (MAGA1_HUMAN)
SWVKVLEYF

SEQ ID NO: 48898 - protein, 10 aa, Artificial Sequence
  Description of Artificial Sequence: Synthetic peptide
  Seed: RFFFPSLREA (MAGA1_HUMAN)
RTFFPSLREV

SEQ ID NO: 48899 - protein, 10 aa, Artificial Sequence
  Description of Artificial Sequence: Synthetic peptide
  Seed: EALEAQQEAL (MAGA1_HUMAN)
EILEAQQEAY

SEQ ID NO: 48900 - protein, 10 aa, Artificial Sequence
  Description of Artificial Sequence: Synthetic peptide
  Seed: RVRFFFPSLR (MAGA1_HUMAN)
RTRFFFPSLP

SEQ ID NO: 48901 - protein, 9 aa, Artificial Sequence
  Description of Artificial Sequence: Synthetic peptide
  Seed: LVQEKYLEY (MAGA1_HUMAN)
LIQEKYLER

SEQ ID NO: 48902 - protein, 9 aa, Artificial Sequence
  Description of Artificial Sequence: Synthetic peptide
  Seed: RAREPVTKA (MAGA1_HUMAN)
RPREPVTKT

SEQ ID NO: 48903 - protein, 10 aa, Artificial Sequence
  Description of Artificial Sequence: Synthetic peptide
  Seed: ALAETSYVKV (MAGA1_HUMAN)
AMAETSYVKM

SEQ ID NO: 48904 - protein, 9 aa, Artificial Sequence
  Description of Artificial Sequence: Synthetic peptide
  Seed: RAREPVTKA (MAGA1_HUMAN)
RYREPVTKK

SEQ ID NO: 48905 - protein, 9 aa, Artificial Sequence
  Description of Artificial Sequence: Synthetic peptide
  Seed: STSCILESL (MAGA1_HUMAN)
STSCILESR

SEQ ID NO: 48906 - protein, 11 aa, Artificial Sequence
  Description of Artificial Sequence: Synthetic peptide
  Seed: RVRFFFPSLRE (MAGA1_HUMAN)
RWRFFFPSLRK

SEQ ID NO: 48907 - protein, 9 aa, Artificial Sequence
  Description of Artificial Sequence: Synthetic peptide
  Seed: VSARVRFFF (MAGA1_HUMAN)
VFARVRFFM

SEQ ID NO: 48908 - protein, 9 aa, Artificial Sequence
  Description of Artificial Sequence: Synthetic peptide
  Seed: EEGPSTSCI (MAGA1_HUMAN)
EEGPSTSCY

SEQ ID NO: 48909 - protein, 9 aa, Artificial Sequence
  Description of Artificial Sequence: Synthetic peptide
  Seed: SARVRFFFP (MAGA1_HUMAN)
SQRVRFFFM

SEQ ID NO: 48910 - protein, 9 aa, Artificial Sequence
  Description of Artificial Sequence: Synthetic peptide
  Seed: YDGREHSAY (MAGA1_HUMAN)
YKGREHSAY

SEQ ID NO: 48911 - protein, 10 aa, Artificial Sequence
  Description of Artificial Sequence: Synthetic peptide
  Seed: LVQEKYLEYR (MAGA1_HUMAN)
LMQEKYLEYR

SEQ ID NO: 48912 - protein, 9 aa, Artificial Sequence
  Description of Artificial Sequence: Synthetic peptide
  Seed: KYRAREPVT (MAGA1_HUMAN)
KIRAREPVI

SEQ ID NO: 48913 - protein, 9 aa, Artificial Sequence
  Description of Artificial Sequence: Synthetic peptide
  Seed: KYRAREPVT (MAGA1_HUMAN)
KARAREPVK

SEQ ID NO: 48914 - protein, 8 aa, Artificial Sequence
  Description of Artificial Sequence: Synthetic peptide
  Seed: RVRFFFPS (MAGA1_HUMAN)
RSRFFFPY

SEQ ID NO: 48915 - protein, 9 aa, Artificial Sequence
  Description of Artificial Sequence: Synthetic peptide
  Seed: SAYGEPRKL (MAGA1_HUMAN)
SHYGEPRKF

SEQ ID NO: 48916 - protein, 10 aa, Artificial Sequence
  Description of Artificial Sequence: Synthetic peptide
  Seed: DVKEADPTGH (MAGA1_HUMAN)
DTKEADPTGK

SEQ ID NO: 48917 - protein, 10 aa, Artificial Sequence
  Description of Artificial Sequence: Synthetic peptide
  Seed: SVMEVYDGRE (MAGA1_HUMAN)
STMEVYDGRK

SEQ ID NO: 48918 - protein, 9 aa, Artificial Sequence
  Description of Artificial Sequence: Synthetic peptide
  Seed: RVRFFFPSL (MAGA1_HUMAN)
RVRFFFPST

SEQ ID NO: 48919 - protein, 10 aa, Artificial Sequence
  Description of Artificial Sequence: Synthetic peptide
  Seed: SYVLVTCLGL (MAGA1_HUMAN)
SYVLVTCLGW

SEQ ID NO: 48920 - protein, 9 aa, Artificial Sequence
  Description of Artificial Sequence: Synthetic peptide
  Seed: SSSPLVLGT (MAGA1_HUMAN)
SSSPLVLGI

SEQ ID NO: 48921 - protein, 9 aa, Artificial Sequence
  Description of Artificial Sequence: Synthetic peptide
  Seed: KYRAREPVT (MAGA1_HUMAN)
KTRAREPVN

SEQ ID NO: 48922 - protein, 10 aa, Artificial Sequence
  Description of Artificial Sequence: Synthetic peptide
  Seed: LSVMEVYDGR (MAGA1_HUMAN)
LLVMEVYDGR

SEQ ID NO: 48923 - protein, 11 aa, Artificial Sequence
  Description of Artificial Sequence: Synthetic peptide
  Seed: IKVSARVRFFF (MAGA1_HUMAN)
IHVSARVRFFW

SEQ ID NO: 48924 - protein, 9 aa, Artificial Sequence
  Description of Artificial Sequence: Synthetic peptide
  Seed: LVQEKYLEY (MAGA1_HUMAN)
LQQEKYLEL

SEQ ID NO: 48925 - protein, 10 aa, Artificial Sequence
  Description of Artificial Sequence: Synthetic peptide
  Seed: SLFRAVITKK (MAGA1_HUMAN)
SVFRAVITKK

SEQ ID NO: 48926 - protein, 11 aa, Artificial Sequence
  Description of Artificial Sequence: Synthetic peptide
  Seed: RVRFFFPSLRE (MAGA1_HUMAN)
RTRFFFPSLRD

SEQ ID NO: 48927 - protein, 8 aa, Artificial Sequence
  Description of Artificial Sequence: Synthetic peptide
  Seed: AFPTTINF (MAGA1_HUMAN)
AYPTTINL

SEQ ID NO: 48928 - protein, 10 aa, Artificial Sequence
  Description of Artificial Sequence: Synthetic peptide
  Seed: SARVRFFFPS (MAGA1_HUMAN)
SMRVRFFFPA

SEQ ID NO: 48929 - protein, 11 aa, Artificial Sequence
  Description of Artificial Sequence: Synthetic peptide
  Seed: ARVRFFFPSLR (MAGA1_HUMAN)
ASVRFFFPSLR

SEQ ID NO: 48930 - protein, 9 aa, Artificial Sequence
  Description of Artificial Sequence: Synthetic peptide
  Seed: KASESLQLV (MAGA1_HUMAN)
KLSESLQLW

SEQ ID NO: 48931 - protein, 10 aa, Artificial Sequence
  Description of Artificial Sequence: Synthetic peptide
  Seed: SLFRAVITKK (MAGA1_HUMAN)
SHFRAVITKR

SEQ ID NO: 48932 - protein, 10 aa, Artificial Sequence
  Description of Artificial Sequence: Synthetic peptide
  Seed: STSCILESLF (MAGA1_HUMAN)
SPSCILESLW

SEQ ID NO: 48933 - protein, 9 aa, Artificial Sequence
  Description of Artificial Sequence: Synthetic peptide
  Seed: STDPPQSPQ (MAGA1_HUMAN)
SLDPPQSPI

SEQ ID NO: 48934 - protein, 10 aa, Artificial Sequence
  Description of Artificial Sequence: Synthetic peptide
  Seed: SAFPTTINFT (MAGA1_HUMAN)
SLFPTTINFA

SEQ ID NO: 48935 - protein, 9 aa, Artificial Sequence
  Description of Artificial Sequence: Synthetic peptide
  Seed: FFFPSLREA (MAGA1_HUMAN)
FWFPSLREI

SEQ ID NO: 48936 - protein, 9 aa, Artificial Sequence
  Description of Artificial Sequence: Synthetic peptide
  Seed: LVTCLGLSY (MAGA1_HUMAN)
LTTCLGLSF

SEQ ID NO: 48937 - protein, 10 aa, Artificial Sequence
  Description of Artificial Sequence: Synthetic peptide
  Seed: KEADPTGHSY (MAGA1_HUMAN)
KMADPTGHSK

SEQ ID NO: 48938 - protein, 9 aa, Artificial Sequence
  Description of Artificial Sequence: Synthetic peptide
  Seed: LVQEKYLEY (MAGA1_HUMAN)
LIQEKYLEM

SEQ ID NO: 48939 - protein, 9 aa, Artificial Sequence
  Description of Artificial Sequence: Synthetic peptide
  Seed: ARVRFFFPS (MAGA1_HUMAN)
ARVRFFFPK

SEQ ID NO: 48940 - protein, 11 aa, Artificial Sequence
  Description of Artificial Sequence: Synthetic peptide
  Seed: REEEGPSTSCI (MAGA1_HUMAN)
REEEGPSTSCW

SEQ ID NO: 48941 - protein, 10 aa, Artificial Sequence
  Description of Artificial Sequence: Synthetic peptide
  Seed: KVSARVRFFF (MAGA1_HUMAN)
KYSARVRFFW

SEQ ID NO: 48942 - protein, 9 aa, Artificial Sequence
  Description of Artificial Sequence: Synthetic peptide
  Seed: GTLEEVPTA (MAGA1_HUMAN)
GMLEEVPTA

SEQ ID NO: 48943 - protein, 9 aa, Artificial Sequence
  Description of Artificial Sequence: Synthetic peptide
  Seed: ALEAQQEAL (MAGA1_HUMAN)
AQEAQQEAL

SEQ ID NO: 48944 - protein, 10 aa, Artificial Sequence
  Description of Artificial Sequence: Synthetic peptide
  Seed: SARVRFFFPS (MAGA1_HUMAN)
SMRVRFFFPI

SEQ ID NO: 48945 - protein, 9 aa, Artificial Sequence
  Description of Artificial Sequence: Synthetic peptide
  Seed: RVRFFFPSL (MAGA1_HUMAN)
RSRFFFPSI

SEQ ID NO: 48946 - protein, 10 aa, Artificial Sequence
  Description of Artificial Sequence: Synthetic peptide
  Seed: SARVRFFFPS (MAGA1_HUMAN)
SYRVRFFFPL

SEQ ID NO: 48947 - protein, 10 aa, Artificial Sequence
  Description of Artificial Sequence: Synthetic peptide
  Seed: RYEFLWGPRA (MAGA1_HUMAN)
RSEFLWGPRL

SEQ ID NO: 48948 - protein, 11 aa, Artificial Sequence
  Description of Artificial Sequence: Synthetic peptide
  Seed: EMLESVIKNYK (MAGA1_HUMAN)
ESLESVIKNYK

SEQ ID NO: 48949 - protein, 9 aa, Artificial Sequence
  Description of Artificial Sequence: Synthetic peptide
  Seed: YVIKVSARV (MAGA1_HUMAN)
YIIKVSARR

SEQ ID NO: 48950 - protein, 9 aa, Artificial Sequence
  Description of Artificial Sequence: Synthetic peptide
  Seed: YVIKVSARV (MAGA1_HUMAN)
YLIKVSARV

SEQ ID NO: 48951 - protein, 10 aa, Artificial Sequence
  Description of Artificial Sequence: Synthetic peptide
  Seed: EVYDGREHSA (MAGA1_HUMAN)
EIYDGREHSV

SEQ ID NO: 48952 - protein, 9 aa, Artificial Sequence
  Description of Artificial Sequence: Synthetic peptide
  Seed: EALEAQQEA (MAGA1_HUMAN)
EVLEAQQEL

SEQ ID NO: 48953 - protein, 10 aa, Artificial Sequence
  Description of Artificial Sequence: Synthetic peptide
  Seed: ARVRFFFPSL (MAGA1_HUMAN)
AIVRFFFPSI

SEQ ID NO: 48954 - protein, 11 aa, Artificial Sequence
  Description of Artificial Sequence: Synthetic peptide
  Seed: TKKVADLVGFL (MAGA1_HUMAN)
TLKVADLVGFV

SEQ ID NO: 48955 - protein, 9 aa, Artificial Sequence
  Description of Artificial Sequence: Synthetic peptide
  Seed: ALEAQQEAL (MAGA1_HUMAN)
AFEAQQEAM

SEQ ID NO: 48956 - protein, 10 aa, Artificial Sequence
  Description of Artificial Sequence: Synthetic peptide
  Seed: ATSSSSPLVL (MAGA1_HUMAN)
AVSSSSPLVW

SEQ ID NO: 48957 - protein, 10 aa, Artificial Sequence
  Description of Artificial Sequence: Synthetic peptide
  Seed: KNYKHCFPEI (MAGA1_HUMAN)
KFYKHCFPEF

SEQ ID NO: 48958 - protein, 9 aa, Artificial Sequence
  Description of Artificial Sequence: Synthetic peptide
  Seed: MPKTGFLII (MAGA1_HUMAN)
MMKTGFLIM

SEQ ID NO: 48959 - protein, 9 aa, Artificial Sequence
  Description of Artificial Sequence: Synthetic peptide
  Seed: TKAEMLESV (MAGA1_HUMAN)
TRAEMLESF

SEQ ID NO: 48960 - protein, 9 aa, Artificial Sequence
  Description of Artificial Sequence: Synthetic peptide
  Seed: TSYVKVLEY (MAGA1_HUMAN)
TQYVKVLEL

SEQ ID NO: 48961 - protein, 10 aa, Artificial Sequence
  Description of Artificial Sequence: Synthetic peptide
  Seed: TSCILESLFR (MAGA1_HUMAN)
TLCILESLFR

SEQ ID NO: 48962 - protein, 9 aa, Artificial Sequence
  Description of Artificial Sequence: Synthetic peptide
  Seed: SLHCKPEEA (MAGA1_HUMAN)
SMHCKPEEI

SEQ ID NO: 48963 - protein, 9 aa, Artificial Sequence
  Description of Artificial Sequence: Synthetic peptide
  Seed: FPSLREAAL (MAGA1_HUMAN)
FISLREAAF

SEQ ID NO: 48964 - protein, 9 aa, Artificial Sequence
  Description of Artificial Sequence: Synthetic peptide
  Seed: LQLVFGIDV (MAGA1_HUMAN)
LKLVFGIDY

SEQ ID NO: 48965 - protein, 10 aa, Artificial Sequence
  Description of Artificial Sequence: Synthetic peptide
  Seed: IMPKTGFLII (MAGA1_HUMAN)
IYPKTGFLIV

SEQ ID NO: 48966 - protein, 9 aa, Artificial Sequence
  Description of Artificial Sequence: Synthetic peptide
  Seed: LFRAVITKK (MAGA1_HUMAN)
LSRAVITKK

SEQ ID NO: 48967 - protein, 10 aa, Artificial Sequence
  Description of Artificial Sequence: Synthetic peptide
  Seed: SCILESLFRA (MAGA1_HUMAN)
SFILESLFRV

SEQ ID NO: 48968 - protein, 9 aa, Artificial Sequence
  Description of Artificial Sequence: Synthetic peptide
  Seed: QSPQGASAF (MAGA1_HUMAN)
QCPQGASAL

SEQ ID NO: 48969 - protein, 10 aa, Artificial Sequence
  Description of Artificial Sequence: Synthetic peptide
  Seed: RALAETSYVK (MAGA1_HUMAN)
RFLAETSYVR

SEQ ID NO: 48970 - protein, 11 aa, Artificial Sequence
  Description of Artificial Sequence: Synthetic peptide
  Seed: YEFLWGPRALA (MAGA1_HUMAN)
YGFLWGPRALL

SEQ ID NO: 48971 - protein, 9 aa, Artificial Sequence
  Description of Artificial Sequence: Synthetic peptide
  Seed: KVADLVGFL (MAGA1_HUMAN)
KTADLVGFF

SEQ ID NO: 48972 - protein, 9 aa, Artificial Sequence
  Description of Artificial Sequence: Synthetic peptide
  Seed: RVRFFFPSL (MAGA1_HUMAN)
RVRFFFPSN

SEQ ID NO: 48973 - protein, 10 aa, Artificial Sequence
  Description of Artificial Sequence: Synthetic peptide
  Seed: RVRFFFPSLR (MAGA1_HUMAN)
RSRFFFPSLM

SEQ ID NO: 48974 - protein, 10 aa, Artificial Sequence
  Description of Artificial Sequence: Synthetic peptide
  Seed: YEFLWGPRAL (MAGA1_HUMAN)
YDFLWGPRAY

SEQ ID NO: 48975 - protein, 9 aa, Artificial Sequence
  Description of Artificial Sequence: Synthetic peptide
  Seed: SVMEVYDGR (MAGA1_HUMAN)
SAMEVYDGK

SEQ ID NO: 48976 - protein, 9 aa, Artificial Sequence
  Description of Artificial Sequence: Synthetic peptide
  Seed: TQDLVQEKY (MAGA1_HUMAN)
TQDLVQEKV

SEQ ID NO: 48977 - protein, 11 aa, Artificial Sequence
  Description of Artificial Sequence: Synthetic peptide
  Seed: RQVPDSDPARY (MAGA1_HUMAN)
RLVPDSDPARV

SEQ ID NO: 48978 - protein, 10 aa, Artificial Sequence
  Description of Artificial Sequence: Synthetic peptide
  Seed: ASAFPTTINF (MAGA1_HUMAN)
AQAFPTTINY

SEQ ID NO: 48979 - protein, 9 aa, Artificial Sequence
  Description of Artificial Sequence: Synthetic peptide
  Seed: KVLEYVIKV (MAGA1_HUMAN)
KMLEYVIKY

SEQ ID NO: 48980 - protein, 9 aa, Artificial Sequence
  Description of Artificial Sequence: Synthetic peptide
  Seed: LTQDLVQEK (MAGA1_HUMAN)
LYQDLVQEM

SEQ ID NO: 48981 - protein, 9 aa, Artificial Sequence
  Description of Artificial Sequence: Synthetic peptide
  Seed: ALAETSYVK (MAGA1_HUMAN)
AQAETSYVK

SEQ ID NO: 48982 - protein, 9 aa, Artificial Sequence
  Description of Artificial Sequence: Synthetic peptide
  Seed: TSYVKVLEY (MAGA1_HUMAN)
TAYVKVLEF

SEQ ID NO: 48983 - protein, 10 aa, Artificial Sequence
  Description of Artificial Sequence: Synthetic peptide
  Seed: FFPSLREAAL (MAGA1_HUMAN)
FNPSLREAAF

SEQ ID NO: 48984 - protein, 9 aa, Artificial Sequence
  Description of Artificial Sequence: Synthetic peptide
  Seed: YKHCFPEIF (MAGA1_HUMAN)
YHHCFPEII

SEQ ID NO: 48985 - protein, 9 aa, Artificial Sequence
  Description of Artificial Sequence: Synthetic peptide
  Seed: SARVRFFFP (MAGA1_HUMAN)
SMRVRFFFS

SEQ ID NO: 48986 - protein, 10 aa, Artificial Sequence
  Description of Artificial Sequence: Synthetic peptide
  Seed: SARVRFFFPS (MAGA1_HUMAN)
SYRVRFFFPF

SEQ ID NO: 48987 - protein, 9 aa, Artificial Sequence
  Description of Artificial Sequence: Synthetic peptide
  Seed: VIKNYKHCF (MAGA1_HUMAN)
VAKNYKHCF

SEQ ID NO: 48988 - protein, 10 aa, Artificial Sequence
  Description of Artificial Sequence: Synthetic peptide
  Seed: VTKAEMLESV (MAGA1_HUMAN)
VMKAEMLESI

SEQ ID NO: 48989 - protein, 9 aa, Artificial Sequence
  Description of Artificial Sequence: Synthetic peptide
  Seed: FFFPSLREA (MAGA1_HUMAN)
FWFPSLREV

SEQ ID NO: 48990 - protein, 9 aa, Artificial Sequence
  Description of Artificial Sequence: Synthetic peptide
  Seed: ESLQLVFGI (MAGA1_HUMAN)
ELLQLVFGV

SEQ ID NO: 48991 - protein, 10 aa, Artificial Sequence
  Description of Artificial Sequence: Synthetic peptide
  Seed: SLEQRSLHCK (MAGA1_HUMAN)
STEQRSLHCY

SEQ ID NO: 48992 - protein, 10 aa, Artificial Sequence
  Description of Artificial Sequence: Synthetic peptide
  Seed: EIFGKASESL (MAGA1_HUMAN)
EVFGKASESR

SEQ ID NO: 48993 - protein, 9 aa, Artificial Sequence
  Description of Artificial Sequence: Synthetic peptide
  Seed: REPVTKAEM (MAGA1_HUMAN)
RLPVTKAEY

SEQ ID NO: 48994 - protein, 9 aa, Artificial Sequence
  Description of Artificial Sequence: Synthetic peptide
  Seed: ESLQLVFGI (MAGA1_HUMAN)
ESLQLVFGV

SEQ ID NO: 48995 - protein, 10 aa, Artificial Sequence
  Description of Artificial Sequence: Synthetic peptide
  Seed: RVRFFFPSLR (MAGA1_HUMAN)
RDRFFFPSLH

SEQ ID NO: 48996 - protein, 8 aa, Artificial Sequence
  Description of Artificial Sequence: Synthetic peptide
  Seed: AEMLESVI (MAGA1_HUMAN)
AEMLESVM

SEQ ID NO: 48997 - protein, 8 aa, Artificial Sequence
  Description of Artificial Sequence: Synthetic peptide
  Seed: FLWGPRAL (MAGA1_HUMAN)
FFWGPRAF

SEQ ID NO: 48998 - protein, 9 aa, Artificial Sequence
  Description of Artificial Sequence: Synthetic peptide
  Seed: VRFFFPSLR (MAGA1_HUMAN)
VVFFFPSLK

SEQ ID NO: 48999 - protein, 9 aa, Artificial Sequence
  Description of Artificial Sequence: Synthetic peptide
  Seed: AQQEALGLV (MAGA1_HUMAN)
AEQEALGLA

SEQ ID NO: 49000 - protein, 11 aa, Artificial Sequence
  Description of Artificial Sequence: Synthetic peptide
  Seed: KVADLVGFLLL (MAGA1_HUMAN)
KCADLVGFLLW

SEQ ID NO: 49001 - protein, 11 aa, Artificial Sequence
  Description of Artificial Sequence: Synthetic peptide
  Seed: RVRFFFPSLRE (MAGA1_HUMAN)
RTRFFFPSLRP

SEQ ID NO: 49002 - protein, 10 aa, Artificial Sequence
  Description of Artificial Sequence: Synthetic peptide
  Seed: KEADPTGHSY (MAGA1_HUMAN)
KYADPTGHSY

SEQ ID NO: 49003 - protein, 9 aa, Artificial Sequence
  Description of Artificial Sequence: Synthetic peptide
  Seed: TSSSSPLVL (MAGA1_HUMAN)
TYSSSPLVY

SEQ ID NO: 49004 - protein, 9 aa, Artificial Sequence
  Description of Artificial Sequence: Synthetic peptide
  Seed: RAREPVTKA (MAGA1_HUMAN)
RVREPVTKL

SEQ ID NO: 49005 - protein, 9 aa, Artificial Sequence
  Description of Artificial Sequence: Synthetic peptide
  Seed: QIMPKTGFL (MAGA1_HUMAN)
QSMPKTGFR

SEQ ID NO: 49006 - protein, 9 aa, Artificial Sequence
  Description of Artificial Sequence: Synthetic peptide
  Seed: LESLFRAVI (MAGA1_HUMAN)
LSSLFRAVF

SEQ ID NO: 49007 - protein, 9 aa, Artificial Sequence
  Description of Artificial Sequence: Synthetic peptide
  Seed: AATSSSSPL (MAGA1_HUMAN)
AWTSSSSPF

SEQ ID NO: 49008 - protein, 10 aa, Artificial Sequence
  Description of Artificial Sequence: Synthetic peptide
  Seed: FFPSLREAAL (MAGA1_HUMAN)
FYPSLREAAY

SEQ ID NO: 49009 - protein, 9 aa, Artificial Sequence
  Description of Artificial Sequence: Synthetic peptide
  Seed: MPKTGFLII (MAGA1_HUMAN)
MAKTGFLIM

SEQ ID NO: 49010 - protein, 9 aa, Artificial Sequence
  Description of Artificial Sequence: Synthetic peptide
  Seed: RVRFFFPSL (MAGA1_HUMAN)
RIRFFFPSF

SEQ ID NO: 49011 - protein, 10 aa, Artificial Sequence
  Description of Artificial Sequence: Synthetic peptide
  Seed: VLVTCLGLSY (MAGA1_HUMAN)
VQVTCLGLSM

SEQ ID NO: 49012 - protein, 11 aa, Artificial Sequence
  Description of Artificial Sequence: Synthetic peptide
  Seed: VPDSDPARYEF (MAGA1_HUMAN)
VIDSDPARYEL

SEQ ID NO: 49013 - protein, 9 aa, Artificial Sequence
  Description of Artificial Sequence: Synthetic peptide
  Seed: YVLVTCLGL (MAGA1_HUMAN)
YQLVTCLGA

SEQ ID NO: 49014 - protein, 9 aa, Artificial Sequence
  Description of Artificial Sequence: Synthetic peptide
  Seed: RALAETSYV (MAGA1_HUMAN)
RFLAETSYY

SEQ ID NO: 49015 - protein, 9 aa, Artificial Sequence
  Description of Artificial Sequence: Synthetic peptide
  Seed: KVADLVGFL (MAGA1_HUMAN)
KLADLVGFA

SEQ ID NO: 49016 - protein, 9 aa, Artificial Sequence
  Description of Artificial Sequence: Synthetic peptide
  Seed: GASAFPTTI (MAGA1_HUMAN)
GTSAFPTTF

SEQ ID NO: 49017 - protein, 11 aa, Artificial Sequence
  Description of Artificial Sequence: Synthetic peptide
  Seed: IKVSARVRFFF (MAGA1_HUMAN)
IWVSARVRFFW

SEQ ID NO: 49018 - protein, 9 aa, Artificial Sequence
  Description of Artificial Sequence: Synthetic peptide
  Seed: HCFPEIFGK (MAGA1_HUMAN)
HTFPEIFGY

SEQ ID NO: 49019 - protein, 10 aa, Artificial Sequence
  Description of Artificial Sequence: Synthetic peptide
  Seed: YEFLWGPRAL (MAGA1_HUMAN)
YQFLWGPRAW

SEQ ID NO: 49020 - protein, 9 aa, Artificial Sequence
  Description of Artificial Sequence: Synthetic peptide
  Seed: QSPQGASAF (MAGA1_HUMAN)
QWPQGASAM

SEQ ID NO: 49021 - protein, 9 aa, Artificial Sequence
  Description of Artificial Sequence: Synthetic peptide
  Seed: LTQDLVQEK (MAGA1_HUMAN)
LLQDLVQER

SEQ ID NO: 49022 - protein, 10 aa, Artificial Sequence
  Description of Artificial Sequence: Synthetic peptide
  Seed: EALGLVCVQA (MAGA1_HUMAN)
ESLGLVCVQV

SEQ ID NO: 49023 - protein, 8 aa, Artificial Sequence
  Description of Artificial Sequence: Synthetic peptide
  Seed: RFFFPSLR (MAGA1_HUMAN)
RIFFPSLR

SEQ ID NO: 49024 - protein, 11 aa, Artificial Sequence
  Description of Artificial Sequence: Synthetic peptide
  Seed: DLVGFLLLKYR (MAGA1_HUMAN)
DSVGFLLLKYR

SEQ ID NO: 49025 - protein, 9 aa, Artificial Sequence
  Description of Artificial Sequence: Synthetic peptide
  Seed: RAREPVTKA (MAGA1_HUMAN)
RVREPVTKR

SEQ ID NO: 49026 - protein, 10 aa, Artificial Sequence
  Description of Artificial Sequence: Synthetic peptide
  Seed: SCILESLFRA (MAGA1_HUMAN)
SLILESLFRC

SEQ ID NO: 49027 - protein, 11 aa, Artificial Sequence
  Description of Artificial Sequence: Synthetic peptide
  Seed: RQVPDSDPARY (MAGA1_HUMAN)
RSVPDSDPARM

SEQ ID NO: 49028 - protein, 9 aa, Artificial Sequence
  Description of Artificial Sequence: Synthetic peptide
  Seed: KVLEYVIKV (MAGA1_HUMAN)
KILEYVIKV

SEQ ID NO: 49029 - protein, 11 aa, Artificial Sequence
  Description of Artificial Sequence: Synthetic peptide
  Seed: VLGTLEEVPTA (MAGA1_HUMAN)
VMGTLEEVPTV

SEQ ID NO: 49030 - protein, 10 aa, Artificial Sequence
  Description of Artificial Sequence: Synthetic peptide
  Seed: KEADPTGHSY (MAGA1_HUMAN)
KHADPTGHSL

SEQ ID NO: 49031 - protein, 9 aa, Artificial Sequence
  Description of Artificial Sequence: Synthetic peptide
  Seed: TSYVKVLEY (MAGA1_HUMAN)
TTYVKVLEL

SEQ ID NO: 49032 - protein, 11 aa, Artificial Sequence
  Description of Artificial Sequence: Synthetic peptide
  Seed: RQVPDSDPARY (MAGA1_HUMAN)
RIVPDSDPARM

SEQ ID NO: 49033 - protein, 9 aa, Artificial Sequence
  Description of Artificial Sequence: Synthetic peptide
  Seed: ARYEFLWGP (MAGA1_HUMAN)
AQYEFLWGL

SEQ ID NO: 49034 - protein, 9 aa, Artificial Sequence
  Description of Artificial Sequence: Synthetic peptide
  Seed: KVADLVGFL (MAGA1_HUMAN)
KSADLVGFY

SEQ ID NO: 49035 - protein, 9 aa, Artificial Sequence
  Description of Artificial Sequence: Synthetic peptide
  Seed: KVADLVGFL (MAGA1_HUMAN)
KMADLVGFK

SEQ ID NO: 49036 - protein, 9 aa, Artificial Sequence
  Description of Artificial Sequence: Synthetic peptide
  Seed: IIVLVMIAM (MAGA1_HUMAN)
IQVLVMIAF

SEQ ID NO: 49037 - protein, 10 aa, Artificial Sequence
  Description of Artificial Sequence: Synthetic peptide
  Seed: SLFRAVITKK (MAGA1_HUMAN)
SIFRAVITKR

SEQ ID NO: 49038 - protein, 11 aa, Artificial Sequence
  Description of Artificial Sequence: Synthetic peptide
  Seed: KVADLVGFLLL (MAGA1_HUMAN)
KLADLVGFLLQ

SEQ ID NO: 49039 - protein, 9 aa, Artificial Sequence
  Description of Artificial Sequence: Synthetic peptide
  Seed: DSDPARYEF (MAGA1_HUMAN)
DIDPARYEM

SEQ ID NO: 49040 - protein, 11 aa, Artificial Sequence
  Description of Artificial Sequence: Synthetic peptide
  Seed: RVRFFFPSLRE (MAGA1_HUMAN)
RFRFFFPSLRT

SEQ ID NO: 49041 - protein, 9 aa, Artificial Sequence
  Description of Artificial Sequence: Synthetic peptide
  Seed: IAMEGGHAP (MAGA1_HUMAN)
IIMEGGHAV

SEQ ID NO: 49042 - protein, 9 aa, Artificial Sequence
  Description of Artificial Sequence: Synthetic peptide
  Seed: RVRFFFPSL (MAGA1_HUMAN)
RYRFFFPSR

SEQ ID NO: 49043 - protein, 9 aa, Artificial Sequence
  Description of Artificial Sequence: Synthetic peptide
  Seed: RALAETSYV (MAGA1_HUMAN)
RLLAETSYK

SEQ ID NO: 49044 - protein, 9 aa, Artificial Sequence
  Description of Artificial Sequence: Synthetic peptide
  Seed: SAFPTTINF (MAGA1_HUMAN)
SAFPTTINA

SEQ ID NO: 49045 - protein, 9 aa, Artificial Sequence
  Description of Artificial Sequence: Synthetic peptide
  Seed: YRAREPVTK (MAGA1_HUMAN)
YRAREPVTV

SEQ ID NO: 49046 - protein, 9 aa, Artificial Sequence
  Description of Artificial Sequence: Synthetic peptide
  Seed: LGDNQIMPK (MAGA1_HUMAN)
LLDNQIMPY

SEQ ID NO: 49047 - protein, 10 aa, Artificial Sequence
  Description of Artificial Sequence: Synthetic peptide
  Seed: VYDGREHSAY (MAGA1_HUMAN)
VMDGREHSAY

SEQ ID NO: 49048 - protein, 9 aa, Artificial Sequence
  Description of Artificial Sequence: Synthetic peptide
  Seed: FPTTINFTR (MAGA1_HUMAN)
FCTTINFTY

SEQ ID NO: 49049 - protein, 10 aa, Artificial Sequence
  Description of Artificial Sequence: Synthetic peptide
  Seed: CILESLFRAV (MAGA1_HUMAN)
CMLESLFRAV

SEQ ID NO: 49050 - protein, 11 aa, Artificial Sequence
  Description of Artificial Sequence: Synthetic peptide
  Seed: ELSVMEVYDGR (MAGA1_HUMAN)
EFSVMEVYDGR

SEQ ID NO: 49051 - protein, 9 aa, Artificial Sequence
  Description of Artificial Sequence: Synthetic peptide
  Seed: FFFPSLREA (MAGA1_HUMAN)
FGFPSLREV

SEQ ID NO: 49052 - protein, 9 aa, Artificial Sequence
  Description of Artificial Sequence: Synthetic peptide
  Seed: FLWGPRALA (MAGA1_HUMAN)
FLWGPRALC

SEQ ID NO: 49053 - protein, 9 aa, Artificial Sequence
  Description of Artificial Sequence: Synthetic peptide
  Seed: KASESLQLV (MAGA1_HUMAN)
KCSESLQLW

SEQ ID NO: 49054 - protein, 9 aa, Artificial Sequence
  Description of Artificial Sequence: Synthetic peptide
  Seed: MPKTGFLII (MAGA1_HUMAN)
MQKTGFLIM

SEQ ID NO: 49055 - protein, 9 aa, Artificial Sequence
  Description of Artificial Sequence: Synthetic peptide
  Seed: SLFRAVITK (MAGA1_HUMAN)
SGFRAVITR

SEQ ID NO: 49056 - protein, 10 aa, Artificial Sequence
  Description of Artificial Sequence: Synthetic peptide
  Seed: KKVADLVGFL (MAGA1_HUMAN)
KSVADLVGFV

SEQ ID NO: 49057 - protein, 9 aa, Artificial Sequence
  Description of Artificial Sequence: Synthetic peptide
  Seed: KTGFLIIVL (MAGA1_HUMAN)
KTGFLIIVM

SEQ ID NO: 49058 - protein, 9 aa, Artificial Sequence
  Description of Artificial Sequence: Synthetic peptide
  Seed: QLVFGIDVK (MAGA1_HUMAN)
QTVFGIDVK

SEQ ID NO: 49059 - protein, 11 aa, Artificial Sequence
  Description of Artificial Sequence: Synthetic peptide
  Seed: SPQGASAFPTT (MAGA1_HUMAN)
SPQGASAFPTM

SEQ ID NO: 49060 - protein, 11 aa, Artificial Sequence
  Description of Artificial Sequence: Synthetic peptide
  Seed: STSCILESLFR (MAGA1_HUMAN)
SMSCILESLFR

SEQ ID NO: 49061 - protein, 11 aa, Artificial Sequence
  Description of Artificial Sequence: Synthetic peptide
  Seed: FLWGPRALAET (MAGA1_HUMAN)
FMWGPRALAEA

SEQ ID NO: 49062 - protein, 9 aa, Artificial Sequence
  Description of Artificial Sequence: Synthetic peptide
  Seed: ALAETSYVK (MAGA1_HUMAN)
AAAETSYVR

SEQ ID NO: 49063 - protein, 10 aa, Artificial Sequence
  Description of Artificial Sequence: Synthetic peptide
  Seed: ASAFPTTINF (MAGA1_HUMAN)
ANAFPTTINW

SEQ ID NO: 49064 - protein, 10 aa, Artificial Sequence
  Description of Artificial Sequence: Synthetic peptide
  Seed: KEADPTGHSY (MAGA1_HUMAN)
KLADPTGHSL

SEQ ID NO: 49065 - protein, 8 aa, Artificial Sequence
  Description of Artificial Sequence: Synthetic peptide
  Seed: LESLFRAV (MAGA1_HUMAN)
LESLFRAL

SEQ ID NO: 49066 - protein, 10 aa, Artificial Sequence
  Description of Artificial Sequence: Synthetic peptide
  Seed: KVADLVGFLL (MAGA1_HUMAN)
KVADLVGFLY

SEQ ID NO: 49067 - protein, 9 aa, Artificial Sequence
  Description of Artificial Sequence: Synthetic peptide
  Seed: TQDLVQEKY (MAGA1_HUMAN)
TMDLVQEKF

SEQ ID NO: 49068 - protein, 11 aa, Artificial Sequence
  Description of Artificial Sequence: Synthetic peptide
  Seed: YVLVTCLGLSY (MAGA1_HUMAN)
YMLVTCLGLSF

SEQ ID NO: 49069 - protein, 8 aa, Artificial Sequence
  Description of Artificial Sequence: Synthetic peptide
  Seed: VADLVGFL (MAGA1_HUMAN)
VTDLVGFI

SEQ ID NO: 49070 - protein, 10 aa, Artificial Sequence
  Description of Artificial Sequence: Synthetic peptide
  Seed: KEADPTGHSY (MAGA1_HUMAN)
KSADPTGHSW

SEQ ID NO: 49071 - protein, 9 aa, Artificial Sequence
  Description of Artificial Sequence: Synthetic peptide
  Seed: QSPQGASAF (MAGA1_HUMAN)
QSPQGASAL

SEQ ID NO: 49072 - protein, 10 aa, Artificial Sequence
  Description of Artificial Sequence: Synthetic peptide
  Seed: VLVTCLGLSY (MAGA1_HUMAN)
VIVTCLGLSY

SEQ ID NO: 49073 - protein, 9 aa, Artificial Sequence
  Description of Artificial Sequence: Synthetic peptide
  Seed: QSPQGASAF (MAGA1_HUMAN)
QFPQGASAI

SEQ ID NO: 49074 - protein, 9 aa, Artificial Sequence
  Description of Artificial Sequence: Synthetic peptide
  Seed: AEMLESVIK (MAGA1_HUMAN)
AEMLESVIF

SEQ ID NO: 49075 - protein, 9 aa, Artificial Sequence
  Description of Artificial Sequence: Synthetic peptide
  Seed: LVQEKYLEY (MAGA1_HUMAN)
LSQEKYLEV

SEQ ID NO: 49076 - protein, 9 aa, Artificial Sequence
  Description of Artificial Sequence: Synthetic peptide
  Seed: KASESLQLV (MAGA1_HUMAN)
KRSESLQLF

SEQ ID NO: 49077 - protein, 9 aa, Artificial Sequence
  Description of Artificial Sequence: Synthetic peptide
  Seed: RVRFFFPSL (MAGA1_HUMAN)
RWRFFFPST

SEQ ID NO: 49078 - protein, 10 aa, Artificial Sequence
  Description of Artificial Sequence: Synthetic peptide
  Seed: ILESLFRAVI (MAGA1_HUMAN)
ILESLFRAVV

SEQ ID NO: 49079 - protein, 11 aa, Artificial Sequence
  Description of Artificial Sequence: Synthetic peptide
  Seed: KVSARVRFFFP (MAGA1_HUMAN)
KSSARVRFFFA

SEQ ID NO: 49080 - protein, 11 aa, Artificial Sequence
  Description of Artificial Sequence: Synthetic peptide
  Seed: RVRFFFPSLRE (MAGA1_HUMAN)
RFRFFFPSLRH

SEQ ID NO: 49081 - protein, 10 aa, Artificial Sequence
  Description of Artificial Sequence: Synthetic peptide
  Seed: IMPKTGFLII (MAGA1_HUMAN)
IWPKTGFLIL

SEQ ID NO: 49082 - protein, 9 aa, Artificial Sequence
  Description of Artificial Sequence: Synthetic peptide
  Seed: EADPTGHSY (MAGA1_HUMAN)
EIDPTGHSL

SEQ ID NO: 49083 - protein, 9 aa, Artificial Sequence
  Description of Artificial Sequence: Synthetic peptide
  Seed: RAREPVTKA (MAGA1_HUMAN)
RVREPVTKM

SEQ ID NO: 49084 - protein, 9 aa, Artificial Sequence
  Description of Artificial Sequence: Synthetic peptide
  Seed: KVLEYVIKV (MAGA1_HUMAN)
KVLEYVIKK

SEQ ID NO: 49085 - protein, 9 aa, Artificial Sequence
  Description of Artificial Sequence: Synthetic peptide
  Seed: SAFPTTINF (MAGA1_HUMAN)
SLFPTTINY

SEQ ID NO: 49086 - protein, 8 aa, Artificial Sequence
  Description of Artificial Sequence: Synthetic peptide
  Seed: FLWGPRAL (MAGA1_HUMAN)
FAWGPRAI

SEQ ID NO: 49087 - protein, 9 aa, Artificial Sequence
  Description of Artificial Sequence: Synthetic peptide
  Seed: LVQEKYLEY (MAGA1_HUMAN)
LFQEKYLEY

SEQ ID NO: 49088 - protein, 9 aa, Artificial Sequence
  Description of Artificial Sequence: Synthetic peptide
  Seed: LTQDLVQEK (MAGA1_HUMAN)
LAQDLVQEL

SEQ ID NO: 49089 - protein, 9 aa, Artificial Sequence
  Description of Artificial Sequence: Synthetic peptide
  Seed: AATSSSSPL (MAGA1_HUMAN)
AQTSSSSPY

SEQ ID NO: 49090 - protein, 11 aa, Artificial Sequence
  Description of Artificial Sequence: Synthetic peptide
  Seed: STDPPQSPQGA (MAGA1_HUMAN)
SSDPPQSPQGI

SEQ ID NO: 49091 - protein, 10 aa, Artificial Sequence
  Description of Artificial Sequence: Synthetic peptide
  Seed: KYRAREPVTK (MAGA1_HUMAN)
KYRAREPVTA

SEQ ID NO: 49092 - protein, 9 aa, Artificial Sequence
  Description of Artificial Sequence: Synthetic peptide
  Seed: REPVTKAEM (MAGA1_HUMAN)
RLPVTKAEF

SEQ ID NO: 49093 - protein, 9 aa, Artificial Sequence
  Description of Artificial Sequence: Synthetic peptide
  Seed: KVLEYVIKV (MAGA1_HUMAN)
KMLEYVIKR

SEQ ID NO: 49094 - protein, 9 aa, Artificial Sequence
  Description of Artificial Sequence: Synthetic peptide
  Seed: KVLEYVIKV (MAGA1_HUMAN)
KQLEYVIKY

SEQ ID NO: 49095 - protein, 9 aa, Artificial Sequence
  Description of Artificial Sequence: Synthetic peptide
  Seed: GLVCVQAAT (MAGA1_HUMAN)
GVVCVQAAL

SEQ ID NO: 49096 - protein, 9 aa, Artificial Sequence
  Description of Artificial Sequence: Synthetic peptide
  Seed: FPTTINFTR (MAGA1_HUMAN)
FMTTINFTY

SEQ ID NO: 49097 - protein, 10 aa, Artificial Sequence
  Description of Artificial Sequence: Synthetic peptide
  Seed: RVRFFFPSLR (MAGA1_HUMAN)
RMRFFFPSLK

SEQ ID NO: 49098 - protein, 11 aa, Artificial Sequence
  Description of Artificial Sequence: Synthetic peptide
  Seed: RVRFFFPSLRE (MAGA1_HUMAN)
RFRFFFPSLRN

SEQ ID NO: 49099 - protein, 10 aa, Artificial Sequence
  Description of Artificial Sequence: Synthetic peptide
  Seed: ARVRFFFPSL (MAGA1_HUMAN)
AWVRFFFPSA

SEQ ID NO: 49100 - protein, 11 aa, Artificial Sequence
  Description of Artificial Sequence: Synthetic peptide
  Seed: EMLESVIKNYK (MAGA1_HUMAN)
EVLESVIKNYR

SEQ ID NO: 49101 - protein, 10 aa, Artificial Sequence
  Description of Artificial Sequence: Synthetic peptide
  Seed: KVSARVRFFF (MAGA1_HUMAN)
KYSARVRFFA

SEQ ID NO: 49102 - protein, 10 aa, Artificial Sequence
  Description of Artificial Sequence: Synthetic peptide
  Seed: YEFLWGPRAL (MAGA1_HUMAN)
YWFLWGPRAM

SEQ ID NO: 49103 - protein, 9 aa, Artificial Sequence
  Description of Artificial Sequence: Synthetic peptide
  Seed: TTINFTRQR (MAGA1_HUMAN)
TFINFTRQR

SEQ ID NO: 49104 - protein, 9 aa, Artificial Sequence
  Description of Artificial Sequence: Synthetic peptide
  Seed: DSDPARYEF (MAGA1_HUMAN)
DTDPARYEL

SEQ ID NO: 49105 - protein, 9 aa, Artificial Sequence
  Description of Artificial Sequence: Synthetic peptide
  Seed: KVADLVGFL (MAGA1_HUMAN)
KQADLVGFV

SEQ ID NO: 49106 - protein, 9 aa, Artificial Sequence
  Description of Artificial Sequence: Synthetic peptide
  Seed: RAREPVTKA (MAGA1_HUMAN)
RLREPVTKF

SEQ ID NO: 49107 - protein, 9 aa, Artificial Sequence
  Description of Artificial Sequence: Synthetic peptide
  Seed: STDPPQSPQ (MAGA1_HUMAN)
SIDPPQSPY

SEQ ID NO: 49108 - protein, 10 aa, Artificial Sequence
  Description of Artificial Sequence: Synthetic peptide
  Seed: DLVQEKYLEY (MAGA1_HUMAN)
DVVQEKYLEY

SEQ ID NO: 49109 - protein, 9 aa, Artificial Sequence
  Description of Artificial Sequence: Synthetic peptide
  Seed: MLESVIKNY (MAGA1_HUMAN)
MAESVIKNM

SEQ ID NO: 49110 - protein, 11 aa, Artificial Sequence
  Description of Artificial Sequence: Synthetic peptide
  Seed: STDPPQSPQGA (MAGA1_HUMAN)
STDPPQSPQGM

SEQ ID NO: 49111 - protein, 10 aa, Artificial Sequence
  Description of Artificial Sequence: Synthetic peptide
  Seed: YEFLWGPRAL (MAGA1_HUMAN)
YQFLWGPRAI

SEQ ID NO: 49112 - protein, 9 aa, Artificial Sequence
  Description of Artificial Sequence: Synthetic peptide
  Seed: VADLVGFLL (MAGA1_HUMAN)
VTDLVGFLL

SEQ ID NO: 49113 - protein, 9 aa, Artificial Sequence
  Description of Artificial Sequence: Synthetic peptide
  Seed: SAYGEPRKL (MAGA1_HUMAN)
SGYGEPRKY

SEQ ID NO: 49114 - protein, 10 aa, Artificial Sequence
  Description of Artificial Sequence: Synthetic peptide
  Seed: SSSPLVLGTL (MAGA1_HUMAN)
STSPLVLGTF

SEQ ID NO: 49115 - protein, 10 aa, Artificial Sequence
  Description of Artificial Sequence: Synthetic peptide
  Seed: TSYVKVLEYV (MAGA1_HUMAN)
THYVKVLEYW

SEQ ID NO: 49116 - protein, 11 aa, Artificial Sequence
  Description of Artificial Sequence: Synthetic peptide
  Seed: KVADLVGFLLL (MAGA1_HUMAN)
KMADLVGFLLM

SEQ ID NO: 49117 - protein, 9 aa, Artificial Sequence
  Description of Artificial Sequence: Synthetic peptide
  Seed: HCFPEIFGK (MAGA1_HUMAN)
HPFPEIFGR

SEQ ID NO: 49118 - protein, 10 aa, Artificial Sequence
  Description of Artificial Sequence: Synthetic peptide
  Seed: SARVRFFFPS (MAGA1_HUMAN)
SGRVRFFFPL

SEQ ID NO: 49119 - protein, 9 aa, Artificial Sequence
  Description of Artificial Sequence: Synthetic peptide
  Seed: YKHCFPEIF (MAGA1_HUMAN)
YTHCFPEIF

SEQ ID NO: 49120 - protein, 10 aa, Artificial Sequence
  Description of Artificial Sequence: Synthetic peptide
  Seed: WEELSVMEVY (MAGA1_HUMAN)
WQELSVMEVW

SEQ ID NO: 49121 - protein, 9 aa, Artificial Sequence
  Description of Artificial Sequence: Synthetic peptide
  Seed: LTQDLVQEK (MAGA1_HUMAN)
LAQDLVQEI

SEQ ID NO: 49122 - protein, 9 aa, Artificial Sequence
  Description of Artificial Sequence: Synthetic peptide
  Seed: LESLFRAVI (MAGA1_HUMAN)
LQSLFRAVA

SEQ ID NO: 49123 - protein, 10 aa, Artificial Sequence
  Description of Artificial Sequence: Synthetic peptide
  Seed: KNYKHCFPEI (MAGA1_HUMAN)
KWYKHCFPEW

SEQ ID NO: 49124 - protein, 9 aa, Artificial Sequence
  Description of Artificial Sequence: Synthetic peptide
  Seed: YKHCFPEIF (MAGA1_HUMAN)
YHHCFPEIF

SEQ ID NO: 49125 - protein, 9 aa, Artificial Sequence
  Description of Artificial Sequence: Synthetic peptide
  Seed: EYVIKVSAR (MAGA1_HUMAN)
EIVIKVSAK

SEQ ID NO: 49126 - protein, 9 aa, Artificial Sequence
  Description of Artificial Sequence: Synthetic peptide
  Seed: LESLFRAVI (MAGA1_HUMAN)
LKSLFRAVY

SEQ ID NO: 49127 - protein, 11 aa, Artificial Sequence
  Description of Artificial Sequence: Synthetic peptide
  Seed: KYRAREPVTKA (MAGA1_HUMAN)
KVRAREPVTKK

SEQ ID NO: 49128 - protein, 9 aa, Artificial Sequence
  Description of Artificial Sequence: Synthetic peptide
  Seed: SAFPTTINF (MAGA1_HUMAN)
SKFPTTINL

SEQ ID NO: 49129 - protein, 11 aa, Artificial Sequence
  Description of Artificial Sequence: Synthetic peptide
  Seed: STDPPQSPQGA (MAGA1_HUMAN)
SSDPPQSPQGM

SEQ ID NO: 49130 - protein, 11 aa, Artificial Sequence
  Description of Artificial Sequence: Synthetic peptide
  Seed: EVYDGREHSAY (MAGA1_HUMAN)
EMYDGREHSAF

SEQ ID NO: 49131 - protein, 10 aa, Artificial Sequence
  Description of Artificial Sequence: Synthetic peptide
  Seed: ADPTGHSYVL (MAGA1_HUMAN)
ANPTGHSYVM

SEQ ID NO: 49132 - protein, 9 aa, Artificial Sequence
  Description of Artificial Sequence: Synthetic peptide
  Seed: MLESVIKNY (MAGA1_HUMAN)
MFESVIKNY

SEQ ID NO: 49133 - protein, 10 aa, Artificial Sequence
  Description of Artificial Sequence: Synthetic peptide
  Seed: LEYVIKVSAR (MAGA1_HUMAN)
LSYVIKVSAR

SEQ ID NO: 49134 - protein, 11 aa, Artificial Sequence
  Description of Artificial Sequence: Synthetic peptide
  Seed: STSCILESLFR (MAGA1_HUMAN)
SVSCILESLFK

SEQ ID NO: 49135 - protein, 9 aa, Artificial Sequence
  Description of Artificial Sequence: Synthetic peptide
  Seed: VYDGREHSA (MAGA1_HUMAN)
VADGREHSF

SEQ ID NO: 49136 - protein, 9 aa, Artificial Sequence
  Description of Artificial Sequence: Synthetic peptide
  Seed: SARVRFFFP (MAGA1_HUMAN)
SARVRFFFS

SEQ ID NO: 49137 - protein, 9 aa, Artificial Sequence
  Description of Artificial Sequence: Synthetic peptide
  Seed: RVRFFFPSL (MAGA1_HUMAN)
RWRFFFPSA

SEQ ID NO: 49138 - protein, 9 aa, Artificial Sequence
  Description of Artificial Sequence: Synthetic peptide
  Seed: AATSSSSPL (MAGA1_HUMAN)
AATSSSSPF

SEQ ID NO: 49139 - protein, 9 aa, Artificial Sequence
  Description of Artificial Sequence: Synthetic peptide
  Seed: FPTTINFTR (MAGA1_HUMAN)
FPTTINFTW

SEQ ID NO: 49140 - protein, 10 aa, Artificial Sequence
  Description of Artificial Sequence: Synthetic peptide
  Seed: KVADLVGFLL (MAGA1_HUMAN)
KLADLVGFLN

SEQ ID NO: 49141 - protein, 11 aa, Artificial Sequence
  Description of Artificial Sequence: Synthetic peptide
  Seed: RVRFFFPSLRE (MAGA1_HUMAN)
RTRFFFPSLRG

SEQ ID NO: 49142 - protein, 10 aa, Artificial Sequence
  Description of Artificial Sequence: Synthetic peptide
  Seed: SESLQLVFGI (MAGA1_HUMAN)
SESLQLVFGL

SEQ ID NO: 49143 - protein, 9 aa, Artificial Sequence
  Description of Artificial Sequence: Synthetic peptide
  Seed: EADPTGHSY (MAGA1_HUMAN)
ETDPTGHSK

SEQ ID NO: 49144 - protein, 8 aa, Artificial Sequence
  Description of Artificial Sequence: Synthetic peptide
  Seed: FFPSLREA (MAGA1_HUMAN)
FWPSLREL

SEQ ID NO: 49145 - protein, 10 aa, Artificial Sequence
  Description of Artificial Sequence: Synthetic peptide
  Seed: AFPTTINFTR (MAGA1_HUMAN)
ASPTTINFTR

SEQ ID NO: 49146 - protein, 9 aa, Artificial Sequence
  Description of Artificial Sequence: Synthetic peptide
  Seed: IAMEGGHAP (MAGA1_HUMAN)
IQMEGGHAF

SEQ ID NO: 49147 - protein, 9 aa, Artificial Sequence
  Description of Artificial Sequence: Synthetic peptide
  Seed: HCFPEIFGK (MAGA1_HUMAN)
HTFPEIFGR

SEQ ID NO: 49148 - protein, 11 aa, Artificial Sequence
  Description of Artificial Sequence: Synthetic peptide
  Seed: STDPPQSPQGA (MAGA1_HUMAN)
SMDPPQSPQGY

SEQ ID NO: 49149 - protein, 9 aa, Artificial Sequence
  Description of Artificial Sequence: Synthetic peptide
  Seed: SYVKVLEYV (MAGA1_HUMAN)
SVVKVLEYL

SEQ ID NO: 49150 - protein, 11 aa, Artificial Sequence
  Description of Artificial Sequence: Synthetic peptide
  Seed: RVRFFFPSLRE (MAGA1_HUMAN)
RFRFFFPSLRE

SEQ ID NO: 49151 - protein, 10 aa, Artificial Sequence
  Description of Artificial Sequence: Synthetic peptide
  Seed: SLFRAVITKK (MAGA1_HUMAN)
SQFRAVITKR

SEQ ID NO: 49152 - protein, 9 aa, Artificial Sequence
  Description of Artificial Sequence: Synthetic peptide
  Seed: RAREPVTKA (MAGA1_HUMAN)
RLREPVTKR

SEQ ID NO: 49153 - protein, 10 aa, Artificial Sequence
  Description of Artificial Sequence: Synthetic peptide
  Seed: EALEAQQEAL (MAGA1_HUMAN)
ELLEAQQEAR

SEQ ID NO: 49154 - protein, 9 aa, Artificial Sequence
  Description of Artificial Sequence: Synthetic peptide
  Seed: SAYGEPRKL (MAGA1_HUMAN)
SPYGEPRKA

SEQ ID NO: 49155 - protein, 10 aa, Artificial Sequence
  Description of Artificial Sequence: Synthetic peptide
  Seed: KEADPTGHSY (MAGA1_HUMAN)
KSADPTGHSR

SEQ ID NO: 49156 - protein, 9 aa, Artificial Sequence
  Description of Artificial Sequence: Synthetic peptide
  Seed: RALAETSYV (MAGA1_HUMAN)
RALAETSYY

SEQ ID NO: 49157 - protein, 11 aa, Artificial Sequence
  Description of Artificial Sequence: Synthetic peptide
  Seed: KNYKHCFPEIF (MAGA1_HUMAN)
KKYKHCFPEIY

SEQ ID NO: 49158 - protein, 10 aa, Artificial Sequence
  Description of Artificial Sequence: Synthetic peptide
  Seed: KASESLQLVF (MAGA1_HUMAN)
KKSESLQLVF

SEQ ID NO: 49159 - protein, 9 aa, Artificial Sequence
  Description of Artificial Sequence: Synthetic peptide
  Seed: LKYRAREPV (MAGA1_HUMAN)
LSYRAREPY

SEQ ID NO: 49160 - protein, 10 aa, Artificial Sequence
  Description of Artificial Sequence: Synthetic peptide
  Seed: KVLEYVIKVS (MAGA1_HUMAN)
KMLEYVIKVN

SEQ ID NO: 49161 - protein, 9 aa, Artificial Sequence
  Description of Artificial Sequence: Synthetic peptide
  Seed: KASESLQLV (MAGA1_HUMAN)
KYSESLQLF

SEQ ID NO: 49162 - protein, 9 aa, Artificial Sequence
  Description of Artificial Sequence: Synthetic peptide
  Seed: LESLFRAVI (MAGA1_HUMAN)
LRSLFRAVM

SEQ ID NO: 49163 - protein, 10 aa, Artificial Sequence
  Description of Artificial Sequence: Synthetic peptide
  Seed: SARVRFFFPS (MAGA1_HUMAN)
SFRVRFFFPI

SEQ ID NO: 49164 - protein, 9 aa, Artificial Sequence
  Description of Artificial Sequence: Synthetic peptide
  Seed: ATSSSSPLV (MAGA1_HUMAN)
AASSSSPLY

SEQ ID NO: 49165 - protein, 10 aa, Artificial Sequence
  Description of Artificial Sequence: Synthetic peptide
  Seed: KVADLVGFLL (MAGA1_HUMAN)
KIADLVGFLR

SEQ ID NO: 49166 - protein, 10 aa, Artificial Sequence
  Description of Artificial Sequence: Synthetic peptide
  Seed: ATSSSSPLVL (MAGA1_HUMAN)
AMSSSSPLVF

SEQ ID NO: 49167 - protein, 11 aa, Artificial Sequence
  Description of Artificial Sequence: Synthetic peptide
  Seed: RVRFFFPSLRE (MAGA1_HUMAN)
RFRFFFPSLRM

SEQ ID NO: 49168 - protein, 9 aa, Artificial Sequence
  Description of Artificial Sequence: Synthetic peptide
  Seed: FFPSLREAA (MAGA1_HUMAN)
FWPSLREAM

SEQ ID NO: 49169 - protein, 9 aa, Artificial Sequence
  Description of Artificial Sequence: Synthetic peptide
  Seed: QEALGLVCV (MAGA1_HUMAN)
QEALGLVCM

SEQ ID NO: 49170 - protein, 11 aa, Artificial Sequence
  Description of Artificial Sequence: Synthetic peptide
  Seed: SARVRFFFPSL (MAGA1_HUMAN)
SGRVRFFFPSK

SEQ ID NO: 49171 - protein, 10 aa, Artificial Sequence
  Description of Artificial Sequence: Synthetic peptide
  Seed: SARVRFFFPS (MAGA1_HUMAN)
SKRVRFFFPF

SEQ ID NO: 49172 - protein, 11 aa, Artificial Sequence
  Description of Artificial Sequence: Synthetic peptide
  Seed: IKNYKHCFPEI (MAGA1_HUMAN)
IWNYKHCFPEF

SEQ ID NO: 49173 - protein, 10 aa, Artificial Sequence
  Description of Artificial Sequence: Synthetic peptide
  Seed: YEFLWGPRAL (MAGA1_HUMAN)
YWFLWGPRAF

SEQ ID NO: 49174 - protein, 9 aa, Artificial Sequence
  Description of Artificial Sequence: Synthetic peptide
  Seed: SARVRFFFP (MAGA1_HUMAN)
SYRVRFFFM

SEQ ID NO: 49175 - protein, 10 aa, Artificial Sequence
  Description of Artificial Sequence: Synthetic peptide
  Seed: VKVLEYVIKV (MAGA1_HUMAN)
VTVLEYVIKV

SEQ ID NO: 49176 - protein, 9 aa, Artificial Sequence
  Description of Artificial Sequence: Synthetic peptide
  Seed: RYEFLWGPR (MAGA1_HUMAN)
RMEFLWGPR

SEQ ID NO: 49177 - protein, 9 aa, Artificial Sequence
  Description of Artificial Sequence: Synthetic peptide
  Seed: LTQDLVQEK (MAGA1_HUMAN)
LMQDLVQEM

SEQ ID NO: 49178 - protein, 9 aa, Artificial Sequence
  Description of Artificial Sequence: Synthetic peptide
  Seed: VYDGREHSA (MAGA1_HUMAN)
VADGREHSL

SEQ ID NO: 49179 - protein, 10 aa, Artificial Sequence
  Description of Artificial Sequence: Synthetic peptide
  Seed: SCILESLFRA (MAGA1_HUMAN)
SCILESLFRV

SEQ ID NO: 49180 - protein, 10 aa, Artificial Sequence
  Description of Artificial Sequence: Synthetic peptide
  Seed: SARVRFFFPS (MAGA1_HUMAN)
SSRVRFFFPV

SEQ ID NO: 49181 - protein, 10 aa, Artificial Sequence
  Description of Artificial Sequence: Synthetic peptide
  Seed: KVSARVRFFF (MAGA1_HUMAN)
KASARVRFFK

SEQ ID NO: 49182 - protein, 10 aa, Artificial Sequence
  Description of Artificial Sequence: Synthetic peptide
  Seed: FFPSLREAAL (MAGA1_HUMAN)
FTPSLREAAM

SEQ ID NO: 49183 - protein, 11 aa, Artificial Sequence
  Description of Artificial Sequence: Synthetic peptide
  Seed: RALAETSYVKV (MAGA1_HUMAN)
RMLAETSYVKI

SEQ ID NO: 49184 - protein, 9 aa, Artificial Sequence
  Description of Artificial Sequence: Synthetic peptide
  Seed: MPKTGFLII (MAGA1_HUMAN)
MMKTGFLIL

SEQ ID NO: 49185 - protein, 9 aa, Artificial Sequence
  Description of Artificial Sequence: Synthetic peptide
  Seed: RALAETSYV (MAGA1_HUMAN)
RSLAETSYI

SEQ ID NO: 49186 - protein, 10 aa, Artificial Sequence
  Description of Artificial Sequence: Synthetic peptide
  Seed: RVRFFFPSLR (MAGA1_HUMAN)
RERFFFPSLR

SEQ ID NO: 49187 - protein, 9 aa, Artificial Sequence
  Description of Artificial Sequence: Synthetic peptide
  Seed: SSPLVLGTL (MAGA1_HUMAN)
SIPLVLGTM

SEQ ID NO: 49188 - protein, 10 aa, Artificial Sequence
  Description of Artificial Sequence: Synthetic peptide
  Seed: KKVADLVGFL (MAGA1_HUMAN)
KGVADLVGFV

SEQ ID NO: 49189 - protein, 9 aa, Artificial Sequence
  Description of Artificial Sequence: Synthetic peptide
  Seed: TSSSSPLVL (MAGA1_HUMAN)
TSSSSPLVV

SEQ ID NO: 49190 - protein, 9 aa, Artificial Sequence
  Description of Artificial Sequence: Synthetic peptide
  Seed: KASESLQLV (MAGA1_HUMAN)
KTSESLQLL

SEQ ID NO: 49191 - protein, 9 aa, Artificial Sequence
  Description of Artificial Sequence: Synthetic peptide
  Seed: LVQEKYLEY (MAGA1_HUMAN)
LWQEKYLEM

SEQ ID NO: 49192 - protein, 9 aa, Artificial Sequence
  Description of Artificial Sequence: Synthetic peptide
  Seed: IAMEGGHAP (MAGA1_HUMAN)
IPMEGGHAL

SEQ ID NO: 49193 - protein, 9 aa, Artificial Sequence
  Description of Artificial Sequence: Synthetic peptide
  Seed: STDPPQSPQ (MAGA1_HUMAN)
SFDPPQSPF

SEQ ID NO: 49194 - protein, 9 aa, Artificial Sequence
  Description of Artificial Sequence: Synthetic peptide
  Seed: VADLVGFLL (MAGA1_HUMAN)
VQDLVGFLY

SEQ ID NO: 49195 - protein, 10 aa, Artificial Sequence
  Description of Artificial Sequence: Synthetic peptide
  Seed: EVYDGREHSA (MAGA1_HUMAN)
ESYDGREHSV

SEQ ID NO: 49196 - protein, 10 aa, Artificial Sequence
  Description of Artificial Sequence: Synthetic peptide
  Seed: SARVRFFFPS (MAGA1_HUMAN)
SYRVRFFFPR

SEQ ID NO: 49197 - protein, 9 aa, Artificial Sequence
  Description of Artificial Sequence: Synthetic peptide
  Seed: RAREPVTKA (MAGA1_HUMAN)
RPREPVTKA

SEQ ID NO: 49198 - protein, 9 aa, Artificial Sequence
  Description of Artificial Sequence: Synthetic peptide
  Seed: KVSARVRFF (MAGA1_HUMAN)
KASARVRFW

SEQ ID NO: 49199 - protein, 9 aa, Artificial Sequence
  Description of Artificial Sequence: Synthetic peptide
  Seed: QIMPKTGFL (MAGA1_HUMAN)
QYMPKTGFY

SEQ ID NO: 49200 - protein, 10 aa, Artificial Sequence
  Description of Artificial Sequence: Synthetic peptide
  Seed: SDPARYEFLW (MAGA1_HUMAN)
STPARYEFLW

SEQ ID NO: 49201 - protein, 9 aa, Artificial Sequence
  Description of Artificial Sequence: Synthetic peptide
  Seed: FLWGPRALA (MAGA1_HUMAN)
FMWGPRALM

SEQ ID NO: 49202 - protein, 9 aa, Artificial Sequence
  Description of Artificial Sequence: Synthetic peptide
  Seed: LQLVFGIDV (MAGA1_HUMAN)
LQLVFGIDY

SEQ ID NO: 49203 - protein, 9 aa, Artificial Sequence
  Description of Artificial Sequence: Synthetic peptide
  Seed: RAREPVTKA (MAGA1_HUMAN)
RWREPVTKK

SEQ ID NO: 49204 - protein, 9 aa, Artificial Sequence
  Description of Artificial Sequence: Synthetic peptide
  Seed: KVLEYVIKV (MAGA1_HUMAN)
KGLEYVIKR

SEQ ID NO: 49205 - protein, 9 aa, Artificial Sequence
  Description of Artificial Sequence: Synthetic peptide
  Seed: LVLGTLEEV (MAGA1_HUMAN)
LLLGTLEEM

SEQ ID NO: 49206 - protein, 9 aa, Artificial Sequence
  Description of Artificial Sequence: Synthetic peptide
  Seed: YKHCFPEIF (MAGA1_HUMAN)
YFHCFPEIF

SEQ ID NO: 49207 - protein, 9 aa, Artificial Sequence
  Description of Artificial Sequence: Synthetic peptide
  Seed: KYRAREPVT (MAGA1_HUMAN)
KIRAREPVA

SEQ ID NO: 49208 - protein, 8 aa, Artificial Sequence
  Description of Artificial Sequence: Synthetic peptide
  Seed: RVRFFFPS (MAGA1_HUMAN)
RTRFFFPR

SEQ ID NO: 49209 - protein, 9 aa, Artificial Sequence
  Description of Artificial Sequence: Synthetic peptide
  Seed: ALAETSYVK (MAGA1_HUMAN)
ASAETSYVR

SEQ ID NO: 49210 - protein, 10 aa, Artificial Sequence
  Description of Artificial Sequence: Synthetic peptide
  Seed: ARVRFFFPSL (MAGA1_HUMAN)
AWVRFFFPSV

SEQ ID NO: 49211 - protein, 9 aa, Artificial Sequence
  Description of Artificial Sequence: Synthetic peptide
  Seed: DPTGHSYVL (MAGA1_HUMAN)
DATGHSYVI

SEQ ID NO: 49212 - protein, 11 aa, Artificial Sequence
  Description of Artificial Sequence: Synthetic peptide
  Seed: ELSVMEVYDGR (MAGA1_HUMAN)
EKSVMEVYDGR

SEQ ID NO: 49213 - protein, 9 aa, Artificial Sequence
  Description of Artificial Sequence: Synthetic peptide
  Seed: VQEKYLEYR (MAGA1_HUMAN)
VSEKYLEYY

SEQ ID NO: 49214 - protein, 9 aa, Artificial Sequence
  Description of Artificial Sequence: Synthetic peptide
  Seed: TSSSSPLVL (MAGA1_HUMAN)
TPSSSPLVF

SEQ ID NO: 49215 - protein, 10 aa, Artificial Sequence
  Description of Artificial Sequence: Synthetic peptide
  Seed: RVRFFFPSLR (MAGA1_HUMAN)
RGRFFFPSLF

SEQ ID NO: 49216 - protein, 10 aa, Artificial Sequence
  Description of Artificial Sequence: Synthetic peptide
  Seed: KVLEYVIKVS (MAGA1_HUMAN)
KMLEYVIKVF

SEQ ID NO: 49217 - protein, 10 aa, Artificial Sequence
  Description of Artificial Sequence: Synthetic peptide
  Seed: KVSARVRFFF (MAGA1_HUMAN)
KGSARVRFFY

SEQ ID NO: 49218 - protein, 11 aa, Artificial Sequence
  Description of Artificial Sequence: Synthetic peptide
  Seed: EVYDGREHSAY (MAGA1_HUMAN)
EMYDGREHSAW

SEQ ID NO: 49219 - protein, 8 aa, Artificial Sequence
  Description of Artificial Sequence: Synthetic peptide
  Seed: YKHCFPEI (MAGA1_HUMAN)
YQHCFPEV

SEQ ID NO: 49220 - protein, 9 aa, Artificial Sequence
  Description of Artificial Sequence: Synthetic peptide
  Seed: FLWGPRALA (MAGA1_HUMAN)
FQWGPRALM

SEQ ID NO: 49221 - protein, 10 aa, Artificial Sequence
  Description of Artificial Sequence: Synthetic peptide
  Seed: RVRFFFPSLR (MAGA1_HUMAN)
RSRFFFPSLF

SEQ ID NO: 49222 - protein, 9 aa, Artificial Sequence
  Description of Artificial Sequence: Synthetic peptide
  Seed: KASESLQLV (MAGA1_HUMAN)
KTSESLQLM

SEQ ID NO: 49223 - protein, 9 aa, Artificial Sequence
  Description of Artificial Sequence: Synthetic peptide
  Seed: HCFPEIFGK (MAGA1_HUMAN)
HTFPEIFGL

SEQ ID NO: 49224 - protein, 9 aa, Artificial Sequence
  Description of Artificial Sequence: Synthetic peptide
  Seed: RVRFFFPSL (MAGA1_HUMAN)
RIRFFFPSM

SEQ ID NO: 49225 - protein, 9 aa, Artificial Sequence
  Description of Artificial Sequence: Synthetic peptide
  Seed: FPTTINFTR (MAGA1_HUMAN)
FPTTINFTP

SEQ ID NO: 49226 - protein, 9 aa, Artificial Sequence
  Description of Artificial Sequence: Synthetic peptide
  Seed: AATSSSSPL (MAGA1_HUMAN)
ARTSSSSPY

SEQ ID NO: 49227 - protein, 9 aa, Artificial Sequence
  Description of Artificial Sequence: Synthetic peptide
  Seed: VGFLLLKYR (MAGA1_HUMAN)
VYFLLLKYR

SEQ ID NO: 49228 - protein, 9 aa, Artificial Sequence
  Description of Artificial Sequence: Synthetic peptide
  Seed: DSDPARYEF (MAGA1_HUMAN)
DSDPARYEL

SEQ ID NO: 49229 - protein, 10 aa, Artificial Sequence
  Description of Artificial Sequence: Synthetic peptide
  Seed: TSCILESLFR (MAGA1_HUMAN)
TVCILESLFR

SEQ ID NO: 49230 - protein, 10 aa, Artificial Sequence
  Description of Artificial Sequence: Synthetic peptide
  Seed: RAREPVTKAE (MAGA1_HUMAN)
RIREPVTKAV

SEQ ID NO: 49231 - protein, 9 aa, Artificial Sequence
  Description of Artificial Sequence: Synthetic peptide
  Seed: RQVPDSDPA (MAGA1_HUMAN)
RIVPDSDPI

SEQ ID NO: 49232 - protein, 9 aa, Artificial Sequence
  Description of Artificial Sequence: Synthetic peptide
  Seed: TTINFTRQR (MAGA1_HUMAN)
TSINFTRQR

SEQ ID NO: 49233 - protein, 9 aa, Artificial Sequence
  Description of Artificial Sequence: Synthetic peptide
  Seed: ITKKVADLV (MAGA1_HUMAN)
ITKKVADLF

SEQ ID NO: 49234 - protein, 9 aa, Artificial Sequence
  Description of Artificial Sequence: Synthetic peptide
  Seed: RAREPVTKA (MAGA1_HUMAN)
RPREPVTKF

SEQ ID NO: 49235 - protein, 9 aa, Artificial Sequence
  Description of Artificial Sequence: Synthetic peptide
  Seed: IMPKTGFLI (MAGA1_HUMAN)
IQPKTGFLF

SEQ ID NO: 49236 - protein, 9 aa, Artificial Sequence
  Description of Artificial Sequence: Synthetic peptide
  Seed: VPDSDPARY (MAGA1_HUMAN)
VADSDPARY

SEQ ID NO: 49237 - protein, 10 aa, Artificial Sequence
  Description of Artificial Sequence: Synthetic peptide
  Seed: RVRFFFPSLR (MAGA1_HUMAN)
RHRFFFPSLY

SEQ ID NO: 49238 - protein, 10 aa, Artificial Sequence
  Description of Artificial Sequence: Synthetic peptide
  Seed: DVKEADPTGH (MAGA1_HUMAN)
DVKEADPTGR

SEQ ID NO: 49239 - protein, 10 aa, Artificial Sequence
  Description of Artificial Sequence: Synthetic peptide
  Seed: SLEQRSLHCK (MAGA1_HUMAN)
SSEQRSLHCY

SEQ ID NO: 49240 - protein, 10 aa, Artificial Sequence
  Description of Artificial Sequence: Synthetic peptide
  Seed: SARVRFFFPS (MAGA1_HUMAN)
SFRVRFFFPM

SEQ ID NO: 49241 - protein, 9 aa, Artificial Sequence
  Description of Artificial Sequence: Synthetic peptide
  Seed: TQDLVQEKY (MAGA1_HUMAN)
TLDLVQEKF

SEQ ID NO: 49242 - protein, 9 aa, Artificial Sequence
  Description of Artificial Sequence: Synthetic peptide
  Seed: KYRAREPVT (MAGA1_HUMAN)
KVRAREPVF

SEQ ID NO: 49243 - protein, 8 aa, Artificial Sequence
  Description of Artificial Sequence: Synthetic peptide
  Seed: RVRFFFPS (MAGA1_HUMAN)
RSRFFFPL

SEQ ID NO: 49244 - protein, 10 aa, Artificial Sequence
  Description of Artificial Sequence: Synthetic peptide
  Seed: ADLVGFLLLK (MAGA1_HUMAN)
AGLVGFLLLK

SEQ ID NO: 49245 - protein, 10 aa, Artificial Sequence
  Description of Artificial Sequence: Synthetic peptide
  Seed: KVSARVRFFF (MAGA1_HUMAN)
KCSARVRFFF

SEQ ID NO: 49246 - protein, 10 aa, Artificial Sequence
  Description of Artificial Sequence: Synthetic peptide
  Seed: FFPSLREAAL (MAGA1_HUMAN)
FAPSLREAAL

SEQ ID NO: 49247 - protein, 10 aa, Artificial Sequence
  Description of Artificial Sequence: Synthetic peptide
  Seed: SDPARYEFLW (MAGA1_HUMAN)
SLPARYEFLW

SEQ ID NO: 49248 - protein, 11 aa, Artificial Sequence
  Description of Artificial Sequence: Synthetic peptide
  Seed: RVRFFFPSLRE (MAGA1_HUMAN)
RMRFFFPSLRT

SEQ ID NO: 49249 - protein, 9 aa, Artificial Sequence
  Description of Artificial Sequence: Synthetic peptide
  Seed: IAMEGGHAP (MAGA1_HUMAN)
IIMEGGHAI

SEQ ID NO: 49250 - protein, 10 aa, Artificial Sequence
  Description of Artificial Sequence: Synthetic peptide
  Seed: LEYVIKVSAR (MAGA1_HUMAN)
LTYVIKVSAR

SEQ ID NO: 49251 - protein, 9 aa, Artificial Sequence
  Description of Artificial Sequence: Synthetic peptide
  Seed: LVTCLGLSY (MAGA1_HUMAN)
LMTCLGLSL

SEQ ID NO: 49252 - protein, 11 aa, Artificial Sequence
  Description of Artificial Sequence: Synthetic peptide
  Seed: ELSVMEVYDGR (MAGA1_HUMAN)
EASVMEVYDGR

SEQ ID NO: 49253 - protein, 9 aa, Artificial Sequence
  Description of Artificial Sequence: Synthetic peptide
  Seed: SYVKVLEYV (MAGA1_HUMAN)
SWVKVLEYL

SEQ ID NO: 49254 - protein, 9 aa, Artificial Sequence
  Description of Artificial Sequence: Synthetic peptide
  Seed: TTINFTRQR (MAGA1_HUMAN)
TLINFTRQR

SEQ ID NO: 49255 - protein, 9 aa, Artificial Sequence
  Description of Artificial Sequence: Synthetic peptide
  Seed: DLVGFLLLK (MAGA1_HUMAN)
DFVGFLLLK

SEQ ID NO: 49256 - protein, 10 aa, Artificial Sequence
  Description of Artificial Sequence: Synthetic peptide
  Seed: YEFLWGPRAL (MAGA1_HUMAN)
YFFLWGPRAV

SEQ ID NO: 49257 - protein, 10 aa, Artificial Sequence
  Description of Artificial Sequence: Synthetic peptide
  Seed: KEADPTGHSY (MAGA1_HUMAN)
KMADPTGHSF

SEQ ID NO: 49258 - protein, 9 aa, Artificial Sequence
  Description of Artificial Sequence: Synthetic peptide
  Seed: SSSPLVLGT (MAGA1_HUMAN)
SVSPLVLGV

SEQ ID NO: 49259 - protein, 9 aa, Artificial Sequence
  Description of Artificial Sequence: Synthetic peptide
  Seed: SSSPLVLGT (MAGA1_HUMAN)
SQSPLVLGL

SEQ ID NO: 49260 - protein, 11 aa, Artificial Sequence
  Description of Artificial Sequence: Synthetic peptide
  Seed: EVYDGREHSAY (MAGA1_HUMAN)
EIYDGREHSAR

SEQ ID NO: 49261 - protein, 9 aa, Artificial Sequence
  Description of Artificial Sequence: Synthetic peptide
  Seed: EHSAYGEPR (MAGA1_HUMAN)
EFSAYGEPR

SEQ ID NO: 49262 - protein, 9 aa, Artificial Sequence
  Description of Artificial Sequence: Synthetic peptide
  Seed: ESLQLVFGI (MAGA1_HUMAN)
EVLQLVFGV

SEQ ID NO: 49263 - protein, 10 aa, Artificial Sequence
  Description of Artificial Sequence: Synthetic peptide
  Seed: YEFLWGPRAL (MAGA1_HUMAN)
YVFLWGPRAY

SEQ ID NO: 49264 - protein, 10 aa, Artificial Sequence
  Description of Artificial Sequence: Synthetic peptide
  Seed: KEADPTGHSY (MAGA1_HUMAN)
KVADPTGHSK

SEQ ID NO: 49265 - protein, 10 aa, Artificial Sequence
  Description of Artificial Sequence: Synthetic peptide
  Seed: WEELSVMEVY (MAGA1_HUMAN)
WTELSVMEVW

SEQ ID NO: 49266 - protein, 9 aa, Artificial Sequence
  Description of Artificial Sequence: Synthetic peptide
  Seed: SLFRAVITK (MAGA1_HUMAN)
SLFRAVITR

SEQ ID NO: 49267 - protein, 9 aa, Artificial Sequence
  Description of Artificial Sequence: Synthetic peptide
  Seed: MPKTGFLII (MAGA1_HUMAN)
MMKTGFLIY

SEQ ID NO: 49268 - protein, 9 aa, Artificial Sequence
  Description of Artificial Sequence: Synthetic peptide
  Seed: IAMEGGHAP (MAGA1_HUMAN)
IGMEGGHAF

SEQ ID NO: 49269 - protein, 9 aa, Artificial Sequence
  Description of Artificial Sequence: Synthetic peptide
  Seed: IAMEGGHAP (MAGA1_HUMAN)
IMMEGGHAF

SEQ ID NO: 49270 - protein, 11 aa, Artificial Sequence
  Description of Artificial Sequence: Synthetic peptide
  Seed: SSSSPLVLGTL (MAGA1_HUMAN)
SASSPLVLGTW

SEQ ID NO: 49271 - protein, 9 aa, Artificial Sequence
  Description of Artificial Sequence: Synthetic peptide
  Seed: REEEGPSTS (MAGA1_HUMAN)
REEEGPSTV

SEQ ID NO: 49272 - protein, 10 aa, Artificial Sequence
  Description of Artificial Sequence: Synthetic peptide
  Seed: EVYDGREHSA (MAGA1_HUMAN)
ELYDGREHSR

SEQ ID NO: 49273 - protein, 10 aa, Artificial Sequence
  Description of Artificial Sequence: Synthetic peptide
  Seed: YEFLWGPRAL (MAGA1_HUMAN)
YAFLWGPRAL

SEQ ID NO: 49274 - protein, 10 aa, Artificial Sequence
  Description of Artificial Sequence: Synthetic peptide
  Seed: ARYEFLWGPR (MAGA1_HUMAN)
ATYEFLWGPK

SEQ ID NO: 49275 - protein, 9 aa, Artificial Sequence
  Description of Artificial Sequence: Synthetic peptide
  Seed: RVRFFFPSL (MAGA1_HUMAN)
RLRFFFPSP

SEQ ID NO: 49276 - protein, 9 aa, Artificial Sequence
  Description of Artificial Sequence: Synthetic peptide
  Seed: KVLEYVIKV (MAGA1_HUMAN)
KGLEYVIKW

SEQ ID NO: 49277 - protein, 11 aa, Artificial Sequence
  Description of Artificial Sequence: Synthetic peptide
  Seed: RVRFFFPSLRE (MAGA1_HUMAN)
RMRFFFPSLRV

SEQ ID NO: 49278 - protein, 9 aa, Artificial Sequence
  Description of Artificial Sequence: Synthetic peptide
  Seed: RAREPVTKA (MAGA1_HUMAN)
RTREPVTKM

SEQ ID NO: 49279 - protein, 9 aa, Artificial Sequence
  Description of Artificial Sequence: Synthetic peptide
  Seed: SVMEVYDGR (MAGA1_HUMAN)
SFMEVYDGR

SEQ ID NO: 49280 - protein, 10 aa, Artificial Sequence
  Description of Artificial Sequence: Synthetic peptide
  Seed: YEFLWGPRAL (MAGA1_HUMAN)
YPFLWGPRAM

SEQ ID NO: 49281 - protein, 11 aa, Artificial Sequence
  Description of Artificial Sequence: Synthetic peptide
  Seed: RYEFLWGPRAL (MAGA1_HUMAN)
RWEFLWGPRAF

SEQ ID NO: 49282 - protein, 9 aa, Artificial Sequence
  Description of Artificial Sequence: Synthetic peptide
  Seed: DPTGHSYVL (MAGA1_HUMAN)
DPTGHSYVM

SEQ ID NO: 49283 - protein, 10 aa, Artificial Sequence
  Description of Artificial Sequence: Synthetic peptide
  Seed: IMPKTGFLII (MAGA1_HUMAN)
ILPKTGFLIF

SEQ ID NO: 49284 - protein, 10 aa, Artificial Sequence
  Description of Artificial Sequence: Synthetic peptide
  Seed: KTGFLIIVLV (MAGA1_HUMAN)
KLGFLIIVLL

SEQ ID NO: 49285 - protein, 10 aa, Artificial Sequence
  Description of Artificial Sequence: Synthetic peptide
  Seed: SSSPLVLGTL (MAGA1_HUMAN)
SASPLVLGTF

SEQ ID NO: 49286 - protein, 9 aa, Artificial Sequence
  Description of Artificial Sequence: Synthetic peptide
  Seed: VADLVGFLL (MAGA1_HUMAN)
VVDLVGFLW

SEQ ID NO: 49287 - protein, 10 aa, Artificial Sequence
  Description of Artificial Sequence: Synthetic peptide
  Seed: KVADLVGFLL (MAGA1_HUMAN)
KIADLVGFLF

SEQ ID NO: 49288 - protein, 10 aa, Artificial Sequence
  Description of Artificial Sequence: Synthetic peptide
  Seed: RAREPVTKAE (MAGA1_HUMAN)
RVREPVTKAV

SEQ ID NO: 49289 - protein, 11 aa, Artificial Sequence
  Description of Artificial Sequence: Synthetic peptide
  Seed: SARVRFFFPSL (MAGA1_HUMAN)
SNRVRFFFPSK

SEQ ID NO: 49290 - protein, 10 aa, Artificial Sequence
  Description of Artificial Sequence: Synthetic peptide
  Seed: KYRAREPVTK (MAGA1_HUMAN)
KTRAREPVTV

SEQ ID NO: 49291 - protein, 9 aa, Artificial Sequence
  Description of Artificial Sequence: Synthetic peptide
  Seed: ARYEFLWGP (MAGA1_HUMAN)
ARYEFLWGI

SEQ ID NO: 49292 - protein, 9 aa, Artificial Sequence
  Description of Artificial Sequence: Synthetic peptide
  Seed: KASESLQLV (MAGA1_HUMAN)
KTSESLQLA

SEQ ID NO: 49293 - protein, 9 aa, Artificial Sequence
  Description of Artificial Sequence: Synthetic peptide
  Seed: SARVRFFFP (MAGA1_HUMAN)
SGRVRFFFY

SEQ ID NO: 49294 - protein, 10 aa, Artificial Sequence
  Description of Artificial Sequence: Synthetic peptide
  Seed: YEFLWGPRAL (MAGA1_HUMAN)
YCFLWGPRAL

SEQ ID NO: 49295 - protein, 9 aa, Artificial Sequence
  Description of Artificial Sequence: Synthetic peptide
  Seed: ETSYVKVLE (MAGA1_HUMAN)
EASYVKVLR

SEQ ID NO: 49296 - protein, 9 aa, Artificial Sequence
  Description of Artificial Sequence: Synthetic peptide
  Seed: LQLVFGIDV (MAGA1_HUMAN)
LKLVFGIDF

SEQ ID NO: 49297 - protein, 9 aa, Artificial Sequence
  Description of Artificial Sequence: Synthetic peptide
  Seed: LTQDLVQEK (MAGA1_HUMAN)
LRQDLVQEV

SEQ ID NO: 49298 - protein, 9 aa, Artificial Sequence
  Description of Artificial Sequence: Synthetic peptide
  Seed: QQEALGLVC (MAGA1_HUMAN)
QEEALGLVV

SEQ ID NO: 49299 - protein, 10 aa, Artificial Sequence
  Description of Artificial Sequence: Synthetic peptide
  Seed: DLVGFLLLKY (MAGA1_HUMAN)
DIVGFLLLKR

SEQ ID NO: 49300 - protein, 10 aa, Artificial Sequence
  Description of Artificial Sequence: Synthetic peptide
  Seed: RVRFFFPSLR (MAGA1_HUMAN)
RERFFFPSLH

SEQ ID NO: 49301 - protein, 9 aa, Artificial Sequence
  Description of Artificial Sequence: Synthetic peptide
  Seed: STDPPQSPQ (MAGA1_HUMAN)
SNDPPQSPF

SEQ ID NO: 49302 - protein, 9 aa, Artificial Sequence
  Description of Artificial Sequence: Synthetic peptide
  Seed: SAYGEPRKL (MAGA1_HUMAN)
SMYGEPRKV

SEQ ID NO: 49303 - protein, 10 aa, Artificial Sequence
  Description of Artificial Sequence: Synthetic peptide
  Seed: SAFPTTINFT (MAGA1_HUMAN)
SVFPTTINFM

SEQ ID NO: 49304 - protein, 10 aa, Artificial Sequence
  Description of Artificial Sequence: Synthetic peptide
  Seed: ASAFPTTINF (MAGA1_HUMAN)
AMAFPTTINW

SEQ ID NO: 49305 - protein, 10 aa, Artificial Sequence
  Description of Artificial Sequence: Synthetic peptide
  Seed: ADPTGHSYVL (MAGA1_HUMAN)
AWPTGHSYVL

SEQ ID NO: 49306 - protein, 10 aa, Artificial Sequence
  Description of Artificial Sequence: Synthetic peptide
  Seed: RVRFFFPSLR (MAGA1_HUMAN)
RYRFFFPSLM

SEQ ID NO: 49307 - protein, 11 aa, Artificial Sequence
  Description of Artificial Sequence: Synthetic peptide
  Seed: ELSVMEVYDGR (MAGA1_HUMAN)
ENSVMEVYDGR

SEQ ID NO: 49308 - protein, 10 aa, Artificial Sequence
  Description of Artificial Sequence: Synthetic peptide
  Seed: WEELSVMEVY (MAGA1_HUMAN)
WKELSVMEVY

SEQ ID NO: 49309 - protein, 9 aa, Artificial Sequence
  Description of Artificial Sequence: Synthetic peptide
  Seed: RALAETSYV (MAGA1_HUMAN)
RILAETSYF

SEQ ID NO: 49310 - protein, 9 aa, Artificial Sequence
  Description of Artificial Sequence: Synthetic peptide
  Seed: NYKHCFPEI (MAGA1_HUMAN)
NWKHCFPEF

SEQ ID NO: 49311 - protein, 9 aa, Artificial Sequence
  Description of Artificial Sequence: Synthetic peptide
  Seed: LFRAVITKK (MAGA1_HUMAN)
LTRAVITKL

SEQ ID NO: 49312 - protein, 9 aa, Artificial Sequence
  Description of Artificial Sequence: Synthetic peptide
  Seed: EADPTGHSY (MAGA1_HUMAN)
EPDPTGHSW

SEQ ID NO: 49313 - protein, 10 aa, Artificial Sequence
  Description of Artificial Sequence: Synthetic peptide
  Seed: ASAFPTTINF (MAGA1_HUMAN)
ASAFPTTINW

SEQ ID NO: 49314 - protein, 9 aa, Artificial Sequence
  Description of Artificial Sequence: Synthetic peptide
  Seed: KASESLQLV (MAGA1_HUMAN)
KQSESLQLF

SEQ ID NO: 49315 - protein, 10 aa, Artificial Sequence
  Description of Artificial Sequence: Synthetic peptide
  Seed: FPSLREAALR (MAGA1_HUMAN)
FISLREAALR

SEQ ID NO: 49316 - protein, 9 aa, Artificial Sequence
  Description of Artificial Sequence: Synthetic peptide
  Seed: SAFPTTINF (MAGA1_HUMAN)
SIFPTTINV

SEQ ID NO: 49317 - protein, 9 aa, Artificial Sequence
  Description of Artificial Sequence: Synthetic peptide
  Seed: ESLQLVFGI (MAGA1_HUMAN)
ESLQLVFGA

SEQ ID NO: 49318 - protein, 11 aa, Artificial Sequence
  Description of Artificial Sequence: Synthetic peptide
  Seed: ARVRFFFPSLR (MAGA1_HUMAN)
ASVRFFFPSLL

SEQ ID NO: 49319 - protein, 9 aa, Artificial Sequence
  Description of Artificial Sequence: Synthetic peptide
  Seed: RALAETSYV (MAGA1_HUMAN)
RVLAETSYV

SEQ ID NO: 49320 - protein, 9 aa, Artificial Sequence
  Description of Artificial Sequence: Synthetic peptide
  Seed: RVRFFFPSL (MAGA1_HUMAN)
RIRFFFPSW

SEQ ID NO: 49321 - protein, 10 aa, Artificial Sequence
  Description of Artificial Sequence: Synthetic peptide
  Seed: KEADPTGHSY (MAGA1_HUMAN)
KPADPTGHSF

SEQ ID NO: 49322 - protein, 10 aa, Artificial Sequence
  Description of Artificial Sequence: Synthetic peptide
  Seed: EYVIKVSARV (MAGA1_HUMAN)
EAVIKVSARV

SEQ ID NO: 49323 - protein, 11 aa, Artificial Sequence
  Description of Artificial Sequence: Synthetic peptide
  Seed: TKKVADLVGFL (MAGA1_HUMAN)
TNKVADLVGFV

SEQ ID NO: 49324 - protein, 9 aa, Artificial Sequence
  Description of Artificial Sequence: Synthetic peptide
  Seed: GLVCVQAAT (MAGA1_HUMAN)
GIVCVQAAI

SEQ ID NO: 49325 - protein, 11 aa, Artificial Sequence
  Description of Artificial Sequence: Synthetic peptide
  Seed: EVYDGREHSAY (MAGA1_HUMAN)
EVYDGREHSAR

SEQ ID NO: 49326 - protein, 10 aa, Artificial Sequence
  Description of Artificial Sequence: Synthetic peptide
  Seed: YEFLWGPRAL (MAGA1_HUMAN)
YCFLWGPRAF

SEQ ID NO: 49327 - protein, 9 aa, Artificial Sequence
  Description of Artificial Sequence: Synthetic peptide
  Seed: RQVPDSDPA (MAGA1_HUMAN)
RMVPDSDPY

SEQ ID NO: 49328 - protein, 9 aa, Artificial Sequence
  Description of Artificial Sequence: Synthetic peptide
  Seed: KVADLVGFL (MAGA1_HUMAN)
KAADLVGFI

SEQ ID NO: 49329 - protein, 9 aa, Artificial Sequence
  Description of Artificial Sequence: Synthetic peptide
  Seed: SARVRFFFP (MAGA1_HUMAN)
SIRVRFFFL

SEQ ID NO: 49330 - protein, 9 aa, Artificial Sequence
  Description of Artificial Sequence: Synthetic peptide
  Seed: IFGKASESL (MAGA1_HUMAN)
IAGKASESM

SEQ ID NO: 49331 - protein, 9 aa, Artificial Sequence
  Description of Artificial Sequence: Synthetic peptide
  Seed: LVQEKYLEY (MAGA1_HUMAN)
LSQEKYLEY

SEQ ID NO: 49332 - protein, 9 aa, Artificial Sequence
  Description of Artificial Sequence: Synthetic peptide
  Seed: VYDGREHSA (MAGA1_HUMAN)
VLDGREHSV

SEQ ID NO: 49333 - protein, 10 aa, Artificial Sequence
  Description of Artificial Sequence: Synthetic peptide
  Seed: RVRFFFPSLR (MAGA1_HUMAN)
RPRFFFPSLA

SEQ ID NO: 49334 - protein, 10 aa, Artificial Sequence
  Description of Artificial Sequence: Synthetic peptide
  Seed: LSVMEVYDGR (MAGA1_HUMAN)
LTVMEVYDGR

SEQ ID NO: 49335 - protein, 9 aa, Artificial Sequence
  Description of Artificial Sequence: Synthetic peptide
  Seed: YVIKVSARV (MAGA1_HUMAN)
YLIKVSARI

SEQ ID NO: 49336 - protein, 9 aa, Artificial Sequence
  Description of Artificial Sequence: Synthetic peptide
  Seed: SSSPLVLGT (MAGA1_HUMAN)
SVSPLVLGM

SEQ ID NO: 49337 - protein, 9 aa, Artificial Sequence
  Description of Artificial Sequence: Synthetic peptide
  Seed: STSCILESL (MAGA1_HUMAN)
SVSCILESA

SEQ ID NO: 49338 - protein, 9 aa, Artificial Sequence
  Description of Artificial Sequence: Synthetic peptide
  Seed: TQDLVQEKY (MAGA1_HUMAN)
TGDLVQEKV

SEQ ID NO: 49339 - protein, 10 aa, Artificial Sequence
  Description of Artificial Sequence: Synthetic peptide
  Seed: EMLESVIKNY (MAGA1_HUMAN)
EILESVIKNR

SEQ ID NO: 49340 - protein, 9 aa, Artificial Sequence
  Description of Artificial Sequence: Synthetic peptide
  Seed: LVTCLGLSY (MAGA1_HUMAN)
LPTCLGLSW

SEQ ID NO: 49341 - protein, 10 aa, Artificial Sequence
  Description of Artificial Sequence: Synthetic peptide
  Seed: ATSSSSPLVL (MAGA1_HUMAN)
AVSSSSPLVV

SEQ ID NO: 49342 - protein, 10 aa, Artificial Sequence
  Description of Artificial Sequence: Synthetic peptide
  Seed: SSSPLVLGTL (MAGA1_HUMAN)
SVSPLVLGTW

SEQ ID NO: 49343 - protein, 9 aa, Artificial Sequence
  Description of Artificial Sequence: Synthetic peptide
  Seed: EIWEELSVM (MAGA1_HUMAN)
ETWEELSVR

SEQ ID NO: 49344 - protein, 9 aa, Artificial Sequence
  Description of Artificial Sequence: Synthetic peptide
  Seed: KVADLVGFL (MAGA1_HUMAN)
KTADLVGFY

SEQ ID NO: 49345 - protein, 9 aa, Artificial Sequence
  Description of Artificial Sequence: Synthetic peptide
  Seed: VADLVGFLL (MAGA1_HUMAN)
VPDLVGFLL

SEQ ID NO: 49346 - protein, 9 aa, Artificial Sequence
  Description of Artificial Sequence: Synthetic peptide
  Seed: TSYVKVLEY (MAGA1_HUMAN)
TFYVKVLEF

SEQ ID NO: 49347 - protein, 9 aa, Artificial Sequence
  Description of Artificial Sequence: Synthetic peptide
  Seed: GTLEEVPTA (MAGA1_HUMAN)
GMLEEVPTI

SEQ ID NO: 49348 - protein, 9 aa, Artificial Sequence
  Description of Artificial Sequence: Synthetic peptide
  Seed: FPTTINFTR (MAGA1_HUMAN)
FLTTINFTR

SEQ ID NO: 49349 - protein, 9 aa, Artificial Sequence
  Description of Artificial Sequence: Synthetic peptide
  Seed: FFFPSLREA (MAGA1_HUMAN)
FAFPSLREM

SEQ ID NO: 49350 - protein, 9 aa, Artificial Sequence
  Description of Artificial Sequence: Synthetic peptide
  Seed: IMPKTGFLI (MAGA1_HUMAN)
ILPKTGFLL

SEQ ID NO: 49351 - protein, 9 aa, Artificial Sequence
  Description of Artificial Sequence: Synthetic peptide
  Seed: TSYVKVLEY (MAGA1_HUMAN)
TAYVKVLEV

SEQ ID NO: 49352 - protein, 9 aa, Artificial Sequence
  Description of Artificial Sequence: Synthetic peptide
  Seed: QSPQGASAF (MAGA1_HUMAN)
QSPQGASAI

SEQ ID NO: 49353 - protein, 9 aa, Artificial Sequence
  Description of Artificial Sequence: Synthetic peptide
  Seed: SAFPTTINF (MAGA1_HUMAN)
SEFPTTINM

SEQ ID NO: 49354 - protein, 9 aa, Artificial Sequence
  Description of Artificial Sequence: Synthetic peptide
  Seed: ASESLQLVF (MAGA1_HUMAN)
AVESLQLVW

SEQ ID NO: 49355 - protein, 11 aa, Artificial Sequence
  Description of Artificial Sequence: Synthetic peptide
  Seed: RVRFFFPSLRE (MAGA1_HUMAN)
RMRFFFPSLRE

SEQ ID NO: 49356 - protein, 9 aa, Artificial Sequence
  Description of Artificial Sequence: Synthetic peptide
  Seed: AEMLESVIK (MAGA1_HUMAN)
AEMLESVIP

SEQ ID NO: 49357 - protein, 10 aa, Artificial Sequence
  Description of Artificial Sequence: Synthetic peptide
  Seed: RVRFFFPSLR (MAGA1_HUMAN)
RYRFFFPSLK

SEQ ID NO: 49358 - protein, 9 aa, Artificial Sequence
  Description of Artificial Sequence: Synthetic peptide
  Seed: IMPKTGFLI (MAGA1_HUMAN)
IFPKTGFLL

SEQ ID NO: 49359 - protein, 9 aa, Artificial Sequence
  Description of Artificial Sequence: Synthetic peptide
  Seed: YKHCFPEIF (MAGA1_HUMAN)
YAHCFPEIL

SEQ ID NO: 49360 - protein, 9 aa, Artificial Sequence
  Description of Artificial Sequence: Synthetic peptide
  Seed: RALAETSYV (MAGA1_HUMAN)
RYLAETSYK

SEQ ID NO: 49361 - protein, 9 aa, Artificial Sequence
  Description of Artificial Sequence: Synthetic peptide
  Seed: GKASESLQL (MAGA1_HUMAN)
GMASESLQM

SEQ ID NO: 49362 - protein, 9 aa, Artificial Sequence
  Description of Artificial Sequence: Synthetic peptide
  Seed: LGDNQIMPK (MAGA1_HUMAN)
LMDNQIMPY

SEQ ID NO: 49363 - protein, 10 aa, Artificial Sequence
  Description of Artificial Sequence: Synthetic peptide
  Seed: KEADPTGHSY (MAGA1_HUMAN)
KSADPTGHSV

SEQ ID NO: 49364 - protein, 9 aa, Artificial Sequence
  Description of Artificial Sequence: Synthetic peptide
  Seed: FFPSLREAA (MAGA1_HUMAN)
FYPSLREAV

SEQ ID NO: 49365 - protein, 11 aa, Artificial Sequence
  Description of Artificial Sequence: Synthetic peptide
  Seed: EMLESVIKNYK (MAGA1_HUMAN)
EILESVIKNYR

SEQ ID NO: 49366 - protein, 10 aa, Artificial Sequence
  Description of Artificial Sequence: Synthetic peptide
  Seed: LTQDLVQEKY (MAGA1_HUMAN)
LCQDLVQEKW

SEQ ID NO: 49367 - protein, 9 aa, Artificial Sequence
  Description of Artificial Sequence: Synthetic peptide
  Seed: FLIIVLVMI (MAGA1_HUMAN)
FVIIVLVMV

SEQ ID NO: 49368 - protein, 9 aa, Artificial Sequence
  Description of Artificial Sequence: Synthetic peptide
  Seed: GASAFPTTI (MAGA1_HUMAN)
GISAFPTTF

SEQ ID NO: 49369 - protein, 9 aa, Artificial Sequence
  Description of Artificial Sequence: Synthetic peptide
  Seed: SAYGEPRKL (MAGA1_HUMAN)
SMYGEPRKI

SEQ ID NO: 49370 - protein, 9 aa, Artificial Sequence
  Description of Artificial Sequence: Synthetic peptide
  Seed: TKAEMLESV (MAGA1_HUMAN)
TVAEMLESA

SEQ ID NO: 49371 - protein, 9 aa, Artificial Sequence
  Description of Artificial Sequence: Synthetic peptide
  Seed: TKAEMLESV (MAGA1_HUMAN)
TQAEMLESM

SEQ ID NO: 49372 - protein, 9 aa, Artificial Sequence
  Description of Artificial Sequence: Synthetic peptide
  Seed: AATSSSSPL (MAGA1_HUMAN)
AITSSSSPY

SEQ ID NO: 49373 - protein, 10 aa, Artificial Sequence
  Description of Artificial Sequence: Synthetic peptide
  Seed: ESLFRAVITK (MAGA1_HUMAN)
ETLFRAVITK

SEQ ID NO: 49374 - protein, 9 aa, Artificial Sequence
  Description of Artificial Sequence: Synthetic peptide
  Seed: RVRFFFPSL (MAGA1_HUMAN)
RARFFFPSC

SEQ ID NO: 49375 - protein, 9 aa, Artificial Sequence
  Description of Artificial Sequence: Synthetic peptide
  Seed: SAFPTTINF (MAGA1_HUMAN)
SPFPTTINY

SEQ ID NO: 49376 - protein, 9 aa, Artificial Sequence
  Description of Artificial Sequence: Synthetic peptide
  Seed: RALAETSYV (MAGA1_HUMAN)
RSLAETSYW

SEQ ID NO: 49377 - protein, 10 aa, Artificial Sequence
  Description of Artificial Sequence: Synthetic peptide
  Seed: ETSYVKVLEY (MAGA1_HUMAN)
EQSYVKVLER

SEQ ID NO: 49378 - protein, 10 aa, Artificial Sequence
  Description of Artificial Sequence: Synthetic peptide
  Seed: EMLESVIKNY (MAGA1_HUMAN)
EMLESVIKNR

SEQ ID NO: 49379 - protein, 9 aa, Artificial Sequence
  Description of Artificial Sequence: Synthetic peptide
  Seed: VSARVRFFF (MAGA1_HUMAN)
VLARVRFFW

SEQ ID NO: 49380 - protein, 9 aa, Artificial Sequence
  Description of Artificial Sequence: Synthetic peptide
  Seed: HSYVLVTCL (MAGA1_HUMAN)
HTYVLVTCM

SEQ ID NO: 49381 - protein, 10 aa, Artificial Sequence
  Description of Artificial Sequence: Synthetic peptide
  Seed: FFPSLREAAL (MAGA1_HUMAN)
FLPSLREAAM

SEQ ID NO: 49382 - protein, 11 aa, Artificial Sequence
  Description of Artificial Sequence: Synthetic peptide
  Seed: RVRFFFPSLRE (MAGA1_HUMAN)
RFRFFFPSLRI

SEQ ID NO: 49383 - protein, 10 aa, Artificial Sequence
  Description of Artificial Sequence: Synthetic peptide
  Seed: RVRFFFPSLR (MAGA1_HUMAN)
RTRFFFPSLC

SEQ ID NO: 49384 - protein, 11 aa, Artificial Sequence
  Description of Artificial Sequence: Synthetic peptide
  Seed: YEFLWGPRALA (MAGA1_HUMAN)
YYFLWGPRALL

SEQ ID NO: 49385 - protein, 9 aa, Artificial Sequence
  Description of Artificial Sequence: Synthetic peptide
  Seed: LKYRAREPV (MAGA1_HUMAN)
LNYRAREPY

SEQ ID NO: 49386 - protein, 10 aa, Artificial Sequence
  Description of Artificial Sequence: Synthetic peptide
  Seed: SLFRAVITKK (MAGA1_HUMAN)
SMFRAVITKK

SEQ ID NO: 49387 - protein, 8 aa, Artificial Sequence
  Description of Artificial Sequence: Synthetic peptide
  Seed: FLLLKYRA (MAGA1_HUMAN)
FLLLKYRV

SEQ ID NO: 49388 - protein, 11 aa, Artificial Sequence
  Description of Artificial Sequence: Synthetic peptide
  Seed: RVRFFFPSLRE (MAGA1_HUMAN)
RTRFFFPSLRM

SEQ ID NO: 49389 - protein, 9 aa, Artificial Sequence
  Description of Artificial Sequence: Synthetic peptide
  Seed: LVLGTLEEV (MAGA1_HUMAN)
LTLGTLEEA

SEQ ID NO: 49390 - protein, 9 aa, Artificial Sequence
  Description of Artificial Sequence: Synthetic peptide
  Seed: SSPLVLGTL (MAGA1_HUMAN)
SFPLVLGTF

SEQ ID NO: 49391 - protein, 9 aa, Artificial Sequence
  Description of Artificial Sequence: Synthetic peptide
  Seed: SAYGEPRKL (MAGA1_HUMAN)
SMYGEPRKR

SEQ ID NO: 49392 - protein, 10 aa, Artificial Sequence
  Description of Artificial Sequence: Synthetic peptide
  Seed: KNYKHCFPEI (MAGA1_HUMAN)
KPYKHCFPEF

SEQ ID NO: 49393 - protein, 9 aa, Artificial Sequence
  Description of Artificial Sequence: Synthetic peptide
  Seed: EFLWGPRAL (MAGA1_HUMAN)
EFLWGPRAY

SEQ ID NO: 49394 - protein, 10 aa, Artificial Sequence
  Description of Artificial Sequence: Synthetic peptide
  Seed: KVLEYVIKVS (MAGA1_HUMAN)
KLLEYVIKVI

SEQ ID NO: 49395 - protein, 9 aa, Artificial Sequence
  Description of Artificial Sequence: Synthetic peptide
  Seed: YEFLWGPRA (MAGA1_HUMAN)
YEFLWGPRM

SEQ ID NO: 49396 - protein, 9 aa, Artificial Sequence
  Description of Artificial Sequence: Synthetic peptide
  Seed: SAYGEPRKL (MAGA1_HUMAN)
SLYGEPRKL

SEQ ID NO: 49397 - protein, 9 aa, Artificial Sequence
  Description of Artificial Sequence: Synthetic peptide
  Seed: FLIIVLVMI (MAGA1_HUMAN)
FMIIVLVMA

SEQ ID NO: 49398 - protein, 9 aa, Artificial Sequence
  Description of Artificial Sequence: Synthetic peptide
  Seed: TSSSSPLVL (MAGA1_HUMAN)
TASSSPLVW

SEQ ID NO: 49399 - protein, 11 aa, Artificial Sequence
  Description of Artificial Sequence: Synthetic peptide
  Seed: FLWGPRALAET (MAGA1_HUMAN)
FVWGPRALAEV

SEQ ID NO: 49400 - protein, 10 aa, Artificial Sequence
  Description of Artificial Sequence: Synthetic peptide
  Seed: LVLGTLEEVP (MAGA1_HUMAN)
LMLGTLEEVV

SEQ ID NO: 49401 - protein, 9 aa, Artificial Sequence
  Description of Artificial Sequence: Synthetic peptide
  Seed: GASAFPTTI (MAGA1_HUMAN)
GVSAFPTTW

SEQ ID NO: 49402 - protein, 9 aa, Artificial Sequence
  Description of Artificial Sequence: Synthetic peptide
  Seed: IAMEGGHAP (MAGA1_HUMAN)
ICMEGGHAM

SEQ ID NO: 49403 - protein, 9 aa, Artificial Sequence
  Description of Artificial Sequence: Synthetic peptide
  Seed: RVRFFFPSL (MAGA1_HUMAN)
RTRFFFPSE

SEQ ID NO: 49404 - protein, 9 aa, Artificial Sequence
  Description of Artificial Sequence: Synthetic peptide
  Seed: FLIIVLVMI (MAGA1_HUMAN)
FLIIVLVMA

SEQ ID NO: 49405 - protein, 10 aa, Artificial Sequence
  Description of Artificial Sequence: Synthetic peptide
  Seed: KVSARVRFFF (MAGA1_HUMAN)
KYSARVRFFK

SEQ ID NO: 49406 - protein, 9 aa, Artificial Sequence
  Description of Artificial Sequence: Synthetic peptide
  Seed: QSPQGASAF (MAGA1_HUMAN)
QAPQGASAL

SEQ ID NO: 49407 - protein, 10 aa, Artificial Sequence
  Description of Artificial Sequence: Synthetic peptide
  Seed: SCILESLFRA (MAGA1_HUMAN)
SDILESLFRL

SEQ ID NO: 49408 - protein, 8 aa, Artificial Sequence
  Description of Artificial Sequence: Synthetic peptide
  Seed: RFFFPSLR (MAGA1_HUMAN)
RLFFPSLR

SEQ ID NO: 49409 - protein, 9 aa, Artificial Sequence
  Description of Artificial Sequence: Synthetic peptide
  Seed: RVRFFFPSL (MAGA1_HUMAN)
RQRFFFPSV

SEQ ID NO: 49410 - protein, 9 aa, Artificial Sequence
  Description of Artificial Sequence: Synthetic peptide
  Seed: EADPTGHSY (MAGA1_HUMAN)
EADPTGHSF

SEQ ID NO: 49411 - protein, 9 aa, Artificial Sequence
  Description of Artificial Sequence: Synthetic peptide
  Seed: LVTCLGLSY (MAGA1_HUMAN)
LSTCLGLSL

SEQ ID NO: 49412 - protein, 10 aa, Artificial Sequence
  Description of Artificial Sequence: Synthetic peptide
  Seed: EVYDGREHSA (MAGA1_HUMAN)
EMYDGREHSK

SEQ ID NO: 49413 - protein, 10 aa, Artificial Sequence
  Description of Artificial Sequence: Synthetic peptide
  Seed: VLVTCLGLSY (MAGA1_HUMAN)
VQVTCLGLSF

SEQ ID NO: 49414 - protein, 9 aa, Artificial Sequence
  Description of Artificial Sequence: Synthetic peptide
  Seed: ATSSSSPLV (MAGA1_HUMAN)
ASSSSSPLY

SEQ ID NO: 49415 - protein, 9 aa, Artificial Sequence
  Description of Artificial Sequence: Synthetic peptide
  Seed: KVADLVGFL (MAGA1_HUMAN)
KSADLVGFM

SEQ ID NO: 49416 - protein, 11 aa, Artificial Sequence
  Description of Artificial Sequence: Synthetic peptide
  Seed: EVYDGREHSAY (MAGA1_HUMAN)
ETYDGREHSAK

SEQ ID NO: 49417 - protein, 9 aa, Artificial Sequence
  Description of Artificial Sequence: Synthetic peptide
  Seed: STSCILESL (MAGA1_HUMAN)
SLSCILEST

SEQ ID NO: 49418 - protein, 9 aa, Artificial Sequence
  Description of Artificial Sequence: Synthetic peptide
  Seed: KASESLQLV (MAGA1_HUMAN)
KTSESLQLK

SEQ ID NO: 49419 - protein, 9 aa, Artificial Sequence
  Description of Artificial Sequence: Synthetic peptide
  Seed: IAMEGGHAP (MAGA1_HUMAN)
IPMEGGHAV

SEQ ID NO: 49420 - protein, 9 aa, Artificial Sequence
  Description of Artificial Sequence: Synthetic peptide
  Seed: ITKKVADLV (MAGA1_HUMAN)
ITKKVADLY

SEQ ID NO: 49421 - protein, 9 aa, Artificial Sequence
  Description of Artificial Sequence: Synthetic peptide
  Seed: AEMLESVIK (MAGA1_HUMAN)
AEMLESVIC

SEQ ID NO: 49422 - protein, 10 aa, Artificial Sequence
  Description of Artificial Sequence: Synthetic peptide
  Seed: FFPSLREAAL (MAGA1_HUMAN)
FAPSLREAAM

SEQ ID NO: 49423 - protein, 9 aa, Artificial Sequence
  Description of Artificial Sequence: Synthetic peptide
  Seed: KVLEYVIKV (MAGA1_HUMAN)
KVLEYVIKY

SEQ ID NO: 49424 - protein, 9 aa, Artificial Sequence
  Description of Artificial Sequence: Synthetic peptide
  Seed: TSYVKVLEY (MAGA1_HUMAN)
TYYVKVLEV

SEQ ID NO: 49425 - protein, 10 aa, Artificial Sequence
  Description of Artificial Sequence: Synthetic peptide
  Seed: ARVRFFFPSL (MAGA1_HUMAN)
ACVRFFFPSV

SEQ ID NO: 49426 - protein, 10 aa, Artificial Sequence
  Description of Artificial Sequence: Synthetic peptide
  Seed: KNYKHCFPEI (MAGA1_HUMAN)
KIYKHCFPEK

SEQ ID NO: 49427 - protein, 9 aa, Artificial Sequence
  Description of Artificial Sequence: Synthetic peptide
  Seed: RAREPVTKA (MAGA1_HUMAN)
RPREPVTKS

SEQ ID NO: 49428 - protein, 9 aa, Artificial Sequence
  Description of Artificial Sequence: Synthetic peptide
  Seed: REPVTKAEM (MAGA1_HUMAN)
REPVTKAEY

SEQ ID NO: 49429 - protein, 9 aa, Artificial Sequence
  Description of Artificial Sequence: Synthetic peptide
  Seed: YVIKVSARV (MAGA1_HUMAN)
YIIKVSARY

SEQ ID NO: 49430 - protein, 10 aa, Artificial Sequence
  Description of Artificial Sequence: Synthetic peptide
  Seed: SCILESLFRA (MAGA1_HUMAN)
SYILESLFRA

SEQ ID NO: 49431 - protein, 10 aa, Artificial Sequence
  Description of Artificial Sequence: Synthetic peptide
  Seed: KVSARVRFFF (MAGA1_HUMAN)
KGSARVRFFF

SEQ ID NO: 49432 - protein, 10 aa, Artificial Sequence
  Description of Artificial Sequence: Synthetic peptide
  Seed: EHSAYGEPRK (MAGA1_HUMAN)
EASAYGEPRR

SEQ ID NO: 49433 - protein, 9 aa, Artificial Sequence
  Description of Artificial Sequence: Synthetic peptide
  Seed: SARVRFFFP (MAGA1_HUMAN)
SVRVRFFFG

SEQ ID NO: 49434 - protein, 9 aa, Artificial Sequence
  Description of Artificial Sequence: Synthetic peptide
  Seed: VQAATSSSS (MAGA1_HUMAN)
VMAATSSSH

SEQ ID NO: 49435 - protein, 8 aa, Artificial Sequence
  Description of Artificial Sequence: Synthetic peptide
  Seed: RVRFFFPS (MAGA1_HUMAN)
RVRFFFPP

SEQ ID NO: 49436 - protein, 9 aa, Artificial Sequence
  Description of Artificial Sequence: Synthetic peptide
  Seed: RQVPDSDPA (MAGA1_HUMAN)
REVPDSDPA

SEQ ID NO: 49437 - protein, 10 aa, Artificial Sequence
  Description of Artificial Sequence: Synthetic peptide
  Seed: LVGFLLLKYR (MAGA1_HUMAN)
LFGFLLLKYR

SEQ ID NO: 49438 - protein, 9 aa, Artificial Sequence
  Description of Artificial Sequence: Synthetic peptide
  Seed: DSDPARYEF (MAGA1_HUMAN)
DADPARYEY

SEQ ID NO: 49439 - protein, 9 aa, Artificial Sequence
  Description of Artificial Sequence: Synthetic peptide
  Seed: MPKTGFLII (MAGA1_HUMAN)
MSKTGFLIF

SEQ ID NO: 49440 - protein, 9 aa, Artificial Sequence
  Description of Artificial Sequence: Synthetic peptide
  Seed: TSYVKVLEY (MAGA1_HUMAN)
TRYVKVLEI

SEQ ID NO: 49441 - protein, 9 aa, Artificial Sequence
  Description of Artificial Sequence: Synthetic peptide
  Seed: TSSSSPLVL (MAGA1_HUMAN)
TRSSSPLVF

SEQ ID NO: 49442 - protein, 10 aa, Artificial Sequence
  Description of Artificial Sequence: Synthetic peptide
  Seed: ESLFRAVITK (MAGA1_HUMAN)
EVLFRAVITR

SEQ ID NO: 49443 - protein, 9 aa, Artificial Sequence
  Description of Artificial Sequence: Synthetic peptide
  Seed: ATSSSSPLV (MAGA1_HUMAN)
AMSSSSPLI

SEQ ID NO: 49444 - protein, 10 aa, Artificial Sequence
  Description of Artificial Sequence: Synthetic peptide
  Seed: YEFLWGPRAL (MAGA1_HUMAN)
YRFLWGPRAL

SEQ ID NO: 49445 - protein, 9 aa, Artificial Sequence
  Description of Artificial Sequence: Synthetic peptide
  Seed: KVLEYVIKV (MAGA1_HUMAN)
KMLEYVIKM

SEQ ID NO: 49446 - protein, 9 aa, Artificial Sequence
  Description of Artificial Sequence: Synthetic peptide
  Seed: EADPTGHSY (MAGA1_HUMAN)
EEDPTGHSY

SEQ ID NO: 49447 - protein, 9 aa, Artificial Sequence
  Description of Artificial Sequence: Synthetic peptide
  Seed: TSSSSPLVL (MAGA1_HUMAN)
TTSSSPLVF

SEQ ID NO: 49448 - protein, 9 aa, Artificial Sequence
  Description of Artificial Sequence: Synthetic peptide
  Seed: QIMPKTGFL (MAGA1_HUMAN)
QPMPKTGFI

SEQ ID NO: 49449 - protein, 9 aa, Artificial Sequence
  Description of Artificial Sequence: Synthetic peptide
  Seed: VQAATSSSS (MAGA1_HUMAN)
VQAATSSSF

SEQ ID NO: 49450 - protein, 10 aa, Artificial Sequence
  Description of Artificial Sequence: Synthetic peptide
  Seed: SSSPLVLGTL (MAGA1_HUMAN)
SASPLVLGTL

SEQ ID NO: 49451 - protein, 10 aa, Artificial Sequence
  Description of Artificial Sequence: Synthetic peptide
  Seed: CILESLFRAV (MAGA1_HUMAN)
CVLESLFRAA

SEQ ID NO: 49452 - protein, 9 aa, Artificial Sequence
  Description of Artificial Sequence: Synthetic peptide
  Seed: RALAETSYV (MAGA1_HUMAN)
RVLAETSYL

SEQ ID NO: 49453 - protein, 9 aa, Artificial Sequence
  Description of Artificial Sequence: Synthetic peptide
  Seed: KVLEYVIKV (MAGA1_HUMAN)
KFLEYVIKV

SEQ ID NO: 49454 - protein, 10 aa, Artificial Sequence
  Description of Artificial Sequence: Synthetic peptide
  Seed: ESLFRAVITK (MAGA1_HUMAN)
ELLFRAVITR

SEQ ID NO: 49455 - protein, 10 aa, Artificial Sequence
  Description of Artificial Sequence: Synthetic peptide
  Seed: TSYVKVLEYV (MAGA1_HUMAN)
TMYVKVLEYA

SEQ ID NO: 49456 - protein, 9 aa, Artificial Sequence
  Description of Artificial Sequence: Synthetic peptide
  Seed: KVADLVGFL (MAGA1_HUMAN)
KMADLVGFL

SEQ ID NO: 49457 - protein, 10 aa, Artificial Sequence
  Description of Artificial Sequence: Synthetic peptide
  Seed: SCILESLFRA (MAGA1_HUMAN)
SWILESLFRL

SEQ ID NO: 49458 - protein, 9 aa, Artificial Sequence
  Description of Artificial Sequence: Synthetic peptide
  Seed: RAREPVTKA (MAGA1_HUMAN)
RFREPVTKK

SEQ ID NO: 49459 - protein, 10 aa, Artificial Sequence
  Description of Artificial Sequence: Synthetic peptide
  Seed: RVRFFFPSLR (MAGA1_HUMAN)
RKRFFFPSLI

SEQ ID NO: 49460 - protein, 9 aa, Artificial Sequence
  Description of Artificial Sequence: Synthetic peptide
  Seed: TSSSSPLVL (MAGA1_HUMAN)
TESSSPLVL

SEQ ID NO: 49461 - protein, 10 aa, Artificial Sequence
  Description of Artificial Sequence: Synthetic peptide
  Seed: RQVPDSDPAR (MAGA1_HUMAN)
RTVPDSDPAR

SEQ ID NO: 49462 - protein, 10 aa, Artificial Sequence
  Description of Artificial Sequence: Synthetic peptide
  Seed: RYEFLWGPRA (MAGA1_HUMAN)
RKEFLWGPRL

SEQ ID NO: 49463 - protein, 10 aa, Artificial Sequence
  Description of Artificial Sequence: Synthetic peptide
  Seed: SARVRFFFPS (MAGA1_HUMAN)
SSRVRFFFPL

SEQ ID NO: 49464 - protein, 11 aa, Artificial Sequence
  Description of Artificial Sequence: Synthetic peptide
  Seed: KVLEYVIKVSA (MAGA1_HUMAN)
KLLEYVIKVSI

SEQ ID NO: 49465 - protein, 9 aa, Artificial Sequence
  Description of Artificial Sequence: Synthetic peptide
  Seed: VRFFFPSLR (MAGA1_HUMAN)
VNFFFPSLR

SEQ ID NO: 49466 - protein, 11 aa, Artificial Sequence
  Description of Artificial Sequence: Synthetic peptide
  Seed: YVKVLEYVIKV (MAGA1_HUMAN)
YQKVLEYVIKL

SEQ ID NO: 49467 - protein, 9 aa, Artificial Sequence
  Description of Artificial Sequence: Synthetic peptide
  Seed: VADLVGFLL (MAGA1_HUMAN)
VADLVGFLY

SEQ ID NO: 49468 - protein, 9 aa, Artificial Sequence
  Description of Artificial Sequence: Synthetic peptide
  Seed: RQRQPSEGS (MAGA1_HUMAN)
RARQPSEGV

SEQ ID NO: 49469 - protein, 9 aa, Artificial Sequence
  Description of Artificial Sequence: Synthetic peptide
  Seed: QEALGLVCV (MAGA1_HUMAN)
QEALGLVCI

SEQ ID NO: 49470 - protein, 10 aa, Artificial Sequence
  Description of Artificial Sequence: Synthetic peptide
  Seed: RVRFFFPSLR (MAGA1_HUMAN)
RVRFFFPSLT

SEQ ID NO: 49471 - protein, 9 aa, Artificial Sequence
  Description of Artificial Sequence: Synthetic peptide
  Seed: FLIIVLVMI (MAGA1_HUMAN)
FTIIVLVML

SEQ ID NO: 49472 - protein, 10 aa, Artificial Sequence
  Description of Artificial Sequence: Synthetic peptide
  Seed: IMPKTGFLII (MAGA1_HUMAN)
IYPKTGFLII

SEQ ID NO: 49473 - protein, 9 aa, Artificial Sequence
  Description of Artificial Sequence: Synthetic peptide
  Seed: LVLGTLEEV (MAGA1_HUMAN)
LLLGTLEEV

SEQ ID NO: 49474 - protein, 9 aa, Artificial Sequence
  Description of Artificial Sequence: Synthetic peptide
  Seed: TSYVKVLEY (MAGA1_HUMAN)
TTYVKVLEF

SEQ ID NO: 49475 - protein, 10 aa, Artificial Sequence
  Description of Artificial Sequence: Synthetic peptide
  Seed: MLESVIKNYK (MAGA1_HUMAN)
MLESVIKNYR

SEQ ID NO: 49476 - protein, 9 aa, Artificial Sequence
  Description of Artificial Sequence: Synthetic peptide
  Seed: ASESLQLVF (MAGA1_HUMAN)
AAESLQLVL

SEQ ID NO: 49477 - protein, 10 aa, Artificial Sequence
  Description of Artificial Sequence: Synthetic peptide
  Seed: SAFPTTINFT (MAGA1_HUMAN)
SLFPTTINFV

SEQ ID NO: 49478 - protein, 9 aa, Artificial Sequence
  Description of Artificial Sequence: Synthetic peptide
  Seed: KVLEYVIKV (MAGA1_HUMAN)
KSLEYVIKW

SEQ ID NO: 49479 - protein, 9 aa, Artificial Sequence
  Description of Artificial Sequence: Synthetic peptide
  Seed: SAFPTTINF (MAGA1_HUMAN)
SQFPTTINF

SEQ ID NO: 49480 - protein, 8 aa, Artificial Sequence
  Description of Artificial Sequence: Synthetic peptide
  Seed: ASAFPTTI (MAGA1_HUMAN)
AQAFPTTI

SEQ ID NO: 49481 - protein, 9 aa, Artificial Sequence
  Description of Artificial Sequence: Synthetic peptide
  Seed: MLESVIKNY (MAGA1_HUMAN)
MSESVIKNY

SEQ ID NO: 49482 - protein, 9 aa, Artificial Sequence
  Description of Artificial Sequence: Synthetic peptide
  Seed: SAFPTTINF (MAGA1_HUMAN)
SRFPTTINI

SEQ ID NO: 49483 - protein, 9 aa, Artificial Sequence
  Description of Artificial Sequence: Synthetic peptide
  Seed: REPVTKAEM (MAGA1_HUMAN)
RAPVTKAEM

SEQ ID NO: 49484 - protein, 10 aa, Artificial Sequence
  Description of Artificial Sequence: Synthetic peptide
  Seed: TSYVKVLEYV (MAGA1_HUMAN)
TYYVKVLEYI

SEQ ID NO: 49485 - protein, 10 aa, Artificial Sequence
  Description of Artificial Sequence: Synthetic peptide
  Seed: ADLVGFLLLK (MAGA1_HUMAN)
ATLVGFLLLK

SEQ ID NO: 49486 - protein, 10 aa, Artificial Sequence
  Description of Artificial Sequence: Synthetic peptide
  Seed: FFPSLREAAL (MAGA1_HUMAN)
FYPSLREAAM

SEQ ID NO: 49487 - protein, 10 aa, Artificial Sequence
  Description of Artificial Sequence: Synthetic peptide
  Seed: YEFLWGPRAL (MAGA1_HUMAN)
YCFLWGPRAY

SEQ ID NO: 49488 - protein, 10 aa, Artificial Sequence
  Description of Artificial Sequence: Synthetic peptide
  Seed: EMLESVIKNY (MAGA1_HUMAN)
EALESVIKNK

SEQ ID NO: 49489 - protein, 9 aa, Artificial Sequence
  Description of Artificial Sequence: Synthetic peptide
  Seed: SYVKVLEYV (MAGA1_HUMAN)
SMVKVLEYM

SEQ ID NO: 49490 - protein, 10 aa, Artificial Sequence
  Description of Artificial Sequence: Synthetic peptide
  Seed: RVRFFFPSLR (MAGA1_HUMAN)
RYRFFFPSLH

SEQ ID NO: 49491 - protein, 9 aa, Artificial Sequence
  Description of Artificial Sequence: Synthetic peptide
  Seed: EADPTGHSY (MAGA1_HUMAN)
EYDPTGHSF

SEQ ID NO: 49492 - protein, 9 aa, Artificial Sequence
  Description of Artificial Sequence: Synthetic peptide
  Seed: TKAEMLESV (MAGA1_HUMAN)
TRAEMLESA

SEQ ID NO: 49493 - protein, 9 aa, Artificial Sequence
  Description of Artificial Sequence: Synthetic peptide
  Seed: STSCILESL (MAGA1_HUMAN)
SVSCILESY

SEQ ID NO: 49494 - protein, 9 aa, Artificial Sequence
  Description of Artificial Sequence: Synthetic peptide
  Seed: AATSSSSPL (MAGA1_HUMAN)
AETSSSSPF

SEQ ID NO: 49495 - protein, 9 aa, Artificial Sequence
  Description of Artificial Sequence: Synthetic peptide
  Seed: GHSYVLVTC (MAGA1_HUMAN)
GHSYVLVTA

SEQ ID NO: 49496 - protein, 9 aa, Artificial Sequence
  Description of Artificial Sequence: Synthetic peptide
  Seed: TSYVKVLEY (MAGA1_HUMAN)
TEYVKVLEF

SEQ ID NO: 49497 - protein, 10 aa, Artificial Sequence
  Description of Artificial Sequence: Synthetic peptide
  Seed: SESLQLVFGI (MAGA1_HUMAN)
STSLQLVFGW

SEQ ID NO: 49498 - protein, 9 aa, Artificial Sequence
  Description of Artificial Sequence: Synthetic peptide
  Seed: STDPPQSPQ (MAGA1_HUMAN)
SLDPPQSPF

SEQ ID NO: 49499 - protein, 9 aa, Artificial Sequence
  Description of Artificial Sequence: Synthetic peptide
  Seed: GPRALAETS (MAGA1_HUMAN)
GPRALAETL

SEQ ID NO: 49500 - protein, 9 aa, Artificial Sequence
  Description of Artificial Sequence: Synthetic peptide
  Seed: VYDGREHSA (MAGA1_HUMAN)
VSDGREHSM

SEQ ID NO: 49501 - protein, 9 aa, Artificial Sequence
  Description of Artificial Sequence: Synthetic peptide
  Seed: LKYRAREPV (MAGA1_HUMAN)
LAYRAREPM

SEQ ID NO: 49502 - protein, 10 aa, Artificial Sequence
  Description of Artificial Sequence: Synthetic peptide
  Seed: FFPSLREAAL (MAGA1_HUMAN)
FEPSLREAAY

SEQ ID NO: 49503 - protein, 11 aa, Artificial Sequence
  Description of Artificial Sequence: Synthetic peptide
  Seed: SARVRFFFPSL (MAGA1_HUMAN)
STRVRFFFPSA

SEQ ID NO: 49504 - protein, 9 aa, Artificial Sequence
  Description of Artificial Sequence: Synthetic peptide
  Seed: STDPPQSPQ (MAGA1_HUMAN)
SCDPPQSPI

SEQ ID NO: 49505 - protein, 9 aa, Artificial Sequence
  Description of Artificial Sequence: Synthetic peptide
  Seed: ALEAQQEAL (MAGA1_HUMAN)
AQEAQQEAW

SEQ ID NO: 49506 - protein, 10 aa, Artificial Sequence
  Description of Artificial Sequence: Synthetic peptide
  Seed: ESLFRAVITK (MAGA1_HUMAN)
EKLFRAVITR

SEQ ID NO: 49507 - protein, 9 aa, Artificial Sequence
  Description of Artificial Sequence: Synthetic peptide
  Seed: FPTTINFTR (MAGA1_HUMAN)
FVTTINFTK

SEQ ID NO: 49508 - protein, 9 aa, Artificial Sequence
  Description of Artificial Sequence: Synthetic peptide
  Seed: TQDLVQEKY (MAGA1_HUMAN)
TCDLVQEKF

SEQ ID NO: 49509 - protein, 9 aa, Artificial Sequence
  Description of Artificial Sequence: Synthetic peptide
  Seed: QIMPKTGFL (MAGA1_HUMAN)
QPMPKTGFL

SEQ ID NO: 49510 - protein, 9 aa, Artificial Sequence
  Description of Artificial Sequence: Synthetic peptide
  Seed: CILESLFRA (MAGA1_HUMAN)
CLLESLFRT

SEQ ID NO: 49511 - protein, 10 aa, Artificial Sequence
  Description of Artificial Sequence: Synthetic peptide
  Seed: EHSAYGEPRK (MAGA1_HUMAN)
ETSAYGEPRK

SEQ ID NO: 49512 - protein, 9 aa, Artificial Sequence
  Description of Artificial Sequence: Synthetic peptide
  Seed: KVLEYVIKV (MAGA1_HUMAN)
KFLEYVIKY

SEQ ID NO: 49513 - protein, 9 aa, Artificial Sequence
  Description of Artificial Sequence: Synthetic peptide
  Seed: TKAEMLESV (MAGA1_HUMAN)
TSAEMLESL

SEQ ID NO: 49514 - protein, 9 aa, Artificial Sequence
  Description of Artificial Sequence: Synthetic peptide
  Seed: SSPLVLGTL (MAGA1_HUMAN)
STPLVLGTW

SEQ ID NO: 49515 - protein, 8 aa, Artificial Sequence
  Description of Artificial Sequence: Synthetic peptide
  Seed: YVKVLEYV (MAGA1_HUMAN)
YMKVLEYV

SEQ ID NO: 49516 - protein, 9 aa, Artificial Sequence
  Description of Artificial Sequence: Synthetic peptide
  Seed: SAFPTTINF (MAGA1_HUMAN)
SIFPTTINF

SEQ ID NO: 49517 - protein, 9 aa, Artificial Sequence
  Description of Artificial Sequence: Synthetic peptide
  Seed: LGDNQIMPK (MAGA1_HUMAN)
LMDNQIMPK

SEQ ID NO: 49518 - protein, 10 aa, Artificial Sequence
  Description of Artificial Sequence: Synthetic peptide
  Seed: TSYVKVLEYV (MAGA1_HUMAN)
TDYVKVLEYF

SEQ ID NO: 49519 - protein, 9 aa, Artificial Sequence
  Description of Artificial Sequence: Synthetic peptide
  Seed: GASAFPTTI (MAGA1_HUMAN)
GVSAFPTTV

SEQ ID NO: 49520 - protein, 9 aa, Artificial Sequence
  Description of Artificial Sequence: Synthetic peptide
  Seed: ILESLFRAV (MAGA1_HUMAN)
IMESLFRAV

SEQ ID NO: 49521 - protein, 9 aa, Artificial Sequence
  Description of Artificial Sequence: Synthetic peptide
  Seed: RQVPDSDPA (MAGA1_HUMAN)
RVVPDSDPV

SEQ ID NO: 49522 - protein, 10 aa, Artificial Sequence
  Description of Artificial Sequence: Synthetic peptide
  Seed: ADLVGFLLLK (MAGA1_HUMAN)
AHLVGFLLLK

SEQ ID NO: 49523 - protein, 10 aa, Artificial Sequence
  Description of Artificial Sequence: Synthetic peptide
  Seed: FFPSLREAAL (MAGA1_HUMAN)
FPPSLREAAL

SEQ ID NO: 49524 - protein, 10 aa, Artificial Sequence
  Description of Artificial Sequence: Synthetic peptide
  Seed: RVRFFFPSLR (MAGA1_HUMAN)
RNRFFFPSLK

SEQ ID NO: 49525 - protein, 10 aa, Artificial Sequence
  Description of Artificial Sequence: Synthetic peptide
  Seed: YEFLWGPRAL (MAGA1_HUMAN)
YNFLWGPRAM

SEQ ID NO: 49526 - protein, 9 aa, Artificial Sequence
  Description of Artificial Sequence: Synthetic peptide
  Seed: IMPKTGFLI (MAGA1_HUMAN)
IWPKTGFLM

SEQ ID NO: 49527 - protein, 10 aa, Artificial Sequence
  Description of Artificial Sequence: Synthetic peptide
  Seed: DLVGFLLLKY (MAGA1_HUMAN)
DTVGFLLLKF

SEQ ID NO: 49528 - protein, 10 aa, Artificial Sequence
  Description of Artificial Sequence: Synthetic peptide
  Seed: FFPSLREAAL (MAGA1_HUMAN)
FFPSLREAAM

SEQ ID NO: 49529 - protein, 10 aa, Artificial Sequence
  Description of Artificial Sequence: Synthetic peptide
  Seed: TSYVKVLEYV (MAGA1_HUMAN)
TEYVKVLEYI

SEQ ID NO: 49530 - protein, 10 aa, Artificial Sequence
  Description of Artificial Sequence: Synthetic peptide
  Seed: RVRFFFPSLR (MAGA1_HUMAN)
RSRFFFPSLV

SEQ ID NO: 49531 - protein, 10 aa, Artificial Sequence
  Description of Artificial Sequence: Synthetic peptide
  Seed: KVLEYVIKVS (MAGA1_HUMAN)
KILEYVIKVI

SEQ ID NO: 49532 - protein, 9 aa, Artificial Sequence
  Description of Artificial Sequence: Synthetic peptide
  Seed: LTQDLVQEK (MAGA1_HUMAN)
LMQDLVQER

SEQ ID NO: 49533 - protein, 9 aa, Artificial Sequence
  Description of Artificial Sequence: Synthetic peptide
  Seed: KVLEYVIKV (MAGA1_HUMAN)
KLLEYVIKC

SEQ ID NO: 49534 - protein, 11 aa, Artificial Sequence
  Description of Artificial Sequence: Synthetic peptide
  Seed: TKKVADLVGFL (MAGA1_HUMAN)
TIKVADLVGFV

SEQ ID NO: 49535 - protein, 10 aa, Artificial Sequence
  Description of Artificial Sequence: Synthetic peptide
  Seed: RAREPVTKAE (MAGA1_HUMAN)
RVREPVTKAA

SEQ ID NO: 49536 - protein, 10 aa, Artificial Sequence
  Description of Artificial Sequence: Synthetic peptide
  Seed: TSYVKVLEYV (MAGA1_HUMAN)
TWYVKVLEYI

SEQ ID NO: 49537 - protein, 9 aa, Artificial Sequence
  Description of Artificial Sequence: Synthetic peptide
  Seed: FLWGPRALA (MAGA1_HUMAN)
FMWGPRALI

SEQ ID NO: 49538 - protein, 9 aa, Artificial Sequence
  Description of Artificial Sequence: Synthetic peptide
  Seed: KVLEYVIKV (MAGA1_HUMAN)
KILEYVIKM

SEQ ID NO: 49539 - protein, 10 aa, Artificial Sequence
  Description of Artificial Sequence: Synthetic peptide
  Seed: MLESVIKNYK (MAGA1_HUMAN)
MAESVIKNYR

SEQ ID NO: 49540 - protein, 10 aa, Artificial Sequence
  Description of Artificial Sequence: Synthetic peptide
  Seed: ALAETSYVKV (MAGA1_HUMAN)
ALAETSYVKM

SEQ ID NO: 49541 - protein, 9 aa, Artificial Sequence
  Description of Artificial Sequence: Synthetic peptide
  Seed: EADPTGHSY (MAGA1_HUMAN)
EIDPTGHSI

SEQ ID NO: 49542 - protein, 9 aa, Artificial Sequence
  Description of Artificial Sequence: Synthetic peptide
  Seed: FPTTINFTR (MAGA1_HUMAN)
FLTTINFTY

SEQ ID NO: 49543 - protein, 10 aa, Artificial Sequence
  Description of Artificial Sequence: Synthetic peptide
  Seed: ARVRFFFPSL (MAGA1_HUMAN)
AFVRFFFPSV

SEQ ID NO: 49544 - protein, 9 aa, Artificial Sequence
  Description of Artificial Sequence: Synthetic peptide
  Seed: RAREPVTKA (MAGA1_HUMAN)
RTREPVTKS

SEQ ID NO: 49545 - protein, 9 aa, Artificial Sequence
  Description of Artificial Sequence: Synthetic peptide
  Seed: KASESLQLV (MAGA1_HUMAN)
KESESLQLF

SEQ ID NO: 49546 - protein, 9 aa, Artificial Sequence
  Description of Artificial Sequence: Synthetic peptide
  Seed: QIMPKTGFL (MAGA1_HUMAN)
QWMPKTGFY

SEQ ID NO: 49547 - protein, 9 aa, Artificial Sequence
  Description of Artificial Sequence: Synthetic peptide
  Seed: SAFPTTINF (MAGA1_HUMAN)
SVFPTTINI

SEQ ID NO: 49548 - protein, 9 aa, Artificial Sequence
  Description of Artificial Sequence: Synthetic peptide
  Seed: KVLEYVIKV (MAGA1_HUMAN)
KLLEYVIKS

SEQ ID NO: 49549 - protein, 9 aa, Artificial Sequence
  Description of Artificial Sequence: Synthetic peptide
  Seed: KVLEYVIKV (MAGA1_HUMAN)
KGLEYVIKY

SEQ ID NO: 49550 - protein, 9 aa, Artificial Sequence
  Description of Artificial Sequence: Synthetic peptide
  Seed: RVRFFFPSL (MAGA1_HUMAN)
RWRFFFPSQ

SEQ ID NO: 49551 - protein, 9 aa, Artificial Sequence
  Description of Artificial Sequence: Synthetic peptide
  Seed: SSPLVLGTL (MAGA1_HUMAN)
SAPLVLGTF

SEQ ID NO: 49552 - protein, 9 aa, Artificial Sequence
  Description of Artificial Sequence: Synthetic peptide
  Seed: SYVKVLEYV (MAGA1_HUMAN)
SLVKVLEYL

SEQ ID NO: 49553 - protein, 9 aa, Artificial Sequence
  Description of Artificial Sequence: Synthetic peptide
  Seed: SAFPTTINF (MAGA1_HUMAN)
SAFPTTINR

SEQ ID NO: 49554 - protein, 9 aa, Artificial Sequence
  Description of Artificial Sequence: Synthetic peptide
  Seed: FFFPSLREA (MAGA1_HUMAN)
FQFPSLREY

SEQ ID NO: 49555 - protein, 10 aa, Artificial Sequence
  Description of Artificial Sequence: Synthetic peptide
  Seed: KASESLQLVF (MAGA1_HUMAN)
KVSESLQLVW

SEQ ID NO: 49556 - protein, 10 aa, Artificial Sequence
  Description of Artificial Sequence: Synthetic peptide
  Seed: RVRFFFPSLR (MAGA1_HUMAN)
RSRFFFPSLR

SEQ ID NO: 49557 - protein, 10 aa, Artificial Sequence
  Description of Artificial Sequence: Synthetic peptide
  Seed: YEFLWGPRAL (MAGA1_HUMAN)
YHFLWGPRAY

SEQ ID NO: 49558 - protein, 10 aa, Artificial Sequence
  Description of Artificial Sequence: Synthetic peptide
  Seed: KNYKHCFPEI (MAGA1_HUMAN)
KAYKHCFPEK

SEQ ID NO: 49559 - protein, 11 aa, Artificial Sequence
  Description of Artificial Sequence: Synthetic peptide
  Seed: SAFPTTINFTR (MAGA1_HUMAN)
SFFPTTINFTR

SEQ ID NO: 49560 - protein, 10 aa, Artificial Sequence
  Description of Artificial Sequence: Synthetic peptide
  Seed: TSYVKVLEYV (MAGA1_HUMAN)
TSYVKVLEYI

SEQ ID NO: 49561 - protein, 9 aa, Artificial Sequence
  Description of Artificial Sequence: Synthetic peptide
  Seed: LFRAVITKK (MAGA1_HUMAN)
LGRAVITKR

SEQ ID NO: 49562 - protein, 9 aa, Artificial Sequence
  Description of Artificial Sequence: Synthetic peptide
  Seed: FFPSLREAA (MAGA1_HUMAN)
FWPSLREAL

SEQ ID NO: 49563 - protein, 10 aa, Artificial Sequence
  Description of Artificial Sequence: Synthetic peptide
  Seed: RFFFPSLREA (MAGA1_HUMAN)
RYFFPSLREK

SEQ ID NO: 49564 - protein, 9 aa, Artificial Sequence
  Description of Artificial Sequence: Synthetic peptide
  Seed: KTGFLIIVL (MAGA1_HUMAN)
KLGFLIIVI

SEQ ID NO: 49565 - protein, 9 aa, Artificial Sequence
  Description of Artificial Sequence: Synthetic peptide
  Seed: HCFPEIFGK (MAGA1_HUMAN)
HYFPEIFGK

SEQ ID NO: 49566 - protein, 9 aa, Artificial Sequence
  Description of Artificial Sequence: Synthetic peptide
  Seed: LVQEKYLEY (MAGA1_HUMAN)
LMQEKYLEW

SEQ ID NO: 49567 - protein, 9 aa, Artificial Sequence
  Description of Artificial Sequence: Synthetic peptide
  Seed: TSSSSPLVL (MAGA1_HUMAN)
TISSSPLVY

SEQ ID NO: 49568 - protein, 9 aa, Artificial Sequence
  Description of Artificial Sequence: Synthetic peptide
  Seed: TSSSSPLVL (MAGA1_HUMAN)
TKSSSPLVF

SEQ ID NO: 49569 - protein, 10 aa, Artificial Sequence
  Description of Artificial Sequence: Synthetic peptide
  Seed: SESLQLVFGI (MAGA1_HUMAN)
SHSLQLVFGW

SEQ ID NO: 49570 - protein, 10 aa, Artificial Sequence
  Description of Artificial Sequence: Synthetic peptide
  Seed: EIFGKASESL (MAGA1_HUMAN)
ETFGKASESW

SEQ ID NO: 49571 - protein, 9 aa, Artificial Sequence
  Description of Artificial Sequence: Synthetic peptide
  Seed: RVRFFFPSL (MAGA1_HUMAN)
RLRFFFPSH

SEQ ID NO: 49572 - protein, 10 aa, Artificial Sequence
  Description of Artificial Sequence: Synthetic peptide
  Seed: YEFLWGPRAL (MAGA1_HUMAN)
YYFLWGPRAL

SEQ ID NO: 49573 - protein, 11 aa, Artificial Sequence
  Description of Artificial Sequence: Synthetic peptide
  Seed: RQVPDSDPARY (MAGA1_HUMAN)
RKVPDSDPARY

SEQ ID NO: 49574 - protein, 9 aa, Artificial Sequence
  Description of Artificial Sequence: Synthetic peptide
  Seed: VYDGREHSA (MAGA1_HUMAN)
VNDGREHSV

SEQ ID NO: 49575 - protein, 9 aa, Artificial Sequence
  Description of Artificial Sequence: Synthetic peptide
  Seed: RVRFFFPSL (MAGA1_HUMAN)
RGRFFFPSL

SEQ ID NO: 49576 - protein, 11 aa, Artificial Sequence
  Description of Artificial Sequence: Synthetic peptide
  Seed: KVADLVGFLLL (MAGA1_HUMAN)
KMADLVGFLLT

SEQ ID NO: 49577 - protein, 8 aa, Artificial Sequence
  Description of Artificial Sequence: Synthetic peptide
  Seed: VSARVRFF (MAGA1_HUMAN)
VTARVRFW

SEQ ID NO: 49578 - protein, 9 aa, Artificial Sequence
  Description of Artificial Sequence: Synthetic peptide
  Seed: KASESLQLV (MAGA1_HUMAN)
KMSESLQLM

SEQ ID NO: 49579 - protein, 9 aa, Artificial Sequence
  Description of Artificial Sequence: Synthetic peptide
  Seed: HCFPEIFGK (MAGA1_HUMAN)
HAFPEIFGI

SEQ ID NO: 49580 - protein, 10 aa, Artificial Sequence
  Description of Artificial Sequence: Synthetic peptide
  Seed: VRFFFPSLRE (MAGA1_HUMAN)
VRFFFPSLRK

SEQ ID NO: 49581 - protein, 9 aa, Artificial Sequence
  Description of Artificial Sequence: Synthetic peptide
  Seed: VQAATSSSS (MAGA1_HUMAN)
VQAATSSSA

SEQ ID NO: 49582 - protein, 10 aa, Artificial Sequence
  Description of Artificial Sequence: Synthetic peptide
  Seed: EIFGKASESL (MAGA1_HUMAN)
ETFGKASESY

SEQ ID NO: 49583 - protein, 8 aa, Artificial Sequence
  Description of Artificial Sequence: Synthetic peptide
  Seed: SARVRFFF (MAGA1_HUMAN)
SIRVRFFL

SEQ ID NO: 49584 - protein, 9 aa, Artificial Sequence
  Description of Artificial Sequence: Synthetic peptide
  Seed: TSYVKVLEY (MAGA1_HUMAN)
TLYVKVLEK

SEQ ID NO: 49585 - protein, 9 aa, Artificial Sequence
  Description of Artificial Sequence: Synthetic peptide
  Seed: TTINFTRQR (MAGA1_HUMAN)
TTINFTRQK

SEQ ID NO: 49586 - protein, 10 aa, Artificial Sequence
  Description of Artificial Sequence: Synthetic peptide
  Seed: IMPKTGFLII (MAGA1_HUMAN)
IMPKTGFLIF

SEQ ID NO: 49587 - protein, 9 aa, Artificial Sequence
  Description of Artificial Sequence: Synthetic peptide
  Seed: RAREPVTKA (MAGA1_HUMAN)
RTREPVTKV

SEQ ID NO: 49588 - protein, 10 aa, Artificial Sequence
  Description of Artificial Sequence: Synthetic peptide
  Seed: DVKEADPTGH (MAGA1_HUMAN)
DTKEADPTGR

SEQ ID NO: 49589 - protein, 9 aa, Artificial Sequence
  Description of Artificial Sequence: Synthetic peptide
  Seed: VADLVGFLL (MAGA1_HUMAN)
VVDLVGFLM

SEQ ID NO: 49590 - protein, 10 aa, Artificial Sequence
  Description of Artificial Sequence: Synthetic peptide
  Seed: KASESLQLVF (MAGA1_HUMAN)
KSSESLQLVM

SEQ ID NO: 49591 - protein, 9 aa, Artificial Sequence
  Description of Artificial Sequence: Synthetic peptide
  Seed: KVLEYVIKV (MAGA1_HUMAN)
KTLEYVIKM

SEQ ID NO: 49592 - protein, 9 aa, Artificial Sequence
  Description of Artificial Sequence: Synthetic peptide
  Seed: SSPLVLGTL (MAGA1_HUMAN)
SLPLVLGTF

SEQ ID NO: 49593 - protein, 10 aa, Artificial Sequence
  Description of Artificial Sequence: Synthetic peptide
  Seed: TSCILESLFR (MAGA1_HUMAN)
TTCILESLFK

SEQ ID NO: 49594 - protein, 9 aa, Artificial Sequence
  Description of Artificial Sequence: Synthetic peptide
  Seed: LGDNQIMPK (MAGA1_HUMAN)
LADNQIMPL

SEQ ID NO: 49595 - protein, 9 aa, Artificial Sequence
  Description of Artificial Sequence: Synthetic peptide
  Seed: ATSSSSPLV (MAGA1_HUMAN)
AVSSSSPLF

SEQ ID NO: 49596 - protein, 10 aa, Artificial Sequence
  Description of Artificial Sequence: Synthetic peptide
  Seed: RAREPVTKAE (MAGA1_HUMAN)
RTREPVTKAL

SEQ ID NO: 49597 - protein, 9 aa, Artificial Sequence
  Description of Artificial Sequence: Synthetic peptide
  Seed: ATSSSSPLV (MAGA1_HUMAN)
AVSSSSPLV

SEQ ID NO: 49598 - protein, 9 aa, Artificial Sequence
  Description of Artificial Sequence: Synthetic peptide
  Seed: RAREPVTKA (MAGA1_HUMAN)
RPREPVTKM

SEQ ID NO: 49599 - protein, 9 aa, Artificial Sequence
  Description of Artificial Sequence: Synthetic peptide
  Seed: SAFPTTINF (MAGA1_HUMAN)
SIFPTTINR

SEQ ID NO: 49600 - protein, 9 aa, Artificial Sequence
  Description of Artificial Sequence: Synthetic peptide
  Seed: YKHCFPEIF (MAGA1_HUMAN)
YMHCFPEIF

SEQ ID NO: 49601 - protein, 10 aa, Artificial Sequence
  Description of Artificial Sequence: Synthetic peptide
  Seed: KEADPTGHSY (MAGA1_HUMAN)
KMADPTGHSY

SEQ ID NO: 49602 - protein, 9 aa, Artificial Sequence
  Description of Artificial Sequence: Synthetic peptide
  Seed: SAFPTTINF (MAGA1_HUMAN)
SPFPTTINF

SEQ ID NO: 49603 - protein, 10 aa, Artificial Sequence
  Description of Artificial Sequence: Synthetic peptide
  Seed: EYVIKVSARV (MAGA1_HUMAN)
EQVIKVSARV

SEQ ID NO: 49604 - protein, 10 aa, Artificial Sequence
  Description of Artificial Sequence: Synthetic peptide
  Seed: SLFRAVITKK (MAGA1_HUMAN)
SMFRAVITKR

SEQ ID NO: 49605 - protein, 10 aa, Artificial Sequence
  Description of Artificial Sequence: Synthetic peptide
  Seed: FFFPSLREAA (MAGA1_HUMAN)
FFFPSLREAF

SEQ ID NO: 49606 - protein, 9 aa, Artificial Sequence
  Description of Artificial Sequence: Synthetic peptide
  Seed: LGDNQIMPK (MAGA1_HUMAN)
LSDNQIMPK

SEQ ID NO: 49607 - protein, 9 aa, Artificial Sequence
  Description of Artificial Sequence: Synthetic peptide
  Seed: DSDPARYEF (MAGA1_HUMAN)
DFDPARYEF

SEQ ID NO: 49608 - protein, 9 aa, Artificial Sequence
  Description of Artificial Sequence: Synthetic peptide
  Seed: SARVRFFFP (MAGA1_HUMAN)
SYRVRFFFI

SEQ ID NO: 49609 - protein, 10 aa, Artificial Sequence
  Description of Artificial Sequence: Synthetic peptide
  Seed: RVRFFFPSLR (MAGA1_HUMAN)
RIRFFFPSLS

SEQ ID NO: 49610 - protein, 9 aa, Artificial Sequence
  Description of Artificial Sequence: Synthetic peptide
  Seed: SAYGEPRKL (MAGA1_HUMAN)
SYYGEPRKL

SEQ ID NO: 49611 - protein, 10 aa, Artificial Sequence
  Description of Artificial Sequence: Synthetic peptide
  Seed: KVADLVGFLL (MAGA1_HUMAN)
KKADLVGFLW

SEQ ID NO: 49612 - protein, 9 aa, Artificial Sequence
  Description of Artificial Sequence: Synthetic peptide
  Seed: ITKKVADLV (MAGA1_HUMAN)
IAKKVADLW

SEQ ID NO: 49613 - protein, 9 aa, Artificial Sequence
  Description of Artificial Sequence: Synthetic peptide
  Seed: SLFRAVITK (MAGA1_HUMAN)
SFFRAVITR

SEQ ID NO: 49614 - protein, 10 aa, Artificial Sequence
  Description of Artificial Sequence: Synthetic peptide
  Seed: KEADPTGHSY (MAGA1_HUMAN)
KEADPTGHSV

SEQ ID NO: 49615 - protein, 9 aa, Artificial Sequence
  Description of Artificial Sequence: Synthetic peptide
  Seed: TKAEMLESV (MAGA1_HUMAN)
THAEMLESM

SEQ ID NO: 49616 - protein, 10 aa, Artificial Sequence
  Description of Artificial Sequence: Synthetic peptide
  Seed: FPSLREAALR (MAGA1_HUMAN)
FVSLREAALR

SEQ ID NO: 49617 - protein, 9 aa, Artificial Sequence
  Description of Artificial Sequence: Synthetic peptide
  Seed: KYRAREPVT (MAGA1_HUMAN)
KFRAREPVK

SEQ ID NO: 49618 - protein, 9 aa, Artificial Sequence
  Description of Artificial Sequence: Synthetic peptide
  Seed: SARVRFFFP (MAGA1_HUMAN)
SHRVRFFFK

SEQ ID NO: 49619 - protein, 9 aa, Artificial Sequence
  Description of Artificial Sequence: Synthetic peptide
  Seed: GTLEEVPTA (MAGA1_HUMAN)
GALEEVPTV

SEQ ID NO: 49620 - protein, 8 aa, Artificial Sequence
  Description of Artificial Sequence: Synthetic peptide
  Seed: AYGEPRKL (MAGA1_HUMAN)
AAGEPRKF

SEQ ID NO: 49621 - protein, 8 aa, Artificial Sequence
  Description of Artificial Sequence: Synthetic peptide
  Seed: RVRFFFPS (MAGA1_HUMAN)
RTRFFFPK

SEQ ID NO: 49622 - protein, 9 aa, Artificial Sequence
  Description of Artificial Sequence: Synthetic peptide
  Seed: VQAATSSSS (MAGA1_HUMAN)
VHAATSSSM

SEQ ID NO: 49623 - protein, 9 aa, Artificial Sequence
  Description of Artificial Sequence: Synthetic peptide
  Seed: TQDLVQEKY (MAGA1_HUMAN)
TSDLVQEKM

SEQ ID NO: 49624 - protein, 9 aa, Artificial Sequence
  Description of Artificial Sequence: Synthetic peptide
  Seed: SARVRFFFP (MAGA1_HUMAN)
SVRVRFFFP

SEQ ID NO: 49625 - protein, 10 aa, Artificial Sequence
  Description of Artificial Sequence: Synthetic peptide
  Seed: QIMPKTGFLI (MAGA1_HUMAN)
QQMPKTGFLI

SEQ ID NO: 49626 - protein, 10 aa, Artificial Sequence
  Description of Artificial Sequence: Synthetic peptide
  Seed: FLWGPRALAE (MAGA1_HUMAN)
FQWGPRALAL

SEQ ID NO: 49627 - protein, 10 aa, Artificial Sequence
  Description of Artificial Sequence: Synthetic peptide
  Seed: EMLESVIKNY (MAGA1_HUMAN)
EALESVIKNW

SEQ ID NO: 49628 - protein, 9 aa, Artificial Sequence
  Description of Artificial Sequence: Synthetic peptide
  Seed: RVRFFFPSL (MAGA1_HUMAN)
RTRFFFPSR

SEQ ID NO: 49629 - protein, 9 aa, Artificial Sequence
  Description of Artificial Sequence: Synthetic peptide
  Seed: VGFLLLKYR (MAGA1_HUMAN)
VSFLLLKYR

SEQ ID NO: 49630 - protein, 9 aa, Artificial Sequence
  Description of Artificial Sequence: Synthetic peptide
  Seed: RALAETSYV (MAGA1_HUMAN)
RVLAETSYI

SEQ ID NO: 49631 - protein, 9 aa, Artificial Sequence
  Description of Artificial Sequence: Synthetic peptide
  Seed: SVMEVYDGR (MAGA1_HUMAN)
SGMEVYDGR

SEQ ID NO: 49632 - protein, 9 aa, Artificial Sequence
  Description of Artificial Sequence: Synthetic peptide
  Seed: NYKHCFPEI (MAGA1_HUMAN)
NFKHCFPEM

SEQ ID NO: 49633 - protein, 9 aa, Artificial Sequence
  Description of Artificial Sequence: Synthetic peptide
  Seed: IMPKTGFLI (MAGA1_HUMAN)
IIPKTGFLL

SEQ ID NO: 49634 - protein, 10 aa, Artificial Sequence
  Description of Artificial Sequence: Synthetic peptide
  Seed: VYDGREHSAY (MAGA1_HUMAN)
VYDGREHSAF

SEQ ID NO: 49635 - protein, 9 aa, Artificial Sequence
  Description of Artificial Sequence: Synthetic peptide
  Seed: GTLEEVPTA (MAGA1_HUMAN)
GLLEEVPTC

SEQ ID NO: 49636 - protein, 11 aa, Artificial Sequence
  Description of Artificial Sequence: Synthetic peptide
  Seed: ARVRFFFPSLR (MAGA1_HUMAN)
ARVRFFFPSLI

SEQ ID NO: 49637 - protein, 10 aa, Artificial Sequence
  Description of Artificial Sequence: Synthetic peptide
  Seed: CILESLFRAV (MAGA1_HUMAN)
CQLESLFRAV

SEQ ID NO: 49638 - protein, 9 aa, Artificial Sequence
  Description of Artificial Sequence: Synthetic peptide
  Seed: ESLQLVFGI (MAGA1_HUMAN)
EALQLVFGV

SEQ ID NO: 49639 - protein, 10 aa, Artificial Sequence
  Description of Artificial Sequence: Synthetic peptide
  Seed: SCILESLFRA (MAGA1_HUMAN)
SEILESLFRL

SEQ ID NO: 49640 - protein, 9 aa, Artificial Sequence
  Description of Artificial Sequence: Synthetic peptide
  Seed: KASESLQLV (MAGA1_HUMAN)
KMSESLQLA

SEQ ID NO: 49641 - protein, 10 aa, Artificial Sequence
  Description of Artificial Sequence: Synthetic peptide
  Seed: RVRFFFPSLR (MAGA1_HUMAN)
RMRFFFPSLM

SEQ ID NO: 49642 - protein, 8 aa, Artificial Sequence
  Description of Artificial Sequence: Synthetic peptide
  Seed: RVRFFFPS (MAGA1_HUMAN)
RTRFFFPL

SEQ ID NO: 49643 - protein, 10 aa, Artificial Sequence
  Description of Artificial Sequence: Synthetic peptide
  Seed: KASESLQLVF (MAGA1_HUMAN)
KSSESLQLVF

SEQ ID NO: 49644 - protein, 9 aa, Artificial Sequence
  Description of Artificial Sequence: Synthetic peptide
  Seed: KASESLQLV (MAGA1_HUMAN)
KISESLQLK

SEQ ID NO: 49645 - protein, 10 aa, Artificial Sequence
  Description of Artificial Sequence: Synthetic peptide
  Seed: KKVADLVGFL (MAGA1_HUMAN)
KMVADLVGFM

SEQ ID NO: 49646 - protein, 10 aa, Artificial Sequence
  Description of Artificial Sequence: Synthetic peptide
  Seed: ARYEFLWGPR (MAGA1_HUMAN)
AYYEFLWGPR

SEQ ID NO: 49647 - protein, 10 aa, Artificial Sequence
  Description of Artificial Sequence: Synthetic peptide
  Seed: ARVRFFFPSL (MAGA1_HUMAN)
ADVRFFFPSI

SEQ ID NO: 49648 - protein, 9 aa, Artificial Sequence
  Description of Artificial Sequence: Synthetic peptide
  Seed: RVRFFFPSL (MAGA1_HUMAN)
RTRFFFPSW

SEQ ID NO: 49649 - protein, 9 aa, Artificial Sequence
  Description of Artificial Sequence: Synthetic peptide
  Seed: VPDSDPARY (MAGA1_HUMAN)
VLDSDPARY

SEQ ID NO: 49650 - protein, 11 aa, Artificial Sequence
  Description of Artificial Sequence: Synthetic peptide
  Seed: SCILESLFRAV (MAGA1_HUMAN)
SYILESLFRAV

SEQ ID NO: 49651 - protein, 10 aa, Artificial Sequence
  Description of Artificial Sequence: Synthetic peptide
  Seed: ARVRFFFPSL (MAGA1_HUMAN)
AWVRFFFPSK

SEQ ID NO: 49652 - protein, 10 aa, Artificial Sequence
  Description of Artificial Sequence: Synthetic peptide
  Seed: FFPSLREAAL (MAGA1_HUMAN)
FNPSLREAAY

SEQ ID NO: 49653 - protein, 9 aa, Artificial Sequence
  Description of Artificial Sequence: Synthetic peptide
  Seed: IAMEGGHAP (MAGA1_HUMAN)
ISMEGGHAM

SEQ ID NO: 49654 - protein, 9 aa, Artificial Sequence
  Description of Artificial Sequence: Synthetic peptide
  Seed: SAFPTTINF (MAGA1_HUMAN)
SRFPTTINV

SEQ ID NO: 49655 - protein, 9 aa, Artificial Sequence
  Description of Artificial Sequence: Synthetic peptide
  Seed: SLFRAVITK (MAGA1_HUMAN)
SAFRAVITK

SEQ ID NO: 49656 - protein, 9 aa, Artificial Sequence
  Description of Artificial Sequence: Synthetic peptide
  Seed: GTLEEVPTA (MAGA1_HUMAN)
GLLEEVPTI

SEQ ID NO: 49657 - protein, 9 aa, Artificial Sequence
  Description of Artificial Sequence: Synthetic peptide
  Seed: EELSVMEVY (MAGA1_HUMAN)
EELSVMEVM

SEQ ID NO: 49658 - protein, 8 aa, Artificial Sequence
  Description of Artificial Sequence: Synthetic peptide
  Seed: FLWGPRAL (MAGA1_HUMAN)
FAWGPRAV

SEQ ID NO: 49659 - protein, 10 aa, Artificial Sequence
  Description of Artificial Sequence: Synthetic peptide
  Seed: RVRFFFPSLR (MAGA1_HUMAN)
RMRFFFPSLG

SEQ ID NO: 49660 - protein, 10 aa, Artificial Sequence
  Description of Artificial Sequence: Synthetic peptide
  Seed: KNYKHCFPEI (MAGA1_HUMAN)
KVYKHCFPEA

SEQ ID NO: 49661 - protein, 10 aa, Artificial Sequence
  Description of Artificial Sequence: Synthetic peptide
  Seed: ADPTGHSYVL (MAGA1_HUMAN)
ACPTGHSYVL

SEQ ID NO: 49662 - protein, 9 aa, Artificial Sequence
  Description of Artificial Sequence: Synthetic peptide
  Seed: SARVRFFFP (MAGA1_HUMAN)
SMRVRFFFM

SEQ ID NO: 49663 - protein, 9 aa, Artificial Sequence
  Description of Artificial Sequence: Synthetic peptide
  Seed: FFFPSLREA (MAGA1_HUMAN)
FAFPSLREA

SEQ ID NO: 49664 - protein, 9 aa, Artificial Sequence
  Description of Artificial Sequence: Synthetic peptide
  Seed: IMPKTGFLI (MAGA1_HUMAN)
ISPKTGFLF

SEQ ID NO: 49665 - protein, 10 aa, Artificial Sequence
  Description of Artificial Sequence: Synthetic peptide
  Seed: ARVRFFFPSL (MAGA1_HUMAN)
AEVRFFFPSK

SEQ ID NO: 49666 - protein, 9 aa, Artificial Sequence
  Description of Artificial Sequence: Synthetic peptide
  Seed: TSSSSPLVL (MAGA1_HUMAN)
TRSSSPLVL

SEQ ID NO: 49667 - protein, 10 aa, Artificial Sequence
  Description of Artificial Sequence: Synthetic peptide
  Seed: SLFRAVITKK (MAGA1_HUMAN)
SLFRAVITKR

SEQ ID NO: 49668 - protein, 9 aa, Artificial Sequence
  Description of Artificial Sequence: Synthetic peptide
  Seed: QPSEGSSSR (MAGA1_HUMAN)
QSSEGSSSK

SEQ ID NO: 49669 - protein, 9 aa, Artificial Sequence
  Description of Artificial Sequence: Synthetic peptide
  Seed: STDPPQSPQ (MAGA1_HUMAN)
STDPPQSPY

SEQ ID NO: 49670 - protein, 9 aa, Artificial Sequence
  Description of Artificial Sequence: Synthetic peptide
  Seed: MPKTGFLII (MAGA1_HUMAN)
MPKTGFLIP

SEQ ID NO: 49671 - protein, 10 aa, Artificial Sequence
  Description of Artificial Sequence: Synthetic peptide
  Seed: FLWGPRALAE (MAGA1_HUMAN)
FMWGPRALAV

SEQ ID NO: 49672 - protein, 11 aa, Artificial Sequence
  Description of Artificial Sequence: Synthetic peptide
  Seed: VPDSDPARYEF (MAGA1_HUMAN)
VADSDPARYEM

SEQ ID NO: 49673 - protein, 9 aa, Artificial Sequence
  Description of Artificial Sequence: Synthetic peptide
  Seed: STSCILESL (MAGA1_HUMAN)
SVSCILESV

SEQ ID NO: 49674 - protein, 10 aa, Artificial Sequence
  Description of Artificial Sequence: Synthetic peptide
  Seed: KNYKHCFPEI (MAGA1_HUMAN)
KSYKHCFPEI

SEQ ID NO: 49675 - protein, 9 aa, Artificial Sequence
  Description of Artificial Sequence: Synthetic peptide
  Seed: EADPTGHSY (MAGA1_HUMAN)
EGDPTGHSV

SEQ ID NO: 49676 - protein, 10 aa, Artificial Sequence
  Description of Artificial Sequence: Synthetic peptide
  Seed: ADLVGFLLLK (MAGA1_HUMAN)
AKLVGFLLLR

SEQ ID NO: 49677 - protein, 10 aa, Artificial Sequence
  Description of Artificial Sequence: Synthetic peptide
  Seed: FPSLREAALR (MAGA1_HUMAN)
FVSLREAALK

SEQ ID NO: 49678 - protein, 11 aa, Artificial Sequence
  Description of Artificial Sequence: Synthetic peptide
  Seed: YVKVLEYVIKV (MAGA1_HUMAN)
YMKVLEYVIKI

SEQ ID NO: 49679 - protein, 9 aa, Artificial Sequence
  Description of Artificial Sequence: Synthetic peptide
  Seed: LVQEKYLEY (MAGA1_HUMAN)
LAQEKYLEM

SEQ ID NO: 49680 - protein, 10 aa, Artificial Sequence
  Description of Artificial Sequence: Synthetic peptide
  Seed: EYVIKVSARV (MAGA1_HUMAN)
EEVIKVSARV

SEQ ID NO: 49681 - protein, 9 aa, Artificial Sequence
  Description of Artificial Sequence: Synthetic peptide
  Seed: QSPQGASAF (MAGA1_HUMAN)
QVPQGASAF

SEQ ID NO: 49682 - protein, 9 aa, Artificial Sequence
  Description of Artificial Sequence: Synthetic peptide
  Seed: EEVPTAGST (MAGA1_HUMAN)
EEVPTAGSL

SEQ ID NO: 49683 - protein, 10 aa, Artificial Sequence
  Description of Artificial Sequence: Synthetic peptide
  Seed: SARVRFFFPS (MAGA1_HUMAN)
SDRVRFFFPI

SEQ ID NO: 49684 - protein, 9 aa, Artificial Sequence
  Description of Artificial Sequence: Synthetic peptide
  Seed: KVADLVGFL (MAGA1_HUMAN)
KMADLVGFA

SEQ ID NO: 49685 - protein, 10 aa, Artificial Sequence
  Description of Artificial Sequence: Synthetic peptide
  Seed: RVRFFFPSLR (MAGA1_HUMAN)
RYRFFFPSLT

SEQ ID NO: 49686 - protein, 10 aa, Artificial Sequence
  Description of Artificial Sequence: Synthetic peptide
  Seed: KEADPTGHSY (MAGA1_HUMAN)
KLADPTGHSV

SEQ ID NO: 49687 - protein, 10 aa, Artificial Sequence
  Description of Artificial Sequence: Synthetic peptide
  Seed: KVLEYVIKVS (MAGA1_HUMAN)
KLLEYVIKVQ

SEQ ID NO: 49688 - protein, 10 aa, Artificial Sequence
  Description of Artificial Sequence: Synthetic peptide
  Seed: ETSYVKVLEY (MAGA1_HUMAN)
EMSYVKVLEW

SEQ ID NO: 49689 - protein, 9 aa, Artificial Sequence
  Description of Artificial Sequence: Synthetic peptide
  Seed: HSYVLVTCL (MAGA1_HUMAN)
HAYVLVTCM

SEQ ID NO: 49690 - protein, 9 aa, Artificial Sequence
  Description of Artificial Sequence: Synthetic peptide
  Seed: TGFLIIVLV (MAGA1_HUMAN)
TVFLIIVLV

SEQ ID NO: 49691 - protein, 9 aa, Artificial Sequence
  Description of Artificial Sequence: Synthetic peptide
  Seed: LVLGTLEEV (MAGA1_HUMAN)
LQLGTLEEF

SEQ ID NO: 49692 - protein, 9 aa, Artificial Sequence
  Description of Artificial Sequence: Synthetic peptide
  Seed: HCFPEIFGK (MAGA1_HUMAN)
HVFPEIFGY

SEQ ID NO: 49693 - protein, 10 aa, Artificial Sequence
  Description of Artificial Sequence: Synthetic peptide
  Seed: SESLQLVFGI (MAGA1_HUMAN)
SESLQLVFGW

SEQ ID NO: 49694 - protein, 9 aa, Artificial Sequence
  Description of Artificial Sequence: Synthetic peptide
  Seed: YDGREHSAY (MAGA1_HUMAN)
YSGREHSAY

SEQ ID NO: 49695 - protein, 9 aa, Artificial Sequence
  Description of Artificial Sequence: Synthetic peptide
  Seed: IAMEGGHAP (MAGA1_HUMAN)
IVMEGGHAI

SEQ ID NO: 49696 - protein, 10 aa, Artificial Sequence
  Description of Artificial Sequence: Synthetic peptide
  Seed: KVLEYVIKVS (MAGA1_HUMAN)
KMLEYVIKVP

SEQ ID NO: 49697 - protein, 9 aa, Artificial Sequence
  Description of Artificial Sequence: Synthetic peptide
  Seed: IMPKTGFLI (MAGA1_HUMAN)
IYPKTGFLV

SEQ ID NO: 49698 - protein, 9 aa, Artificial Sequence
  Description of Artificial Sequence: Synthetic peptide
  Seed: AATSSSSPL (MAGA1_HUMAN)
AFTSSSSPL

SEQ ID NO: 49699 - protein, 9 aa, Artificial Sequence
  Description of Artificial Sequence: Synthetic peptide
  Seed: GKASESLQL (MAGA1_HUMAN)
GRASESLQL

SEQ ID NO: 49700 - protein, 9 aa, Artificial Sequence
  Description of Artificial Sequence: Synthetic peptide
  Seed: LTQDLVQEK (MAGA1_HUMAN)
LVQDLVQEM

SEQ ID NO: 49701 - protein, 10 aa, Artificial Sequence
  Description of Artificial Sequence: Synthetic peptide
  Seed: RVRFFFPSLR (MAGA1_HUMAN)
RARFFFPSLR

SEQ ID NO: 49702 - protein, 9 aa, Artificial Sequence
  Description of Artificial Sequence: Synthetic peptide
  Seed: KYRAREPVT (MAGA1_HUMAN)
KIRAREPVV

SEQ ID NO: 49703 - protein, 8 aa, Artificial Sequence
  Description of Artificial Sequence: Synthetic peptide
  Seed: FLWGPRAL (MAGA1_HUMAN)
FAWGPRAL

SEQ ID NO: 49704 - protein, 10 aa, Artificial Sequence
  Description of Artificial Sequence: Synthetic peptide
  Seed: RVRFFFPSLR (MAGA1_HUMAN)
RPRFFFPSLY

SEQ ID NO: 49705 - protein, 9 aa, Artificial Sequence
  Description of Artificial Sequence: Synthetic peptide
  Seed: CILESLFRA (MAGA1_HUMAN)
CSLESLFRV

SEQ ID NO: 49706 - protein, 9 aa, Artificial Sequence
  Description of Artificial Sequence: Synthetic peptide
  Seed: LVLGTLEEV (MAGA1_HUMAN)
LILGTLEEV

SEQ ID NO: 49707 - protein, 9 aa, Artificial Sequence
  Description of Artificial Sequence: Synthetic peptide
  Seed: RVRFFFPSL (MAGA1_HUMAN)
RSRFFFPSH

SEQ ID NO: 49708 - protein, 9 aa, Artificial Sequence
  Description of Artificial Sequence: Synthetic peptide
  Seed: SARVRFFFP (MAGA1_HUMAN)
SIRVRFFFT

SEQ ID NO: 49709 - protein, 9 aa, Artificial Sequence
  Description of Artificial Sequence: Synthetic peptide
  Seed: LTQDLVQEK (MAGA1_HUMAN)
LGQDLVQEL

SEQ ID NO: 49710 - protein, 9 aa, Artificial Sequence
  Description of Artificial Sequence: Synthetic peptide
  Seed: RAREPVTKA (MAGA1_HUMAN)
RSREPVTKY

SEQ ID NO: 49711 - protein, 10 aa, Artificial Sequence
  Description of Artificial Sequence: Synthetic peptide
  Seed: KHCFPEIFGK (MAGA1_HUMAN)
KYCFPEIFGR

SEQ ID NO: 49712 - protein, 9 aa, Artificial Sequence
  Description of Artificial Sequence: Synthetic peptide
  Seed: RAREPVTKA (MAGA1_HUMAN)
RHREPVTKL

SEQ ID NO: 49713 - protein, 10 aa, Artificial Sequence
  Description of Artificial Sequence: Synthetic peptide
  Seed: ARVRFFFPSL (MAGA1_HUMAN)
AGVRFFFPSI

SEQ ID NO: 49714 - protein, 10 aa, Artificial Sequence
  Description of Artificial Sequence: Synthetic peptide
  Seed: KVLEYVIKVS (MAGA1_HUMAN)
KLLEYVIKVA

SEQ ID NO: 49715 - protein, 10 aa, Artificial Sequence
  Description of Artificial Sequence: Synthetic peptide
  Seed: ARVRFFFPSL (MAGA1_HUMAN)
AQVRFFFPSV

SEQ ID NO: 49716 - protein, 11 aa, Artificial Sequence
  Description of Artificial Sequence: Synthetic peptide
  Seed: REEEGPSTSCI (MAGA1_HUMAN)
REEEGPSTSCL

SEQ ID NO: 49717 - protein, 9 aa, Artificial Sequence
  Description of Artificial Sequence: Synthetic peptide
  Seed: TTINFTRQR (MAGA1_HUMAN)
TYINFTRQR

SEQ ID NO: 49718 - protein, 9 aa, Artificial Sequence
  Description of Artificial Sequence: Synthetic peptide
  Seed: RVRFFFPSL (MAGA1_HUMAN)
RNRFFFPSL

SEQ ID NO: 49719 - protein, 10 aa, Artificial Sequence
  Description of Artificial Sequence: Synthetic peptide
  Seed: RAREPVTKAE (MAGA1_HUMAN)
RTREPVTKAV

SEQ ID NO: 49720 - protein, 9 aa, Artificial Sequence
  Description of Artificial Sequence: Synthetic peptide
  Seed: DPTGHSYVL (MAGA1_HUMAN)
DRTGHSYVL

SEQ ID NO: 49721 - protein, 9 aa, Artificial Sequence
  Description of Artificial Sequence: Synthetic peptide
  Seed: LTQDLVQEK (MAGA1_HUMAN)
LFQDLVQEF

SEQ ID NO: 49722 - protein, 9 aa, Artificial Sequence
  Description of Artificial Sequence: Synthetic peptide
  Seed: VQAATSSSS (MAGA1_HUMAN)
VRAATSSSF

SEQ ID NO: 49723 - protein, 11 aa, Artificial Sequence
  Description of Artificial Sequence: Synthetic peptide
  Seed: TKKVADLVGFL (MAGA1_HUMAN)
TRKVADLVGFV

SEQ ID NO: 49724 - protein, 9 aa, Artificial Sequence
  Description of Artificial Sequence: Synthetic peptide
  Seed: FPTTINFTR (MAGA1_HUMAN)
FATTINFTL

SEQ ID NO: 49725 - protein, 9 aa, Artificial Sequence
  Description of Artificial Sequence: Synthetic peptide
  Seed: KASESLQLV (MAGA1_HUMAN)
KVSESLQLL

SEQ ID NO: 49726 - protein, 9 aa, Artificial Sequence
  Description of Artificial Sequence: Synthetic peptide
  Seed: GASAFPTTI (MAGA1_HUMAN)
GRSAFPTTL

SEQ ID NO: 49727 - protein, 9 aa, Artificial Sequence
  Description of Artificial Sequence: Synthetic peptide
  Seed: LKYRAREPV (MAGA1_HUMAN)
LLYRAREPM

SEQ ID NO: 49728 - protein, 9 aa, Artificial Sequence
  Description of Artificial Sequence: Synthetic peptide
  Seed: ATSSSSPLV (MAGA1_HUMAN)
AQSSSSPLI

SEQ ID NO: 49729 - protein, 9 aa, Artificial Sequence
  Description of Artificial Sequence: Synthetic peptide
  Seed: GLVCVQAAT (MAGA1_HUMAN)
GTVCVQAAV

SEQ ID NO: 49730 - protein, 10 aa, Artificial Sequence
  Description of Artificial Sequence: Synthetic peptide
  Seed: ALAETSYVKV (MAGA1_HUMAN)
ATAETSYVKR

SEQ ID NO: 49731 - protein, 9 aa, Artificial Sequence
  Description of Artificial Sequence: Synthetic peptide
  Seed: FPTTINFTR (MAGA1_HUMAN)
FPTTINFTA

SEQ ID NO: 49732 - protein, 9 aa, Artificial Sequence
  Description of Artificial Sequence: Synthetic peptide
  Seed: TKAEMLESV (MAGA1_HUMAN)
TQAEMLESI

SEQ ID NO: 49733 - protein, 9 aa, Artificial Sequence
  Description of Artificial Sequence: Synthetic peptide
  Seed: TQDLVQEKY (MAGA1_HUMAN)
TIDLVQEKV

SEQ ID NO: 49734 - protein, 11 aa, Artificial Sequence
  Description of Artificial Sequence: Synthetic peptide
  Seed: VQAATSSSSPL (MAGA1_HUMAN)
VKAATSSSSPF

SEQ ID NO: 49735 - protein, 9 aa, Artificial Sequence
  Description of Artificial Sequence: Synthetic peptide
  Seed: KASESLQLV (MAGA1_HUMAN)
KQSESLQLM

SEQ ID NO: 49736 - protein, 9 aa, Artificial Sequence
  Description of Artificial Sequence: Synthetic peptide
  Seed: FFFPSLREA (MAGA1_HUMAN)
FTFPSLREH

SEQ ID NO: 49737 - protein, 10 aa, Artificial Sequence
  Description of Artificial Sequence: Synthetic peptide
  Seed: YEFLWGPRAL (MAGA1_HUMAN)
YPFLWGPRAY

SEQ ID NO: 49738 - protein, 9 aa, Artificial Sequence
  Description of Artificial Sequence: Synthetic peptide
  Seed: SYVKVLEYV (MAGA1_HUMAN)
SAVKVLEYL

SEQ ID NO: 49739 - protein, 11 aa, Artificial Sequence
  Description of Artificial Sequence: Synthetic peptide
  Seed: KVADLVGFLLL (MAGA1_HUMAN)
KQADLVGFLLV

SEQ ID NO: 49740 - protein, 10 aa, Artificial Sequence
  Description of Artificial Sequence: Synthetic peptide
  Seed: RAREPVTKAE (MAGA1_HUMAN)
RTREPVTKAI

SEQ ID NO: 49741 - protein, 11 aa, Artificial Sequence
  Description of Artificial Sequence: Synthetic peptide
  Seed: RVRFFFPSLRE (MAGA1_HUMAN)
RRRFFFPSLRR

SEQ ID NO: 49742 - protein, 10 aa, Artificial Sequence
  Description of Artificial Sequence: Synthetic peptide
  Seed: ALAETSYVKV (MAGA1_HUMAN)
AMAETSYVKR

SEQ ID NO: 49743 - protein, 9 aa, Artificial Sequence
  Description of Artificial Sequence: Synthetic peptide
  Seed: FLWGPRALA (MAGA1_HUMAN)
FMWGPRALS

SEQ ID NO: 49744 - protein, 11 aa, Artificial Sequence
  Description of Artificial Sequence: Synthetic peptide
  Seed: EMLESVIKNYK (MAGA1_HUMAN)
ETLESVIKNYR

SEQ ID NO: 49745 - protein, 9 aa, Artificial Sequence
  Description of Artificial Sequence: Synthetic peptide
  Seed: VSARVRFFF (MAGA1_HUMAN)
VFARVRFFW

SEQ ID NO: 49746 - protein, 9 aa, Artificial Sequence
  Description of Artificial Sequence: Synthetic peptide
  Seed: SARVRFFFP (MAGA1_HUMAN)
SSRVRFFFT

SEQ ID NO: 49747 - protein, 9 aa, Artificial Sequence
  Description of Artificial Sequence: Synthetic peptide
  Seed: SAFPTTINF (MAGA1_HUMAN)
STFPTTINY

SEQ ID NO: 49748 - protein, 9 aa, Artificial Sequence
  Description of Artificial Sequence: Synthetic peptide
  Seed: VQEKYLEYR (MAGA1_HUMAN)
VVEKYLEYY

SEQ ID NO: 49749 - protein, 9 aa, Artificial Sequence
  Description of Artificial Sequence: Synthetic peptide
  Seed: SAYGEPRKL (MAGA1_HUMAN)
SQYGEPRKI

SEQ ID NO: 49750 - protein, 9 aa, Artificial Sequence
  Description of Artificial Sequence: Synthetic peptide
  Seed: RVRFFFPSL (MAGA1_HUMAN)
RARFFFPSR

SEQ ID NO: 49751 - protein, 10 aa, Artificial Sequence
  Description of Artificial Sequence: Synthetic peptide
  Seed: KNYKHCFPEI (MAGA1_HUMAN)
KYYKHCFPEM

SEQ ID NO: 49752 - protein, 10 aa, Artificial Sequence
  Description of Artificial Sequence: Synthetic peptide
  Seed: KVADLVGFLL (MAGA1_HUMAN)
KGADLVGFLW

SEQ ID NO: 49753 - protein, 9 aa, Artificial Sequence
  Description of Artificial Sequence: Synthetic peptide
  Seed: ILESLFRAV (MAGA1_HUMAN)
IAESLFRAL

SEQ ID NO: 49754 - protein, 9 aa, Artificial Sequence
  Description of Artificial Sequence: Synthetic peptide
  Seed: TQDLVQEKY (MAGA1_HUMAN)
TADLVQEKY

SEQ ID NO: 49755 - protein, 9 aa, Artificial Sequence
  Description of Artificial Sequence: Synthetic peptide
  Seed: RQVPDSDPA (MAGA1_HUMAN)
RQVPDSDPI

SEQ ID NO: 49756 - protein, 10 aa, Artificial Sequence
  Description of Artificial Sequence: Synthetic peptide
  Seed: SARVRFFFPS (MAGA1_HUMAN)
SQRVRFFFPL

SEQ ID NO: 49757 - protein, 9 aa, Artificial Sequence
  Description of Artificial Sequence: Synthetic peptide
  Seed: FFFPSLREA (MAGA1_HUMAN)
FVFPSLREM

SEQ ID NO: 49758 - protein, 11 aa, Artificial Sequence
  Description of Artificial Sequence: Synthetic peptide
  Seed: SAFPTTINFTR (MAGA1_HUMAN)
STFPTTINFTR

SEQ ID NO: 49759 - protein, 9 aa, Artificial Sequence
  Description of Artificial Sequence: Synthetic peptide
  Seed: SAFPTTINF (MAGA1_HUMAN)
SSFPTTINV

SEQ ID NO: 49760 - protein, 10 aa, Artificial Sequence
  Description of Artificial Sequence: Synthetic peptide
  Seed: VTKAEMLESV (MAGA1_HUMAN)
VMKAEMLESA

SEQ ID NO: 49761 - protein, 11 aa, Artificial Sequence
  Description of Artificial Sequence: Synthetic peptide
  Seed: KVADLVGFLLL (MAGA1_HUMAN)
KLADLVGFLLM

SEQ ID NO: 49762 - protein, 9 aa, Artificial Sequence
  Description of Artificial Sequence: Synthetic peptide
  Seed: MEGGHAPEE (MAGA1_HUMAN)
MEGGHAPEA

SEQ ID NO: 49763 - protein, 11 aa, Artificial Sequence
  Description of Artificial Sequence: Synthetic peptide
  Seed: RQVPDSDPARY (MAGA1_HUMAN)
RMVPDSDPARL

SEQ ID NO: 49764 - protein, 9 aa, Artificial Sequence
  Description of Artificial Sequence: Synthetic peptide
  Seed: RVRFFFPSL (MAGA1_HUMAN)
RMRFFFPSY

SEQ ID NO: 49765 - protein, 10 aa, Artificial Sequence
  Description of Artificial Sequence: Synthetic peptide
  Seed: ADPTGHSYVL (MAGA1_HUMAN)
AYPTGHSYVL

SEQ ID NO: 49766 - protein, 10 aa, Artificial Sequence
  Description of Artificial Sequence: Synthetic peptide
  Seed: RALAETSYVK (MAGA1_HUMAN)
RQLAETSYVK

SEQ ID NO: 49767 - protein, 9 aa, Artificial Sequence
  Description of Artificial Sequence: Synthetic peptide
  Seed: FLWGPRALA (MAGA1_HUMAN)
FIWGPRALV

SEQ ID NO: 49768 - protein, 9 aa, Artificial Sequence
  Description of Artificial Sequence: Synthetic peptide
  Seed: EIWEELSVM (MAGA1_HUMAN)
EIWEELSVV

SEQ ID NO: 49769 - protein, 8 aa, Artificial Sequence
  Description of Artificial Sequence: Synthetic peptide
  Seed: RVRFFFPS (MAGA1_HUMAN)
RSRFFFPK

SEQ ID NO: 49770 - protein, 10 aa, Artificial Sequence
  Description of Artificial Sequence: Synthetic peptide
  Seed: RVRFFFPSLR (MAGA1_HUMAN)
RVRFFFPSLG

SEQ ID NO: 49771 - protein, 9 aa, Artificial Sequence
  Description of Artificial Sequence: Synthetic peptide
  Seed: STDPPQSPQ (MAGA1_HUMAN)
SADPPQSPV

SEQ ID NO: 49772 - protein, 9 aa, Artificial Sequence
  Description of Artificial Sequence: Synthetic peptide
  Seed: YVLVTCLGL (MAGA1_HUMAN)
YLLVTCLGM

SEQ ID NO: 49773 - protein, 9 aa, Artificial Sequence
  Description of Artificial Sequence: Synthetic peptide
  Seed: LESLFRAVI (MAGA1_HUMAN)
LRSLFRAVF

SEQ ID NO: 49774 - protein, 10 aa, Artificial Sequence
  Description of Artificial Sequence: Synthetic peptide
  Seed: SARVRFFFPS (MAGA1_HUMAN)
SNRVRFFFPY

SEQ ID NO: 49775 - protein, 9 aa, Artificial Sequence
  Description of Artificial Sequence: Synthetic peptide
  Seed: QIMPKTGFL (MAGA1_HUMAN)
QAMPKTGFY

SEQ ID NO: 49776 - protein, 10 aa, Artificial Sequence
  Description of Artificial Sequence: Synthetic peptide
  Seed: RVRFFFPSLR (MAGA1_HUMAN)
RRRFFFPSLH

SEQ ID NO: 49777 - protein, 9 aa, Artificial Sequence
  Description of Artificial Sequence: Synthetic peptide
  Seed: MPKTGFLII (MAGA1_HUMAN)
MPKTGFLIS

SEQ ID NO: 49778 - protein, 9 aa, Artificial Sequence
  Description of Artificial Sequence: Synthetic peptide
  Seed: FLLLKYRAR (MAGA1_HUMAN)
FSLLKYRAR

SEQ ID NO: 49779 - protein, 9 aa, Artificial Sequence
  Description of Artificial Sequence: Synthetic peptide
  Seed: RQRQPSEGS (MAGA1_HUMAN)
RYRQPSEGV

SEQ ID NO: 49780 - protein, 10 aa, Artificial Sequence
  Description of Artificial Sequence: Synthetic peptide
  Seed: KEADPTGHSY (MAGA1_HUMAN)
KHADPTGHSF

SEQ ID NO: 49781 - protein, 9 aa, Artificial Sequence
  Description of Artificial Sequence: Synthetic peptide
  Seed: FFFPSLREA (MAGA1_HUMAN)
FLFPSLREL

SEQ ID NO: 49782 - protein, 9 aa, Artificial Sequence
  Description of Artificial Sequence: Synthetic peptide
  Seed: RALAETSYV (MAGA1_HUMAN)
RTLAETSYR

SEQ ID NO: 49783 - protein, 10 aa, Artificial Sequence
  Description of Artificial Sequence: Synthetic peptide
  Seed: WEELSVMEVY (MAGA1_HUMAN)
WRELSVMEVW

SEQ ID NO: 49784 - protein, 9 aa, Artificial Sequence
  Description of Artificial Sequence: Synthetic peptide
  Seed: SAFPTTINF (MAGA1_HUMAN)
SSFPTTINM

SEQ ID NO: 49785 - protein, 9 aa, Artificial Sequence
  Description of Artificial Sequence: Synthetic peptide
  Seed: TSSSSPLVL (MAGA1_HUMAN)
TFSSSPLVM

SEQ ID NO: 49786 - protein, 9 aa, Artificial Sequence
  Description of Artificial Sequence: Synthetic peptide
  Seed: KVLEYVIKV (MAGA1_HUMAN)
KALEYVIKF

SEQ ID NO: 49787 - protein, 10 aa, Artificial Sequence
  Description of Artificial Sequence: Synthetic peptide
  Seed: ALAETSYVKV (MAGA1_HUMAN)
AQAETSYVKV

SEQ ID NO: 49788 - protein, 10 aa, Artificial Sequence
  Description of Artificial Sequence: Synthetic peptide
  Seed: YEFLWGPRAL (MAGA1_HUMAN)
YDFLWGPRAM

SEQ ID NO: 49789 - protein, 11 aa, Artificial Sequence
  Description of Artificial Sequence: Synthetic peptide
  Seed: STDPPQSPQGA (MAGA1_HUMAN)
SLDPPQSPQGY

SEQ ID NO: 49790 - protein, 9 aa, Artificial Sequence
  Description of Artificial Sequence: Synthetic peptide
  Seed: FPSLREAAL (MAGA1_HUMAN)
FVSLREAAF

SEQ ID NO: 49791 - protein, 10 aa, Artificial Sequence
  Description of Artificial Sequence: Synthetic peptide
  Seed: VLVTCLGLSY (MAGA1_HUMAN)
VYVTCLGLSY

SEQ ID NO: 49792 - protein, 9 aa, Artificial Sequence
  Description of Artificial Sequence: Synthetic peptide
  Seed: FPSLREAAL (MAGA1_HUMAN)
FRSLREAAL

SEQ ID NO: 49793 - protein, 9 aa, Artificial Sequence
  Description of Artificial Sequence: Synthetic peptide
  Seed: QSPQGASAF (MAGA1_HUMAN)
QVPQGASAR

SEQ ID NO: 49794 - protein, 9 aa, Artificial Sequence
  Description of Artificial Sequence: Synthetic peptide
  Seed: ARVRFFFPS (MAGA1_HUMAN)
ARVRFFFPH

SEQ ID NO: 49795 - protein, 9 aa, Artificial Sequence
  Description of Artificial Sequence: Synthetic peptide
  Seed: ESLQLVFGI (MAGA1_HUMAN)
EVLQLVFGF

SEQ ID NO: 49796 - protein, 11 aa, Artificial Sequence
  Description of Artificial Sequence: Synthetic peptide
  Seed: YVLVTCLGLSY (MAGA1_HUMAN)
YQLVTCLGLSY

SEQ ID NO: 49797 - protein, 11 aa, Artificial Sequence
  Description of Artificial Sequence: Synthetic peptide
  Seed: RQVPDSDPARY (MAGA1_HUMAN)
RLVPDSDPARW

SEQ ID NO: 49798 - protein, 10 aa, Artificial Sequence
  Description of Artificial Sequence: Synthetic peptide
  Seed: KVADLVGFLL (MAGA1_HUMAN)
KLADLVGFLQ

SEQ ID NO: 49799 - protein, 9 aa, Artificial Sequence
  Description of Artificial Sequence: Synthetic peptide
  Seed: STSCILESL (MAGA1_HUMAN)
STSCILESM

SEQ ID NO: 49800 - protein, 10 aa, Artificial Sequence
  Description of Artificial Sequence: Synthetic peptide
  Seed: ARVRFFFPSL (MAGA1_HUMAN)
AEVRFFFPSA

SEQ ID NO: 49801 - protein, 9 aa, Artificial Sequence
  Description of Artificial Sequence: Synthetic peptide
  Seed: FPTTINFTR (MAGA1_HUMAN)
FVTTINFTM

SEQ ID NO: 49802 - protein, 11 aa, Artificial Sequence
  Description of Artificial Sequence: Synthetic peptide
  Seed: KEADPTGHSYV (MAGA1_HUMAN)
KEADPTGHSYW

SEQ ID NO: 49803 - protein, 9 aa, Artificial Sequence
  Description of Artificial Sequence: Synthetic peptide
  Seed: RVRFFFPSL (MAGA1_HUMAN)
RFRFFFPSM

SEQ ID NO: 49804 - protein, 10 aa, Artificial Sequence
  Description of Artificial Sequence: Synthetic peptide
  Seed: EYVIKVSARV (MAGA1_HUMAN)
ETVIKVSARL

SEQ ID NO: 49805 - protein, 9 aa, Artificial Sequence
  Description of Artificial Sequence: Synthetic peptide
  Seed: LVTCLGLSY (MAGA1_HUMAN)
LKTCLGLSF

SEQ ID NO: 49806 - protein, 10 aa, Artificial Sequence
  Description of Artificial Sequence: Synthetic peptide
  Seed: TSCILESLFR (MAGA1_HUMAN)
TMCILESLFK

SEQ ID NO: 49807 - protein, 10 aa, Artificial Sequence
  Description of Artificial Sequence: Synthetic peptide
  Seed: KNYKHCFPEI (MAGA1_HUMAN)
KAYKHCFPEF

SEQ ID NO: 49808 - protein, 10 aa, Artificial Sequence
  Description of Artificial Sequence: Synthetic peptide
  Seed: EALEAQQEAL (MAGA1_HUMAN)
EALEAQQEAW

SEQ ID NO: 49809 - protein, 9 aa, Artificial Sequence
  Description of Artificial Sequence: Synthetic peptide
  Seed: ALEAQQEAL (MAGA1_HUMAN)
AAEAQQEAM

SEQ ID NO: 49810 - protein, 9 aa, Artificial Sequence
  Description of Artificial Sequence: Synthetic peptide
  Seed: TQDLVQEKY (MAGA1_HUMAN)
TLDLVQEKV

SEQ ID NO: 49811 - protein, 9 aa, Artificial Sequence
  Description of Artificial Sequence: Synthetic peptide
  Seed: ETSYVKVLE (MAGA1_HUMAN)
EQSYVKVLK

SEQ ID NO: 49812 - protein, 10 aa, Artificial Sequence
  Description of Artificial Sequence: Synthetic peptide
  Seed: SSSPLVLGTL (MAGA1_HUMAN)
SMSPLVLGTA

SEQ ID NO: 49813 - protein, 10 aa, Artificial Sequence
  Description of Artificial Sequence: Synthetic peptide
  Seed: KVADLVGFLL (MAGA1_HUMAN)
KMADLVGFLD

SEQ ID NO: 49814 - protein, 10 aa, Artificial Sequence
  Description of Artificial Sequence: Synthetic peptide
  Seed: MPKTGFLIIV (MAGA1_HUMAN)
MPKTGFLIIA

SEQ ID NO: 49815 - protein, 9 aa, Artificial Sequence
  Description of Artificial Sequence: Synthetic peptide
  Seed: HCFPEIFGK (MAGA1_HUMAN)
HTFPEIFGM

SEQ ID NO: 49816 - protein, 10 aa, Artificial Sequence
  Description of Artificial Sequence: Synthetic peptide
  Seed: RQPSEGSSSR (MAGA1_HUMAN)
RTPSEGSSSR

SEQ ID NO: 49817 - protein, 10 aa, Artificial Sequence
  Description of Artificial Sequence: Synthetic peptide
  Seed: KKVADLVGFL (MAGA1_HUMAN)
KWVADLVGFV

SEQ ID NO: 49818 - protein, 9 aa, Artificial Sequence
  Description of Artificial Sequence: Synthetic peptide
  Seed: SSPLVLGTL (MAGA1_HUMAN)
SGPLVLGTL

SEQ ID NO: 49819 - protein, 10 aa, Artificial Sequence
  Description of Artificial Sequence: Synthetic peptide
  Seed: SLFRAVITKK (MAGA1_HUMAN)
SAFRAVITKK

SEQ ID NO: 49820 - protein, 9 aa, Artificial Sequence
  Description of Artificial Sequence: Synthetic peptide
  Seed: SARVRFFFP (MAGA1_HUMAN)
SSRVRFFFG

SEQ ID NO: 49821 - protein, 9 aa, Artificial Sequence
  Description of Artificial Sequence: Synthetic peptide
  Seed: KTGFLIIVL (MAGA1_HUMAN)
KLGFLIIVV

SEQ ID NO: 49822 - protein, 10 aa, Artificial Sequence
  Description of Artificial Sequence: Synthetic peptide
  Seed: SVMEVYDGRE (MAGA1_HUMAN)
SSMEVYDGRR

SEQ ID NO: 49823 - protein, 10 aa, Artificial Sequence
  Description of Artificial Sequence: Synthetic peptide
  Seed: RYEFLWGPRA (MAGA1_HUMAN)
RWEFLWGPRL

SEQ ID NO: 49824 - protein, 9 aa, Artificial Sequence
  Description of Artificial Sequence: Synthetic peptide
  Seed: SARVRFFFP (MAGA1_HUMAN)
STRVRFFFG

SEQ ID NO: 49825 - protein, 10 aa, Artificial Sequence
  Description of Artificial Sequence: Synthetic peptide
  Seed: RVRFFFPSLR (MAGA1_HUMAN)
RYRFFFPSLG

SEQ ID NO: 49826 - protein, 10 aa, Artificial Sequence
  Description of Artificial Sequence: Synthetic peptide
  Seed: KVSARVRFFF (MAGA1_HUMAN)
KISARVRFFY

SEQ ID NO: 49827 - protein, 9 aa, Artificial Sequence
  Description of Artificial Sequence: Synthetic peptide
  Seed: QPSEGSSSR (MAGA1_HUMAN)
QASEGSSSR

SEQ ID NO: 49828 - protein, 9 aa, Artificial Sequence
  Description of Artificial Sequence: Synthetic peptide
  Seed: KVLEYVIKV (MAGA1_HUMAN)
KLLEYVIKV

SEQ ID NO: 49829 - protein, 10 aa, Artificial Sequence
  Description of Artificial Sequence: Synthetic peptide
  Seed: EEIWEELSVM (MAGA1_HUMAN)
EEIWEELSVY

SEQ ID NO: 49830 - protein, 9 aa, Artificial Sequence
  Description of Artificial Sequence: Synthetic peptide
  Seed: FPSLREAAL (MAGA1_HUMAN)
FASLREAAI

SEQ ID NO: 49831 - protein, 9 aa, Artificial Sequence
  Description of Artificial Sequence: Synthetic peptide
  Seed: SARVRFFFP (MAGA1_HUMAN)
SGRVRFFFK

SEQ ID NO: 49832 - protein, 9 aa, Artificial Sequence
  Description of Artificial Sequence: Synthetic peptide
  Seed: KVADLVGFL (MAGA1_HUMAN)
KAADLVGFM

SEQ ID NO: 49833 - protein, 9 aa, Artificial Sequence
  Description of Artificial Sequence: Synthetic peptide
  Seed: LFRAVITKK (MAGA1_HUMAN)
LVRAVITKK

SEQ ID NO: 49834 - protein, 10 aa, Artificial Sequence
  Description of Artificial Sequence: Synthetic peptide
  Seed: REAALREEEE (MAGA1_HUMAN)
REAALREEEL

SEQ ID NO: 49835 - protein, 11 aa, Artificial Sequence
  Description of Artificial Sequence: Synthetic peptide
  Seed: RQVPDSDPARY (MAGA1_HUMAN)
RTVPDSDPARR

SEQ ID NO: 49836 - protein, 10 aa, Artificial Sequence
  Description of Artificial Sequence: Synthetic peptide
  Seed: KVADLVGFLL (MAGA1_HUMAN)
KEADLVGFLW

SEQ ID NO: 49837 - protein, 10 aa, Artificial Sequence
  Description of Artificial Sequence: Synthetic peptide
  Seed: ADPTGHSYVL (MAGA1_HUMAN)
AYPTGHSYVM

SEQ ID NO: 49838 - protein, 9 aa, Artificial Sequence
  Description of Artificial Sequence: Synthetic peptide
  Seed: ATSSSSPLV (MAGA1_HUMAN)
AVSSSSPLI

SEQ ID NO: 49839 - protein, 9 aa, Artificial Sequence
  Description of Artificial Sequence: Synthetic peptide
  Seed: RVRFFFPSL (MAGA1_HUMAN)
RTRFFFPSC

SEQ ID NO: 49840 - protein, 10 aa, Artificial Sequence
  Description of Artificial Sequence: Synthetic peptide
  Seed: TSYVKVLEYV (MAGA1_HUMAN)
TCYVKVLEYW

SEQ ID NO: 49841 - protein, 9 aa, Artificial Sequence
  Description of Artificial Sequence: Synthetic peptide
  Seed: ATSSSSPLV (MAGA1_HUMAN)
AGSSSSPLW

SEQ ID NO: 49842 - protein, 9 aa, Artificial Sequence
  Description of Artificial Sequence: Synthetic peptide
  Seed: ATSSSSPLV (MAGA1_HUMAN)
ATSSSSPLW

SEQ ID NO: 49843 - protein, 10 aa, Artificial Sequence
  Description of Artificial Sequence: Synthetic peptide
  Seed: ATSSSSPLVL (MAGA1_HUMAN)
AASSSSPLVL

SEQ ID NO: 49844 - protein, 10 aa, Artificial Sequence
  Description of Artificial Sequence: Synthetic peptide
  Seed: KEADPTGHSY (MAGA1_HUMAN)
KAADPTGHSR

SEQ ID NO: 49845 - protein, 9 aa, Artificial Sequence
  Description of Artificial Sequence: Synthetic peptide
  Seed: VADLVGFLL (MAGA1_HUMAN)
VPDLVGFLM

SEQ ID NO: 49846 - protein, 10 aa, Artificial Sequence
  Description of Artificial Sequence: Synthetic peptide
  Seed: KVADLVGFLL (MAGA1_HUMAN)
KQADLVGFLV

SEQ ID NO: 49847 - protein, 9 aa, Artificial Sequence
  Description of Artificial Sequence: Synthetic peptide
  Seed: TSYVKVLEY (MAGA1_HUMAN)
TNYVKVLEV

SEQ ID NO: 49848 - protein, 9 aa, Artificial Sequence
  Description of Artificial Sequence: Synthetic peptide
  Seed: YRAREPVTK (MAGA1_HUMAN)
YYAREPVTL

SEQ ID NO: 49849 - protein, 9 aa, Artificial Sequence
  Description of Artificial Sequence: Synthetic peptide
  Seed: FRAVITKKV (MAGA1_HUMAN)
FAAVITKKL

SEQ ID NO: 49850 - protein, 9 aa, Artificial Sequence
  Description of Artificial Sequence: Synthetic peptide
  Seed: ATSSSSPLV (MAGA1_HUMAN)
AQSSSSPLV

SEQ ID NO: 49851 - protein, 10 aa, Artificial Sequence
  Description of Artificial Sequence: Synthetic peptide
  Seed: RVRFFFPSLR (MAGA1_HUMAN)
RVRFFFPSLQ

SEQ ID NO: 49852 - protein, 10 aa, Artificial Sequence
  Description of Artificial Sequence: Synthetic peptide
  Seed: KEADPTGHSY (MAGA1_HUMAN)
KLADPTGHSR

SEQ ID NO: 49853 - protein, 9 aa, Artificial Sequence
  Description of Artificial Sequence: Synthetic peptide
  Seed: FFFPSLREA (MAGA1_HUMAN)
FTFPSLREF

SEQ ID NO: 49854 - protein, 9 aa, Artificial Sequence
  Description of Artificial Sequence: Synthetic peptide
  Seed: SARVRFFFP (MAGA1_HUMAN)
SVRVRFFFK

SEQ ID NO: 49855 - protein, 10 aa, Artificial Sequence
  Description of Artificial Sequence: Synthetic peptide
  Seed: ASAFPTTINF (MAGA1_HUMAN)
ALAFPTTINY

SEQ ID NO: 49856 - protein, 9 aa, Artificial Sequence
  Description of Artificial Sequence: Synthetic peptide
  Seed: SLFRAVITK (MAGA1_HUMAN)
SWFRAVITR

SEQ ID NO: 49857 - protein, 11 aa, Artificial Sequence
  Description of Artificial Sequence: Synthetic peptide
  Seed: RQVPDSDPARY (MAGA1_HUMAN)
RIVPDSDPARI

SEQ ID NO: 49858 - protein, 10 aa, Artificial Sequence
  Description of Artificial Sequence: Synthetic peptide
  Seed: QVPDSDPARY (MAGA1_HUMAN)
QTPDSDPARK

SEQ ID NO: 49859 - protein, 9 aa, Artificial Sequence
  Description of Artificial Sequence: Synthetic peptide
  Seed: ARYEFLWGP (MAGA1_HUMAN)
AQYEFLWGM

SEQ ID NO: 49860 - protein, 9 aa, Artificial Sequence
  Description of Artificial Sequence: Synthetic peptide
  Seed: ETSYVKVLE (MAGA1_HUMAN)
EGSYVKVLK

SEQ ID NO: 49861 - protein, 9 aa, Artificial Sequence
  Description of Artificial Sequence: Synthetic peptide
  Seed: SAYGEPRKL (MAGA1_HUMAN)
SMYGEPRKY

SEQ ID NO: 49862 - protein, 10 aa, Artificial Sequence
  Description of Artificial Sequence: Synthetic peptide
  Seed: ADPTGHSYVL (MAGA1_HUMAN)
AWPTGHSYVM

SEQ ID NO: 49863 - protein, 9 aa, Artificial Sequence
  Description of Artificial Sequence: Synthetic peptide
  Seed: ITKKVADLV (MAGA1_HUMAN)
ISKKVADLW

SEQ ID NO: 49864 - protein, 11 aa, Artificial Sequence
  Description of Artificial Sequence: Synthetic peptide
  Seed: FPTTINFTRQR (MAGA1_HUMAN)
FLTTINFTRQR

SEQ ID NO: 49865 - protein, 10 aa, Artificial Sequence
  Description of Artificial Sequence: Synthetic peptide
  Seed: RVRFFFPSLR (MAGA1_HUMAN)
RRRFFFPSLI

SEQ ID NO: 49866 - protein, 9 aa, Artificial Sequence
  Description of Artificial Sequence: Synthetic peptide
  Seed: REHSAYGEP (MAGA1_HUMAN)
REHSAYGEM

SEQ ID NO: 49867 - protein, 10 aa, Artificial Sequence
  Description of Artificial Sequence: Synthetic peptide
  Seed: RVRFFFPSLR (MAGA1_HUMAN)
RPRFFFPSLH

SEQ ID NO: 49868 - protein, 9 aa, Artificial Sequence
  Description of Artificial Sequence: Synthetic peptide
  Seed: LESLFRAVI (MAGA1_HUMAN)
LTSLFRAVF

SEQ ID NO: 49869 - protein, 10 aa, Artificial Sequence
  Description of Artificial Sequence: Synthetic peptide
  Seed: KEADPTGHSY (MAGA1_HUMAN)
KEADPTGHSW

SEQ ID NO: 49870 - protein, 11 aa, Artificial Sequence
  Description of Artificial Sequence: Synthetic peptide
  Seed: RVRFFFPSLRE (MAGA1_HUMAN)
RMRFFFPSLRF

SEQ ID NO: 49871 - protein, 10 aa, Artificial Sequence
  Description of Artificial Sequence: Synthetic peptide
  Seed: ASAFPTTINF (MAGA1_HUMAN)
ATAFPTTINY

SEQ ID NO: 49872 - protein, 9 aa, Artificial Sequence
  Description of Artificial Sequence: Synthetic peptide
  Seed: FFFPSLREA (MAGA1_HUMAN)
FAFPSLREI

SEQ ID NO: 49873 - protein, 9 aa, Artificial Sequence
  Description of Artificial Sequence: Synthetic peptide
  Seed: LVTCLGLSY (MAGA1_HUMAN)
LPTCLGLSL

SEQ ID NO: 49874 - protein, 9 aa, Artificial Sequence
  Description of Artificial Sequence: Synthetic peptide
  Seed: STDPPQSPQ (MAGA1_HUMAN)
SCDPPQSPM

SEQ ID NO: 49875 - protein, 9 aa, Artificial Sequence
  Description of Artificial Sequence: Synthetic peptide
  Seed: RVRFFFPSL (MAGA1_HUMAN)
RWRFFFPSL

SEQ ID NO: 49876 - protein, 9 aa, Artificial Sequence
  Description of Artificial Sequence: Synthetic peptide
  Seed: ALEAQQEAL (MAGA1_HUMAN)
ATEAQQEAL

SEQ ID NO: 49877 - protein, 10 aa, Artificial Sequence
  Description of Artificial Sequence: Synthetic peptide
  Seed: FPSLREAALR (MAGA1_HUMAN)
FSSLREAALR

SEQ ID NO: 49878 - protein, 10 aa, Artificial Sequence
  Description of Artificial Sequence: Synthetic peptide
  Seed: KVSARVRFFF (MAGA1_HUMAN)
KISARVRFFF

SEQ ID NO: 49879 - protein, 9 aa, Artificial Sequence
  Description of Artificial Sequence: Synthetic peptide
  Seed: RVRFFFPSL (MAGA1_HUMAN)
RLRFFFPSF

SEQ ID NO: 49880 - protein, 10 aa, Artificial Sequence
  Description of Artificial Sequence: Synthetic peptide
  Seed: RFFFPSLREA (MAGA1_HUMAN)
RMFFPSLREK

SEQ ID NO: 49881 - protein, 10 aa, Artificial Sequence
  Description of Artificial Sequence: Synthetic peptide
  Seed: KVSARVRFFF (MAGA1_HUMAN)
KNSARVRFFW

SEQ ID NO: 49882 - protein, 9 aa, Artificial Sequence
  Description of Artificial Sequence: Synthetic peptide
  Seed: AATSSSSPL (MAGA1_HUMAN)
APTSSSSPL

SEQ ID NO: 49883 - protein, 9 aa, Artificial Sequence
  Description of Artificial Sequence: Synthetic peptide
  Seed: RYEFLWGPR (MAGA1_HUMAN)
RQEFLWGPR

SEQ ID NO: 49884 - protein, 9 aa, Artificial Sequence
  Description of Artificial Sequence: Synthetic peptide
  Seed: GASAFPTTI (MAGA1_HUMAN)
GISAFPTTI

SEQ ID NO: 49885 - protein, 10 aa, Artificial Sequence
  Description of Artificial Sequence: Synthetic peptide
  Seed: EYVIKVSARV (MAGA1_HUMAN)
ESVIKVSARV

SEQ ID NO: 49886 - protein, 8 aa, Artificial Sequence
  Description of Artificial Sequence: Synthetic peptide
  Seed: RFFFPSLR (MAGA1_HUMAN)
RQFFPSLR

SEQ ID NO: 49887 - protein, 9 aa, Artificial Sequence
  Description of Artificial Sequence: Synthetic peptide
  Seed: SAFPTTINF (MAGA1_HUMAN)
SYFPTTINY

SEQ ID NO: 49888 - protein, 9 aa, Artificial Sequence
  Description of Artificial Sequence: Synthetic peptide
  Seed: KYRAREPVT (MAGA1_HUMAN)
KSRAREPVR

SEQ ID NO: 49889 - protein, 10 aa, Artificial Sequence
  Description of Artificial Sequence: Synthetic peptide
  Seed: KEADPTGHSY (MAGA1_HUMAN)
KVADPTGHSL

SEQ ID NO: 49890 - protein, 9 aa, Artificial Sequence
  Description of Artificial Sequence: Synthetic peptide
  Seed: TSSSSPLVL (MAGA1_HUMAN)
TLSSSPLVY

SEQ ID NO: 49891 - protein, 9 aa, Artificial Sequence
  Description of Artificial Sequence: Synthetic peptide
  Seed: SAYGEPRKL (MAGA1_HUMAN)
SKYGEPRKL

SEQ ID NO: 49892 - protein, 9 aa, Artificial Sequence
  Description of Artificial Sequence: Synthetic peptide
  Seed: TSYVKVLEY (MAGA1_HUMAN)
TAYVKVLEM

SEQ ID NO: 49893 - protein, 10 aa, Artificial Sequence
  Description of Artificial Sequence: Synthetic peptide
  Seed: KKVADLVGFL (MAGA1_HUMAN)
KIVADLVGFI

SEQ ID NO: 49894 - protein, 9 aa, Artificial Sequence
  Description of Artificial Sequence: Synthetic peptide
  Seed: VITKKVADL (MAGA1_HUMAN)
VATKKVADM

SEQ ID NO: 49895 - protein, 9 aa, Artificial Sequence
  Description of Artificial Sequence: Synthetic peptide
  Seed: EIWEELSVM (MAGA1_HUMAN)
EIWEELSVY

SEQ ID NO: 49896 - protein, 10 aa, Artificial Sequence
  Description of Artificial Sequence: Synthetic peptide
  Seed: TSYVKVLEYV (MAGA1_HUMAN)
TIYVKVLEYI

SEQ ID NO: 49897 - protein, 9 aa, Artificial Sequence
  Description of Artificial Sequence: Synthetic peptide
  Seed: SAYGEPRKL (MAGA1_HUMAN)
SLYGEPRKY

SEQ ID NO: 49898 - protein, 10 aa, Artificial Sequence
  Description of Artificial Sequence: Synthetic peptide
  Seed: KNYKHCFPEI (MAGA1_HUMAN)
KQYKHCFPEF

SEQ ID NO: 49899 - protein, 10 aa, Artificial Sequence
  Description of Artificial Sequence: Synthetic peptide
  Seed: SAFPTTINFT (MAGA1_HUMAN)
SAFPTTINFY

SEQ ID NO: 49900 - protein, 9 aa, Artificial Sequence
  Description of Artificial Sequence: Synthetic peptide
  Seed: LTQDLVQEK (MAGA1_HUMAN)
LLQDLVQEM

SEQ ID NO: 49901 - protein, 9 aa, Artificial Sequence
  Description of Artificial Sequence: Synthetic peptide
  Seed: MSLEQRSLH (MAGA1_HUMAN)
MSLEQRSLY

SEQ ID NO: 49902 - protein, 9 aa, Artificial Sequence
  Description of Artificial Sequence: Synthetic peptide
  Seed: HCFPEIFGK (MAGA1_HUMAN)
HLFPEIFGR

SEQ ID NO: 49903 - protein, 9 aa, Artificial Sequence
  Description of Artificial Sequence: Synthetic peptide
  Seed: HSAYGEPRK (MAGA1_HUMAN)
HTAYGEPRK

SEQ ID NO: 49904 - protein, 9 aa, Artificial Sequence
  Description of Artificial Sequence: Synthetic peptide
  Seed: KVSARVRFF (MAGA1_HUMAN)
KYSARVRFY

SEQ ID NO: 49905 - protein, 11 aa, Artificial Sequence
  Description of Artificial Sequence: Synthetic peptide
  Seed: RQVPDSDPARY (MAGA1_HUMAN)
RLVPDSDPARY

SEQ ID NO: 49906 - protein, 9 aa, Artificial Sequence
  Description of Artificial Sequence: Synthetic peptide
  Seed: VIKNYKHCF (MAGA1_HUMAN)
VIKNYKHCY

SEQ ID NO: 49907 - protein, 9 aa, Artificial Sequence
  Description of Artificial Sequence: Synthetic peptide
  Seed: IMPKTGFLI (MAGA1_HUMAN)
IFPKTGFLI

SEQ ID NO: 49908 - protein, 9 aa, Artificial Sequence
  Description of Artificial Sequence: Synthetic peptide
  Seed: GDNQIMPKT (MAGA1_HUMAN)
GENQIMPKT

SEQ ID NO: 49909 - protein, 10 aa, Artificial Sequence
  Description of Artificial Sequence: Synthetic peptide
  Seed: FFPSLREAAL (MAGA1_HUMAN)
FKPSLREAAL

SEQ ID NO: 49910 - protein, 10 aa, Artificial Sequence
  Description of Artificial Sequence: Synthetic peptide
  Seed: KVADLVGFLL (MAGA1_HUMAN)
KAADLVGFLY

SEQ ID NO: 49911 - protein, 9 aa, Artificial Sequence
  Description of Artificial Sequence: Synthetic peptide
  Seed: RVRFFFPSL (MAGA1_HUMAN)
RSRFFFPSP

SEQ ID NO: 49912 - protein, 9 aa, Artificial Sequence
  Description of Artificial Sequence: Synthetic peptide
  Seed: YVLVTCLGL (MAGA1_HUMAN)
YVLVTCLGI

SEQ ID NO: 49913 - protein, 9 aa, Artificial Sequence
  Description of Artificial Sequence: Synthetic peptide
  Seed: LVQEKYLEY (MAGA1_HUMAN)
LRQEKYLEF

SEQ ID NO: 49914 - protein, 9 aa, Artificial Sequence
  Description of Artificial Sequence: Synthetic peptide
  Seed: VRFFFPSLR (MAGA1_HUMAN)
VTFFFPSLK

SEQ ID NO: 49915 - protein, 9 aa, Artificial Sequence
  Description of Artificial Sequence: Synthetic peptide
  Seed: FPTTINFTR (MAGA1_HUMAN)
FITTINFTY

SEQ ID NO: 49916 - protein, 11 aa, Artificial Sequence
  Description of Artificial Sequence: Synthetic peptide
  Seed: DLVGFLLLKYR (MAGA1_HUMAN)
DFVGFLLLKYR

SEQ ID NO: 49917 - protein, 9 aa, Artificial Sequence
  Description of Artificial Sequence: Synthetic peptide
  Seed: KVADLVGFL (MAGA1_HUMAN)
KGADLVGFW

SEQ ID NO: 49918 - protein, 8 aa, Artificial Sequence
  Description of Artificial Sequence: Synthetic peptide
  Seed: LESLFRAV (MAGA1_HUMAN)
LQSLFRAV

SEQ ID NO: 49919 - protein, 9 aa, Artificial Sequence
  Description of Artificial Sequence: Synthetic peptide
  Seed: SSPLVLGTL (MAGA1_HUMAN)
SLPLVLGTL

SEQ ID NO: 49920 - protein, 9 aa, Artificial Sequence
  Description of Artificial Sequence: Synthetic peptide
  Seed: AATSSSSPL (MAGA1_HUMAN)
ALTSSSSPM

SEQ ID NO: 49921 - protein, 9 aa, Artificial Sequence
  Description of Artificial Sequence: Synthetic peptide
  Seed: NQIMPKTGF (MAGA1_HUMAN)
NEIMPKTGW

SEQ ID NO: 49922 - protein, 9 aa, Artificial Sequence
  Description of Artificial Sequence: Synthetic peptide
  Seed: AQQEALGLV (MAGA1_HUMAN)
AQQEALGLL

SEQ ID NO: 49923 - protein, 9 aa, Artificial Sequence
  Description of Artificial Sequence: Synthetic peptide
  Seed: RVRFFFPSL (MAGA1_HUMAN)
RYRFFFPSC

SEQ ID NO: 49924 - protein, 9 aa, Artificial Sequence
  Description of Artificial Sequence: Synthetic peptide
  Seed: TSYVKVLEY (MAGA1_HUMAN)
TIYVKVLEV

SEQ ID NO: 49925 - protein, 9 aa, Artificial Sequence
  Description of Artificial Sequence: Synthetic peptide
  Seed: HCFPEIFGK (MAGA1_HUMAN)
HTFPEIFGH

SEQ ID NO: 49926 - protein, 9 aa, Artificial Sequence
  Description of Artificial Sequence: Synthetic peptide
  Seed: STSCILESL (MAGA1_HUMAN)
STSCILESA

SEQ ID NO: 49927 - protein, 10 aa, Artificial Sequence
  Description of Artificial Sequence: Synthetic peptide
  Seed: RVRFFFPSLR (MAGA1_HUMAN)
RFRFFFPSLY

SEQ ID NO: 49928 - protein, 10 aa, Artificial Sequence
  Description of Artificial Sequence: Synthetic peptide
  Seed: GPRALAETSY (MAGA1_HUMAN)
GQRALAETSF

SEQ ID NO: 49929 - protein, 10 aa, Artificial Sequence
  Description of Artificial Sequence: Synthetic peptide
  Seed: RVRFFFPSLR (MAGA1_HUMAN)
RYRFFFPSLV

SEQ ID NO: 49930 - protein, 9 aa, Artificial Sequence
  Description of Artificial Sequence: Synthetic peptide
  Seed: VIKNYKHCF (MAGA1_HUMAN)
VSKNYKHCY

SEQ ID NO: 49931 - protein, 9 aa, Artificial Sequence
  Description of Artificial Sequence: Synthetic peptide
  Seed: RQRQPSEGS (MAGA1_HUMAN)
RFRQPSEGV

SEQ ID NO: 49932 - protein, 8 aa, Artificial Sequence
  Description of Artificial Sequence: Synthetic peptide
  Seed: SESLQLVF (MAGA1_HUMAN)
SESLQLVA

SEQ ID NO: 49933 - protein, 10 aa, Artificial Sequence
  Description of Artificial Sequence: Synthetic peptide
  Seed: RVRFFFPSLR (MAGA1_HUMAN)
RNRFFFPSLA

SEQ ID NO: 49934 - protein, 9 aa, Artificial Sequence
  Description of Artificial Sequence: Synthetic peptide
  Seed: DLVGFLLLK (MAGA1_HUMAN)
DMVGFLLLK

SEQ ID NO: 49935 - protein, 10 aa, Artificial Sequence
  Description of Artificial Sequence: Synthetic peptide
  Seed: KKVADLVGFL (MAGA1_HUMAN)
KLVADLVGFA

SEQ ID NO: 49936 - protein, 9 aa, Artificial Sequence
  Description of Artificial Sequence: Synthetic peptide
  Seed: LVQEKYLEY (MAGA1_HUMAN)
LVQEKYLEK

SEQ ID NO: 49937 - protein, 11 aa, Artificial Sequence
  Description of Artificial Sequence: Synthetic peptide
  Seed: RQVPDSDPARY (MAGA1_HUMAN)
RIVPDSDPARK

SEQ ID NO: 49938 - protein, 9 aa, Artificial Sequence
  Description of Artificial Sequence: Synthetic peptide
  Seed: YKHCFPEIF (MAGA1_HUMAN)
YMHCFPEIY

SEQ ID NO: 49939 - protein, 10 aa, Artificial Sequence
  Description of Artificial Sequence: Synthetic peptide
  Seed: KEADPTGHSY (MAGA1_HUMAN)
KKADPTGHSM

SEQ ID NO: 49940 - protein, 9 aa, Artificial Sequence
  Description of Artificial Sequence: Synthetic peptide
  Seed: CILESLFRA (MAGA1_HUMAN)
CALESLFRI

SEQ ID NO: 49941 - protein, 10 aa, Artificial Sequence
  Description of Artificial Sequence: Synthetic peptide
  Seed: KVADLVGFLL (MAGA1_HUMAN)
KVADLVGFLI

SEQ ID NO: 49942 - protein, 9 aa, Artificial Sequence
  Description of Artificial Sequence: Synthetic peptide
  Seed: IAMEGGHAP (MAGA1_HUMAN)
IFMEGGHAF

SEQ ID NO: 49943 - protein, 9 aa, Artificial Sequence
  Description of Artificial Sequence: Synthetic peptide
  Seed: EYVIKVSAR (MAGA1_HUMAN)
ETVIKVSAK

SEQ ID NO: 49944 - protein, 9 aa, Artificial Sequence
  Description of Artificial Sequence: Synthetic peptide
  Seed: SSPLVLGTL (MAGA1_HUMAN)
SMPLVLGTV

SEQ ID NO: 49945 - protein, 11 aa, Artificial Sequence
  Description of Artificial Sequence: Synthetic peptide
  Seed: SPQGASAFPTT (MAGA1_HUMAN)
SPQGASAFPTI

SEQ ID NO: 49946 - protein, 9 aa, Artificial Sequence
  Description of Artificial Sequence: Synthetic peptide
  Seed: STSCILESL (MAGA1_HUMAN)
SQSCILESV

SEQ ID NO: 49947 - protein, 10 aa, Artificial Sequence
  Description of Artificial Sequence: Synthetic peptide
  Seed: RVRFFFPSLR (MAGA1_HUMAN)
RWRFFFPSLY

SEQ ID NO: 49948 - protein, 9 aa, Artificial Sequence
  Description of Artificial Sequence: Synthetic peptide
  Seed: RALAETSYV (MAGA1_HUMAN)
RQLAETSYL

SEQ ID NO: 49949 - protein, 10 aa, Artificial Sequence
  Description of Artificial Sequence: Synthetic peptide
  Seed: VKVLEYVIKV (MAGA1_HUMAN)
VMVLEYVIKV

SEQ ID NO: 49950 - protein, 11 aa, Artificial Sequence
  Description of Artificial Sequence: Synthetic peptide
  Seed: FPTTINFTRQR (MAGA1_HUMAN)
FVTTINFTRQR

SEQ ID NO: 49951 - protein, 10 aa, Artificial Sequence
  Description of Artificial Sequence: Synthetic peptide
  Seed: EVYDGREHSA (MAGA1_HUMAN)
EAYDGREHSY

SEQ ID NO: 49952 - protein, 9 aa, Artificial Sequence
  Description of Artificial Sequence: Synthetic peptide
  Seed: VADLVGFLL (MAGA1_HUMAN)
VADLVGFLV

SEQ ID NO: 49953 - protein, 11 aa, Artificial Sequence
  Description of Artificial Sequence: Synthetic peptide
  Seed: STDPPQSPQGA (MAGA1_HUMAN)
SMDPPQSPQGI

SEQ ID NO: 49954 - protein, 11 aa, Artificial Sequence
  Description of Artificial Sequence: Synthetic peptide
  Seed: KVSARVRFFFP (MAGA1_HUMAN)
KGSARVRFFFK

SEQ ID NO: 49955 - protein, 9 aa, Artificial Sequence
  Description of Artificial Sequence: Synthetic peptide
  Seed: VADLVGFLL (MAGA1_HUMAN)
VADLVGFLM

SEQ ID NO: 49956 - protein, 10 aa, Artificial Sequence
  Description of Artificial Sequence: Synthetic peptide
  Seed: ADLVGFLLLK (MAGA1_HUMAN)
AELVGFLLLK

SEQ ID NO: 49957 - protein, 10 aa, Artificial Sequence
  Description of Artificial Sequence: Synthetic peptide
  Seed: RVRFFFPSLR (MAGA1_HUMAN)
RLRFFFPSLV

SEQ ID NO: 49958 - protein, 11 aa, Artificial Sequence
  Description of Artificial Sequence: Synthetic peptide
  Seed: TKKVADLVGFL (MAGA1_HUMAN)
TAKVADLVGFV

SEQ ID NO: 49959 - protein, 9 aa, Artificial Sequence
  Description of Artificial Sequence: Synthetic peptide
  Seed: RVRFFFPSL (MAGA1_HUMAN)
RARFFFPSF

SEQ ID NO: 49960 - protein, 9 aa, Artificial Sequence
  Description of Artificial Sequence: Synthetic peptide
  Seed: TSSSSPLVL (MAGA1_HUMAN)
TSSSSPLVF

SEQ ID NO: 49961 - protein, 11 aa, Artificial Sequence
  Description of Artificial Sequence: Synthetic peptide
  Seed: FLWGPRALAET (MAGA1_HUMAN)
FMWGPRALAEL

SEQ ID NO: 49962 - protein, 9 aa, Artificial Sequence
  Description of Artificial Sequence: Synthetic peptide
  Seed: FPEIFGKAS (MAGA1_HUMAN)
FPEIFGKAA

SEQ ID NO: 49963 - protein, 10 aa, Artificial Sequence
  Description of Artificial Sequence: Synthetic peptide
  Seed: KNYKHCFPEI (MAGA1_HUMAN)
KEYKHCFPEK

SEQ ID NO: 49964 - protein, 9 aa, Artificial Sequence
  Description of Artificial Sequence: Synthetic peptide
  Seed: VQAATSSSS (MAGA1_HUMAN)
VTAATSSSY

SEQ ID NO: 49965 - protein, 9 aa, Artificial Sequence
  Description of Artificial Sequence: Synthetic peptide
  Seed: RALAETSYV (MAGA1_HUMAN)
RLLAETSYW

SEQ ID NO: 49966 - protein, 9 aa, Artificial Sequence
  Description of Artificial Sequence: Synthetic peptide
  Seed: FFFPSLREA (MAGA1_HUMAN)
FTFPSLREC

SEQ ID NO: 49967 - protein, 9 aa, Artificial Sequence
  Description of Artificial Sequence: Synthetic peptide
  Seed: DPTGHSYVL (MAGA1_HUMAN)
DATGHSYVW

SEQ ID NO: 49968 - protein, 10 aa, Artificial Sequence
  Description of Artificial Sequence: Synthetic peptide
  Seed: ATSSSSPLVL (MAGA1_HUMAN)
AASSSSPLVF

SEQ ID NO: 49969 - protein, 10 aa, Artificial Sequence
  Description of Artificial Sequence: Synthetic peptide
  Seed: ARVRFFFPSL (MAGA1_HUMAN)
ATVRFFFPSI

SEQ ID NO: 49970 - protein, 10 aa, Artificial Sequence
  Description of Artificial Sequence: Synthetic peptide
  Seed: AFPTTINFTR (MAGA1_HUMAN)
AIPTTINFTR

SEQ ID NO: 49971 - protein, 9 aa, Artificial Sequence
  Description of Artificial Sequence: Synthetic peptide
  Seed: LFRAVITKK (MAGA1_HUMAN)
LLRAVITKK

SEQ ID NO: 49972 - protein, 9 aa, Artificial Sequence
  Description of Artificial Sequence: Synthetic peptide
  Seed: SARVRFFFP (MAGA1_HUMAN)
SMRVRFFFI

SEQ ID NO: 49973 - protein, 9 aa, Artificial Sequence
  Description of Artificial Sequence: Synthetic peptide
  Seed: KYRAREPVT (MAGA1_HUMAN)
KTRAREPVP

SEQ ID NO: 49974 - protein, 9 aa, Artificial Sequence
  Description of Artificial Sequence: Synthetic peptide
  Seed: SAYGEPRKL (MAGA1_HUMAN)
SGYGEPRKL

SEQ ID NO: 49975 - protein, 9 aa, Artificial Sequence
  Description of Artificial Sequence: Synthetic peptide
  Seed: FPTTINFTR (MAGA1_HUMAN)
FITTINFTK

SEQ ID NO: 49976 - protein, 9 aa, Artificial Sequence
  Description of Artificial Sequence: Synthetic peptide
  Seed: FFFPSLREA (MAGA1_HUMAN)
FVFPSLREA

SEQ ID NO: 49977 - protein, 9 aa, Artificial Sequence
  Description of Artificial Sequence: Synthetic peptide
  Seed: REPVTKAEM (MAGA1_HUMAN)
RAPVTKAEF

SEQ ID NO: 49978 - protein, 9 aa, Artificial Sequence
  Description of Artificial Sequence: Synthetic peptide
  Seed: FLIIVLVMI (MAGA1_HUMAN)
FLIIVLVMV

SEQ ID NO: 49979 - protein, 9 aa, Artificial Sequence
  Description of Artificial Sequence: Synthetic peptide
  Seed: FFPSLREAA (MAGA1_HUMAN)
FFPSLREAV

SEQ ID NO: 49980 - protein, 9 aa, Artificial Sequence
  Description of Artificial Sequence: Synthetic peptide
  Seed: LKYRAREPV (MAGA1_HUMAN)
LIYRAREPF

SEQ ID NO: 49981 - protein, 10 aa, Artificial Sequence
  Description of Artificial Sequence: Synthetic peptide
  Seed: IKVSARVRFF (MAGA1_HUMAN)
IQVSARVRFY

SEQ ID NO: 49982 - protein, 9 aa, Artificial Sequence
  Description of Artificial Sequence: Synthetic peptide
  Seed: IIVLVMIAM (MAGA1_HUMAN)
IQVLVMIAY

SEQ ID NO: 49983 - protein, 11 aa, Artificial Sequence
  Description of Artificial Sequence: Synthetic peptide
  Seed: STSCILESLFR (MAGA1_HUMAN)
SASCILESLFR

SEQ ID NO: 49984 - protein, 9 aa, Artificial Sequence
  Description of Artificial Sequence: Synthetic peptide
  Seed: KVSARVRFF (MAGA1_HUMAN)
KVSARVRFS

SEQ ID NO: 49985 - protein, 10 aa, Artificial Sequence
  Description of Artificial Sequence: Synthetic peptide
  Seed: SARVRFFFPS (MAGA1_HUMAN)
SERVRFFFPK

SEQ ID NO: 49986 - protein, 10 aa, Artificial Sequence
  Description of Artificial Sequence: Synthetic peptide
  Seed: KEADPTGHSY (MAGA1_HUMAN)
KVADPTGHSH

SEQ ID NO: 49987 - protein, 9 aa, Artificial Sequence
  Description of Artificial Sequence: Synthetic peptide
  Seed: RALAETSYV (MAGA1_HUMAN)
RQLAETSYF

SEQ ID NO: 49988 - protein, 10 aa, Artificial Sequence
  Description of Artificial Sequence: Synthetic peptide
  Seed: KKVADLVGFL (MAGA1_HUMAN)
KLVADLVGFV

SEQ ID NO: 49989 - protein, 9 aa, Artificial Sequence
  Description of Artificial Sequence: Synthetic peptide
  Seed: EIWEELSVM (MAGA1_HUMAN)
EAWEELSVR

SEQ ID NO: 49990 - protein, 9 aa, Artificial Sequence
  Description of Artificial Sequence: Synthetic peptide
  Seed: IAMEGGHAP (MAGA1_HUMAN)
IPMEGGHAC

SEQ ID NO: 49991 - protein, 9 aa, Artificial Sequence
  Description of Artificial Sequence: Synthetic peptide
  Seed: STSCILESL (MAGA1_HUMAN)
SQSCILESM

SEQ ID NO: 49992 - protein, 9 aa, Artificial Sequence
  Description of Artificial Sequence: Synthetic peptide
  Seed: KVLEYVIKV (MAGA1_HUMAN)
KELEYVIKY

SEQ ID NO: 49993 - protein, 11 aa, Artificial Sequence
  Description of Artificial Sequence: Synthetic peptide
  Seed: EVYDGREHSAY (MAGA1_HUMAN)
EPYDGREHSAY

SEQ ID NO: 49994 - protein, 9 aa, Artificial Sequence
  Description of Artificial Sequence: Synthetic peptide
  Seed: EADPTGHSY (MAGA1_HUMAN)
EWDPTGHSI

SEQ ID NO: 49995 - protein, 9 aa, Artificial Sequence
  Description of Artificial Sequence: Synthetic peptide
  Seed: LTQDLVQEK (MAGA1_HUMAN)
LMQDLVQEK

SEQ ID NO: 49996 - protein, 9 aa, Artificial Sequence
  Description of Artificial Sequence: Synthetic peptide
  Seed: RAREPVTKA (MAGA1_HUMAN)
RYREPVTKY

SEQ ID NO: 49997 - protein, 9 aa, Artificial Sequence
  Description of Artificial Sequence: Synthetic peptide
  Seed: FLWGPRALA (MAGA1_HUMAN)
FLWGPRALV

SEQ ID NO: 49998 - protein, 9 aa, Artificial Sequence
  Description of Artificial Sequence: Synthetic peptide
  Seed: KVADLVGFL (MAGA1_HUMAN)
KIADLVGFM

SEQ ID NO: 49999 - protein, 9 aa, Artificial Sequence
  Description of Artificial Sequence: Synthetic peptide
  Seed: RVRFFFPSL (MAGA1_HUMAN)
RQRFFFPSH

SEQ ID NO: 50000 - protein, 10 aa, Artificial Sequence
  Description of Artificial Sequence: Synthetic peptide
  Seed: KYRAREPVTK (MAGA1_HUMAN)
KSRAREPVTR

SEQ ID NO: 50001 - protein, 10 aa, Artificial Sequence
  Description of Artificial Sequence: Synthetic peptide
  Seed: RVRFFFPSLR (MAGA1_HUMAN)
RYRFFFPSLL

SEQ ID NO: 50002 - protein, 10 aa, Artificial Sequence
  Description of Artificial Sequence: Synthetic peptide
  Seed: FFFPSLREAA (MAGA1_HUMAN)
FRFPSLREAM

SEQ ID NO: 50003 - protein, 9 aa, Artificial Sequence
  Description of Artificial Sequence: Synthetic peptide
  Seed: EEIWEELSV (MAGA1_HUMAN)
EEIWEELSF

SEQ ID NO: 50004 - protein, 9 aa, Artificial Sequence
  Description of Artificial Sequence: Synthetic peptide
  Seed: LFRAVITKK (MAGA1_HUMAN)
LTRAVITKK

SEQ ID NO: 50005 - protein, 9 aa, Artificial Sequence
  Description of Artificial Sequence: Synthetic peptide
  Seed: SAYGEPRKL (MAGA1_HUMAN)
SEYGEPRKI

SEQ ID NO: 50006 - protein, 11 aa, Artificial Sequence
  Description of Artificial Sequence: Synthetic peptide
  Seed: KVADLVGFLLL (MAGA1_HUMAN)
KMADLVGFLLY

SEQ ID NO: 50007 - protein, 9 aa, Artificial Sequence
  Description of Artificial Sequence: Synthetic peptide
  Seed: SAFPTTINF (MAGA1_HUMAN)
SIFPTTINI

SEQ ID NO: 50008 - protein, 9 aa, Artificial Sequence
  Description of Artificial Sequence: Synthetic peptide
  Seed: AQQEALGLV (MAGA1_HUMAN)
AIQEALGLV

SEQ ID NO: 50009 - protein, 9 aa, Artificial Sequence
  Description of Artificial Sequence: Synthetic peptide
  Seed: SYVKVLEYV (MAGA1_HUMAN)
SYVKVLEYL

SEQ ID NO: 50010 - protein, 9 aa, Artificial Sequence
  Description of Artificial Sequence: Synthetic peptide
  Seed: MPKTGFLII (MAGA1_HUMAN)
MVKTGFLIF

SEQ ID NO: 50011 - protein, 10 aa, Artificial Sequence
  Description of Artificial Sequence: Synthetic peptide
  Seed: KHCFPEIFGK (MAGA1_HUMAN)
KACFPEIFGR

SEQ ID NO: 50012 - protein, 9 aa, Artificial Sequence
  Description of Artificial Sequence: Synthetic peptide
  Seed: FLLLKYRAR (MAGA1_HUMAN)
FTLLKYRAR

SEQ ID NO: 50013 - protein, 9 aa, Artificial Sequence
  Description of Artificial Sequence: Synthetic peptide
  Seed: HSYVLVTCL (MAGA1_HUMAN)
HTYVLVTCI

SEQ ID NO: 50014 - protein, 9 aa, Artificial Sequence
  Description of Artificial Sequence: Synthetic peptide
  Seed: EIWEELSVM (MAGA1_HUMAN)
EPWEELSVF

SEQ ID NO: 50015 - protein, 10 aa, Artificial Sequence
  Description of Artificial Sequence: Synthetic peptide
  Seed: KVLEYVIKVS (MAGA1_HUMAN)
KVLEYVIKVI

SEQ ID NO: 50016 - protein, 9 aa, Artificial Sequence
  Description of Artificial Sequence: Synthetic peptide
  Seed: KVADLVGFL (MAGA1_HUMAN)
KGADLVGFY

SEQ ID NO: 50017 - protein, 11 aa, Artificial Sequence
  Description of Artificial Sequence: Synthetic peptide
  Seed: YEFLWGPRALA (MAGA1_HUMAN)
YIFLWGPRALI

SEQ ID NO: 50018 - protein, 10 aa, Artificial Sequence
  Description of Artificial Sequence: Synthetic peptide
  Seed: ARYEFLWGPR (MAGA1_HUMAN)
AYYEFLWGPK

SEQ ID NO: 50019 - protein, 9 aa, Artificial Sequence
  Description of Artificial Sequence: Synthetic peptide
  Seed: STSCILESL (MAGA1_HUMAN)
SASCILESV

SEQ ID NO: 50020 - protein, 11 aa, Artificial Sequence
  Description of Artificial Sequence: Synthetic peptide
  Seed: FLWGPRALAET (MAGA1_HUMAN)
FQWGPRALAEL

SEQ ID NO: 50021 - protein, 9 aa, Artificial Sequence
  Description of Artificial Sequence: Synthetic peptide
  Seed: SARVRFFFP (MAGA1_HUMAN)
SLRVRFFFL

SEQ ID NO: 50022 - protein, 11 aa, Artificial Sequence
  Description of Artificial Sequence: Synthetic peptide
  Seed: YVLVTCLGLSY (MAGA1_HUMAN)
YYLVTCLGLSY

SEQ ID NO: 50023 - protein, 9 aa, Artificial Sequence
  Description of Artificial Sequence: Synthetic peptide
  Seed: SVMEVYDGR (MAGA1_HUMAN)
SAMEVYDGL

SEQ ID NO: 50024 - protein, 10 aa, Artificial Sequence
  Description of Artificial Sequence: Synthetic peptide
  Seed: EMLESVIKNY (MAGA1_HUMAN)
EVLESVIKNF

SEQ ID NO: 50025 - protein, 9 aa, Artificial Sequence
  Description of Artificial Sequence: Synthetic peptide
  Seed: SAYGEPRKL (MAGA1_HUMAN)
SRYGEPRKF

SEQ ID NO: 50026 - protein, 10 aa, Artificial Sequence
  Description of Artificial Sequence: Synthetic peptide
  Seed: KEADPTGHSY (MAGA1_HUMAN)
KGADPTGHSY

SEQ ID NO: 50027 - protein, 10 aa, Artificial Sequence
  Description of Artificial Sequence: Synthetic peptide
  Seed: EVYDGREHSA (MAGA1_HUMAN)
ELYDGREHSL

SEQ ID NO: 50028 - protein, 9 aa, Artificial Sequence
  Description of Artificial Sequence: Synthetic peptide
  Seed: EIWEELSVM (MAGA1_HUMAN)
ETWEELSVI

SEQ ID NO: 50029 - protein, 10 aa, Artificial Sequence
  Description of Artificial Sequence: Synthetic peptide
  Seed: ARVRFFFPSL (MAGA1_HUMAN)
ARVRFFFPSF

SEQ ID NO: 50030 - protein, 9 aa, Artificial Sequence
  Description of Artificial Sequence: Synthetic peptide
  Seed: STSCILESL (MAGA1_HUMAN)
SMSCILESW

SEQ ID NO: 50031 - protein, 11 aa, Artificial Sequence
  Description of Artificial Sequence: Synthetic peptide
  Seed: RVRFFFPSLRE (MAGA1_HUMAN)
RTRFFFPSLRW

SEQ ID NO: 50032 - protein, 9 aa, Artificial Sequence
  Description of Artificial Sequence: Synthetic peptide
  Seed: VYDGREHSA (MAGA1_HUMAN)
VLDGREHSM

SEQ ID NO: 50033 - protein, 11 aa, Artificial Sequence
  Description of Artificial Sequence: Synthetic peptide
  Seed: ELSVMEVYDGR (MAGA1_HUMAN)
ESSVMEVYDGR

SEQ ID NO: 50034 - protein, 9 aa, Artificial Sequence
  Description of Artificial Sequence: Synthetic peptide
  Seed: KVADLVGFL (MAGA1_HUMAN)
KAADLVGFL

SEQ ID NO: 50035 - protein, 9 aa, Artificial Sequence
  Description of Artificial Sequence: Synthetic peptide
  Seed: MPKTGFLII (MAGA1_HUMAN)
MPKTGFLIF

SEQ ID NO: 50036 - protein, 10 aa, Artificial Sequence
  Description of Artificial Sequence: Synthetic peptide
  Seed: SAFPTTINFT (MAGA1_HUMAN)
STFPTTINFA

SEQ ID NO: 50037 - protein, 10 aa, Artificial Sequence
  Description of Artificial Sequence: Synthetic peptide
  Seed: STSCILESLF (MAGA1_HUMAN)
SDSCILESLW

SEQ ID NO: 50038 - protein, 9 aa, Artificial Sequence
  Description of Artificial Sequence: Synthetic peptide
  Seed: SSPLVLGTL (MAGA1_HUMAN)
SAPLVLGTW

SEQ ID NO: 50039 - protein, 9 aa, Artificial Sequence
  Description of Artificial Sequence: Synthetic peptide
  Seed: SAYGEPRKL (MAGA1_HUMAN)
SDYGEPRKM

SEQ ID NO: 50040 - protein, 9 aa, Artificial Sequence
  Description of Artificial Sequence: Synthetic peptide
  Seed: STDPPQSPQ (MAGA1_HUMAN)
SGDPPQSPV

SEQ ID NO: 50041 - protein, 8 aa, Artificial Sequence
  Description of Artificial Sequence: Synthetic peptide
  Seed: RVRFFFPS (MAGA1_HUMAN)
RFRFFFPK

SEQ ID NO: 50042 - protein, 10 aa, Artificial Sequence
  Description of Artificial Sequence: Synthetic peptide
  Seed: EYVIKVSARV (MAGA1_HUMAN)
EVVIKVSARV

SEQ ID NO: 50043 - protein, 9 aa, Artificial Sequence
  Description of Artificial Sequence: Synthetic peptide
  Seed: RVRFFFPSL (MAGA1_HUMAN)
RWRFFFPSC

SEQ ID NO: 50044 - protein, 9 aa, Artificial Sequence
  Description of Artificial Sequence: Synthetic peptide
  Seed: TSSSSPLVL (MAGA1_HUMAN)
TMSSSPLVL

SEQ ID NO: 50045 - protein, 10 aa, Artificial Sequence
  Description of Artificial Sequence: Synthetic peptide
  Seed: ALAETSYVKV (MAGA1_HUMAN)
AMAETSYVKV

SEQ ID NO: 50046 - protein, 11 aa, Artificial Sequence
  Description of Artificial Sequence: Synthetic peptide
  Seed: SAFPTTINFTR (MAGA1_HUMAN)
SSFPTTINFTR

SEQ ID NO: 50047 - protein, 11 aa, Artificial Sequence
  Description of Artificial Sequence: Synthetic peptide
  Seed: RVRFFFPSLRE (MAGA1_HUMAN)
RCRFFFPSLRR

SEQ ID NO: 50048 - protein, 9 aa, Artificial Sequence
  Description of Artificial Sequence: Synthetic peptide
  Seed: ALREEEEGV (MAGA1_HUMAN)
AMREEEEGV

SEQ ID NO: 50049 - protein, 10 aa, Artificial Sequence
  Description of Artificial Sequence: Synthetic peptide
  Seed: FFPSLREAAL (MAGA1_HUMAN)
FRPSLREAAL

SEQ ID NO: 50050 - protein, 10 aa, Artificial Sequence
  Description of Artificial Sequence: Synthetic peptide
  Seed: KHCFPEIFGK (MAGA1_HUMAN)
KYCFPEIFGK

SEQ ID NO: 50051 - protein, 11 aa, Artificial Sequence
  Description of Artificial Sequence: Synthetic peptide
  Seed: RAREPVTKAEM (MAGA1_HUMAN)
RPREPVTKAEM

SEQ ID NO: 50052 - protein, 10 aa, Artificial Sequence
  Description of Artificial Sequence: Synthetic peptide
  Seed: RVRFFFPSLR (MAGA1_HUMAN)
RQRFFFPSLI

SEQ ID NO: 50053 - protein, 9 aa, Artificial Sequence
  Description of Artificial Sequence: Synthetic peptide
  Seed: GTLEEVPTA (MAGA1_HUMAN)
GVLEEVPTL

SEQ ID NO: 50054 - protein, 9 aa, Artificial Sequence
  Description of Artificial Sequence: Synthetic peptide
  Seed: LTQDLVQEK (MAGA1_HUMAN)
LGQDLVQEY

SEQ ID NO: 50055 - protein, 9 aa, Artificial Sequence
  Description of Artificial Sequence: Synthetic peptide
  Seed: EADPTGHSY (MAGA1_HUMAN)
ETDPTGHSI

SEQ ID NO: 50056 - protein, 9 aa, Artificial Sequence
  Description of Artificial Sequence: Synthetic peptide
  Seed: LGDNQIMPK (MAGA1_HUMAN)
LIDNQIMPY

SEQ ID NO: 50057 - protein, 10 aa, Artificial Sequence
  Description of Artificial Sequence: Synthetic peptide
  Seed: SCILESLFRA (MAGA1_HUMAN)
SRILESLFRI

SEQ ID NO: 50058 - protein, 9 aa, Artificial Sequence
  Description of Artificial Sequence: Synthetic peptide
  Seed: YKHCFPEIF (MAGA1_HUMAN)
YAHCFPEIM

SEQ ID NO: 50059 - protein, 9 aa, Artificial Sequence
  Description of Artificial Sequence: Synthetic peptide
  Seed: LVQEKYLEY (MAGA1_HUMAN)
LGQEKYLEW

SEQ ID NO: 50060 - protein, 9 aa, Artificial Sequence
  Description of Artificial Sequence: Synthetic peptide
  Seed: SAYGEPRKL (MAGA1_HUMAN)
SWYGEPRKF

SEQ ID NO: 50061 - protein, 9 aa, Artificial Sequence
  Description of Artificial Sequence: Synthetic peptide
  Seed: KVLEYVIKV (MAGA1_HUMAN)
KILEYVIKC

SEQ ID NO: 50062 - protein, 10 aa, Artificial Sequence
  Description of Artificial Sequence: Synthetic peptide
  Seed: YEFLWGPRAL (MAGA1_HUMAN)
YMFLWGPRAM

SEQ ID NO: 50063 - protein, 9 aa, Artificial Sequence
  Description of Artificial Sequence: Synthetic peptide
  Seed: TKAEMLESV (MAGA1_HUMAN)
TIAEMLESA

SEQ ID NO: 50064 - protein, 9 aa, Artificial Sequence
  Description of Artificial Sequence: Synthetic peptide
  Seed: VADLVGFLL (MAGA1_HUMAN)
VADLVGFLI

SEQ ID NO: 50065 - protein, 9 aa, Artificial Sequence
  Description of Artificial Sequence: Synthetic peptide
  Seed: SAFPTTINF (MAGA1_HUMAN)
STFPTTINV

SEQ ID NO: 50066 - protein, 9 aa, Artificial Sequence
  Description of Artificial Sequence: Synthetic peptide
  Seed: VSARVRFFF (MAGA1_HUMAN)
VVARVRFFW

SEQ ID NO: 50067 - protein, 10 aa, Artificial Sequence
  Description of Artificial Sequence: Synthetic peptide
  Seed: KEADPTGHSY (MAGA1_HUMAN)
KWADPTGHSF

SEQ ID NO: 50068 - protein, 9 aa, Artificial Sequence
  Description of Artificial Sequence: Synthetic peptide
  Seed: DSDPARYEF (MAGA1_HUMAN)
DADPARYEM

SEQ ID NO: 50069 - protein, 9 aa, Artificial Sequence
  Description of Artificial Sequence: Synthetic peptide
  Seed: SVMEVYDGR (MAGA1_HUMAN)
SQMEVYDGR

SEQ ID NO: 50070 - protein, 9 aa, Artificial Sequence
  Description of Artificial Sequence: Synthetic peptide
  Seed: KVLEYVIKV (MAGA1_HUMAN)
KALEYVIKV

SEQ ID NO: 50071 - protein, 10 aa, Artificial Sequence
  Description of Artificial Sequence: Synthetic peptide
  Seed: KEADPTGHSY (MAGA1_HUMAN)
KCADPTGHSW

SEQ ID NO: 50072 - protein, 9 aa, Artificial Sequence
  Description of Artificial Sequence: Synthetic peptide
  Seed: KVLEYVIKV (MAGA1_HUMAN)
KLLEYVIKK

SEQ ID NO: 50073 - protein, 9 aa, Artificial Sequence
  Description of Artificial Sequence: Synthetic peptide
  Seed: TSYVKVLEY (MAGA1_HUMAN)
TSYVKVLEK

SEQ ID NO: 50074 - protein, 10 aa, Artificial Sequence
  Description of Artificial Sequence: Synthetic peptide
  Seed: SCILESLFRA (MAGA1_HUMAN)
SQILESLFRL

SEQ ID NO: 50075 - protein, 9 aa, Artificial Sequence
  Description of Artificial Sequence: Synthetic peptide
  Seed: KVLEYVIKV (MAGA1_HUMAN)
KMLEYVIKT

SEQ ID NO: 50076 - protein, 9 aa, Artificial Sequence
  Description of Artificial Sequence: Synthetic peptide
  Seed: EELSVMEVY (MAGA1_HUMAN)
EQLSVMEVY

SEQ ID NO: 50077 - protein, 11 aa, Artificial Sequence
  Description of Artificial Sequence: Synthetic peptide
  Seed: RQVPDSDPARY (MAGA1_HUMAN)
RAVPDSDPARL

SEQ ID NO: 50078 - protein, 10 aa, Artificial Sequence
  Description of Artificial Sequence: Synthetic peptide
  Seed: LESLFRAVIT (MAGA1_HUMAN)
LESLFRAVIL

SEQ ID NO: 50079 - protein, 9 aa, Artificial Sequence
  Description of Artificial Sequence: Synthetic peptide
  Seed: LVTCLGLSY (MAGA1_HUMAN)
LKTCLGLSL

SEQ ID NO: 50080 - protein, 11 aa, Artificial Sequence
  Description of Artificial Sequence: Synthetic peptide
  Seed: RVRFFFPSLRE (MAGA1_HUMAN)
RTRFFFPSLRV

SEQ ID NO: 50081 - protein, 9 aa, Artificial Sequence
  Description of Artificial Sequence: Synthetic peptide
  Seed: KASESLQLV (MAGA1_HUMAN)
KGSESLQLY

SEQ ID NO: 50082 - protein, 9 aa, Artificial Sequence
  Description of Artificial Sequence: Synthetic peptide
  Seed: SAYGEPRKL (MAGA1_HUMAN)
SGYGEPRKF

SEQ ID NO: 50083 - protein, 10 aa, Artificial Sequence
  Description of Artificial Sequence: Synthetic peptide
  Seed: ADPTGHSYVL (MAGA1_HUMAN)
AIPTGHSYVL

SEQ ID NO: 50084 - protein, 9 aa, Artificial Sequence
  Description of Artificial Sequence: Synthetic peptide
  Seed: FFFPSLREA (MAGA1_HUMAN)
FMFPSLRES

SEQ ID NO: 50085 - protein, 9 aa, Artificial Sequence
  Description of Artificial Sequence: Synthetic peptide
  Seed: GKASESLQL (MAGA1_HUMAN)
GMASESLQF

SEQ ID NO: 50086 - protein, 9 aa, Artificial Sequence
  Description of Artificial Sequence: Synthetic peptide
  Seed: TKAEMLESV (MAGA1_HUMAN)
TMAEMLESL

SEQ ID NO: 50087 - protein, 9 aa, Artificial Sequence
  Description of Artificial Sequence: Synthetic peptide
  Seed: VSARVRFFF (MAGA1_HUMAN)
VMARVRFFW

SEQ ID NO: 50088 - protein, 11 aa, Artificial Sequence
  Description of Artificial Sequence: Synthetic peptide
  Seed: SAFPTTINFTR (MAGA1_HUMAN)
SSFPTTINFTK

SEQ ID NO: 50089 - protein, 10 aa, Artificial Sequence
  Description of Artificial Sequence: Synthetic peptide
  Seed: CILESLFRAV (MAGA1_HUMAN)
CILESLFRAA

SEQ ID NO: 50090 - protein, 9 aa, Artificial Sequence
  Description of Artificial Sequence: Synthetic peptide
  Seed: ETSYVKVLE (MAGA1_HUMAN)
EVSYVKVLY

SEQ ID NO: 50091 - protein, 9 aa, Artificial Sequence
  Description of Artificial Sequence: Synthetic peptide
  Seed: GTLEEVPTA (MAGA1_HUMAN)
GTLEEVPTI

SEQ ID NO: 50092 - protein, 11 aa, Artificial Sequence
  Description of Artificial Sequence: Synthetic peptide
  Seed: FPTTINFTRQR (MAGA1_HUMAN)
FNTTINFTRQR

SEQ ID NO: 50093 - protein, 10 aa, Artificial Sequence
  Description of Artificial Sequence: Synthetic peptide
  Seed: SESLQLVFGI (MAGA1_HUMAN)
SNSLQLVFGW

SEQ ID NO: 50094 - protein, 10 aa, Artificial Sequence
  Description of Artificial Sequence: Synthetic peptide
  Seed: RVRFFFPSLR (MAGA1_HUMAN)
RKRFFFPSLF

SEQ ID NO: 50095 - protein, 9 aa, Artificial Sequence
  Description of Artificial Sequence: Synthetic peptide
  Seed: RVRFFFPSL (MAGA1_HUMAN)
RYRFFFPSV

SEQ ID NO: 50096 - protein, 9 aa, Artificial Sequence
  Description of Artificial Sequence: Synthetic peptide
  Seed: VYDGREHSA (MAGA1_HUMAN)
VWDGREHSF

SEQ ID NO: 50097 - protein, 10 aa, Artificial Sequence
  Description of Artificial Sequence: Synthetic peptide
  Seed: TSYVKVLEYV (MAGA1_HUMAN)
TCYVKVLEYL

SEQ ID NO: 50098 - protein, 9 aa, Artificial Sequence
  Description of Artificial Sequence: Synthetic peptide
  Seed: HCFPEIFGK (MAGA1_HUMAN)
HMFPEIFGV

SEQ ID NO: 50099 - protein, 9 aa, Artificial Sequence
  Description of Artificial Sequence: Synthetic peptide
  Seed: RVRFFFPSL (MAGA1_HUMAN)
RRRFFFPSY

SEQ ID NO: 50100 - protein, 9 aa, Artificial Sequence
  Description of Artificial Sequence: Synthetic peptide
  Seed: SYVKVLEYV (MAGA1_HUMAN)
SWVKVLEYW

SEQ ID NO: 50101 - protein, 11 aa, Artificial Sequence
  Description of Artificial Sequence: Synthetic peptide
  Seed: KVSARVRFFFP (MAGA1_HUMAN)
KESARVRFFFK

SEQ ID NO: 50102 - protein, 9 aa, Artificial Sequence
  Description of Artificial Sequence: Synthetic peptide
  Seed: EHSAYGEPR (MAGA1_HUMAN)
EWSAYGEPR

SEQ ID NO: 50103 - protein, 9 aa, Artificial Sequence
  Description of Artificial Sequence: Synthetic peptide
  Seed: VRFFFPSLR (MAGA1_HUMAN)
VRFFFPSLK

SEQ ID NO: 50104 - protein, 9 aa, Artificial Sequence
  Description of Artificial Sequence: Synthetic peptide
  Seed: SAFPTTINF (MAGA1_HUMAN)
SFFPTTINW

SEQ ID NO: 50105 - protein, 11 aa, Artificial Sequence
  Description of Artificial Sequence: Synthetic peptide
  Seed: KEADPTGHSYV (MAGA1_HUMAN)
KEADPTGHSYF

SEQ ID NO: 50106 - protein, 9 aa, Artificial Sequence
  Description of Artificial Sequence: Synthetic peptide
  Seed: MSLEQRSLH (MAGA1_HUMAN)
MFLEQRSLY

SEQ ID NO: 50107 - protein, 10 aa, Artificial Sequence
  Description of Artificial Sequence: Synthetic peptide
  Seed: YEFLWGPRAL (MAGA1_HUMAN)
YHFLWGPRAI

SEQ ID NO: 50108 - protein, 10 aa, Artificial Sequence
  Description of Artificial Sequence: Synthetic peptide
  Seed: EIFGKASESL (MAGA1_HUMAN)
ETFGKASESR

SEQ ID NO: 50109 - protein, 9 aa, Artificial Sequence
  Description of Artificial Sequence: Synthetic peptide
  Seed: SLFRAVITK (MAGA1_HUMAN)
SMFRAVITL

SEQ ID NO: 50110 - protein, 10 aa, Artificial Sequence
  Description of Artificial Sequence: Synthetic peptide
  Seed: SSSPLVLGTL (MAGA1_HUMAN)
SVSPLVLGTY

SEQ ID NO: 50111 - protein, 9 aa, Artificial Sequence
  Description of Artificial Sequence: Synthetic peptide
  Seed: QSPQGASAF (MAGA1_HUMAN)
QMPQGASAM

SEQ ID NO: 50112 - protein, 9 aa, Artificial Sequence
  Description of Artificial Sequence: Synthetic peptide
  Seed: RALAETSYV (MAGA1_HUMAN)
RSLAETSYK

SEQ ID NO: 50113 - protein, 9 aa, Artificial Sequence
  Description of Artificial Sequence: Synthetic peptide
  Seed: IAMEGGHAP (MAGA1_HUMAN)
ITMEGGHAL

SEQ ID NO: 50114 - protein, 10 aa, Artificial Sequence
  Description of Artificial Sequence: Synthetic peptide
  Seed: ARVRFFFPSL (MAGA1_HUMAN)
ASVRFFFPSI

SEQ ID NO: 50115 - protein, 9 aa, Artificial Sequence
  Description of Artificial Sequence: Synthetic peptide
  Seed: KVSARVRFF (MAGA1_HUMAN)
KVSARVRFL

SEQ ID NO: 50116 - protein, 9 aa, Artificial Sequence
  Description of Artificial Sequence: Synthetic peptide
  Seed: FPTTINFTR (MAGA1_HUMAN)
FSTTINFTF

SEQ ID NO: 50117 - protein, 10 aa, Artificial Sequence
  Description of Artificial Sequence: Synthetic peptide
  Seed: RFFFPSLREA (MAGA1_HUMAN)
RIFFPSLREK

SEQ ID NO: 50118 - protein, 10 aa, Artificial Sequence
  Description of Artificial Sequence: Synthetic peptide
  Seed: KKVADLVGFL (MAGA1_HUMAN)
KMVADLVGFI

SEQ ID NO: 50119 - protein, 9 aa, Artificial Sequence
  Description of Artificial Sequence: Synthetic peptide
  Seed: STDPPQSPQ (MAGA1_HUMAN)
SYDPPQSPV

SEQ ID NO: 50120 - protein, 11 aa, Artificial Sequence
  Description of Artificial Sequence: Synthetic peptide
  Seed: IKVSARVRFFF (MAGA1_HUMAN)
IEVSARVRFFW

SEQ ID NO: 50121 - protein, 9 aa, Artificial Sequence
  Description of Artificial Sequence: Synthetic peptide
  Seed: HSYVLVTCL (MAGA1_HUMAN)
HRYVLVTCY

SEQ ID NO: 50122 - protein, 10 aa, Artificial Sequence
  Description of Artificial Sequence: Synthetic peptide
  Seed: SARVRFFFPS (MAGA1_HUMAN)
SKRVRFFFPI

SEQ ID NO: 50123 - protein, 11 aa, Artificial Sequence
  Description of Artificial Sequence: Synthetic peptide
  Seed: FLWGPRALAET (MAGA1_HUMAN)
FQWGPRALAEA

SEQ ID NO: 50124 - protein, 10 aa, Artificial Sequence
  Description of Artificial Sequence: Synthetic peptide
  Seed: SCILESLFRA (MAGA1_HUMAN)
SNILESLFRL

SEQ ID NO: 50125 - protein, 11 aa, Artificial Sequence
  Description of Artificial Sequence: Synthetic peptide
  Seed: RVRFFFPSLRE (MAGA1_HUMAN)
RRRFFFPSLRK

SEQ ID NO: 50126 - protein, 9 aa, Artificial Sequence
  Description of Artificial Sequence: Synthetic peptide
  Seed: TSSSSPLVL (MAGA1_HUMAN)
TTSSSPLVM

SEQ ID NO: 50127 - protein, 9 aa, Artificial Sequence
  Description of Artificial Sequence: Synthetic peptide
  Seed: QIMPKTGFL (MAGA1_HUMAN)
QFMPKTGFY

SEQ ID NO: 50128 - protein, 9 aa, Artificial Sequence
  Description of Artificial Sequence: Synthetic peptide
  Seed: VADLVGFLL (MAGA1_HUMAN)
VWDLVGFLF

SEQ ID NO: 50129 - protein, 10 aa, Artificial Sequence
  Description of Artificial Sequence: Synthetic peptide
  Seed: LLGDNQIMPK (MAGA1_HUMAN)
LTGDNQIMPK

SEQ ID NO: 50130 - protein, 11 aa, Artificial Sequence
  Description of Artificial Sequence: Synthetic peptide
  Seed: KEADPTGHSYV (MAGA1_HUMAN)
KQADPTGHSYL

SEQ ID NO: 50131 - protein, 9 aa, Artificial Sequence
  Description of Artificial Sequence: Synthetic peptide
  Seed: KVADLVGFL (MAGA1_HUMAN)
KVADLVGFR

SEQ ID NO: 50132 - protein, 9 aa, Artificial Sequence
  Description of Artificial Sequence: Synthetic peptide
  Seed: LKYRAREPV (MAGA1_HUMAN)
LHYRAREPF

SEQ ID NO: 50133 - protein, 9 aa, Artificial Sequence
  Description of Artificial Sequence: Synthetic peptide
  Seed: MPKTGFLII (MAGA1_HUMAN)
MSKTGFLIY

SEQ ID NO: 50134 - protein, 10 aa, Artificial Sequence
  Description of Artificial Sequence: Synthetic peptide
  Seed: RVRFFFPSLR (MAGA1_HUMAN)
RNRFFFPSLM

SEQ ID NO: 50135 - protein, 9 aa, Artificial Sequence
  Description of Artificial Sequence: Synthetic peptide
  Seed: KVLEYVIKV (MAGA1_HUMAN)
KVLEYVIKA

SEQ ID NO: 50136 - protein, 10 aa, Artificial Sequence
  Description of Artificial Sequence: Synthetic peptide
  Seed: RVRFFFPSLR (MAGA1_HUMAN)
RVRFFFPSLA

SEQ ID NO: 50137 - protein, 9 aa, Artificial Sequence
  Description of Artificial Sequence: Synthetic peptide
  Seed: AQQEALGLV (MAGA1_HUMAN)
AEQEALGLT

SEQ ID NO: 50138 - protein, 9 aa, Artificial Sequence
  Description of Artificial Sequence: Synthetic peptide
  Seed: FLWGPRALA (MAGA1_HUMAN)
FMWGPRALK

SEQ ID NO: 50139 - protein, 9 aa, Artificial Sequence
  Description of Artificial Sequence: Synthetic peptide
  Seed: RVRFFFPSL (MAGA1_HUMAN)
RLRFFFPSE

SEQ ID NO: 50140 - protein, 10 aa, Artificial Sequence
  Description of Artificial Sequence: Synthetic peptide
  Seed: CILESLFRAV (MAGA1_HUMAN)
CSLESLFRAV

SEQ ID NO: 50141 - protein, 9 aa, Artificial Sequence
  Description of Artificial Sequence: Synthetic peptide
  Seed: LESLFRAVI (MAGA1_HUMAN)
LISLFRAVY

SEQ ID NO: 50142 - protein, 9 aa, Artificial Sequence
  Description of Artificial Sequence: Synthetic peptide
  Seed: GTLEEVPTA (MAGA1_HUMAN)
GALEEVPTA

SEQ ID NO: 50143 - protein, 10 aa, Artificial Sequence
  Description of Artificial Sequence: Synthetic peptide
  Seed: SCILESLFRA (MAGA1_HUMAN)
SEILESLFRI

SEQ ID NO: 50144 - protein, 9 aa, Artificial Sequence
  Description of Artificial Sequence: Synthetic peptide
  Seed: RAREPVTKA (MAGA1_HUMAN)
RPREPVTKC

SEQ ID NO: 50145 - protein, 10 aa, Artificial Sequence
  Description of Artificial Sequence: Synthetic peptide
  Seed: SAFPTTINFT (MAGA1_HUMAN)
SAFPTTINFL

SEQ ID NO: 50146 - protein, 10 aa, Artificial Sequence
  Description of Artificial Sequence: Synthetic peptide
  Seed: MLESVIKNYK (MAGA1_HUMAN)
MLESVIKNYY

SEQ ID NO: 50147 - protein, 8 aa, Artificial Sequence
  Description of Artificial Sequence: Synthetic peptide
  Seed: RVRFFFPS (MAGA1_HUMAN)
RTRFFFPN

SEQ ID NO: 50148 - protein, 10 aa, Artificial Sequence
  Description of Artificial Sequence: Synthetic peptide
  Seed: REEEGPSTSC (MAGA1_HUMAN)
REEEGPSTSI

SEQ ID NO: 50149 - protein, 9 aa, Artificial Sequence
  Description of Artificial Sequence: Synthetic peptide
  Seed: DSDPARYEF (MAGA1_HUMAN)
DVDPARYEY

SEQ ID NO: 50150 - protein, 8 aa, Artificial Sequence
  Description of Artificial Sequence: Synthetic peptide
  Seed: RVRFFFPS (MAGA1_HUMAN)
RVRFFFPL

SEQ ID NO: 50151 - protein, 10 aa, Artificial Sequence
  Description of Artificial Sequence: Synthetic peptide
  Seed: RVRFFFPSLR (MAGA1_HUMAN)
RLRFFFPSLY

SEQ ID NO: 50152 - protein, 10 aa, Artificial Sequence
  Description of Artificial Sequence: Synthetic peptide
  Seed: RVRFFFPSLR (MAGA1_HUMAN)
RMRFFFPSLF

SEQ ID NO: 50153 - protein, 9 aa, Artificial Sequence
  Description of Artificial Sequence: Synthetic peptide
  Seed: GASAFPTTI (MAGA1_HUMAN)
GQSAFPTTM

SEQ ID NO: 50154 - protein, 9 aa, Artificial Sequence
  Description of Artificial Sequence: Synthetic peptide
  Seed: IMPKTGFLI (MAGA1_HUMAN)
IMPKTGFLF

SEQ ID NO: 50155 - protein, 9 aa, Artificial Sequence
  Description of Artificial Sequence: Synthetic peptide
  Seed: KTGFLIIVL (MAGA1_HUMAN)
KAGFLIIVF

SEQ ID NO: 50156 - protein, 10 aa, Artificial Sequence
  Description of Artificial Sequence: Synthetic peptide
  Seed: SCILESLFRA (MAGA1_HUMAN)
SYILESLFRI

SEQ ID NO: 50157 - protein, 10 aa, Artificial Sequence
  Description of Artificial Sequence: Synthetic peptide
  Seed: TSYVKVLEYV (MAGA1_HUMAN)
TYYVKVLEYF

SEQ ID NO: 50158 - protein, 9 aa, Artificial Sequence
  Description of Artificial Sequence: Synthetic peptide
  Seed: SYVKVLEYV (MAGA1_HUMAN)
SRVKVLEYM

SEQ ID NO: 50159 - protein, 8 aa, Artificial Sequence
  Description of Artificial Sequence: Synthetic peptide
  Seed: FFPSLREA (MAGA1_HUMAN)
FYPSLREF

SEQ ID NO: 50160 - protein, 9 aa, Artificial Sequence
  Description of Artificial Sequence: Synthetic peptide
  Seed: KASESLQLV (MAGA1_HUMAN)
KMSESLQLW

SEQ ID NO: 50161 - protein, 9 aa, Artificial Sequence
  Description of Artificial Sequence: Synthetic peptide
  Seed: IAMEGGHAP (MAGA1_HUMAN)
ITMEGGHAM

SEQ ID NO: 50162 - protein, 9 aa, Artificial Sequence
  Description of Artificial Sequence: Synthetic peptide
  Seed: VADLVGFLL (MAGA1_HUMAN)
VWDLVGFLM

SEQ ID NO: 50163 - protein, 9 aa, Artificial Sequence
  Description of Artificial Sequence: Synthetic peptide
  Seed: RVRFFFPSL (MAGA1_HUMAN)
RSRFFFPST

SEQ ID NO: 50164 - protein, 10 aa, Artificial Sequence
  Description of Artificial Sequence: Synthetic peptide
  Seed: RVRFFFPSLR (MAGA1_HUMAN)
RVRFFFPSLH

SEQ ID NO: 50165 - protein, 9 aa, Artificial Sequence
  Description of Artificial Sequence: Synthetic peptide
  Seed: YVLVTCLGL (MAGA1_HUMAN)
YALVTCLGV

SEQ ID NO: 50166 - protein, 9 aa, Artificial Sequence
  Description of Artificial Sequence: Synthetic peptide
  Seed: YVLVTCLGL (MAGA1_HUMAN)
YLLVTCLGF

SEQ ID NO: 50167 - protein, 10 aa, Artificial Sequence
  Description of Artificial Sequence: Synthetic peptide
  Seed: YEFLWGPRAL (MAGA1_HUMAN)
YMFLWGPRAY

SEQ ID NO: 50168 - protein, 9 aa, Artificial Sequence
  Description of Artificial Sequence: Synthetic peptide
  Seed: LVQEKYLEY (MAGA1_HUMAN)
LIQEKYLEW

SEQ ID NO: 50169 - protein, 9 aa, Artificial Sequence
  Description of Artificial Sequence: Synthetic peptide
  Seed: LESLFRAVI (MAGA1_HUMAN)
LGSLFRAVF

SEQ ID NO: 50170 - protein, 9 aa, Artificial Sequence
  Description of Artificial Sequence: Synthetic peptide
  Seed: KVADLVGFL (MAGA1_HUMAN)
KSADLVGFV

SEQ ID NO: 50171 - protein, 9 aa, Artificial Sequence
  Description of Artificial Sequence: Synthetic peptide
  Seed: RVRFFFPSL (MAGA1_HUMAN)
RSRFFFPSK

SEQ ID NO: 50172 - protein, 9 aa, Artificial Sequence
  Description of Artificial Sequence: Synthetic peptide
  Seed: GASAFPTTI (MAGA1_HUMAN)
GLSAFPTTM

SEQ ID NO: 50173 - protein, 10 aa, Artificial Sequence
  Description of Artificial Sequence: Synthetic peptide
  Seed: FFPSLREAAL (MAGA1_HUMAN)
FKPSLREAAF

SEQ ID NO: 50174 - protein, 9 aa, Artificial Sequence
  Description of Artificial Sequence: Synthetic peptide
  Seed: YKHCFPEIF (MAGA1_HUMAN)
YLHCFPEIF

SEQ ID NO: 50175 - protein, 9 aa, Artificial Sequence
  Description of Artificial Sequence: Synthetic peptide
  Seed: KASESLQLV (MAGA1_HUMAN)
KVSESLQLW

SEQ ID NO: 50176 - protein, 9 aa, Artificial Sequence
  Description of Artificial Sequence: Synthetic peptide
  Seed: TSCILESLF (MAGA1_HUMAN)
TMCILESLW

SEQ ID NO: 50177 - protein, 9 aa, Artificial Sequence
  Description of Artificial Sequence: Synthetic peptide
  Seed: KASESLQLV (MAGA1_HUMAN)
KASESLQLF

SEQ ID NO: 50178 - protein, 11 aa, Artificial Sequence
  Description of Artificial Sequence: Synthetic peptide
  Seed: MEVYDGREHSA (MAGA1_HUMAN)
MEVYDGREHSM

SEQ ID NO: 50179 - protein, 9 aa, Artificial Sequence
  Description of Artificial Sequence: Synthetic peptide
  Seed: TQDLVQEKY (MAGA1_HUMAN)
TLDLVQEKI

SEQ ID NO: 50180 - protein, 10 aa, Artificial Sequence
  Description of Artificial Sequence: Synthetic peptide
  Seed: AQQEALGLVC (MAGA1_HUMAN)
AEQEALGLVA

SEQ ID NO: 50181 - protein, 9 aa, Artificial Sequence
  Description of Artificial Sequence: Synthetic peptide
  Seed: SSSPLVLGT (MAGA1_HUMAN)
STSPLVLGA

SEQ ID NO: 50182 - protein, 10 aa, Artificial Sequence
  Description of Artificial Sequence: Synthetic peptide
  Seed: KEADPTGHSY (MAGA1_HUMAN)
KRADPTGHSY

SEQ ID NO: 50183 - protein, 9 aa, Artificial Sequence
  Description of Artificial Sequence: Synthetic peptide
  Seed: SAFPTTINF (MAGA1_HUMAN)
SIFPTTINM

SEQ ID NO: 50184 - protein, 10 aa, Artificial Sequence
  Description of Artificial Sequence: Synthetic peptide
  Seed: KEADPTGHSY (MAGA1_HUMAN)
KLADPTGHSY

SEQ ID NO: 50185 - protein, 11 aa, Artificial Sequence
  Description of Artificial Sequence: Synthetic peptide
  Seed: CILESLFRAVI (MAGA1_HUMAN)
CLLESLFRAVA

SEQ ID NO: 50186 - protein, 9 aa, Artificial Sequence
  Description of Artificial Sequence: Synthetic peptide
  Seed: KASESLQLV (MAGA1_HUMAN)
KLSESLQLM

SEQ ID NO: 50187 - protein, 9 aa, Artificial Sequence
  Description of Artificial Sequence: Synthetic peptide
  Seed: SAYGEPRKL (MAGA1_HUMAN)
SAYGEPRKY

SEQ ID NO: 50188 - protein, 9 aa, Artificial Sequence
  Description of Artificial Sequence: Synthetic peptide
  Seed: KVLEYVIKV (MAGA1_HUMAN)
KQLEYVIKR

SEQ ID NO: 50189 - protein, 11 aa, Artificial Sequence
  Description of Artificial Sequence: Synthetic peptide
  Seed: ARVRFFFPSLR (MAGA1_HUMAN)
AVVRFFFPSLR

SEQ ID NO: 50190 - protein, 9 aa, Artificial Sequence
  Description of Artificial Sequence: Synthetic peptide
  Seed: VIKNYKHCF (MAGA1_HUMAN)
VAKNYKHCY

SEQ ID NO: 50191 - protein, 9 aa, Artificial Sequence
  Description of Artificial Sequence: Synthetic peptide
  Seed: REPVTKAEM (MAGA1_HUMAN)
RMPVTKAEY

SEQ ID NO: 50192 - protein, 9 aa, Artificial Sequence
  Description of Artificial Sequence: Synthetic peptide
  Seed: KVSARVRFF (MAGA1_HUMAN)
KSSARVRFF

SEQ ID NO: 50193 - protein, 10 aa, Artificial Sequence
  Description of Artificial Sequence: Synthetic peptide
  Seed: EADPTGHSYV (MAGA1_HUMAN)
ETDPTGHSYL

SEQ ID NO: 50194 - protein, 9 aa, Artificial Sequence
  Description of Artificial Sequence: Synthetic peptide
  Seed: GLLGDNQIM (MAGA1_HUMAN)
GQLGDNQIL

SEQ ID NO: 50195 - protein, 11 aa, Artificial Sequence
  Description of Artificial Sequence: Synthetic peptide
  Seed: RQVPDSDPARY (MAGA1_HUMAN)
RQVPDSDPARI

SEQ ID NO: 50196 - protein, 10 aa, Artificial Sequence
  Description of Artificial Sequence: Synthetic peptide
  Seed: KYRAREPVTK (MAGA1_HUMAN)
KTRAREPVTL

SEQ ID NO: 50197 - protein, 9 aa, Artificial Sequence
  Description of Artificial Sequence: Synthetic peptide
  Seed: MPKTGFLII (MAGA1_HUMAN)
MPKTGFLIT

SEQ ID NO: 50198 - protein, 9 aa, Artificial Sequence
  Description of Artificial Sequence: Synthetic peptide
  Seed: LVLGTLEEV (MAGA1_HUMAN)
LMLGTLEET

SEQ ID NO: 50199 - protein, 10 aa, Artificial Sequence
  Description of Artificial Sequence: Synthetic peptide
  Seed: KVADLVGFLL (MAGA1_HUMAN)
KRADLVGFLW

SEQ ID NO: 50200 - protein, 9 aa, Artificial Sequence
  Description of Artificial Sequence: Synthetic peptide
  Seed: TSSSSPLVL (MAGA1_HUMAN)
TKSSSPLVM

SEQ ID NO: 50201 - protein, 9 aa, Artificial Sequence
  Description of Artificial Sequence: Synthetic peptide
  Seed: STSCILESL (MAGA1_HUMAN)
SISCILESW

SEQ ID NO: 50202 - protein, 10 aa, Artificial Sequence
  Description of Artificial Sequence: Synthetic peptide
  Seed: SARVRFFFPS (MAGA1_HUMAN)
SARVRFFFPY

SEQ ID NO: 50203 - protein, 9 aa, Artificial Sequence
  Description of Artificial Sequence: Synthetic peptide
  Seed: SAFPTTINF (MAGA1_HUMAN)
SMFPTTINK

SEQ ID NO: 50204 - protein, 9 aa, Artificial Sequence
  Description of Artificial Sequence: Synthetic peptide
  Seed: DLVGFLLLK (MAGA1_HUMAN)
DMVGFLLLR

SEQ ID NO: 50205 - protein, 10 aa, Artificial Sequence
  Description of Artificial Sequence: Synthetic peptide
  Seed: EYVIKVSARV (MAGA1_HUMAN)
ERVIKVSARV

SEQ ID NO: 50206 - protein, 9 aa, Artificial Sequence
  Description of Artificial Sequence: Synthetic peptide
  Seed: FPTTINFTR (MAGA1_HUMAN)
FTTTINFTK

SEQ ID NO: 50207 - protein, 10 aa, Artificial Sequence
  Description of Artificial Sequence: Synthetic peptide
  Seed: KNYKHCFPEI (MAGA1_HUMAN)
KYYKHCFPEF

SEQ ID NO: 50208 - protein, 9 aa, Artificial Sequence
  Description of Artificial Sequence: Synthetic peptide
  Seed: STDPPQSPQ (MAGA1_HUMAN)
SMDPPQSPI

SEQ ID NO: 50209 - protein, 10 aa, Artificial Sequence
  Description of Artificial Sequence: Synthetic peptide
  Seed: LVGFLLLKYR (MAGA1_HUMAN)
LYGFLLLKYR

SEQ ID NO: 50210 - protein, 10 aa, Artificial Sequence
  Description of Artificial Sequence: Synthetic peptide
  Seed: REAALREEEE (MAGA1_HUMAN)
REAALREEEV

SEQ ID NO: 50211 - protein, 10 aa, Artificial Sequence
  Description of Artificial Sequence: Synthetic peptide
  Seed: DLVQEKYLEY (MAGA1_HUMAN)
DTVQEKYLEY

SEQ ID NO: 50212 - protein, 10 aa, Artificial Sequence
  Description of Artificial Sequence: Synthetic peptide
  Seed: TSYVKVLEYV (MAGA1_HUMAN)
TEYVKVLEYF

SEQ ID NO: 50213 - protein, 9 aa, Artificial Sequence
  Description of Artificial Sequence: Synthetic peptide
  Seed: ASESLQLVF (MAGA1_HUMAN)
AKESLQLVY

SEQ ID NO: 50214 - protein, 11 aa, Artificial Sequence
  Description of Artificial Sequence: Synthetic peptide
  Seed: KVADLVGFLLL (MAGA1_HUMAN)
KMADLVGFLLK

SEQ ID NO: 50215 - protein, 9 aa, Artificial Sequence
  Description of Artificial Sequence: Synthetic peptide
  Seed: SAFPTTINF (MAGA1_HUMAN)
SAFPTTINY

SEQ ID NO: 50216 - protein, 9 aa, Artificial Sequence
  Description of Artificial Sequence: Synthetic peptide
  Seed: KVLEYVIKV (MAGA1_HUMAN)
KMLEYVIKA

SEQ ID NO: 50217 - protein, 9 aa, Artificial Sequence
  Description of Artificial Sequence: Synthetic peptide
  Seed: KASESLQLV (MAGA1_HUMAN)
KMSESLQLY

SEQ ID NO: 50218 - protein, 10 aa, Artificial Sequence
  Description of Artificial Sequence: Synthetic peptide
  Seed: KNYKHCFPEI (MAGA1_HUMAN)
KCYKHCFPEF

SEQ ID NO: 50219 - protein, 9 aa, Artificial Sequence
  Description of Artificial Sequence: Synthetic peptide
  Seed: SSPLVLGTL (MAGA1_HUMAN)
SPPLVLGTI

SEQ ID NO: 50220 - protein, 10 aa, Artificial Sequence
  Description of Artificial Sequence: Synthetic peptide
  Seed: LSVMEVYDGR (MAGA1_HUMAN)
LAVMEVYDGR

SEQ ID NO: 50221 - protein, 10 aa, Artificial Sequence
  Description of Artificial Sequence: Synthetic peptide
  Seed: KASESLQLVF (MAGA1_HUMAN)
KQSESLQLVF

SEQ ID NO: 50222 - protein, 9 aa, Artificial Sequence
  Description of Artificial Sequence: Synthetic peptide
  Seed: SAFPTTINF (MAGA1_HUMAN)
SSFPTTINH

SEQ ID NO: 50223 - protein, 10 aa, Artificial Sequence
  Description of Artificial Sequence: Synthetic peptide
  Seed: KEADPTGHSY (MAGA1_HUMAN)
KDADPTGHSW

SEQ ID NO: 50224 - protein, 10 aa, Artificial Sequence
  Description of Artificial Sequence: Synthetic peptide
  Seed: RVRFFFPSLR (MAGA1_HUMAN)
RLRFFFPSLR

SEQ ID NO: 50225 - protein, 10 aa, Artificial Sequence
  Description of Artificial Sequence: Synthetic peptide
  Seed: EALGLVCVQA (MAGA1_HUMAN)
EALGLVCVQV

SEQ ID NO: 50226 - protein, 10 aa, Artificial Sequence
  Description of Artificial Sequence: Synthetic peptide
  Seed: EVYDGREHSA (MAGA1_HUMAN)
ETYDGREHSF

SEQ ID NO: 50227 - protein, 9 aa, Artificial Sequence
  Description of Artificial Sequence: Synthetic peptide
  Seed: TSYVKVLEY (MAGA1_HUMAN)
TQYVKVLER

SEQ ID NO: 50228 - protein, 11 aa, Artificial Sequence
  Description of Artificial Sequence: Synthetic peptide
  Seed: YEFLWGPRALA (MAGA1_HUMAN)
YIFLWGPRALV

SEQ ID NO: 50229 - protein, 9 aa, Artificial Sequence
  Description of Artificial Sequence: Synthetic peptide
  Seed: STSCILESL (MAGA1_HUMAN)
SISCILESA

SEQ ID NO: 50230 - protein, 9 aa, Artificial Sequence
  Description of Artificial Sequence: Synthetic peptide
  Seed: TKAEMLESV (MAGA1_HUMAN)
TYAEMLESL

SEQ ID NO: 50231 - protein, 9 aa, Artificial Sequence
  Description of Artificial Sequence: Synthetic peptide
  Seed: KVSARVRFF (MAGA1_HUMAN)
KSSARVRFY

SEQ ID NO: 50232 - protein, 10 aa, Artificial Sequence
  Description of Artificial Sequence: Synthetic peptide
  Seed: EIFGKASESL (MAGA1_HUMAN)
EIFGKASESI

SEQ ID NO: 50233 - protein, 8 aa, Artificial Sequence
  Description of Artificial Sequence: Synthetic peptide
  Seed: RVRFFFPS (MAGA1_HUMAN)
RTRFFFPG

SEQ ID NO: 50234 - protein, 10 aa, Artificial Sequence
  Description of Artificial Sequence: Synthetic peptide
  Seed: TSYVKVLEYV (MAGA1_HUMAN)
TIYVKVLEYF

SEQ ID NO: 50235 - protein, 9 aa, Artificial Sequence
  Description of Artificial Sequence: Synthetic peptide
  Seed: RVRFFFPSL (MAGA1_HUMAN)
RLRFFFPSQ

SEQ ID NO: 50236 - protein, 9 aa, Artificial Sequence
  Description of Artificial Sequence: Synthetic peptide
  Seed: LVQEKYLEY (MAGA1_HUMAN)
LLQEKYLEK

SEQ ID NO: 50237 - protein, 9 aa, Artificial Sequence
  Description of Artificial Sequence: Synthetic peptide
  Seed: VYDGREHSA (MAGA1_HUMAN)
VTDGREHSM

SEQ ID NO: 50238 - protein, 9 aa, Artificial Sequence
  Description of Artificial Sequence: Synthetic peptide
  Seed: GTLEEVPTA (MAGA1_HUMAN)
GSLEEVPTV

SEQ ID NO: 50239 - protein, 9 aa, Artificial Sequence
  Description of Artificial Sequence: Synthetic peptide
  Seed: YRAREPVTK (MAGA1_HUMAN)
YRAREPVTF

SEQ ID NO: 50240 - protein, 9 aa, Artificial Sequence
  Description of Artificial Sequence: Synthetic peptide
  Seed: YVIKVSARV (MAGA1_HUMAN)
YSIKVSARF

SEQ ID NO: 50241 - protein, 10 aa, Artificial Sequence
  Description of Artificial Sequence: Synthetic peptide
  Seed: KEADPTGHSY (MAGA1_HUMAN)
KEADPTGHSC

SEQ ID NO: 50242 - protein, 10 aa, Artificial Sequence
  Description of Artificial Sequence: Synthetic peptide
  Seed: SCILESLFRA (MAGA1_HUMAN)
STILESLFRV

SEQ ID NO: 50243 - protein, 9 aa, Artificial Sequence
  Description of Artificial Sequence: Synthetic peptide
  Seed: TSYVKVLEY (MAGA1_HUMAN)
TVYVKVLEK

SEQ ID NO: 50244 - protein, 9 aa, Artificial Sequence
  Description of Artificial Sequence: Synthetic peptide
  Seed: SARVRFFFP (MAGA1_HUMAN)
SYRVRFFFR

SEQ ID NO: 50245 - protein, 9 aa, Artificial Sequence
  Description of Artificial Sequence: Synthetic peptide
  Seed: RQVPDSDPA (MAGA1_HUMAN)
REVPDSDPY

SEQ ID NO: 50246 - protein, 10 aa, Artificial Sequence
  Description of Artificial Sequence: Synthetic peptide
  Seed: SARVRFFFPS (MAGA1_HUMAN)
SIRVRFFFPA

SEQ ID NO: 50247 - protein, 9 aa, Artificial Sequence
  Description of Artificial Sequence: Synthetic peptide
  Seed: SYVKVLEYV (MAGA1_HUMAN)
SLVKVLEYV

SEQ ID NO: 50248 - protein, 10 aa, Artificial Sequence
  Description of Artificial Sequence: Synthetic peptide
  Seed: RVRFFFPSLR (MAGA1_HUMAN)
RSRFFFPSLQ

SEQ ID NO: 50249 - protein, 9 aa, Artificial Sequence
  Description of Artificial Sequence: Synthetic peptide
  Seed: MIAMEGGHA (MAGA1_HUMAN)
MMAMEGGHA

SEQ ID NO: 50250 - protein, 9 aa, Artificial Sequence
  Description of Artificial Sequence: Synthetic peptide
  Seed: TSYVKVLEY (MAGA1_HUMAN)
TIYVKVLEL

SEQ ID NO: 50251 - protein, 9 aa, Artificial Sequence
  Description of Artificial Sequence: Synthetic peptide
  Seed: KVLEYVIKV (MAGA1_HUMAN)
KWLEYVIKF

SEQ ID NO: 50252 - protein, 9 aa, Artificial Sequence
  Description of Artificial Sequence: Synthetic peptide
  Seed: YVKVLEYVI (MAGA1_HUMAN)
YLKVLEYVV

SEQ ID NO: 50253 - protein, 9 aa, Artificial Sequence
  Description of Artificial Sequence: Synthetic peptide
  Seed: TKAEMLESV (MAGA1_HUMAN)
TMAEMLESA

SEQ ID NO: 50254 - protein, 9 aa, Artificial Sequence
  Description of Artificial Sequence: Synthetic peptide
  Seed: LVTCLGLSY (MAGA1_HUMAN)
LPTCLGLSY

SEQ ID NO: 50255 - protein, 9 aa, Artificial Sequence
  Description of Artificial Sequence: Synthetic peptide
  Seed: RVRFFFPSL (MAGA1_HUMAN)
RGRFFFPSA

SEQ ID NO: 50256 - protein, 10 aa, Artificial Sequence
  Description of Artificial Sequence: Synthetic peptide
  Seed: SCILESLFRA (MAGA1_HUMAN)
SLILESLFRA

SEQ ID NO: 50257 - protein, 9 aa, Artificial Sequence
  Description of Artificial Sequence: Synthetic peptide
  Seed: LVQEKYLEY (MAGA1_HUMAN)
LAQEKYLEI

SEQ ID NO: 50258 - protein, 9 aa, Artificial Sequence
  Description of Artificial Sequence: Synthetic peptide
  Seed: FFFPSLREA (MAGA1_HUMAN)
FQFPSLREI

SEQ ID NO: 50259 - protein, 9 aa, Artificial Sequence
  Description of Artificial Sequence: Synthetic peptide
  Seed: KVLEYVIKV (MAGA1_HUMAN)
KQLEYVIKV

SEQ ID NO: 50260 - protein, 10 aa, Artificial Sequence
  Description of Artificial Sequence: Synthetic peptide
  Seed: ADPTGHSYVL (MAGA1_HUMAN)
ALPTGHSYVL

SEQ ID NO: 50261 - protein, 10 aa, Artificial Sequence
  Description of Artificial Sequence: Synthetic peptide
  Seed: KVADLVGFLL (MAGA1_HUMAN)
KLADLVGFLY

SEQ ID NO: 50262 - protein, 9 aa, Artificial Sequence
  Description of Artificial Sequence: Synthetic peptide
  Seed: SAYGEPRKL (MAGA1_HUMAN)
SGYGEPRKM

SEQ ID NO: 50263 - protein, 9 aa, Artificial Sequence
  Description of Artificial Sequence: Synthetic peptide
  Seed: RAREPVTKA (MAGA1_HUMAN)
RIREPVTKV

SEQ ID NO: 50264 - protein, 9 aa, Artificial Sequence
  Description of Artificial Sequence: Synthetic peptide
  Seed: VYDGREHSA (MAGA1_HUMAN)
VIDGREHSM

SEQ ID NO: 50265 - protein, 11 aa, Artificial Sequence
  Description of Artificial Sequence: Synthetic peptide
  Seed: KVADLVGFLLL (MAGA1_HUMAN)
KTADLVGFLLW

SEQ ID NO: 50266 - protein, 9 aa, Artificial Sequence
  Description of Artificial Sequence: Synthetic peptide
  Seed: VRFFFPSLR (MAGA1_HUMAN)
VSFFFPSLK

SEQ ID NO: 50267 - protein, 10 aa, Artificial Sequence
  Description of Artificial Sequence: Synthetic peptide
  Seed: FFPSLREAAL (MAGA1_HUMAN)
FQPSLREAAL

SEQ ID NO: 50268 - protein, 10 aa, Artificial Sequence
  Description of Artificial Sequence: Synthetic peptide
  Seed: ESLFRAVITK (MAGA1_HUMAN)
EYLFRAVITR

SEQ ID NO: 50269 - protein, 10 aa, Artificial Sequence
  Description of Artificial Sequence: Synthetic peptide
  Seed: KEADPTGHSY (MAGA1_HUMAN)
KMADPTGHSL

SEQ ID NO: 50270 - protein, 9 aa, Artificial Sequence
  Description of Artificial Sequence: Synthetic peptide
  Seed: VADLVGFLL (MAGA1_HUMAN)
VGDLVGFLM

SEQ ID NO: 50271 - protein, 9 aa, Artificial Sequence
  Description of Artificial Sequence: Synthetic peptide
  Seed: RAREPVTKA (MAGA1_HUMAN)
RTREPVTKY

SEQ ID NO: 50272 - protein, 10 aa, Artificial Sequence
  Description of Artificial Sequence: Synthetic peptide
  Seed: SCILESLFRA (MAGA1_HUMAN)
SMILESLFRM

SEQ ID NO: 50273 - protein, 9 aa, Artificial Sequence
  Description of Artificial Sequence: Synthetic peptide
  Seed: TSSSSPLVL (MAGA1_HUMAN)
TQSSSPLVY

SEQ ID NO: 50274 - protein, 10 aa, Artificial Sequence
  Description of Artificial Sequence: Synthetic peptide
  Seed: KVSARVRFFF (MAGA1_HUMAN)
KMSARVRFFW

SEQ ID NO: 50275 - protein, 9 aa, Artificial Sequence
  Description of Artificial Sequence: Synthetic peptide
  Seed: RVRFFFPSL (MAGA1_HUMAN)
RGRFFFPSI

SEQ ID NO: 50276 - protein, 10 aa, Artificial Sequence
  Description of Artificial Sequence: Synthetic peptide
  Seed: SSSPLVLGTL (MAGA1_HUMAN)
SMSPLVLGTI

SEQ ID NO: 50277 - protein, 9 aa, Artificial Sequence
  Description of Artificial Sequence: Synthetic peptide
  Seed: GLVCVQAAT (MAGA1_HUMAN)
GAVCVQAAV

SEQ ID NO: 50278 - protein, 9 aa, Artificial Sequence
  Description of Artificial Sequence: Synthetic peptide
  Seed: LTQDLVQEK (MAGA1_HUMAN)
LTQDLVQEF

SEQ ID NO: 50279 - protein, 10 aa, Artificial Sequence
  Description of Artificial Sequence: Synthetic peptide
  Seed: RVRFFFPSLR (MAGA1_HUMAN)
RIRFFFPSLM

SEQ ID NO: 50280 - protein, 10 aa, Artificial Sequence
  Description of Artificial Sequence: Synthetic peptide
  Seed: DLVGFLLLKY (MAGA1_HUMAN)
DLVGFLLLKR

SEQ ID NO: 50281 - protein, 9 aa, Artificial Sequence
  Description of Artificial Sequence: Synthetic peptide
  Seed: LFRAVITKK (MAGA1_HUMAN)
LTRAVITKV

SEQ ID NO: 50282 - protein, 9 aa, Artificial Sequence
  Description of Artificial Sequence: Synthetic peptide
  Seed: QSPQGASAF (MAGA1_HUMAN)
QTPQGASAL

SEQ ID NO: 50283 - protein, 9 aa, Artificial Sequence
  Description of Artificial Sequence: Synthetic peptide
  Seed: SYVKVLEYV (MAGA1_HUMAN)
SQVKVLEYI

SEQ ID NO: 50284 - protein, 9 aa, Artificial Sequence
  Description of Artificial Sequence: Synthetic peptide
  Seed: QQEALGLVC (MAGA1_HUMAN)
QEEALGLVM

SEQ ID NO: 50285 - protein, 9 aa, Artificial Sequence
  Description of Artificial Sequence: Synthetic peptide
  Seed: KVLEYVIKV (MAGA1_HUMAN)
KSLEYVIKM

SEQ ID NO: 50286 - protein, 9 aa, Artificial Sequence
  Description of Artificial Sequence: Synthetic peptide
  Seed: HCFPEIFGK (MAGA1_HUMAN)
HAFPEIFGM

SEQ ID NO: 50287 - protein, 10 aa, Artificial Sequence
  Description of Artificial Sequence: Synthetic peptide
  Seed: RVRFFFPSLR (MAGA1_HUMAN)
RSRFFFPSLI

SEQ ID NO: 50288 - protein, 11 aa, Artificial Sequence
  Description of Artificial Sequence: Synthetic peptide
  Seed: IKVSARVRFFF (MAGA1_HUMAN)
IQVSARVRFFW

SEQ ID NO: 50289 - protein, 10 aa, Artificial Sequence
  Description of Artificial Sequence: Synthetic peptide
  Seed: ESLFRAVITK (MAGA1_HUMAN)
ERLFRAVITK

SEQ ID NO: 50290 - protein, 10 aa, Artificial Sequence
  Description of Artificial Sequence: Synthetic peptide
  Seed: ETSYVKVLEY (MAGA1_HUMAN)
EISYVKVLER

SEQ ID NO: 50291 - protein, 10 aa, Artificial Sequence
  Description of Artificial Sequence: Synthetic peptide
  Seed: FFPSLREAAL (MAGA1_HUMAN)
FGPSLREAAF

SEQ ID NO: 50292 - protein, 9 aa, Artificial Sequence
  Description of Artificial Sequence: Synthetic peptide
  Seed: LVLGTLEEV (MAGA1_HUMAN)
LTLGTLEEI

SEQ ID NO: 50293 - protein, 9 aa, Artificial Sequence
  Description of Artificial Sequence: Synthetic peptide
  Seed: FPSLREAAL (MAGA1_HUMAN)
FASLREAAL

SEQ ID NO: 50294 - protein, 9 aa, Artificial Sequence
  Description of Artificial Sequence: Synthetic peptide
  Seed: IMPKTGFLI (MAGA1_HUMAN)
IWPKTGFLI

SEQ ID NO: 50295 - protein, 9 aa, Artificial Sequence
  Description of Artificial Sequence: Synthetic peptide
  Seed: TSCILESLF (MAGA1_HUMAN)
TGCILESLW

SEQ ID NO: 50296 - protein, 9 aa, Artificial Sequence
  Description of Artificial Sequence: Synthetic peptide
  Seed: VYDGREHSA (MAGA1_HUMAN)
VHDGREHSL

SEQ ID NO: 50297 - protein, 10 aa, Artificial Sequence
  Description of Artificial Sequence: Synthetic peptide
  Seed: ARYEFLWGPR (MAGA1_HUMAN)
AWYEFLWGPK

SEQ ID NO: 50298 - protein, 9 aa, Artificial Sequence
  Description of Artificial Sequence: Synthetic peptide
  Seed: SARVRFFFP (MAGA1_HUMAN)
SIRVRFFFK

SEQ ID NO: 50299 - protein, 9 aa, Artificial Sequence
  Description of Artificial Sequence: Synthetic peptide
  Seed: KASESLQLV (MAGA1_HUMAN)
KASESLQLM

SEQ ID NO: 50300 - protein, 9 aa, Artificial Sequence
  Description of Artificial Sequence: Synthetic peptide
  Seed: TGFLIIVLV (MAGA1_HUMAN)
TAFLIIVLV

SEQ ID NO: 50301 - protein, 9 aa, Artificial Sequence
  Description of Artificial Sequence: Synthetic peptide
  Seed: HSYVLVTCL (MAGA1_HUMAN)
HQYVLVTCV

SEQ ID NO: 50302 - protein, 9 aa, Artificial Sequence
  Description of Artificial Sequence: Synthetic peptide
  Seed: TQDLVQEKY (MAGA1_HUMAN)
TSDLVQEKY

SEQ ID NO: 50303 - protein, 9 aa, Artificial Sequence
  Description of Artificial Sequence: Synthetic peptide
  Seed: ASESLQLVF (MAGA1_HUMAN)
ATESLQLVF

SEQ ID NO: 50304 - protein, 9 aa, Artificial Sequence
  Description of Artificial Sequence: Synthetic peptide
  Seed: LVLGTLEEV (MAGA1_HUMAN)
LLLGTLEEI

SEQ ID NO: 50305 - protein, 10 aa, Artificial Sequence
  Description of Artificial Sequence: Synthetic peptide
  Seed: YEFLWGPRAL (MAGA1_HUMAN)
YEFLWGPRAY

SEQ ID NO: 50306 - protein, 9 aa, Artificial Sequence
  Description of Artificial Sequence: Synthetic peptide
  Seed: IAMEGGHAP (MAGA1_HUMAN)
ISMEGGHAI

SEQ ID NO: 50307 - protein, 9 aa, Artificial Sequence
  Description of Artificial Sequence: Synthetic peptide
  Seed: AATSSSSPL (MAGA1_HUMAN)
AETSSSSPY

SEQ ID NO: 50308 - protein, 9 aa, Artificial Sequence
  Description of Artificial Sequence: Synthetic peptide
  Seed: KTGFLIIVL (MAGA1_HUMAN)
KTGFLIIVY

SEQ ID NO: 50309 - protein, 9 aa, Artificial Sequence
  Description of Artificial Sequence: Synthetic peptide
  Seed: EEEGPSTSC (MAGA1_HUMAN)
EEEGPSTSV

SEQ ID NO: 50310 - protein, 9 aa, Artificial Sequence
  Description of Artificial Sequence: Synthetic peptide
  Seed: KVLEYVIKV (MAGA1_HUMAN)
KQLEYVIKT

SEQ ID NO: 50311 - protein, 9 aa, Artificial Sequence
  Description of Artificial Sequence: Synthetic peptide
  Seed: VSARVRFFF (MAGA1_HUMAN)
VAARVRFFW

SEQ ID NO: 50312 - protein, 9 aa, Artificial Sequence
  Description of Artificial Sequence: Synthetic peptide
  Seed: KVLEYVIKV (MAGA1_HUMAN)
KLLEYVIKT

SEQ ID NO: 50313 - protein, 9 aa, Artificial Sequence
  Description of Artificial Sequence: Synthetic peptide
  Seed: SLHCKPEEA (MAGA1_HUMAN)
SQHCKPEEV

SEQ ID NO: 50314 - protein, 11 aa, Artificial Sequence
  Description of Artificial Sequence: Synthetic peptide
  Seed: SSSSPLVLGTL (MAGA1_HUMAN)
SGSSPLVLGTW

SEQ ID NO: 50315 - protein, 9 aa, Artificial Sequence
  Description of Artificial Sequence: Synthetic peptide
  Seed: VADLVGFLL (MAGA1_HUMAN)
VSDLVGFLF

SEQ ID NO: 50316 - protein, 9 aa, Artificial Sequence
  Description of Artificial Sequence: Synthetic peptide
  Seed: VQAATSSSS (MAGA1_HUMAN)
VMAATSSSW

SEQ ID NO: 50317 - protein, 9 aa, Artificial Sequence
  Description of Artificial Sequence: Synthetic peptide
  Seed: NYKHCFPEI (MAGA1_HUMAN)
NFKHCFPEL

SEQ ID NO: 50318 - protein, 9 aa, Artificial Sequence
  Description of Artificial Sequence: Synthetic peptide
  Seed: WEELSVMEV (MAGA1_HUMAN)
WEELSVMEA

SEQ ID NO: 50319 - protein, 9 aa, Artificial Sequence
  Description of Artificial Sequence: Synthetic peptide
  Seed: YVLVTCLGL (MAGA1_HUMAN)
YVLVTCLGY

SEQ ID NO: 50320 - protein, 10 aa, Artificial Sequence
  Description of Artificial Sequence: Synthetic peptide
  Seed: SESLQLVFGI (MAGA1_HUMAN)
SPSLQLVFGW

SEQ ID NO: 50321 - protein, 9 aa, Artificial Sequence
  Description of Artificial Sequence: Synthetic peptide
  Seed: HSYVLVTCL (MAGA1_HUMAN)
HRYVLVTCF

SEQ ID NO: 50322 - protein, 9 aa, Artificial Sequence
  Description of Artificial Sequence: Synthetic peptide
  Seed: RAREPVTKA (MAGA1_HUMAN)
RTREPVTKI

SEQ ID NO: 50323 - protein, 9 aa, Artificial Sequence
  Description of Artificial Sequence: Synthetic peptide
  Seed: TQDLVQEKY (MAGA1_HUMAN)
TYDLVQEKF

SEQ ID NO: 50324 - protein, 10 aa, Artificial Sequence
  Description of Artificial Sequence: Synthetic peptide
  Seed: AFPTTINFTR (MAGA1_HUMAN)
ATPTTINFTR

SEQ ID NO: 50325 - protein, 9 aa, Artificial Sequence
  Description of Artificial Sequence: Synthetic peptide
  Seed: VSARVRFFF (MAGA1_HUMAN)
VNARVRFFY

SEQ ID NO: 50326 - protein, 11 aa, Artificial Sequence
  Description of Artificial Sequence: Synthetic peptide
  Seed: GLLGDNQIMPK (MAGA1_HUMAN)
GTLGDNQIMPR

SEQ ID NO: 50327 - protein, 9 aa, Artificial Sequence
  Description of Artificial Sequence: Synthetic peptide
  Seed: SARVRFFFP (MAGA1_HUMAN)
SSRVRFFFM

SEQ ID NO: 50328 - protein, 9 aa, Artificial Sequence
  Description of Artificial Sequence: Synthetic peptide
  Seed: SARVRFFFP (MAGA1_HUMAN)
SVRVRFFFS

SEQ ID NO: 50329 - protein, 9 aa, Artificial Sequence
  Description of Artificial Sequence: Synthetic peptide
  Seed: LEYVIKVSA (MAGA1_HUMAN)
LEYVIKVSF

SEQ ID NO: 50330 - protein, 10 aa, Artificial Sequence
  Description of Artificial Sequence: Synthetic peptide
  Seed: IMPKTGFLII (MAGA1_HUMAN)
IWPKTGFLIM

SEQ ID NO: 50331 - protein, 11 aa, Artificial Sequence
  Description of Artificial Sequence: Synthetic peptide
  Seed: ALAETSYVKVL (MAGA1_HUMAN)
AMAETSYVKVL

SEQ ID NO: 50332 - protein, 9 aa, Artificial Sequence
  Description of Artificial Sequence: Synthetic peptide
  Seed: VYDGREHSA (MAGA1_HUMAN)
VFDGREHSI

SEQ ID NO: 50333 - protein, 8 aa, Artificial Sequence
  Description of Artificial Sequence: Synthetic peptide
  Seed: VADLVGFL (MAGA1_HUMAN)
VLDLVGFL

SEQ ID NO: 50334 - protein, 9 aa, Artificial Sequence
  Description of Artificial Sequence: Synthetic peptide
  Seed: EFLWGPRAL (MAGA1_HUMAN)
EYLWGPRAM

SEQ ID NO: 50335 - protein, 9 aa, Artificial Sequence
  Description of Artificial Sequence: Synthetic peptide
  Seed: DPTGHSYVL (MAGA1_HUMAN)
DATGHSYVM

SEQ ID NO: 50336 - protein, 10 aa, Artificial Sequence
  Description of Artificial Sequence: Synthetic peptide
  Seed: RVRFFFPSLR (MAGA1_HUMAN)
RMRFFFPSLY

SEQ ID NO: 50337 - protein, 11 aa, Artificial Sequence
  Description of Artificial Sequence: Synthetic peptide
  Seed: ARVRFFFPSLR (MAGA1_HUMAN)
AAVRFFFPSLL

SEQ ID NO: 50338 - protein, 8 aa, Artificial Sequence
  Description of Artificial Sequence: Synthetic peptide
  Seed: FPSLREAA (MAGA1_HUMAN)
FPSLREAL

SEQ ID NO: 50339 - protein, 9 aa, Artificial Sequence
  Description of Artificial Sequence: Synthetic peptide
  Seed: QSPQGASAF (MAGA1_HUMAN)
QQPQGASAF

SEQ ID NO: 50340 - protein, 9 aa, Artificial Sequence
  Description of Artificial Sequence: Synthetic peptide
  Seed: LTQDLVQEK (MAGA1_HUMAN)
LVQDLVQER

SEQ ID NO: 50341 - protein, 11 aa, Artificial Sequence
  Description of Artificial Sequence: Synthetic peptide
  Seed: KVADLVGFLLL (MAGA1_HUMAN)
KLADLVGFLLF

SEQ ID NO: 50342 - protein, 10 aa, Artificial Sequence
  Description of Artificial Sequence: Synthetic peptide
  Seed: ADPTGHSYVL (MAGA1_HUMAN)
AKPTGHSYVL

SEQ ID NO: 50343 - protein, 9 aa, Artificial Sequence
  Description of Artificial Sequence: Synthetic peptide
  Seed: QIMPKTGFL (MAGA1_HUMAN)
QMMPKTGFL

SEQ ID NO: 50344 - protein, 11 aa, Artificial Sequence
  Description of Artificial Sequence: Synthetic peptide
  Seed: RQVPDSDPARY (MAGA1_HUMAN)
RIVPDSDPARL

SEQ ID NO: 50345 - protein, 9 aa, Artificial Sequence
  Description of Artificial Sequence: Synthetic peptide
  Seed: HSYVLVTCL (MAGA1_HUMAN)
HAYVLVTCF

SEQ ID NO: 50346 - protein, 9 aa, Artificial Sequence
  Description of Artificial Sequence: Synthetic peptide
  Seed: KVADLVGFL (MAGA1_HUMAN)
KLADLVGFF

SEQ ID NO: 50347 - protein, 9 aa, Artificial Sequence
  Description of Artificial Sequence: Synthetic peptide
  Seed: SAFPTTINF (MAGA1_HUMAN)
STFPTTINM

SEQ ID NO: 50348 - protein, 11 aa, Artificial Sequence
  Description of Artificial Sequence: Synthetic peptide
  Seed: ARVRFFFPSLR (MAGA1_HUMAN)
ALVRFFFPSLL

SEQ ID NO: 50349 - protein, 9 aa, Artificial Sequence
  Description of Artificial Sequence: Synthetic peptide
  Seed: RAREPVTKA (MAGA1_HUMAN)
RRREPVTKF

SEQ ID NO: 50350 - protein, 9 aa, Artificial Sequence
  Description of Artificial Sequence: Synthetic peptide
  Seed: RVRFFFPSL (MAGA1_HUMAN)
RCRFFFPSR

SEQ ID NO: 50351 - protein, 8 aa, Artificial Sequence
  Description of Artificial Sequence: Synthetic peptide
  Seed: VADLVGFL (MAGA1_HUMAN)
VQDLVGFL

SEQ ID NO: 50352 - protein, 10 aa, Artificial Sequence
  Description of Artificial Sequence: Synthetic peptide
  Seed: VKVLEYVIKV (MAGA1_HUMAN)
VMVLEYVIKI

SEQ ID NO: 50353 - protein, 9 aa, Artificial Sequence
  Description of Artificial Sequence: Synthetic peptide
  Seed: RAVITKKVA (MAGA1_HUMAN)
RPVITKKVA

SEQ ID NO: 50354 - protein, 9 aa, Artificial Sequence
  Description of Artificial Sequence: Synthetic peptide
  Seed: LFRAVITKK (MAGA1_HUMAN)
LFRAVITKR

SEQ ID NO: 50355 - protein, 9 aa, Artificial Sequence
  Description of Artificial Sequence: Synthetic peptide
  Seed: KASESLQLV (MAGA1_HUMAN)
KQSESLQLL

SEQ ID NO: 50356 - protein, 9 aa, Artificial Sequence
  Description of Artificial Sequence: Synthetic peptide
  Seed: IAMEGGHAP (MAGA1_HUMAN)
IAMEGGHAH

SEQ ID NO: 50357 - protein, 10 aa, Artificial Sequence
  Description of Artificial Sequence: Synthetic peptide
  Seed: KEADPTGHSY (MAGA1_HUMAN)
KIADPTGHSF

SEQ ID NO: 50358 - protein, 10 aa, Artificial Sequence
  Description of Artificial Sequence: Synthetic peptide
  Seed: FFPSLREAAL (MAGA1_HUMAN)
FMPSLREAAM

SEQ ID NO: 50359 - protein, 9 aa, Artificial Sequence
  Description of Artificial Sequence: Synthetic peptide
  Seed: GTLEEVPTA (MAGA1_HUMAN)
GLLEEVPTT

SEQ ID NO: 50360 - protein, 11 aa, Artificial Sequence
  Description of Artificial Sequence: Synthetic peptide
  Seed: RVRFFFPSLRE (MAGA1_HUMAN)
RVRFFFPSLRF

SEQ ID NO: 50361 - protein, 9 aa, Artificial Sequence
  Description of Artificial Sequence: Synthetic peptide
  Seed: VQAATSSSS (MAGA1_HUMAN)
VGAATSSSY

SEQ ID NO: 50362 - protein, 11 aa, Artificial Sequence
  Description of Artificial Sequence: Synthetic peptide
  Seed: SAFPTTINFTR (MAGA1_HUMAN)
STFPTTINFTK

SEQ ID NO: 50363 - protein, 9 aa, Artificial Sequence
  Description of Artificial Sequence: Synthetic peptide
  Seed: FFFPSLREA (MAGA1_HUMAN)
FWFPSLREY

SEQ ID NO: 50364 - protein, 10 aa, Artificial Sequence
  Description of Artificial Sequence: Synthetic peptide
  Seed: VKVLEYVIKV (MAGA1_HUMAN)
VSVLEYVIKV

SEQ ID NO: 50365 - protein, 9 aa, Artificial Sequence
  Description of Artificial Sequence: Synthetic peptide
  Seed: LVQEKYLEY (MAGA1_HUMAN)
LMQEKYLEM

SEQ ID NO: 50366 - protein, 9 aa, Artificial Sequence
  Description of Artificial Sequence: Synthetic peptide
  Seed: AETSYVKVL (MAGA1_HUMAN)
AETSYVKVV

SEQ ID NO: 50367 - protein, 10 aa, Artificial Sequence
  Description of Artificial Sequence: Synthetic peptide
  Seed: SCILESLFRA (MAGA1_HUMAN)
SYILESLFRL

SEQ ID NO: 50368 - protein, 9 aa, Artificial Sequence
  Description of Artificial Sequence: Synthetic peptide
  Seed: TSSSSPLVL (MAGA1_HUMAN)
TKSSSPLVY

SEQ ID NO: 50369 - protein, 9 aa, Artificial Sequence
  Description of Artificial Sequence: Synthetic peptide
  Seed: EIWEELSVM (MAGA1_HUMAN)
ESWEELSVR

SEQ ID NO: 50370 - protein, 9 aa, Artificial Sequence
  Description of Artificial Sequence: Synthetic peptide
  Seed: SSSPLVLGT (MAGA1_HUMAN)
SLSPLVLGL

SEQ ID NO: 50371 - protein, 10 aa, Artificial Sequence
  Description of Artificial Sequence: Synthetic peptide
  Seed: ADLVGFLLLK (MAGA1_HUMAN)
AWLVGFLLLK

SEQ ID NO: 50372 - protein, 10 aa, Artificial Sequence
  Description of Artificial Sequence: Synthetic peptide
  Seed: TKKVADLVGF (MAGA1_HUMAN)
TQKVADLVGY

SEQ ID NO: 50373 - protein, 10 aa, Artificial Sequence
  Description of Artificial Sequence: Synthetic peptide
  Seed: ADLVGFLLLK (MAGA1_HUMAN)
AMLVGFLLLK

SEQ ID NO: 50374 - protein, 9 aa, Artificial Sequence
  Description of Artificial Sequence: Synthetic peptide
  Seed: KVLEYVIKV (MAGA1_HUMAN)
KGLEYVIKI

SEQ ID NO: 50375 - protein, 10 aa, Artificial Sequence
  Description of Artificial Sequence: Synthetic peptide
  Seed: RAREPVTKAE (MAGA1_HUMAN)
RYREPVTKAK

SEQ ID NO: 50376 - protein, 10 aa, Artificial Sequence
  Description of Artificial Sequence: Synthetic peptide
  Seed: LTQDLVQEKY (MAGA1_HUMAN)
LSQDLVQEKY

SEQ ID NO: 50377 - protein, 9 aa, Artificial Sequence
  Description of Artificial Sequence: Synthetic peptide
  Seed: LTQDLVQEK (MAGA1_HUMAN)
LLQDLVQEL

SEQ ID NO: 50378 - protein, 9 aa, Artificial Sequence
  Description of Artificial Sequence: Synthetic peptide
  Seed: SAFPTTINF (MAGA1_HUMAN)
SLFPTTINV

SEQ ID NO: 50379 - protein, 10 aa, Artificial Sequence
  Description of Artificial Sequence: Synthetic peptide
  Seed: TSYVKVLEYV (MAGA1_HUMAN)
TMYVKVLEYF

SEQ ID NO: 50380 - protein, 9 aa, Artificial Sequence
  Description of Artificial Sequence: Synthetic peptide
  Seed: SAYGEPRKL (MAGA1_HUMAN)
SYYGEPRKY

SEQ ID NO: 50381 - protein, 10 aa, Artificial Sequence
  Description of Artificial Sequence: Synthetic peptide
  Seed: KNYKHCFPEI (MAGA1_HUMAN)
KYYKHCFPEI

SEQ ID NO: 50382 - protein, 9 aa, Artificial Sequence
  Description of Artificial Sequence: Synthetic peptide
  Seed: IAMEGGHAP (MAGA1_HUMAN)
IQMEGGHAL

SEQ ID NO: 50383 - protein, 10 aa, Artificial Sequence
  Description of Artificial Sequence: Synthetic peptide
  Seed: ASAFPTTINF (MAGA1_HUMAN)
APAFPTTINW

SEQ ID NO: 50384 - protein, 9 aa, Artificial Sequence
  Description of Artificial Sequence: Synthetic peptide
  Seed: VSARVRFFF (MAGA1_HUMAN)
VFARVRFFF

SEQ ID NO: 50385 - protein, 9 aa, Artificial Sequence
  Description of Artificial Sequence: Synthetic peptide
  Seed: HCFPEIFGK (MAGA1_HUMAN)
HCFPEIFGR

SEQ ID NO: 50386 - protein, 9 aa, Artificial Sequence
  Description of Artificial Sequence: Synthetic peptide
  Seed: MPKTGFLII (MAGA1_HUMAN)
MTKTGFLIF

SEQ ID NO: 50387 - protein, 9 aa, Artificial Sequence
  Description of Artificial Sequence: Synthetic peptide
  Seed: RQRQPSEGS (MAGA1_HUMAN)
RTRQPSEGM

SEQ ID NO: 50388 - protein, 8 aa, Artificial Sequence
  Description of Artificial Sequence: Synthetic peptide
  Seed: SPQGASAF (MAGA1_HUMAN)
SPQGASAM

SEQ ID NO: 50389 - protein, 9 aa, Artificial Sequence
  Description of Artificial Sequence: Synthetic peptide
  Seed: KASESLQLV (MAGA1_HUMAN)
KISESLQLF

SEQ ID NO: 50390 - protein, 9 aa, Artificial Sequence
  Description of Artificial Sequence: Synthetic peptide
  Seed: LVQEKYLEY (MAGA1_HUMAN)
LRQEKYLEL

SEQ ID NO: 50391 - protein, 9 aa, Artificial Sequence
  Description of Artificial Sequence: Synthetic peptide
  Seed: VADLVGFLL (MAGA1_HUMAN)
VGDLVGFLF

SEQ ID NO: 50392 - protein, 11 aa, Artificial Sequence
  Description of Artificial Sequence: Synthetic peptide
  Seed: FLWGPRALAET (MAGA1_HUMAN)
FVWGPRALAEI

SEQ ID NO: 50393 - protein, 11 aa, Artificial Sequence
  Description of Artificial Sequence: Synthetic peptide
  Seed: RQVPDSDPARY (MAGA1_HUMAN)
RMVPDSDPARK

SEQ ID NO: 50394 - protein, 10 aa, Artificial Sequence
  Description of Artificial Sequence: Synthetic peptide
  Seed: YEFLWGPRAL (MAGA1_HUMAN)
YIFLWGPRAF

SEQ ID NO: 50395 - protein, 10 aa, Artificial Sequence
  Description of Artificial Sequence: Synthetic peptide
  Seed: RVRFFFPSLR (MAGA1_HUMAN)
RMRFFFPSLS

SEQ ID NO: 50396 - protein, 9 aa, Artificial Sequence
  Description of Artificial Sequence: Synthetic peptide
  Seed: FFFPSLREA (MAGA1_HUMAN)
FLFPSLREG

SEQ ID NO: 50397 - protein, 10 aa, Artificial Sequence
  Description of Artificial Sequence: Synthetic peptide
  Seed: SARVRFFFPS (MAGA1_HUMAN)
SDRVRFFFPM

SEQ ID NO: 50398 - protein, 9 aa, Artificial Sequence
  Description of Artificial Sequence: Synthetic peptide
  Seed: KVSARVRFF (MAGA1_HUMAN)
KQSARVRFK

SEQ ID NO: 50399 - protein, 9 aa, Artificial Sequence
  Description of Artificial Sequence: Synthetic peptide
  Seed: SVMEVYDGR (MAGA1_HUMAN)
STMEVYDGR

SEQ ID NO: 50400 - protein, 9 aa, Artificial Sequence
  Description of Artificial Sequence: Synthetic peptide
  Seed: ATSSSSPLV (MAGA1_HUMAN)
ALSSSSPLL

SEQ ID NO: 50401 - protein, 10 aa, Artificial Sequence
  Description of Artificial Sequence: Synthetic peptide
  Seed: YEFLWGPRAL (MAGA1_HUMAN)
YKFLWGPRAL

SEQ ID NO: 50402 - protein, 9 aa, Artificial Sequence
  Description of Artificial Sequence: Synthetic peptide
  Seed: ASESLQLVF (MAGA1_HUMAN)
AQESLQLVW

SEQ ID NO: 50403 - protein, 9 aa, Artificial Sequence
  Description of Artificial Sequence: Synthetic peptide
  Seed: MPKTGFLII (MAGA1_HUMAN)
MMKTGFLIV

SEQ ID NO: 50404 - protein, 9 aa, Artificial Sequence
  Description of Artificial Sequence: Synthetic peptide
  Seed: YDGREHSAY (MAGA1_HUMAN)
YMGREHSAF

SEQ ID NO: 50405 - protein, 10 aa, Artificial Sequence
  Description of Artificial Sequence: Synthetic peptide
  Seed: CILESLFRAV (MAGA1_HUMAN)
CMLESLFRAI

SEQ ID NO: 50406 - protein, 9 aa, Artificial Sequence
  Description of Artificial Sequence: Synthetic peptide
  Seed: KVADLVGFL (MAGA1_HUMAN)
KMADLVGFM

SEQ ID NO: 50407 - protein, 10 aa, Artificial Sequence
  Description of Artificial Sequence: Synthetic peptide
  Seed: TSCILESLFR (MAGA1_HUMAN)
TLCILESLFK

SEQ ID NO: 50408 - protein, 9 aa, Artificial Sequence
  Description of Artificial Sequence: Synthetic peptide
  Seed: TSSSSPLVL (MAGA1_HUMAN)
THSSSPLVF

SEQ ID NO: 50409 - protein, 10 aa, Artificial Sequence
  Description of Artificial Sequence: Synthetic peptide
  Seed: KVSARVRFFF (MAGA1_HUMAN)
KFSARVRFFK

SEQ ID NO: 50410 - protein, 9 aa, Artificial Sequence
  Description of Artificial Sequence: Synthetic peptide
  Seed: KVSARVRFF (MAGA1_HUMAN)
KSSARVRFM

SEQ ID NO: 50411 - protein, 9 aa, Artificial Sequence
  Description of Artificial Sequence: Synthetic peptide
  Seed: EALEAQQEA (MAGA1_HUMAN)
ETLEAQQEV

SEQ ID NO: 50412 - protein, 11 aa, Artificial Sequence
  Description of Artificial Sequence: Synthetic peptide
  Seed: RQVPDSDPARY (MAGA1_HUMAN)
RAVPDSDPARY

SEQ ID NO: 50413 - protein, 10 aa, Artificial Sequence
  Description of Artificial Sequence: Synthetic peptide
  Seed: KVSARVRFFF (MAGA1_HUMAN)
KVSARVRFFK

SEQ ID NO: 50414 - protein, 9 aa, Artificial Sequence
  Description of Artificial Sequence: Synthetic peptide
  Seed: LGDNQIMPK (MAGA1_HUMAN)
LADNQIMPY

SEQ ID NO: 50415 - protein, 10 aa, Artificial Sequence
  Description of Artificial Sequence: Synthetic peptide
  Seed: LSVMEVYDGR (MAGA1_HUMAN)
LGVMEVYDGR

SEQ ID NO: 50416 - protein, 10 aa, Artificial Sequence
  Description of Artificial Sequence: Synthetic peptide
  Seed: EVYDGREHSA (MAGA1_HUMAN)
EMYDGREHSL

SEQ ID NO: 50417 - protein, 9 aa, Artificial Sequence
  Description of Artificial Sequence: Synthetic peptide
  Seed: SSPLVLGTL (MAGA1_HUMAN)
SYPLVLGTY

SEQ ID NO: 50418 - protein, 11 aa, Artificial Sequence
  Description of Artificial Sequence: Synthetic peptide
  Seed: FLWGPRALAET (MAGA1_HUMAN)
FSWGPRALAEV

SEQ ID NO: 50419 - protein, 11 aa, Artificial Sequence
  Description of Artificial Sequence: Synthetic peptide
  Seed: STDPPQSPQGA (MAGA1_HUMAN)
SADPPQSPQGL

SEQ ID NO: 50420 - protein, 10 aa, Artificial Sequence
  Description of Artificial Sequence: Synthetic peptide
  Seed: LTQDLVQEKY (MAGA1_HUMAN)
LTQDLVQEKF

SEQ ID NO: 50421 - protein, 9 aa, Artificial Sequence
  Description of Artificial Sequence: Synthetic peptide
  Seed: RAREPVTKA (MAGA1_HUMAN)
RTREPVTKF

SEQ ID NO: 50422 - protein, 9 aa, Artificial Sequence
  Description of Artificial Sequence: Synthetic peptide
  Seed: TKAEMLESV (MAGA1_HUMAN)
TIAEMLESM

SEQ ID NO: 50423 - protein, 10 aa, Artificial Sequence
  Description of Artificial Sequence: Synthetic peptide
  Seed: YEFLWGPRAL (MAGA1_HUMAN)
YAFLWGPRAM

SEQ ID NO: 50424 - protein, 9 aa, Artificial Sequence
  Description of Artificial Sequence: Synthetic peptide
  Seed: KVADLVGFL (MAGA1_HUMAN)
KQADLVGFL

SEQ ID NO: 50425 - protein, 9 aa, Artificial Sequence
  Description of Artificial Sequence: Synthetic peptide
  Seed: REAALREEE (MAGA1_HUMAN)
REAALREEA

SEQ ID NO: 50426 - protein, 9 aa, Artificial Sequence
  Description of Artificial Sequence: Synthetic peptide
  Seed: SCILESLFR (MAGA1_HUMAN)
STILESLFR

SEQ ID NO: 50427 - protein, 9 aa, Artificial Sequence
  Description of Artificial Sequence: Synthetic peptide
  Seed: FFFPSLREA (MAGA1_HUMAN)
FIFPSLREY

SEQ ID NO: 50428 - protein, 10 aa, Artificial Sequence
  Description of Artificial Sequence: Synthetic peptide
  Seed: RYEFLWGPRA (MAGA1_HUMAN)
RYEFLWGPRR

SEQ ID NO: 50429 - protein, 9 aa, Artificial Sequence
  Description of Artificial Sequence: Synthetic peptide
  Seed: SAYGEPRKL (MAGA1_HUMAN)
SLYGEPRKI

SEQ ID NO: 50430 - protein, 9 aa, Artificial Sequence
  Description of Artificial Sequence: Synthetic peptide
  Seed: KVSARVRFF (MAGA1_HUMAN)
KISARVRFK

SEQ ID NO: 50431 - protein, 9 aa, Artificial Sequence
  Description of Artificial Sequence: Synthetic peptide
  Seed: AATSSSSPL (MAGA1_HUMAN)
AYTSSSSPV

SEQ ID NO: 50432 - protein, 9 aa, Artificial Sequence
  Description of Artificial Sequence: Synthetic peptide
  Seed: EIWEELSVM (MAGA1_HUMAN)
EIWEELSVF

SEQ ID NO: 50433 - protein, 9 aa, Artificial Sequence
  Description of Artificial Sequence: Synthetic peptide
  Seed: YVIKVSARV (MAGA1_HUMAN)
YSIKVSARR

SEQ ID NO: 50434 - protein, 9 aa, Artificial Sequence
  Description of Artificial Sequence: Synthetic peptide
  Seed: RQVPDSDPA (MAGA1_HUMAN)
RMVPDSDPM

SEQ ID NO: 50435 - protein, 9 aa, Artificial Sequence
  Description of Artificial Sequence: Synthetic peptide
  Seed: LKYRAREPV (MAGA1_HUMAN)
LMYRAREPF

SEQ ID NO: 50436 - protein, 9 aa, Artificial Sequence
  Description of Artificial Sequence: Synthetic peptide
  Seed: HCFPEIFGK (MAGA1_HUMAN)
HFFPEIFGK

SEQ ID NO: 50437 - protein, 9 aa, Artificial Sequence
  Description of Artificial Sequence: Synthetic peptide
  Seed: YVLVTCLGL (MAGA1_HUMAN)
YILVTCLGV

SEQ ID NO: 50438 - protein, 10 aa, Artificial Sequence
  Description of Artificial Sequence: Synthetic peptide
  Seed: RVRFFFPSLR (MAGA1_HUMAN)
RSRFFFPSLS

SEQ ID NO: 50439 - protein, 10 aa, Artificial Sequence
  Description of Artificial Sequence: Synthetic peptide
  Seed: KASESLQLVF (MAGA1_HUMAN)
KRSESLQLVW

SEQ ID NO: 50440 - protein, 9 aa, Artificial Sequence
  Description of Artificial Sequence: Synthetic peptide
  Seed: KYRAREPVT (MAGA1_HUMAN)
KMRAREPVV

SEQ ID NO: 50441 - protein, 10 aa, Artificial Sequence
  Description of Artificial Sequence: Synthetic peptide
  Seed: KYRAREPVTK (MAGA1_HUMAN)
KTRAREPVTY

SEQ ID NO: 50442 - protein, 9 aa, Artificial Sequence
  Description of Artificial Sequence: Synthetic peptide
  Seed: RQVPDSDPA (MAGA1_HUMAN)
RTVPDSDPF

SEQ ID NO: 50443 - protein, 10 aa, Artificial Sequence
  Description of Artificial Sequence: Synthetic peptide
  Seed: YEFLWGPRAL (MAGA1_HUMAN)
YKFLWGPRAF

SEQ ID NO: 50444 - protein, 10 aa, Artificial Sequence
  Description of Artificial Sequence: Synthetic peptide
  Seed: KEADPTGHSY (MAGA1_HUMAN)
KIADPTGHSI

SEQ ID NO: 50445 - protein, 9 aa, Artificial Sequence
  Description of Artificial Sequence: Synthetic peptide
  Seed: MLESVIKNY (MAGA1_HUMAN)
MQESVIKNF

SEQ ID NO: 50446 - protein, 9 aa, Artificial Sequence
  Description of Artificial Sequence: Synthetic peptide
  Seed: SARVRFFFP (MAGA1_HUMAN)
SWRVRFFFA

SEQ ID NO: 50447 - protein, 9 aa, Artificial Sequence
  Description of Artificial Sequence: Synthetic peptide
  Seed: EIWEELSVM (MAGA1_HUMAN)
EAWEELSVK

SEQ ID NO: 50448 - protein, 11 aa, Artificial Sequence
  Description of Artificial Sequence: Synthetic peptide
  Seed: ARVRFFFPSLR (MAGA1_HUMAN)
ATVRFFFPSLR

SEQ ID NO: 50449 - protein, 9 aa, Artificial Sequence
  Description of Artificial Sequence: Synthetic peptide
  Seed: KVLEYVIKV (MAGA1_HUMAN)
KYLEYVIKY

SEQ ID NO: 50450 - protein, 10 aa, Artificial Sequence
  Description of Artificial Sequence: Synthetic peptide
  Seed: RYEFLWGPRA (MAGA1_HUMAN)
RIEFLWGPRR

SEQ ID NO: 50451 - protein, 11 aa, Artificial Sequence
  Description of Artificial Sequence: Synthetic peptide
  Seed: STDPPQSPQGA (MAGA1_HUMAN)
SFDPPQSPQGL

SEQ ID NO: 50452 - protein, 10 aa, Artificial Sequence
  Description of Artificial Sequence: Synthetic peptide
  Seed: SCILESLFRA (MAGA1_HUMAN)
SRILESLFRL

SEQ ID NO: 50453 - protein, 9 aa, Artificial Sequence
  Description of Artificial Sequence: Synthetic peptide
  Seed: TQDLVQEKY (MAGA1_HUMAN)
TTDLVQEKI

SEQ ID NO: 50454 - protein, 9 aa, Artificial Sequence
  Description of Artificial Sequence: Synthetic peptide
  Seed: VSARVRFFF (MAGA1_HUMAN)
VCARVRFFW

SEQ ID NO: 50455 - protein, 9 aa, Homo sapiens
  Native (MAGA1_HUMAN)
TSCILESLF

SEQ ID NO: 50456 - protein, 10 aa, Homo sapiens
  Native (MAGA1_HUMAN)
CILESLFRAV

SEQ ID NO: 50457 - protein, 10 aa, Homo sapiens
  Native (MAGA1_HUMAN)
ATSSSSPLVL

SEQ ID NO: 50458 - protein, 10 aa, Homo sapiens
  Native (MAGA1_HUMAN)
ASAFPTTINF

SEQ ID NO: 50459 - protein, 10 aa, Homo sapiens
  Native (MAGA1_HUMAN)
VTKAEMLESV

SEQ ID NO: 50460 - protein, 8 aa, Homo sapiens
  Native (MAGA1_HUMAN)
EALGLVCV

SEQ ID NO: 50461 - protein, 11 aa, Homo sapiens
  Native (MAGA1_HUMAN)
EYVIKVSARVR

SEQ ID NO: 50462 - protein, 9 aa, Homo sapiens
  Native (MAGA1_HUMAN)
LTQDLVQEK

SEQ ID NO: 50463 - protein, 10 aa, Homo sapiens
  Native (MAGA1_HUMAN)
MPKTGFLIIV

SEQ ID NO: 50464 - protein, 9 aa, Homo sapiens
  Native (MAGA1_HUMAN)
ARYEFLWGP

SEQ ID NO: 50465 - protein, 10 aa, Homo sapiens
  Native (MAGA1_HUMAN)
DLVGFLLLKY

SEQ ID NO: 50466 - protein, 8 aa, Homo sapiens
  Native (MAGA1_HUMAN)
SSSSPLVL

SEQ ID NO: 50467 - protein, 10 aa, Homo sapiens
  Native (MAGA1_HUMAN)
REAALREEEE

SEQ ID NO: 50468 - protein, 10 aa, Homo sapiens
  Native (MAGA1_HUMAN)
TQDLVQEKYL

SEQ ID NO: 50469 - protein, 9 aa, Homo sapiens
  Native (MAGA1_HUMAN)
IKVSARVRF

SEQ ID NO: 50470 - protein, 8 aa, Homo sapiens
  Native (MAGA1_HUMAN)
LEQRSLHC

SEQ ID NO: 50471 - protein, 11 aa, Homo sapiens
  Native (MAGA1_HUMAN)
REEEGPSTSCI

SEQ ID NO: 50472 - protein, 10 aa, Homo sapiens
  Native (MAGA1_HUMAN)
EAQQEALGLV

SEQ ID NO: 50473 - protein, 9 aa, Homo sapiens
  Native (MAGA1_HUMAN)
MEGGHAPEE

SEQ ID NO: 50474 - protein, 8 aa, Homo sapiens
  Native (MAGA1_HUMAN)
LEEVPTAG

SEQ ID NO: 50475 - protein, 9 aa, Homo sapiens
  Native (MAGA1_HUMAN)
VQAATSSSS

SEQ ID NO: 50476 - protein, 11 aa, Homo sapiens
  Native (MAGA1_HUMAN)
IFGKASESLQL

SEQ ID NO: 50477 - protein, 11 aa, Homo sapiens
  Native (MAGA1_HUMAN)
VGFLLLKYRAR

SEQ ID NO: 50478 - protein, 11 aa, Homo sapiens
  Native (MAGA1_HUMAN)
DSDPARYEFLW

SEQ ID NO: 50479 - protein, 10 aa, Homo sapiens
  Native (MAGA1_HUMAN)
VKVLEYVIKV

SEQ ID NO: 50480 - protein, 8 aa, Homo sapiens
  Native (MAGA1_HUMAN)
FPSLREAA

SEQ ID NO: 50481 - protein, 11 aa, Homo sapiens
  Native (MAGA1_HUMAN)
EGGHAPEEEIW

SEQ ID NO: 50482 - protein, 9 aa, Homo sapiens
  Native (MAGA1_HUMAN)
TKAEMLESV

SEQ ID NO: 50483 - protein, 10 aa, Homo sapiens
  Native (MAGA1_HUMAN)
SAYGEPRKLL

SEQ ID NO: 50484 - protein, 9 aa, Homo sapiens
  Native (MAGA1_HUMAN)
SARVRFFFP

SEQ ID NO: 50485 - protein, 11 aa, Homo sapiens
  Native (MAGA1_HUMAN)
AETSYVKVLEY

SEQ ID NO: 50486 - protein, 11 aa, Homo sapiens
  Native (MAGA1_HUMAN)
YRQVPDSDPAR

SEQ ID NO: 50487 - protein, 11 aa, Homo sapiens
  Native (MAGA1_HUMAN)
LEAQQEALGLV

SEQ ID NO: 50488 - protein, 9 aa, Homo sapiens
  Native (MAGA1_HUMAN)
ESVIKNYKH

SEQ ID NO: 50489 - protein, 8 aa, Homo sapiens
  Native (MAGA1_HUMAN)
MPKTGFLI

SEQ ID NO: 50490 - protein, 9 aa, Homo sapiens
  Native (MAGA1_HUMAN)
GHAPEEEIW

SEQ ID NO: 50491 - protein, 8 aa, Homo sapiens
  Native (MAGA1_HUMAN)
MSLEQRSL

SEQ ID NO: 50492 - protein, 9 aa, Homo sapiens
  Native (MAGA1_HUMAN)
SDPARYEFL

SEQ ID NO: 50493 - protein, 11 aa, Homo sapiens
  Native (MAGA1_HUMAN)
KVLEYVIKVSA

SEQ ID NO: 50494 - protein, 9 aa, Homo sapiens
  Native (MAGA1_HUMAN)
GPRALAETS

SEQ ID NO: 50495 - protein, 11 aa, Homo sapiens
  Native (MAGA1_HUMAN)
GASAFPTTINF

SEQ ID NO: 50496 - protein, 8 aa, Homo sapiens
  Native (MAGA1_HUMAN)
ALAETSYV

SEQ ID NO: 50497 - protein, 10 aa, Homo sapiens
  Native (MAGA1_HUMAN)
DSDPARYEFL

SEQ ID NO: 50498 - protein, 9 aa, Homo sapiens
  Native (MAGA1_HUMAN)
EEEIWEELS

SEQ ID NO: 50499 - protein, 10 aa, Homo sapiens
  Native (MAGA1_HUMAN)
EFLWGPRALA

SEQ ID NO: 50500 - protein, 10 aa, Homo sapiens
  Native (MAGA1_HUMAN)
ETSYVKVLEY

SEQ ID NO: 50501 - protein, 9 aa, Homo sapiens
  Native (MAGA1_HUMAN)
FPEIFGKAS

SEQ ID NO: 50502 - protein, 11 aa, Homo sapiens
  Native (MAGA1_HUMAN)
IKNYKHCFPEI

SEQ ID NO: 50503 - protein, 11 aa, Homo sapiens
  Native (MAGA1_HUMAN)
AATSSSSPLVL

SEQ ID NO: 50504 - protein, 10 aa, Homo sapiens
  Native (MAGA1_HUMAN)
YVKVLEYVIK

SEQ ID NO: 50505 - protein, 11 aa, Homo sapiens
  Native (MAGA1_HUMAN)
ESLFRAVITKK

SEQ ID NO: 50506 - protein, 8 aa, Homo sapiens
  Native (MAGA1_HUMAN)
ADLVGFLL

SEQ ID NO: 50507 - protein, 10 aa, Homo sapiens
  Native (MAGA1_HUMAN)
PLVLGTLEEV

SEQ ID NO: 50508 - protein, 11 aa, Homo sapiens
  Native (MAGA1_HUMAN)
QEALGLVCVQA

SEQ ID NO: 50509 - protein, 8 aa, Homo sapiens
  Native (MAGA1_HUMAN)
KPEEALEA

SEQ ID NO: 50510 - protein, 10 aa, Homo sapiens
  Native (MAGA1_HUMAN)
LLKYRAREPV

SEQ ID NO: 50511 - protein, 9 aa, Homo sapiens
  Native (MAGA1_HUMAN)
QVPDSDPAR

SEQ ID NO: 50512 - protein, 11 aa, Homo sapiens
  Native (MAGA1_HUMAN)
NQIMPKTGFLI

SEQ ID NO: 50513 - protein, 11 aa, Homo sapiens
  Native (MAGA1_HUMAN)
SLFRAVITKKV

SEQ ID NO: 50514 - protein, 10 aa, Homo sapiens
  Native (MAGA1_HUMAN)
EEALEAQQEA

SEQ ID NO: 50515 - protein, 9 aa, Homo sapiens
  Native (MAGA1_HUMAN)
MLESVIKNY

SEQ ID NO: 50516 - protein, 10 aa, Homo sapiens
  Native (MAGA1_HUMAN)
RFFFPSLREA

SEQ ID NO: 50517 - protein, 10 aa, Homo sapiens
  Native (MAGA1_HUMAN)
FPSLREAALR

SEQ ID NO: 50518 - protein, 11 aa, Homo sapiens
  Native (MAGA1_HUMAN)
ARVRFFFPSLR

SEQ ID NO: 50519 - protein, 9 aa, Homo sapiens
  Native (MAGA1_HUMAN)
PSLREAALR

SEQ ID NO: 50520 - protein, 10 aa, Homo sapiens
  Native (MAGA1_HUMAN)
VLVTCLGLSY

SEQ ID NO: 50521 - protein, 8 aa, Homo sapiens
  Native (MAGA1_HUMAN)
DPARYEFL

SEQ ID NO: 50522 - protein, 9 aa, Homo sapiens
  Native (MAGA1_HUMAN)
QDLVQEKYL

SEQ ID NO: 50523 - protein, 9 aa, Homo sapiens
  Native (MAGA1_HUMAN)
IAMEGGHAP

SEQ ID NO: 50524 - protein, 11 aa, Homo sapiens
  Native (MAGA1_HUMAN)
FFFPSLREAAL

SEQ ID NO: 50525 - protein, 9 aa, Homo sapiens
  Native (MAGA1_HUMAN)
FPTTINFTR

SEQ ID NO: 50526 - protein, 11 aa, Homo sapiens
  Native (MAGA1_HUMAN)
RYEFLWGPRAL

SEQ ID NO: 50527 - protein, 11 aa, Homo sapiens
  Native (MAGA1_HUMAN)
RSLHCKPEEAL

SEQ ID NO: 50528 - protein, 10 aa, Homo sapiens
  Native (MAGA1_HUMAN)
LAETSYVKVL

SEQ ID NO: 50529 - protein, 10 aa, Homo sapiens
  Native (MAGA1_HUMAN)
LVQEKYLEYR

SEQ ID NO: 50530 - protein, 8 aa, Homo sapiens
  Native (MAGA1_HUMAN)
HSYVLVTC

SEQ ID NO: 50531 - protein, 9 aa, Homo sapiens
  Native (MAGA1_HUMAN)
VQEKYLEYR

SEQ ID NO: 50532 - protein, 11 aa, Homo sapiens
  Native (MAGA1_HUMAN)
ARYEFLWGPRA

SEQ ID NO: 50533 - protein, 9 aa, Homo sapiens
  Native (MAGA1_HUMAN)
QQEALGLVC

SEQ ID NO: 50534 - protein, 8 aa, Homo sapiens
  Native (MAGA1_HUMAN)
LVFGIDVK

SEQ ID NO: 50535 - protein, 9 aa, Homo sapiens
  Native (MAGA1_HUMAN)
FFPSLREAA

SEQ ID NO: 50536 - protein, 9 aa, Homo sapiens
  Native (MAGA1_HUMAN)
EYVIKVSAR

SEQ ID NO: 50537 - protein, 10 aa, Homo sapiens
  Native (MAGA1_HUMAN)
SCILESLFRA

SEQ ID NO: 50538 - protein, 11 aa, Homo sapiens
  Native (MAGA1_HUMAN)
RALAETSYVKV

SEQ ID NO: 50539 - protein, 10 aa, Homo sapiens
  Native (MAGA1_HUMAN)
SLEQRSLHCK

SEQ ID NO: 50540 - protein, 11 aa, Homo sapiens
  Native (MAGA1_HUMAN)
ETSYVKVLEYV

SEQ ID NO: 50541 - protein, 10 aa, Homo sapiens
  Native (MAGA1_HUMAN)
DLVQEKYLEY

SEQ ID NO: 50542 - protein, 11 aa, Homo sapiens
  Native (MAGA1_HUMAN)
GPSTSCILESL

SEQ ID NO: 50543 - protein, 10 aa, Homo sapiens
  Native (MAGA1_HUMAN)
FFFPSLREAA

SEQ ID NO: 50544 - protein, 8 aa, Homo sapiens
  Native (MAGA1_HUMAN)
SYVLVTCL

SEQ ID NO: 50545 - protein, 10 aa, Homo sapiens
  Native (MAGA1_HUMAN)
QEKYLEYRQV

SEQ ID NO: 50546 - protein, 10 aa, Homo sapiens
  Native (MAGA1_HUMAN)
ARVRFFFPSL

SEQ ID NO: 50547 - protein, 11 aa, Homo sapiens
  Native (MAGA1_HUMAN)
SEGSSSREEEG

SEQ ID NO: 50548 - protein, 11 aa, Homo sapiens
  Native (MAGA1_HUMAN)
SLQLVFGIDVK

SEQ ID NO: 50549 - protein, 10 aa, Homo sapiens
  Native (MAGA1_HUMAN)
GGHAPEEEIW

SEQ ID NO: 50550 - protein, 8 aa, Homo sapiens
  Native (MAGA1_HUMAN)
LFRAVITK

SEQ ID NO: 50551 - protein, 10 aa, Homo sapiens
  Native (MAGA1_HUMAN)
SLQLVFGIDV

SEQ ID NO: 50552 - protein, 8 aa, Homo sapiens
  Native (MAGA1_HUMAN)
SPLVLGTL

SEQ ID NO: 50553 - protein, 10 aa, Homo sapiens
  Native (MAGA1_HUMAN)
EEEGPSTSCI

SEQ ID NO: 50554 - protein, 10 aa, Homo sapiens
  Native (MAGA1_HUMAN)
FLWGPRALAE

SEQ ID NO: 50555 - protein, 10 aa, Homo sapiens
  Native (MAGA1_HUMAN)
LVFGIDVKEA

SEQ ID NO: 50556 - protein, 8 aa, Homo sapiens
  Native (MAGA1_HUMAN)
FLLLKYRA

SEQ ID NO: 50557 - protein, 11 aa, Homo sapiens
  Native (MAGA1_HUMAN)
GPRALAETSYV

SEQ ID NO: 50558 - protein, 9 aa, Homo sapiens
  Native (MAGA1_HUMAN)
ADPTGHSYV

SEQ ID NO: 50559 - protein, 8 aa, Homo sapiens
  Native (MAGA1_HUMAN)
ADPTGHSY

SEQ ID NO: 50560 - protein, 8 aa, Homo sapiens
  Native (MAGA1_HUMAN)
PARYEFLW

SEQ ID NO: 50561 - protein, 11 aa, Homo sapiens
  Native (MAGA1_HUMAN)
LESLFRAVITK

SEQ ID NO: 50562 - protein, 8 aa, Homo sapiens
  Native (MAGA1_HUMAN)
RFFFPSLR

SEQ ID NO: 50563 - protein, 10 aa, Homo sapiens
  Native (MAGA1_HUMAN)
TTINFTRQRQ

SEQ ID NO: 50564 - protein, 8 aa, Homo sapiens
  Native (MAGA1_HUMAN)
YEFLWGPR

SEQ ID NO: 50565 - protein, 8 aa, Homo sapiens
  Native (MAGA1_HUMAN)
YVIKVSAR

SEQ ID NO: 50566 - protein, 10 aa, Homo sapiens
  Native (MAGA1_HUMAN)
EHSAYGEPRK

SEQ ID NO: 50567 - protein, 8 aa, Homo sapiens
  Native (MAGA1_HUMAN)
FFPSLREA

SEQ ID NO: 50568 - protein, 11 aa, Homo sapiens
  Native (MAGA1_HUMAN)
YVLVTCLGLSY

SEQ ID NO: 50569 - protein, 9 aa, Homo sapiens
  Native (MAGA1_HUMAN)
IIVLVMIAM

SEQ ID NO: 50570 - protein, 8 aa, Homo sapiens
  Native (MAGA1_HUMAN)
YDGREHSA

SEQ ID NO: 50571 - protein, 10 aa, Homo sapiens
  Native (MAGA1_HUMAN)
FLIIVLVMIA

SEQ ID NO: 50572 - protein, 11 aa, Homo sapiens
  Native (MAGA1_HUMAN)
TKKVADLVGFL

SEQ ID NO: 50573 - protein, 8 aa, Homo sapiens
  Native (MAGA1_HUMAN)
IMPKTGFL

SEQ ID NO: 50574 - protein, 10 aa, Homo sapiens
  Native (MAGA1_HUMAN)
RYEFLWGPRA

SEQ ID NO: 50575 - protein, 9 aa, Homo sapiens
  Native (MAGA1_HUMAN)
STDPPQSPQ

SEQ ID NO: 50576 - protein, 11 aa, Homo sapiens
  Native (MAGA1_HUMAN)
GKASESLQLVF

SEQ ID NO: 50577 - protein, 10 aa, Homo sapiens
  Native (MAGA1_HUMAN)
SYVLVTCLGL

SEQ ID NO: 50578 - protein, 10 aa, Homo sapiens
  Native (MAGA1_HUMAN)
NQIMPKTGFL

SEQ ID NO: 50579 - protein, 10 aa, Homo sapiens
  Native (MAGA1_HUMAN)
FFPSLREAAL

SEQ ID NO: 50580 - protein, 10 aa, Homo sapiens
  Native (MAGA1_HUMAN)
KNYKHCFPEI

SEQ ID NO: 50581 - protein, 9 aa, Homo sapiens
  Native (MAGA1_HUMAN)
MSLEQRSLH

SEQ ID NO: 50582 - protein, 8 aa, Homo sapiens
  Native (MAGA1_HUMAN)
VRFFFPSL

SEQ ID NO: 50583 - protein, 9 aa, Homo sapiens
  Native (MAGA1_HUMAN)
SREEEGPST

SEQ ID NO: 50584 - protein, 9 aa, Homo sapiens
  Native (MAGA1_HUMAN)
AQQEALGLV

SEQ ID NO: 50585 - protein, 10 aa, Homo sapiens
  Native (MAGA1_HUMAN)
GPRALAETSY

SEQ ID NO: 50586 - protein, 9 aa, Homo sapiens
  Native (MAGA1_HUMAN)
TSSSSPLVL

SEQ ID NO: 50587 - protein, 9 aa, Homo sapiens
  Native (MAGA1_HUMAN)
REHSAYGEP

SEQ ID NO: 50588 - protein, 9 aa, Homo sapiens
  Native (MAGA1_HUMAN)
MEVYDGREH

SEQ ID NO: 50589 - protein, 9 aa, Homo sapiens
  Native (MAGA1_HUMAN)
LESVIKNYK

SEQ ID NO: 50590 - protein, 9 aa, Homo sapiens
  Native (MAGA1_HUMAN)
LEYRQVPDS

SEQ ID NO: 50591 - protein, 10 aa, Homo sapiens
  Native (MAGA1_HUMAN)
AREPVTKAEM

SEQ ID NO: 50592 - protein, 11 aa, Homo sapiens
  Native (MAGA1_HUMAN)
VLGTLEEVPTA

SEQ ID NO: 50593 - protein, 10 aa, Homo sapiens
  Native (MAGA1_HUMAN)
EALEAQQEAL

SEQ ID NO: 50594 - protein, 10 aa, Homo sapiens
  Native (MAGA1_HUMAN)
ESLFRAVITK

SEQ ID NO: 50595 - protein, 9 aa, Homo sapiens
  Native (MAGA1_HUMAN)
EGPSTSCIL

SEQ ID NO: 50596 - protein, 9 aa, Homo sapiens
  Native (MAGA1_HUMAN)
FFFPSLREA

SEQ ID NO: 50597 - protein, 9 aa, Homo sapiens
  Native (MAGA1_HUMAN)
EHSAYGEPR

SEQ ID NO: 50598 - protein, 9 aa, Homo sapiens
  Native (MAGA1_HUMAN)
SSSPLVLGT

SEQ ID NO: 50599 - protein, 8 aa, Homo sapiens
  Native (MAGA1_HUMAN)
DGREHSAY

SEQ ID NO: 50600 - protein, 9 aa, Homo sapiens
  Native (MAGA1_HUMAN)
ADLVGFLLL

SEQ ID NO: 50601 - protein, 9 aa, Homo sapiens
  Native (MAGA1_HUMAN)
QIMPKTGFL

SEQ ID NO: 50602 - protein, 9 aa, Homo sapiens
  Native (MAGA1_HUMAN)
SCILESLFR

SEQ ID NO: 50603 - protein, 10 aa, Homo sapiens
  Native (MAGA1_HUMAN)
EEGPSTSCIL

SEQ ID NO: 50604 - protein, 10 aa, Homo sapiens
  Native (MAGA1_HUMAN)
ALGLVCVQAA

SEQ ID NO: 50605 - protein, 9 aa, Homo sapiens
  Native (MAGA1_HUMAN)
FLLLKYRAR

SEQ ID NO: 50606 - protein, 9 aa, Homo sapiens
  Native (MAGA1_HUMAN)
DSDPARYEF

SEQ ID NO: 50607 - protein, 9 aa, Homo sapiens
  Native (MAGA1_HUMAN)
VGFLLLKYR

SEQ ID NO: 50608 - protein, 9 aa, Homo sapiens
  Native (MAGA1_HUMAN)
YKHCFPEIF

SEQ ID NO: 50609 - protein, 9 aa, Homo sapiens
  Native (MAGA1_HUMAN)
RQRQPSEGS

SEQ ID NO: 50610 - protein, 11 aa, Homo sapiens
  Native (MAGA1_HUMAN)
EIWEELSVMEV

SEQ ID NO: 50611 - protein, 9 aa, Homo sapiens
  Native (MAGA1_HUMAN)
REPVTKAEM

SEQ ID NO: 50612 - protein, 11 aa, Homo sapiens
  Native (MAGA1_HUMAN)
EHSAYGEPRKL

SEQ ID NO: 50613 - protein, 8 aa, Homo sapiens
  Native (MAGA1_HUMAN)
SARVRFFF

SEQ ID NO: 50614 - protein, 10 aa, Homo sapiens
  Native (MAGA1_HUMAN)
EEIWEELSVM

SEQ ID NO: 50615 - protein, 8 aa, Homo sapiens
  Native (MAGA1_HUMAN)
VADLVGFL

SEQ ID NO: 50616 - protein, 9 aa, Homo sapiens
  Native (MAGA1_HUMAN)
ALEAQQEAL

SEQ ID NO: 50617 - protein, 9 aa, Homo sapiens
  Native (MAGA1_HUMAN)
ATSSSSPLV

SEQ ID NO: 50618 - protein, 10 aa, Homo sapiens
  Native (MAGA1_HUMAN)
AVITKKVADL

SEQ ID NO: 50619 - protein, 11 aa, Homo sapiens
  Native (MAGA1_HUMAN)
KLLTQDLVQEK

SEQ ID NO: 50620 - protein, 11 aa, Homo sapiens
  Native (MAGA1_HUMAN)
EIFGKASESLQ

SEQ ID NO: 50621 - protein, 9 aa, Homo sapiens
  Native (MAGA1_HUMAN)
EIWEELSVM

SEQ ID NO: 50622 - protein, 10 aa, Homo sapiens
  Native (MAGA1_HUMAN)
RAREPVTKAE

SEQ ID NO: 50623 - protein, 8 aa, Homo sapiens
  Native (MAGA1_HUMAN)
LEYVIKVS

SEQ ID NO: 50624 - protein, 11 aa, Homo sapiens
  Native (MAGA1_HUMAN)
PEIFGKASESL

SEQ ID NO: 50625 - protein, 10 aa, Homo sapiens
  Native (MAGA1_HUMAN)
LLGDNQIMPK

SEQ ID NO: 50626 - protein, 8 aa, Homo sapiens
  Native (MAGA1_HUMAN)
AFPTTINF

SEQ ID NO: 50627 - protein, 8 aa, Homo sapiens
  Native (MAGA1_HUMAN)
SLQLVFGI

SEQ ID NO: 50628 - protein, 10 aa, Homo sapiens
  Native (MAGA1_HUMAN)
SARVRFFFPS

SEQ ID NO: 50629 - protein, 11 aa, Homo sapiens
  Native (MAGA1_HUMAN)
GREHSAYGEPR

SEQ ID NO: 50630 - protein, 9 aa, Homo sapiens
  Native (MAGA1_HUMAN)
KKVADLVGF

SEQ ID NO: 50631 - protein, 9 aa, Homo sapiens
  Native (MAGA1_HUMAN)
GASAFPTTI

SEQ ID NO: 50632 - protein, 9 aa, Homo sapiens
  Native (MAGA1_HUMAN)
YEFLWGPRA

SEQ ID NO: 50633 - protein, 10 aa, Homo sapiens
  Native (MAGA1_HUMAN)
SVMEVYDGRE

SEQ ID NO: 50634 - protein, 9 aa, Homo sapiens
  Native (MAGA1_HUMAN)
ETSYVKVLE

SEQ ID NO: 50635 - protein, 10 aa, Homo sapiens
  Native (MAGA1_HUMAN)
AFPTTINFTR

SEQ ID NO: 50636 - protein, 8 aa, Homo sapiens
  Native (MAGA1_HUMAN)
HAPEEEIW

SEQ ID NO: 50637 - protein, 8 aa, Homo sapiens
  Native (MAGA1_HUMAN)
QDLVQEKY

SEQ ID NO: 50638 - protein, 9 aa, Homo sapiens
  Native (MAGA1_HUMAN)
GLVCVQAAT

SEQ ID NO: 50639 - protein, 10 aa, Homo sapiens
  Native (MAGA1_HUMAN)
SVIKNYKHCF

SEQ ID NO: 50640 - protein, 8 aa, Homo sapiens
  Native (MAGA1_HUMAN)
LESVIKNY

SEQ ID NO: 50641 - protein, 11 aa, Homo sapiens
  Native (MAGA1_HUMAN)
SPLVLGTLEEV

SEQ ID NO: 50642 - protein, 10 aa, Homo sapiens
  Native (MAGA1_HUMAN)
QIMPKTGFLI

SEQ ID NO: 50643 - protein, 10 aa, Homo sapiens
  Native (MAGA1_HUMAN)
LEEVPTAGST

SEQ ID NO: 50644 - protein, 9 aa, Homo sapiens
  Native (MAGA1_HUMAN)
EFLWGPRAL

SEQ ID NO: 50645 - protein, 10 aa, Homo sapiens
  Native (MAGA1_HUMAN)
HSAYGEPRKL

SEQ ID NO: 50646 - protein, 10 aa, Homo sapiens
  Native (MAGA1_HUMAN)
DVKEADPTGH

SEQ ID NO: 50647 - protein, 8 aa, Homo sapiens
  Native (MAGA1_HUMAN)
LESLFRAV

SEQ ID NO: 50648 - protein, 10 aa, Homo sapiens
  Native (MAGA1_HUMAN)
TSYVKVLEYV

SEQ ID NO: 50649 - protein, 8 aa, Homo sapiens
  Native (MAGA1_HUMAN)
EMLESVIK

SEQ ID NO: 50650 - protein, 9 aa, Homo sapiens
  Native (MAGA1_HUMAN)
VPDSDPARY

SEQ ID NO: 50651 - protein, 9 aa, Homo sapiens
  Native (MAGA1_HUMAN)
SPQGASAFP

SEQ ID NO: 50652 - protein, 11 aa, Homo sapiens
  Native (MAGA1_HUMAN)
AREPVTKAEML

SEQ ID NO: 50653 - protein, 11 aa, Homo sapiens
  Native (MAGA1_HUMAN)
LKYRAREPVTK

SEQ ID NO: 50654 - protein, 10 aa, Homo sapiens
  Native (MAGA1_HUMAN)
ALAETSYVKV

SEQ ID NO: 50655 - protein, 8 aa, Homo sapiens
  Native (MAGA1_HUMAN)
AEMLESVI

SEQ ID NO: 50656 - protein, 8 aa, Homo sapiens
  Native (MAGA1_HUMAN)
REEEGPST

SEQ ID NO: 50657 - protein, 10 aa, Homo sapiens
  Native (MAGA1_HUMAN)
SAFPTTINFT

SEQ ID NO: 50658 - protein, 9 aa, Homo sapiens
  Native (MAGA1_HUMAN)
LFRAVITKK

SEQ ID NO: 50659 - protein, 8 aa, Homo sapiens
  Native (MAGA1_HUMAN)
FPEIFGKA

SEQ ID NO: 50660 - protein, 9 aa, Homo sapiens
  Native (MAGA1_HUMAN)
SYVKVLEYV

SEQ ID NO: 50661 - protein, 9 aa, Homo sapiens
  Native (MAGA1_HUMAN)
STSCILESL

SEQ ID NO: 50662 - protein, 11 aa, Homo sapiens
  Native (MAGA1_HUMAN)
ELSVMEVYDGR

SEQ ID NO: 50663 - protein, 10 aa, Homo sapiens
  Native (MAGA1_HUMAN)
EIFGKASESL

SEQ ID NO: 50664 - protein, 9 aa, Homo sapiens
  Native (MAGA1_HUMAN)
TQDLVQEKY

SEQ ID NO: 50665 - protein, 9 aa, Homo sapiens
  Native (MAGA1_HUMAN)
AYGEPRKLL

SEQ ID NO: 50666 - protein, 9 aa, Homo sapiens
  Native (MAGA1_HUMAN)
AATSSSSPL

SEQ ID NO: 50667 - protein, 9 aa, Homo sapiens
  Native (MAGA1_HUMAN)
DPTGHSYVL

SEQ ID NO: 50668 - protein, 8 aa, Homo sapiens
  Native (MAGA1_HUMAN)
EPVTKAEM

SEQ ID NO: 50669 - protein, 8 aa, Homo sapiens
  Native (MAGA1_HUMAN)
GDNQIMPK

SEQ ID NO: 50670 - protein, 11 aa, Homo sapiens
  Native (MAGA1_HUMAN)
EADPTGHSYVL

SEQ ID NO: 50671 - protein, 11 aa, Homo sapiens
  Native (MAGA1_HUMAN)
SPQGASAFPTT

SEQ ID NO: 50672 - protein, 9 aa, Homo sapiens
  Native (MAGA1_HUMAN)
EALEAQQEA

SEQ ID NO: 50673 - protein, 9 aa, Homo sapiens
  Native (MAGA1_HUMAN)
REAALREEE

SEQ ID NO: 50674 - protein, 10 aa, Homo sapiens
  Native (MAGA1_HUMAN)
EPRKLLTQDL

SEQ ID NO: 50675 - protein, 9 aa, Homo sapiens
  Native (MAGA1_HUMAN)
KTGFLIIVL

SEQ ID NO: 50676 - protein, 10 aa, Homo sapiens
  Native (MAGA1_HUMAN)
SESLQLVFGI

SEQ ID NO: 50677 - protein, 11 aa, Homo sapiens
  Native (MAGA1_HUMAN)
SYDGLLGDNQI

SEQ ID NO: 50678 - protein, 9 aa, Homo sapiens
  Native (MAGA1_HUMAN)
RYEFLWGPR

SEQ ID NO: 50679 - protein, 8 aa, Homo sapiens
  Native (MAGA1_HUMAN)
TSCILESL

SEQ ID NO: 50680 - protein, 9 aa, Homo sapiens
  Native (MAGA1_HUMAN)
ARVRFFFPS

SEQ ID NO: 50681 - protein, 9 aa, Homo sapiens
  Native (MAGA1_HUMAN)
AEMLESVIK

SEQ ID NO: 50682 - protein, 9 aa, Homo sapiens
  Native (MAGA1_HUMAN)
ASESLQLVF

SEQ ID NO: 50683 - protein, 10 aa, Homo sapiens
  Native (MAGA1_HUMAN)
KVLEYVIKVS

SEQ ID NO: 50684 - protein, 10 aa, Homo sapiens
  Native (MAGA1_HUMAN)
LSVMEVYDGR

SEQ ID NO: 50685 - protein, 8 aa, Homo sapiens
  Native (MAGA1_HUMAN)
RVRFFFPS

SEQ ID NO: 50686 - protein, 10 aa, Homo sapiens
  Native (MAGA1_HUMAN)
EALGLVCVQA

SEQ ID NO: 50687 - protein, 10 aa, Homo sapiens
  Native (MAGA1_HUMAN)
MEVYDGREHS

SEQ ID NO: 50688 - protein, 9 aa, Homo sapiens
  Native (MAGA1_HUMAN)
HSAYGEPRK

SEQ ID NO: 50689 - protein, 10 aa, Homo sapiens
  Native (MAGA1_HUMAN)
NYKHCFPEIF

SEQ ID NO: 50690 - protein, 10 aa, Homo sapiens
  Native (MAGA1_HUMAN)
AALREEEEGV

SEQ ID NO: 50691 - protein, 10 aa, Homo sapiens
  Native (MAGA1_HUMAN)
EMLESVIKNY

SEQ ID NO: 50692 - protein, 8 aa, Homo sapiens
  Native (MAGA1_HUMAN)
KASESLQL

SEQ ID NO: 50693 - protein, 10 aa, Homo sapiens
  Native (MAGA1_HUMAN)
FRAVITKKVA

SEQ ID NO: 50694 - protein, 8 aa, Homo sapiens
  Native (MAGA1_HUMAN)
VLGTLEEV

SEQ ID NO: 50695 - protein, 9 aa, Homo sapiens
  Native (MAGA1_HUMAN)
KVSARVRFF

SEQ ID NO: 50696 - protein, 9 aa, Homo sapiens
  Native (MAGA1_HUMAN)
KYRAREPVT

SEQ ID NO: 50697 - protein, 10 aa, Homo sapiens
  Native (MAGA1_HUMAN)
LEYVIKVSAR

SEQ ID NO: 50698 - protein, 9 aa, Homo sapiens
  Native (MAGA1_HUMAN)
WEELSVMEV

SEQ ID NO: 50699 - protein, 10 aa, Homo sapiens
  Native (MAGA1_HUMAN)
CLGLSYDGLL

SEQ ID NO: 50700 - protein, 8 aa, Homo sapiens
  Native (MAGA1_HUMAN)
EVYDGREH

SEQ ID NO: 50701 - protein, 9 aa, Homo sapiens
  Native (MAGA1_HUMAN)
MIAMEGGHA

SEQ ID NO: 50702 - protein, 11 aa, Homo sapiens
  Native (MAGA1_HUMAN)
PPQSPQGASAF

SEQ ID NO: 50703 - protein, 10 aa, Homo sapiens
  Native (MAGA1_HUMAN)
GHSYVLVTCL

SEQ ID NO: 50704 - protein, 9 aa, Homo sapiens
  Native (MAGA1_HUMAN)
LEEVPTAGS

SEQ ID NO: 50705 - protein, 11 aa, Homo sapiens
  Native (MAGA1_HUMAN)
GLLGDNQIMPK

SEQ ID NO: 50706 - protein, 9 aa, Homo sapiens
  Native (MAGA1_HUMAN)
GDNQIMPKT

SEQ ID NO: 50707 - protein, 9 aa, Homo sapiens
  Native (MAGA1_HUMAN)
VPTAGSTDP

SEQ ID NO: 50708 - protein, 9 aa, Homo sapiens
  Native (MAGA1_HUMAN)
GFLIIVLVM

SEQ ID NO: 50709 - protein, 10 aa, Homo sapiens
  Native (MAGA1_HUMAN)
KYRAREPVTK

SEQ ID NO: 50710 - protein, 9 aa, Homo sapiens
  Native (MAGA1_HUMAN)
RQVPDSDPA

SEQ ID NO: 50711 - protein, 9 aa, Homo sapiens
  Native (MAGA1_HUMAN)
YRAREPVTK

SEQ ID NO: 50712 - protein, 11 aa, Homo sapiens
  Native (MAGA1_HUMAN)
VKEADPTGHSY

SEQ ID NO: 50713 - protein, 10 aa, Homo sapiens
  Native (MAGA1_HUMAN)
QAATSSSSPL

SEQ ID NO: 50714 - protein, 8 aa, Homo sapiens
  Native (MAGA1_HUMAN)
RALAETSY

SEQ ID NO: 50715 - protein, 10 aa, Homo sapiens
  Native (MAGA1_HUMAN)
GFLLLKYRAR

SEQ ID NO: 50716 - protein, 11 aa, Homo sapiens
  Native (MAGA1_HUMAN)
STDPPQSPQGA

SEQ ID NO: 50717 - protein, 10 aa, Homo sapiens
  Native (MAGA1_HUMAN)
VRFFFPSLRE

SEQ ID NO: 50718 - protein, 10 aa, Homo sapiens
  Native (MAGA1_HUMAN)
SLFRAVITKK

SEQ ID NO: 50719 - protein, 11 aa, Homo sapiens
  Native (MAGA1_HUMAN)
EEEGPSTSCIL

SEQ ID NO: 50720 - protein, 10 aa, Homo sapiens
  Native (MAGA1_HUMAN)
PQSPQGASAF

SEQ ID NO: 50721 - protein, 11 aa, Homo sapiens
  Native (MAGA1_HUMAN)
LLTQDLVQEKY

SEQ ID NO: 50722 - protein, 9 aa, Homo sapiens
  Native (MAGA1_HUMAN)
TGFLIIVLV

SEQ ID NO: 50723 - protein, 8 aa, Homo sapiens
  Native (MAGA1_HUMAN)
TQDLVQEK

SEQ ID NO: 50724 - protein, 8 aa, Homo sapiens
  Native (MAGA1_HUMAN)
GFLLLKYR

SEQ ID NO: 50725 - protein, 10 aa, Homo sapiens
  Native (MAGA1_HUMAN)
LEAQQEALGL

SEQ ID NO: 50726 - protein, 8 aa, Homo sapiens
  Native (MAGA1_HUMAN)
KTGFLIIV

SEQ ID NO: 50727 - protein, 10 aa, Homo sapiens
  Native (MAGA1_HUMAN)
KAEMLESVIK

SEQ ID NO: 50728 - protein, 11 aa, Homo sapiens
  Native (MAGA1_HUMAN)
ALAETSYVKVL

SEQ ID NO: 50729 - protein, 9 aa, Homo sapiens
  Native (MAGA1_HUMAN)
FLWGPRALA

SEQ ID NO: 50730 - protein, 11 aa, Homo sapiens
  Native (MAGA1_HUMAN)
GEPRKLLTQDL

SEQ ID NO: 50731 - protein, 11 aa, Homo sapiens
  Native (MAGA1_HUMAN)
LLLKYRAREPV

SEQ ID NO: 50732 - protein, 10 aa, Homo sapiens
  Native (MAGA1_HUMAN)
STSCILESLF

SEQ ID NO: 50733 - protein, 9 aa, Homo sapiens
  Native (MAGA1_HUMAN)
QLVFGIDVK

SEQ ID NO: 50734 - protein, 10 aa, Homo sapiens
  Native (MAGA1_HUMAN)
VMIAMEGGHA

SEQ ID NO: 50735 - protein, 9 aa, Homo sapiens
  Native (MAGA1_HUMAN)
YVLVTCLGL

SEQ ID NO: 50736 - protein, 9 aa, Homo sapiens
  Native (MAGA1_HUMAN)
EAQQEALGL

SEQ ID NO: 50737 - protein, 9 aa, Homo sapiens
  Native (MAGA1_HUMAN)
GHSYVLVTC

SEQ ID NO: 50738 - protein, 11 aa, Homo sapiens
  Native (MAGA1_HUMAN)
VPDSDPARYEF

SEQ ID NO: 50739 - protein, 8 aa, Homo sapiens
  Native (MAGA1_HUMAN)
LHCKPEEA

SEQ ID NO: 50740 - protein, 8 aa, Homo sapiens
  Native (MAGA1_HUMAN)
LEAQQEAL

SEQ ID NO: 50741 - protein, 8 aa, Homo sapiens
  Native (MAGA1_HUMAN)
FLWGPRAL

SEQ ID NO: 50742 - protein, 11 aa, Homo sapiens
  Native (MAGA1_HUMAN)
SREEEGPSTSC

SEQ ID NO: 50743 - protein, 10 aa, Homo sapiens
  Native (MAGA1_HUMAN)
YRAREPVTKA

SEQ ID NO: 50744 - protein, 8 aa, Homo sapiens
  Native (MAGA1_HUMAN)
EEEIWEEL

SEQ ID NO: 50745 - protein, 10 aa, Homo sapiens
  Native (MAGA1_HUMAN)
ILESLFRAVI

SEQ ID NO: 50746 - protein, 9 aa, Homo sapiens
  Native (MAGA1_HUMAN)
ALGLVCVQA

SEQ ID NO: 50747 - protein, 10 aa, Homo sapiens
  Native (MAGA1_HUMAN)
IMPKTGFLII

SEQ ID NO: 50748 - protein, 9 aa, Homo sapiens
  Native (MAGA1_HUMAN)
GLLGDNQIM

SEQ ID NO: 50749 - protein, 10 aa, Homo sapiens
  Native (MAGA1_HUMAN)
YRQVPDSDPA

SEQ ID NO: 50750 - protein, 11 aa, Homo sapiens
  Native (MAGA1_HUMAN)
LTQDLVQEKYL

SEQ ID NO: 50751 - protein, 9 aa, Homo sapiens
  Native (MAGA1_HUMAN)
SLHCKPEEA

SEQ ID NO: 50752 - protein, 9 aa, Homo sapiens
  Native (MAGA1_HUMAN)
REEEGPSTS

SEQ ID NO: 50753 - protein, 8 aa, Homo sapiens
  Native (MAGA1_HUMAN)
HSAYGEPR

SEQ ID NO: 50754 - protein, 10 aa, Homo sapiens
  Native (MAGA1_HUMAN)
EADPTGHSYV

SEQ ID NO: 50755 - protein, 11 aa, Homo sapiens
  Native (MAGA1_HUMAN)
KNYKHCFPEIF

SEQ ID NO: 50756 - protein, 9 aa, Homo sapiens
  Native (MAGA1_HUMAN)
CILESLFRA

SEQ ID NO: 50757 - protein, 10 aa, Homo sapiens
  Native (MAGA1_HUMAN)
SDPARYEFLW

SEQ ID NO: 50758 - protein, 10 aa, Homo sapiens
  Native (MAGA1_HUMAN)
VLEYVIKVSA

SEQ ID NO: 50759 - protein, 11 aa, Homo sapiens
  Native (MAGA1_HUMAN)
YVKVLEYVIKV

SEQ ID NO: 50760 - protein, 11 aa, Homo sapiens
  Native (MAGA1_HUMAN)
REAALREEEEG

SEQ ID NO: 50761 - protein, 9 aa, Homo sapiens
  Native (MAGA1_HUMAN)
GGHAPEEEI

SEQ ID NO: 50762 - protein, 10 aa, Homo sapiens
  Native (MAGA1_HUMAN)
REPVTKAEML

SEQ ID NO: 50763 - protein, 10 aa, Homo sapiens
  Native (MAGA1_HUMAN)
KTGFLIIVLV

SEQ ID NO: 50764 - protein, 9 aa, Homo sapiens
  Native (MAGA1_HUMAN)
KEADPTGHS

SEQ ID NO: 50765 - protein, 9 aa, Homo sapiens
  Native (MAGA1_HUMAN)
CLGLSYDGL

SEQ ID NO: 50766 - protein, 8 aa, Homo sapiens
  Native (MAGA1_HUMAN)
SESLQLVF

SEQ ID NO: 50767 - protein, 8 aa, Homo sapiens
  Native (MAGA1_HUMAN)
RAREPVTK

SEQ ID NO: 50768 - protein, 11 aa, Homo sapiens
  Native (MAGA1_HUMAN)
SARVRFFFPSL

SEQ ID NO: 50769 - protein, 8 aa, Homo sapiens
  Native (MAGA1_HUMAN)
AETSYVKV

SEQ ID NO: 50770 - protein, 11 aa, Homo sapiens
  Native (MAGA1_HUMAN)
IKVSARVRFFF

SEQ ID NO: 50771 - protein, 8 aa, Homo sapiens
  Native (MAGA1_HUMAN)
CILESLFR

SEQ ID NO: 50772 - protein, 9 aa, Homo sapiens
  Native (MAGA1_HUMAN)
EEVPTAGST

SEQ ID NO: 50773 - protein, 10 aa, Homo sapiens
  Native (MAGA1_HUMAN)
QQEALGLVCV

SEQ ID NO: 50774 - protein, 9 aa, Homo sapiens
  Native (MAGA1_HUMAN)
LQLVFGIDV

SEQ ID NO: 50775 - protein, 11 aa, Homo sapiens
  Native (MAGA1_HUMAN)
VQAATSSSSPL

SEQ ID NO: 50776 - protein, 9 aa, Homo sapiens
  Native (MAGA1_HUMAN)
YDGREHSAY

SEQ ID NO: 50777 - protein, 8 aa, Homo sapiens
  Native (MAGA1_HUMAN)
ITKKVADL

SEQ ID NO: 50778 - protein, 11 aa, Homo sapiens
  Native (MAGA1_HUMAN)
EMLESVIKNYK

SEQ ID NO: 50779 - protein, 11 aa, Homo sapiens
  Native (MAGA1_HUMAN)
SVMEVYDGREH

SEQ ID NO: 50780 - protein, 11 aa, Homo sapiens
  Native (MAGA1_HUMAN)
GDNQIMPKTGF

SEQ ID NO: 50781 - protein, 9 aa, Homo sapiens
  Native (MAGA1_HUMAN)
YVKVLEYVI

SEQ ID NO: 50782 - protein, 10 aa, Homo sapiens
  Native (MAGA1_HUMAN)
TSCILESLFR

SEQ ID NO: 50783 - protein, 11 aa, Homo sapiens
  Native (MAGA1_HUMAN)
EEVPTAGSTDP

SEQ ID NO: 50784 - protein, 9 aa, Homo sapiens
  Native (MAGA1_HUMAN)
ILESLFRAV

SEQ ID NO: 50785 - protein, 8 aa, Homo sapiens
  Native (MAGA1_HUMAN)
ESVIKNYK

SEQ ID NO: 50786 - protein, 10 aa, Homo sapiens
  Native (MAGA1_HUMAN)
DPTGHSYVLV

SEQ ID NO: 50787 - protein, 8 aa, Homo sapiens
  Native (MAGA1_HUMAN)
EEGPSTSC

SEQ ID NO: 50788 - protein, 10 aa, Homo sapiens
  Native (MAGA1_HUMAN)
MLESVIKNYK

SEQ ID NO: 50789 - protein, 8 aa, Homo sapiens
  Native (MAGA1_HUMAN)
SPQGASAF

SEQ ID NO: 50790 - protein, 10 aa, Homo sapiens
  Native (MAGA1_HUMAN)
KVSARVRFFF

SEQ ID NO: 50791 - protein, 9 aa, Homo sapiens
  Native (MAGA1_HUMAN)
NQIMPKTGF

SEQ ID NO: 50792 - protein, 9 aa, Homo sapiens
  Native (MAGA1_HUMAN)
HCFPEIFGK

SEQ ID NO: 50793 - protein, 8 aa, Homo sapiens
  Native (MAGA1_HUMAN)
VTCLGLSY

SEQ ID NO: 50794 - protein, 10 aa, Homo sapiens
  Native (MAGA1_HUMAN)
KVADLVGFLL

SEQ ID NO: 50795 - protein, 8 aa, Homo sapiens
  Native (MAGA1_HUMAN)
GPSTSCIL

SEQ ID NO: 50796 - protein, 8 aa, Homo sapiens
  Native (MAGA1_HUMAN)
FPTTINFT

SEQ ID NO: 50797 - protein, 9 aa, Homo sapiens
  Native (MAGA1_HUMAN)
DLVGFLLLK

SEQ ID NO: 50798 - protein, 11 aa, Homo sapiens
  Native (MAGA1_HUMAN)
DLVQEKYLEYR

SEQ ID NO: 50799 - protein, 11 aa, Homo sapiens
  Native (MAGA1_HUMAN)
MEVYDGREHSA

SEQ ID NO: 50800 - protein, 9 aa, Homo sapiens
  Native (MAGA1_HUMAN)
DPPQSPQGA

SEQ ID NO: 50801 - protein, 11 aa, Homo sapiens
  Native (MAGA1_HUMAN)
KVSARVRFFFP

SEQ ID NO: 50802 - protein, 11 aa, Homo sapiens
  Native (MAGA1_HUMAN)
SYVKVLEYVIK

SEQ ID NO: 50803 - protein, 9 aa, Homo sapiens
  Native (MAGA1_HUMAN)
DGLLGDNQI

SEQ ID NO: 50804 - protein, 10 aa, Homo sapiens
  Native (MAGA1_HUMAN)
VADLVGFLLL

SEQ ID NO: 50805 - protein, 10 aa, Homo sapiens
  Native (MAGA1_HUMAN)
YVIKVSARVR

SEQ ID NO: 50806 - protein, 9 aa, Homo sapiens
  Native (MAGA1_HUMAN)
QSPQGASAF

SEQ ID NO: 50807 - protein, 9 aa, Homo sapiens
  Native (MAGA1_HUMAN)
LKYRAREPV

SEQ ID NO: 50808 - protein, 11 aa, Homo sapiens
  Native (MAGA1_HUMAN)
CILESLFRAVI

SEQ ID NO: 50809 - protein, 10 aa, Homo sapiens
  Native (MAGA1_HUMAN)
RQVPDSDPAR

SEQ ID NO: 50810 - protein, 9 aa, Homo sapiens
  Native (MAGA1_HUMAN)
QPSEGSSSR

SEQ ID NO: 50811 - protein, 9 aa, Homo sapiens
  Native (MAGA1_HUMAN)
VIKNYKHCF

SEQ ID NO: 50812 - protein, 9 aa, Homo sapiens
  Native (MAGA1_HUMAN)
EKYLEYRQV

SEQ ID NO: 50813 - protein, 8 aa, Homo sapiens
  Native (MAGA1_HUMAN)
TGHSYVLV

SEQ ID NO: 50814 - protein, 10 aa, Homo sapiens
  Native (MAGA1_HUMAN)
EEEIWEELSV

SEQ ID NO: 50815 - protein, 11 aa, Homo sapiens
  Native (MAGA1_HUMAN)
RQVPDSDPARY

SEQ ID NO: 50816 - protein, 11 aa, Homo sapiens
  Native (MAGA1_HUMAN)
DPPQSPQGASA

SEQ ID NO: 50817 - protein, 11 aa, Homo sapiens
  Native (MAGA1_HUMAN)
ITKKVADLVGF

SEQ ID NO: 50818 - protein, 9 aa, Homo sapiens
  Native (MAGA1_HUMAN)
PRALAETSY

SEQ ID NO: 50819 - protein, 9 aa, Homo sapiens
  Native (MAGA1_HUMAN)
EEGPSTSCI

SEQ ID NO: 50820 - protein, 8 aa, Homo sapiens
  Native (MAGA1_HUMAN)
VSARVRFF

SEQ ID NO: 50821 - protein, 11 aa, Homo sapiens
  Native (MAGA1_HUMAN)
STSCILESLFR

SEQ ID NO: 50822 - protein, 10 aa, Homo sapiens
  Native (MAGA1_HUMAN)
ARYEFLWGPR

SEQ ID NO: 50823 - protein, 9 aa, Homo sapiens
  Native (MAGA1_HUMAN)
KASESLQLV

SEQ ID NO: 50824 - protein, 9 aa, Homo sapiens
  Native (MAGA1_HUMAN)
ALREEEEGV

SEQ ID NO: 50825 - protein, 11 aa, Homo sapiens
  Native (MAGA1_HUMAN)
FPTTINFTRQR

SEQ ID NO: 50826 - protein, 10 aa, Homo sapiens
  Native (MAGA1_HUMAN)
PPQSPQGASA

SEQ ID NO: 50827 - protein, 10 aa, Homo sapiens
  Native (MAGA1_HUMAN)
SLHCKPEEAL

SEQ ID NO: 50828 - protein, 11 aa, Homo sapiens
  Native (MAGA1_HUMAN)
QRQPSEGSSSR

SEQ ID NO: 50829 - protein, 9 aa, Homo sapiens
  Native (MAGA1_HUMAN)
SESLQLVFG

SEQ ID NO: 50830 - protein, 10 aa, Homo sapiens
  Native (MAGA1_HUMAN)
PTTINFTRQR

SEQ ID NO: 50831 - protein, 10 aa, Homo sapiens
  Native (MAGA1_HUMAN)
RQPSEGSSSR

SEQ ID NO: 50832 - protein, 8 aa, Homo sapiens
  Native (MAGA1_HUMAN)
AYGEPRKL

SEQ ID NO: 50833 - protein, 9 aa, Homo sapiens
  Native (MAGA1_HUMAN)
GKASESLQL

SEQ ID NO: 50834 - protein, 8 aa, Homo sapiens
  Native (MAGA1_HUMAN)
KHCFPEIF

SEQ ID NO: 50835 - protein, 11 aa, Homo sapiens
  Native (MAGA1_HUMAN)
FLWGPRALAET

SEQ ID NO: 50836 - protein, 10 aa, Homo sapiens
  Native (MAGA1_HUMAN)
APEEEIWEEL

SEQ ID NO: 50837 - protein, 11 aa, Homo sapiens
  Native (MAGA1_HUMAN)
RVRFFFPSLRE

SEQ ID NO: 50838 - protein, 10 aa, Homo sapiens
  Native (MAGA1_HUMAN)
VIKVSARVRF

SEQ ID NO: 50839 - protein, 8 aa, Homo sapiens
  Native (MAGA1_HUMAN)
AQQEALGL

SEQ ID NO: 50840 - protein, 10 aa, Homo sapiens
  Native (MAGA1_HUMAN)
AQQEALGLVC

SEQ ID NO: 50841 - protein, 11 aa, Homo sapiens
  Native (MAGA1_HUMAN)
KYRAREPVTKA

SEQ ID NO: 50842 - protein, 9 aa, Homo sapiens
  Native (MAGA1_HUMAN)
RALAETSYV

SEQ ID NO: 50843 - protein, 10 aa, Homo sapiens
  Native (MAGA1_HUMAN)
VPTAGSTDPP

SEQ ID NO: 50844 - protein, 8 aa, Homo sapiens
  Native (MAGA1_HUMAN)
EELSVMEV

SEQ ID NO: 50845 - protein, 8 aa, Homo sapiens
  Native (MAGA1_HUMAN)
IWEELSVM

SEQ ID NO: 50846 - protein, 9 aa, Homo sapiens
  Native (MAGA1_HUMAN)
RAVITKKVA

SEQ ID NO: 50847 - protein, 11 aa, Homo sapiens
  Native (MAGA1_HUMAN)
YEFLWGPRALA

SEQ ID NO: 50848 - protein, 11 aa, Homo sapiens
  Native (MAGA1_HUMAN)
FFPSLREAALR

SEQ ID NO: 50849 - protein, 8 aa, Homo sapiens
  Native (MAGA1_HUMAN)
YGEPRKLL

SEQ ID NO: 50850 - protein, 8 aa, Homo sapiens
  Native (MAGA1_HUMAN)
SYVKVLEY

SEQ ID NO: 50851 - protein, 9 aa, Homo sapiens
  Native (MAGA1_HUMAN)
PQSPQGASA

SEQ ID NO: 50852 - protein, 9 aa, Homo sapiens
  Native (MAGA1_HUMAN)
EEEGPSTSC

SEQ ID NO: 50853 - protein, 9 aa, Homo sapiens
  Native (MAGA1_HUMAN)
FLIIVLVMI

SEQ ID NO: 50854 - protein, 11 aa, Homo sapiens
  Native (MAGA1_HUMAN)
SCILESLFRAV

SEQ ID NO: 50855 - protein, 8 aa, Homo sapiens
  Native (MAGA1_HUMAN)
SAYGEPRK

SEQ ID NO: 50856 - protein, 8 aa, Homo sapiens
  Native (MAGA1_HUMAN)
YKHCFPEI

SEQ ID NO: 50857 - protein, 9 aa, Homo sapiens
  Native (MAGA1_HUMAN)
PEEEIWEEL

SEQ ID NO: 50858 - protein, 11 aa, Homo sapiens
  Native (MAGA1_HUMAN)
KEADPTGHSYV

SEQ ID NO: 50859 - protein, 11 aa, Homo sapiens
  Native (MAGA1_HUMAN)
DLVGFLLLKYR

SEQ ID NO: 50860 - protein, 9 aa, Homo sapiens
  Native (MAGA1_HUMAN)
LESLFRAVI

SEQ ID NO: 50861 - protein, 10 aa, Homo sapiens
  Native (MAGA1_HUMAN)
SSSPLVLGTL

SEQ ID NO: 50862 - protein, 8 aa, Homo sapiens
  Native (MAGA1_HUMAN)
GHAPEEEI

SEQ ID NO: 50863 - protein, 11 aa, Homo sapiens
  Native (MAGA1_HUMAN)
KVADLVGFLLL

SEQ ID NO: 50864 - protein, 11 aa, Homo sapiens
  Native (MAGA1_HUMAN)
MSLEQRSLHCK

SEQ ID NO: 50865 - protein, 9 aa, Homo sapiens
  Native (MAGA1_HUMAN)
LGDNQIMPK

SEQ ID NO: 50866 - protein, 9 aa, Homo sapiens
  Native (MAGA1_HUMAN)
KAEMLESVI

SEQ ID NO: 50867 - protein, 10 aa, Homo sapiens
  Native (MAGA1_HUMAN)
LVLGTLEEVP

SEQ ID NO: 50868 - protein, 10 aa, Homo sapiens
  Native (MAGA1_HUMAN)
LLTQDLVQEK

SEQ ID NO: 50869 - protein, 11 aa, Homo sapiens
  Native (MAGA1_HUMAN)
AQQEALGLVCV

SEQ ID NO: 50870 - protein, 10 aa, Homo sapiens
  Native (MAGA1_HUMAN)
KKVADLVGFL

SEQ ID NO: 50871 - protein, 10 aa, Homo sapiens
  Native (MAGA1_HUMAN)
LESLFRAVIT

SEQ ID NO: 50872 - protein, 11 aa, Homo sapiens
  Native (MAGA1_HUMAN)
RAREPVTKAEM

SEQ ID NO: 50873 - protein, 11 aa, Homo sapiens
  Native (MAGA1_HUMAN)
SAFPTTINFTR

SEQ ID NO: 50874 - protein, 10 aa, Homo sapiens
  Native (MAGA1_HUMAN)
WEELSVMEVY

SEQ ID NO: 50875 - protein, 11 aa, Homo sapiens
  Native (MAGA1_HUMAN)
EEALEAQQEAL

SEQ ID NO: 50876 - protein, 11 aa, Homo sapiens
  Native (MAGA1_HUMAN)
AGSTDPPQSPQ

SEQ ID NO: 50877 - protein, 10 aa, Homo sapiens
  Native (MAGA1_HUMAN)
SPQGASAFPT

SEQ ID NO: 50878 - protein, 11 aa, Homo sapiens
  Native (MAGA1_HUMAN)
IWEELSVMEVY

SEQ ID NO: 50879 - protein, 9 aa, Homo sapiens
  Native (MAGA1_HUMAN)
LEAQQEALG

SEQ ID NO: 50880 - protein, 11 aa, Homo sapiens
  Native (MAGA1_HUMAN)
YVIKVSARVRF

SEQ ID NO: 50881 - protein, 11 aa, Homo sapiens
  Native (MAGA1_HUMAN)
FGKASESLQLV

SEQ ID NO: 50882 - protein, 8 aa, Homo sapiens
  Native (MAGA1_HUMAN)
ASAFPTTI

SEQ ID NO: 50883 - protein, 10 aa, Homo sapiens
  Native (MAGA1_HUMAN)
EYVIKVSARV

SEQ ID NO: 50884 - protein, 11 aa, Homo sapiens
  Native (MAGA1_HUMAN)
HAPEEEIWEEL

SEQ ID NO: 50885 - protein, 10 aa, Homo sapiens
  Native (MAGA1_HUMAN)
KHCFPEIFGK

SEQ ID NO: 50886 - protein, 8 aa, Homo sapiens
  Native (MAGA1_HUMAN)
RAVITKKV

SEQ ID NO: 50887 - protein, 10 aa, Homo sapiens
  Native (MAGA1_HUMAN)
REEEGPSTSC

SEQ ID NO: 50888 - protein, 9 aa, Homo sapiens
  Native (MAGA1_HUMAN)
ITKKVADLV

SEQ ID NO: 50889 - protein, 9 aa, Homo sapiens
  Native (MAGA1_HUMAN)
HSYVLVTCL

SEQ ID NO: 50890 - protein, 9 aa, Homo sapiens
  Native (MAGA1_HUMAN)
EADPTGHSY

SEQ ID NO: 50891 - protein, 9 aa, Homo sapiens
  Native (MAGA1_HUMAN)
VIKVSARVR

SEQ ID NO: 50892 - protein, 9 aa, Homo sapiens
  Native (MAGA1_HUMAN)
KVADLVGFL

SEQ ID NO: 50893 - protein, 8 aa, Homo sapiens
  Native (MAGA1_HUMAN)
FGKASESL

SEQ ID NO: 50894 - protein, 10 aa, Homo sapiens
  Native (MAGA1_HUMAN)
ADLVGFLLLK

SEQ ID NO: 50895 - protein, 8 aa, Homo sapiens
  Native (MAGA1_HUMAN)
QEALGLVC

SEQ ID NO: 50896 - protein, 8 aa, Homo sapiens
  Native (MAGA1_HUMAN)
VQEKYLEY

SEQ ID NO: 50897 - protein, 8 aa, Homo sapiens
  Native (MAGA1_HUMAN)
YVKVLEYV

SEQ ID NO: 50898 - protein, 11 aa, Homo sapiens
  Native (MAGA1_HUMAN)
MPKTGFLIIVL

SEQ ID NO: 50899 - protein, 10 aa, Homo sapiens
  Native (MAGA1_HUMAN)
EVYDGREHSA

SEQ ID NO: 50900 - protein, 9 aa, Homo sapiens
  Native (MAGA1_HUMAN)
VRFFFPSLR

SEQ ID NO: 50901 - protein, 8 aa, Homo sapiens
  Native (MAGA1_HUMAN)
VLEYVIKV

SEQ ID NO: 50902 - protein, 8 aa, Homo sapiens
  Native (MAGA1_HUMAN)
ELSVMEVY

SEQ ID NO: 50903 - protein, 11 aa, Homo sapiens
  Native (MAGA1_HUMAN)
ALEAQQEALGL

SEQ ID NO: 50904 - protein, 10 aa, Homo sapiens
  Native (MAGA1_HUMAN)
VYDGREHSAY

SEQ ID NO: 50905 - protein, 9 aa, Homo sapiens
  Native (MAGA1_HUMAN)
EPVTKAEML

SEQ ID NO: 50906 - protein, 11 aa, Homo sapiens
  Native (MAGA1_HUMAN)
EEEIWEELSVM

SEQ ID NO: 50907 - protein, 11 aa, Homo sapiens
  Native (MAGA1_HUMAN)
IMPKTGFLIIV

SEQ ID NO: 50908 - protein, 11 aa, Homo sapiens
  Native (MAGA1_HUMAN)
LHCKPEEALEA

SEQ ID NO: 50909 - protein, 8 aa, Homo sapiens
  Native (MAGA1_HUMAN)
VGFLLLKY

SEQ ID NO: 50910 - protein, 10 aa, Homo sapiens
  Native (MAGA1_HUMAN)
LVGFLLLKYR

SEQ ID NO: 50911 - protein, 8 aa, Homo sapiens
  Native (MAGA1_HUMAN)
SDPARYEF

SEQ ID NO: 50912 - protein, 9 aa, Homo sapiens
  Native (MAGA1_HUMAN)
VYDGREHSA

SEQ ID NO: 50913 - protein, 8 aa, Homo sapiens
  Native (MAGA1_HUMAN)
TGFLIIVL

SEQ ID NO: 50914 - protein, 11 aa, Homo sapiens
  Native (MAGA1_HUMAN)
MEGGHAPEEEI

SEQ ID NO: 50915 - protein, 10 aa, Homo sapiens
  Native (MAGA1_HUMAN)
TKKVADLVGF

SEQ ID NO: 50916 - protein, 11 aa, Homo sapiens
  Native (MAGA1_HUMAN)
SSSSPLVLGTL

SEQ ID NO: 50917 - protein, 8 aa, Homo sapiens
  Native (MAGA1_HUMAN)
ILESLFRA

SEQ ID NO: 50918 - protein, 9 aa, Homo sapiens
  Native (MAGA1_HUMAN)
LAETSYVKV

SEQ ID NO: 50919 - protein, 11 aa, Homo sapiens
  Native (MAGA1_HUMAN)
VADLVGFLLLK

SEQ ID NO: 50920 - protein, 9 aa, Homo sapiens
  Native (MAGA1_HUMAN)
VITKKVADL

SEQ ID NO: 50921 - protein, 9 aa, Homo sapiens
  Native (MAGA1_HUMAN)
GTLEEVPTA

SEQ ID NO: 50922 - protein, 10 aa, Homo sapiens
  Native (MAGA1_HUMAN)
IKVSARVRFF

SEQ ID NO: 50923 - protein, 10 aa, Artificial Sequence
  Description of Artificial Sequence: Synthetic peptide
  Seed: AALREEEEGV (MAGA1_HUMAN)
  misc_feature (2)..(2): Xaa can be Tyr, Phe, Met, Leu, Val, Asn, Ile, Ala, Thr, Asp, His, Arg, Glu, Ser, Pro, Gln, Cys, Trp, Gly, or Lys
  misc_feature (10)..(10): Xaa can be Leu, Val, or Ile
AXLREEEEGX

SEQ ID NO: 50924 - protein, 9 aa, Artificial Sequence
  Description of Artificial Sequence: Synthetic peptide
  Seed: AATSSSSPL (MAGA1_HUMAN)
  misc_feature (2)..(2): Xaa can be Pro, Gln, Ala, Leu, Ser, Tyr, Val, Ile, Lys, Thr, Met, Trp, Phe, Gly, His, Glu, Arg, Asp, Asn, or Cys
  misc_feature (9)..(9): Xaa can be Tyr, Phe, Leu, Met, Ile, Trp, Val, His, Ala, Lys, Arg, Cys, Gly, Thr, Ser, or Pro
AXTSSSSPX

SEQ ID NO: 50925 - protein, 11 aa, Artificial Sequence
  Description of Artificial Sequence: Synthetic peptide
  Seed: AATSSSSPLVL (MAGA1_HUMAN)
  misc_feature (2)..(2): Xaa can be Ala, Ser, Thr, Val, Ile, Gly, Leu, Arg, Cys, Gln, Met, Asn, Asp, or Glu
  misc_feature (11)..(11): Xaa can be Lys, Arg, Tyr, Phe, Leu, His, Met, Ile, Val, or Trp
AXTSSSSPLVX

SEQ ID NO: 50926 - protein, 8 aa, Artificial Sequence
  Description of Artificial Sequence: Synthetic peptide
  Seed: ADLVGFLL (MAGA1_HUMAN)
  misc_feature (2)..(2): Xaa can be Glu, or Asp
  misc_feature (8)..(8): Xaa can be Leu, Met, Ala, Val, Ile, Phe, Ser, Cys, Thr, Pro, or Gly
AXLVGFLX

SEQ ID NO: 50927 - protein, 9 aa, Artificial Sequence
  Description of Artificial Sequence: Synthetic peptide
  Seed: ADLVGFLLL (MAGA1_HUMAN)
  misc_feature (2)..(2): Xaa can be Glu, Gln, Asp, Arg, Ala, His, Asn, Ser, Leu, Met, Ile, Gly, Val, Thr, Lys, Pro, or Tyr
  misc_feature (9)..(9): Xaa can be Val, Leu, Ile, Met, Phe, Cys, Tyr, Trp, Thr, Ala, Lys, Pro, Arg, His, Asp, Gln, Ser, Gly, Glu, or Asn
AXLVGFLLX

SEQ ID NO: 50928 - protein, 10 aa, Artificial Sequence
  Description of Artificial Sequence: Synthetic peptide
  Seed: ADLVGFLLLK (MAGA1_HUMAN)
  misc_feature (2)..(2): Xaa can be Thr, Met, Ala, Ile, Val, Arg, Leu, Lys, Ser, Trp, Gly, Asp, Pro, Tyr, Glu, Phe, His, Cys, Asn, or Gln
  misc_feature (10)..(10): Xaa can be Arg, Lys, Tyr, or His
AXLVGFLLLX

SEQ ID NO: 50929 - protein, 8 aa, Artificial Sequence
  Description of Artificial Sequence: Synthetic peptide
  Seed: ADPTGHSY (MAGA1_HUMAN)
  misc_feature (2)..(2): Xaa can be Ala, Glu, Ser, Ile, Thr, Val, Gln, Asp, Gly, Cys, Asn, Leu, Met, Pro, Phe, Tyr, or Lys
  misc_feature (8)..(8): Xaa can be Tyr, Phe, Leu, Met, Val, Ile, His, Trp, Ala, Cys, Lys, Thr, Gln, or Arg
AXPTGHSX

SEQ ID NO: 50930 - protein, 9 aa, Artificial Sequence
  Description of Artificial Sequence: Synthetic peptide
  Seed: ADPTGHSYV (MAGA1_HUMAN)
  misc_feature (2)..(2): Xaa can be Glu, Asp, Gln, Ala, or Ser
  misc_feature (9)..(9): Xaa can be Met, Leu, Phe, Ile, Val, Ala, Tyr, Ser, Trp, Gly, Pro, Cys, or Thr
AXPTGHSYX

SEQ ID NO: 50931 - protein, 10 aa, Artificial Sequence
  Description of Artificial Sequence: Synthetic peptide
  Seed: ADPTGHSYVL (MAGA1_HUMAN)
  misc_feature (2)..(2): Xaa can be Glu, Met, Phe, Pro, Tyr, Leu, Val, His, Thr, Trp, Gln, Lys, Asp, Asn, Cys, Arg, Ala, Gly, Ser, or Ile
  misc_feature (10)..(10): Xaa can be Ile, Met, Val, Leu, Phe, Ala, Trp, Pro, Thr, Cys, or Tyr
AXPTGHSYVX

SEQ ID NO: 50932 - protein, 8 aa, Artificial Sequence
  Description of Artificial Sequence: Synthetic peptide
  Seed: AEMLESVI (MAGA1_HUMAN)
  misc_feature (2)..(2): Xaa can be Glu, Asp, Gln, Ala, Ser, or Met
  misc_feature (8)..(8): Xaa can be Ile, Leu, Val, Met, Ala, Tyr, Phe, Thr, Trp, Pro, Ser, Cys, Gly, or His
AXMLESVX

SEQ ID NO: 50933 - protein, 9 aa, Artificial Sequence
  Description of Artificial Sequence: Synthetic peptide
  Seed: AEMLESVIK (MAGA1_HUMAN)
  misc_feature (2)..(2): Xaa can be Glu, Asp, Gln, or Arg
  misc_feature (9)..(9): Xaa can be Phe, Tyr, Val, Cys, Lys, Ala, Trp, Leu, Met, Ile, Pro, Thr, Arg, Ser, His, Glu, Asn, Asp, Gly, or Gln
AXMLESVIX

SEQ ID NO: 50934 - protein, 11 aa, Artificial Sequence
  Description of Artificial Sequence: Synthetic peptide
  Seed: AEMLESVIKNY (MAGA1_HUMAN)
  misc_feature (2)..(2): Xaa can be Glu, Asp, Gln, Lys, Ala, Leu, Val, Met, Ile, Ser, Arg, His, Thr, or Pro
  misc_feature (11)..(11): Xaa can be Tyr, Phe, Leu, Trp, Met, Ile, Lys, Cys, His, Thr, Val, or Ala
AXMLESVIKNX

SEQ ID NO: 50935 - protein, 8 aa, Artificial Sequence
  Description of Artificial Sequence: Synthetic peptide
  Seed: AETSYVKV (MAGA1_HUMAN)
  misc_feature (2)..(2): Xaa can be Glu, Asp, Gln, Ala, or Ser
  misc_feature (8)..(8): Xaa can be Ile, Val, Leu, Met, Phe, Cys, Ala, Pro, or Thr
AXTSYVKX

SEQ ID NO: 50936 - protein, 9 aa, Artificial Sequence
  Description of Artificial Sequence: Synthetic peptide
  Seed: AETSYVKVL (MAGA1_HUMAN)
  misc_feature (2)..(2): Xaa can be Glu, Gln, Asp, Val, Ile, Met, Arg, Leu, Gly, Thr, Ala, Asn, Ser, His, Tyr, Lys, Phe, Pro, Trp, or Cys
  misc_feature (9)..(9): Xaa can be Leu, Phe, Met, Tyr, Ile, Val, Trp, Cys, Thr, Ala, Lys, His, Pro, Ser, Arg, Glu, Asn, Asp, Gln, or Gly
AXTSYVKVX

SEQ ID NO: 50937 - protein, 11 aa, Artificial Sequence
  Description of Artificial Sequence: Synthetic peptide
  Seed: AETSYVKVLEY (MAGA1_HUMAN)
  misc_feature (2)..(2): Xaa can be Glu, Thr, Ser, Ala, Asp, Leu, Phe, Lys, Tyr, Trp, Cys, Asn, Gly, Val, Met, Arg, Pro, His, Gln, or Ile
  misc_feature (11)..(11): Xaa can be Trp, Phe, Tyr, Met, Ile, Leu, or His
AXTSYVKVLEX

SEQ ID NO: 50938 - protein, 8 aa, Artificial Sequence
  Description of Artificial Sequence: Synthetic peptide
  Seed: AFPTTINF (MAGA1_HUMAN)
  misc_feature (2)..(2): Xaa can be Phe, Tyr, Arg, Trp, His, Gln, Ala, or Met
  misc_feature (8)..(8): Xaa can be Leu, Phe, Tyr, Met, Val, Trp, or Ile
AXPTTINX

SEQ ID NO: 50939 - protein, 10 aa, Artificial Sequence
  Description of Artificial Sequence: Synthetic peptide
  Seed: AFPTTINFTR (MAGA1_HUMAN)
  misc_feature (2)..(2): Xaa can be Val, Met, Thr, Leu, Ala, Gln, Phe, Ser, Trp, Ile, Tyr, Asn, or Gly
  misc_feature (10)..(10): Xaa can be Arg, Lys, or Tyr
AXPTTINFTX

SEQ ID NO: 50940 - protein, 11 aa, Artificial Sequence
  Description of Artificial Sequence: Synthetic peptide
  Seed: AGSTDPPQSPQ (MAGA1_HUMAN)
  misc_feature (2)..(2): Xaa can be Arg, Gly, Asn, Ala, Pro, or Gln
  misc_feature (11)..(11): Xaa can be Lys, Tyr, Arg, Phe, His, Leu, Asn, Ile, Trp, Met, Gln, or Glu
AXSTDPPQSPX

SEQ ID NO: 50941 - protein, 8 aa, Artificial Sequence
  Description of Artificial Sequence: Synthetic peptide
  Seed: ALAETSYV (MAGA1_HUMAN)
  misc_feature (2)..(2): Xaa can be Met, Leu, or Ile
  misc_feature (8)..(8): Xaa can be Val, Ala, Leu, Ile, or Met
AXAETSYX

SEQ ID NO: 50942 - protein, 9 aa, Artificial Sequence
  Description of Artificial Sequence: Synthetic peptide
  Seed: ALAETSYVK (MAGA1_HUMAN)
  misc_feature (2)..(2): Xaa can be Met, Leu, Ile, Thr, Val, Ala, Ser, Gly, Asn, Phe, Gln, Asp, Cys, Glu, Trp, Tyr, or Pro
  misc_feature (9)..(9): Xaa can be Lys, Tyr, Arg, His, Leu, Phe, Met, Ile, or Val
AXAETSYVX

SEQ ID NO: 50943 - protein, 10 aa, Artificial Sequence
  Description of Artificial Sequence: Synthetic peptide
  Seed: ALAETSYVKV (MAGA1_HUMAN)
  misc_feature (2)..(2): Xaa can be Gln, Leu, Met, Ile, Val, Thr, Glu, Ala, Ser, Phe, Tyr, Gly, Asn, Trp, or Lys
  misc_feature (10)..(10): Xaa can be Arg, Lys, Trp, Val, Phe, Ile, Leu, Met, Tyr, Ala, Thr, or Cys
AXAETSYVKX

SEQ ID NO: 50944 - protein, 11 aa, Artificial Sequence
  Description of Artificial Sequence: Synthetic peptide
  Seed: ALAETSYVKVL (MAGA1_HUMAN)
  misc_feature (2)..(2): Xaa can be Leu, Met, Gln, Glu, Ile, Val, Asn, Trp, Lys, Cys, Asp, Gly, His, Pro, Ser, Arg, Tyr, Ala, Phe, or Thr
  misc_feature (11)..(11): Xaa can be Leu, Val, Ile, Phe, Met, Trp, Ala, Thr, Lys, Asp, Tyr, Gly, Pro, Glu, Asn, Cys, Arg, His, Ser, or Gln
AXAETSYVKVX

SEQ ID NO: 50945 - protein, 9 aa, Artificial Sequence
  Description of Artificial Sequence: Synthetic peptide
  Seed: ALEAQQEAL (MAGA1_HUMAN)
  misc_feature (2)..(2): Xaa can be Gln, Ala, Ile, Tyr, Leu, Val, Met, Ser, Phe, Thr, Trp, Gly, His, Arg, Glu, Cys, Asn, Lys, or Asp
  misc_feature (9)..(9): Xaa can be Met, Leu, Phe, Ile, Val, Trp, Tyr, or Ala
AXEAQQEAX

SEQ ID NO: 50946 - protein, 11 aa, Artificial Sequence
  Description of Artificial Sequence: Synthetic peptide
  Seed: ALEAQQEALGL (MAGA1_HUMAN)
  misc_feature (2)..(2): Xaa can be Gln, Leu, Met, Ile, or Val
  misc_feature (11)..(11): Xaa can be Trp, Phe, Leu, Ile, or Met
AXEAQQEALGX

SEQ ID NO: 50947 - protein, 9 aa, Artificial Sequence
  Description of Artificial Sequence: Synthetic peptide
  Seed: ALGLVCVQA (MAGA1_HUMAN)
  misc_feature (2)..(2): Xaa can be Met, Leu, Ile, Val, Gln, Thr, Ala, or Ser
  misc_feature (9)..(9): Xaa can be Val, Ile, Leu, Ala, Met, or Thr
AXGLVCVQX

SEQ ID NO: 50948 - protein, 10 aa, Artificial Sequence
  Description of Artificial Sequence: Synthetic peptide
  Seed: ALGLVCVQAA (MAGA1_HUMAN)
  misc_feature (2)..(2): Xaa can be Met, Leu, Gln, Val, Ile, or Thr
  misc_feature (10)..(10): Xaa can be Val, Ile, Ala, or Leu
AXGLVCVQAX

SEQ ID NO: 50949 - protein, 9 aa, Artificial Sequence
  Description of Artificial Sequence: Synthetic peptide
  Seed: ALREEEEGV (MAGA1_HUMAN)
  misc_feature (2)..(2): Xaa can be Leu, Gln, Met, Ile, Ala, Thr, Ser, Glu, Val, or Asn
  misc_feature (9)..(9): Xaa can be Trp, Leu, Phe, Val, Ile, Met, Ala, or Tyr
AXREEEEGX

SEQ ID NO: 50950 - protein, 10 aa, Artificial Sequence
  Description of Artificial Sequence: Synthetic peptide
  Seed: APEEEIWEEL (MAGA1_HUMAN)
  misc_feature (2)..(2): Xaa can be Pro, Glu, Ala, Phe, Trp, Tyr, Asn, Met, Val, His, Gln, Ile, Gly, Ser, Asp, Thr, Lys, Leu, Cys, or Arg
  misc_feature (10)..(10): Xaa can be Leu, Met, Phe, Tyr, Trp, Ala, or Ile
AXEEEIWEEX

SEQ ID NO: 50951 - protein, 8 aa, Artificial Sequence
  Description of Artificial Sequence: Synthetic peptide
  Seed: AQQEALGL (MAGA1_HUMAN)
  misc_feature (2)..(2): Xaa can be , or Gln
  misc_feature (8)..(8): Xaa can be Trp, Leu, Ile, Val, or Phe
AXQEALGX

SEQ ID NO: 50952 - protein, 9 aa, Artificial Sequence
  Description of Artificial Sequence: Synthetic peptide
  Seed: AQQEALGLV (MAGA1_HUMAN)
  misc_feature (2)..(2): Xaa can be Glu, Met, Leu, Gln, Asp, Val, Arg, Ile, Thr, Ala, Asn, Ser, Gly, His, Tyr, Phe, Trp, Pro, Lys, or Cys
  misc_feature (9)..(9): Xaa can be Tyr, Leu, Phe, Met, Ile, Val, Trp, Ala, Cys, Thr, Ser, His, Pro, Asn, Arg, Lys, Glu, Gln, Asp, or Gly
AXQEALGLX

SEQ ID NO: 50953 - protein, 10 aa, Artificial Sequence
  Description of Artificial Sequence: Synthetic peptide
  Seed: AQQEALGLVC (MAGA1_HUMAN)
  misc_feature (2)..(2): Xaa can be Glu, Asp, Gln, Met, Leu, Ile, Val, Ala, Thr, Ser, His, Asn, Arg, or Lys
  misc_feature (10)..(10): Xaa can be Trp, Phe, Leu, Val, Ile, Met, Pro, Ala, Cys, Thr, Tyr, Gly, Ser, Arg, Gln, Glu, Lys, Asn, Asp, or His
AXQEALGLVX

SEQ ID NO: 50954 - protein, 11 aa, Artificial Sequence
  Description of Artificial Sequence: Synthetic peptide
  Seed: AQQEALGLVCV (MAGA1_HUMAN)
  misc_feature (2)..(2): Xaa can be Gln, Met, Leu, Ile, Val, Glu, Ala, or Thr
  misc_feature (11)..(11): Xaa can be Trp, Phe, Val, Leu, Ile, Met, Ala, or Tyr
AXQEALGLVCX

SEQ ID NO: 50955 - protein, 10 aa, Artificial Sequence
  Description of Artificial Sequence: Synthetic peptide
  Seed: AREPVTKAEM (MAGA1_HUMAN)
  misc_feature (2)..(2): Xaa can be Arg, Tyr, Gln, His, Phe, Ala, Trp, Val, Lys, Glu, Ile, Leu, Met, Gly, Ser, Asn, Thr, or Pr o
  misc_feature (10)..(10): Xaa can be Met, Leu, Phe, Tyr, Ile, Trp, Val, Gln, Cys, Ala, Arg, His, or Lys
AXEPVTKAEX

SEQ ID NO: 50956 - protein, 11 aa, Artificial Sequence
  Description of Artificial Sequence: Synthetic peptide
  Seed: AREPVTKAEML (MAGA1_HUMAN)
  misc_feature (2)..(2): Xaa can be Arg, His, Tyr, Gln, Phe, Trp, or Ala
  misc_feature (11)..(11): Xaa can be Phe, Leu, Met, Tyr, Ile, Val, Cys, Trp, Ala, His, Gln, Lys, or Arg
AXEPVTKAEMX

SEQ ID NO: 50957 - protein, 9 aa, Artificial Sequence
  Description of Artificial Sequence: Synthetic peptide
  Seed: ARVRFFFPS (MAGA1_HUMAN)
  misc_feature (2)..(2): Xaa can be Arg, Gln, Lys, His, Glu, or Met
  misc_feature (9)..(9): Xaa can be Leu, Val, Met, Ile, Ala, Phe, Lys, Arg, Thr, Tyr, Trp, Ser, Glu, Gln, Asn, Gly, Cys, Pro, or His
AXVRFFFPX

SEQ ID NO: 50958 - protein, 10 aa, Artificial Sequence
  Description of Artificial Sequence: Synthetic peptide
  Seed: ARVRFFFPSL (MAGA1_HUMAN)
  misc_feature (2)..(2): Xaa can be Arg, Ser, Thr, Tyr, Lys, Met, Trp, Gly, Ala, Gln, His, Phe, Asn, Val, Asp, Pro, Glu, Leu, Ile, or Cys
  misc_feature (10)..(10): Xaa can be Leu, Ile, Pro, Ser, Arg, Gly, Phe, Lys, Tyr, Thr, Val, Ala, Met, Cys, Asn, His, Gln, Glu, or Trp
AXVRFFFPSX

SEQ ID NO: 50959 - protein, 11 aa, Artificial Sequence
  Description of Artificial Sequence: Synthetic peptide
  Seed: ARVRFFFPSLR (MAGA1_HUMAN)
  misc_feature (2)..(2): Xaa can be Arg, Lys, Gln, Met, Ser, Val, Phe, Gly, Cys, Tyr, Thr, Trp, His, Glu, Asp, Leu, Pro, Asn, Ala, or Ile
  misc_feature (11)..(11): Xaa can be Val, Ile, Lys, Met, Leu, Phe, Arg, Tyr, Ala, His, Gly, Asn, Thr, Pro, Asp, Gln, Glu, Trp, Ser, or Cys
AXVRFFFPSLX

SEQ ID NO: 50960 - protein, 9 aa, Artificial Sequence
  Description of Artificial Sequence: Synthetic peptide
  Seed: ARYEFLWGP (MAGA1_HUMAN)
  misc_feature (2)..(2): Xaa can be Arg, Gln, Lys, His, Met, or Glu
  misc_feature (9)..(9): Xaa can be Val, Ile, Leu, Phe, Ala, Met, Tyr, Lys, Arg, Thr, Trp, Cys, Pro, Gln, Ser, Glu, His, Gly, or Asn
AXYEFLWGX

SEQ ID NO: 50961 - protein, 10 aa, Artificial Sequence
  Description of Artificial Sequence: Synthetic peptide
  Seed: ARYEFLWGPR (MAGA1_HUMAN)
  misc_feature (2)..(2): Xaa can be Arg, Tyr, Gln, Met, Ser, Thr, Trp, Val, Leu, Phe, Ile, His, Asn, Asp, Pro, Gly, Glu, Lys, Cys, or Ala
  misc_feature (10)..(10): Xaa can be Lys, Arg, His, Tyr, Phe, Ser, Val, Ala, Asn, Trp, Met, Ile, Leu, Thr, Gln, Cys, or Gly
AXYEFLWGPX

SEQ ID NO: 50962 - protein, 11 aa, Artificial Sequence
  Description of Artificial Sequence: Synthetic peptide
  Seed: ARYEFLWGPRA (MAGA1_HUMAN)
  misc_feature (2)..(2): Xaa can be Arg, Glu, Gln, Lys, Asp, Cys, Leu, His, Phe, Val, Ala, Pro, Trp, Thr, Tyr, Met, Asn, Ser, Ile, or Gly
  misc_feature (11)..(11): Xaa can be Ala, Pro, Val, Leu, Ile, Phe, Glu, Trp, Cys, Tyr, Arg, Thr, Ser, His, Met, Lys, Asn, Gly, or Gln
AXYEFLWGPRX

SEQ ID NO: 50963 - protein, 8 aa, Artificial Sequence
  Description of Artificial Sequence: Synthetic peptide
  Seed: ASAFPTTI (MAGA1_HUMAN)
  misc_feature (2)..(2): Xaa can be Ala, Thr, Ser, Val, Ile, Gly, Gln, Met, Glu, Leu, Cys, Asn, Pro, or Phe
  misc_feature (8)..(8): Xaa can be Leu, Tyr, Ile, Phe, Val, Met, His, Lys, Trp, or Ala
AXAFPTTX

SEQ ID NO: 50964 - protein, 10 aa, Artificial Sequence
  Description of Artificial Sequence: Synthetic peptide
  Seed: ASAFPTTINF (MAGA1_HUMAN)
  misc_feature (2)..(2): Xaa can be Ala, Ser, Thr, Gly, Gln, Lys, Ile, Met, Tyr, Val, Phe, Arg, Leu, Asp, Asn, His, Pro, Trp, Glu, or Cys
  misc_feature (10)..(10): Xaa can be Met, Tyr, Trp, Phe, Leu, Ile, Arg, Val, His, or Lys
AXAFPTTINX

SEQ ID NO: 50965 - protein, 9 aa, Artificial Sequence
  Description of Artificial Sequence: Synthetic peptide
  Seed: ASESLQLVF (MAGA1_HUMAN)
  misc_feature (2)..(2): Xaa can be Ala, Val, Met, Gln, Thr, Ile, Ser, Gly, Arg, Leu, Asn, Glu, Cys, Phe, Tyr, Asp, His, Lys, Pro, or Trp
  misc_feature (9)..(9): Xaa can be Leu, Tyr, Met, Phe, Trp, Ile, Val, Lys, Arg, His, Ala, or Cys
AXESLQLVX

SEQ ID NO: 50966 - protein, 9 aa, Artificial Sequence
  Description of Artificial Sequence: Synthetic peptide
  Seed: ATSSSSPLV (MAGA1_HUMAN)
  misc_feature (2)..(2): Xaa can be Met, Leu, Ala, Gln, Val, Ile, Ser, Thr, Asn, Gly, Phe, Cys, Glu, Pro, Tyr, Trp, or Asp
  misc_feature (9)..(9): Xaa can be Trp, Leu, Lys, Met, Phe, Tyr, Val, Ile, Arg, Ala, Thr, Cys, or His
AXSSSSPLX

SEQ ID NO: 50967 - protein, 10 aa, Artificial Sequence
  Description of Artificial Sequence: Synthetic peptide
  Seed: ATSSSSPLVL (MAGA1_HUMAN)
  misc_feature (2)..(2): Xaa can be Ala, Ile, Met, Gln, Leu, Val, Gly, Ser, Thr, Arg, Glu, Pro, Cys, Phe, Asn, Asp, Tyr, His, Trp, or Lys
  misc_feature (10)..(10): Xaa can be Phe, Met, Tyr, Trp, Leu, Lys, Arg, Ile, Val, His, Ala, Cys, or Gln
AXSSSSPLVX

SEQ ID NO: 50968 - protein, 10 aa, Artificial Sequence
  Description of Artificial Sequence: Synthetic peptide
  Seed: AVITKKVADL (MAGA1_HUMAN)
  misc_feature (2)..(2): Xaa can be Met, Leu, Val, Ile, Gln, or Thr
  misc_feature (10)..(10): Xaa can be Val, Leu, or Ile
AXITKKVADX

SEQ ID NO: 50969 - protein, 8 aa, Artificial Sequence
  Description of Artificial Sequence: Synthetic peptide
  Seed: AYGEPRKL (MAGA1_HUMAN)
  misc_feature (2)..(2): Xaa can be Ala, Val, Ile, Thr, Ser, Tyr, Gly, Leu, Arg, Phe, His, Gln, Met, Trp, Glu, Asn, Cys, Lys, Asp, or Pro
  misc_feature (8)..(8): Xaa can be Leu, Tyr, Phe, Met, Ile, Val, Lys, Trp, Arg, or His
AXGEPRKX

SEQ ID NO: 50970 - protein, 9 aa, Artificial Sequence
  Description of Artificial Sequence: Synthetic peptide
  Seed: AYGEPRKLL (MAGA1_HUMAN)
  misc_feature (2)..(2): Xaa can be Arg, Ala, Tyr, Ser, Ile, Val, Phe, Gly, Thr, Trp, Met, Glu, Gln, Leu, Asn, His, Lys, Cys, Pro, or Asp
  misc_feature (9)..(9): Xaa can be Leu, Met, Tyr, Phe, Ile, Val, Trp, Lys, Arg, His, Cys, or Ala
AXGEPRKLX

SEQ ID NO: 50971 - protein, 8 aa, Artificial Sequence
  Description of Artificial Sequence: Synthetic peptide
  Seed: CILESLFR (MAGA1_HUMAN)
  misc_feature (2)..(2): Xaa can be Leu, Gln, Tyr, Ser, Ile, Val, Thr, Met, or Phe
  misc_feature (8)..(8): Xaa can be , or Arg
CXLESLFX

SEQ ID NO: 50972 - protein, 9 aa, Artificial Sequence
  Description of Artificial Sequence: Synthetic peptide
  Seed: CILESLFRA (MAGA1_HUMAN)
  misc_feature (2)..(2): Xaa can be Met, Leu, Gln, Val, Ile, Thr, Ala, Ser, Phe, Gly, Asn, Glu, Cys, Tyr, or Trp
  misc_feature (9)..(9): Xaa can be Val, Leu, Ile, Ala, Met, Thr, Phe, Cys, Ser, Pro, Tyr, or Gly
CXLESLFRX

SEQ ID NO: 50973 - protein, 10 aa, Artificial Sequence
  Description of Artificial Sequence: Synthetic peptide
  Seed: CILESLFRAV (MAGA1_HUMAN)
  misc_feature (2)..(2): Xaa can be Met, Leu, Gln, Thr, Val, Ile, Ser, Ala, Tyr, Phe, Gly, Cys, or Trp
  misc_feature (10)..(10): Xaa can be Val, Leu, Ile, Ala, Thr, Met, Cys, Ser, Phe, Tyr, Arg, Gly, Trp, Gln, Lys, Glu, Pro, Asp, His, or Asn
CXLESLFRAX

SEQ ID NO: 50974 - protein, 11 aa, Artificial Sequence
  Description of Artificial Sequence: Synthetic peptide
  Seed: CILESLFRAVI (MAGA1_HUMAN)
  misc_feature (2)..(2): Xaa can be Met, Leu, Ile, Gln, Val, or Thr
  misc_feature (11)..(11): Xaa can be Val, Leu, Ile, Ala, Tyr, Thr, Lys, His, Cys, Arg, Met, Asp, Trp, Glu, Ser, Asn, Gly, Gln, Pro, or Phe
CXLESLFRAVX

SEQ ID NO: 50975 - protein, 9 aa, Artificial Sequence
  Description of Artificial Sequence: Synthetic peptide
  Seed: CLGLSYDGL (MAGA1_HUMAN)
  misc_feature (2)..(2): Xaa can be Met, Leu, Gln, Ile, or Val
  misc_feature (9)..(9): Xaa can be Val, Leu, or Ile
CXGLSYDGX

SEQ ID NO: 50976 - protein, 10 aa, Artificial Sequence
  Description of Artificial Sequence: Synthetic peptide
  Seed: CLGLSYDGLL (MAGA1_HUMAN)
  misc_feature (2)..(2): Xaa can be Met, or Leu
  misc_feature (10)..(10): Xaa can be Val, or Leu
CXGLSYDGLX

SEQ ID NO: 50977 - protein, 9 aa, Artificial Sequence
  Description of Artificial Sequence: Synthetic peptide
  Seed: DGLLGDNQI (MAGA1_HUMAN)
  misc_feature (2)..(2): Xaa can be Ala, Pro, Ser, Val, Gly, Thr, or Ile
  misc_feature (9)..(9): Xaa can be Ile, Val, Leu, Phe, Met, Ala, or Cys
DXLLGDNQX

SEQ ID NO: 50978 - protein, 8 aa, Artificial Sequence
  Description of Artificial Sequence: Synthetic peptide
  Seed: DGREHSAY (MAGA1_HUMAN)
  misc_feature (2)..(2): Xaa can be Gln, Ala, Thr, Leu, Val, Met, Ile, Ser, Asn, Gly, Glu, Phe, or Tyr
  misc_feature (8)..(8): Xaa can be Tyr, Phe, Leu, or Met
DXREHSAX

SEQ ID NO: 50979 - protein, 9 aa, Artificial Sequence
  Description of Artificial Sequence: Synthetic peptide
  Seed: DLVGFLLLK (MAGA1_HUMAN)
  misc_feature (2)..(2): Xaa can be Thr, Val, Ala, Ile, Ser, Leu, Met, Asn, Gly, Gln, Phe, Asp, Cys, Tyr, Pro, Lys, Glu, Arg, Trp, or His
  misc_feature (9)..(9): Xaa can be Arg, Lys, Tyr, His, Phe, Met, Leu, Val, Gln, Ile, Ala, or Asn
DXVGFLLLX

SEQ ID NO: 50980 - protein, 10 aa, Artificial Sequence
  Description of Artificial Sequence: Synthetic peptide
  Seed: DLVGFLLLKY (MAGA1_HUMAN)
  misc_feature (2)..(2): Xaa can be Thr, Val, Ile, Ala, Ser, Met, Leu, Gln, Tyr, Gly, Phe, Glu, Asn, Cys, Pro, Trp, Asp, His, or Lys
  misc_feature (10)..(10): Xaa can be Lys, Arg, Tyr, Phe, Trp, Leu, Met, His, Ile, Gln, Val, or Ala
DXVGFLLLKX

SEQ ID NO: 50981 - protein, 11 aa, Artificial Sequence
  Description of Artificial Sequence: Synthetic peptide
  Seed: DLVGFLLLKYR (MAGA1_HUMAN)
  misc_feature (2)..(2): Xaa can be Val, Ala, Tyr, Thr, Met, Phe, Ile, Ser, His, Leu, Asn, Trp, Gln, or Gly
  misc_feature (11)..(11): Xaa can be Arg, or Lys
DXVGFLLLKYX

SEQ ID NO: 50982 - protein, 10 aa, Artificial Sequence
  Description of Artificial Sequence: Synthetic peptide
  Seed: DLVQEKYLEY (MAGA1_HUMAN)
  misc_feature (2)..(2): Xaa can be Thr, Val, Gln, Ser, Ile, Met, Ala, Leu, Glu, Tyr, Arg, Phe, or Trp
  misc_feature (10)..(10): Xaa can be Tyr, Phe, Trp, Met, Leu, or Lys
DXVQEKYLEX

SEQ ID NO: 50983 - protein, 11 aa, Artificial Sequence
  Description of Artificial Sequence: Synthetic peptide
  Seed: DLVQEKYLEYR (MAGA1_HUMAN)
  misc_feature (2)..(2): Xaa can be Leu, Tyr, Met, Ala, Phe, Ser, Ile, Val, Thr, Trp, Gly, Gln, or Asn
  misc_feature (11)..(11): Xaa can be Arg, or Lys
DXVQEKYLEYX

SEQ ID NO: 50984 - protein, 8 aa, Artificial Sequence
  Description of Artificial Sequence: Synthetic peptide
  Seed: DPARYEFL (MAGA1_HUMAN)
  misc_feature (2)..(2): Xaa can be Pro, or Ala
  misc_feature (8)..(8): Xaa can be Leu, Ile, or Val
DXARYEFX

SEQ ID NO: 50985 - protein, 9 aa, Artificial Sequence
  Description of Artificial Sequence: Synthetic peptide
  Seed: DPARYEFLW (MAGA1_HUMAN)
  misc_feature (2)..(2): Xaa can be Pro, Ser, Thr, Ala, Ile, Gly, Phe, Met, Cys, Leu, Val, Gln, or Asn
  misc_feature (9)..(9): Xaa can be Trp, Phe, Met, Ile, or Tyr
DXARYEFLX

SEQ ID NO: 50986 - protein, 9 aa, Artificial Sequence
  Description of Artificial Sequence: Synthetic peptide
  Seed: DPPQSPQGA (MAGA1_HUMAN)
  misc_feature (2)..(2): Xaa can be Pro, or Ala
  misc_feature (9)..(9): Xaa can be Met, Ala, Leu, Ile, Phe, or Val
DXPQSPQGX

SEQ ID NO: 50987 - protein, 11 aa, Artificial Sequence
  Description of Artificial Sequence: Synthetic peptide
  Seed: DPPQSPQGASA (MAGA1_HUMAN)
  misc_feature (2)..(2): Xaa can be Pro, or Ala
  misc_feature (11)..(11): Xaa can be Ala, Leu, Met, Val, Ile, or Phe
DXPQSPQGASX

SEQ ID NO: 50988 - protein, 9 aa, Artificial Sequence
  Description of Artificial Sequence: Synthetic peptide
  Seed: DPTGHSYVL (MAGA1_HUMAN)
  misc_feature (2)..(2): Xaa can be Pro, Ala, Arg, Ser, Thr, Gly, Gln, Val, Ile, Met, Leu, His, Lys, Cys, Glu, Asn, Phe, or As p
  misc_feature (9)..(9): Xaa can be Leu, Trp, Met, Val, Ile, Phe, Tyr, Ala, His, Cys, Thr, or Pro
DXTGHSYVX

SEQ ID NO: 50989 - protein, 10 aa, Artificial Sequence
  Description of Artificial Sequence: Synthetic peptide
  Seed: DPTGHSYVLV (MAGA1_HUMAN)
  misc_feature (2)..(2): Xaa can be Thr, Val, Ile, Met, Gln, Cys, Glu, Pro, Ala, Ser, His, Asp, Tyr, Lys, Trp, Phe, Leu, Asn, Gly, or Arg
  misc_feature (10)..(10): Xaa can be Val, Ile, Leu, or Ala
DXTGHSYVLX

SEQ ID NO: 50990 - protein, 9 aa, Artificial Sequence
  Description of Artificial Sequence: Synthetic peptide
  Seed: DSDPARYEF (MAGA1_HUMAN)
  misc_feature (2)..(2): Xaa can be Ala, Phe, Ser, Ile, Tyr, Val, Thr, Met, Leu, Trp, Glu, Gln, Gly, Pro, Asn, Arg, Asp, Cys, His, or Lys
  misc_feature (9)..(9): Xaa can be Phe, Leu, Ile, Tyr, Met, Trp, Val, Lys, Cys, Arg, Ala, His, or Thr
DXDPARYEX

SEQ ID NO: 50991 - protein, 10 aa, Artificial Sequence
  Description of Artificial Sequence: Synthetic peptide
  Seed: DSDPARYEFL (MAGA1_HUMAN)
  misc_feature (2)..(2): Xaa can be Ala, Ser, Ile, Met, Thr, Leu, Val, Gly, Phe, Gln, Cys, or Tyr
  misc_feature (10)..(10): Xaa can be Leu, Met, Phe, Ile, or Val
DXDPARYEFX

SEQ ID NO: 50992 - protein, 11 aa, Artificial Sequence
  Description of Artificial Sequence: Synthetic peptide
  Seed: DSDPARYEFLW (MAGA1_HUMAN)
  misc_feature (2)..(2): Xaa can be Thr, Trp, Phe, Val, Tyr, Ile, Gly, Met, Cys, Ala, Leu, or Ser
  misc_feature (11)..(11): Xaa can be Trp, or Phe
DXDPARYEFLX

SEQ ID NO: 50993 - protein, 10 aa, Artificial Sequence
  Description of Artificial Sequence: Synthetic peptide
  Seed: DVKEADPTGH (MAGA1_HUMAN)
  misc_feature (2)..(2): Xaa can be Val, Ile, Thr, Ala, Met, Ser, Phe, Leu, Asn, Tyr, Trp, Gln, Cys, Asp, Gly, Glu, or Pro
  misc_feature (10)..(10): Xaa can be Arg, Lys, Tyr, Leu, His, Phe, Gln, Met, or Val
DXKEADPTGX

SEQ ID NO: 50994 - protein, 9 aa, Artificial Sequence
  Description of Artificial Sequence: Synthetic peptide
  Seed: EADPTGHSY (MAGA1_HUMAN)
  misc_feature (2)..(2): Xaa can be Phe, Ala, Tyr, Pro, Ser, Thr, Ile, Met, Glu, Trp, Arg, Leu, Val, Gly, Gln, Asn, Cys, His, Asp, or Lys
  misc_feature (9)..(9): Xaa can be Tyr, Val, Phe, Met, Ile, Lys, Trp, Leu, Arg, Ala, Cys, His, Thr, Gln, Ser, Pro, or Gly
EXDPTGHSX

SEQ ID NO: 50995 - protein, 10 aa, Artificial Sequence
  Description of Artificial Sequence: Synthetic peptide
  Seed: EADPTGHSYV (MAGA1_HUMAN)
  misc_feature (2)..(2): Xaa can be Met, Ala, Leu, Ser, Thr, Ile, Pro, Cys, Phe, Val, Gln, Gly, Tyr, Trp, Asn, Glu, or His
  misc_feature (10)..(10): Xaa can be Leu, Phe, Met, Ile, Val, Tyr, Trp, Cys, or Ala
EXDPTGHSYX

SEQ ID NO: 50996 - protein, 11 aa, Artificial Sequence
  Description of Artificial Sequence: Synthetic peptide
  Seed: EADPTGHSYVL (MAGA1_HUMAN)
  misc_feature (2)..(2): Xaa can be Ser, Ala, Thr, Pro, Ile, Tyr, Val, Met, Phe, Gly, Leu, Trp, Cys, Arg, Gln, His, Asp, Glu, or Asn
  misc_feature (11)..(11): Xaa can be Leu, Lys, Met, Phe, Ile, Val, Tyr, Arg, Trp, Ala, or Cys
EXDPTGHSYVX

SEQ ID NO: 50997 - protein, 9 aa, Artificial Sequence
  Description of Artificial Sequence: Synthetic peptide
  Seed: EALEAQQEA (MAGA1_HUMAN)
  misc_feature (2)..(2): Xaa can be Pro, Ala, Thr, Ile, Val, Ser, Gly, Met, Leu, Cys, or Gln
  misc_feature (9)..(9): Xaa can be Val, Ile, Leu, Met, Ala, Thr, Cys, Phe, Pro, Tyr, or Ser
EXLEAQQEX

SEQ ID NO: 50998 - protein, 10 aa, Artificial Sequence
  Description of Artificial Sequence: Synthetic peptide
  Seed: EALEAQQEAL (MAGA1_HUMAN)
  misc_feature (2)..(2): Xaa can be Thr, Val, Ile, Ala, Ser, Gln, Met, Leu, Glu, Gly, Pro, Asn, Phe, Cys, Asp, or Tyr
  misc_feature (10)..(10): Xaa can be Arg, Lys, Trp, Tyr, Phe, Val, Ile, Leu, Met, Gln, His, or Ala
EXLEAQQEAX

SEQ ID NO: 50999 - protein, 8 aa, Artificial Sequence
  Description of Artificial Sequence: Synthetic peptide
  Seed: EALGLVCV (MAGA1_HUMAN)
  misc_feature (2)..(2): Xaa can be Pro, or Ala
  misc_feature (8)..(8): Xaa can be Ile, Val, or Leu
EXLGLVCX

SEQ ID NO: 51000 - protein, 10 aa, Artificial Sequence
  Description of Artificial Sequence: Synthetic peptide
  Seed: EALGLVCVQA (MAGA1_HUMAN)
  misc_feature (2)..(2): Xaa can be Thr, Val, Ala, Ser, Ile, Met, or Leu
  misc_feature (10)..(10): Xaa can be Val, Leu, Ile, Ala, Met, or Thr
EXLGLVCVQX

SEQ ID NO: 51001 - protein, 9 aa, Artificial Sequence
  Description of Artificial Sequence: Synthetic peptide
  Seed: EAQQEALGL (MAGA1_HUMAN)
  misc_feature (2)..(2): Xaa can be Ala, Arg, Pro, Ser, Gln, Gly, Ile, Val, Thr, or Tyr
  misc_feature (9)..(9): Xaa can be Leu, Lys, Met, Val, Ile, Phe, Arg, or Tyr
EXQQEALGX

SEQ ID NO: 51002 - protein, 10 aa, Artificial Sequence
  Description of Artificial Sequence: Synthetic peptide
  Seed: EAQQEALGLV (MAGA1_HUMAN)
  misc_feature (2)..(2): Xaa can be Thr, Val, Ser, Ala, or Ile
  misc_feature (10)..(10): Xaa can be Val, Ile, Leu, or Ala
EXQQEALGLX

SEQ ID NO: 51003 - protein, 10 aa, Artificial Sequence
  Description of Artificial Sequence: Synthetic peptide
  Seed: EEALEAQQEA (MAGA1_HUMAN)
  misc_feature (2)..(2): Xaa can be Glu, or Gln
  misc_feature (10)..(10): Xaa can be Ala, Met, Leu, Val, Phe, Ser, Gly, Tyr, Ile, Pro, Cys, or Thr
EXALEAQQEX

SEQ ID NO: 51004 - protein, 11 aa, Artificial Sequence
  Description of Artificial Sequence: Synthetic peptide
  Seed: EEALEAQQEAL (MAGA1_HUMAN)
  misc_feature (2)..(2): Xaa can be Glu, Gln, Asp, Ala, Lys, His, Arg, Asn, or Ser
  misc_feature (11)..(11): Xaa can be Trp, Phe, Leu, Tyr, Cys, Met, Ala, Thr, Ser, Val, Gly, Pro, or Ile
EXALEAQQEAX

SEQ ID NO: 51005 - protein, 9 aa, Artificial Sequence
  Description of Artificial Sequence: Synthetic peptide
  Seed: EEEGPSTSC (MAGA1_HUMAN)
  misc_feature (2)..(2): Xaa can be Glu, Asp, Gln, Val, Ala, or Ile
  misc_feature (9)..(9): Xaa can be Leu, Phe, Ala, Pro, Cys, Met, Ile, Thr, Trp, Tyr, Val, His, Gly, Asp, Ser, or Glu
EXEGPSTSX

SEQ ID NO: 51006 - protein, 10 aa, Artificial Sequence
  Description of Artificial Sequence: Synthetic peptide
  Seed: EEEGPSTSCI (MAGA1_HUMAN)
  misc_feature (2)..(2): Xaa can be Glu, Gln, or Asp
  misc_feature (10)..(10): Xaa can be Trp, Ala, Val, Tyr, Leu, Phe, Cys, Ser, Ile, Gly, Thr, Pro, or Met
EXEGPSTSCX

SEQ ID NO: 51007 - protein, 11 aa, Artificial Sequence
  Description of Artificial Sequence: Synthetic peptide
  Seed: EEEGPSTSCIL (MAGA1_HUMAN)
  misc_feature (2)..(2): Xaa can be Glu, Gln, Lys, Asp, or Arg
  misc_feature (11)..(11): Xaa can be Trp, Phe, Tyr, Ala, Met, Ile, Ser, Val, Leu, Pro, Thr, or Cys
EXEGPSTSCIX

SEQ ID NO: 51008 - protein, 8 aa, Artificial Sequence
  Description of Artificial Sequence: Synthetic peptide
  Seed: EEEIWEEL (MAGA1_HUMAN)
  misc_feature (2)..(2): Xaa can be Glu, or Gln
  misc_feature (8)..(8): Xaa can be Leu, Met, Ala, Ile, Phe, Thr, or Val
EXEIWEEX

SEQ ID NO: 51009 - protein, 9 aa, Artificial Sequence
  Description of Artificial Sequence: Synthetic peptide
  Seed: EEEIWEELS (MAGA1_HUMAN)
  misc_feature (2)..(2): Xaa can be Glu, Gln, or Asp
  misc_feature (9)..(9): Xaa can be Leu, Val, Ile, Ala, Cys, Met, Thr, Ser, Phe, Gly, or Pro
EXEIWEELX

SEQ ID NO: 51010 - protein, 10 aa, Artificial Sequence
  Description of Artificial Sequence: Synthetic peptide
  Seed: EEEIWEELSV (MAGA1_HUMAN)
  misc_feature (2)..(2): Xaa can be , or Glu
  misc_feature (10)..(10): Xaa can be Leu, Val, Thr, Phe, Ala, Met, Ile, Pro, or Cys
EXEIWEELSX

SEQ ID NO: 51011 - protein, 11 aa, Artificial Sequence
  Description of Artificial Sequence: Synthetic peptide
  Seed: EEEIWEELSVM (MAGA1_HUMAN)
  misc_feature (2)..(2): Xaa can be , or Glu
  misc_feature (11)..(11): Xaa can be Phe, Met, Val, Cys, Ile, Ala, or Leu
EXEIWEELSVX

SEQ ID NO: 51012 - protein, 8 aa, Artificial Sequence
  Description of Artificial Sequence: Synthetic peptide
  Seed: EEGPSTSC (MAGA1_HUMAN)
  misc_feature (2)..(2): Xaa can be Glu, or Asp
  misc_feature (8)..(8): Xaa can be Val, Leu, Ala, Ile, Thr, Met, Phe, Pro, or Cys
EXGPSTSX

SEQ ID NO: 51013 - protein, 9 aa, Artificial Sequence
  Description of Artificial Sequence: Synthetic peptide
  Seed: EEGPSTSCI (MAGA1_HUMAN)
  misc_feature (2)..(2): Xaa can be Glu, Asp, or Gln
  misc_feature (9)..(9): Xaa can be Met, Val, Trp, Tyr, Ala, Leu, Phe, Ile, Thr, Cys, Gly, Ser, or Pro
EXGPSTSCX

SEQ ID NO: 51014 - protein, 10 aa, Artificial Sequence
  Description of Artificial Sequence: Synthetic peptide
  Seed: EEGPSTSCIL (MAGA1_HUMAN)
  misc_feature (2)..(2): Xaa can be Glu, Gln, Lys, or Asp
  misc_feature (10)..(10): Xaa can be Trp, Phe, Tyr, Leu, Thr, Cys, Ile, Val, Pro, Ser, Met, or Ala
EXGPSTSCIX

SEQ ID NO: 51015 - protein, 9 aa, Artificial Sequence
  Description of Artificial Sequence: Synthetic peptide
  Seed: EEIWEELSV (MAGA1_HUMAN)
  misc_feature (2)..(2): Xaa can be Glu, Gln, Asp, Ala, Ser, Lys, Arg, or Asn
  misc_feature (9)..(9): Xaa can be Trp, Leu, Val, Ile, Cys, Phe, Met, Tyr, Ala, Pro, Lys, Ser, Gly, Arg, His, or Thr
EXIWEELSX

SEQ ID NO: 51016 - protein, 10 aa, Artificial Sequence
  Description of Artificial Sequence: Synthetic peptide
  Seed: EEIWEELSVM (MAGA1_HUMAN)
  misc_feature (2)..(2): Xaa can be Glu, Gln, Asp, Arg, or Lys
  misc_feature (10)..(10): Xaa can be Trp, Phe, Tyr, Leu, Ala, Met, Cys, Gly, Ser, Thr, Pro, Val, or Ile
EXIWEELSVX

SEQ ID NO: 51017 - protein, 8 aa, Artificial Sequence
  Description of Artificial Sequence: Synthetic peptide
  Seed: EELSVMEV (MAGA1_HUMAN)
  misc_feature (2)..(2): Xaa can be Glu, Asp, Gln, Met, Pro, Gly, Asn, Ala, Ser, Leu, Thr, Val, His, or Ile
  misc_feature (8)..(8): Xaa can be Val, Ile, Leu, Ala, Tyr, Met, Phe, Gln, Cys, Pro, Trp, Ser, Lys, Thr, Gly, His, or Arg
EXLSVMEX

SEQ ID NO: 51018 - protein, 9 aa, Artificial Sequence
  Description of Artificial Sequence: Synthetic peptide
  Seed: EELSVMEVY (MAGA1_HUMAN)
  misc_feature (2)..(2): Xaa can be Glu, Gln, Asp, His, Ala, Leu, Arg, Met, Ser, Thr, Ile, Val, Asn, Gly, Lys, Cys, Phe, Pro, Tyr, or Trp
  misc_feature (9)..(9): Xaa can be Tyr, Phe, Trp, Leu, Met, Ile, Thr, Ala, Cys, His, Val, Pro, Arg, Lys, Asp, Glu, Gly, Gln, Ser, or Asn
EXLSVMEVX

SEQ ID NO: 51019 - protein, 9 aa, Artificial Sequence
  Description of Artificial Sequence: Synthetic peptide
  Seed: EEVPTAGST (MAGA1_HUMAN)
  misc_feature (2)..(2): Xaa can be Glu, Gln, Asp, His, or Ala
  misc_feature (9)..(9): Xaa can be Tyr, Leu, Thr, Pro, Val, Met, Cys, Ala, Ile, Phe, Arg, Trp, Asp, Ser, Lys, His, Gln, or Gl y
EXVPTAGSX

SEQ ID NO: 51020 - protein, 11 aa, Artificial Sequence
  Description of Artificial Sequence: Synthetic peptide
  Seed: EEVPTAGSTDP (MAGA1_HUMAN)
  misc_feature (2)..(2): Xaa can be Glu, or Gln
  misc_feature (11)..(11): Xaa can be Cys, Val, Ala, Ser, Phe, Pro, Leu, Ile, Met, Gly, or Thr
EXVPTAGSTDX

SEQ ID NO: 51021 - protein, 9 aa, Artificial Sequence
  Description of Artificial Sequence: Synthetic peptide
  Seed: EFLWGPRAL (MAGA1_HUMAN)
  misc_feature (2)..(2): Xaa can be Tyr, Phe, Arg, Trp, Ala, Gln, His, Met, Glu, Gly, Leu, Thr, Val, Ile, or Ser
  misc_feature (9)..(9): Xaa can be Leu, Met, Tyr, Phe, Ile, Val, or Trp
EXLWGPRAX

SEQ ID NO: 51022 - protein, 10 aa, Artificial Sequence
  Description of Artificial Sequence: Synthetic peptide
  Seed: EFLWGPRALA (MAGA1_HUMAN)
  misc_feature (2)..(2): Xaa can be Met, Tyr, Phe, Leu, Val, Lys, Trp, Ser, Ile, Arg, Thr, Gly, Ala, His, Asn, Glu, Cys, Asp, Gln, or Pro
  misc_feature (10)..(10): Xaa can be Val, Leu, Ile, Ala, or Met
EXLWGPRALX

SEQ ID NO: 51023 - protein, 11 aa, Artificial Sequence
  Description of Artificial Sequence: Synthetic peptide
  Seed: EGGHAPEEEIW (MAGA1_HUMAN)
  misc_feature (2)..(2): Xaa can be Thr, Phe, Ala, Val, Ile, Cys, Ser, Gly, Leu, Met, or Asn
  misc_feature (11)..(11): Xaa can be Trp, or Phe
EXGHAPEEEIX

SEQ ID NO: 51024 - protein, 9 aa, Artificial Sequence
  Description of Artificial Sequence: Synthetic peptide
  Seed: EGPSTSCIL (MAGA1_HUMAN)
  misc_feature (2)..(2): Xaa can be Ala, Gly, Ile, Val, Phe, Met, Ser, Leu, Tyr, Thr, or Cys
  misc_feature (9)..(9): Xaa can be Leu, Met, Ile, Val, or Phe
EXPSTSCIX

SEQ ID NO: 51025 - protein, 9 aa, Artificial Sequence
  Description of Artificial Sequence: Synthetic peptide
  Seed: EHSAYGEPR (MAGA1_HUMAN)
  misc_feature (2)..(2): Xaa can be Ala, Met, Phe, Val, Tyr, Trp, Ser, Ile, Thr, Leu, Asn, Cys, Arg, His, Pro, Gly, Glu, Gln, Asp, or Lys
  misc_feature (9)..(9): Xaa can be Arg, or Lys
EXSAYGEPX

SEQ ID NO: 51026 - protein, 10 aa, Artificial Sequence
  Description of Artificial Sequence: Synthetic peptide
  Seed: EHSAYGEPRK (MAGA1_HUMAN)
  misc_feature (2)..(2): Xaa can be Thr, Val, Ser, Ala, Lys, Asp, Met, Arg, Trp, Asn, Pro, Ile, Leu, Gln, His, Gly, Tyr, Cys, Glu, or Phe
  misc_feature (10)..(10): Xaa can be Arg, Lys, Tyr, Leu, Asp, Met, His, Pro, Cys, Glu, Gly, Ile, Trp, Val, Ser, Ala, Thr, Phe, Gln, or Asn
EXSAYGEPRX

SEQ ID NO: 51027 - protein, 11 aa, Artificial Sequence
  Description of Artificial Sequence: Synthetic peptide
  Seed: EHSAYGEPRKL (MAGA1_HUMAN)
  misc_feature (2)..(2): Xaa can be , or His
  misc_feature (11)..(11): Xaa can be Ile, Trp, Leu, Val, Phe, or Met
EXSAYGEPRKX

SEQ ID NO: 51028 - protein, 10 aa, Artificial Sequence
  Description of Artificial Sequence: Synthetic peptide
  Seed: EIFGKASESL (MAGA1_HUMAN)
  misc_feature (2)..(2): Xaa can be Thr, Val, Ile, Ala, Ser, Leu, Met, Gln, Asn, Glu, Gly, Cys, Asp, Phe, Tyr, Pro, or Trp
  misc_feature (10)..(10): Xaa can be Arg, Lys, Trp, Tyr, Val, Phe, Leu, Ile, Met, Ala, His, Gln, or Thr
EXFGKASESX

SEQ ID NO: 51029 - protein, 11 aa, Artificial Sequence
  Description of Artificial Sequence: Synthetic peptide
  Seed: EIFGKASESLQ (MAGA1_HUMAN)
  misc_feature (2)..(2): Xaa can be Val, Thr, Ile, Ala, Ser, Pro, Cys, Asn, Leu, Asp, Gly, Glu, Gln, Met, Phe, or Tyr
  misc_feature (11)..(11): Xaa can be Arg, Lys, His, Tyr, Met, Gln, Leu, Phe, Asn, or Glu
EXFGKASESLX

SEQ ID NO: 51030 - protein, 9 aa, Artificial Sequence
  Description of Artificial Sequence: Synthetic peptide
  Seed: EIWEELSVM (MAGA1_HUMAN)
  misc_feature (2)..(2): Xaa can be Thr, Val, Met, Ile, Leu, Ala, Pro, Ser, Gln, Gly, Glu, Asn, Phe, Cys, Asp, Tyr, Trp, Lys, His, or Arg
  misc_feature (9)..(9): Xaa can be Phe, Tyr, Arg, Lys, Met, Trp, Val, Leu, Ile, His, Ala, Thr, or Gln
EXWEELSVX

SEQ ID NO: 51031 - protein, 11 aa, Artificial Sequence
  Description of Artificial Sequence: Synthetic peptide
  Seed: EIWEELSVMEV (MAGA1_HUMAN)
  misc_feature (2)..(2): Xaa can be Thr, Met, Leu, Val, Ile, Ala, Gln, or Ser
  misc_feature (11)..(11): Xaa can be Val, Ile, Leu, or Ala
EXWEELSVMEX

SEQ ID NO: 51032 - protein, 9 aa, Artificial Sequence
  Description of Artificial Sequence: Synthetic peptide
  Seed: EKYLEYRQV (MAGA1_HUMAN)
  misc_feature (2)..(2): Xaa can be Gln, Ala, Glu, Gly, Val, Met, Ser, Ile, Asn, Leu, Asp, His, Thr, or Lys
  misc_feature (9)..(9): Xaa can be Val, Ile, Leu, Met, Phe, Ala, Thr, or Cys
EXYLEYRQX

SEQ ID NO: 51033 - protein, 8 aa, Artificial Sequence
  Description of Artificial Sequence: Synthetic peptide
  Seed: ELSVMEVY (MAGA1_HUMAN)
  misc_feature (2)..(2): Xaa can be Gln, Ala, Met, Ser, Leu, or Glu
  misc_feature (8)..(8): Xaa can be Tyr, or Phe
EXSVMEVX

SEQ ID NO: 51034 - protein, 11 aa, Artificial Sequence
  Description of Artificial Sequence: Synthetic peptide
  Seed: ELSVMEVYDGR (MAGA1_HUMAN)
  misc_feature (2)..(2): Xaa can be Leu, Asp, His, Asn, Tyr, Trp, Pro, Ile, Cys, Val, Glu, Gly, Gln, Phe, Lys, Arg, Thr, Met, Ala, or Ser
  misc_feature (11)..(11): Xaa can be Lys, or Arg
EXSVMEVYDGX

SEQ ID NO: 51035 - protein, 8 aa, Artificial Sequence
  Description of Artificial Sequence: Synthetic peptide
  Seed: EMLESVIK (MAGA1_HUMAN)
  misc_feature (2)..(2): Xaa can be Ile, Thr, Val, Leu, Ala, Gly, Asn, Met, Gln, Phe, or Ser
  misc_feature (8)..(8): Xaa can be Lys, or Arg
EXLESVIX

SEQ ID NO: 51036 - protein, 10 aa, Artificial Sequence
  Description of Artificial Sequence: Synthetic peptide
  Seed: EMLESVIKNY (MAGA1_HUMAN)
  misc_feature (2)..(2): Xaa can be Val, Thr, Ile, Ala, Ser, Met, Gln, Leu, Glu, Gly, Asn, Tyr, Phe, Trp, Pro, Cys, Arg, Asp, Lys, or His
  misc_feature (10)..(10): Xaa can be Tyr, Arg, Lys, Phe, Trp, Met, Leu, Ile, His, Val, Gln, or Ala
EXLESVIKNX

SEQ ID NO: 51037 - protein, 11 aa, Artificial Sequence
  Description of Artificial Sequence: Synthetic peptide
  Seed: EMLESVIKNYK (MAGA1_HUMAN)
  misc_feature (2)..(2): Xaa can be Val, Thr, Cys, Leu, Glu, Trp, Asn, Tyr, Ala, Gln, Met, Asp, Ile, Ser, Phe, Gly, Pro, or Hi s
  misc_feature (11)..(11): Xaa can be Arg, Lys, Tyr, Met, His, Gln, or Phe
EXLESVIKNYX

SEQ ID NO: 51038 - protein, 10 aa, Artificial Sequence
  Description of Artificial Sequence: Synthetic peptide
  Seed: EPRKLLTQDL (MAGA1_HUMAN)
  misc_feature (2)..(2): Xaa can be , or Pro
  misc_feature (10)..(10): Xaa can be Leu, Met, or Phe
EXRKLLTQDX

SEQ ID NO: 51039 - protein, 8 aa, Artificial Sequence
  Description of Artificial Sequence: Synthetic peptide
  Seed: EPVTKAEM (MAGA1_HUMAN)
  misc_feature (2)..(2): Xaa can be Pro, Met, Ala, Ile, Gly, Leu, Gln, or Val
  misc_feature (8)..(8): Xaa can be Leu, Met, Ile, Val, or Phe
EXVTKAEX

SEQ ID NO: 51040 - protein, 9 aa, Artificial Sequence
  Description of Artificial Sequence: Synthetic peptide
  Seed: EPVTKAEML (MAGA1_HUMAN)
  misc_feature (2)..(2): Xaa can be Arg, Ala, Pro, Gln, His, Ser, Val, Gly, Leu, Met, Ile, Glu, Lys, or Asn
  misc_feature (9)..(9): Xaa can be Leu, Val, Ile, Met, Phe, Tyr, Cys, Ala, or Trp
EXVTKAEMX

SEQ ID NO: 51041 - protein, 10 aa, Artificial Sequence
  Description of Artificial Sequence: Synthetic peptide
  Seed: ESLFRAVITK (MAGA1_HUMAN)
  misc_feature (2)..(2): Xaa can be Thr, Val, Lys, Ile, Arg, Met, Asp, Ala, Cys, Asn, Glu, Gln, Trp, Phe, Tyr, Ser, His, Pro, Leu, or Gly
  misc_feature (10)..(10): Xaa can be Arg, Lys, Tyr, or His
EXLFRAVITX

SEQ ID NO: 51042 - protein, 11 aa, Artificial Sequence
  Description of Artificial Sequence: Synthetic peptide
  Seed: ESLFRAVITKK (MAGA1_HUMAN)
  misc_feature (2)..(2): Xaa can be Ala, Val, Gln, Gly, Phe, Ser, Tyr, Ile, Met, Leu, Thr, His, Cys, Glu, Asp, Asn, Arg, Lys, or Trp
  misc_feature (11)..(11): Xaa can be Arg, or Lys
EXLFRAVITKX

SEQ ID NO: 51043 - protein, 9 aa, Artificial Sequence
  Description of Artificial Sequence: Synthetic peptide
  Seed: ESLQLVFGI (MAGA1_HUMAN)
  misc_feature (2)..(2): Xaa can be Thr, Val, Ile, Ala, Ser, Met, Leu, Gly, Gln, Pro, Asn, or Cys
  misc_feature (9)..(9): Xaa can be Ile, Val, Leu, Ala, Trp, Tyr, Met, Phe, Thr, Cys, or Ser
EXLQLVFGX

SEQ ID NO: 51044 - protein, 8 aa, Artificial Sequence
  Description of Artificial Sequence: Synthetic peptide
  Seed: ESVIKNYK (MAGA1_HUMAN)
  misc_feature (2)..(2): Xaa can be Ala, Val, Thr, Ile, or Ser
  misc_feature (8)..(8): Xaa can be , or Lys
EXVIKNYX

SEQ ID NO: 51045 - protein, 9 aa, Artificial Sequence
  Description of Artificial Sequence: Synthetic peptide
  Seed: ESVIKNYKH (MAGA1_HUMAN)
  misc_feature (2)..(2): Xaa can be Ala, Val, Ser, Ile, Thr, Leu, Met, Gly, Gln, Asp, Asn, Phe, Cys, or Glu
  misc_feature (9)..(9): Xaa can be Lys, Arg, Tyr, or His
EXVIKNYKX

SEQ ID NO: 51046 - protein, 9 aa, Artificial Sequence
  Description of Artificial Sequence: Synthetic peptide
  Seed: ETSYVKVLE (MAGA1_HUMAN)
  misc_feature (2)..(2): Xaa can be Thr, Val, Ile, Ser, Ala, Leu, Met, Trp, Phe, Pro, Cys, Gly, Asn, Gln, Tyr, Glu, or Asp
  misc_feature (9)..(9): Xaa can be Arg, Lys, Tyr, His, Gln, Glu, or Met
EXSYVKVLX

SEQ ID NO: 51047 - protein, 10 aa, Artificial Sequence
  Description of Artificial Sequence: Synthetic peptide
  Seed: ETSYVKVLEY (MAGA1_HUMAN)
  misc_feature (2)..(2): Xaa can be Val, Thr, Met, Arg, Ile, Tyr, Ser, Phe, Lys, Trp, His, Leu, Ala, Gln, Cys, Gly, Asn, Glu, Asp, or Pro
  misc_feature (10)..(10): Xaa can be Lys, Arg, Trp, Phe, Tyr, Met, Leu, or His
EXSYVKVLEX

SEQ ID NO: 51048 - protein, 11 aa, Artificial Sequence
  Description of Artificial Sequence: Synthetic peptide
  Seed: ETSYVKVLEYV (MAGA1_HUMAN)
  misc_feature (2)..(2): Xaa can be Thr, Ala, Val, Ile, Ser, Met, or Leu
  misc_feature (11)..(11): Xaa can be Val, Leu, Ile, Ala, or Met
EXSYVKVLEYX

SEQ ID NO: 51049 - protein, 8 aa, Artificial Sequence
  Description of Artificial Sequence: Synthetic peptide
  Seed: EVYDGREH (MAGA1_HUMAN)
  misc_feature (2)..(2): Xaa can be Ala, Ser, Ile, Val, Leu, Met, Gly, Thr, Gln, Asn, Glu, Cys, or Phe
  misc_feature (8)..(8): Xaa can be Tyr, Phe, Leu, Met, His, Lys, Ile, Val, or Trp
EXYDGREX

SEQ ID NO: 51050 - protein, 10 aa, Artificial Sequence
  Description of Artificial Sequence: Synthetic peptide
  Seed: EVYDGREHSA (MAGA1_HUMAN)
  misc_feature (2)..(2): Xaa can be Val, Thr, Pro, Ala, Ile, Leu, Met, Ser, Gln, Gly, Glu, Asn, Cys, Phe, Lys, Tyr, Asp, Trp, His, or Arg
  misc_feature (10)..(10): Xaa can be Tyr, Arg, Phe, Lys, Met, Leu, Trp, His, Val, Ile, Ala, Gln, Thr, Cys, Gly, Asn, Glu, Ser, or Pro
EXYDGREHSX

SEQ ID NO: 51051 - protein, 11 aa, Artificial Sequence
  Description of Artificial Sequence: Synthetic peptide
  Seed: EVYDGREHSAY (MAGA1_HUMAN)
  misc_feature (2)..(2): Xaa can be Thr, Val, Ala, Ile, Ser, Leu, Met, Gln, Gly, Pro, Glu, Cys, Asp, Asn, Phe, Tyr, Lys, Trp, Arg, or His
  misc_feature (11)..(11): Xaa can be Tyr, Phe, Arg, Lys, Trp, Met, Leu, His, Gln, Ile, Ala, Asn, Val, or Glu
EXYDGREHSAX

SEQ ID NO: 51052 - protein, 9 aa, Artificial Sequence
  Description of Artificial Sequence: Synthetic peptide
  Seed: EYVIKVSAR (MAGA1_HUMAN)
  misc_feature (2)..(2): Xaa can be Val, Thr, Ala, Ile, Ser, Leu, Met, Pro, Asp, Cys, Glu, Asn, Trp, Gln, Tyr, Phe, Gly, Lys, Arg, or His
  misc_feature (9)..(9): Xaa can be Arg, Lys, Tyr, His, Met, Phe, Val, Leu, Ile, Gln, or Ala
EXVIKVSAX

SEQ ID NO: 51053 - protein, 10 aa, Artificial Sequence
  Description of Artificial Sequence: Synthetic peptide
  Seed: EYVIKVSARV (MAGA1_HUMAN)
  misc_feature (2)..(2): Xaa can be Thr, Met, Ala, Ser, Val, Asn, Trp, Ile, Gln, Leu, Arg, Lys, Pro, Gly, Tyr, Glu, Asp, Phe, His, or Cys
  misc_feature (10)..(10): Xaa can be Leu, Ala, Ile, Val, Met, or Thr
EXVIKVSARX

SEQ ID NO: 51054 - protein, 11 aa, Artificial Sequence
  Description of Artificial Sequence: Synthetic peptide
  Seed: EYVIKVSARVR (MAGA1_HUMAN)
  misc_feature (2)..(2): Xaa can be Phe, Tyr, Val, Thr, Met, Gly, Ala, Asn, Trp, Gln, Leu, Ser, or Ile
  misc_feature (11)..(11): Xaa can be Arg, or Lys
EXVIKVSARVX

SEQ ID NO: 51055 - protein, 9 aa, Artificial Sequence
  Description of Artificial Sequence: Synthetic peptide
  Seed: FFFPSLREA (MAGA1_HUMAN)
  misc_feature (2)..(2): Xaa can be Arg, Ala, Tyr, Ser, Met, Leu, Val, Thr, Phe, Gln, Ile, Gly, Asn, His, Trp, Cys, Pro, Glu, Lys, or Asp
  misc_feature (9)..(9): Xaa can be Met, Phe, Tyr, Ile, Leu, Val, Trp, His, Ala, Cys, Lys, Arg, Thr, Ser, Gln, Gly, Pro, Glu, or Asn
FXFPSLREX

SEQ ID NO: 51056 - protein, 10 aa, Artificial Sequence
  Description of Artificial Sequence: Synthetic peptide
  Seed: FFFPSLREAA (MAGA1_HUMAN)
  misc_feature (2)..(2): Xaa can be Tyr, Phe, Trp, Met, Arg, His, Ala, Leu, Pro, Val, Ser, Asn, Lys, Asp, Gln, Cys, Ile, Glu, Gly, or Thr
  misc_feature (10)..(10): Xaa can be Phe, Tyr, Met, Leu, Ile, Val, Trp, His, Ala, Cys, Thr, or Lys
FXFPSLREAX

SEQ ID NO: 51057 - protein, 11 aa, Artificial Sequence
  Description of Artificial Sequence: Synthetic peptide
  Seed: FFFPSLREAAL (MAGA1_HUMAN)
  misc_feature (2)..(2): Xaa can be Arg, Tyr, Pro, Trp, Phe, Lys, Gln, Met, His, Ala, Glu, Cys, Leu, Asn, Ser, Gly, Val, Thr, Ile, or Asp
  misc_feature (11)..(11): Xaa can be Val, Met, Phe, Leu, Ile, Tyr, Trp, Cys, His, Ala, Thr, Arg, or Lys
FXFPSLREAAX

SEQ ID NO: 51058 - protein, 8 aa, Artificial Sequence
  Description of Artificial Sequence: Synthetic peptide
  Seed: FFPSLREA (MAGA1_HUMAN)
  misc_feature (2)..(2): Xaa can be Tyr, Phe, Trp, Met, Ala, Leu, Ser, Val, Gly, Ile, His, Gln, Thr, Asn, Arg, Cys, or Pro
  misc_feature (8)..(8): Xaa can be Leu, Phe, Met, Tyr, Ile, Val, Trp, Ala, His, Cys, Thr, Lys, or Arg
FXPSLREX

SEQ ID NO: 51059 - protein, 9 aa, Artificial Sequence
  Description of Artificial Sequence: Synthetic peptide
  Seed: FFPSLREAA (MAGA1_HUMAN)
  misc_feature (2)..(2): Xaa can be Tyr, Phe, Trp, Met, Leu, Thr, Gln, Ser, Ile, Ala, Val, His, Gly, Asn, Pro, Arg, Cys, or Ly s
  misc_feature (9)..(9): Xaa can be Leu, Phe, Met, Tyr, Ile, Val, Trp, His, Cys, Ala, Arg, Lys, Thr, Gln, or Ser
FXPSLREAX

SEQ ID NO: 51060 - protein, 10 aa, Artificial Sequence
  Description of Artificial Sequence: Synthetic peptide
  Seed: FFPSLREAAL (MAGA1_HUMAN)
  misc_feature (2)..(2): Xaa can be Tyr, Gly, Ala, Ser, Val, Phe, His, Trp, Asn, Cys, Asp, Leu, Glu, Ile, Thr, Gln, Arg, Met, Lys, or Pro
  misc_feature (10)..(10): Xaa can be Trp, Ala, Phe, Tyr, Met, Leu, Val, Ile, Lys, His, or Cys
FXPSLREAAX

SEQ ID NO: 51061 - protein, 11 aa, Artificial Sequence
  Description of Artificial Sequence: Synthetic peptide
  Seed: FFPSLREAALR (MAGA1_HUMAN)
  misc_feature (2)..(2): Xaa can be Thr, Phe, Ile, Leu, Met, Val, Ala, or Tyr
  misc_feature (11)..(11): Xaa can be , or Arg
FXPSLREAALX

SEQ ID NO: 51062 - protein, 8 aa, Artificial Sequence
  Description of Artificial Sequence: Synthetic peptide
  Seed: FGKASESL (MAGA1_HUMAN)
  misc_feature (2)..(2): Xaa can be Ser, Ala, Gly, Val, Thr, Ile, Gln, Phe, Asn, Met, Leu, His, Arg, Glu, Tyr, or Asp
  misc_feature (8)..(8): Xaa can be Leu, Tyr, Phe, Met, Val, Ile, or His
FXKASESX

SEQ ID NO: 51063 - protein, 11 aa, Artificial Sequence
  Description of Artificial Sequence: Synthetic peptide
  Seed: FGKASESLQLV (MAGA1_HUMAN)
  misc_feature (2)..(2): Xaa can be Met, Leu, Gln, Val, Ile, Thr, Phe, Cys, Ser, Asp, Lys, Arg, Asn, Tyr, His, Gly, Glu, Trp, Ala, or Pro
  misc_feature (11)..(11): Xaa can be Val, Leu, Ile, Met, or Ala
FXKASESLQLX

SEQ ID NO: 51064 - protein, 9 aa, Artificial Sequence
  Description of Artificial Sequence: Synthetic peptide
  Seed: FLIIVLVMI (MAGA1_HUMAN)
  misc_feature (2)..(2): Xaa can be Met, Leu, Gln, Thr, Val, Ile, Ala, Ser, Asn, Gly, Phe, Glu, or Cys
  misc_feature (9)..(9): Xaa can be Val, Leu, Arg, Lys, Ile, Met, Ala, Thr, Phe, Ser, Tyr, Cys, or Gly
FXIIVLVMX

SEQ ID NO: 51065 - protein, 10 aa, Artificial Sequence
  Description of Artificial Sequence: Synthetic peptide
  Seed: FLIIVLVMIA (MAGA1_HUMAN)
  misc_feature (2)..(2): Xaa can be Met, Leu, Ile, Val, Thr, Gln, Ala, or Ser
  misc_feature (10)..(10): Xaa can be Val, Leu, Ile, Ala, or Met
FXIIVLVMIX

SEQ ID NO: 51066 - protein, 8 aa, Artificial Sequence
  Description of Artificial Sequence: Synthetic peptide
  Seed: FLLLKYRA (MAGA1_HUMAN)
  misc_feature (2)..(2): Xaa can be Leu, or Met
  misc_feature (8)..(8): Xaa can be Ile, Leu, Val, or Ala
FXLLKYRX

SEQ ID NO: 51067 - protein, 9 aa, Artificial Sequence
  Description of Artificial Sequence: Synthetic peptide
  Seed: FLLLKYRAR (MAGA1_HUMAN)
  misc_feature (2)..(2): Xaa can be Met, Ile, Gln, Val, Trp, Tyr, Ser, Leu, Phe, Thr, Asn, Asp, Gly, Pro, Cys, Ala, or Glu
  misc_feature (9)..(9): Xaa can be Arg, Lys, Leu, or Tyr
FXLLKYRAX

SEQ ID NO: 51068 - protein, 8 aa, Artificial Sequence
  Description of Artificial Sequence: Synthetic peptide
  Seed: FLWGPRAL (MAGA1_HUMAN)
  misc_feature (2)..(2): Xaa can be Ala, Arg, Tyr, Ser, Gln, Thr, Ile, Phe, Gly, Val, Met, Leu, Asn, Trp, Asp, Glu, Pro, His, Cys, or Lys
  misc_feature (8)..(8): Xaa can be Tyr, Leu, Phe, Met, Ile, Val, His, Ala, Lys, Trp, Cys, Arg, Thr, or Gln
FXWGPRAX

SEQ ID NO: 51069 - protein, 9 aa, Artificial Sequence
  Description of Artificial Sequence: Synthetic peptide
  Seed: FLWGPRALA (MAGA1_HUMAN)
  misc_feature (2)..(2): Xaa can be Met, Leu, Ile, Val, Gln, Ala, Ser, Thr, Phe, Gly, Trp, Cys, Tyr, Asn, Pro, Asp, Glu, His, or Lys
  misc_feature (9)..(9): Xaa can be Arg, Lys, Val, Leu, Ile, Tyr, Ala, Phe, Met, His, Cys, Thr, Ser, Glu, Gly, Gln, Pro, or Tr p
FXWGPRALX

SEQ ID NO: 51070 - protein, 10 aa, Artificial Sequence
  Description of Artificial Sequence: Synthetic peptide
  Seed: FLWGPRALAE (MAGA1_HUMAN)
  misc_feature (2)..(2): Xaa can be Met, Leu, Val, Ile, Thr, Gln, Ser, Ala, Phe, Gly, Cys, or Trp
  misc_feature (10)..(10): Xaa can be Val, Ile, Leu, Ala, Met, Thr, Phe, Gln, Pro, Trp, Gly, Asn, Tyr, Lys, Arg, Asp, Ser, His, Glu, or Cys
FXWGPRALAX

SEQ ID NO: 51071 - protein, 11 aa, Artificial Sequence
  Description of Artificial Sequence: Synthetic peptide
  Seed: FLWGPRALAET (MAGA1_HUMAN)
  misc_feature (2)..(2): Xaa can be Leu, Met, Gln, Val, Ile, Thr, Ser, Ala, Gly, or Phe
  misc_feature (11)..(11): Xaa can be Val, Ile, Leu, Ala, Met, Thr, Ser, Phe, Cys, Pro, or Gly
FXWGPRALAEX

SEQ ID NO: 51072 - protein, 8 aa, Artificial Sequence
  Description of Artificial Sequence: Synthetic peptide
  Seed: FPEIFGKA (MAGA1_HUMAN)
  misc_feature (2)..(2): Xaa can be , or Pro
  misc_feature (8)..(8): Xaa can be Leu, Val, or Ala
FXEIFGKX

SEQ ID NO: 51073 - protein, 9 aa, Artificial Sequence
  Description of Artificial Sequence: Synthetic peptide
  Seed: FPEIFGKAS (MAGA1_HUMAN)
  misc_feature (2)..(2): Xaa can be Pro, Ala, or Val
  misc_feature (9)..(9): Xaa can be Leu, Ala, Phe, Met, Ile, Pro, Trp, Gly, Lys, Cys, Arg, Tyr, Ser, Thr, or Val
FXEIFGKAX

SEQ ID NO: 51074 - protein, 8 aa, Artificial Sequence
  Description of Artificial Sequence: Synthetic peptide
  Seed: FPSLREAA (MAGA1_HUMAN)
  misc_feature (2)..(2): Xaa can be Pro, or Ala
  misc_feature (8)..(8): Xaa can be Leu, Phe, Thr, Ile, Ala, Ser, Tyr, Pro, Met, Val, or Cys
FXSLREAX

SEQ ID NO: 51075 - protein, 9 aa, Artificial Sequence
  Description of Artificial Sequence: Synthetic peptide
  Seed: FPSLREAAL (MAGA1_HUMAN)
  misc_feature (2)..(2): Xaa can be Pro, Gln, His, Ala, Ser, Met, Arg, Val, Ile, Gly, Leu, Glu, Thr, Lys, Phe, Asp, Tyr, Cys, Trp, or Asn
  misc_feature (9)..(9): Xaa can be Phe, Val, Tyr, Met, Ile, Leu, Ala, Trp, Cys, Thr, Pro, His, Lys, Gly, Ser, Asn, Arg, Gln, or Glu
FXSLREAAX

SEQ ID NO: 51076 - protein, 10 aa, Artificial Sequence
  Description of Artificial Sequence: Synthetic peptide
  Seed: FPSLREAALR (MAGA1_HUMAN)
  misc_feature (2)..(2): Xaa can be Pro, Met, Trp, Thr, Ser, Tyr, Gln, Phe, Ile, Leu, Gly, Asp, Ala, Asn, Val, His, Arg, Glu, Cys, or Lys
  misc_feature (10)..(10): Xaa can be Arg, Lys, Tyr, Asp, Val, Asn, His, Pro, Ile, Leu, Cys, Trp, Thr, Gly, Met, Ser, Ala, Glu, Phe, or Gln
FXSLREAALX

SEQ ID NO: 51077 - protein, 8 aa, Artificial Sequence
  Description of Artificial Sequence: Synthetic peptide
  Seed: FPTTINFT (MAGA1_HUMAN)
  misc_feature (2)..(2): Xaa can be , or Pro
  misc_feature (8)..(8): Xaa can be Val, Met, Thr, Pro, Leu, Ile, or Ala
FXTTINFX

SEQ ID NO: 51078 - protein, 9 aa, Artificial Sequence
  Description of Artificial Sequence: Synthetic peptide
  Seed: FPTTINFTR (MAGA1_HUMAN)
  misc_feature (2)..(2): Xaa can be Pro, Ala, Val, Ile, Thr, Met, Ser, Leu, Cys, Phe, Tyr, Gln, Gly, Glu, Asn, Trp, Lys, His, Asp, or Arg
  misc_feature (9)..(9): Xaa can be Arg, Tyr, Lys, Phe, Met, His, Leu, Trp, Ala, Gln, Ser, Val, Ile, Gly, Glu, Pro, Asn, Asp, Cys, or Thr
FXTTINFTX

SEQ ID NO: 51079 - protein, 11 aa, Artificial Sequence
  Description of Artificial Sequence: Synthetic peptide
  Seed: FPTTINFTRQR (MAGA1_HUMAN)
  misc_feature (2)..(2): Xaa can be Pro, Ile, Gly, Thr, Trp, Asp, Tyr, Ala, Gln, Ser, Asn, Cys, Leu, Met, Arg, Phe, Glu, His, Val, or Lys
  misc_feature (11)..(11): Xaa can be Lys, or Arg
FXTTINFTRQX

SEQ ID NO: 51080 - protein, 9 aa, Artificial Sequence
  Description of Artificial Sequence: Synthetic peptide
  Seed: FRAVITKKV (MAGA1_HUMAN)
  misc_feature (2)..(2): Xaa can be Arg, His, Gln, Lys, Glu, Tyr, Asn, Gly, Ala, Val, Phe, Ile, Ser, Thr, Leu, Met, Trp, Asp, Pro, or Cys
  misc_feature (9)..(9): Xaa can be Leu, Phe, Met, Tyr, Ile, Val, Ala, Cys, Pro, Gly, Lys, Arg, His, Thr, Ser, or Trp
FXAVITKKX

SEQ ID NO: 51081 - protein, 10 aa, Artificial Sequence
  Description of Artificial Sequence: Synthetic peptide
  Seed: FRAVITKKVA (MAGA1_HUMAN)
  misc_feature (2)..(2): Xaa can be His, or Arg
  misc_feature (10)..(10): Xaa can be Ala, Val, Thr, Met, Cys, Leu, or Ile
FXAVITKKVX

SEQ ID NO: 51082 - protein, 9 aa, Artificial Sequence
  Description of Artificial Sequence: Synthetic peptide
  Seed: GASAFPTTI (MAGA1_HUMAN)
  misc_feature (2)..(2): Xaa can be Ala, Arg, Leu, Thr, Ser, Val, Ile, Met, Gln, Gly, Asp, Pro, Asn, Tyr, Cys, Phe, Glu, Lys, His, or Trp
  misc_feature (9)..(9): Xaa can be Leu, Phe, Tyr, Met, Ile, Val, Trp, Lys, His, Ala, Arg, Cys, Thr, Gln, or Ser
GXSAFPTTX

SEQ ID NO: 51083 - protein, 11 aa, Artificial Sequence
  Description of Artificial Sequence: Synthetic peptide
  Seed: GASAFPTTINF (MAGA1_HUMAN)
  misc_feature (2)..(2): Xaa can be Ala, Ser, Thr, Val, Ile, Gly, Leu, Met, Gln, Trp, His, Lys, Cys, Arg, Phe, Tyr, Glu, Asp, Asn, or Pro
  misc_feature (11)..(11): Xaa can be Trp, Tyr, Phe, Lys, Met, Arg, Leu, Ile, Val, or His
GXSAFPTTINX

SEQ ID NO: 51084 - protein, 8 aa, Artificial Sequence
  Description of Artificial Sequence: Synthetic peptide
  Seed: GDNQIMPK (MAGA1_HUMAN)
  misc_feature (2)..(2): Xaa can be Ala, Ile, Val, Gly, or Asp
  misc_feature (8)..(8): Xaa can be Lys, Arg, or Leu
GXNQIMPX

SEQ ID NO: 51085 - protein, 9 aa, Artificial Sequence
  Description of Artificial Sequence: Synthetic peptide
  Seed: GDNQIMPKT (MAGA1_HUMAN)
  misc_feature (2)..(2): Xaa can be Glu, Asp, or Gln
  misc_feature (9)..(9): Xaa can be Val, Ala, Cys, Pro, Leu, Met, Thr, Ile, Glu, Asp, Gly, Phe, Ser, or Tyr
GXNQIMPKX

SEQ ID NO: 51086 - protein, 11 aa, Artificial Sequence
  Description of Artificial Sequence: Synthetic peptide
  Seed: GDNQIMPKTGF (MAGA1_HUMAN)
  misc_feature (2)..(2): Xaa can be Glu, or Asp
  misc_feature (11)..(11): Xaa can be Phe, Leu, Met, Trp, Ile, Cys, or Val
GXNQIMPKTGX

SEQ ID NO: 51087 - protein, 11 aa, Artificial Sequence
  Description of Artificial Sequence: Synthetic peptide
  Seed: GEPRKLLTQDL (MAGA1_HUMAN)
  misc_feature (2)..(2): Xaa can be , or Glu
  misc_feature (11)..(11): Xaa can be , or Leu
GXPRKLLTQDX

SEQ ID NO: 51088 - protein, 9 aa, Artificial Sequence
  Description of Artificial Sequence: Synthetic peptide
  Seed: GFLIIVLVM (MAGA1_HUMAN)
  misc_feature (2)..(2): Xaa can be Tyr, or Phe
  misc_feature (9)..(9): Xaa can be Tyr, Leu, Phe, or Met
GXLIIVLVX

SEQ ID NO: 51089 - protein, 8 aa, Artificial Sequence
  Description of Artificial Sequence: Synthetic peptide
  Seed: GFLLLKYR (MAGA1_HUMAN)
  misc_feature (2)..(2): Xaa can be Ser, Met, Leu, Tyr, Phe, Val, or Thr
  misc_feature (8)..(8): Xaa can be , or Arg
GXLLLKYX

SEQ ID NO: 51090 - protein, 10 aa, Artificial Sequence
  Description of Artificial Sequence: Synthetic peptide
  Seed: GFLLLKYRAR (MAGA1_HUMAN)
  misc_feature (2)..(2): Xaa can be Tyr, Ser, Trp, Val, Met, Phe, Thr, Gln, Lys, His, Cys, Arg, Gly, Leu, Ile, Ala, or Asn
  misc_feature (10)..(10): Xaa can be Arg, or Lys
GXLLLKYRAX

SEQ ID NO: 51091 - protein, 9 aa, Artificial Sequence
  Description of Artificial Sequence: Synthetic peptide
  Seed: GGHAPEEEI (MAGA1_HUMAN)
  misc_feature (2)..(2): Xaa can be Ala, Ser, Val, Thr, Gly, Ile, Met, Cys, Leu, Asn, or Gln
  misc_feature (9)..(9): Xaa can be Leu, Ile, Met, Val, Phe, or Tyr
GXHAPEEEX

SEQ ID NO: 51092 - protein, 10 aa, Artificial Sequence
  Description of Artificial Sequence: Synthetic peptide
  Seed: GGHAPEEEIW (MAGA1_HUMAN)
  misc_feature (2)..(2): Xaa can be Ser, Thr, Cys, Gly, Ile, Met, Ala, Val, Pro, Leu, or Asn
  misc_feature (10)..(10): Xaa can be Trp, or Phe
GXHAPEEEIX

SEQ ID NO: 51093 - protein, 8 aa, Artificial Sequence
  Description of Artificial Sequence: Synthetic peptide
  Seed: GHAPEEEI (MAGA1_HUMAN)
  misc_feature (2)..(2): Xaa can be , or His
  misc_feature (8)..(8): Xaa can be Phe, Leu, Met, or Ile
GXAPEEEX

SEQ ID NO: 51094 - protein, 9 aa, Artificial Sequence
  Description of Artificial Sequence: Synthetic peptide
  Seed: GHAPEEEIW (MAGA1_HUMAN)
  misc_feature (2)..(2): Xaa can be His, Gln, Arg, Glu, or Lys
  misc_feature (9)..(9): Xaa can be Phe, Ile, Leu, Trp, Val, Met, Cys, Tyr, or Ala
GXAPEEEIX

SEQ ID NO: 51095 - protein, 9 aa, Artificial Sequence
  Description of Artificial Sequence: Synthetic peptide
  Seed: GHSYVLVTC (MAGA1_HUMAN)
  misc_feature (2)..(2): Xaa can be His, Gln, Arg, Pro, or Glu
  misc_feature (9)..(9): Xaa can be Ala, Leu, Cys, Ile, Val, Met, Phe, Pro, Tyr, Trp, Gly, Ser, or Thr
GXSYVLVTX

SEQ ID NO: 51096 - protein, 10 aa, Artificial Sequence
  Description of Artificial Sequence: Synthetic peptide
  Seed: GHSYVLVTCL (MAGA1_HUMAN)
  misc_feature (2)..(2): Xaa can be , or His
  misc_feature (10)..(10): Xaa can be Phe, Leu, or Ile
GXSYVLVTCX

SEQ ID NO: 51097 - protein, 9 aa, Artificial Sequence
  Description of Artificial Sequence: Synthetic peptide
  Seed: GKASESLQL (MAGA1_HUMAN)
  misc_feature (2)..(2): Xaa can be Arg, Gln, Ala, Lys, Gly, Phe, Asn, His, Met, Ser, Leu, Tyr, Glu, Thr, Val, Ile, or Asp
  misc_feature (9)..(9): Xaa can be Tyr, Leu, Phe, Met, Val, Trp, Ile, His, Lys, Ser, Cys, Thr, Pro, Gly, Ala, or Arg
GXASESLQX

SEQ ID NO: 51098 - protein, 11 aa, Artificial Sequence
  Description of Artificial Sequence: Synthetic peptide
  Seed: GKASESLQLVF (MAGA1_HUMAN)
  misc_feature (2)..(2): Xaa can be Gln, Glu, Arg, Lys, Met, Leu, Ala, or His
  misc_feature (11)..(11): Xaa can be Tyr, Phe, Met, Trp, or Leu
GXASESLQLVX

SEQ ID NO: 51099 - protein, 9 aa, Artificial Sequence
  Description of Artificial Sequence: Synthetic peptide
  Seed: GLLGDNQIM (MAGA1_HUMAN)
  misc_feature (2)..(2): Xaa can be Gln, Leu, Val, Met, Ile, Ala, Ser, Thr, Glu, Gly, Asn, Tyr, Cys, Lys, Arg, Phe, Pro, or Hi s
  misc_feature (9)..(9): Xaa can be Tyr, Trp, Phe, Ile, Leu, Val, Met, Ala, Thr, His, or Cys
GXLGDNQIX

SEQ ID NO: 51100 - protein, 11 aa, Artificial Sequence
  Description of Artificial Sequence: Synthetic peptide
  Seed: GLLGDNQIMPK (MAGA1_HUMAN)
  misc_feature (2)..(2): Xaa can be Ala, Val, Ser, Thr, Asn, Leu, Gln, Asp, Cys, Met, Tyr, Ile, Glu, Phe, Trp, Gly, Arg, or Pr o
  misc_feature (11)..(11): Xaa can be Lys, Arg, Tyr, Leu, Phe, or Met
GXLGDNQIMPX

SEQ ID NO: 51101 - protein, 9 aa, Artificial Sequence
  Description of Artificial Sequence: Synthetic peptide
  Seed: GLVCVQAAT (MAGA1_HUMAN)
  misc_feature (2)..(2): Xaa can be Met, Leu, Gln, Ile, Val, Thr, Ala, or Ser
  misc_feature (9)..(9): Xaa can be Val, Ile, Leu, Ala, Met, Phe, or Thr
GXVCVQAAX

SEQ ID NO: 51102 - protein, 9 aa, Artificial Sequence
  Description of Artificial Sequence: Synthetic peptide
  Seed: GPRALAETS (MAGA1_HUMAN)
  misc_feature (2)..(2): Xaa can be Pro, Ala, Val, or Ile
  misc_feature (9)..(9): Xaa can be Leu, Met, Ala, Val, Ile, Phe, His, Trp, Ser, Pro, Tyr, Cys, Gly, or Thr
GXRALAETX

SEQ ID NO: 51103 - protein, 10 aa, Artificial Sequence
  Description of Artificial Sequence: Synthetic peptide
  Seed: GPRALAETSY (MAGA1_HUMAN)
  misc_feature (2)..(2): Xaa can be Pro, Met, Gln, Leu, Val, Ile, Ala, Thr, Glu, Ser, Lys, Asn, Gly, or Phe
  misc_feature (10)..(10): Xaa can be Tyr, Phe, Met, Leu, Trp, Ala, Gly, Ile, Val, Ser, Pro, Cys, or Thr
GXRALAETSX

SEQ ID NO: 51104 - protein, 11 aa, Artificial Sequence
  Description of Artificial Sequence: Synthetic peptide
  Seed: GPRALAETSYV (MAGA1_HUMAN)
  misc_feature (2)..(2): Xaa can be , or Pro
  misc_feature (11)..(11): Xaa can be Val, Cys, Leu, Met, Ile, Ala, or Phe
GXRALAETSYX

SEQ ID NO: 51105 - protein, 8 aa, Artificial Sequence
  Description of Artificial Sequence: Synthetic peptide
  Seed: GPSTSCIL (MAGA1_HUMAN)
  misc_feature (2)..(2): Xaa can be , or Pro
  misc_feature (8)..(8): Xaa can be , or Leu
GXSTSCIX

SEQ ID NO: 51106 - protein, 11 aa, Artificial Sequence
  Description of Artificial Sequence: Synthetic peptide
  Seed: GPSTSCILESL (MAGA1_HUMAN)
  misc_feature (2)..(2): Xaa can be , or Pro
  misc_feature (11)..(11): Xaa can be Cys, Val, Met, Ile, Leu, Ala, or Phe
GXSTSCILESX

SEQ ID NO: 51107 - protein, 11 aa, Artificial Sequence
  Description of Artificial Sequence: Synthetic peptide
  Seed: GREHSAYGEPR (MAGA1_HUMAN)
  misc_feature (2)..(2): Xaa can be , or Arg
  misc_feature (11)..(11): Xaa can be Lys, Tyr, Arg, or Phe
GXEHSAYGEPX

SEQ ID NO: 51108 - protein, 9 aa, Artificial Sequence
  Description of Artificial Sequence: Synthetic peptide
  Seed: GTLEEVPTA (MAGA1_HUMAN)
  misc_feature (2)..(2): Xaa can be Met, Leu, Gln, Ala, Ile, Val, Thr, Ser, Gly, Glu, Asn, Cys, Phe, Tyr, Asp, or Trp
  misc_feature (9)..(9): Xaa can be Leu, Val, Ile, Met, Ala, Phe, Cys, Thr, Ser, Tyr, Arg, Pro, Gly, Lys, Glu, or Gln
GXLEEVPTX

SEQ ID NO: 51109 - protein, 8 aa, Artificial Sequence
  Description of Artificial Sequence: Synthetic peptide
  Seed: HAPEEEIW (MAGA1_HUMAN)
  misc_feature (2)..(2): Xaa can be Pro, Thr, Ala, or Ser
  misc_feature (8)..(8): Xaa can be , or Trp
HXPEEEIX

SEQ ID NO: 51110 - protein, 11 aa, Artificial Sequence
  Description of Artificial Sequence: Synthetic peptide
  Seed: HAPEEEIWEEL (MAGA1_HUMAN)
  misc_feature (2)..(2): Xaa can be Ala, Gln, Met, Ile, Val, Ser, Thr, Arg, Leu, Tyr, Phe, Gly, Trp, Pro, His, Cys, Glu, Asp, or Asn
  misc_feature (11)..(11): Xaa can be Lys, Leu, Met, Arg, Phe, Tyr, Ile, Trp, Val, or His
HXPEEEIWEEX

SEQ ID NO: 51111 - protein, 9 aa, Artificial Sequence
  Description of Artificial Sequence: Synthetic peptide
  Seed: HCFPEIFGK (MAGA1_HUMAN)
  misc_feature (2)..(2): Xaa can be Thr, Met, Val, Ala, Leu, Ser, Ile, Gln, Gly, Cys, Tyr, Phe, Asn, Trp, Pro, Glu, Asp, His, Arg, or Lys
  misc_feature (9)..(9): Xaa can be Arg, Lys, Tyr, Leu, Phe, Met, His, Ile, Val, Gln, Ala, Trp, Asn, Thr, Glu, or Cys
HXFPEIFGX

SEQ ID NO: 51112 - protein, 8 aa, Artificial Sequence
  Description of Artificial Sequence: Synthetic peptide
  Seed: HSAYGEPR (MAGA1_HUMAN)
  misc_feature (2)..(2): Xaa can be Thr, Val, Ala, Ser, or Ile
  misc_feature (8)..(8): Xaa can be , or Arg
HXAYGEPX

SEQ ID NO: 51113 - protein, 9 aa, Artificial Sequence
  Description of Artificial Sequence: Synthetic peptide
  Seed: HSAYGEPRK (MAGA1_HUMAN)
  misc_feature (2)..(2): Xaa can be Val, Thr, Phe, Ser, Asn, Ile, Pro, Asp, Gly, Met, Ala, Gln, or Leu
  misc_feature (9)..(9): Xaa can be Arg, Lys, Tyr, His, Leu, or Met
HXAYGEPRX

SEQ ID NO: 51114 - protein, 10 aa, Artificial Sequence
  Description of Artificial Sequence: Synthetic peptide
  Seed: HSAYGEPRKL (MAGA1_HUMAN)
  misc_feature (2)..(2): Xaa can be Ala, Thr, Ser, Met, Val, Ile, Leu, Gln, Glu, Cys, Gly, Asn, Pro, Asp, or Phe
  misc_feature (10)..(10): Xaa can be Trp, Tyr, Phe, Met, Leu, Ile, Val, or His
HXAYGEPRKX

SEQ ID NO: 51115 - protein, 8 aa, Artificial Sequence
  Description of Artificial Sequence: Synthetic peptide
  Seed: HSYVLVTC (MAGA1_HUMAN)
  misc_feature (2)..(2): Xaa can be Gln, Ala, Ser, Glu, Gly, Asn, Asp, Pro, His, Met, Thr, Val, Ile, Leu, Lys, Cys, Phe, Arg, or Tyr
  misc_feature (8)..(8): Xaa can be Ile, Val, Leu, Met, Phe, Cys, Ala, Thr, Trp, Pro, Tyr, or Ser
HXYVLVTX

SEQ ID NO: 51116 - protein, 9 aa, Artificial Sequence
  Description of Artificial Sequence: Synthetic peptide
  Seed: HSYVLVTCL (MAGA1_HUMAN)
  misc_feature (2)..(2): Xaa can be Arg, Gln, Ala, Pro, Thr, Met, Val, Gly, Ser, His, Asp, Leu, Ile, Phe, Glu, Lys, Asn, Cys, Tyr, or Trp
  misc_feature (9)..(9): Xaa can be Met, Leu, Phe, Tyr, Val, Ile, Trp, His, Ala, Cys, Thr, Lys, Gly, Pro, or Arg
HXYVLVTCX

SEQ ID NO: 51117 - protein, 9 aa, Artificial Sequence
  Description of Artificial Sequence: Synthetic peptide
  Seed: IAMEGGHAP (MAGA1_HUMAN)
  misc_feature (2)..(2): Xaa can be Pro, Ala, Ser, Val, Thr, Ile, Gly, Met, Leu, Gln, Cys, Phe, Asn, Glu, Tyr, Asp, Trp, His, Lys, or Arg
  misc_feature (9)..(9): Xaa can be Tyr, Met, Phe, Leu, Lys, Arg, His, Ile, Val, Trp, Ala, Cys, Thr, Ser, Gln, Pro, Gly, Asn, Glu, or Asp
IXMEGGHAX

SEQ ID NO: 51118 - protein, 9 aa, Artificial Sequence
  Description of Artificial Sequence: Synthetic peptide
  Seed: IFGKASESL (MAGA1_HUMAN)
  misc_feature (2)..(2): Xaa can be Arg, Ala, Tyr, Thr, Ser, Phe, Trp, Val, Gly, Ile, Met, Gln, Leu, Cys, His, Glu, Asn, Asp, or Pro
  misc_feature (9)..(9): Xaa can be Leu, Met, Tyr, Phe, Ile, Val, Trp, Lys, His, or Arg
IXGKASESX

SEQ ID NO: 51119 - protein, 11 aa, Artificial Sequence
  Description of Artificial Sequence: Synthetic peptide
  Seed: IFGKASESLQL (MAGA1_HUMAN)
  misc_feature (2)..(2): Xaa can be Trp, Tyr, or Phe
  misc_feature (11)..(11): Xaa can be Phe, Trp, Leu, Ile, or Met
IXGKASESLQX

SEQ ID NO: 51120 - protein, 9 aa, Artificial Sequence
  Description of Artificial Sequence: Synthetic peptide
  Seed: IIVLVMIAM (MAGA1_HUMAN)
  misc_feature (2)..(2): Xaa can be Ala, Gln, Met, Ser, Thr, Gly, Pro, Leu, Val, Ile, Cys, Glu, Asn, Trp, His, Asp, Arg, Phe, Tyr, or Lys
  misc_feature (9)..(9): Xaa can be Tyr, Phe, Met, Leu, Val, Ile, His, Trp, Lys, Ala, or Arg
IXVLVMIAX

SEQ ID NO: 51121 - protein, 11 aa, Artificial Sequence
  Description of Artificial Sequence: Synthetic peptide
  Seed: IKNYKHCFPEI (MAGA1_HUMAN)
  misc_feature (2)..(2): Xaa can be Tyr, Leu, Phe, Arg, Cys, Gly, Trp, Met, Ala, Ile, Lys, Glu, Asn, Ser, Gln, Val, His, Thr, Pro, or Asp
  misc_feature (11)..(11): Xaa can be Phe, Trp, Leu, Ile, or Met
IXNYKHCFPEX

SEQ ID NO: 51122 - protein, 9 aa, Artificial Sequence
  Description of Artificial Sequence: Synthetic peptide
  Seed: IKVSARVRF (MAGA1_HUMAN)
  misc_feature (2)..(2): Xaa can be Gln, Arg, Met, His, Lys, Tyr, Phe, Ala, Leu, Val, Glu, Ser, Ile, Thr, Gly, Asn, Cys, Trp, or Pro
  misc_feature (9)..(9): Xaa can be Tyr, Phe, Met, Leu, Ile, Trp, His, Val, or Ala
IXVSARVRX

SEQ ID NO: 51123 - protein, 10 aa, Artificial Sequence
  Description of Artificial Sequence: Synthetic peptide
  Seed: IKVSARVRFF (MAGA1_HUMAN)
  misc_feature (2)..(2): Xaa can be Gln, Met, Lys, Arg, Ala, Glu, His, or Leu
  misc_feature (10)..(10): Xaa can be Phe, Tyr, Met, Arg, Ala, Gln, Lys, Pro, His, Thr, Trp, Glu, Gly, Asp, Leu, Ser, Ile, Cys, Asn, or Val
IXVSARVRFX

SEQ ID NO: 51124 - protein, 11 aa, Artificial Sequence
  Description of Artificial Sequence: Synthetic peptide
  Seed: IKVSARVRFFF (MAGA1_HUMAN)
  misc_feature (2)..(2): Xaa can be Ser, Thr, Gln, Lys, Ile, Met, Arg, Tyr, Val, Asn, Glu, Pro, Leu, Gly, Phe, Cys, Asp, Trp, His, or Ala
  misc_feature (11)..(11): Xaa can be Trp, Tyr, Phe, Met, or Leu
IXVSARVRFFX

SEQ ID NO: 51125 - protein, 8 aa, Artificial Sequence
  Description of Artificial Sequence: Synthetic peptide
  Seed: ILESLFRA (MAGA1_HUMAN)
  misc_feature (2)..(2): Xaa can be Met, Leu, Trp, Val, Phe, Ile, or Tyr
  misc_feature (8)..(8): Xaa can be Val, Ile, Met, Leu, or Ala
IXESLFRX

SEQ ID NO: 51126 - protein, 9 aa, Artificial Sequence
  Description of Artificial Sequence: Synthetic peptide
  Seed: ILESLFRAV (MAGA1_HUMAN)
  misc_feature (2)..(2): Xaa can be Ala, Val, Gln, Thr, Leu, Ser, Phe, Met, Ile, Gly, Asn, Cys, Tyr, Trp, Glu, or Asp
  misc_feature (9)..(9): Xaa can be Leu, Met, Phe, Val, Ile, Tyr, Trp, Ala, or Lys
IXESLFRAX

SEQ ID NO: 51127 - protein, 10 aa, Artificial Sequence
  Description of Artificial Sequence: Synthetic peptide
  Seed: ILESLFRAVI (MAGA1_HUMAN)
  misc_feature (2)..(2): Xaa can be Ser, His, Met, Cys, Pro, Arg, Thr, Gly, Asp, Asn, Tyr, Val, Phe, Leu, Lys, Ile, Ala, Gln, Glu, or Trp
  misc_feature (10)..(10): Xaa can be Ala, Ile, Val, Phe, Met, or Leu
IXESLFRAVX

SEQ ID NO: 51128 - protein, 8 aa, Artificial Sequence
  Description of Artificial Sequence: Synthetic peptide
  Seed: IMPKTGFL (MAGA1_HUMAN)
  misc_feature (2)..(2): Xaa can be Ala, Ser, Pro, Val, Thr, Met, Leu, Cys, Gly, Phe, or Ile
  misc_feature (8)..(8): Xaa can be Leu, Met, Ile, Phe, or Val
IXPKTGFX

SEQ ID NO: 51129 - protein, 9 aa, Artificial Sequence
  Description of Artificial Sequence: Synthetic peptide
  Seed: IMPKTGFLI (MAGA1_HUMAN)
  misc_feature (2)..(2): Xaa can be Tyr, Leu, Met, Ala, Phe, Val, Gln, Ile, Trp, Ser, Gly, Thr, Asn, Cys, Glu, His, Arg, Pro, Asp, or Lys
  misc_feature (9)..(9): Xaa can be Leu, Met, Ile, Val, Phe, Trp, Tyr, Arg, Lys, Ala, Cys, Thr, Gly, or Ser
IXPKTGFLX

SEQ ID NO: 51130 - protein, 10 aa, Artificial Sequence
  Description of Artificial Sequence: Synthetic peptide
  Seed: IMPKTGFLII (MAGA1_HUMAN)
  misc_feature (2)..(2): Xaa can be Tyr, Trp, Phe, Leu, Met, Gln, His, Ser, Glu, Gly, Pro, Cys, Ile, Arg, Lys, Asn, Val, Ala, Thr, or Asp
  misc_feature (10)..(10): Xaa can be Met, Val, Leu, Ile, Phe, Trp, Ala, Tyr, Glu, Lys, Asp, Gly, Thr, Cys, Ser, Pro, Asn, His, Gln, or Arg
IXPKTGFLIX

SEQ ID NO: 51131 - protein, 11 aa, Artificial Sequence
  Description of Artificial Sequence: Synthetic peptide
  Seed: IMPKTGFLIIV (MAGA1_HUMAN)
  misc_feature (2)..(2): Xaa can be Met, or Leu
  misc_feature (11)..(11): Xaa can be Leu, Val, or Ile
IXPKTGFLIIX

SEQ ID NO: 51132 - protein, 8 aa, Artificial Sequence
  Description of Artificial Sequence: Synthetic peptide
  Seed: ITKKVADL (MAGA1_HUMAN)
  misc_feature (2)..(2): Xaa can be Ala, Ser, Thr, Val, Ile, Gly, Gln, or Met
  misc_feature (8)..(8): Xaa can be Tyr, Phe, Leu, Met, Ile, His, or Val
IXKKVADX

SEQ ID NO: 51133 - protein, 9 aa, Artificial Sequence
  Description of Artificial Sequence: Synthetic peptide
  Seed: ITKKVADLV (MAGA1_HUMAN)
  misc_feature (2)..(2): Xaa can be Thr, Ser, Met, Gln, Leu, Val, Ala, Ile, Gly, Phe, Asn, Cys, Glu, Asp, Pro, Tyr, Trp, Arg, His, or Lys
  misc_feature (9)..(9): Xaa can be Trp, Phe, Leu, Val, Tyr, Lys, Met, Ile, Ala, Cys, or His
IXKKVADLX

SEQ ID NO: 51134 - protein, 11 aa, Artificial Sequence
  Description of Artificial Sequence: Synthetic peptide
  Seed: ITKKVADLVGF (MAGA1_HUMAN)
  misc_feature (2)..(2): Xaa can be Thr, Ser, Ala, Val, Cys, Gln, Phe, Pro, Met, Asp, Glu, Ile, Gly, Leu, or Asn
  misc_feature (11)..(11): Xaa can be Trp, Phe, Met, Ile, Tyr, or Leu
IXKKVADLVGX

SEQ ID NO: 51135 - protein, 8 aa, Artificial Sequence
  Description of Artificial Sequence: Synthetic peptide
  Seed: IWEELSVM (MAGA1_HUMAN)
  misc_feature (2)..(2): Xaa can be Tyr, Phe, Trp, Ser, or Ala
  misc_feature (8)..(8): Xaa can be Leu, Phe, Met, Ile, Val, or Tyr
IXEELSVX

SEQ ID NO: 51136 - protein, 11 aa, Artificial Sequence
  Description of Artificial Sequence: Synthetic peptide
  Seed: IWEELSVMEVY (MAGA1_HUMAN)
  misc_feature (2)..(2): Xaa can be Tyr, Leu, Ile, Ser, Gln, Phe, Gly, Thr, Trp, Val, Asn, Ala, or Met
  misc_feature (11)..(11): Xaa can be , or Tyr
IXEELSVMEVX

SEQ ID NO: 51137 - protein, 9 aa, Artificial Sequence
  Description of Artificial Sequence: Synthetic peptide
  Seed: KAEMLESVI (MAGA1_HUMAN)
  misc_feature (2)..(2): Xaa can be Ala, Thr, Val, Ser, Arg, Ile, Tyr, Gln, Phe, Gly, Met, Leu, Asn, Cys, Glu, His, Trp, or Pr o
  misc_feature (9)..(9): Xaa can be Leu, Trp, Phe, Met, Ile, Val, Tyr, or Lys
KXEMLESVX

SEQ ID NO: 51138 - protein, 10 aa, Artificial Sequence
  Description of Artificial Sequence: Synthetic peptide
  Seed: KAEMLESVIK (MAGA1_HUMAN)
  misc_feature (2)..(2): Xaa can be Thr, Ile, Gln, Ala, Leu, Met, Val, Ser, Asn, or Cys
  misc_feature (10)..(10): Xaa can be Tyr, Lys, or Arg
KXEMLESVIX

SEQ ID NO: 51139 - protein, 8 aa, Artificial Sequence
  Description of Artificial Sequence: Synthetic peptide
  Seed: KASESLQL (MAGA1_HUMAN)
  misc_feature (2)..(2): Xaa can be Ala, Val, Ile, Thr, Ser, Gln, Arg, Met, Phe, Asn, Leu, Cys, Gly, Asp, Pro, Tyr, Glu, or Hi s
  misc_feature (8)..(8): Xaa can be Leu, Trp, Ile, Tyr, Phe, Val, Met, Arg, Lys, or His
KXSESLQX

SEQ ID NO: 51140 - protein, 9 aa, Artificial Sequence
  Description of Artificial Sequence: Synthetic peptide
  Seed: KASESLQLV (MAGA1_HUMAN)
  misc_feature (2)..(2): Xaa can be Gln, Leu, Met, Ala, Ser, Val, Thr, Ile, Arg, Gly, Tyr, Phe, Cys, Glu, Asn, Asp, Pro, Trp, His, or Lys
  misc_feature (9)..(9): Xaa can be Phe, Arg, Met, Tyr, Ile, Val, Trp, Leu, Lys, His, Cys, Ala, Thr, Gly, Ser, Pro, or Gln
KXSESLQLX

SEQ ID NO: 51141 - protein, 10 aa, Artificial Sequence
  Description of Artificial Sequence: Synthetic peptide
  Seed: KASESLQLVF (MAGA1_HUMAN)
  misc_feature (2)..(2): Xaa can be Ser, Thr, Ala, Gln, Val, Met, Ile, Leu, Arg, Gly, Glu, Cys, Asn, Lys, Tyr, His, Phe, Asp, Pro, or Trp
  misc_feature (10)..(10): Xaa can be Trp, Tyr, Phe, Leu, Met, Val, Ile, Lys, His, Cys, Arg, Gly, or Asn
KXSESLQLVX

SEQ ID NO: 51142 - protein, 9 aa, Artificial Sequence
  Description of Artificial Sequence: Synthetic peptide
  Seed: KEADPTGHS (MAGA1_HUMAN)
  misc_feature (2)..(2): Xaa can be Glu, Asp, or Gln
  misc_feature (9)..(9): Xaa can be Leu, Val, Cys, Phe, Met, Pro, Ile, Ala, Gly, Trp, Ser, Tyr, or Thr
KXADPTGHX

SEQ ID NO: 51143 - protein, 10 aa, Artificial Sequence
  Description of Artificial Sequence: Synthetic peptide
  Seed: KEADPTGHSY (MAGA1_HUMAN)
  misc_feature (2)..(2): Xaa can be Glu, Arg, Ser, Ala, Val, Thr, Ile, Gln, Met, Asp, Leu, Gly, Pro, Tyr, His, Phe, Cys, Lys, Asn, or Trp
  misc_feature (10)..(10): Xaa can be Phe, Ile, Met, Leu, His, Val, Lys, Tyr, Trp, Arg, Ala, Cys, Thr, Gln, Ser, Gly, Pro, Asn, Glu, or Asp
KXADPTGHSX

SEQ ID NO: 51144 - protein, 11 aa, Artificial Sequence
  Description of Artificial Sequence: Synthetic peptide
  Seed: KEADPTGHSYV (MAGA1_HUMAN)
  misc_feature (2)..(2): Xaa can be Glu, Gln, Asp, Met, Leu, Ala, Val, Ile, Thr, Ser, Asn, Gly, Lys, His, Arg, Cys, or Phe
  misc_feature (11)..(11): Xaa can be Trp, Leu, Phe, Ile, Met, Val, Cys, Tyr, Ala, His, Ser, Lys, Arg, Thr, Pro, or Gly
KXADPTGHSYX

SEQ ID NO: 51145 - protein, 8 aa, Artificial Sequence
  Description of Artificial Sequence: Synthetic peptide
  Seed: KHCFPEIF (MAGA1_HUMAN)
  misc_feature (2)..(2): Xaa can be , or His
  misc_feature (8)..(8): Xaa can be Met, Phe, Ile, or Leu
KXCFPEIX

SEQ ID NO: 51146 - protein, 10 aa, Artificial Sequence
  Description of Artificial Sequence: Synthetic peptide
  Seed: KHCFPEIFGK (MAGA1_HUMAN)
  misc_feature (2)..(2): Xaa can be Trp, Met, Phe, Leu, Thr, Tyr, Ile, Val, Ser, Ala, Gly, Gln, His, Asn, Pro, Cys, Asp, Lys, Arg, or Glu
  misc_feature (10)..(10): Xaa can be Arg, Lys, His, or Tyr
KXCFPEIFGX

SEQ ID NO: 51147 - protein, 9 aa, Artificial Sequence
  Description of Artificial Sequence: Synthetic peptide
  Seed: KKVADLVGF (MAGA1_HUMAN)
  misc_feature (2)..(2): Xaa can be Arg, Gln, Met, Leu, Ile, Val, Ala, Glu, Lys, His, Ser, Thr, Tyr, Asn, Gly, Phe, Pro, Cys, Asp, or Trp
  misc_feature (9)..(9): Xaa can be Tyr, Phe, Leu, Met, Trp, His, Val, Ile, or Arg
KXVADLVGX

SEQ ID NO: 51148 - protein, 10 aa, Artificial Sequence
  Description of Artificial Sequence: Synthetic peptide
  Seed: KKVADLVGFL (MAGA1_HUMAN)
  misc_feature (2)..(2): Xaa can be Leu, Met, Gln, Tyr, Phe, Gly, Thr, His, Ala, Glu, Pro, Trp, Asp, Cys, Asn, Lys, Val, Ser, Arg, or Ile
  misc_feature (10)..(10): Xaa can be Ile, Met, Leu, Ala, Val, Phe, Cys, Ser, or Thr
KXVADLVGFX

SEQ ID NO: 51149 - protein, 11 aa, Artificial Sequence
  Description of Artificial Sequence: Synthetic peptide
  Seed: KLLTQDLVQEK (MAGA1_HUMAN)
  misc_feature (2)..(2): Xaa can be Met, Ile, Val, Leu, Thr, Gln, Ala, Trp, Tyr, Glu, Asn, Phe, Gly, Ser, Lys, Pro, Arg, Asp, Cys, or His
  misc_feature (11)..(11): Xaa can be Lys, Arg, Tyr, Phe, Leu, Met, or His
KXLTQDLVQEX

SEQ ID NO: 51150 - protein, 10 aa, Artificial Sequence
  Description of Artificial Sequence: Synthetic peptide
  Seed: KNYKHCFPEI (MAGA1_HUMAN)
  misc_feature (2)..(2): Xaa can be Thr, Ser, Val, Met, Ile, Ala, Trp, Phe, Leu, Gln, Tyr, Gly, Asn, His, Glu, Pro, Arg, Cys, Lys, or Asp
  misc_feature (10)..(10): Xaa can be Val, Ser, Leu, Met, Phe, Ile, Ala, Trp, Lys, Arg, Tyr, Gly, Thr, Pro, Cys, His, Gln, Asn, or Glu
KXYKHCFPEX

SEQ ID NO: 51151 - protein, 11 aa, Artificial Sequence
  Description of Artificial Sequence: Synthetic peptide
  Seed: KNYKHCFPEIF (MAGA1_HUMAN)
  misc_feature (2)..(2): Xaa can be Gln, Met, Ala, Lys, Glu, Leu, Val, Thr, His, Ser, Tyr, Gly, Arg, Asn, Ile, Phe, or Pro
  misc_feature (11)..(11): Xaa can be Tyr, Phe, Met, Leu, Ile, Trp, or His
KXYKHCFPEIX

SEQ ID NO: 51152 - protein, 8 aa, Artificial Sequence
  Description of Artificial Sequence: Synthetic peptide
  Seed: KPEEALEA (MAGA1_HUMAN)
  misc_feature (2)..(2): Xaa can be , or Pro
  misc_feature (8)..(8): Xaa can be Val, Leu, or Ala
KXEEALEX

SEQ ID NO: 51153 - protein, 8 aa, Artificial Sequence
  Description of Artificial Sequence: Synthetic peptide
  Seed: KTGFLIIV (MAGA1_HUMAN)
  misc_feature (2)..(2): Xaa can be Ala, Ser, Thr, or Val
  misc_feature (8)..(8): Xaa can be Leu, Val, Ile, or Met
KXGFLIIX

SEQ ID NO: 51154 - protein, 9 aa, Artificial Sequence
  Description of Artificial Sequence: Synthetic peptide
  Seed: KTGFLIIVL (MAGA1_HUMAN)
  misc_feature (2)..(2): Xaa can be Ala, Thr, Ser, Val, Met, Leu, Gln, Ile, Asn, Gly, Arg, Cys, Glu, Lys, Phe, His, Asp, Trp, Tyr, or Pro
  misc_feature (9)..(9): Xaa can be Leu, Trp, Met, Phe, Ile, Val, Tyr, Ala, Cys, His, or Thr
KXGFLIIVX

SEQ ID NO: 51155 - protein, 10 aa, Artificial Sequence
  Description of Artificial Sequence: Synthetic peptide
  Seed: KTGFLIIVLV (MAGA1_HUMAN)
  misc_feature (2)..(2): Xaa can be Met, Leu, Gln, Val, Ile, or Thr
  misc_feature (10)..(10): Xaa can be Val, Ile, Leu, Ala, Thr, Met, or Ser
KXGFLIIVLX

SEQ ID NO: 51156 - protein, 9 aa, Artificial Sequence
  Description of Artificial Sequence: Synthetic peptide
  Seed: KVADLVGFL (MAGA1_HUMAN)
  misc_feature (2)..(2): Xaa can be Met, Leu, Ile, Gln, Val, Thr, Ala, Arg, Ser, Tyr, Gly, Glu, Asn, Phe, Cys, Trp, His, Pro, Asp, or Lys
  misc_feature (9)..(9): Xaa can be Phe, Trp, Arg, Leu, Tyr, Val, Lys, Ile, Met, His, Cys, Ala, Thr, Ser, Gly, or Pro
KXADLVGFX

SEQ ID NO: 51157 - protein, 10 aa, Artificial Sequence
  Description of Artificial Sequence: Synthetic peptide
  Seed: KVADLVGFLL (MAGA1_HUMAN)
  misc_feature (2)..(2): Xaa can be Leu, Met, Ile, Gln, Ser, Ala, Thr, Val, Arg, Glu, Gly, Phe, Cys, Asn, Tyr, Trp, Lys, His, Asp, or Pro
  misc_feature (10)..(10): Xaa can be Tyr, Arg, Phe, Trp, Leu, Met, Lys, Val, Ile, Ala, His, Cys, Thr, Gly, Asn, Pro, Ser, Glu, Gln, or Asp
KXADLVGFLX

SEQ ID NO: 51158 - protein, 11 aa, Artificial Sequence
  Description of Artificial Sequence: Synthetic peptide
  Seed: KVADLVGFLLL (MAGA1_HUMAN)
  misc_feature (2)..(2): Xaa can be Gln, Leu, Met, Ile, Val, Thr, Ser, Ala, Glu, Cys, Gly, Asp, Phe, Asn, Trp, Tyr, Pro, Lys, Arg, or His
  misc_feature (11)..(11): Xaa can be Trp, Arg, Lys, Phe, Leu, Met, Ile, Tyr, Val, Cys, His, Gln, Ala, Thr, Pro, Glu, Ser, Gly, Asn, or Asp
KXADLVGFLLX

SEQ ID NO: 51159 - protein, 9 aa, Artificial Sequence
  Description of Artificial Sequence: Synthetic peptide
  Seed: KVLEYVIKV (MAGA1_HUMAN)
  misc_feature (2)..(2): Xaa can be Arg, Met, Leu, Gln, Ile, Val, Thr, Ser, Ala, Glu, His, Asn, Phe, Tyr, Gly, Cys, Trp, Pro, Asp, or Lys
  misc_feature (9)..(9): Xaa can be Lys, Phe, Val, Leu, Ile, Tyr, Met, Trp, Arg, His, Ala, Cys, Thr, Ser, Gln, Gly, Pro, Asn, or Glu
KXLEYVIKX

SEQ ID NO: 51160 - protein, 10 aa, Artificial Sequence
  Description of Artificial Sequence: Synthetic peptide
  Seed: KVLEYVIKVS (MAGA1_HUMAN)
  misc_feature (2)..(2): Xaa can be Ile, Val, Leu, Gln, Met, Thr, Ser, Tyr, Phe, Trp, or Ala
  misc_feature (10)..(10): Xaa can be Val, Met, Pro, His, Ser, Trp, Ala, Gln, Tyr, Asp, Gly, Asn, Lys, Leu, Thr, Cys, Glu, Phe, Arg, or Ile
KXLEYVIKVX

SEQ ID NO: 51161 - protein, 11 aa, Artificial Sequence
  Description of Artificial Sequence: Synthetic peptide
  Seed: KVLEYVIKVSA (MAGA1_HUMAN)
  misc_feature (2)..(2): Xaa can be Met, Leu, Ile, Gln, Val, Thr, Tyr, Ala, Ser, or Phe
  misc_feature (11)..(11): Xaa can be Val, Ile, Leu, Met, Ala, Thr, Pro, Phe, Asn, Gly, Ser, Cys, Arg, Gln, Asp, Lys, Tyr, Glu, His, or Trp
KXLEYVIKVSX

SEQ ID NO: 51162 - protein, 9 aa, Artificial Sequence
  Description of Artificial Sequence: Synthetic peptide
  Seed: KVSARVRFF (MAGA1_HUMAN)
  misc_feature (2)..(2): Xaa can be Thr, Met, Ser, Val, Tyr, Ala, Ile, Gln, Phe, Leu, Trp, Gly, Arg, Asn, Cys, Lys, Glu, His, Pro, or Asp
  misc_feature (9)..(9): Xaa can be Tyr, Trp, Met, Phe, Leu, Lys, Val, Ile, Ala, Arg, Ser, Gly, Thr, Cys, His, Pro, Gln, Asn, or Glu
KXSARVRFX

SEQ ID NO: 51163 - protein, 10 aa, Artificial Sequence
  Description of Artificial Sequence: Synthetic peptide
  Seed: KVSARVRFFF (MAGA1_HUMAN)
  misc_feature (2)..(2): Xaa can be Thr, Val, Ser, Met, Tyr, Gln, Phe, Ala, Ile, Trp, Leu, Asn, His, Gly, Lys, Pro, Arg, Glu, Cys, or Asp
  misc_feature (10)..(10): Xaa can be Tyr, Phe, Val, Ser, Trp, Met, Ala, Leu, Lys, Ile, Arg, Gly, Thr, His, Pro, Cys, Asn, or Gl n
KXSARVRFFX

SEQ ID NO: 51164 - protein, 11 aa, Artificial Sequence
  Description of Artificial Sequence: Synthetic peptide
  Seed: KVSARVRFFFP (MAGA1_HUMAN)
  misc_feature (2)..(2): Xaa can be Thr, Ser, Val, Met, Tyr, Phe, Gln, Trp, Ile, Arg, Lys, Pro, Asp, Ala, Glu, Gly, Leu, His, Asn, or Cys
  misc_feature (11)..(11): Xaa can be Ile, Val, Leu, Lys, Ala, Met, Ser, Tyr, Thr, Arg, Gly, Phe, Pro, His, or Gln
KXSARVRFFFX

SEQ ID NO: 51165 - protein, 9 aa, Artificial Sequence
  Description of Artificial Sequence: Synthetic peptide
  Seed: KYRAREPVT (MAGA1_HUMAN)
  misc_feature (2)..(2): Xaa can be Val, Thr, Met, Ser, Tyr, Ala, Phe, Ile, Leu, Trp, Gln, Asn, Gly, Cys, Glu, Arg, His, or Ly s
  misc_feature (9)..(9): Xaa can be Lys, Ala, Tyr, Val, Met, Ile, Thr, Leu, Phe, Ser, Arg, Gly, Gln, Pro, Asn, Cys, His, Glu, Trp, or Asp
KXRAREPVX

SEQ ID NO: 51166 - protein, 10 aa, Artificial Sequence
  Description of Artificial Sequence: Synthetic peptide
  Seed: KYRAREPVTK (MAGA1_HUMAN)
  misc_feature (2)..(2): Xaa can be Ser, Val, Thr, Tyr, Met, Phe, Ile, Ala, Trp, Leu, Gln, Gly, Asn, His, Lys, or Cys
  misc_feature (10)..(10): Xaa can be Lys, Val, Ile, Ala, Arg, Tyr, Met, Ser, Leu, Gly, Phe, Thr, Pro, Cys, Asn, Gln, Glu, or Hi s
KXRAREPVTX

SEQ ID NO: 51167 - protein, 11 aa, Artificial Sequence
  Description of Artificial Sequence: Synthetic peptide
  Seed: KYRAREPVTKA (MAGA1_HUMAN)
  misc_feature (2)..(2): Xaa can be Thr, Val, Ser, Met, Tyr, Phe, Ala, Ile, Trp, Leu, Gln, Gly, Asn, His, Glu, Asp, Cys, Arg, Lys, or Pro
  misc_feature (11)..(11): Xaa can be Lys, Ala, Val, Ile, Met, Leu, Tyr, Ser, Arg, Gly, Asn, Gln, Phe, Thr, Pro, Cys, His, Glu, Asp, or Trp
KXRAREPVTKX

SEQ ID NO: 51168 - protein, 9 aa, Artificial Sequence
  Description of Artificial Sequence: Synthetic peptide
  Seed: LAETSYVKV (MAGA1_HUMAN)
  misc_feature (2)..(2): Xaa can be Ala, Val, Gly, Ile, Thr, Ser, Leu, Met, Tyr, Pro, Gln, Phe, Cys, Glu, Asn, or Asp
  misc_feature (9)..(9): Xaa can be Leu, Met, Ile, Val, Phe, Tyr, or Trp
LXETSYVKX

SEQ ID NO: 51169 - protein, 10 aa, Artificial Sequence
  Description of Artificial Sequence: Synthetic peptide
  Seed: LAETSYVKVL (MAGA1_HUMAN)
  misc_feature (2)..(2): Xaa can be Glu, His, Trp, Gln, Tyr, Asp, Leu, Thr, Ile, Lys, Pro, Cys, Val, Gly, Asn, Met, Arg, Phe, Ser, or Ala
  misc_feature (10)..(10): Xaa can be Leu, Met, or Ile
LXETSYVKVX

SEQ ID NO: 51170 - protein, 8 aa, Artificial Sequence
  Description of Artificial Sequence: Synthetic peptide
  Seed: LEAQQEAL (MAGA1_HUMAN)
  misc_feature (2)..(2): Xaa can be Glu, or Asp
  misc_feature (8)..(8): Xaa can be Phe, Ile, Met, Val, Leu, Pro, Thr, Cys, Ala, or Tyr
LXAQQEAX

SEQ ID NO: 51171 - protein, 9 aa, Artificial Sequence
  Description of Artificial Sequence: Synthetic peptide
  Seed: LEAQQEALG (MAGA1_HUMAN)
  misc_feature (2)..(2): Xaa can be Glu, or Asp
  misc_feature (9)..(9): Xaa can be Val, Ala, Ile, Leu, Met, Gly, Thr, Phe, Ser, Pro, or Cys
LXAQQEALX

SEQ ID NO: 51172 - protein, 10 aa, Artificial Sequence
  Description of Artificial Sequence: Synthetic peptide
  Seed: LEAQQEALGL (MAGA1_HUMAN)
  misc_feature (2)..(2): Xaa can be Glu, Arg, Gln, Gly, Thr, Met, Ser, Ala, Ile, Leu, Asn, Val, Phe, Cys, Trp, Asp, Lys, or Pr o
  misc_feature (10)..(10): Xaa can be Leu, Phe, Ile, Met, Trp, Lys, Tyr, Val, Thr, Gly, Ala, Pro, Cys, Arg, His, or Ser
LXAQQEALGX

SEQ ID NO: 51173 - protein, 11 aa, Artificial Sequence
  Description of Artificial Sequence: Synthetic peptide
  Seed: LEAQQEALGLV (MAGA1_HUMAN)
  misc_feature (2)..(2): Xaa can be , or Glu
  misc_feature (11)..(11): Xaa can be Pro, Ile, Val, Leu, Met, Ala, Thr, Phe, or Cys
LXAQQEALGLX

SEQ ID NO: 51174 - protein, 8 aa, Artificial Sequence
  Description of Artificial Sequence: Synthetic peptide
  Seed: LEEVPTAG (MAGA1_HUMAN)
  misc_feature (2)..(2): Xaa can be Glu, or Asp
  misc_feature (8)..(8): Xaa can be Ile, Val, Leu, Phe, Cys, Ala, Gly, Thr, Pro, or Met
LXEVPTAX

SEQ ID NO: 51175 - protein, 9 aa, Artificial Sequence
  Description of Artificial Sequence: Synthetic peptide
  Seed: LEEVPTAGS (MAGA1_HUMAN)
  misc_feature (2)..(2): Xaa can be Glu, or Asp
  misc_feature (9)..(9): Xaa can be Leu, Ala, Val, Thr, Ser, Met, Ile, Cys, Phe, Pro, or Gly
LXEVPTAGX

SEQ ID NO: 51176 - protein, 10 aa, Artificial Sequence
  Description of Artificial Sequence: Synthetic peptide
  Seed: LEEVPTAGST (MAGA1_HUMAN)
  misc_feature (2)..(2): Xaa can be , or Glu
  misc_feature (10)..(10): Xaa can be Gly, Ile, Leu, Phe, Thr, Pro, Ser, Val, Cys, Ala, or Met
LXEVPTAGSX

SEQ ID NO: 51177 - protein, 8 aa, Artificial Sequence
  Description of Artificial Sequence: Synthetic peptide
  Seed: LEQRSLHC (MAGA1_HUMAN)
  misc_feature (2)..(2): Xaa can be , or Glu
  misc_feature (8)..(8): Xaa can be Ala, Cys, Val, Leu, Met, or Ile
LXQRSLHX

SEQ ID NO: 51178 - protein, 8 aa, Artificial Sequence
  Description of Artificial Sequence: Synthetic peptide
  Seed: LESLFRAV (MAGA1_HUMAN)
  misc_feature (2)..(2): Xaa can be Glu, Asp, Gln, Met, Pro, Asn, Ser, Ala, Gly, Leu, Ile, Val, His, or Thr
  misc_feature (8)..(8): Xaa can be Ile, Val, Leu, Met, Phe, Tyr, Ala, Trp, His, Pro, Cys, Ser, or Thr
LXSLFRAX

SEQ ID NO: 51179 - protein, 9 aa, Artificial Sequence
  Description of Artificial Sequence: Synthetic peptide
  Seed: LESLFRAVI (MAGA1_HUMAN)
  misc_feature (2)..(2): Xaa can be Gln, Glu, Asp, Met, Lys, Ser, Ala, Leu, His, Val, Asn, Ile, Gly, Arg, Pro, Tyr, Thr, Phe, Cys, or Trp
  misc_feature (9)..(9): Xaa can be Tyr, Phe, Met, Ile, Val, Leu, Trp, His, Ala, Gly, Cys, Pro, Ser, Thr, Gln, or Asn
LXSLFRAVX

SEQ ID NO: 51180 - protein, 10 aa, Artificial Sequence
  Description of Artificial Sequence: Synthetic peptide
  Seed: LESLFRAVIT (MAGA1_HUMAN)
  misc_feature (2)..(2): Xaa can be , or Glu
  misc_feature (10)..(10): Xaa can be Gly, Phe, Thr, Cys, Ile, Pro, Leu, Ser, Met, Val, or Ala
LXSLFRAVIX

SEQ ID NO: 51181 - protein, 11 aa, Artificial Sequence
  Description of Artificial Sequence: Synthetic peptide
  Seed: LESLFRAVITK (MAGA1_HUMAN)
  misc_feature (2)..(2): Xaa can be Thr, Arg, Gln, Ser, Asp, Asn, Pro, Lys, Met, Ala, Gly, Ile, Cys, Leu, Tyr, Phe, Val, Glu, His, or Trp
  misc_feature (11)..(11): Xaa can be , or Lys
LXSLFRAVITX

SEQ ID NO: 51182 - protein, 8 aa, Artificial Sequence
  Description of Artificial Sequence: Synthetic peptide
  Seed: LESVIKNY (MAGA1_HUMAN)
  misc_feature (2)..(2): Xaa can be Glu, Gln, Pro, or Asp
  misc_feature (8)..(8): Xaa can be Tyr, Trp, Met, Phe, Ile, or Leu
LXSVIKNX

SEQ ID NO: 51183 - protein, 9 aa, Artificial Sequence
  Description of Artificial Sequence: Synthetic peptide
  Seed: LESVIKNYK (MAGA1_HUMAN)
  misc_feature (2)..(2): Xaa can be Val, Thr, Leu, Ser, Ile, Met, Ala, Gly, Phe, Glu, Gln, Asn, Asp, or Pro
  misc_feature (9)..(9): Xaa can be Lys, Arg, Tyr, or His
LXSVIKNYX

SEQ ID NO: 51184 - protein, 9 aa, Artificial Sequence
  Description of Artificial Sequence: Synthetic peptide
  Seed: LEYRQVPDS (MAGA1_HUMAN)
  misc_feature (2)..(2): Xaa can be Glu, or Asp
  misc_feature (9)..(9): Xaa can be Cys, Ala, Ile, Leu, Val, Phe, Pro, Tyr, Gly, Ser, Met, or Thr
LXYRQVPDX

SEQ ID NO: 51185 - protein, 8 aa, Artificial Sequence
  Description of Artificial Sequence: Synthetic peptide
  Seed: LEYVIKVS (MAGA1_HUMAN)
  misc_feature (2)..(2): Xaa can be Glu, or Asp
  misc_feature (8)..(8): Xaa can be Ile, Val, Met, Leu, Ala, Cys, Pro, Thr, Gly, Phe, or Ser
LXYVIKVX

SEQ ID NO: 51186 - protein, 9 aa, Artificial Sequence
  Description of Artificial Sequence: Synthetic peptide
  Seed: LEYVIKVSA (MAGA1_HUMAN)
  misc_feature (2)..(2): Xaa can be Glu, Asp, His, Gln, Arg, Pro, Ser, Ala, Asn, Met, Lys, Gly, Val, Leu, Thr, Ile, or Phe
  misc_feature (9)..(9): Xaa can be Val, Leu, Ile, Met, Cys, Ala, Phe, Pro, Thr, Tyr, Trp, Ser, Gly, Glu, Lys, Asn, Gln, His, Arg, or Asp
LXYVIKVSX

SEQ ID NO: 51187 - protein, 10 aa, Artificial Sequence
  Description of Artificial Sequence: Synthetic peptide
  Seed: LEYVIKVSAR (MAGA1_HUMAN)
  misc_feature (2)..(2): Xaa can be Ala, Trp, Tyr, Met, Val, Ser, Thr, Asn, Gly, Leu, Phe, Ile, Gln, Cys, Asp, His, Pro, Lys, Arg, or Glu
  misc_feature (10)..(10): Xaa can be Arg, or Lys
LXYVIKVSAX

SEQ ID NO: 51188 - protein, 8 aa, Artificial Sequence
  Description of Artificial Sequence: Synthetic peptide
  Seed: LFRAVITK (MAGA1_HUMAN)
  misc_feature (2)..(2): Xaa can be Thr, Tyr, Gln, Phe, Ala, Ser, Val, or Met
  misc_feature (8)..(8): Xaa can be Lys, or Ala
LXRAVITX

SEQ ID NO: 51189 - protein, 9 aa, Artificial Sequence
  Description of Artificial Sequence: Synthetic peptide
  Seed: LFRAVITKK (MAGA1_HUMAN)
  misc_feature (2)..(2): Xaa can be Thr, Ser, Val, Met, Leu, Tyr, Ile, Ala, Gln, Trp, Phe, Gly, Asn, Cys, Asp, Pro, Glu, His, Arg, or Lys
  misc_feature (9)..(9): Xaa can be Arg, Lys, Ala, Val, Ile, Leu, Met, Tyr, Gly, His, Phe, Ser, Thr, Cys, or Pro
LXRAVITKX

SEQ ID NO: 51190 - protein, 9 aa, Artificial Sequence
  Description of Artificial Sequence: Synthetic peptide
  Seed: LGDNQIMPK (MAGA1_HUMAN)
  misc_feature (2)..(2): Xaa can be Ala, Thr, Val, Ser, Leu, Gly, Phe, Met, Ile, Trp, Tyr, Cys, Asn, Gln, Arg, Pro, Asp, Glu, His, or Lys
  misc_feature (9)..(9): Xaa can be Tyr, Lys, Phe, Met, Arg, Leu, Val, Ile, His, Trp, Gln, Ala, or Cys
LXDNQIMPX

SEQ ID NO: 51191 - protein, 8 aa, Artificial Sequence
  Description of Artificial Sequence: Synthetic peptide
  Seed: LHCKPEEA (MAGA1_HUMAN)
  misc_feature (2)..(2): Xaa can be , or His
  misc_feature (8)..(8): Xaa can be Val, Ile, Ala, Leu, or Met
LXCKPEEX

SEQ ID NO: 51192 - protein, 9 aa, Artificial Sequence
  Description of Artificial Sequence: Synthetic peptide
  Seed: LHCKPEEAL (MAGA1_HUMAN)
  misc_feature (2)..(2): Xaa can be His, Arg, Gln, Pro, Tyr, Ala, Phe, Lys, Glu, Ser, Met, Asn, Gly, Val, Trp, Leu, Ile, Thr, or Asp
  misc_feature (9)..(9): Xaa can be Leu, Met, Tyr, Phe, Ile, Val, Ala, Trp, Cys, Pro, Thr, or Ser
LXCKPEEAX

SEQ ID NO: 51193 - protein, 11 aa, Artificial Sequence
  Description of Artificial Sequence: Synthetic peptide
  Seed: LHCKPEEALEA (MAGA1_HUMAN)
  misc_feature (2)..(2): Xaa can be , or His
  misc_feature (11)..(11): Xaa can be Leu, or Ala
LXCKPEEALEX

SEQ ID NO: 51194 - protein, 9 aa, Artificial Sequence
  Description of Artificial Sequence: Synthetic peptide
  Seed: LKYRAREPV (MAGA1_HUMAN)
  misc_feature (2)..(2): Xaa can be Gln, Met, Lys, Glu, Leu, His, Ala, Ser, Arg, Val, Ile, Thr, Asn, Tyr, Phe, Trp, Gly, Cys, Pro, or Asp
  misc_feature (9)..(9): Xaa can be Tyr, Phe, Met, Leu, Trp, Ile, His, Val, Ala, Gly, Thr, Ser, Gln, Asn, Cys, or Pro
LXYRAREPX

SEQ ID NO: 51195 - protein, 11 aa, Artificial Sequence
  Description of Artificial Sequence: Synthetic peptide
  Seed: LKYRAREPVTK (MAGA1_HUMAN)
  misc_feature (2)..(2): Xaa can be Lys, Arg, Met, Ser, Tyr, Val, Ala, or Thr
  misc_feature (11)..(11): Xaa can be , or Lys
LXYRAREPVTX

SEQ ID NO: 51196 - protein, 10 aa, Artificial Sequence
  Description of Artificial Sequence: Synthetic peptide
  Seed: LLGDNQIMPK (MAGA1_HUMAN)
  misc_feature (2)..(2): Xaa can be Ala, Ser, Val, Thr, Met, Asp, Phe, Gln, Leu, Ile, Asn, Gly, Glu, Cys, or Tyr
  misc_feature (10)..(10): Xaa can be Arg, Lys, Tyr, Phe, Met, Leu, or Trp
LXGDNQIMPX

SEQ ID NO: 51197 - protein, 10 aa, Artificial Sequence
  Description of Artificial Sequence: Synthetic peptide
  Seed: LLKYRAREPV (MAGA1_HUMAN)
  misc_feature (2)..(2): Xaa can be Met, Leu, Pro, Ile, Gln, Ala, Val, Arg, Gly, Asn, Ser, Phe, Thr, Trp, or Lys
  misc_feature (10)..(10): Xaa can be Leu, Met, Ile, Phe, Val, or Ala
LXKYRAREPX

SEQ ID NO: 51198 - protein, 11 aa, Artificial Sequence
  Description of Artificial Sequence: Synthetic peptide
  Seed: LLLKYRAREPV (MAGA1_HUMAN)
  misc_feature (2)..(2): Xaa can be Leu, or Met
  misc_feature (11)..(11): Xaa can be , or Val
LXLKYRAREPX

SEQ ID NO: 51199 - protein, 10 aa, Artificial Sequence
  Description of Artificial Sequence: Synthetic peptide
  Seed: LLTQDLVQEK (MAGA1_HUMAN)
  misc_feature (2)..(2): Xaa can be Ala, Met, Gln, Val, Ser, Leu, Thr, Ile, Gly, Asn, Tyr, Glu, Arg, Asp, Lys, Pro, Trp, His, Cys, or Phe
  misc_feature (10)..(10): Xaa can be Lys, Arg, Tyr, Met, Leu, or Phe
LXTQDLVQEX

SEQ ID NO: 51200 - protein, 11 aa, Artificial Sequence
  Description of Artificial Sequence: Synthetic peptide
  Seed: LLTQDLVQEKY (MAGA1_HUMAN)
  misc_feature (2)..(2): Xaa can be Met, Gln, Phe, Ser, Leu, Thr, Tyr, or Trp
  misc_feature (11)..(11): Xaa can be Tyr, or Phe
LXTQDLVQEKX

SEQ ID NO: 51201 - protein, 9 aa, Artificial Sequence
  Description of Artificial Sequence: Synthetic peptide
  Seed: LQLVFGIDV (MAGA1_HUMAN)
  misc_feature (2)..(2): Xaa can be Met, Gln, Leu, Ala, Glu, Ser, Lys, Val, Ile, Arg, His, or Thr
  misc_feature (9)..(9): Xaa can be Val, Phe, Tyr, Leu, Ile, Met, Ala, or Trp
LXLVFGIDX

SEQ ID NO: 51202 - protein, 10 aa, Artificial Sequence
  Description of Artificial Sequence: Synthetic peptide
  Seed: LSVMEVYDGR (MAGA1_HUMAN)
  misc_feature (2)..(2): Xaa can be Thr, Met, Pro, Tyr, Ala, Glu, Ile, Asn, Lys, Phe, Trp, Cys, Gly, Gln, Asp, Ser, Val, His, Leu, or Arg
  misc_feature (10)..(10): Xaa can be Arg, Lys, or Tyr
LXVMEVYDGX

SEQ ID NO: 51203 - protein, 9 aa, Artificial Sequence
  Description of Artificial Sequence: Synthetic peptide
  Seed: LTQDLVQEK (MAGA1_HUMAN)
  misc_feature (2)..(2): Xaa can be Ala, Ser, Arg, Ile, Val, Thr, Gln, Met, Leu, Gly, Asn, Cys, Phe, Tyr, Trp, Pro, His, Glu, Lys, or Asp
  misc_feature (9)..(9): Xaa can be Met, Phe, Tyr, Lys, Leu, Arg, Ile, Val, Trp, His, Ala, Cys, Thr, Pro, Ser, or Gln
LXQDLVQEX

SEQ ID NO: 51204 - protein, 10 aa, Artificial Sequence
  Description of Artificial Sequence: Synthetic peptide
  Seed: LTQDLVQEKY (MAGA1_HUMAN)
  misc_feature (2)..(2): Xaa can be Thr, Ala, Ser, Leu, Met, Gln, Val, Ile, Tyr, Glu, Asn, Trp, Phe, Gly, Asp, Pro, Cys, Arg, His, or Lys
  misc_feature (10)..(10): Xaa can be Trp, Tyr, Phe, Lys, Arg, Leu, Met, Val, Ile, His, or Cys
LXQDLVQEKX

SEQ ID NO: 51205 - protein, 11 aa, Artificial Sequence
  Description of Artificial Sequence: Synthetic peptide
  Seed: LTQDLVQEKYL (MAGA1_HUMAN)
  misc_feature (2)..(2): Xaa can be Thr, Ser, Ala, Cys, Gly, Val, Met, Ile, Leu, Asn, Gln, or Pro
  misc_feature (11)..(11): Xaa can be Trp, Phe, Leu, Ile, Met, or Tyr
LXQDLVQEKYX

SEQ ID NO: 51206 - protein, 8 aa, Artificial Sequence
  Description of Artificial Sequence: Synthetic peptide
  Seed: LVFGIDVK (MAGA1_HUMAN)
  misc_feature (2)..(2): Xaa can be Ala, Val, Gly, or Ile
  misc_feature (8)..(8): Xaa can be Lys, or Leu
LXFGIDVX

SEQ ID NO: 51207 - protein, 10 aa, Artificial Sequence
  Description of Artificial Sequence: Synthetic peptide
  Seed: LVFGIDVKEA (MAGA1_HUMAN)
  misc_feature (2)..(2): Xaa can be Leu, Met, Val, Gln, Ile, Thr, Ala, or Ser
  misc_feature (10)..(10): Xaa can be Val, Leu, Ile, Ala, Met, or Thr
LXFGIDVKEX

SEQ ID NO: 51208 - protein, 9 aa, Artificial Sequence
  Description of Artificial Sequence: Synthetic peptide
  Seed: LVGFLLLKY (MAGA1_HUMAN)
  misc_feature (2)..(2): Xaa can be Ala, Thr, Ser, Val, Met, Ile, Gly, Gln, Leu, Pro, Tyr, Trp, Asp, Phe, Glu, Asn, Cys, Lys, or His
  misc_feature (9)..(9): Xaa can be Tyr, Phe, Lys, Leu, Trp, Arg, Met, Val, Ile, or His
LXGFLLLKX

SEQ ID NO: 51209 - protein, 10 aa, Artificial Sequence
  Description of Artificial Sequence: Synthetic peptide
  Seed: LVGFLLLKYR (MAGA1_HUMAN)
  misc_feature (2)..(2): Xaa can be Gln, Trp, Ala, Leu, Tyr, His, Phe, Thr, Val, Ser, Gly, Asn, Arg, Ile, Met, Cys, Glu, Asp, Lys, or Pro
  misc_feature (10)..(10): Xaa can be Arg, or Lys
LXGFLLLKYX

SEQ ID NO: 51210 - protein, 9 aa, Artificial Sequence
  Description of Artificial Sequence: Synthetic peptide
  Seed: LVLGTLEEV (MAGA1_HUMAN)
  misc_feature (2)..(2): Xaa can be Leu, Met, Gln, Ile, Val, Ala, Thr, Ser, Gly, Pro, Asn, Glu, Phe, Asp, Tyr, Cys, Lys, His, Trp, or Arg
  misc_feature (9)..(9): Xaa can be Val, Leu, Phe, Tyr, Lys, Ile, Arg, Trp, Met, His, Ala, Thr, Cys, or Ser
LXLGTLEEX

SEQ ID NO: 51211 - protein, 10 aa, Artificial Sequence
  Description of Artificial Sequence: Synthetic peptide
  Seed: LVLGTLEEVP (MAGA1_HUMAN)
  misc_feature (2)..(2): Xaa can be Val, Leu, Gln, Ile, Met, Thr, Ser, or Ala
  misc_feature (10)..(10): Xaa can be Val, Ala, Leu, Ile, Asp, Tyr, Asn, Glu, Gly, Cys, His, Trp, Met, Gln, Phe, Lys, Pro, Arg, Thr, or Ser
LXLGTLEEVX

SEQ ID NO: 51212 - protein, 9 aa, Artificial Sequence
  Description of Artificial Sequence: Synthetic peptide
  Seed: LVQEKYLEY (MAGA1_HUMAN)
  misc_feature (2)..(2): Xaa can be Ala, Tyr, Phe, Arg, Thr, Ser, Pro, Gln, Ile, Met, Trp, Leu, Val, Gly, Asn, Cys, Glu, Asp, His, or Lys
  misc_feature (9)..(9): Xaa can be Tyr, Leu, Phe, Trp, Met, Ile, Val, Lys, Arg, His, Ala, Cys, Thr, or Gln
LXQEKYLEX

SEQ ID NO: 51213 - protein, 10 aa, Artificial Sequence
  Description of Artificial Sequence: Synthetic peptide
  Seed: LVQEKYLEYR (MAGA1_HUMAN)
  misc_feature (2)..(2): Xaa can be Met, Ala, Thr, Tyr, Phe, Gln, Val, Ser, Trp, Leu, Ile, Pro, Glu, Asp, Gly, Asn, Lys, Cys, Arg, or His
  misc_feature (10)..(10): Xaa can be Arg, or Lys
LXQEKYLEYX

SEQ ID NO: 51214 - protein, 9 aa, Artificial Sequence
  Description of Artificial Sequence: Synthetic peptide
  Seed: LVTCLGLSY (MAGA1_HUMAN)
  misc_feature (2)..(2): Xaa can be Pro, Gln, Ala, Met, Thr, Ser, Ile, Val, Lys, Gly, Leu, His, Phe, Glu, Asn, Arg, Cys, Tyr, Asp, or Trp
  misc_feature (9)..(9): Xaa can be Phe, Tyr, Met, Trp, Leu, Lys, Arg, His, Ile, Val, Ala, Gly, Thr, Ser, Gln, or Cys
LXTCLGLSX

SEQ ID NO: 51215 - protein, 9 aa, Artificial Sequence
  Description of Artificial Sequence: Synthetic peptide
  Seed: MEGGHAPEE (MAGA1_HUMAN)
  misc_feature (2)..(2): Xaa can be Glu, Asp, or Gln
  misc_feature (9)..(9): Xaa can be Ile, Leu, Val, Ala, Cys, Thr, Met, Pro, Glu, Asp, Gln, Tyr, Gly, Ser, Phe, or Trp
MXGGHAPEX

SEQ ID NO: 51216 - protein, 11 aa, Artificial Sequence
  Description of Artificial Sequence: Synthetic peptide
  Seed: MEGGHAPEEEI (MAGA1_HUMAN)
  misc_feature (2)..(2): Xaa can be Glu, Asp, or Gln
  misc_feature (11)..(11): Xaa can be Phe, Trp, Leu, Tyr, Thr, Met, Pro, Ile, Ser, Gly, Val, Ala, or Cys
MXGGHAPEEEX

SEQ ID NO: 51217 - protein, 9 aa, Artificial Sequence
  Description of Artificial Sequence: Synthetic peptide
  Seed: MEVYDGREH (MAGA1_HUMAN)
  misc_feature (2)..(2): Xaa can be Glu, Asp, or Gln
  misc_feature (9)..(9): Xaa can be Trp, Tyr, Phe, Ile, Leu, Val, Met, or His
MXVYDGREX

SEQ ID NO: 51218 - protein, 10 aa, Artificial Sequence
  Description of Artificial Sequence: Synthetic peptide
  Seed: MEVYDGREHS (MAGA1_HUMAN)
  misc_feature (2)..(2): Xaa can be , or Glu
  misc_feature (10)..(10): Xaa can be Ala, Leu, Ser, Ile, Cys, Phe, Thr, Gly, Met, Pro, or Val
MXVYDGREHX

SEQ ID NO: 51219 - protein, 11 aa, Artificial Sequence
  Description of Artificial Sequence: Synthetic peptide
  Seed: MEVYDGREHSA (MAGA1_HUMAN)
  misc_feature (2)..(2): Xaa can be Glu, Asp, or Gln
  misc_feature (11)..(11): Xaa can be Leu, Ala, Met, Ile, Cys, Phe, Thr, Trp, Ser, Gly, Val, Pro, or Tyr
MXVYDGREHSX

SEQ ID NO: 51220 - protein, 9 aa, Artificial Sequence
  Description of Artificial Sequence: Synthetic peptide
  Seed: MIAMEGGHA (MAGA1_HUMAN)
  misc_feature (2)..(2): Xaa can be Leu, Met, Ile, Val, Gln, or Thr
  misc_feature (9)..(9): Xaa can be Val, Ile, Ala, Leu, Met, or Thr
MXAMEGGHX

SEQ ID NO: 51221 - protein, 9 aa, Artificial Sequence
  Description of Artificial Sequence: Synthetic peptide
  Seed: MLESVIKNY (MAGA1_HUMAN)
  misc_feature (2)..(2): Xaa can be Ala, Ser, Thr, Val, Phe, Ile, Met, Tyr, Leu, Gln, Gly, Asn, Cys, Trp, Glu, Asp, Pro, Lys, Arg, or His
  misc_feature (9)..(9): Xaa can be Tyr, Phe, Met, Leu, Lys, Arg, Ile, Val, Trp, His, or Ala
MXESVIKNX

SEQ ID NO: 51222 - protein, 10 aa, Artificial Sequence
  Description of Artificial Sequence: Synthetic peptide
  Seed: MLESVIKNYK (MAGA1_HUMAN)
  misc_feature (2)..(2): Xaa can be Thr, Ser, Met, Leu, Ile, Ala, Val, Asn, Gly, Tyr, Asp, Trp, Phe, Gln, Pro, Cys, His, Arg, Glu, or Lys
  misc_feature (10)..(10): Xaa can be Arg, Lys, Tyr, Phe, His, Leu, Gln, Met, or Trp
MXESVIKNYX

SEQ ID NO: 51223 - protein, 8 aa, Artificial Sequence
  Description of Artificial Sequence: Synthetic peptide
  Seed: MPKTGFLI (MAGA1_HUMAN)
  misc_feature (2)..(2): Xaa can be Pro, Ala, Leu, Met, or Ile
  misc_feature (8)..(8): Xaa can be Leu, Ile, Val, Ser, Thr, Pro, Cys, Phe, Met, Gly, Ala, or Tyr
MXKTGFLX

SEQ ID NO: 51224 - protein, 9 aa, Artificial Sequence
  Description of Artificial Sequence: Synthetic peptide
  Seed: MPKTGFLII (MAGA1_HUMAN)
  misc_feature (2)..(2): Xaa can be Pro, Ala, His, Gln, Met, Arg, Ile, Thr, Gly, Ser, Leu, Val, Glu, Asp, Lys, Asn, Cys, Phe, Tyr, or Trp
  misc_feature (9)..(9): Xaa can be Phe, Tyr, Leu, Met, Ile, Val, Ala, Trp, Thr, Cys, Pro, His, Ser, Gly, Arg, Gln, Asp, Glu, Asn, or Lys
MXKTGFLIX

SEQ ID NO: 51225 - protein, 10 aa, Artificial Sequence
  Description of Artificial Sequence: Synthetic peptide
  Seed: MPKTGFLIIV (MAGA1_HUMAN)
  misc_feature (2)..(2): Xaa can be Pro, or Ala
  misc_feature (10)..(10): Xaa can be Ala, Ser, Lys, Ile, Cys, Tyr, Thr, Phe, Leu, Gly, Val, Trp, Arg, Met, or Pro
MXKTGFLIIX

SEQ ID NO: 51226 - protein, 11 aa, Artificial Sequence
  Description of Artificial Sequence: Synthetic peptide
  Seed: MPKTGFLIIVL (MAGA1_HUMAN)
  misc_feature (2)..(2): Xaa can be Pro, Leu, or Met
  misc_feature (11)..(11): Xaa can be Leu, Thr, Phe, Gly, Val, Cys, Met, Ile, Ser, Pro, or Ala
MXKTGFLIIVX

SEQ ID NO: 51227 - protein, 8 aa, Artificial Sequence
  Description of Artificial Sequence: Synthetic peptide
  Seed: MSLEQRSL (MAGA1_HUMAN)
  misc_feature (2)..(2): Xaa can be Ser, Ala, Thr, Gln, Val, Asp, Met, Gly, Glu, Ile, Asn, Leu, or Cys
  misc_feature (8)..(8): Xaa can be Ile, Trp, Val, Leu, Phe, Tyr, or Met
MXLEQRSX

SEQ ID NO: 51228 - protein, 9 aa, Artificial Sequence
  Description of Artificial Sequence: Synthetic peptide
  Seed: MSLEQRSLH (MAGA1_HUMAN)
  misc_feature (2)..(2): Xaa can be Ala, Ser, Thr, Tyr, Gln, Met, Val, Gly, Ile, Leu, Asn, Glu, Asp, Phe, Cys, Trp, Pro, His, Arg, or Lys
  misc_feature (9)..(9): Xaa can be Tyr, Lys, Phe, Arg, Met, Leu, His, Trp, Val, Ile, or Ala
MXLEQRSLX

SEQ ID NO: 51229 - protein, 11 aa, Artificial Sequence
  Description of Artificial Sequence: Synthetic peptide
  Seed: MSLEQRSLHCK (MAGA1_HUMAN)
  misc_feature (2)..(2): Xaa can be Met, Ala, Gln, Val, Ser, Leu, Thr, or Ile
  misc_feature (11)..(11): Xaa can be Arg, or Lys
MXLEQRSLHCX

SEQ ID NO: 51230 - protein, 9 aa, Artificial Sequence
  Description of Artificial Sequence: Synthetic peptide
  Seed: NQIMPKTGF (MAGA1_HUMAN)
  misc_feature (2)..(2): Xaa can be Arg, Glu, His, Gln, Met, Asp, Ser, Ala, Leu, Val, Lys, Ile, Tyr, Phe, Pro, Thr, Gly, Asn, Cys, or Trp
  misc_feature (9)..(9): Xaa can be Tyr, Phe, Leu, Met, Ile, Val, His, Trp, Lys, Ala, Cys, Arg, or Thr
NXIMPKTGX

SEQ ID NO: 51231 - protein, 10 aa, Artificial Sequence
  Description of Artificial Sequence: Synthetic peptide
  Seed: NQIMPKTGFL (MAGA1_HUMAN)
  misc_feature (2)..(2): Xaa can be , or Gln
  misc_feature (10)..(10): Xaa can be Ile, Val, Trp, Leu, or Phe
NXIMPKTGFX

SEQ ID NO: 51232 - protein, 11 aa, Artificial Sequence
  Description of Artificial Sequence: Synthetic peptide
  Seed: NQIMPKTGFLI (MAGA1_HUMAN)
  misc_feature (2)..(2): Xaa can be Gln, Met, or Leu
  misc_feature (11)..(11): Xaa can be Trp, Phe, Val, Ile, Leu, or Met
NXIMPKTGFLX

SEQ ID NO: 51233 - protein, 9 aa, Artificial Sequence
  Description of Artificial Sequence: Synthetic peptide
  Seed: NYKHCFPEI (MAGA1_HUMAN)
  misc_feature (2)..(2): Xaa can be Tyr, Phe, Arg, Trp, Met, Ala, Gln, His, Ile, Ser, Leu, Val, Glu, Gly, Thr, Asp, Lys, Asn, or Pro
  misc_feature (9)..(9): Xaa can be Leu, Met, Phe, Tyr, Ile, Val, Trp, or His
NXKHCFPEX

SEQ ID NO: 51234 - protein, 10 aa, Artificial Sequence
  Description of Artificial Sequence: Synthetic peptide
  Seed: NYKHCFPEIF (MAGA1_HUMAN)
  misc_feature (2)..(2): Xaa can be Tyr, Trp, or Phe
  misc_feature (10)..(10): Xaa can be Phe, Trp, Leu, Ile, or Met
NXKHCFPEIX

SEQ ID NO: 51235 - protein, 8 aa, Artificial Sequence
  Description of Artificial Sequence: Synthetic peptide
  Seed: PARYEFLW (MAGA1_HUMAN)
  misc_feature (2)..(2): Xaa can be Ser, Ala, or Thr
  misc_feature (8)..(8): Xaa can be , or Trp
PXRYEFLX

SEQ ID NO: 51236 - protein, 9 aa, Artificial Sequence
  Description of Artificial Sequence: Synthetic peptide
  Seed: PEEEIWEEL (MAGA1_HUMAN)
  misc_feature (2)..(2): Xaa can be Glu, or Gln
  misc_feature (9)..(9): Xaa can be Phe, Pro, Leu, Thr, Ile, Ala, Val, or Met
PXEEIWEEX

SEQ ID NO: 51237 - protein, 11 aa, Artificial Sequence
  Description of Artificial Sequence: Synthetic peptide
  Seed: PEIFGKASESL (MAGA1_HUMAN)
  misc_feature (2)..(2): Xaa can be , or Glu
  misc_feature (11)..(11): Xaa can be Leu, Val, or Ala
PXIFGKASESX

SEQ ID NO: 51238 - protein, 10 aa, Artificial Sequence
  Description of Artificial Sequence: Synthetic peptide
  Seed: PLVLGTLEEV (MAGA1_HUMAN)
  misc_feature (2)..(2): Xaa can be Phe, Tyr, Met, Trp, His, Leu, Ala, Gly, Arg, Thr, Ile, Ser, Val, Lys, Gln, or Cys
  misc_feature (10)..(10): Xaa can be Val, Leu, Ile, Ala, or Met
PXVLGTLEEX

SEQ ID NO: 51239 - protein, 10 aa, Artificial Sequence
  Description of Artificial Sequence: Synthetic peptide
  Seed: PPQSPQGASA (MAGA1_HUMAN)
  misc_feature (2)..(2): Xaa can be Pro, Ala, Met, or Val
  misc_feature (10)..(10): Xaa can be Leu, Ala, Met, Phe, Cys, Thr, Ile, Val, Tyr, or Pro
PXQSPQGASX

SEQ ID NO: 51240 - protein, 11 aa, Artificial Sequence
  Description of Artificial Sequence: Synthetic peptide
  Seed: PPQSPQGASAF (MAGA1_HUMAN)
  misc_feature (2)..(2): Xaa can be Pro, Ala, or Val
  misc_feature (11)..(11): Xaa can be Leu, Met, Tyr, Ala, Phe, Thr, Val, Ile, Pro, Cys, or Trp
PXQSPQGASAX

SEQ ID NO: 51241 - protein, 9 aa, Artificial Sequence
  Description of Artificial Sequence: Synthetic peptide
  Seed: PQSPQGASA (MAGA1_HUMAN)
  misc_feature (2)..(2): Xaa can be His, Arg, or Gln
  misc_feature (9)..(9): Xaa can be Ala, Val, Ile, or Leu
PXSPQGASX

SEQ ID NO: 51242 - protein, 10 aa, Artificial Sequence
  Description of Artificial Sequence: Synthetic peptide
  Seed: PQSPQGASAF (MAGA1_HUMAN)
  misc_feature (2)..(2): Xaa can be Val, Gln, Met, Leu, Ile, Thr, Ser, Ala, Trp, Arg, Asn, Gly, His, Glu, Lys, Tyr, Phe, Pro, or Cys
  misc_feature (10)..(10): Xaa can be Tyr, Phe, or Met
PXSPQGASAX

SEQ ID NO: 51243 - protein, 9 aa, Artificial Sequence
  Description of Artificial Sequence: Synthetic peptide
  Seed: PRALAETSY (MAGA1_HUMAN)
  misc_feature (2)..(2): Xaa can be Met, Arg, Gln, His, Glu, or Tyr
  misc_feature (9)..(9): Xaa can be Tyr, or Phe
PXALAETSX

SEQ ID NO: 51244 - protein, 9 aa, Artificial Sequence
  Description of Artificial Sequence: Synthetic peptide
  Seed: PSLREAALR (MAGA1_HUMAN)
  misc_feature (2)..(2): Xaa can be Met, Ser, Val, Tyr, Phe, Thr, Ala, or Ile
  misc_feature (9)..(9): Xaa can be , or Arg
PXLREAALX

SEQ ID NO: 51245 - protein, 10 aa, Artificial Sequence
  Description of Artificial Sequence: Synthetic peptide
  Seed: PTTINFTRQR (MAGA1_HUMAN)
  misc_feature (2)..(2): Xaa can be Thr, Trp, Glu, Tyr, Asp, Ser, Met, Asn, His, Arg, Phe, Ile, Leu, Gln, Ala, Cys, Gly, Val, or Lys
  misc_feature (10)..(10): Xaa can be Arg, or Lys
PXTINFTRQX

SEQ ID NO: 51246 - protein, 10 aa, Artificial Sequence
  Description of Artificial Sequence: Synthetic peptide
  Seed: QAATSSSSPL (MAGA1_HUMAN)
  misc_feature (2)..(2): Xaa can be Ala, Val, Ile, Ser, Met, Gly, Tyr, Phe, Thr, Leu, or Gln
  misc_feature (10)..(10): Xaa can be Tyr, Phe, Lys, Met, Leu, Arg, or His
QXATSSSSPX

SEQ ID NO: 51247 - protein, 8 aa, Artificial Sequence
  Description of Artificial Sequence: Synthetic peptide
  Seed: QDLVQEKY (MAGA1_HUMAN)
  misc_feature (2)..(2): Xaa can be Glu, Asp, or Gln
  misc_feature (8)..(8): Xaa can be Phe, Leu, Tyr, Trp, Ile, Val, Met, or His
QXLVQEKX

SEQ ID NO: 51248 - protein, 9 aa, Artificial Sequence
  Description of Artificial Sequence: Synthetic peptide
  Seed: QDLVQEKYL (MAGA1_HUMAN)
  misc_feature (2)..(2): Xaa can be Glu, Asp, or Gln
  misc_feature (9)..(9): Xaa can be Phe, Leu, Val, Ile, Ala, Met, Cys, Ser, Tyr, Thr, Trp, Pro, or Gly
QXLVQEKYX

SEQ ID NO: 51249 - protein, 8 aa, Artificial Sequence
  Description of Artificial Sequence: Synthetic peptide
  Seed: QEALGLVC (MAGA1_HUMAN)
  misc_feature (2)..(2): Xaa can be Glu, Asp, or Gln
  misc_feature (8)..(8): Xaa can be Leu, Met, Val, Phe, Ala, Ile, Cys, Gly, Ser, Thr, or Pro
QXALGLVX

SEQ ID NO: 51250 - protein, 9 aa, Artificial Sequence
  Description of Artificial Sequence: Synthetic peptide
  Seed: QEALGLVCV (MAGA1_HUMAN)
  misc_feature (2)..(2): Xaa can be Glu, Asp, Gln, Ala, Met, Ser, or Leu
  misc_feature (9)..(9): Xaa can be Ile, Val, Leu, Tyr, Met, Cys, Phe, Trp, Ala, Pro, Glu, Gly, Thr, Ser, His, or Asp
QXALGLVCX

SEQ ID NO: 51251 - protein, 11 aa, Artificial Sequence
  Description of Artificial Sequence: Synthetic peptide
  Seed: QEALGLVCVQA (MAGA1_HUMAN)
  misc_feature (2)..(2): Xaa can be , or Glu
  misc_feature (11)..(11): Xaa can be Val, Pro, Ala, Cys, Leu, Ser, Phe, Thr, Ile, or Met
QXALGLVCVQX

SEQ ID NO: 51252 - protein, 10 aa, Artificial Sequence
  Description of Artificial Sequence: Synthetic peptide
  Seed: QEKYLEYRQV (MAGA1_HUMAN)
  misc_feature (2)..(2): Xaa can be , or Glu
  misc_feature (10)..(10): Xaa can be Cys, Met, Ala, Ile, Phe, Leu, or Val
QXKYLEYRQX

SEQ ID NO: 51253 - protein, 9 aa, Artificial Sequence
  Description of Artificial Sequence: Synthetic peptide
  Seed: QIMPKTGFL (MAGA1_HUMAN)
  misc_feature (2)..(2): Xaa can be Leu, Met, Thr, Val, Pro, Ser, Ala, Ile, Gln, Gly, Asn, Tyr, Phe, Arg, Glu, Asp, Trp, Cys, His, or Lys
  misc_feature (9)..(9): Xaa can be Tyr, Leu, Arg, Lys, Met, Phe, Trp, Val, Ile, Ala, His, Thr, Cys, Gln, or Ser
QXMPKTGFX

SEQ ID NO: 51254 - protein, 10 aa, Artificial Sequence
  Description of Artificial Sequence: Synthetic peptide
  Seed: QIMPKTGFLI (MAGA1_HUMAN)
  misc_feature (2)..(2): Xaa can be Met, Leu, Gln, Ile, Thr, Phe, Val, Tyr, Ser, Trp, Ala, Asn, Cys, Gly, Asp, His, Arg, Glu, Pro, or Lys
  misc_feature (10)..(10): Xaa can be Val, Ile, Leu, Ala, Met, Phe, Thr, or Cys
QXMPKTGFLX

SEQ ID NO: 51255 - protein, 9 aa, Artificial Sequence
  Description of Artificial Sequence: Synthetic peptide
  Seed: QLVFGIDVK (MAGA1_HUMAN)
  misc_feature (2)..(2): Xaa can be Ala, Thr, Ser, Val, Asp, Gly, Met, Gln, Leu, Asn, Ile, Phe, or Glu
  misc_feature (9)..(9): Xaa can be Lys, Arg, Leu, Tyr, Met, Ile, Phe, His, or Val
QXVFGIDVX

SEQ ID NO: 51256 - protein, 9 aa, Artificial Sequence
  Description of Artificial Sequence: Synthetic peptide
  Seed: QPSEGSSSR (MAGA1_HUMAN)
  misc_feature (2)..(2): Xaa can be Val, Thr, Ala, Ile, Ser, Leu, Met, Tyr, Trp, Gly, Cys, Gln, Pro, Asp, Glu, Phe, Asn, or Hi s
  misc_feature (9)..(9): Xaa can be Arg, Lys, Tyr, His, Leu, Met, Phe, Val, Gln, Ile, or Ala
QXSEGSSSX

SEQ ID NO: 51257 - protein, 9 aa, Artificial Sequence
  Description of Artificial Sequence: Synthetic peptide
  Seed: QQEALGLVC (MAGA1_HUMAN)
  misc_feature (2)..(2): Xaa can be Glu, Gln, or Asp
  misc_feature (9)..(9): Xaa can be Ala, Leu, Cys, Phe, Pro, Val, Thr, Met, Ile, Lys, Tyr, Asp, Glu, Arg, Gly, Ser, Trp, Asn, or Gln
QXEALGLVX

SEQ ID NO: 51258 - protein, 10 aa, Artificial Sequence
  Description of Artificial Sequence: Synthetic peptide
  Seed: QQEALGLVCV (MAGA1_HUMAN)
  misc_feature (2)..(2): Xaa can be Glu, Gln, or Met
  misc_feature (10)..(10): Xaa can be Val, Ala, Cys, Leu, Thr, Pro, Ser, Met, Ile, Phe, Tyr, or Gly
QXEALGLVCX

SEQ ID NO: 51259 - protein, 11 aa, Artificial Sequence
  Description of Artificial Sequence: Synthetic peptide
  Seed: QRQPSEGSSSR (MAGA1_HUMAN)
  misc_feature (2)..(2): Xaa can be Arg, Gly, Tyr, Ala, Trp, Phe, Gln, His, Ser, Glu, Met, or Asn
  misc_feature (11)..(11): Xaa can be Phe, Tyr, Lys, Leu, Met, Ile, Arg, Trp, Ala, Cys, Asn, Val, His, or Glu
QXQPSEGSSSX

SEQ ID NO: 51260 - protein, 9 aa, Artificial Sequence
  Description of Artificial Sequence: Synthetic peptide
  Seed: QSPQGASAF (MAGA1_HUMAN)
  misc_feature (2)..(2): Xaa can be Ala, Ile, Met, Leu, Val, Ser, Thr, Tyr, Phe, Arg, Pro, Glu, Gly, Gln, Asn, Cys, Asp, Trp, His, or Lys
  misc_feature (9)..(9): Xaa can be Phe, Tyr, Leu, Met, Ile, Val, Trp, Arg, His, Ala, Lys, Cys, Gln, or Thr
QXPQGASAX

SEQ ID NO: 51261 - protein, 9 aa, Artificial Sequence
  Description of Artificial Sequence: Synthetic peptide
  Seed: QVPDSDPAR (MAGA1_HUMAN)
  misc_feature (2)..(2): Xaa can be Ala, Ser, Thr, Met, Val, Leu, Ile, Gly, Phe, Tyr, Gln, Asn, Cys, Trp, Pro, Asp, or Glu
  misc_feature (9)..(9): Xaa can be Tyr, Met, Arg, Lys, Leu, Phe, Val, Ile, His, Cys, Trp, or Ala
QXPDSDPAX

SEQ ID NO: 51262 - protein, 10 aa, Artificial Sequence
  Description of Artificial Sequence: Synthetic peptide
  Seed: QVPDSDPARY (MAGA1_HUMAN)
  misc_feature (2)..(2): Xaa can be Val, Ile, Thr, Ala, Tyr, Met, Ser, Arg, Gln, Leu, Phe, Pro, Gly, Trp, His, Glu, Cys, Asp, Asn, or Lys
  misc_feature (10)..(10): Xaa can be Tyr, Lys, Phe, Arg, Leu, Met, Trp, Ile, His, Val, Gln, or Ala
QXPDSDPARX

SEQ ID NO: 51263 - protein, 8 aa, Artificial Sequence
  Description of Artificial Sequence: Synthetic peptide
  Seed: RALAETSY (MAGA1_HUMAN)
  misc_feature (2)..(2): Xaa can be Gln, Ala, Met, Lys, Leu, Val, Glu, Ser, Pro, His, Ile, Arg, Tyr, or Thr
  misc_feature (8)..(8): Xaa can be Tyr, Phe, Met, Leu, or Ile
RXLAETSX

SEQ ID NO: 51264 - protein, 9 aa, Artificial Sequence
  Description of Artificial Sequence: Synthetic peptide
  Seed: RALAETSYV (MAGA1_HUMAN)
  misc_feature (2)..(2): Xaa can be Thr, Met, Ser, Leu, Val, Gln, Phe, Ile, Ala, Tyr, Gly, Asn, Glu, Trp, Asp, Arg, Cys, Pro, His, or Lys
  misc_feature (9)..(9): Xaa can be Tyr, Leu, Phe, Trp, Lys, Met, Ile, Val, Arg, Ala, His, Thr, Cys, Ser, or Gly
RXLAETSYX

SEQ ID NO: 51265 - protein, 10 aa, Artificial Sequence
  Description of Artificial Sequence: Synthetic peptide
  Seed: RALAETSYVK (MAGA1_HUMAN)
  misc_feature (2)..(2): Xaa can be Thr, Ser, Val, Trp, Met, Leu, Ile, Phe, Tyr, Glu, Gln, Asn, Asp, Lys, Gly, His, Arg, Ala, Pro, or Cys
  misc_feature (10)..(10): Xaa can be Arg, Lys, Tyr, His, Ala, Val, Ile, Leu, or Met
RXLAETSYVX

SEQ ID NO: 51266 - protein, 11 aa, Artificial Sequence
  Description of Artificial Sequence: Synthetic peptide
  Seed: RALAETSYVKV (MAGA1_HUMAN)
  misc_feature (2)..(2): Xaa can be Leu, Tyr, Phe, Met, Trp, Lys, Ile, Arg, Thr, Ser, Val, Gly, Gln, Ala, or His
  misc_feature (11)..(11): Xaa can be Leu, Val, Ile, Ala, Met, or Cys
RXLAETSYVKX

SEQ ID NO: 51267 - protein, 8 aa, Artificial Sequence
  Description of Artificial Sequence: Synthetic peptide
  Seed: RAREPVTK (MAGA1_HUMAN)
  misc_feature (2)..(2): Xaa can be Thr, Val, Ser, Ala, Ile, Met, Gly, Gln, Leu, Glu, Tyr, Phe, Asn, Asp, Trp, Cys, or Pro
  misc_feature (8)..(8): Xaa can be Tyr, Lys, Phe, Leu, Met, Ala, Val, His, Ile, Arg, Ser, Pro, Gln, Gly, Trp, Thr, or Asn
RXREPVTX

SEQ ID NO: 51268 - protein, 9 aa, Artificial Sequence
  Description of Artificial Sequence: Synthetic peptide
  Seed: RAREPVTKA (MAGA1_HUMAN)
  misc_feature (2)..(2): Xaa can be Pro, Thr, Val, Met, Tyr, Ser, Arg, Ala, Phe, Ile, Leu, Gln, Gly, Trp, Asn, His, Glu, Cys, Lys, or Asp
  misc_feature (9)..(9): Xaa can be Ile, Val, Lys, Leu, Met, Tyr, Phe, His, Ala, Arg, Trp, Gly, Thr, Cys, Ser, Gln, Asn, Pro, Glu, or Asp
RXREPVTKX

SEQ ID NO: 51269 - protein, 10 aa, Artificial Sequence
  Description of Artificial Sequence: Synthetic peptide
  Seed: RAREPVTKAE (MAGA1_HUMAN)
  misc_feature (2)..(2): Xaa can be Ser, Val, Thr, Phe, Ala, Tyr, Met, Ile, Trp, Leu, Gln, Gly, Asn, Lys, Cys, or His
  misc_feature (10)..(10): Xaa can be Lys, Met, Ala, Ile, Val, Tyr, Ser, Arg, Leu, Gly, Pro, Phe, Thr, Glu, Cys, Gln, Asn, His, Trp, or Asp
RXREPVTKAX

SEQ ID NO: 51270 - protein, 11 aa, Artificial Sequence
  Description of Artificial Sequence: Synthetic peptide
  Seed: RAREPVTKAEM (MAGA1_HUMAN)
  misc_feature (2)..(2): Xaa can be Pro, Arg, Ala, Val, Gln, Thr, Ser, Tyr, Glu, Ile, His, Met, Cys, Gly, Lys, Leu, Trp, or Ph e
  misc_feature (11)..(11): Xaa can be Phe, Tyr, Leu, Met, Ile, Trp, His, Val, Cys, Ser, Gln, Thr, Lys, Arg, Gly, Pro, or Ala
RXREPVTKAEX

SEQ ID NO: 51271 - protein, 8 aa, Artificial Sequence
  Description of Artificial Sequence: Synthetic peptide
  Seed: RAVITKKV (MAGA1_HUMAN)
  misc_feature (2)..(2): Xaa can be Ala, Ser, Thr, Gln, Gly, Met, Glu, Asp, Leu, Asn, Val, or Ile
  misc_feature (8)..(8): Xaa can be Val, Ile, Leu, Phe, Met, or Tyr
RXVITKKX

SEQ ID NO: 51272 - protein, 9 aa, Artificial Sequence
  Description of Artificial Sequence: Synthetic peptide
  Seed: RAVITKKVA (MAGA1_HUMAN)
  misc_feature (2)..(2): Xaa can be Pro, Ala, Ser, Val, Ile, Thr, Gly, Gln, Met, Asn, Cys, Leu, Asp, or Glu
  misc_feature (9)..(9): Xaa can be Tyr, Phe, Met, Leu, His, Ile, Val, Ala, Cys, Pro, Thr, Ser, or Gly
RXVITKKVX

SEQ ID NO: 51273 - protein, 9 aa, Artificial Sequence
  Description of Artificial Sequence: Synthetic peptide
  Seed: REAALREEE (MAGA1_HUMAN)
  misc_feature (2)..(2): Xaa can be Glu, Asp, or Gln
  misc_feature (9)..(9): Xaa can be Val, Ala, Leu, Phe, Ile, Cys, Met, Tyr, Thr, Pro, Asn, Gln, Trp, Arg, Asp, Glu, Ser, Gly, Lys, or His
RXAALREEX

SEQ ID NO: 51274 - protein, 10 aa, Artificial Sequence
  Description of Artificial Sequence: Synthetic peptide
  Seed: REAALREEEE (MAGA1_HUMAN)
  misc_feature (2)..(2): Xaa can be Glu, Asp, or Gln
  misc_feature (10)..(10): Xaa can be Ala, Cys, Leu, Ile, Val, Met, Gln, Trp, Asp, Glu, Phe, Thr, Ser, Gly, Pro, or Tyr
RXAALREEEX

SEQ ID NO: 51275 - protein, 11 aa, Artificial Sequence
  Description of Artificial Sequence: Synthetic peptide
  Seed: REAALREEEEG (MAGA1_HUMAN)
  misc_feature (2)..(2): Xaa can be Glu, or Asp
  misc_feature (11)..(11): Xaa can be Cys, Ala, Leu, Thr, Tyr, Ile, Val, Met, Trp, Phe, Gly, Pro, or Ser
RXAALREEEEX

SEQ ID NO: 51276 - protein, 8 aa, Artificial Sequence
  Description of Artificial Sequence: Synthetic peptide
  Seed: REEEGPST (MAGA1_HUMAN)
  misc_feature (2)..(2): Xaa can be Glu, Asp, or Gln
  misc_feature (8)..(8): Xaa can be Leu, Val, Met, Ile, Ala, Phe, Gly, Cys, Ser, Pro, Tyr, or Thr
RXEEGPSX

SEQ ID NO: 51277 - protein, 9 aa, Artificial Sequence
  Description of Artificial Sequence: Synthetic peptide
  Seed: REEEGPSTS (MAGA1_HUMAN)
  misc_feature (2)..(2): Xaa can be Glu, Asp, Gln, Ala, Ser, Val, Ile, Gly, Leu, Met, or Asn
  misc_feature (9)..(9): Xaa can be Leu, Phe, Met, Ile, Ala, Pro, Trp, Cys, Val, Tyr, Thr, Ser, Asn, Arg, Gln, His, Asp, Gly, Lys, or Glu
RXEEGPSTX

SEQ ID NO: 51278 - protein, 10 aa, Artificial Sequence
  Description of Artificial Sequence: Synthetic peptide
  Seed: REEEGPSTSC (MAGA1_HUMAN)
  misc_feature (2)..(2): Xaa can be Glu, Asp, Gln, Val, Ala, Lys, Ser, Leu, Met, Pro, Arg, His, Thr, Ile, or Asn
  misc_feature (10)..(10): Xaa can be Trp, Phe, Leu, Tyr, Pro, Ala, Cys, Val, Met, Thr, Ile, Gly, Ser, Asn, Asp, Gln, His, Lys, Glu, or Arg
RXEEGPSTSX

SEQ ID NO: 51279 - protein, 11 aa, Artificial Sequence
  Description of Artificial Sequence: Synthetic peptide
  Seed: REEEGPSTSCI (MAGA1_HUMAN)
  misc_feature (2)..(2): Xaa can be Glu, Asp, Gln, Ala, Arg, Asn, Ser, Met, Thr, Lys, Ile, His, or Val
  misc_feature (11)..(11): Xaa can be Trp, Ala, Leu, Met, Tyr, Val, Ile, Phe, Cys, Arg, Ser, Gln, Thr, Asp, Lys, Glu, His, Pro, or Gly
RXEEGPSTSCX

SEQ ID NO: 51280 - protein, 9 aa, Artificial Sequence
  Description of Artificial Sequence: Synthetic peptide
  Seed: REHSAYGEP (MAGA1_HUMAN)
  misc_feature (2)..(2): Xaa can be Glu, Asp, or Gln
  misc_feature (9)..(9): Xaa can be Ile, Met, Leu, Ala, Val, Phe, Thr, Pro, Cys, Glu, Tyr, Trp, Asp, Gly, or Ser
RXHSAYGEX

SEQ ID NO: 51281 - protein, 9 aa, Artificial Sequence
  Description of Artificial Sequence: Synthetic peptide
  Seed: REPVTKAEM (MAGA1_HUMAN)
  misc_feature (2)..(2): Xaa can be Glu, Arg, Asp, Ala, Gln, Ile, Ser, Thr, Val, Tyr, Leu, Met, Phe, Asn, His, Gly, Pro, Lys, Trp, or Cys
  misc_feature (9)..(9): Xaa can be Phe, Tyr, Met, Leu, Ile, Val, Trp, His, Cys, Ala, Pro, Arg, Lys, Thr, Ser, or Gly
RXPVTKAEX

SEQ ID NO: 51282 - protein, 10 aa, Artificial Sequence
  Description of Artificial Sequence: Synthetic peptide
  Seed: REPVTKAEML (MAGA1_HUMAN)
  misc_feature (2)..(2): Xaa can be Glu, Pro, Gln, Asp, Tyr, Gly, Ile, Phe, Thr, Val, Trp, Met, Ala, Ser, Arg, Asn, His, Lys, Cys, or Leu
  misc_feature (10)..(10): Xaa can be Met, Leu, Phe, Trp, Ile, Val, Tyr, Thr, Pro, Ala, Gly, Cys, or Ser
RXPVTKAEMX

SEQ ID NO: 51283 - protein, 8 aa, Artificial Sequence
  Description of Artificial Sequence: Synthetic peptide
  Seed: RFFFPSLR (MAGA1_HUMAN)
  misc_feature (2)..(2): Xaa can be Thr, Leu, Val, Gln, Ser, Ile, Met, Ala, Tyr, Trp, Phe, Arg, Asn, Gly, Cys, Lys, or His
  misc_feature (8)..(8): Xaa can be Arg, or Lys
RXFFPSLX

SEQ ID NO: 51284 - protein, 10 aa, Artificial Sequence
  Description of Artificial Sequence: Synthetic peptide
  Seed: RFFFPSLREA (MAGA1_HUMAN)
  misc_feature (2)..(2): Xaa can be Thr, Val, Ser, Ala, Met, Ile, Tyr, Phe, Trp, Gly, Asn, Leu, Gln, Arg, Cys, Lys, His, Pro, Glu, or Asp
  misc_feature (10)..(10): Xaa can be Lys, Ala, Val, Ile, Arg, Met, Gly, Leu, Ser, Tyr, Thr, Cys, His, Phe, or Pro
RXFFPSLREX

SEQ ID NO: 51285 - protein, 10 aa, Artificial Sequence
  Description of Artificial Sequence: Synthetic peptide
  Seed: RQPSEGSSSR (MAGA1_HUMAN)
  misc_feature (2)..(2): Xaa can be Arg, Gly, Ala, Leu, Val, Thr, Ile, Met, Ser, Gln, Pro, Asn, Phe, Asp, Tyr, Glu, Cys, Lys, or Trp
  misc_feature (10)..(10): Xaa can be Arg, Lys, Leu, Phe, Met, Tyr, Val, His, Ile, Glu, Trp, Asn, or Gln
RXPSEGSSSX

SEQ ID NO: 51286 - protein, 9 aa, Artificial Sequence
  Description of Artificial Sequence: Synthetic peptide
  Seed: RQRQPSEGS (MAGA1_HUMAN)
  misc_feature (2)..(2): Xaa can be Met, Thr, Ser, Val, Tyr, Phe, Ile, Ala, Leu, Trp, Gln, Gly, Asn, Cys, His, or Lys
  misc_feature (9)..(9): Xaa can be Lys, Val, Ala, Ile, Leu, Arg, Met, Ser, Tyr, Gly, Thr, Cys, Phe, Pro, Gln, His, Asn, or Gl u
RXRQPSEGX

SEQ ID NO: 51287 - protein, 9 aa, Artificial Sequence
  Description of Artificial Sequence: Synthetic peptide
  Seed: RQVPDSDPA (MAGA1_HUMAN)
  misc_feature (2)..(2): Xaa can be Glu, Gln, His, Leu, Met, Asp, Lys, Val, Ile, Thr, Ser, Ala, Arg, Asn, Gly, Pro, Phe, Tyr, Cys, or Trp
  misc_feature (9)..(9): Xaa can be Tyr, Phe, Met, Leu, Val, Ile, Ala, Thr, Cys, His, Trp, Pro, Gln, Gly, Glu, Ser, Asp, or Ar g
RXVPDSDPX

SEQ ID NO: 51288 - protein, 10 aa, Artificial Sequence
  Description of Artificial Sequence: Synthetic peptide
  Seed: RQVPDSDPAR (MAGA1_HUMAN)
  misc_feature (2)..(2): Xaa can be Arg, Glu, Gln, Ala, Ser, Met, Leu, Ile, Thr, Val, Asp, Gly, Cys, Tyr, Lys, Phe, Asn, Pro, or Trp
  misc_feature (10)..(10): Xaa can be Lys, Arg, Leu, Tyr, Met, Phe, Ile, Val, Trp, Ala, Asn, Pro, Ser, Cys, Gln, Glu, Gly, Thr, or His
RXVPDSDPAX

SEQ ID NO: 51289 - protein, 11 aa, Artificial Sequence
  Description of Artificial Sequence: Synthetic peptide
  Seed: RQVPDSDPARY (MAGA1_HUMAN)
  misc_feature (2)..(2): Xaa can be Arg, Glu, Gln, Leu, Met, Ala, Val, Ile, Thr, Ser, Tyr, Lys, His, Asp, Gly, Asn, Phe, Cys, Trp, or Pro
  misc_feature (11)..(11): Xaa can be Phe, Leu, Tyr, Met, Trp, Lys, Arg, Ile, Val, His, Cys, Ala, Thr, Gln, Gly, Ser, Pro, Asn, Glu, or Asp
RXVPDSDPARX

SEQ ID NO: 51290 - protein, 11 aa, Artificial Sequence
  Description of Artificial Sequence: Synthetic peptide
  Seed: RSLHCKPEEAL (MAGA1_HUMAN)
  misc_feature (2)..(2): Xaa can be Ser, Thr, Ala, Val, Ile, Cys, Gly, Asp, Gln, Asn, Pro, Leu, or Met
  misc_feature (11)..(11): Xaa can be Trp, Phe, Tyr, Leu, Ile, or Met
RXLHCKPEEAX

SEQ ID NO: 51291 - protein, 8 aa, Artificial Sequence
  Description of Artificial Sequence: Synthetic peptide
  Seed: RVRFFFPS (MAGA1_HUMAN)
  misc_feature (2)..(2): Xaa can be Ser, Val, Thr, Met, Tyr, Ala, Ile, Phe, Leu, Gln, Trp, Gly, Asn, Arg, Lys, Cys, or His
  misc_feature (8)..(8): Xaa can be Lys, Ala, Met, Val, Tyr, Leu, Ile, Arg, Phe, Ser, Pro, Asn, Gly, Thr, His, Gln, Cys, Glu, Trp, or Asp
RXRFFFPX

SEQ ID NO: 51292 - protein, 9 aa, Artificial Sequence
  Description of Artificial Sequence: Synthetic peptide
  Seed: RVRFFFPSL (MAGA1_HUMAN)
  misc_feature (2)..(2): Xaa can be Pro, Phe, Asn, Trp, Thr, Ala, Tyr, Val, Met, Ile, Gly, Leu, Ser, Gln, Cys, His, Arg, Lys, Glu, or Asp
  misc_feature (9)..(9): Xaa can be Ala, Met, Trp, Phe, Lys, Leu, Tyr, Arg, Ile, Val, His, Ser, Gly, Pro, Thr, Cys, Asn, Glu, Gln, or Asp
RXRFFFPSX

SEQ ID NO: 51293 - protein, 10 aa, Artificial Sequence
  Description of Artificial Sequence: Synthetic peptide
  Seed: RVRFFFPSLR (MAGA1_HUMAN)
  misc_feature (2)..(2): Xaa can be Trp, Ala, Arg, Gly, Leu, Met, Val, Ser, Gln, Phe, Ile, Thr, Tyr, Glu, Asn, His, Asp, Pro, Lys, or Cys
  misc_feature (10)..(10): Xaa can be Val, Gly, Lys, Cys, Ala, Pro, Tyr, Trp, Leu, His, Ser, Ile, Arg, Gln, Met, Glu, Phe, Thr, Asn, or Asp
RXRFFFPSLX

SEQ ID NO: 51294 - protein, 11 aa, Artificial Sequence
  Description of Artificial Sequence: Synthetic peptide
  Seed: RVRFFFPSLRE (MAGA1_HUMAN)
  misc_feature (2)..(2): Xaa can be Pro, His, Gly, Gln, Thr, Glu, Met, Cys, Lys, Phe, Arg, Val, Trp, Asn, Ser, Leu, Tyr, Ile, Asp, or Ala
  misc_feature (11)..(11): Xaa can be Tyr, Cys, Ala, Glu, His, Gly, Val, Phe, Ile, Leu, Ser, Trp, Thr, Arg, Asp, Pro, Gln, Asn, Met, or Lys
RXRFFFPSLRX

SEQ ID NO: 51295 - protein, 9 aa, Artificial Sequence
  Description of Artificial Sequence: Synthetic peptide
  Seed: RYEFLWGPR (MAGA1_HUMAN)
  misc_feature (2)..(2): Xaa can be Met, Val, Ser, Gln, Ile, Leu, Thr, Gly, Asn, Trp, Phe, Tyr, Ala, His, Cys, or Pro
  misc_feature (9)..(9): Xaa can be Arg, Lys, or His
RXEFLWGPX

SEQ ID NO: 51296 - protein, 10 aa, Artificial Sequence
  Description of Artificial Sequence: Synthetic peptide
  Seed: RYEFLWGPRA (MAGA1_HUMAN)
  misc_feature (2)..(2): Xaa can be Phe, Tyr, Met, Thr, Val, Leu, Ser, Trp, Ile, Gln, Asn, Glu, Gly, Ala, Arg, His, Cys, Pro, Lys, or Asp
  misc_feature (10)..(10): Xaa can be Pro, Ile, Met, Phe, Leu, Val, Ala, Arg, Lys, His, Tyr, Thr, Cys, Asn, Ser, Trp, Asp, Gly, Glu, or Gln
RXEFLWGPRX

SEQ ID NO: 51297 - protein, 11 aa, Artificial Sequence
  Description of Artificial Sequence: Synthetic peptide
  Seed: RYEFLWGPRAL (MAGA1_HUMAN)
  misc_feature (2)..(2): Xaa can be Tyr, Glu, Phe, Trp, Arg, Gly, Gln, Ser, Met, His, Lys, Ala, Thr, Ile, Cys, Asn, Pro, Val, Asp, or Leu
  misc_feature (11)..(11): Xaa can be Phe, Met, Leu, Ile, Trp, Val, Tyr, or Ala
RXEFLWGPRAX

SEQ ID NO: 51298 - protein, 9 aa, Artificial Sequence
  Description of Artificial Sequence: Synthetic peptide
  Seed: SAFPTTINF (MAGA1_HUMAN)
  misc_feature (2)..(2): Xaa can be Arg, Ala, Gln, Glu, Pro, Thr, Tyr, Met, Val, Asp, Leu, His, Ser, Phe, Ile, Trp, Gly, Cys, Asn, or Lys
  misc_feature (9)..(9): Xaa can be Lys, Val, Phe, Met, Tyr, Leu, Ile, Trp, Arg, His, Cys, Ala, Thr, Gln, Ser, Pro, Gly, Asn, or Glu
SXFPTTINX

SEQ ID NO: 51299 - protein, 10 aa, Artificial Sequence
  Description of Artificial Sequence: Synthetic peptide
  Seed: SAFPTTINFT (MAGA1_HUMAN)
  misc_feature (2)..(2): Xaa can be Ala, Met, Val, Ile, Leu, Gln, Thr, Ser, Glu, Gly, Cys, Asn, Phe, Pro, Lys, Asp, Arg, or Ty r
  misc_feature (10)..(10): Xaa can be Tyr, Phe, Val, Met, Leu, His, Ile, Ala, Trp, Thr, Cys, Ser, Gln, Lys, or Arg
SXFPTTINFX

SEQ ID NO: 51300 - protein, 11 aa, Artificial Sequence
  Description of Artificial Sequence: Synthetic peptide
  Seed: SAFPTTINFTR (MAGA1_HUMAN)
  misc_feature (2)..(2): Xaa can be Thr, Met, Ser, Ala, Val, Ile, Leu, Gly, Cys, Gln, Phe, Asn, Asp, Tyr, Glu, Trp, Arg, Lys, Pro, or His
  misc_feature (11)..(11): Xaa can be Arg, Lys, Phe, Tyr, Leu, Met, Trp, His, Val, Gln, or Ile
SXFPTTINFTX

SEQ ID NO: 51301 - protein, 8 aa, Artificial Sequence
  Description of Artificial Sequence: Synthetic peptide
  Seed: SARVRFFF (MAGA1_HUMAN)
  misc_feature (2)..(2): Xaa can be Met, Leu, Ala, Pro, Gln, Val, Ile, Asn, Ser, Arg, Lys, Thr, Phe, Gly, or Trp
  misc_feature (8)..(8): Xaa can be Leu, Met, Ile, Val, Ala, Phe, Thr, Ser, Tyr, Pro, or Cys
SXRVRFFX

SEQ ID NO: 51302 - protein, 9 aa, Artificial Sequence
  Description of Artificial Sequence: Synthetic peptide
  Seed: SARVRFFFP (MAGA1_HUMAN)
  misc_feature (2)..(2): Xaa can be Gln, Thr, Ile, Ser, Val, Met, Phe, Ala, Tyr, Trp, Leu, Gly, Asn, Arg, His, Cys, Lys, Pro, Glu, or Asp
  misc_feature (9)..(9): Xaa can be Lys, Val, Met, Ile, Ser, Ala, Tyr, Leu, Arg, Gly, Phe, Cys, Pro, Gln, His, Thr, Asn, Glu, Asp, or Trp
SXRVRFFFX

SEQ ID NO: 51303 - protein, 10 aa, Artificial Sequence
  Description of Artificial Sequence: Synthetic peptide
  Seed: SARVRFFFPS (MAGA1_HUMAN)
  misc_feature (2)..(2): Xaa can be Val, Ser, Tyr, Thr, Phe, Arg, Ala, Met, Ile, Asn, Trp, Gly, Leu, Cys, Lys, Asp, Gln, Glu, Pro, or His
  misc_feature (10)..(10): Xaa can be Ala, Val, Gly, Arg, Ile, His, Lys, Pro, Leu, Thr, Phe, Ser, Tyr, Trp, Cys, Gln, Met, Asn, or Glu
SXRVRFFFPX

SEQ ID NO: 51304 - protein, 11 aa, Artificial Sequence
  Description of Artificial Sequence: Synthetic peptide
  Seed: SARVRFFFPSL (MAGA1_HUMAN)
  misc_feature (2)..(2): Xaa can be Thr, Ser, Trp, Phe, Tyr, Met, Val, Gln, Ala, Pro, Ile, Arg, Leu, Glu, Cys, His, Gly, Asn, Lys, or Asp
  misc_feature (11)..(11): Xaa can be Leu, Thr, Ala, Lys, Tyr, Val, Gly, Ser, Met, Ile, Arg, Phe, Pro, Cys, His, Gln, or Asn
SXRVRFFFPSX

SEQ ID NO: 51305 - protein, 8 aa, Artificial Sequence
  Description of Artificial Sequence: Synthetic peptide
  Seed: SAYGEPRK (MAGA1_HUMAN)
  misc_feature (2)..(2): Xaa can be Thr, Val, Ile, or Ala
  misc_feature (8)..(8): Xaa can be Lys, or Arg
SXYGEPRX

SEQ ID NO: 51306 - protein, 9 aa, Artificial Sequence
  Description of Artificial Sequence: Synthetic peptide
  Seed: SAYGEPRKL (MAGA1_HUMAN)
  misc_feature (2)..(2): Xaa can be Arg, Glu, Pro, Ala, Gln, Ser, Asp, Val, Leu, His, Tyr, Met, Ile, Phe, Thr, Trp, Gly, Asn, Lys, or Cys
  misc_feature (9)..(9): Xaa can be Val, Tyr, Trp, Ile, Phe, Met, Leu, Arg, Lys, His, Ala, Cys, Thr, Pro, Ser, Gln, Gly, Glu, or Asn
SXYGEPRKX

SEQ ID NO: 51307 - protein, 10 aa, Artificial Sequence
  Description of Artificial Sequence: Synthetic peptide
  Seed: SAYGEPRKLL (MAGA1_HUMAN)
  misc_feature (2)..(2): Xaa can be Ala, Ser, Arg, Thr, Val, Ile, Met, Gln, Glu, Gly, Leu, Tyr, Asp, Phe, Cys, Asn, Pro, or Hi s
  misc_feature (10)..(10): Xaa can be Tyr, Trp, Phe, Leu, Met, Val, Ile, His, Ala, or Cys
SXYGEPRKLX

SEQ ID NO: 51308 - protein, 9 aa, Artificial Sequence
  Description of Artificial Sequence: Synthetic peptide
  Seed: SCILESLFR (MAGA1_HUMAN)
  misc_feature (2)..(2): Xaa can be Met, Thr, Leu, Val, Ile, Gln, Tyr, Asn, Trp, Gly, Phe, Ala, Pro, Ser, His, Glu, Cys, or As p
  misc_feature (9)..(9): Xaa can be Arg, Lys, Tyr, Leu, Val, or His
SXILESLFX

SEQ ID NO: 51309 - protein, 10 aa, Artificial Sequence
  Description of Artificial Sequence: Synthetic peptide
  Seed: SCILESLFRA (MAGA1_HUMAN)
  misc_feature (2)..(2): Xaa can be Leu, Met, Gln, Val, Ile, Ser, Ala, Tyr, Thr, Phe, Gly, His, Asp, Lys, Cys, Pro, Arg, Asn, Trp, or Glu
  misc_feature (10)..(10): Xaa can be Met, Leu, Val, Ala, Ile, Thr, Cys, Phe, or Ser
SXILESLFRX

SEQ ID NO: 51310 - protein, 11 aa, Artificial Sequence
  Description of Artificial Sequence: Synthetic peptide
  Seed: SCILESLFRAV (MAGA1_HUMAN)
  misc_feature (2)..(2): Xaa can be Met, Leu, Tyr, Phe, Lys, Ser, Arg, Ala, His, Thr, Val, Trp, Ile, Cys, Gln, Asn, or Gly
  misc_feature (11)..(11): Xaa can be Val, Ile, Leu, Ala, Tyr, Phe, Gln, Cys, Asn, Glu, Met, Arg, Gly, Lys, His, Asp, Thr, Trp, Pro, or Ser
SXILESLFRAX

SEQ ID NO: 51311 - protein, 8 aa, Artificial Sequence
  Description of Artificial Sequence: Synthetic peptide
  Seed: SDPARYEF (MAGA1_HUMAN)
  misc_feature (2)..(2): Xaa can be Glu, Ala, Asp, Gly, Ser, Arg, Gln, His, Asn, Met, Phe, Lys, Tyr, Pro, Ile, Leu, Thr, or Va l
  misc_feature (8)..(8): Xaa can be Leu, Ile, Met, Phe, Val, Trp, Ala, Tyr, or Cys
SXPARYEX

SEQ ID NO: 51312 - protein, 9 aa, Artificial Sequence
  Description of Artificial Sequence: Synthetic peptide
  Seed: SDPARYEFL (MAGA1_HUMAN)
  misc_feature (2)..(2): Xaa can be Glu, Asp, Ala, Arg, Gly, His, Met, Ser, Phe, Val, Asn, Tyr, Gln, Leu, Ile, Thr, Lys, Pro, Cys, or Trp
  misc_feature (9)..(9): Xaa can be Met, Leu, Ile, Val, Phe, Cys, Ala, Trp, Gly, Pro, Thr, Ser, or Tyr
SXPARYEFX

SEQ ID NO: 51313 - protein, 10 aa, Artificial Sequence
  Description of Artificial Sequence: Synthetic peptide
  Seed: SDPARYEFLW (MAGA1_HUMAN)
  misc_feature (2)..(2): Xaa can be Ser, Tyr, Phe, Met, Ala, Thr, Trp, Asn, Ile, Gly, Arg, Pro, His, Leu, Glu, Asp, Val, Lys, Cys, or Gln
  misc_feature (10)..(10): Xaa can be Phe, Trp, Tyr, Met, Ile, or Leu
SXPARYEFLX

SEQ ID NO: 51314 - protein, 11 aa, Artificial Sequence
  Description of Artificial Sequence: Synthetic peptide
  Seed: SEGSSSREEEG (MAGA1_HUMAN)
  misc_feature (2)..(2): Xaa can be , or Glu
  misc_feature (11)..(11): Xaa can be Thr, Val, Tyr, Cys, Phe, Gly, Leu, Ala, Pro, Trp, Met, Ser, or Ile
SXGSSSREEEX

SEQ ID NO: 51315 - protein, 8 aa, Artificial Sequence
  Description of Artificial Sequence: Synthetic peptide
  Seed: SESLQLVF (MAGA1_HUMAN)
  misc_feature (2)..(2): Xaa can be Glu, Asp, or Gln
  misc_feature (8)..(8): Xaa can be Trp, Leu, Tyr, Val, Phe, Met, Ile, Ala, Gly, Ser, His, Cys, Thr, or Pro
SXSLQLVX

SEQ ID NO: 51316 - protein, 9 aa, Artificial Sequence
  Description of Artificial Sequence: Synthetic peptide
  Seed: SESLQLVFG (MAGA1_HUMAN)
  misc_feature (2)..(2): Xaa can be Glu, Asp, or Gln
  misc_feature (9)..(9): Xaa can be Ala, Leu, Cys, Val, Met, Ile, Phe, Gly, Pro, Thr, Tyr, or Ser
SXSLQLVFX

SEQ ID NO: 51317 - protein, 10 aa, Artificial Sequence
  Description of Artificial Sequence: Synthetic peptide
  Seed: SESLQLVFGI (MAGA1_HUMAN)
  misc_feature (2)..(2): Xaa can be Glu, Gln, Ser, Met, Thr, Arg, Lys, Ala, Val, Phe, Tyr, Trp, Gly, His, Asp, Pro, Ile, Cys, Asn, or Leu
  misc_feature (10)..(10): Xaa can be Trp, Tyr, Ile, Phe, Met, Leu, Val, Cys, Ala, Pro, Ser, or Thr
SXSLQLVFGX

SEQ ID NO: 51318 - protein, 10 aa, Artificial Sequence
  Description of Artificial Sequence: Synthetic peptide
  Seed: SLEQRSLHCK (MAGA1_HUMAN)
  misc_feature (2)..(2): Xaa can be Thr, Ser, Tyr, Trp, Gln, Val, Leu, Phe, Ala, Ile, Met, Gly, Asn, Cys, Asp, or Glu
  misc_feature (10)..(10): Xaa can be Tyr, Arg, Lys, Phe, or His
SXEQRSLHCX

SEQ ID NO: 51319 - protein, 9 aa, Artificial Sequence
  Description of Artificial Sequence: Synthetic peptide
  Seed: SLFRAVITK (MAGA1_HUMAN)
  misc_feature (2)..(2): Xaa can be Thr, Val, Ser, Ile, Ala, Leu, Met, Gln, Tyr, Phe, Asn, His, Gly, Asp, Pro, Glu, Trp, Cys, Arg, or Lys
  misc_feature (9)..(9): Xaa can be Arg, Lys, Tyr, Leu, Met, Ile, His, Phe, Val, Ala, Ser, Gln, or Gly
SXFRAVITX

SEQ ID NO: 51320 - protein, 10 aa, Artificial Sequence
  Description of Artificial Sequence: Synthetic peptide
  Seed: SLFRAVITKK (MAGA1_HUMAN)
  misc_feature (2)..(2): Xaa can be Val, Met, Ser, Thr, Ile, Leu, Tyr, Ala, Gln, Arg, Trp, Lys, Phe, Gly, Asp, Glu, Cys, His, Asn, or Pro
  misc_feature (10)..(10): Xaa can be Ala, Arg, Lys, Val, Ile, Leu, Tyr, Met, His, Ser, Gly, Phe, Asn, Cys, Trp, Thr, Asp, Gln, Pro, or Glu
SXFRAVITKX

SEQ ID NO: 51321 - protein, 11 aa, Artificial Sequence
  Description of Artificial Sequence: Synthetic peptide
  Seed: SLFRAVITKKV (MAGA1_HUMAN)
  misc_feature (2)..(2): Xaa can be Met, Leu, or Ile
  misc_feature (11)..(11): Xaa can be Val, Ala, Ile, Leu, or Met
SXFRAVITKKX

SEQ ID NO: 51322 - protein, 9 aa, Artificial Sequence
  Description of Artificial Sequence: Synthetic peptide
  Seed: SLHCKPEEA (MAGA1_HUMAN)
  misc_feature (2)..(2): Xaa can be Leu, Met, Gln, Ile, Val, Thr, Ser, or Ala
  misc_feature (9)..(9): Xaa can be Val, Leu, Ile, Ala, Met, or Thr
SXHCKPEEX

SEQ ID NO: 51323 - protein, 10 aa, Artificial Sequence
  Description of Artificial Sequence: Synthetic peptide
  Seed: SLHCKPEEAL (MAGA1_HUMAN)
  misc_feature (2)..(2): Xaa can be Leu, Met, Ala, or Ile
  misc_feature (10)..(10): Xaa can be Val, Leu, Ala, or Ile
SXHCKPEEAX

SEQ ID NO: 51324 - protein, 8 aa, Artificial Sequence
  Description of Artificial Sequence: Synthetic peptide
  Seed: SLQLVFGI (MAGA1_HUMAN)
  misc_feature (2)..(2): Xaa can be Met, Leu, or Ile
  misc_feature (8)..(8): Xaa can be Val, Leu, Ile, or Ala
SXQLVFGX

SEQ ID NO: 51325 - protein, 10 aa, Artificial Sequence
  Description of Artificial Sequence: Synthetic peptide
  Seed: SLQLVFGIDV (MAGA1_HUMAN)
  misc_feature (2)..(2): Xaa can be Leu, Met, Phe, Tyr, His, Asn, Ala, Gly, Glu, Ser, Thr, Asp, Arg, Cys, Ile, Trp, Pro, Lys, Val, or Gln
  misc_feature (10)..(10): Xaa can be Val, Ala, Leu, or Ile
SXQLVFGIDX

SEQ ID NO: 51326 - protein, 11 aa, Artificial Sequence
  Description of Artificial Sequence: Synthetic peptide
  Seed: SLQLVFGIDVK (MAGA1_HUMAN)
  misc_feature (2)..(2): Xaa can be Gly, Ala, Ser, Val, Ile, Gln, Asn, Leu, or Thr
  misc_feature (11)..(11): Xaa can be Lys, or Arg
SXQLVFGIDVX

SEQ ID NO: 51327 - protein, 8 aa, Artificial Sequence
  Description of Artificial Sequence: Synthetic peptide
  Seed: SPLVLGTL (MAGA1_HUMAN)
  misc_feature (2)..(2): Xaa can be Pro, Ala, Glu, Gln, Ser, Asp, or Gly
  misc_feature (8)..(8): Xaa can be Ile, Val, Leu, Met, Pro, Cys, Ser, Ala, Phe, or Thr
SXLVLGTX

SEQ ID NO: 51328 - protein, 11 aa, Artificial Sequence
  Description of Artificial Sequence: Synthetic peptide
  Seed: SPLVLGTLEEV (MAGA1_HUMAN)
  misc_feature (2)..(2): Xaa can be Pro, Met, Leu, Tyr, Phe, Gln, Trp, Ile, Lys, Asp, Ala, Glu, Val, Ser, His, Gly, Arg, Thr, Cys, or Asn
  misc_feature (11)..(11): Xaa can be Val, Ile, Leu, Ala, Met, Phe, Pro, Thr, Cys, Gly, or Ser
SXLVLGTLEEX

SEQ ID NO: 51329 - protein, 8 aa, Artificial Sequence
  Description of Artificial Sequence: Synthetic peptide
  Seed: SPQGASAF (MAGA1_HUMAN)
  misc_feature (2)..(2): Xaa can be , or Pro
  misc_feature (8)..(8): Xaa can be Leu, Ala, Val, Met, Phe, Tyr, or Ile
SXQGASAX

SEQ ID NO: 51330 - protein, 9 aa, Artificial Sequence
  Description of Artificial Sequence: Synthetic peptide
  Seed: SPQGASAFP (MAGA1_HUMAN)
  misc_feature (2)..(2): Xaa can be Pro, or Ala
  misc_feature (9)..(9): Xaa can be Ala, Phe, Tyr, Gly, Met, Leu, Ser, Cys, Ile, Pro, Val, or Thr
SXQGASAFX

SEQ ID NO: 51331 - protein, 10 aa, Artificial Sequence
  Description of Artificial Sequence: Synthetic peptide
  Seed: SPQGASAFPT (MAGA1_HUMAN)
  misc_feature (2)..(2): Xaa can be , or Pro
  misc_feature (10)..(10): Xaa can be Cys, Pro, Arg, Val, Tyr, Ala, Ser, Thr, Met, Ile, Leu, Phe, Lys, Gly, or Trp
SXQGASAFPX

SEQ ID NO: 51332 - protein, 11 aa, Artificial Sequence
  Description of Artificial Sequence: Synthetic peptide
  Seed: SPQGASAFPTT (MAGA1_HUMAN)
  misc_feature (2)..(2): Xaa can be Pro, or Ala
  misc_feature (11)..(11): Xaa can be Leu, Cys, Ala, Met, Glu, His, Tyr, Arg, Ser, Phe, Ile, Pro, Thr, Val, Gly, Asn, Lys, Trp, or Gln
SXQGASAFPTX

SEQ ID NO: 51333 - protein, 9 aa, Artificial Sequence
  Description of Artificial Sequence: Synthetic peptide
  Seed: SREEEGPST (MAGA1_HUMAN)
  misc_feature (2)..(2): Xaa can be His, Arg, Gln, Pro, or Lys
  misc_feature (9)..(9): Xaa can be Ala, Leu, Val, Ile, Met, Cys, Thr, Gly, Pro, Ser, or Phe
SXEEEGPSX

SEQ ID NO: 51334 - protein, 11 aa, Artificial Sequence
  Description of Artificial Sequence: Synthetic peptide
  Seed: SREEEGPSTSC (MAGA1_HUMAN)
  misc_feature (2)..(2): Xaa can be Arg, His, Tyr, Phe, Trp, Gln, Ala, Gly, Val, Met, Ser, Leu, Pro, Thr, Cys, Ile, Asn, Glu, or Lys
  misc_feature (11)..(11): Xaa can be Met, Leu, Phe, Ile, Val, Ala, Cys, Trp, Tyr, Pro, Ser, Lys, Gly, Thr, or Arg
SXEEEGPSTSX

SEQ ID NO: 51335 - protein, 9 aa, Artificial Sequence
  Description of Artificial Sequence: Synthetic peptide
  Seed: SSPLVLGTL (MAGA1_HUMAN)
  misc_feature (2)..(2): Xaa can be Thr, Ala, Gln, Leu, Met, Phe, Glu, Pro, Ser, Tyr, Val, Arg, Ile, Asn, Gly, Asp, Cys, Trp, His, or Lys
  misc_feature (9)..(9): Xaa can be Ile, Val, Met, Tyr, Leu, Phe, Trp, Arg, Lys, Cys, His, Ala, or Thr
SXPLVLGTX

SEQ ID NO: 51336 - protein, 9 aa, Artificial Sequence
  Description of Artificial Sequence: Synthetic peptide
  Seed: SSSPLVLGT (MAGA1_HUMAN)
  misc_feature (2)..(2): Xaa can be Ala, Ser, Thr, Val, Leu, Met, Ile, Cys, Gly, Asn, Gln, Pro, Phe, Asp, Tyr, Glu, or Arg
  misc_feature (9)..(9): Xaa can be Leu, Val, Met, Ile, Phe, Ala, Thr, Cys, Tyr, or Trp
SXSPLVLGX

SEQ ID NO: 51337 - protein, 10 aa, Artificial Sequence
  Description of Artificial Sequence: Synthetic peptide
  Seed: SSSPLVLGTL (MAGA1_HUMAN)
  misc_feature (2)..(2): Xaa can be Leu, Thr, Gln, Met, Val, Ala, Ile, Ser, Gly, Glu, Asn, Arg, Phe, His, Tyr, Cys, Pro, Asp, Lys, or Trp
  misc_feature (10)..(10): Xaa can be Tyr, Trp, Leu, Phe, Met, Lys, Val, Ile, Arg, His, Ala, Cys, Thr, or Ser
SXSPLVLGTX

SEQ ID NO: 51338 - protein, 8 aa, Artificial Sequence
  Description of Artificial Sequence: Synthetic peptide
  Seed: SSSSPLVL (MAGA1_HUMAN)
  misc_feature (2)..(2): Xaa can be Ala, Ile, Val, Ser, Thr, Gly, Gln, Leu, Met, Asn, Arg, Cys, Asp, Phe, Pro, Glu, Tyr, or Hi s
  misc_feature (8)..(8): Xaa can be Leu, Lys, Trp, Met, Tyr, Arg, Phe, Ile, Val, His, or Ala
SXSSPLVX

SEQ ID NO: 51339 - protein, 11 aa, Artificial Sequence
  Description of Artificial Sequence: Synthetic peptide
  Seed: SSSSPLVLGTL (MAGA1_HUMAN)
  misc_feature (2)..(2): Xaa can be Ala, Ser, Thr, Val, Gln, Gly, Met, Ile, Leu, Arg, Glu, Asn, Cys, Pro, Tyr, Phe, His, Lys, Asp, or Trp
  misc_feature (11)..(11): Xaa can be Trp, Phe, Tyr, Lys, Leu, Met, Arg, His, Ile, Val, or Ala
SXSSPLVLGTX

SEQ ID NO: 51340 - protein, 9 aa, Artificial Sequence
  Description of Artificial Sequence: Synthetic peptide
  Seed: STDPPQSPQ (MAGA1_HUMAN)
  misc_feature (2)..(2): Xaa can be Thr, Ala, Ile, Ser, Val, Met, Leu, Gln, Asn, Gly, Phe, Cys, Trp, Tyr, Pro, Glu, Lys, Asp, His, or Arg
  misc_feature (9)..(9): Xaa can be Lys, Phe, Arg, Leu, Val, Met, Ile, Tyr, Cys, Ala, Trp, Thr, His, Pro, Gln, Ser, Gly, Glu, or Asn
SXDPPQSPX

SEQ ID NO: 51341 - protein, 11 aa, Artificial Sequence
  Description of Artificial Sequence: Synthetic peptide
  Seed: STDPPQSPQGA (MAGA1_HUMAN)
  misc_feature (2)..(2): Xaa can be Ala, Thr, Ser, Ile, Met, Val, Leu, Gly, Cys, Phe, Asn, Gln, Tyr, Trp, Glu, Pro, Asp, Lys, His, or Arg
  misc_feature (11)..(11): Xaa can be Tyr, Met, Leu, Phe, Lys, Val, Ile, Arg, Trp, Cys, His, Ala, Thr, Gln, Glu, Ser, Pro, Asn, or Gly
SXDPPQSPQGX

SEQ ID NO: 51342 - protein, 9 aa, Artificial Sequence
  Description of Artificial Sequence: Synthetic peptide
  Seed: STSCILESL (MAGA1_HUMAN)
  misc_feature (2)..(2): Xaa can be Met, Leu, Gln, Ile, Val, Ala, Thr, Ser, Arg, Gly, Asn, Phe, Pro, Glu, Cys, Tyr, His, Trp, Asp, or Lys
  misc_feature (9)..(9): Xaa can be Trp, Leu, Tyr, Met, Phe, Lys, Val, Arg, Ile, Ala, His, Thr, Cys, Ser, Gly, or Pro
SXSCILESX

SEQ ID NO: 51343 - protein, 10 aa, Artificial Sequence
  Description of Artificial Sequence: Synthetic peptide
  Seed: STSCILESLF (MAGA1_HUMAN)
  misc_feature (2)..(2): Xaa can be Thr, Ser, Ala, Val, Met, Ile, Leu, Glu, Phe, Asn, Gln, Gly, Asp, His, Trp, Tyr, Cys, Lys, Arg, or Pro
  misc_feature (10)..(10): Xaa can be Trp, Phe, Tyr, Lys, Arg, Ile, Met, Leu, or His
SXSCILESLX

SEQ ID NO: 51344 - protein, 11 aa, Artificial Sequence
  Description of Artificial Sequence: Synthetic peptide
  Seed: STSCILESLFR (MAGA1_HUMAN)
  misc_feature (2)..(2): Xaa can be Thr, Gly, Gln, Ile, Asn, Ala, Ser, Met, Val, Leu, Phe, Cys, Trp, Tyr, Arg, Lys, Glu, Asp, or His
  misc_feature (11)..(11): Xaa can be Arg, Lys, Tyr, or His
SXSCILESLFX

SEQ ID NO: 51345 - protein, 10 aa, Artificial Sequence
  Description of Artificial Sequence: Synthetic peptide
  Seed: SVIKNYKHCF (MAGA1_HUMAN)
  misc_feature (2)..(2): Xaa can be Thr, Ser, Gln, Met, Ala, Ile, Leu, Glu, Val, Cys, Pro, Asn, Asp, or Gly
  misc_feature (10)..(10): Xaa can be Trp, Tyr, Phe, Met, or Leu
SXIKNYKHCX

SEQ ID NO: 51346 - protein, 9 aa, Artificial Sequence
  Description of Artificial Sequence: Synthetic peptide
  Seed: SVMEVYDGR (MAGA1_HUMAN)
  misc_feature (2)..(2): Xaa can be Thr, Met, Ala, Ser, Val, Leu, Ile, Gln, Gly, Phe, Tyr, Asn, Trp, Cys, Glu, Asp, Arg, Pro, His, or Lys
  misc_feature (9)..(9): Xaa can be Arg, Tyr, Lys, Phe, Met, Ile, Leu, Val, His, Trp, Ala, or Gln
SXMEVYDGX

SEQ ID NO: 51347 - protein, 10 aa, Artificial Sequence
  Description of Artificial Sequence: Synthetic peptide
  Seed: SVMEVYDGRE (MAGA1_HUMAN)
  misc_feature (2)..(2): Xaa can be Ser, Ala, Val, Thr, Ile, Asn, Met, Pro, Leu, Gly, or Phe
  misc_feature (10)..(10): Xaa can be Arg, Lys, Asp, Ala, Trp, Gly, Gln, His, Thr, Pro, Met, Asn, Ser, Cys, Glu, Tyr, Ile, Leu, Phe, or Val
SXMEVYDGRX

SEQ ID NO: 51348 - protein, 11 aa, Artificial Sequence
  Description of Artificial Sequence: Synthetic peptide
  Seed: SVMEVYDGREH (MAGA1_HUMAN)
  misc_feature (2)..(2): Xaa can be Ala, Ser, Val, Ile, Thr, Gln, Gly, Glu, Leu, Met, Asn, Cys, or Asp
  misc_feature (11)..(11): Xaa can be Tyr, Phe, His, Lys, Met, Leu, Trp, or Ile
SXMEVYDGREX

SEQ ID NO: 51349 - protein, 11 aa, Artificial Sequence
  Description of Artificial Sequence: Synthetic peptide
  Seed: SYDGLLGDNQI (MAGA1_HUMAN)
  misc_feature (2)..(2): Xaa can be Tyr, Arg, Phe, Trp, Gly, Gln, Met, His, Leu, Ala, Pro, Ile, Val, Ser, Cys, Glu, or Thr
  misc_feature (11)..(11): Xaa can be Leu, Phe, Met, Val, Lys, Trp, Tyr, Ile, Cys, or Arg
SXDGLLGDNQX

SEQ ID NO: 51350 - protein, 8 aa, Artificial Sequence
  Description of Artificial Sequence: Synthetic peptide
  Seed: SYVKVLEY (MAGA1_HUMAN)
  misc_feature (2)..(2): Xaa can be Arg, Gln, Tyr, Phe, Ala, Trp, His, Glu, Met, Lys, Ser, Pro, Ile, Gly, Thr, Asn, Leu, Val, Asp, or Cys
  misc_feature (8)..(8): Xaa can be Tyr, Phe, Leu, Met, Val, Ile, His, Trp, Lys, or Arg
SXVKVLEX

SEQ ID NO: 51351 - protein, 9 aa, Artificial Sequence
  Description of Artificial Sequence: Synthetic peptide
  Seed: SYVKVLEYV (MAGA1_HUMAN)
  misc_feature (2)..(2): Xaa can be Met, Leu, Arg, Gln, Tyr, Val, Ile, Ser, Ala, Thr, Gly, His, Trp, Phe, Asn, Glu, Lys, Asp, Cys, or Pro
  misc_feature (9)..(9): Xaa can be Leu, Val, Met, Phe, Ile, Tyr, Ala, Trp, Thr, Cys, Ser, Lys, Gly, Arg, His, or Pro
SXVKVLEYX

SEQ ID NO: 51352 - protein, 10 aa, Artificial Sequence
  Description of Artificial Sequence: Synthetic peptide
  Seed: SYVKVLEYVI (MAGA1_HUMAN)
  misc_feature (2)..(2): Xaa can be Tyr, Trp, Phe, or Met
  misc_feature (10)..(10): Xaa can be Phe, Trp, Ile, Met, Leu, Val, or Tyr
SXVKVLEYVX

SEQ ID NO: 51353 - protein, 11 aa, Artificial Sequence
  Description of Artificial Sequence: Synthetic peptide
  Seed: SYVKVLEYVIK (MAGA1_HUMAN)
  misc_feature (2)..(2): Xaa can be Met, Tyr, Phe, Trp, Ala, Val, Ser, Gln, Leu, Thr, or Ile
  misc_feature (11)..(11): Xaa can be Arg, or Lys
SXVKVLEYVIX

SEQ ID NO: 51354 - protein, 8 aa, Artificial Sequence
  Description of Artificial Sequence: Synthetic peptide
  Seed: SYVLVTCL (MAGA1_HUMAN)
  misc_feature (2)..(2): Xaa can be Tyr, or Phe
  misc_feature (8)..(8): Xaa can be Met, Leu, Phe, Tyr, Trp, or Ile
SXVLVTCX

SEQ ID NO: 51355 - protein, 10 aa, Artificial Sequence
  Description of Artificial Sequence: Synthetic peptide
  Seed: SYVLVTCLGL (MAGA1_HUMAN)
  misc_feature (2)..(2): Xaa can be Tyr, Trp, or Phe
  misc_feature (10)..(10): Xaa can be Trp, Phe, Ile, Leu, Met, Val, or Tyr
SXVLVTCLGX

SEQ ID NO: 51356 - protein, 8 aa, Artificial Sequence
  Description of Artificial Sequence: Synthetic peptide
  Seed: TGFLIIVL (MAGA1_HUMAN)
  misc_feature (2)..(2): Xaa can be Gln, Pro, Ser, Ala, Thr, Glu, Gly, Asp, Lys, Met, Leu, Asn, Val, His, Ile, Arg, or Phe
  misc_feature (8)..(8): Xaa can be Val, Ile, Leu, Met, Phe, Tyr, Ala, Cys, or Thr
TXFLIIVX

SEQ ID NO: 51357 - protein, 9 aa, Artificial Sequence
  Description of Artificial Sequence: Synthetic peptide
  Seed: TGFLIIVLV (MAGA1_HUMAN)
  misc_feature (2)..(2): Xaa can be Leu, Ala, Pro, Gln, Thr, Met, Ser, Val, Glu, Ile, Asn, Gly, His, Asp, Lys, Cys, or Phe
  misc_feature (9)..(9): Xaa can be Val, Leu, Ile, Met, Ala, Thr, Phe, Cys, or Ser
TXFLIIVLX

SEQ ID NO: 51358 - protein, 8 aa, Artificial Sequence
  Description of Artificial Sequence: Synthetic peptide
  Seed: TGHSYVLV (MAGA1_HUMAN)
  misc_feature (2)..(2): Xaa can be Gln, Glu, Ser, Ala, Gly, or Met
  misc_feature (8)..(8): Xaa can be Val, Ile, Leu, Met, or Phe
TXHSYVLX

SEQ ID NO: 51359 - protein, 9 aa, Artificial Sequence
  Description of Artificial Sequence: Synthetic peptide
  Seed: TKAEMLESV (MAGA1_HUMAN)
  misc_feature (2)..(2): Xaa can be Arg, His, Gln, Met, Ile, Leu, Ala, Val, Thr, Asn, Ser, Tyr, Lys, Gly, Asp, Glu, Phe, Pro, Trp, or Cys
  misc_feature (9)..(9): Xaa can be Leu, Ile, Met, Val, Phe, Lys, Ala, Tyr, Thr, Arg, Cys, Ser, Pro, Gly, or Trp
TXAEMLESX

SEQ ID NO: 51360 - protein, 10 aa, Artificial Sequence
  Description of Artificial Sequence: Synthetic peptide
  Seed: TKKVADLVGF (MAGA1_HUMAN)
  misc_feature (2)..(2): Xaa can be Gln, Met, His, Glu, Tyr, Lys, Ile, Phe, Ser, Arg, Leu, Ala, Val, Thr, Gly, or Trp
  misc_feature (10)..(10): Xaa can be Tyr, Phe, or Met
TXKVADLVGX

SEQ ID NO: 51361 - protein, 11 aa, Artificial Sequence
  Description of Artificial Sequence: Synthetic peptide
  Seed: TKKVADLVGFL (MAGA1_HUMAN)
  misc_feature (2)..(2): Xaa can be Thr, Ser, Gly, Tyr, His, Pro, Val, Asp, Lys, Met, Phe, Ala, Asn, Ile, Gln, Trp, Glu, Arg, Cys, or Leu
  misc_feature (11)..(11): Xaa can be Val, Ile, Leu, or Ala
TXKVADLVGFX

SEQ ID NO: 51362 - protein, 8 aa, Artificial Sequence
  Description of Artificial Sequence: Synthetic peptide
  Seed: TQDLVQEK (MAGA1_HUMAN)
  misc_feature (2)..(2): Xaa can be Thr, Ala, Ser, Val, Phe, Tyr, Met, Ile, Leu, Gly, Trp, Gln, Cys, Asn, Asp, Glu, His, or Pr o
  misc_feature (8)..(8): Xaa can be Lys, Tyr, Arg, Leu, Met, Phe, Ile, His, Val, or Trp
TXDLVQEX

SEQ ID NO: 51363 - protein, 9 aa, Artificial Sequence
  Description of Artificial Sequence: Synthetic peptide
  Seed: TQDLVQEKY (MAGA1_HUMAN)
  misc_feature (2)..(2): Xaa can be Val, Ile, Ala, Thr, Ser, Leu, Met, Glu, Gly, Phe, Gln, Pro, Tyr, Cys, Asn, Arg, Asp, Trp, His, or Lys
  misc_feature (9)..(9): Xaa can be Tyr, Phe, Leu, Met, Lys, Val, Ile, Trp, Arg, Ala, Cys, His, Thr, Gln, or Ser
TXDLVQEKX

SEQ ID NO: 51364 - protein, 10 aa, Artificial Sequence
  Description of Artificial Sequence: Synthetic peptide
  Seed: TQDLVQEKYL (MAGA1_HUMAN)
  misc_feature (2)..(2): Xaa can be Glu, Met, His, Ala, Thr, Val, Ile, Ser, Leu, Gln, Phe, Gly, Cys, Asn, or Tyr
  misc_feature (10)..(10): Xaa can be Leu, Met, Phe, Ile, Val, Trp, Ala, or Cys
TXDLVQEKYX

SEQ ID NO: 51365 - protein, 8 aa, Artificial Sequence
  Description of Artificial Sequence: Synthetic peptide
  Seed: TSCILESL (MAGA1_HUMAN)
  misc_feature (2)..(2): Xaa can be Ser, Ala, Gln, Met, Glu, Gly, Val, Thr, or Leu
  misc_feature (8)..(8): Xaa can be Ile, Leu, Val, Phe, Met, or Tyr
TXCILESX

SEQ ID NO: 51366 - protein, 9 aa, Artificial Sequence
  Description of Artificial Sequence: Synthetic peptide
  Seed: TSCILESLF (MAGA1_HUMAN)
  misc_feature (2)..(2): Xaa can be Ala, Ser, Thr, Gln, Val, Met, Gly, Ile, Phe, Pro, Asn, Cys, Glu, Leu, Tyr, His, Arg, Asp, Lys, or Trp
  misc_feature (9)..(9): Xaa can be Trp, Tyr, Phe, Lys, Met, Leu, Val, Ile, His, or Arg
TXCILESLX

SEQ ID NO: 51367 - protein, 10 aa, Artificial Sequence
  Description of Artificial Sequence: Synthetic peptide
  Seed: TSCILESLFR (MAGA1_HUMAN)
  misc_feature (2)..(2): Xaa can be Thr, Phe, Ser, Gln, Ile, Met, Gly, Leu, Val, Asn, Ala, Glu, Tyr, Cys, Trp, Asp, His, or Pr o
  misc_feature (10)..(10): Xaa can be Lys, Arg, Tyr, or Phe
TXCILESLFX

SEQ ID NO: 51368 - protein, 9 aa, Artificial Sequence
  Description of Artificial Sequence: Synthetic peptide
  Seed: TSSSSPLVL (MAGA1_HUMAN)
  misc_feature (2)..(2): Xaa can be Ala, Gln, Glu, Tyr, Ser, Pro, Arg, Thr, Ile, Met, Val, Asp, Phe, Leu, Gly, Asn, Cys, Trp, Lys, or His
  misc_feature (9)..(9): Xaa can be Phe, Tyr, Leu, Ile, Met, Val, Trp, Lys, Arg, His, Ala, Cys, Pro, Thr, Ser, Gly, or Gln
TXSSSPLVX

SEQ ID NO: 51369 - protein, 9 aa, Artificial Sequence
  Description of Artificial Sequence: Synthetic peptide
  Seed: TSYVKVLEY (MAGA1_HUMAN)
  misc_feature (2)..(2): Xaa can be Arg, Tyr, Ala, Gln, Pro, Ser, Thr, Val, Phe, Trp, Gly, Met, Leu, His, Glu, Ile, Asn, Cys, Lys, or Asp
  misc_feature (9)..(9): Xaa can be Phe, Tyr, Ile, Trp, Val, Leu, Met, Lys, Arg, His, Ala, Cys, Thr, Gln, Ser, Gly, Asn, or Pr o
TXYVKVLEX

SEQ ID NO: 51370 - protein, 10 aa, Artificial Sequence
  Description of Artificial Sequence: Synthetic peptide
  Seed: TSYVKVLEYV (MAGA1_HUMAN)
  misc_feature (2)..(2): Xaa can be Met, Leu, Thr, Ser, Ala, Tyr, Ile, Gln, Val, Asn, Trp, Asp, His, Arg, Pro, Gly, Phe, Lys, Cys, or Glu
  misc_feature (10)..(10): Xaa can be Met, Leu, Trp, Val, Ile, Phe, Ala, Tyr, Thr, or Ser
TXYVKVLEYX

SEQ ID NO: 51371 - protein, 9 aa, Artificial Sequence
  Description of Artificial Sequence: Synthetic peptide
  Seed: TTINFTRQR (MAGA1_HUMAN)
  misc_feature (2)..(2): Xaa can be Ala, Val, Ser, Met, Ile, Thr, Leu, Phe, Gly, Tyr, Asn, Gln, Cys, Trp, Pro, Asp, Glu, Lys, His, or Arg
  misc_feature (9)..(9): Xaa can be Arg, Lys, Leu, Tyr, Phe, Met, Val, Ile, Trp, His, Ala, or Cys
TXINFTRQX

SEQ ID NO: 51372 - protein, 10 aa, Artificial Sequence
  Description of Artificial Sequence: Synthetic peptide
  Seed: TTINFTRQRQ (MAGA1_HUMAN)
  misc_feature (2)..(2): Xaa can be Val, Thr, Ile, Leu, Met, Phe, Ala, Ser, Asn, Gly, Tyr, Arg, Asp, Trp, Cys, Gln, His, Glu, Pro, or Lys
  misc_feature (10)..(10): Xaa can be Arg, Lys, Tyr, Thr, Pro, Gln, His, Cys, Ile, Asn, Met, Glu, Asp, Ser, Phe, Trp, Gly, Val, Ala, or Leu
TXINFTRQRX

SEQ ID NO: 51373 - protein, 8 aa, Artificial Sequence
  Description of Artificial Sequence: Synthetic peptide
  Seed: VADLVGFL (MAGA1_HUMAN)
  misc_feature (2)..(2): Xaa can be Ala, Ser, Gly, Ile, Val, Gln, Asn, Leu, Thr, Tyr, Phe, Cys, Trp, Met, Pro, His, Asp, Arg, or Glu
  misc_feature (8)..(8): Xaa can be Leu, Met, Phe, Ile, Val, Lys, Arg, Tyr, or Trp
VXDLVGFX

SEQ ID NO: 51374 - protein, 9 aa, Artificial Sequence
  Description of Artificial Sequence: Synthetic peptide
  Seed: VADLVGFLL (MAGA1_HUMAN)
  misc_feature (2)..(2): Xaa can be Thr, Ser, Ala, Val, Leu, Tyr, Met, Phe, Ile, Trp, Pro, Gly, Glu, Gln, Cys, Arg, Asn, Asp, His, or Lys
  misc_feature (9)..(9): Xaa can be Trp, Lys, Tyr, Met, Leu, Val, Phe, Ile, Arg, His, Ala, Cys, Thr, Gln, Ser, Asn, Glu, Gly, or Pro
VXDLVGFLX

SEQ ID NO: 51375 - protein, 10 aa, Artificial Sequence
  Description of Artificial Sequence: Synthetic peptide
  Seed: VADLVGFLLL (MAGA1_HUMAN)
  misc_feature (2)..(2): Xaa can be Ala, Thr, Ser, Val, Leu, Gly, Ile, Tyr, Met, Cys, Trp, Phe, Gln, Pro, Asn, Arg, Asp, or Gl u
  misc_feature (10)..(10): Xaa can be Leu, Met, Trp, Lys, Phe, Ile, Val, Arg, Tyr, or Cys
VXDLVGFLLX

SEQ ID NO: 51376 - protein, 11 aa, Artificial Sequence
  Description of Artificial Sequence: Synthetic peptide
  Seed: VADLVGFLLLK (MAGA1_HUMAN)
  misc_feature (2)..(2): Xaa can be Thr, Ser, Val, Met, Ala, Asn, Asp, Gly, Gln, Cys, Phe, Glu, Leu, Ile, His, Arg, Trp, Tyr, Pro, or Lys
  misc_feature (11)..(11): Xaa can be Lys, Tyr, His, Arg, Phe, or Trp
VXDLVGFLLLX

SEQ ID NO: 51377 - protein, 8 aa, Artificial Sequence
  Description of Artificial Sequence: Synthetic peptide
  Seed: VGFLLLKY (MAGA1_HUMAN)
  misc_feature (2)..(2): Xaa can be Ala, Gln, Ser, Thr, Met, Asn, Val, Leu, Lys, Arg, Glu, Ile, or Gly
  misc_feature (8)..(8): Xaa can be Tyr, Phe, Leu, Met, Ile, or Val
VXFLLLKX

SEQ ID NO: 51378 - protein, 9 aa, Artificial Sequence
  Description of Artificial Sequence: Synthetic peptide
  Seed: VGFLLLKYR (MAGA1_HUMAN)
  misc_feature (2)..(2): Xaa can be Met, Leu, Thr, Ser, Val, Asn, Phe, Trp, Tyr, Ala, Ile, Gly, Gln, Glu, Pro, Cys, His, or As p
  misc_feature (9)..(9): Xaa can be Arg, Lys, Val, Met, Leu, Tyr, or Ile
VXFLLLKYX

SEQ ID NO: 51379 - protein, 11 aa, Artificial Sequence
  Description of Artificial Sequence: Synthetic peptide
  Seed: VGFLLLKYRAR (MAGA1_HUMAN)
  misc_feature (2)..(2): Xaa can be Tyr, Arg, Trp, Ser, Met, Phe, Ala, His, Asn, Val, Gly, Ile, Lys, Thr, Gln, or Leu
  misc_feature (11)..(11): Xaa can be Arg, or Lys
VXFLLLKYRAX

SEQ ID NO: 51380 - protein, 9 aa, Artificial Sequence
  Description of Artificial Sequence: Synthetic peptide
  Seed: VIKNYKHCF (MAGA1_HUMAN)
  misc_feature (2)..(2): Xaa can be Ala, Ser, Tyr, Gln, Thr, Phe, Met, Val, Trp, Ile, Gly, Leu, Lys, Cys, Asn, Pro, Glu, His, Arg, or Asp
  misc_feature (9)..(9): Xaa can be Tyr, Phe, Trp, Met, Leu, Ile, Val, His, or Ala
VXKNYKHCX

SEQ ID NO: 51381 - protein, 9 aa, Artificial Sequence
  Description of Artificial Sequence: Synthetic peptide
  Seed: VIKVSARVR (MAGA1_HUMAN)
  misc_feature (2)..(2): Xaa can be Met, Thr, Ile, Leu, Ser, Val, Tyr, Gln, Trp, Pro, Ala, Gly, Asn, Asp, or Phe
  misc_feature (9)..(9): Xaa can be Arg, or Lys
VXKVSARVX

SEQ ID NO: 51382 - protein, 10 aa, Artificial Sequence
  Description of Artificial Sequence: Synthetic peptide
  Seed: VIKVSARVRF (MAGA1_HUMAN)
  misc_feature (2)..(2): Xaa can be Gln, Met, Tyr, Phe, Arg, Gly, Leu, Ala, Asn, His, Lys, Cys, Val, Glu, Asp, Thr, Trp, Pro, Ser, or Ile
  misc_feature (10)..(10): Xaa can be Phe, Tyr, Met, or Leu
VXKVSARVRX

SEQ ID NO: 51383 - protein, 9 aa, Artificial Sequence
  Description of Artificial Sequence: Synthetic peptide
  Seed: VITKKVADL (MAGA1_HUMAN)
  misc_feature (2)..(2): Xaa can be Ala, Arg, Ser, Val, Met, Gln, Thr, Leu, Phe, Pro, Ile, Gly, Tyr, Cys, Asn, Glu, Asp, His, or Trp
  misc_feature (9)..(9): Xaa can be Leu, Met, Tyr, Phe, Ile, Val, His, Trp, Lys, or Arg
VXTKKVADX

SEQ ID NO: 51384 - protein, 11 aa, Artificial Sequence
  Description of Artificial Sequence: Synthetic peptide
  Seed: VKEADPTGHSY (MAGA1_HUMAN)
  misc_feature (2)..(2): Xaa can be Gln, Met, Leu, Ala, Lys, Ser, Phe, Val, Arg, Thr, Ile, Glu, Pro, Tyr, Gly, Trp, or His
  misc_feature (11)..(11): Xaa can be Tyr, Phe, Trp, Met, or Leu
VXEADPTGHSX

SEQ ID NO: 51385 - protein, 10 aa, Artificial Sequence
  Description of Artificial Sequence: Synthetic peptide
  Seed: VKVLEYVIKV (MAGA1_HUMAN)
  misc_feature (2)..(2): Xaa can be Leu, Met, Gln, Ile, Phe, Tyr, Arg, Ala, Asp, Cys, Lys, Glu, Asn, Pro, Thr, Gly, Ser, His, Trp, or Val
  misc_feature (10)..(10): Xaa can be Val, Ile, Leu, Ala, Met, Thr, Cys, or Ser
VXVLEYVIKX

SEQ ID NO: 51386 - protein, 8 aa, Artificial Sequence
  Description of Artificial Sequence: Synthetic peptide
  Seed: VLEYVIKV (MAGA1_HUMAN)
  misc_feature (2)..(2): Xaa can be Met, or Leu
  misc_feature (8)..(8): Xaa can be Leu, Val, or Ile
VXEYVIKX

SEQ ID NO: 51387 - protein, 10 aa, Artificial Sequence
  Description of Artificial Sequence: Synthetic peptide
  Seed: VLEYVIKVSA (MAGA1_HUMAN)
  misc_feature (2)..(2): Xaa can be Glu, Lys, Tyr, Val, Ser, His, Ile, Asn, Met, Pro, Ala, Arg, Gln, Leu, Thr, Phe, Cys, Asp, Trp, or Gly
  misc_feature (10)..(10): Xaa can be Ala, or Val
VXEYVIKVSX

SEQ ID NO: 51388 - protein, 8 aa, Artificial Sequence
  Description of Artificial Sequence: Synthetic peptide
  Seed: VLGTLEEV (MAGA1_HUMAN)
  misc_feature (2)..(2): Xaa can be Gln, Leu, Glu, Gly, Met, Ser, Ala, Val, or Ile
  misc_feature (8)..(8): Xaa can be Ile, Val, Leu, Phe, or Met
VXGTLEEX

SEQ ID NO: 51389 - protein, 11 aa, Artificial Sequence
  Description of Artificial Sequence: Synthetic peptide
  Seed: VLGTLEEVPTA (MAGA1_HUMAN)
  misc_feature (2)..(2): Xaa can be Leu, Met, Tyr, Ile, Phe, Val, or Gln
  misc_feature (11)..(11): Xaa can be Val, Ala, Leu, Ile, or Met
VXGTLEEVPTX

SEQ ID NO: 51390 - protein, 10 aa, Artificial Sequence
  Description of Artificial Sequence: Synthetic peptide
  Seed: VLVTCLGLSY (MAGA1_HUMAN)
  misc_feature (2)..(2): Xaa can be Gln, Met, Ala, Ser, Thr, Val, Ile, Leu, Lys, His, Phe, Tyr, Gly, Pro, Trp, Arg, Asp, Asn, Glu, or Cys
  misc_feature (10)..(10): Xaa can be Phe, Tyr, Met, Lys, Arg, Leu, His, Ile, Trp, Val, or Ala
VXVTCLGLSX

SEQ ID NO: 51391 - protein, 10 aa, Artificial Sequence
  Description of Artificial Sequence: Synthetic peptide
  Seed: VMIAMEGGHA (MAGA1_HUMAN)
  misc_feature (2)..(2): Xaa can be Met, Leu, Ile, Val, Thr, or Gln
  misc_feature (10)..(10): Xaa can be Val, Ile, Leu, or Ala
VXIAMEGGHX

SEQ ID NO: 51392 - protein, 9 aa, Artificial Sequence
  Description of Artificial Sequence: Synthetic peptide
  Seed: VPDSDPARY (MAGA1_HUMAN)
  misc_feature (2)..(2): Xaa can be Thr, Ser, Ile, Pro, Val, Leu, Ala, Met, Phe, Tyr, Gln, Gly, Trp, Glu, Asp, Asn, Cys, Lys, or His
  misc_feature (9)..(9): Xaa can be Tyr, Lys, Arg, Phe, Met, Leu, Trp, His, Val, Gln, Ile, or Ala
VXDSDPARX

SEQ ID NO: 51393 - protein, 11 aa, Artificial Sequence
  Description of Artificial Sequence: Synthetic peptide
  Seed: VPDSDPARYEF (MAGA1_HUMAN)
  misc_feature (2)..(2): Xaa can be Pro, Thr, Ser, Ala, Val, Ile, Met, Leu, Cys, Gln, Phe, Gly, Asn, Trp, Tyr, Glu, Lys, or As p
  misc_feature (11)..(11): Xaa can be Trp, Phe, Leu, Met, Ile, Tyr, Val, Cys, Ala, Thr, or His
VXDSDPARYEX

SEQ ID NO: 51394 - protein, 9 aa, Artificial Sequence
  Description of Artificial Sequence: Synthetic peptide
  Seed: VPTAGSTDP (MAGA1_HUMAN)
  misc_feature (2)..(2): Xaa can be , or Pro
  misc_feature (9)..(9): Xaa can be Cys, Val, Ala, Ser, Leu, Pro, Ile, Phe, Thr, or Met
VXTAGSTDX

SEQ ID NO: 51395 - protein, 10 aa, Artificial Sequence
  Description of Artificial Sequence: Synthetic peptide
  Seed: VPTAGSTDPP (MAGA1_HUMAN)
  misc_feature (2)..(2): Xaa can be , or Pro
  misc_feature (10)..(10): Xaa can be Ala, Thr, Pro, Leu, Ile, Phe, Cys, Met, Ser, or Val
VXTAGSTDPX

SEQ ID NO: 51396 - protein, 9 aa, Artificial Sequence
  Description of Artificial Sequence: Synthetic peptide
  Seed: VQAATSSSS (MAGA1_HUMAN)
  misc_feature (2)..(2): Xaa can be Gln, Met, Lys, His, Ala, Leu, Glu, Arg, Ser, Val, Phe, Ile, Tyr, Asn, Thr, Gly, Trp, Cys, or Pro
  misc_feature (9)..(9): Xaa can be Phe, Tyr, Met, Leu, Trp, Ile, His, Val, Ala, Ser, Thr, Cys, Gly, Gln, or Asn
VXAATSSSX

SEQ ID NO: 51397 - protein, 11 aa, Artificial Sequence
  Description of Artificial Sequence: Synthetic peptide
  Seed: VQAATSSSSPL (MAGA1_HUMAN)
  misc_feature (2)..(2): Xaa can be Gln, Met, Lys, Val, Arg, His, Leu, Ile, Glu, Ala, Pro, Thr, Asn, Ser, Phe, Tyr, Gly, Trp, Cys, or Asp
  misc_feature (11)..(11): Xaa can be Tyr, Phe, Met, Leu, Trp, or Ile
VXAATSSSSPX

SEQ ID NO: 51398 - protein, 8 aa, Artificial Sequence
  Description of Artificial Sequence: Synthetic peptide
  Seed: VQEKYLEY (MAGA1_HUMAN)
  misc_feature (2)..(2): Xaa can be Ser, Thr, Ala, Ile, Leu, Met, Gln, Gly, Val, Asp, Asn, Pro, Cys, Glu, Arg, Phe, Trp, or Ty r
  misc_feature (8)..(8): Xaa can be Tyr, Lys, Phe, Arg, Leu, Met, or His
VXEKYLEX

SEQ ID NO: 51399 - protein, 9 aa, Artificial Sequence
  Description of Artificial Sequence: Synthetic peptide
  Seed: VQEKYLEYR (MAGA1_HUMAN)
  misc_feature (2)..(2): Xaa can be Thr, Met, Leu, Ser, Ala, Val, Ile, Gln, Asn, Phe, Glu, Gly, Asp, Trp, Tyr, Pro, His, or Cy s
  misc_feature (9)..(9): Xaa can be Tyr, Arg, Lys, Phe, His, Met, Leu, Val, or Trp
VXEKYLEYX

SEQ ID NO: 51400 - protein, 8 aa, Artificial Sequence
  Description of Artificial Sequence: Synthetic peptide
  Seed: VRFFFPSL (MAGA1_HUMAN)
  misc_feature (2)..(2): Xaa can be His, Gln, Arg, Ala, Glu, Gly, Ser, Asp, Tyr, Asn, Val, Met, Lys, Pro, Leu, Thr, Ile, or Ph e
  misc_feature (8)..(8): Xaa can be Leu, Val, Ile, Met, Phe, Tyr, Ala, Cys, Thr, or Pro
VXFFFPSX

SEQ ID NO: 51401 - protein, 9 aa, Artificial Sequence
  Description of Artificial Sequence: Synthetic peptide
  Seed: VRFFFPSLR (MAGA1_HUMAN)
  misc_feature (2)..(2): Xaa can be Arg, Tyr, Phe, Ser, Trp, Met, Lys, Gln, Gly, Ala, Thr, His, Asn, Leu, Val, Ile, Glu, Cys, Asp, or Pro
  misc_feature (9)..(9): Xaa can be Arg, Lys, Tyr, Phe, Leu, Met, His, Ile, Val, Trp, Gly, Ala, Gln, or Cys
VXFFFPSLX

SEQ ID NO: 51402 - protein, 10 aa, Artificial Sequence
  Description of Artificial Sequence: Synthetic peptide
  Seed: VRFFFPSLRE (MAGA1_HUMAN)
  misc_feature (2)..(2): Xaa can be , or Arg
  misc_feature (10)..(10): Xaa can be Phe, His, Pro, Glu, Leu, Ala, Gln, Trp, Val, Arg, Lys, Cys, Asn, Tyr, Ser, Gly, Met, Thr, or Ile
VXFFFPSLRX

SEQ ID NO: 51403 - protein, 8 aa, Artificial Sequence
  Description of Artificial Sequence: Synthetic peptide
  Seed: VSARVRFF (MAGA1_HUMAN)
  misc_feature (2)..(2): Xaa can be Ala, Ser, Thr, Val, Gly, Ile, Pro, Glu, Phe, Asn, Asp, Cys, Met, Trp, Gln, or Leu
  misc_feature (8)..(8): Xaa can be Trp, Leu, Phe, Ile, Tyr, Met, or Val
VXARVRFX

SEQ ID NO: 51404 - protein, 9 aa, Artificial Sequence
  Description of Artificial Sequence: Synthetic peptide
  Seed: VSARVRFFF (MAGA1_HUMAN)
  misc_feature (2)..(2): Xaa can be Tyr, Ser, Thr, Gln, Met, Phe, Trp, Ala, Val, Ile, Leu, Lys, Gly, Glu, His, Cys, Asn, Pro, Arg, or Asp
  misc_feature (9)..(9): Xaa can be Trp, Tyr, Phe, Met, Leu, Ile, Val, His, Cys, Gly, or Ala
VXARVRFFX

SEQ ID NO: 51405 - protein, 8 aa, Artificial Sequence
  Description of Artificial Sequence: Synthetic peptide
  Seed: VTCLGLSY (MAGA1_HUMAN)
  misc_feature (2)..(2): Xaa can be Ala, Ser, Thr, Val, Ile, Met, Gly, Gln, Leu, Pro, Glu, Asn, Phe, Lys, Trp, Arg, Tyr, His, or Cys
  misc_feature (8)..(8): Xaa can be Tyr, Trp, Phe, Leu, Met, Ile, Val, or His
VXCLGLSX

SEQ ID NO: 51406 - protein, 10 aa, Artificial Sequence
  Description of Artificial Sequence: Synthetic peptide
  Seed: VTKAEMLESV (MAGA1_HUMAN)
  misc_feature (2)..(2): Xaa can be Leu, Met, Val, Gln, Ile, Thr, Ser, or Ala
  misc_feature (10)..(10): Xaa can be Val, Leu, Ile, Met, Ala, Thr, or Ser
VXKAEMLESX

SEQ ID NO: 51407 - protein, 9 aa, Artificial Sequence
  Description of Artificial Sequence: Synthetic peptide
  Seed: VYDGREHSA (MAGA1_HUMAN)
  misc_feature (2)..(2): Xaa can be Tyr, Phe, Ala, Trp, Arg, Ser, Ile, Gln, Val, Thr, Gly, Met, Leu, Cys, His, Asn, Asp, Pro, Lys, or Glu
  misc_feature (9)..(9): Xaa can be Met, Leu, Ile, Val, Tyr, Phe, Cys, Trp, Ala, Thr, Ser, Lys, Arg, His, Gln, Pro, Gly, or Gl u
VXDGREHSX

SEQ ID NO: 51408 - protein, 10 aa, Artificial Sequence
  Description of Artificial Sequence: Synthetic peptide
  Seed: VYDGREHSAY (MAGA1_HUMAN)
  misc_feature (2)..(2): Xaa can be Thr, Tyr, Trp, Ala, Ser, Met, Phe, Gln, Val, Ile, Leu, Arg, Gly, Cys, Glu, His, Asn, Pro, Lys, or Asp
  misc_feature (10)..(10): Xaa can be Tyr, Leu, Met, Phe, Lys, Trp, Ile, Arg, Val, His, Cys, or Gln
VXDGREHSAX

SEQ ID NO: 51409 - protein, 9 aa, Artificial Sequence
  Description of Artificial Sequence: Synthetic peptide
  Seed: WEELSVMEV (MAGA1_HUMAN)
  misc_feature (2)..(2): Xaa can be Glu, Gln, or Asp
  misc_feature (9)..(9): Xaa can be Leu, Ala, Ile, Met, Phe, Val, Ser, Tyr, Thr, Gly, Trp, Pro, or Cys
WXELSVMEX

SEQ ID NO: 51410 - protein, 10 aa, Artificial Sequence
  Description of Artificial Sequence: Synthetic peptide
  Seed: WEELSVMEVY (MAGA1_HUMAN)
  misc_feature (2)..(2): Xaa can be Gln, Leu, Cys, Ser, Glu, Lys, Thr, Ile, Arg, Met, Asn, Tyr, Ala, Asp, Gly, Pro, Trp, Val, His, or Phe
  misc_feature (10)..(10): Xaa can be Met, Trp, Tyr, Phe, or Leu
WXELSVMEVX

SEQ ID NO: 51411 - protein, 8 aa, Artificial Sequence
  Description of Artificial Sequence: Synthetic peptide
  Seed: YDGREHSA (MAGA1_HUMAN)
  misc_feature (2)..(2): Xaa can be Glu, or Asp
  misc_feature (8)..(8): Xaa can be Ala, Leu, Val, Thr, Met, Ile, Phe, Cys, or Pro
YXGREHSX

SEQ ID NO: 51412 - protein, 9 aa, Artificial Sequence
  Description of Artificial Sequence: Synthetic peptide
  Seed: YDGREHSAY (MAGA1_HUMAN)
  misc_feature (2)..(2): Xaa can be Ala, Ser, Val, Gln, Met, Glu, Thr, Ile, Gly, Lys, Leu, Cys, Asp, Pro, Arg, Phe, Trp, Asn, Tyr, or His
  misc_feature (9)..(9): Xaa can be Phe, Tyr, Met, Leu, His, Ile, Trp, Lys, Val, or Ala
YXGREHSAX

SEQ ID NO: 51413 - protein, 8 aa, Artificial Sequence
  Description of Artificial Sequence: Synthetic peptide
  Seed: YEFLWGPR (MAGA1_HUMAN)
  misc_feature (2)..(2): Xaa can be Glu, Asp, or Gln
  misc_feature (8)..(8): Xaa can be Tyr, Phe, Met, Leu, Lys, Glu, Gln, Arg, Ala, Trp, Thr, Pro, Val, Ser, Ile, His, Cys, or As n
YXFLWGPX

SEQ ID NO: 51414 - protein, 9 aa, Artificial Sequence
  Description of Artificial Sequence: Synthetic peptide
  Seed: YEFLWGPRA (MAGA1_HUMAN)
  misc_feature (2)..(2): Xaa can be Glu, His, Asp, Gln, Pro, Arg, or Lys
  misc_feature (9)..(9): Xaa can be Ala, Ile, Leu, Val, Phe, Cys, Tyr, Thr, Met, Pro, Ser, Gly, Trp, or His
YXFLWGPRX

SEQ ID NO: 51415 - protein, 10 aa, Artificial Sequence
  Description of Artificial Sequence: Synthetic peptide
  Seed: YEFLWGPRAL (MAGA1_HUMAN)
  misc_feature (2)..(2): Xaa can be Glu, Gln, Tyr, Phe, His, Trp, Lys, Met, Ala, Leu, Ser, Asp, Gly, Val, Cys, Arg, Ile, Pro, Thr, or Asn
  misc_feature (10)..(10): Xaa can be Val, Met, Ile, Tyr, Trp, Phe, Leu, His, Ala, Thr, Ser, Cys, Gly, Asn, Pro, or Gln
YXFLWGPRAX

SEQ ID NO: 51416 - protein, 11 aa, Artificial Sequence
  Description of Artificial Sequence: Synthetic peptide
  Seed: YEFLWGPRALA (MAGA1_HUMAN)
  misc_feature (2)..(2): Xaa can be Leu, Met, Glu, Thr, Arg, Tyr, Lys, Cys, Phe, His, Pro, Asp, Trp, Gln, Ala, Gly, Ile, Val, Asn, or Ser
  misc_feature (11)..(11): Xaa can be Ala, Met, Thr, Ile, Leu, Val, Tyr, Asp, Trp, Lys, Ser, His, Cys, Glu, Pro, Phe, Gln, Gly, Arg, or Asn
YXFLWGPRALX

SEQ ID NO: 51417 - protein, 8 aa, Artificial Sequence
  Description of Artificial Sequence: Synthetic peptide
  Seed: YGEPRKLL (MAGA1_HUMAN)
  misc_feature (2)..(2): Xaa can be Ala, Ser, Thr, His, Val, Phe, Gln, Trp, Tyr, Gly, Arg, Asn, Asp, Ile, Met, Glu, Leu, Cys, Lys, or Pro
  misc_feature (8)..(8): Xaa can be Leu, Phe, Met, Ile, Tyr, Val, or Trp
YXEPRKLX

SEQ ID NO: 51418 - protein, 8 aa, Artificial Sequence
  Description of Artificial Sequence: Synthetic peptide
  Seed: YKHCFPEI (MAGA1_HUMAN)
  misc_feature (2)..(2): Xaa can be Gln, Ala, Glu, Met, Ser, Gly, Pro, Asp, His, Val, Lys, Phe, Leu, Ile, Asn, or Thr
  misc_feature (8)..(8): Xaa can be Leu, Val, Ile, Met, Phe, Cys, Ala, or Thr
YXHCFPEX

SEQ ID NO: 51419 - protein, 9 aa, Artificial Sequence
  Description of Artificial Sequence: Synthetic peptide
  Seed: YKHCFPEIF (MAGA1_HUMAN)
  misc_feature (2)..(2): Xaa can be Arg, His, Gln, Met, Tyr, Pro, Ala, Lys, Ile, Leu, Val, Phe, Glu, Ser, Thr, Asn, Gly, Trp, Asp, or Cys
  misc_feature (9)..(9): Xaa can be Leu, Met, Phe, Tyr, Ile, Val, Trp, His, Ala, Cys, Gly, Thr, Arg, or Lys
YXHCFPEIX

SEQ ID NO: 51420 - protein, 9 aa, Artificial Sequence
  Description of Artificial Sequence: Synthetic peptide
  Seed: YRAREPVTK (MAGA1_HUMAN)
  misc_feature (2)..(2): Xaa can be Arg, Tyr, Gln, Gly, Ala, Phe, Met, Trp, Lys, Asn, His, Ser, Thr, Ile, Val, Glu, Leu, Pro, Cys, or Asp
  misc_feature (9)..(9): Xaa can be Leu, Phe, Met, Tyr, Ile, Val, Lys, Arg, Trp, His, Cys, Ala, Gln, Ser, Thr, Gly, or Pro
YXAREPVTX

SEQ ID NO: 51421 - protein, 10 aa, Artificial Sequence
  Description of Artificial Sequence: Synthetic peptide
  Seed: YRAREPVTKA (MAGA1_HUMAN)
  misc_feature (2)..(2): Xaa can be Arg, His, or Gln
  misc_feature (10)..(10): Xaa can be Leu, Ala, Trp, Val, Tyr, Met, Ile, Phe, or Cys
YXAREPVTKX

SEQ ID NO: 51422 - protein, 10 aa, Artificial Sequence
  Description of Artificial Sequence: Synthetic peptide
  Seed: YRQVPDSDPA (MAGA1_HUMAN)
  misc_feature (2)..(2): Xaa can be His, or Arg
  misc_feature (10)..(10): Xaa can be , or Ala
YXQVPDSDPX

SEQ ID NO: 51423 - protein, 11 aa, Artificial Sequence
  Description of Artificial Sequence: Synthetic peptide
  Seed: YRQVPDSDPAR (MAGA1_HUMAN)
  misc_feature (2)..(2): Xaa can be Arg, Tyr, Trp, or Phe
  misc_feature (11)..(11): Xaa can be Tyr, Phe, Leu, Met, Trp, Arg, Lys, or Ile
YXQVPDSDPAX

SEQ ID NO: 51424 - protein, 8 aa, Artificial Sequence
  Description of Artificial Sequence: Synthetic peptide
  Seed: YVIKVSAR (MAGA1_HUMAN)
  misc_feature (2)..(2): Xaa can be Thr, Ala, Trp, Tyr, Phe, Ile, Val, Met, or Ser
  misc_feature (8)..(8): Xaa can be Arg, or Lys
YXIKVSAX

SEQ ID NO: 51425 - protein, 9 aa, Artificial Sequence
  Description of Artificial Sequence: Synthetic peptide
  Seed: YVIKVSARV (MAGA1_HUMAN)
  misc_feature (2)..(2): Xaa can be Met, Leu, Thr, Gln, Val, Ser, Ala, Ile, Asn, Gly, Glu, Pro, Phe, Cys, Tyr, Asp, Trp, or Ly s
  misc_feature (9)..(9): Xaa can be Arg, Tyr, Leu, Phe, Met, Val, Lys, Ile, Ala, Thr, His, Trp, Cys, Ser, Gly, or Pro
YXIKVSARX

SEQ ID NO: 51426 - protein, 10 aa, Artificial Sequence
  Description of Artificial Sequence: Synthetic peptide
  Seed: YVIKVSARVR (MAGA1_HUMAN)
  misc_feature (2)..(2): Xaa can be Thr, Val, Ile, Ala, Ser, Asn, Trp, Tyr, Met, Phe, Leu, Gly, Pro, Gln, or Arg
  misc_feature (10)..(10): Xaa can be Arg, Lys, Tyr, Met, or Phe
YXIKVSARVX

SEQ ID NO: 51427 - protein, 11 aa, Artificial Sequence
  Description of Artificial Sequence: Synthetic peptide
  Seed: YVIKVSARVRF (MAGA1_HUMAN)
  misc_feature (2)..(2): Xaa can be Met, Gln, Gly, Lys, Ser, Leu, Thr, His, Val, Glu, Ala, Phe, Arg, Ile, Cys, Asn, Pro, Trp, Tyr, or Asp
  misc_feature (11)..(11): Xaa can be Tyr, Phe, or Met
YXIKVSARVRX

SEQ ID NO: 51428 - protein, 8 aa, Artificial Sequence
  Description of Artificial Sequence: Synthetic peptide
  Seed: YVKVLEYV (MAGA1_HUMAN)
  misc_feature (2)..(2): Xaa can be Leu, Met, Ile, Gln, or Val
  misc_feature (8)..(8): Xaa can be Leu, Val, Met, Ala, Ile, or Thr
YXKVLEYX

SEQ ID NO: 51429 - protein, 9 aa, Artificial Sequence
  Description of Artificial Sequence: Synthetic peptide
  Seed: YVKVLEYVI (MAGA1_HUMAN)
  misc_feature (2)..(2): Xaa can be Gln, Leu, Met, Glu, Ala, Ile, Ser, Val, Asp, or Thr
  misc_feature (9)..(9): Xaa can be Val, Leu, Ile, Ala, Met, Trp, or Phe
YXKVLEYVX

SEQ ID NO: 51430 - protein, 10 aa, Artificial Sequence
  Description of Artificial Sequence: Synthetic peptide
  Seed: YVKVLEYVIK (MAGA1_HUMAN)
  misc_feature (2)..(2): Xaa can be Ala, Val, Ser, Thr, or Ile
  misc_feature (10)..(10): Xaa can be Arg, or Lys
YXKVLEYVIX

SEQ ID NO: 51431 - protein, 11 aa, Artificial Sequence
  Description of Artificial Sequence: Synthetic peptide
  Seed: YVKVLEYVIKV (MAGA1_HUMAN)
  misc_feature (2)..(2): Xaa can be Met, Leu, Gln, Glu, Pro, Asp, Cys, Trp, Thr, Gly, His, Phe, Arg, Ser, Asn, Lys, Ile, Val, Tyr, or Ala
  misc_feature (11)..(11): Xaa can be Ile, Leu, Val, Ala, Thr, Met, Cys, or Ser
YXKVLEYVIKX

SEQ ID NO: 51432 - protein, 9 aa, Artificial Sequence
  Description of Artificial Sequence: Synthetic peptide
  Seed: YVLVTCLGL (MAGA1_HUMAN)
  misc_feature (2)..(2): Xaa can be Met, Ala, Gln, Leu, Val, Thr, Ile, Gly, Ser, Asn, Glu, Pro, Cys, Phe, Arg, Tyr, Asp, Lys, His, or Trp
  misc_feature (9)..(9): Xaa can be Tyr, Phe, Val, Met, Leu, Ile, Ala, Thr, Ser, Trp, His, Lys, Cys, or Arg
YXLVTCLGX

SEQ ID NO: 51433 - protein, 11 aa, Artificial Sequence
  Description of Artificial Sequence: Synthetic peptide
  Seed: YVLVTCLGLSY (MAGA1_HUMAN)
  misc_feature (2)..(2): Xaa can be Gln, Met, Leu, Ala, Ser, Ile, Val, Thr, Asn, Lys, Tyr, Glu, Pro, Asp, Cys, Arg, His, Trp, Gly, or Phe
  misc_feature (11)..(11): Xaa can be Tyr, Phe, Met, Leu, or Trp
YXLVTCLGLSX

SEQ ID NO: 51434 - protein, 9 aa, Artificial Sequence
  Description of Artificial Sequence: Synthetic peptide
  Seed: AEMLGSVVG (MAGA3_HUMAN)
AEMLGSVVI

SEQ ID NO: 51435 - protein, 8 aa, Artificial Sequence
  Description of Artificial Sequence: Synthetic peptide
  Seed: FPDLESEF (MAGA3_HUMAN)
FADLESEL

SEQ ID NO: 51436 - protein, 8 aa, Artificial Sequence
  Description of Artificial Sequence: Synthetic peptide
  Seed: FPDLESEF (MAGA3_HUMAN)
FFDLESEL

SEQ ID NO: 51437 - protein, 9 aa, Artificial Sequence
  Description of Artificial Sequence: Synthetic peptide
  Seed: FVQENYLEY (MAGA3_HUMAN)
FMQENYLEF

SEQ ID NO: 51438 - protein, 9 aa, Artificial Sequence
  Description of Artificial Sequence: Synthetic peptide
  Seed: FQAALSRKV (MAGA3_HUMAN)
FRAALSRKM

SEQ ID NO: 51439 - protein, 9 aa, Artificial Sequence
  Description of Artificial Sequence: Synthetic peptide
  Seed: FVQENYLEY (MAGA3_HUMAN)
FSQENYLEY

SEQ ID NO: 51440 - protein, 9 aa, Artificial Sequence
  Description of Artificial Sequence: Synthetic peptide
  Seed: FVQENYLEY (MAGA3_HUMAN)
FTQENYLEY

SEQ ID NO: 51441 - protein, 9 aa, Artificial Sequence
  Description of Artificial Sequence: Synthetic peptide
  Seed: FVQENYLEY (MAGA3_HUMAN)
FYQENYLEM

SEQ ID NO: 51442 - protein, 9 aa, Artificial Sequence
  Description of Artificial Sequence: Synthetic peptide
  Seed: ISYPPLHEW (MAGA3_HUMAN)
IAYPPLHEF

SEQ ID NO: 51443 - protein, 9 aa, Artificial Sequence
  Description of Artificial Sequence: Synthetic peptide
  Seed: ISYPPLHEW (MAGA3_HUMAN)
IAYPPLHEL

SEQ ID NO: 51444 - protein, 9 aa, Artificial Sequence
  Description of Artificial Sequence: Synthetic peptide
  Seed: ISYPPLHEW (MAGA3_HUMAN)
IQYPPLHEL

SEQ ID NO: 51445 - protein, 9 aa, Artificial Sequence
  Description of Artificial Sequence: Synthetic peptide
  Seed: KVAELVHFL (MAGA3_HUMAN)
KAAELVHFL

SEQ ID NO: 51446 - protein, 9 aa, Artificial Sequence
  Description of Artificial Sequence: Synthetic peptide
  Seed: KVAELVHFL (MAGA3_HUMAN)
KAAELVHFV

SEQ ID NO: 51447 - protein, 9 aa, Artificial Sequence
  Description of Artificial Sequence: Synthetic peptide
  Seed: KVAELVHFL (MAGA3_HUMAN)
KQAELVHFL

SEQ ID NO: 51448 - protein, 9 aa, Artificial Sequence
  Description of Artificial Sequence: Synthetic peptide
  Seed: KVAELVHFL (MAGA3_HUMAN)
KTAELVHFI

SEQ ID NO: 51449 - protein, 9 aa, Artificial Sequence
  Description of Artificial Sequence: Synthetic peptide
  Seed: KVAELVHFL (MAGA3_HUMAN)
KTAELVHFL

SEQ ID NO: 51450 - protein, 9 aa, Artificial Sequence
  Description of Artificial Sequence: Synthetic peptide
  Seed: KVLHHMVKI (MAGA3_HUMAN)
KTLHHMVKV

SEQ ID NO: 51451 - protein, 10 aa, Artificial Sequence
  Description of Artificial Sequence: Synthetic peptide
  Seed: MEVDPIGHLY (MAGA3_HUMAN)
MMVDPIGHLY

SEQ ID NO: 51452 - protein, 9 aa, Artificial Sequence
  Description of Artificial Sequence: Synthetic peptide
  Seed: MPKAGLLII (MAGA3_HUMAN)
MPKAGLLIL

SEQ ID NO: 51453 - protein, 10 aa, Artificial Sequence
  Description of Artificial Sequence: Synthetic peptide
  Seed: MEVDPIGHLY (MAGA3_HUMAN)
MQVDPIGHLY

SEQ ID NO: 51454 - protein, 10 aa, Artificial Sequence
  Description of Artificial Sequence: Synthetic peptide
  Seed: MEVDPIGHLY (MAGA3_HUMAN)
MSVDPIGHLY

SEQ ID NO: 51455 - protein, 10 aa, Artificial Sequence
  Description of Artificial Sequence: Synthetic peptide
  Seed: MNYPLWSQSY (MAGA3_HUMAN)
MTYPLWSQSY

SEQ ID NO: 51456 - protein, 9 aa, Artificial Sequence
  Description of Artificial Sequence: Synthetic peptide
  Seed: NWQYFFPVI (MAGA3_HUMAN)
NYQYFFPVF

SEQ ID NO: 51457 - protein, 9 aa, Artificial Sequence
  Description of Artificial Sequence: Synthetic peptide
  Seed: QSPQGASSL (MAGA3_HUMAN)
QAPQGASSL

SEQ ID NO: 51458 - protein, 10 aa, Artificial Sequence
  Description of Artificial Sequence: Synthetic peptide
  Seed: QYFFPVIFSK (MAGA3_HUMAN)
QTFFPVIFSR

SEQ ID NO: 51459 - protein, 9 aa, Artificial Sequence
  Description of Artificial Sequence: Synthetic peptide
  Seed: SVVGNWQYF (MAGA3_HUMAN)
STVGNWQYY

SEQ ID NO: 51460 - protein, 9 aa, Artificial Sequence
  Description of Artificial Sequence: Synthetic peptide
  Seed: SYPPLHEWV (MAGA3_HUMAN)
SYPPLHEWF

SEQ ID NO: 51461 - protein, 10 aa, Artificial Sequence
  Description of Artificial Sequence: Synthetic peptide
  Seed: SYPPLHEWVL (MAGA3_HUMAN)
SYPPLHEWVF

SEQ ID NO: 51462 - protein, 9 aa, Artificial Sequence
  Description of Artificial Sequence: Synthetic peptide
  Seed: TFPDLESEF (MAGA3_HUMAN)
TFPDLESEL

SEQ ID NO: 51463 - protein, 9 aa, Artificial Sequence
  Description of Artificial Sequence: Synthetic peptide
  Seed: VVGNWQYFF (MAGA3_HUMAN)
VMGNWQYFF

SEQ ID NO: 51464 - protein, 9 aa, Artificial Sequence
  Description of Artificial Sequence: Synthetic peptide
  Seed: YIFATCLGL (MAGA3_HUMAN)
YAFATCLGV

SEQ ID NO: 51465 - protein, 9 aa, Artificial Sequence
  Description of Artificial Sequence: Synthetic peptide
  Seed: YFFPVIFSK (MAGA3_HUMAN)
YMFPVIFSK

SEQ ID NO: 51466 - protein, 9 aa, Artificial Sequence
  Description of Artificial Sequence: Synthetic peptide
  Seed: YFFPVIFSK (MAGA3_HUMAN)
YTFPVIFSK

SEQ ID NO: 51467 - protein, 9 aa, Artificial Sequence
  Description of Artificial Sequence: Synthetic peptide
  Seed: YFFPVIFSK (MAGA3_HUMAN)
YTFPVIFSR

SEQ ID NO: 51468 - protein, 9 aa, Artificial Sequence
  Description of Artificial Sequence: Synthetic peptide
  Seed: YFFPVIFSK (MAGA3_HUMAN)
YVFPVIFSK

SEQ ID NO: 51469 - protein, 9 aa, Homo sapiens
  Native (MAGA3_HUMAN)
AELVHFLLL

SEQ ID NO: 51470 - protein, 10 aa, Homo sapiens
  Native (MAGA3_HUMAN)
AELVHFLLLK

SEQ ID NO: 51471 - protein, 11 aa, Homo sapiens
  Native (MAGA3_HUMAN)
AEMLGSVVGNW

SEQ ID NO: 51472 - protein, 9 aa, Homo sapiens
  Native (MAGA3_HUMAN)
ALVETSYVK

SEQ ID NO: 51473 - protein, 9 aa, Homo sapiens
  Native (MAGA3_HUMAN)
ASSSLQLVF

SEQ ID NO: 51474 - protein, 9 aa, Homo sapiens
  Native (MAGA3_HUMAN)
DPIGHLYIF

SEQ ID NO: 51475 - protein, 9 aa, Homo sapiens
  Native (MAGA3_HUMAN)
EELSVLEVF

SEQ ID NO: 51476 - protein, 9 aa, Homo sapiens
  Native (MAGA3_HUMAN)
EVDPIGHLY

SEQ ID NO: 51477 - protein, 10 aa, Homo sapiens
  Native (MAGA3_HUMAN)
EVFEGREDSI

SEQ ID NO: 51478 - protein, 9 aa, Homo sapiens
  Native (MAGA3_HUMAN)
FATCLGLSY

SEQ ID NO: 51479 - protein, 9 aa, Homo sapiens
  Native (MAGA3_HUMAN)
FPVIFSKAS

SEQ ID NO: 51480 - protein, 9 aa, Homo sapiens
  Native (MAGA3_HUMAN)
FVQENYLEY

SEQ ID NO: 51481 - protein, 9 aa, Homo sapiens
  Native (MAGA3_HUMAN)
GASSLPTTM

SEQ ID NO: 51482 - protein, 9 aa, Homo sapiens
  Native (MAGA3_HUMAN)
GEALGLVGA

SEQ ID NO: 51483 - protein, 9 aa, Homo sapiens
  Native (MAGA3_HUMAN)
GEVPAAESP

SEQ ID NO: 51484 - protein, 9 aa, Homo sapiens
  Native (MAGA3_HUMAN)
GPHISYPPL

SEQ ID NO: 51485 - protein, 9 aa, Homo sapiens
  Native (MAGA3_HUMAN)
GSDPACYEF

SEQ ID NO: 51486 - protein, 10 aa, Homo sapiens
  Native (MAGA3_HUMAN)
HFLLLKYRAR

SEQ ID NO: 51487 - protein, 9 aa, Homo sapiens
  Native (MAGA3_HUMAN)
ISYPPLHEW

SEQ ID NO: 51488 - protein, 9 aa, Homo sapiens
  Native (MAGA3_HUMAN)
KASSSLQLV

SEQ ID NO: 51489 - protein, 9 aa, Homo sapiens
  Native (MAGA3_HUMAN)
KIWEELSVL

SEQ ID NO: 51490 - protein, 9 aa, Homo sapiens
  Native (MAGA3_HUMAN)
KVAELVHFL

SEQ ID NO: 51491 - protein, 9 aa, Homo sapiens
  Native (MAGA3_HUMAN)
KVLHHMVKI

SEQ ID NO: 51492 - protein, 9 aa, Homo sapiens
  Native (MAGA3_HUMAN)
LESEFQAAL

SEQ ID NO: 51493 - protein, 9 aa, Homo sapiens
  Native (MAGA3_HUMAN)
LPTTMNYPL

SEQ ID NO: 51494 - protein, 10 aa, Homo sapiens
  Native (MAGA3_HUMAN)
LVFGIELMEV

SEQ ID NO: 51495 - protein, 10 aa, Homo sapiens
  Native (MAGA3_HUMAN)
MEVDPIGHLY

SEQ ID NO: 51496 - protein, 10 aa, Homo sapiens
  Native (MAGA3_HUMAN)
MNYPLWSQSY

SEQ ID NO: 51497 - protein, 9 aa, Homo sapiens
  Native (MAGA3_HUMAN)
MPKAGLLII

SEQ ID NO: 51498 - protein, 10 aa, Homo sapiens
  Native (MAGA3_HUMAN)
MPKAGLLIIV

SEQ ID NO: 51499 - protein, 10 aa, Homo sapiens
  Native (MAGA3_HUMAN)
NWQYFFPVIF

SEQ ID NO: 51500 - protein, 9 aa, Homo sapiens
  Native (MAGA3_HUMAN)
NYPLWSQSY

SEQ ID NO: 51501 - protein, 9 aa, Homo sapiens
  Native (MAGA3_HUMAN)
QSPQGASSL

SEQ ID NO: 51502 - protein, 11 aa, Homo sapiens
  Native (MAGA3_HUMAN)
RQVPGSDPACY

SEQ ID NO: 51503 - protein, 9 aa, Homo sapiens
  Native (MAGA3_HUMAN)
SSLPTTMNY

SEQ ID NO: 51504 - protein, 9 aa, Homo sapiens
  Native (MAGA3_HUMAN)
SSSSTLVEV

SEQ ID NO: 51505 - protein, 9 aa, Homo sapiens
  Native (MAGA3_HUMAN)
SVLEVFEGR

SEQ ID NO: 51506 - protein, 9 aa, Homo sapiens
  Native (MAGA3_HUMAN)
SYVKVLHHM

SEQ ID NO: 51507 - protein, 9 aa, Homo sapiens
  Native (MAGA3_HUMAN)
TFPDLESEF

SEQ ID NO: 51508 - protein, 9 aa, Homo sapiens
  Native (MAGA3_HUMAN)
VETSYVKVL

SEQ ID NO: 51509 - protein, 9 aa, Homo sapiens
  Native (MAGA3_HUMAN)
YFFPVIFSK

SEQ ID NO: 51510 - protein, 9 aa, Homo sapiens
  Native (MAGA3_HUMAN)
YIFATCLGL

SEQ ID NO: 51511 - protein, 10 aa, Artificial Sequence
  Description of Artificial Sequence: Synthetic peptide
  Seed: DLESEFQAAL (MAGA3_HUMAN)
DPESEFQAAF

SEQ ID NO: 51512 - protein, 10 aa, Artificial Sequence
  Description of Artificial Sequence: Synthetic peptide
  Seed: NWQYFFPVIF (MAGA3_HUMAN)
NYQYFFPVIY

SEQ ID NO: 51513 - protein, 10 aa, Artificial Sequence
  Description of Artificial Sequence: Synthetic peptide
  Seed: DLESEFQAAL (MAGA3_HUMAN)
DIESEFQAAF

SEQ ID NO: 51514 - protein, 9 aa, Artificial Sequence
  Description of Artificial Sequence: Synthetic peptide
  Seed: WQYFFPVIF (MAGA3_HUMAN)
WQYFFPVIL

SEQ ID NO: 51515 - protein, 8 aa, Artificial Sequence
  Description of Artificial Sequence: Synthetic peptide
  Seed: FPDLESEF (MAGA3_HUMAN)
FWDLESEL

SEQ ID NO: 51516 - protein, 9 aa, Artificial Sequence
  Description of Artificial Sequence: Synthetic peptide
  Seed: SSLPTTMNY (MAGA3_HUMAN)
SMLPTTMNF

SEQ ID NO: 51517 - protein, 9 aa, Artificial Sequence
  Description of Artificial Sequence: Synthetic peptide
  Seed: KVLHHMVKI (MAGA3_HUMAN)
KILHHMVKA

SEQ ID NO: 51518 - protein, 10 aa, Artificial Sequence
  Description of Artificial Sequence: Synthetic peptide
  Seed: TSYVKVLHHM (MAGA3_HUMAN)
TYYVKVLHHI

SEQ ID NO: 51519 - protein, 9 aa, Artificial Sequence
  Description of Artificial Sequence: Synthetic peptide
  Seed: KASSSLQLV (MAGA3_HUMAN)
KTSSSLQLK

SEQ ID NO: 51520 - protein, 9 aa, Artificial Sequence
  Description of Artificial Sequence: Synthetic peptide
  Seed: AASSSSTLV (MAGA3_HUMAN)
AQSSSSTLL

SEQ ID NO: 51521 - protein, 10 aa, Artificial Sequence
  Description of Artificial Sequence: Synthetic peptide
  Seed: SLPTTMNYPL (MAGA3_HUMAN)
SYPTTMNYPM

SEQ ID NO: 51522 - protein, 10 aa, Artificial Sequence
  Description of Artificial Sequence: Synthetic peptide
  Seed: MEVDPIGHLY (MAGA3_HUMAN)
MWVDPIGHLF

SEQ ID NO: 51523 - protein, 9 aa, Artificial Sequence
  Description of Artificial Sequence: Synthetic peptide
  Seed: ELVHFLLLK (MAGA3_HUMAN)
EQVHFLLLK

SEQ ID NO: 51524 - protein, 9 aa, Artificial Sequence
  Description of Artificial Sequence: Synthetic peptide
  Seed: GLVGAQAPA (MAGA3_HUMAN)
GVVGAQAPI

SEQ ID NO: 51525 - protein, 9 aa, Artificial Sequence
  Description of Artificial Sequence: Synthetic peptide
  Seed: HEWVLREGE (MAGA3_HUMAN)
HEWVLREGT

SEQ ID NO: 51526 - protein, 9 aa, Artificial Sequence
  Description of Artificial Sequence: Synthetic peptide
  Seed: ALGLVGAQA (MAGA3_HUMAN)
AMGLVGAQL

SEQ ID NO: 51527 - protein, 10 aa, Artificial Sequence
  Description of Artificial Sequence: Synthetic peptide
  Seed: ASSSSTLVEV (MAGA3_HUMAN)
AASSSTLVEF

SEQ ID NO: 51528 - protein, 9 aa, Artificial Sequence
  Description of Artificial Sequence: Synthetic peptide
  Seed: KAGLLIIVL (MAGA3_HUMAN)
KLGLLIIVY

SEQ ID NO: 51529 - protein, 9 aa, Artificial Sequence
  Description of Artificial Sequence: Synthetic peptide
  Seed: RQVPGSDPA (MAGA3_HUMAN)
RKVPGSDPL

SEQ ID NO: 51530 - protein, 9 aa, Artificial Sequence
  Description of Artificial Sequence: Synthetic peptide
  Seed: YIFATCLGL (MAGA3_HUMAN)
YYFATCLGV

SEQ ID NO: 51531 - protein, 9 aa, Artificial Sequence
  Description of Artificial Sequence: Synthetic peptide
  Seed: QLVFGIELM (MAGA3_HUMAN)
QLVFGIELA

SEQ ID NO: 51532 - protein, 9 aa, Artificial Sequence
  Description of Artificial Sequence: Synthetic peptide
  Seed: VTLGEVPAA (MAGA3_HUMAN)
VILGEVPAA

SEQ ID NO: 51533 - protein, 10 aa, Artificial Sequence
  Description of Artificial Sequence: Synthetic peptide
  Seed: VIFSKASSSL (MAGA3_HUMAN)
VMFSKASSSV

SEQ ID NO: 51534 - protein, 9 aa, Artificial Sequence
  Description of Artificial Sequence: Synthetic peptide
  Seed: KVLHHMVKI (MAGA3_HUMAN)
KILHHMVKM

SEQ ID NO: 51535 - protein, 10 aa, Artificial Sequence
  Description of Artificial Sequence: Synthetic peptide
  Seed: SSSTLVEVTL (MAGA3_HUMAN)
SVSTLVEVTW

SEQ ID NO: 51536 - protein, 9 aa, Artificial Sequence
  Description of Artificial Sequence: Synthetic peptide
  Seed: FVQENYLEY (MAGA3_HUMAN)
FCQENYLEY

SEQ ID NO: 51537 - protein, 10 aa, Artificial Sequence
  Description of Artificial Sequence: Synthetic peptide
  Seed: LPTTMNYPLW (MAGA3_HUMAN)
LKTTMNYPLW

SEQ ID NO: 51538 - protein, 9 aa, Artificial Sequence
  Description of Artificial Sequence: Synthetic peptide
  Seed: VVGNWQYFF (MAGA3_HUMAN)
VTGNWQYFY

SEQ ID NO: 51539 - protein, 11 aa, Artificial Sequence
  Description of Artificial Sequence: Synthetic peptide
  Seed: SRKVAELVHFL (MAGA3_HUMAN)
SQKVAELVHFV

SEQ ID NO: 51540 - protein, 9 aa, Artificial Sequence
  Description of Artificial Sequence: Synthetic peptide
  Seed: LQLVFGIEL (MAGA3_HUMAN)
LMLVFGIEV

SEQ ID NO: 51541 - protein, 10 aa, Artificial Sequence
  Description of Artificial Sequence: Synthetic peptide
  Seed: NWQYFFPVIF (MAGA3_HUMAN)
NTQYFFPVIF

SEQ ID NO: 51542 - protein, 9 aa, Artificial Sequence
  Description of Artificial Sequence: Synthetic peptide
  Seed: ISGGPHISY (MAGA3_HUMAN)
IMGGPHISF

SEQ ID NO: 51543 - protein, 9 aa, Artificial Sequence
  Description of Artificial Sequence: Synthetic peptide
  Seed: FQAALSRKV (MAGA3_HUMAN)
FHAALSRKA

SEQ ID NO: 51544 - protein, 10 aa, Artificial Sequence
  Description of Artificial Sequence: Synthetic peptide
  Seed: YFFPVIFSKA (MAGA3_HUMAN)
YLFPVIFSKC

SEQ ID NO: 51545 - protein, 9 aa, Artificial Sequence
  Description of Artificial Sequence: Synthetic peptide
  Seed: FVQENYLEY (MAGA3_HUMAN)
FKQENYLEF

SEQ ID NO: 51546 - protein, 9 aa, Artificial Sequence
  Description of Artificial Sequence: Synthetic peptide
  Seed: EFQAALSRK (MAGA3_HUMAN)
EWQAALSRR

SEQ ID NO: 51547 - protein, 9 aa, Artificial Sequence
  Description of Artificial Sequence: Synthetic peptide
  Seed: ILGDPKKLL (MAGA3_HUMAN)
IAGDPKKLM

SEQ ID NO: 51548 - protein, 9 aa, Artificial Sequence
  Description of Artificial Sequence: Synthetic peptide
  Seed: YPPLHEWVL (MAGA3_HUMAN)
YVPLHEWVL

SEQ ID NO: 51549 - protein, 9 aa, Artificial Sequence
  Description of Artificial Sequence: Synthetic peptide
  Seed: MPKAGLLII (MAGA3_HUMAN)
MPKAGLLIT

SEQ ID NO: 51550 - protein, 9 aa, Artificial Sequence
  Description of Artificial Sequence: Synthetic peptide
  Seed: HLYIFATCL (MAGA3_HUMAN)
HPYIFATCY

SEQ ID NO: 51551 - protein, 9 aa, Artificial Sequence
  Description of Artificial Sequence: Synthetic peptide
  Seed: SVLEVFEGR (MAGA3_HUMAN)
SQLEVFEGK

SEQ ID NO: 51552 - protein, 11 aa, Artificial Sequence
  Description of Artificial Sequence: Synthetic peptide
  Seed: GSDPACYEFLW (MAGA3_HUMAN)
GTDPACYEFLW

SEQ ID NO: 51553 - protein, 9 aa, Artificial Sequence
  Description of Artificial Sequence: Synthetic peptide
  Seed: SYVKVLHHM (MAGA3_HUMAN)
SVVKVLHHY

SEQ ID NO: 51554 - protein, 9 aa, Artificial Sequence
  Description of Artificial Sequence: Synthetic peptide
  Seed: ISGGPHISY (MAGA3_HUMAN)
IRGGPHISY

SEQ ID NO: 51555 - protein, 9 aa, Artificial Sequence
  Description of Artificial Sequence: Synthetic peptide
  Seed: RQVPGSDPA (MAGA3_HUMAN)
RRVPGSDPM

SEQ ID NO: 51556 - protein, 11 aa, Artificial Sequence
  Description of Artificial Sequence: Synthetic peptide
  Seed: YIFATCLGLSY (MAGA3_HUMAN)
YKFATCLGLSY

SEQ ID NO: 51557 - protein, 10 aa, Artificial Sequence
  Description of Artificial Sequence: Synthetic peptide
  Seed: ASSSSTLVEV (MAGA3_HUMAN)
ALSSSTLVEM

SEQ ID NO: 51558 - protein, 10 aa, Artificial Sequence
  Description of Artificial Sequence: Synthetic peptide
  Seed: MNYPLWSQSY (MAGA3_HUMAN)
MPYPLWSQSV

SEQ ID NO: 51559 - protein, 9 aa, Artificial Sequence
  Description of Artificial Sequence: Synthetic peptide
  Seed: GSDPACYEF (MAGA3_HUMAN)
GQDPACYEI

SEQ ID NO: 51560 - protein, 10 aa, Artificial Sequence
  Description of Artificial Sequence: Synthetic peptide
  Seed: MNYPLWSQSY (MAGA3_HUMAN)
MLYPLWSQSF

SEQ ID NO: 51561 - protein, 10 aa, Artificial Sequence
  Description of Artificial Sequence: Synthetic peptide
  Seed: MNYPLWSQSY (MAGA3_HUMAN)
MWYPLWSQSV

SEQ ID NO: 51562 - protein, 9 aa, Artificial Sequence
  Description of Artificial Sequence: Synthetic peptide
  Seed: ELVHFLLLK (MAGA3_HUMAN)
EVVHFLLLR

SEQ ID NO: 51563 - protein, 10 aa, Artificial Sequence
  Description of Artificial Sequence: Synthetic peptide
  Seed: ELVHFLLLKY (MAGA3_HUMAN)
EMVHFLLLKK

SEQ ID NO: 51564 - protein, 10 aa, Artificial Sequence
  Description of Artificial Sequence: Synthetic peptide
  Seed: ESEFQAALSR (MAGA3_HUMAN)
ETEFQAALSR

SEQ ID NO: 51565 - protein, 9 aa, Artificial Sequence
  Description of Artificial Sequence: Synthetic peptide
  Seed: KVLHHMVKI (MAGA3_HUMAN)
KQLHHMVKV

SEQ ID NO: 51566 - protein, 9 aa, Artificial Sequence
  Description of Artificial Sequence: Synthetic peptide
  Seed: ISGGPHISY (MAGA3_HUMAN)
IRGGPHISF

SEQ ID NO: 51567 - protein, 10 aa, Artificial Sequence
  Description of Artificial Sequence: Synthetic peptide
  Seed: KASSSLQLVF (MAGA3_HUMAN)
KLSSSLQLVM

SEQ ID NO: 51568 - protein, 9 aa, Artificial Sequence
  Description of Artificial Sequence: Synthetic peptide
  Seed: ISYPPLHEW (MAGA3_HUMAN)
IGYPPLHEY

SEQ ID NO: 51569 - protein, 10 aa, Artificial Sequence
  Description of Artificial Sequence: Synthetic peptide
  Seed: MNYPLWSQSY (MAGA3_HUMAN)
MWYPLWSQSL

SEQ ID NO: 51570 - protein, 10 aa, Artificial Sequence
  Description of Artificial Sequence: Synthetic peptide
  Seed: ESPDPPQSPQ (MAGA3_HUMAN)
ETPDPPQSPK

SEQ ID NO: 51571 - protein, 10 aa, Artificial Sequence
  Description of Artificial Sequence: Synthetic peptide
  Seed: TSYVKVLHHM (MAGA3_HUMAN)
TWYVKVLHHI

SEQ ID NO: 51572 - protein, 9 aa, Artificial Sequence
  Description of Artificial Sequence: Synthetic peptide
  Seed: QSPQGASSL (MAGA3_HUMAN)
QAPQGASSM

SEQ ID NO: 51573 - protein, 10 aa, Artificial Sequence
  Description of Artificial Sequence: Synthetic peptide
  Seed: LVHFLLLKYR (MAGA3_HUMAN)
LMHFLLLKYK

SEQ ID NO: 51574 - protein, 8 aa, Artificial Sequence
  Description of Artificial Sequence: Synthetic peptide
  Seed: YVKVLHHM (MAGA3_HUMAN)
YMKVLHHL

SEQ ID NO: 51575 - protein, 10 aa, Artificial Sequence
  Description of Artificial Sequence: Synthetic peptide
  Seed: AESPDPPQSP (MAGA3_HUMAN)
AESPDPPQSL

SEQ ID NO: 51576 - protein, 9 aa, Artificial Sequence
  Description of Artificial Sequence: Synthetic peptide
  Seed: KIWEELSVL (MAGA3_HUMAN)
KRWEELSVY

SEQ ID NO: 51577 - protein, 10 aa, Artificial Sequence
  Description of Artificial Sequence: Synthetic peptide
  Seed: ESPDPPQSPQ (MAGA3_HUMAN)
ELPDPPQSPR

SEQ ID NO: 51578 - protein, 10 aa, Artificial Sequence
  Description of Artificial Sequence: Synthetic peptide
  Seed: FLWGPRALVE (MAGA3_HUMAN)
FQWGPRALVV

SEQ ID NO: 51579 - protein, 10 aa, Artificial Sequence
  Description of Artificial Sequence: Synthetic peptide
  Seed: KVAELVHFLL (MAGA3_HUMAN)
KPAELVHFLW

SEQ ID NO: 51580 - protein, 11 aa, Artificial Sequence
  Description of Artificial Sequence: Synthetic peptide
  Seed: ELSVLEVFEGR (MAGA3_HUMAN)
ETSVLEVFEGR

SEQ ID NO: 51581 - protein, 10 aa, Artificial Sequence
  Description of Artificial Sequence: Synthetic peptide
  Seed: KASSSLQLVF (MAGA3_HUMAN)
KISSSLQLVI

SEQ ID NO: 51582 - protein, 9 aa, Artificial Sequence
  Description of Artificial Sequence: Synthetic peptide
  Seed: KASSSLQLV (MAGA3_HUMAN)
KQSSSLQLY

SEQ ID NO: 51583 - protein, 9 aa, Artificial Sequence
  Description of Artificial Sequence: Synthetic peptide
  Seed: SSSSTLVEV (MAGA3_HUMAN)
SQSSTLVEI

SEQ ID NO: 51584 - protein, 9 aa, Artificial Sequence
  Description of Artificial Sequence: Synthetic peptide
  Seed: AELVHFLLL (MAGA3_HUMAN)
AELVHFLLI

SEQ ID NO: 51585 - protein, 10 aa, Artificial Sequence
  Description of Artificial Sequence: Synthetic peptide
  Seed: KASSSLQLVF (MAGA3_HUMAN)
KESSSLQLVF

SEQ ID NO: 51586 - protein, 11 aa, Artificial Sequence
  Description of Artificial Sequence: Synthetic peptide
  Seed: VVGNWQYFFPV (MAGA3_HUMAN)
VLGNWQYFFPL

SEQ ID NO: 51587 - protein, 9 aa, Artificial Sequence
  Description of Artificial Sequence: Synthetic peptide
  Seed: SYVKVLHHM (MAGA3_HUMAN)
SLVKVLHHY

SEQ ID NO: 51588 - protein, 9 aa, Artificial Sequence
  Description of Artificial Sequence: Synthetic peptide
  Seed: SSLQLVFGI (MAGA3_HUMAN)
SQLQLVFGF

SEQ ID NO: 51589 - protein, 9 aa, Artificial Sequence
  Description of Artificial Sequence: Synthetic peptide
  Seed: QEEEGPSTF (MAGA3_HUMAN)
QEEEGPSTY

SEQ ID NO: 51590 - protein, 10 aa, Artificial Sequence
  Description of Artificial Sequence: Synthetic peptide
  Seed: STFPDLESEF (MAGA3_HUMAN)
STFPDLESEK

SEQ ID NO: 51591 - protein, 9 aa, Artificial Sequence
  Description of Artificial Sequence: Synthetic peptide
  Seed: QSPQGASSL (MAGA3_HUMAN)
QIPQGASSR

SEQ ID NO: 51592 - protein, 9 aa, Artificial Sequence
  Description of Artificial Sequence: Synthetic peptide
  Seed: KVAELVHFL (MAGA3_HUMAN)
KVAELVHFA

SEQ ID NO: 51593 - protein, 9 aa, Artificial Sequence
  Description of Artificial Sequence: Synthetic peptide
  Seed: VVGNWQYFF (MAGA3_HUMAN)
VAGNWQYFW

SEQ ID NO: 51594 - protein, 9 aa, Artificial Sequence
  Description of Artificial Sequence: Synthetic peptide
  Seed: IMPKAGLLI (MAGA3_HUMAN)
IQPKAGLLF

SEQ ID NO: 51595 - protein, 9 aa, Artificial Sequence
  Description of Artificial Sequence: Synthetic peptide
  Seed: KVLHHMVKI (MAGA3_HUMAN)
KSLHHMVKM

SEQ ID NO: 51596 - protein, 10 aa, Artificial Sequence
  Description of Artificial Sequence: Synthetic peptide
  Seed: ASSLPTTMNY (MAGA3_HUMAN)
AHSLPTTMNW

SEQ ID NO: 51597 - protein, 9 aa, Artificial Sequence
  Description of Artificial Sequence: Synthetic peptide
  Seed: ISYPPLHEW (MAGA3_HUMAN)
INYPPLHEW

SEQ ID NO: 51598 - protein, 9 aa, Artificial Sequence
  Description of Artificial Sequence: Synthetic peptide
  Seed: SSLPTTMNY (MAGA3_HUMAN)
SQLPTTMNY

SEQ ID NO: 51599 - protein, 10 aa, Artificial Sequence
  Description of Artificial Sequence: Synthetic peptide
  Seed: WEELSVLEVF (MAGA3_HUMAN)
WEELSVLEVI

SEQ ID NO: 51600 - protein, 9 aa, Artificial Sequence
  Description of Artificial Sequence: Synthetic peptide
  Seed: FVQENYLEY (MAGA3_HUMAN)
FHQENYLEF

SEQ ID NO: 51601 - protein, 10 aa, Artificial Sequence
  Description of Artificial Sequence: Synthetic peptide
  Seed: FSKASSSLQL (MAGA3_HUMAN)
FNKASSSLQM

SEQ ID NO: 51602 - protein, 10 aa, Artificial Sequence
  Description of Artificial Sequence: Synthetic peptide
  Seed: ISYPPLHEWV (MAGA3_HUMAN)
IYYPPLHEWL

SEQ ID NO: 51603 - protein, 10 aa, Artificial Sequence
  Description of Artificial Sequence: Synthetic peptide
  Seed: GPRALVETSY (MAGA3_HUMAN)
GPRALVETSL

SEQ ID NO: 51604 - protein, 9 aa, Artificial Sequence
  Description of Artificial Sequence: Synthetic peptide
  Seed: KASSSLQLV (MAGA3_HUMAN)
KLSSSLQLW

SEQ ID NO: 51605 - protein, 10 aa, Artificial Sequence
  Description of Artificial Sequence: Synthetic peptide
  Seed: ASSLPTTMNY (MAGA3_HUMAN)
AASLPTTMNK

SEQ ID NO: 51606 - protein, 11 aa, Artificial Sequence
  Description of Artificial Sequence: Synthetic peptide
  Seed: QEAASSSSTLV (MAGA3_HUMAN)
QEAASSSSTLY

SEQ ID NO: 51607 - protein, 11 aa, Artificial Sequence
  Description of Artificial Sequence: Synthetic peptide
  Seed: SNQEEEGPSTF (MAGA3_HUMAN)
SHQEEEGPSTV

SEQ ID NO: 51608 - protein, 9 aa, Artificial Sequence
  Description of Artificial Sequence: Synthetic peptide
  Seed: RQVPGSDPA (MAGA3_HUMAN)
RHVPGSDPY

SEQ ID NO: 51609 - protein, 10 aa, Artificial Sequence
  Description of Artificial Sequence: Synthetic peptide
  Seed: SLPTTMNYPL (MAGA3_HUMAN)
SMPTTMNYPI

SEQ ID NO: 51610 - protein, 9 aa, Artificial Sequence
  Description of Artificial Sequence: Synthetic peptide
  Seed: RQVPGSDPA (MAGA3_HUMAN)
REVPGSDPI

SEQ ID NO: 51611 - protein, 9 aa, Artificial Sequence
  Description of Artificial Sequence: Synthetic peptide
  Seed: YIFATCLGL (MAGA3_HUMAN)
YLFATCLGM

SEQ ID NO: 51612 - protein, 9 aa, Artificial Sequence
  Description of Artificial Sequence: Synthetic peptide
  Seed: FVQENYLEY (MAGA3_HUMAN)
FLQENYLEY

SEQ ID NO: 51613 - protein, 10 aa, Artificial Sequence
  Description of Artificial Sequence: Synthetic peptide
  Seed: ALVETSYVKV (MAGA3_HUMAN)
AQVETSYVKV

SEQ ID NO: 51614 - protein, 10 aa, Artificial Sequence
  Description of Artificial Sequence: Synthetic peptide
  Seed: KISGGPHISY (MAGA3_HUMAN)
KKSGGPHISF

SEQ ID NO: 51615 - protein, 10 aa, Artificial Sequence
  Description of Artificial Sequence: Synthetic peptide
  Seed: STFPDLESEF (MAGA3_HUMAN)
SVFPDLESEW

SEQ ID NO: 51616 - protein, 9 aa, Artificial Sequence
  Description of Artificial Sequence: Synthetic peptide
  Seed: LSRKVAELV (MAGA3_HUMAN)
LARKVAELF

SEQ ID NO: 51617 - protein, 10 aa, Artificial Sequence
  Description of Artificial Sequence: Synthetic peptide
  Seed: FLWGPRALVE (MAGA3_HUMAN)
FLWGPRALVS

SEQ ID NO: 51618 - protein, 10 aa, Artificial Sequence
  Description of Artificial Sequence: Synthetic peptide
  Seed: KVAELVHFLL (MAGA3_HUMAN)
KAAELVHFLM

SEQ ID NO: 51619 - protein, 10 aa, Artificial Sequence
  Description of Artificial Sequence: Synthetic peptide
  Seed: LGSVVGNWQY (MAGA3_HUMAN)
LSSVVGNWQF

SEQ ID NO: 51620 - protein, 9 aa, Artificial Sequence
  Description of Artificial Sequence: Synthetic peptide
  Seed: KVLHHMVKI (MAGA3_HUMAN)
KALHHMVKW

SEQ ID NO: 51621 - protein, 10 aa, Artificial Sequence
  Description of Artificial Sequence: Synthetic peptide
  Seed: SPQGASSLPT (MAGA3_HUMAN)
SPQGASSLPL

SEQ ID NO: 51622 - protein, 9 aa, Artificial Sequence
  Description of Artificial Sequence: Synthetic peptide
  Seed: ASSSLQLVF (MAGA3_HUMAN)
AESSLQLVY

SEQ ID NO: 51623 - protein, 10 aa, Artificial Sequence
  Description of Artificial Sequence: Synthetic peptide
  Seed: LQLVFGIELM (MAGA3_HUMAN)
LSLVFGIELL

SEQ ID NO: 51624 - protein, 10 aa, Artificial Sequence
  Description of Artificial Sequence: Synthetic peptide
  Seed: NWQYFFPVIF (MAGA3_HUMAN)
NMQYFFPVIM

SEQ ID NO: 51625 - protein, 9 aa, Artificial Sequence
  Description of Artificial Sequence: Synthetic peptide
  Seed: LLIIVLAII (MAGA3_HUMAN)
LMIIVLAIL

SEQ ID NO: 51626 - protein, 9 aa, Artificial Sequence
  Description of Artificial Sequence: Synthetic peptide
  Seed: SSLPTTMNY (MAGA3_HUMAN)
SELPTTMNF

SEQ ID NO: 51627 - protein, 10 aa, Artificial Sequence
  Description of Artificial Sequence: Synthetic peptide
  Seed: VDPIGHLYIF (MAGA3_HUMAN)
VTPIGHLYIY

SEQ ID NO: 51628 - protein, 10 aa, Artificial Sequence
  Description of Artificial Sequence: Synthetic peptide
  Seed: KVAELVHFLL (MAGA3_HUMAN)
KIAELVHFLY

SEQ ID NO: 51629 - protein, 9 aa, Artificial Sequence
  Description of Artificial Sequence: Synthetic peptide
  Seed: KVAELVHFL (MAGA3_HUMAN)
KSAELVHFV

SEQ ID NO: 51630 - protein, 11 aa, Artificial Sequence
  Description of Artificial Sequence: Synthetic peptide
  Seed: ISYPPLHEWVL (MAGA3_HUMAN)
IYYPPLHEWVI

SEQ ID NO: 51631 - protein, 10 aa, Artificial Sequence
  Description of Artificial Sequence: Synthetic peptide
  Seed: YRQVPGSDPA (MAGA3_HUMAN)
YGQVPGSDPV

SEQ ID NO: 51632 - protein, 10 aa, Artificial Sequence
  Description of Artificial Sequence: Synthetic peptide
  Seed: SVVGNWQYFF (MAGA3_HUMAN)
SRVGNWQYFY

SEQ ID NO: 51633 - protein, 9 aa, Artificial Sequence
  Description of Artificial Sequence: Synthetic peptide
  Seed: SKASSSLQL (MAGA3_HUMAN)
SRASSSLQY

SEQ ID NO: 51634 - protein, 9 aa, Artificial Sequence
  Description of Artificial Sequence: Synthetic peptide
  Seed: MEVDPIGHL (MAGA3_HUMAN)
MVVDPIGHL

SEQ ID NO: 51635 - protein, 11 aa, Artificial Sequence
  Description of Artificial Sequence: Synthetic peptide
  Seed: GSVVGNWQYFF (MAGA3_HUMAN)
GTVVGNWQYFW

SEQ ID NO: 51636 - protein, 9 aa, Artificial Sequence
  Description of Artificial Sequence: Synthetic peptide
  Seed: QLVFGIELM (MAGA3_HUMAN)
QLVFGIELL

SEQ ID NO: 51637 - protein, 9 aa, Artificial Sequence
  Description of Artificial Sequence: Synthetic peptide
  Seed: EVDPIGHLY (MAGA3_HUMAN)
EADPIGHLM

SEQ ID NO: 51638 - protein, 10 aa, Artificial Sequence
  Description of Artificial Sequence: Synthetic peptide
  Seed: LGSVVGNWQY (MAGA3_HUMAN)
LQSVVGNWQW

SEQ ID NO: 51639 - protein, 9 aa, Artificial Sequence
  Description of Artificial Sequence: Synthetic peptide
  Seed: GASSLPTTM (MAGA3_HUMAN)
GPSSLPTTF

SEQ ID NO: 51640 - protein, 9 aa, Artificial Sequence
  Description of Artificial Sequence: Synthetic peptide
  Seed: EVDPIGHLY (MAGA3_HUMAN)
EGDPIGHLM

SEQ ID NO: 51641 - protein, 10 aa, Artificial Sequence
  Description of Artificial Sequence: Synthetic peptide
  Seed: RKVAELVHFL (MAGA3_HUMAN)
RCVAELVHFI

SEQ ID NO: 51642 - protein, 9 aa, Artificial Sequence
  Description of Artificial Sequence: Synthetic peptide
  Seed: FATCLGLSY (MAGA3_HUMAN)
FLTCLGLSM

SEQ ID NO: 51643 - protein, 9 aa, Artificial Sequence
  Description of Artificial Sequence: Synthetic peptide
  Seed: AELVHFLLL (MAGA3_HUMAN)
AELVHFLLM

SEQ ID NO: 51644 - protein, 9 aa, Artificial Sequence
  Description of Artificial Sequence: Synthetic peptide
  Seed: MVKISGGPH (MAGA3_HUMAN)
MTKISGGPY

SEQ ID NO: 51645 - protein, 10 aa, Artificial Sequence
  Description of Artificial Sequence: Synthetic peptide
  Seed: QYFFPVIFSK (MAGA3_HUMAN)
QCFFPVIFSR

SEQ ID NO: 51646 - protein, 9 aa, Artificial Sequence
  Description of Artificial Sequence: Synthetic peptide
  Seed: TSYVKVLHH (MAGA3_HUMAN)
TIYVKVLHR

SEQ ID NO: 51647 - protein, 9 aa, Artificial Sequence
  Description of Artificial Sequence: Synthetic peptide
  Seed: TFPDLESEF (MAGA3_HUMAN)
TLPDLESEL

SEQ ID NO: 51648 - protein, 11 aa, Artificial Sequence
  Description of Artificial Sequence: Synthetic peptide
  Seed: REGDCAPEEKI (MAGA3_HUMAN)
RLGDCAPEEKL

SEQ ID NO: 51649 - protein, 10 aa, Artificial Sequence
  Description of Artificial Sequence: Synthetic peptide
  Seed: TLVEVTLGEV (MAGA3_HUMAN)
TLVEVTLGEI

SEQ ID NO: 51650 - protein, 9 aa, Artificial Sequence
  Description of Artificial Sequence: Synthetic peptide
  Seed: EFQAALSRK (MAGA3_HUMAN)
EFQAALSRR

SEQ ID NO: 51651 - protein, 10 aa, Artificial Sequence
  Description of Artificial Sequence: Synthetic peptide
  Seed: ASSSSTLVEV (MAGA3_HUMAN)
AASSSTLVEM

SEQ ID NO: 51652 - protein, 11 aa, Artificial Sequence
  Description of Artificial Sequence: Synthetic peptide
  Seed: MLGSVVGNWQY (MAGA3_HUMAN)
MSGSVVGNWQF

SEQ ID NO: 51653 - protein, 9 aa, Artificial Sequence
  Description of Artificial Sequence: Synthetic peptide
  Seed: SSSSTLVEV (MAGA3_HUMAN)
SRSSTLVEL

SEQ ID NO: 51654 - protein, 9 aa, Artificial Sequence
  Description of Artificial Sequence: Synthetic peptide
  Seed: EVDPIGHLY (MAGA3_HUMAN)
EYDPIGHLM

SEQ ID NO: 51655 - protein, 8 aa, Artificial Sequence
  Description of Artificial Sequence: Synthetic peptide
  Seed: AGLLIIVL (MAGA3_HUMAN)
AQLLIIVV

SEQ ID NO: 51656 - protein, 10 aa, Artificial Sequence
  Description of Artificial Sequence: Synthetic peptide
  Seed: KVAELVHFLL (MAGA3_HUMAN)
KVAELVHFLY

SEQ ID NO: 51657 - protein, 10 aa, Artificial Sequence
  Description of Artificial Sequence: Synthetic peptide
  Seed: KASSSLQLVF (MAGA3_HUMAN)
KISSSLQLVY

SEQ ID NO: 51658 - protein, 10 aa, Artificial Sequence
  Description of Artificial Sequence: Synthetic peptide
  Seed: HISYPPLHEW (MAGA3_HUMAN)
HRSYPPLHEM

SEQ ID NO: 51659 - protein, 10 aa, Artificial Sequence
  Description of Artificial Sequence: Synthetic peptide
  Seed: AESPDPPQSP (MAGA3_HUMAN)
AESPDPPQSF

SEQ ID NO: 51660 - protein, 9 aa, Artificial Sequence
  Description of Artificial Sequence: Synthetic peptide
  Seed: IIVLAIIAR (MAGA3_HUMAN)
IYVLAIIAR

SEQ ID NO: 51661 - protein, 9 aa, Artificial Sequence
  Description of Artificial Sequence: Synthetic peptide
  Seed: KASSSLQLV (MAGA3_HUMAN)
KQSSSLQLF

SEQ ID NO: 51662 - protein, 9 aa, Artificial Sequence
  Description of Artificial Sequence: Synthetic peptide
  Seed: SYVKVLHHM (MAGA3_HUMAN)
SWVKVLHHI

SEQ ID NO: 51663 - protein, 11 aa, Artificial Sequence
  Description of Artificial Sequence: Synthetic peptide
  Seed: MLGSVVGNWQY (MAGA3_HUMAN)
MHGSVVGNWQW

SEQ ID NO: 51664 - protein, 9 aa, Artificial Sequence
  Description of Artificial Sequence: Synthetic peptide
  Seed: IMPKAGLLI (MAGA3_HUMAN)
ILPKAGLLY

SEQ ID NO: 51665 - protein, 11 aa, Artificial Sequence
  Description of Artificial Sequence: Synthetic peptide
  Seed: VKISGGPHISY (MAGA3_HUMAN)
VVISGGPHISY

SEQ ID NO: 51666 - protein, 9 aa, Artificial Sequence
  Description of Artificial Sequence: Synthetic peptide
  Seed: FATCLGLSY (MAGA3_HUMAN)
FQTCLGLSI

SEQ ID NO: 51667 - protein, 10 aa, Artificial Sequence
  Description of Artificial Sequence: Synthetic peptide
  Seed: LVFGIELMEV (MAGA3_HUMAN)
LMFGIELMEV

SEQ ID NO: 51668 - protein, 9 aa, Artificial Sequence
  Description of Artificial Sequence: Synthetic peptide
  Seed: QIMPKAGLL (MAGA3_HUMAN)
QVMPKAGLK

SEQ ID NO: 51669 - protein, 11 aa, Artificial Sequence
  Description of Artificial Sequence: Synthetic peptide
  Seed: FLWGPRALVET (MAGA3_HUMAN)
FIWGPRALVEL

SEQ ID NO: 51670 - protein, 11 aa, Artificial Sequence
  Description of Artificial Sequence: Synthetic peptide
  Seed: RQVPGSDPACY (MAGA3_HUMAN)
RYVPGSDPACY

SEQ ID NO: 51671 - protein, 9 aa, Artificial Sequence
  Description of Artificial Sequence: Synthetic peptide
  Seed: IMPKAGLLI (MAGA3_HUMAN)
IWPKAGLLF

SEQ ID NO: 51672 - protein, 10 aa, Artificial Sequence
  Description of Artificial Sequence: Synthetic peptide
  Seed: LGSVVGNWQY (MAGA3_HUMAN)
LYSVVGNWQW

SEQ ID NO: 51673 - protein, 9 aa, Artificial Sequence
  Description of Artificial Sequence: Synthetic peptide
  Seed: FVQENYLEY (MAGA3_HUMAN)
FIQENYLER

SEQ ID NO: 51674 - protein, 9 aa, Artificial Sequence
  Description of Artificial Sequence: Synthetic peptide
  Seed: YFFPVIFSK (MAGA3_HUMAN)
YPFPVIFSY

SEQ ID NO: 51675 - protein, 10 aa, Artificial Sequence
  Description of Artificial Sequence: Synthetic peptide
  Seed: KISGGPHISY (MAGA3_HUMAN)
KISGGPHISW

SEQ ID NO: 51676 - protein, 10 aa, Artificial Sequence
  Description of Artificial Sequence: Synthetic peptide
  Seed: MNYPLWSQSY (MAGA3_HUMAN)
MDYPLWSQSV

SEQ ID NO: 51677 - protein, 9 aa, Artificial Sequence
  Description of Artificial Sequence: Synthetic peptide
  Seed: ISYPPLHEW (MAGA3_HUMAN)
IGYPPLHEM

SEQ ID NO: 51678 - protein, 10 aa, Artificial Sequence
  Description of Artificial Sequence: Synthetic peptide
  Seed: MVKISGGPHI (MAGA3_HUMAN)
MCKISGGPHF

SEQ ID NO: 51679 - protein, 10 aa, Artificial Sequence
  Description of Artificial Sequence: Synthetic peptide
  Seed: WEELSVLEVF (MAGA3_HUMAN)
WQELSVLEVL

SEQ ID NO: 51680 - protein, 8 aa, Artificial Sequence
  Description of Artificial Sequence: Synthetic peptide
  Seed: FPDLESEF (MAGA3_HUMAN)
FMDLESEM

SEQ ID NO: 51681 - protein, 10 aa, Artificial Sequence
  Description of Artificial Sequence: Synthetic peptide
  Seed: EAASSSSTLV (MAGA3_HUMAN)
EVASSSSTLI

SEQ ID NO: 51682 - protein, 10 aa, Artificial Sequence
  Description of Artificial Sequence: Synthetic peptide
  Seed: NWQYFFPVIF (MAGA3_HUMAN)
NAQYFFPVIF

SEQ ID NO: 51683 - protein, 9 aa, Artificial Sequence
  Description of Artificial Sequence: Synthetic peptide
  Seed: NWQYFFPVI (MAGA3_HUMAN)
NFQYFFPVW

SEQ ID NO: 51684 - protein, 11 aa, Artificial Sequence
  Description of Artificial Sequence: Synthetic peptide
  Seed: AEMLGSVVGNW (MAGA3_HUMAN)
AAMLGSVVGNW

SEQ ID NO: 51685 - protein, 9 aa, Artificial Sequence
  Description of Artificial Sequence: Synthetic peptide
  Seed: GASSLPTTM (MAGA3_HUMAN)
GTSSLPTTV

SEQ ID NO: 51686 - protein, 9 aa, Artificial Sequence
  Description of Artificial Sequence: Synthetic peptide
  Seed: FVQENYLEY (MAGA3_HUMAN)
FYQENYLEV

SEQ ID NO: 51687 - protein, 9 aa, Artificial Sequence
  Description of Artificial Sequence: Synthetic peptide
  Seed: FVQENYLEY (MAGA3_HUMAN)
FSQENYLEI

SEQ ID NO: 51688 - protein, 10 aa, Artificial Sequence
  Description of Artificial Sequence: Synthetic peptide
  Seed: ELVHFLLLKY (MAGA3_HUMAN)
EVVHFLLLKY

SEQ ID NO: 51689 - protein, 9 aa, Artificial Sequence
  Description of Artificial Sequence: Synthetic peptide
  Seed: LSRKVAELV (MAGA3_HUMAN)
LVRKVAELF

SEQ ID NO: 51690 - protein, 10 aa, Artificial Sequence
  Description of Artificial Sequence: Synthetic peptide
  Seed: STFPDLESEF (MAGA3_HUMAN)
SLFPDLESER

SEQ ID NO: 51691 - protein, 9 aa, Artificial Sequence
  Description of Artificial Sequence: Synthetic peptide
  Seed: KIWEELSVL (MAGA3_HUMAN)
KSWEELSVI

SEQ ID NO: 51692 - protein, 9 aa, Artificial Sequence
  Description of Artificial Sequence: Synthetic peptide
  Seed: TSYVKVLHH (MAGA3_HUMAN)
TQYVKVLHK

SEQ ID NO: 51693 - protein, 9 aa, Artificial Sequence
  Description of Artificial Sequence: Synthetic peptide
  Seed: EALGLVGAQ (MAGA3_HUMAN)
ETLGLVGAY

SEQ ID NO: 51694 - protein, 11 aa, Artificial Sequence
  Description of Artificial Sequence: Synthetic peptide
  Seed: MEVDPIGHLYI (MAGA3_HUMAN)
MQVDPIGHLYF

SEQ ID NO: 51695 - protein, 10 aa, Artificial Sequence
  Description of Artificial Sequence: Synthetic peptide
  Seed: KISGGPHISY (MAGA3_HUMAN)
KCSGGPHISW

SEQ ID NO: 51696 - protein, 9 aa, Artificial Sequence
  Description of Artificial Sequence: Synthetic peptide
  Seed: YFFPVIFSK (MAGA3_HUMAN)
YQFPVIFSV

SEQ ID NO: 51697 - protein, 9 aa, Artificial Sequence
  Description of Artificial Sequence: Synthetic peptide
  Seed: MLGSVVGNW (MAGA3_HUMAN)
MQGSVVGNL

SEQ ID NO: 51698 - protein, 9 aa, Artificial Sequence
  Description of Artificial Sequence: Synthetic peptide
  Seed: FVQENYLEY (MAGA3_HUMAN)
FFQENYLEY

SEQ ID NO: 51699 - protein, 10 aa, Artificial Sequence
  Description of Artificial Sequence: Synthetic peptide
  Seed: RKVAELVHFL (MAGA3_HUMAN)
RSVAELVHFI

SEQ ID NO: 51700 - protein, 10 aa, Artificial Sequence
  Description of Artificial Sequence: Synthetic peptide
  Seed: VTKAEMLGSV (MAGA3_HUMAN)
VMKAEMLGSI

SEQ ID NO: 51701 - protein, 9 aa, Artificial Sequence
  Description of Artificial Sequence: Synthetic peptide
  Seed: RQVPGSDPA (MAGA3_HUMAN)
RQVPGSDPM

SEQ ID NO: 51702 - protein, 9 aa, Artificial Sequence
  Description of Artificial Sequence: Synthetic peptide
  Seed: SVVGNWQYF (MAGA3_HUMAN)
SIVGNWQYR

SEQ ID NO: 51703 - protein, 10 aa, Artificial Sequence
  Description of Artificial Sequence: Synthetic peptide
  Seed: YIFATCLGLS (MAGA3_HUMAN)
YTFATCLGLL

SEQ ID NO: 51704 - protein, 10 aa, Artificial Sequence
  Description of Artificial Sequence: Synthetic peptide
  Seed: KVAELVHFLL (MAGA3_HUMAN)
KIAELVHFLT

SEQ ID NO: 51705 - protein, 9 aa, Artificial Sequence
  Description of Artificial Sequence: Synthetic peptide
  Seed: KIWEELSVL (MAGA3_HUMAN)
KQWEELSVL

SEQ ID NO: 51706 - protein, 9 aa, Artificial Sequence
  Description of Artificial Sequence: Synthetic peptide
  Seed: SSTLVEVTL (MAGA3_HUMAN)
SLTLVEVTF

SEQ ID NO: 51707 - protein, 9 aa, Artificial Sequence
  Description of Artificial Sequence: Synthetic peptide
  Seed: EVDPIGHLY (MAGA3_HUMAN)
ETDPIGHLY

SEQ ID NO: 51708 - protein, 10 aa, Artificial Sequence
  Description of Artificial Sequence: Synthetic peptide
  Seed: KASSSLQLVF (MAGA3_HUMAN)
KDSSSLQLVY

SEQ ID NO: 51709 - protein, 9 aa, Artificial Sequence
  Description of Artificial Sequence: Synthetic peptide
  Seed: IFSKASSSL (MAGA3_HUMAN)
IGSKASSSY

SEQ ID NO: 51710 - protein, 9 aa, Artificial Sequence
  Description of Artificial Sequence: Synthetic peptide
  Seed: FVQENYLEY (MAGA3_HUMAN)
FRQENYLEL

SEQ ID NO: 51711 - protein, 10 aa, Artificial Sequence
  Description of Artificial Sequence: Synthetic peptide
  Seed: LPTTMNYPLW (MAGA3_HUMAN)
LHTTMNYPLW

SEQ ID NO: 51712 - protein, 9 aa, Artificial Sequence
  Description of Artificial Sequence: Synthetic peptide
  Seed: GASSLPTTM (MAGA3_HUMAN)
GESSLPTTF

SEQ ID NO: 51713 - protein, 10 aa, Artificial Sequence
  Description of Artificial Sequence: Synthetic peptide
  Seed: KAEMLGSVVG (MAGA3_HUMAN)
KTEMLGSVVA

SEQ ID NO: 51714 - protein, 9 aa, Artificial Sequence
  Description of Artificial Sequence: Synthetic peptide
  Seed: MPLEQRSQH (MAGA3_HUMAN)
MPLEQRSQM

SEQ ID NO: 51715 - protein, 9 aa, Artificial Sequence
  Description of Artificial Sequence: Synthetic peptide
  Seed: SVLEVFEGR (MAGA3_HUMAN)
STLEVFEGY

SEQ ID NO: 51716 - protein, 10 aa, Artificial Sequence
  Description of Artificial Sequence: Synthetic peptide
  Seed: LVFGIELMEV (MAGA3_HUMAN)
LVFGIELMEI

SEQ ID NO: 51717 - protein, 9 aa, Artificial Sequence
  Description of Artificial Sequence: Synthetic peptide
  Seed: KAGLLIIVL (MAGA3_HUMAN)
KQGLLIIVL

SEQ ID NO: 51718 - protein, 9 aa, Artificial Sequence
  Description of Artificial Sequence: Synthetic peptide
  Seed: GSDPACYEF (MAGA3_HUMAN)
GLDPACYEI

SEQ ID NO: 51719 - protein, 10 aa, Artificial Sequence
  Description of Artificial Sequence: Synthetic peptide
  Seed: KASSSLQLVF (MAGA3_HUMAN)
KQSSSLQLVI

SEQ ID NO: 51720 - protein, 9 aa, Artificial Sequence
  Description of Artificial Sequence: Synthetic peptide
  Seed: LESEFQAAL (MAGA3_HUMAN)
LVSEFQAAL

SEQ ID NO: 51721 - protein, 8 aa, Artificial Sequence
  Description of Artificial Sequence: Synthetic peptide
  Seed: FPDLESEF (MAGA3_HUMAN)
FLDLESEV

SEQ ID NO: 51722 - protein, 9 aa, Artificial Sequence
  Description of Artificial Sequence: Synthetic peptide
  Seed: LVHFLLLKY (MAGA3_HUMAN)
LMHFLLLKY

SEQ ID NO: 51723 - protein, 10 aa, Artificial Sequence
  Description of Artificial Sequence: Synthetic peptide
  Seed: ISYPPLHEWV (MAGA3_HUMAN)
IDYPPLHEWI

SEQ ID NO: 51724 - protein, 10 aa, Artificial Sequence
  Description of Artificial Sequence: Synthetic peptide
  Seed: EAASSSSTLV (MAGA3_HUMAN)
ESASSSSTLV

SEQ ID NO: 51725 - protein, 9 aa, Artificial Sequence
  Description of Artificial Sequence: Synthetic peptide
  Seed: YVKVLHHMV (MAGA3_HUMAN)
YSKVLHHML

SEQ ID NO: 51726 - protein, 8 aa, Artificial Sequence
  Description of Artificial Sequence: Synthetic peptide
  Seed: FPDLESEF (MAGA3_HUMAN)
FSDLESEL

SEQ ID NO: 51727 - protein, 9 aa, Artificial Sequence
  Description of Artificial Sequence: Synthetic peptide
  Seed: GSDPACYEF (MAGA3_HUMAN)
GTDPACYEL

SEQ ID NO: 51728 - protein, 9 aa, Artificial Sequence
  Description of Artificial Sequence: Synthetic peptide
  Seed: KVLHHMVKI (MAGA3_HUMAN)
KILHHMVKW

SEQ ID NO: 51729 - protein, 10 aa, Artificial Sequence
  Description of Artificial Sequence: Synthetic peptide
  Seed: DLESEFQAAL (MAGA3_HUMAN)
DAESEFQAAF

SEQ ID NO: 51730 - protein, 9 aa, Artificial Sequence
  Description of Artificial Sequence: Synthetic peptide
  Seed: IMPKAGLLI (MAGA3_HUMAN)
ISPKAGLLL

SEQ ID NO: 51731 - protein, 9 aa, Artificial Sequence
  Description of Artificial Sequence: Synthetic peptide
  Seed: RQVPGSDPA (MAGA3_HUMAN)
RLVPGSDPW

SEQ ID NO: 51732 - protein, 9 aa, Artificial Sequence
  Description of Artificial Sequence: Synthetic peptide
  Seed: NQIMPKAGL (MAGA3_HUMAN)
NHIMPKAGV

SEQ ID NO: 51733 - protein, 11 aa, Artificial Sequence
  Description of Artificial Sequence: Synthetic peptide
  Seed: KIWEELSVLEV (MAGA3_HUMAN)
KLWEELSVLET

SEQ ID NO: 51734 - protein, 10 aa, Artificial Sequence
  Description of Artificial Sequence: Synthetic peptide
  Seed: LVFGIELMEV (MAGA3_HUMAN)
LTFGIELMEL

SEQ ID NO: 51735 - protein, 10 aa, Artificial Sequence
  Description of Artificial Sequence: Synthetic peptide
  Seed: KISGGPHISY (MAGA3_HUMAN)
KQSGGPHISR

SEQ ID NO: 51736 - protein, 10 aa, Artificial Sequence
  Description of Artificial Sequence: Synthetic peptide
  Seed: KAEMLGSVVG (MAGA3_HUMAN)
KEEMLGSVVP

SEQ ID NO: 51737 - protein, 10 aa, Artificial Sequence
  Description of Artificial Sequence: Synthetic peptide
  Seed: ASSSSTLVEV (MAGA3_HUMAN)
ATSSSTLVEI

SEQ ID NO: 51738 - protein, 9 aa, Artificial Sequence
  Description of Artificial Sequence: Synthetic peptide
  Seed: WQYFFPVIF (MAGA3_HUMAN)
WEYFFPVIF

SEQ ID NO: 51739 - protein, 10 aa, Artificial Sequence
  Description of Artificial Sequence: Synthetic peptide
  Seed: SVVGNWQYFF (MAGA3_HUMAN)
SGVGNWQYFY

SEQ ID NO: 51740 - protein, 9 aa, Artificial Sequence
  Description of Artificial Sequence: Synthetic peptide
  Seed: AELVHFLLL (MAGA3_HUMAN)
AELVHFLLV

SEQ ID NO: 51741 - protein, 10 aa, Artificial Sequence
  Description of Artificial Sequence: Synthetic peptide
  Seed: LTQHFVQENY (MAGA3_HUMAN)
LSQHFVQENF

SEQ ID NO: 51742 - protein, 9 aa, Artificial Sequence
  Description of Artificial Sequence: Synthetic peptide
  Seed: KVLHHMVKI (MAGA3_HUMAN)
KALHHMVKF

SEQ ID NO: 51743 - protein, 10 aa, Artificial Sequence
  Description of Artificial Sequence: Synthetic peptide
  Seed: MVKISGGPHI (MAGA3_HUMAN)
MSKISGGPHM

SEQ ID NO: 51744 - protein, 9 aa, Artificial Sequence
  Description of Artificial Sequence: Synthetic peptide
  Seed: MEVDPIGHL (MAGA3_HUMAN)
MEVDPIGHY

SEQ ID NO: 51745 - protein, 9 aa, Artificial Sequence
  Description of Artificial Sequence: Synthetic peptide
  Seed: YIFATCLGL (MAGA3_HUMAN)
YFFATCLGL

SEQ ID NO: 51746 - protein, 9 aa, Artificial Sequence
  Description of Artificial Sequence: Synthetic peptide
  Seed: ALSRKVAEL (MAGA3_HUMAN)
ALSRKVAEM

SEQ ID NO: 51747 - protein, 10 aa, Artificial Sequence
  Description of Artificial Sequence: Synthetic peptide
  Seed: YIFATCLGLS (MAGA3_HUMAN)
YIFATCLGLI

SEQ ID NO: 51748 - protein, 9 aa, Artificial Sequence
  Description of Artificial Sequence: Synthetic peptide
  Seed: ISGGPHISY (MAGA3_HUMAN)
IMGGPHISL

SEQ ID NO: 51749 - protein, 9 aa, Artificial Sequence
  Description of Artificial Sequence: Synthetic peptide
  Seed: MPKAGLLII (MAGA3_HUMAN)
MAKAGLLIF

SEQ ID NO: 51750 - protein, 10 aa, Artificial Sequence
  Description of Artificial Sequence: Synthetic peptide
  Seed: KASSSLQLVF (MAGA3_HUMAN)
KASSSLQLVM

SEQ ID NO: 51751 - protein, 10 aa, Artificial Sequence
  Description of Artificial Sequence: Synthetic peptide
  Seed: MNYPLWSQSY (MAGA3_HUMAN)
MQYPLWSQSA

SEQ ID NO: 51752 - protein, 9 aa, Artificial Sequence
  Description of Artificial Sequence: Synthetic peptide
  Seed: LQLVFGIEL (MAGA3_HUMAN)
LELVFGIEV

SEQ ID NO: 51753 - protein, 11 aa, Artificial Sequence
  Description of Artificial Sequence: Synthetic peptide
  Seed: STFPDLESEFQ (MAGA3_HUMAN)
STFPDLESEFR

SEQ ID NO: 51754 - protein, 10 aa, Artificial Sequence
  Description of Artificial Sequence: Synthetic peptide
  Seed: SILGDPKKLL (MAGA3_HUMAN)
SQLGDPKKLL

SEQ ID NO: 51755 - protein, 9 aa, Artificial Sequence
  Description of Artificial Sequence: Synthetic peptide
  Seed: GEALGLVGA (MAGA3_HUMAN)
GEALGLVGI

SEQ ID NO: 51756 - protein, 10 aa, Artificial Sequence
  Description of Artificial Sequence: Synthetic peptide
  Seed: YIFATCLGLS (MAGA3_HUMAN)
YMFATCLGLY

SEQ ID NO: 51757 - protein, 10 aa, Artificial Sequence
  Description of Artificial Sequence: Synthetic peptide
  Seed: MNYPLWSQSY (MAGA3_HUMAN)
MSYPLWSQSW

SEQ ID NO: 51758 - protein, 9 aa, Artificial Sequence
  Description of Artificial Sequence: Synthetic peptide
  Seed: SYVKVLHHM (MAGA3_HUMAN)
SWVKVLHHF

SEQ ID NO: 51759 - protein, 11 aa, Artificial Sequence
  Description of Artificial Sequence: Synthetic peptide
  Seed: SKASSSLQLVF (MAGA3_HUMAN)
SMASSSLQLVF

SEQ ID NO: 51760 - protein, 9 aa, Artificial Sequence
  Description of Artificial Sequence: Synthetic peptide
  Seed: LVHFLLLKY (MAGA3_HUMAN)
LAHFLLLKF

SEQ ID NO: 51761 - protein, 9 aa, Artificial Sequence
  Description of Artificial Sequence: Synthetic peptide
  Seed: YVKVLHHMV (MAGA3_HUMAN)
YSKVLHHMM

SEQ ID NO: 51762 - protein, 10 aa, Artificial Sequence
  Description of Artificial Sequence: Synthetic peptide
  Seed: LGLVGAQAPA (MAGA3_HUMAN)
LLLVGAQAPV

SEQ ID NO: 51763 - protein, 8 aa, Artificial Sequence
  Description of Artificial Sequence: Synthetic peptide
  Seed: FPDLESEF (MAGA3_HUMAN)
FADLESEV

SEQ ID NO: 51764 - protein, 9 aa, Artificial Sequence
  Description of Artificial Sequence: Synthetic peptide
  Seed: ISGGPHISY (MAGA3_HUMAN)
IWGGPHISL

SEQ ID NO: 51765 - protein, 9 aa, Artificial Sequence
  Description of Artificial Sequence: Synthetic peptide
  Seed: ALGLVGAQA (MAGA3_HUMAN)
AVGLVGAQV

SEQ ID NO: 51766 - protein, 10 aa, Artificial Sequence
  Description of Artificial Sequence: Synthetic peptide
  Seed: DLESEFQAAL (MAGA3_HUMAN)
DWESEFQAAF

SEQ ID NO: 51767 - protein, 11 aa, Artificial Sequence
  Description of Artificial Sequence: Synthetic peptide
  Seed: GASSLPTTMNY (MAGA3_HUMAN)
GASSLPTTMNW

SEQ ID NO: 51768 - protein, 9 aa, Artificial Sequence
  Description of Artificial Sequence: Synthetic peptide
  Seed: TSYVKVLHH (MAGA3_HUMAN)
TTYVKVLHM

SEQ ID NO: 51769 - protein, 10 aa, Artificial Sequence
  Description of Artificial Sequence: Synthetic peptide
  Seed: WEELSVLEVF (MAGA3_HUMAN)
WDELSVLEVY

SEQ ID NO: 51770 - protein, 9 aa, Artificial Sequence
  Description of Artificial Sequence: Synthetic peptide
  Seed: KVLHHMVKI (MAGA3_HUMAN)
KVLHHMVKY

SEQ ID NO: 51771 - protein, 10 aa, Artificial Sequence
  Description of Artificial Sequence: Synthetic peptide
  Seed: SEFQAALSRK (MAGA3_HUMAN)
SIFQAALSRK

SEQ ID NO: 51772 - protein, 9 aa, Artificial Sequence
  Description of Artificial Sequence: Synthetic peptide
  Seed: HLYIFATCL (MAGA3_HUMAN)
HYYIFATCM

SEQ ID NO: 51773 - protein, 10 aa, Artificial Sequence
  Description of Artificial Sequence: Synthetic peptide
  Seed: KVAELVHFLL (MAGA3_HUMAN)
KLAELVHFLW

SEQ ID NO: 51774 - protein, 9 aa, Artificial Sequence
  Description of Artificial Sequence: Synthetic peptide
  Seed: KVAELVHFL (MAGA3_HUMAN)
KMAELVHFW

SEQ ID NO: 51775 - protein, 10 aa, Artificial Sequence
  Description of Artificial Sequence: Synthetic peptide
  Seed: EAASSSSTLV (MAGA3_HUMAN)
ETASSSSTLL

SEQ ID NO: 51776 - protein, 9 aa, Artificial Sequence
  Description of Artificial Sequence: Synthetic peptide
  Seed: KIWEELSVL (MAGA3_HUMAN)
KMWEELSVK

SEQ ID NO: 51777 - protein, 9 aa, Artificial Sequence
  Description of Artificial Sequence: Synthetic peptide
  Seed: RKVAELVHF (MAGA3_HUMAN)
RMVAELVHM

SEQ ID NO: 51778 - protein, 9 aa, Artificial Sequence
  Description of Artificial Sequence: Synthetic peptide
  Seed: EAASSSSTL (MAGA3_HUMAN)
EPASSSSTF

SEQ ID NO: 51779 - protein, 9 aa, Artificial Sequence
  Description of Artificial Sequence: Synthetic peptide
  Seed: GEVPAAESP (MAGA3_HUMAN)
GEVPAAESC

SEQ ID NO: 51780 - protein, 9 aa, Artificial Sequence
  Description of Artificial Sequence: Synthetic peptide
  Seed: LESEFQAAL (MAGA3_HUMAN)
LHSEFQAAL

SEQ ID NO: 51781 - protein, 9 aa, Artificial Sequence
  Description of Artificial Sequence: Synthetic peptide
  Seed: AASSSSTLV (MAGA3_HUMAN)
ALSSSSTLV

SEQ ID NO: 51782 - protein, 9 aa, Artificial Sequence
  Description of Artificial Sequence: Synthetic peptide
  Seed: IELMEVDPI (MAGA3_HUMAN)
IELMEVDPL

SEQ ID NO: 51783 - protein, 9 aa, Artificial Sequence
  Description of Artificial Sequence: Synthetic peptide
  Seed: SVLEVFEGR (MAGA3_HUMAN)
SILEVFEGR

SEQ ID NO: 51784 - protein, 10 aa, Artificial Sequence
  Description of Artificial Sequence: Synthetic peptide
  Seed: VDPIGHLYIF (MAGA3_HUMAN)
VSPIGHLYIY

SEQ ID NO: 51785 - protein, 9 aa, Artificial Sequence
  Description of Artificial Sequence: Synthetic peptide
  Seed: LESEFQAAL (MAGA3_HUMAN)
LLSEFQAAT

SEQ ID NO: 51786 - protein, 9 aa, Artificial Sequence
  Description of Artificial Sequence: Synthetic peptide
  Seed: KVAELVHFL (MAGA3_HUMAN)
KNAELVHFY

SEQ ID NO: 51787 - protein, 10 aa, Artificial Sequence
  Description of Artificial Sequence: Synthetic peptide
  Seed: KASSSLQLVF (MAGA3_HUMAN)
KPSSSLQLVM

SEQ ID NO: 51788 - protein, 10 aa, Artificial Sequence
  Description of Artificial Sequence: Synthetic peptide
  Seed: YFFPVIFSKA (MAGA3_HUMAN)
YQFPVIFSKR

SEQ ID NO: 51789 - protein, 9 aa, Artificial Sequence
  Description of Artificial Sequence: Synthetic peptide
  Seed: WQYFFPVIF (MAGA3_HUMAN)
WSYFFPVIF

SEQ ID NO: 51790 - protein, 9 aa, Artificial Sequence
  Description of Artificial Sequence: Synthetic peptide
  Seed: HLYIFATCL (MAGA3_HUMAN)
HTYIFATCF

SEQ ID NO: 51791 - protein, 9 aa, Artificial Sequence
  Description of Artificial Sequence: Synthetic peptide
  Seed: LGDPKKLLT (MAGA3_HUMAN)
LSDPKKLLI

SEQ ID NO: 51792 - protein, 9 aa, Artificial Sequence
  Description of Artificial Sequence: Synthetic peptide
  Seed: EAASSSSTL (MAGA3_HUMAN)
EAASSSSTW

SEQ ID NO: 51793 - protein, 10 aa, Artificial Sequence
  Description of Artificial Sequence: Synthetic peptide
  Seed: LGSVVGNWQY (MAGA3_HUMAN)
LFSVVGNWQF

SEQ ID NO: 51794 - protein, 10 aa, Artificial Sequence
  Description of Artificial Sequence: Synthetic peptide
  Seed: TSYVKVLHHM (MAGA3_HUMAN)
TMYVKVLHHF

SEQ ID NO: 51795 - protein, 9 aa, Artificial Sequence
  Description of Artificial Sequence: Synthetic peptide
  Seed: TQHFVQENY (MAGA3_HUMAN)
TVHFVQENY

SEQ ID NO: 51796 - protein, 10 aa, Artificial Sequence
  Description of Artificial Sequence: Synthetic peptide
  Seed: SLQLVFGIEL (MAGA3_HUMAN)
SHQLVFGIEY

SEQ ID NO: 51797 - protein, 9 aa, Artificial Sequence
  Description of Artificial Sequence: Synthetic peptide
  Seed: VTLGEVPAA (MAGA3_HUMAN)
VLLGEVPAI

SEQ ID NO: 51798 - protein, 10 aa, Artificial Sequence
  Description of Artificial Sequence: Synthetic peptide
  Seed: AALSRKVAEL (MAGA3_HUMAN)
ADLSRKVAEV

SEQ ID NO: 51799 - protein, 10 aa, Artificial Sequence
  Description of Artificial Sequence: Synthetic peptide
  Seed: SEFQAALSRK (MAGA3_HUMAN)
SAFQAALSRK

SEQ ID NO: 51800 - protein, 9 aa, Artificial Sequence
  Description of Artificial Sequence: Synthetic peptide
  Seed: YFFPVIFSK (MAGA3_HUMAN)
YPFPVIFSR

SEQ ID NO: 51801 - protein, 10 aa, Artificial Sequence
  Description of Artificial Sequence: Synthetic peptide
  Seed: HISYPPLHEW (MAGA3_HUMAN)
HVSYPPLHEF

SEQ ID NO: 51802 - protein, 9 aa, Artificial Sequence
  Description of Artificial Sequence: Synthetic peptide
  Seed: IFSKASSSL (MAGA3_HUMAN)
IFSKASSSF

SEQ ID NO: 51803 - protein, 8 aa, Artificial Sequence
  Description of Artificial Sequence: Synthetic peptide
  Seed: QYFFPVIF (MAGA3_HUMAN)
QMFFPVIY

SEQ ID NO: 51804 - protein, 10 aa, Artificial Sequence
  Description of Artificial Sequence: Synthetic peptide
  Seed: MNYPLWSQSY (MAGA3_HUMAN)
MQYPLWSQSW

SEQ ID NO: 51805 - protein, 10 aa, Artificial Sequence
  Description of Artificial Sequence: Synthetic peptide
  Seed: TSYVKVLHHM (MAGA3_HUMAN)
TEYVKVLHHF

SEQ ID NO: 51806 - protein, 10 aa, Artificial Sequence
  Description of Artificial Sequence: Synthetic peptide
  Seed: TLVEVTLGEV (MAGA3_HUMAN)
TMVEVTLGEA

SEQ ID NO: 51807 - protein, 9 aa, Artificial Sequence
  Description of Artificial Sequence: Synthetic peptide
  Seed: KVLHHMVKI (MAGA3_HUMAN)
KMLHHMVKF

SEQ ID NO: 51808 - protein, 10 aa, Artificial Sequence
  Description of Artificial Sequence: Synthetic peptide
  Seed: YRQVPGSDPA (MAGA3_HUMAN)
YTQVPGSDPV

SEQ ID NO: 51809 - protein, 11 aa, Artificial Sequence
  Description of Artificial Sequence: Synthetic peptide
  Seed: EVDPIGHLYIF (MAGA3_HUMAN)
ESDPIGHLYIY

SEQ ID NO: 51810 - protein, 9 aa, Artificial Sequence
  Description of Artificial Sequence: Synthetic peptide
  Seed: GASSLPTTM (MAGA3_HUMAN)
GPSSLPTTY

SEQ ID NO: 51811 - protein, 9 aa, Artificial Sequence
  Description of Artificial Sequence: Synthetic peptide
  Seed: KIWEELSVL (MAGA3_HUMAN)
KAWEELSVM

SEQ ID NO: 51812 - protein, 10 aa, Artificial Sequence
  Description of Artificial Sequence: Synthetic peptide
  Seed: ETSYVKVLHH (MAGA3_HUMAN)
EVSYVKVLHR

SEQ ID NO: 51813 - protein, 11 aa, Artificial Sequence
  Description of Artificial Sequence: Synthetic peptide
  Seed: SSSSTLVEVTL (MAGA3_HUMAN)
SMSSTLVEVTW

SEQ ID NO: 51814 - protein, 9 aa, Artificial Sequence
  Description of Artificial Sequence: Synthetic peptide
  Seed: TFPDLESEF (MAGA3_HUMAN)
TAPDLESEF

SEQ ID NO: 51815 - protein, 10 aa, Artificial Sequence
  Description of Artificial Sequence: Synthetic peptide
  Seed: VIFSKASSSL (MAGA3_HUMAN)
VVFSKASSSI

SEQ ID NO: 51816 - protein, 9 aa, Artificial Sequence
  Description of Artificial Sequence: Synthetic peptide
  Seed: EAASSSSTL (MAGA3_HUMAN)
EIASSSSTV

SEQ ID NO: 51817 - protein, 10 aa, Artificial Sequence
  Description of Artificial Sequence: Synthetic peptide
  Seed: LQLVFGIELM (MAGA3_HUMAN)
LALVFGIELL

SEQ ID NO: 51818 - protein, 8 aa, Artificial Sequence
  Description of Artificial Sequence: Synthetic peptide
  Seed: SGGPHISY (MAGA3_HUMAN)
SQGPHISY

SEQ ID NO: 51819 - protein, 9 aa, Artificial Sequence
  Description of Artificial Sequence: Synthetic peptide
  Seed: QLVFGIELM (MAGA3_HUMAN)
QQVFGIELF

SEQ ID NO: 51820 - protein, 9 aa, Artificial Sequence
  Description of Artificial Sequence: Synthetic peptide
  Seed: FATCLGLSY (MAGA3_HUMAN)
FPTCLGLSH

SEQ ID NO: 51821 - protein, 10 aa, Artificial Sequence
  Description of Artificial Sequence: Synthetic peptide
  Seed: ISYPPLHEWV (MAGA3_HUMAN)
ILYPPLHEWC

SEQ ID NO: 51822 - protein, 8 aa, Artificial Sequence
  Description of Artificial Sequence: Synthetic peptide
  Seed: SSSTLVEV (MAGA3_HUMAN)
SQSTLVEI

SEQ ID NO: 51823 - protein, 9 aa, Artificial Sequence
  Description of Artificial Sequence: Synthetic peptide
  Seed: ISGGPHISY (MAGA3_HUMAN)
IGGGPHISL

SEQ ID NO: 51824 - protein, 10 aa, Artificial Sequence
  Description of Artificial Sequence: Synthetic peptide
  Seed: YFFPVIFSKA (MAGA3_HUMAN)
YIFPVIFSKM

SEQ ID NO: 51825 - protein, 9 aa, Artificial Sequence
  Description of Artificial Sequence: Synthetic peptide
  Seed: ISYPPLHEW (MAGA3_HUMAN)
ITYPPLHEL

SEQ ID NO: 51826 - protein, 10 aa, Artificial Sequence
  Description of Artificial Sequence: Synthetic peptide
  Seed: WEELSVLEVF (MAGA3_HUMAN)
WGELSVLEVW

SEQ ID NO: 51827 - protein, 9 aa, Artificial Sequence
  Description of Artificial Sequence: Synthetic peptide
  Seed: AASSSSTLV (MAGA3_HUMAN)
AASSSSTLY

SEQ ID NO: 51828 - protein, 10 aa, Artificial Sequence
  Description of Artificial Sequence: Synthetic peptide
  Seed: MNYPLWSQSY (MAGA3_HUMAN)
MLYPLWSQSM

SEQ ID NO: 51829 - protein, 9 aa, Artificial Sequence
  Description of Artificial Sequence: Synthetic peptide
  Seed: TSYVKVLHH (MAGA3_HUMAN)
TAYVKVLHM

SEQ ID NO: 51830 - protein, 9 aa, Artificial Sequence
  Description of Artificial Sequence: Synthetic peptide
  Seed: SYVKVLHHM (MAGA3_HUMAN)
SFVKVLHHW

SEQ ID NO: 51831 - protein, 9 aa, Artificial Sequence
  Description of Artificial Sequence: Synthetic peptide
  Seed: IMPKAGLLI (MAGA3_HUMAN)
ISPKAGLLV

SEQ ID NO: 51832 - protein, 10 aa, Artificial Sequence
  Description of Artificial Sequence: Synthetic peptide
  Seed: RQVPGSDPAC (MAGA3_HUMAN)
RTVPGSDPAF

SEQ ID NO: 51833 - protein, 10 aa, Artificial Sequence
  Description of Artificial Sequence: Synthetic peptide
  Seed: ETSYVKVLHH (MAGA3_HUMAN)
EVSYVKVLHK

SEQ ID NO: 51834 - protein, 9 aa, Artificial Sequence
  Description of Artificial Sequence: Synthetic peptide
  Seed: SSLPTTMNY (MAGA3_HUMAN)
SVLPTTMNH

SEQ ID NO: 51835 - protein, 9 aa, Artificial Sequence
  Description of Artificial Sequence: Synthetic peptide
  Seed: FVQENYLEY (MAGA3_HUMAN)
FQQENYLEF

SEQ ID NO: 51836 - protein, 9 aa, Artificial Sequence
  Description of Artificial Sequence: Synthetic peptide
  Seed: QIMPKAGLL (MAGA3_HUMAN)
QIMPKAGLV

SEQ ID NO: 51837 - protein, 9 aa, Artificial Sequence
  Description of Artificial Sequence: Synthetic peptide
  Seed: EVDPIGHLY (MAGA3_HUMAN)
EIDPIGHLL

SEQ ID NO: 51838 - protein, 11 aa, Artificial Sequence
  Description of Artificial Sequence: Synthetic peptide
  Seed: PHISYPPLHEW (MAGA3_HUMAN)
PRISYPPLHEW

SEQ ID NO: 51839 - protein, 9 aa, Artificial Sequence
  Description of Artificial Sequence: Synthetic peptide
  Seed: YFFPVIFSK (MAGA3_HUMAN)
YNFPVIFSK

SEQ ID NO: 51840 - protein, 10 aa, Artificial Sequence
  Description of Artificial Sequence: Synthetic peptide
  Seed: TSYVKVLHHM (MAGA3_HUMAN)
TAYVKVLHHF

SEQ ID NO: 51841 - protein, 10 aa, Artificial Sequence
  Description of Artificial Sequence: Synthetic peptide
  Seed: EAASSSSTLV (MAGA3_HUMAN)
EVASSSSTLV

SEQ ID NO: 51842 - protein, 10 aa, Artificial Sequence
  Description of Artificial Sequence: Synthetic peptide
  Seed: KVAELVHFLL (MAGA3_HUMAN)
KIAELVHFLW

SEQ ID NO: 51843 - protein, 9 aa, Artificial Sequence
  Description of Artificial Sequence: Synthetic peptide
  Seed: HLYIFATCL (MAGA3_HUMAN)
HVYIFATCF

SEQ ID NO: 51844 - protein, 11 aa, Artificial Sequence
  Description of Artificial Sequence: Synthetic peptide
  Seed: YIFATCLGLSY (MAGA3_HUMAN)
YVFATCLGLSF

SEQ ID NO: 51845 - protein, 9 aa, Artificial Sequence
  Description of Artificial Sequence: Synthetic peptide
  Seed: YIFATCLGL (MAGA3_HUMAN)
YVFATCLGK

SEQ ID NO: 51846 - protein, 11 aa, Artificial Sequence
  Description of Artificial Sequence: Synthetic peptide
  Seed: AEMLGSVVGNW (MAGA3_HUMAN)
ASMLGSVVGNF

SEQ ID NO: 51847 - protein, 9 aa, Artificial Sequence
  Description of Artificial Sequence: Synthetic peptide
  Seed: SYVKVLHHM (MAGA3_HUMAN)
SYVKVLHHI

SEQ ID NO: 51848 - protein, 9 aa, Artificial Sequence
  Description of Artificial Sequence: Synthetic peptide
  Seed: SSSSTLVEV (MAGA3_HUMAN)
SVSSTLVEY

SEQ ID NO: 51849 - protein, 11 aa, Artificial Sequence
  Description of Artificial Sequence: Synthetic peptide
  Seed: AQAPATEEQEA (MAGA3_HUMAN)
AMAPATEEQEI

SEQ ID NO: 51850 - protein, 10 aa, Artificial Sequence
  Description of Artificial Sequence: Synthetic peptide
  Seed: LQLVFGIELM (MAGA3_HUMAN)
LGLVFGIELL

SEQ ID NO: 51851 - protein, 10 aa, Artificial Sequence
  Description of Artificial Sequence: Synthetic peptide
  Seed: RQVPGSDPAC (MAGA3_HUMAN)
RTVPGSDPAY

SEQ ID NO: 51852 - protein, 9 aa, Artificial Sequence
  Description of Artificial Sequence: Synthetic peptide
  Seed: RALVETSYV (MAGA3_HUMAN)
RMLVETSYK

SEQ ID NO: 51853 - protein, 9 aa, Artificial Sequence
  Description of Artificial Sequence: Synthetic peptide
  Seed: GLVGAQAPA (MAGA3_HUMAN)
GVVGAQAPL

SEQ ID NO: 51854 - protein, 9 aa, Artificial Sequence
  Description of Artificial Sequence: Synthetic peptide
  Seed: FVQENYLEY (MAGA3_HUMAN)
FMQENYLEL

SEQ ID NO: 51855 - protein, 9 aa, Artificial Sequence
  Description of Artificial Sequence: Synthetic peptide
  Seed: LGDPKKLLT (MAGA3_HUMAN)
LFDPKKLLI

SEQ ID NO: 51856 - protein, 9 aa, Artificial Sequence
  Description of Artificial Sequence: Synthetic peptide
  Seed: DPIGHLYIF (MAGA3_HUMAN)
DPIGHLYIV

SEQ ID NO: 51857 - protein, 9 aa, Artificial Sequence
  Description of Artificial Sequence: Synthetic peptide
  Seed: KVAELVHFL (MAGA3_HUMAN)
KIAELVHFK

SEQ ID NO: 51858 - protein, 8 aa, Artificial Sequence
  Description of Artificial Sequence: Synthetic peptide
  Seed: FPDLESEF (MAGA3_HUMAN)
FVDLESEI

SEQ ID NO: 51859 - protein, 11 aa, Artificial Sequence
  Description of Artificial Sequence: Synthetic peptide
  Seed: SYPPLHEWVLR (MAGA3_HUMAN)
SYPPLHEWVLW

SEQ ID NO: 51860 - protein, 9 aa, Artificial Sequence
  Description of Artificial Sequence: Synthetic peptide
  Seed: SYVKVLHHM (MAGA3_HUMAN)
SAVKVLHHL

SEQ ID NO: 51861 - protein, 10 aa, Artificial Sequence
  Description of Artificial Sequence: Synthetic peptide
  Seed: ELMEVDPIGH (MAGA3_HUMAN)
EVMEVDPIGR

SEQ ID NO: 51862 - protein, 9 aa, Artificial Sequence
  Description of Artificial Sequence: Synthetic peptide
  Seed: EVDPIGHLY (MAGA3_HUMAN)
EMDPIGHLW

SEQ ID NO: 51863 - protein, 9 aa, Artificial Sequence
  Description of Artificial Sequence: Synthetic peptide
  Seed: RQVPGSDPA (MAGA3_HUMAN)
RKVPGSDPI

SEQ ID NO: 51864 - protein, 9 aa, Artificial Sequence
  Description of Artificial Sequence: Synthetic peptide
  Seed: EVDPIGHLY (MAGA3_HUMAN)
ELDPIGHLI

SEQ ID NO: 51865 - protein, 10 aa, Artificial Sequence
  Description of Artificial Sequence: Synthetic peptide
  Seed: FVQENYLEYR (MAGA3_HUMAN)
FFQENYLEYR

SEQ ID NO: 51866 - protein, 9 aa, Artificial Sequence
  Description of Artificial Sequence: Synthetic peptide
  Seed: SSTLVEVTL (MAGA3_HUMAN)
SSTLVEVTW

SEQ ID NO: 51867 - protein, 9 aa, Artificial Sequence
  Description of Artificial Sequence: Synthetic peptide
  Seed: AQAPATEEQ (MAGA3_HUMAN)
AIAPATEEY

SEQ ID NO: 51868 - protein, 10 aa, Artificial Sequence
  Description of Artificial Sequence: Synthetic peptide
  Seed: MVKISGGPHI (MAGA3_HUMAN)
MAKISGGPHY

SEQ ID NO: 51869 - protein, 10 aa, Artificial Sequence
  Description of Artificial Sequence: Synthetic peptide
  Seed: SYVKVLHHMV (MAGA3_HUMAN)
SYVKVLHHMW

SEQ ID NO: 51870 - protein, 9 aa, Artificial Sequence
  Description of Artificial Sequence: Synthetic peptide
  Seed: HLYIFATCL (MAGA3_HUMAN)
HIYIFATCY

SEQ ID NO: 51871 - protein, 9 aa, Artificial Sequence
  Description of Artificial Sequence: Synthetic peptide
  Seed: KVLHHMVKI (MAGA3_HUMAN)
KVLHHMVKK

SEQ ID NO: 51872 - protein, 10 aa, Artificial Sequence
  Description of Artificial Sequence: Synthetic peptide
  Seed: ISYPPLHEWV (MAGA3_HUMAN)
IPYPPLHEWF

SEQ ID NO: 51873 - protein, 11 aa, Artificial Sequence
  Description of Artificial Sequence: Synthetic peptide
  Seed: SRKVAELVHFL (MAGA3_HUMAN)
SIKVAELVHFV

SEQ ID NO: 51874 - protein, 9 aa, Artificial Sequence
  Description of Artificial Sequence: Synthetic peptide
  Seed: EFQAALSRK (MAGA3_HUMAN)
EYQAALSRR

SEQ ID NO: 51875 - protein, 9 aa, Artificial Sequence
  Description of Artificial Sequence: Synthetic peptide
  Seed: MEVDPIGHL (MAGA3_HUMAN)
MAVDPIGHA

SEQ ID NO: 51876 - protein, 9 aa, Artificial Sequence
  Description of Artificial Sequence: Synthetic peptide
  Seed: MEVDPIGHL (MAGA3_HUMAN)
MTVDPIGHM

SEQ ID NO: 51877 - protein, 11 aa, Artificial Sequence
  Description of Artificial Sequence: Synthetic peptide
  Seed: SPQGASSLPTT (MAGA3_HUMAN)
SPQGASSLPTC

SEQ ID NO: 51878 - protein, 9 aa, Artificial Sequence
  Description of Artificial Sequence: Synthetic peptide
  Seed: EALGLVGAQ (MAGA3_HUMAN)
EILGLVGAR

SEQ ID NO: 51879 - protein, 10 aa, Artificial Sequence
  Description of Artificial Sequence: Synthetic peptide
  Seed: RKVAELVHFL (MAGA3_HUMAN)
RFVAELVHFV

SEQ ID NO: 51880 - protein, 8 aa, Artificial Sequence
  Description of Artificial Sequence: Synthetic peptide
  Seed: FPDLESEF (MAGA3_HUMAN)
FFDLESEF

SEQ ID NO: 51881 - protein, 10 aa, Artificial Sequence
  Description of Artificial Sequence: Synthetic peptide
  Seed: YRQVPGSDPA (MAGA3_HUMAN)
YIQVPGSDPL

SEQ ID NO: 51882 - protein, 9 aa, Artificial Sequence
  Description of Artificial Sequence: Synthetic peptide
  Seed: NWQYFFPVI (MAGA3_HUMAN)
NWQYFFPVL

SEQ ID NO: 51883 - protein, 10 aa, Artificial Sequence
  Description of Artificial Sequence: Synthetic peptide
  Seed: SLQLVFGIEL (MAGA3_HUMAN)
SLQLVFGIEV

SEQ ID NO: 51884 - protein, 10 aa, Artificial Sequence
  Description of Artificial Sequence: Synthetic peptide
  Seed: VDPIGHLYIF (MAGA3_HUMAN)
VEPIGHLYIY

SEQ ID NO: 51885 - protein, 10 aa, Artificial Sequence
  Description of Artificial Sequence: Synthetic peptide
  Seed: VDPIGHLYIF (MAGA3_HUMAN)
VYPIGHLYIM

SEQ ID NO: 51886 - protein, 10 aa, Artificial Sequence
  Description of Artificial Sequence: Synthetic peptide
  Seed: TSYVKVLHHM (MAGA3_HUMAN)
THYVKVLHHI

SEQ ID NO: 51887 - protein, 9 aa, Artificial Sequence
  Description of Artificial Sequence: Synthetic peptide
  Seed: GSDPACYEF (MAGA3_HUMAN)
GTDPACYEI

SEQ ID NO: 51888 - protein, 9 aa, Artificial Sequence
  Description of Artificial Sequence: Synthetic peptide
  Seed: VKISGGPHI (MAGA3_HUMAN)
VLISGGPHF

SEQ ID NO: 51889 - protein, 9 aa, Artificial Sequence
  Description of Artificial Sequence: Synthetic peptide
  Seed: LESEFQAAL (MAGA3_HUMAN)
LSSEFQAAY

SEQ ID NO: 51890 - protein, 11 aa, Artificial Sequence
  Description of Artificial Sequence: Synthetic peptide
  Seed: HCKPEEGLEAR (MAGA3_HUMAN)
HLKPEEGLEAR

SEQ ID NO: 51891 - protein, 9 aa, Artificial Sequence
  Description of Artificial Sequence: Synthetic peptide
  Seed: MEVDPIGHL (MAGA3_HUMAN)
MAVDPIGHM

SEQ ID NO: 51892 - protein, 11 aa, Artificial Sequence
  Description of Artificial Sequence: Synthetic peptide
  Seed: GEALGLVGAQA (MAGA3_HUMAN)
GEALGLVGAQM

SEQ ID NO: 51893 - protein, 9 aa, Artificial Sequence
  Description of Artificial Sequence: Synthetic peptide
  Seed: WEELSVLEV (MAGA3_HUMAN)
WEELSVLEA

SEQ ID NO: 51894 - protein, 10 aa, Artificial Sequence
  Description of Artificial Sequence: Synthetic peptide
  Seed: QGASSLPTTM (MAGA3_HUMAN)
QSASSLPTTY

SEQ ID NO: 51895 - protein, 9 aa, Artificial Sequence
  Description of Artificial Sequence: Synthetic peptide
  Seed: KVAELVHFL (MAGA3_HUMAN)
KIAELVHFM

SEQ ID NO: 51896 - protein, 10 aa, Artificial Sequence
  Description of Artificial Sequence: Synthetic peptide
  Seed: NWQYFFPVIF (MAGA3_HUMAN)
NEQYFFPVIF

SEQ ID NO: 51897 - protein, 11 aa, Artificial Sequence
  Description of Artificial Sequence: Synthetic peptide
  Seed: SSLPTTMNYPL (MAGA3_HUMAN)
SSLPTTMNYPF

SEQ ID NO: 51898 - protein, 11 aa, Artificial Sequence
  Description of Artificial Sequence: Synthetic peptide
  Seed: ELVHFLLLKYR (MAGA3_HUMAN)
EAVHFLLLKYR

SEQ ID NO: 51899 - protein, 10 aa, Artificial Sequence
  Description of Artificial Sequence: Synthetic peptide
  Seed: IFATCLGLSY (MAGA3_HUMAN)
ISATCLGLSW

SEQ ID NO: 51900 - protein, 9 aa, Artificial Sequence
  Description of Artificial Sequence: Synthetic peptide
  Seed: MPKAGLLII (MAGA3_HUMAN)
MLKAGLLIY

SEQ ID NO: 51901 - protein, 10 aa, Artificial Sequence
  Description of Artificial Sequence: Synthetic peptide
  Seed: FSKASSSLQL (MAGA3_HUMAN)
FVKASSSLQY

SEQ ID NO: 51902 - protein, 9 aa, Artificial Sequence
  Description of Artificial Sequence: Synthetic peptide
  Seed: KIWEELSVL (MAGA3_HUMAN)
KTWEELSVI

SEQ ID NO: 51903 - protein, 9 aa, Artificial Sequence
  Description of Artificial Sequence: Synthetic peptide
  Seed: FQAALSRKV (MAGA3_HUMAN)
FMAALSRKM

SEQ ID NO: 51904 - protein, 9 aa, Artificial Sequence
  Description of Artificial Sequence: Synthetic peptide
  Seed: YFFPVIFSK (MAGA3_HUMAN)
YFFPVIFSY

SEQ ID NO: 51905 - protein, 10 aa, Artificial Sequence
  Description of Artificial Sequence: Synthetic peptide
  Seed: MEVDPIGHLY (MAGA3_HUMAN)
MEVDPIGHLV

SEQ ID NO: 51906 - protein, 10 aa, Artificial Sequence
  Description of Artificial Sequence: Synthetic peptide
  Seed: WQYFFPVIFS (MAGA3_HUMAN)
WQYFFPVIFF

SEQ ID NO: 51907 - protein, 11 aa, Artificial Sequence
  Description of Artificial Sequence: Synthetic peptide
  Seed: SLPTTMNYPLW (MAGA3_HUMAN)
SYPTTMNYPLI

SEQ ID NO: 51908 - protein, 9 aa, Artificial Sequence
  Description of Artificial Sequence: Synthetic peptide
  Seed: EELSVLEVF (MAGA3_HUMAN)
EELSVLEVV

SEQ ID NO: 51909 - protein, 10 aa, Artificial Sequence
  Description of Artificial Sequence: Synthetic peptide
  Seed: ASSLPTTMNY (MAGA3_HUMAN)
ASSLPTTMNW

SEQ ID NO: 51910 - protein, 9 aa, Artificial Sequence
  Description of Artificial Sequence: Synthetic peptide
  Seed: ISGGPHISY (MAGA3_HUMAN)
IVGGPHISL

SEQ ID NO: 51911 - protein, 9 aa, Artificial Sequence
  Description of Artificial Sequence: Synthetic peptide
  Seed: VEVTLGEVP (MAGA3_HUMAN)
VEVTLGEVM

SEQ ID NO: 51912 - protein, 9 aa, Artificial Sequence
  Description of Artificial Sequence: Synthetic peptide
  Seed: FVQENYLEY (MAGA3_HUMAN)
FLQENYLEF

SEQ ID NO: 51913 - protein, 9 aa, Artificial Sequence
  Description of Artificial Sequence: Synthetic peptide
  Seed: HLYIFATCL (MAGA3_HUMAN)
HRYIFATCY

SEQ ID NO: 51914 - protein, 10 aa, Artificial Sequence
  Description of Artificial Sequence: Synthetic peptide
  Seed: YIFATCLGLS (MAGA3_HUMAN)
YLFATCLGLQ

SEQ ID NO: 51915 - protein, 10 aa, Artificial Sequence
  Description of Artificial Sequence: Synthetic peptide
  Seed: RKVAELVHFL (MAGA3_HUMAN)
RMVAELVHFI

SEQ ID NO: 51916 - protein, 10 aa, Artificial Sequence
  Description of Artificial Sequence: Synthetic peptide
  Seed: SSSTLVEVTL (MAGA3_HUMAN)
SNSTLVEVTW

SEQ ID NO: 51917 - protein, 10 aa, Artificial Sequence
  Description of Artificial Sequence: Synthetic peptide
  Seed: NWQYFFPVIF (MAGA3_HUMAN)
NMQYFFPVIY

SEQ ID NO: 51918 - protein, 11 aa, Artificial Sequence
  Description of Artificial Sequence: Synthetic peptide
  Seed: RQVPGSDPACY (MAGA3_HUMAN)
REVPGSDPACY

SEQ ID NO: 51919 - protein, 9 aa, Artificial Sequence
  Description of Artificial Sequence: Synthetic peptide
  Seed: ISYPPLHEW (MAGA3_HUMAN)
ISYPPLHEI

SEQ ID NO: 51920 - protein, 9 aa, Artificial Sequence
  Description of Artificial Sequence: Synthetic peptide
  Seed: VTLGEVPAA (MAGA3_HUMAN)
VQLGEVPAI

SEQ ID NO: 51921 - protein, 9 aa, Artificial Sequence
  Description of Artificial Sequence: Synthetic peptide
  Seed: SSLPTTMNY (MAGA3_HUMAN)
SQLPTTMNF

SEQ ID NO: 51922 - protein, 11 aa, Artificial Sequence
  Description of Artificial Sequence: Synthetic peptide
  Seed: SEFQAALSRKV (MAGA3_HUMAN)
SEFQAALSRKC

SEQ ID NO: 51923 - protein, 10 aa, Artificial Sequence
  Description of Artificial Sequence: Synthetic peptide
  Seed: STFPDLESEF (MAGA3_HUMAN)
SVFPDLESEL

SEQ ID NO: 51924 - protein, 9 aa, Artificial Sequence
  Description of Artificial Sequence: Synthetic peptide
  Seed: ISGGPHISY (MAGA3_HUMAN)
IGGGPHISW

SEQ ID NO: 51925 - protein, 9 aa, Artificial Sequence
  Description of Artificial Sequence: Synthetic peptide
  Seed: VKISGGPHI (MAGA3_HUMAN)
VKISGGPHL

SEQ ID NO: 51926 - protein, 10 aa, Artificial Sequence
  Description of Artificial Sequence: Synthetic peptide
  Seed: KASSSLQLVF (MAGA3_HUMAN)
KPSSSLQLVW

SEQ ID NO: 51927 - protein, 9 aa, Artificial Sequence
  Description of Artificial Sequence: Synthetic peptide
  Seed: ISGGPHISY (MAGA3_HUMAN)
IYGGPHISL

SEQ ID NO: 51928 - protein, 9 aa, Artificial Sequence
  Description of Artificial Sequence: Synthetic peptide
  Seed: FATCLGLSY (MAGA3_HUMAN)
FVTCLGLSF

SEQ ID NO: 51929 - protein, 9 aa, Artificial Sequence
  Description of Artificial Sequence: Synthetic peptide
  Seed: YPLWSQSYE (MAGA3_HUMAN)
YILWSQSYY

SEQ ID NO: 51930 - protein, 9 aa, Artificial Sequence
  Description of Artificial Sequence: Synthetic peptide
  Seed: ASSSLQLVF (MAGA3_HUMAN)
ASSSLQLVM

SEQ ID NO: 51931 - protein, 10 aa, Artificial Sequence
  Description of Artificial Sequence: Synthetic peptide
  Seed: KASSSLQLVF (MAGA3_HUMAN)
KPSSSLQLVI

SEQ ID NO: 51932 - protein, 9 aa, Artificial Sequence
  Description of Artificial Sequence: Synthetic peptide
  Seed: EVDPIGHLY (MAGA3_HUMAN)
EWDPIGHLY

SEQ ID NO: 51933 - protein, 9 aa, Artificial Sequence
  Description of Artificial Sequence: Synthetic peptide
  Seed: SSTLVEVTL (MAGA3_HUMAN)
SRTLVEVTY

SEQ ID NO: 51934 - protein, 9 aa, Artificial Sequence
  Description of Artificial Sequence: Synthetic peptide
  Seed: YIFATCLGL (MAGA3_HUMAN)
YQFATCLGF

SEQ ID NO: 51935 - protein, 9 aa, Artificial Sequence
  Description of Artificial Sequence: Synthetic peptide
  Seed: MEVDPIGHL (MAGA3_HUMAN)
MIVDPIGHV

SEQ ID NO: 51936 - protein, 9 aa, Artificial Sequence
  Description of Artificial Sequence: Synthetic peptide
  Seed: KVAELVHFL (MAGA3_HUMAN)
KIAELVHFT

SEQ ID NO: 51937 - protein, 11 aa, Artificial Sequence
  Description of Artificial Sequence: Synthetic peptide
  Seed: MEVDPIGHLYI (MAGA3_HUMAN)
MEVDPIGHLYL

SEQ ID NO: 51938 - protein, 11 aa, Artificial Sequence
  Description of Artificial Sequence: Synthetic peptide
  Seed: YIFATCLGLSY (MAGA3_HUMAN)
YSFATCLGLSW

SEQ ID NO: 51939 - protein, 10 aa, Artificial Sequence
  Description of Artificial Sequence: Synthetic peptide
  Seed: LGLVGAQAPA (MAGA3_HUMAN)
LKLVGAQAPL

SEQ ID NO: 51940 - protein, 9 aa, Artificial Sequence
  Description of Artificial Sequence: Synthetic peptide
  Seed: KVAELVHFL (MAGA3_HUMAN)
KFAELVHFR

SEQ ID NO: 51941 - protein, 9 aa, Artificial Sequence
  Description of Artificial Sequence: Synthetic peptide
  Seed: KASSSLQLV (MAGA3_HUMAN)
KMSSSLQLI

SEQ ID NO: 51942 - protein, 10 aa, Artificial Sequence
  Description of Artificial Sequence: Synthetic peptide
  Seed: STFPDLESEF (MAGA3_HUMAN)
SPFPDLESEW

SEQ ID NO: 51943 - protein, 11 aa, Artificial Sequence
  Description of Artificial Sequence: Synthetic peptide
  Seed: ISYPPLHEWVL (MAGA3_HUMAN)
ISYPPLHEWVF

SEQ ID NO: 51944 - protein, 9 aa, Artificial Sequence
  Description of Artificial Sequence: Synthetic peptide
  Seed: LLIIVLAII (MAGA3_HUMAN)
LMIIVLAII

SEQ ID NO: 51945 - protein, 9 aa, Artificial Sequence
  Description of Artificial Sequence: Synthetic peptide
  Seed: RQVPGSDPA (MAGA3_HUMAN)
REVPGSDPP

SEQ ID NO: 51946 - protein, 9 aa, Artificial Sequence
  Description of Artificial Sequence: Synthetic peptide
  Seed: SSSSTLVEV (MAGA3_HUMAN)
SRSSTLVEM

SEQ ID NO: 51947 - protein, 10 aa, Artificial Sequence
  Description of Artificial Sequence: Synthetic peptide
  Seed: FSKASSSLQL (MAGA3_HUMAN)
FFKASSSLQY

SEQ ID NO: 51948 - protein, 9 aa, Artificial Sequence
  Description of Artificial Sequence: Synthetic peptide
  Seed: LSRKVAELV (MAGA3_HUMAN)
LQRKVAELL

SEQ ID NO: 51949 - protein, 11 aa, Artificial Sequence
  Description of Artificial Sequence: Synthetic peptide
  Seed: SRKVAELVHFL (MAGA3_HUMAN)
SFKVAELVHFV

SEQ ID NO: 51950 - protein, 9 aa, Artificial Sequence
  Description of Artificial Sequence: Synthetic peptide
  Seed: RQVPGSDPA (MAGA3_HUMAN)
RMVPGSDPM

SEQ ID NO: 51951 - protein, 11 aa, Artificial Sequence
  Description of Artificial Sequence: Synthetic peptide
  Seed: AQAPATEEQEA (MAGA3_HUMAN)
AQAPATEEQEL

SEQ ID NO: 51952 - protein, 10 aa, Artificial Sequence
  Description of Artificial Sequence: Synthetic peptide
  Seed: GHLYIFATCL (MAGA3_HUMAN)
GLLYIFATCV

SEQ ID NO: 51953 - protein, 9 aa, Artificial Sequence
  Description of Artificial Sequence: Synthetic peptide
  Seed: FATCLGLSY (MAGA3_HUMAN)
FSTCLGLSK

SEQ ID NO: 51954 - protein, 11 aa, Artificial Sequence
  Description of Artificial Sequence: Synthetic peptide
  Seed: ELSVLEVFEGR (MAGA3_HUMAN)
EVSVLEVFEGK

SEQ ID NO: 51955 - protein, 9 aa, Artificial Sequence
  Description of Artificial Sequence: Synthetic peptide
  Seed: SSSSTLVEV (MAGA3_HUMAN)
SLSSTLVEA

SEQ ID NO: 51956 - protein, 10 aa, Artificial Sequence
  Description of Artificial Sequence: Synthetic peptide
  Seed: MNYPLWSQSY (MAGA3_HUMAN)
MDYPLWSQSI

SEQ ID NO: 51957 - protein, 10 aa, Artificial Sequence
  Description of Artificial Sequence: Synthetic peptide
  Seed: MVKISGGPHI (MAGA3_HUMAN)
MGKISGGPHF

SEQ ID NO: 51958 - protein, 9 aa, Artificial Sequence
  Description of Artificial Sequence: Synthetic peptide
  Seed: SSLQLVFGI (MAGA3_HUMAN)
SLLQLVFGS

SEQ ID NO: 51959 - protein, 9 aa, Artificial Sequence
  Description of Artificial Sequence: Synthetic peptide
  Seed: RALVETSYV (MAGA3_HUMAN)
RILVETSYV

SEQ ID NO: 51960 - protein, 9 aa, Artificial Sequence
  Description of Artificial Sequence: Synthetic peptide
  Seed: HLYIFATCL (MAGA3_HUMAN)
HRYIFATCF

SEQ ID NO: 51961 - protein, 9 aa, Artificial Sequence
  Description of Artificial Sequence: Synthetic peptide
  Seed: KVLHHMVKI (MAGA3_HUMAN)
KILHHMVKR

SEQ ID NO: 51962 - protein, 10 aa, Artificial Sequence
  Description of Artificial Sequence: Synthetic peptide
  Seed: KVAELVHFLL (MAGA3_HUMAN)
KMAELVHFLK

SEQ ID NO: 51963 - protein, 9 aa, Artificial Sequence
  Description of Artificial Sequence: Synthetic peptide
  Seed: QSPQGASSL (MAGA3_HUMAN)
QTPQGASSM

SEQ ID NO: 51964 - protein, 9 aa, Artificial Sequence
  Description of Artificial Sequence: Synthetic peptide
  Seed: FATCLGLSY (MAGA3_HUMAN)
FMTCLGLSF

SEQ ID NO: 51965 - protein, 9 aa, Artificial Sequence
  Description of Artificial Sequence: Synthetic peptide
  Seed: FQAALSRKV (MAGA3_HUMAN)
FSAALSRKI

SEQ ID NO: 51966 - protein, 9 aa, Artificial Sequence
  Description of Artificial Sequence: Synthetic peptide
  Seed: KVAELVHFL (MAGA3_HUMAN)
KVAELVHFR

SEQ ID NO: 51967 - protein, 10 aa, Artificial Sequence
  Description of Artificial Sequence: Synthetic peptide
  Seed: STFPDLESEF (MAGA3_HUMAN)
SAFPDLESEK

SEQ ID NO: 51968 - protein, 10 aa, Artificial Sequence
  Description of Artificial Sequence: Synthetic peptide
  Seed: VIFSKASSSL (MAGA3_HUMAN)
VWFSKASSSM

SEQ ID NO: 51969 - protein, 9 aa, Artificial Sequence
  Description of Artificial Sequence: Synthetic peptide
  Seed: SSLQLVFGI (MAGA3_HUMAN)
SALQLVFGA

SEQ ID NO: 51970 - protein, 9 aa, Artificial Sequence
  Description of Artificial Sequence: Synthetic peptide
  Seed: WQYFFPVIF (MAGA3_HUMAN)
WAYFFPVIM

SEQ ID NO: 51971 - protein, 9 aa, Artificial Sequence
  Description of Artificial Sequence: Synthetic peptide
  Seed: LGDPKKLLT (MAGA3_HUMAN)
LMDPKKLLL

SEQ ID NO: 51972 - protein, 9 aa, Artificial Sequence
  Description of Artificial Sequence: Synthetic peptide
  Seed: LSRKVAELV (MAGA3_HUMAN)
LSRKVAELL

SEQ ID NO: 51973 - protein, 10 aa, Artificial Sequence
  Description of Artificial Sequence: Synthetic peptide
  Seed: MEVDPIGHLY (MAGA3_HUMAN)
MFVDPIGHLL

SEQ ID NO: 51974 - protein, 10 aa, Artificial Sequence
  Description of Artificial Sequence: Synthetic peptide
  Seed: FFPVIFSKAS (MAGA3_HUMAN)
FKPVIFSKAV

SEQ ID NO: 51975 - protein, 11 aa, Artificial Sequence
  Description of Artificial Sequence: Synthetic peptide
  Seed: AEMLGSVVGNW (MAGA3_HUMAN)
AMMLGSVVGNY

SEQ ID NO: 51976 - protein, 10 aa, Artificial Sequence
  Description of Artificial Sequence: Synthetic peptide
  Seed: MVKISGGPHI (MAGA3_HUMAN)
MVKISGGPHY

SEQ ID NO: 51977 - protein, 10 aa, Artificial Sequence
  Description of Artificial Sequence: Synthetic peptide
  Seed: SLQLVFGIEL (MAGA3_HUMAN)
SMQLVFGIEV

SEQ ID NO: 51978 - protein, 10 aa, Artificial Sequence
  Description of Artificial Sequence: Synthetic peptide
  Seed: ISYPPLHEWV (MAGA3_HUMAN)
ITYPPLHEWW

SEQ ID NO: 51979 - protein, 10 aa, Artificial Sequence
  Description of Artificial Sequence: Synthetic peptide
  Seed: SEFQAALSRK (MAGA3_HUMAN)
SEFQAALSRY

SEQ ID NO: 51980 - protein, 9 aa, Artificial Sequence
  Description of Artificial Sequence: Synthetic peptide
  Seed: RKVAELVHF (MAGA3_HUMAN)
RAVAELVHY

SEQ ID NO: 51981 - protein, 10 aa, Artificial Sequence
  Description of Artificial Sequence: Synthetic peptide
  Seed: MVKISGGPHI (MAGA3_HUMAN)
MGKISGGPHY

SEQ ID NO: 51982 - protein, 11 aa, Artificial Sequence
  Description of Artificial Sequence: Synthetic peptide
  Seed: SNQEEEGPSTF (MAGA3_HUMAN)
SHQEEEGPSTF

SEQ ID NO: 51983 - protein, 10 aa, Artificial Sequence
  Description of Artificial Sequence: Synthetic peptide
  Seed: LSVLEVFEGR (MAGA3_HUMAN)
LAVLEVFEGR

SEQ ID NO: 51984 - protein, 11 aa, Artificial Sequence
  Description of Artificial Sequence: Synthetic peptide
  Seed: YIFATCLGLSY (MAGA3_HUMAN)
YHFATCLGLSY

SEQ ID NO: 51985 - protein, 9 aa, Artificial Sequence
  Description of Artificial Sequence: Synthetic peptide
  Seed: VTLGEVPAA (MAGA3_HUMAN)
VALGEVPAM

SEQ ID NO: 51986 - protein, 9 aa, Artificial Sequence
  Description of Artificial Sequence: Synthetic peptide
  Seed: ISYPPLHEW (MAGA3_HUMAN)
IDYPPLHEW

SEQ ID NO: 51987 - protein, 9 aa, Artificial Sequence
  Description of Artificial Sequence: Synthetic peptide
  Seed: ELVHFLLLK (MAGA3_HUMAN)
ESVHFLLLK

SEQ ID NO: 51988 - protein, 10 aa, Artificial Sequence
  Description of Artificial Sequence: Synthetic peptide
  Seed: MNYPLWSQSY (MAGA3_HUMAN)
MWYPLWSQSM

SEQ ID NO: 51989 - protein, 9 aa, Artificial Sequence
  Description of Artificial Sequence: Synthetic peptide
  Seed: KIWEELSVL (MAGA3_HUMAN)
KSWEELSVL

SEQ ID NO: 51990 - protein, 9 aa, Artificial Sequence
  Description of Artificial Sequence: Synthetic peptide
  Seed: EVDPIGHLY (MAGA3_HUMAN)
EADPIGHLI

SEQ ID NO: 51991 - protein, 10 aa, Artificial Sequence
  Description of Artificial Sequence: Synthetic peptide
  Seed: FVQENYLEYR (MAGA3_HUMAN)
FTQENYLEYR

SEQ ID NO: 51992 - protein, 10 aa, Artificial Sequence
  Description of Artificial Sequence: Synthetic peptide
  Seed: VIFSKASSSL (MAGA3_HUMAN)
VAFSKASSSL

SEQ ID NO: 51993 - protein, 9 aa, Artificial Sequence
  Description of Artificial Sequence: Synthetic peptide
  Seed: SEFQAALSR (MAGA3_HUMAN)
STFQAALSK

SEQ ID NO: 51994 - protein, 10 aa, Artificial Sequence
  Description of Artificial Sequence: Synthetic peptide
  Seed: VIFSKASSSL (MAGA3_HUMAN)
VSFSKASSSF

SEQ ID NO: 51995 - protein, 9 aa, Artificial Sequence
  Description of Artificial Sequence: Synthetic peptide
  Seed: SSLQLVFGI (MAGA3_HUMAN)
STLQLVFGW

SEQ ID NO: 51996 - protein, 9 aa, Artificial Sequence
  Description of Artificial Sequence: Synthetic peptide
  Seed: ARGEALGLV (MAGA3_HUMAN)
ARGEALGLM

SEQ ID NO: 51997 - protein, 9 aa, Artificial Sequence
  Description of Artificial Sequence: Synthetic peptide
  Seed: VTLGEVPAA (MAGA3_HUMAN)
VVLGEVPAI

SEQ ID NO: 51998 - protein, 10 aa, Artificial Sequence
  Description of Artificial Sequence: Synthetic peptide
  Seed: LQLVFGIELM (MAGA3_HUMAN)
LFLVFGIELI

SEQ ID NO: 51999 - protein, 11 aa, Artificial Sequence
  Description of Artificial Sequence: Synthetic peptide
  Seed: SYPPLHEWVLR (MAGA3_HUMAN)
SYPPLHEWVLI

SEQ ID NO: 52000 - protein, 9 aa, Artificial Sequence
  Description of Artificial Sequence: Synthetic peptide
  Seed: IFSKASSSL (MAGA3_HUMAN)
IYSKASSSL

SEQ ID NO: 52001 - protein, 9 aa, Artificial Sequence
  Description of Artificial Sequence: Synthetic peptide
  Seed: ILGDPKKLL (MAGA3_HUMAN)
IIGDPKKLL

SEQ ID NO: 52002 - protein, 9 aa, Artificial Sequence
  Description of Artificial Sequence: Synthetic peptide
  Seed: WQYFFPVIF (MAGA3_HUMAN)
WKYFFPVIY

SEQ ID NO: 52003 - protein, 11 aa, Artificial Sequence
  Description of Artificial Sequence: Synthetic peptide
  Seed: SRKVAELVHFL (MAGA3_HUMAN)
SMKVAELVHFM

SEQ ID NO: 52004 - protein, 11 aa, Artificial Sequence
  Description of Artificial Sequence: Synthetic peptide
  Seed: SKASSSLQLVF (MAGA3_HUMAN)
STASSSLQLVY

SEQ ID NO: 52005 - protein, 10 aa, Artificial Sequence
  Description of Artificial Sequence: Synthetic peptide
  Seed: SLQLVFGIEL (MAGA3_HUMAN)
SCQLVFGIEY

SEQ ID NO: 52006 - protein, 10 aa, Artificial Sequence
  Description of Artificial Sequence: Synthetic peptide
  Seed: FSKASSSLQL (MAGA3_HUMAN)
FDKASSSLQM

SEQ ID NO: 52007 - protein, 9 aa, Artificial Sequence
  Description of Artificial Sequence: Synthetic peptide
  Seed: GASSLPTTM (MAGA3_HUMAN)
GLSSLPTTM

SEQ ID NO: 52008 - protein, 10 aa, Artificial Sequence
  Description of Artificial Sequence: Synthetic peptide
  Seed: RALVETSYVK (MAGA3_HUMAN)
RMLVETSYVK

SEQ ID NO: 52009 - protein, 9 aa, Artificial Sequence
  Description of Artificial Sequence: Synthetic peptide
  Seed: YIFATCLGL (MAGA3_HUMAN)
YAFATCLGF

SEQ ID NO: 52010 - protein, 9 aa, Artificial Sequence
  Description of Artificial Sequence: Synthetic peptide
  Seed: FVQENYLEY (MAGA3_HUMAN)
FGQENYLEM

SEQ ID NO: 52011 - protein, 10 aa, Artificial Sequence
  Description of Artificial Sequence: Synthetic peptide
  Seed: RKVAELVHFL (MAGA3_HUMAN)
RLVAELVHFT

SEQ ID NO: 52012 - protein, 9 aa, Artificial Sequence
  Description of Artificial Sequence: Synthetic peptide
  Seed: MPLEQRSQH (MAGA3_HUMAN)
MALEQRSQF

SEQ ID NO: 52013 - protein, 10 aa, Artificial Sequence
  Description of Artificial Sequence: Synthetic peptide
  Seed: EMLGSVVGNW (MAGA3_HUMAN)
ESLGSVVGNF

SEQ ID NO: 52014 - protein, 10 aa, Artificial Sequence
  Description of Artificial Sequence: Synthetic peptide
  Seed: ISYPPLHEWV (MAGA3_HUMAN)
IYYPPLHEWF

SEQ ID NO: 52015 - protein, 9 aa, Artificial Sequence
  Description of Artificial Sequence: Synthetic peptide
  Seed: QLVFGIELM (MAGA3_HUMAN)
QIVFGIELL

SEQ ID NO: 52016 - protein, 9 aa, Artificial Sequence
  Description of Artificial Sequence: Synthetic peptide
  Seed: QIMPKAGLL (MAGA3_HUMAN)
QVMPKAGLV

SEQ ID NO: 52017 - protein, 9 aa, Artificial Sequence
  Description of Artificial Sequence: Synthetic peptide
  Seed: ISYPPLHEW (MAGA3_HUMAN)
IAYPPLHEH

SEQ ID NO: 52018 - protein, 9 aa, Artificial Sequence
  Description of Artificial Sequence: Synthetic peptide
  Seed: KASSSLQLV (MAGA3_HUMAN)
KMSSSLQLT

SEQ ID NO: 52019 - protein, 8 aa, Artificial Sequence
  Description of Artificial Sequence: Synthetic peptide
  Seed: HEWVLREG (MAGA3_HUMAN)
HDWVLREL

SEQ ID NO: 52020 - protein, 9 aa, Artificial Sequence
  Description of Artificial Sequence: Synthetic peptide
  Seed: YIFATCLGL (MAGA3_HUMAN)
YQFATCLGI

SEQ ID NO: 52021 - protein, 9 aa, Artificial Sequence
  Description of Artificial Sequence: Synthetic peptide
  Seed: LGDPKKLLT (MAGA3_HUMAN)
LVDPKKLLL

SEQ ID NO: 52022 - protein, 9 aa, Artificial Sequence
  Description of Artificial Sequence: Synthetic peptide
  Seed: SKASSSLQL (MAGA3_HUMAN)
SRASSSLQL

SEQ ID NO: 52023 - protein, 10 aa, Artificial Sequence
  Description of Artificial Sequence: Synthetic peptide
  Seed: STFPDLESEF (MAGA3_HUMAN)
SMFPDLESEF

SEQ ID NO: 52024 - protein, 9 aa, Artificial Sequence
  Description of Artificial Sequence: Synthetic peptide
  Seed: SVVGNWQYF (MAGA3_HUMAN)
SRVGNWQYY

SEQ ID NO: 52025 - protein, 9 aa, Artificial Sequence
  Description of Artificial Sequence: Synthetic peptide
  Seed: KVLHHMVKI (MAGA3_HUMAN)
KVLHHMVKL

SEQ ID NO: 52026 - protein, 10 aa, Artificial Sequence
  Description of Artificial Sequence: Synthetic peptide
  Seed: KASSSLQLVF (MAGA3_HUMAN)
KCSSSLQLVM

SEQ ID NO: 52027 - protein, 10 aa, Artificial Sequence
  Description of Artificial Sequence: Synthetic peptide
  Seed: TSYVKVLHHM (MAGA3_HUMAN)
TIYVKVLHHW

SEQ ID NO: 52028 - protein, 11 aa, Artificial Sequence
  Description of Artificial Sequence: Synthetic peptide
  Seed: KVAELVHFLLL (MAGA3_HUMAN)
KMAELVHFLLP

SEQ ID NO: 52029 - protein, 9 aa, Artificial Sequence
  Description of Artificial Sequence: Synthetic peptide
  Seed: EEQEAASSS (MAGA3_HUMAN)
EEQEAASST

SEQ ID NO: 52030 - protein, 9 aa, Artificial Sequence
  Description of Artificial Sequence: Synthetic peptide
  Seed: GASSLPTTM (MAGA3_HUMAN)
GASSLPTTF

SEQ ID NO: 52031 - protein, 9 aa, Artificial Sequence
  Description of Artificial Sequence: Synthetic peptide
  Seed: ISGGPHISY (MAGA3_HUMAN)
IKGGPHISM

SEQ ID NO: 52032 - protein, 9 aa, Artificial Sequence
  Description of Artificial Sequence: Synthetic peptide
  Seed: LESEFQAAL (MAGA3_HUMAN)
LESEFQAAW

SEQ ID NO: 52033 - protein, 9 aa, Artificial Sequence
  Description of Artificial Sequence: Synthetic peptide
  Seed: RALVETSYV (MAGA3_HUMAN)
RSLVETSYY

SEQ ID NO: 52034 - protein, 9 aa, Artificial Sequence
  Description of Artificial Sequence: Synthetic peptide
  Seed: EFQAALSRK (MAGA3_HUMAN)
ETQAALSRK

SEQ ID NO: 52035 - protein, 9 aa, Artificial Sequence
  Description of Artificial Sequence: Synthetic peptide
  Seed: VQENYLEYR (MAGA3_HUMAN)
VMENYLEYR

SEQ ID NO: 52036 - protein, 9 aa, Artificial Sequence
  Description of Artificial Sequence: Synthetic peptide
  Seed: SSLPTTMNY (MAGA3_HUMAN)
SFLPTTMNI

SEQ ID NO: 52037 - protein, 9 aa, Artificial Sequence
  Description of Artificial Sequence: Synthetic peptide
  Seed: KAGLLIIVL (MAGA3_HUMAN)
KQGLLIIVV

SEQ ID NO: 52038 - protein, 11 aa, Artificial Sequence
  Description of Artificial Sequence: Synthetic peptide
  Seed: ELVHFLLLKYR (MAGA3_HUMAN)
ETVHFLLLKYK

SEQ ID NO: 52039 - protein, 8 aa, Artificial Sequence
  Description of Artificial Sequence: Synthetic peptide
  Seed: FPDLESEF (MAGA3_HUMAN)
FMDLESEI

SEQ ID NO: 52040 - protein, 9 aa, Artificial Sequence
  Description of Artificial Sequence: Synthetic peptide
  Seed: LESEFQAAL (MAGA3_HUMAN)
LQSEFQAAW

SEQ ID NO: 52041 - protein, 10 aa, Artificial Sequence
  Description of Artificial Sequence: Synthetic peptide
  Seed: FFPVIFSKAS (MAGA3_HUMAN)
FEPVIFSKAA

SEQ ID NO: 52042 - protein, 9 aa, Artificial Sequence
  Description of Artificial Sequence: Synthetic peptide
  Seed: GNWQYFFPV (MAGA3_HUMAN)
GQWQYFFPM

SEQ ID NO: 52043 - protein, 11 aa, Artificial Sequence
  Description of Artificial Sequence: Synthetic peptide
  Seed: VKISGGPHISY (MAGA3_HUMAN)
VRISGGPHISY

SEQ ID NO: 52044 - protein, 9 aa, Artificial Sequence
  Description of Artificial Sequence: Synthetic peptide
  Seed: SVVGNWQYF (MAGA3_HUMAN)
SPVGNWQYF

SEQ ID NO: 52045 - protein, 10 aa, Artificial Sequence
  Description of Artificial Sequence: Synthetic peptide
  Seed: WEELSVLEVF (MAGA3_HUMAN)
WTELSVLEVM

SEQ ID NO: 52046 - protein, 9 aa, Artificial Sequence
  Description of Artificial Sequence: Synthetic peptide
  Seed: LSRKVAELV (MAGA3_HUMAN)
LQRKVAELI

SEQ ID NO: 52047 - protein, 9 aa, Artificial Sequence
  Description of Artificial Sequence: Synthetic peptide
  Seed: KASSSLQLV (MAGA3_HUMAN)
KASSSLQLK

SEQ ID NO: 52048 - protein, 10 aa, Artificial Sequence
  Description of Artificial Sequence: Synthetic peptide
  Seed: EEQEAASSSS (MAGA3_HUMAN)
EEQEAASSSI

SEQ ID NO: 52049 - protein, 9 aa, Artificial Sequence
  Description of Artificial Sequence: Synthetic peptide
  Seed: IMPKAGLLI (MAGA3_HUMAN)
IAPKAGLLF

SEQ ID NO: 52050 - protein, 9 aa, Artificial Sequence
  Description of Artificial Sequence: Synthetic peptide
  Seed: KVAELVHFL (MAGA3_HUMAN)
KGAELVHFR

SEQ ID NO: 52051 - protein, 10 aa, Artificial Sequence
  Description of Artificial Sequence: Synthetic peptide
  Seed: RQVPGSDPAC (MAGA3_HUMAN)
RRVPGSDPAY

SEQ ID NO: 52052 - protein, 10 aa, Artificial Sequence
  Description of Artificial Sequence: Synthetic peptide
  Seed: ASSSSTLVEV (MAGA3_HUMAN)
AMSSSTLVEI

SEQ ID NO: 52053 - protein, 10 aa, Artificial Sequence
  Description of Artificial Sequence: Synthetic peptide
  Seed: MNYPLWSQSY (MAGA3_HUMAN)
MSYPLWSQSY

SEQ ID NO: 52054 - protein, 9 aa, Artificial Sequence
  Description of Artificial Sequence: Synthetic peptide
  Seed: SYVKVLHHM (MAGA3_HUMAN)
SAVKVLHHV

SEQ ID NO: 52055 - protein, 10 aa, Artificial Sequence
  Description of Artificial Sequence: Synthetic peptide
  Seed: SLQLVFGIEL (MAGA3_HUMAN)
SNQLVFGIEF

SEQ ID NO: 52056 - protein, 10 aa, Artificial Sequence
  Description of Artificial Sequence: Synthetic peptide
  Seed: RKVAELVHFL (MAGA3_HUMAN)
RFVAELVHFI

SEQ ID NO: 52057 - protein, 10 aa, Artificial Sequence
  Description of Artificial Sequence: Synthetic peptide
  Seed: STFPDLESEF (MAGA3_HUMAN)
SMFPDLESEM

SEQ ID NO: 52058 - protein, 10 aa, Artificial Sequence
  Description of Artificial Sequence: Synthetic peptide
  Seed: LYIFATCLGL (MAGA3_HUMAN)
LDIFATCLGV

SEQ ID NO: 52059 - protein, 9 aa, Artificial Sequence
  Description of Artificial Sequence: Synthetic peptide
  Seed: ALVETSYVK (MAGA3_HUMAN)
AAVETSYVK

SEQ ID NO: 52060 - protein, 11 aa, Artificial Sequence
  Description of Artificial Sequence: Synthetic peptide
  Seed: ISYPPLHEWVL (MAGA3_HUMAN)
IWYPPLHEWVF

SEQ ID NO: 52061 - protein, 9 aa, Artificial Sequence
  Description of Artificial Sequence: Synthetic peptide
  Seed: QIMPKAGLL (MAGA3_HUMAN)
QPMPKAGLI

SEQ ID NO: 52062 - protein, 11 aa, Artificial Sequence
  Description of Artificial Sequence: Synthetic peptide
  Seed: SKASSSLQLVF (MAGA3_HUMAN)
SGASSSLQLVW

SEQ ID NO: 52063 - protein, 9 aa, Artificial Sequence
  Description of Artificial Sequence: Synthetic peptide
  Seed: SYVKVLHHM (MAGA3_HUMAN)
SWVKVLHHY

SEQ ID NO: 52064 - protein, 9 aa, Artificial Sequence
  Description of Artificial Sequence: Synthetic peptide
  Seed: ISYPPLHEW (MAGA3_HUMAN)
ILYPPLHEV

SEQ ID NO: 52065 - protein, 9 aa, Artificial Sequence
  Description of Artificial Sequence: Synthetic peptide
  Seed: YIFATCLGL (MAGA3_HUMAN)
YKFATCLGL

SEQ ID NO: 52066 - protein, 10 aa, Artificial Sequence
  Description of Artificial Sequence: Synthetic peptide
  Seed: LPTTMNYPLW (MAGA3_HUMAN)
LMTTMNYPLW

SEQ ID NO: 52067 - protein, 10 aa, Artificial Sequence
  Description of Artificial Sequence: Synthetic peptide
  Seed: NWQYFFPVIF (MAGA3_HUMAN)
NGQYFFPVIY

SEQ ID NO: 52068 - protein, 10 aa, Artificial Sequence
  Description of Artificial Sequence: Synthetic peptide
  Seed: YFFPVIFSKA (MAGA3_HUMAN)
YMFPVIFSKV

SEQ ID NO: 52069 - protein, 9 aa, Artificial Sequence
  Description of Artificial Sequence: Synthetic peptide
  Seed: ISYPPLHEW (MAGA3_HUMAN)
IAYPPLHEW

SEQ ID NO: 52070 - protein, 8 aa, Artificial Sequence
  Description of Artificial Sequence: Synthetic peptide
  Seed: ASSLPTTM (MAGA3_HUMAN)
ATSLPTTL

SEQ ID NO: 52071 - protein, 9 aa, Artificial Sequence
  Description of Artificial Sequence: Synthetic peptide
  Seed: SEFQAALSR (MAGA3_HUMAN)
STFQAALSH

SEQ ID NO: 52072 - protein, 10 aa, Artificial Sequence
  Description of Artificial Sequence: Synthetic peptide
  Seed: NWQYFFPVIF (MAGA3_HUMAN)
NPQYFFPVIY

SEQ ID NO: 52073 - protein, 10 aa, Artificial Sequence
  Description of Artificial Sequence: Synthetic peptide
  Seed: FSKASSSLQL (MAGA3_HUMAN)
FQKASSSLQM

SEQ ID NO: 52074 - protein, 9 aa, Artificial Sequence
  Description of Artificial Sequence: Synthetic peptide
  Seed: SEFQAALSR (MAGA3_HUMAN)
SEFQAALSY

SEQ ID NO: 52075 - protein, 8 aa, Artificial Sequence
  Description of Artificial Sequence: Synthetic peptide
  Seed: EELSVLEV (MAGA3_HUMAN)
EELSVLEF

SEQ ID NO: 52076 - protein, 9 aa, Artificial Sequence
  Description of Artificial Sequence: Synthetic peptide
  Seed: FATCLGLSY (MAGA3_HUMAN)
FFTCLGLSF

SEQ ID NO: 52077 - protein, 11 aa, Artificial Sequence
  Description of Artificial Sequence: Synthetic peptide
  Seed: MLGSVVGNWQY (MAGA3_HUMAN)
MFGSVVGNWQW

SEQ ID NO: 52078 - protein, 9 aa, Artificial Sequence
  Description of Artificial Sequence: Synthetic peptide
  Seed: YFFPVIFSK (MAGA3_HUMAN)
YVFPVIFSV

SEQ ID NO: 52079 - protein, 9 aa, Artificial Sequence
  Description of Artificial Sequence: Synthetic peptide
  Seed: ELVHFLLLK (MAGA3_HUMAN)
EFVHFLLLR

SEQ ID NO: 52080 - protein, 9 aa, Artificial Sequence
  Description of Artificial Sequence: Synthetic peptide
  Seed: YFFPVIFSK (MAGA3_HUMAN)
YFFPVIFSH

SEQ ID NO: 52081 - protein, 9 aa, Artificial Sequence
  Description of Artificial Sequence: Synthetic peptide
  Seed: SSTLVEVTL (MAGA3_HUMAN)
STTLVEVTL

SEQ ID NO: 52082 - protein, 10 aa, Artificial Sequence
  Description of Artificial Sequence: Synthetic peptide
  Seed: ALVETSYVKV (MAGA3_HUMAN)
ALVETSYVKL

SEQ ID NO: 52083 - protein, 10 aa, Artificial Sequence
  Description of Artificial Sequence: Synthetic peptide
  Seed: MVKISGGPHI (MAGA3_HUMAN)
MKKISGGPHF

SEQ ID NO: 52084 - protein, 10 aa, Artificial Sequence
  Description of Artificial Sequence: Synthetic peptide
  Seed: QYFFPVIFSK (MAGA3_HUMAN)
QAFFPVIFSK

SEQ ID NO: 52085 - protein, 10 aa, Artificial Sequence
  Description of Artificial Sequence: Synthetic peptide
  Seed: VIFSKASSSL (MAGA3_HUMAN)
VAFSKASSSY

SEQ ID NO: 52086 - protein, 9 aa, Artificial Sequence
  Description of Artificial Sequence: Synthetic peptide
  Seed: MPKAGLLII (MAGA3_HUMAN)
MIKAGLLIF

SEQ ID NO: 52087 - protein, 10 aa, Artificial Sequence
  Description of Artificial Sequence: Synthetic peptide
  Seed: FSKASSSLQL (MAGA3_HUMAN)
FGKASSSLQM

SEQ ID NO: 52088 - protein, 11 aa, Artificial Sequence
  Description of Artificial Sequence: Synthetic peptide
  Seed: TEEQEAASSSS (MAGA3_HUMAN)
TEEQEAASSSA

SEQ ID NO: 52089 - protein, 9 aa, Artificial Sequence
  Description of Artificial Sequence: Synthetic peptide
  Seed: VFEGREDSI (MAGA3_HUMAN)
VYEGREDSM

SEQ ID NO: 52090 - protein, 11 aa, Artificial Sequence
  Description of Artificial Sequence: Synthetic peptide
  Seed: KIWEELSVLEV (MAGA3_HUMAN)
KLWEELSVLEA

SEQ ID NO: 52091 - protein, 8 aa, Artificial Sequence
  Description of Artificial Sequence: Synthetic peptide
  Seed: FPDLESEF (MAGA3_HUMAN)
FWDLESEM

SEQ ID NO: 52092 - protein, 9 aa, Artificial Sequence
  Description of Artificial Sequence: Synthetic peptide
  Seed: AQAPATEEQ (MAGA3_HUMAN)
AMAPATEEL

SEQ ID NO: 52093 - protein, 9 aa, Artificial Sequence
  Description of Artificial Sequence: Synthetic peptide
  Seed: EELSVLEVF (MAGA3_HUMAN)
EELSVLEVP

SEQ ID NO: 52094 - protein, 10 aa, Artificial Sequence
  Description of Artificial Sequence: Synthetic peptide
  Seed: FSKASSSLQL (MAGA3_HUMAN)
FKKASSSLQY

SEQ ID NO: 52095 - protein, 9 aa, Artificial Sequence
  Description of Artificial Sequence: Synthetic peptide
  Seed: SSLQLVFGI (MAGA3_HUMAN)
SLLQLVFGM

SEQ ID NO: 52096 - protein, 11 aa, Artificial Sequence
  Description of Artificial Sequence: Synthetic peptide
  Seed: AQAPATEEQEA (MAGA3_HUMAN)
ALAPATEEQEW

SEQ ID NO: 52097 - protein, 9 aa, Artificial Sequence
  Description of Artificial Sequence: Synthetic peptide
  Seed: GSDPACYEF (MAGA3_HUMAN)
GIDPACYEV

SEQ ID NO: 52098 - protein, 10 aa, Artificial Sequence
  Description of Artificial Sequence: Synthetic peptide
  Seed: HISYPPLHEW (MAGA3_HUMAN)
HMSYPPLHEY

SEQ ID NO: 52099 - protein, 9 aa, Artificial Sequence
  Description of Artificial Sequence: Synthetic peptide
  Seed: MEVDPIGHL (MAGA3_HUMAN)
MTVDPIGHL

SEQ ID NO: 52100 - protein, 11 aa, Artificial Sequence
  Description of Artificial Sequence: Synthetic peptide
  Seed: KVAELVHFLLL (MAGA3_HUMAN)
KMAELVHFLLW

SEQ ID NO: 52101 - protein, 9 aa, Artificial Sequence
  Description of Artificial Sequence: Synthetic peptide
  Seed: FATCLGLSY (MAGA3_HUMAN)
FPTCLGLSM

SEQ ID NO: 52102 - protein, 9 aa, Artificial Sequence
  Description of Artificial Sequence: Synthetic peptide
  Seed: CYEFLWGPR (MAGA3_HUMAN)
CMEFLWGPR

SEQ ID NO: 52103 - protein, 9 aa, Artificial Sequence
  Description of Artificial Sequence: Synthetic peptide
  Seed: EAASSSSTL (MAGA3_HUMAN)
EPASSSSTL

SEQ ID NO: 52104 - protein, 10 aa, Artificial Sequence
  Description of Artificial Sequence: Synthetic peptide
  Seed: KASSSLQLVF (MAGA3_HUMAN)
KSSSSLQLVF

SEQ ID NO: 52105 - protein, 10 aa, Artificial Sequence
  Description of Artificial Sequence: Synthetic peptide
  Seed: MVKISGGPHI (MAGA3_HUMAN)
MEKISGGPHF

SEQ ID NO: 52106 - protein, 8 aa, Artificial Sequence
  Description of Artificial Sequence: Synthetic peptide
  Seed: SGGPHISY (MAGA3_HUMAN)
SAGPHISI

SEQ ID NO: 52107 - protein, 8 aa, Artificial Sequence
  Description of Artificial Sequence: Synthetic peptide
  Seed: FPDLESEF (MAGA3_HUMAN)
FLDLESEI

SEQ ID NO: 52108 - protein, 9 aa, Artificial Sequence
  Description of Artificial Sequence: Synthetic peptide
  Seed: EAASSSSTL (MAGA3_HUMAN)
ELASSSSTW

SEQ ID NO: 52109 - protein, 11 aa, Artificial Sequence
  Description of Artificial Sequence: Synthetic peptide
  Seed: WQYFFPVIFSK (MAGA3_HUMAN)
WMYFFPVIFSR

SEQ ID NO: 52110 - protein, 10 aa, Artificial Sequence
  Description of Artificial Sequence: Synthetic peptide
  Seed: MEVDPIGHLY (MAGA3_HUMAN)
MKVDPIGHLY

SEQ ID NO: 52111 - protein, 9 aa, Artificial Sequence
  Description of Artificial Sequence: Synthetic peptide
  Seed: VFEGREDSI (MAGA3_HUMAN)
VVEGREDSL

SEQ ID NO: 52112 - protein, 10 aa, Artificial Sequence
  Description of Artificial Sequence: Synthetic peptide
  Seed: QYFFPVIFSK (MAGA3_HUMAN)
QEFFPVIFSR

SEQ ID NO: 52113 - protein, 9 aa, Artificial Sequence
  Description of Artificial Sequence: Synthetic peptide
  Seed: LQLVFGIEL (MAGA3_HUMAN)
LMLVFGIEI

SEQ ID NO: 52114 - protein, 9 aa, Artificial Sequence
  Description of Artificial Sequence: Synthetic peptide
  Seed: QSPQGASSL (MAGA3_HUMAN)
QYPQGASSM

SEQ ID NO: 52115 - protein, 10 aa, Artificial Sequence
  Description of Artificial Sequence: Synthetic peptide
  Seed: FVQENYLEYR (MAGA3_HUMAN)
FVQENYLEYK

SEQ ID NO: 52116 - protein, 9 aa, Artificial Sequence
  Description of Artificial Sequence: Synthetic peptide
  Seed: NWQYFFPVI (MAGA3_HUMAN)
NFQYFFPVM

SEQ ID NO: 52117 - protein, 8 aa, Artificial Sequence
  Description of Artificial Sequence: Synthetic peptide
  Seed: SGGPHISY (MAGA3_HUMAN)
SQGPHISF

SEQ ID NO: 52118 - protein, 9 aa, Artificial Sequence
  Description of Artificial Sequence: Synthetic peptide
  Seed: KIWEELSVL (MAGA3_HUMAN)
KKWEELSVM

SEQ ID NO: 52119 - protein, 8 aa, Artificial Sequence
  Description of Artificial Sequence: Synthetic peptide
  Seed: YPLWSQSY (MAGA3_HUMAN)
YFLWSQSF

SEQ ID NO: 52120 - protein, 9 aa, Artificial Sequence
  Description of Artificial Sequence: Synthetic peptide
  Seed: SYVKVLHHM (MAGA3_HUMAN)
SFVKVLHHF

SEQ ID NO: 52121 - protein, 11 aa, Artificial Sequence
  Description of Artificial Sequence: Synthetic peptide
  Seed: SRKVAELVHFL (MAGA3_HUMAN)
SPKVAELVHFV

SEQ ID NO: 52122 - protein, 9 aa, Artificial Sequence
  Description of Artificial Sequence: Synthetic peptide
  Seed: SSLPTTMNY (MAGA3_HUMAN)
SNLPTTMNW

SEQ ID NO: 52123 - protein, 9 aa, Artificial Sequence
  Description of Artificial Sequence: Synthetic peptide
  Seed: KIWEELSVL (MAGA3_HUMAN)
KQWEELSVI

SEQ ID NO: 52124 - protein, 9 aa, Artificial Sequence
  Description of Artificial Sequence: Synthetic peptide
  Seed: LESEFQAAL (MAGA3_HUMAN)
LISEFQAAV

SEQ ID NO: 52125 - protein, 9 aa, Artificial Sequence
  Description of Artificial Sequence: Synthetic peptide
  Seed: VKISGGPHI (MAGA3_HUMAN)
VQISGGPHY

SEQ ID NO: 52126 - protein, 11 aa, Artificial Sequence
  Description of Artificial Sequence: Synthetic peptide
  Seed: AASSSSTLVEV (MAGA3_HUMAN)
AASSSSTLVEL

SEQ ID NO: 52127 - protein, 9 aa, Artificial Sequence
  Description of Artificial Sequence: Synthetic peptide
  Seed: SSLPTTMNY (MAGA3_HUMAN)
SCLPTTMNW

SEQ ID NO: 52128 - protein, 9 aa, Artificial Sequence
  Description of Artificial Sequence: Synthetic peptide
  Seed: YVKVLHHMV (MAGA3_HUMAN)
YIKVLHHML

SEQ ID NO: 52129 - protein, 11 aa, Artificial Sequence
  Description of Artificial Sequence: Synthetic peptide
  Seed: RQVPGSDPACY (MAGA3_HUMAN)
RIVPGSDPACY

SEQ ID NO: 52130 - protein, 9 aa, Artificial Sequence
  Description of Artificial Sequence: Synthetic peptide
  Seed: AASSSSTLV (MAGA3_HUMAN)
ATSSSSTLV

SEQ ID NO: 52131 - protein, 10 aa, Artificial Sequence
  Description of Artificial Sequence: Synthetic peptide
  Seed: MNYPLWSQSY (MAGA3_HUMAN)
MLYPLWSQSL

SEQ ID NO: 52132 - protein, 9 aa, Artificial Sequence
  Description of Artificial Sequence: Synthetic peptide
  Seed: SEFQAALSR (MAGA3_HUMAN)
SDFQAALSL

SEQ ID NO: 52133 - protein, 10 aa, Artificial Sequence
  Description of Artificial Sequence: Synthetic peptide
  Seed: KVAELVHFLL (MAGA3_HUMAN)
KCAELVHFLW

SEQ ID NO: 52134 - protein, 10 aa, Artificial Sequence
  Description of Artificial Sequence: Synthetic peptide
  Seed: LGLVGAQAPA (MAGA3_HUMAN)
LVLVGAQAPL

SEQ ID NO: 52135 - protein, 8 aa, Artificial Sequence
  Description of Artificial Sequence: Synthetic peptide
  Seed: IMPKAGLL (MAGA3_HUMAN)
IFPKAGLL

SEQ ID NO: 52136 - protein, 10 aa, Artificial Sequence
  Description of Artificial Sequence: Synthetic peptide
  Seed: KISGGPHISY (MAGA3_HUMAN)
KRSGGPHISM

SEQ ID NO: 52137 - protein, 10 aa, Artificial Sequence
  Description of Artificial Sequence: Synthetic peptide
  Seed: FFPVIFSKAS (MAGA3_HUMAN)
FRPVIFSKAA

SEQ ID NO: 52138 - protein, 10 aa, Artificial Sequence
  Description of Artificial Sequence: Synthetic peptide
  Seed: YRQVPGSDPA (MAGA3_HUMAN)
YFQVPGSDPV

SEQ ID NO: 52139 - protein, 9 aa, Artificial Sequence
  Description of Artificial Sequence: Synthetic peptide
  Seed: KVAELVHFL (MAGA3_HUMAN)
KSAELVHFR

SEQ ID NO: 52140 - protein, 10 aa, Artificial Sequence
  Description of Artificial Sequence: Synthetic peptide
  Seed: WEELSVLEVF (MAGA3_HUMAN)
WAELSVLEVL

SEQ ID NO: 52141 - protein, 10 aa, Artificial Sequence
  Description of Artificial Sequence: Synthetic peptide
  Seed: STFPDLESEF (MAGA3_HUMAN)
SWFPDLESEY

SEQ ID NO: 52142 - protein, 10 aa, Artificial Sequence
  Description of Artificial Sequence: Synthetic peptide
  Seed: VDPIGHLYIF (MAGA3_HUMAN)
VDPIGHLYIW

SEQ ID NO: 52143 - protein, 9 aa, Artificial Sequence
  Description of Artificial Sequence: Synthetic peptide
  Seed: MEVDPIGHL (MAGA3_HUMAN)
MEVDPIGHF

SEQ ID NO: 52144 - protein, 10 aa, Artificial Sequence
  Description of Artificial Sequence: Synthetic peptide
  Seed: KASSSLQLVF (MAGA3_HUMAN)
KRSSSLQLVY

SEQ ID NO: 52145 - protein, 10 aa, Artificial Sequence
  Description of Artificial Sequence: Synthetic peptide
  Seed: ISYPPLHEWV (MAGA3_HUMAN)
IRYPPLHEWW

SEQ ID NO: 52146 - protein, 11 aa, Artificial Sequence
  Description of Artificial Sequence: Synthetic peptide
  Seed: MLGSVVGNWQY (MAGA3_HUMAN)
MKGSVVGNWQW

SEQ ID NO: 52147 - protein, 10 aa, Artificial Sequence
  Description of Artificial Sequence: Synthetic peptide
  Seed: ISYPPLHEWV (MAGA3_HUMAN)
IFYPPLHEWW

SEQ ID NO: 52148 - protein, 9 aa, Artificial Sequence
  Description of Artificial Sequence: Synthetic peptide
  Seed: IMPKAGLLI (MAGA3_HUMAN)
IWPKAGLLV

SEQ ID NO: 52149 - protein, 9 aa, Artificial Sequence
  Description of Artificial Sequence: Synthetic peptide
  Seed: FVQENYLEY (MAGA3_HUMAN)
FWQENYLEI

SEQ ID NO: 52150 - protein, 10 aa, Artificial Sequence
  Description of Artificial Sequence: Synthetic peptide
  Seed: KASSSLQLVF (MAGA3_HUMAN)
KWSSSLQLVI

SEQ ID NO: 52151 - protein, 9 aa, Artificial Sequence
  Description of Artificial Sequence: Synthetic peptide
  Seed: FQAALSRKV (MAGA3_HUMAN)
FAAALSRKM

SEQ ID NO: 52152 - protein, 11 aa, Artificial Sequence
  Description of Artificial Sequence: Synthetic peptide
  Seed: AQAPATEEQEA (MAGA3_HUMAN)
ALAPATEEQEL

SEQ ID NO: 52153 - protein, 11 aa, Artificial Sequence
  Description of Artificial Sequence: Synthetic peptide
  Seed: REGDCAPEEKI (MAGA3_HUMAN)
RQGDCAPEEKM

SEQ ID NO: 52154 - protein, 10 aa, Artificial Sequence
  Description of Artificial Sequence: Synthetic peptide
  Seed: MEVDPIGHLY (MAGA3_HUMAN)
MQVDPIGHLM

SEQ ID NO: 52155 - protein, 10 aa, Artificial Sequence
  Description of Artificial Sequence: Synthetic peptide
  Seed: ASSLPTTMNY (MAGA3_HUMAN)
ASSLPTTMNK

SEQ ID NO: 52156 - protein, 10 aa, Artificial Sequence
  Description of Artificial Sequence: Synthetic peptide
  Seed: TSYVKVLHHM (MAGA3_HUMAN)
TAYVKVLHHL

SEQ ID NO: 52157 - protein, 9 aa, Artificial Sequence
  Description of Artificial Sequence: Synthetic peptide
  Seed: SSLPTTMNY (MAGA3_HUMAN)
SLLPTTMNF

SEQ ID NO: 52158 - protein, 9 aa, Artificial Sequence
  Description of Artificial Sequence: Synthetic peptide
  Seed: FVQENYLEY (MAGA3_HUMAN)
FAQENYLEY

SEQ ID NO: 52159 - protein, 10 aa, Artificial Sequence
  Description of Artificial Sequence: Synthetic peptide
  Seed: DLESEFQAAL (MAGA3_HUMAN)
DKESEFQAAF

SEQ ID NO: 52160 - protein, 10 aa, Artificial Sequence
  Description of Artificial Sequence: Synthetic peptide
  Seed: KISGGPHISY (MAGA3_HUMAN)
KVSGGPHISR

SEQ ID NO: 52161 - protein, 10 aa, Artificial Sequence
  Description of Artificial Sequence: Synthetic peptide
  Seed: LPTTMNYPLW (MAGA3_HUMAN)
LYTTMNYPLW

SEQ ID NO: 52162 - protein, 10 aa, Artificial Sequence
  Description of Artificial Sequence: Synthetic peptide
  Seed: ASSLPTTMNY (MAGA3_HUMAN)
ASSLPTTMNR

SEQ ID NO: 52163 - protein, 10 aa, Artificial Sequence
  Description of Artificial Sequence: Synthetic peptide
  Seed: EVDPIGHLYI (MAGA3_HUMAN)
EIDPIGHLYL

SEQ ID NO: 52164 - protein, 10 aa, Artificial Sequence
  Description of Artificial Sequence: Synthetic peptide
  Seed: ESEFQAALSR (MAGA3_HUMAN)
ETEFQAALSK

SEQ ID NO: 52165 - protein, 9 aa, Artificial Sequence
  Description of Artificial Sequence: Synthetic peptide
  Seed: FVQENYLEY (MAGA3_HUMAN)
FHQENYLEM

SEQ ID NO: 52166 - protein, 9 aa, Artificial Sequence
  Description of Artificial Sequence: Synthetic peptide
  Seed: KIWEELSVL (MAGA3_HUMAN)
KEWEELSVF

SEQ ID NO: 52167 - protein, 8 aa, Artificial Sequence
  Description of Artificial Sequence: Synthetic peptide
  Seed: FPDLESEF (MAGA3_HUMAN)
FWDLESEI

SEQ ID NO: 52168 - protein, 9 aa, Artificial Sequence
  Description of Artificial Sequence: Synthetic peptide
  Seed: AEMLGSVVG (MAGA3_HUMAN)
AEMLGSVVL

SEQ ID NO: 52169 - protein, 8 aa, Artificial Sequence
  Description of Artificial Sequence: Synthetic peptide
  Seed: WQYFFPVI (MAGA3_HUMAN)
WKYFFPVF

SEQ ID NO: 52170 - protein, 9 aa, Artificial Sequence
  Description of Artificial Sequence: Synthetic peptide
  Seed: KIWEELSVL (MAGA3_HUMAN)
KLWEELSVA

SEQ ID NO: 52171 - protein, 10 aa, Artificial Sequence
  Description of Artificial Sequence: Synthetic peptide
  Seed: YVKVLHHMVK (MAGA3_HUMAN)
YSKVLHHMVK

SEQ ID NO: 52172 - protein, 10 aa, Artificial Sequence
  Description of Artificial Sequence: Synthetic peptide
  Seed: RKVAELVHFL (MAGA3_HUMAN)
RWVAELVHFL

SEQ ID NO: 52173 - protein, 9 aa, Artificial Sequence
  Description of Artificial Sequence: Synthetic peptide
  Seed: YFFPVIFSK (MAGA3_HUMAN)
YNFPVIFSR

SEQ ID NO: 52174 - protein, 9 aa, Artificial Sequence
  Description of Artificial Sequence: Synthetic peptide
  Seed: FVQENYLEY (MAGA3_HUMAN)
FYQENYLEY

SEQ ID NO: 52175 - protein, 11 aa, Artificial Sequence
  Description of Artificial Sequence: Synthetic peptide
  Seed: ISYPPLHEWVL (MAGA3_HUMAN)
ITYPPLHEWVM

SEQ ID NO: 52176 - protein, 9 aa, Artificial Sequence
  Description of Artificial Sequence: Synthetic peptide
  Seed: IMPKAGLLI (MAGA3_HUMAN)
IVPKAGLLI

SEQ ID NO: 52177 - protein, 11 aa, Artificial Sequence
  Description of Artificial Sequence: Synthetic peptide
  Seed: KVAELVHFLLL (MAGA3_HUMAN)
KQAELVHFLLL

SEQ ID NO: 52178 - protein, 11 aa, Artificial Sequence
  Description of Artificial Sequence: Synthetic peptide
  Seed: FLWGPRALVET (MAGA3_HUMAN)
FVWGPRALVEL

SEQ ID NO: 52179 - protein, 10 aa, Artificial Sequence
  Description of Artificial Sequence: Synthetic peptide
  Seed: YLEYRQVPGS (MAGA3_HUMAN)
YLEYRQVPGA

SEQ ID NO: 52180 - protein, 9 aa, Artificial Sequence
  Description of Artificial Sequence: Synthetic peptide
  Seed: AEMLGSVVG (MAGA3_HUMAN)
ADMLGSVVF

SEQ ID NO: 52181 - protein, 9 aa, Artificial Sequence
  Description of Artificial Sequence: Synthetic peptide
  Seed: AESPDPPQS (MAGA3_HUMAN)
AESPDPPQV

SEQ ID NO: 52182 - protein, 11 aa, Artificial Sequence
  Description of Artificial Sequence: Synthetic peptide
  Seed: HCKPEEGLEAR (MAGA3_HUMAN)
HAKPEEGLEAL

SEQ ID NO: 52183 - protein, 9 aa, Artificial Sequence
  Description of Artificial Sequence: Synthetic peptide
  Seed: KVAELVHFL (MAGA3_HUMAN)
KQAELVHFW

SEQ ID NO: 52184 - protein, 10 aa, Artificial Sequence
  Description of Artificial Sequence: Synthetic peptide
  Seed: YFFPVIFSKA (MAGA3_HUMAN)
YWFPVIFSKR

SEQ ID NO: 52185 - protein, 8 aa, Artificial Sequence
  Description of Artificial Sequence: Synthetic peptide
  Seed: LGDPKKLL (MAGA3_HUMAN)
LADPKKLM

SEQ ID NO: 52186 - protein, 9 aa, Artificial Sequence
  Description of Artificial Sequence: Synthetic peptide
  Seed: EVDPIGHLY (MAGA3_HUMAN)
EIDPIGHLY

SEQ ID NO: 52187 - protein, 10 aa, Artificial Sequence
  Description of Artificial Sequence: Synthetic peptide
  Seed: EVFEGREDSI (MAGA3_HUMAN)
EVFEGREDSF

SEQ ID NO: 52188 - protein, 9 aa, Artificial Sequence
  Description of Artificial Sequence: Synthetic peptide
  Seed: RALVETSYV (MAGA3_HUMAN)
RTLVETSYM

SEQ ID NO: 52189 - protein, 9 aa, Artificial Sequence
  Description of Artificial Sequence: Synthetic peptide
  Seed: ASSSLQLVF (MAGA3_HUMAN)
ALSSLQLVL

SEQ ID NO: 52190 - protein, 10 aa, Artificial Sequence
  Description of Artificial Sequence: Synthetic peptide
  Seed: TLVEVTLGEV (MAGA3_HUMAN)
TMVEVTLGEL

SEQ ID NO: 52191 - protein, 9 aa, Artificial Sequence
  Description of Artificial Sequence: Synthetic peptide
  Seed: KVLHHMVKI (MAGA3_HUMAN)
KTLHHMVKF

SEQ ID NO: 52192 - protein, 10 aa, Artificial Sequence
  Description of Artificial Sequence: Synthetic peptide
  Seed: KAEMLGSVVG (MAGA3_HUMAN)
KWEMLGSVVV

SEQ ID NO: 52193 - protein, 10 aa, Artificial Sequence
  Description of Artificial Sequence: Synthetic peptide
  Seed: MEVDPIGHLY (MAGA3_HUMAN)
MLVDPIGHLI

SEQ ID NO: 52194 - protein, 9 aa, Artificial Sequence
  Description of Artificial Sequence: Synthetic peptide
  Seed: ISGGPHISY (MAGA3_HUMAN)
IIGGPHISM

SEQ ID NO: 52195 - protein, 10 aa, Artificial Sequence
  Description of Artificial Sequence: Synthetic peptide
  Seed: TSYVKVLHHM (MAGA3_HUMAN)
TEYVKVLHHL

SEQ ID NO: 52196 - protein, 9 aa, Artificial Sequence
  Description of Artificial Sequence: Synthetic peptide
  Seed: SKASSSLQL (MAGA3_HUMAN)
SHASSSLQI

SEQ ID NO: 52197 - protein, 10 aa, Artificial Sequence
  Description of Artificial Sequence: Synthetic peptide
  Seed: HISYPPLHEW (MAGA3_HUMAN)
HDSYPPLHEY

SEQ ID NO: 52198 - protein, 9 aa, Artificial Sequence
  Description of Artificial Sequence: Synthetic peptide
  Seed: YFFPVIFSK (MAGA3_HUMAN)
YMFPVIFSA

SEQ ID NO: 52199 - protein, 9 aa, Artificial Sequence
  Description of Artificial Sequence: Synthetic peptide
  Seed: IFSKASSSL (MAGA3_HUMAN)
IASKASSSY

SEQ ID NO: 52200 - protein, 11 aa, Artificial Sequence
  Description of Artificial Sequence: Synthetic peptide
  Seed: AQAPATEEQEA (MAGA3_HUMAN)
AMAPATEEQEW

SEQ ID NO: 52201 - protein, 9 aa, Artificial Sequence
  Description of Artificial Sequence: Synthetic peptide
  Seed: EVDPIGHLY (MAGA3_HUMAN)
ELDPIGHLM

SEQ ID NO: 52202 - protein, 11 aa, Artificial Sequence
  Description of Artificial Sequence: Synthetic peptide
  Seed: STFPDLESEFQ (MAGA3_HUMAN)
SIFPDLESEFK

SEQ ID NO: 52203 - protein, 9 aa, Artificial Sequence
  Description of Artificial Sequence: Synthetic peptide
  Seed: SILGDPKKL (MAGA3_HUMAN)
SMLGDPKKF

SEQ ID NO: 52204 - protein, 10 aa, Artificial Sequence
  Description of Artificial Sequence: Synthetic peptide
  Seed: SVVGNWQYFF (MAGA3_HUMAN)
STVGNWQYFW

SEQ ID NO: 52205 - protein, 9 aa, Artificial Sequence
  Description of Artificial Sequence: Synthetic peptide
  Seed: SILGDPKKL (MAGA3_HUMAN)
SLLGDPKKV

SEQ ID NO: 52206 - protein, 9 aa, Artificial Sequence
  Description of Artificial Sequence: Synthetic peptide
  Seed: ALSRKVAEL (MAGA3_HUMAN)
AYSRKVAEM

SEQ ID NO: 52207 - protein, 9 aa, Artificial Sequence
  Description of Artificial Sequence: Synthetic peptide
  Seed: KVLHHMVKI (MAGA3_HUMAN)
KYLHHMVKY

SEQ ID NO: 52208 - protein, 10 aa, Artificial Sequence
  Description of Artificial Sequence: Synthetic peptide
  Seed: ASSLPTTMNY (MAGA3_HUMAN)
ALSLPTTMNY

SEQ ID NO: 52209 - protein, 10 aa, Artificial Sequence
  Description of Artificial Sequence: Synthetic peptide
  Seed: LIIVLAIIAR (MAGA3_HUMAN)
LTIVLAIIAR

SEQ ID NO: 52210 - protein, 10 aa, Artificial Sequence
  Description of Artificial Sequence: Synthetic peptide
  Seed: HISYPPLHEW (MAGA3_HUMAN)
HRSYPPLHEW

SEQ ID NO: 52211 - protein, 9 aa, Artificial Sequence
  Description of Artificial Sequence: Synthetic peptide
  Seed: ASSSLQLVF (MAGA3_HUMAN)
ASSSLQLVV

SEQ ID NO: 52212 - protein, 9 aa, Artificial Sequence
  Description of Artificial Sequence: Synthetic peptide
  Seed: YIFATCLGL (MAGA3_HUMAN)
YGFATCLGY

SEQ ID NO: 52213 - protein, 9 aa, Artificial Sequence
  Description of Artificial Sequence: Synthetic peptide
  Seed: VVGNWQYFF (MAGA3_HUMAN)
VEGNWQYFY

SEQ ID NO: 52214 - protein, 9 aa, Artificial Sequence
  Description of Artificial Sequence: Synthetic peptide
  Seed: YPPLHEWVL (MAGA3_HUMAN)
YRPLHEWVF

SEQ ID NO: 52215 - protein, 9 aa, Artificial Sequence
  Description of Artificial Sequence: Synthetic peptide
  Seed: KASSSLQLV (MAGA3_HUMAN)
KSSSSLQLW

SEQ ID NO: 52216 - protein, 9 aa, Artificial Sequence
  Description of Artificial Sequence: Synthetic peptide
  Seed: LGDPKKLLT (MAGA3_HUMAN)
LQDPKKLLL

SEQ ID NO: 52217 - protein, 9 aa, Artificial Sequence
  Description of Artificial Sequence: Synthetic peptide
  Seed: ISYPPLHEW (MAGA3_HUMAN)
IKYPPLHEM

SEQ ID NO: 52218 - protein, 11 aa, Artificial Sequence
  Description of Artificial Sequence: Synthetic peptide
  Seed: MEVDPIGHLYI (MAGA3_HUMAN)
MEVDPIGHLYV

SEQ ID NO: 52219 - protein, 9 aa, Artificial Sequence
  Description of Artificial Sequence: Synthetic peptide
  Seed: VKISGGPHI (MAGA3_HUMAN)
VMISGGPHW

SEQ ID NO: 52220 - protein, 9 aa, Artificial Sequence
  Description of Artificial Sequence: Synthetic peptide
  Seed: DSILGDPKK (MAGA3_HUMAN)
DVILGDPKK

SEQ ID NO: 52221 - protein, 9 aa, Artificial Sequence
  Description of Artificial Sequence: Synthetic peptide
  Seed: SKASSSLQL (MAGA3_HUMAN)
SMASSSLQM

SEQ ID NO: 52222 - protein, 10 aa, Artificial Sequence
  Description of Artificial Sequence: Synthetic peptide
  Seed: MVKISGGPHI (MAGA3_HUMAN)
MRKISGGPHF

SEQ ID NO: 52223 - protein, 9 aa, Artificial Sequence
  Description of Artificial Sequence: Synthetic peptide
  Seed: SSSSTLVEV (MAGA3_HUMAN)
SISSTLVEL

SEQ ID NO: 52224 - protein, 10 aa, Artificial Sequence
  Description of Artificial Sequence: Synthetic peptide
  Seed: STFPDLESEF (MAGA3_HUMAN)
SQFPDLESEM

SEQ ID NO: 52225 - protein, 9 aa, Artificial Sequence
  Description of Artificial Sequence: Synthetic peptide
  Seed: DSILGDPKK (MAGA3_HUMAN)
DIILGDPKR

SEQ ID NO: 52226 - protein, 9 aa, Artificial Sequence
  Description of Artificial Sequence: Synthetic peptide
  Seed: SSLQLVFGI (MAGA3_HUMAN)
SVLQLVFGM

SEQ ID NO: 52227 - protein, 10 aa, Artificial Sequence
  Description of Artificial Sequence: Synthetic peptide
  Seed: DLESEFQAAL (MAGA3_HUMAN)
DYESEFQAAF

SEQ ID NO: 52228 - protein, 9 aa, Artificial Sequence
  Description of Artificial Sequence: Synthetic peptide
  Seed: SYVKVLHHM (MAGA3_HUMAN)
SSVKVLHHI

SEQ ID NO: 52229 - protein, 9 aa, Artificial Sequence
  Description of Artificial Sequence: Synthetic peptide
  Seed: LESEFQAAL (MAGA3_HUMAN)
LASEFQAAF

SEQ ID NO: 52230 - protein, 9 aa, Artificial Sequence
  Description of Artificial Sequence: Synthetic peptide
  Seed: MPKAGLLII (MAGA3_HUMAN)
MPKAGLLIM

SEQ ID NO: 52231 - protein, 11 aa, Artificial Sequence
  Description of Artificial Sequence: Synthetic peptide
  Seed: EVFEGREDSIL (MAGA3_HUMAN)
EVFEGREDSIW

SEQ ID NO: 52232 - protein, 10 aa, Artificial Sequence
  Description of Artificial Sequence: Synthetic peptide
  Seed: VIFSKASSSL (MAGA3_HUMAN)
VFFSKASSSY

SEQ ID NO: 52233 - protein, 11 aa, Artificial Sequence
  Description of Artificial Sequence: Synthetic peptide
  Seed: YIFATCLGLSY (MAGA3_HUMAN)
YAFATCLGLSM

SEQ ID NO: 52234 - protein, 10 aa, Artificial Sequence
  Description of Artificial Sequence: Synthetic peptide
  Seed: MNYPLWSQSY (MAGA3_HUMAN)
MFYPLWSQSW

SEQ ID NO: 52235 - protein, 9 aa, Artificial Sequence
  Description of Artificial Sequence: Synthetic peptide
  Seed: LESEFQAAL (MAGA3_HUMAN)
LLSEFQAAV

SEQ ID NO: 52236 - protein, 9 aa, Artificial Sequence
  Description of Artificial Sequence: Synthetic peptide
  Seed: QSPQGASSL (MAGA3_HUMAN)
QLPQGASSI

SEQ ID NO: 52237 - protein, 9 aa, Artificial Sequence
  Description of Artificial Sequence: Synthetic peptide
  Seed: KASSSLQLV (MAGA3_HUMAN)
KMSSSLQLM

SEQ ID NO: 52238 - protein, 9 aa, Artificial Sequence
  Description of Artificial Sequence: Synthetic peptide
  Seed: GSDPACYEF (MAGA3_HUMAN)
GWDPACYEL

SEQ ID NO: 52239 - protein, 10 aa, Artificial Sequence
  Description of Artificial Sequence: Synthetic peptide
  Seed: TSYVKVLHHM (MAGA3_HUMAN)
TVYVKVLHHI

SEQ ID NO: 52240 - protein, 10 aa, Artificial Sequence
  Description of Artificial Sequence: Synthetic peptide
  Seed: RQVPGSDPAC (MAGA3_HUMAN)
REVPGSDPAL

SEQ ID NO: 52241 - protein, 9 aa, Artificial Sequence
  Description of Artificial Sequence: Synthetic peptide
  Seed: ALSRKVAEL (MAGA3_HUMAN)
ALSRKVAEW

SEQ ID NO: 52242 - protein, 10 aa, Artificial Sequence
  Description of Artificial Sequence: Synthetic peptide
  Seed: LVFGIELMEV (MAGA3_HUMAN)
LTFGIELMEI

SEQ ID NO: 52243 - protein, 10 aa, Artificial Sequence
  Description of Artificial Sequence: Synthetic peptide
  Seed: TSYVKVLHHM (MAGA3_HUMAN)
TYYVKVLHHW

SEQ ID NO: 52244 - protein, 11 aa, Artificial Sequence
  Description of Artificial Sequence: Synthetic peptide
  Seed: VKISGGPHISY (MAGA3_HUMAN)
VMISGGPHISY

SEQ ID NO: 52245 - protein, 10 aa, Artificial Sequence
  Description of Artificial Sequence: Synthetic peptide
  Seed: MEVDPIGHLY (MAGA3_HUMAN)
MTVDPIGHLK

SEQ ID NO: 52246 - protein, 9 aa, Artificial Sequence
  Description of Artificial Sequence: Synthetic peptide
  Seed: MEVDPIGHL (MAGA3_HUMAN)
MRVDPIGHV

SEQ ID NO: 52247 - protein, 10 aa, Artificial Sequence
  Description of Artificial Sequence: Synthetic peptide
  Seed: KVAELVHFLL (MAGA3_HUMAN)
KMAELVHFLW

SEQ ID NO: 52248 - protein, 11 aa, Artificial Sequence
  Description of Artificial Sequence: Synthetic peptide
  Seed: SNQEEEGPSTF (MAGA3_HUMAN)
SMQEEEGPSTW

SEQ ID NO: 52249 - protein, 9 aa, Artificial Sequence
  Description of Artificial Sequence: Synthetic peptide
  Seed: KVAELVHFL (MAGA3_HUMAN)
KMAELVHFI

SEQ ID NO: 52250 - protein, 10 aa, Artificial Sequence
  Description of Artificial Sequence: Synthetic peptide
  Seed: YIFATCLGLS (MAGA3_HUMAN)
YMFATCLGLD

SEQ ID NO: 52251 - protein, 9 aa, Artificial Sequence
  Description of Artificial Sequence: Synthetic peptide
  Seed: LPTTMNYPL (MAGA3_HUMAN)
LPTTMNYPT

SEQ ID NO: 52252 - protein, 10 aa, Artificial Sequence
  Description of Artificial Sequence: Synthetic peptide
  Seed: SLQLVFGIEL (MAGA3_HUMAN)
SEQLVFGIEF

SEQ ID NO: 52253 - protein, 10 aa, Artificial Sequence
  Description of Artificial Sequence: Synthetic peptide
  Seed: KVAELVHFLL (MAGA3_HUMAN)
KAAELVHFLW

SEQ ID NO: 52254 - protein, 9 aa, Artificial Sequence
  Description of Artificial Sequence: Synthetic peptide
  Seed: WQYFFPVIF (MAGA3_HUMAN)
WMYFFPVIY

SEQ ID NO: 52255 - protein, 10 aa, Artificial Sequence
  Description of Artificial Sequence: Synthetic peptide
  Seed: TTMNYPLWSQ (MAGA3_HUMAN)
TVMNYPLWSR

SEQ ID NO: 52256 - protein, 10 aa, Artificial Sequence
  Description of Artificial Sequence: Synthetic peptide
  Seed: KISGGPHISY (MAGA3_HUMAN)
KSSGGPHISY

SEQ ID NO: 52257 - protein, 9 aa, Artificial Sequence
  Description of Artificial Sequence: Synthetic peptide
  Seed: AELVHFLLL (MAGA3_HUMAN)
ADLVHFLLI

SEQ ID NO: 52258 - protein, 9 aa, Artificial Sequence
  Description of Artificial Sequence: Synthetic peptide
  Seed: SYVKVLHHM (MAGA3_HUMAN)
SSVKVLHHF

SEQ ID NO: 52259 - protein, 9 aa, Artificial Sequence
  Description of Artificial Sequence: Synthetic peptide
  Seed: RKVAELVHF (MAGA3_HUMAN)
RSVAELVHY

SEQ ID NO: 52260 - protein, 10 aa, Artificial Sequence
  Description of Artificial Sequence: Synthetic peptide
  Seed: TSYVKVLHHM (MAGA3_HUMAN)
TAYVKVLHHW

SEQ ID NO: 52261 - protein, 9 aa, Artificial Sequence
  Description of Artificial Sequence: Synthetic peptide
  Seed: MEVDPIGHL (MAGA3_HUMAN)
MMVDPIGHA

SEQ ID NO: 52262 - protein, 10 aa, Artificial Sequence
  Description of Artificial Sequence: Synthetic peptide
  Seed: TSYVKVLHHM (MAGA3_HUMAN)
TGYVKVLHHF

SEQ ID NO: 52263 - protein, 10 aa, Artificial Sequence
  Description of Artificial Sequence: Synthetic peptide
  Seed: SLPTTMNYPL (MAGA3_HUMAN)
SLPTTMNYPV

SEQ ID NO: 52264 - protein, 9 aa, Artificial Sequence
  Description of Artificial Sequence: Synthetic peptide
  Seed: ALSRKVAEL (MAGA3_HUMAN)
AMSRKVAEL

SEQ ID NO: 52265 - protein, 10 aa, Artificial Sequence
  Description of Artificial Sequence: Synthetic peptide
  Seed: QYFFPVIFSK (MAGA3_HUMAN)
QSFFPVIFSK

SEQ ID NO: 52266 - protein, 9 aa, Artificial Sequence
  Description of Artificial Sequence: Synthetic peptide
  Seed: KIWEELSVL (MAGA3_HUMAN)
KQWEELSVH

SEQ ID NO: 52267 - protein, 9 aa, Artificial Sequence
  Description of Artificial Sequence: Synthetic peptide
  Seed: DSILGDPKK (MAGA3_HUMAN)
DVILGDPKR

SEQ ID NO: 52268 - protein, 9 aa, Artificial Sequence
  Description of Artificial Sequence: Synthetic peptide
  Seed: VFEGREDSI (MAGA3_HUMAN)
VWEGREDSM

SEQ ID NO: 52269 - protein, 9 aa, Artificial Sequence
  Description of Artificial Sequence: Synthetic peptide
  Seed: ILGDPKKLL (MAGA3_HUMAN)
IYGDPKKLL

SEQ ID NO: 52270 - protein, 9 aa, Artificial Sequence
  Description of Artificial Sequence: Synthetic peptide
  Seed: NYPLWSQSY (MAGA3_HUMAN)
NWPLWSQSM

SEQ ID NO: 52271 - protein, 11 aa, Artificial Sequence
  Description of Artificial Sequence: Synthetic peptide
  Seed: RQVPGSDPACY (MAGA3_HUMAN)
RLVPGSDPACY

SEQ ID NO: 52272 - protein, 9 aa, Artificial Sequence
  Description of Artificial Sequence: Synthetic peptide
  Seed: RALVETSYV (MAGA3_HUMAN)
RLLVETSYA

SEQ ID NO: 52273 - protein, 9 aa, Artificial Sequence
  Description of Artificial Sequence: Synthetic peptide
  Seed: ISYPPLHEW (MAGA3_HUMAN)
ITYPPLHEI

SEQ ID NO: 52274 - protein, 10 aa, Artificial Sequence
  Description of Artificial Sequence: Synthetic peptide
  Seed: KISGGPHISY (MAGA3_HUMAN)
KISGGPHISF

SEQ ID NO: 52275 - protein, 9 aa, Artificial Sequence
  Description of Artificial Sequence: Synthetic peptide
  Seed: VQENYLEYR (MAGA3_HUMAN)
VTENYLEYY

SEQ ID NO: 52276 - protein, 9 aa, Artificial Sequence
  Description of Artificial Sequence: Synthetic peptide
  Seed: YIFATCLGL (MAGA3_HUMAN)
YWFATCLGL

SEQ ID NO: 52277 - protein, 9 aa, Artificial Sequence
  Description of Artificial Sequence: Synthetic peptide
  Seed: DPIGHLYIF (MAGA3_HUMAN)
DPIGHLYIW

SEQ ID NO: 52278 - protein, 10 aa, Artificial Sequence
  Description of Artificial Sequence: Synthetic peptide
  Seed: VIFSKASSSL (MAGA3_HUMAN)
VYFSKASSSF

SEQ ID NO: 52279 - protein, 10 aa, Artificial Sequence
  Description of Artificial Sequence: Synthetic peptide
  Seed: VTKAEMLGSV (MAGA3_HUMAN)
VMKAEMLGSV

SEQ ID NO: 52280 - protein, 9 aa, Artificial Sequence
  Description of Artificial Sequence: Synthetic peptide
  Seed: LVHFLLLKY (MAGA3_HUMAN)
LMHFLLLKK

SEQ ID NO: 52281 - protein, 9 aa, Artificial Sequence
  Description of Artificial Sequence: Synthetic peptide
  Seed: KAGLLIIVL (MAGA3_HUMAN)
KRGLLIIVY

SEQ ID NO: 52282 - protein, 10 aa, Artificial Sequence
  Description of Artificial Sequence: Synthetic peptide
  Seed: VIFSKASSSL (MAGA3_HUMAN)
VLFSKASSSM

SEQ ID NO: 52283 - protein, 11 aa, Artificial Sequence
  Description of Artificial Sequence: Synthetic peptide
  Seed: KIWEELSVLEV (MAGA3_HUMAN)
KIWEELSVLEI

SEQ ID NO: 52284 - protein, 9 aa, Artificial Sequence
  Description of Artificial Sequence: Synthetic peptide
  Seed: EVDPIGHLY (MAGA3_HUMAN)
EADPIGHLK

SEQ ID NO: 52285 - protein, 10 aa, Artificial Sequence
  Description of Artificial Sequence: Synthetic peptide
  Seed: TSYVKVLHHM (MAGA3_HUMAN)
TDYVKVLHHW

SEQ ID NO: 52286 - protein, 11 aa, Artificial Sequence
  Description of Artificial Sequence: Synthetic peptide
  Seed: FLWGPRALVET (MAGA3_HUMAN)
FVWGPRALVEV

SEQ ID NO: 52287 - protein, 9 aa, Artificial Sequence
  Description of Artificial Sequence: Synthetic peptide
  Seed: VTLGEVPAA (MAGA3_HUMAN)
VLLGEVPAL

SEQ ID NO: 52288 - protein, 9 aa, Artificial Sequence
  Description of Artificial Sequence: Synthetic peptide
  Seed: VVGNWQYFF (MAGA3_HUMAN)
VWGNWQYFM

SEQ ID NO: 52289 - protein, 9 aa, Artificial Sequence
  Description of Artificial Sequence: Synthetic peptide
  Seed: TFPDLESEF (MAGA3_HUMAN)
TIPDLESEI

SEQ ID NO: 52290 - protein, 9 aa, Artificial Sequence
  Description of Artificial Sequence: Synthetic peptide
  Seed: KAGLLIIVL (MAGA3_HUMAN)
KMGLLIIVW

SEQ ID NO: 52291 - protein, 9 aa, Artificial Sequence
  Description of Artificial Sequence: Synthetic peptide
  Seed: GASSLPTTM (MAGA3_HUMAN)
GQSSLPTTF

SEQ ID NO: 52292 - protein, 10 aa, Artificial Sequence
  Description of Artificial Sequence: Synthetic peptide
  Seed: EFLWGPRALV (MAGA3_HUMAN)
EALWGPRALV

SEQ ID NO: 52293 - protein, 8 aa, Artificial Sequence
  Description of Artificial Sequence: Synthetic peptide
  Seed: FPDLESEF (MAGA3_HUMAN)
FCDLESEL

SEQ ID NO: 52294 - protein, 9 aa, Artificial Sequence
  Description of Artificial Sequence: Synthetic peptide
  Seed: KVAELVHFL (MAGA3_HUMAN)
KQAELVHFV

SEQ ID NO: 52295 - protein, 9 aa, Artificial Sequence
  Description of Artificial Sequence: Synthetic peptide
  Seed: TEEQEAASS (MAGA3_HUMAN)
TEEQEAASA

SEQ ID NO: 52296 - protein, 9 aa, Artificial Sequence
  Description of Artificial Sequence: Synthetic peptide
  Seed: SKASSSLQL (MAGA3_HUMAN)
SQASSSLQL

SEQ ID NO: 52297 - protein, 9 aa, Artificial Sequence
  Description of Artificial Sequence: Synthetic peptide
  Seed: EAASSSSTL (MAGA3_HUMAN)
ELASSSSTF

SEQ ID NO: 52298 - protein, 9 aa, Artificial Sequence
  Description of Artificial Sequence: Synthetic peptide
  Seed: EELSVLEVF (MAGA3_HUMAN)
EMLSVLEVF

SEQ ID NO: 52299 - protein, 9 aa, Artificial Sequence
  Description of Artificial Sequence: Synthetic peptide
  Seed: ALSRKVAEL (MAGA3_HUMAN)
AQSRKVAEW

SEQ ID NO: 52300 - protein, 9 aa, Artificial Sequence
  Description of Artificial Sequence: Synthetic peptide
  Seed: QIMPKAGLL (MAGA3_HUMAN)
QTMPKAGLK

SEQ ID NO: 52301 - protein, 10 aa, Artificial Sequence
  Description of Artificial Sequence: Synthetic peptide
  Seed: SDPACYEFLW (MAGA3_HUMAN)
SNPACYEFLW

SEQ ID NO: 52302 - protein, 9 aa, Artificial Sequence
  Description of Artificial Sequence: Synthetic peptide
  Seed: YFFPVIFSK (MAGA3_HUMAN)
YWFPVIFSR

SEQ ID NO: 52303 - protein, 9 aa, Artificial Sequence
  Description of Artificial Sequence: Synthetic peptide
  Seed: TFPDLESEF (MAGA3_HUMAN)
TYPDLESEI

SEQ ID NO: 52304 - protein, 9 aa, Artificial Sequence
  Description of Artificial Sequence: Synthetic peptide
  Seed: QEEEGPSTF (MAGA3_HUMAN)
QMEEGPSTY

SEQ ID NO: 52305 - protein, 10 aa, Artificial Sequence
  Description of Artificial Sequence: Synthetic peptide
  Seed: STFPDLESEF (MAGA3_HUMAN)
SSFPDLESEY

SEQ ID NO: 52306 - protein, 9 aa, Artificial Sequence
  Description of Artificial Sequence: Synthetic peptide
  Seed: GNWQYFFPV (MAGA3_HUMAN)
GMWQYFFPV

SEQ ID NO: 52307 - protein, 10 aa, Artificial Sequence
  Description of Artificial Sequence: Synthetic peptide
  Seed: SVVGNWQYFF (MAGA3_HUMAN)
SAVGNWQYFY

SEQ ID NO: 52308 - protein, 9 aa, Artificial Sequence
  Description of Artificial Sequence: Synthetic peptide
  Seed: EAASSSSTL (MAGA3_HUMAN)
EPASSSSTW

SEQ ID NO: 52309 - protein, 11 aa, Artificial Sequence
  Description of Artificial Sequence: Synthetic peptide
  Seed: RQVPGSDPACY (MAGA3_HUMAN)
RYVPGSDPACF

SEQ ID NO: 52310 - protein, 9 aa, Artificial Sequence
  Description of Artificial Sequence: Synthetic peptide
  Seed: WQYFFPVIF (MAGA3_HUMAN)
WNYFFPVIF

SEQ ID NO: 52311 - protein, 9 aa, Artificial Sequence
  Description of Artificial Sequence: Synthetic peptide
  Seed: ISYPPLHEW (MAGA3_HUMAN)
IVYPPLHEM

SEQ ID NO: 52312 - protein, 10 aa, Artificial Sequence
  Description of Artificial Sequence: Synthetic peptide
  Seed: MNYPLWSQSY (MAGA3_HUMAN)
MSYPLWSQSI

SEQ ID NO: 52313 - protein, 10 aa, Artificial Sequence
  Description of Artificial Sequence: Synthetic peptide
  Seed: TSYVKVLHHM (MAGA3_HUMAN)
TDYVKVLHHI

SEQ ID NO: 52314 - protein, 10 aa, Artificial Sequence
  Description of Artificial Sequence: Synthetic peptide
  Seed: KASSSLQLVF (MAGA3_HUMAN)
KISSSLQLVW

SEQ ID NO: 52315 - protein, 10 aa, Artificial Sequence
  Description of Artificial Sequence: Synthetic peptide
  Seed: YFFPVIFSKA (MAGA3_HUMAN)
YMFPVIFSKI

SEQ ID NO: 52316 - protein, 10 aa, Artificial Sequence
  Description of Artificial Sequence: Synthetic peptide
  Seed: VIFSKASSSL (MAGA3_HUMAN)
VQFSKASSSY

SEQ ID NO: 52317 - protein, 9 aa, Artificial Sequence
  Description of Artificial Sequence: Synthetic peptide
  Seed: VTLGEVPAA (MAGA3_HUMAN)
VLLGEVPAA

SEQ ID NO: 52318 - protein, 10 aa, Artificial Sequence
  Description of Artificial Sequence: Synthetic peptide
  Seed: NQEEEGPSTF (MAGA3_HUMAN)
NHEEEGPSTF

SEQ ID NO: 52319 - protein, 10 aa, Artificial Sequence
  Description of Artificial Sequence: Synthetic peptide
  Seed: YEDSSNQEEE (MAGA3_HUMAN)
YEDSSNQEEL

SEQ ID NO: 52320 - protein, 9 aa, Artificial Sequence
  Description of Artificial Sequence: Synthetic peptide
  Seed: SSSSTLVEV (MAGA3_HUMAN)
SASSTLVEF

SEQ ID NO: 52321 - protein, 9 aa, Artificial Sequence
  Description of Artificial Sequence: Synthetic peptide
  Seed: HLYIFATCL (MAGA3_HUMAN)
HFYIFATCM

SEQ ID NO: 52322 - protein, 9 aa, Artificial Sequence
  Description of Artificial Sequence: Synthetic peptide
  Seed: GASSLPTTM (MAGA3_HUMAN)
GTSSLPTTW

SEQ ID NO: 52323 - protein, 10 aa, Artificial Sequence
  Description of Artificial Sequence: Synthetic peptide
  Seed: RKVAELVHFL (MAGA3_HUMAN)
RPVAELVHFV

SEQ ID NO: 52324 - protein, 9 aa, Artificial Sequence
  Description of Artificial Sequence: Synthetic peptide
  Seed: QIMPKAGLL (MAGA3_HUMAN)
QPMPKAGLM

SEQ ID NO: 52325 - protein, 9 aa, Artificial Sequence
  Description of Artificial Sequence: Synthetic peptide
  Seed: MEVDPIGHL (MAGA3_HUMAN)
MSVDPIGHL

SEQ ID NO: 52326 - protein, 9 aa, Artificial Sequence
  Description of Artificial Sequence: Synthetic peptide
  Seed: QIMPKAGLL (MAGA3_HUMAN)
QAMPKAGLF

SEQ ID NO: 52327 - protein, 9 aa, Artificial Sequence
  Description of Artificial Sequence: Synthetic peptide
  Seed: YFFPVIFSK (MAGA3_HUMAN)
YLFPVIFSL

SEQ ID NO: 52328 - protein, 10 aa, Artificial Sequence
  Description of Artificial Sequence: Synthetic peptide
  Seed: HISYPPLHEW (MAGA3_HUMAN)
HWSYPPLHEM

SEQ ID NO: 52329 - protein, 9 aa, Artificial Sequence
  Description of Artificial Sequence: Synthetic peptide
  Seed: SVLEVFEGR (MAGA3_HUMAN)
SNLEVFEGR

SEQ ID NO: 52330 - protein, 9 aa, Artificial Sequence
  Description of Artificial Sequence: Synthetic peptide
  Seed: YFFPVIFSK (MAGA3_HUMAN)
YSFPVIFSK

SEQ ID NO: 52331 - protein, 10 aa, Artificial Sequence
  Description of Artificial Sequence: Synthetic peptide
  Seed: TEEQEAASSS (MAGA3_HUMAN)
TEEQEAASSA

SEQ ID NO: 52332 - protein, 10 aa, Artificial Sequence
  Description of Artificial Sequence: Synthetic peptide
  Seed: ISYPPLHEWV (MAGA3_HUMAN)
ISYPPLHEWW

SEQ ID NO: 52333 - protein, 9 aa, Artificial Sequence
  Description of Artificial Sequence: Synthetic peptide
  Seed: RQVPGSDPA (MAGA3_HUMAN)
RMVPGSDPL

SEQ ID NO: 52334 - protein, 9 aa, Artificial Sequence
  Description of Artificial Sequence: Synthetic peptide
  Seed: SKASSSLQL (MAGA3_HUMAN)
SQASSSLQI

SEQ ID NO: 52335 - protein, 9 aa, Artificial Sequence
  Description of Artificial Sequence: Synthetic peptide
  Seed: LVHFLLLKY (MAGA3_HUMAN)
LTHFLLLKM

SEQ ID NO: 52336 - protein, 9 aa, Artificial Sequence
  Description of Artificial Sequence: Synthetic peptide
  Seed: GASSLPTTM (MAGA3_HUMAN)
GPSSLPTTI

SEQ ID NO: 52337 - protein, 9 aa, Artificial Sequence
  Description of Artificial Sequence: Synthetic peptide
  Seed: VETSYVKVL (MAGA3_HUMAN)
VETSYVKVV

SEQ ID NO: 52338 - protein, 10 aa, Artificial Sequence
  Description of Artificial Sequence: Synthetic peptide
  Seed: FVQENYLEYR (MAGA3_HUMAN)
FMQENYLEYR

SEQ ID NO: 52339 - protein, 8 aa, Artificial Sequence
  Description of Artificial Sequence: Synthetic peptide
  Seed: FSKASSSL (MAGA3_HUMAN)
FAKASSSM

SEQ ID NO: 52340 - protein, 9 aa, Artificial Sequence
  Description of Artificial Sequence: Synthetic peptide
  Seed: GSVVGNWQY (MAGA3_HUMAN)
GVVVGNWQY

SEQ ID NO: 52341 - protein, 9 aa, Artificial Sequence
  Description of Artificial Sequence: Synthetic peptide
  Seed: KVLHHMVKI (MAGA3_HUMAN)
KTLHHMVKR

SEQ ID NO: 52342 - protein, 10 aa, Artificial Sequence
  Description of Artificial Sequence: Synthetic peptide
  Seed: VDPIGHLYIF (MAGA3_HUMAN)
VVPIGHLYIY

SEQ ID NO: 52343 - protein, 10 aa, Artificial Sequence
  Description of Artificial Sequence: Synthetic peptide
  Seed: IFATCLGLSY (MAGA3_HUMAN)
IIATCLGLSY

SEQ ID NO: 52344 - protein, 9 aa, Artificial Sequence
  Description of Artificial Sequence: Synthetic peptide
  Seed: ISYPPLHEW (MAGA3_HUMAN)
IKYPPLHEL

SEQ ID NO: 52345 - protein, 9 aa, Artificial Sequence
  Description of Artificial Sequence: Synthetic peptide
  Seed: GSDPACYEF (MAGA3_HUMAN)
GYDPACYEV

SEQ ID NO: 52346 - protein, 10 aa, Artificial Sequence
  Description of Artificial Sequence: Synthetic peptide
  Seed: MNYPLWSQSY (MAGA3_HUMAN)
MDYPLWSQSF

SEQ ID NO: 52347 - protein, 9 aa, Artificial Sequence
  Description of Artificial Sequence: Synthetic peptide
  Seed: RALVETSYV (MAGA3_HUMAN)
RTLVETSYF

SEQ ID NO: 52348 - protein, 8 aa, Artificial Sequence
  Description of Artificial Sequence: Synthetic peptide
  Seed: SGGPHISY (MAGA3_HUMAN)
SAGPHISV

SEQ ID NO: 52349 - protein, 9 aa, Artificial Sequence
  Description of Artificial Sequence: Synthetic peptide
  Seed: KVAELVHFL (MAGA3_HUMAN)
KNAELVHFM

SEQ ID NO: 52350 - protein, 10 aa, Artificial Sequence
  Description of Artificial Sequence: Synthetic peptide
  Seed: VIFSKASSSL (MAGA3_HUMAN)
VMFSKASSSI

SEQ ID NO: 52351 - protein, 10 aa, Artificial Sequence
  Description of Artificial Sequence: Synthetic peptide
  Seed: GSVVGNWQYF (MAGA3_HUMAN)
GAVVGNWQYW

SEQ ID NO: 52352 - protein, 9 aa, Artificial Sequence
  Description of Artificial Sequence: Synthetic peptide
  Seed: NYPLWSQSY (MAGA3_HUMAN)
NFPLWSQSM

SEQ ID NO: 52353 - protein, 9 aa, Artificial Sequence
  Description of Artificial Sequence: Synthetic peptide
  Seed: GNWQYFFPV (MAGA3_HUMAN)
GLWQYFFPI

SEQ ID NO: 52354 - protein, 10 aa, Artificial Sequence
  Description of Artificial Sequence: Synthetic peptide
  Seed: LPTTMNYPLW (MAGA3_HUMAN)
LATTMNYPLF

SEQ ID NO: 52355 - protein, 9 aa, Artificial Sequence
  Description of Artificial Sequence: Synthetic peptide
  Seed: HHMVKISGG (MAGA3_HUMAN)
HHMVKISGL

SEQ ID NO: 52356 - protein, 9 aa, Artificial Sequence
  Description of Artificial Sequence: Synthetic peptide
  Seed: QSPQGASSL (MAGA3_HUMAN)
QQPQGASSF

SEQ ID NO: 52357 - protein, 9 aa, Artificial Sequence
  Description of Artificial Sequence: Synthetic peptide
  Seed: AEMLGSVVG (MAGA3_HUMAN)
AEMLGSVVY

SEQ ID NO: 52358 - protein, 9 aa, Artificial Sequence
  Description of Artificial Sequence: Synthetic peptide
  Seed: FQAALSRKV (MAGA3_HUMAN)
FTAALSRKV

SEQ ID NO: 52359 - protein, 10 aa, Artificial Sequence
  Description of Artificial Sequence: Synthetic peptide
  Seed: IFATCLGLSY (MAGA3_HUMAN)
ILATCLGLSY

SEQ ID NO: 52360 - protein, 10 aa, Artificial Sequence
  Description of Artificial Sequence: Synthetic peptide
  Seed: KVAELVHFLL (MAGA3_HUMAN)
KIAELVHFLC

SEQ ID NO: 52361 - protein, 10 aa, Artificial Sequence
  Description of Artificial Sequence: Synthetic peptide
  Seed: FLWGPRALVE (MAGA3_HUMAN)
FMWGPRALVH

SEQ ID NO: 52362 - protein, 10 aa, Artificial Sequence
  Description of Artificial Sequence: Synthetic peptide
  Seed: SSSTLVEVTL (MAGA3_HUMAN)
SISTLVEVTW

SEQ ID NO: 52363 - protein, 9 aa, Artificial Sequence
  Description of Artificial Sequence: Synthetic peptide
  Seed: LESEFQAAL (MAGA3_HUMAN)
LTSEFQAAY

SEQ ID NO: 52364 - protein, 9 aa, Artificial Sequence
  Description of Artificial Sequence: Synthetic peptide
  Seed: IIVLAIIAR (MAGA3_HUMAN)
IVVLAIIAR

SEQ ID NO: 52365 - protein, 9 aa, Artificial Sequence
  Description of Artificial Sequence: Synthetic peptide
  Seed: SSLPTTMNY (MAGA3_HUMAN)
SSLPTTMNW

SEQ ID NO: 52366 - protein, 11 aa, Artificial Sequence
  Description of Artificial Sequence: Synthetic peptide
  Seed: STLVEVTLGEV (MAGA3_HUMAN)
SLLVEVTLGEV

SEQ ID NO: 52367 - protein, 10 aa, Artificial Sequence
  Description of Artificial Sequence: Synthetic peptide
  Seed: IFATCLGLSY (MAGA3_HUMAN)
ISATCLGLSM

SEQ ID NO: 52368 - protein, 9 aa, Artificial Sequence
  Description of Artificial Sequence: Synthetic peptide
  Seed: LESEFQAAL (MAGA3_HUMAN)
LESEFQAAT

SEQ ID NO: 52369 - protein, 10 aa, Artificial Sequence
  Description of Artificial Sequence: Synthetic peptide
  Seed: AESPDPPQSP (MAGA3_HUMAN)
AESPDPPQSW

SEQ ID NO: 52370 - protein, 9 aa, Artificial Sequence
  Description of Artificial Sequence: Synthetic peptide
  Seed: EVDPIGHLY (MAGA3_HUMAN)
EWDPIGHLL

SEQ ID NO: 52371 - protein, 9 aa, Artificial Sequence
  Description of Artificial Sequence: Synthetic peptide
  Seed: LQLVFGIEL (MAGA3_HUMAN)
LPLVFGIEY

SEQ ID NO: 52372 - protein, 9 aa, Artificial Sequence
  Description of Artificial Sequence: Synthetic peptide
  Seed: RALVETSYV (MAGA3_HUMAN)
RVLVETSYW

SEQ ID NO: 52373 - protein, 10 aa, Artificial Sequence
  Description of Artificial Sequence: Synthetic peptide
  Seed: MNYPLWSQSY (MAGA3_HUMAN)
MNYPLWSQSI

SEQ ID NO: 52374 - protein, 11 aa, Artificial Sequence
  Description of Artificial Sequence: Synthetic peptide
  Seed: SKASSSLQLVF (MAGA3_HUMAN)
SMASSSLQLVY

SEQ ID NO: 52375 - protein, 9 aa, Artificial Sequence
  Description of Artificial Sequence: Synthetic peptide
  Seed: SSLQLVFGI (MAGA3_HUMAN)
SALQLVFGF

SEQ ID NO: 52376 - protein, 9 aa, Artificial Sequence
  Description of Artificial Sequence: Synthetic peptide
  Seed: GASSLPTTM (MAGA3_HUMAN)
GLSSLPTTW

SEQ ID NO: 52377 - protein, 9 aa, Artificial Sequence
  Description of Artificial Sequence: Synthetic peptide
  Seed: SSSSTLVEV (MAGA3_HUMAN)
SMSSTLVEM

SEQ ID NO: 52378 - protein, 10 aa, Artificial Sequence
  Description of Artificial Sequence: Synthetic peptide
  Seed: VTKAEMLGSV (MAGA3_HUMAN)
VLKAEMLGSI

SEQ ID NO: 52379 - protein, 9 aa, Artificial Sequence
  Description of Artificial Sequence: Synthetic peptide
  Seed: EALGLVGAQ (MAGA3_HUMAN)
EMLGLVGAR

SEQ ID NO: 52380 - protein, 9 aa, Artificial Sequence
  Description of Artificial Sequence: Synthetic peptide
  Seed: KVAELVHFL (MAGA3_HUMAN)
KWAELVHFI

SEQ ID NO: 52381 - protein, 10 aa, Artificial Sequence
  Description of Artificial Sequence: Synthetic peptide
  Seed: SVVGNWQYFF (MAGA3_HUMAN)
SAVGNWQYFW

SEQ ID NO: 52382 - protein, 9 aa, Artificial Sequence
  Description of Artificial Sequence: Synthetic peptide
  Seed: EEEGPSTFP (MAGA3_HUMAN)
EEEGPSTFA

SEQ ID NO: 52383 - protein, 9 aa, Artificial Sequence
  Description of Artificial Sequence: Synthetic peptide
  Seed: SSLQLVFGI (MAGA3_HUMAN)
SLLQLVFGT

SEQ ID NO: 52384 - protein, 10 aa, Artificial Sequence
  Description of Artificial Sequence: Synthetic peptide
  Seed: LPTTMNYPLW (MAGA3_HUMAN)
LFTTMNYPLW

SEQ ID NO: 52385 - protein, 9 aa, Artificial Sequence
  Description of Artificial Sequence: Synthetic peptide
  Seed: MPKAGLLII (MAGA3_HUMAN)
MMKAGLLIL

SEQ ID NO: 52386 - protein, 9 aa, Artificial Sequence
  Description of Artificial Sequence: Synthetic peptide
  Seed: GASSLPTTM (MAGA3_HUMAN)
GPSSLPTTL

SEQ ID NO: 52387 - protein, 9 aa, Artificial Sequence
  Description of Artificial Sequence: Synthetic peptide
  Seed: SYVKVLHHM (MAGA3_HUMAN)
STVKVLHHY

SEQ ID NO: 52388 - protein, 9 aa, Artificial Sequence
  Description of Artificial Sequence: Synthetic peptide
  Seed: NQIMPKAGL (MAGA3_HUMAN)
NQIMPKAGF

SEQ ID NO: 52389 - protein, 9 aa, Artificial Sequence
  Description of Artificial Sequence: Synthetic peptide
  Seed: EVDPIGHLY (MAGA3_HUMAN)
ECDPIGHLM

SEQ ID NO: 52390 - protein, 10 aa, Artificial Sequence
  Description of Artificial Sequence: Synthetic peptide
  Seed: ASSSLQLVFG (MAGA3_HUMAN)
AKSSLQLVFW

SEQ ID NO: 52391 - protein, 9 aa, Artificial Sequence
  Description of Artificial Sequence: Synthetic peptide
  Seed: SVLEVFEGR (MAGA3_HUMAN)
SVLEVFEGK

SEQ ID NO: 52392 - protein, 10 aa, Artificial Sequence
  Description of Artificial Sequence: Synthetic peptide
  Seed: MVKISGGPHI (MAGA3_HUMAN)
MIKISGGPHF

SEQ ID NO: 52393 - protein, 10 aa, Artificial Sequence
  Description of Artificial Sequence: Synthetic peptide
  Seed: MVKISGGPHI (MAGA3_HUMAN)
MYKISGGPHY

SEQ ID NO: 52394 - protein, 9 aa, Artificial Sequence
  Description of Artificial Sequence: Synthetic peptide
  Seed: KVAELVHFL (MAGA3_HUMAN)
KEAELVHFF

SEQ ID NO: 52395 - protein, 10 aa, Artificial Sequence
  Description of Artificial Sequence: Synthetic peptide
  Seed: MNYPLWSQSY (MAGA3_HUMAN)
MEYPLWSQSF

SEQ ID NO: 52396 - protein, 10 aa, Artificial Sequence
  Description of Artificial Sequence: Synthetic peptide
  Seed: MEVDPIGHLY (MAGA3_HUMAN)
MMVDPIGHLF

SEQ ID NO: 52397 - protein, 9 aa, Artificial Sequence
  Description of Artificial Sequence: Synthetic peptide
  Seed: LGDPKKLLT (MAGA3_HUMAN)
LNDPKKLLI

SEQ ID NO: 52398 - protein, 11 aa, Artificial Sequence
  Description of Artificial Sequence: Synthetic peptide
  Seed: YIFATCLGLSY (MAGA3_HUMAN)
YSFATCLGLSM

SEQ ID NO: 52399 - protein, 9 aa, Artificial Sequence
  Description of Artificial Sequence: Synthetic peptide
  Seed: LGDPKKLLT (MAGA3_HUMAN)
LNDPKKLLV

SEQ ID NO: 52400 - protein, 10 aa, Artificial Sequence
  Description of Artificial Sequence: Synthetic peptide
  Seed: IFATCLGLSY (MAGA3_HUMAN)
IPATCLGLSF

SEQ ID NO: 52401 - protein, 11 aa, Artificial Sequence
  Description of Artificial Sequence: Synthetic peptide
  Seed: IWEELSVLEVF (MAGA3_HUMAN)
IYEELSVLEVF

SEQ ID NO: 52402 - protein, 10 aa, Artificial Sequence
  Description of Artificial Sequence: Synthetic peptide
  Seed: FSKASSSLQL (MAGA3_HUMAN)
FAKASSSLQF

SEQ ID NO: 52403 - protein, 10 aa, Artificial Sequence
  Description of Artificial Sequence: Synthetic peptide
  Seed: FFPVIFSKAS (MAGA3_HUMAN)
FMPVIFSKAA

SEQ ID NO: 52404 - protein, 10 aa, Artificial Sequence
  Description of Artificial Sequence: Synthetic peptide
  Seed: EVFEGREDSI (MAGA3_HUMAN)
EVFEGREDSY

SEQ ID NO: 52405 - protein, 9 aa, Artificial Sequence
  Description of Artificial Sequence: Synthetic peptide
  Seed: FATCLGLSY (MAGA3_HUMAN)
FSTCLGLSF

SEQ ID NO: 52406 - protein, 9 aa, Artificial Sequence
  Description of Artificial Sequence: Synthetic peptide
  Seed: YPPLHEWVL (MAGA3_HUMAN)
YTPLHEWVM

SEQ ID NO: 52407 - protein, 9 aa, Artificial Sequence
  Description of Artificial Sequence: Synthetic peptide
  Seed: GEALGLVGA (MAGA3_HUMAN)
GEALGLVGC

SEQ ID NO: 52408 - protein, 9 aa, Artificial Sequence
  Description of Artificial Sequence: Synthetic peptide
  Seed: FATCLGLSY (MAGA3_HUMAN)
FQTCLGLSV

SEQ ID NO: 52409 - protein, 10 aa, Artificial Sequence
  Description of Artificial Sequence: Synthetic peptide
  Seed: TLVEVTLGEV (MAGA3_HUMAN)
TQVEVTLGEV

SEQ ID NO: 52410 - protein, 9 aa, Artificial Sequence
  Description of Artificial Sequence: Synthetic peptide
  Seed: QLVFGIELM (MAGA3_HUMAN)
QMVFGIELV

SEQ ID NO: 52411 - protein, 9 aa, Artificial Sequence
  Description of Artificial Sequence: Synthetic peptide
  Seed: SILGDPKKL (MAGA3_HUMAN)
SVLGDPKKL

SEQ ID NO: 52412 - protein, 9 aa, Artificial Sequence
  Description of Artificial Sequence: Synthetic peptide
  Seed: YIFATCLGL (MAGA3_HUMAN)
YMFATCLGT

SEQ ID NO: 52413 - protein, 9 aa, Artificial Sequence
  Description of Artificial Sequence: Synthetic peptide
  Seed: KIWEELSVL (MAGA3_HUMAN)
KRWEELSVF

SEQ ID NO: 52414 - protein, 9 aa, Artificial Sequence
  Description of Artificial Sequence: Synthetic peptide
  Seed: KASSSLQLV (MAGA3_HUMAN)
KSSSSLQLK

SEQ ID NO: 52415 - protein, 10 aa, Artificial Sequence
  Description of Artificial Sequence: Synthetic peptide
  Seed: FSKASSSLQL (MAGA3_HUMAN)
FYKASSSLQF

SEQ ID NO: 52416 - protein, 9 aa, Artificial Sequence
  Description of Artificial Sequence: Synthetic peptide
  Seed: YPPLHEWVL (MAGA3_HUMAN)
YRPLHEWVM

SEQ ID NO: 52417 - protein, 9 aa, Artificial Sequence
  Description of Artificial Sequence: Synthetic peptide
  Seed: GSDPACYEF (MAGA3_HUMAN)
GADPACYEV

SEQ ID NO: 52418 - protein, 8 aa, Artificial Sequence
  Description of Artificial Sequence: Synthetic peptide
  Seed: LGDPKKLL (MAGA3_HUMAN)
LIDPKKLL

SEQ ID NO: 52419 - protein, 9 aa, Artificial Sequence
  Description of Artificial Sequence: Synthetic peptide
  Seed: ISYPPLHEW (MAGA3_HUMAN)
IIYPPLHEF

SEQ ID NO: 52420 - protein, 9 aa, Artificial Sequence
  Description of Artificial Sequence: Synthetic peptide
  Seed: GSDPACYEF (MAGA3_HUMAN)
GQDPACYEL

SEQ ID NO: 52421 - protein, 9 aa, Artificial Sequence
  Description of Artificial Sequence: Synthetic peptide
  Seed: ISYPPLHEW (MAGA3_HUMAN)
IQYPPLHEY

SEQ ID NO: 52422 - protein, 8 aa, Artificial Sequence
  Description of Artificial Sequence: Synthetic peptide
  Seed: SGGPHISY (MAGA3_HUMAN)
SSGPHISY

SEQ ID NO: 52423 - protein, 10 aa, Artificial Sequence
  Description of Artificial Sequence: Synthetic peptide
  Seed: SEFQAALSRK (MAGA3_HUMAN)
SQFQAALSRK

SEQ ID NO: 52424 - protein, 10 aa, Artificial Sequence
  Description of Artificial Sequence: Synthetic peptide
  Seed: NWQYFFPVIF (MAGA3_HUMAN)
NDQYFFPVIF

SEQ ID NO: 52425 - protein, 9 aa, Artificial Sequence
  Description of Artificial Sequence: Synthetic peptide
  Seed: SSTLVEVTL (MAGA3_HUMAN)
SLTLVEVTI

SEQ ID NO: 52426 - protein, 11 aa, Artificial Sequence
  Description of Artificial Sequence: Synthetic peptide
  Seed: RQVPGSDPACY (MAGA3_HUMAN)
REVPGSDPACF

SEQ ID NO: 52427 - protein, 9 aa, Artificial Sequence
  Description of Artificial Sequence: Synthetic peptide
  Seed: MEVDPIGHL (MAGA3_HUMAN)
MEVDPIGHA

SEQ ID NO: 52428 - protein, 11 aa, Artificial Sequence
  Description of Artificial Sequence: Synthetic peptide
  Seed: KVAELVHFLLL (MAGA3_HUMAN)
KEAELVHFLLL

SEQ ID NO: 52429 - protein, 9 aa, Artificial Sequence
  Description of Artificial Sequence: Synthetic peptide
  Seed: ASSSLQLVF (MAGA3_HUMAN)
AYSSLQLVY

SEQ ID NO: 52430 - protein, 10 aa, Artificial Sequence
  Description of Artificial Sequence: Synthetic peptide
  Seed: RKVAELVHFL (MAGA3_HUMAN)
RKVAELVHFI

SEQ ID NO: 52431 - protein, 10 aa, Artificial Sequence
  Description of Artificial Sequence: Synthetic peptide
  Seed: TSYVKVLHHM (MAGA3_HUMAN)
TTYVKVLHHW

SEQ ID NO: 52432 - protein, 9 aa, Artificial Sequence
  Description of Artificial Sequence: Synthetic peptide
  Seed: GDCAPEEKI (MAGA3_HUMAN)
GECAPEEKV

SEQ ID NO: 52433 - protein, 9 aa, Artificial Sequence
  Description of Artificial Sequence: Synthetic peptide
  Seed: WQYFFPVIF (MAGA3_HUMAN)
WQYFFPVIA

SEQ ID NO: 52434 - protein, 9 aa, Artificial Sequence
  Description of Artificial Sequence: Synthetic peptide
  Seed: GSDPACYEF (MAGA3_HUMAN)
GYDPACYEL

SEQ ID NO: 52435 - protein, 10 aa, Artificial Sequence
  Description of Artificial Sequence: Synthetic peptide
  Seed: MVKISGGPHI (MAGA3_HUMAN)
MLKISGGPHM

SEQ ID NO: 52436 - protein, 9 aa, Artificial Sequence
  Description of Artificial Sequence: Synthetic peptide
  Seed: ISYPPLHEW (MAGA3_HUMAN)
IEYPPLHEL

SEQ ID NO: 52437 - protein, 10 aa, Artificial Sequence
  Description of Artificial Sequence: Synthetic peptide
  Seed: FLWGPRALVE (MAGA3_HUMAN)
FMWGPRALVE

SEQ ID NO: 52438 - protein, 10 aa, Artificial Sequence
  Description of Artificial Sequence: Synthetic peptide
  Seed: FLWGPRALVE (MAGA3_HUMAN)
FMWGPRALVN

SEQ ID NO: 52439 - protein, 10 aa, Artificial Sequence
  Description of Artificial Sequence: Synthetic peptide
  Seed: EEGPSTFPDL (MAGA3_HUMAN)
EEGPSTFPDW

SEQ ID NO: 52440 - protein, 9 aa, Artificial Sequence
  Description of Artificial Sequence: Synthetic peptide
  Seed: KIWEELSVL (MAGA3_HUMAN)
KRWEELSVM

SEQ ID NO: 52441 - protein, 10 aa, Artificial Sequence
  Description of Artificial Sequence: Synthetic peptide
  Seed: YRQVPGSDPA (MAGA3_HUMAN)
YSQVPGSDPV

SEQ ID NO: 52442 - protein, 11 aa, Artificial Sequence
  Description of Artificial Sequence: Synthetic peptide
  Seed: YIFATCLGLSY (MAGA3_HUMAN)
YHFATCLGLSM

SEQ ID NO: 52443 - protein, 10 aa, Artificial Sequence
  Description of Artificial Sequence: Synthetic peptide
  Seed: ELMEVDPIGH (MAGA3_HUMAN)
ELMEVDPIGR

SEQ ID NO: 52444 - protein, 9 aa, Artificial Sequence
  Description of Artificial Sequence: Synthetic peptide
  Seed: EVDPIGHLY (MAGA3_HUMAN)
EYDPIGHLF

SEQ ID NO: 52445 - protein, 10 aa, Artificial Sequence
  Description of Artificial Sequence: Synthetic peptide
  Seed: HISYPPLHEW (MAGA3_HUMAN)
HHSYPPLHEM

SEQ ID NO: 52446 - protein, 10 aa, Artificial Sequence
  Description of Artificial Sequence: Synthetic peptide
  Seed: STFPDLESEF (MAGA3_HUMAN)
SVFPDLESEK

SEQ ID NO: 52447 - protein, 9 aa, Artificial Sequence
  Description of Artificial Sequence: Synthetic peptide
  Seed: AESPDPPQS (MAGA3_HUMAN)
AESPDPPQA

SEQ ID NO: 52448 - protein, 9 aa, Artificial Sequence
  Description of Artificial Sequence: Synthetic peptide
  Seed: LPTTMNYPL (MAGA3_HUMAN)
LRTTMNYPM

SEQ ID NO: 52449 - protein, 11 aa, Artificial Sequence
  Description of Artificial Sequence: Synthetic peptide
  Seed: SNQEEEGPSTF (MAGA3_HUMAN)
SLQEEEGPSTW

SEQ ID NO: 52450 - protein, 8 aa, Artificial Sequence
  Description of Artificial Sequence: Synthetic peptide
  Seed: FPDLESEF (MAGA3_HUMAN)
FGDLESEM

SEQ ID NO: 52451 - protein, 10 aa, Artificial Sequence
  Description of Artificial Sequence: Synthetic peptide
  Seed: AALSRKVAEL (MAGA3_HUMAN)
AFLSRKVAEV

SEQ ID NO: 52452 - protein, 9 aa, Artificial Sequence
  Description of Artificial Sequence: Synthetic peptide
  Seed: VVGNWQYFF (MAGA3_HUMAN)
VLGNWQYFW

SEQ ID NO: 52453 - protein, 9 aa, Artificial Sequence
  Description of Artificial Sequence: Synthetic peptide
  Seed: TKAEMLGSV (MAGA3_HUMAN)
THAEMLGSI

SEQ ID NO: 52454 - protein, 9 aa, Artificial Sequence
  Description of Artificial Sequence: Synthetic peptide
  Seed: AELVHFLLL (MAGA3_HUMAN)
AQLVHFLLL

SEQ ID NO: 52455 - protein, 9 aa, Artificial Sequence
  Description of Artificial Sequence: Synthetic peptide
  Seed: VTLGEVPAA (MAGA3_HUMAN)
VMLGEVPAT

SEQ ID NO: 52456 - protein, 10 aa, Artificial Sequence
  Description of Artificial Sequence: Synthetic peptide
  Seed: KASSSLQLVF (MAGA3_HUMAN)
KRSSSLQLVF

SEQ ID NO: 52457 - protein, 10 aa, Artificial Sequence
  Description of Artificial Sequence: Synthetic peptide
  Seed: NWQYFFPVIF (MAGA3_HUMAN)
NRQYFFPVIF

SEQ ID NO: 52458 - protein, 10 aa, Artificial Sequence
  Description of Artificial Sequence: Synthetic peptide
  Seed: KASSSLQLVF (MAGA3_HUMAN)
KKSSSLQLVI

SEQ ID NO: 52459 - protein, 8 aa, Artificial Sequence
  Description of Artificial Sequence: Synthetic peptide
  Seed: FPDLESEF (MAGA3_HUMAN)
FNDLESEV

SEQ ID NO: 52460 - protein, 9 aa, Artificial Sequence
  Description of Artificial Sequence: Synthetic peptide
  Seed: ALSRKVAEL (MAGA3_HUMAN)
AASRKVAEF

SEQ ID NO: 52461 - protein, 9 aa, Artificial Sequence
  Description of Artificial Sequence: Synthetic peptide
  Seed: ISYPPLHEW (MAGA3_HUMAN)
ISYPPLHEF

SEQ ID NO: 52462 - protein, 10 aa, Artificial Sequence
  Description of Artificial Sequence: Synthetic peptide
  Seed: MVKISGGPHI (MAGA3_HUMAN)
MAKISGGPHF

SEQ ID NO: 52463 - protein, 9 aa, Artificial Sequence
  Description of Artificial Sequence: Synthetic peptide
  Seed: GLVGAQAPA (MAGA3_HUMAN)
GMVGAQAPL

SEQ ID NO: 52464 - protein, 10 aa, Artificial Sequence
  Description of Artificial Sequence: Synthetic peptide
  Seed: KAEMLGSVVG (MAGA3_HUMAN)
KIEMLGSVVV

SEQ ID NO: 52465 - protein, 9 aa, Artificial Sequence
  Description of Artificial Sequence: Synthetic peptide
  Seed: KVAELVHFL (MAGA3_HUMAN)
KGAELVHFY

SEQ ID NO: 52466 - protein, 9 aa, Artificial Sequence
  Description of Artificial Sequence: Synthetic peptide
  Seed: LPTTMNYPL (MAGA3_HUMAN)
LQTTMNYPL

SEQ ID NO: 52467 - protein, 9 aa, Artificial Sequence
  Description of Artificial Sequence: Synthetic peptide
  Seed: NWQYFFPVI (MAGA3_HUMAN)
NWQYFFPVM

SEQ ID NO: 52468 - protein, 11 aa, Artificial Sequence
  Description of Artificial Sequence: Synthetic peptide
  Seed: KVAELVHFLLL (MAGA3_HUMAN)
KMAELVHFLLM

SEQ ID NO: 52469 - protein, 9 aa, Artificial Sequence
  Description of Artificial Sequence: Synthetic peptide
  Seed: KVAELVHFL (MAGA3_HUMAN)
KEAELVHFL

SEQ ID NO: 52470 - protein, 9 aa, Artificial Sequence
  Description of Artificial Sequence: Synthetic peptide
  Seed: LGDPKKLLT (MAGA3_HUMAN)
LQDPKKLLM

SEQ ID NO: 52471 - protein, 9 aa, Artificial Sequence
  Description of Artificial Sequence: Synthetic peptide
  Seed: KVLHHMVKI (MAGA3_HUMAN)
KVLHHMVKF

SEQ ID NO: 52472 - protein, 9 aa, Artificial Sequence
  Description of Artificial Sequence: Synthetic peptide
  Seed: TFPDLESEF (MAGA3_HUMAN)
TTPDLESEF

SEQ ID NO: 52473 - protein, 8 aa, Artificial Sequence
  Description of Artificial Sequence: Synthetic peptide
  Seed: YVKVLHHM (MAGA3_HUMAN)
YSKVLHHL

SEQ ID NO: 52474 - protein, 10 aa, Artificial Sequence
  Description of Artificial Sequence: Synthetic peptide
  Seed: KVAELVHFLL (MAGA3_HUMAN)
KTAELVHFLF

SEQ ID NO: 52475 - protein, 9 aa, Artificial Sequence
  Description of Artificial Sequence: Synthetic peptide
  Seed: SPQGASSLP (MAGA3_HUMAN)
SPQGASSLI

SEQ ID NO: 52476 - protein, 9 aa, Artificial Sequence
  Description of Artificial Sequence: Synthetic peptide
  Seed: EEQEAASSS (MAGA3_HUMAN)
EEQEAASSV

SEQ ID NO: 52477 - protein, 11 aa, Artificial Sequence
  Description of Artificial Sequence: Synthetic peptide
  Seed: YIFATCLGLSY (MAGA3_HUMAN)
YAFATCLGLSY

SEQ ID NO: 52478 - protein, 9 aa, Artificial Sequence
  Description of Artificial Sequence: Synthetic peptide
  Seed: KIWEELSVL (MAGA3_HUMAN)
KTWEELSVW

SEQ ID NO: 52479 - protein, 10 aa, Artificial Sequence
  Description of Artificial Sequence: Synthetic peptide
  Seed: FSKASSSLQL (MAGA3_HUMAN)
FNKASSSLQY

SEQ ID NO: 52480 - protein, 9 aa, Artificial Sequence
  Description of Artificial Sequence: Synthetic peptide
  Seed: LVHFLLLKY (MAGA3_HUMAN)
LAHFLLLKW

SEQ ID NO: 52481 - protein, 9 aa, Artificial Sequence
  Description of Artificial Sequence: Synthetic peptide
  Seed: FVQENYLEY (MAGA3_HUMAN)
FAQENYLEI

SEQ ID NO: 52482 - protein, 11 aa, Artificial Sequence
  Description of Artificial Sequence: Synthetic peptide
  Seed: SKASSSLQLVF (MAGA3_HUMAN)
SEASSSLQLVW

SEQ ID NO: 52483 - protein, 9 aa, Artificial Sequence
  Description of Artificial Sequence: Synthetic peptide
  Seed: ASSSLQLVF (MAGA3_HUMAN)
ARSSLQLVF

SEQ ID NO: 52484 - protein, 9 aa, Artificial Sequence
  Description of Artificial Sequence: Synthetic peptide
  Seed: GEVPAAESP (MAGA3_HUMAN)
GEVPAAESS

SEQ ID NO: 52485 - protein, 10 aa, Artificial Sequence
  Description of Artificial Sequence: Synthetic peptide
  Seed: RKVAELVHFL (MAGA3_HUMAN)
RLVAELVHFA

SEQ ID NO: 52486 - protein, 9 aa, Artificial Sequence
  Description of Artificial Sequence: Synthetic peptide
  Seed: FATCLGLSY (MAGA3_HUMAN)
FPTCLGLSL

SEQ ID NO: 52487 - protein, 9 aa, Artificial Sequence
  Description of Artificial Sequence: Synthetic peptide
  Seed: KIWEELSVL (MAGA3_HUMAN)
KQWEELSVV

SEQ ID NO: 52488 - protein, 10 aa, Artificial Sequence
  Description of Artificial Sequence: Synthetic peptide
  Seed: KVAELVHFLL (MAGA3_HUMAN)
KMAELVHFLQ

SEQ ID NO: 52489 - protein, 10 aa, Artificial Sequence
  Description of Artificial Sequence: Synthetic peptide
  Seed: FFPVIFSKAS (MAGA3_HUMAN)
FIPVIFSKAA

SEQ ID NO: 52490 - protein, 9 aa, Artificial Sequence
  Description of Artificial Sequence: Synthetic peptide
  Seed: SEFQAALSR (MAGA3_HUMAN)
SMFQAALSL

SEQ ID NO: 52491 - protein, 9 aa, Artificial Sequence
  Description of Artificial Sequence: Synthetic peptide
  Seed: ELVHFLLLK (MAGA3_HUMAN)
EAVHFLLLR

SEQ ID NO: 52492 - protein, 9 aa, Artificial Sequence
  Description of Artificial Sequence: Synthetic peptide
  Seed: LESEFQAAL (MAGA3_HUMAN)
LVSEFQAAI

SEQ ID NO: 52493 - protein, 9 aa, Artificial Sequence
  Description of Artificial Sequence: Synthetic peptide
  Seed: ISGGPHISY (MAGA3_HUMAN)
IMGGPHISR

SEQ ID NO: 52494 - protein, 9 aa, Artificial Sequence
  Description of Artificial Sequence: Synthetic peptide
  Seed: ELVHFLLLK (MAGA3_HUMAN)
EQVHFLLLR

SEQ ID NO: 52495 - protein, 9 aa, Artificial Sequence
  Description of Artificial Sequence: Synthetic peptide
  Seed: NWQYFFPVI (MAGA3_HUMAN)
NFQYFFPVL

SEQ ID NO: 52496 - protein, 9 aa, Artificial Sequence
  Description of Artificial Sequence: Synthetic peptide
  Seed: FPVIFSKAS (MAGA3_HUMAN)
FPVIFSKAW

SEQ ID NO: 52497 - protein, 10 aa, Artificial Sequence
  Description of Artificial Sequence: Synthetic peptide
  Seed: LGLVGAQAPA (MAGA3_HUMAN)
LVLVGAQAPV

SEQ ID NO: 52498 - protein, 10 aa, Artificial Sequence
  Description of Artificial Sequence: Synthetic peptide
  Seed: HISYPPLHEW (MAGA3_HUMAN)
HVSYPPLHEM

SEQ ID NO: 52499 - protein, 9 aa, Artificial Sequence
  Description of Artificial Sequence: Synthetic peptide
  Seed: YFFPVIFSK (MAGA3_HUMAN)
YIFPVIFSV

SEQ ID NO: 52500 - protein, 11 aa, Artificial Sequence
  Description of Artificial Sequence: Synthetic peptide
  Seed: GASSLPTTMNY (MAGA3_HUMAN)
GSSSLPTTMNW

SEQ ID NO: 52501 - protein, 9 aa, Artificial Sequence
  Description of Artificial Sequence: Synthetic peptide
  Seed: QSPQGASSL (MAGA3_HUMAN)
QIPQGASSF

SEQ ID NO: 52502 - protein, 9 aa, Artificial Sequence
  Description of Artificial Sequence: Synthetic peptide
  Seed: FATCLGLSY (MAGA3_HUMAN)
FITCLGLSL

SEQ ID NO: 52503 - protein, 9 aa, Artificial Sequence
  Description of Artificial Sequence: Synthetic peptide
  Seed: KASSSLQLV (MAGA3_HUMAN)
KVSSSLQLV

SEQ ID NO: 52504 - protein, 10 aa, Artificial Sequence
  Description of Artificial Sequence: Synthetic peptide
  Seed: MNYPLWSQSY (MAGA3_HUMAN)
MWYPLWSQSF

SEQ ID NO: 52505 - protein, 9 aa, Artificial Sequence
  Description of Artificial Sequence: Synthetic peptide
  Seed: SSLPTTMNY (MAGA3_HUMAN)
SALPTTMNI

SEQ ID NO: 52506 - protein, 9 aa, Artificial Sequence
  Description of Artificial Sequence: Synthetic peptide
  Seed: QLVFGIELM (MAGA3_HUMAN)
QQVFGIELV

SEQ ID NO: 52507 - protein, 9 aa, Artificial Sequence
  Description of Artificial Sequence: Synthetic peptide
  Seed: GSVVGNWQY (MAGA3_HUMAN)
GQVVGNWQF

SEQ ID NO: 52508 - protein, 9 aa, Artificial Sequence
  Description of Artificial Sequence: Synthetic peptide
  Seed: ISGGPHISY (MAGA3_HUMAN)
ITGGPHISR

SEQ ID NO: 52509 - protein, 9 aa, Artificial Sequence
  Description of Artificial Sequence: Synthetic peptide
  Seed: ASSSLQLVF (MAGA3_HUMAN)
ACSSLQLVW

SEQ ID NO: 52510 - protein, 10 aa, Artificial Sequence
  Description of Artificial Sequence: Synthetic peptide
  Seed: REDSILGDPK (MAGA3_HUMAN)
REDSILGDPV

SEQ ID NO: 52511 - protein, 10 aa, Artificial Sequence
  Description of Artificial Sequence: Synthetic peptide
  Seed: LGLVGAQAPA (MAGA3_HUMAN)
LWLVGAQAPL

SEQ ID NO: 52512 - protein, 9 aa, Artificial Sequence
  Description of Artificial Sequence: Synthetic peptide
  Seed: SVLEVFEGR (MAGA3_HUMAN)
SYLEVFEGK

SEQ ID NO: 52513 - protein, 9 aa, Artificial Sequence
  Description of Artificial Sequence: Synthetic peptide
  Seed: ISGGPHISY (MAGA3_HUMAN)
IWGGPHISY

SEQ ID NO: 52514 - protein, 10 aa, Artificial Sequence
  Description of Artificial Sequence: Synthetic peptide
  Seed: KVAELVHFLL (MAGA3_HUMAN)
KSAELVHFLI

SEQ ID NO: 52515 - protein, 10 aa, Artificial Sequence
  Description of Artificial Sequence: Synthetic peptide
  Seed: YLEYRQVPGS (MAGA3_HUMAN)
YMEYRQVPGA

SEQ ID NO: 52516 - protein, 9 aa, Artificial Sequence
  Description of Artificial Sequence: Synthetic peptide
  Seed: SKASSSLQL (MAGA3_HUMAN)
SLASSSLQM

SEQ ID NO: 52517 - protein, 9 aa, Artificial Sequence
  Description of Artificial Sequence: Synthetic peptide
  Seed: WQYFFPVIF (MAGA3_HUMAN)
WKYFFPVIL

SEQ ID NO: 52518 - protein, 9 aa, Artificial Sequence
  Description of Artificial Sequence: Synthetic peptide
  Seed: SSLPTTMNY (MAGA3_HUMAN)
SLLPTTMNM

SEQ ID NO: 52519 - protein, 9 aa, Artificial Sequence
  Description of Artificial Sequence: Synthetic peptide
  Seed: LPTTMNYPL (MAGA3_HUMAN)
LATTMNYPF

SEQ ID NO: 52520 - protein, 10 aa, Artificial Sequence
  Description of Artificial Sequence: Synthetic peptide
  Seed: LTQHFVQENY (MAGA3_HUMAN)
LMQHFVQENF

SEQ ID NO: 52521 - protein, 11 aa, Artificial Sequence
  Description of Artificial Sequence: Synthetic peptide
  Seed: AEMLGSVVGNW (MAGA3_HUMAN)
AQMLGSVVGNF

SEQ ID NO: 52522 - protein, 10 aa, Artificial Sequence
  Description of Artificial Sequence: Synthetic peptide
  Seed: HFVQENYLEY (MAGA3_HUMAN)
HMVQENYLEF

SEQ ID NO: 52523 - protein, 9 aa, Artificial Sequence
  Description of Artificial Sequence: Synthetic peptide
  Seed: SYVKVLHHM (MAGA3_HUMAN)
SWVKVLHHM

SEQ ID NO: 52524 - protein, 9 aa, Artificial Sequence
  Description of Artificial Sequence: Synthetic peptide
  Seed: KIWEELSVL (MAGA3_HUMAN)
KAWEELSVH

SEQ ID NO: 52525 - protein, 9 aa, Artificial Sequence
  Description of Artificial Sequence: Synthetic peptide
  Seed: ISYPPLHEW (MAGA3_HUMAN)
ICYPPLHEY

SEQ ID NO: 52526 - protein, 9 aa, Artificial Sequence
  Description of Artificial Sequence: Synthetic peptide
  Seed: SEFQAALSR (MAGA3_HUMAN)
SQFQAALSL

SEQ ID NO: 52527 - protein, 10 aa, Artificial Sequence
  Description of Artificial Sequence: Synthetic peptide
  Seed: SEFQAALSRK (MAGA3_HUMAN)
SFFQAALSRR

SEQ ID NO: 52528 - protein, 10 aa, Artificial Sequence
  Description of Artificial Sequence: Synthetic peptide
  Seed: MEVDPIGHLY (MAGA3_HUMAN)
MYVDPIGHLY

SEQ ID NO: 52529 - protein, 10 aa, Artificial Sequence
  Description of Artificial Sequence: Synthetic peptide
  Seed: KVAELVHFLL (MAGA3_HUMAN)
KMAELVHFLP

SEQ ID NO: 52530 - protein, 9 aa, Artificial Sequence
  Description of Artificial Sequence: Synthetic peptide
  Seed: FATCLGLSY (MAGA3_HUMAN)
FKTCLGLSY

SEQ ID NO: 52531 - protein, 9 aa, Artificial Sequence
  Description of Artificial Sequence: Synthetic peptide
  Seed: KASSSLQLV (MAGA3_HUMAN)
KLSSSLQLF

SEQ ID NO: 52532 - protein, 9 aa, Artificial Sequence
  Description of Artificial Sequence: Synthetic peptide
  Seed: ALSRKVAEL (MAGA3_HUMAN)
AYSRKVAEL

SEQ ID NO: 52533 - protein, 9 aa, Artificial Sequence
  Description of Artificial Sequence: Synthetic peptide
  Seed: MEVDPIGHL (MAGA3_HUMAN)
MEVDPIGHM

SEQ ID NO: 52534 - protein, 9 aa, Artificial Sequence
  Description of Artificial Sequence: Synthetic peptide
  Seed: GEVPAAESP (MAGA3_HUMAN)
GEVPAAESA

SEQ ID NO: 52535 - protein, 9 aa, Artificial Sequence
  Description of Artificial Sequence: Synthetic peptide
  Seed: YVKVLHHMV (MAGA3_HUMAN)
YLKVLHHMI

SEQ ID NO: 52536 - protein, 10 aa, Artificial Sequence
  Description of Artificial Sequence: Synthetic peptide
  Seed: EMLGSVVGNW (MAGA3_HUMAN)
ESLGSVVGNY

SEQ ID NO: 52537 - protein, 10 aa, Artificial Sequence
  Description of Artificial Sequence: Synthetic peptide
  Seed: YIFATCLGLS (MAGA3_HUMAN)
YMFATCLGLF

SEQ ID NO: 52538 - protein, 9 aa, Artificial Sequence
  Description of Artificial Sequence: Synthetic peptide
  Seed: HLYIFATCL (MAGA3_HUMAN)
HQYIFATCV

SEQ ID NO: 52539 - protein, 9 aa, Artificial Sequence
  Description of Artificial Sequence: Synthetic peptide
  Seed: TEEQEAASS (MAGA3_HUMAN)
TEEQEAASL

SEQ ID NO: 52540 - protein, 10 aa, Artificial Sequence
  Description of Artificial Sequence: Synthetic peptide
  Seed: SSSTLVEVTL (MAGA3_HUMAN)
SSSTLVEVTW

SEQ ID NO: 52541 - protein, 10 aa, Artificial Sequence
  Description of Artificial Sequence: Synthetic peptide
  Seed: HISYPPLHEW (MAGA3_HUMAN)
HKSYPPLHEF

SEQ ID NO: 52542 - protein, 9 aa, Artificial Sequence
  Description of Artificial Sequence: Synthetic peptide
  Seed: SSLQLVFGI (MAGA3_HUMAN)
SLLQLVFGV

SEQ ID NO: 52543 - protein, 9 aa, Artificial Sequence
  Description of Artificial Sequence: Synthetic peptide
  Seed: WQYFFPVIF (MAGA3_HUMAN)
WEYFFPVIY

SEQ ID NO: 52544 - protein, 9 aa, Artificial Sequence
  Description of Artificial Sequence: Synthetic peptide
  Seed: VTLGEVPAA (MAGA3_HUMAN)
VQLGEVPAA

SEQ ID NO: 52545 - protein, 10 aa, Artificial Sequence
  Description of Artificial Sequence: Synthetic peptide
  Seed: QEEEGPSTFP (MAGA3_HUMAN)
QEEEGPSTFV

SEQ ID NO: 52546 - protein, 9 aa, Artificial Sequence
  Description of Artificial Sequence: Synthetic peptide
  Seed: QEEEGPSTF (MAGA3_HUMAN)
QLEEGPSTY

SEQ ID NO: 52547 - protein, 9 aa, Artificial Sequence
  Description of Artificial Sequence: Synthetic peptide
  Seed: GSDPACYEF (MAGA3_HUMAN)
GLDPACYEM

SEQ ID NO: 52548 - protein, 10 aa, Artificial Sequence
  Description of Artificial Sequence: Synthetic peptide
  Seed: SLQLVFGIEL (MAGA3_HUMAN)
SLQLVFGIEY

SEQ ID NO: 52549 - protein, 11 aa, Artificial Sequence
  Description of Artificial Sequence: Synthetic peptide
  Seed: SLPTTMNYPLW (MAGA3_HUMAN)
SFPTTMNYPLW

SEQ ID NO: 52550 - protein, 9 aa, Artificial Sequence
  Description of Artificial Sequence: Synthetic peptide
  Seed: KIWEELSVL (MAGA3_HUMAN)
KGWEELSVW

SEQ ID NO: 52551 - protein, 9 aa, Artificial Sequence
  Description of Artificial Sequence: Synthetic peptide
  Seed: GSDPACYEF (MAGA3_HUMAN)
GADPACYEF

SEQ ID NO: 52552 - protein, 9 aa, Artificial Sequence
  Description of Artificial Sequence: Synthetic peptide
  Seed: KVAELVHFL (MAGA3_HUMAN)
KWAELVHFW

SEQ ID NO: 52553 - protein, 9 aa, Artificial Sequence
  Description of Artificial Sequence: Synthetic peptide
  Seed: SYVKVLHHM (MAGA3_HUMAN)
SYVKVLHHF

SEQ ID NO: 52554 - protein, 8 aa, Artificial Sequence
  Description of Artificial Sequence: Synthetic peptide
  Seed: YPLWSQSY (MAGA3_HUMAN)
YYLWSQSY

SEQ ID NO: 52555 - protein, 10 aa, Artificial Sequence
  Description of Artificial Sequence: Synthetic peptide
  Seed: LGSVVGNWQY (MAGA3_HUMAN)
LCSVVGNWQW

SEQ ID NO: 52556 - protein, 9 aa, Artificial Sequence
  Description of Artificial Sequence: Synthetic peptide
  Seed: AASSSSTLV (MAGA3_HUMAN)
AASSSSTLM

SEQ ID NO: 52557 - protein, 9 aa, Artificial Sequence
  Description of Artificial Sequence: Synthetic peptide
  Seed: AELVHFLLL (MAGA3_HUMAN)
ASLVHFLLY

SEQ ID NO: 52558 - protein, 9 aa, Artificial Sequence
  Description of Artificial Sequence: Synthetic peptide
  Seed: SSSSTLVEV (MAGA3_HUMAN)
SMSSTLVET

SEQ ID NO: 52559 - protein, 9 aa, Artificial Sequence
  Description of Artificial Sequence: Synthetic peptide
  Seed: EVDPIGHLY (MAGA3_HUMAN)
EVDPIGHLI

SEQ ID NO: 52560 - protein, 9 aa, Artificial Sequence
  Description of Artificial Sequence: Synthetic peptide
  Seed: LGDPKKLLT (MAGA3_HUMAN)
LVDPKKLLV

SEQ ID NO: 52561 - protein, 9 aa, Artificial Sequence
  Description of Artificial Sequence: Synthetic peptide
  Seed: VTLGEVPAA (MAGA3_HUMAN)
VILGEVPAL

SEQ ID NO: 52562 - protein, 9 aa, Artificial Sequence
  Description of Artificial Sequence: Synthetic peptide
  Seed: TSYVKVLHH (MAGA3_HUMAN)
TAYVKVLHL

SEQ ID NO: 52563 - protein, 10 aa, Artificial Sequence
  Description of Artificial Sequence: Synthetic peptide
  Seed: WEELSVLEVF (MAGA3_HUMAN)
WWELSVLEVW

SEQ ID NO: 52564 - protein, 9 aa, Artificial Sequence
  Description of Artificial Sequence: Synthetic peptide
  Seed: YIFATCLGL (MAGA3_HUMAN)
YFFATCLGY

SEQ ID NO: 52565 - protein, 10 aa, Artificial Sequence
  Description of Artificial Sequence: Synthetic peptide
  Seed: IFATCLGLSY (MAGA3_HUMAN)
ISATCLGLSF

SEQ ID NO: 52566 - protein, 10 aa, Artificial Sequence
  Description of Artificial Sequence: Synthetic peptide
  Seed: KASSSLQLVF (MAGA3_HUMAN)
KWSSSLQLVY

SEQ ID NO: 52567 - protein, 9 aa, Artificial Sequence
  Description of Artificial Sequence: Synthetic peptide
  Seed: SKASSSLQL (MAGA3_HUMAN)
SHASSSLQY

SEQ ID NO: 52568 - protein, 10 aa, Artificial Sequence
  Description of Artificial Sequence: Synthetic peptide
  Seed: SLQLVFGIEL (MAGA3_HUMAN)
SNQLVFGIEY

SEQ ID NO: 52569 - protein, 10 aa, Artificial Sequence
  Description of Artificial Sequence: Synthetic peptide
  Seed: ASSLPTTMNY (MAGA3_HUMAN)
APSLPTTMNF

SEQ ID NO: 52570 - protein, 9 aa, Artificial Sequence
  Description of Artificial Sequence: Synthetic peptide
  Seed: GASSLPTTM (MAGA3_HUMAN)
GPSSLPTTV

SEQ ID NO: 52571 - protein, 9 aa, Artificial Sequence
  Description of Artificial Sequence: Synthetic peptide
  Seed: SILGDPKKL (MAGA3_HUMAN)
SLLGDPKKL

SEQ ID NO: 52572 - protein, 9 aa, Artificial Sequence
  Description of Artificial Sequence: Synthetic peptide
  Seed: TFPDLESEF (MAGA3_HUMAN)
TSPDLESEI

SEQ ID NO: 52573 - protein, 9 aa, Artificial Sequence
  Description of Artificial Sequence: Synthetic peptide
  Seed: ASSSLQLVF (MAGA3_HUMAN)
APSSLQLVY

SEQ ID NO: 52574 - protein, 9 aa, Artificial Sequence
  Description of Artificial Sequence: Synthetic peptide
  Seed: KASSSLQLV (MAGA3_HUMAN)
KQSSSLQLI

SEQ ID NO: 52575 - protein, 11 aa, Artificial Sequence
  Description of Artificial Sequence: Synthetic peptide
  Seed: SEFQAALSRKV (MAGA3_HUMAN)
SEFQAALSRKI

SEQ ID NO: 52576 - protein, 10 aa, Artificial Sequence
  Description of Artificial Sequence: Synthetic peptide
  Seed: DLESEFQAAL (MAGA3_HUMAN)
DMESEFQAAF

SEQ ID NO: 52577 - protein, 9 aa, Artificial Sequence
  Description of Artificial Sequence: Synthetic peptide
  Seed: GPRALVETS (MAGA3_HUMAN)
GPRALVETA

SEQ ID NO: 52578 - protein, 9 aa, Artificial Sequence
  Description of Artificial Sequence: Synthetic peptide
  Seed: SYVKVLHHM (MAGA3_HUMAN)
SRVKVLHHV

SEQ ID NO: 52579 - protein, 10 aa, Artificial Sequence
  Description of Artificial Sequence: Synthetic peptide
  Seed: MNYPLWSQSY (MAGA3_HUMAN)
MYYPLWSQSL

SEQ ID NO: 52580 - protein, 9 aa, Artificial Sequence
  Description of Artificial Sequence: Synthetic peptide
  Seed: VTLGEVPAA (MAGA3_HUMAN)
VSLGEVPAY

SEQ ID NO: 52581 - protein, 9 aa, Artificial Sequence
  Description of Artificial Sequence: Synthetic peptide
  Seed: KVAELVHFL (MAGA3_HUMAN)
KLAELVHFT

SEQ ID NO: 52582 - protein, 9 aa, Artificial Sequence
  Description of Artificial Sequence: Synthetic peptide
  Seed: NYPLWSQSY (MAGA3_HUMAN)
NMPLWSQSF

SEQ ID NO: 52583 - protein, 9 aa, Artificial Sequence
  Description of Artificial Sequence: Synthetic peptide
  Seed: YFFPVIFSK (MAGA3_HUMAN)
YIFPVIFSL

SEQ ID NO: 52584 - protein, 10 aa, Artificial Sequence
  Description of Artificial Sequence: Synthetic peptide
  Seed: VDPIGHLYIF (MAGA3_HUMAN)
VMPIGHLYIW

SEQ ID NO: 52585 - protein, 9 aa, Artificial Sequence
  Description of Artificial Sequence: Synthetic peptide
  Seed: KIWEELSVL (MAGA3_HUMAN)
KSWEELSVW

SEQ ID NO: 52586 - protein, 10 aa, Artificial Sequence
  Description of Artificial Sequence: Synthetic peptide
  Seed: RKVAELVHFL (MAGA3_HUMAN)
RTVAELVHFL

SEQ ID NO: 52587 - protein, 9 aa, Artificial Sequence
  Description of Artificial Sequence: Synthetic peptide
  Seed: VTLGEVPAA (MAGA3_HUMAN)
VILGEVPAY

SEQ ID NO: 52588 - protein, 9 aa, Artificial Sequence
  Description of Artificial Sequence: Synthetic peptide
  Seed: EVDPIGHLY (MAGA3_HUMAN)
EMDPIGHLI

SEQ ID NO: 52589 - protein, 8 aa, Artificial Sequence
  Description of Artificial Sequence: Synthetic peptide
  Seed: IMPKAGLL (MAGA3_HUMAN)
IYPKAGLL

SEQ ID NO: 52590 - protein, 11 aa, Artificial Sequence
  Description of Artificial Sequence: Synthetic peptide
  Seed: SRKVAELVHFL (MAGA3_HUMAN)
SMKVAELVHFI

SEQ ID NO: 52591 - protein, 9 aa, Artificial Sequence
  Description of Artificial Sequence: Synthetic peptide
  Seed: LESEFQAAL (MAGA3_HUMAN)
LTSEFQAAA

SEQ ID NO: 52592 - protein, 11 aa, Artificial Sequence
  Description of Artificial Sequence: Synthetic peptide
  Seed: MLGSVVGNWQY (MAGA3_HUMAN)
MCGSVVGNWQW

SEQ ID NO: 52593 - protein, 10 aa, Artificial Sequence
  Description of Artificial Sequence: Synthetic peptide
  Seed: MNYPLWSQSY (MAGA3_HUMAN)
MAYPLWSQSY

SEQ ID NO: 52594 - protein, 9 aa, Artificial Sequence
  Description of Artificial Sequence: Synthetic peptide
  Seed: GASSLPTTM (MAGA3_HUMAN)
GFSSLPTTM

SEQ ID NO: 52595 - protein, 9 aa, Artificial Sequence
  Description of Artificial Sequence: Synthetic peptide
  Seed: KIWEELSVL (MAGA3_HUMAN)
KYWEELSVY

SEQ ID NO: 52596 - protein, 10 aa, Artificial Sequence
  Description of Artificial Sequence: Synthetic peptide
  Seed: MNYPLWSQSY (MAGA3_HUMAN)
MTYPLWSQSL

SEQ ID NO: 52597 - protein, 9 aa, Artificial Sequence
  Description of Artificial Sequence: Synthetic peptide
  Seed: HEWVLREGE (MAGA3_HUMAN)
HEWVLREGM

SEQ ID NO: 52598 - protein, 9 aa, Artificial Sequence
  Description of Artificial Sequence: Synthetic peptide
  Seed: ILGDPKKLL (MAGA3_HUMAN)
IYGDPKKLF

SEQ ID NO: 52599 - protein, 9 aa, Artificial Sequence
  Description of Artificial Sequence: Synthetic peptide
  Seed: KASSSLQLV (MAGA3_HUMAN)
KISSSLQLI

SEQ ID NO: 52600 - protein, 10 aa, Artificial Sequence
  Description of Artificial Sequence: Synthetic peptide
  Seed: TSYVKVLHHM (MAGA3_HUMAN)
TVYVKVLHHW

SEQ ID NO: 52601 - protein, 11 aa, Artificial Sequence
  Description of Artificial Sequence: Synthetic peptide
  Seed: AQAPATEEQEA (MAGA3_HUMAN)
AEAPATEEQEV

SEQ ID NO: 52602 - protein, 9 aa, Artificial Sequence
  Description of Artificial Sequence: Synthetic peptide
  Seed: RQVPGSDPA (MAGA3_HUMAN)
RTVPGSDPM

SEQ ID NO: 52603 - protein, 11 aa, Artificial Sequence
  Description of Artificial Sequence: Synthetic peptide
  Seed: YIFATCLGLSY (MAGA3_HUMAN)
YTFATCLGLSF

SEQ ID NO: 52604 - protein, 9 aa, Artificial Sequence
  Description of Artificial Sequence: Synthetic peptide
  Seed: SVVGNWQYF (MAGA3_HUMAN)
SQVGNWQYL

SEQ ID NO: 52605 - protein, 10 aa, Artificial Sequence
  Description of Artificial Sequence: Synthetic peptide
  Seed: YFFPVIFSKA (MAGA3_HUMAN)
YMFPVIFSKA

SEQ ID NO: 52606 - protein, 10 aa, Artificial Sequence
  Description of Artificial Sequence: Synthetic peptide
  Seed: HISYPPLHEW (MAGA3_HUMAN)
HPSYPPLHEY

SEQ ID NO: 52607 - protein, 9 aa, Artificial Sequence
  Description of Artificial Sequence: Synthetic peptide
  Seed: RKVAELVHF (MAGA3_HUMAN)
RVVAELVHY

SEQ ID NO: 52608 - protein, 9 aa, Artificial Sequence
  Description of Artificial Sequence: Synthetic peptide
  Seed: ISYPPLHEW (MAGA3_HUMAN)
IDYPPLHEF

SEQ ID NO: 52609 - protein, 10 aa, Artificial Sequence
  Description of Artificial Sequence: Synthetic peptide
  Seed: LQLVFGIELM (MAGA3_HUMAN)
LWLVFGIELV

SEQ ID NO: 52610 - protein, 9 aa, Artificial Sequence
  Description of Artificial Sequence: Synthetic peptide
  Seed: TFPDLESEF (MAGA3_HUMAN)
TSPDLESEF

SEQ ID NO: 52611 - protein, 9 aa, Artificial Sequence
  Description of Artificial Sequence: Synthetic peptide
  Seed: KIWEELSVL (MAGA3_HUMAN)
KTWEELSVL

SEQ ID NO: 52612 - protein, 9 aa, Artificial Sequence
  Description of Artificial Sequence: Synthetic peptide
  Seed: YFFPVIFSK (MAGA3_HUMAN)
YAFPVIFSL

SEQ ID NO: 52613 - protein, 9 aa, Artificial Sequence
  Description of Artificial Sequence: Synthetic peptide
  Seed: FATCLGLSY (MAGA3_HUMAN)
FTTCLGLSY

SEQ ID NO: 52614 - protein, 9 aa, Artificial Sequence
  Description of Artificial Sequence: Synthetic peptide
  Seed: VEVTLGEVP (MAGA3_HUMAN)
VEVTLGEVA

SEQ ID NO: 52615 - protein, 8 aa, Artificial Sequence
  Description of Artificial Sequence: Synthetic peptide
  Seed: HHMVKISG (MAGA3_HUMAN)
HHMVKISA

SEQ ID NO: 52616 - protein, 9 aa, Artificial Sequence
  Description of Artificial Sequence: Synthetic peptide
  Seed: QSPQGASSL (MAGA3_HUMAN)
QMPQGASSF

SEQ ID NO: 52617 - protein, 9 aa, Artificial Sequence
  Description of Artificial Sequence: Synthetic peptide
  Seed: GNWQYFFPV (MAGA3_HUMAN)
GSWQYFFPA

SEQ ID NO: 52618 - protein, 9 aa, Artificial Sequence
  Description of Artificial Sequence: Synthetic peptide
  Seed: RALVETSYV (MAGA3_HUMAN)
RLLVETSYI

SEQ ID NO: 52619 - protein, 9 aa, Artificial Sequence
  Description of Artificial Sequence: Synthetic peptide
  Seed: IMPKAGLLI (MAGA3_HUMAN)
ITPKAGLLM

SEQ ID NO: 52620 - protein, 10 aa, Artificial Sequence
  Description of Artificial Sequence: Synthetic peptide
  Seed: RQVPGSDPAC (MAGA3_HUMAN)
RKVPGSDPAY

SEQ ID NO: 52621 - protein, 9 aa, Artificial Sequence
  Description of Artificial Sequence: Synthetic peptide
  Seed: SSLPTTMNY (MAGA3_HUMAN)
STLPTTMNY

SEQ ID NO: 52622 - protein, 9 aa, Artificial Sequence
  Description of Artificial Sequence: Synthetic peptide
  Seed: YPPLHEWVL (MAGA3_HUMAN)
YSPLHEWVL

SEQ ID NO: 52623 - protein, 9 aa, Artificial Sequence
  Description of Artificial Sequence: Synthetic peptide
  Seed: RALVETSYV (MAGA3_HUMAN)
RILVETSYK

SEQ ID NO: 52624 - protein, 9 aa, Artificial Sequence
  Description of Artificial Sequence: Synthetic peptide
  Seed: GASSLPTTM (MAGA3_HUMAN)
GSSSLPTTY

SEQ ID NO: 52625 - protein, 10 aa, Artificial Sequence
  Description of Artificial Sequence: Synthetic peptide
  Seed: KASSSLQLVF (MAGA3_HUMAN)
KHSSSLQLVF

SEQ ID NO: 52626 - protein, 9 aa, Artificial Sequence
  Description of Artificial Sequence: Synthetic peptide
  Seed: FVQENYLEY (MAGA3_HUMAN)
FSQENYLEH

SEQ ID NO: 52627 - protein, 9 aa, Artificial Sequence
  Description of Artificial Sequence: Synthetic peptide
  Seed: MVKISGGPH (MAGA3_HUMAN)
MVKISGGPY

SEQ ID NO: 52628 - protein, 9 aa, Artificial Sequence
  Description of Artificial Sequence: Synthetic peptide
  Seed: FPVIFSKAS (MAGA3_HUMAN)
FMVIFSKAY

SEQ ID NO: 52629 - protein, 10 aa, Artificial Sequence
  Description of Artificial Sequence: Synthetic peptide
  Seed: MEVDPIGHLY (MAGA3_HUMAN)
MQVDPIGHLW

SEQ ID NO: 52630 - protein, 10 aa, Artificial Sequence
  Description of Artificial Sequence: Synthetic peptide
  Seed: AELVHFLLLK (MAGA3_HUMAN)
ASLVHFLLLK

SEQ ID NO: 52631 - protein, 9 aa, Artificial Sequence
  Description of Artificial Sequence: Synthetic peptide
  Seed: FVQENYLEY (MAGA3_HUMAN)
FPQENYLEH

SEQ ID NO: 52632 - protein, 10 aa, Artificial Sequence
  Description of Artificial Sequence: Synthetic peptide
  Seed: ISYPPLHEWV (MAGA3_HUMAN)
ISYPPLHEWF

SEQ ID NO: 52633 - protein, 11 aa, Artificial Sequence
  Description of Artificial Sequence: Synthetic peptide
  Seed: FLWGPRALVET (MAGA3_HUMAN)
FQWGPRALVEA

SEQ ID NO: 52634 - protein, 9 aa, Artificial Sequence
  Description of Artificial Sequence: Synthetic peptide
  Seed: ILGDPKKLL (MAGA3_HUMAN)
IQGDPKKLY

SEQ ID NO: 52635 - protein, 9 aa, Artificial Sequence
  Description of Artificial Sequence: Synthetic peptide
  Seed: CYEFLWGPR (MAGA3_HUMAN)
CVEFLWGPR

SEQ ID NO: 52636 - protein, 11 aa, Artificial Sequence
  Description of Artificial Sequence: Synthetic peptide
  Seed: QHCKPEEGLEA (MAGA3_HUMAN)
QHCKPEEGLEM

SEQ ID NO: 52637 - protein, 9 aa, Artificial Sequence
  Description of Artificial Sequence: Synthetic peptide
  Seed: SSLQLVFGI (MAGA3_HUMAN)
SVLQLVFGI

SEQ ID NO: 52638 - protein, 9 aa, Artificial Sequence
  Description of Artificial Sequence: Synthetic peptide
  Seed: LPTTMNYPL (MAGA3_HUMAN)
LPTTMNYPI

SEQ ID NO: 52639 - protein, 9 aa, Artificial Sequence
  Description of Artificial Sequence: Synthetic peptide
  Seed: AELVHFLLL (MAGA3_HUMAN)
AMLVHFLLF

SEQ ID NO: 52640 - protein, 11 aa, Artificial Sequence
  Description of Artificial Sequence: Synthetic peptide
  Seed: EVFEGREDSIL (MAGA3_HUMAN)
EVFEGREDSIR

SEQ ID NO: 52641 - protein, 10 aa, Artificial Sequence
  Description of Artificial Sequence: Synthetic peptide
  Seed: TSYVKVLHHM (MAGA3_HUMAN)
TMYVKVLHHL

SEQ ID NO: 52642 - protein, 9 aa, Artificial Sequence
  Description of Artificial Sequence: Synthetic peptide
  Seed: GASSLPTTM (MAGA3_HUMAN)
GLSSLPTTY

SEQ ID NO: 52643 - protein, 10 aa, Artificial Sequence
  Description of Artificial Sequence: Synthetic peptide
  Seed: MNYPLWSQSY (MAGA3_HUMAN)
MVYPLWSQSL

SEQ ID NO: 52644 - protein, 11 aa, Artificial Sequence
  Description of Artificial Sequence: Synthetic peptide
  Seed: SRKVAELVHFL (MAGA3_HUMAN)
SLKVAELVHFV

SEQ ID NO: 52645 - protein, 9 aa, Artificial Sequence
  Description of Artificial Sequence: Synthetic peptide
  Seed: SVLEVFEGR (MAGA3_HUMAN)
SLLEVFEGK

SEQ ID NO: 52646 - protein, 9 aa, Artificial Sequence
  Description of Artificial Sequence: Synthetic peptide
  Seed: SVVGNWQYF (MAGA3_HUMAN)
SRVGNWQYL

SEQ ID NO: 52647 - protein, 9 aa, Artificial Sequence
  Description of Artificial Sequence: Synthetic peptide
  Seed: SSLPTTMNY (MAGA3_HUMAN)
SILPTTMNL

SEQ ID NO: 52648 - protein, 10 aa, Artificial Sequence
  Description of Artificial Sequence: Synthetic peptide
  Seed: ASSLPTTMNY (MAGA3_HUMAN)
AVSLPTTMNW

SEQ ID NO: 52649 - protein, 9 aa, Artificial Sequence
  Description of Artificial Sequence: Synthetic peptide
  Seed: EVDPIGHLY (MAGA3_HUMAN)
EADPIGHLY

SEQ ID NO: 52650 - protein, 9 aa, Artificial Sequence
  Description of Artificial Sequence: Synthetic peptide
  Seed: SKASSSLQL (MAGA3_HUMAN)
SAASSSLQM

SEQ ID NO: 52651 - protein, 10 aa, Artificial Sequence
  Description of Artificial Sequence: Synthetic peptide
  Seed: YIFATCLGLS (MAGA3_HUMAN)
YMFATCLGLH

SEQ ID NO: 52652 - protein, 9 aa, Artificial Sequence
  Description of Artificial Sequence: Synthetic peptide
  Seed: EALGLVGAQ (MAGA3_HUMAN)
EALGLVGAR

SEQ ID NO: 52653 - protein, 9 aa, Artificial Sequence
  Description of Artificial Sequence: Synthetic peptide
  Seed: IFSKASSSL (MAGA3_HUMAN)
IPSKASSSY

SEQ ID NO: 52654 - protein, 9 aa, Artificial Sequence
  Description of Artificial Sequence: Synthetic peptide
  Seed: SSLPTTMNY (MAGA3_HUMAN)
SPLPTTMNY

SEQ ID NO: 52655 - protein, 9 aa, Artificial Sequence
  Description of Artificial Sequence: Synthetic peptide
  Seed: MEVDPIGHL (MAGA3_HUMAN)
MMVDPIGHI

SEQ ID NO: 52656 - protein, 8 aa, Artificial Sequence
  Description of Artificial Sequence: Synthetic peptide
  Seed: LGDPKKLL (MAGA3_HUMAN)
LADPKKLL

SEQ ID NO: 52657 - protein, 9 aa, Artificial Sequence
  Description of Artificial Sequence: Synthetic peptide
  Seed: TQHFVQENY (MAGA3_HUMAN)
TQHFVQENI

SEQ ID NO: 52658 - protein, 11 aa, Artificial Sequence
  Description of Artificial Sequence: Synthetic peptide
  Seed: GASSLPTTMNY (MAGA3_HUMAN)
GTSSLPTTMNF

SEQ ID NO: 52659 - protein, 9 aa, Artificial Sequence
  Description of Artificial Sequence: Synthetic peptide
  Seed: ISGGPHISY (MAGA3_HUMAN)
IRGGPHISM

SEQ ID NO: 52660 - protein, 10 aa, Artificial Sequence
  Description of Artificial Sequence: Synthetic peptide
  Seed: LGLVGAQAPA (MAGA3_HUMAN)
LDLVGAQAPV

SEQ ID NO: 52661 - protein, 10 aa, Artificial Sequence
  Description of Artificial Sequence: Synthetic peptide
  Seed: RKVAELVHFL (MAGA3_HUMAN)
RGVAELVHFL

SEQ ID NO: 52662 - protein, 10 aa, Artificial Sequence
  Description of Artificial Sequence: Synthetic peptide
  Seed: SLQLVFGIEL (MAGA3_HUMAN)
SRQLVFGIEF

SEQ ID NO: 52663 - protein, 10 aa, Artificial Sequence
  Description of Artificial Sequence: Synthetic peptide
  Seed: SSSTLVEVTL (MAGA3_HUMAN)
SSSTLVEVTF

SEQ ID NO: 52664 - protein, 10 aa, Artificial Sequence
  Description of Artificial Sequence: Synthetic peptide
  Seed: ASSSLQLVFG (MAGA3_HUMAN)
ANSSLQLVFW

SEQ ID NO: 52665 - protein, 11 aa, Artificial Sequence
  Description of Artificial Sequence: Synthetic peptide
  Seed: MLGSVVGNWQY (MAGA3_HUMAN)
MSGSVVGNWQW

SEQ ID NO: 52666 - protein, 9 aa, Artificial Sequence
  Description of Artificial Sequence: Synthetic peptide
  Seed: AEMLGSVVG (MAGA3_HUMAN)
AEMLGSVVP

SEQ ID NO: 52667 - protein, 10 aa, Artificial Sequence
  Description of Artificial Sequence: Synthetic peptide
  Seed: LPTTMNYPLW (MAGA3_HUMAN)
LPTTMNYPLY

SEQ ID NO: 52668 - protein, 9 aa, Artificial Sequence
  Description of Artificial Sequence: Synthetic peptide
  Seed: SSLQLVFGI (MAGA3_HUMAN)
STLQLVFGF

SEQ ID NO: 52669 - protein, 10 aa, Artificial Sequence
  Description of Artificial Sequence: Synthetic peptide
  Seed: STFPDLESEF (MAGA3_HUMAN)
SLFPDLESEL

SEQ ID NO: 52670 - protein, 9 aa, Artificial Sequence
  Description of Artificial Sequence: Synthetic peptide
  Seed: KVLHHMVKI (MAGA3_HUMAN)
KSLHHMVKV

SEQ ID NO: 52671 - protein, 9 aa, Artificial Sequence
  Description of Artificial Sequence: Synthetic peptide
  Seed: YIFATCLGL (MAGA3_HUMAN)
YMFATCLGF

SEQ ID NO: 52672 - protein, 8 aa, Artificial Sequence
  Description of Artificial Sequence: Synthetic peptide
  Seed: MPKAGLLI (MAGA3_HUMAN)
MPKAGLLA

SEQ ID NO: 52673 - protein, 9 aa, Artificial Sequence
  Description of Artificial Sequence: Synthetic peptide
  Seed: RQVPGSDPA (MAGA3_HUMAN)
RIVPGSDPM

SEQ ID NO: 52674 - protein, 9 aa, Artificial Sequence
  Description of Artificial Sequence: Synthetic peptide
  Seed: GSDPACYEF (MAGA3_HUMAN)
GADPACYEY

SEQ ID NO: 52675 - protein, 9 aa, Artificial Sequence
  Description of Artificial Sequence: Synthetic peptide
  Seed: IIVLAIIAR (MAGA3_HUMAN)
ITVLAIIAR

SEQ ID NO: 52676 - protein, 10 aa, Artificial Sequence
  Description of Artificial Sequence: Synthetic peptide
  Seed: YRQVPGSDPA (MAGA3_HUMAN)
YDQVPGSDPV

SEQ ID NO: 52677 - protein, 9 aa, Artificial Sequence
  Description of Artificial Sequence: Synthetic peptide
  Seed: LESEFQAAL (MAGA3_HUMAN)
LHSEFQAAY

SEQ ID NO: 52678 - protein, 9 aa, Artificial Sequence
  Description of Artificial Sequence: Synthetic peptide
  Seed: SKASSSLQL (MAGA3_HUMAN)
SHASSSLQM

SEQ ID NO: 52679 - protein, 9 aa, Artificial Sequence
  Description of Artificial Sequence: Synthetic peptide
  Seed: QEEEGPSTF (MAGA3_HUMAN)
QEEEGPSTV

SEQ ID NO: 52680 - protein, 9 aa, Artificial Sequence
  Description of Artificial Sequence: Synthetic peptide
  Seed: ISYPPLHEW (MAGA3_HUMAN)
IGYPPLHEF

SEQ ID NO: 52681 - protein, 10 aa, Artificial Sequence
  Description of Artificial Sequence: Synthetic peptide
  Seed: ISYPPLHEWV (MAGA3_HUMAN)
IAYPPLHEWY

SEQ ID NO: 52682 - protein, 9 aa, Artificial Sequence
  Description of Artificial Sequence: Synthetic peptide
  Seed: SSLQLVFGI (MAGA3_HUMAN)
SALQLVFGI

SEQ ID NO: 52683 - protein, 9 aa, Artificial Sequence
  Description of Artificial Sequence: Synthetic peptide
  Seed: WEELSVLEV (MAGA3_HUMAN)
WEELSVLEF

SEQ ID NO: 52684 - protein, 9 aa, Artificial Sequence
  Description of Artificial Sequence: Synthetic peptide
  Seed: ISYPPLHEW (MAGA3_HUMAN)
IRYPPLHEF

SEQ ID NO: 52685 - protein, 9 aa, Artificial Sequence
  Description of Artificial Sequence: Synthetic peptide
  Seed: SILGDPKKL (MAGA3_HUMAN)
SMLGDPKKL

SEQ ID NO: 52686 - protein, 10 aa, Artificial Sequence
  Description of Artificial Sequence: Synthetic peptide
  Seed: LGLVGAQAPA (MAGA3_HUMAN)
LFLVGAQAPL

SEQ ID NO: 52687 - protein, 9 aa, Artificial Sequence
  Description of Artificial Sequence: Synthetic peptide
  Seed: EELSVLEVF (MAGA3_HUMAN)
EQLSVLEVY

SEQ ID NO: 52688 - protein, 9 aa, Artificial Sequence
  Description of Artificial Sequence: Synthetic peptide
  Seed: TSYVKVLHH (MAGA3_HUMAN)
TMYVKVLHR

SEQ ID NO: 52689 - protein, 9 aa, Artificial Sequence
  Description of Artificial Sequence: Synthetic peptide
  Seed: KVLHHMVKI (MAGA3_HUMAN)
KGLHHMVKW

SEQ ID NO: 52690 - protein, 10 aa, Artificial Sequence
  Description of Artificial Sequence: Synthetic peptide
  Seed: SVVGNWQYFF (MAGA3_HUMAN)
SFVGNWQYFW

SEQ ID NO: 52691 - protein, 10 aa, Artificial Sequence
  Description of Artificial Sequence: Synthetic peptide
  Seed: TTMNYPLWSQ (MAGA3_HUMAN)
TTMNYPLWSR

SEQ ID NO: 52692 - protein, 10 aa, Artificial Sequence
  Description of Artificial Sequence: Synthetic peptide
  Seed: ASSLPTTMNY (MAGA3_HUMAN)
AVSLPTTMNY

SEQ ID NO: 52693 - protein, 9 aa, Artificial Sequence
  Description of Artificial Sequence: Synthetic peptide
  Seed: RQVPGSDPA (MAGA3_HUMAN)
RQVPGSDPL

SEQ ID NO: 52694 - protein, 10 aa, Artificial Sequence
  Description of Artificial Sequence: Synthetic peptide
  Seed: KVAELVHFLL (MAGA3_HUMAN)
KVAELVHFLW

SEQ ID NO: 52695 - protein, 11 aa, Artificial Sequence
  Description of Artificial Sequence: Synthetic peptide
  Seed: SKASSSLQLVF (MAGA3_HUMAN)
SFASSSLQLVW

SEQ ID NO: 52696 - protein, 9 aa, Artificial Sequence
  Description of Artificial Sequence: Synthetic peptide
  Seed: KASSSLQLV (MAGA3_HUMAN)
KQSSSLQLK

SEQ ID NO: 52697 - protein, 9 aa, Artificial Sequence
  Description of Artificial Sequence: Synthetic peptide
  Seed: YFFPVIFSK (MAGA3_HUMAN)
YVFPVIFSR

SEQ ID NO: 52698 - protein, 10 aa, Artificial Sequence
  Description of Artificial Sequence: Synthetic peptide
  Seed: LYIFATCLGL (MAGA3_HUMAN)
LMIFATCLGL

SEQ ID NO: 52699 - protein, 10 aa, Artificial Sequence
  Description of Artificial Sequence: Synthetic peptide
  Seed: MPKAGLLIIV (MAGA3_HUMAN)
MPKAGLLIIT

SEQ ID NO: 52700 - protein, 10 aa, Artificial Sequence
  Description of Artificial Sequence: Synthetic peptide
  Seed: YIFATCLGLS (MAGA3_HUMAN)
YMFATCLGLE

SEQ ID NO: 52701 - protein, 9 aa, Artificial Sequence
  Description of Artificial Sequence: Synthetic peptide
  Seed: FVQENYLEY (MAGA3_HUMAN)
FHQENYLEL

SEQ ID NO: 52702 - protein, 10 aa, Artificial Sequence
  Description of Artificial Sequence: Synthetic peptide
  Seed: GHLYIFATCL (MAGA3_HUMAN)
GMLYIFATCI

SEQ ID NO: 52703 - protein, 10 aa, Artificial Sequence
  Description of Artificial Sequence: Synthetic peptide
  Seed: STFPDLESEF (MAGA3_HUMAN)
SLFPDLESEY

SEQ ID NO: 52704 - protein, 10 aa, Artificial Sequence
  Description of Artificial Sequence: Synthetic peptide
  Seed: HISYPPLHEW (MAGA3_HUMAN)
HLSYPPLHEY

SEQ ID NO: 52705 - protein, 10 aa, Artificial Sequence
  Description of Artificial Sequence: Synthetic peptide
  Seed: SVVGNWQYFF (MAGA3_HUMAN)
STVGNWQYFY

SEQ ID NO: 52706 - protein, 9 aa, Artificial Sequence
  Description of Artificial Sequence: Synthetic peptide
  Seed: ASSSLQLVF (MAGA3_HUMAN)
AASSLQLVV

SEQ ID NO: 52707 - protein, 9 aa, Artificial Sequence
  Description of Artificial Sequence: Synthetic peptide
  Seed: VTLGEVPAA (MAGA3_HUMAN)
VILGEVPAM

SEQ ID NO: 52708 - protein, 9 aa, Artificial Sequence
  Description of Artificial Sequence: Synthetic peptide
  Seed: KVLHHMVKI (MAGA3_HUMAN)
KILHHMVKK

SEQ ID NO: 52709 - protein, 9 aa, Artificial Sequence
  Description of Artificial Sequence: Synthetic peptide
  Seed: ILGDPKKLL (MAGA3_HUMAN)
IYGDPKKLY

SEQ ID NO: 52710 - protein, 9 aa, Artificial Sequence
  Description of Artificial Sequence: Synthetic peptide
  Seed: SSLPTTMNY (MAGA3_HUMAN)
SNLPTTMNY

SEQ ID NO: 52711 - protein, 9 aa, Artificial Sequence
  Description of Artificial Sequence: Synthetic peptide
  Seed: LESEFQAAL (MAGA3_HUMAN)
LPSEFQAAY

SEQ ID NO: 52712 - protein, 10 aa, Artificial Sequence
  Description of Artificial Sequence: Synthetic peptide
  Seed: YRQVPGSDPA (MAGA3_HUMAN)
YAQVPGSDPV

SEQ ID NO: 52713 - protein, 10 aa, Artificial Sequence
  Description of Artificial Sequence: Synthetic peptide
  Seed: HISYPPLHEW (MAGA3_HUMAN)
HNSYPPLHEY

SEQ ID NO: 52714 - protein, 9 aa, Artificial Sequence
  Description of Artificial Sequence: Synthetic peptide
  Seed: SSLPTTMNY (MAGA3_HUMAN)
STLPTTMNW

SEQ ID NO: 52715 - protein, 9 aa, Artificial Sequence
  Description of Artificial Sequence: Synthetic peptide
  Seed: SSLPTTMNY (MAGA3_HUMAN)
SLLPTTMNW

SEQ ID NO: 52716 - protein, 11 aa, Artificial Sequence
  Description of Artificial Sequence: Synthetic peptide
  Seed: MEVDPIGHLYI (MAGA3_HUMAN)
MEVDPIGHLYA

SEQ ID NO: 52717 - protein, 9 aa, Artificial Sequence
  Description of Artificial Sequence: Synthetic peptide
  Seed: EAASSSSTL (MAGA3_HUMAN)
EAASSSSTR

SEQ ID NO: 52718 - protein, 8 aa, Artificial Sequence
  Description of Artificial Sequence: Synthetic peptide
  Seed: EVDPIGHL (MAGA3_HUMAN)
ELDPIGHL

SEQ ID NO: 52719 - protein, 9 aa, Artificial Sequence
  Description of Artificial Sequence: Synthetic peptide
  Seed: FVQENYLEY (MAGA3_HUMAN)
FNQENYLEL

SEQ ID NO: 52720 - protein, 10 aa, Artificial Sequence
  Description of Artificial Sequence: Synthetic peptide
  Seed: KVAELVHFLL (MAGA3_HUMAN)
KLAELVHFLS

SEQ ID NO: 52721 - protein, 9 aa, Artificial Sequence
  Description of Artificial Sequence: Synthetic peptide
  Seed: AESPDPPQS (MAGA3_HUMAN)
AESPDPPQT

SEQ ID NO: 52722 - protein, 10 aa, Artificial Sequence
  Description of Artificial Sequence: Synthetic peptide
  Seed: EVFEGREDSI (MAGA3_HUMAN)
EVFEGREDSR

SEQ ID NO: 52723 - protein, 10 aa, Artificial Sequence
  Description of Artificial Sequence: Synthetic peptide
  Seed: KASSSLQLVF (MAGA3_HUMAN)
KHSSSLQLVW

SEQ ID NO: 52724 - protein, 10 aa, Artificial Sequence
  Description of Artificial Sequence: Synthetic peptide
  Seed: LVHFLLLKYR (MAGA3_HUMAN)
LMHFLLLKYR

SEQ ID NO: 52725 - protein, 9 aa, Artificial Sequence
  Description of Artificial Sequence: Synthetic peptide
  Seed: EVDPIGHLY (MAGA3_HUMAN)
EFDPIGHLI

SEQ ID NO: 52726 - protein, 10 aa, Artificial Sequence
  Description of Artificial Sequence: Synthetic peptide
  Seed: TSYVKVLHHM (MAGA3_HUMAN)
TYYVKVLHHL

SEQ ID NO: 52727 - protein, 10 aa, Artificial Sequence
  Description of Artificial Sequence: Synthetic peptide
  Seed: SLQLVFGIEL (MAGA3_HUMAN)
SCQLVFGIEF

SEQ ID NO: 52728 - protein, 9 aa, Artificial Sequence
  Description of Artificial Sequence: Synthetic peptide
  Seed: EVDPIGHLY (MAGA3_HUMAN)
ETDPIGHLV

SEQ ID NO: 52729 - protein, 9 aa, Artificial Sequence
  Description of Artificial Sequence: Synthetic peptide
  Seed: YIFATCLGL (MAGA3_HUMAN)
YTFATCLGV

SEQ ID NO: 52730 - protein, 9 aa, Artificial Sequence
  Description of Artificial Sequence: Synthetic peptide
  Seed: HLYIFATCL (MAGA3_HUMAN)
HAYIFATCM

SEQ ID NO: 52731 - protein, 9 aa, Artificial Sequence
  Description of Artificial Sequence: Synthetic peptide
  Seed: ISGGPHISY (MAGA3_HUMAN)
IQGGPHISY

SEQ ID NO: 52732 - protein, 11 aa, Artificial Sequence
  Description of Artificial Sequence: Synthetic peptide
  Seed: ISYPPLHEWVL (MAGA3_HUMAN)
IGYPPLHEWVW

SEQ ID NO: 52733 - protein, 10 aa, Artificial Sequence
  Description of Artificial Sequence: Synthetic peptide
  Seed: MNYPLWSQSY (MAGA3_HUMAN)
MQYPLWSQSV

SEQ ID NO: 52734 - protein, 9 aa, Artificial Sequence
  Description of Artificial Sequence: Synthetic peptide
  Seed: EELSVLEVF (MAGA3_HUMAN)
EELSVLEVL

SEQ ID NO: 52735 - protein, 10 aa, Artificial Sequence
  Description of Artificial Sequence: Synthetic peptide
  Seed: YFFPVIFSKA (MAGA3_HUMAN)
YMFPVIFSKT

SEQ ID NO: 52736 - protein, 9 aa, Artificial Sequence
  Description of Artificial Sequence: Synthetic peptide
  Seed: GSDPACYEF (MAGA3_HUMAN)
GQDPACYEM

SEQ ID NO: 52737 - protein, 10 aa, Artificial Sequence
  Description of Artificial Sequence: Synthetic peptide
  Seed: SLPTTMNYPL (MAGA3_HUMAN)
SEPTTMNYPM

SEQ ID NO: 52738 - protein, 9 aa, Artificial Sequence
  Description of Artificial Sequence: Synthetic peptide
  Seed: TFPDLESEF (MAGA3_HUMAN)
TLPDLESEI

SEQ ID NO: 52739 - protein, 11 aa, Artificial Sequence
  Description of Artificial Sequence: Synthetic peptide
  Seed: AEMLGSVVGNW (MAGA3_HUMAN)
ASMLGSVVGNW

SEQ ID NO: 52740 - protein, 9 aa, Artificial Sequence
  Description of Artificial Sequence: Synthetic peptide
  Seed: LESEFQAAL (MAGA3_HUMAN)
LQSEFQAAF

SEQ ID NO: 52741 - protein, 10 aa, Artificial Sequence
  Description of Artificial Sequence: Synthetic peptide
  Seed: SYVKVLHHMV (MAGA3_HUMAN)
SYVKVLHHMM

SEQ ID NO: 52742 - protein, 11 aa, Artificial Sequence
  Description of Artificial Sequence: Synthetic peptide
  Seed: ELVHFLLLKYR (MAGA3_HUMAN)
EYVHFLLLKYR

SEQ ID NO: 52743 - protein, 10 aa, Artificial Sequence
  Description of Artificial Sequence: Synthetic peptide
  Seed: ISYPPLHEWV (MAGA3_HUMAN)
IHYPPLHEWW

SEQ ID NO: 52744 - protein, 10 aa, Artificial Sequence
  Description of Artificial Sequence: Synthetic peptide
  Seed: NWQYFFPVIF (MAGA3_HUMAN)
NFQYFFPVIY

SEQ ID NO: 52745 - protein, 9 aa, Artificial Sequence
  Description of Artificial Sequence: Synthetic peptide
  Seed: ISYPPLHEW (MAGA3_HUMAN)
IRYPPLHEI

SEQ ID NO: 52746 - protein, 9 aa, Artificial Sequence
  Description of Artificial Sequence: Synthetic peptide
  Seed: EALGLVGAQ (MAGA3_HUMAN)
EVLGLVGAY

SEQ ID NO: 52747 - protein, 10 aa, Artificial Sequence
  Description of Artificial Sequence: Synthetic peptide
  Seed: EVFEGREDSI (MAGA3_HUMAN)
ESFEGREDSV

SEQ ID NO: 52748 - protein, 9 aa, Artificial Sequence
  Description of Artificial Sequence: Synthetic peptide
  Seed: TSYVKVLHH (MAGA3_HUMAN)
TSYVKVLHM

SEQ ID NO: 52749 - protein, 9 aa, Artificial Sequence
  Description of Artificial Sequence: Synthetic peptide
  Seed: GLVGAQAPA (MAGA3_HUMAN)
GQVGAQAPI

SEQ ID NO: 52750 - protein, 11 aa, Artificial Sequence
  Description of Artificial Sequence: Synthetic peptide
  Seed: SEFQAALSRKV (MAGA3_HUMAN)
SEFQAALSRKF

SEQ ID NO: 52751 - protein, 10 aa, Artificial Sequence
  Description of Artificial Sequence: Synthetic peptide
  Seed: MNYPLWSQSY (MAGA3_HUMAN)
MVYPLWSQSY

SEQ ID NO: 52752 - protein, 9 aa, Artificial Sequence
  Description of Artificial Sequence: Synthetic peptide
  Seed: KAGLLIIVL (MAGA3_HUMAN)
KRGLLIIVL

SEQ ID NO: 52753 - protein, 10 aa, Artificial Sequence
  Description of Artificial Sequence: Synthetic peptide
  Seed: KAEMLGSVVG (MAGA3_HUMAN)
KGEMLGSVVA

SEQ ID NO: 52754 - protein, 10 aa, Artificial Sequence
  Description of Artificial Sequence: Synthetic peptide
  Seed: HFVQENYLEY (MAGA3_HUMAN)
HPVQENYLEY

SEQ ID NO: 52755 - protein, 9 aa, Artificial Sequence
  Description of Artificial Sequence: Synthetic peptide
  Seed: KASSSLQLV (MAGA3_HUMAN)
KMSSSLQLL

SEQ ID NO: 52756 - protein, 9 aa, Artificial Sequence
  Description of Artificial Sequence: Synthetic peptide
  Seed: ISGGPHISY (MAGA3_HUMAN)
ILGGPHISW

SEQ ID NO: 52757 - protein, 9 aa, Artificial Sequence
  Description of Artificial Sequence: Synthetic peptide
  Seed: LESEFQAAL (MAGA3_HUMAN)
LDSEFQAAL

SEQ ID NO: 52758 - protein, 9 aa, Artificial Sequence
  Description of Artificial Sequence: Synthetic peptide
  Seed: QEEEGPSTF (MAGA3_HUMAN)
QEEEGPSTI

SEQ ID NO: 52759 - protein, 10 aa, Artificial Sequence
  Description of Artificial Sequence: Synthetic peptide
  Seed: IFATCLGLSY (MAGA3_HUMAN)
IMATCLGLSW

SEQ ID NO: 52760 - protein, 9 aa, Artificial Sequence
  Description of Artificial Sequence: Synthetic peptide
  Seed: MEVDPIGHL (MAGA3_HUMAN)
MRVDPIGHI

SEQ ID NO: 52761 - protein, 11 aa, Artificial Sequence
  Description of Artificial Sequence: Synthetic peptide
  Seed: MLGSVVGNWQY (MAGA3_HUMAN)
MDGSVVGNWQW

SEQ ID NO: 52762 - protein, 10 aa, Artificial Sequence
  Description of Artificial Sequence: Synthetic peptide
  Seed: YFFPVIFSKA (MAGA3_HUMAN)
YQFPVIFSKL

SEQ ID NO: 52763 - protein, 9 aa, Artificial Sequence
  Description of Artificial Sequence: Synthetic peptide
  Seed: ALSRKVAEL (MAGA3_HUMAN)
ALSRKVAEI

SEQ ID NO: 52764 - protein, 11 aa, Artificial Sequence
  Description of Artificial Sequence: Synthetic peptide
  Seed: FLWGPRALVET (MAGA3_HUMAN)
FQWGPRALVEI

SEQ ID NO: 52765 - protein, 10 aa, Artificial Sequence
  Description of Artificial Sequence: Synthetic peptide
  Seed: IFATCLGLSY (MAGA3_HUMAN)
IKATCLGLSF

SEQ ID NO: 52766 - protein, 9 aa, Artificial Sequence
  Description of Artificial Sequence: Synthetic peptide
  Seed: SSLPTTMNY (MAGA3_HUMAN)
STLPTTMNR

SEQ ID NO: 52767 - protein, 10 aa, Artificial Sequence
  Description of Artificial Sequence: Synthetic peptide
  Seed: SLPTTMNYPL (MAGA3_HUMAN)
SQPTTMNYPM

SEQ ID NO: 52768 - protein, 9 aa, Artificial Sequence
  Description of Artificial Sequence: Synthetic peptide
  Seed: GASSLPTTM (MAGA3_HUMAN)
GLSSLPTTF

SEQ ID NO: 52769 - protein, 9 aa, Artificial Sequence
  Description of Artificial Sequence: Synthetic peptide
  Seed: GLLIIVLAI (MAGA3_HUMAN)
GLLIIVLAV

SEQ ID NO: 52770 - protein, 10 aa, Artificial Sequence
  Description of Artificial Sequence: Synthetic peptide
  Seed: VDPIGHLYIF (MAGA3_HUMAN)
VNPIGHLYIW

SEQ ID NO: 52771 - protein, 10 aa, Artificial Sequence
  Description of Artificial Sequence: Synthetic peptide
  Seed: WEELSVLEVF (MAGA3_HUMAN)
WAELSVLEVW

SEQ ID NO: 52772 - protein, 9 aa, Artificial Sequence
  Description of Artificial Sequence: Synthetic peptide
  Seed: MEVDPIGHL (MAGA3_HUMAN)
MIVDPIGHL

SEQ ID NO: 52773 - protein, 9 aa, Artificial Sequence
  Description of Artificial Sequence: Synthetic peptide
  Seed: SSLPTTMNY (MAGA3_HUMAN)
SFLPTTMNV

SEQ ID NO: 52774 - protein, 9 aa, Artificial Sequence
  Description of Artificial Sequence: Synthetic peptide
  Seed: FQAALSRKV (MAGA3_HUMAN)
FTAALSRKY

SEQ ID NO: 52775 - protein, 10 aa, Artificial Sequence
  Description of Artificial Sequence: Synthetic peptide
  Seed: ASSSLQLVFG (MAGA3_HUMAN)
ADSSLQLVFW

SEQ ID NO: 52776 - protein, 9 aa, Artificial Sequence
  Description of Artificial Sequence: Synthetic peptide
  Seed: LVHFLLLKY (MAGA3_HUMAN)
LAHFLLLKL

SEQ ID NO: 52777 - protein, 9 aa, Artificial Sequence
  Description of Artificial Sequence: Synthetic peptide
  Seed: RALVETSYV (MAGA3_HUMAN)
RFLVETSYY

SEQ ID NO: 52778 - protein, 9 aa, Artificial Sequence
  Description of Artificial Sequence: Synthetic peptide
  Seed: LPTTMNYPL (MAGA3_HUMAN)
LHTTMNYPL

SEQ ID NO: 52779 - protein, 10 aa, Artificial Sequence
  Description of Artificial Sequence: Synthetic peptide
  Seed: RKVAELVHFL (MAGA3_HUMAN)
RMVAELVHFM

SEQ ID NO: 52780 - protein, 10 aa, Artificial Sequence
  Description of Artificial Sequence: Synthetic peptide
  Seed: WEELSVLEVF (MAGA3_HUMAN)
WGELSVLEVL

SEQ ID NO: 52781 - protein, 9 aa, Artificial Sequence
  Description of Artificial Sequence: Synthetic peptide
  Seed: FVQENYLEY (MAGA3_HUMAN)
FTQENYLEF

SEQ ID NO: 52782 - protein, 11 aa, Artificial Sequence
  Description of Artificial Sequence: Synthetic peptide
  Seed: YIFATCLGLSY (MAGA3_HUMAN)
YYFATCLGLSY

SEQ ID NO: 52783 - protein, 10 aa, Artificial Sequence
  Description of Artificial Sequence: Synthetic peptide
  Seed: MEVDPIGHLY (MAGA3_HUMAN)
MKVDPIGHLF

SEQ ID NO: 52784 - protein, 9 aa, Artificial Sequence
  Description of Artificial Sequence: Synthetic peptide
  Seed: SYPPLHEWV (MAGA3_HUMAN)
SFPPLHEWL

SEQ ID NO: 52785 - protein, 9 aa, Artificial Sequence
  Description of Artificial Sequence: Synthetic peptide
  Seed: ISYPPLHEW (MAGA3_HUMAN)
ITYPPLHEA

SEQ ID NO: 52786 - protein, 10 aa, Artificial Sequence
  Description of Artificial Sequence: Synthetic peptide
  Seed: FLWGPRALVE (MAGA3_HUMAN)
FMWGPRALVW

SEQ ID NO: 52787 - protein, 9 aa, Artificial Sequence
  Description of Artificial Sequence: Synthetic peptide
  Seed: FVQENYLEY (MAGA3_HUMAN)
FVQENYLEK

SEQ ID NO: 52788 - protein, 10 aa, Artificial Sequence
  Description of Artificial Sequence: Synthetic peptide
  Seed: MEVDPIGHLY (MAGA3_HUMAN)
MMVDPIGHLM

SEQ ID NO: 52789 - protein, 9 aa, Artificial Sequence
  Description of Artificial Sequence: Synthetic peptide
  Seed: SSSSTLVEV (MAGA3_HUMAN)
SLSSTLVEM

SEQ ID NO: 52790 - protein, 10 aa, Artificial Sequence
  Description of Artificial Sequence: Synthetic peptide
  Seed: HFVQENYLEY (MAGA3_HUMAN)
HSVQENYLEY

SEQ ID NO: 52791 - protein, 10 aa, Artificial Sequence
  Description of Artificial Sequence: Synthetic peptide
  Seed: LYIFATCLGL (MAGA3_HUMAN)
LMIFATCLGV

SEQ ID NO: 52792 - protein, 9 aa, Artificial Sequence
  Description of Artificial Sequence: Synthetic peptide
  Seed: EAASSSSTL (MAGA3_HUMAN)
EGASSSSTR

SEQ ID NO: 52793 - protein, 9 aa, Artificial Sequence
  Description of Artificial Sequence: Synthetic peptide
  Seed: SKASSSLQL (MAGA3_HUMAN)
SQASSSLQV

SEQ ID NO: 52794 - protein, 9 aa, Artificial Sequence
  Description of Artificial Sequence: Synthetic peptide
  Seed: FQAALSRKV (MAGA3_HUMAN)
FIAALSRKF

SEQ ID NO: 52795 - protein, 9 aa, Artificial Sequence
  Description of Artificial Sequence: Synthetic peptide
  Seed: IFSKASSSL (MAGA3_HUMAN)
IFSKASSSV

SEQ ID NO: 52796 - protein, 10 aa, Artificial Sequence
  Description of Artificial Sequence: Synthetic peptide
  Seed: YIFATCLGLS (MAGA3_HUMAN)
YLFATCLGLG

SEQ ID NO: 52797 - protein, 9 aa, Artificial Sequence
  Description of Artificial Sequence: Synthetic peptide
  Seed: YPPLHEWVL (MAGA3_HUMAN)
YAPLHEWVM

SEQ ID NO: 52798 - protein, 10 aa, Artificial Sequence
  Description of Artificial Sequence: Synthetic peptide
  Seed: ASSSLQLVFG (MAGA3_HUMAN)
AHSSLQLVFW

SEQ ID NO: 52799 - protein, 9 aa, Artificial Sequence
  Description of Artificial Sequence: Synthetic peptide
  Seed: QSPQGASSL (MAGA3_HUMAN)
QMPQGASSM

SEQ ID NO: 52800 - protein, 10 aa, Artificial Sequence
  Description of Artificial Sequence: Synthetic peptide
  Seed: SVVGNWQYFF (MAGA3_HUMAN)
SYVGNWQYFH

SEQ ID NO: 52801 - protein, 9 aa, Artificial Sequence
  Description of Artificial Sequence: Synthetic peptide
  Seed: SVVGNWQYF (MAGA3_HUMAN)
SSVGNWQYL

SEQ ID NO: 52802 - protein, 9 aa, Artificial Sequence
  Description of Artificial Sequence: Synthetic peptide
  Seed: ISGGPHISY (MAGA3_HUMAN)
IMGGPHISM

SEQ ID NO: 52803 - protein, 9 aa, Artificial Sequence
  Description of Artificial Sequence: Synthetic peptide
  Seed: YIFATCLGL (MAGA3_HUMAN)
YNFATCLGY

SEQ ID NO: 52804 - protein, 9 aa, Artificial Sequence
  Description of Artificial Sequence: Synthetic peptide
  Seed: RQVPGSDPA (MAGA3_HUMAN)
RVVPGSDPV

SEQ ID NO: 52805 - protein, 9 aa, Artificial Sequence
  Description of Artificial Sequence: Synthetic peptide
  Seed: YPPLHEWVL (MAGA3_HUMAN)
YTPLHEWVL

SEQ ID NO: 52806 - protein, 10 aa, Artificial Sequence
  Description of Artificial Sequence: Synthetic peptide
  Seed: YFFPVIFSKA (MAGA3_HUMAN)
YIFPVIFSKI

SEQ ID NO: 52807 - protein, 9 aa, Artificial Sequence
  Description of Artificial Sequence: Synthetic peptide
  Seed: HLYIFATCL (MAGA3_HUMAN)
HQYIFATCY

SEQ ID NO: 52808 - protein, 10 aa, Artificial Sequence
  Description of Artificial Sequence: Synthetic peptide
  Seed: ISYPPLHEWV (MAGA3_HUMAN)
IIYPPLHEWI

SEQ ID NO: 52809 - protein, 10 aa, Artificial Sequence
  Description of Artificial Sequence: Synthetic peptide
  Seed: VIFSKASSSL (MAGA3_HUMAN)
VVFSKASSSL

SEQ ID NO: 52810 - protein, 10 aa, Artificial Sequence
  Description of Artificial Sequence: Synthetic peptide
  Seed: HISYPPLHEW (MAGA3_HUMAN)
HGSYPPLHEF

SEQ ID NO: 52811 - protein, 9 aa, Artificial Sequence
  Description of Artificial Sequence: Synthetic peptide
  Seed: EVDPIGHLY (MAGA3_HUMAN)
EYDPIGHLY

SEQ ID NO: 52812 - protein, 10 aa, Artificial Sequence
  Description of Artificial Sequence: Synthetic peptide
  Seed: GPRALVETSY (MAGA3_HUMAN)
GQRALVETSF

SEQ ID NO: 52813 - protein, 9 aa, Artificial Sequence
  Description of Artificial Sequence: Synthetic peptide
  Seed: EARGEALGL (MAGA3_HUMAN)
ETRGEALGK

SEQ ID NO: 52814 - protein, 9 aa, Artificial Sequence
  Description of Artificial Sequence: Synthetic peptide
  Seed: KVLHHMVKI (MAGA3_HUMAN)
KQLHHMVKW

SEQ ID NO: 52815 - protein, 9 aa, Artificial Sequence
  Description of Artificial Sequence: Synthetic peptide
  Seed: KVAELVHFL (MAGA3_HUMAN)
KMAELVHFF

SEQ ID NO: 52816 - protein, 9 aa, Artificial Sequence
  Description of Artificial Sequence: Synthetic peptide
  Seed: LEYRQVPGS (MAGA3_HUMAN)
LEYRQVPGM

SEQ ID NO: 52817 - protein, 9 aa, Artificial Sequence
  Description of Artificial Sequence: Synthetic peptide
  Seed: LPTTMNYPL (MAGA3_HUMAN)
LATTMNYPY

SEQ ID NO: 52818 - protein, 8 aa, Artificial Sequence
  Description of Artificial Sequence: Synthetic peptide
  Seed: HEWVLREG (MAGA3_HUMAN)
HEWVLREA

SEQ ID NO: 52819 - protein, 10 aa, Artificial Sequence
  Description of Artificial Sequence: Synthetic peptide
  Seed: WEELSVLEVF (MAGA3_HUMAN)
WYELSVLEVL

SEQ ID NO: 52820 - protein, 10 aa, Artificial Sequence
  Description of Artificial Sequence: Synthetic peptide
  Seed: ISYPPLHEWV (MAGA3_HUMAN)
IIYPPLHEWF

SEQ ID NO: 52821 - protein, 9 aa, Artificial Sequence
  Description of Artificial Sequence: Synthetic peptide
  Seed: SSTLVEVTL (MAGA3_HUMAN)
SMTLVEVTI

SEQ ID NO: 52822 - protein, 9 aa, Artificial Sequence
  Description of Artificial Sequence: Synthetic peptide
  Seed: SEFQAALSR (MAGA3_HUMAN)
SLFQAALSR

SEQ ID NO: 52823 - protein, 11 aa, Artificial Sequence
  Description of Artificial Sequence: Synthetic peptide
  Seed: RQVPGSDPACY (MAGA3_HUMAN)
RLVPGSDPACW

SEQ ID NO: 52824 - protein, 10 aa, Artificial Sequence
  Description of Artificial Sequence: Synthetic peptide
  Seed: KASSSLQLVF (MAGA3_HUMAN)
KCSSSLQLVF

SEQ ID NO: 52825 - protein, 8 aa, Artificial Sequence
  Description of Artificial Sequence: Synthetic peptide
  Seed: SGGPHISY (MAGA3_HUMAN)
SAGPHISL

SEQ ID NO: 52826 - protein, 11 aa, Artificial Sequence
  Description of Artificial Sequence: Synthetic peptide
  Seed: SNQEEEGPSTF (MAGA3_HUMAN)
SLQEEEGPSTL

SEQ ID NO: 52827 - protein, 10 aa, Artificial Sequence
  Description of Artificial Sequence: Synthetic peptide
  Seed: RKVAELVHFL (MAGA3_HUMAN)
RFVAELVHFL

SEQ ID NO: 52828 - protein, 10 aa, Artificial Sequence
  Description of Artificial Sequence: Synthetic peptide
  Seed: ISYPPLHEWV (MAGA3_HUMAN)
IQYPPLHEWW

SEQ ID NO: 52829 - protein, 9 aa, Artificial Sequence
  Description of Artificial Sequence: Synthetic peptide
  Seed: ELVHFLLLK (MAGA3_HUMAN)
EMVHFLLLR

SEQ ID NO: 52830 - protein, 9 aa, Artificial Sequence
  Description of Artificial Sequence: Synthetic peptide
  Seed: AELVHFLLL (MAGA3_HUMAN)
AKLVHFLLF

SEQ ID NO: 52831 - protein, 10 aa, Artificial Sequence
  Description of Artificial Sequence: Synthetic peptide
  Seed: TLVEVTLGEV (MAGA3_HUMAN)
TVVEVTLGEV

SEQ ID NO: 52832 - protein, 11 aa, Artificial Sequence
  Description of Artificial Sequence: Synthetic peptide
  Seed: ELVHFLLLKYR (MAGA3_HUMAN)
EFVHFLLLKYR

SEQ ID NO: 52833 - protein, 9 aa, Artificial Sequence
  Description of Artificial Sequence: Synthetic peptide
  Seed: SSSSTLVEV (MAGA3_HUMAN)
SMSSTLVEV

SEQ ID NO: 52834 - protein, 10 aa, Artificial Sequence
  Description of Artificial Sequence: Synthetic peptide
  Seed: HISYPPLHEW (MAGA3_HUMAN)
HKSYPPLHEW

SEQ ID NO: 52835 - protein, 9 aa, Artificial Sequence
  Description of Artificial Sequence: Synthetic peptide
  Seed: SKASSSLQL (MAGA3_HUMAN)
SEASSSLQF

SEQ ID NO: 52836 - protein, 10 aa, Artificial Sequence
  Description of Artificial Sequence: Synthetic peptide
  Seed: STFPDLESEF (MAGA3_HUMAN)
SYFPDLESEI

SEQ ID NO: 52837 - protein, 9 aa, Artificial Sequence
  Description of Artificial Sequence: Synthetic peptide
  Seed: LESEFQAAL (MAGA3_HUMAN)
LQSEFQAAV

SEQ ID NO: 52838 - protein, 9 aa, Artificial Sequence
  Description of Artificial Sequence: Synthetic peptide
  Seed: SILGDPKKL (MAGA3_HUMAN)
SMLGDPKKV

SEQ ID NO: 52839 - protein, 9 aa, Artificial Sequence
  Description of Artificial Sequence: Synthetic peptide
  Seed: GASSLPTTM (MAGA3_HUMAN)
GYSSLPTTM

SEQ ID NO: 52840 - protein, 10 aa, Artificial Sequence
  Description of Artificial Sequence: Synthetic peptide
  Seed: LTQHFVQENY (MAGA3_HUMAN)
LMQHFVQENY

SEQ ID NO: 52841 - protein, 9 aa, Artificial Sequence
  Description of Artificial Sequence: Synthetic peptide
  Seed: LPTTMNYPL (MAGA3_HUMAN)
LATTMNYPW

SEQ ID NO: 52842 - protein, 9 aa, Artificial Sequence
  Description of Artificial Sequence: Synthetic peptide
  Seed: YIFATCLGL (MAGA3_HUMAN)
YLFATCLGL

SEQ ID NO: 52843 - protein, 10 aa, Artificial Sequence
  Description of Artificial Sequence: Synthetic peptide
  Seed: TEEQEAASSS (MAGA3_HUMAN)
TEEQEAASSL

SEQ ID NO: 52844 - protein, 9 aa, Artificial Sequence
  Description of Artificial Sequence: Synthetic peptide
  Seed: LSRKVAELV (MAGA3_HUMAN)
LVRKVAELW

SEQ ID NO: 52845 - protein, 9 aa, Artificial Sequence
  Description of Artificial Sequence: Synthetic peptide
  Seed: AQAPATEEQ (MAGA3_HUMAN)
AVAPATEEM

SEQ ID NO: 52846 - protein, 9 aa, Artificial Sequence
  Description of Artificial Sequence: Synthetic peptide
  Seed: SYPPLHEWV (MAGA3_HUMAN)
SWPPLHEWM

SEQ ID NO: 52847 - protein, 9 aa, Artificial Sequence
  Description of Artificial Sequence: Synthetic peptide
  Seed: LSRKVAELV (MAGA3_HUMAN)
LGRKVAELW

SEQ ID NO: 52848 - protein, 9 aa, Artificial Sequence
  Description of Artificial Sequence: Synthetic peptide
  Seed: YPLWSQSYE (MAGA3_HUMAN)
YALWSQSYM

SEQ ID NO: 52849 - protein, 9 aa, Artificial Sequence
  Description of Artificial Sequence: Synthetic peptide
  Seed: IMPKAGLLI (MAGA3_HUMAN)
ILPKAGLLF

SEQ ID NO: 52850 - protein, 9 aa, Artificial Sequence
  Description of Artificial Sequence: Synthetic peptide
  Seed: VKISGGPHI (MAGA3_HUMAN)
VSISGGPHF

SEQ ID NO: 52851 - protein, 9 aa, Artificial Sequence
  Description of Artificial Sequence: Synthetic peptide
  Seed: AEMLGSVVG (MAGA3_HUMAN)
ADMLGSVVA

SEQ ID NO: 52852 - protein, 9 aa, Artificial Sequence
  Description of Artificial Sequence: Synthetic peptide
  Seed: KIWEELSVL (MAGA3_HUMAN)
KAWEELSVF

SEQ ID NO: 52853 - protein, 9 aa, Artificial Sequence
  Description of Artificial Sequence: Synthetic peptide
  Seed: SVLEVFEGR (MAGA3_HUMAN)
SPLEVFEGR

SEQ ID NO: 52854 - protein, 9 aa, Artificial Sequence
  Description of Artificial Sequence: Synthetic peptide
  Seed: EVDPIGHLY (MAGA3_HUMAN)
EPDPIGHLW

SEQ ID NO: 52855 - protein, 9 aa, Artificial Sequence
  Description of Artificial Sequence: Synthetic peptide
  Seed: KASSSLQLV (MAGA3_HUMAN)
KLSSSLQLV

SEQ ID NO: 52856 - protein, 10 aa, Artificial Sequence
  Description of Artificial Sequence: Synthetic peptide
  Seed: KASSSLQLVF (MAGA3_HUMAN)
KVSSSLQLVM

SEQ ID NO: 52857 - protein, 10 aa, Artificial Sequence
  Description of Artificial Sequence: Synthetic peptide
  Seed: IFATCLGLSY (MAGA3_HUMAN)
IYATCLGLSY

SEQ ID NO: 52858 - protein, 9 aa, Artificial Sequence
  Description of Artificial Sequence: Synthetic peptide
  Seed: EVDPIGHLY (MAGA3_HUMAN)
EVDPIGHLM

SEQ ID NO: 52859 - protein, 9 aa, Artificial Sequence
  Description of Artificial Sequence: Synthetic peptide
  Seed: YPLWSQSYE (MAGA3_HUMAN)
YPLWSQSYW

SEQ ID NO: 52860 - protein, 9 aa, Artificial Sequence
  Description of Artificial Sequence: Synthetic peptide
  Seed: NYPLWSQSY (MAGA3_HUMAN)
NFPLWSQSV

SEQ ID NO: 52861 - protein, 9 aa, Artificial Sequence
  Description of Artificial Sequence: Synthetic peptide
  Seed: AASSSSTLV (MAGA3_HUMAN)
AVSSSSTLY

SEQ ID NO: 52862 - protein, 8 aa, Artificial Sequence
  Description of Artificial Sequence: Synthetic peptide
  Seed: FPDLESEF (MAGA3_HUMAN)
FIDLESEL

SEQ ID NO: 52863 - protein, 10 aa, Artificial Sequence
  Description of Artificial Sequence: Synthetic peptide
  Seed: LGSVVGNWQY (MAGA3_HUMAN)
LISVVGNWQW

SEQ ID NO: 52864 - protein, 9 aa, Artificial Sequence
  Description of Artificial Sequence: Synthetic peptide
  Seed: TSYVKVLHH (MAGA3_HUMAN)
TVYVKVLHY

SEQ ID NO: 52865 - protein, 9 aa, Artificial Sequence
  Description of Artificial Sequence: Synthetic peptide
  Seed: IFSKASSSL (MAGA3_HUMAN)
IWSKASSSF

SEQ ID NO: 52866 - protein, 9 aa, Artificial Sequence
  Description of Artificial Sequence: Synthetic peptide
  Seed: GSVVGNWQY (MAGA3_HUMAN)
GAVVGNWQW

SEQ ID NO: 52867 - protein, 11 aa, Artificial Sequence
  Description of Artificial Sequence: Synthetic peptide
  Seed: KIWEELSVLEV (MAGA3_HUMAN)
KMWEELSVLET

SEQ ID NO: 52868 - protein, 9 aa, Artificial Sequence
  Description of Artificial Sequence: Synthetic peptide
  Seed: YIFATCLGL (MAGA3_HUMAN)
YRFATCLGM

SEQ ID NO: 52869 - protein, 9 aa, Artificial Sequence
  Description of Artificial Sequence: Synthetic peptide
  Seed: RQVPGSDPA (MAGA3_HUMAN)
RLVPGSDPL

SEQ ID NO: 52870 - protein, 10 aa, Artificial Sequence
  Description of Artificial Sequence: Synthetic peptide
  Seed: WEELSVLEVF (MAGA3_HUMAN)
WCELSVLEVM

SEQ ID NO: 52871 - protein, 10 aa, Artificial Sequence
  Description of Artificial Sequence: Synthetic peptide
  Seed: MEVDPIGHLY (MAGA3_HUMAN)
MMVDPIGHLW

SEQ ID NO: 52872 - protein, 11 aa, Artificial Sequence
  Description of Artificial Sequence: Synthetic peptide
  Seed: SSSSTLVEVTL (MAGA3_HUMAN)
SSSSTLVEVTF

SEQ ID NO: 52873 - protein, 10 aa, Artificial Sequence
  Description of Artificial Sequence: Synthetic peptide
  Seed: ASSLPTTMNY (MAGA3_HUMAN)
ADSLPTTMNY

SEQ ID NO: 52874 - protein, 11 aa, Artificial Sequence
  Description of Artificial Sequence: Synthetic peptide
  Seed: EVFEGREDSIL (MAGA3_HUMAN)
ETFEGREDSIW

SEQ ID NO: 52875 - protein, 9 aa, Artificial Sequence
  Description of Artificial Sequence: Synthetic peptide
  Seed: QIMPKAGLL (MAGA3_HUMAN)
QAMPKAGLL

SEQ ID NO: 52876 - protein, 10 aa, Artificial Sequence
  Description of Artificial Sequence: Synthetic peptide
  Seed: ASSLPTTMNY (MAGA3_HUMAN)
ATSLPTTMNK

SEQ ID NO: 52877 - protein, 10 aa, Artificial Sequence
  Description of Artificial Sequence: Synthetic peptide
  Seed: AELVHFLLLK (MAGA3_HUMAN)
AWLVHFLLLK

SEQ ID NO: 52878 - protein, 10 aa, Artificial Sequence
  Description of Artificial Sequence: Synthetic peptide
  Seed: HISYPPLHEW (MAGA3_HUMAN)
HCSYPPLHEY

SEQ ID NO: 52879 - protein, 9 aa, Artificial Sequence
  Description of Artificial Sequence: Synthetic peptide
  Seed: SSLPTTMNY (MAGA3_HUMAN)
SGLPTTMNW

SEQ ID NO: 52880 - protein, 9 aa, Artificial Sequence
  Description of Artificial Sequence: Synthetic peptide
  Seed: SSTLVEVTL (MAGA3_HUMAN)
SPTLVEVTI

SEQ ID NO: 52881 - protein, 10 aa, Artificial Sequence
  Description of Artificial Sequence: Synthetic peptide
  Seed: STFPDLESEF (MAGA3_HUMAN)
SVFPDLESEY

SEQ ID NO: 52882 - protein, 11 aa, Artificial Sequence
  Description of Artificial Sequence: Synthetic peptide
  Seed: ISYPPLHEWVL (MAGA3_HUMAN)
ITYPPLHEWVY

SEQ ID NO: 52883 - protein, 9 aa, Artificial Sequence
  Description of Artificial Sequence: Synthetic peptide
  Seed: YIFATCLGL (MAGA3_HUMAN)
YMFATCLGL

SEQ ID NO: 52884 - protein, 8 aa, Artificial Sequence
  Description of Artificial Sequence: Synthetic peptide
  Seed: RALVETSY (MAGA3_HUMAN)
RMLVETSY

SEQ ID NO: 52885 - protein, 9 aa, Artificial Sequence
  Description of Artificial Sequence: Synthetic peptide
  Seed: EELSVLEVF (MAGA3_HUMAN)
EELSVLEVT

SEQ ID NO: 52886 - protein, 10 aa, Artificial Sequence
  Description of Artificial Sequence: Synthetic peptide
  Seed: LQLVFGIELM (MAGA3_HUMAN)
LALVFGIELV

SEQ ID NO: 52887 - protein, 10 aa, Artificial Sequence
  Description of Artificial Sequence: Synthetic peptide
  Seed: LPTTMNYPLW (MAGA3_HUMAN)
LPTTMNYPLL

SEQ ID NO: 52888 - protein, 10 aa, Artificial Sequence
  Description of Artificial Sequence: Synthetic peptide
  Seed: FLWGPRALVE (MAGA3_HUMAN)
FVWGPRALVV

SEQ ID NO: 52889 - protein, 9 aa, Artificial Sequence
  Description of Artificial Sequence: Synthetic peptide
  Seed: SSLPTTMNY (MAGA3_HUMAN)
SYLPTTMNV

SEQ ID NO: 52890 - protein, 9 aa, Artificial Sequence
  Description of Artificial Sequence: Synthetic peptide
  Seed: HEWVLREGE (MAGA3_HUMAN)
HEWVLREGP

SEQ ID NO: 52891 - protein, 10 aa, Artificial Sequence
  Description of Artificial Sequence: Synthetic peptide
  Seed: RKVAELVHFL (MAGA3_HUMAN)
RRVAELVHFL

SEQ ID NO: 52892 - protein, 9 aa, Artificial Sequence
  Description of Artificial Sequence: Synthetic peptide
  Seed: AELVHFLLL (MAGA3_HUMAN)
AHLVHFLLF

SEQ ID NO: 52893 - protein, 9 aa, Artificial Sequence
  Description of Artificial Sequence: Synthetic peptide
  Seed: GEVPAAESP (MAGA3_HUMAN)
GEVPAAEST

SEQ ID NO: 52894 - protein, 9 aa, Artificial Sequence
  Description of Artificial Sequence: Synthetic peptide
  Seed: FATCLGLSY (MAGA3_HUMAN)
FNTCLGLSY

SEQ ID NO: 52895 - protein, 10 aa, Artificial Sequence
  Description of Artificial Sequence: Synthetic peptide
  Seed: KAEMLGSVVG (MAGA3_HUMAN)
KFEMLGSVVV

SEQ ID NO: 52896 - protein, 9 aa, Artificial Sequence
  Description of Artificial Sequence: Synthetic peptide
  Seed: KVLHHMVKI (MAGA3_HUMAN)
KQLHHMVKA

SEQ ID NO: 52897 - protein, 9 aa, Artificial Sequence
  Description of Artificial Sequence: Synthetic peptide
  Seed: SVVGNWQYF (MAGA3_HUMAN)
SAVGNWQYY

SEQ ID NO: 52898 - protein, 9 aa, Artificial Sequence
  Description of Artificial Sequence: Synthetic peptide
  Seed: NQIMPKAGL (MAGA3_HUMAN)
NHIMPKAGL

SEQ ID NO: 52899 - protein, 10 aa, Artificial Sequence
  Description of Artificial Sequence: Synthetic peptide
  Seed: KISGGPHISY (MAGA3_HUMAN)
KLSGGPHISW

SEQ ID NO: 52900 - protein, 9 aa, Artificial Sequence
  Description of Artificial Sequence: Synthetic peptide
  Seed: LESEFQAAL (MAGA3_HUMAN)
LESEFQAAI

SEQ ID NO: 52901 - protein, 11 aa, Artificial Sequence
  Description of Artificial Sequence: Synthetic peptide
  Seed: AQAPATEEQEA (MAGA3_HUMAN)
AQAPATEEQEI

SEQ ID NO: 52902 - protein, 8 aa, Artificial Sequence
  Description of Artificial Sequence: Synthetic peptide
  Seed: SYPPLHEW (MAGA3_HUMAN)
SRPPLHEL

SEQ ID NO: 52903 - protein, 10 aa, Artificial Sequence
  Description of Artificial Sequence: Synthetic peptide
  Seed: VDPIGHLYIF (MAGA3_HUMAN)
VCPIGHLYIW

SEQ ID NO: 52904 - protein, 9 aa, Artificial Sequence
  Description of Artificial Sequence: Synthetic peptide
  Seed: FVQENYLEY (MAGA3_HUMAN)
FYQENYLEF

SEQ ID NO: 52905 - protein, 11 aa, Artificial Sequence
  Description of Artificial Sequence: Synthetic peptide
  Seed: AQAPATEEQEA (MAGA3_HUMAN)
AQAPATEEQEM

SEQ ID NO: 52906 - protein, 11 aa, Artificial Sequence
  Description of Artificial Sequence: Synthetic peptide
  Seed: HCKPEEGLEAR (MAGA3_HUMAN)
HSKPEEGLEAR

SEQ ID NO: 52907 - protein, 9 aa, Artificial Sequence
  Description of Artificial Sequence: Synthetic peptide
  Seed: GNWQYFFPV (MAGA3_HUMAN)
GLWQYFFPM

SEQ ID NO: 52908 - protein, 9 aa, Artificial Sequence
  Description of Artificial Sequence: Synthetic peptide
  Seed: YIFATCLGL (MAGA3_HUMAN)
YIFATCLGI

SEQ ID NO: 52909 - protein, 8 aa, Artificial Sequence
  Description of Artificial Sequence: Synthetic peptide
  Seed: FPDLESEF (MAGA3_HUMAN)
FGDLESEF

SEQ ID NO: 52910 - protein, 9 aa, Artificial Sequence
  Description of Artificial Sequence: Synthetic peptide
  Seed: KVLHHMVKI (MAGA3_HUMAN)
KLLHHMVKR

SEQ ID NO: 52911 - protein, 8 aa, Artificial Sequence
  Description of Artificial Sequence: Synthetic peptide
  Seed: SYPPLHEW (MAGA3_HUMAN)
SRPPLHEF

SEQ ID NO: 52912 - protein, 9 aa, Artificial Sequence
  Description of Artificial Sequence: Synthetic peptide
  Seed: VFGIELMEV (MAGA3_HUMAN)
VYGIELMEL

SEQ ID NO: 52913 - protein, 11 aa, Artificial Sequence
  Description of Artificial Sequence: Synthetic peptide
  Seed: SYPPLHEWVLR (MAGA3_HUMAN)
SWPPLHEWVLF

SEQ ID NO: 52914 - protein, 10 aa, Artificial Sequence
  Description of Artificial Sequence: Synthetic peptide
  Seed: HISYPPLHEW (MAGA3_HUMAN)
HYSYPPLHEM

SEQ ID NO: 52915 - protein, 10 aa, Artificial Sequence
  Description of Artificial Sequence: Synthetic peptide
  Seed: FLWGPRALVE (MAGA3_HUMAN)
FLWGPRALVR

SEQ ID NO: 52916 - protein, 11 aa, Artificial Sequence
  Description of Artificial Sequence: Synthetic peptide
  Seed: SEFQAALSRKV (MAGA3_HUMAN)
SEFQAALSRKL

SEQ ID NO: 52917 - protein, 10 aa, Artificial Sequence
  Description of Artificial Sequence: Synthetic peptide
  Seed: KVAELVHFLL (MAGA3_HUMAN)
KMAELVHFLV

SEQ ID NO: 52918 - protein, 9 aa, Artificial Sequence
  Description of Artificial Sequence: Synthetic peptide
  Seed: SSLPTTMNY (MAGA3_HUMAN)
STLPTTMNI

SEQ ID NO: 52919 - protein, 9 aa, Artificial Sequence
  Description of Artificial Sequence: Synthetic peptide
  Seed: YFFPVIFSK (MAGA3_HUMAN)
YVFPVIFSL

SEQ ID NO: 52920 - protein, 9 aa, Artificial Sequence
  Description of Artificial Sequence: Synthetic peptide
  Seed: GASSLPTTM (MAGA3_HUMAN)
GTSSLPTTI

SEQ ID NO: 52921 - protein, 10 aa, Artificial Sequence
  Description of Artificial Sequence: Synthetic peptide
  Seed: TSYVKVLHHM (MAGA3_HUMAN)
TGYVKVLHHL

SEQ ID NO: 52922 - protein, 10 aa, Artificial Sequence
  Description of Artificial Sequence: Synthetic peptide
  Seed: VTKAEMLGSV (MAGA3_HUMAN)
VMKAEMLGSA

SEQ ID NO: 52923 - protein, 9 aa, Artificial Sequence
  Description of Artificial Sequence: Synthetic peptide
  Seed: FATCLGLSY (MAGA3_HUMAN)
FQTCLGLSH

SEQ ID NO: 52924 - protein, 9 aa, Artificial Sequence
  Description of Artificial Sequence: Synthetic peptide
  Seed: ISYPPLHEW (MAGA3_HUMAN)
IAYPPLHEV

SEQ ID NO: 52925 - protein, 9 aa, Artificial Sequence
  Description of Artificial Sequence: Synthetic peptide
  Seed: VVGNWQYFF (MAGA3_HUMAN)
VSGNWQYFF

SEQ ID NO: 52926 - protein, 10 aa, Artificial Sequence
  Description of Artificial Sequence: Synthetic peptide
  Seed: KISGGPHISY (MAGA3_HUMAN)
KRSGGPHISF

SEQ ID NO: 52927 - protein, 10 aa, Artificial Sequence
  Description of Artificial Sequence: Synthetic peptide
  Seed: GSDPACYEFL (MAGA3_HUMAN)
GADPACYEFM

SEQ ID NO: 52928 - protein, 9 aa, Artificial Sequence
  Description of Artificial Sequence: Synthetic peptide
  Seed: ISYPPLHEW (MAGA3_HUMAN)
ISYPPLHEV

SEQ ID NO: 52929 - protein, 10 aa, Artificial Sequence
  Description of Artificial Sequence: Synthetic peptide
  Seed: QYFFPVIFSK (MAGA3_HUMAN)
QDFFPVIFSR

SEQ ID NO: 52930 - protein, 9 aa, Artificial Sequence
  Description of Artificial Sequence: Synthetic peptide
  Seed: SVVGNWQYF (MAGA3_HUMAN)
SYVGNWQYW

SEQ ID NO: 52931 - protein, 11 aa, Artificial Sequence
  Description of Artificial Sequence: Synthetic peptide
  Seed: SSLPTTMNYPL (MAGA3_HUMAN)
SPLPTTMNYPM

SEQ ID NO: 52932 - protein, 10 aa, Artificial Sequence
  Description of Artificial Sequence: Synthetic peptide
  Seed: YFFPVIFSKA (MAGA3_HUMAN)
YIFPVIFSKL

SEQ ID NO: 52933 - protein, 10 aa, Artificial Sequence
  Description of Artificial Sequence: Synthetic peptide
  Seed: MNYPLWSQSY (MAGA3_HUMAN)
MFYPLWSQSM

SEQ ID NO: 52934 - protein, 9 aa, Artificial Sequence
  Description of Artificial Sequence: Synthetic peptide
  Seed: VVGNWQYFF (MAGA3_HUMAN)
VWGNWQYFW

SEQ ID NO: 52935 - protein, 9 aa, Artificial Sequence
  Description of Artificial Sequence: Synthetic peptide
  Seed: SSTLVEVTL (MAGA3_HUMAN)
SETLVEVTL

SEQ ID NO: 52936 - protein, 9 aa, Artificial Sequence
  Description of Artificial Sequence: Synthetic peptide
  Seed: RALVETSYV (MAGA3_HUMAN)
RVLVETSYV

SEQ ID NO: 52937 - protein, 10 aa, Artificial Sequence
  Description of Artificial Sequence: Synthetic peptide
  Seed: EVFEGREDSI (MAGA3_HUMAN)
EAFEGREDSR

SEQ ID NO: 52938 - protein, 9 aa, Artificial Sequence
  Description of Artificial Sequence: Synthetic peptide
  Seed: VAELVHFLL (MAGA3_HUMAN)
VTELVHFLW

SEQ ID NO: 52939 - protein, 10 aa, Artificial Sequence
  Description of Artificial Sequence: Synthetic peptide
  Seed: SDPACYEFLW (MAGA3_HUMAN)
SAPACYEFLW

SEQ ID NO: 52940 - protein, 9 aa, Artificial Sequence
  Description of Artificial Sequence: Synthetic peptide
  Seed: QLVFGIELM (MAGA3_HUMAN)
QMVFGIELF

SEQ ID NO: 52941 - protein, 8 aa, Artificial Sequence
  Description of Artificial Sequence: Synthetic peptide
  Seed: YVKVLHHM (MAGA3_HUMAN)
YAKVLHHF

SEQ ID NO: 52942 - protein, 10 aa, Artificial Sequence
  Description of Artificial Sequence: Synthetic peptide
  Seed: KASSSLQLVF (MAGA3_HUMAN)
KQSSSLQLVM

SEQ ID NO: 52943 - protein, 8 aa, Artificial Sequence
  Description of Artificial Sequence: Synthetic peptide
  Seed: WQYFFPVI (MAGA3_HUMAN)
WQYFFPVM

SEQ ID NO: 52944 - protein, 10 aa, Artificial Sequence
  Description of Artificial Sequence: Synthetic peptide
  Seed: LGLVGAQAPA (MAGA3_HUMAN)
LGLVGAQAPV

SEQ ID NO: 52945 - protein, 10 aa, Artificial Sequence
  Description of Artificial Sequence: Synthetic peptide
  Seed: AELVHFLLLK (MAGA3_HUMAN)
AHLVHFLLLK

SEQ ID NO: 52946 - protein, 9 aa, Artificial Sequence
  Description of Artificial Sequence: Synthetic peptide
  Seed: YIFATCLGL (MAGA3_HUMAN)
YWFATCLGM

SEQ ID NO: 52947 - protein, 9 aa, Artificial Sequence
  Description of Artificial Sequence: Synthetic peptide
  Seed: AQAPATEEQ (MAGA3_HUMAN)
AKAPATEEY

SEQ ID NO: 52948 - protein, 10 aa, Artificial Sequence
  Description of Artificial Sequence: Synthetic peptide
  Seed: WEELSVLEVF (MAGA3_HUMAN)
WCELSVLEVW

SEQ ID NO: 52949 - protein, 10 aa, Artificial Sequence
  Description of Artificial Sequence: Synthetic peptide
  Seed: KVAELVHFLL (MAGA3_HUMAN)
KMAELVHFLT

SEQ ID NO: 52950 - protein, 8 aa, Artificial Sequence
  Description of Artificial Sequence: Synthetic peptide
  Seed: FPDLESEF (MAGA3_HUMAN)
FPDLESEY

SEQ ID NO: 52951 - protein, 11 aa, Artificial Sequence
  Description of Artificial Sequence: Synthetic peptide
  Seed: RQVPGSDPACY (MAGA3_HUMAN)
RMVPGSDPACL

SEQ ID NO: 52952 - protein, 9 aa, Artificial Sequence
  Description of Artificial Sequence: Synthetic peptide
  Seed: SSLPTTMNY (MAGA3_HUMAN)
SILPTTMNW

SEQ ID NO: 52953 - protein, 10 aa, Artificial Sequence
  Description of Artificial Sequence: Synthetic peptide
  Seed: RQVPGSDPAC (MAGA3_HUMAN)
RLVPGSDPAM

SEQ ID NO: 52954 - protein, 11 aa, Artificial Sequence
  Description of Artificial Sequence: Synthetic peptide
  Seed: YIFATCLGLSY (MAGA3_HUMAN)
YMFATCLGLSF

SEQ ID NO: 52955 - protein, 10 aa, Artificial Sequence
  Description of Artificial Sequence: Synthetic peptide
  Seed: FLWGPRALVE (MAGA3_HUMAN)
FMWGPRALVD

SEQ ID NO: 52956 - protein, 10 aa, Artificial Sequence
  Description of Artificial Sequence: Synthetic peptide
  Seed: MNYPLWSQSY (MAGA3_HUMAN)
MVYPLWSQSV

SEQ ID NO: 52957 - protein, 11 aa, Artificial Sequence
  Description of Artificial Sequence: Synthetic peptide
  Seed: KVAELVHFLLL (MAGA3_HUMAN)
KLAELVHFLLM

SEQ ID NO: 52958 - protein, 9 aa, Artificial Sequence
  Description of Artificial Sequence: Synthetic peptide
  Seed: TQHFVQENY (MAGA3_HUMAN)
TQHFVQENM

SEQ ID NO: 52959 - protein, 9 aa, Artificial Sequence
  Description of Artificial Sequence: Synthetic peptide
  Seed: FVQENYLEY (MAGA3_HUMAN)
FKQENYLEY

SEQ ID NO: 52960 - protein, 9 aa, Artificial Sequence
  Description of Artificial Sequence: Synthetic peptide
  Seed: ALSRKVAEL (MAGA3_HUMAN)
ASSRKVAEY

SEQ ID NO: 52961 - protein, 10 aa, Artificial Sequence
  Description of Artificial Sequence: Synthetic peptide
  Seed: TSYVKVLHHM (MAGA3_HUMAN)
TCYVKVLHHF

SEQ ID NO: 52962 - protein, 9 aa, Artificial Sequence
  Description of Artificial Sequence: Synthetic peptide
  Seed: MPLEQRSQH (MAGA3_HUMAN)
MPLEQRSQI

SEQ ID NO: 52963 - protein, 9 aa, Artificial Sequence
  Description of Artificial Sequence: Synthetic peptide
  Seed: RALVETSYV (MAGA3_HUMAN)
RVLVETSYY

SEQ ID NO: 52964 - protein, 9 aa, Artificial Sequence
  Description of Artificial Sequence: Synthetic peptide
  Seed: SPDPPQSPQ (MAGA3_HUMAN)
SPDPPQSPM

SEQ ID NO: 52965 - protein, 9 aa, Artificial Sequence
  Description of Artificial Sequence: Synthetic peptide
  Seed: KVLHHMVKI (MAGA3_HUMAN)
KQLHHMVKR

SEQ ID NO: 52966 - protein, 9 aa, Artificial Sequence
  Description of Artificial Sequence: Synthetic peptide
  Seed: VKISGGPHI (MAGA3_HUMAN)
VIISGGPHF

SEQ ID NO: 52967 - protein, 10 aa, Artificial Sequence
  Description of Artificial Sequence: Synthetic peptide
  Seed: ISYPPLHEWV (MAGA3_HUMAN)
ITYPPLHEWI

SEQ ID NO: 52968 - protein, 10 aa, Artificial Sequence
  Description of Artificial Sequence: Synthetic peptide
  Seed: VIFSKASSSL (MAGA3_HUMAN)
VLFSKASSSF

SEQ ID NO: 52969 - protein, 10 aa, Artificial Sequence
  Description of Artificial Sequence: Synthetic peptide
  Seed: ISYPPLHEWV (MAGA3_HUMAN)
ISYPPLHEWI

SEQ ID NO: 52970 - protein, 10 aa, Artificial Sequence
  Description of Artificial Sequence: Synthetic peptide
  Seed: LVFGIELMEV (MAGA3_HUMAN)
LQFGIELMEV

SEQ ID NO: 52971 - protein, 9 aa, Artificial Sequence
  Description of Artificial Sequence: Synthetic peptide
  Seed: FPVIFSKAS (MAGA3_HUMAN)
FPVIFSKAA

SEQ ID NO: 52972 - protein, 9 aa, Artificial Sequence
  Description of Artificial Sequence: Synthetic peptide
  Seed: FLWGPRALV (MAGA3_HUMAN)
FSWGPRALY

SEQ ID NO: 52973 - protein, 9 aa, Artificial Sequence
  Description of Artificial Sequence: Synthetic peptide
  Seed: TFPDLESEF (MAGA3_HUMAN)
TYPDLESEW

SEQ ID NO: 52974 - protein, 9 aa, Artificial Sequence
  Description of Artificial Sequence: Synthetic peptide
  Seed: LVHFLLLKY (MAGA3_HUMAN)
LLHFLLLKY

SEQ ID NO: 52975 - protein, 9 aa, Artificial Sequence
  Description of Artificial Sequence: Synthetic peptide
  Seed: NYPLWSQSY (MAGA3_HUMAN)
NAPLWSQSF

SEQ ID NO: 52976 - protein, 10 aa, Artificial Sequence
  Description of Artificial Sequence: Synthetic peptide
  Seed: TSYVKVLHHM (MAGA3_HUMAN)
TVYVKVLHHL

SEQ ID NO: 52977 - protein, 9 aa, Artificial Sequence
  Description of Artificial Sequence: Synthetic peptide
  Seed: SVVGNWQYF (MAGA3_HUMAN)
STVGNWQYW

SEQ ID NO: 52978 - protein, 9 aa, Artificial Sequence
  Description of Artificial Sequence: Synthetic peptide
  Seed: NQIMPKAGL (MAGA3_HUMAN)
NMIMPKAGF

SEQ ID NO: 52979 - protein, 9 aa, Artificial Sequence
  Description of Artificial Sequence: Synthetic peptide
  Seed: SSLPTTMNY (MAGA3_HUMAN)
SQLPTTMNL

SEQ ID NO: 52980 - protein, 10 aa, Artificial Sequence
  Description of Artificial Sequence: Synthetic peptide
  Seed: SLQLVFGIEL (MAGA3_HUMAN)
SIQLVFGIEF

SEQ ID NO: 52981 - protein, 10 aa, Artificial Sequence
  Description of Artificial Sequence: Synthetic peptide
  Seed: KASSSLQLVF (MAGA3_HUMAN)
KCSSSLQLVY

SEQ ID NO: 52982 - protein, 9 aa, Artificial Sequence
  Description of Artificial Sequence: Synthetic peptide
  Seed: LESEFQAAL (MAGA3_HUMAN)
LISEFQAAA

SEQ ID NO: 52983 - protein, 9 aa, Artificial Sequence
  Description of Artificial Sequence: Synthetic peptide
  Seed: LGDPKKLLT (MAGA3_HUMAN)
LWDPKKLLL

SEQ ID NO: 52984 - protein, 9 aa, Artificial Sequence
  Description of Artificial Sequence: Synthetic peptide
  Seed: ALGLVGAQA (MAGA3_HUMAN)
AIGLVGAQV

SEQ ID NO: 52985 - protein, 10 aa, Artificial Sequence
  Description of Artificial Sequence: Synthetic peptide
  Seed: VIFSKASSSL (MAGA3_HUMAN)
VQFSKASSSL

SEQ ID NO: 52986 - protein, 9 aa, Artificial Sequence
  Description of Artificial Sequence: Synthetic peptide
  Seed: HLYIFATCL (MAGA3_HUMAN)
HIYIFATCF

SEQ ID NO: 52987 - protein, 9 aa, Artificial Sequence
  Description of Artificial Sequence: Synthetic peptide
  Seed: NWQYFFPVI (MAGA3_HUMAN)
NYQYFFPVI

SEQ ID NO: 52988 - protein, 10 aa, Artificial Sequence
  Description of Artificial Sequence: Synthetic peptide
  Seed: YLEYRQVPGS (MAGA3_HUMAN)
YIEYRQVPGV

SEQ ID NO: 52989 - protein, 9 aa, Artificial Sequence
  Description of Artificial Sequence: Synthetic peptide
  Seed: EEQEAASSS (MAGA3_HUMAN)
EEQEAASSP

SEQ ID NO: 52990 - protein, 10 aa, Artificial Sequence
  Description of Artificial Sequence: Synthetic peptide
  Seed: LYIFATCLGL (MAGA3_HUMAN)
LVIFATCLGV

SEQ ID NO: 52991 - protein, 9 aa, Artificial Sequence
  Description of Artificial Sequence: Synthetic peptide
  Seed: KAGLLIIVL (MAGA3_HUMAN)
KSGLLIIVF

SEQ ID NO: 52992 - protein, 9 aa, Artificial Sequence
  Description of Artificial Sequence: Synthetic peptide
  Seed: YFFPVIFSK (MAGA3_HUMAN)
YCFPVIFSR

SEQ ID NO: 52993 - protein, 9 aa, Artificial Sequence
  Description of Artificial Sequence: Synthetic peptide
  Seed: KVAELVHFL (MAGA3_HUMAN)
KVAELVHFT

SEQ ID NO: 52994 - protein, 9 aa, Artificial Sequence
  Description of Artificial Sequence: Synthetic peptide
  Seed: AESPDPPQS (MAGA3_HUMAN)
AESPDPPQL

SEQ ID NO: 52995 - protein, 9 aa, Artificial Sequence
  Description of Artificial Sequence: Synthetic peptide
  Seed: SEFQAALSR (MAGA3_HUMAN)
SVFQAALSK

SEQ ID NO: 52996 - protein, 11 aa, Artificial Sequence
  Description of Artificial Sequence: Synthetic peptide
  Seed: SKASSSLQLVF (MAGA3_HUMAN)
SWASSSLQLVW

SEQ ID NO: 52997 - protein, 10 aa, Artificial Sequence
  Description of Artificial Sequence: Synthetic peptide
  Seed: ETSYVKVLHH (MAGA3_HUMAN)
ESSYVKVLHR

SEQ ID NO: 52998 - protein, 8 aa, Artificial Sequence
  Description of Artificial Sequence: Synthetic peptide
  Seed: EELSVLEV (MAGA3_HUMAN)
EQLSVLEV

SEQ ID NO: 52999 - protein, 9 aa, Artificial Sequence
  Description of Artificial Sequence: Synthetic peptide
  Seed: RQVPGSDPA (MAGA3_HUMAN)
RIVPGSDPW

SEQ ID NO: 53000 - protein, 10 aa, Artificial Sequence
  Description of Artificial Sequence: Synthetic peptide
  Seed: STFPDLESEF (MAGA3_HUMAN)
SSFPDLESEL

SEQ ID NO: 53001 - protein, 10 aa, Artificial Sequence
  Description of Artificial Sequence: Synthetic peptide
  Seed: IFATCLGLSY (MAGA3_HUMAN)
IHATCLGLSF

SEQ ID NO: 53002 - protein, 10 aa, Artificial Sequence
  Description of Artificial Sequence: Synthetic peptide
  Seed: LGSVVGNWQY (MAGA3_HUMAN)
LKSVVGNWQF

SEQ ID NO: 53003 - protein, 10 aa, Artificial Sequence
  Description of Artificial Sequence: Synthetic peptide
  Seed: YFFPVIFSKA (MAGA3_HUMAN)
YVFPVIFSKV

SEQ ID NO: 53004 - protein, 10 aa, Artificial Sequence
  Description of Artificial Sequence: Synthetic peptide
  Seed: KVAELVHFLL (MAGA3_HUMAN)
KIAELVHFLP

SEQ ID NO: 53005 - protein, 10 aa, Artificial Sequence
  Description of Artificial Sequence: Synthetic peptide
  Seed: KASSSLQLVF (MAGA3_HUMAN)
KGSSSLQLVF

SEQ ID NO: 53006 - protein, 9 aa, Artificial Sequence
  Description of Artificial Sequence: Synthetic peptide
  Seed: YIFATCLGL (MAGA3_HUMAN)
YFFATCLGM

SEQ ID NO: 53007 - protein, 11 aa, Artificial Sequence
  Description of Artificial Sequence: Synthetic peptide
  Seed: SYPPLHEWVLR (MAGA3_HUMAN)
SFPPLHEWVLW

SEQ ID NO: 53008 - protein, 9 aa, Artificial Sequence
  Description of Artificial Sequence: Synthetic peptide
  Seed: EFQAALSRK (MAGA3_HUMAN)
EVQAALSRK

SEQ ID NO: 53009 - protein, 10 aa, Artificial Sequence
  Description of Artificial Sequence: Synthetic peptide
  Seed: GNWQYFFPVI (MAGA3_HUMAN)
GYWQYFFPVF

SEQ ID NO: 53010 - protein, 10 aa, Artificial Sequence
  Description of Artificial Sequence: Synthetic peptide
  Seed: KASSSLQLVF (MAGA3_HUMAN)
KKSSSLQLVM

SEQ ID NO: 53011 - protein, 9 aa, Artificial Sequence
  Description of Artificial Sequence: Synthetic peptide
  Seed: LESEFQAAL (MAGA3_HUMAN)
LDSEFQAAF

SEQ ID NO: 53012 - protein, 10 aa, Artificial Sequence
  Description of Artificial Sequence: Synthetic peptide
  Seed: WEELSVLEVF (MAGA3_HUMAN)
WFELSVLEVM

SEQ ID NO: 53013 - protein, 10 aa, Artificial Sequence
  Description of Artificial Sequence: Synthetic peptide
  Seed: RKVAELVHFL (MAGA3_HUMAN)
RYVAELVHFL

SEQ ID NO: 53014 - protein, 9 aa, Artificial Sequence
  Description of Artificial Sequence: Synthetic peptide
  Seed: VDPIGHLYI (MAGA3_HUMAN)
VAPIGHLYL

SEQ ID NO: 53015 - protein, 10 aa, Artificial Sequence
  Description of Artificial Sequence: Synthetic peptide
  Seed: SEFQAALSRK (MAGA3_HUMAN)
SSFQAALSRR

SEQ ID NO: 53016 - protein, 9 aa, Artificial Sequence
  Description of Artificial Sequence: Synthetic peptide
  Seed: ISGGPHISY (MAGA3_HUMAN)
ITGGPHISY

SEQ ID NO: 53017 - protein, 9 aa, Artificial Sequence
  Description of Artificial Sequence: Synthetic peptide
  Seed: FVQENYLEY (MAGA3_HUMAN)
FLQENYLEI

SEQ ID NO: 53018 - protein, 10 aa, Artificial Sequence
  Description of Artificial Sequence: Synthetic peptide
  Seed: MNYPLWSQSY (MAGA3_HUMAN)
MCYPLWSQSI

SEQ ID NO: 53019 - protein, 9 aa, Artificial Sequence
  Description of Artificial Sequence: Synthetic peptide
  Seed: ISYPPLHEW (MAGA3_HUMAN)
IWYPPLHEW

SEQ ID NO: 53020 - protein, 10 aa, Artificial Sequence
  Description of Artificial Sequence: Synthetic peptide
  Seed: KASSSLQLVF (MAGA3_HUMAN)
KYSSSLQLVW

SEQ ID NO: 53021 - protein, 9 aa, Artificial Sequence
  Description of Artificial Sequence: Synthetic peptide
  Seed: EVTLGEVPA (MAGA3_HUMAN)
EITLGEVPV

SEQ ID NO: 53022 - protein, 10 aa, Artificial Sequence
  Description of Artificial Sequence: Synthetic peptide
  Seed: FSKASSSLQL (MAGA3_HUMAN)
FVKASSSLQW

SEQ ID NO: 53023 - protein, 9 aa, Artificial Sequence
  Description of Artificial Sequence: Synthetic peptide
  Seed: LESEFQAAL (MAGA3_HUMAN)
LTSEFQAAF

SEQ ID NO: 53024 - protein, 9 aa, Artificial Sequence
  Description of Artificial Sequence: Synthetic peptide
  Seed: RKVAELVHF (MAGA3_HUMAN)
RKVAELVHL

SEQ ID NO: 53025 - protein, 9 aa, Artificial Sequence
  Description of Artificial Sequence: Synthetic peptide
  Seed: SSLPTTMNY (MAGA3_HUMAN)
SRLPTTMNI

SEQ ID NO: 53026 - protein, 10 aa, Artificial Sequence
  Description of Artificial Sequence: Synthetic peptide
  Seed: QEEEGPSTFP (MAGA3_HUMAN)
QEEEGPSTFI

SEQ ID NO: 53027 - protein, 9 aa, Artificial Sequence
  Description of Artificial Sequence: Synthetic peptide
  Seed: SVVGNWQYF (MAGA3_HUMAN)
SSVGNWQYR

SEQ ID NO: 53028 - protein, 9 aa, Artificial Sequence
  Description of Artificial Sequence: Synthetic peptide
  Seed: VVGNWQYFF (MAGA3_HUMAN)
VYGNWQYFF

SEQ ID NO: 53029 - protein, 9 aa, Artificial Sequence
  Description of Artificial Sequence: Synthetic peptide
  Seed: KVAELVHFL (MAGA3_HUMAN)
KWAELVHFF

SEQ ID NO: 53030 - protein, 10 aa, Artificial Sequence
  Description of Artificial Sequence: Synthetic peptide
  Seed: LQLVFGIELM (MAGA3_HUMAN)
LVLVFGIELV

SEQ ID NO: 53031 - protein, 10 aa, Artificial Sequence
  Description of Artificial Sequence: Synthetic peptide
  Seed: NWQYFFPVIF (MAGA3_HUMAN)
NKQYFFPVIM

SEQ ID NO: 53032 - protein, 9 aa, Artificial Sequence
  Description of Artificial Sequence: Synthetic peptide
  Seed: HEWVLREGE (MAGA3_HUMAN)
HEWVLREGL

SEQ ID NO: 53033 - protein, 10 aa, Artificial Sequence
  Description of Artificial Sequence: Synthetic peptide
  Seed: AELVHFLLLK (MAGA3_HUMAN)
AVLVHFLLLK

SEQ ID NO: 53034 - protein, 10 aa, Artificial Sequence
  Description of Artificial Sequence: Synthetic peptide
  Seed: WEELSVLEVF (MAGA3_HUMAN)
WIELSVLEVL

SEQ ID NO: 53035 - protein, 9 aa, Artificial Sequence
  Description of Artificial Sequence: Synthetic peptide
  Seed: LGDPKKLLT (MAGA3_HUMAN)
LQDPKKLLI

SEQ ID NO: 53036 - protein, 9 aa, Artificial Sequence
  Description of Artificial Sequence: Synthetic peptide
  Seed: SILGDPKKL (MAGA3_HUMAN)
SVLGDPKKV

SEQ ID NO: 53037 - protein, 10 aa, Artificial Sequence
  Description of Artificial Sequence: Synthetic peptide
  Seed: MEVDPIGHLY (MAGA3_HUMAN)
MVVDPIGHLY

SEQ ID NO: 53038 - protein, 10 aa, Artificial Sequence
  Description of Artificial Sequence: Synthetic peptide
  Seed: YIFATCLGLS (MAGA3_HUMAN)
YLFATCLGLF

SEQ ID NO: 53039 - protein, 10 aa, Artificial Sequence
  Description of Artificial Sequence: Synthetic peptide
  Seed: MEVDPIGHLY (MAGA3_HUMAN)
MAVDPIGHLY

SEQ ID NO: 53040 - protein, 9 aa, Artificial Sequence
  Description of Artificial Sequence: Synthetic peptide
  Seed: KVLHHMVKI (MAGA3_HUMAN)
KLLHHMVKT

SEQ ID NO: 53041 - protein, 9 aa, Artificial Sequence
  Description of Artificial Sequence: Synthetic peptide
  Seed: WQYFFPVIF (MAGA3_HUMAN)
WEYFFPVIH

SEQ ID NO: 53042 - protein, 9 aa, Artificial Sequence
  Description of Artificial Sequence: Synthetic peptide
  Seed: QLVFGIELM (MAGA3_HUMAN)
QAVFGIELF

SEQ ID NO: 53043 - protein, 9 aa, Artificial Sequence
  Description of Artificial Sequence: Synthetic peptide
  Seed: YIFATCLGL (MAGA3_HUMAN)
YMFATCLGV

SEQ ID NO: 53044 - protein, 10 aa, Artificial Sequence
  Description of Artificial Sequence: Synthetic peptide
  Seed: MNYPLWSQSY (MAGA3_HUMAN)
MQYPLWSQSI

SEQ ID NO: 53045 - protein, 9 aa, Artificial Sequence
  Description of Artificial Sequence: Synthetic peptide
  Seed: EALGLVGAQ (MAGA3_HUMAN)
EMLGLVGAK

SEQ ID NO: 53046 - protein, 10 aa, Artificial Sequence
  Description of Artificial Sequence: Synthetic peptide
  Seed: ASSSLQLVFG (MAGA3_HUMAN)
AWSSLQLVFW

SEQ ID NO: 53047 - protein, 9 aa, Artificial Sequence
  Description of Artificial Sequence: Synthetic peptide
  Seed: SSLPTTMNY (MAGA3_HUMAN)
SMLPTTMNW

SEQ ID NO: 53048 - protein, 9 aa, Artificial Sequence
  Description of Artificial Sequence: Synthetic peptide
  Seed: IFSKASSSL (MAGA3_HUMAN)
IASKASSSL

SEQ ID NO: 53049 - protein, 10 aa, Artificial Sequence
  Description of Artificial Sequence: Synthetic peptide
  Seed: MEVDPIGHLY (MAGA3_HUMAN)
MMVDPIGHLR

SEQ ID NO: 53050 - protein, 11 aa, Artificial Sequence
  Description of Artificial Sequence: Synthetic peptide
  Seed: TLVEVTLGEVP (MAGA3_HUMAN)
TMVEVTLGEVV

SEQ ID NO: 53051 - protein, 9 aa, Artificial Sequence
  Description of Artificial Sequence: Synthetic peptide
  Seed: REGDCAPEE (MAGA3_HUMAN)
REGDCAPEA

SEQ ID NO: 53052 - protein, 9 aa, Artificial Sequence
  Description of Artificial Sequence: Synthetic peptide
  Seed: KIWEELSVL (MAGA3_HUMAN)
KNWEELSVY

SEQ ID NO: 53053 - protein, 9 aa, Artificial Sequence
  Description of Artificial Sequence: Synthetic peptide
  Seed: ISGGPHISY (MAGA3_HUMAN)
IVGGPHISM

SEQ ID NO: 53054 - protein, 10 aa, Artificial Sequence
  Description of Artificial Sequence: Synthetic peptide
  Seed: ASSSLQLVFG (MAGA3_HUMAN)
AYSSLQLVFW

SEQ ID NO: 53055 - protein, 10 aa, Artificial Sequence
  Description of Artificial Sequence: Synthetic peptide
  Seed: SEFQAALSRK (MAGA3_HUMAN)
SEFQAALSRW

SEQ ID NO: 53056 - protein, 9 aa, Artificial Sequence
  Description of Artificial Sequence: Synthetic peptide
  Seed: MEVDPIGHL (MAGA3_HUMAN)
MMVDPIGHF

SEQ ID NO: 53057 - protein, 11 aa, Artificial Sequence
  Description of Artificial Sequence: Synthetic peptide
  Seed: LGSVVGNWQYF (MAGA3_HUMAN)
LSSVVGNWQYF

SEQ ID NO: 53058 - protein, 10 aa, Artificial Sequence
  Description of Artificial Sequence: Synthetic peptide
  Seed: AESPDPPQSP (MAGA3_HUMAN)
AESPDPPQSC

SEQ ID NO: 53059 - protein, 9 aa, Artificial Sequence
  Description of Artificial Sequence: Synthetic peptide
  Seed: IMPKAGLLI (MAGA3_HUMAN)
ISPKAGLLF

SEQ ID NO: 53060 - protein, 9 aa, Artificial Sequence
  Description of Artificial Sequence: Synthetic peptide
  Seed: TFPDLESEF (MAGA3_HUMAN)
TVPDLESEL

SEQ ID NO: 53061 - protein, 9 aa, Artificial Sequence
  Description of Artificial Sequence: Synthetic peptide
  Seed: EVDPIGHLY (MAGA3_HUMAN)
EGDPIGHLV

SEQ ID NO: 53062 - protein, 11 aa, Artificial Sequence
  Description of Artificial Sequence: Synthetic peptide
  Seed: RQVPGSDPACY (MAGA3_HUMAN)
RVVPGSDPACW

SEQ ID NO: 53063 - protein, 9 aa, Artificial Sequence
  Description of Artificial Sequence: Synthetic peptide
  Seed: KASSSLQLV (MAGA3_HUMAN)
KGSSSLQLW

SEQ ID NO: 53064 - protein, 10 aa, Artificial Sequence
  Description of Artificial Sequence: Synthetic peptide
  Seed: MEVDPIGHLY (MAGA3_HUMAN)
MMVDPIGHLK

SEQ ID NO: 53065 - protein, 9 aa, Artificial Sequence
  Description of Artificial Sequence: Synthetic peptide
  Seed: AELVHFLLL (MAGA3_HUMAN)
AELVHFLLF

SEQ ID NO: 53066 - protein, 10 aa, Artificial Sequence
  Description of Artificial Sequence: Synthetic peptide
  Seed: MNYPLWSQSY (MAGA3_HUMAN)
MDYPLWSQSL

SEQ ID NO: 53067 - protein, 10 aa, Artificial Sequence
  Description of Artificial Sequence: Synthetic peptide
  Seed: KAEMLGSVVG (MAGA3_HUMAN)
KEEMLGSVVV

SEQ ID NO: 53068 - protein, 8 aa, Artificial Sequence
  Description of Artificial Sequence: Synthetic peptide
  Seed: FPDLESEF (MAGA3_HUMAN)
FTDLESEI

SEQ ID NO: 53069 - protein, 10 aa, Artificial Sequence
  Description of Artificial Sequence: Synthetic peptide
  Seed: FLWGPRALVE (MAGA3_HUMAN)
FMWGPRALVK

SEQ ID NO: 53070 - protein, 9 aa, Artificial Sequence
  Description of Artificial Sequence: Synthetic peptide
  Seed: EAASSSSTL (MAGA3_HUMAN)
ETASSSSTY

SEQ ID NO: 53071 - protein, 9 aa, Artificial Sequence
  Description of Artificial Sequence: Synthetic peptide
  Seed: MEVDPIGHL (MAGA3_HUMAN)
MMVDPIGHV

SEQ ID NO: 53072 - protein, 9 aa, Artificial Sequence
  Description of Artificial Sequence: Synthetic peptide
  Seed: WQYFFPVIF (MAGA3_HUMAN)
WQYFFPVIV

SEQ ID NO: 53073 - protein, 9 aa, Artificial Sequence
  Description of Artificial Sequence: Synthetic peptide
  Seed: YIFATCLGL (MAGA3_HUMAN)
YKFATCLGY

SEQ ID NO: 53074 - protein, 9 aa, Artificial Sequence
  Description of Artificial Sequence: Synthetic peptide
  Seed: FVQENYLEY (MAGA3_HUMAN)
FRQENYLEY

SEQ ID NO: 53075 - protein, 10 aa, Artificial Sequence
  Description of Artificial Sequence: Synthetic peptide
  Seed: SVVGNWQYFF (MAGA3_HUMAN)
SYVGNWQYFT

SEQ ID NO: 53076 - protein, 9 aa, Artificial Sequence
  Description of Artificial Sequence: Synthetic peptide
  Seed: ELVHFLLLK (MAGA3_HUMAN)
EIVHFLLLR

SEQ ID NO: 53077 - protein, 11 aa, Artificial Sequence
  Description of Artificial Sequence: Synthetic peptide
  Seed: GSVVGNWQYFF (MAGA3_HUMAN)
GSVVGNWQYFW

SEQ ID NO: 53078 - protein, 9 aa, Artificial Sequence
  Description of Artificial Sequence: Synthetic peptide
  Seed: EAASSSSTL (MAGA3_HUMAN)
EVASSSSTR

SEQ ID NO: 53079 - protein, 10 aa, Artificial Sequence
  Description of Artificial Sequence: Synthetic peptide
  Seed: LTQHFVQENY (MAGA3_HUMAN)
LFQHFVQENY

SEQ ID NO: 53080 - protein, 11 aa, Artificial Sequence
  Description of Artificial Sequence: Synthetic peptide
  Seed: SRKVAELVHFL (MAGA3_HUMAN)
STKVAELVHFV

SEQ ID NO: 53081 - protein, 11 aa, Artificial Sequence
  Description of Artificial Sequence: Synthetic peptide
  Seed: EEQEAASSSST (MAGA3_HUMAN)
EEQEAASSSSA

SEQ ID NO: 53082 - protein, 10 aa, Artificial Sequence
  Description of Artificial Sequence: Synthetic peptide
  Seed: ISYPPLHEWV (MAGA3_HUMAN)
ILYPPLHEWM

SEQ ID NO: 53083 - protein, 11 aa, Artificial Sequence
  Description of Artificial Sequence: Synthetic peptide
  Seed: SKASSSLQLVF (MAGA3_HUMAN)
SVASSSLQLVW

SEQ ID NO: 53084 - protein, 9 aa, Artificial Sequence
  Description of Artificial Sequence: Synthetic peptide
  Seed: SYPPLHEWV (MAGA3_HUMAN)
SWPPLHEWF

SEQ ID NO: 53085 - protein, 10 aa, Artificial Sequence
  Description of Artificial Sequence: Synthetic peptide
  Seed: KASSSLQLVF (MAGA3_HUMAN)
KQSSSLQLVY

SEQ ID NO: 53086 - protein, 10 aa, Artificial Sequence
  Description of Artificial Sequence: Synthetic peptide
  Seed: DLESEFQAAL (MAGA3_HUMAN)
DNESEFQAAY

SEQ ID NO: 53087 - protein, 10 aa, Artificial Sequence
  Description of Artificial Sequence: Synthetic peptide
  Seed: ISYPPLHEWV (MAGA3_HUMAN)
IVYPPLHEWY

SEQ ID NO: 53088 - protein, 9 aa, Artificial Sequence
  Description of Artificial Sequence: Synthetic peptide
  Seed: MPLEQRSQH (MAGA3_HUMAN)
MVLEQRSQY

SEQ ID NO: 53089 - protein, 9 aa, Artificial Sequence
  Description of Artificial Sequence: Synthetic peptide
  Seed: RQVPGSDPA (MAGA3_HUMAN)
RQVPGSDPY

SEQ ID NO: 53090 - protein, 9 aa, Artificial Sequence
  Description of Artificial Sequence: Synthetic peptide
  Seed: MPLEQRSQH (MAGA3_HUMAN)
MPLEQRSQA

SEQ ID NO: 53091 - protein, 9 aa, Artificial Sequence
  Description of Artificial Sequence: Synthetic peptide
  Seed: ISGGPHISY (MAGA3_HUMAN)
IVGGPHISR

SEQ ID NO: 53092 - protein, 10 aa, Artificial Sequence
  Description of Artificial Sequence: Synthetic peptide
  Seed: ASSSLQLVFG (MAGA3_HUMAN)
AMSSLQLVFW

SEQ ID NO: 53093 - protein, 10 aa, Artificial Sequence
  Description of Artificial Sequence: Synthetic peptide
  Seed: QYFFPVIFSK (MAGA3_HUMAN)
QRFFPVIFSR

SEQ ID NO: 53094 - protein, 11 aa, Artificial Sequence
  Description of Artificial Sequence: Synthetic peptide
  Seed: FLWGPRALVET (MAGA3_HUMAN)
FMWGPRALVEV

SEQ ID NO: 53095 - protein, 9 aa, Artificial Sequence
  Description of Artificial Sequence: Synthetic peptide
  Seed: FATCLGLSY (MAGA3_HUMAN)
FGTCLGLSY

SEQ ID NO: 53096 - protein, 9 aa, Artificial Sequence
  Description of Artificial Sequence: Synthetic peptide
  Seed: KVAELVHFL (MAGA3_HUMAN)
KMAELVHFS

SEQ ID NO: 53097 - protein, 9 aa, Artificial Sequence
  Description of Artificial Sequence: Synthetic peptide
  Seed: NWQYFFPVI (MAGA3_HUMAN)
NYQYFFPVY

SEQ ID NO: 53098 - protein, 10 aa, Artificial Sequence
  Description of Artificial Sequence: Synthetic peptide
  Seed: FLWGPRALVE (MAGA3_HUMAN)
FMWGPRALVP

SEQ ID NO: 53099 - protein, 11 aa, Artificial Sequence
  Description of Artificial Sequence: Synthetic peptide
  Seed: YIFATCLGLSY (MAGA3_HUMAN)
YWFATCLGLSY

SEQ ID NO: 53100 - protein, 10 aa, Artificial Sequence
  Description of Artificial Sequence: Synthetic peptide
  Seed: HISYPPLHEW (MAGA3_HUMAN)
HCSYPPLHEF

SEQ ID NO: 53101 - protein, 10 aa, Artificial Sequence
  Description of Artificial Sequence: Synthetic peptide
  Seed: MEVDPIGHLY (MAGA3_HUMAN)
MHVDPIGHLY

SEQ ID NO: 53102 - protein, 9 aa, Artificial Sequence
  Description of Artificial Sequence: Synthetic peptide
  Seed: GASSLPTTM (MAGA3_HUMAN)
GASSLPTTL

SEQ ID NO: 53103 - protein, 9 aa, Artificial Sequence
  Description of Artificial Sequence: Synthetic peptide
  Seed: FVQENYLEY (MAGA3_HUMAN)
FGQENYLEL

SEQ ID NO: 53104 - protein, 9 aa, Artificial Sequence
  Description of Artificial Sequence: Synthetic peptide
  Seed: ISGGPHISY (MAGA3_HUMAN)
IGGGPHISY

SEQ ID NO: 53105 - protein, 10 aa, Artificial Sequence
  Description of Artificial Sequence: Synthetic peptide
  Seed: TTMNYPLWSQ (MAGA3_HUMAN)
TVMNYPLWSK

SEQ ID NO: 53106 - protein, 9 aa, Artificial Sequence
  Description of Artificial Sequence: Synthetic peptide
  Seed: EVDPIGHLY (MAGA3_HUMAN)
ELDPIGHLR

SEQ ID NO: 53107 - protein, 9 aa, Artificial Sequence
  Description of Artificial Sequence: Synthetic peptide
  Seed: FVQENYLEY (MAGA3_HUMAN)
FAQENYLEV

SEQ ID NO: 53108 - protein, 10 aa, Artificial Sequence
  Description of Artificial Sequence: Synthetic peptide
  Seed: KVAELVHFLL (MAGA3_HUMAN)
KHAELVHFLW

SEQ ID NO: 53109 - protein, 9 aa, Artificial Sequence
  Description of Artificial Sequence: Synthetic peptide
  Seed: RALVETSYV (MAGA3_HUMAN)
RTLVETSYL

SEQ ID NO: 53110 - protein, 9 aa, Artificial Sequence
  Description of Artificial Sequence: Synthetic peptide
  Seed: LESEFQAAL (MAGA3_HUMAN)
LQSEFQAAM

SEQ ID NO: 53111 - protein, 9 aa, Artificial Sequence
  Description of Artificial Sequence: Synthetic peptide
  Seed: WQYFFPVIF (MAGA3_HUMAN)
WGYFFPVIY

SEQ ID NO: 53112 - protein, 10 aa, Artificial Sequence
  Description of Artificial Sequence: Synthetic peptide
  Seed: AESPDPPQSP (MAGA3_HUMAN)
AESPDPPQSA

SEQ ID NO: 53113 - protein, 9 aa, Artificial Sequence
  Description of Artificial Sequence: Synthetic peptide
  Seed: AELVHFLLL (MAGA3_HUMAN)
AQLVHFLLF

SEQ ID NO: 53114 - protein, 10 aa, Artificial Sequence
  Description of Artificial Sequence: Synthetic peptide
  Seed: KVAELVHFLL (MAGA3_HUMAN)
KLAELVHFLC

SEQ ID NO: 53115 - protein, 10 aa, Artificial Sequence
  Description of Artificial Sequence: Synthetic peptide
  Seed: MVKISGGPHI (MAGA3_HUMAN)
MEKISGGPHM

SEQ ID NO: 53116 - protein, 10 aa, Artificial Sequence
  Description of Artificial Sequence: Synthetic peptide
  Seed: YFFPVIFSKA (MAGA3_HUMAN)
YIFPVIFSKR

SEQ ID NO: 53117 - protein, 9 aa, Artificial Sequence
  Description of Artificial Sequence: Synthetic peptide
  Seed: IMPKAGLLI (MAGA3_HUMAN)
IAPKAGLLV

SEQ ID NO: 53118 - protein, 9 aa, Artificial Sequence
  Description of Artificial Sequence: Synthetic peptide
  Seed: GLVGAQAPA (MAGA3_HUMAN)
GIVGAQAPI

SEQ ID NO: 53119 - protein, 11 aa, Artificial Sequence
  Description of Artificial Sequence: Synthetic peptide
  Seed: STFPDLESEFQ (MAGA3_HUMAN)
SVFPDLESEFK

SEQ ID NO: 53120 - protein, 9 aa, Artificial Sequence
  Description of Artificial Sequence: Synthetic peptide
  Seed: SSLPTTMNY (MAGA3_HUMAN)
SILPTTMNY

SEQ ID NO: 53121 - protein, 9 aa, Artificial Sequence
  Description of Artificial Sequence: Synthetic peptide
  Seed: ISGGPHISY (MAGA3_HUMAN)
IVGGPHISW

SEQ ID NO: 53122 - protein, 10 aa, Artificial Sequence
  Description of Artificial Sequence: Synthetic peptide
  Seed: MVKISGGPHI (MAGA3_HUMAN)
MTKISGGPHF

SEQ ID NO: 53123 - protein, 10 aa, Artificial Sequence
  Description of Artificial Sequence: Synthetic peptide
  Seed: ISYPPLHEWV (MAGA3_HUMAN)
IVYPPLHEWL

SEQ ID NO: 53124 - protein, 10 aa, Artificial Sequence
  Description of Artificial Sequence: Synthetic peptide
  Seed: KVAELVHFLL (MAGA3_HUMAN)
KLAELVHFLG

SEQ ID NO: 53125 - protein, 10 aa, Artificial Sequence
  Description of Artificial Sequence: Synthetic peptide
  Seed: EFLWGPRALV (MAGA3_HUMAN)
ESLWGPRALV

SEQ ID NO: 53126 - protein, 10 aa, Artificial Sequence
  Description of Artificial Sequence: Synthetic peptide
  Seed: LGSVVGNWQY (MAGA3_HUMAN)
LTSVVGNWQY

SEQ ID NO: 53127 - protein, 9 aa, Artificial Sequence
  Description of Artificial Sequence: Synthetic peptide
  Seed: ISGGPHISY (MAGA3_HUMAN)
IVGGPHISF

SEQ ID NO: 53128 - protein, 10 aa, Artificial Sequence
  Description of Artificial Sequence: Synthetic peptide
  Seed: VDPIGHLYIF (MAGA3_HUMAN)
VYPIGHLYIW

SEQ ID NO: 53129 - protein, 9 aa, Artificial Sequence
  Description of Artificial Sequence: Synthetic peptide
  Seed: GASSLPTTM (MAGA3_HUMAN)
GVSSLPTTM

SEQ ID NO: 53130 - protein, 9 aa, Artificial Sequence
  Description of Artificial Sequence: Synthetic peptide
  Seed: TKAEMLGSV (MAGA3_HUMAN)
TRAEMLGSA

SEQ ID NO: 53131 - protein, 10 aa, Artificial Sequence
  Description of Artificial Sequence: Synthetic peptide
  Seed: STFPDLESEF (MAGA3_HUMAN)
SQFPDLESEW

SEQ ID NO: 53132 - protein, 10 aa, Artificial Sequence
  Description of Artificial Sequence: Synthetic peptide
  Seed: HISYPPLHEW (MAGA3_HUMAN)
HWSYPPLHEF

SEQ ID NO: 53133 - protein, 9 aa, Artificial Sequence
  Description of Artificial Sequence: Synthetic peptide
  Seed: GASSLPTTM (MAGA3_HUMAN)
GASSLPTTI

SEQ ID NO: 53134 - protein, 9 aa, Artificial Sequence
  Description of Artificial Sequence: Synthetic peptide
  Seed: ARGEALGLV (MAGA3_HUMAN)
ARGEALGLL

SEQ ID NO: 53135 - protein, 10 aa, Artificial Sequence
  Description of Artificial Sequence: Synthetic peptide
  Seed: FFPVIFSKAS (MAGA3_HUMAN)
FNPVIFSKAA

SEQ ID NO: 53136 - protein, 10 aa, Artificial Sequence
  Description of Artificial Sequence: Synthetic peptide
  Seed: MVKISGGPHI (MAGA3_HUMAN)
MVKISGGPHK

SEQ ID NO: 53137 - protein, 11 aa, Artificial Sequence
  Description of Artificial Sequence: Synthetic peptide
  Seed: SNQEEEGPSTF (MAGA3_HUMAN)
STQEEEGPSTF

SEQ ID NO: 53138 - protein, 9 aa, Artificial Sequence
  Description of Artificial Sequence: Synthetic peptide
  Seed: YIFATCLGL (MAGA3_HUMAN)
YYFATCLGI

SEQ ID NO: 53139 - protein, 10 aa, Artificial Sequence
  Description of Artificial Sequence: Synthetic peptide
  Seed: MVKISGGPHI (MAGA3_HUMAN)
MMKISGGPHF

SEQ ID NO: 53140 - protein, 11 aa, Artificial Sequence
  Description of Artificial Sequence: Synthetic peptide
  Seed: SLPTTMNYPLW (MAGA3_HUMAN)
SYPTTMNYPLM

SEQ ID NO: 53141 - protein, 9 aa, Artificial Sequence
  Description of Artificial Sequence: Synthetic peptide
  Seed: YFFPVIFSK (MAGA3_HUMAN)
YSFPVIFSR

SEQ ID NO: 53142 - protein, 11 aa, Artificial Sequence
  Description of Artificial Sequence: Synthetic peptide
  Seed: ISYPPLHEWVL (MAGA3_HUMAN)
IAYPPLHEWVF

SEQ ID NO: 53143 - protein, 9 aa, Artificial Sequence
  Description of Artificial Sequence: Synthetic peptide
  Seed: LGDPKKLLT (MAGA3_HUMAN)
LADPKKLLI

SEQ ID NO: 53144 - protein, 9 aa, Artificial Sequence
  Description of Artificial Sequence: Synthetic peptide
  Seed: DPIGHLYIF (MAGA3_HUMAN)
DAIGHLYIL

SEQ ID NO: 53145 - protein, 9 aa, Artificial Sequence
  Description of Artificial Sequence: Synthetic peptide
  Seed: NWQYFFPVI (MAGA3_HUMAN)
NYQYFFPVV

SEQ ID NO: 53146 - protein, 10 aa, Artificial Sequence
  Description of Artificial Sequence: Synthetic peptide
  Seed: YIFATCLGLS (MAGA3_HUMAN)
YMFATCLGLV

SEQ ID NO: 53147 - protein, 10 aa, Artificial Sequence
  Description of Artificial Sequence: Synthetic peptide
  Seed: GHLYIFATCL (MAGA3_HUMAN)
GLLYIFATCI

SEQ ID NO: 53148 - protein, 10 aa, Artificial Sequence
  Description of Artificial Sequence: Synthetic peptide
  Seed: ESPDPPQSPQ (MAGA3_HUMAN)
EVPDPPQSPR

SEQ ID NO: 53149 - protein, 10 aa, Artificial Sequence
  Description of Artificial Sequence: Synthetic peptide
  Seed: ISYPPLHEWV (MAGA3_HUMAN)
IQYPPLHEWV

SEQ ID NO: 53150 - protein, 9 aa, Artificial Sequence
  Description of Artificial Sequence: Synthetic peptide
  Seed: SSSSTLVEV (MAGA3_HUMAN)
SASSTLVEW

SEQ ID NO: 53151 - protein, 10 aa, Artificial Sequence
  Description of Artificial Sequence: Synthetic peptide
  Seed: EVFEGREDSI (MAGA3_HUMAN)
ETFEGREDSI

SEQ ID NO: 53152 - protein, 9 aa, Artificial Sequence
  Description of Artificial Sequence: Synthetic peptide
  Seed: IMPKAGLLI (MAGA3_HUMAN)
IWPKAGLLW

SEQ ID NO: 53153 - protein, 9 aa, Artificial Sequence
  Description of Artificial Sequence: Synthetic peptide
  Seed: HHMVKISGG (MAGA3_HUMAN)
HHMVKISGV

SEQ ID NO: 53154 - protein, 10 aa, Artificial Sequence
  Description of Artificial Sequence: Synthetic peptide
  Seed: NWQYFFPVIF (MAGA3_HUMAN)
NVQYFFPVIF

SEQ ID NO: 53155 - protein, 10 aa, Artificial Sequence
  Description of Artificial Sequence: Synthetic peptide
  Seed: EFLWGPRALV (MAGA3_HUMAN)
ETLWGPRALA

SEQ ID NO: 53156 - protein, 11 aa, Artificial Sequence
  Description of Artificial Sequence: Synthetic peptide
  Seed: ALVETSYVKVL (MAGA3_HUMAN)
AMVETSYVKVV

SEQ ID NO: 53157 - protein, 10 aa, Artificial Sequence
  Description of Artificial Sequence: Synthetic peptide
  Seed: FVQENYLEYR (MAGA3_HUMAN)
FIQENYLEYR

SEQ ID NO: 53158 - protein, 10 aa, Artificial Sequence
  Description of Artificial Sequence: Synthetic peptide
  Seed: ISYPPLHEWV (MAGA3_HUMAN)
IPYPPLHEWL

SEQ ID NO: 53159 - protein, 10 aa, Artificial Sequence
  Description of Artificial Sequence: Synthetic peptide
  Seed: KAEMLGSVVG (MAGA3_HUMAN)
KVEMLGSVVV

SEQ ID NO: 53160 - protein, 9 aa, Artificial Sequence
  Description of Artificial Sequence: Synthetic peptide
  Seed: RALVETSYV (MAGA3_HUMAN)
RILVETSYW

SEQ ID NO: 53161 - protein, 9 aa, Artificial Sequence
  Description of Artificial Sequence: Synthetic peptide
  Seed: KVLHHMVKI (MAGA3_HUMAN)
KMLHHMVKC

SEQ ID NO: 53162 - protein, 9 aa, Artificial Sequence
  Description of Artificial Sequence: Synthetic peptide
  Seed: ELVHFLLLK (MAGA3_HUMAN)
EGVHFLLLK

SEQ ID NO: 53163 - protein, 10 aa, Artificial Sequence
  Description of Artificial Sequence: Synthetic peptide
  Seed: FSKASSSLQL (MAGA3_HUMAN)
FLKASSSLQY

SEQ ID NO: 53164 - protein, 9 aa, Artificial Sequence
  Description of Artificial Sequence: Synthetic peptide
  Seed: ISYPPLHEW (MAGA3_HUMAN)
ICYPPLHEL

SEQ ID NO: 53165 - protein, 9 aa, Artificial Sequence
  Description of Artificial Sequence: Synthetic peptide
  Seed: ISGGPHISY (MAGA3_HUMAN)
IAGGPHISY

SEQ ID NO: 53166 - protein, 9 aa, Artificial Sequence
  Description of Artificial Sequence: Synthetic peptide
  Seed: EALGLVGAQ (MAGA3_HUMAN)
ESLGLVGAR

SEQ ID NO: 53167 - protein, 9 aa, Artificial Sequence
  Description of Artificial Sequence: Synthetic peptide
  Seed: TSYVKVLHH (MAGA3_HUMAN)
TSYVKVLHV

SEQ ID NO: 53168 - protein, 9 aa, Artificial Sequence
  Description of Artificial Sequence: Synthetic peptide
  Seed: NYPLWSQSY (MAGA3_HUMAN)
NAPLWSQSL

SEQ ID NO: 53169 - protein, 9 aa, Artificial Sequence
  Description of Artificial Sequence: Synthetic peptide
  Seed: NYPLWSQSY (MAGA3_HUMAN)
NFPLWSQSY

SEQ ID NO: 53170 - protein, 11 aa, Artificial Sequence
  Description of Artificial Sequence: Synthetic peptide
  Seed: HCKPEEGLEAR (MAGA3_HUMAN)
HVKPEEGLEAK

SEQ ID NO: 53171 - protein, 11 aa, Artificial Sequence
  Description of Artificial Sequence: Synthetic peptide
  Seed: REGDCAPEEKI (MAGA3_HUMAN)
REGDCAPEEKY

SEQ ID NO: 53172 - protein, 10 aa, Artificial Sequence
  Description of Artificial Sequence: Synthetic peptide
  Seed: SEFQAALSRK (MAGA3_HUMAN)
SIFQAALSRR

SEQ ID NO: 53173 - protein, 9 aa, Artificial Sequence
  Description of Artificial Sequence: Synthetic peptide
  Seed: KVAELVHFL (MAGA3_HUMAN)
KGAELVHFI

SEQ ID NO: 53174 - protein, 9 aa, Artificial Sequence
  Description of Artificial Sequence: Synthetic peptide
  Seed: VKISGGPHI (MAGA3_HUMAN)
VQISGGPHL

SEQ ID NO: 53175 - protein, 10 aa, Artificial Sequence
  Description of Artificial Sequence: Synthetic peptide
  Seed: VIFSKASSSL (MAGA3_HUMAN)
VFFSKASSSL

SEQ ID NO: 53176 - protein, 10 aa, Artificial Sequence
  Description of Artificial Sequence: Synthetic peptide
  Seed: SEFQAALSRK (MAGA3_HUMAN)
SYFQAALSRR

SEQ ID NO: 53177 - protein, 11 aa, Artificial Sequence
  Description of Artificial Sequence: Synthetic peptide
  Seed: KVAELVHFLLL (MAGA3_HUMAN)
KLAELVHFLLR

SEQ ID NO: 53178 - protein, 10 aa, Artificial Sequence
  Description of Artificial Sequence: Synthetic peptide
  Seed: LQLVFGIELM (MAGA3_HUMAN)
LDLVFGIELV

SEQ ID NO: 53179 - protein, 10 aa, Artificial Sequence
  Description of Artificial Sequence: Synthetic peptide
  Seed: ISYPPLHEWV (MAGA3_HUMAN)
IRYPPLHEWI

SEQ ID NO: 53180 - protein, 10 aa, Artificial Sequence
  Description of Artificial Sequence: Synthetic peptide
  Seed: VDPIGHLYIF (MAGA3_HUMAN)
VIPIGHLYIY

SEQ ID NO: 53181 - protein, 9 aa, Artificial Sequence
  Description of Artificial Sequence: Synthetic peptide
  Seed: RQVPGSDPA (MAGA3_HUMAN)
RLVPGSDPV

SEQ ID NO: 53182 - protein, 9 aa, Artificial Sequence
  Description of Artificial Sequence: Synthetic peptide
  Seed: FLWGPRALV (MAGA3_HUMAN)
FAWGPRALY

SEQ ID NO: 53183 - protein, 9 aa, Artificial Sequence
  Description of Artificial Sequence: Synthetic peptide
  Seed: QEEEGPSTF (MAGA3_HUMAN)
QQEEGPSTL

SEQ ID NO: 53184 - protein, 9 aa, Artificial Sequence
  Description of Artificial Sequence: Synthetic peptide
  Seed: SVVGNWQYF (MAGA3_HUMAN)
SAVGNWQYW

SEQ ID NO: 53185 - protein, 10 aa, Artificial Sequence
  Description of Artificial Sequence: Synthetic peptide
  Seed: MNYPLWSQSY (MAGA3_HUMAN)
MHYPLWSQSV

SEQ ID NO: 53186 - protein, 8 aa, Artificial Sequence
  Description of Artificial Sequence: Synthetic peptide
  Seed: WQYFFPVI (MAGA3_HUMAN)
WQYFFPVL

SEQ ID NO: 53187 - protein, 10 aa, Artificial Sequence
  Description of Artificial Sequence: Synthetic peptide
  Seed: RKVAELVHFL (MAGA3_HUMAN)
RGVAELVHFV

SEQ ID NO: 53188 - protein, 11 aa, Artificial Sequence
  Description of Artificial Sequence: Synthetic peptide
  Seed: MEVDPIGHLYI (MAGA3_HUMAN)
MEVDPIGHLYM

SEQ ID NO: 53189 - protein, 10 aa, Artificial Sequence
  Description of Artificial Sequence: Synthetic peptide
  Seed: TSYVKVLHHM (MAGA3_HUMAN)
TYYVKVLHHF

SEQ ID NO: 53190 - protein, 10 aa, Artificial Sequence
  Description of Artificial Sequence: Synthetic peptide
  Seed: HISYPPLHEW (MAGA3_HUMAN)
HFSYPPLHEY

SEQ ID NO: 53191 - protein, 9 aa, Artificial Sequence
  Description of Artificial Sequence: Synthetic peptide
  Seed: ALSRKVAEL (MAGA3_HUMAN)
AASRKVAEV

SEQ ID NO: 53192 - protein, 10 aa, Artificial Sequence
  Description of Artificial Sequence: Synthetic peptide
  Seed: FSKASSSLQL (MAGA3_HUMAN)
FIKASSSLQY

SEQ ID NO: 53193 - protein, 10 aa, Artificial Sequence
  Description of Artificial Sequence: Synthetic peptide
  Seed: KVAELVHFLL (MAGA3_HUMAN)
KMAELVHFLR

SEQ ID NO: 53194 - protein, 9 aa, Artificial Sequence
  Description of Artificial Sequence: Synthetic peptide
  Seed: TSYVKVLHH (MAGA3_HUMAN)
TSYVKVLHI

SEQ ID NO: 53195 - protein, 10 aa, Artificial Sequence
  Description of Artificial Sequence: Synthetic peptide
  Seed: TSYVKVLHHM (MAGA3_HUMAN)
TYYVKVLHHM

SEQ ID NO: 53196 - protein, 9 aa, Artificial Sequence
  Description of Artificial Sequence: Synthetic peptide
  Seed: EAASSSSTL (MAGA3_HUMAN)
EVASSSSTM

SEQ ID NO: 53197 - protein, 10 aa, Artificial Sequence
  Description of Artificial Sequence: Synthetic peptide
  Seed: YIFATCLGLS (MAGA3_HUMAN)
YAFATCLGLV

SEQ ID NO: 53198 - protein, 9 aa, Artificial Sequence
  Description of Artificial Sequence: Synthetic peptide
  Seed: ISYPPLHEW (MAGA3_HUMAN)
IIYPPLHEL

SEQ ID NO: 53199 - protein, 10 aa, Artificial Sequence
  Description of Artificial Sequence: Synthetic peptide
  Seed: LGSVVGNWQY (MAGA3_HUMAN)
LWSVVGNWQW

SEQ ID NO: 53200 - protein, 9 aa, Artificial Sequence
  Description of Artificial Sequence: Synthetic peptide
  Seed: ALSRKVAEL (MAGA3_HUMAN)
ATSRKVAEF

SEQ ID NO: 53201 - protein, 9 aa, Artificial Sequence
  Description of Artificial Sequence: Synthetic peptide
  Seed: FQAALSRKV (MAGA3_HUMAN)
FSAALSRKM

SEQ ID NO: 53202 - protein, 9 aa, Artificial Sequence
  Description of Artificial Sequence: Synthetic peptide
  Seed: FVQENYLEY (MAGA3_HUMAN)
FTQENYLEK

SEQ ID NO: 53203 - protein, 9 aa, Artificial Sequence
  Description of Artificial Sequence: Synthetic peptide
  Seed: ISGGPHISY (MAGA3_HUMAN)
ISGGPHISV

SEQ ID NO: 53204 - protein, 11 aa, Artificial Sequence
  Description of Artificial Sequence: Synthetic peptide
  Seed: KVAELVHFLLL (MAGA3_HUMAN)
KMAELVHFLLF

SEQ ID NO: 53205 - protein, 9 aa, Artificial Sequence
  Description of Artificial Sequence: Synthetic peptide
  Seed: TQHFVQENY (MAGA3_HUMAN)
TEHFVQENF

SEQ ID NO: 53206 - protein, 9 aa, Artificial Sequence
  Description of Artificial Sequence: Synthetic peptide
  Seed: IFSKASSSL (MAGA3_HUMAN)
IFSKASSSY

SEQ ID NO: 53207 - protein, 9 aa, Artificial Sequence
  Description of Artificial Sequence: Synthetic peptide
  Seed: MVKISGGPH (MAGA3_HUMAN)
MSKISGGPY

SEQ ID NO: 53208 - protein, 9 aa, Artificial Sequence
  Description of Artificial Sequence: Synthetic peptide
  Seed: ELVHFLLLK (MAGA3_HUMAN)
ETVHFLLLY

SEQ ID NO: 53209 - protein, 9 aa, Artificial Sequence
  Description of Artificial Sequence: Synthetic peptide
  Seed: FQAALSRKV (MAGA3_HUMAN)
FSAALSRKV

SEQ ID NO: 53210 - protein, 10 aa, Artificial Sequence
  Description of Artificial Sequence: Synthetic peptide
  Seed: KAEMLGSVVG (MAGA3_HUMAN)
KIEMLGSVVA

SEQ ID NO: 53211 - protein, 10 aa, Artificial Sequence
  Description of Artificial Sequence: Synthetic peptide
  Seed: LVFGIELMEV (MAGA3_HUMAN)
LVFGIELMEA

SEQ ID NO: 53212 - protein, 8 aa, Artificial Sequence
  Description of Artificial Sequence: Synthetic peptide
  Seed: FPDLESEF (MAGA3_HUMAN)
FADLESEI

SEQ ID NO: 53213 - protein, 9 aa, Artificial Sequence
  Description of Artificial Sequence: Synthetic peptide
  Seed: AQAPATEEQ (MAGA3_HUMAN)
AVAPATEEY

SEQ ID NO: 53214 - protein, 10 aa, Artificial Sequence
  Description of Artificial Sequence: Synthetic peptide
  Seed: ISYPPLHEWV (MAGA3_HUMAN)
IVYPPLHEWW

SEQ ID NO: 53215 - protein, 9 aa, Artificial Sequence
  Description of Artificial Sequence: Synthetic peptide
  Seed: MPLEQRSQH (MAGA3_HUMAN)
MMLEQRSQY

SEQ ID NO: 53216 - protein, 9 aa, Artificial Sequence
  Description of Artificial Sequence: Synthetic peptide
  Seed: SILGDPKKL (MAGA3_HUMAN)
SRLGDPKKM

SEQ ID NO: 53217 - protein, 9 aa, Artificial Sequence
  Description of Artificial Sequence: Synthetic peptide
  Seed: YPPLHEWVL (MAGA3_HUMAN)
YPPLHEWVF

SEQ ID NO: 53218 - protein, 9 aa, Artificial Sequence
  Description of Artificial Sequence: Synthetic peptide
  Seed: EVDPIGHLY (MAGA3_HUMAN)
ESDPIGHLV

SEQ ID NO: 53219 - protein, 9 aa, Artificial Sequence
  Description of Artificial Sequence: Synthetic peptide
  Seed: IFSKASSSL (MAGA3_HUMAN)
ITSKASSSF

SEQ ID NO: 53220 - protein, 10 aa, Artificial Sequence
  Description of Artificial Sequence: Synthetic peptide
  Seed: ASSSSTLVEV (MAGA3_HUMAN)
AVSSSTLVEL

SEQ ID NO: 53221 - protein, 10 aa, Artificial Sequence
  Description of Artificial Sequence: Synthetic peptide
  Seed: LGSVVGNWQY (MAGA3_HUMAN)
LMSVVGNWQY

SEQ ID NO: 53222 - protein, 9 aa, Artificial Sequence
  Description of Artificial Sequence: Synthetic peptide
  Seed: EARGEALGL (MAGA3_HUMAN)
EIRGEALGW

SEQ ID NO: 53223 - protein, 10 aa, Artificial Sequence
  Description of Artificial Sequence: Synthetic peptide
  Seed: KVAELVHFLL (MAGA3_HUMAN)
KAAELVHFLI

SEQ ID NO: 53224 - protein, 11 aa, Artificial Sequence
  Description of Artificial Sequence: Synthetic peptide
  Seed: LGSVVGNWQYF (MAGA3_HUMAN)
LTSVVGNWQYW

SEQ ID NO: 53225 - protein, 9 aa, Artificial Sequence
  Description of Artificial Sequence: Synthetic peptide
  Seed: YPPLHEWVL (MAGA3_HUMAN)
YIPLHEWVL

SEQ ID NO: 53226 - protein, 10 aa, Artificial Sequence
  Description of Artificial Sequence: Synthetic peptide
  Seed: KASSSLQLVF (MAGA3_HUMAN)
KFSSSLQLVW

SEQ ID NO: 53227 - protein, 10 aa, Artificial Sequence
  Description of Artificial Sequence: Synthetic peptide
  Seed: EMLGSVVGNW (MAGA3_HUMAN)
EVLGSVVGNY

SEQ ID NO: 53228 - protein, 9 aa, Artificial Sequence
  Description of Artificial Sequence: Synthetic peptide
  Seed: SVVGNWQYF (MAGA3_HUMAN)
SMVGNWQYW

SEQ ID NO: 53229 - protein, 11 aa, Artificial Sequence
  Description of Artificial Sequence: Synthetic peptide
  Seed: SKASSSLQLVF (MAGA3_HUMAN)
SPASSSLQLVW

SEQ ID NO: 53230 - protein, 9 aa, Artificial Sequence
  Description of Artificial Sequence: Synthetic peptide
  Seed: VKISGGPHI (MAGA3_HUMAN)
VMISGGPHY

SEQ ID NO: 53231 - protein, 9 aa, Artificial Sequence
  Description of Artificial Sequence: Synthetic peptide
  Seed: KIWEELSVL (MAGA3_HUMAN)
KLWEELSVY

SEQ ID NO: 53232 - protein, 11 aa, Artificial Sequence
  Description of Artificial Sequence: Synthetic peptide
  Seed: VVGNWQYFFPV (MAGA3_HUMAN)
VIGNWQYFFPV

SEQ ID NO: 53233 - protein, 10 aa, Artificial Sequence
  Description of Artificial Sequence: Synthetic peptide
  Seed: ISYPPLHEWV (MAGA3_HUMAN)
IQYPPLHEWF

SEQ ID NO: 53234 - protein, 9 aa, Artificial Sequence
  Description of Artificial Sequence: Synthetic peptide
  Seed: YFFPVIFSK (MAGA3_HUMAN)
YLFPVIFSA

SEQ ID NO: 53235 - protein, 9 aa, Artificial Sequence
  Description of Artificial Sequence: Synthetic peptide
  Seed: LSRKVAELV (MAGA3_HUMAN)
LTRKVAELF

SEQ ID NO: 53236 - protein, 10 aa, Artificial Sequence
  Description of Artificial Sequence: Synthetic peptide
  Seed: REDSILGDPK (MAGA3_HUMAN)
RSDSILGDPY

SEQ ID NO: 53237 - protein, 9 aa, Artificial Sequence
  Description of Artificial Sequence: Synthetic peptide
  Seed: RKVAELVHF (MAGA3_HUMAN)
RMVAELVHY

SEQ ID NO: 53238 - protein, 9 aa, Artificial Sequence
  Description of Artificial Sequence: Synthetic peptide
  Seed: SSLPTTMNY (MAGA3_HUMAN)
SYLPTTMNL

SEQ ID NO: 53239 - protein, 9 aa, Artificial Sequence
  Description of Artificial Sequence: Synthetic peptide
  Seed: VVGNWQYFF (MAGA3_HUMAN)
VAGNWQYFF

SEQ ID NO: 53240 - protein, 11 aa, Artificial Sequence
  Description of Artificial Sequence: Synthetic peptide
  Seed: RQVPGSDPACY (MAGA3_HUMAN)
RIVPGSDPACL

SEQ ID NO: 53241 - protein, 10 aa, Artificial Sequence
  Description of Artificial Sequence: Synthetic peptide
  Seed: MEVDPIGHLY (MAGA3_HUMAN)
MPVDPIGHLW

SEQ ID NO: 53242 - protein, 9 aa, Artificial Sequence
  Description of Artificial Sequence: Synthetic peptide
  Seed: LGDPKKLLT (MAGA3_HUMAN)
LTDPKKLLV

SEQ ID NO: 53243 - protein, 9 aa, Artificial Sequence
  Description of Artificial Sequence: Synthetic peptide
  Seed: EVDPIGHLY (MAGA3_HUMAN)
ETDPIGHLM

SEQ ID NO: 53244 - protein, 9 aa, Artificial Sequence
  Description of Artificial Sequence: Synthetic peptide
  Seed: ISGGPHISY (MAGA3_HUMAN)
ILGGPHISM

SEQ ID NO: 53245 - protein, 9 aa, Artificial Sequence
  Description of Artificial Sequence: Synthetic peptide
  Seed: LQLVFGIEL (MAGA3_HUMAN)
LMLVFGIEL

SEQ ID NO: 53246 - protein, 9 aa, Artificial Sequence
  Description of Artificial Sequence: Synthetic peptide
  Seed: GLLIIVLAI (MAGA3_HUMAN)
GMLIIVLAI

SEQ ID NO: 53247 - protein, 10 aa, Artificial Sequence
  Description of Artificial Sequence: Synthetic peptide
  Seed: LVFGIELMEV (MAGA3_HUMAN)
LIFGIELMEA

SEQ ID NO: 53248 - protein, 10 aa, Artificial Sequence
  Description of Artificial Sequence: Synthetic peptide
  Seed: SDPACYEFLW (MAGA3_HUMAN)
SHPACYEFLW

SEQ ID NO: 53249 - protein, 10 aa, Artificial Sequence
  Description of Artificial Sequence: Synthetic peptide
  Seed: IFATCLGLSY (MAGA3_HUMAN)
ISATCLGLSY

SEQ ID NO: 53250 - protein, 9 aa, Artificial Sequence
  Description of Artificial Sequence: Synthetic peptide
  Seed: YIFATCLGL (MAGA3_HUMAN)
YSFATCLGL

SEQ ID NO: 53251 - protein, 9 aa, Artificial Sequence
  Description of Artificial Sequence: Synthetic peptide
  Seed: GSDPACYEF (MAGA3_HUMAN)
GVDPACYEY

SEQ ID NO: 53252 - protein, 9 aa, Artificial Sequence
  Description of Artificial Sequence: Synthetic peptide
  Seed: SVLEVFEGR (MAGA3_HUMAN)
SALEVFEGY

SEQ ID NO: 53253 - protein, 9 aa, Artificial Sequence
  Description of Artificial Sequence: Synthetic peptide
  Seed: IFSKASSSL (MAGA3_HUMAN)
IMSKASSSM

SEQ ID NO: 53254 - protein, 10 aa, Artificial Sequence
  Description of Artificial Sequence: Synthetic peptide
  Seed: VIFSKASSSL (MAGA3_HUMAN)
VQFSKASSSV

SEQ ID NO: 53255 - protein, 10 aa, Artificial Sequence
  Description of Artificial Sequence: Synthetic peptide
  Seed: KISGGPHISY (MAGA3_HUMAN)
KTSGGPHISY

SEQ ID NO: 53256 - protein, 9 aa, Artificial Sequence
  Description of Artificial Sequence: Synthetic peptide
  Seed: LSRKVAELV (MAGA3_HUMAN)
LYRKVAELK

SEQ ID NO: 53257 - protein, 11 aa, Artificial Sequence
  Description of Artificial Sequence: Synthetic peptide
  Seed: WQYFFPVIFSK (MAGA3_HUMAN)
WRYFFPVIFSR

SEQ ID NO: 53258 - protein, 9 aa, Artificial Sequence
  Description of Artificial Sequence: Synthetic peptide
  Seed: GEVPAAESP (MAGA3_HUMAN)
GEVPAAESV

SEQ ID NO: 53259 - protein, 9 aa, Artificial Sequence
  Description of Artificial Sequence: Synthetic peptide
  Seed: QLVFGIELM (MAGA3_HUMAN)
QIVFGIELV

SEQ ID NO: 53260 - protein, 9 aa, Artificial Sequence
  Description of Artificial Sequence: Synthetic peptide
  Seed: LESEFQAAL (MAGA3_HUMAN)
LHSEFQAAA

SEQ ID NO: 53261 - protein, 9 aa, Artificial Sequence
  Description of Artificial Sequence: Synthetic peptide
  Seed: KIWEELSVL (MAGA3_HUMAN)
KQWEELSVA

SEQ ID NO: 53262 - protein, 9 aa, Artificial Sequence
  Description of Artificial Sequence: Synthetic peptide
  Seed: FLWGPRALV (MAGA3_HUMAN)
FSWGPRALI

SEQ ID NO: 53263 - protein, 9 aa, Artificial Sequence
  Description of Artificial Sequence: Synthetic peptide
  Seed: MEVDPIGHL (MAGA3_HUMAN)
MAVDPIGHH

SEQ ID NO: 53264 - protein, 9 aa, Artificial Sequence
  Description of Artificial Sequence: Synthetic peptide
  Seed: DPIGHLYIF (MAGA3_HUMAN)
DEIGHLYIM

SEQ ID NO: 53265 - protein, 8 aa, Artificial Sequence
  Description of Artificial Sequence: Synthetic peptide
  Seed: FSKASSSL (MAGA3_HUMAN)
FAKASSSY

SEQ ID NO: 53266 - protein, 11 aa, Artificial Sequence
  Description of Artificial Sequence: Synthetic peptide
  Seed: KVAELVHFLLL (MAGA3_HUMAN)
KLAELVHFLLK

SEQ ID NO: 53267 - protein, 9 aa, Artificial Sequence
  Description of Artificial Sequence: Synthetic peptide
  Seed: EVDPIGHLY (MAGA3_HUMAN)
EIDPIGHLR

SEQ ID NO: 53268 - protein, 9 aa, Artificial Sequence
  Description of Artificial Sequence: Synthetic peptide
  Seed: HLYIFATCL (MAGA3_HUMAN)
HGYIFATCY

SEQ ID NO: 53269 - protein, 9 aa, Artificial Sequence
  Description of Artificial Sequence: Synthetic peptide
  Seed: EAASSSSTL (MAGA3_HUMAN)
EVASSSSTL

SEQ ID NO: 53270 - protein, 10 aa, Artificial Sequence
  Description of Artificial Sequence: Synthetic peptide
  Seed: TTMNYPLWSQ (MAGA3_HUMAN)
TSMNYPLWSR

SEQ ID NO: 53271 - protein, 9 aa, Artificial Sequence
  Description of Artificial Sequence: Synthetic peptide
  Seed: NYPLWSQSY (MAGA3_HUMAN)
NFPLWSQSL

SEQ ID NO: 53272 - protein, 10 aa, Artificial Sequence
  Description of Artificial Sequence: Synthetic peptide
  Seed: MVKISGGPHI (MAGA3_HUMAN)
MPKISGGPHF

SEQ ID NO: 53273 - protein, 9 aa, Artificial Sequence
  Description of Artificial Sequence: Synthetic peptide
  Seed: NQIMPKAGL (MAGA3_HUMAN)
NEIMPKAGL

SEQ ID NO: 53274 - protein, 10 aa, Artificial Sequence
  Description of Artificial Sequence: Synthetic peptide
  Seed: VDPIGHLYIF (MAGA3_HUMAN)
VPPIGHLYIW

SEQ ID NO: 53275 - protein, 9 aa, Artificial Sequence
  Description of Artificial Sequence: Synthetic peptide
  Seed: EGDCAPEEK (MAGA3_HUMAN)
EMDCAPEEY

SEQ ID NO: 53276 - protein, 9 aa, Artificial Sequence
  Description of Artificial Sequence: Synthetic peptide
  Seed: HLYIFATCL (MAGA3_HUMAN)
HSYIFATCM

SEQ ID NO: 53277 - protein, 9 aa, Artificial Sequence
  Description of Artificial Sequence: Synthetic peptide
  Seed: NWQYFFPVI (MAGA3_HUMAN)
NYQYFFPVM

SEQ ID NO: 53278 - protein, 10 aa, Artificial Sequence
  Description of Artificial Sequence: Synthetic peptide
  Seed: NWQYFFPVIF (MAGA3_HUMAN)
NNQYFFPVIF

SEQ ID NO: 53279 - protein, 10 aa, Artificial Sequence
  Description of Artificial Sequence: Synthetic peptide
  Seed: LGSVVGNWQY (MAGA3_HUMAN)
LKSVVGNWQW

SEQ ID NO: 53280 - protein, 10 aa, Artificial Sequence
  Description of Artificial Sequence: Synthetic peptide
  Seed: YVKVLHHMVK (MAGA3_HUMAN)
YTKVLHHMVK

SEQ ID NO: 53281 - protein, 10 aa, Artificial Sequence
  Description of Artificial Sequence: Synthetic peptide
  Seed: NWQYFFPVIF (MAGA3_HUMAN)
NHQYFFPVIY

SEQ ID NO: 53282 - protein, 10 aa, Artificial Sequence
  Description of Artificial Sequence: Synthetic peptide
  Seed: LVFGIELMEV (MAGA3_HUMAN)
LMFGIELMET

SEQ ID NO: 53283 - protein, 9 aa, Artificial Sequence
  Description of Artificial Sequence: Synthetic peptide
  Seed: KVAELVHFL (MAGA3_HUMAN)
KLAELVHFA

SEQ ID NO: 53284 - protein, 9 aa, Artificial Sequence
  Description of Artificial Sequence: Synthetic peptide
  Seed: SVVGNWQYF (MAGA3_HUMAN)
SVVGNWQYR

SEQ ID NO: 53285 - protein, 11 aa, Artificial Sequence
  Description of Artificial Sequence: Synthetic peptide
  Seed: QEAASSSSTLV (MAGA3_HUMAN)
QEAASSSSTLL

SEQ ID NO: 53286 - protein, 10 aa, Artificial Sequence
  Description of Artificial Sequence: Synthetic peptide
  Seed: MNYPLWSQSY (MAGA3_HUMAN)
MEYPLWSQSY

SEQ ID NO: 53287 - protein, 9 aa, Artificial Sequence
  Description of Artificial Sequence: Synthetic peptide
  Seed: ISGGPHISY (MAGA3_HUMAN)
ILGGPHISY

SEQ ID NO: 53288 - protein, 11 aa, Artificial Sequence
  Description of Artificial Sequence: Synthetic peptide
  Seed: KIWEELSVLEV (MAGA3_HUMAN)
KMWEELSVLEL

SEQ ID NO: 53289 - protein, 9 aa, Artificial Sequence
  Description of Artificial Sequence: Synthetic peptide
  Seed: VKISGGPHI (MAGA3_HUMAN)
VKISGGPHM

SEQ ID NO: 53290 - protein, 11 aa, Artificial Sequence
  Description of Artificial Sequence: Synthetic peptide
  Seed: EVDPIGHLYIF (MAGA3_HUMAN)
ETDPIGHLYIY

SEQ ID NO: 53291 - protein, 9 aa, Artificial Sequence
  Description of Artificial Sequence: Synthetic peptide
  Seed: KVAELVHFL (MAGA3_HUMAN)
KTAELVHFW

SEQ ID NO: 53292 - protein, 9 aa, Artificial Sequence
  Description of Artificial Sequence: Synthetic peptide
  Seed: RALVETSYV (MAGA3_HUMAN)
RLLVETSYF

SEQ ID NO: 53293 - protein, 10 aa, Artificial Sequence
  Description of Artificial Sequence: Synthetic peptide
  Seed: YIFATCLGLS (MAGA3_HUMAN)
YQFATCLGLA

SEQ ID NO: 53294 - protein, 10 aa, Artificial Sequence
  Description of Artificial Sequence: Synthetic peptide
  Seed: EMLGSVVGNW (MAGA3_HUMAN)
EALGSVVGNW

SEQ ID NO: 53295 - protein, 10 aa, Artificial Sequence
  Description of Artificial Sequence: Synthetic peptide
  Seed: MVKISGGPHI (MAGA3_HUMAN)
MNKISGGPHM

SEQ ID NO: 53296 - protein, 10 aa, Artificial Sequence
  Description of Artificial Sequence: Synthetic peptide
  Seed: LQLVFGIELM (MAGA3_HUMAN)
LWLVFGIELL

SEQ ID NO: 53297 - protein, 9 aa, Artificial Sequence
  Description of Artificial Sequence: Synthetic peptide
  Seed: VVGNWQYFF (MAGA3_HUMAN)
VNGNWQYFY

SEQ ID NO: 53298 - protein, 9 aa, Artificial Sequence
  Description of Artificial Sequence: Synthetic peptide
  Seed: ISGGPHISY (MAGA3_HUMAN)
IPGGPHISF

SEQ ID NO: 53299 - protein, 9 aa, Artificial Sequence
  Description of Artificial Sequence: Synthetic peptide
  Seed: GNWQYFFPV (MAGA3_HUMAN)
GLWQYFFPL

SEQ ID NO: 53300 - protein, 9 aa, Artificial Sequence
  Description of Artificial Sequence: Synthetic peptide
  Seed: ELVHFLLLK (MAGA3_HUMAN)
EAVHFLLLK

SEQ ID NO: 53301 - protein, 9 aa, Artificial Sequence
  Description of Artificial Sequence: Synthetic peptide
  Seed: VKISGGPHI (MAGA3_HUMAN)
VTISGGPHF

SEQ ID NO: 53302 - protein, 10 aa, Artificial Sequence
  Description of Artificial Sequence: Synthetic peptide
  Seed: KAEMLGSVVG (MAGA3_HUMAN)
KKEMLGSVVV

SEQ ID NO: 53303 - protein, 9 aa, Artificial Sequence
  Description of Artificial Sequence: Synthetic peptide
  Seed: AQAPATEEQ (MAGA3_HUMAN)
ALAPATEEY

SEQ ID NO: 53304 - protein, 10 aa, Artificial Sequence
  Description of Artificial Sequence: Synthetic peptide
  Seed: MEVDPIGHLY (MAGA3_HUMAN)
MGVDPIGHLL

SEQ ID NO: 53305 - protein, 9 aa, Artificial Sequence
  Description of Artificial Sequence: Synthetic peptide
  Seed: YFFPVIFSK (MAGA3_HUMAN)
YQFPVIFSK

SEQ ID NO: 53306 - protein, 9 aa, Artificial Sequence
  Description of Artificial Sequence: Synthetic peptide
  Seed: TQHFVQENY (MAGA3_HUMAN)
TMHFVQENL

SEQ ID NO: 53307 - protein, 9 aa, Artificial Sequence
  Description of Artificial Sequence: Synthetic peptide
  Seed: LSRKVAELV (MAGA3_HUMAN)
LQRKVAELV

SEQ ID NO: 53308 - protein, 9 aa, Artificial Sequence
  Description of Artificial Sequence: Synthetic peptide
  Seed: EVTLGEVPA (MAGA3_HUMAN)
ETTLGEVPV

SEQ ID NO: 53309 - protein, 10 aa, Artificial Sequence
  Description of Artificial Sequence: Synthetic peptide
  Seed: TLVEVTLGEV (MAGA3_HUMAN)
TTVEVTLGEI

SEQ ID NO: 53310 - protein, 10 aa, Artificial Sequence
  Description of Artificial Sequence: Synthetic peptide
  Seed: LYIFATCLGL (MAGA3_HUMAN)
LLIFATCLGI

SEQ ID NO: 53311 - protein, 9 aa, Artificial Sequence
  Description of Artificial Sequence: Synthetic peptide
  Seed: AASSSSTLV (MAGA3_HUMAN)
AVSSSSTLV

SEQ ID NO: 53312 - protein, 10 aa, Artificial Sequence
  Description of Artificial Sequence: Synthetic peptide
  Seed: AALSRKVAEL (MAGA3_HUMAN)
AGLSRKVAEV

SEQ ID NO: 53313 - protein, 10 aa, Artificial Sequence
  Description of Artificial Sequence: Synthetic peptide
  Seed: GLVGAQAPAT (MAGA3_HUMAN)
GMVGAQAPAI

SEQ ID NO: 53314 - protein, 10 aa, Artificial Sequence
  Description of Artificial Sequence: Synthetic peptide
  Seed: FSKASSSLQL (MAGA3_HUMAN)
FRKASSSLQM

SEQ ID NO: 53315 - protein, 10 aa, Artificial Sequence
  Description of Artificial Sequence: Synthetic peptide
  Seed: YIFATCLGLS (MAGA3_HUMAN)
YMFATCLGLA

SEQ ID NO: 53316 - protein, 9 aa, Artificial Sequence
  Description of Artificial Sequence: Synthetic peptide
  Seed: IMPKAGLLI (MAGA3_HUMAN)
IMPKAGLLY

SEQ ID NO: 53317 - protein, 9 aa, Artificial Sequence
  Description of Artificial Sequence: Synthetic peptide
  Seed: ISYPPLHEW (MAGA3_HUMAN)
IMYPPLHEF

SEQ ID NO: 53318 - protein, 10 aa, Artificial Sequence
  Description of Artificial Sequence: Synthetic peptide
  Seed: AALSRKVAEL (MAGA3_HUMAN)
AQLSRKVAEV

SEQ ID NO: 53319 - protein, 9 aa, Artificial Sequence
  Description of Artificial Sequence: Synthetic peptide
  Seed: IMPKAGLLI (MAGA3_HUMAN)
IAPKAGLLL

SEQ ID NO: 53320 - protein, 10 aa, Artificial Sequence
  Description of Artificial Sequence: Synthetic peptide
  Seed: MNYPLWSQSY (MAGA3_HUMAN)
MMYPLWSQSM

SEQ ID NO: 53321 - protein, 9 aa, Artificial Sequence
  Description of Artificial Sequence: Synthetic peptide
  Seed: IMPKAGLLI (MAGA3_HUMAN)
IIPKAGLLY

SEQ ID NO: 53322 - protein, 10 aa, Artificial Sequence
  Description of Artificial Sequence: Synthetic peptide
  Seed: RKVAELVHFL (MAGA3_HUMAN)
RAVAELVHFL

SEQ ID NO: 53323 - protein, 9 aa, Artificial Sequence
  Description of Artificial Sequence: Synthetic peptide
  Seed: HLYIFATCL (MAGA3_HUMAN)
HMYIFATCI

SEQ ID NO: 53324 - protein, 9 aa, Artificial Sequence
  Description of Artificial Sequence: Synthetic peptide
  Seed: QSPQGASSL (MAGA3_HUMAN)
QVPQGASSK

SEQ ID NO: 53325 - protein, 10 aa, Artificial Sequence
  Description of Artificial Sequence: Synthetic peptide
  Seed: MNYPLWSQSY (MAGA3_HUMAN)
MPYPLWSQSI

SEQ ID NO: 53326 - protein, 10 aa, Artificial Sequence
  Description of Artificial Sequence: Synthetic peptide
  Seed: SYVKVLHHMV (MAGA3_HUMAN)
SYVKVLHHMI

SEQ ID NO: 53327 - protein, 10 aa, Artificial Sequence
  Description of Artificial Sequence: Synthetic peptide
  Seed: MNYPLWSQSY (MAGA3_HUMAN)
MGYPLWSQSY

SEQ ID NO: 53328 - protein, 10 aa, Artificial Sequence
  Description of Artificial Sequence: Synthetic peptide
  Seed: HISYPPLHEW (MAGA3_HUMAN)
HYSYPPLHEF

SEQ ID NO: 53329 - protein, 10 aa, Artificial Sequence
  Description of Artificial Sequence: Synthetic peptide
  Seed: NWQYFFPVIF (MAGA3_HUMAN)
NLQYFFPVIF

SEQ ID NO: 53330 - protein, 9 aa, Artificial Sequence
  Description of Artificial Sequence: Synthetic peptide
  Seed: YIFATCLGL (MAGA3_HUMAN)
YLFATCLGS

SEQ ID NO: 53331 - protein, 9 aa, Artificial Sequence
  Description of Artificial Sequence: Synthetic peptide
  Seed: YIFATCLGL (MAGA3_HUMAN)
YIFATCLGW

SEQ ID NO: 53332 - protein, 10 aa, Artificial Sequence
  Description of Artificial Sequence: Synthetic peptide
  Seed: LGSVVGNWQY (MAGA3_HUMAN)
LMSVVGNWQW

SEQ ID NO: 53333 - protein, 10 aa, Artificial Sequence
  Description of Artificial Sequence: Synthetic peptide
  Seed: TSYVKVLHHM (MAGA3_HUMAN)
TCYVKVLHHW

SEQ ID NO: 53334 - protein, 9 aa, Artificial Sequence
  Description of Artificial Sequence: Synthetic peptide
  Seed: YFFPVIFSK (MAGA3_HUMAN)
YGFPVIFSK

SEQ ID NO: 53335 - protein, 9 aa, Artificial Sequence
  Description of Artificial Sequence: Synthetic peptide
  Seed: KVAELVHFL (MAGA3_HUMAN)
KFAELVHFY

SEQ ID NO: 53336 - protein, 9 aa, Artificial Sequence
  Description of Artificial Sequence: Synthetic peptide
  Seed: SVVGNWQYF (MAGA3_HUMAN)
SFVGNWQYI

SEQ ID NO: 53337 - protein, 9 aa, Artificial Sequence
  Description of Artificial Sequence: Synthetic peptide
  Seed: KVAELVHFL (MAGA3_HUMAN)
KLAELVHFG

SEQ ID NO: 53338 - protein, 9 aa, Artificial Sequence
  Description of Artificial Sequence: Synthetic peptide
  Seed: EALGLVGAQ (MAGA3_HUMAN)
EGLGLVGAR

SEQ ID NO: 53339 - protein, 9 aa, Artificial Sequence
  Description of Artificial Sequence: Synthetic peptide
  Seed: KIWEELSVL (MAGA3_HUMAN)
KQWEELSVY

SEQ ID NO: 53340 - protein, 11 aa, Artificial Sequence
  Description of Artificial Sequence: Synthetic peptide
  Seed: ELSVLEVFEGR (MAGA3_HUMAN)
EASVLEVFEGR

SEQ ID NO: 53341 - protein, 9 aa, Artificial Sequence
  Description of Artificial Sequence: Synthetic peptide
  Seed: VTLGEVPAA (MAGA3_HUMAN)
VALGEVPAI

SEQ ID NO: 53342 - protein, 10 aa, Artificial Sequence
  Description of Artificial Sequence: Synthetic peptide
  Seed: RKVAELVHFL (MAGA3_HUMAN)
RVVAELVHFV

SEQ ID NO: 53343 - protein, 10 aa, Artificial Sequence
  Description of Artificial Sequence: Synthetic peptide
  Seed: TSYVKVLHHM (MAGA3_HUMAN)
TKYVKVLHHI

SEQ ID NO: 53344 - protein, 10 aa, Artificial Sequence
  Description of Artificial Sequence: Synthetic peptide
  Seed: TSYVKVLHHM (MAGA3_HUMAN)
TTYVKVLHHF

SEQ ID NO: 53345 - protein, 9 aa, Artificial Sequence
  Description of Artificial Sequence: Synthetic peptide
  Seed: EELSVLEVF (MAGA3_HUMAN)
EELSVLEVW

SEQ ID NO: 53346 - protein, 10 aa, Artificial Sequence
  Description of Artificial Sequence: Synthetic peptide
  Seed: GIELMEVDPI (MAGA3_HUMAN)
GEELMEVDPL

SEQ ID NO: 53347 - protein, 9 aa, Artificial Sequence
  Description of Artificial Sequence: Synthetic peptide
  Seed: RKVAELVHF (MAGA3_HUMAN)
RKVAELVHY

SEQ ID NO: 53348 - protein, 9 aa, Artificial Sequence
  Description of Artificial Sequence: Synthetic peptide
  Seed: ILGDPKKLL (MAGA3_HUMAN)
ISGDPKKLM

SEQ ID NO: 53349 - protein, 9 aa, Artificial Sequence
  Description of Artificial Sequence: Synthetic peptide
  Seed: MLGSVVGNW (MAGA3_HUMAN)
MTGSVVGNW

SEQ ID NO: 53350 - protein, 10 aa, Artificial Sequence
  Description of Artificial Sequence: Synthetic peptide
  Seed: MNYPLWSQSY (MAGA3_HUMAN)
MGYPLWSQSV

SEQ ID NO: 53351 - protein, 9 aa, Artificial Sequence
  Description of Artificial Sequence: Synthetic peptide
  Seed: NYPLWSQSY (MAGA3_HUMAN)
NYPLWSQSW

SEQ ID NO: 53352 - protein, 9 aa, Artificial Sequence
  Description of Artificial Sequence: Synthetic peptide
  Seed: RQVPGSDPA (MAGA3_HUMAN)
RTVPGSDPF

SEQ ID NO: 53353 - protein, 10 aa, Artificial Sequence
  Description of Artificial Sequence: Synthetic peptide
  Seed: TSYVKVLHHM (MAGA3_HUMAN)
TRYVKVLHHW

SEQ ID NO: 53354 - protein, 10 aa, Artificial Sequence
  Description of Artificial Sequence: Synthetic peptide
  Seed: WQYFFPVIFS (MAGA3_HUMAN)
WQYFFPVIFM

SEQ ID NO: 53355 - protein, 9 aa, Artificial Sequence
  Description of Artificial Sequence: Synthetic peptide
  Seed: GEVPAAESP (MAGA3_HUMAN)
GEVPAAESM

SEQ ID NO: 53356 - protein, 10 aa, Artificial Sequence
  Description of Artificial Sequence: Synthetic peptide
  Seed: WEELSVLEVF (MAGA3_HUMAN)
WEELSVLEVW

SEQ ID NO: 53357 - protein, 9 aa, Artificial Sequence
  Description of Artificial Sequence: Synthetic peptide
  Seed: ALSRKVAEL (MAGA3_HUMAN)
ATSRKVAEY

SEQ ID NO: 53358 - protein, 9 aa, Artificial Sequence
  Description of Artificial Sequence: Synthetic peptide
  Seed: RKVAELVHF (MAGA3_HUMAN)
RYVAELVHF

SEQ ID NO: 53359 - protein, 8 aa, Artificial Sequence
  Description of Artificial Sequence: Synthetic peptide
  Seed: SGGPHISY (MAGA3_HUMAN)
SRGPHISM

SEQ ID NO: 53360 - protein, 10 aa, Artificial Sequence
  Description of Artificial Sequence: Synthetic peptide
  Seed: TSYVKVLHHM (MAGA3_HUMAN)
TGYVKVLHHI

SEQ ID NO: 53361 - protein, 9 aa, Artificial Sequence
  Description of Artificial Sequence: Synthetic peptide
  Seed: ALSRKVAEL (MAGA3_HUMAN)
AMSRKVAEM

SEQ ID NO: 53362 - protein, 11 aa, Artificial Sequence
  Description of Artificial Sequence: Synthetic peptide
  Seed: YIFATCLGLSY (MAGA3_HUMAN)
YPFATCLGLSM

SEQ ID NO: 53363 - protein, 10 aa, Artificial Sequence
  Description of Artificial Sequence: Synthetic peptide
  Seed: LGSVVGNWQY (MAGA3_HUMAN)
LDSVVGNWQF

SEQ ID NO: 53364 - protein, 10 aa, Artificial Sequence
  Description of Artificial Sequence: Synthetic peptide
  Seed: VIFSKASSSL (MAGA3_HUMAN)
VMFSKASSSL

SEQ ID NO: 53365 - protein, 10 aa, Artificial Sequence
  Description of Artificial Sequence: Synthetic peptide
  Seed: QEAASSSSTL (MAGA3_HUMAN)
QEAASSSSTW

SEQ ID NO: 53366 - protein, 9 aa, Artificial Sequence
  Description of Artificial Sequence: Synthetic peptide
  Seed: KVAELVHFL (MAGA3_HUMAN)
KTAELVHFK

SEQ ID NO: 53367 - protein, 10 aa, Artificial Sequence
  Description of Artificial Sequence: Synthetic peptide
  Seed: STFPDLESEF (MAGA3_HUMAN)
SFFPDLESEF

SEQ ID NO: 53368 - protein, 9 aa, Artificial Sequence
  Description of Artificial Sequence: Synthetic peptide
  Seed: SVVGNWQYF (MAGA3_HUMAN)
SAVGNWQYM

SEQ ID NO: 53369 - protein, 11 aa, Artificial Sequence
  Description of Artificial Sequence: Synthetic peptide
  Seed: FLWGPRALVET (MAGA3_HUMAN)
FVWGPRALVEI

SEQ ID NO: 53370 - protein, 9 aa, Artificial Sequence
  Description of Artificial Sequence: Synthetic peptide
  Seed: KVLHHMVKI (MAGA3_HUMAN)
KNLHHMVKR

SEQ ID NO: 53371 - protein, 9 aa, Artificial Sequence
  Description of Artificial Sequence: Synthetic peptide
  Seed: YFFPVIFSK (MAGA3_HUMAN)
YIFPVIFSF

SEQ ID NO: 53372 - protein, 11 aa, Artificial Sequence
  Description of Artificial Sequence: Synthetic peptide
  Seed: SKASSSLQLVF (MAGA3_HUMAN)
SKASSSLQLVY

SEQ ID NO: 53373 - protein, 9 aa, Artificial Sequence
  Description of Artificial Sequence: Synthetic peptide
  Seed: FLWGPRALV (MAGA3_HUMAN)
FAWGPRALI

SEQ ID NO: 53374 - protein, 9 aa, Artificial Sequence
  Description of Artificial Sequence: Synthetic peptide
  Seed: GNWQYFFPV (MAGA3_HUMAN)
GMWQYFFPI

SEQ ID NO: 53375 - protein, 9 aa, Artificial Sequence
  Description of Artificial Sequence: Synthetic peptide
  Seed: KVLHHMVKI (MAGA3_HUMAN)
KSLHHMVKI

SEQ ID NO: 53376 - protein, 9 aa, Artificial Sequence
  Description of Artificial Sequence: Synthetic peptide
  Seed: KIWEELSVL (MAGA3_HUMAN)
KVWEELSVI

SEQ ID NO: 53377 - protein, 9 aa, Artificial Sequence
  Description of Artificial Sequence: Synthetic peptide
  Seed: SSLQLVFGI (MAGA3_HUMAN)
SQLQLVFGW

SEQ ID NO: 53378 - protein, 10 aa, Artificial Sequence
  Description of Artificial Sequence: Synthetic peptide
  Seed: LYIFATCLGL (MAGA3_HUMAN)
LWIFATCLGV

SEQ ID NO: 53379 - protein, 9 aa, Artificial Sequence
  Description of Artificial Sequence: Synthetic peptide
  Seed: AQAPATEEQ (MAGA3_HUMAN)
AMAPATEEY

SEQ ID NO: 53380 - protein, 9 aa, Artificial Sequence
  Description of Artificial Sequence: Synthetic peptide
  Seed: VFEGREDSI (MAGA3_HUMAN)
VAEGREDSL

SEQ ID NO: 53381 - protein, 9 aa, Artificial Sequence
  Description of Artificial Sequence: Synthetic peptide
  Seed: TQHFVQENY (MAGA3_HUMAN)
TYHFVQENF

SEQ ID NO: 53382 - protein, 10 aa, Artificial Sequence
  Description of Artificial Sequence: Synthetic peptide
  Seed: YLEYRQVPGS (MAGA3_HUMAN)
YLEYRQVPGV

SEQ ID NO: 53383 - protein, 10 aa, Artificial Sequence
  Description of Artificial Sequence: Synthetic peptide
  Seed: EVFEGREDSI (MAGA3_HUMAN)
ETFEGREDSF

SEQ ID NO: 53384 - protein, 8 aa, Artificial Sequence
  Description of Artificial Sequence: Synthetic peptide
  Seed: YVKVLHHM (MAGA3_HUMAN)
YAKVLHHY

SEQ ID NO: 53385 - protein, 9 aa, Artificial Sequence
  Description of Artificial Sequence: Synthetic peptide
  Seed: AEMLGSVVG (MAGA3_HUMAN)
AEMLGSVVV

SEQ ID NO: 53386 - protein, 9 aa, Artificial Sequence
  Description of Artificial Sequence: Synthetic peptide
  Seed: KIWEELSVL (MAGA3_HUMAN)
KLWEELSVK

SEQ ID NO: 53387 - protein, 9 aa, Artificial Sequence
  Description of Artificial Sequence: Synthetic peptide
  Seed: FVQENYLEY (MAGA3_HUMAN)
FRQENYLEI

SEQ ID NO: 53388 - protein, 9 aa, Artificial Sequence
  Description of Artificial Sequence: Synthetic peptide
  Seed: GSVVGNWQY (MAGA3_HUMAN)
GMVVGNWQF

SEQ ID NO: 53389 - protein, 9 aa, Artificial Sequence
  Description of Artificial Sequence: Synthetic peptide
  Seed: QSPQGASSL (MAGA3_HUMAN)
QPPQGASSL

SEQ ID NO: 53390 - protein, 10 aa, Artificial Sequence
  Description of Artificial Sequence: Synthetic peptide
  Seed: VDPIGHLYIF (MAGA3_HUMAN)
VMPIGHLYIY

SEQ ID NO: 53391 - protein, 9 aa, Artificial Sequence
  Description of Artificial Sequence: Synthetic peptide
  Seed: LQLVFGIEL (MAGA3_HUMAN)
LQLVFGIEY

SEQ ID NO: 53392 - protein, 9 aa, Artificial Sequence
  Description of Artificial Sequence: Synthetic peptide
  Seed: QSPQGASSL (MAGA3_HUMAN)
QYPQGASSY

SEQ ID NO: 53393 - protein, 9 aa, Artificial Sequence
  Description of Artificial Sequence: Synthetic peptide
  Seed: LESEFQAAL (MAGA3_HUMAN)
LISEFQAAF

SEQ ID NO: 53394 - protein, 9 aa, Artificial Sequence
  Description of Artificial Sequence: Synthetic peptide
  Seed: QEAASSSST (MAGA3_HUMAN)
QEAASSSSP

SEQ ID NO: 53395 - protein, 10 aa, Artificial Sequence
  Description of Artificial Sequence: Synthetic peptide
  Seed: SSSTLVEVTL (MAGA3_HUMAN)
SASTLVEVTW

SEQ ID NO: 53396 - protein, 10 aa, Artificial Sequence
  Description of Artificial Sequence: Synthetic peptide
  Seed: MEVDPIGHLY (MAGA3_HUMAN)
MEVDPIGHLA

SEQ ID NO: 53397 - protein, 9 aa, Artificial Sequence
  Description of Artificial Sequence: Synthetic peptide
  Seed: MEVDPIGHL (MAGA3_HUMAN)
MTVDPIGHF

SEQ ID NO: 53398 - protein, 9 aa, Artificial Sequence
  Description of Artificial Sequence: Synthetic peptide
  Seed: AQAPATEEQ (MAGA3_HUMAN)
AQAPATEEF

SEQ ID NO: 53399 - protein, 10 aa, Artificial Sequence
  Description of Artificial Sequence: Synthetic peptide
  Seed: KASSSLQLVF (MAGA3_HUMAN)
KTSSSLQLVM

SEQ ID NO: 53400 - protein, 9 aa, Artificial Sequence
  Description of Artificial Sequence: Synthetic peptide
  Seed: SKASSSLQL (MAGA3_HUMAN)
SAASSSLQL

SEQ ID NO: 53401 - protein, 9 aa, Artificial Sequence
  Description of Artificial Sequence: Synthetic peptide
  Seed: EELSVLEVF (MAGA3_HUMAN)
EQLSVLEVW

SEQ ID NO: 53402 - protein, 9 aa, Artificial Sequence
  Description of Artificial Sequence: Synthetic peptide
  Seed: YIFATCLGL (MAGA3_HUMAN)
YSFATCLGI

SEQ ID NO: 53403 - protein, 9 aa, Artificial Sequence
  Description of Artificial Sequence: Synthetic peptide
  Seed: KASSSLQLV (MAGA3_HUMAN)
KYSSSLQLY

SEQ ID NO: 53404 - protein, 9 aa, Artificial Sequence
  Description of Artificial Sequence: Synthetic peptide
  Seed: LESEFQAAL (MAGA3_HUMAN)
LVSEFQAAY

SEQ ID NO: 53405 - protein, 8 aa, Artificial Sequence
  Description of Artificial Sequence: Synthetic peptide
  Seed: LGDPKKLL (MAGA3_HUMAN)
LWDPKKLL

SEQ ID NO: 53406 - protein, 9 aa, Artificial Sequence
  Description of Artificial Sequence: Synthetic peptide
  Seed: ISYPPLHEW (MAGA3_HUMAN)
IDYPPLHEY

SEQ ID NO: 53407 - protein, 9 aa, Artificial Sequence
  Description of Artificial Sequence: Synthetic peptide
  Seed: SYVKVLHHM (MAGA3_HUMAN)
SFVKVLHHL

SEQ ID NO: 53408 - protein, 10 aa, Artificial Sequence
  Description of Artificial Sequence: Synthetic peptide
  Seed: FSKASSSLQL (MAGA3_HUMAN)
FCKASSSLQM

SEQ ID NO: 53409 - protein, 9 aa, Artificial Sequence
  Description of Artificial Sequence: Synthetic peptide
  Seed: YIFATCLGL (MAGA3_HUMAN)
YIFATCLGA

SEQ ID NO: 53410 - protein, 10 aa, Artificial Sequence
  Description of Artificial Sequence: Synthetic peptide
  Seed: IFATCLGLSY (MAGA3_HUMAN)
ITATCLGLSF

SEQ ID NO: 53411 - protein, 9 aa, Artificial Sequence
  Description of Artificial Sequence: Synthetic peptide
  Seed: SYVKVLHHM (MAGA3_HUMAN)
SWVKVLHHL

SEQ ID NO: 53412 - protein, 11 aa, Artificial Sequence
  Description of Artificial Sequence: Synthetic peptide
  Seed: VPGSDPACYEF (MAGA3_HUMAN)
VPGSDPACYEY

SEQ ID NO: 53413 - protein, 11 aa, Artificial Sequence
  Description of Artificial Sequence: Synthetic peptide
  Seed: QLVFGIELMEV (MAGA3_HUMAN)
QYVFGIELMEV

SEQ ID NO: 53414 - protein, 11 aa, Artificial Sequence
  Description of Artificial Sequence: Synthetic peptide
  Seed: MEVDPIGHLYI (MAGA3_HUMAN)
MQVDPIGHLYI

SEQ ID NO: 53415 - protein, 10 aa, Artificial Sequence
  Description of Artificial Sequence: Synthetic peptide
  Seed: KAEMLGSVVG (MAGA3_HUMAN)
KTEMLGSVVV

SEQ ID NO: 53416 - protein, 9 aa, Artificial Sequence
  Description of Artificial Sequence: Synthetic peptide
  Seed: ISGGPHISY (MAGA3_HUMAN)
IIGGPHISW

SEQ ID NO: 53417 - protein, 10 aa, Artificial Sequence
  Description of Artificial Sequence: Synthetic peptide
  Seed: MNYPLWSQSY (MAGA3_HUMAN)
MKYPLWSQSV

SEQ ID NO: 53418 - protein, 9 aa, Artificial Sequence
  Description of Artificial Sequence: Synthetic peptide
  Seed: SSLQLVFGI (MAGA3_HUMAN)
STLQLVFGA

SEQ ID NO: 53419 - protein, 11 aa, Artificial Sequence
  Description of Artificial Sequence: Synthetic peptide
  Seed: AEMLGSVVGNW (MAGA3_HUMAN)
AEMLGSVVGNA

SEQ ID NO: 53420 - protein, 9 aa, Artificial Sequence
  Description of Artificial Sequence: Synthetic peptide
  Seed: SILGDPKKL (MAGA3_HUMAN)
SQLGDPKKY

SEQ ID NO: 53421 - protein, 10 aa, Artificial Sequence
  Description of Artificial Sequence: Synthetic peptide
  Seed: KAEMLGSVVG (MAGA3_HUMAN)
KNEMLGSVVA

SEQ ID NO: 53422 - protein, 9 aa, Artificial Sequence
  Description of Artificial Sequence: Synthetic peptide
  Seed: ASSSLQLVF (MAGA3_HUMAN)
AQSSLQLVL

SEQ ID NO: 53423 - protein, 11 aa, Artificial Sequence
  Description of Artificial Sequence: Synthetic peptide
  Seed: SYPPLHEWVLR (MAGA3_HUMAN)
SWPPLHEWVLW

SEQ ID NO: 53424 - protein, 9 aa, Artificial Sequence
  Description of Artificial Sequence: Synthetic peptide
  Seed: YPPLHEWVL (MAGA3_HUMAN)
YSPLHEWVY

SEQ ID NO: 53425 - protein, 9 aa, Artificial Sequence
  Description of Artificial Sequence: Synthetic peptide
  Seed: AESPDPPQS (MAGA3_HUMAN)
AESPDPPQP

SEQ ID NO: 53426 - protein, 10 aa, Artificial Sequence
  Description of Artificial Sequence: Synthetic peptide
  Seed: LTQHFVQENY (MAGA3_HUMAN)
LAQHFVQENW

SEQ ID NO: 53427 - protein, 9 aa, Artificial Sequence
  Description of Artificial Sequence: Synthetic peptide
  Seed: SKASSSLQL (MAGA3_HUMAN)
SMASSSLQL

SEQ ID NO: 53428 - protein, 11 aa, Artificial Sequence
  Description of Artificial Sequence: Synthetic peptide
  Seed: HCKPEEGLEAR (MAGA3_HUMAN)
HTKPEEGLEAR

SEQ ID NO: 53429 - protein, 9 aa, Artificial Sequence
  Description of Artificial Sequence: Synthetic peptide
  Seed: RKVAELVHF (MAGA3_HUMAN)
RGVAELVHY

SEQ ID NO: 53430 - protein, 9 aa, Artificial Sequence
  Description of Artificial Sequence: Synthetic peptide
  Seed: LESEFQAAL (MAGA3_HUMAN)
LESEFQAAV

SEQ ID NO: 53431 - protein, 9 aa, Artificial Sequence
  Description of Artificial Sequence: Synthetic peptide
  Seed: SSSSTLVEV (MAGA3_HUMAN)
SMSSTLVEF

SEQ ID NO: 53432 - protein, 10 aa, Artificial Sequence
  Description of Artificial Sequence: Synthetic peptide
  Seed: KVAELVHFLL (MAGA3_HUMAN)
KLAELVHFLP

SEQ ID NO: 53433 - protein, 9 aa, Artificial Sequence
  Description of Artificial Sequence: Synthetic peptide
  Seed: ISYPPLHEW (MAGA3_HUMAN)
IHYPPLHEM

SEQ ID NO: 53434 - protein, 9 aa, Artificial Sequence
  Description of Artificial Sequence: Synthetic peptide
  Seed: ASSSLQLVF (MAGA3_HUMAN)
AISSLQLVW

SEQ ID NO: 53435 - protein, 9 aa, Artificial Sequence
  Description of Artificial Sequence: Synthetic peptide
  Seed: TFPDLESEF (MAGA3_HUMAN)
TTPDLESEY

SEQ ID NO: 53436 - protein, 9 aa, Artificial Sequence
  Description of Artificial Sequence: Synthetic peptide
  Seed: SSSSTLVEV (MAGA3_HUMAN)
STSSTLVEM

SEQ ID NO: 53437 - protein, 10 aa, Artificial Sequence
  Description of Artificial Sequence: Synthetic peptide
  Seed: GLVGAQAPAT (MAGA3_HUMAN)
GLVGAQAPAV

SEQ ID NO: 53438 - protein, 9 aa, Artificial Sequence
  Description of Artificial Sequence: Synthetic peptide
  Seed: GPRALVETS (MAGA3_HUMAN)
GPRALVETL

SEQ ID NO: 53439 - protein, 10 aa, Artificial Sequence
  Description of Artificial Sequence: Synthetic peptide
  Seed: MEVDPIGHLY (MAGA3_HUMAN)
MWVDPIGHLY

SEQ ID NO: 53440 - protein, 10 aa, Artificial Sequence
  Description of Artificial Sequence: Synthetic peptide
  Seed: MNYPLWSQSY (MAGA3_HUMAN)
MNYPLWSQSW

SEQ ID NO: 53441 - protein, 9 aa, Artificial Sequence
  Description of Artificial Sequence: Synthetic peptide
  Seed: EAASSSSTL (MAGA3_HUMAN)
ETASSSSTV

SEQ ID NO: 53442 - protein, 9 aa, Artificial Sequence
  Description of Artificial Sequence: Synthetic peptide
  Seed: ALSRKVAEL (MAGA3_HUMAN)
AASRKVAEI

SEQ ID NO: 53443 - protein, 10 aa, Artificial Sequence
  Description of Artificial Sequence: Synthetic peptide
  Seed: ISYPPLHEWV (MAGA3_HUMAN)
IYYPPLHEWI

SEQ ID NO: 53444 - protein, 10 aa, Artificial Sequence
  Description of Artificial Sequence: Synthetic peptide
  Seed: MVKISGGPHI (MAGA3_HUMAN)
MLKISGGPHY

SEQ ID NO: 53445 - protein, 11 aa, Artificial Sequence
  Description of Artificial Sequence: Synthetic peptide
  Seed: KIWEELSVLEV (MAGA3_HUMAN)
KQWEELSVLEM

SEQ ID NO: 53446 - protein, 10 aa, Artificial Sequence
  Description of Artificial Sequence: Synthetic peptide
  Seed: LGSVVGNWQY (MAGA3_HUMAN)
LQSVVGNWQF

SEQ ID NO: 53447 - protein, 10 aa, Artificial Sequence
  Description of Artificial Sequence: Synthetic peptide
  Seed: MVKISGGPHI (MAGA3_HUMAN)
MNKISGGPHY

SEQ ID NO: 53448 - protein, 9 aa, Artificial Sequence
  Description of Artificial Sequence: Synthetic peptide
  Seed: KVAELVHFL (MAGA3_HUMAN)
KQAELVHFR

SEQ ID NO: 53449 - protein, 9 aa, Artificial Sequence
  Description of Artificial Sequence: Synthetic peptide
  Seed: LPTTMNYPL (MAGA3_HUMAN)
LPTTMNYPW

SEQ ID NO: 53450 - protein, 9 aa, Artificial Sequence
  Description of Artificial Sequence: Synthetic peptide
  Seed: EVDPIGHLY (MAGA3_HUMAN)
EFDPIGHLW

SEQ ID NO: 53451 - protein, 9 aa, Artificial Sequence
  Description of Artificial Sequence: Synthetic peptide
  Seed: GSVVGNWQY (MAGA3_HUMAN)
GFVVGNWQY

SEQ ID NO: 53452 - protein, 9 aa, Artificial Sequence
  Description of Artificial Sequence: Synthetic peptide
  Seed: WQYFFPVIF (MAGA3_HUMAN)
WEYFFPVII

SEQ ID NO: 53453 - protein, 9 aa, Artificial Sequence
  Description of Artificial Sequence: Synthetic peptide
  Seed: FQAALSRKV (MAGA3_HUMAN)
FQAALSRKI

SEQ ID NO: 53454 - protein, 9 aa, Artificial Sequence
  Description of Artificial Sequence: Synthetic peptide
  Seed: IMPKAGLLI (MAGA3_HUMAN)
IMPKAGLLF

SEQ ID NO: 53455 - protein, 9 aa, Artificial Sequence
  Description of Artificial Sequence: Synthetic peptide
  Seed: SSTLVEVTL (MAGA3_HUMAN)
SMTLVEVTY

SEQ ID NO: 53456 - protein, 11 aa, Artificial Sequence
  Description of Artificial Sequence: Synthetic peptide
  Seed: YIFATCLGLSY (MAGA3_HUMAN)
YMFATCLGLSM

SEQ ID NO: 53457 - protein, 10 aa, Artificial Sequence
  Description of Artificial Sequence: Synthetic peptide
  Seed: FLWGPRALVE (MAGA3_HUMAN)
FLWGPRALVP

SEQ ID NO: 53458 - protein, 9 aa, Artificial Sequence
  Description of Artificial Sequence: Synthetic peptide
  Seed: KASSSLQLV (MAGA3_HUMAN)
KRSSSLQLL

SEQ ID NO: 53459 - protein, 11 aa, Artificial Sequence
  Description of Artificial Sequence: Synthetic peptide
  Seed: AEMLGSVVGNW (MAGA3_HUMAN)
AEMLGSVVGNY

SEQ ID NO: 53460 - protein, 9 aa, Artificial Sequence
  Description of Artificial Sequence: Synthetic peptide
  Seed: FPVIFSKAS (MAGA3_HUMAN)
FPVIFSKAY

SEQ ID NO: 53461 - protein, 9 aa, Artificial Sequence
  Description of Artificial Sequence: Synthetic peptide
  Seed: YIFATCLGL (MAGA3_HUMAN)
YKFATCLGF

SEQ ID NO: 53462 - protein, 10 aa, Artificial Sequence
  Description of Artificial Sequence: Synthetic peptide
  Seed: LYIFATCLGL (MAGA3_HUMAN)
LMIFATCLGA

SEQ ID NO: 53463 - protein, 9 aa, Artificial Sequence
  Description of Artificial Sequence: Synthetic peptide
  Seed: AELVHFLLL (MAGA3_HUMAN)
AELVHFLLW

SEQ ID NO: 53464 - protein, 9 aa, Artificial Sequence
  Description of Artificial Sequence: Synthetic peptide
  Seed: EALGLVGAQ (MAGA3_HUMAN)
ELLGLVGAK

SEQ ID NO: 53465 - protein, 9 aa, Artificial Sequence
  Description of Artificial Sequence: Synthetic peptide
  Seed: KVAELVHFL (MAGA3_HUMAN)
KMAELVHFA

SEQ ID NO: 53466 - protein, 10 aa, Artificial Sequence
  Description of Artificial Sequence: Synthetic peptide
  Seed: RKVAELVHFL (MAGA3_HUMAN)
RLVAELVHFV

SEQ ID NO: 53467 - protein, 10 aa, Artificial Sequence
  Description of Artificial Sequence: Synthetic peptide
  Seed: AALSRKVAEL (MAGA3_HUMAN)
AFLSRKVAEA

SEQ ID NO: 53468 - protein, 8 aa, Artificial Sequence
  Description of Artificial Sequence: Synthetic peptide
  Seed: KIWEELSV (MAGA3_HUMAN)
KLWEELSV

SEQ ID NO: 53469 - protein, 10 aa, Artificial Sequence
  Description of Artificial Sequence: Synthetic peptide
  Seed: LGSVVGNWQY (MAGA3_HUMAN)
LPSVVGNWQF

SEQ ID NO: 53470 - protein, 9 aa, Artificial Sequence
  Description of Artificial Sequence: Synthetic peptide
  Seed: RQVPGSDPA (MAGA3_HUMAN)
RAVPGSDPY

SEQ ID NO: 53471 - protein, 9 aa, Artificial Sequence
  Description of Artificial Sequence: Synthetic peptide
  Seed: IMPKAGLLI (MAGA3_HUMAN)
ITPKAGLLL

SEQ ID NO: 53472 - protein, 10 aa, Artificial Sequence
  Description of Artificial Sequence: Synthetic peptide
  Seed: KASSSLQLVF (MAGA3_HUMAN)
KYSSSLQLVM

SEQ ID NO: 53473 - protein, 10 aa, Artificial Sequence
  Description of Artificial Sequence: Synthetic peptide
  Seed: FFPVIFSKAS (MAGA3_HUMAN)
FSPVIFSKAV

SEQ ID NO: 53474 - protein, 9 aa, Artificial Sequence
  Description of Artificial Sequence: Synthetic peptide
  Seed: SSLPTTMNY (MAGA3_HUMAN)
SWLPTTMNF

SEQ ID NO: 53475 - protein, 9 aa, Artificial Sequence
  Description of Artificial Sequence: Synthetic peptide
  Seed: FVQENYLEY (MAGA3_HUMAN)
FMQENYLEW

SEQ ID NO: 53476 - protein, 10 aa, Artificial Sequence
  Description of Artificial Sequence: Synthetic peptide
  Seed: STFPDLESEF (MAGA3_HUMAN)
SIFPDLESEY

SEQ ID NO: 53477 - protein, 8 aa, Artificial Sequence
  Description of Artificial Sequence: Synthetic peptide
  Seed: FPDLESEF (MAGA3_HUMAN)
FLDLESEM

SEQ ID NO: 53478 - protein, 10 aa, Artificial Sequence
  Description of Artificial Sequence: Synthetic peptide
  Seed: LGLVGAQAPA (MAGA3_HUMAN)
LFLVGAQAPA

SEQ ID NO: 53479 - protein, 10 aa, Artificial Sequence
  Description of Artificial Sequence: Synthetic peptide
  Seed: ASSLPTTMNY (MAGA3_HUMAN)
ARSLPTTMNW

SEQ ID NO: 53480 - protein, 10 aa, Artificial Sequence
  Description of Artificial Sequence: Synthetic peptide
  Seed: SPQGASSLPT (MAGA3_HUMAN)
SPQGASSLPA

SEQ ID NO: 53481 - protein, 9 aa, Artificial Sequence
  Description of Artificial Sequence: Synthetic peptide
  Seed: TSYVKVLHH (MAGA3_HUMAN)
TGYVKVLHF

SEQ ID NO: 53482 - protein, 8 aa, Artificial Sequence
  Description of Artificial Sequence: Synthetic peptide
  Seed: FPDLESEF (MAGA3_HUMAN)
FMDLESEF

SEQ ID NO: 53483 - protein, 9 aa, Artificial Sequence
  Description of Artificial Sequence: Synthetic peptide
  Seed: QSPQGASSL (MAGA3_HUMAN)
QFPQGASSL

SEQ ID NO: 53484 - protein, 10 aa, Artificial Sequence
  Description of Artificial Sequence: Synthetic peptide
  Seed: ASSSLQLVFG (MAGA3_HUMAN)
ASSSLQLVFF

SEQ ID NO: 53485 - protein, 10 aa, Artificial Sequence
  Description of Artificial Sequence: Synthetic peptide
  Seed: MNYPLWSQSY (MAGA3_HUMAN)
MRYPLWSQSF

SEQ ID NO: 53486 - protein, 11 aa, Artificial Sequence
  Description of Artificial Sequence: Synthetic peptide
  Seed: KIWEELSVLEV (MAGA3_HUMAN)
KLWEELSVLEV

SEQ ID NO: 53487 - protein, 11 aa, Artificial Sequence
  Description of Artificial Sequence: Synthetic peptide
  Seed: REGDCAPEEKI (MAGA3_HUMAN)
RMGDCAPEEKF

SEQ ID NO: 53488 - protein, 9 aa, Artificial Sequence
  Description of Artificial Sequence: Synthetic peptide
  Seed: ALVETSYVK (MAGA3_HUMAN)
ATVETSYVK

SEQ ID NO: 53489 - protein, 9 aa, Artificial Sequence
  Description of Artificial Sequence: Synthetic peptide
  Seed: RKVAELVHF (MAGA3_HUMAN)
RMVAELVHF

SEQ ID NO: 53490 - protein, 11 aa, Artificial Sequence
  Description of Artificial Sequence: Synthetic peptide
  Seed: ALVETSYVKVL (MAGA3_HUMAN)
ALVETSYVKVV

SEQ ID NO: 53491 - protein, 9 aa, Artificial Sequence
  Description of Artificial Sequence: Synthetic peptide
  Seed: SKASSSLQL (MAGA3_HUMAN)
SQASSSLQF

SEQ ID NO: 53492 - protein, 9 aa, Artificial Sequence
  Description of Artificial Sequence: Synthetic peptide
  Seed: SSLQLVFGI (MAGA3_HUMAN)
SMLQLVFGF

SEQ ID NO: 53493 - protein, 9 aa, Artificial Sequence
  Description of Artificial Sequence: Synthetic peptide
  Seed: QLVFGIELM (MAGA3_HUMAN)
QMVFGIELY

SEQ ID NO: 53494 - protein, 9 aa, Artificial Sequence
  Description of Artificial Sequence: Synthetic peptide
  Seed: SYPPLHEWV (MAGA3_HUMAN)
SWPPLHEWL

SEQ ID NO: 53495 - protein, 10 aa, Artificial Sequence
  Description of Artificial Sequence: Synthetic peptide
  Seed: YIFATCLGLS (MAGA3_HUMAN)
YMFATCLGLR

SEQ ID NO: 53496 - protein, 11 aa, Artificial Sequence
  Description of Artificial Sequence: Synthetic peptide
  Seed: KVAELVHFLLL (MAGA3_HUMAN)
KLAELVHFLLS

SEQ ID NO: 53497 - protein, 10 aa, Artificial Sequence
  Description of Artificial Sequence: Synthetic peptide
  Seed: KASSSLQLVF (MAGA3_HUMAN)
KLSSSLQLVF

SEQ ID NO: 53498 - protein, 10 aa, Artificial Sequence
  Description of Artificial Sequence: Synthetic peptide
  Seed: MVKISGGPHI (MAGA3_HUMAN)
MTKISGGPHM

SEQ ID NO: 53499 - protein, 10 aa, Artificial Sequence
  Description of Artificial Sequence: Synthetic peptide
  Seed: MNYPLWSQSY (MAGA3_HUMAN)
MYYPLWSQSY

SEQ ID NO: 53500 - protein, 9 aa, Artificial Sequence
  Description of Artificial Sequence: Synthetic peptide
  Seed: LESEFQAAL (MAGA3_HUMAN)
LASEFQAAL

SEQ ID NO: 53501 - protein, 10 aa, Artificial Sequence
  Description of Artificial Sequence: Synthetic peptide
  Seed: QVPGSDPACY (MAGA3_HUMAN)
QMPGSDPACF

SEQ ID NO: 53502 - protein, 11 aa, Artificial Sequence
  Description of Artificial Sequence: Synthetic peptide
  Seed: KIWEELSVLEV (MAGA3_HUMAN)
KLWEELSVLEM

SEQ ID NO: 53503 - protein, 10 aa, Artificial Sequence
  Description of Artificial Sequence: Synthetic peptide
  Seed: AALSRKVAEL (MAGA3_HUMAN)
AWLSRKVAEV

SEQ ID NO: 53504 - protein, 10 aa, Artificial Sequence
  Description of Artificial Sequence: Synthetic peptide
  Seed: STFPDLESEF (MAGA3_HUMAN)
SCFPDLESEW

SEQ ID NO: 53505 - protein, 10 aa, Artificial Sequence
  Description of Artificial Sequence: Synthetic peptide
  Seed: MNYPLWSQSY (MAGA3_HUMAN)
MRYPLWSQSW

SEQ ID NO: 53506 - protein, 9 aa, Artificial Sequence
  Description of Artificial Sequence: Synthetic peptide
  Seed: RALVETSYV (MAGA3_HUMAN)
RSLVETSYK

SEQ ID NO: 53507 - protein, 9 aa, Artificial Sequence
  Description of Artificial Sequence: Synthetic peptide
  Seed: VFEGREDSI (MAGA3_HUMAN)
VYEGREDSL

SEQ ID NO: 53508 - protein, 11 aa, Artificial Sequence
  Description of Artificial Sequence: Synthetic peptide
  Seed: YIFATCLGLSY (MAGA3_HUMAN)
YTFATCLGLSW

SEQ ID NO: 53509 - protein, 9 aa, Artificial Sequence
  Description of Artificial Sequence: Synthetic peptide
  Seed: HLYIFATCL (MAGA3_HUMAN)
HMYIFATCL

SEQ ID NO: 53510 - protein, 9 aa, Artificial Sequence
  Description of Artificial Sequence: Synthetic peptide
  Seed: GASSLPTTM (MAGA3_HUMAN)
GASSLPTTW

SEQ ID NO: 53511 - protein, 9 aa, Artificial Sequence
  Description of Artificial Sequence: Synthetic peptide
  Seed: EALGLVGAQ (MAGA3_HUMAN)
EQLGLVGAR

SEQ ID NO: 53512 - protein, 11 aa, Artificial Sequence
  Description of Artificial Sequence: Synthetic peptide
  Seed: KVAELVHFLLL (MAGA3_HUMAN)
KMAELVHFLLR

SEQ ID NO: 53513 - protein, 10 aa, Artificial Sequence
  Description of Artificial Sequence: Synthetic peptide
  Seed: LQLVFGIELM (MAGA3_HUMAN)
LCLVFGIELV

SEQ ID NO: 53514 - protein, 10 aa, Artificial Sequence
  Description of Artificial Sequence: Synthetic peptide
  Seed: KVAELVHFLL (MAGA3_HUMAN)
KLAELVHFLI

SEQ ID NO: 53515 - protein, 9 aa, Artificial Sequence
  Description of Artificial Sequence: Synthetic peptide
  Seed: SEFQAALSR (MAGA3_HUMAN)
SEFQAALSW

SEQ ID NO: 53516 - protein, 10 aa, Artificial Sequence
  Description of Artificial Sequence: Synthetic peptide
  Seed: FSKASSSLQL (MAGA3_HUMAN)
FDKASSSLQY

SEQ ID NO: 53517 - protein, 10 aa, Artificial Sequence
  Description of Artificial Sequence: Synthetic peptide
  Seed: NQEEEGPSTF (MAGA3_HUMAN)
NEEEEGPSTL

SEQ ID NO: 53518 - protein, 9 aa, Artificial Sequence
  Description of Artificial Sequence: Synthetic peptide
  Seed: LESEFQAAL (MAGA3_HUMAN)
LMSEFQAAW

SEQ ID NO: 53519 - protein, 9 aa, Artificial Sequence
  Description of Artificial Sequence: Synthetic peptide
  Seed: VQENYLEYR (MAGA3_HUMAN)
VAENYLEYY

SEQ ID NO: 53520 - protein, 10 aa, Artificial Sequence
  Description of Artificial Sequence: Synthetic peptide
  Seed: MEVDPIGHLY (MAGA3_HUMAN)
MLVDPIGHLR

SEQ ID NO: 53521 - protein, 10 aa, Artificial Sequence
  Description of Artificial Sequence: Synthetic peptide
  Seed: NWQYFFPVIF (MAGA3_HUMAN)
NQQYFFPVIY

SEQ ID NO: 53522 - protein, 10 aa, Artificial Sequence
  Description of Artificial Sequence: Synthetic peptide
  Seed: QVPGSDPACY (MAGA3_HUMAN)
QPPGSDPACY

SEQ ID NO: 53523 - protein, 10 aa, Artificial Sequence
  Description of Artificial Sequence: Synthetic peptide
  Seed: HISYPPLHEW (MAGA3_HUMAN)
HVSYPPLHEY

SEQ ID NO: 53524 - protein, 9 aa, Artificial Sequence
  Description of Artificial Sequence: Synthetic peptide
  Seed: ISYPPLHEW (MAGA3_HUMAN)
IMYPPLHEI

SEQ ID NO: 53525 - protein, 9 aa, Artificial Sequence
  Description of Artificial Sequence: Synthetic peptide
  Seed: GNWQYFFPV (MAGA3_HUMAN)
GIWQYFFPM

SEQ ID NO: 53526 - protein, 10 aa, Artificial Sequence
  Description of Artificial Sequence: Synthetic peptide
  Seed: KVAELVHFLL (MAGA3_HUMAN)
KGAELVHFLW

SEQ ID NO: 53527 - protein, 10 aa, Artificial Sequence
  Description of Artificial Sequence: Synthetic peptide
  Seed: FPVIFSKASS (MAGA3_HUMAN)
FPVIFSKAST

SEQ ID NO: 53528 - protein, 11 aa, Artificial Sequence
  Description of Artificial Sequence: Synthetic peptide
  Seed: EEGLEARGEAL (MAGA3_HUMAN)
EEGLEARGEAY

SEQ ID NO: 53529 - protein, 11 aa, Artificial Sequence
  Description of Artificial Sequence: Synthetic peptide
  Seed: EEGLEARGEAL (MAGA3_HUMAN)
EEGLEARGEAW

SEQ ID NO: 53530 - protein, 9 aa, Artificial Sequence
  Description of Artificial Sequence: Synthetic peptide
  Seed: LGDPKKLLT (MAGA3_HUMAN)
LTDPKKLLI

SEQ ID NO: 53531 - protein, 9 aa, Artificial Sequence
  Description of Artificial Sequence: Synthetic peptide
  Seed: LLIIVLAII (MAGA3_HUMAN)
LMIIVLAIV

SEQ ID NO: 53532 - protein, 9 aa, Artificial Sequence
  Description of Artificial Sequence: Synthetic peptide
  Seed: QSPQGASSL (MAGA3_HUMAN)
QIPQGASSV

SEQ ID NO: 53533 - protein, 9 aa, Artificial Sequence
  Description of Artificial Sequence: Synthetic peptide
  Seed: NYPLWSQSY (MAGA3_HUMAN)
NVPLWSQSY

SEQ ID NO: 53534 - protein, 11 aa, Artificial Sequence
  Description of Artificial Sequence: Synthetic peptide
  Seed: YIFATCLGLSY (MAGA3_HUMAN)
YKFATCLGLSF

SEQ ID NO: 53535 - protein, 9 aa, Artificial Sequence
  Description of Artificial Sequence: Synthetic peptide
  Seed: FATCLGLSY (MAGA3_HUMAN)
FATCLGLSF

SEQ ID NO: 53536 - protein, 9 aa, Artificial Sequence
  Description of Artificial Sequence: Synthetic peptide
  Seed: GSDPACYEF (MAGA3_HUMAN)
GFDPACYEV

SEQ ID NO: 53537 - protein, 9 aa, Artificial Sequence
  Description of Artificial Sequence: Synthetic peptide
  Seed: GSDPACYEF (MAGA3_HUMAN)
GVDPACYEF

SEQ ID NO: 53538 - protein, 10 aa, Artificial Sequence
  Description of Artificial Sequence: Synthetic peptide
  Seed: STFPDLESEF (MAGA3_HUMAN)
SIFPDLESEW

SEQ ID NO: 53539 - protein, 9 aa, Artificial Sequence
  Description of Artificial Sequence: Synthetic peptide
  Seed: EVDPIGHLY (MAGA3_HUMAN)
EQDPIGHLY

SEQ ID NO: 53540 - protein, 9 aa, Artificial Sequence
  Description of Artificial Sequence: Synthetic peptide
  Seed: KVAELVHFL (MAGA3_HUMAN)
KAAELVHFM

SEQ ID NO: 53541 - protein, 10 aa, Artificial Sequence
  Description of Artificial Sequence: Synthetic peptide
  Seed: ASSLPTTMNY (MAGA3_HUMAN)
AKSLPTTMNY

SEQ ID NO: 53542 - protein, 10 aa, Artificial Sequence
  Description of Artificial Sequence: Synthetic peptide
  Seed: NWQYFFPVIF (MAGA3_HUMAN)
NQQYFFPVIM

SEQ ID NO: 53543 - protein, 10 aa, Artificial Sequence
  Description of Artificial Sequence: Synthetic peptide
  Seed: KVAELVHFLL (MAGA3_HUMAN)
KVAELVHFLR

SEQ ID NO: 53544 - protein, 9 aa, Artificial Sequence
  Description of Artificial Sequence: Synthetic peptide
  Seed: FATCLGLSY (MAGA3_HUMAN)
FVTCLGLSL

SEQ ID NO: 53545 - protein, 10 aa, Artificial Sequence
  Description of Artificial Sequence: Synthetic peptide
  Seed: AELVHFLLLK (MAGA3_HUMAN)
AYLVHFLLLR

SEQ ID NO: 53546 - protein, 10 aa, Artificial Sequence
  Description of Artificial Sequence: Synthetic peptide
  Seed: RKVAELVHFL (MAGA3_HUMAN)
RNVAELVHFV

SEQ ID NO: 53547 - protein, 10 aa, Artificial Sequence
  Description of Artificial Sequence: Synthetic peptide
  Seed: IFATCLGLSY (MAGA3_HUMAN)
IYATCLGLSL

SEQ ID NO: 53548 - protein, 9 aa, Artificial Sequence
  Description of Artificial Sequence: Synthetic peptide
  Seed: LEYRQVPGS (MAGA3_HUMAN)
LEYRQVPGI

SEQ ID NO: 53549 - protein, 9 aa, Artificial Sequence
  Description of Artificial Sequence: Synthetic peptide
  Seed: SSLQLVFGI (MAGA3_HUMAN)
STLQLVFGM

SEQ ID NO: 53550 - protein, 9 aa, Artificial Sequence
  Description of Artificial Sequence: Synthetic peptide
  Seed: MVKISGGPH (MAGA3_HUMAN)
MAKISGGPM

SEQ ID NO: 53551 - protein, 10 aa, Artificial Sequence
  Description of Artificial Sequence: Synthetic peptide
  Seed: ASSLPTTMNY (MAGA3_HUMAN)
AKSLPTTMNK

SEQ ID NO: 53552 - protein, 10 aa, Artificial Sequence
  Description of Artificial Sequence: Synthetic peptide
  Seed: ISYPPLHEWV (MAGA3_HUMAN)
IDYPPLHEWW

SEQ ID NO: 53553 - protein, 10 aa, Artificial Sequence
  Description of Artificial Sequence: Synthetic peptide
  Seed: KASSSLQLVF (MAGA3_HUMAN)
KHSSSLQLVI

SEQ ID NO: 53554 - protein, 10 aa, Artificial Sequence
  Description of Artificial Sequence: Synthetic peptide
  Seed: KVAELVHFLL (MAGA3_HUMAN)
KMAELVHFLE

SEQ ID NO: 53555 - protein, 10 aa, Artificial Sequence
  Description of Artificial Sequence: Synthetic peptide
  Seed: FSKASSSLQL (MAGA3_HUMAN)
FIKASSSLQM

SEQ ID NO: 53556 - protein, 10 aa, Artificial Sequence
  Description of Artificial Sequence: Synthetic peptide
  Seed: KISGGPHISY (MAGA3_HUMAN)
KLSGGPHISY

SEQ ID NO: 53557 - protein, 9 aa, Artificial Sequence
  Description of Artificial Sequence: Synthetic peptide
  Seed: YIFATCLGL (MAGA3_HUMAN)
YAFATCLGR

SEQ ID NO: 53558 - protein, 10 aa, Artificial Sequence
  Description of Artificial Sequence: Synthetic peptide
  Seed: SVVGNWQYFF (MAGA3_HUMAN)
SYVGNWQYFL

SEQ ID NO: 53559 - protein, 9 aa, Artificial Sequence
  Description of Artificial Sequence: Synthetic peptide
  Seed: MEVDPIGHL (MAGA3_HUMAN)
MIVDPIGHI

SEQ ID NO: 53560 - protein, 9 aa, Artificial Sequence
  Description of Artificial Sequence: Synthetic peptide
  Seed: VTLGEVPAA (MAGA3_HUMAN)
VVLGEVPAL

SEQ ID NO: 53561 - protein, 9 aa, Artificial Sequence
  Description of Artificial Sequence: Synthetic peptide
  Seed: KIWEELSVL (MAGA3_HUMAN)
KMWEELSVS

SEQ ID NO: 53562 - protein, 9 aa, Artificial Sequence
  Description of Artificial Sequence: Synthetic peptide
  Seed: ALSRKVAEL (MAGA3_HUMAN)
AFSRKVAEM

SEQ ID NO: 53563 - protein, 11 aa, Artificial Sequence
  Description of Artificial Sequence: Synthetic peptide
  Seed: MLGSVVGNWQY (MAGA3_HUMAN)
MLGSVVGNWQW

SEQ ID NO: 53564 - protein, 10 aa, Artificial Sequence
  Description of Artificial Sequence: Synthetic peptide
  Seed: DLESEFQAAL (MAGA3_HUMAN)
DKESEFQAAY

SEQ ID NO: 53565 - protein, 11 aa, Artificial Sequence
  Description of Artificial Sequence: Synthetic peptide
  Seed: VVGNWQYFFPV (MAGA3_HUMAN)
VMGNWQYFFPA

SEQ ID NO: 53566 - protein, 11 aa, Artificial Sequence
  Description of Artificial Sequence: Synthetic peptide
  Seed: HFVQENYLEYR (MAGA3_HUMAN)
HMVQENYLEYR

SEQ ID NO: 53567 - protein, 9 aa, Artificial Sequence
  Description of Artificial Sequence: Synthetic peptide
  Seed: GASSLPTTM (MAGA3_HUMAN)
GLSSLPTTI

SEQ ID NO: 53568 - protein, 10 aa, Artificial Sequence
  Description of Artificial Sequence: Synthetic peptide
  Seed: YVKVLHHMVK (MAGA3_HUMAN)
YMKVLHHMVR

SEQ ID NO: 53569 - protein, 9 aa, Artificial Sequence
  Description of Artificial Sequence: Synthetic peptide
  Seed: KASSSLQLV (MAGA3_HUMAN)
KTSSSLQLV

SEQ ID NO: 53570 - protein, 9 aa, Artificial Sequence
  Description of Artificial Sequence: Synthetic peptide
  Seed: SILGDPKKL (MAGA3_HUMAN)
SQLGDPKKW

SEQ ID NO: 53571 - protein, 11 aa, Artificial Sequence
  Description of Artificial Sequence: Synthetic peptide
  Seed: MEVDPIGHLYI (MAGA3_HUMAN)
MEVDPIGHLYY

SEQ ID NO: 53572 - protein, 9 aa, Artificial Sequence
  Description of Artificial Sequence: Synthetic peptide
  Seed: MEVDPIGHL (MAGA3_HUMAN)
MHVDPIGHL

SEQ ID NO: 53573 - protein, 9 aa, Artificial Sequence
  Description of Artificial Sequence: Synthetic peptide
  Seed: YIFATCLGL (MAGA3_HUMAN)
YTFATCLGY

SEQ ID NO: 53574 - protein, 11 aa, Artificial Sequence
  Description of Artificial Sequence: Synthetic peptide
  Seed: KVAELVHFLLL (MAGA3_HUMAN)
KMAELVHFLLN

SEQ ID NO: 53575 - protein, 9 aa, Artificial Sequence
  Description of Artificial Sequence: Synthetic peptide
  Seed: ISYPPLHEW (MAGA3_HUMAN)
ICYPPLHEI

SEQ ID NO: 53576 - protein, 10 aa, Artificial Sequence
  Description of Artificial Sequence: Synthetic peptide
  Seed: MNYPLWSQSY (MAGA3_HUMAN)
MWYPLWSQSW

SEQ ID NO: 53577 - protein, 9 aa, Artificial Sequence
  Description of Artificial Sequence: Synthetic peptide
  Seed: SYPPLHEWV (MAGA3_HUMAN)
SWPPLHEWI

SEQ ID NO: 53578 - protein, 10 aa, Artificial Sequence
  Description of Artificial Sequence: Synthetic peptide
  Seed: MNYPLWSQSY (MAGA3_HUMAN)
MKYPLWSQSF

SEQ ID NO: 53579 - protein, 9 aa, Artificial Sequence
  Description of Artificial Sequence: Synthetic peptide
  Seed: GNWQYFFPV (MAGA3_HUMAN)
GQWQYFFPT

SEQ ID NO: 53580 - protein, 10 aa, Artificial Sequence
  Description of Artificial Sequence: Synthetic peptide
  Seed: YRQVPGSDPA (MAGA3_HUMAN)
YVQVPGSDPL

SEQ ID NO: 53581 - protein, 10 aa, Artificial Sequence
  Description of Artificial Sequence: Synthetic peptide
  Seed: LGLVGAQAPA (MAGA3_HUMAN)
LCLVGAQAPV

SEQ ID NO: 53582 - protein, 10 aa, Artificial Sequence
  Description of Artificial Sequence: Synthetic peptide
  Seed: NWQYFFPVIF (MAGA3_HUMAN)
NYQYFFPVII

SEQ ID NO: 53583 - protein, 8 aa, Artificial Sequence
  Description of Artificial Sequence: Synthetic peptide
  Seed: EELSVLEV (MAGA3_HUMAN)
EELSVLEY

SEQ ID NO: 53584 - protein, 9 aa, Artificial Sequence
  Description of Artificial Sequence: Synthetic peptide
  Seed: QLVFGIELM (MAGA3_HUMAN)
QVVFGIELL

SEQ ID NO: 53585 - protein, 9 aa, Artificial Sequence
  Description of Artificial Sequence: Synthetic peptide
  Seed: VTLGEVPAA (MAGA3_HUMAN)
VTLGEVPAI

SEQ ID NO: 53586 - protein, 9 aa, Artificial Sequence
  Description of Artificial Sequence: Synthetic peptide
  Seed: SVLEVFEGR (MAGA3_HUMAN)
SALEVFEGM

SEQ ID NO: 53587 - protein, 9 aa, Artificial Sequence
  Description of Artificial Sequence: Synthetic peptide
  Seed: FPVIFSKAS (MAGA3_HUMAN)
FPVIFSKAI

SEQ ID NO: 53588 - protein, 9 aa, Artificial Sequence
  Description of Artificial Sequence: Synthetic peptide
  Seed: ASSSLQLVF (MAGA3_HUMAN)
ALSSLQLVI

SEQ ID NO: 53589 - protein, 10 aa, Artificial Sequence
  Description of Artificial Sequence: Synthetic peptide
  Seed: YIFATCLGLS (MAGA3_HUMAN)
YLFATCLGLD

SEQ ID NO: 53590 - protein, 9 aa, Artificial Sequence
  Description of Artificial Sequence: Synthetic peptide
  Seed: IMPKAGLLI (MAGA3_HUMAN)
ITPKAGLLV

SEQ ID NO: 53591 - protein, 9 aa, Artificial Sequence
  Description of Artificial Sequence: Synthetic peptide
  Seed: HLYIFATCL (MAGA3_HUMAN)
HQYIFATCM

SEQ ID NO: 53592 - protein, 9 aa, Artificial Sequence
  Description of Artificial Sequence: Synthetic peptide
  Seed: TQHFVQENY (MAGA3_HUMAN)
TRHFVQENM

SEQ ID NO: 53593 - protein, 9 aa, Artificial Sequence
  Description of Artificial Sequence: Synthetic peptide
  Seed: IAREGDCAP (MAGA3_HUMAN)
IAREGDCAY

SEQ ID NO: 53594 - protein, 11 aa, Artificial Sequence
  Description of Artificial Sequence: Synthetic peptide
  Seed: AQAPATEEQEA (MAGA3_HUMAN)
AEAPATEEQEM

SEQ ID NO: 53595 - protein, 9 aa, Artificial Sequence
  Description of Artificial Sequence: Synthetic peptide
  Seed: GASSLPTTM (MAGA3_HUMAN)
GRSSLPTTF

SEQ ID NO: 53596 - protein, 9 aa, Artificial Sequence
  Description of Artificial Sequence: Synthetic peptide
  Seed: LESEFQAAL (MAGA3_HUMAN)
LESEFQAAA

SEQ ID NO: 53597 - protein, 9 aa, Artificial Sequence
  Description of Artificial Sequence: Synthetic peptide
  Seed: KIWEELSVL (MAGA3_HUMAN)
KHWEELSVF

SEQ ID NO: 53598 - protein, 9 aa, Artificial Sequence
  Description of Artificial Sequence: Synthetic peptide
  Seed: LESEFQAAL (MAGA3_HUMAN)
LASEFQAAI

SEQ ID NO: 53599 - protein, 11 aa, Artificial Sequence
  Description of Artificial Sequence: Synthetic peptide
  Seed: SRKVAELVHFL (MAGA3_HUMAN)
SKKVAELVHFV

SEQ ID NO: 53600 - protein, 10 aa, Artificial Sequence
  Description of Artificial Sequence: Synthetic peptide
  Seed: TTMNYPLWSQ (MAGA3_HUMAN)
TMMNYPLWSR

SEQ ID NO: 53601 - protein, 10 aa, Artificial Sequence
  Description of Artificial Sequence: Synthetic peptide
  Seed: GSDPACYEFL (MAGA3_HUMAN)
GIDPACYEFY

SEQ ID NO: 53602 - protein, 9 aa, Artificial Sequence
  Description of Artificial Sequence: Synthetic peptide
  Seed: KVAELVHFL (MAGA3_HUMAN)
KQAELVHFK

SEQ ID NO: 53603 - protein, 9 aa, Artificial Sequence
  Description of Artificial Sequence: Synthetic peptide
  Seed: DPACYEFLW (MAGA3_HUMAN)
DAACYEFLW

SEQ ID NO: 53604 - protein, 10 aa, Artificial Sequence
  Description of Artificial Sequence: Synthetic peptide
  Seed: WEELSVLEVF (MAGA3_HUMAN)
WEELSVLEVY

SEQ ID NO: 53605 - protein, 9 aa, Artificial Sequence
  Description of Artificial Sequence: Synthetic peptide
  Seed: GSVVGNWQY (MAGA3_HUMAN)
GSVVGNWQW

SEQ ID NO: 53606 - protein, 9 aa, Artificial Sequence
  Description of Artificial Sequence: Synthetic peptide
  Seed: SSSSTLVEV (MAGA3_HUMAN)
SASSTLVEV

SEQ ID NO: 53607 - protein, 10 aa, Artificial Sequence
  Description of Artificial Sequence: Synthetic peptide
  Seed: WEELSVLEVF (MAGA3_HUMAN)
WIELSVLEVW

SEQ ID NO: 53608 - protein, 9 aa, Artificial Sequence
  Description of Artificial Sequence: Synthetic peptide
  Seed: YFFPVIFSK (MAGA3_HUMAN)
YYFPVIFSF

SEQ ID NO: 53609 - protein, 10 aa, Artificial Sequence
  Description of Artificial Sequence: Synthetic peptide
  Seed: MVKISGGPHI (MAGA3_HUMAN)
MVKISGGPHM

SEQ ID NO: 53610 - protein, 9 aa, Artificial Sequence
  Description of Artificial Sequence: Synthetic peptide
  Seed: KIWEELSVL (MAGA3_HUMAN)
KSWEELSVY

SEQ ID NO: 53611 - protein, 10 aa, Artificial Sequence
  Description of Artificial Sequence: Synthetic peptide
  Seed: AELVHFLLLK (MAGA3_HUMAN)
AELVHFLLLL

SEQ ID NO: 53612 - protein, 10 aa, Artificial Sequence
  Description of Artificial Sequence: Synthetic peptide
  Seed: EMLGSVVGNW (MAGA3_HUMAN)
EVLGSVVGNL

SEQ ID NO: 53613 - protein, 10 aa, Artificial Sequence
  Description of Artificial Sequence: Synthetic peptide
  Seed: AELVHFLLLK (MAGA3_HUMAN)
AYLVHFLLLK

SEQ ID NO: 53614 - protein, 9 aa, Artificial Sequence
  Description of Artificial Sequence: Synthetic peptide
  Seed: EAASSSSTL (MAGA3_HUMAN)
EEASSSSTM

SEQ ID NO: 53615 - protein, 9 aa, Artificial Sequence
  Description of Artificial Sequence: Synthetic peptide
  Seed: ALSRKVAEL (MAGA3_HUMAN)
ATSRKVAEL

SEQ ID NO: 53616 - protein, 9 aa, Artificial Sequence
  Description of Artificial Sequence: Synthetic peptide
  Seed: GASSLPTTM (MAGA3_HUMAN)
GSSSLPTTF

SEQ ID NO: 53617 - protein, 11 aa, Artificial Sequence
  Description of Artificial Sequence: Synthetic peptide
  Seed: MLGSVVGNWQY (MAGA3_HUMAN)
MPGSVVGNWQW

SEQ ID NO: 53618 - protein, 9 aa, Artificial Sequence
  Description of Artificial Sequence: Synthetic peptide
  Seed: FVQENYLEY (MAGA3_HUMAN)
FIQENYLEL

SEQ ID NO: 53619 - protein, 9 aa, Artificial Sequence
  Description of Artificial Sequence: Synthetic peptide
  Seed: VTLGEVPAA (MAGA3_HUMAN)
VILGEVPAI

SEQ ID NO: 53620 - protein, 9 aa, Artificial Sequence
  Description of Artificial Sequence: Synthetic peptide
  Seed: KVLHHMVKI (MAGA3_HUMAN)
KVLHHMVKW

SEQ ID NO: 53621 - protein, 10 aa, Artificial Sequence
  Description of Artificial Sequence: Synthetic peptide
  Seed: KVAELVHFLL (MAGA3_HUMAN)
KFAELVHFLW

SEQ ID NO: 53622 - protein, 9 aa, Artificial Sequence
  Description of Artificial Sequence: Synthetic peptide
  Seed: QEEEGPSTF (MAGA3_HUMAN)
QMEEGPSTF

SEQ ID NO: 53623 - protein, 9 aa, Artificial Sequence
  Description of Artificial Sequence: Synthetic peptide
  Seed: SYVKVLHHM (MAGA3_HUMAN)
SRVKVLHHI

SEQ ID NO: 53624 - protein, 10 aa, Artificial Sequence
  Description of Artificial Sequence: Synthetic peptide
  Seed: ALVETSYVKV (MAGA3_HUMAN)
AMVETSYVKV

SEQ ID NO: 53625 - protein, 10 aa, Artificial Sequence
  Description of Artificial Sequence: Synthetic peptide
  Seed: MNYPLWSQSY (MAGA3_HUMAN)
MWYPLWSQSI

SEQ ID NO: 53626 - protein, 10 aa, Artificial Sequence
  Description of Artificial Sequence: Synthetic peptide
  Seed: ISYPPLHEWV (MAGA3_HUMAN)
IEYPPLHEWF

SEQ ID NO: 53627 - protein, 9 aa, Artificial Sequence
  Description of Artificial Sequence: Synthetic peptide
  Seed: KIWEELSVL (MAGA3_HUMAN)
KGWEELSVY

SEQ ID NO: 53628 - protein, 9 aa, Artificial Sequence
  Description of Artificial Sequence: Synthetic peptide
  Seed: GPRALVETS (MAGA3_HUMAN)
GPRALVETI

SEQ ID NO: 53629 - protein, 10 aa, Artificial Sequence
  Description of Artificial Sequence: Synthetic peptide
  Seed: QYFFPVIFSK (MAGA3_HUMAN)
QSFFPVIFSR

SEQ ID NO: 53630 - protein, 10 aa, Artificial Sequence
  Description of Artificial Sequence: Synthetic peptide
  Seed: YFFPVIFSKA (MAGA3_HUMAN)
YIFPVIFSKV

SEQ ID NO: 53631 - protein, 10 aa, Artificial Sequence
  Description of Artificial Sequence: Synthetic peptide
  Seed: NWQYFFPVIF (MAGA3_HUMAN)
NCQYFFPVIY

SEQ ID NO: 53632 - protein, 9 aa, Artificial Sequence
  Description of Artificial Sequence: Synthetic peptide
  Seed: KIWEELSVL (MAGA3_HUMAN)
KQWEELSVM

SEQ ID NO: 53633 - protein, 10 aa, Artificial Sequence
  Description of Artificial Sequence: Synthetic peptide
  Seed: LGSVVGNWQY (MAGA3_HUMAN)
LASVVGNWQF

SEQ ID NO: 53634 - protein, 9 aa, Artificial Sequence
  Description of Artificial Sequence: Synthetic peptide
  Seed: EARGEALGL (MAGA3_HUMAN)
ETRGEALGR

SEQ ID NO: 53635 - protein, 9 aa, Artificial Sequence
  Description of Artificial Sequence: Synthetic peptide
  Seed: VTLGEVPAA (MAGA3_HUMAN)
VALGEVPAV

SEQ ID NO: 53636 - protein, 9 aa, Artificial Sequence
  Description of Artificial Sequence: Synthetic peptide
  Seed: RQVPGSDPA (MAGA3_HUMAN)
RVVPGSDPL

SEQ ID NO: 53637 - protein, 10 aa, Artificial Sequence
  Description of Artificial Sequence: Synthetic peptide
  Seed: STFPDLESEF (MAGA3_HUMAN)
SEFPDLESEY

SEQ ID NO: 53638 - protein, 11 aa, Artificial Sequence
  Description of Artificial Sequence: Synthetic peptide
  Seed: SEFQAALSRKV (MAGA3_HUMAN)
SEFQAALSRKA

SEQ ID NO: 53639 - protein, 9 aa, Artificial Sequence
  Description of Artificial Sequence: Synthetic peptide
  Seed: SSTLVEVTL (MAGA3_HUMAN)
SSTLVEVTY

SEQ ID NO: 53640 - protein, 9 aa, Artificial Sequence
  Description of Artificial Sequence: Synthetic peptide
  Seed: EVDPIGHLY (MAGA3_HUMAN)
EIDPIGHLM

SEQ ID NO: 53641 - protein, 8 aa, Artificial Sequence
  Description of Artificial Sequence: Synthetic peptide
  Seed: AELVHFLL (MAGA3_HUMAN)
AELVHFLA

SEQ ID NO: 53642 - protein, 8 aa, Artificial Sequence
  Description of Artificial Sequence: Synthetic peptide
  Seed: AELVHFLL (MAGA3_HUMAN)
AELVHFLI

SEQ ID NO: 53643 - protein, 11 aa, Artificial Sequence
  Description of Artificial Sequence: Synthetic peptide
  Seed: SNQEEEGPSTF (MAGA3_HUMAN)
SHQEEEGPSTW

SEQ ID NO: 53644 - protein, 10 aa, Artificial Sequence
  Description of Artificial Sequence: Synthetic peptide
  Seed: ELVHFLLLKY (MAGA3_HUMAN)
ELVHFLLLKK

SEQ ID NO: 53645 - protein, 10 aa, Artificial Sequence
  Description of Artificial Sequence: Synthetic peptide
  Seed: SEFQAALSRK (MAGA3_HUMAN)
STFQAALSRK

SEQ ID NO: 53646 - protein, 9 aa, Artificial Sequence
  Description of Artificial Sequence: Synthetic peptide
  Seed: LGDPKKLLT (MAGA3_HUMAN)
LGDPKKLLI

SEQ ID NO: 53647 - protein, 9 aa, Artificial Sequence
  Description of Artificial Sequence: Synthetic peptide
  Seed: RALVETSYV (MAGA3_HUMAN)
RQLVETSYK

SEQ ID NO: 53648 - protein, 10 aa, Artificial Sequence
  Description of Artificial Sequence: Synthetic peptide
  Seed: VIFSKASSSL (MAGA3_HUMAN)
VSFSKASSSY

SEQ ID NO: 53649 - protein, 9 aa, Artificial Sequence
  Description of Artificial Sequence: Synthetic peptide
  Seed: FATCLGLSY (MAGA3_HUMAN)
FTTCLGLSK

SEQ ID NO: 53650 - protein, 10 aa, Artificial Sequence
  Description of Artificial Sequence: Synthetic peptide
  Seed: SLPTTMNYPL (MAGA3_HUMAN)
SKPTTMNYPL

SEQ ID NO: 53651 - protein, 10 aa, Artificial Sequence
  Description of Artificial Sequence: Synthetic peptide
  Seed: IFATCLGLSY (MAGA3_HUMAN)
IVATCLGLSY

SEQ ID NO: 53652 - protein, 10 aa, Artificial Sequence
  Description of Artificial Sequence: Synthetic peptide
  Seed: ASSSLQLVFG (MAGA3_HUMAN)
AESSLQLVFW

SEQ ID NO: 53653 - protein, 10 aa, Artificial Sequence
  Description of Artificial Sequence: Synthetic peptide
  Seed: QENYLEYRQV (MAGA3_HUMAN)
QENYLEYRQW

SEQ ID NO: 53654 - protein, 9 aa, Artificial Sequence
  Description of Artificial Sequence: Synthetic peptide
  Seed: YFFPVIFSK (MAGA3_HUMAN)
YWFPVIFSF

SEQ ID NO: 53655 - protein, 9 aa, Artificial Sequence
  Description of Artificial Sequence: Synthetic peptide
  Seed: LGDPKKLLT (MAGA3_HUMAN)
LTDPKKLLM

SEQ ID NO: 53656 - protein, 10 aa, Artificial Sequence
  Description of Artificial Sequence: Synthetic peptide
  Seed: AEMLGSVVGN (MAGA3_HUMAN)
AEMLGSVVGI

SEQ ID NO: 53657 - protein, 9 aa, Artificial Sequence
  Description of Artificial Sequence: Synthetic peptide
  Seed: ISYPPLHEW (MAGA3_HUMAN)
IFYPPLHEL

SEQ ID NO: 53658 - protein, 9 aa, Artificial Sequence
  Description of Artificial Sequence: Synthetic peptide
  Seed: KIWEELSVL (MAGA3_HUMAN)
KIWEELSVW

SEQ ID NO: 53659 - protein, 11 aa, Artificial Sequence
  Description of Artificial Sequence: Synthetic peptide
  Seed: KIWEELSVLEV (MAGA3_HUMAN)
KLWEELSVLEI

SEQ ID NO: 53660 - protein, 10 aa, Artificial Sequence
  Description of Artificial Sequence: Synthetic peptide
  Seed: FSKASSSLQL (MAGA3_HUMAN)
FLKASSSLQM

SEQ ID NO: 53661 - protein, 10 aa, Artificial Sequence
  Description of Artificial Sequence: Synthetic peptide
  Seed: KAEMLGSVVG (MAGA3_HUMAN)
KSEMLGSVVA

SEQ ID NO: 53662 - protein, 11 aa, Artificial Sequence
  Description of Artificial Sequence: Synthetic peptide
  Seed: FLWGPRALVET (MAGA3_HUMAN)
FMWGPRALVEL

SEQ ID NO: 53663 - protein, 9 aa, Artificial Sequence
  Description of Artificial Sequence: Synthetic peptide
  Seed: GNWQYFFPV (MAGA3_HUMAN)
GVWQYFFPT

SEQ ID NO: 53664 - protein, 9 aa, Artificial Sequence
  Description of Artificial Sequence: Synthetic peptide
  Seed: KVAELVHFL (MAGA3_HUMAN)
KMAELVHFG

SEQ ID NO: 53665 - protein, 9 aa, Artificial Sequence
  Description of Artificial Sequence: Synthetic peptide
  Seed: RALVETSYV (MAGA3_HUMAN)
RTLVETSYA

SEQ ID NO: 53666 - protein, 10 aa, Artificial Sequence
  Description of Artificial Sequence: Synthetic peptide
  Seed: RKVAELVHFL (MAGA3_HUMAN)
RYVAELVHFV

SEQ ID NO: 53667 - protein, 9 aa, Artificial Sequence
  Description of Artificial Sequence: Synthetic peptide
  Seed: QSPQGASSL (MAGA3_HUMAN)
QVPQGASSY

SEQ ID NO: 53668 - protein, 10 aa, Artificial Sequence
  Description of Artificial Sequence: Synthetic peptide
  Seed: RQVPGSDPAC (MAGA3_HUMAN)
RQVPGSDPAV

SEQ ID NO: 53669 - protein, 9 aa, Artificial Sequence
  Description of Artificial Sequence: Synthetic peptide
  Seed: YFFPVIFSK (MAGA3_HUMAN)
YTFPVIFSV

SEQ ID NO: 53670 - protein, 10 aa, Artificial Sequence
  Description of Artificial Sequence: Synthetic peptide
  Seed: VTKAEMLGSV (MAGA3_HUMAN)
VMKAEMLGSL

SEQ ID NO: 53671 - protein, 11 aa, Artificial Sequence
  Description of Artificial Sequence: Synthetic peptide
  Seed: RQVPGSDPACY (MAGA3_HUMAN)
RVVPGSDPACF

SEQ ID NO: 53672 - protein, 10 aa, Artificial Sequence
  Description of Artificial Sequence: Synthetic peptide
  Seed: ALSRKVAELV (MAGA3_HUMAN)
AMSRKVAELV

SEQ ID NO: 53673 - protein, 9 aa, Artificial Sequence
  Description of Artificial Sequence: Synthetic peptide
  Seed: SSLQLVFGI (MAGA3_HUMAN)
SQLQLVFGT

SEQ ID NO: 53674 - protein, 9 aa, Artificial Sequence
  Description of Artificial Sequence: Synthetic peptide
  Seed: FATCLGLSY (MAGA3_HUMAN)
FTTCLGLSV

SEQ ID NO: 53675 - protein, 9 aa, Artificial Sequence
  Description of Artificial Sequence: Synthetic peptide
  Seed: MLGSVVGNW (MAGA3_HUMAN)
MMGSVVGNW

SEQ ID NO: 53676 - protein, 9 aa, Artificial Sequence
  Description of Artificial Sequence: Synthetic peptide
  Seed: GASSLPTTM (MAGA3_HUMAN)
GQSSLPTTW

SEQ ID NO: 53677 - protein, 9 aa, Artificial Sequence
  Description of Artificial Sequence: Synthetic peptide
  Seed: FATCLGLSY (MAGA3_HUMAN)
FNTCLGLSF

SEQ ID NO: 53678 - protein, 10 aa, Artificial Sequence
  Description of Artificial Sequence: Synthetic peptide
  Seed: KAEMLGSVVG (MAGA3_HUMAN)
KVEMLGSVVA

SEQ ID NO: 53679 - protein, 9 aa, Artificial Sequence
  Description of Artificial Sequence: Synthetic peptide
  Seed: FQAALSRKV (MAGA3_HUMAN)
FRAALSRKL

SEQ ID NO: 53680 - protein, 9 aa, Artificial Sequence
  Description of Artificial Sequence: Synthetic peptide
  Seed: EAASSSSTL (MAGA3_HUMAN)
EAASSSSTK

SEQ ID NO: 53681 - protein, 9 aa, Artificial Sequence
  Description of Artificial Sequence: Synthetic peptide
  Seed: LQLVFGIEL (MAGA3_HUMAN)
LKLVFGIEF

SEQ ID NO: 53682 - protein, 10 aa, Artificial Sequence
  Description of Artificial Sequence: Synthetic peptide
  Seed: SEFQAALSRK (MAGA3_HUMAN)
SQFQAALSRR

SEQ ID NO: 53683 - protein, 9 aa, Artificial Sequence
  Description of Artificial Sequence: Synthetic peptide
  Seed: GPHISYPPL (MAGA3_HUMAN)
GPHISYPPA

SEQ ID NO: 53684 - protein, 9 aa, Artificial Sequence
  Description of Artificial Sequence: Synthetic peptide
  Seed: SSLQLVFGI (MAGA3_HUMAN)
SQLQLVFGM

SEQ ID NO: 53685 - protein, 9 aa, Artificial Sequence
  Description of Artificial Sequence: Synthetic peptide
  Seed: ISYPPLHEW (MAGA3_HUMAN)
IAYPPLHEY

SEQ ID NO: 53686 - protein, 9 aa, Artificial Sequence
  Description of Artificial Sequence: Synthetic peptide
  Seed: FVQENYLEY (MAGA3_HUMAN)
FQQENYLEL

SEQ ID NO: 53687 - protein, 10 aa, Artificial Sequence
  Description of Artificial Sequence: Synthetic peptide
  Seed: ASSLPTTMNY (MAGA3_HUMAN)
ALSLPTTMNK

SEQ ID NO: 53688 - protein, 9 aa, Artificial Sequence
  Description of Artificial Sequence: Synthetic peptide
  Seed: FVQENYLEY (MAGA3_HUMAN)
FWQENYLEF

SEQ ID NO: 53689 - protein, 10 aa, Artificial Sequence
  Description of Artificial Sequence: Synthetic peptide
  Seed: ISYPPLHEWV (MAGA3_HUMAN)
ISYPPLHEWM

SEQ ID NO: 53690 - protein, 10 aa, Artificial Sequence
  Description of Artificial Sequence: Synthetic peptide
  Seed: VDPIGHLYIF (MAGA3_HUMAN)
VMPIGHLYIF

SEQ ID NO: 53691 - protein, 9 aa, Artificial Sequence
  Description of Artificial Sequence: Synthetic peptide
  Seed: SSLQLVFGI (MAGA3_HUMAN)
SQLQLVFGA

SEQ ID NO: 53692 - protein, 9 aa, Artificial Sequence
  Description of Artificial Sequence: Synthetic peptide
  Seed: LQLVFGIEL (MAGA3_HUMAN)
LMLVFGIEA

SEQ ID NO: 53693 - protein, 11 aa, Artificial Sequence
  Description of Artificial Sequence: Synthetic peptide
  Seed: RKVAELVHFLL (MAGA3_HUMAN)
RRVAELVHFLI

SEQ ID NO: 53694 - protein, 10 aa, Artificial Sequence
  Description of Artificial Sequence: Synthetic peptide
  Seed: AALSRKVAEL (MAGA3_HUMAN)
AALSRKVAEY

SEQ ID NO: 53695 - protein, 10 aa, Artificial Sequence
  Description of Artificial Sequence: Synthetic peptide
  Seed: MPKAGLLIIV (MAGA3_HUMAN)
MPKAGLLIIM

SEQ ID NO: 53696 - protein, 9 aa, Artificial Sequence
  Description of Artificial Sequence: Synthetic peptide
  Seed: RALVETSYV (MAGA3_HUMAN)
RALVETSYL

SEQ ID NO: 53697 - protein, 9 aa, Artificial Sequence
  Description of Artificial Sequence: Synthetic peptide
  Seed: SSSSTLVEV (MAGA3_HUMAN)
SSSSTLVEF

SEQ ID NO: 53698 - protein, 9 aa, Artificial Sequence
  Description of Artificial Sequence: Synthetic peptide
  Seed: RQVPGSDPA (MAGA3_HUMAN)
REVPGSDPT

SEQ ID NO: 53699 - protein, 9 aa, Artificial Sequence
  Description of Artificial Sequence: Synthetic peptide
  Seed: MEVDPIGHL (MAGA3_HUMAN)
MSVDPIGHH

SEQ ID NO: 53700 - protein, 10 aa, Artificial Sequence
  Description of Artificial Sequence: Synthetic peptide
  Seed: KAEMLGSVVG (MAGA3_HUMAN)
KCEMLGSVVA

SEQ ID NO: 53701 - protein, 9 aa, Artificial Sequence
  Description of Artificial Sequence: Synthetic peptide
  Seed: SSLPTTMNY (MAGA3_HUMAN)
SLLPTTMNL

SEQ ID NO: 53702 - protein, 9 aa, Artificial Sequence
  Description of Artificial Sequence: Synthetic peptide
  Seed: LPTTMNYPL (MAGA3_HUMAN)
LHTTMNYPM

SEQ ID NO: 53703 - protein, 11 aa, Artificial Sequence
  Description of Artificial Sequence: Synthetic peptide
  Seed: FLWGPRALVET (MAGA3_HUMAN)
FMWGPRALVEM

SEQ ID NO: 53704 - protein, 9 aa, Artificial Sequence
  Description of Artificial Sequence: Synthetic peptide
  Seed: TFPDLESEF (MAGA3_HUMAN)
TMPDLESEI

SEQ ID NO: 53705 - protein, 9 aa, Artificial Sequence
  Description of Artificial Sequence: Synthetic peptide
  Seed: AQAPATEEQ (MAGA3_HUMAN)
ASAPATEEF

SEQ ID NO: 53706 - protein, 10 aa, Artificial Sequence
  Description of Artificial Sequence: Synthetic peptide
  Seed: LGLVGAQAPA (MAGA3_HUMAN)
LLLVGAQAPL

SEQ ID NO: 53707 - protein, 11 aa, Artificial Sequence
  Description of Artificial Sequence: Synthetic peptide
  Seed: HCKPEEGLEAR (MAGA3_HUMAN)
HTKPEEGLEAK

SEQ ID NO: 53708 - protein, 9 aa, Artificial Sequence
  Description of Artificial Sequence: Synthetic peptide
  Seed: SSLPTTMNY (MAGA3_HUMAN)
SMLPTTMNK

SEQ ID NO: 53709 - protein, 9 aa, Artificial Sequence
  Description of Artificial Sequence: Synthetic peptide
  Seed: SSTLVEVTL (MAGA3_HUMAN)
SETLVEVTV

SEQ ID NO: 53710 - protein, 10 aa, Artificial Sequence
  Description of Artificial Sequence: Synthetic peptide
  Seed: SSSTLVEVTL (MAGA3_HUMAN)
SPSTLVEVTW

SEQ ID NO: 53711 - protein, 9 aa, Artificial Sequence
  Description of Artificial Sequence: Synthetic peptide
  Seed: ISGGPHISY (MAGA3_HUMAN)
ILGGPHISR

SEQ ID NO: 53712 - protein, 10 aa, Artificial Sequence
  Description of Artificial Sequence: Synthetic peptide
  Seed: YFFPVIFSKA (MAGA3_HUMAN)
YFFPVIFSKK

SEQ ID NO: 53713 - protein, 9 aa, Artificial Sequence
  Description of Artificial Sequence: Synthetic peptide
  Seed: GASSLPTTM (MAGA3_HUMAN)
GYSSLPTTY

SEQ ID NO: 53714 - protein, 10 aa, Artificial Sequence
  Description of Artificial Sequence: Synthetic peptide
  Seed: HFVQENYLEY (MAGA3_HUMAN)
HPVQENYLEF

SEQ ID NO: 53715 - protein, 9 aa, Artificial Sequence
  Description of Artificial Sequence: Synthetic peptide
  Seed: RQVPGSDPA (MAGA3_HUMAN)
RTVPGSDPY

SEQ ID NO: 53716 - protein, 9 aa, Artificial Sequence
  Description of Artificial Sequence: Synthetic peptide
  Seed: AASSSSTLV (MAGA3_HUMAN)
AMSSSSTLV

SEQ ID NO: 53717 - protein, 10 aa, Artificial Sequence
  Description of Artificial Sequence: Synthetic peptide
  Seed: KISGGPHISY (MAGA3_HUMAN)
KASGGPHISM

SEQ ID NO: 53718 - protein, 10 aa, Artificial Sequence
  Description of Artificial Sequence: Synthetic peptide
  Seed: SLQLVFGIEL (MAGA3_HUMAN)
SIQLVFGIEY

SEQ ID NO: 53719 - protein, 9 aa, Artificial Sequence
  Description of Artificial Sequence: Synthetic peptide
  Seed: YFFPVIFSK (MAGA3_HUMAN)
YTFPVIFSF

SEQ ID NO: 53720 - protein, 9 aa, Artificial Sequence
  Description of Artificial Sequence: Synthetic peptide
  Seed: RQVPGSDPA (MAGA3_HUMAN)
RMVPGSDPF

SEQ ID NO: 53721 - protein, 9 aa, Artificial Sequence
  Description of Artificial Sequence: Synthetic peptide
  Seed: YVKVLHHMV (MAGA3_HUMAN)
YSKVLHHMY

SEQ ID NO: 53722 - protein, 10 aa, Artificial Sequence
  Description of Artificial Sequence: Synthetic peptide
  Seed: DLESEFQAAL (MAGA3_HUMAN)
DDESEFQAAY

SEQ ID NO: 53723 - protein, 10 aa, Artificial Sequence
  Description of Artificial Sequence: Synthetic peptide
  Seed: SYVKVLHHMV (MAGA3_HUMAN)
SWVKVLHHMF

SEQ ID NO: 53724 - protein, 10 aa, Artificial Sequence
  Description of Artificial Sequence: Synthetic peptide
  Seed: DLESEFQAAL (MAGA3_HUMAN)
DTESEFQAAF

SEQ ID NO: 53725 - protein, 9 aa, Artificial Sequence
  Description of Artificial Sequence: Synthetic peptide
  Seed: FQAALSRKV (MAGA3_HUMAN)
FTAALSRKI

SEQ ID NO: 53726 - protein, 10 aa, Artificial Sequence
  Description of Artificial Sequence: Synthetic peptide
  Seed: NQEEEGPSTF (MAGA3_HUMAN)
NEEEEGPSTF

SEQ ID NO: 53727 - protein, 9 aa, Artificial Sequence
  Description of Artificial Sequence: Synthetic peptide
  Seed: IAREGDCAP (MAGA3_HUMAN)
IPREGDCAA

SEQ ID NO: 53728 - protein, 10 aa, Artificial Sequence
  Description of Artificial Sequence: Synthetic peptide
  Seed: SILGDPKKLL (MAGA3_HUMAN)
SQLGDPKKLF

SEQ ID NO: 53729 - protein, 9 aa, Artificial Sequence
  Description of Artificial Sequence: Synthetic peptide
  Seed: ELVHFLLLK (MAGA3_HUMAN)
EYVHFLLLK

SEQ ID NO: 53730 - protein, 9 aa, Artificial Sequence
  Description of Artificial Sequence: Synthetic peptide
  Seed: LQLVFGIEL (MAGA3_HUMAN)
LVLVFGIEV

SEQ ID NO: 53731 - protein, 11 aa, Artificial Sequence
  Description of Artificial Sequence: Synthetic peptide
  Seed: VKISGGPHISY (MAGA3_HUMAN)
VAISGGPHISY

SEQ ID NO: 53732 - protein, 9 aa, Artificial Sequence
  Description of Artificial Sequence: Synthetic peptide
  Seed: FVQENYLEY (MAGA3_HUMAN)
FPQENYLEY

SEQ ID NO: 53733 - protein, 9 aa, Artificial Sequence
  Description of Artificial Sequence: Synthetic peptide
  Seed: NYPLWSQSY (MAGA3_HUMAN)
NYPLWSQSL

SEQ ID NO: 53734 - protein, 11 aa, Artificial Sequence
  Description of Artificial Sequence: Synthetic peptide
  Seed: YIFATCLGLSY (MAGA3_HUMAN)
YTFATCLGLSL

SEQ ID NO: 53735 - protein, 9 aa, Artificial Sequence
  Description of Artificial Sequence: Synthetic peptide
  Seed: VTLGEVPAA (MAGA3_HUMAN)
VTLGEVPAY

SEQ ID NO: 53736 - protein, 11 aa, Artificial Sequence
  Description of Artificial Sequence: Synthetic peptide
  Seed: SRKVAELVHFL (MAGA3_HUMAN)
SYKVAELVHFV

SEQ ID NO: 53737 - protein, 10 aa, Artificial Sequence
  Description of Artificial Sequence: Synthetic peptide
  Seed: KISGGPHISY (MAGA3_HUMAN)
KSSGGPHISF

SEQ ID NO: 53738 - protein, 10 aa, Artificial Sequence
  Description of Artificial Sequence: Synthetic peptide
  Seed: MEVDPIGHLY (MAGA3_HUMAN)
MSVDPIGHLL

SEQ ID NO: 53739 - protein, 9 aa, Artificial Sequence
  Description of Artificial Sequence: Synthetic peptide
  Seed: FQAALSRKV (MAGA3_HUMAN)
FRAALSRKI

SEQ ID NO: 53740 - protein, 8 aa, Artificial Sequence
  Description of Artificial Sequence: Synthetic peptide
  Seed: FPDLESEF (MAGA3_HUMAN)
FTDLESEF

SEQ ID NO: 53741 - protein, 8 aa, Artificial Sequence
  Description of Artificial Sequence: Synthetic peptide
  Seed: LGDPKKLL (MAGA3_HUMAN)
LTDPKKLI

SEQ ID NO: 53742 - protein, 9 aa, Artificial Sequence
  Description of Artificial Sequence: Synthetic peptide
  Seed: ELVHFLLLK (MAGA3_HUMAN)
EWVHFLLLR

SEQ ID NO: 53743 - protein, 9 aa, Artificial Sequence
  Description of Artificial Sequence: Synthetic peptide
  Seed: KASSSLQLV (MAGA3_HUMAN)
KMSSSLQLY

SEQ ID NO: 53744 - protein, 9 aa, Artificial Sequence
  Description of Artificial Sequence: Synthetic peptide
  Seed: LESEFQAAL (MAGA3_HUMAN)
LMSEFQAAL

SEQ ID NO: 53745 - protein, 10 aa, Artificial Sequence
  Description of Artificial Sequence: Synthetic peptide
  Seed: VIFSKASSSL (MAGA3_HUMAN)
VVFSKASSSV

SEQ ID NO: 53746 - protein, 9 aa, Artificial Sequence
  Description of Artificial Sequence: Synthetic peptide
  Seed: YIFATCLGL (MAGA3_HUMAN)
YWFATCLGY

SEQ ID NO: 53747 - protein, 10 aa, Artificial Sequence
  Description of Artificial Sequence: Synthetic peptide
  Seed: MPKAGLLIIV (MAGA3_HUMAN)
MPKAGLLIIY

SEQ ID NO: 53748 - protein, 9 aa, Artificial Sequence
  Description of Artificial Sequence: Synthetic peptide
  Seed: MEVDPIGHL (MAGA3_HUMAN)
MYVDPIGHL

SEQ ID NO: 53749 - protein, 9 aa, Artificial Sequence
  Description of Artificial Sequence: Synthetic peptide
  Seed: LVHFLLLKY (MAGA3_HUMAN)
LSHFLLLKM

SEQ ID NO: 53750 - protein, 9 aa, Artificial Sequence
  Description of Artificial Sequence: Synthetic peptide
  Seed: SSTLVEVTL (MAGA3_HUMAN)
SMTLVEVTF

SEQ ID NO: 53751 - protein, 9 aa, Artificial Sequence
  Description of Artificial Sequence: Synthetic peptide
  Seed: LESEFQAAL (MAGA3_HUMAN)
LQSEFQAAL

SEQ ID NO: 53752 - protein, 10 aa, Artificial Sequence
  Description of Artificial Sequence: Synthetic peptide
  Seed: MNYPLWSQSY (MAGA3_HUMAN)
MCYPLWSQSY

SEQ ID NO: 53753 - protein, 10 aa, Artificial Sequence
  Description of Artificial Sequence: Synthetic peptide
  Seed: QVPGSDPACY (MAGA3_HUMAN)
QVPGSDPACK

SEQ ID NO: 53754 - protein, 9 aa, Artificial Sequence
  Description of Artificial Sequence: Synthetic peptide
  Seed: SSSSTLVEV (MAGA3_HUMAN)
SQSSTLVEM

SEQ ID NO: 53755 - protein, 9 aa, Artificial Sequence
  Description of Artificial Sequence: Synthetic peptide
  Seed: KVAELVHFL (MAGA3_HUMAN)
KTAELVHFY

SEQ ID NO: 53756 - protein, 9 aa, Artificial Sequence
  Description of Artificial Sequence: Synthetic peptide
  Seed: QSPQGASSL (MAGA3_HUMAN)
QIPQGASSL

SEQ ID NO: 53757 - protein, 9 aa, Artificial Sequence
  Description of Artificial Sequence: Synthetic peptide
  Seed: RALVETSYV (MAGA3_HUMAN)
RALVETSYF

SEQ ID NO: 53758 - protein, 9 aa, Artificial Sequence
  Description of Artificial Sequence: Synthetic peptide
  Seed: KIWEELSVL (MAGA3_HUMAN)
KAWEELSVY

SEQ ID NO: 53759 - protein, 9 aa, Artificial Sequence
  Description of Artificial Sequence: Synthetic peptide
  Seed: SSSSTLVEV (MAGA3_HUMAN)
SQSSTLVEW

SEQ ID NO: 53760 - protein, 9 aa, Artificial Sequence
  Description of Artificial Sequence: Synthetic peptide
  Seed: RKVAELVHF (MAGA3_HUMAN)
RIVAELVHY

SEQ ID NO: 53761 - protein, 9 aa, Artificial Sequence
  Description of Artificial Sequence: Synthetic peptide
  Seed: QSPQGASSL (MAGA3_HUMAN)
QAPQGASSR

SEQ ID NO: 53762 - protein, 10 aa, Artificial Sequence
  Description of Artificial Sequence: Synthetic peptide
  Seed: KASSSLQLVF (MAGA3_HUMAN)
KQSSSLQLVL

SEQ ID NO: 53763 - protein, 10 aa, Artificial Sequence
  Description of Artificial Sequence: Synthetic peptide
  Seed: LGSVVGNWQY (MAGA3_HUMAN)
LTSVVGNWQF

SEQ ID NO: 53764 - protein, 9 aa, Artificial Sequence
  Description of Artificial Sequence: Synthetic peptide
  Seed: FQAALSRKV (MAGA3_HUMAN)
FIAALSRKV

SEQ ID NO: 53765 - protein, 9 aa, Artificial Sequence
  Description of Artificial Sequence: Synthetic peptide
  Seed: GSDPACYEF (MAGA3_HUMAN)
GTDPACYEF

SEQ ID NO: 53766 - protein, 9 aa, Artificial Sequence
  Description of Artificial Sequence: Synthetic peptide
  Seed: NQIMPKAGL (MAGA3_HUMAN)
NHIMPKAGA

SEQ ID NO: 53767 - protein, 8 aa, Artificial Sequence
  Description of Artificial Sequence: Synthetic peptide
  Seed: SSSLQLVF (MAGA3_HUMAN)
SASLQLVM

SEQ ID NO: 53768 - protein, 10 aa, Artificial Sequence
  Description of Artificial Sequence: Synthetic peptide
  Seed: ASSSLQLVFG (MAGA3_HUMAN)
AVSSLQLVFW

SEQ ID NO: 53769 - protein, 10 aa, Artificial Sequence
  Description of Artificial Sequence: Synthetic peptide
  Seed: RQVPGSDPAC (MAGA3_HUMAN)
RIVPGSDPAY

SEQ ID NO: 53770 - protein, 9 aa, Artificial Sequence
  Description of Artificial Sequence: Synthetic peptide
  Seed: ASSSLQLVF (MAGA3_HUMAN)
AASSLQLVM

SEQ ID NO: 53771 - protein, 9 aa, Artificial Sequence
  Description of Artificial Sequence: Synthetic peptide
  Seed: SSLQLVFGI (MAGA3_HUMAN)
SVLQLVFGA

SEQ ID NO: 53772 - protein, 9 aa, Artificial Sequence
  Description of Artificial Sequence: Synthetic peptide
  Seed: KIWEELSVL (MAGA3_HUMAN)
KLWEELSVW

SEQ ID NO: 53773 - protein, 9 aa, Artificial Sequence
  Description of Artificial Sequence: Synthetic peptide
  Seed: HLYIFATCL (MAGA3_HUMAN)
HTYIFATCR

SEQ ID NO: 53774 - protein, 9 aa, Artificial Sequence
  Description of Artificial Sequence: Synthetic peptide
  Seed: MPKAGLLII (MAGA3_HUMAN)
MQKAGLLIM

SEQ ID NO: 53775 - protein, 11 aa, Artificial Sequence
  Description of Artificial Sequence: Synthetic peptide
  Seed: SRKVAELVHFL (MAGA3_HUMAN)
SSKVAELVHFV

SEQ ID NO: 53776 - protein, 9 aa, Artificial Sequence
  Description of Artificial Sequence: Synthetic peptide
  Seed: WEELSVLEV (MAGA3_HUMAN)
WEELSVLEM

SEQ ID NO: 53777 - protein, 10 aa, Artificial Sequence
  Description of Artificial Sequence: Synthetic peptide
  Seed: AELVHFLLLK (MAGA3_HUMAN)
AALVHFLLLR

SEQ ID NO: 53778 - protein, 9 aa, Artificial Sequence
  Description of Artificial Sequence: Synthetic peptide
  Seed: SKASSSLQL (MAGA3_HUMAN)
SHASSSLQL

SEQ ID NO: 53779 - protein, 9 aa, Artificial Sequence
  Description of Artificial Sequence: Synthetic peptide
  Seed: KVAELVHFL (MAGA3_HUMAN)
KRAELVHFI

SEQ ID NO: 53780 - protein, 10 aa, Artificial Sequence
  Description of Artificial Sequence: Synthetic peptide
  Seed: MEVDPIGHLY (MAGA3_HUMAN)
MIVDPIGHLM

SEQ ID NO: 53781 - protein, 11 aa, Artificial Sequence
  Description of Artificial Sequence: Synthetic peptide
  Seed: MLGSVVGNWQY (MAGA3_HUMAN)
MTGSVVGNWQY

SEQ ID NO: 53782 - protein, 10 aa, Artificial Sequence
  Description of Artificial Sequence: Synthetic peptide
  Seed: ASSLPTTMNY (MAGA3_HUMAN)
AWSLPTTMNK

SEQ ID NO: 53783 - protein, 10 aa, Artificial Sequence
  Description of Artificial Sequence: Synthetic peptide
  Seed: FFPVIFSKAS (MAGA3_HUMAN)
FAPVIFSKAA

SEQ ID NO: 53784 - protein, 9 aa, Artificial Sequence
  Description of Artificial Sequence: Synthetic peptide
  Seed: QEEEGPSTF (MAGA3_HUMAN)
QHEEGPSTY

SEQ ID NO: 53785 - protein, 9 aa, Artificial Sequence
  Description of Artificial Sequence: Synthetic peptide
  Seed: MLGSVVGNW (MAGA3_HUMAN)
MVGSVVGNW

SEQ ID NO: 53786 - protein, 9 aa, Artificial Sequence
  Description of Artificial Sequence: Synthetic peptide
  Seed: SEFQAALSR (MAGA3_HUMAN)
SVFQAALSY

SEQ ID NO: 53787 - protein, 9 aa, Artificial Sequence
  Description of Artificial Sequence: Synthetic peptide
  Seed: SSLQLVFGI (MAGA3_HUMAN)
SILQLVFGM

SEQ ID NO: 53788 - protein, 9 aa, Artificial Sequence
  Description of Artificial Sequence: Synthetic peptide
  Seed: FATCLGLSY (MAGA3_HUMAN)
FRTCLGLSY

SEQ ID NO: 53789 - protein, 10 aa, Artificial Sequence
  Description of Artificial Sequence: Synthetic peptide
  Seed: ALVETSYVKV (MAGA3_HUMAN)
AQVETSYVKI

SEQ ID NO: 53790 - protein, 9 aa, Artificial Sequence
  Description of Artificial Sequence: Synthetic peptide
  Seed: SKASSSLQL (MAGA3_HUMAN)
SQASSSLQW

SEQ ID NO: 53791 - protein, 9 aa, Artificial Sequence
  Description of Artificial Sequence: Synthetic peptide
  Seed: FATCLGLSY (MAGA3_HUMAN)
FTTCLGLSF

SEQ ID NO: 53792 - protein, 10 aa, Artificial Sequence
  Description of Artificial Sequence: Synthetic peptide
  Seed: YFFPVIFSKA (MAGA3_HUMAN)
YTFPVIFSKV

SEQ ID NO: 53793 - protein, 10 aa, Artificial Sequence
  Description of Artificial Sequence: Synthetic peptide
  Seed: RQVPGSDPAC (MAGA3_HUMAN)
REVPGSDPAV

SEQ ID NO: 53794 - protein, 9 aa, Artificial Sequence
  Description of Artificial Sequence: Synthetic peptide
  Seed: MEVDPIGHL (MAGA3_HUMAN)
MMVDPIGHL

SEQ ID NO: 53795 - protein, 10 aa, Artificial Sequence
  Description of Artificial Sequence: Synthetic peptide
  Seed: NWQYFFPVIF (MAGA3_HUMAN)
NRQYFFPVIY

SEQ ID NO: 53796 - protein, 10 aa, Artificial Sequence
  Description of Artificial Sequence: Synthetic peptide
  Seed: EAASSSSTLV (MAGA3_HUMAN)
ETASSSSTLI

SEQ ID NO: 53797 - protein, 10 aa, Artificial Sequence
  Description of Artificial Sequence: Synthetic peptide
  Seed: MVKISGGPHI (MAGA3_HUMAN)
MQKISGGPHM

SEQ ID NO: 53798 - protein, 10 aa, Artificial Sequence
  Description of Artificial Sequence: Synthetic peptide
  Seed: SDPACYEFLW (MAGA3_HUMAN)
SYPACYEFLW

SEQ ID NO: 53799 - protein, 10 aa, Artificial Sequence
  Description of Artificial Sequence: Synthetic peptide
  Seed: QEEEGPSTFP (MAGA3_HUMAN)
QEEEGPSTFA

SEQ ID NO: 53800 - protein, 10 aa, Artificial Sequence
  Description of Artificial Sequence: Synthetic peptide
  Seed: KASSSLQLVF (MAGA3_HUMAN)
KFSSSLQLVY

SEQ ID NO: 53801 - protein, 9 aa, Artificial Sequence
  Description of Artificial Sequence: Synthetic peptide
  Seed: RKVAELVHF (MAGA3_HUMAN)
RQVAELVHF

SEQ ID NO: 53802 - protein, 9 aa, Artificial Sequence
  Description of Artificial Sequence: Synthetic peptide
  Seed: GASSLPTTM (MAGA3_HUMAN)
GISSLPTTY

SEQ ID NO: 53803 - protein, 10 aa, Artificial Sequence
  Description of Artificial Sequence: Synthetic peptide
  Seed: KISGGPHISY (MAGA3_HUMAN)
KVSGGPHISW

SEQ ID NO: 53804 - protein, 10 aa, Artificial Sequence
  Description of Artificial Sequence: Synthetic peptide
  Seed: HISYPPLHEW (MAGA3_HUMAN)
HSSYPPLHEY

SEQ ID NO: 53805 - protein, 10 aa, Artificial Sequence
  Description of Artificial Sequence: Synthetic peptide
  Seed: KVAELVHFLL (MAGA3_HUMAN)
KAAELVHFLV

SEQ ID NO: 53806 - protein, 9 aa, Artificial Sequence
  Description of Artificial Sequence: Synthetic peptide
  Seed: KIWEELSVL (MAGA3_HUMAN)
KAWEELSVL

SEQ ID NO: 53807 - protein, 9 aa, Artificial Sequence
  Description of Artificial Sequence: Synthetic peptide
  Seed: SSSSTLVEV (MAGA3_HUMAN)
SLSSTLVEY

SEQ ID NO: 53808 - protein, 8 aa, Artificial Sequence
  Description of Artificial Sequence: Synthetic peptide
  Seed: ILGDPKKL (MAGA3_HUMAN)
ITGDPKKL

SEQ ID NO: 53809 - protein, 9 aa, Artificial Sequence
  Description of Artificial Sequence: Synthetic peptide
  Seed: SVVGNWQYF (MAGA3_HUMAN)
STVGNWQYR

SEQ ID NO: 53810 - protein, 11 aa, Artificial Sequence
  Description of Artificial Sequence: Synthetic peptide
  Seed: HISYPPLHEWV (MAGA3_HUMAN)
HMSYPPLHEWW

SEQ ID NO: 53811 - protein, 9 aa, Artificial Sequence
  Description of Artificial Sequence: Synthetic peptide
  Seed: SSLQLVFGI (MAGA3_HUMAN)
SMLQLVFGM

SEQ ID NO: 53812 - protein, 11 aa, Artificial Sequence
  Description of Artificial Sequence: Synthetic peptide
  Seed: ISYPPLHEWVL (MAGA3_HUMAN)
IKYPPLHEWVF

SEQ ID NO: 53813 - protein, 10 aa, Artificial Sequence
  Description of Artificial Sequence: Synthetic peptide
  Seed: RQVPGSDPAC (MAGA3_HUMAN)
RHVPGSDPAY

SEQ ID NO: 53814 - protein, 11 aa, Artificial Sequence
  Description of Artificial Sequence: Synthetic peptide
  Seed: SNQEEEGPSTF (MAGA3_HUMAN)
SQQEEEGPSTF

SEQ ID NO: 53815 - protein, 9 aa, Artificial Sequence
  Description of Artificial Sequence: Synthetic peptide
  Seed: SSLPTTMNY (MAGA3_HUMAN)
SVLPTTMNF

SEQ ID NO: 53816 - protein, 10 aa, Artificial Sequence
  Description of Artificial Sequence: Synthetic peptide
  Seed: MVKISGGPHI (MAGA3_HUMAN)
MCKISGGPHY

SEQ ID NO: 53817 - protein, 10 aa, Artificial Sequence
  Description of Artificial Sequence: Synthetic peptide
  Seed: TSYVKVLHHM (MAGA3_HUMAN)
TCYVKVLHHL

SEQ ID NO: 53818 - protein, 9 aa, Artificial Sequence
  Description of Artificial Sequence: Synthetic peptide
  Seed: GASSLPTTM (MAGA3_HUMAN)
GVSSLPTTL

SEQ ID NO: 53819 - protein, 9 aa, Artificial Sequence
  Description of Artificial Sequence: Synthetic peptide
  Seed: SEFQAALSR (MAGA3_HUMAN)
SEFQAALSV

SEQ ID NO: 53820 - protein, 9 aa, Artificial Sequence
  Description of Artificial Sequence: Synthetic peptide
  Seed: MEVDPIGHL (MAGA3_HUMAN)
MLVDPIGHY

SEQ ID NO: 53821 - protein, 9 aa, Artificial Sequence
  Description of Artificial Sequence: Synthetic peptide
  Seed: QEEEGPSTF (MAGA3_HUMAN)
QIEEGPSTF

SEQ ID NO: 53822 - protein, 9 aa, Artificial Sequence
  Description of Artificial Sequence: Synthetic peptide
  Seed: SSLPTTMNY (MAGA3_HUMAN)
SGLPTTMNK

SEQ ID NO: 53823 - protein, 9 aa, Artificial Sequence
  Description of Artificial Sequence: Synthetic peptide
  Seed: LSRKVAELV (MAGA3_HUMAN)
LSRKVAELI

SEQ ID NO: 53824 - protein, 9 aa, Artificial Sequence
  Description of Artificial Sequence: Synthetic peptide
  Seed: TQHFVQENY (MAGA3_HUMAN)
TMHFVQENV

SEQ ID NO: 53825 - protein, 9 aa, Artificial Sequence
  Description of Artificial Sequence: Synthetic peptide
  Seed: SVLEVFEGR (MAGA3_HUMAN)
SQLEVFEGY

SEQ ID NO: 53826 - protein, 10 aa, Artificial Sequence
  Description of Artificial Sequence: Synthetic peptide
  Seed: FLWGPRALVE (MAGA3_HUMAN)
FLWGPRALVT

SEQ ID NO: 53827 - protein, 11 aa, Artificial Sequence
  Description of Artificial Sequence: Synthetic peptide
  Seed: VVGNWQYFFPV (MAGA3_HUMAN)
VMGNWQYFFPV

SEQ ID NO: 53828 - protein, 10 aa, Artificial Sequence
  Description of Artificial Sequence: Synthetic peptide
  Seed: KAEMLGSVVG (MAGA3_HUMAN)
KYEMLGSVVA

SEQ ID NO: 53829 - protein, 9 aa, Artificial Sequence
  Description of Artificial Sequence: Synthetic peptide
  Seed: RQVPGSDPA (MAGA3_HUMAN)
RHVPGSDPM

SEQ ID NO: 53830 - protein, 10 aa, Artificial Sequence
  Description of Artificial Sequence: Synthetic peptide
  Seed: NWQYFFPVIF (MAGA3_HUMAN)
NKQYFFPVIF

SEQ ID NO: 53831 - protein, 9 aa, Artificial Sequence
  Description of Artificial Sequence: Synthetic peptide
  Seed: TSYVKVLHH (MAGA3_HUMAN)
TTYVKVLHF

SEQ ID NO: 53832 - protein, 10 aa, Artificial Sequence
  Description of Artificial Sequence: Synthetic peptide
  Seed: DLESEFQAAL (MAGA3_HUMAN)
DHESEFQAAY

SEQ ID NO: 53833 - protein, 10 aa, Artificial Sequence
  Description of Artificial Sequence: Synthetic peptide
  Seed: STFPDLESEF (MAGA3_HUMAN)
SQFPDLESEI

SEQ ID NO: 53834 - protein, 10 aa, Artificial Sequence
  Description of Artificial Sequence: Synthetic peptide
  Seed: KISGGPHISY (MAGA3_HUMAN)
KASGGPHISK

SEQ ID NO: 53835 - protein, 10 aa, Artificial Sequence
  Description of Artificial Sequence: Synthetic peptide
  Seed: AALSRKVAEL (MAGA3_HUMAN)
ALLSRKVAEV

SEQ ID NO: 53836 - protein, 10 aa, Artificial Sequence
  Description of Artificial Sequence: Synthetic peptide
  Seed: LQLVFGIELM (MAGA3_HUMAN)
LTLVFGIELV

SEQ ID NO: 53837 - protein, 9 aa, Artificial Sequence
  Description of Artificial Sequence: Synthetic peptide
  Seed: HLYIFATCL (MAGA3_HUMAN)
HMYIFATCR

SEQ ID NO: 53838 - protein, 10 aa, Artificial Sequence
  Description of Artificial Sequence: Synthetic peptide
  Seed: LGSVVGNWQY (MAGA3_HUMAN)
LSSVVGNWQM

SEQ ID NO: 53839 - protein, 9 aa, Artificial Sequence
  Description of Artificial Sequence: Synthetic peptide
  Seed: FLWGPRALV (MAGA3_HUMAN)
FTWGPRALM

SEQ ID NO: 53840 - protein, 10 aa, Artificial Sequence
  Description of Artificial Sequence: Synthetic peptide
  Seed: WEELSVLEVF (MAGA3_HUMAN)
WSELSVLEVM

SEQ ID NO: 53841 - protein, 9 aa, Artificial Sequence
  Description of Artificial Sequence: Synthetic peptide
  Seed: ISGGPHISY (MAGA3_HUMAN)
ILGGPHISL

SEQ ID NO: 53842 - protein, 10 aa, Artificial Sequence
  Description of Artificial Sequence: Synthetic peptide
  Seed: NWQYFFPVIF (MAGA3_HUMAN)
NWQYFFPVIY

SEQ ID NO: 53843 - protein, 11 aa, Artificial Sequence
  Description of Artificial Sequence: Synthetic peptide
  Seed: VVGNWQYFFPV (MAGA3_HUMAN)
VLGNWQYFFPA

SEQ ID NO: 53844 - protein, 9 aa, Artificial Sequence
  Description of Artificial Sequence: Synthetic peptide
  Seed: LQLVFGIEL (MAGA3_HUMAN)
LELVFGIEI

SEQ ID NO: 53845 - protein, 9 aa, Artificial Sequence
  Description of Artificial Sequence: Synthetic peptide
  Seed: TSYVKVLHH (MAGA3_HUMAN)
TTYVKVLHR

SEQ ID NO: 53846 - protein, 10 aa, Artificial Sequence
  Description of Artificial Sequence: Synthetic peptide
  Seed: FLWGPRALVE (MAGA3_HUMAN)
FMWGPRALVR

SEQ ID NO: 53847 - protein, 9 aa, Artificial Sequence
  Description of Artificial Sequence: Synthetic peptide
  Seed: KVAELVHFL (MAGA3_HUMAN)
KLAELVHFL

SEQ ID NO: 53848 - protein, 10 aa, Artificial Sequence
  Description of Artificial Sequence: Synthetic peptide
  Seed: VIFSKASSSL (MAGA3_HUMAN)
VVFSKASSSF

SEQ ID NO: 53849 - protein, 9 aa, Artificial Sequence
  Description of Artificial Sequence: Synthetic peptide
  Seed: SRKVAELVH (MAGA3_HUMAN)
SRKVAELVL

SEQ ID NO: 53850 - protein, 10 aa, Artificial Sequence
  Description of Artificial Sequence: Synthetic peptide
  Seed: MVKISGGPHI (MAGA3_HUMAN)
MFKISGGPHY

SEQ ID NO: 53851 - protein, 9 aa, Artificial Sequence
  Description of Artificial Sequence: Synthetic peptide
  Seed: IMPKAGLLI (MAGA3_HUMAN)
IGPKAGLLL

SEQ ID NO: 53852 - protein, 9 aa, Artificial Sequence
  Description of Artificial Sequence: Synthetic peptide
  Seed: FATCLGLSY (MAGA3_HUMAN)
FTTCLGLSW

SEQ ID NO: 53853 - protein, 9 aa, Artificial Sequence
  Description of Artificial Sequence: Synthetic peptide
  Seed: GSDPACYEF (MAGA3_HUMAN)
GIDPACYEF

SEQ ID NO: 53854 - protein, 9 aa, Artificial Sequence
  Description of Artificial Sequence: Synthetic peptide
  Seed: KVAELVHFL (MAGA3_HUMAN)
KVAELVHFW

SEQ ID NO: 53855 - protein, 10 aa, Artificial Sequence
  Description of Artificial Sequence: Synthetic peptide
  Seed: ELVHFLLLKY (MAGA3_HUMAN)
EAVHFLLLKK

SEQ ID NO: 53856 - protein, 10 aa, Artificial Sequence
  Description of Artificial Sequence: Synthetic peptide
  Seed: FSKASSSLQL (MAGA3_HUMAN)
FAKASSSLQL

SEQ ID NO: 53857 - protein, 9 aa, Artificial Sequence
  Description of Artificial Sequence: Synthetic peptide
  Seed: WEELSVLEV (MAGA3_HUMAN)
WEELSVLEI

SEQ ID NO: 53858 - protein, 9 aa, Artificial Sequence
  Description of Artificial Sequence: Synthetic peptide
  Seed: QIMPKAGLL (MAGA3_HUMAN)
QMMPKAGLA

SEQ ID NO: 53859 - protein, 10 aa, Artificial Sequence
  Description of Artificial Sequence: Synthetic peptide
  Seed: MNYPLWSQSY (MAGA3_HUMAN)
MLYPLWSQSV

SEQ ID NO: 53860 - protein, 9 aa, Artificial Sequence
  Description of Artificial Sequence: Synthetic peptide
  Seed: MEVDPIGHL (MAGA3_HUMAN)
MIVDPIGHF

SEQ ID NO: 53861 - protein, 9 aa, Artificial Sequence
  Description of Artificial Sequence: Synthetic peptide
  Seed: QIMPKAGLL (MAGA3_HUMAN)
QAMPKAGLM

SEQ ID NO: 53862 - protein, 9 aa, Artificial Sequence
  Description of Artificial Sequence: Synthetic peptide
  Seed: LQLVFGIEL (MAGA3_HUMAN)
LKLVFGIEY

SEQ ID NO: 53863 - protein, 9 aa, Artificial Sequence
  Description of Artificial Sequence: Synthetic peptide
  Seed: KVAELVHFL (MAGA3_HUMAN)
KAAELVHFI

SEQ ID NO: 53864 - protein, 9 aa, Artificial Sequence
  Description of Artificial Sequence: Synthetic peptide
  Seed: YVKVLHHMV (MAGA3_HUMAN)
YMKVLHHMM

SEQ ID NO: 53865 - protein, 9 aa, Artificial Sequence
  Description of Artificial Sequence: Synthetic peptide
  Seed: KVLHHMVKI (MAGA3_HUMAN)
KYLHHMVKK

SEQ ID NO: 53866 - protein, 10 aa, Artificial Sequence
  Description of Artificial Sequence: Synthetic peptide
  Seed: VIFSKASSSL (MAGA3_HUMAN)
VLFSKASSSI

SEQ ID NO: 53867 - protein, 11 aa, Artificial Sequence
  Description of Artificial Sequence: Synthetic peptide
  Seed: KVAELVHFLLL (MAGA3_HUMAN)
KLAELVHFLLQ

SEQ ID NO: 53868 - protein, 9 aa, Artificial Sequence
  Description of Artificial Sequence: Synthetic peptide
  Seed: LGDPKKLLT (MAGA3_HUMAN)
LADPKKLLM

SEQ ID NO: 53869 - protein, 9 aa, Artificial Sequence
  Description of Artificial Sequence: Synthetic peptide
  Seed: EVDPIGHLY (MAGA3_HUMAN)
EMDPIGHLF

SEQ ID NO: 53870 - protein, 10 aa, Artificial Sequence
  Description of Artificial Sequence: Synthetic peptide
  Seed: SYVKVLHHMV (MAGA3_HUMAN)
SYVKVLHHML

SEQ ID NO: 53871 - protein, 9 aa, Artificial Sequence
  Description of Artificial Sequence: Synthetic peptide
  Seed: KVAELVHFL (MAGA3_HUMAN)
KTAELVHFR

SEQ ID NO: 53872 - protein, 9 aa, Artificial Sequence
  Description of Artificial Sequence: Synthetic peptide
  Seed: KVAELVHFL (MAGA3_HUMAN)
KLAELVHFC

SEQ ID NO: 53873 - protein, 10 aa, Artificial Sequence
  Description of Artificial Sequence: Synthetic peptide
  Seed: ETSYVKVLHH (MAGA3_HUMAN)
ELSYVKVLHK

SEQ ID NO: 53874 - protein, 9 aa, Artificial Sequence
  Description of Artificial Sequence: Synthetic peptide
  Seed: TFPDLESEF (MAGA3_HUMAN)
TAPDLESEL

SEQ ID NO: 53875 - protein, 9 aa, Artificial Sequence
  Description of Artificial Sequence: Synthetic peptide
  Seed: MEVDPIGHL (MAGA3_HUMAN)
MTVDPIGHY

SEQ ID NO: 53876 - protein, 9 aa, Artificial Sequence
  Description of Artificial Sequence: Synthetic peptide
  Seed: VETSYVKVL (MAGA3_HUMAN)
VQTSYVKVI

SEQ ID NO: 53877 - protein, 11 aa, Artificial Sequence
  Description of Artificial Sequence: Synthetic peptide
  Seed: SRKVAELVHFL (MAGA3_HUMAN)
SMKVAELVHFV

SEQ ID NO: 53878 - protein, 10 aa, Artificial Sequence
  Description of Artificial Sequence: Synthetic peptide
  Seed: TSYVKVLHHM (MAGA3_HUMAN)
TNYVKVLHHW

SEQ ID NO: 53879 - protein, 11 aa, Artificial Sequence
  Description of Artificial Sequence: Synthetic peptide
  Seed: RQVPGSDPACY (MAGA3_HUMAN)
RVVPGSDPACR

SEQ ID NO: 53880 - protein, 11 aa, Artificial Sequence
  Description of Artificial Sequence: Synthetic peptide
  Seed: QEAASSSSTLV (MAGA3_HUMAN)
QEAASSSSTLA

SEQ ID NO: 53881 - protein, 10 aa, Artificial Sequence
  Description of Artificial Sequence: Synthetic peptide
  Seed: FSKASSSLQL (MAGA3_HUMAN)
FSKASSSLQW

SEQ ID NO: 53882 - protein, 11 aa, Artificial Sequence
  Description of Artificial Sequence: Synthetic peptide
  Seed: RKVAELVHFLL (MAGA3_HUMAN)
RRVAELVHFLM

SEQ ID NO: 53883 - protein, 10 aa, Artificial Sequence
  Description of Artificial Sequence: Synthetic peptide
  Seed: NWQYFFPVIF (MAGA3_HUMAN)
NCQYFFPVIF

SEQ ID NO: 53884 - protein, 10 aa, Artificial Sequence
  Description of Artificial Sequence: Synthetic peptide
  Seed: HISYPPLHEW (MAGA3_HUMAN)
HLSYPPLHEW

SEQ ID NO: 53885 - protein, 11 aa, Artificial Sequence
  Description of Artificial Sequence: Synthetic peptide
  Seed: SKASSSLQLVF (MAGA3_HUMAN)
SCASSSLQLVW

SEQ ID NO: 53886 - protein, 10 aa, Artificial Sequence
  Description of Artificial Sequence: Synthetic peptide
  Seed: LYIFATCLGL (MAGA3_HUMAN)
LYIFATCLGF

SEQ ID NO: 53887 - protein, 9 aa, Artificial Sequence
  Description of Artificial Sequence: Synthetic peptide
  Seed: YEDSSNQEE (MAGA3_HUMAN)
YEDSSNQEI

SEQ ID NO: 53888 - protein, 9 aa, Artificial Sequence
  Description of Artificial Sequence: Synthetic peptide
  Seed: MPKAGLLII (MAGA3_HUMAN)
MAKAGLLIM

SEQ ID NO: 53889 - protein, 11 aa, Artificial Sequence
  Description of Artificial Sequence: Synthetic peptide
  Seed: YIFATCLGLSY (MAGA3_HUMAN)
YQFATCLGLSF

SEQ ID NO: 53890 - protein, 10 aa, Artificial Sequence
  Description of Artificial Sequence: Synthetic peptide
  Seed: ASSLPTTMNY (MAGA3_HUMAN)
AFSLPTTMNW

SEQ ID NO: 53891 - protein, 10 aa, Artificial Sequence
  Description of Artificial Sequence: Synthetic peptide
  Seed: MNYPLWSQSY (MAGA3_HUMAN)
MIYPLWSQSM

SEQ ID NO: 53892 - protein, 10 aa, Artificial Sequence
  Description of Artificial Sequence: Synthetic peptide
  Seed: RQVPGSDPAC (MAGA3_HUMAN)
RMVPGSDPAV

SEQ ID NO: 53893 - protein, 9 aa, Artificial Sequence
  Description of Artificial Sequence: Synthetic peptide
  Seed: SSLPTTMNY (MAGA3_HUMAN)
SSLPTTMNR

SEQ ID NO: 53894 - protein, 10 aa, Artificial Sequence
  Description of Artificial Sequence: Synthetic peptide
  Seed: KAEMLGSVVG (MAGA3_HUMAN)
KPEMLGSVVV

SEQ ID NO: 53895 - protein, 10 aa, Artificial Sequence
  Description of Artificial Sequence: Synthetic peptide
  Seed: MNYPLWSQSY (MAGA3_HUMAN)
MTYPLWSQSI

SEQ ID NO: 53896 - protein, 10 aa, Artificial Sequence
  Description of Artificial Sequence: Synthetic peptide
  Seed: WEELSVLEVF (MAGA3_HUMAN)
WMELSVLEVL

SEQ ID NO: 53897 - protein, 10 aa, Artificial Sequence
  Description of Artificial Sequence: Synthetic peptide
  Seed: YIFATCLGLS (MAGA3_HUMAN)
YLFATCLGLI

SEQ ID NO: 53898 - protein, 9 aa, Artificial Sequence
  Description of Artificial Sequence: Synthetic peptide
  Seed: YFFPVIFSK (MAGA3_HUMAN)
YWFPVIFSM

SEQ ID NO: 53899 - protein, 10 aa, Artificial Sequence
  Description of Artificial Sequence: Synthetic peptide
  Seed: MEVDPIGHLY (MAGA3_HUMAN)
MAVDPIGHLM

SEQ ID NO: 53900 - protein, 9 aa, Artificial Sequence
  Description of Artificial Sequence: Synthetic peptide
  Seed: KVLHHMVKI (MAGA3_HUMAN)
KQLHHMVKM

SEQ ID NO: 53901 - protein, 10 aa, Artificial Sequence
  Description of Artificial Sequence: Synthetic peptide
  Seed: KAEMLGSVVG (MAGA3_HUMAN)
KEEMLGSVVA

SEQ ID NO: 53902 - protein, 10 aa, Artificial Sequence
  Description of Artificial Sequence: Synthetic peptide
  Seed: MNYPLWSQSY (MAGA3_HUMAN)
MFYPLWSQSV

SEQ ID NO: 53903 - protein, 9 aa, Artificial Sequence
  Description of Artificial Sequence: Synthetic peptide
  Seed: GSVVGNWQY (MAGA3_HUMAN)
GTVVGNWQF

SEQ ID NO: 53904 - protein, 9 aa, Artificial Sequence
  Description of Artificial Sequence: Synthetic peptide
  Seed: RQVPGSDPA (MAGA3_HUMAN)
RNVPGSDPY

SEQ ID NO: 53905 - protein, 11 aa, Artificial Sequence
  Description of Artificial Sequence: Synthetic peptide
  Seed: GASSLPTTMNY (MAGA3_HUMAN)
GISSLPTTMNW

SEQ ID NO: 53906 - protein, 9 aa, Artificial Sequence
  Description of Artificial Sequence: Synthetic peptide
  Seed: KASSSLQLV (MAGA3_HUMAN)
KTSSSLQLM

SEQ ID NO: 53907 - protein, 9 aa, Artificial Sequence
  Description of Artificial Sequence: Synthetic peptide
  Seed: FVQENYLEY (MAGA3_HUMAN)
FVQENYLEW

SEQ ID NO: 53908 - protein, 10 aa, Artificial Sequence
  Description of Artificial Sequence: Synthetic peptide
  Seed: LPTTMNYPLW (MAGA3_HUMAN)
LGTTMNYPLW

SEQ ID NO: 53909 - protein, 9 aa, Artificial Sequence
  Description of Artificial Sequence: Synthetic peptide
  Seed: ASSSLQLVF (MAGA3_HUMAN)
AMSSLQLVM

SEQ ID NO: 53910 - protein, 10 aa, Artificial Sequence
  Description of Artificial Sequence: Synthetic peptide
  Seed: KASSSLQLVF (MAGA3_HUMAN)
KNSSSLQLVY

SEQ ID NO: 53911 - protein, 9 aa, Artificial Sequence
  Description of Artificial Sequence: Synthetic peptide
  Seed: ASSSLQLVF (MAGA3_HUMAN)
ASSSLQLVL

SEQ ID NO: 53912 - protein, 9 aa, Artificial Sequence
  Description of Artificial Sequence: Synthetic peptide
  Seed: MPKAGLLII (MAGA3_HUMAN)
MMKAGLLIY

SEQ ID NO: 53913 - protein, 9 aa, Artificial Sequence
  Description of Artificial Sequence: Synthetic peptide
  Seed: LGDPKKLLT (MAGA3_HUMAN)
LSDPKKLLM

SEQ ID NO: 53914 - protein, 9 aa, Artificial Sequence
  Description of Artificial Sequence: Synthetic peptide
  Seed: YFFPVIFSK (MAGA3_HUMAN)
YVFPVIFSF

SEQ ID NO: 53915 - protein, 9 aa, Artificial Sequence
  Description of Artificial Sequence: Synthetic peptide
  Seed: SYVKVLHHM (MAGA3_HUMAN)
SYVKVLHHL

SEQ ID NO: 53916 - protein, 10 aa, Artificial Sequence
  Description of Artificial Sequence: Synthetic peptide
  Seed: LGLVGAQAPA (MAGA3_HUMAN)
LQLVGAQAPL

SEQ ID NO: 53917 - protein, 9 aa, Artificial Sequence
  Description of Artificial Sequence: Synthetic peptide
  Seed: ASSSLQLVF (MAGA3_HUMAN)
ATSSLQLVF

SEQ ID NO: 53918 - protein, 9 aa, Artificial Sequence
  Description of Artificial Sequence: Synthetic peptide
  Seed: SVVGNWQYF (MAGA3_HUMAN)
SYVGNWQYL

SEQ ID NO: 53919 - protein, 10 aa, Artificial Sequence
  Description of Artificial Sequence: Synthetic peptide
  Seed: ASSSSTLVEV (MAGA3_HUMAN)
AQSSSTLVEL

SEQ ID NO: 53920 - protein, 11 aa, Artificial Sequence
  Description of Artificial Sequence: Synthetic peptide
  Seed: RQVPGSDPACY (MAGA3_HUMAN)
RSVPGSDPACY

SEQ ID NO: 53921 - protein, 9 aa, Artificial Sequence
  Description of Artificial Sequence: Synthetic peptide
  Seed: ASSSLQLVF (MAGA3_HUMAN)
APSSLQLVF

SEQ ID NO: 53922 - protein, 9 aa, Artificial Sequence
  Description of Artificial Sequence: Synthetic peptide
  Seed: WQYFFPVIF (MAGA3_HUMAN)
WMYFFPVIL

SEQ ID NO: 53923 - protein, 10 aa, Artificial Sequence
  Description of Artificial Sequence: Synthetic peptide
  Seed: LVHFLLLKYR (MAGA3_HUMAN)
LAHFLLLKYR

SEQ ID NO: 53924 - protein, 9 aa, Artificial Sequence
  Description of Artificial Sequence: Synthetic peptide
  Seed: QSPQGASSL (MAGA3_HUMAN)
QLPQGASSF

SEQ ID NO: 53925 - protein, 9 aa, Artificial Sequence
  Description of Artificial Sequence: Synthetic peptide
  Seed: FATCLGLSY (MAGA3_HUMAN)
FKTCLGLSF

SEQ ID NO: 53926 - protein, 9 aa, Artificial Sequence
  Description of Artificial Sequence: Synthetic peptide
  Seed: FVQENYLEY (MAGA3_HUMAN)
FMQENYLEY

SEQ ID NO: 53927 - protein, 10 aa, Artificial Sequence
  Description of Artificial Sequence: Synthetic peptide
  Seed: KVAELVHFLL (MAGA3_HUMAN)
KQAELVHFLA

SEQ ID NO: 53928 - protein, 10 aa, Artificial Sequence
  Description of Artificial Sequence: Synthetic peptide
  Seed: SLPTTMNYPL (MAGA3_HUMAN)
SSPTTMNYPL

SEQ ID NO: 53929 - protein, 10 aa, Artificial Sequence
  Description of Artificial Sequence: Synthetic peptide
  Seed: MEVDPIGHLY (MAGA3_HUMAN)
MIVDPIGHLF

SEQ ID NO: 53930 - protein, 9 aa, Artificial Sequence
  Description of Artificial Sequence: Synthetic peptide
  Seed: SSSSTLVEV (MAGA3_HUMAN)
SPSSTLVEI

SEQ ID NO: 53931 - protein, 10 aa, Artificial Sequence
  Description of Artificial Sequence: Synthetic peptide
  Seed: ETSYVKVLHH (MAGA3_HUMAN)
ELSYVKVLHR

SEQ ID NO: 53932 - protein, 9 aa, Artificial Sequence
  Description of Artificial Sequence: Synthetic peptide
  Seed: AASSSSTLV (MAGA3_HUMAN)
AISSSSTLV

SEQ ID NO: 53933 - protein, 9 aa, Artificial Sequence
  Description of Artificial Sequence: Synthetic peptide
  Seed: SSSSTLVEV (MAGA3_HUMAN)
STSSTLVEA

SEQ ID NO: 53934 - protein, 9 aa, Artificial Sequence
  Description of Artificial Sequence: Synthetic peptide
  Seed: SSTLVEVTL (MAGA3_HUMAN)
SSTLVEVTF

SEQ ID NO: 53935 - protein, 9 aa, Artificial Sequence
  Description of Artificial Sequence: Synthetic peptide
  Seed: GASSLPTTM (MAGA3_HUMAN)
GMSSLPTTI

SEQ ID NO: 53936 - protein, 10 aa, Artificial Sequence
  Description of Artificial Sequence: Synthetic peptide
  Seed: SEFQAALSRK (MAGA3_HUMAN)
SWFQAALSRR

SEQ ID NO: 53937 - protein, 10 aa, Artificial Sequence
  Description of Artificial Sequence: Synthetic peptide
  Seed: SRKVAELVHF (MAGA3_HUMAN)
SMKVAELVHF

SEQ ID NO: 53938 - protein, 10 aa, Artificial Sequence
  Description of Artificial Sequence: Synthetic peptide
  Seed: SDPACYEFLW (MAGA3_HUMAN)
SSPACYEFLW

SEQ ID NO: 53939 - protein, 9 aa, Artificial Sequence
  Description of Artificial Sequence: Synthetic peptide
  Seed: ISYPPLHEW (MAGA3_HUMAN)
IVYPPLHEW

SEQ ID NO: 53940 - protein, 9 aa, Artificial Sequence
  Description of Artificial Sequence: Synthetic peptide
  Seed: YPLWSQSYE (MAGA3_HUMAN)
YSLWSQSYY

SEQ ID NO: 53941 - protein, 9 aa, Artificial Sequence
  Description of Artificial Sequence: Synthetic peptide
  Seed: KIWEELSVL (MAGA3_HUMAN)
KIWEELSVY

SEQ ID NO: 53942 - protein, 9 aa, Artificial Sequence
  Description of Artificial Sequence: Synthetic peptide
  Seed: RQVPGSDPA (MAGA3_HUMAN)
RLVPGSDPA

SEQ ID NO: 53943 - protein, 10 aa, Artificial Sequence
  Description of Artificial Sequence: Synthetic peptide
  Seed: MNYPLWSQSY (MAGA3_HUMAN)
MCYPLWSQSL

SEQ ID NO: 53944 - protein, 9 aa, Artificial Sequence
  Description of Artificial Sequence: Synthetic peptide
  Seed: AEMLGSVVG (MAGA3_HUMAN)
AEMLGSVVA

SEQ ID NO: 53945 - protein, 11 aa, Artificial Sequence
  Description of Artificial Sequence: Synthetic peptide
  Seed: SSLPTTMNYPL (MAGA3_HUMAN)
SSLPTTMNYPY

SEQ ID NO: 53946 - protein, 9 aa, Artificial Sequence
  Description of Artificial Sequence: Synthetic peptide
  Seed: TQHFVQENY (MAGA3_HUMAN)
TQHFVQENF

SEQ ID NO: 53947 - protein, 9 aa, Artificial Sequence
  Description of Artificial Sequence: Synthetic peptide
  Seed: YIFATCLGL (MAGA3_HUMAN)
YVFATCLGI

SEQ ID NO: 53948 - protein, 8 aa, Artificial Sequence
  Description of Artificial Sequence: Synthetic peptide
  Seed: SYPPLHEW (MAGA3_HUMAN)
SWPPLHEM

SEQ ID NO: 53949 - protein, 10 aa, Artificial Sequence
  Description of Artificial Sequence: Synthetic peptide
  Seed: FFPVIFSKAS (MAGA3_HUMAN)
FRPVIFSKAV

SEQ ID NO: 53950 - protein, 11 aa, Artificial Sequence
  Description of Artificial Sequence: Synthetic peptide
  Seed: YIFATCLGLSY (MAGA3_HUMAN)
YTFATCLGLSM

SEQ ID NO: 53951 - protein, 9 aa, Artificial Sequence
  Description of Artificial Sequence: Synthetic peptide
  Seed: AQAPATEEQ (MAGA3_HUMAN)
ATAPATEEF

SEQ ID NO: 53952 - protein, 10 aa, Artificial Sequence
  Description of Artificial Sequence: Synthetic peptide
  Seed: KASSSLQLVF (MAGA3_HUMAN)
KMSSSLQLVW

SEQ ID NO: 53953 - protein, 10 aa, Artificial Sequence
  Description of Artificial Sequence: Synthetic peptide
  Seed: LVFGIELMEV (MAGA3_HUMAN)
LIFGIELMEI

SEQ ID NO: 53954 - protein, 8 aa, Artificial Sequence
  Description of Artificial Sequence: Synthetic peptide
  Seed: MPKAGLLI (MAGA3_HUMAN)
MPKAGLLL

SEQ ID NO: 53955 - protein, 9 aa, Artificial Sequence
  Description of Artificial Sequence: Synthetic peptide
  Seed: QEEEGPSTF (MAGA3_HUMAN)
QYEEGPSTM

SEQ ID NO: 53956 - protein, 10 aa, Artificial Sequence
  Description of Artificial Sequence: Synthetic peptide
  Seed: QVPGSDPACY (MAGA3_HUMAN)
QMPGSDPACY

SEQ ID NO: 53957 - protein, 10 aa, Artificial Sequence
  Description of Artificial Sequence: Synthetic peptide
  Seed: ASSLPTTMNY (MAGA3_HUMAN)
ANSLPTTMNW

SEQ ID NO: 53958 - protein, 9 aa, Artificial Sequence
  Description of Artificial Sequence: Synthetic peptide
  Seed: EFQAALSRK (MAGA3_HUMAN)
ESQAALSRR

SEQ ID NO: 53959 - protein, 9 aa, Artificial Sequence
  Description of Artificial Sequence: Synthetic peptide
  Seed: SKASSSLQL (MAGA3_HUMAN)
SYASSSLQL

SEQ ID NO: 53960 - protein, 9 aa, Artificial Sequence
  Description of Artificial Sequence: Synthetic peptide
  Seed: LESEFQAAL (MAGA3_HUMAN)
LRSEFQAAY

SEQ ID NO: 53961 - protein, 9 aa, Artificial Sequence
  Description of Artificial Sequence: Synthetic peptide
  Seed: FATCLGLSY (MAGA3_HUMAN)
FTTCLGLSI

SEQ ID NO: 53962 - protein, 10 aa, Artificial Sequence
  Description of Artificial Sequence: Synthetic peptide
  Seed: ALSRKVAELV (MAGA3_HUMAN)
AMSRKVAELL

SEQ ID NO: 53963 - protein, 10 aa, Artificial Sequence
  Description of Artificial Sequence: Synthetic peptide
  Seed: GDCAPEEKIW (MAGA3_HUMAN)
GECAPEEKIW

SEQ ID NO: 53964 - protein, 9 aa, Artificial Sequence
  Description of Artificial Sequence: Synthetic peptide
  Seed: NQIMPKAGL (MAGA3_HUMAN)
NAIMPKAGF

SEQ ID NO: 53965 - protein, 9 aa, Artificial Sequence
  Description of Artificial Sequence: Synthetic peptide
  Seed: MPKAGLLII (MAGA3_HUMAN)
MPKAGLLIY

SEQ ID NO: 53966 - protein, 9 aa, Artificial Sequence
  Description of Artificial Sequence: Synthetic peptide
  Seed: FATCLGLSY (MAGA3_HUMAN)
FSTCLGLSI

SEQ ID NO: 53967 - protein, 9 aa, Artificial Sequence
  Description of Artificial Sequence: Synthetic peptide
  Seed: IMPKAGLLI (MAGA3_HUMAN)
ISPKAGLLM

SEQ ID NO: 53968 - protein, 10 aa, Artificial Sequence
  Description of Artificial Sequence: Synthetic peptide
  Seed: LGLVGAQAPA (MAGA3_HUMAN)
LFLVGAQAPV

SEQ ID NO: 53969 - protein, 9 aa, Artificial Sequence
  Description of Artificial Sequence: Synthetic peptide
  Seed: ILGDPKKLL (MAGA3_HUMAN)
IAGDPKKLY

SEQ ID NO: 53970 - protein, 9 aa, Artificial Sequence
  Description of Artificial Sequence: Synthetic peptide
  Seed: FQAALSRKV (MAGA3_HUMAN)
FMAALSRKV

SEQ ID NO: 53971 - protein, 9 aa, Artificial Sequence
  Description of Artificial Sequence: Synthetic peptide
  Seed: RQVPGSDPA (MAGA3_HUMAN)
RMVPGSDPY

SEQ ID NO: 53972 - protein, 11 aa, Artificial Sequence
  Description of Artificial Sequence: Synthetic peptide
  Seed: FLWGPRALVET (MAGA3_HUMAN)
FMWGPRALVEA

SEQ ID NO: 53973 - protein, 10 aa, Artificial Sequence
  Description of Artificial Sequence: Synthetic peptide
  Seed: MNYPLWSQSY (MAGA3_HUMAN)
MSYPLWSQSF

SEQ ID NO: 53974 - protein, 9 aa, Artificial Sequence
  Description of Artificial Sequence: Synthetic peptide
  Seed: AASSSSTLV (MAGA3_HUMAN)
AQSSSSTLI

SEQ ID NO: 53975 - protein, 9 aa, Artificial Sequence
  Description of Artificial Sequence: Synthetic peptide
  Seed: QIMPKAGLL (MAGA3_HUMAN)
QMMPKAGLI

SEQ ID NO: 53976 - protein, 10 aa, Artificial Sequence
  Description of Artificial Sequence: Synthetic peptide
  Seed: SSSTLVEVTL (MAGA3_HUMAN)
SMSTLVEVTW

SEQ ID NO: 53977 - protein, 9 aa, Artificial Sequence
  Description of Artificial Sequence: Synthetic peptide
  Seed: EVDPIGHLY (MAGA3_HUMAN)
EMDPIGHLV

SEQ ID NO: 53978 - protein, 9 aa, Artificial Sequence
  Description of Artificial Sequence: Synthetic peptide
  Seed: SVLEVFEGR (MAGA3_HUMAN)
STLEVFEGR

SEQ ID NO: 53979 - protein, 9 aa, Artificial Sequence
  Description of Artificial Sequence: Synthetic peptide
  Seed: FQAALSRKV (MAGA3_HUMAN)
FRAALSRKF

SEQ ID NO: 53980 - protein, 9 aa, Artificial Sequence
  Description of Artificial Sequence: Synthetic peptide
  Seed: KASSSLQLV (MAGA3_HUMAN)
KASSSLQLM

SEQ ID NO: 53981 - protein, 11 aa, Artificial Sequence
  Description of Artificial Sequence: Synthetic peptide
  Seed: TMNYPLWSQSY (MAGA3_HUMAN)
TQNYPLWSQSY

SEQ ID NO: 53982 - protein, 9 aa, Artificial Sequence
  Description of Artificial Sequence: Synthetic peptide
  Seed: KVLHHMVKI (MAGA3_HUMAN)
KMLHHMVKY

SEQ ID NO: 53983 - protein, 9 aa, Artificial Sequence
  Description of Artificial Sequence: Synthetic peptide
  Seed: ELVHFLLLK (MAGA3_HUMAN)
ENVHFLLLR

SEQ ID NO: 53984 - protein, 10 aa, Artificial Sequence
  Description of Artificial Sequence: Synthetic peptide
  Seed: LVFGIELMEV (MAGA3_HUMAN)
LMFGIELMEM

SEQ ID NO: 53985 - protein, 9 aa, Artificial Sequence
  Description of Artificial Sequence: Synthetic peptide
  Seed: KIWEELSVL (MAGA3_HUMAN)
KKWEELSVL

SEQ ID NO: 53986 - protein, 9 aa, Artificial Sequence
  Description of Artificial Sequence: Synthetic peptide
  Seed: YFFPVIFSK (MAGA3_HUMAN)
YYFPVIFSM

SEQ ID NO: 53987 - protein, 9 aa, Artificial Sequence
  Description of Artificial Sequence: Synthetic peptide
  Seed: SILGDPKKL (MAGA3_HUMAN)
SYLGDPKKY

SEQ ID NO: 53988 - protein, 9 aa, Artificial Sequence
  Description of Artificial Sequence: Synthetic peptide
  Seed: GSDPACYEF (MAGA3_HUMAN)
GWDPACYEF

SEQ ID NO: 53989 - protein, 9 aa, Artificial Sequence
  Description of Artificial Sequence: Synthetic peptide
  Seed: SVLEVFEGR (MAGA3_HUMAN)
STLEVFEGL

SEQ ID NO: 53990 - protein, 9 aa, Artificial Sequence
  Description of Artificial Sequence: Synthetic peptide
  Seed: VAELVHFLL (MAGA3_HUMAN)
VTELVHFLF

SEQ ID NO: 53991 - protein, 10 aa, Artificial Sequence
  Description of Artificial Sequence: Synthetic peptide
  Seed: LPTTMNYPLW (MAGA3_HUMAN)
LCTTMNYPLW

SEQ ID NO: 53992 - protein, 9 aa, Artificial Sequence
  Description of Artificial Sequence: Synthetic peptide
  Seed: SSLPTTMNY (MAGA3_HUMAN)
STLPTTMNH

SEQ ID NO: 53993 - protein, 11 aa, Artificial Sequence
  Description of Artificial Sequence: Synthetic peptide
  Seed: SSLPTTMNYPL (MAGA3_HUMAN)
SALPTTMNYPW

SEQ ID NO: 53994 - protein, 9 aa, Artificial Sequence
  Description of Artificial Sequence: Synthetic peptide
  Seed: LGDPKKLLT (MAGA3_HUMAN)
LIDPKKLLI

SEQ ID NO: 53995 - protein, 9 aa, Artificial Sequence
  Description of Artificial Sequence: Synthetic peptide
  Seed: MEVDPIGHL (MAGA3_HUMAN)
MVVDPIGHV

SEQ ID NO: 53996 - protein, 9 aa, Artificial Sequence
  Description of Artificial Sequence: Synthetic peptide
  Seed: FVQENYLEY (MAGA3_HUMAN)
FVQENYLER

SEQ ID NO: 53997 - protein, 11 aa, Artificial Sequence
  Description of Artificial Sequence: Synthetic peptide
  Seed: STFPDLESEFQ (MAGA3_HUMAN)
SAFPDLESEFK

SEQ ID NO: 53998 - protein, 9 aa, Artificial Sequence
  Description of Artificial Sequence: Synthetic peptide
  Seed: SSLPTTMNY (MAGA3_HUMAN)
SALPTTMNV

SEQ ID NO: 53999 - protein, 10 aa, Artificial Sequence
  Description of Artificial Sequence: Synthetic peptide
  Seed: LGLVGAQAPA (MAGA3_HUMAN)
LELVGAQAPL

SEQ ID NO: 54000 - protein, 9 aa, Artificial Sequence
  Description of Artificial Sequence: Synthetic peptide
  Seed: VAELVHFLL (MAGA3_HUMAN)
VAELVHFLW

SEQ ID NO: 54001 - protein, 11 aa, Artificial Sequence
  Description of Artificial Sequence: Synthetic peptide
  Seed: IWEELSVLEVF (MAGA3_HUMAN)
IYEELSVLEVW

SEQ ID NO: 54002 - protein, 9 aa, Artificial Sequence
  Description of Artificial Sequence: Synthetic peptide
  Seed: SSSSTLVEV (MAGA3_HUMAN)
SGSSTLVEY

SEQ ID NO: 54003 - protein, 10 aa, Artificial Sequence
  Description of Artificial Sequence: Synthetic peptide
  Seed: KASSSLQLVF (MAGA3_HUMAN)
KFSSSLQLVF

SEQ ID NO: 54004 - protein, 8 aa, Artificial Sequence
  Description of Artificial Sequence: Synthetic peptide
  Seed: FPDLESEF (MAGA3_HUMAN)
FNDLESEI

SEQ ID NO: 54005 - protein, 10 aa, Artificial Sequence
  Description of Artificial Sequence: Synthetic peptide
  Seed: MNYPLWSQSY (MAGA3_HUMAN)
MIYPLWSQSW

SEQ ID NO: 54006 - protein, 9 aa, Artificial Sequence
  Description of Artificial Sequence: Synthetic peptide
  Seed: SSSSTLVEV (MAGA3_HUMAN)
SVSSTLVEF

SEQ ID NO: 54007 - protein, 9 aa, Artificial Sequence
  Description of Artificial Sequence: Synthetic peptide
  Seed: EAASSSSTL (MAGA3_HUMAN)
EAASSSSTI

SEQ ID NO: 54008 - protein, 9 aa, Artificial Sequence
  Description of Artificial Sequence: Synthetic peptide
  Seed: FVQENYLEY (MAGA3_HUMAN)
FFQENYLEF

SEQ ID NO: 54009 - protein, 9 aa, Artificial Sequence
  Description of Artificial Sequence: Synthetic peptide
  Seed: SSLQLVFGI (MAGA3_HUMAN)
SALQLVFGV

SEQ ID NO: 54010 - protein, 9 aa, Artificial Sequence
  Description of Artificial Sequence: Synthetic peptide
  Seed: LGDPKKLLT (MAGA3_HUMAN)
LGDPKKLLL

SEQ ID NO: 54011 - protein, 11 aa, Artificial Sequence
  Description of Artificial Sequence: Synthetic peptide
  Seed: RQVPGSDPACY (MAGA3_HUMAN)
RLVPGSDPACI

SEQ ID NO: 54012 - protein, 10 aa, Artificial Sequence
  Description of Artificial Sequence: Synthetic peptide
  Seed: YFFPVIFSKA (MAGA3_HUMAN)
YMFPVIFSKK

SEQ ID NO: 54013 - protein, 10 aa, Artificial Sequence
  Description of Artificial Sequence: Synthetic peptide
  Seed: LGSVVGNWQY (MAGA3_HUMAN)
LDSVVGNWQW

SEQ ID NO: 54014 - protein, 9 aa, Artificial Sequence
  Description of Artificial Sequence: Synthetic peptide
  Seed: SEFQAALSR (MAGA3_HUMAN)
SEFQAALST

SEQ ID NO: 54015 - protein, 10 aa, Artificial Sequence
  Description of Artificial Sequence: Synthetic peptide
  Seed: IMPKAGLLII (MAGA3_HUMAN)
ILPKAGLLIV

SEQ ID NO: 54016 - protein, 11 aa, Artificial Sequence
  Description of Artificial Sequence: Synthetic peptide
  Seed: RQVPGSDPACY (MAGA3_HUMAN)
RMVPGSDPACI

SEQ ID NO: 54017 - protein, 9 aa, Artificial Sequence
  Description of Artificial Sequence: Synthetic peptide
  Seed: LESEFQAAL (MAGA3_HUMAN)
LESEFQAAP

SEQ ID NO: 54018 - protein, 9 aa, Artificial Sequence
  Description of Artificial Sequence: Synthetic peptide
  Seed: SVLEVFEGR (MAGA3_HUMAN)
SMLEVFEGV

SEQ ID NO: 54019 - protein, 9 aa, Artificial Sequence
  Description of Artificial Sequence: Synthetic peptide
  Seed: SKASSSLQL (MAGA3_HUMAN)
SIASSSLQF

SEQ ID NO: 54020 - protein, 9 aa, Artificial Sequence
  Description of Artificial Sequence: Synthetic peptide
  Seed: MEVDPIGHL (MAGA3_HUMAN)
MPVDPIGHF

SEQ ID NO: 54021 - protein, 11 aa, Artificial Sequence
  Description of Artificial Sequence: Synthetic peptide
  Seed: YIFATCLGLSY (MAGA3_HUMAN)
YLFATCLGLSF

SEQ ID NO: 54022 - protein, 10 aa, Artificial Sequence
  Description of Artificial Sequence: Synthetic peptide
  Seed: RKVAELVHFL (MAGA3_HUMAN)
RKVAELVHFV

SEQ ID NO: 54023 - protein, 10 aa, Artificial Sequence
  Description of Artificial Sequence: Synthetic peptide
  Seed: RQVPGSDPAC (MAGA3_HUMAN)
RLVPGSDPAF

SEQ ID NO: 54024 - protein, 9 aa, Artificial Sequence
  Description of Artificial Sequence: Synthetic peptide
  Seed: EALGLVGAQ (MAGA3_HUMAN)
EALGLVGAK

SEQ ID NO: 54025 - protein, 9 aa, Artificial Sequence
  Description of Artificial Sequence: Synthetic peptide
  Seed: ILGDPKKLL (MAGA3_HUMAN)
IFGDPKKLM

SEQ ID NO: 54026 - protein, 9 aa, Artificial Sequence
  Description of Artificial Sequence: Synthetic peptide
  Seed: TSYVKVLHH (MAGA3_HUMAN)
TSYVKVLHL

SEQ ID NO: 54027 - protein, 10 aa, Artificial Sequence
  Description of Artificial Sequence: Synthetic peptide
  Seed: VIFSKASSSL (MAGA3_HUMAN)
VYFSKASSSL

SEQ ID NO: 54028 - protein, 10 aa, Artificial Sequence
  Description of Artificial Sequence: Synthetic peptide
  Seed: LVFGIELMEV (MAGA3_HUMAN)
LMFGIELMEL

SEQ ID NO: 54029 - protein, 10 aa, Artificial Sequence
  Description of Artificial Sequence: Synthetic peptide
  Seed: TSYVKVLHHM (MAGA3_HUMAN)
TFYVKVLHHL

SEQ ID NO: 54030 - protein, 9 aa, Artificial Sequence
  Description of Artificial Sequence: Synthetic peptide
  Seed: ISGGPHISY (MAGA3_HUMAN)
IVGGPHISY

SEQ ID NO: 54031 - protein, 9 aa, Artificial Sequence
  Description of Artificial Sequence: Synthetic peptide
  Seed: LQLVFGIEL (MAGA3_HUMAN)
LMLVFGIEF

SEQ ID NO: 54032 - protein, 9 aa, Artificial Sequence
  Description of Artificial Sequence: Synthetic peptide
  Seed: ISGGPHISY (MAGA3_HUMAN)
ISGGPHISW

SEQ ID NO: 54033 - protein, 10 aa, Artificial Sequence
  Description of Artificial Sequence: Synthetic peptide
  Seed: VDPIGHLYIF (MAGA3_HUMAN)
VQPIGHLYIW

SEQ ID NO: 54034 - protein, 11 aa, Artificial Sequence
  Description of Artificial Sequence: Synthetic peptide
  Seed: RQVPGSDPACY (MAGA3_HUMAN)
RTVPGSDPACF

SEQ ID NO: 54035 - protein, 10 aa, Artificial Sequence
  Description of Artificial Sequence: Synthetic peptide
  Seed: AALSRKVAEL (MAGA3_HUMAN)
AILSRKVAEV

SEQ ID NO: 54036 - protein, 9 aa, Artificial Sequence
  Description of Artificial Sequence: Synthetic peptide
  Seed: YPPLHEWVL (MAGA3_HUMAN)
YPPLHEWVY

SEQ ID NO: 54037 - protein, 10 aa, Artificial Sequence
  Description of Artificial Sequence: Synthetic peptide
  Seed: KVAELVHFLL (MAGA3_HUMAN)
KDAELVHFLW

SEQ ID NO: 54038 - protein, 10 aa, Artificial Sequence
  Description of Artificial Sequence: Synthetic peptide
  Seed: LGLVGAQAPA (MAGA3_HUMAN)
LMLVGAQAPA

SEQ ID NO: 54039 - protein, 9 aa, Artificial Sequence
  Description of Artificial Sequence: Synthetic peptide
  Seed: FVQENYLEY (MAGA3_HUMAN)
FRQENYLEF

SEQ ID NO: 54040 - protein, 9 aa, Artificial Sequence
  Description of Artificial Sequence: Synthetic peptide
  Seed: ISGGPHISY (MAGA3_HUMAN)
IQGGPHISF

SEQ ID NO: 54041 - protein, 9 aa, Artificial Sequence
  Description of Artificial Sequence: Synthetic peptide
  Seed: EAASSSSTL (MAGA3_HUMAN)
EIASSSSTF

SEQ ID NO: 54042 - protein, 9 aa, Artificial Sequence
  Description of Artificial Sequence: Synthetic peptide
  Seed: QSPQGASSL (MAGA3_HUMAN)
QTPQGASSK

SEQ ID NO: 54043 - protein, 9 aa, Artificial Sequence
  Description of Artificial Sequence: Synthetic peptide
  Seed: KVAELVHFL (MAGA3_HUMAN)
KTAELVHFA

SEQ ID NO: 54044 - protein, 10 aa, Artificial Sequence
  Description of Artificial Sequence: Synthetic peptide
  Seed: RALVETSYVK (MAGA3_HUMAN)
RSLVETSYVK

SEQ ID NO: 54045 - protein, 9 aa, Artificial Sequence
  Description of Artificial Sequence: Synthetic peptide
  Seed: QEEEGPSTF (MAGA3_HUMAN)
QEEEGPSTP

SEQ ID NO: 54046 - protein, 9 aa, Artificial Sequence
  Description of Artificial Sequence: Synthetic peptide
  Seed: KVAELVHFL (MAGA3_HUMAN)
KFAELVHFL

SEQ ID NO: 54047 - protein, 10 aa, Artificial Sequence
  Description of Artificial Sequence: Synthetic peptide
  Seed: KVAELVHFLL (MAGA3_HUMAN)
KIAELVHFLH

SEQ ID NO: 54048 - protein, 9 aa, Artificial Sequence
  Description of Artificial Sequence: Synthetic peptide
  Seed: MEVDPIGHL (MAGA3_HUMAN)
MEVDPIGHI

SEQ ID NO: 54049 - protein, 9 aa, Artificial Sequence
  Description of Artificial Sequence: Synthetic peptide
  Seed: KASSSLQLV (MAGA3_HUMAN)
KQSSSLQLV

SEQ ID NO: 54050 - protein, 9 aa, Artificial Sequence
  Description of Artificial Sequence: Synthetic peptide
  Seed: YFFPVIFSK (MAGA3_HUMAN)
YAFPVIFSK

SEQ ID NO: 54051 - protein, 10 aa, Artificial Sequence
  Description of Artificial Sequence: Synthetic peptide
  Seed: FVQENYLEYR (MAGA3_HUMAN)
FYQENYLEYR

SEQ ID NO: 54052 - protein, 10 aa, Artificial Sequence
  Description of Artificial Sequence: Synthetic peptide
  Seed: ASSLPTTMNY (MAGA3_HUMAN)
AGSLPTTMNW

SEQ ID NO: 54053 - protein, 10 aa, Artificial Sequence
  Description of Artificial Sequence: Synthetic peptide
  Seed: AELVHFLLLK (MAGA3_HUMAN)
ATLVHFLLLK

SEQ ID NO: 54054 - protein, 9 aa, Artificial Sequence
  Description of Artificial Sequence: Synthetic peptide
  Seed: YFFPVIFSK (MAGA3_HUMAN)
YVFPVIFSY

SEQ ID NO: 54055 - protein, 10 aa, Artificial Sequence
  Description of Artificial Sequence: Synthetic peptide
  Seed: MVKISGGPHI (MAGA3_HUMAN)
MSKISGGPHY

SEQ ID NO: 54056 - protein, 11 aa, Artificial Sequence
  Description of Artificial Sequence: Synthetic peptide
  Seed: AESPDPPQSPQ (MAGA3_HUMAN)
AESPDPPQSPV

SEQ ID NO: 54057 - protein, 11 aa, Artificial Sequence
  Description of Artificial Sequence: Synthetic peptide
  Seed: RQVPGSDPACY (MAGA3_HUMAN)
REVPGSDPACW

SEQ ID NO: 54058 - protein, 10 aa, Artificial Sequence
  Description of Artificial Sequence: Synthetic peptide
  Seed: LGSVVGNWQY (MAGA3_HUMAN)
LVSVVGNWQW

SEQ ID NO: 54059 - protein, 9 aa, Artificial Sequence
  Description of Artificial Sequence: Synthetic peptide
  Seed: FLWGPRALV (MAGA3_HUMAN)
FAWGPRALF

SEQ ID NO: 54060 - protein, 9 aa, Artificial Sequence
  Description of Artificial Sequence: Synthetic peptide
  Seed: EVDPIGHLY (MAGA3_HUMAN)
EVDPIGHLR

SEQ ID NO: 54061 - protein, 9 aa, Artificial Sequence
  Description of Artificial Sequence: Synthetic peptide
  Seed: RQVPGSDPA (MAGA3_HUMAN)
RIVPGSDPV

SEQ ID NO: 54062 - protein, 10 aa, Artificial Sequence
  Description of Artificial Sequence: Synthetic peptide
  Seed: KAEMLGSVVG (MAGA3_HUMAN)
KMEMLGSVVP

SEQ ID NO: 54063 - protein, 10 aa, Artificial Sequence
  Description of Artificial Sequence: Synthetic peptide
  Seed: HISYPPLHEW (MAGA3_HUMAN)
HFSYPPLHEW

SEQ ID NO: 54064 - protein, 9 aa, Artificial Sequence
  Description of Artificial Sequence: Synthetic peptide
  Seed: MLGSVVGNW (MAGA3_HUMAN)
MAGSVVGNF

SEQ ID NO: 54065 - protein, 10 aa, Artificial Sequence
  Description of Artificial Sequence: Synthetic peptide
  Seed: ESPDPPQSPQ (MAGA3_HUMAN)
EAPDPPQSPR

SEQ ID NO: 54066 - protein, 9 aa, Artificial Sequence
  Description of Artificial Sequence: Synthetic peptide
  Seed: GASSLPTTM (MAGA3_HUMAN)
GASSLPTTH

SEQ ID NO: 54067 - protein, 10 aa, Artificial Sequence
  Description of Artificial Sequence: Synthetic peptide
  Seed: STFPDLESEF (MAGA3_HUMAN)
SLFPDLESEF

SEQ ID NO: 54068 - protein, 8 aa, Artificial Sequence
  Description of Artificial Sequence: Synthetic peptide
  Seed: SGGPHISY (MAGA3_HUMAN)
SSGPHISI

SEQ ID NO: 54069 - protein, 9 aa, Artificial Sequence
  Description of Artificial Sequence: Synthetic peptide
  Seed: EVTLGEVPA (MAGA3_HUMAN)
ESTLGEVPV

SEQ ID NO: 54070 - protein, 9 aa, Artificial Sequence
  Description of Artificial Sequence: Synthetic peptide
  Seed: SSLPTTMNY (MAGA3_HUMAN)
SPLPTTMNF

SEQ ID NO: 54071 - protein, 9 aa, Artificial Sequence
  Description of Artificial Sequence: Synthetic peptide
  Seed: QSPQGASSL (MAGA3_HUMAN)
QAPQGASSF

SEQ ID NO: 54072 - protein, 10 aa, Artificial Sequence
  Description of Artificial Sequence: Synthetic peptide
  Seed: MNYPLWSQSY (MAGA3_HUMAN)
MLYPLWSQSI

SEQ ID NO: 54073 - protein, 10 aa, Artificial Sequence
  Description of Artificial Sequence: Synthetic peptide
  Seed: RKVAELVHFL (MAGA3_HUMAN)
RQVAELVHFV

SEQ ID NO: 54074 - protein, 10 aa, Artificial Sequence
  Description of Artificial Sequence: Synthetic peptide
  Seed: EVFEGREDSI (MAGA3_HUMAN)
EVFEGREDSV

SEQ ID NO: 54075 - protein, 9 aa, Artificial Sequence
  Description of Artificial Sequence: Synthetic peptide
  Seed: EVDPIGHLY (MAGA3_HUMAN)
ELDPIGHLF

SEQ ID NO: 54076 - protein, 10 aa, Artificial Sequence
  Description of Artificial Sequence: Synthetic peptide
  Seed: SLPTTMNYPL (MAGA3_HUMAN)
SPPTTMNYPL

SEQ ID NO: 54077 - protein, 9 aa, Artificial Sequence
  Description of Artificial Sequence: Synthetic peptide
  Seed: MPLEQRSQH (MAGA3_HUMAN)
MSLEQRSQY

SEQ ID NO: 54078 - protein, 8 aa, Artificial Sequence
  Description of Artificial Sequence: Synthetic peptide
  Seed: MPKAGLLI (MAGA3_HUMAN)
MPKAGLLM

SEQ ID NO: 54079 - protein, 9 aa, Artificial Sequence
  Description of Artificial Sequence: Synthetic peptide
  Seed: RALVETSYV (MAGA3_HUMAN)
RLLVETSYM

SEQ ID NO: 54080 - protein, 9 aa, Artificial Sequence
  Description of Artificial Sequence: Synthetic peptide
  Seed: EALGLVGAQ (MAGA3_HUMAN)
EVLGLVGAR

SEQ ID NO: 54081 - protein, 9 aa, Artificial Sequence
  Description of Artificial Sequence: Synthetic peptide
  Seed: SVLEVFEGR (MAGA3_HUMAN)
SYLEVFEGR

SEQ ID NO: 54082 - protein, 11 aa, Artificial Sequence
  Description of Artificial Sequence: Synthetic peptide
  Seed: EVFEGREDSIL (MAGA3_HUMAN)
EIFEGREDSIR

SEQ ID NO: 54083 - protein, 9 aa, Artificial Sequence
  Description of Artificial Sequence: Synthetic peptide
  Seed: ISYPPLHEW (MAGA3_HUMAN)
ISYPPLHEA

SEQ ID NO: 54084 - protein, 9 aa, Artificial Sequence
  Description of Artificial Sequence: Synthetic peptide
  Seed: MEVDPIGHL (MAGA3_HUMAN)
MSVDPIGHF

SEQ ID NO: 54085 - protein, 9 aa, Artificial Sequence
  Description of Artificial Sequence: Synthetic peptide
  Seed: SVVGNWQYF (MAGA3_HUMAN)
SVVGNWQYY

SEQ ID NO: 54086 - protein, 9 aa, Artificial Sequence
  Description of Artificial Sequence: Synthetic peptide
  Seed: FQAALSRKV (MAGA3_HUMAN)
FRAALSRKV

SEQ ID NO: 54087 - protein, 9 aa, Artificial Sequence
  Description of Artificial Sequence: Synthetic peptide
  Seed: IFSKASSSL (MAGA3_HUMAN)
ITSKASSSY

SEQ ID NO: 54088 - protein, 11 aa, Artificial Sequence
  Description of Artificial Sequence: Synthetic peptide
  Seed: SKASSSLQLVF (MAGA3_HUMAN)
SQASSSLQLVF

SEQ ID NO: 54089 - protein, 9 aa, Artificial Sequence
  Description of Artificial Sequence: Synthetic peptide
  Seed: SSSSTLVEV (MAGA3_HUMAN)
SSSSTLVEM

SEQ ID NO: 54090 - protein, 10 aa, Artificial Sequence
  Description of Artificial Sequence: Synthetic peptide
  Seed: MEVDPIGHLY (MAGA3_HUMAN)
MRVDPIGHLL

SEQ ID NO: 54091 - protein, 10 aa, Artificial Sequence
  Description of Artificial Sequence: Synthetic peptide
  Seed: MNYPLWSQSY (MAGA3_HUMAN)
MRYPLWSQSV

SEQ ID NO: 54092 - protein, 9 aa, Artificial Sequence
  Description of Artificial Sequence: Synthetic peptide
  Seed: SILGDPKKL (MAGA3_HUMAN)
SLLGDPKKW

SEQ ID NO: 54093 - protein, 9 aa, Artificial Sequence
  Description of Artificial Sequence: Synthetic peptide
  Seed: GSDPACYEF (MAGA3_HUMAN)
GSDPACYEI

SEQ ID NO: 54094 - protein, 10 aa, Artificial Sequence
  Description of Artificial Sequence: Synthetic peptide
  Seed: LQLVFGIELM (MAGA3_HUMAN)
LILVFGIELV

SEQ ID NO: 54095 - protein, 9 aa, Artificial Sequence
  Description of Artificial Sequence: Synthetic peptide
  Seed: RQVPGSDPA (MAGA3_HUMAN)
RHVPGSDPF

SEQ ID NO: 54096 - protein, 10 aa, Artificial Sequence
  Description of Artificial Sequence: Synthetic peptide
  Seed: MNYPLWSQSY (MAGA3_HUMAN)
MEYPLWSQSW

SEQ ID NO: 54097 - protein, 9 aa, Artificial Sequence
  Description of Artificial Sequence: Synthetic peptide
  Seed: GLVGAQAPA (MAGA3_HUMAN)
GQVGAQAPV

SEQ ID NO: 54098 - protein, 9 aa, Artificial Sequence
  Description of Artificial Sequence: Synthetic peptide
  Seed: RALVETSYV (MAGA3_HUMAN)
RLLVETSYL

SEQ ID NO: 54099 - protein, 11 aa, Artificial Sequence
  Description of Artificial Sequence: Synthetic peptide
  Seed: SKASSSLQLVF (MAGA3_HUMAN)
SQASSSLQLVM

SEQ ID NO: 54100 - protein, 9 aa, Artificial Sequence
  Description of Artificial Sequence: Synthetic peptide
  Seed: KVLHHMVKI (MAGA3_HUMAN)
KQLHHMVKY

SEQ ID NO: 54101 - protein, 10 aa, Artificial Sequence
  Description of Artificial Sequence: Synthetic peptide
  Seed: ASSSLQLVFG (MAGA3_HUMAN)
AQSSLQLVFW

SEQ ID NO: 54102 - protein, 10 aa, Artificial Sequence
  Description of Artificial Sequence: Synthetic peptide
  Seed: RALVETSYVK (MAGA3_HUMAN)
RFLVETSYVR

SEQ ID NO: 54103 - protein, 9 aa, Artificial Sequence
  Description of Artificial Sequence: Synthetic peptide
  Seed: LQLVFGIEL (MAGA3_HUMAN)
LKLVFGIEM

SEQ ID NO: 54104 - protein, 10 aa, Artificial Sequence
  Description of Artificial Sequence: Synthetic peptide
  Seed: WEELSVLEVF (MAGA3_HUMAN)
WLELSVLEVM

SEQ ID NO: 54105 - protein, 9 aa, Artificial Sequence
  Description of Artificial Sequence: Synthetic peptide
  Seed: GPRALVETS (MAGA3_HUMAN)
GPRALVETM

SEQ ID NO: 54106 - protein, 10 aa, Artificial Sequence
  Description of Artificial Sequence: Synthetic peptide
  Seed: QGASSLPTTM (MAGA3_HUMAN)
QVASSLPTTY

SEQ ID NO: 54107 - protein, 9 aa, Artificial Sequence
  Description of Artificial Sequence: Synthetic peptide
  Seed: ISYPPLHEW (MAGA3_HUMAN)
ILYPPLHEI

SEQ ID NO: 54108 - protein, 10 aa, Artificial Sequence
  Description of Artificial Sequence: Synthetic peptide
  Seed: DLESEFQAAL (MAGA3_HUMAN)
DEESEFQAAY

SEQ ID NO: 54109 - protein, 10 aa, Artificial Sequence
  Description of Artificial Sequence: Synthetic peptide
  Seed: FLWGPRALVE (MAGA3_HUMAN)
FMWGPRALVF

SEQ ID NO: 54110 - protein, 10 aa, Artificial Sequence
  Description of Artificial Sequence: Synthetic peptide
  Seed: DLESEFQAAL (MAGA3_HUMAN)
DSESEFQAAF

SEQ ID NO: 54111 - protein, 10 aa, Artificial Sequence
  Description of Artificial Sequence: Synthetic peptide
  Seed: EALGLVGAQA (MAGA3_HUMAN)
EALGLVGAQV

SEQ ID NO: 54112 - protein, 9 aa, Artificial Sequence
  Description of Artificial Sequence: Synthetic peptide
  Seed: IAREGDCAP (MAGA3_HUMAN)
IPREGDCAV

SEQ ID NO: 54113 - protein, 9 aa, Artificial Sequence
  Description of Artificial Sequence: Synthetic peptide
  Seed: ALSRKVAEL (MAGA3_HUMAN)
AMSRKVAEA

SEQ ID NO: 54114 - protein, 9 aa, Artificial Sequence
  Description of Artificial Sequence: Synthetic peptide
  Seed: VETSYVKVL (MAGA3_HUMAN)
VETSYVKVI

SEQ ID NO: 54115 - protein, 8 aa, Artificial Sequence
  Description of Artificial Sequence: Synthetic peptide
  Seed: FPDLESEF (MAGA3_HUMAN)
FLDLESEF

SEQ ID NO: 54116 - protein, 9 aa, Artificial Sequence
  Description of Artificial Sequence: Synthetic peptide
  Seed: YFFPVIFSK (MAGA3_HUMAN)
YIFPVIFSY

SEQ ID NO: 54117 - protein, 11 aa, Artificial Sequence
  Description of Artificial Sequence: Synthetic peptide
  Seed: REGDCAPEEKI (MAGA3_HUMAN)
RIGDCAPEEKL

SEQ ID NO: 54118 - protein, 9 aa, Artificial Sequence
  Description of Artificial Sequence: Synthetic peptide
  Seed: RALVETSYV (MAGA3_HUMAN)
RVLVETSYF

SEQ ID NO: 54119 - protein, 9 aa, Artificial Sequence
  Description of Artificial Sequence: Synthetic peptide
  Seed: GSDPACYEF (MAGA3_HUMAN)
GLDPACYEL

SEQ ID NO: 54120 - protein, 10 aa, Artificial Sequence
  Description of Artificial Sequence: Synthetic peptide
  Seed: SVVGNWQYFF (MAGA3_HUMAN)
SYVGNWQYFR

SEQ ID NO: 54121 - protein, 9 aa, Artificial Sequence
  Description of Artificial Sequence: Synthetic peptide
  Seed: IFSKASSSL (MAGA3_HUMAN)
IYSKASSSI

SEQ ID NO: 54122 - protein, 10 aa, Artificial Sequence
  Description of Artificial Sequence: Synthetic peptide
  Seed: FSKASSSLQL (MAGA3_HUMAN)
FVKASSSLQM

SEQ ID NO: 54123 - protein, 10 aa, Artificial Sequence
  Description of Artificial Sequence: Synthetic peptide
  Seed: MVKISGGPHI (MAGA3_HUMAN)
MFKISGGPHM

SEQ ID NO: 54124 - protein, 10 aa, Artificial Sequence
  Description of Artificial Sequence: Synthetic peptide
  Seed: QYFFPVIFSK (MAGA3_HUMAN)
QFFFPVIFSK

SEQ ID NO: 54125 - protein, 8 aa, Artificial Sequence
  Description of Artificial Sequence: Synthetic peptide
  Seed: FPDLESEF (MAGA3_HUMAN)
FMDLESEL

SEQ ID NO: 54126 - protein, 11 aa, Artificial Sequence
  Description of Artificial Sequence: Synthetic peptide
  Seed: ISYPPLHEWVL (MAGA3_HUMAN)
IYYPPLHEWVL

SEQ ID NO: 54127 - protein, 11 aa, Artificial Sequence
  Description of Artificial Sequence: Synthetic peptide
  Seed: TLVEVTLGEVP (MAGA3_HUMAN)
TLVEVTLGEVV

SEQ ID NO: 54128 - protein, 10 aa, Artificial Sequence
  Description of Artificial Sequence: Synthetic peptide
  Seed: QEAASSSSTL (MAGA3_HUMAN)
QEAASSSSTA

SEQ ID NO: 54129 - protein, 10 aa, Artificial Sequence
  Description of Artificial Sequence: Synthetic peptide
  Seed: RALVETSYVK (MAGA3_HUMAN)
RTLVETSYVK

SEQ ID NO: 54130 - protein, 10 aa, Artificial Sequence
  Description of Artificial Sequence: Synthetic peptide
  Seed: LVFGIELMEV (MAGA3_HUMAN)
LLFGIELMEM

SEQ ID NO: 54131 - protein, 10 aa, Artificial Sequence
  Description of Artificial Sequence: Synthetic peptide
  Seed: LGLVGAQAPA (MAGA3_HUMAN)
LMLVGAQAPL

SEQ ID NO: 54132 - protein, 9 aa, Artificial Sequence
  Description of Artificial Sequence: Synthetic peptide
  Seed: ISYPPLHEW (MAGA3_HUMAN)
IHYPPLHEF

SEQ ID NO: 54133 - protein, 9 aa, Artificial Sequence
  Description of Artificial Sequence: Synthetic peptide
  Seed: SYPPLHEWV (MAGA3_HUMAN)
SWPPLHEWW

SEQ ID NO: 54134 - protein, 10 aa, Artificial Sequence
  Description of Artificial Sequence: Synthetic peptide
  Seed: ASSLPTTMNY (MAGA3_HUMAN)
AYSLPTTMNF

SEQ ID NO: 54135 - protein, 9 aa, Artificial Sequence
  Description of Artificial Sequence: Synthetic peptide
  Seed: GSVVGNWQY (MAGA3_HUMAN)
GMVVGNWQY

SEQ ID NO: 54136 - protein, 9 aa, Artificial Sequence
  Description of Artificial Sequence: Synthetic peptide
  Seed: QSPQGASSL (MAGA3_HUMAN)
QAPQGASSV

SEQ ID NO: 54137 - protein, 11 aa, Artificial Sequence
  Description of Artificial Sequence: Synthetic peptide
  Seed: SSLPTTMNYPL (MAGA3_HUMAN)
SSLPTTMNYPW

SEQ ID NO: 54138 - protein, 10 aa, Artificial Sequence
  Description of Artificial Sequence: Synthetic peptide
  Seed: YRQVPGSDPA (MAGA3_HUMAN)
YLQVPGSDPI

SEQ ID NO: 54139 - protein, 9 aa, Artificial Sequence
  Description of Artificial Sequence: Synthetic peptide
  Seed: KVAELVHFL (MAGA3_HUMAN)
KLAELVHFF

SEQ ID NO: 54140 - protein, 10 aa, Artificial Sequence
  Description of Artificial Sequence: Synthetic peptide
  Seed: TLVEVTLGEV (MAGA3_HUMAN)
TLVEVTLGEA

SEQ ID NO: 54141 - protein, 9 aa, Artificial Sequence
  Description of Artificial Sequence: Synthetic peptide
  Seed: SSTLVEVTL (MAGA3_HUMAN)
SQTLVEVTM

SEQ ID NO: 54142 - protein, 10 aa, Artificial Sequence
  Description of Artificial Sequence: Synthetic peptide
  Seed: KAEMLGSVVG (MAGA3_HUMAN)
KLEMLGSVVV

SEQ ID NO: 54143 - protein, 9 aa, Artificial Sequence
  Description of Artificial Sequence: Synthetic peptide
  Seed: FATCLGLSY (MAGA3_HUMAN)
FSTCLGLSW

SEQ ID NO: 54144 - protein, 9 aa, Artificial Sequence
  Description of Artificial Sequence: Synthetic peptide
  Seed: TFPDLESEF (MAGA3_HUMAN)
TCPDLESEL

SEQ ID NO: 54145 - protein, 11 aa, Artificial Sequence
  Description of Artificial Sequence: Synthetic peptide
  Seed: GEALGLVGAQA (MAGA3_HUMAN)
GEALGLVGAQL

SEQ ID NO: 54146 - protein, 8 aa, Artificial Sequence
  Description of Artificial Sequence: Synthetic peptide
  Seed: LGDPKKLL (MAGA3_HUMAN)
LFDPKKLF

SEQ ID NO: 54147 - protein, 10 aa, Artificial Sequence
  Description of Artificial Sequence: Synthetic peptide
  Seed: MEVDPIGHLY (MAGA3_HUMAN)
MEVDPIGHLC

SEQ ID NO: 54148 - protein, 9 aa, Artificial Sequence
  Description of Artificial Sequence: Synthetic peptide
  Seed: NQIMPKAGL (MAGA3_HUMAN)
NHIMPKAGY

SEQ ID NO: 54149 - protein, 9 aa, Artificial Sequence
  Description of Artificial Sequence: Synthetic peptide
  Seed: GNWQYFFPV (MAGA3_HUMAN)
GVWQYFFPL

SEQ ID NO: 54150 - protein, 10 aa, Artificial Sequence
  Description of Artificial Sequence: Synthetic peptide
  Seed: SLQLVFGIEL (MAGA3_HUMAN)
SAQLVFGIEF

SEQ ID NO: 54151 - protein, 10 aa, Artificial Sequence
  Description of Artificial Sequence: Synthetic peptide
  Seed: AESPDPPQSP (MAGA3_HUMAN)
AESPDPPQSI

SEQ ID NO: 54152 - protein, 9 aa, Artificial Sequence
  Description of Artificial Sequence: Synthetic peptide
  Seed: SVVGNWQYF (MAGA3_HUMAN)
SFVGNWQYL

SEQ ID NO: 54153 - protein, 9 aa, Artificial Sequence
  Description of Artificial Sequence: Synthetic peptide
  Seed: FVQENYLEY (MAGA3_HUMAN)
FYQENYLEH

SEQ ID NO: 54154 - protein, 11 aa, Artificial Sequence
  Description of Artificial Sequence: Synthetic peptide
  Seed: SNQEEEGPSTF (MAGA3_HUMAN)
SSQEEEGPSTF

SEQ ID NO: 54155 - protein, 9 aa, Artificial Sequence
  Description of Artificial Sequence: Synthetic peptide
  Seed: GSDPACYEF (MAGA3_HUMAN)
GVDPACYEM

SEQ ID NO: 54156 - protein, 9 aa, Artificial Sequence
  Description of Artificial Sequence: Synthetic peptide
  Seed: SYVKVLHHM (MAGA3_HUMAN)
STVKVLHHF

SEQ ID NO: 54157 - protein, 10 aa, Artificial Sequence
  Description of Artificial Sequence: Synthetic peptide
  Seed: KASSSLQLVF (MAGA3_HUMAN)
KLSSSLQLVY

SEQ ID NO: 54158 - protein, 9 aa, Artificial Sequence
  Description of Artificial Sequence: Synthetic peptide
  Seed: YIFATCLGL (MAGA3_HUMAN)
YVFATCLGA

SEQ ID NO: 54159 - protein, 9 aa, Artificial Sequence
  Description of Artificial Sequence: Synthetic peptide
  Seed: QEEEGPSTF (MAGA3_HUMAN)
QMEEGPSTL

SEQ ID NO: 54160 - protein, 10 aa, Artificial Sequence
  Description of Artificial Sequence: Synthetic peptide
  Seed: ELVHFLLLKY (MAGA3_HUMAN)
ETVHFLLLKR

SEQ ID NO: 54161 - protein, 10 aa, Artificial Sequence
  Description of Artificial Sequence: Synthetic peptide
  Seed: MEVDPIGHLY (MAGA3_HUMAN)
MTVDPIGHLR

SEQ ID NO: 54162 - protein, 11 aa, Artificial Sequence
  Description of Artificial Sequence: Synthetic peptide
  Seed: ELSVLEVFEGR (MAGA3_HUMAN)
ESSVLEVFEGR

SEQ ID NO: 54163 - protein, 9 aa, Artificial Sequence
  Description of Artificial Sequence: Synthetic peptide
  Seed: LESEFQAAL (MAGA3_HUMAN)
LLSEFQAAF

SEQ ID NO: 54164 - protein, 10 aa, Artificial Sequence
  Description of Artificial Sequence: Synthetic peptide
  Seed: TSYVKVLHHM (MAGA3_HUMAN)
TRYVKVLHHI

SEQ ID NO: 54165 - protein, 9 aa, Artificial Sequence
  Description of Artificial Sequence: Synthetic peptide
  Seed: FQAALSRKV (MAGA3_HUMAN)
FIAALSRKA

SEQ ID NO: 54166 - protein, 10 aa, Artificial Sequence
  Description of Artificial Sequence: Synthetic peptide
  Seed: LVFGIELMEV (MAGA3_HUMAN)
LLFGIELMEA

SEQ ID NO: 54167 - protein, 10 aa, Artificial Sequence
  Description of Artificial Sequence: Synthetic peptide
  Seed: KVAELVHFLL (MAGA3_HUMAN)
KLAELVHFLT

SEQ ID NO: 54168 - protein, 10 aa, Artificial Sequence
  Description of Artificial Sequence: Synthetic peptide
  Seed: TSYVKVLHHM (MAGA3_HUMAN)
TPYVKVLHHI

SEQ ID NO: 54169 - protein, 9 aa, Artificial Sequence
  Description of Artificial Sequence: Synthetic peptide
  Seed: TFPDLESEF (MAGA3_HUMAN)
TRPDLESEV

SEQ ID NO: 54170 - protein, 9 aa, Artificial Sequence
  Description of Artificial Sequence: Synthetic peptide
  Seed: GASSLPTTM (MAGA3_HUMAN)
GMSSLPTTY

SEQ ID NO: 54171 - protein, 10 aa, Artificial Sequence
  Description of Artificial Sequence: Synthetic peptide
  Seed: MEVDPIGHLY (MAGA3_HUMAN)
MFVDPIGHLY

SEQ ID NO: 54172 - protein, 9 aa, Artificial Sequence
  Description of Artificial Sequence: Synthetic peptide
  Seed: RKVAELVHF (MAGA3_HUMAN)
RRVAELVHM

SEQ ID NO: 54173 - protein, 9 aa, Artificial Sequence
  Description of Artificial Sequence: Synthetic peptide
  Seed: LSRKVAELV (MAGA3_HUMAN)
LSRKVAELW

SEQ ID NO: 54174 - protein, 10 aa, Artificial Sequence
  Description of Artificial Sequence: Synthetic peptide
  Seed: MEVDPIGHLY (MAGA3_HUMAN)
MAVDPIGHLV

SEQ ID NO: 54175 - protein, 10 aa, Artificial Sequence
  Description of Artificial Sequence: Synthetic peptide
  Seed: KASSSLQLVF (MAGA3_HUMAN)
KYSSSLQLVY

SEQ ID NO: 54176 - protein, 10 aa, Artificial Sequence
  Description of Artificial Sequence: Synthetic peptide
  Seed: TSYVKVLHHM (MAGA3_HUMAN)
TVYVKVLHHF

SEQ ID NO: 54177 - protein, 9 aa, Artificial Sequence
  Description of Artificial Sequence: Synthetic peptide
  Seed: SSLPTTMNY (MAGA3_HUMAN)
SALPTTMNR

SEQ ID NO: 54178 - protein, 9 aa, Artificial Sequence
  Description of Artificial Sequence: Synthetic peptide
  Seed: ALSRKVAEL (MAGA3_HUMAN)
AVSRKVAEW

SEQ ID NO: 54179 - protein, 9 aa, Artificial Sequence
  Description of Artificial Sequence: Synthetic peptide
  Seed: CYEFLWGPR (MAGA3_HUMAN)
CTEFLWGPR

SEQ ID NO: 54180 - protein, 10 aa, Artificial Sequence
  Description of Artificial Sequence: Synthetic peptide
  Seed: ETSYVKVLHH (MAGA3_HUMAN)
EISYVKVLHR

SEQ ID NO: 54181 - protein, 10 aa, Artificial Sequence
  Description of Artificial Sequence: Synthetic peptide
  Seed: KAEMLGSVVG (MAGA3_HUMAN)
KDEMLGSVVA

SEQ ID NO: 54182 - protein, 9 aa, Artificial Sequence
  Description of Artificial Sequence: Synthetic peptide
  Seed: MPKAGLLII (MAGA3_HUMAN)
MPKAGLLIV

SEQ ID NO: 54183 - protein, 10 aa, Artificial Sequence
  Description of Artificial Sequence: Synthetic peptide
  Seed: WEELSVLEVF (MAGA3_HUMAN)
WNELSVLEVL

SEQ ID NO: 54184 - protein, 11 aa, Artificial Sequence
  Description of Artificial Sequence: Synthetic peptide
  Seed: KIWEELSVLEV (MAGA3_HUMAN)
KIWEELSVLEL

SEQ ID NO: 54185 - protein, 9 aa, Artificial Sequence
  Description of Artificial Sequence: Synthetic peptide
  Seed: ISGGPHISY (MAGA3_HUMAN)
IFGGPHISF

SEQ ID NO: 54186 - protein, 11 aa, Artificial Sequence
  Description of Artificial Sequence: Synthetic peptide
  Seed: STFPDLESEFQ (MAGA3_HUMAN)
STFPDLESEFK

SEQ ID NO: 54187 - protein, 10 aa, Artificial Sequence
  Description of Artificial Sequence: Synthetic peptide
  Seed: WEELSVLEVF (MAGA3_HUMAN)
WMELSVLEVM

SEQ ID NO: 54188 - protein, 10 aa, Artificial Sequence
  Description of Artificial Sequence: Synthetic peptide
  Seed: QYFFPVIFSK (MAGA3_HUMAN)
QTFFPVIFSK

SEQ ID NO: 54189 - protein, 9 aa, Artificial Sequence
  Description of Artificial Sequence: Synthetic peptide
  Seed: APATEEQEA (MAGA3_HUMAN)
APATEEQEL

SEQ ID NO: 54190 - protein, 9 aa, Artificial Sequence
  Description of Artificial Sequence: Synthetic peptide
  Seed: EEQEAASSS (MAGA3_HUMAN)
EEQEAASSI

SEQ ID NO: 54191 - protein, 9 aa, Artificial Sequence
  Description of Artificial Sequence: Synthetic peptide
  Seed: NYPLWSQSY (MAGA3_HUMAN)
NWPLWSQSW

SEQ ID NO: 54192 - protein, 9 aa, Artificial Sequence
  Description of Artificial Sequence: Synthetic peptide
  Seed: YPLWSQSYE (MAGA3_HUMAN)
YALWSQSYY

SEQ ID NO: 54193 - protein, 10 aa, Artificial Sequence
  Description of Artificial Sequence: Synthetic peptide
  Seed: YIFATCLGLS (MAGA3_HUMAN)
YSFATCLGLV

SEQ ID NO: 54194 - protein, 10 aa, Artificial Sequence
  Description of Artificial Sequence: Synthetic peptide
  Seed: MNYPLWSQSY (MAGA3_HUMAN)
MYYPLWSQSV

SEQ ID NO: 54195 - protein, 9 aa, Artificial Sequence
  Description of Artificial Sequence: Synthetic peptide
  Seed: YFFPVIFSK (MAGA3_HUMAN)
YYFPVIFSY

SEQ ID NO: 54196 - protein, 10 aa, Artificial Sequence
  Description of Artificial Sequence: Synthetic peptide
  Seed: SLPTTMNYPL (MAGA3_HUMAN)
SSPTTMNYPM

SEQ ID NO: 54197 - protein, 9 aa, Artificial Sequence
  Description of Artificial Sequence: Synthetic peptide
  Seed: EFQAALSRK (MAGA3_HUMAN)
EGQAALSRR

SEQ ID NO: 54198 - protein, 10 aa, Artificial Sequence
  Description of Artificial Sequence: Synthetic peptide
  Seed: MEVDPIGHLY (MAGA3_HUMAN)
MGVDPIGHLM

SEQ ID NO: 54199 - protein, 10 aa, Artificial Sequence
  Description of Artificial Sequence: Synthetic peptide
  Seed: KVAELVHFLL (MAGA3_HUMAN)
KTAELVHFLK

SEQ ID NO: 54200 - protein, 9 aa, Artificial Sequence
  Description of Artificial Sequence: Synthetic peptide
  Seed: MPLEQRSQH (MAGA3_HUMAN)
MPLEQRSQV

SEQ ID NO: 54201 - protein, 9 aa, Artificial Sequence
  Description of Artificial Sequence: Synthetic peptide
  Seed: LESEFQAAL (MAGA3_HUMAN)
LLSEFQAAL

SEQ ID NO: 54202 - protein, 9 aa, Artificial Sequence
  Description of Artificial Sequence: Synthetic peptide
  Seed: IMPKAGLLI (MAGA3_HUMAN)
IYPKAGLLW

SEQ ID NO: 54203 - protein, 9 aa, Artificial Sequence
  Description of Artificial Sequence: Synthetic peptide
  Seed: KIWEELSVL (MAGA3_HUMAN)
KIWEELSVM

SEQ ID NO: 54204 - protein, 9 aa, Artificial Sequence
  Description of Artificial Sequence: Synthetic peptide
  Seed: LESEFQAAL (MAGA3_HUMAN)
LSSEFQAAV

SEQ ID NO: 54205 - protein, 9 aa, Artificial Sequence
  Description of Artificial Sequence: Synthetic peptide
  Seed: EVDPIGHLY (MAGA3_HUMAN)
ETDPIGHLL

SEQ ID NO: 54206 - protein, 9 aa, Artificial Sequence
  Description of Artificial Sequence: Synthetic peptide
  Seed: SVLEVFEGR (MAGA3_HUMAN)
SFLEVFEGY

SEQ ID NO: 54207 - protein, 10 aa, Artificial Sequence
  Description of Artificial Sequence: Synthetic peptide
  Seed: RKVAELVHFL (MAGA3_HUMAN)
RMVAELVHFT

SEQ ID NO: 54208 - protein, 9 aa, Artificial Sequence
  Description of Artificial Sequence: Synthetic peptide
  Seed: IFSKASSSL (MAGA3_HUMAN)
IASKASSSF

SEQ ID NO: 54209 - protein, 9 aa, Artificial Sequence
  Description of Artificial Sequence: Synthetic peptide
  Seed: SILGDPKKL (MAGA3_HUMAN)
SALGDPKKF

SEQ ID NO: 54210 - protein, 10 aa, Artificial Sequence
  Description of Artificial Sequence: Synthetic peptide
  Seed: EAASSSSTLV (MAGA3_HUMAN)
ETASSSSTLV

SEQ ID NO: 54211 - protein, 9 aa, Artificial Sequence
  Description of Artificial Sequence: Synthetic peptide
  Seed: VVGNWQYFF (MAGA3_HUMAN)
VYGNWQYFM

SEQ ID NO: 54212 - protein, 10 aa, Artificial Sequence
  Description of Artificial Sequence: Synthetic peptide
  Seed: WEELSVLEVF (MAGA3_HUMAN)
WVELSVLEVL

SEQ ID NO: 54213 - protein, 10 aa, Artificial Sequence
  Description of Artificial Sequence: Synthetic peptide
  Seed: YFFPVIFSKA (MAGA3_HUMAN)
YMFPVIFSKR

SEQ ID NO: 54214 - protein, 9 aa, Artificial Sequence
  Description of Artificial Sequence: Synthetic peptide
  Seed: KVAELVHFL (MAGA3_HUMAN)
KAAELVHFF

SEQ ID NO: 54215 - protein, 9 aa, Artificial Sequence
  Description of Artificial Sequence: Synthetic peptide
  Seed: ILGDPKKLL (MAGA3_HUMAN)
IAGDPKKLV

SEQ ID NO: 54216 - protein, 11 aa, Artificial Sequence
  Description of Artificial Sequence: Synthetic peptide
  Seed: SSSSTLVEVTL (MAGA3_HUMAN)
SISSTLVEVTW

SEQ ID NO: 54217 - protein, 9 aa, Artificial Sequence
  Description of Artificial Sequence: Synthetic peptide
  Seed: MEVDPIGHL (MAGA3_HUMAN)
MKVDPIGHF

SEQ ID NO: 54218 - protein, 10 aa, Artificial Sequence
  Description of Artificial Sequence: Synthetic peptide
  Seed: KASSSLQLVF (MAGA3_HUMAN)
KNSSSLQLVM

SEQ ID NO: 54219 - protein, 10 aa, Artificial Sequence
  Description of Artificial Sequence: Synthetic peptide
  Seed: STFPDLESEF (MAGA3_HUMAN)
SIFPDLESER

SEQ ID NO: 54220 - protein, 9 aa, Artificial Sequence
  Description of Artificial Sequence: Synthetic peptide
  Seed: FQAALSRKV (MAGA3_HUMAN)
FVAALSRKV

SEQ ID NO: 54221 - protein, 9 aa, Artificial Sequence
  Description of Artificial Sequence: Synthetic peptide
  Seed: RQVPGSDPA (MAGA3_HUMAN)
RVVPGSDPI

SEQ ID NO: 54222 - protein, 9 aa, Artificial Sequence
  Description of Artificial Sequence: Synthetic peptide
  Seed: SVLEVFEGR (MAGA3_HUMAN)
SALEVFEGL

SEQ ID NO: 54223 - protein, 9 aa, Artificial Sequence
  Description of Artificial Sequence: Synthetic peptide
  Seed: YIFATCLGL (MAGA3_HUMAN)
YLFATCLGF

SEQ ID NO: 54224 - protein, 9 aa, Artificial Sequence
  Description of Artificial Sequence: Synthetic peptide
  Seed: SVVGNWQYF (MAGA3_HUMAN)
SAVGNWQYI

SEQ ID NO: 54225 - protein, 9 aa, Artificial Sequence
  Description of Artificial Sequence: Synthetic peptide
  Seed: SILGDPKKL (MAGA3_HUMAN)
SMLGDPKKW

SEQ ID NO: 54226 - protein, 10 aa, Artificial Sequence
  Description of Artificial Sequence: Synthetic peptide
  Seed: QYFFPVIFSK (MAGA3_HUMAN)
QMFFPVIFSK

SEQ ID NO: 54227 - protein, 10 aa, Artificial Sequence
  Description of Artificial Sequence: Synthetic peptide
  Seed: LVHFLLLKYR (MAGA3_HUMAN)
LYHFLLLKYR

SEQ ID NO: 54228 - protein, 9 aa, Artificial Sequence
  Description of Artificial Sequence: Synthetic peptide
  Seed: GPRALVETS (MAGA3_HUMAN)
GPRALVETV

SEQ ID NO: 54229 - protein, 10 aa, Artificial Sequence
  Description of Artificial Sequence: Synthetic peptide
  Seed: WEELSVLEVF (MAGA3_HUMAN)
WMELSVLEVY

SEQ ID NO: 54230 - protein, 11 aa, Artificial Sequence
  Description of Artificial Sequence: Synthetic peptide
  Seed: AEMLGSVVGNW (MAGA3_HUMAN)
AEMLGSVVGNM

SEQ ID NO: 54231 - protein, 9 aa, Artificial Sequence
  Description of Artificial Sequence: Synthetic peptide
  Seed: FVQENYLEY (MAGA3_HUMAN)
FGQENYLEI

SEQ ID NO: 54232 - protein, 9 aa, Artificial Sequence
  Description of Artificial Sequence: Synthetic peptide
  Seed: YIFATCLGL (MAGA3_HUMAN)
YAFATCLGA

SEQ ID NO: 54233 - protein, 9 aa, Artificial Sequence
  Description of Artificial Sequence: Synthetic peptide
  Seed: LQLVFGIEL (MAGA3_HUMAN)
LMLVFGIEY

SEQ ID NO: 54234 - protein, 9 aa, Artificial Sequence
  Description of Artificial Sequence: Synthetic peptide
  Seed: IFSKASSSL (MAGA3_HUMAN)
ISSKASSSY

SEQ ID NO: 54235 - protein, 10 aa, Artificial Sequence
  Description of Artificial Sequence: Synthetic peptide
  Seed: FSKASSSLQL (MAGA3_HUMAN)
FKKASSSLQF

SEQ ID NO: 54236 - protein, 9 aa, Artificial Sequence
  Description of Artificial Sequence: Synthetic peptide
  Seed: KVAELVHFL (MAGA3_HUMAN)
KWAELVHFL

SEQ ID NO: 54237 - protein, 9 aa, Artificial Sequence
  Description of Artificial Sequence: Synthetic peptide
  Seed: ILGDPKKLL (MAGA3_HUMAN)
IQGDPKKLL

SEQ ID NO: 54238 - protein, 9 aa, Artificial Sequence
  Description of Artificial Sequence: Synthetic peptide
  Seed: VQENYLEYR (MAGA3_HUMAN)
VIENYLEYY

SEQ ID NO: 54239 - protein, 10 aa, Artificial Sequence
  Description of Artificial Sequence: Synthetic peptide
  Seed: ISYPPLHEWV (MAGA3_HUMAN)
IYYPPLHEWY

SEQ ID NO: 54240 - protein, 10 aa, Artificial Sequence
  Description of Artificial Sequence: Synthetic peptide
  Seed: TTMNYPLWSQ (MAGA3_HUMAN)
TTMNYPLWSK

SEQ ID NO: 54241 - protein, 10 aa, Artificial Sequence
  Description of Artificial Sequence: Synthetic peptide
  Seed: MNYPLWSQSY (MAGA3_HUMAN)
MMYPLWSQSF

SEQ ID NO: 54242 - protein, 9 aa, Artificial Sequence
  Description of Artificial Sequence: Synthetic peptide
  Seed: RALVETSYV (MAGA3_HUMAN)
RVLVETSYK

SEQ ID NO: 54243 - protein, 10 aa, Artificial Sequence
  Description of Artificial Sequence: Synthetic peptide
  Seed: SVVGNWQYFF (MAGA3_HUMAN)
SYVGNWQYFG

SEQ ID NO: 54244 - protein, 10 aa, Artificial Sequence
  Description of Artificial Sequence: Synthetic peptide
  Seed: KVAELVHFLL (MAGA3_HUMAN)
KLAELVHFLD

SEQ ID NO: 54245 - protein, 10 aa, Artificial Sequence
  Description of Artificial Sequence: Synthetic peptide
  Seed: NWQYFFPVIF (MAGA3_HUMAN)
NQQYFFPVIF

SEQ ID NO: 54246 - protein, 10 aa, Artificial Sequence
  Description of Artificial Sequence: Synthetic peptide
  Seed: MVKISGGPHI (MAGA3_HUMAN)
MAKISGGPHM

SEQ ID NO: 54247 - protein, 9 aa, Artificial Sequence
  Description of Artificial Sequence: Synthetic peptide
  Seed: REDSILGDP (MAGA3_HUMAN)
REDSILGDA

SEQ ID NO: 54248 - protein, 10 aa, Artificial Sequence
  Description of Artificial Sequence: Synthetic peptide
  Seed: MVKISGGPHI (MAGA3_HUMAN)
MVKISGGPHF

SEQ ID NO: 54249 - protein, 9 aa, Artificial Sequence
  Description of Artificial Sequence: Synthetic peptide
  Seed: SSLPTTMNY (MAGA3_HUMAN)
SILPTTMNF

SEQ ID NO: 54250 - protein, 10 aa, Artificial Sequence
  Description of Artificial Sequence: Synthetic peptide
  Seed: RQVPGSDPAC (MAGA3_HUMAN)
RQVPGSDPAI

SEQ ID NO: 54251 - protein, 10 aa, Artificial Sequence
  Description of Artificial Sequence: Synthetic peptide
  Seed: YLEYRQVPGS (MAGA3_HUMAN)
YMEYRQVPGL

SEQ ID NO: 54252 - protein, 9 aa, Artificial Sequence
  Description of Artificial Sequence: Synthetic peptide
  Seed: QIMPKAGLL (MAGA3_HUMAN)
QVMPKAGLR

SEQ ID NO: 54253 - protein, 10 aa, Artificial Sequence
  Description of Artificial Sequence: Synthetic peptide
  Seed: YRQVPGSDPA (MAGA3_HUMAN)
YMQVPGSDPV

SEQ ID NO: 54254 - protein, 9 aa, Artificial Sequence
  Description of Artificial Sequence: Synthetic peptide
  Seed: EVDPIGHLY (MAGA3_HUMAN)
EGDPIGHLY

SEQ ID NO: 54255 - protein, 11 aa, Artificial Sequence
  Description of Artificial Sequence: Synthetic peptide
  Seed: SNQEEEGPSTF (MAGA3_HUMAN)
SVQEEEGPSTW

SEQ ID NO: 54256 - protein, 9 aa, Artificial Sequence
  Description of Artificial Sequence: Synthetic peptide
  Seed: FATCLGLSY (MAGA3_HUMAN)
FPTCLGLSV

SEQ ID NO: 54257 - protein, 10 aa, Artificial Sequence
  Description of Artificial Sequence: Synthetic peptide
  Seed: VDPIGHLYIF (MAGA3_HUMAN)
VCPIGHLYIY

SEQ ID NO: 54258 - protein, 9 aa, Artificial Sequence
  Description of Artificial Sequence: Synthetic peptide
  Seed: SEFQAALSR (MAGA3_HUMAN)
SDFQAALSV

SEQ ID NO: 54259 - protein, 9 aa, Artificial Sequence
  Description of Artificial Sequence: Synthetic peptide
  Seed: QIMPKAGLL (MAGA3_HUMAN)
QLMPKAGLI

SEQ ID NO: 54260 - protein, 9 aa, Artificial Sequence
  Description of Artificial Sequence: Synthetic peptide
  Seed: YPPLHEWVL (MAGA3_HUMAN)
YAPLHEWVF

SEQ ID NO: 54261 - protein, 9 aa, Artificial Sequence
  Description of Artificial Sequence: Synthetic peptide
  Seed: ISYPPLHEW (MAGA3_HUMAN)
IYYPPLHEM

SEQ ID NO: 54262 - protein, 9 aa, Artificial Sequence
  Description of Artificial Sequence: Synthetic peptide
  Seed: YIFATCLGL (MAGA3_HUMAN)
YAFATCLGL

SEQ ID NO: 54263 - protein, 9 aa, Artificial Sequence
  Description of Artificial Sequence: Synthetic peptide
  Seed: RALVETSYV (MAGA3_HUMAN)
RILVETSYI

SEQ ID NO: 54264 - protein, 9 aa, Artificial Sequence
  Description of Artificial Sequence: Synthetic peptide
  Seed: SEFQAALSR (MAGA3_HUMAN)
SAFQAALSK

SEQ ID NO: 54265 - protein, 9 aa, Artificial Sequence
  Description of Artificial Sequence: Synthetic peptide
  Seed: LPTTMNYPL (MAGA3_HUMAN)
LATTMNYPM

SEQ ID NO: 54266 - protein, 8 aa, Artificial Sequence
  Description of Artificial Sequence: Synthetic peptide
  Seed: FPDLESEF (MAGA3_HUMAN)
FIDLESEF

SEQ ID NO: 54267 - protein, 10 aa, Artificial Sequence
  Description of Artificial Sequence: Synthetic peptide
  Seed: FSKASSSLQL (MAGA3_HUMAN)
FHKASSSLQM

SEQ ID NO: 54268 - protein, 9 aa, Artificial Sequence
  Description of Artificial Sequence: Synthetic peptide
  Seed: TSYVKVLHH (MAGA3_HUMAN)
TGYVKVLHL

SEQ ID NO: 54269 - protein, 10 aa, Artificial Sequence
  Description of Artificial Sequence: Synthetic peptide
  Seed: QENYLEYRQV (MAGA3_HUMAN)
QENYLEYRQY

SEQ ID NO: 54270 - protein, 9 aa, Artificial Sequence
  Description of Artificial Sequence: Synthetic peptide
  Seed: YVKVLHHMV (MAGA3_HUMAN)
YPKVLHHML

SEQ ID NO: 54271 - protein, 9 aa, Artificial Sequence
  Description of Artificial Sequence: Synthetic peptide
  Seed: QIMPKAGLL (MAGA3_HUMAN)
QMMPKAGLF

SEQ ID NO: 54272 - protein, 9 aa, Artificial Sequence
  Description of Artificial Sequence: Synthetic peptide
  Seed: EVDPIGHLY (MAGA3_HUMAN)
ECDPIGHLF

SEQ ID NO: 54273 - protein, 10 aa, Artificial Sequence
  Description of Artificial Sequence: Synthetic peptide
  Seed: VIFSKASSSL (MAGA3_HUMAN)
VIFSKASSSY

SEQ ID NO: 54274 - protein, 10 aa, Artificial Sequence
  Description of Artificial Sequence: Synthetic peptide
  Seed: KVAELVHFLL (MAGA3_HUMAN)
KSAELVHFLL

SEQ ID NO: 54275 - protein, 9 aa, Artificial Sequence
  Description of Artificial Sequence: Synthetic peptide
  Seed: IMPKAGLLI (MAGA3_HUMAN)
IQPKAGLLY

SEQ ID NO: 54276 - protein, 9 aa, Artificial Sequence
  Description of Artificial Sequence: Synthetic peptide
  Seed: RALVETSYV (MAGA3_HUMAN)
RQLVETSYF

SEQ ID NO: 54277 - protein, 9 aa, Artificial Sequence
  Description of Artificial Sequence: Synthetic peptide
  Seed: SSSSTLVEV (MAGA3_HUMAN)
SMSSTLVEY

SEQ ID NO: 54278 - protein, 9 aa, Artificial Sequence
  Description of Artificial Sequence: Synthetic peptide
  Seed: SSSSTLVEV (MAGA3_HUMAN)
SGSSTLVEF

SEQ ID NO: 54279 - protein, 9 aa, Artificial Sequence
  Description of Artificial Sequence: Synthetic peptide
  Seed: SSTLVEVTL (MAGA3_HUMAN)
SITLVEVTW

SEQ ID NO: 54280 - protein, 9 aa, Artificial Sequence
  Description of Artificial Sequence: Synthetic peptide
  Seed: GLLIIVLAI (MAGA3_HUMAN)
GTLIIVLAV

SEQ ID NO: 54281 - protein, 10 aa, Artificial Sequence
  Description of Artificial Sequence: Synthetic peptide
  Seed: RQVPGSDPAC (MAGA3_HUMAN)
RKVPGSDPAF

SEQ ID NO: 54282 - protein, 9 aa, Artificial Sequence
  Description of Artificial Sequence: Synthetic peptide
  Seed: SVVGNWQYF (MAGA3_HUMAN)
SQVGNWQYW

SEQ ID NO: 54283 - protein, 11 aa, Artificial Sequence
  Description of Artificial Sequence: Synthetic peptide
  Seed: SLPTTMNYPLW (MAGA3_HUMAN)
SYPTTMNYPLW

SEQ ID NO: 54284 - protein, 10 aa, Artificial Sequence
  Description of Artificial Sequence: Synthetic peptide
  Seed: MVKISGGPHI (MAGA3_HUMAN)
MCKISGGPHM

SEQ ID NO: 54285 - protein, 10 aa, Artificial Sequence
  Description of Artificial Sequence: Synthetic peptide
  Seed: YIFATCLGLS (MAGA3_HUMAN)
YMFATCLGLG

SEQ ID NO: 54286 - protein, 9 aa, Artificial Sequence
  Description of Artificial Sequence: Synthetic peptide
  Seed: SSLQLVFGI (MAGA3_HUMAN)
SALQLVFGW

SEQ ID NO: 54287 - protein, 11 aa, Artificial Sequence
  Description of Artificial Sequence: Synthetic peptide
  Seed: SYPPLHEWVLR (MAGA3_HUMAN)
SYPPLHEWVLF

SEQ ID NO: 54288 - protein, 9 aa, Artificial Sequence
  Description of Artificial Sequence: Synthetic peptide
  Seed: LSRKVAELV (MAGA3_HUMAN)
LARKVAELM

SEQ ID NO: 54289 - protein, 10 aa, Artificial Sequence
  Description of Artificial Sequence: Synthetic peptide
  Seed: ASSLPTTMNY (MAGA3_HUMAN)
AGSLPTTMNY

SEQ ID NO: 54290 - protein, 9 aa, Artificial Sequence
  Description of Artificial Sequence: Synthetic peptide
  Seed: YFFPVIFSK (MAGA3_HUMAN)
YEFPVIFSY

SEQ ID NO: 54291 - protein, 9 aa, Artificial Sequence
  Description of Artificial Sequence: Synthetic peptide
  Seed: SSLQLVFGI (MAGA3_HUMAN)
STLQLVFGY

SEQ ID NO: 54292 - protein, 10 aa, Artificial Sequence
  Description of Artificial Sequence: Synthetic peptide
  Seed: NWQYFFPVIF (MAGA3_HUMAN)
NTQYFFPVIY

SEQ ID NO: 54293 - protein, 11 aa, Artificial Sequence
  Description of Artificial Sequence: Synthetic peptide
  Seed: SNQEEEGPSTF (MAGA3_HUMAN)
SMQEEEGPSTF

SEQ ID NO: 54294 - protein, 10 aa, Artificial Sequence
  Description of Artificial Sequence: Synthetic peptide
  Seed: LSVLEVFEGR (MAGA3_HUMAN)
LTVLEVFEGR

SEQ ID NO: 54295 - protein, 10 aa, Artificial Sequence
  Description of Artificial Sequence: Synthetic peptide
  Seed: MEVDPIGHLY (MAGA3_HUMAN)
MLVDPIGHLK

SEQ ID NO: 54296 - protein, 11 aa, Artificial Sequence
  Description of Artificial Sequence: Synthetic peptide
  Seed: VPAAESPDPPQ (MAGA3_HUMAN)
VPAAESPDPPA

SEQ ID NO: 54297 - protein, 9 aa, Artificial Sequence
  Description of Artificial Sequence: Synthetic peptide
  Seed: RQVPGSDPA (MAGA3_HUMAN)
RIVPGSDPA

SEQ ID NO: 54298 - protein, 11 aa, Artificial Sequence
  Description of Artificial Sequence: Synthetic peptide
  Seed: MPKAGLLIIVL (MAGA3_HUMAN)
MPKAGLLIIVA

SEQ ID NO: 54299 - protein, 8 aa, Artificial Sequence
  Description of Artificial Sequence: Synthetic peptide
  Seed: SGGPHISY (MAGA3_HUMAN)
SSGPHISF

SEQ ID NO: 54300 - protein, 9 aa, Artificial Sequence
  Description of Artificial Sequence: Synthetic peptide
  Seed: QSPQGASSL (MAGA3_HUMAN)
QFPQGASSM

SEQ ID NO: 54301 - protein, 10 aa, Artificial Sequence
  Description of Artificial Sequence: Synthetic peptide
  Seed: ALVETSYVKV (MAGA3_HUMAN)
ALVETSYVKI

SEQ ID NO: 54302 - protein, 9 aa, Artificial Sequence
  Description of Artificial Sequence: Synthetic peptide
  Seed: FATCLGLSY (MAGA3_HUMAN)
FVTCLGLSM

SEQ ID NO: 54303 - protein, 10 aa, Artificial Sequence
  Description of Artificial Sequence: Synthetic peptide
  Seed: KVAELVHFLL (MAGA3_HUMAN)
KIAELVHFLS

SEQ ID NO: 54304 - protein, 9 aa, Artificial Sequence
  Description of Artificial Sequence: Synthetic peptide
  Seed: FATCLGLSY (MAGA3_HUMAN)
FPTCLGLST

SEQ ID NO: 54305 - protein, 9 aa, Artificial Sequence
  Description of Artificial Sequence: Synthetic peptide
  Seed: SPQGASSLP (MAGA3_HUMAN)
SPQGASSLM

SEQ ID NO: 54306 - protein, 9 aa, Artificial Sequence
  Description of Artificial Sequence: Synthetic peptide
  Seed: EAASSSSTL (MAGA3_HUMAN)
EVASSSSTW

SEQ ID NO: 54307 - protein, 10 aa, Artificial Sequence
  Description of Artificial Sequence: Synthetic peptide
  Seed: YIFATCLGLS (MAGA3_HUMAN)
YTFATCLGLV

SEQ ID NO: 54308 - protein, 9 aa, Artificial Sequence
  Description of Artificial Sequence: Synthetic peptide
  Seed: YFFPVIFSK (MAGA3_HUMAN)
YMFPVIFSF

SEQ ID NO: 54309 - protein, 9 aa, Artificial Sequence
  Description of Artificial Sequence: Synthetic peptide
  Seed: HLYIFATCL (MAGA3_HUMAN)
HQYIFATCW

SEQ ID NO: 54310 - protein, 9 aa, Artificial Sequence
  Description of Artificial Sequence: Synthetic peptide
  Seed: FQAALSRKV (MAGA3_HUMAN)
FMAALSRKF

SEQ ID NO: 54311 - protein, 10 aa, Artificial Sequence
  Description of Artificial Sequence: Synthetic peptide
  Seed: YRQVPGSDPA (MAGA3_HUMAN)
YVQVPGSDPV

SEQ ID NO: 54312 - protein, 9 aa, Artificial Sequence
  Description of Artificial Sequence: Synthetic peptide
  Seed: FVQENYLEY (MAGA3_HUMAN)
FSQENYLER

SEQ ID NO: 54313 - protein, 10 aa, Artificial Sequence
  Description of Artificial Sequence: Synthetic peptide
  Seed: AELVHFLLLK (MAGA3_HUMAN)
ANLVHFLLLK

SEQ ID NO: 54314 - protein, 8 aa, Artificial Sequence
  Description of Artificial Sequence: Synthetic peptide
  Seed: SPQGASSL (MAGA3_HUMAN)
SPQGASSM

SEQ ID NO: 54315 - protein, 10 aa, Artificial Sequence
  Description of Artificial Sequence: Synthetic peptide
  Seed: SVVGNWQYFF (MAGA3_HUMAN)
SCVGNWQYFY

SEQ ID NO: 54316 - protein, 11 aa, Artificial Sequence
  Description of Artificial Sequence: Synthetic peptide
  Seed: ISYPPLHEWVL (MAGA3_HUMAN)
IYYPPLHEWVF

SEQ ID NO: 54317 - protein, 11 aa, Artificial Sequence
  Description of Artificial Sequence: Synthetic peptide
  Seed: SSLPTTMNYPL (MAGA3_HUMAN)
STLPTTMNYPF

SEQ ID NO: 54318 - protein, 9 aa, Artificial Sequence
  Description of Artificial Sequence: Synthetic peptide
  Seed: ELVHFLLLK (MAGA3_HUMAN)
EIVHFLLLK

SEQ ID NO: 54319 - protein, 9 aa, Artificial Sequence
  Description of Artificial Sequence: Synthetic peptide
  Seed: ALSRKVAEL (MAGA3_HUMAN)
AQSRKVAEY

SEQ ID NO: 54320 - protein, 11 aa, Artificial Sequence
  Description of Artificial Sequence: Synthetic peptide
  Seed: SNQEEEGPSTF (MAGA3_HUMAN)
SMQEEEGPSTI

SEQ ID NO: 54321 - protein, 10 aa, Artificial Sequence
  Description of Artificial Sequence: Synthetic peptide
  Seed: SILGDPKKLL (MAGA3_HUMAN)
SQLGDPKKLW

SEQ ID NO: 54322 - protein, 9 aa, Artificial Sequence
  Description of Artificial Sequence: Synthetic peptide
  Seed: SSSSTLVEV (MAGA3_HUMAN)
SFSSTLVEL

SEQ ID NO: 54323 - protein, 9 aa, Artificial Sequence
  Description of Artificial Sequence: Synthetic peptide
  Seed: AQAPATEEQ (MAGA3_HUMAN)
AAAPATEEY

SEQ ID NO: 54324 - protein, 10 aa, Artificial Sequence
  Description of Artificial Sequence: Synthetic peptide
  Seed: YIFATCLGLS (MAGA3_HUMAN)
YVFATCLGLV

SEQ ID NO: 54325 - protein, 9 aa, Artificial Sequence
  Description of Artificial Sequence: Synthetic peptide
  Seed: GSVVGNWQY (MAGA3_HUMAN)
GLVVGNWQY

SEQ ID NO: 54326 - protein, 10 aa, Artificial Sequence
  Description of Artificial Sequence: Synthetic peptide
  Seed: KASSSLQLVF (MAGA3_HUMAN)
KGSSSLQLVM

SEQ ID NO: 54327 - protein, 11 aa, Artificial Sequence
  Description of Artificial Sequence: Synthetic peptide
  Seed: GASSLPTTMNY (MAGA3_HUMAN)
GSSSLPTTMNF

SEQ ID NO: 54328 - protein, 9 aa, Artificial Sequence
  Description of Artificial Sequence: Synthetic peptide
  Seed: NYPLWSQSY (MAGA3_HUMAN)
NWPLWSQSF

SEQ ID NO: 54329 - protein, 10 aa, Artificial Sequence
  Description of Artificial Sequence: Synthetic peptide
  Seed: WEELSVLEVF (MAGA3_HUMAN)
WRELSVLEVW

SEQ ID NO: 54330 - protein, 10 aa, Artificial Sequence
  Description of Artificial Sequence: Synthetic peptide
  Seed: SPQGASSLPT (MAGA3_HUMAN)
SPQGASSLPM

SEQ ID NO: 54331 - protein, 11 aa, Artificial Sequence
  Description of Artificial Sequence: Synthetic peptide
  Seed: EVFEGREDSIL (MAGA3_HUMAN)
ETFEGREDSIR

SEQ ID NO: 54332 - protein, 9 aa, Artificial Sequence
  Description of Artificial Sequence: Synthetic peptide
  Seed: TKAEMLGSV (MAGA3_HUMAN)
THAEMLGSA

SEQ ID NO: 54333 - protein, 10 aa, Artificial Sequence
  Description of Artificial Sequence: Synthetic peptide
  Seed: QYFFPVIFSK (MAGA3_HUMAN)
QLFFPVIFSR

SEQ ID NO: 54334 - protein, 9 aa, Artificial Sequence
  Description of Artificial Sequence: Synthetic peptide
  Seed: YIFATCLGL (MAGA3_HUMAN)
YYFATCLGM

SEQ ID NO: 54335 - protein, 10 aa, Artificial Sequence
  Description of Artificial Sequence: Synthetic peptide
  Seed: LGSVVGNWQY (MAGA3_HUMAN)
LLSVVGNWQW

SEQ ID NO: 54336 - protein, 9 aa, Artificial Sequence
  Description of Artificial Sequence: Synthetic peptide
  Seed: LGDPKKLLT (MAGA3_HUMAN)
LQDPKKLLV

SEQ ID NO: 54337 - protein, 10 aa, Artificial Sequence
  Description of Artificial Sequence: Synthetic peptide
  Seed: LQLVFGIELM (MAGA3_HUMAN)
LILVFGIELL

SEQ ID NO: 54338 - protein, 10 aa, Artificial Sequence
  Description of Artificial Sequence: Synthetic peptide
  Seed: ASSLPTTMNY (MAGA3_HUMAN)
AASLPTTMNY

SEQ ID NO: 54339 - protein, 10 aa, Artificial Sequence
  Description of Artificial Sequence: Synthetic peptide
  Seed: AELVHFLLLK (MAGA3_HUMAN)
ADLVHFLLLK

SEQ ID NO: 54340 - protein, 10 aa, Artificial Sequence
  Description of Artificial Sequence: Synthetic peptide
  Seed: WEELSVLEVF (MAGA3_HUMAN)
WRELSVLEVL

SEQ ID NO: 54341 - protein, 10 aa, Artificial Sequence
  Description of Artificial Sequence: Synthetic peptide
  Seed: ASSLPTTMNY (MAGA3_HUMAN)
AQSLPTTMNW

SEQ ID NO: 54342 - protein, 9 aa, Artificial Sequence
  Description of Artificial Sequence: Synthetic peptide
  Seed: ILGDPKKLL (MAGA3_HUMAN)
IVGDPKKLY

SEQ ID NO: 54343 - protein, 9 aa, Artificial Sequence
  Description of Artificial Sequence: Synthetic peptide
  Seed: TSYVKVLHH (MAGA3_HUMAN)
TMYVKVLHK

SEQ ID NO: 54344 - protein, 9 aa, Artificial Sequence
  Description of Artificial Sequence: Synthetic peptide
  Seed: KIWEELSVL (MAGA3_HUMAN)
KLWEELSVF

SEQ ID NO: 54345 - protein, 10 aa, Artificial Sequence
  Description of Artificial Sequence: Synthetic peptide
  Seed: RKVAELVHFL (MAGA3_HUMAN)
RDVAELVHFL

SEQ ID NO: 54346 - protein, 9 aa, Artificial Sequence
  Description of Artificial Sequence: Synthetic peptide
  Seed: QSPQGASSL (MAGA3_HUMAN)
QLPQGASSM

SEQ ID NO: 54347 - protein, 9 aa, Artificial Sequence
  Description of Artificial Sequence: Synthetic peptide
  Seed: FATCLGLSY (MAGA3_HUMAN)
FQTCLGLSW

SEQ ID NO: 54348 - protein, 10 aa, Artificial Sequence
  Description of Artificial Sequence: Synthetic peptide
  Seed: KASSSLQLVF (MAGA3_HUMAN)
KTSSSLQLVY

SEQ ID NO: 54349 - protein, 9 aa, Artificial Sequence
  Description of Artificial Sequence: Synthetic peptide
  Seed: SSSSTLVEV (MAGA3_HUMAN)
SISSTLVEM

SEQ ID NO: 54350 - protein, 10 aa, Artificial Sequence
  Description of Artificial Sequence: Synthetic peptide
  Seed: QYFFPVIFSK (MAGA3_HUMAN)
QYFFPVIFSR

SEQ ID NO: 54351 - protein, 9 aa, Artificial Sequence
  Description of Artificial Sequence: Synthetic peptide
  Seed: SSTLVEVTL (MAGA3_HUMAN)
SDTLVEVTL

SEQ ID NO: 54352 - protein, 10 aa, Artificial Sequence
  Description of Artificial Sequence: Synthetic peptide
  Seed: FLWGPRALVE (MAGA3_HUMAN)
FLWGPRALVQ

SEQ ID NO: 54353 - protein, 9 aa, Artificial Sequence
  Description of Artificial Sequence: Synthetic peptide
  Seed: ALVETSYVK (MAGA3_HUMAN)
ALVETSYVR

SEQ ID NO: 54354 - protein, 9 aa, Artificial Sequence
  Description of Artificial Sequence: Synthetic peptide
  Seed: KVLHHMVKI (MAGA3_HUMAN)
KWLHHMVKY

SEQ ID NO: 54355 - protein, 8 aa, Artificial Sequence
  Description of Artificial Sequence: Synthetic peptide
  Seed: WQYFFPVI (MAGA3_HUMAN)
WQYFFPVF

SEQ ID NO: 54356 - protein, 9 aa, Artificial Sequence
  Description of Artificial Sequence: Synthetic peptide
  Seed: FATCLGLSY (MAGA3_HUMAN)
FMTCLGLSM

SEQ ID NO: 54357 - protein, 10 aa, Artificial Sequence
  Description of Artificial Sequence: Synthetic peptide
  Seed: KAEMLGSVVG (MAGA3_HUMAN)
KAEMLGSVVA

SEQ ID NO: 54358 - protein, 11 aa, Artificial Sequence
  Description of Artificial Sequence: Synthetic peptide
  Seed: KIWEELSVLEV (MAGA3_HUMAN)
KQWEELSVLEW

SEQ ID NO: 54359 - protein, 10 aa, Artificial Sequence
  Description of Artificial Sequence: Synthetic peptide
  Seed: KVAELVHFLL (MAGA3_HUMAN)
KQAELVHFLI

SEQ ID NO: 54360 - protein, 9 aa, Artificial Sequence
  Description of Artificial Sequence: Synthetic peptide
  Seed: VKISGGPHI (MAGA3_HUMAN)
VRISGGPHY

SEQ ID NO: 54361 - protein, 10 aa, Artificial Sequence
  Description of Artificial Sequence: Synthetic peptide
  Seed: STFPDLESEF (MAGA3_HUMAN)
SYFPDLESEW

SEQ ID NO: 54362 - protein, 11 aa, Artificial Sequence
  Description of Artificial Sequence: Synthetic peptide
  Seed: SEFQAALSRKV (MAGA3_HUMAN)
SEFQAALSRKY

SEQ ID NO: 54363 - protein, 9 aa, Artificial Sequence
  Description of Artificial Sequence: Synthetic peptide
  Seed: QIMPKAGLL (MAGA3_HUMAN)
QMMPKAGLV

SEQ ID NO: 54364 - protein, 10 aa, Artificial Sequence
  Description of Artificial Sequence: Synthetic peptide
  Seed: SYPPLHEWVL (MAGA3_HUMAN)
SWPPLHEWVF

SEQ ID NO: 54365 - protein, 9 aa, Artificial Sequence
  Description of Artificial Sequence: Synthetic peptide
  Seed: KASSSLQLV (MAGA3_HUMAN)
KTSSSLQLL

SEQ ID NO: 54366 - protein, 10 aa, Artificial Sequence
  Description of Artificial Sequence: Synthetic peptide
  Seed: IFATCLGLSY (MAGA3_HUMAN)
ITATCLGLSW

SEQ ID NO: 54367 - protein, 9 aa, Artificial Sequence
  Description of Artificial Sequence: Synthetic peptide
  Seed: MVKISGGPH (MAGA3_HUMAN)
MAKISGGPF

SEQ ID NO: 54368 - protein, 9 aa, Artificial Sequence
  Description of Artificial Sequence: Synthetic peptide
  Seed: LQLVFGIEL (MAGA3_HUMAN)
LLLVFGIEF

SEQ ID NO: 54369 - protein, 9 aa, Artificial Sequence
  Description of Artificial Sequence: Synthetic peptide
  Seed: HLYIFATCL (MAGA3_HUMAN)
HFYIFATCL

SEQ ID NO: 54370 - protein, 10 aa, Artificial Sequence
  Description of Artificial Sequence: Synthetic peptide
  Seed: DLESEFQAAL (MAGA3_HUMAN)
DRESEFQAAF

SEQ ID NO: 54371 - protein, 9 aa, Artificial Sequence
  Description of Artificial Sequence: Synthetic peptide
  Seed: ALSRKVAEL (MAGA3_HUMAN)
AVSRKVAEI

SEQ ID NO: 54372 - protein, 11 aa, Artificial Sequence
  Description of Artificial Sequence: Synthetic peptide
  Seed: SNQEEEGPSTF (MAGA3_HUMAN)
SAQEEEGPSTW

SEQ ID NO: 54373 - protein, 10 aa, Artificial Sequence
  Description of Artificial Sequence: Synthetic peptide
  Seed: MEVDPIGHLY (MAGA3_HUMAN)
MHVDPIGHLF

SEQ ID NO: 54374 - protein, 9 aa, Artificial Sequence
  Description of Artificial Sequence: Synthetic peptide
  Seed: GNWQYFFPV (MAGA3_HUMAN)
GVWQYFFPM

SEQ ID NO: 54375 - protein, 10 aa, Artificial Sequence
  Description of Artificial Sequence: Synthetic peptide
  Seed: SVVGNWQYFF (MAGA3_HUMAN)
SEVGNWQYFY

SEQ ID NO: 54376 - protein, 10 aa, Artificial Sequence
  Description of Artificial Sequence: Synthetic peptide
  Seed: ASSLPTTMNY (MAGA3_HUMAN)
AVSLPTTMNK

SEQ ID NO: 54377 - protein, 9 aa, Artificial Sequence
  Description of Artificial Sequence: Synthetic peptide
  Seed: EFQAALSRK (MAGA3_HUMAN)
ELQAALSRK

SEQ ID NO: 54378 - protein, 8 aa, Artificial Sequence
  Description of Artificial Sequence: Synthetic peptide
  Seed: KKLLTQHF (MAGA3_HUMAN)
KQLLTQHF

SEQ ID NO: 54379 - protein, 10 aa, Artificial Sequence
  Description of Artificial Sequence: Synthetic peptide
  Seed: HISYPPLHEW (MAGA3_HUMAN)
HHSYPPLHEW

SEQ ID NO: 54380 - protein, 10 aa, Artificial Sequence
  Description of Artificial Sequence: Synthetic peptide
  Seed: QYFFPVIFSK (MAGA3_HUMAN)
QHFFPVIFSR

SEQ ID NO: 54381 - protein, 9 aa, Artificial Sequence
  Description of Artificial Sequence: Synthetic peptide
  Seed: AASSSSTLV (MAGA3_HUMAN)
AASSSSTLF

SEQ ID NO: 54382 - protein, 9 aa, Artificial Sequence
  Description of Artificial Sequence: Synthetic peptide
  Seed: KIWEELSVL (MAGA3_HUMAN)
KHWEELSVM

SEQ ID NO: 54383 - protein, 10 aa, Artificial Sequence
  Description of Artificial Sequence: Synthetic peptide
  Seed: WEELSVLEVF (MAGA3_HUMAN)
WFELSVLEVW

SEQ ID NO: 54384 - protein, 10 aa, Artificial Sequence
  Description of Artificial Sequence: Synthetic peptide
  Seed: MNYPLWSQSY (MAGA3_HUMAN)
MSYPLWSQSV

SEQ ID NO: 54385 - protein, 8 aa, Artificial Sequence
  Description of Artificial Sequence: Synthetic peptide
  Seed: SGGPHISY (MAGA3_HUMAN)
SAGPHISM

SEQ ID NO: 54386 - protein, 10 aa, Artificial Sequence
  Description of Artificial Sequence: Synthetic peptide
  Seed: LPTTMNYPLW (MAGA3_HUMAN)
LPTTMNYPLM

SEQ ID NO: 54387 - protein, 9 aa, Artificial Sequence
  Description of Artificial Sequence: Synthetic peptide
  Seed: LSRKVAELV (MAGA3_HUMAN)
LLRKVAELW

SEQ ID NO: 54388 - protein, 9 aa, Artificial Sequence
  Description of Artificial Sequence: Synthetic peptide
  Seed: ISYPPLHEW (MAGA3_HUMAN)
IYYPPLHEL

SEQ ID NO: 54389 - protein, 9 aa, Artificial Sequence
  Description of Artificial Sequence: Synthetic peptide
  Seed: LVHFLLLKY (MAGA3_HUMAN)
LAHFLLLKY

SEQ ID NO: 54390 - protein, 9 aa, Artificial Sequence
  Description of Artificial Sequence: Synthetic peptide
  Seed: SEFQAALSR (MAGA3_HUMAN)
SQFQAALSR

SEQ ID NO: 54391 - protein, 10 aa, Artificial Sequence
  Description of Artificial Sequence: Synthetic peptide
  Seed: FFPVIFSKAS (MAGA3_HUMAN)
FQPVIFSKAA

SEQ ID NO: 54392 - protein, 10 aa, Artificial Sequence
  Description of Artificial Sequence: Synthetic peptide
  Seed: SSSLQLVFGI (MAGA3_HUMAN)
STSLQLVFGV

SEQ ID NO: 54393 - protein, 9 aa, Artificial Sequence
  Description of Artificial Sequence: Synthetic peptide
  Seed: VVGNWQYFF (MAGA3_HUMAN)
VSGNWQYFY

SEQ ID NO: 54394 - protein, 10 aa, Artificial Sequence
  Description of Artificial Sequence: Synthetic peptide
  Seed: STFPDLESEF (MAGA3_HUMAN)
SRFPDLESEL

SEQ ID NO: 54395 - protein, 10 aa, Artificial Sequence
  Description of Artificial Sequence: Synthetic peptide
  Seed: SSSTLVEVTL (MAGA3_HUMAN)
SHSTLVEVTW

SEQ ID NO: 54396 - protein, 9 aa, Artificial Sequence
  Description of Artificial Sequence: Synthetic peptide
  Seed: GASSLPTTM (MAGA3_HUMAN)
GHSSLPTTY

SEQ ID NO: 54397 - protein, 11 aa, Artificial Sequence
  Description of Artificial Sequence: Synthetic peptide
  Seed: WQYFFPVIFSK (MAGA3_HUMAN)
WFYFFPVIFSR

SEQ ID NO: 54398 - protein, 10 aa, Artificial Sequence
  Description of Artificial Sequence: Synthetic peptide
  Seed: FSKASSSLQL (MAGA3_HUMAN)
FEKASSSLQY

SEQ ID NO: 54399 - protein, 9 aa, Artificial Sequence
  Description of Artificial Sequence: Synthetic peptide
  Seed: KVLHHMVKI (MAGA3_HUMAN)
KALHHMVKI

SEQ ID NO: 54400 - protein, 11 aa, Artificial Sequence
  Description of Artificial Sequence: Synthetic peptide
  Seed: EQEAASSSSTL (MAGA3_HUMAN)
EHEAASSSSTF

SEQ ID NO: 54401 - protein, 8 aa, Artificial Sequence
  Description of Artificial Sequence: Synthetic peptide
  Seed: WQYFFPVI (MAGA3_HUMAN)
WKYFFPVY

SEQ ID NO: 54402 - protein, 9 aa, Artificial Sequence
  Description of Artificial Sequence: Synthetic peptide
  Seed: YVKVLHHMV (MAGA3_HUMAN)
YSKVLHHMF

SEQ ID NO: 54403 - protein, 9 aa, Artificial Sequence
  Description of Artificial Sequence: Synthetic peptide
  Seed: ALSRKVAEL (MAGA3_HUMAN)
AQSRKVAEF

SEQ ID NO: 54404 - protein, 9 aa, Artificial Sequence
  Description of Artificial Sequence: Synthetic peptide
  Seed: ASSSLQLVF (MAGA3_HUMAN)
ASSSLQLVI

SEQ ID NO: 54405 - protein, 9 aa, Artificial Sequence
  Description of Artificial Sequence: Synthetic peptide
  Seed: RQVPGSDPA (MAGA3_HUMAN)
RMVPGSDPV

SEQ ID NO: 54406 - protein, 9 aa, Artificial Sequence
  Description of Artificial Sequence: Synthetic peptide
  Seed: SVVGNWQYF (MAGA3_HUMAN)
SFVGNWQYF

SEQ ID NO: 54407 - protein, 9 aa, Artificial Sequence
  Description of Artificial Sequence: Synthetic peptide
  Seed: EVDPIGHLY (MAGA3_HUMAN)
EFDPIGHLV

SEQ ID NO: 54408 - protein, 10 aa, Artificial Sequence
  Description of Artificial Sequence: Synthetic peptide
  Seed: STFPDLESEF (MAGA3_HUMAN)
SMFPDLESEI

SEQ ID NO: 54409 - protein, 10 aa, Artificial Sequence
  Description of Artificial Sequence: Synthetic peptide
  Seed: LGLVGAQAPA (MAGA3_HUMAN)
LWLVGAQAPV

SEQ ID NO: 54410 - protein, 10 aa, Artificial Sequence
  Description of Artificial Sequence: Synthetic peptide
  Seed: FSKASSSLQL (MAGA3_HUMAN)
FTKASSSLQM

SEQ ID NO: 54411 - protein, 9 aa, Artificial Sequence
  Description of Artificial Sequence: Synthetic peptide
  Seed: YFFPVIFSK (MAGA3_HUMAN)
YMFPVIFSR

SEQ ID NO: 54412 - protein, 11 aa, Artificial Sequence
  Description of Artificial Sequence: Synthetic peptide
  Seed: VKISGGPHISY (MAGA3_HUMAN)
VIISGGPHISY

SEQ ID NO: 54413 - protein, 10 aa, Artificial Sequence
  Description of Artificial Sequence: Synthetic peptide
  Seed: LYIFATCLGL (MAGA3_HUMAN)
LRIFATCLGV

SEQ ID NO: 54414 - protein, 11 aa, Artificial Sequence
  Description of Artificial Sequence: Synthetic peptide
  Seed: VEVTLGEVPAA (MAGA3_HUMAN)
VEVTLGEVPAL

SEQ ID NO: 54415 - protein, 9 aa, Artificial Sequence
  Description of Artificial Sequence: Synthetic peptide
  Seed: KIWEELSVL (MAGA3_HUMAN)
KLWEELSVT

SEQ ID NO: 54416 - protein, 9 aa, Artificial Sequence
  Description of Artificial Sequence: Synthetic peptide
  Seed: YFFPVIFSK (MAGA3_HUMAN)
YFFPVIFSR

SEQ ID NO: 54417 - protein, 9 aa, Artificial Sequence
  Description of Artificial Sequence: Synthetic peptide
  Seed: FATCLGLSY (MAGA3_HUMAN)
FWTCLGLSY

SEQ ID NO: 54418 - protein, 10 aa, Artificial Sequence
  Description of Artificial Sequence: Synthetic peptide
  Seed: YLEYRQVPGS (MAGA3_HUMAN)
YMEYRQVPGV

SEQ ID NO: 54419 - protein, 10 aa, Artificial Sequence
  Description of Artificial Sequence: Synthetic peptide
  Seed: AALSRKVAEL (MAGA3_HUMAN)
AHLSRKVAEV

SEQ ID NO: 54420 - protein, 9 aa, Artificial Sequence
  Description of Artificial Sequence: Synthetic peptide
  Seed: SYPPLHEWV (MAGA3_HUMAN)
SRPPLHEWL

SEQ ID NO: 54421 - protein, 9 aa, Artificial Sequence
  Description of Artificial Sequence: Synthetic peptide
  Seed: KVAELVHFL (MAGA3_HUMAN)
KVAELVHFC

SEQ ID NO: 54422 - protein, 9 aa, Artificial Sequence
  Description of Artificial Sequence: Synthetic peptide
  Seed: IFSKASSSL (MAGA3_HUMAN)
IYSKASSSW

SEQ ID NO: 54423 - protein, 9 aa, Artificial Sequence
  Description of Artificial Sequence: Synthetic peptide
  Seed: KVLHHMVKI (MAGA3_HUMAN)
KILHHMVKL

SEQ ID NO: 54424 - protein, 9 aa, Artificial Sequence
  Description of Artificial Sequence: Synthetic peptide
  Seed: VTLGEVPAA (MAGA3_HUMAN)
VALGEVPAF

SEQ ID NO: 54425 - protein, 10 aa, Artificial Sequence
  Description of Artificial Sequence: Synthetic peptide
  Seed: FFPVIFSKAS (MAGA3_HUMAN)
FPPVIFSKAA

SEQ ID NO: 54426 - protein, 11 aa, Artificial Sequence
  Description of Artificial Sequence: Synthetic peptide
  Seed: KIWEELSVLEV (MAGA3_HUMAN)
KMWEELSVLEF

SEQ ID NO: 54427 - protein, 8 aa, Artificial Sequence
  Description of Artificial Sequence: Synthetic peptide
  Seed: LGDPKKLL (MAGA3_HUMAN)
LYDPKKLI

SEQ ID NO: 54428 - protein, 10 aa, Artificial Sequence
  Description of Artificial Sequence: Synthetic peptide
  Seed: ELVHFLLLKY (MAGA3_HUMAN)
EIVHFLLLKK

SEQ ID NO: 54429 - protein, 9 aa, Artificial Sequence
  Description of Artificial Sequence: Synthetic peptide
  Seed: ASSSLQLVF (MAGA3_HUMAN)
ASSSLQLVW

SEQ ID NO: 54430 - protein, 9 aa, Artificial Sequence
  Description of Artificial Sequence: Synthetic peptide
  Seed: RALVETSYV (MAGA3_HUMAN)
RQLVETSYW

SEQ ID NO: 54431 - protein, 9 aa, Artificial Sequence
  Description of Artificial Sequence: Synthetic peptide
  Seed: FATCLGLSY (MAGA3_HUMAN)
FYTCLGLSY

SEQ ID NO: 54432 - protein, 10 aa, Artificial Sequence
  Description of Artificial Sequence: Synthetic peptide
  Seed: AALSRKVAEL (MAGA3_HUMAN)
ATLSRKVAEV

SEQ ID NO: 54433 - protein, 9 aa, Artificial Sequence
  Description of Artificial Sequence: Synthetic peptide
  Seed: FPVIFSKAS (MAGA3_HUMAN)
FPVIFSKAL

SEQ ID NO: 54434 - protein, 9 aa, Artificial Sequence
  Description of Artificial Sequence: Synthetic peptide
  Seed: GASSLPTTM (MAGA3_HUMAN)
GQSSLPTTM

SEQ ID NO: 54435 - protein, 10 aa, Artificial Sequence
  Description of Artificial Sequence: Synthetic peptide
  Seed: ASSLPTTMNY (MAGA3_HUMAN)
AISLPTTMNW

SEQ ID NO: 54436 - protein, 10 aa, Artificial Sequence
  Description of Artificial Sequence: Synthetic peptide
  Seed: EVDPIGHLYI (MAGA3_HUMAN)
ELDPIGHLYL

SEQ ID NO: 54437 - protein, 9 aa, Artificial Sequence
  Description of Artificial Sequence: Synthetic peptide
  Seed: YIFATCLGL (MAGA3_HUMAN)
YMFATCLGY

SEQ ID NO: 54438 - protein, 9 aa, Artificial Sequence
  Description of Artificial Sequence: Synthetic peptide
  Seed: GSVVGNWQY (MAGA3_HUMAN)
GAVVGNWQY

SEQ ID NO: 54439 - protein, 9 aa, Artificial Sequence
  Description of Artificial Sequence: Synthetic peptide
  Seed: TSYVKVLHH (MAGA3_HUMAN)
TAYVKVLHF

SEQ ID NO: 54440 - protein, 10 aa, Artificial Sequence
  Description of Artificial Sequence: Synthetic peptide
  Seed: VTKAEMLGSV (MAGA3_HUMAN)
VQKAEMLGSV

SEQ ID NO: 54441 - protein, 9 aa, Artificial Sequence
  Description of Artificial Sequence: Synthetic peptide
  Seed: KVAELVHFL (MAGA3_HUMAN)
KWAELVHFK

SEQ ID NO: 54442 - protein, 9 aa, Artificial Sequence
  Description of Artificial Sequence: Synthetic peptide
  Seed: KAGLLIIVL (MAGA3_HUMAN)
KTGLLIIVY

SEQ ID NO: 54443 - protein, 10 aa, Artificial Sequence
  Description of Artificial Sequence: Synthetic peptide
  Seed: MNYPLWSQSY (MAGA3_HUMAN)
MTYPLWSQSV

SEQ ID NO: 54444 - protein, 10 aa, Artificial Sequence
  Description of Artificial Sequence: Synthetic peptide
  Seed: ISYPPLHEWV (MAGA3_HUMAN)
IEYPPLHEWI

SEQ ID NO: 54445 - protein, 9 aa, Artificial Sequence
  Description of Artificial Sequence: Synthetic peptide
  Seed: IFSKASSSL (MAGA3_HUMAN)
ISSKASSSL

SEQ ID NO: 54446 - protein, 11 aa, Artificial Sequence
  Description of Artificial Sequence: Synthetic peptide
  Seed: SNQEEEGPSTF (MAGA3_HUMAN)
SHQEEEGPSTM

SEQ ID NO: 54447 - protein, 9 aa, Artificial Sequence
  Description of Artificial Sequence: Synthetic peptide
  Seed: SILGDPKKL (MAGA3_HUMAN)
SMLGDPKKI

SEQ ID NO: 54448 - protein, 10 aa, Artificial Sequence
  Description of Artificial Sequence: Synthetic peptide
  Seed: FFPVIFSKAS (MAGA3_HUMAN)
FLPVIFSKAV

SEQ ID NO: 54449 - protein, 9 aa, Artificial Sequence
  Description of Artificial Sequence: Synthetic peptide
  Seed: ISGGPHISY (MAGA3_HUMAN)
IAGGPHISH

SEQ ID NO: 54450 - protein, 10 aa, Artificial Sequence
  Description of Artificial Sequence: Synthetic peptide
  Seed: FLWGPRALVE (MAGA3_HUMAN)
FMWGPRALVI

SEQ ID NO: 54451 - protein, 9 aa, Artificial Sequence
  Description of Artificial Sequence: Synthetic peptide
  Seed: RKVAELVHF (MAGA3_HUMAN)
RSVAELVHF

SEQ ID NO: 54452 - protein, 9 aa, Artificial Sequence
  Description of Artificial Sequence: Synthetic peptide
  Seed: KVAELVHFL (MAGA3_HUMAN)
KYAELVHFI

SEQ ID NO: 54453 - protein, 9 aa, Artificial Sequence
  Description of Artificial Sequence: Synthetic peptide
  Seed: LVHFLLLKY (MAGA3_HUMAN)
LMHFLLLKR

SEQ ID NO: 54454 - protein, 9 aa, Artificial Sequence
  Description of Artificial Sequence: Synthetic peptide
  Seed: HLYIFATCL (MAGA3_HUMAN)
HHYIFATCY

SEQ ID NO: 54455 - protein, 10 aa, Artificial Sequence
  Description of Artificial Sequence: Synthetic peptide
  Seed: MEVDPIGHLY (MAGA3_HUMAN)
MLVDPIGHLM

SEQ ID NO: 54456 - protein, 9 aa, Artificial Sequence
  Description of Artificial Sequence: Synthetic peptide
  Seed: AASSSSTLV (MAGA3_HUMAN)
ALSSSSTLL

SEQ ID NO: 54457 - protein, 10 aa, Artificial Sequence
  Description of Artificial Sequence: Synthetic peptide
  Seed: WEELSVLEVF (MAGA3_HUMAN)
WHELSVLEVW

SEQ ID NO: 54458 - protein, 10 aa, Artificial Sequence
  Description of Artificial Sequence: Synthetic peptide
  Seed: LYIFATCLGL (MAGA3_HUMAN)
LSIFATCLGV

SEQ ID NO: 54459 - protein, 8 aa, Artificial Sequence
  Description of Artificial Sequence: Synthetic peptide
  Seed: HEWVLREG (MAGA3_HUMAN)
HEWVLREM

SEQ ID NO: 54460 - protein, 11 aa, Artificial Sequence
  Description of Artificial Sequence: Synthetic peptide
  Seed: SNQEEEGPSTF (MAGA3_HUMAN)
SMQEEEGPSTY

SEQ ID NO: 54461 - protein, 10 aa, Artificial Sequence
  Description of Artificial Sequence: Synthetic peptide
  Seed: KASSSLQLVF (MAGA3_HUMAN)
KSSSSLQLVL

SEQ ID NO: 54462 - protein, 9 aa, Artificial Sequence
  Description of Artificial Sequence: Synthetic peptide
  Seed: HLYIFATCL (MAGA3_HUMAN)
HMYIFATCM

SEQ ID NO: 54463 - protein, 9 aa, Artificial Sequence
  Description of Artificial Sequence: Synthetic peptide
  Seed: SSLQLVFGI (MAGA3_HUMAN)
SLLQLVFGF

SEQ ID NO: 54464 - protein, 9 aa, Artificial Sequence
  Description of Artificial Sequence: Synthetic peptide
  Seed: SYVKVLHHM (MAGA3_HUMAN)
SIVKVLHHY

SEQ ID NO: 54465 - protein, 8 aa, Artificial Sequence
  Description of Artificial Sequence: Synthetic peptide
  Seed: FPDLESEF (MAGA3_HUMAN)
FFDLESEI

SEQ ID NO: 54466 - protein, 11 aa, Artificial Sequence
  Description of Artificial Sequence: Synthetic peptide
  Seed: EVFEGREDSIL (MAGA3_HUMAN)
EVFEGREDSIK

SEQ ID NO: 54467 - protein, 10 aa, Artificial Sequence
  Description of Artificial Sequence: Synthetic peptide
  Seed: VIFSKASSSL (MAGA3_HUMAN)
VIFSKASSSM

SEQ ID NO: 54468 - protein, 9 aa, Artificial Sequence
  Description of Artificial Sequence: Synthetic peptide
  Seed: QLVFGIELM (MAGA3_HUMAN)
QVVFGIELV

SEQ ID NO: 54469 - protein, 10 aa, Artificial Sequence
  Description of Artificial Sequence: Synthetic peptide
  Seed: KISGGPHISY (MAGA3_HUMAN)
KTSGGPHISR

SEQ ID NO: 54470 - protein, 10 aa, Artificial Sequence
  Description of Artificial Sequence: Synthetic peptide
  Seed: FSKASSSLQL (MAGA3_HUMAN)
FGKASSSLQY

SEQ ID NO: 54471 - protein, 9 aa, Artificial Sequence
  Description of Artificial Sequence: Synthetic peptide
  Seed: SVVGNWQYF (MAGA3_HUMAN)
SMVGNWQYY

SEQ ID NO: 54472 - protein, 9 aa, Artificial Sequence
  Description of Artificial Sequence: Synthetic peptide
  Seed: EVDPIGHLY (MAGA3_HUMAN)
EMDPIGHLY

SEQ ID NO: 54473 - protein, 9 aa, Artificial Sequence
  Description of Artificial Sequence: Synthetic peptide
  Seed: LEYRQVPGS (MAGA3_HUMAN)
LEYRQVPGV

SEQ ID NO: 54474 - protein, 9 aa, Artificial Sequence
  Description of Artificial Sequence: Synthetic peptide
  Seed: AQAPATEEQ (MAGA3_HUMAN)
ALAPATEEF

SEQ ID NO: 54475 - protein, 8 aa, Artificial Sequence
  Description of Artificial Sequence: Synthetic peptide
  Seed: HEWVLREG (MAGA3_HUMAN)
HEWVLRET

SEQ ID NO: 54476 - protein, 9 aa, Artificial Sequence
  Description of Artificial Sequence: Synthetic peptide
  Seed: ASSSLQLVF (MAGA3_HUMAN)
AASSLQLVF

SEQ ID NO: 54477 - protein, 10 aa, Artificial Sequence
  Description of Artificial Sequence: Synthetic peptide
  Seed: ASSSLQLVFG (MAGA3_HUMAN)
AFSSLQLVFW

SEQ ID NO: 54478 - protein, 9 aa, Artificial Sequence
  Description of Artificial Sequence: Synthetic peptide
  Seed: SILGDPKKL (MAGA3_HUMAN)
SSLGDPKKL

SEQ ID NO: 54479 - protein, 11 aa, Artificial Sequence
  Description of Artificial Sequence: Synthetic peptide
  Seed: SNQEEEGPSTF (MAGA3_HUMAN)
STQEEEGPSTW

SEQ ID NO: 54480 - protein, 9 aa, Artificial Sequence
  Description of Artificial Sequence: Synthetic peptide
  Seed: SVVGNWQYF (MAGA3_HUMAN)
STVGNWQYM

SEQ ID NO: 54481 - protein, 9 aa, Artificial Sequence
  Description of Artificial Sequence: Synthetic peptide
  Seed: GASSLPTTM (MAGA3_HUMAN)
GSSSLPTTV

SEQ ID NO: 54482 - protein, 10 aa, Artificial Sequence
  Description of Artificial Sequence: Synthetic peptide
  Seed: MEVDPIGHLY (MAGA3_HUMAN)
MAVDPIGHLL

SEQ ID NO: 54483 - protein, 9 aa, Artificial Sequence
  Description of Artificial Sequence: Synthetic peptide
  Seed: FATCLGLSY (MAGA3_HUMAN)
FLTCLGLSY

SEQ ID NO: 54484 - protein, 10 aa, Artificial Sequence
  Description of Artificial Sequence: Synthetic peptide
  Seed: KISGGPHISY (MAGA3_HUMAN)
KNSGGPHISW

SEQ ID NO: 54485 - protein, 9 aa, Artificial Sequence
  Description of Artificial Sequence: Synthetic peptide
  Seed: KVAELVHFL (MAGA3_HUMAN)
KLAELVHFW

SEQ ID NO: 54486 - protein, 9 aa, Artificial Sequence
  Description of Artificial Sequence: Synthetic peptide
  Seed: QEEEGPSTF (MAGA3_HUMAN)
QHEEGPSTM

SEQ ID NO: 54487 - protein, 10 aa, Artificial Sequence
  Description of Artificial Sequence: Synthetic peptide
  Seed: RALVETSYVK (MAGA3_HUMAN)
RVLVETSYVK

SEQ ID NO: 54488 - protein, 10 aa, Artificial Sequence
  Description of Artificial Sequence: Synthetic peptide
  Seed: RQVPGSDPAC (MAGA3_HUMAN)
RVVPGSDPAY

SEQ ID NO: 54489 - protein, 9 aa, Artificial Sequence
  Description of Artificial Sequence: Synthetic peptide
  Seed: MEVDPIGHL (MAGA3_HUMAN)
MSVDPIGHV

SEQ ID NO: 54490 - protein, 10 aa, Artificial Sequence
  Description of Artificial Sequence: Synthetic peptide
  Seed: SVVGNWQYFF (MAGA3_HUMAN)
SYVGNWQYFW

SEQ ID NO: 54491 - protein, 9 aa, Artificial Sequence
  Description of Artificial Sequence: Synthetic peptide
  Seed: QEEEGPSTF (MAGA3_HUMAN)
QQEEGPSTI

SEQ ID NO: 54492 - protein, 9 aa, Artificial Sequence
  Description of Artificial Sequence: Synthetic peptide
  Seed: QEEEGPSTF (MAGA3_HUMAN)
QQEEGPSTY

SEQ ID NO: 54493 - protein, 9 aa, Artificial Sequence
  Description of Artificial Sequence: Synthetic peptide
  Seed: SSSSTLVEV (MAGA3_HUMAN)
SASSTLVEH

SEQ ID NO: 54494 - protein, 9 aa, Artificial Sequence
  Description of Artificial Sequence: Synthetic peptide
  Seed: QSPQGASSL (MAGA3_HUMAN)
QIPQGASSI

SEQ ID NO: 54495 - protein, 9 aa, Artificial Sequence
  Description of Artificial Sequence: Synthetic peptide
  Seed: MEVDPIGHL (MAGA3_HUMAN)
MAVDPIGHY

SEQ ID NO: 54496 - protein, 10 aa, Artificial Sequence
  Description of Artificial Sequence: Synthetic peptide
  Seed: HFVQENYLEY (MAGA3_HUMAN)
HQVQENYLEY

SEQ ID NO: 54497 - protein, 9 aa, Artificial Sequence
  Description of Artificial Sequence: Synthetic peptide
  Seed: TFPDLESEF (MAGA3_HUMAN)
TWPDLESEM

SEQ ID NO: 54498 - protein, 8 aa, Artificial Sequence
  Description of Artificial Sequence: Synthetic peptide
  Seed: FPDLESEF (MAGA3_HUMAN)
FVDLESEV

SEQ ID NO: 54499 - protein, 10 aa, Artificial Sequence
  Description of Artificial Sequence: Synthetic peptide
  Seed: ASSLPTTMNY (MAGA3_HUMAN)
AISLPTTMNF

SEQ ID NO: 54500 - protein, 9 aa, Artificial Sequence
  Description of Artificial Sequence: Synthetic peptide
  Seed: QSPQGASSL (MAGA3_HUMAN)
QAPQGASSI

SEQ ID NO: 54501 - protein, 11 aa, Artificial Sequence
  Description of Artificial Sequence: Synthetic peptide
  Seed: YIFATCLGLSY (MAGA3_HUMAN)
YQFATCLGLSM

SEQ ID NO: 54502 - protein, 9 aa, Artificial Sequence
  Description of Artificial Sequence: Synthetic peptide
  Seed: SSSSTLVEV (MAGA3_HUMAN)
SYSSTLVEL

SEQ ID NO: 54503 - protein, 9 aa, Artificial Sequence
  Description of Artificial Sequence: Synthetic peptide
  Seed: SVLEVFEGR (MAGA3_HUMAN)
STLEVFEGK

SEQ ID NO: 54504 - protein, 9 aa, Artificial Sequence
  Description of Artificial Sequence: Synthetic peptide
  Seed: YPPLHEWVL (MAGA3_HUMAN)
YAPLHEWVY

SEQ ID NO: 54505 - protein, 9 aa, Artificial Sequence
  Description of Artificial Sequence: Synthetic peptide
  Seed: KASSSLQLV (MAGA3_HUMAN)
KVSSSLQLF

SEQ ID NO: 54506 - protein, 9 aa, Artificial Sequence
  Description of Artificial Sequence: Synthetic peptide
  Seed: YIFATCLGL (MAGA3_HUMAN)
YMFATCLGM

SEQ ID NO: 54507 - protein, 11 aa, Artificial Sequence
  Description of Artificial Sequence: Synthetic peptide
  Seed: YIFATCLGLSY (MAGA3_HUMAN)
YQFATCLGLSW

SEQ ID NO: 54508 - protein, 9 aa, Artificial Sequence
  Description of Artificial Sequence: Synthetic peptide
  Seed: SEFQAALSR (MAGA3_HUMAN)
SNFQAALSR

SEQ ID NO: 54509 - protein, 9 aa, Artificial Sequence
  Description of Artificial Sequence: Synthetic peptide
  Seed: IMPKAGLLI (MAGA3_HUMAN)
IQPKAGLLV

SEQ ID NO: 54510 - protein, 9 aa, Artificial Sequence
  Description of Artificial Sequence: Synthetic peptide
  Seed: FQAALSRKV (MAGA3_HUMAN)
FLAALSRKI

SEQ ID NO: 54511 - protein, 10 aa, Artificial Sequence
  Description of Artificial Sequence: Synthetic peptide
  Seed: YFFPVIFSKA (MAGA3_HUMAN)
YSFPVIFSKR

SEQ ID NO: 54512 - protein, 9 aa, Artificial Sequence
  Description of Artificial Sequence: Synthetic peptide
  Seed: LSRKVAELV (MAGA3_HUMAN)
LTRKVAELK

SEQ ID NO: 54513 - protein, 9 aa, Artificial Sequence
  Description of Artificial Sequence: Synthetic peptide
  Seed: SSTLVEVTL (MAGA3_HUMAN)
SPTLVEVTY

SEQ ID NO: 54514 - protein, 9 aa, Artificial Sequence
  Description of Artificial Sequence: Synthetic peptide
  Seed: VFEGREDSI (MAGA3_HUMAN)
VFEGREDSL

SEQ ID NO: 54515 - protein, 9 aa, Artificial Sequence
  Description of Artificial Sequence: Synthetic peptide
  Seed: KVAELVHFL (MAGA3_HUMAN)
KMAELVHFK

SEQ ID NO: 54516 - protein, 10 aa, Artificial Sequence
  Description of Artificial Sequence: Synthetic peptide
  Seed: GPRALVETSY (MAGA3_HUMAN)
GPRALVETSM

SEQ ID NO: 54517 - protein, 11 aa, Artificial Sequence
  Description of Artificial Sequence: Synthetic peptide
  Seed: EVFEGREDSIL (MAGA3_HUMAN)
EAFEGREDSIR

SEQ ID NO: 54518 - protein, 10 aa, Artificial Sequence
  Description of Artificial Sequence: Synthetic peptide
  Seed: KASSSLQLVF (MAGA3_HUMAN)
KNSSSLQLVW

SEQ ID NO: 54519 - protein, 10 aa, Artificial Sequence
  Description of Artificial Sequence: Synthetic peptide
  Seed: ASSSLQLVFG (MAGA3_HUMAN)
AISSLQLVFW

SEQ ID NO: 54520 - protein, 11 aa, Artificial Sequence
  Description of Artificial Sequence: Synthetic peptide
  Seed: KVAELVHFLLL (MAGA3_HUMAN)
KLAELVHFLLC

SEQ ID NO: 54521 - protein, 11 aa, Artificial Sequence
  Description of Artificial Sequence: Synthetic peptide
  Seed: YIFATCLGLSY (MAGA3_HUMAN)
YVFATCLGLSW

SEQ ID NO: 54522 - protein, 10 aa, Artificial Sequence
  Description of Artificial Sequence: Synthetic peptide
  Seed: ISYPPLHEWV (MAGA3_HUMAN)
ITYPPLHEWV

SEQ ID NO: 54523 - protein, 9 aa, Artificial Sequence
  Description of Artificial Sequence: Synthetic peptide
  Seed: EVDPIGHLY (MAGA3_HUMAN)
EGDPIGHLF

SEQ ID NO: 54524 - protein, 10 aa, Artificial Sequence
  Description of Artificial Sequence: Synthetic peptide
  Seed: ASSSLQLVFG (MAGA3_HUMAN)
ATSSLQLVFW

SEQ ID NO: 54525 - protein, 11 aa, Artificial Sequence
  Description of Artificial Sequence: Synthetic peptide
  Seed: FLWGPRALVET (MAGA3_HUMAN)
FMWGPRALVET

SEQ ID NO: 54526 - protein, 9 aa, Artificial Sequence
  Description of Artificial Sequence: Synthetic peptide
  Seed: ISYPPLHEW (MAGA3_HUMAN)
INYPPLHEF

SEQ ID NO: 54527 - protein, 9 aa, Artificial Sequence
  Description of Artificial Sequence: Synthetic peptide
  Seed: AEMLGSVVG (MAGA3_HUMAN)
AEMLGSVVC

SEQ ID NO: 54528 - protein, 10 aa, Artificial Sequence
  Description of Artificial Sequence: Synthetic peptide
  Seed: FSKASSSLQL (MAGA3_HUMAN)
FTKASSSLQF

SEQ ID NO: 54529 - protein, 9 aa, Artificial Sequence
  Description of Artificial Sequence: Synthetic peptide
  Seed: ALSRKVAEL (MAGA3_HUMAN)
ATSRKVAEW

SEQ ID NO: 54530 - protein, 9 aa, Artificial Sequence
  Description of Artificial Sequence: Synthetic peptide
  Seed: WQYFFPVIF (MAGA3_HUMAN)
WAYFFPVIY

SEQ ID NO: 54531 - protein, 10 aa, Artificial Sequence
  Description of Artificial Sequence: Synthetic peptide
  Seed: SPDPPQSPQG (MAGA3_HUMAN)
SPDPPQSPQA

SEQ ID NO: 54532 - protein, 9 aa, Artificial Sequence
  Description of Artificial Sequence: Synthetic peptide
  Seed: TQHFVQENY (MAGA3_HUMAN)
TYHFVQENY

SEQ ID NO: 54533 - protein, 9 aa, Artificial Sequence
  Description of Artificial Sequence: Synthetic peptide
  Seed: WEELSVLEV (MAGA3_HUMAN)
WEELSVLEL

SEQ ID NO: 54534 - protein, 9 aa, Artificial Sequence
  Description of Artificial Sequence: Synthetic peptide
  Seed: AELVHFLLL (MAGA3_HUMAN)
AMLVHFLLM

SEQ ID NO: 54535 - protein, 10 aa, Artificial Sequence
  Description of Artificial Sequence: Synthetic peptide
  Seed: ETSYVKVLHH (MAGA3_HUMAN)
EASYVKVLHR

SEQ ID NO: 54536 - protein, 11 aa, Artificial Sequence
  Description of Artificial Sequence: Synthetic peptide
  Seed: KIWEELSVLEV (MAGA3_HUMAN)
KQWEELSVLEL

SEQ ID NO: 54537 - protein, 8 aa, Artificial Sequence
  Description of Artificial Sequence: Synthetic peptide
  Seed: AGLLIIVL (MAGA3_HUMAN)
AQLLIIVI

SEQ ID NO: 54538 - protein, 9 aa, Artificial Sequence
  Description of Artificial Sequence: Synthetic peptide
  Seed: ELVHFLLLK (MAGA3_HUMAN)
ETVHFLLLR

SEQ ID NO: 54539 - protein, 9 aa, Artificial Sequence
  Description of Artificial Sequence: Synthetic peptide
  Seed: SVLEVFEGR (MAGA3_HUMAN)
SILEVFEGK

SEQ ID NO: 54540 - protein, 10 aa, Artificial Sequence
  Description of Artificial Sequence: Synthetic peptide
  Seed: SYPPLHEWVL (MAGA3_HUMAN)
SFPPLHEWVF

SEQ ID NO: 54541 - protein, 8 aa, Artificial Sequence
  Description of Artificial Sequence: Synthetic peptide
  Seed: FPDLESEF (MAGA3_HUMAN)
FMDLESEV

SEQ ID NO: 54542 - protein, 8 aa, Artificial Sequence
  Description of Artificial Sequence: Synthetic peptide
  Seed: FPDLESEF (MAGA3_HUMAN)
FYDLESEL

SEQ ID NO: 54543 - protein, 10 aa, Artificial Sequence
  Description of Artificial Sequence: Synthetic peptide
  Seed: LGLVGAQAPA (MAGA3_HUMAN)
LPLVGAQAPV

SEQ ID NO: 54544 - protein, 9 aa, Artificial Sequence
  Description of Artificial Sequence: Synthetic peptide
  Seed: TFPDLESEF (MAGA3_HUMAN)
TMPDLESEF

SEQ ID NO: 54545 - protein, 10 aa, Artificial Sequence
  Description of Artificial Sequence: Synthetic peptide
  Seed: NWQYFFPVIF (MAGA3_HUMAN)
NYQYFFPVIW

SEQ ID NO: 54546 - protein, 9 aa, Artificial Sequence
  Description of Artificial Sequence: Synthetic peptide
  Seed: SSLPTTMNY (MAGA3_HUMAN)
SSLPTTMNI

SEQ ID NO: 54547 - protein, 10 aa, Artificial Sequence
  Description of Artificial Sequence: Synthetic peptide
  Seed: MNYPLWSQSY (MAGA3_HUMAN)
MSYPLWSQSL

SEQ ID NO: 54548 - protein, 9 aa, Artificial Sequence
  Description of Artificial Sequence: Synthetic peptide
  Seed: ASSSLQLVF (MAGA3_HUMAN)
AMSSLQLVL

SEQ ID NO: 54549 - protein, 9 aa, Artificial Sequence
  Description of Artificial Sequence: Synthetic peptide
  Seed: EFQAALSRK (MAGA3_HUMAN)
ESQAALSRK

SEQ ID NO: 54550 - protein, 10 aa, Artificial Sequence
  Description of Artificial Sequence: Synthetic peptide
  Seed: FFPVIFSKAS (MAGA3_HUMAN)
FWPVIFSKAV

SEQ ID NO: 54551 - protein, 9 aa, Artificial Sequence
  Description of Artificial Sequence: Synthetic peptide
  Seed: RQVPGSDPA (MAGA3_HUMAN)
RRVPGSDPY

SEQ ID NO: 54552 - protein, 9 aa, Artificial Sequence
  Description of Artificial Sequence: Synthetic peptide
  Seed: KVLHHMVKI (MAGA3_HUMAN)
KYLHHMVKF

SEQ ID NO: 54553 - protein, 9 aa, Artificial Sequence
  Description of Artificial Sequence: Synthetic peptide
  Seed: FVQENYLEY (MAGA3_HUMAN)
FEQENYLEF

SEQ ID NO: 54554 - protein, 9 aa, Artificial Sequence
  Description of Artificial Sequence: Synthetic peptide
  Seed: KASSSLQLV (MAGA3_HUMAN)
KQSSSLQLW

SEQ ID NO: 54555 - protein, 9 aa, Artificial Sequence
  Description of Artificial Sequence: Synthetic peptide
  Seed: LPTTMNYPL (MAGA3_HUMAN)
LLTTMNYPY

SEQ ID NO: 54556 - protein, 9 aa, Artificial Sequence
  Description of Artificial Sequence: Synthetic peptide
  Seed: HLYIFATCL (MAGA3_HUMAN)
HHYIFATCM

SEQ ID NO: 54557 - protein, 9 aa, Artificial Sequence
  Description of Artificial Sequence: Synthetic peptide
  Seed: SYVKVLHHM (MAGA3_HUMAN)
SQVKVLHHY

SEQ ID NO: 54558 - protein, 9 aa, Artificial Sequence
  Description of Artificial Sequence: Synthetic peptide
  Seed: TFPDLESEF (MAGA3_HUMAN)
TPPDLESEF

SEQ ID NO: 54559 - protein, 9 aa, Artificial Sequence
  Description of Artificial Sequence: Synthetic peptide
  Seed: GSDPACYEF (MAGA3_HUMAN)
GYDPACYEF

SEQ ID NO: 54560 - protein, 9 aa, Artificial Sequence
  Description of Artificial Sequence: Synthetic peptide
  Seed: SEFQAALSR (MAGA3_HUMAN)
SYFQAALSR

SEQ ID NO: 54561 - protein, 9 aa, Artificial Sequence
  Description of Artificial Sequence: Synthetic peptide
  Seed: NYPLWSQSY (MAGA3_HUMAN)
NYPLWSQSI

SEQ ID NO: 54562 - protein, 10 aa, Artificial Sequence
  Description of Artificial Sequence: Synthetic peptide
  Seed: KISGGPHISY (MAGA3_HUMAN)
KSSGGPHISR

SEQ ID NO: 54563 - protein, 9 aa, Artificial Sequence
  Description of Artificial Sequence: Synthetic peptide
  Seed: ALSRKVAEL (MAGA3_HUMAN)
ALSRKVAEA

SEQ ID NO: 54564 - protein, 10 aa, Artificial Sequence
  Description of Artificial Sequence: Synthetic peptide
  Seed: YFFPVIFSKA (MAGA3_HUMAN)
YMFPVIFSKL

SEQ ID NO: 54565 - protein, 11 aa, Artificial Sequence
  Description of Artificial Sequence: Synthetic peptide
  Seed: YIFATCLGLSY (MAGA3_HUMAN)
YSFATCLGLSF

SEQ ID NO: 54566 - protein, 9 aa, Artificial Sequence
  Description of Artificial Sequence: Synthetic peptide
  Seed: KVAELVHFL (MAGA3_HUMAN)
KQAELVHFA

SEQ ID NO: 54567 - protein, 11 aa, Artificial Sequence
  Description of Artificial Sequence: Synthetic peptide
  Seed: REGDCAPEEKI (MAGA3_HUMAN)
REGDCAPEEKF

SEQ ID NO: 54568 - protein, 10 aa, Artificial Sequence
  Description of Artificial Sequence: Synthetic peptide
  Seed: MEVDPIGHLY (MAGA3_HUMAN)
MIVDPIGHLK

SEQ ID NO: 54569 - protein, 10 aa, Artificial Sequence
  Description of Artificial Sequence: Synthetic peptide
  Seed: LPTTMNYPLW (MAGA3_HUMAN)
LDTTMNYPLW

SEQ ID NO: 54570 - protein, 10 aa, Artificial Sequence
  Description of Artificial Sequence: Synthetic peptide
  Seed: AELVHFLLLK (MAGA3_HUMAN)
AMLVHFLLLR

SEQ ID NO: 54571 - protein, 9 aa, Artificial Sequence
  Description of Artificial Sequence: Synthetic peptide
  Seed: YIFATCLGL (MAGA3_HUMAN)
YIFATCLGR

SEQ ID NO: 54572 - protein, 9 aa, Artificial Sequence
  Description of Artificial Sequence: Synthetic peptide
  Seed: KASSSLQLV (MAGA3_HUMAN)
KTSSSLQLY

SEQ ID NO: 54573 - protein, 9 aa, Artificial Sequence
  Description of Artificial Sequence: Synthetic peptide
  Seed: KIWEELSVL (MAGA3_HUMAN)
KVWEELSVV

SEQ ID NO: 54574 - protein, 9 aa, Artificial Sequence
  Description of Artificial Sequence: Synthetic peptide
  Seed: ISGGPHISY (MAGA3_HUMAN)
ITGGPHISF

SEQ ID NO: 54575 - protein, 11 aa, Artificial Sequence
  Description of Artificial Sequence: Synthetic peptide
  Seed: KVAELVHFLLL (MAGA3_HUMAN)
KIAELVHFLLI

SEQ ID NO: 54576 - protein, 10 aa, Artificial Sequence
  Description of Artificial Sequence: Synthetic peptide
  Seed: TSYVKVLHHM (MAGA3_HUMAN)
TTYVKVLHHY

SEQ ID NO: 54577 - protein, 9 aa, Artificial Sequence
  Description of Artificial Sequence: Synthetic peptide
  Seed: ALSRKVAEL (MAGA3_HUMAN)
AASRKVAEY

SEQ ID NO: 54578 - protein, 10 aa, Artificial Sequence
  Description of Artificial Sequence: Synthetic peptide
  Seed: GLVGAQAPAT (MAGA3_HUMAN)
GMVGAQAPAL

SEQ ID NO: 54579 - protein, 9 aa, Artificial Sequence
  Description of Artificial Sequence: Synthetic peptide
  Seed: SSSSTLVEV (MAGA3_HUMAN)
SLSSTLVEF

SEQ ID NO: 54580 - protein, 9 aa, Artificial Sequence
  Description of Artificial Sequence: Synthetic peptide
  Seed: ALSRKVAEL (MAGA3_HUMAN)
AYSRKVAEY

SEQ ID NO: 54581 - protein, 9 aa, Artificial Sequence
  Description of Artificial Sequence: Synthetic peptide
  Seed: KVLHHMVKI (MAGA3_HUMAN)
KMLHHMVKM

SEQ ID NO: 54582 - protein, 9 aa, Artificial Sequence
  Description of Artificial Sequence: Synthetic peptide
  Seed: FATCLGLSY (MAGA3_HUMAN)
FMTCLGLSY

SEQ ID NO: 54583 - protein, 9 aa, Artificial Sequence
  Description of Artificial Sequence: Synthetic peptide
  Seed: KVAELVHFL (MAGA3_HUMAN)
KGAELVHFL

SEQ ID NO: 54584 - protein, 9 aa, Artificial Sequence
  Description of Artificial Sequence: Synthetic peptide
  Seed: ISYPPLHEW (MAGA3_HUMAN)
IFYPPLHEF

SEQ ID NO: 54585 - protein, 11 aa, Artificial Sequence
  Description of Artificial Sequence: Synthetic peptide
  Seed: SNQEEEGPSTF (MAGA3_HUMAN)
SAQEEEGPSTF

SEQ ID NO: 54586 - protein, 8 aa, Artificial Sequence
  Description of Artificial Sequence: Synthetic peptide
  Seed: SYPPLHEW (MAGA3_HUMAN)
SYPPLHEY

SEQ ID NO: 54587 - protein, 10 aa, Artificial Sequence
  Description of Artificial Sequence: Synthetic peptide
  Seed: EVDPIGHLYI (MAGA3_HUMAN)
ESDPIGHLYL

SEQ ID NO: 54588 - protein, 9 aa, Artificial Sequence
  Description of Artificial Sequence: Synthetic peptide
  Seed: QSPQGASSL (MAGA3_HUMAN)
QFPQGASSF

SEQ ID NO: 54589 - protein, 10 aa, Artificial Sequence
  Description of Artificial Sequence: Synthetic peptide
  Seed: YFFPVIFSKA (MAGA3_HUMAN)
YMFPVIFSKS

SEQ ID NO: 54590 - protein, 9 aa, Artificial Sequence
  Description of Artificial Sequence: Synthetic peptide
  Seed: AELVHFLLL (MAGA3_HUMAN)
AELVHFLLA

SEQ ID NO: 54591 - protein, 11 aa, Artificial Sequence
  Description of Artificial Sequence: Synthetic peptide
  Seed: EVFEGREDSIL (MAGA3_HUMAN)
EIFEGREDSIW

SEQ ID NO: 54592 - protein, 9 aa, Artificial Sequence
  Description of Artificial Sequence: Synthetic peptide
  Seed: YIFATCLGL (MAGA3_HUMAN)
YEFATCLGM

SEQ ID NO: 54593 - protein, 10 aa, Artificial Sequence
  Description of Artificial Sequence: Synthetic peptide
  Seed: ELMEVDPIGH (MAGA3_HUMAN)
EIMEVDPIGK

SEQ ID NO: 54594 - protein, 10 aa, Artificial Sequence
  Description of Artificial Sequence: Synthetic peptide
  Seed: EVFEGREDSI (MAGA3_HUMAN)
ETFEGREDSY

SEQ ID NO: 54595 - protein, 9 aa, Artificial Sequence
  Description of Artificial Sequence: Synthetic peptide
  Seed: SSLQLVFGI (MAGA3_HUMAN)
STLQLVFGL

SEQ ID NO: 54596 - protein, 10 aa, Artificial Sequence
  Description of Artificial Sequence: Synthetic peptide
  Seed: MNYPLWSQSY (MAGA3_HUMAN)
MWYPLWSQSY

SEQ ID NO: 54597 - protein, 10 aa, Artificial Sequence
  Description of Artificial Sequence: Synthetic peptide
  Seed: KISGGPHISY (MAGA3_HUMAN)
KQSGGPHISF

SEQ ID NO: 54598 - protein, 9 aa, Artificial Sequence
  Description of Artificial Sequence: Synthetic peptide
  Seed: SSLQLVFGI (MAGA3_HUMAN)
SMLQLVFGA

SEQ ID NO: 54599 - protein, 10 aa, Artificial Sequence
  Description of Artificial Sequence: Synthetic peptide
  Seed: SYPPLHEWVL (MAGA3_HUMAN)
SFPPLHEWVI

SEQ ID NO: 54600 - protein, 9 aa, Artificial Sequence
  Description of Artificial Sequence: Synthetic peptide
  Seed: SVVGNWQYF (MAGA3_HUMAN)
SMVGNWQYM

SEQ ID NO: 54601 - protein, 8 aa, Artificial Sequence
  Description of Artificial Sequence: Synthetic peptide
  Seed: YPLWSQSY (MAGA3_HUMAN)
YYLWSQSI

SEQ ID NO: 54602 - protein, 10 aa, Artificial Sequence
  Description of Artificial Sequence: Synthetic peptide
  Seed: GHLYIFATCL (MAGA3_HUMAN)
GQLYIFATCV

SEQ ID NO: 54603 - protein, 9 aa, Artificial Sequence
  Description of Artificial Sequence: Synthetic peptide
  Seed: KVAELVHFL (MAGA3_HUMAN)
KSAELVHFA

SEQ ID NO: 54604 - protein, 9 aa, Artificial Sequence
  Description of Artificial Sequence: Synthetic peptide
  Seed: YIFATCLGL (MAGA3_HUMAN)
YFFATCLGF

SEQ ID NO: 54605 - protein, 9 aa, Artificial Sequence
  Description of Artificial Sequence: Synthetic peptide
  Seed: FVQENYLEY (MAGA3_HUMAN)
FIQENYLEF

SEQ ID NO: 54606 - protein, 9 aa, Artificial Sequence
  Description of Artificial Sequence: Synthetic peptide
  Seed: KVAELVHFL (MAGA3_HUMAN)
KYAELVHFK

SEQ ID NO: 54607 - protein, 9 aa, Artificial Sequence
  Description of Artificial Sequence: Synthetic peptide
  Seed: LLIIVLAII (MAGA3_HUMAN)
LLIIVLAIV

SEQ ID NO: 54608 - protein, 10 aa, Artificial Sequence
  Description of Artificial Sequence: Synthetic peptide
  Seed: YFFPVIFSKA (MAGA3_HUMAN)
YLFPVIFSKI

SEQ ID NO: 54609 - protein, 10 aa, Artificial Sequence
  Description of Artificial Sequence: Synthetic peptide
  Seed: KVAELVHFLL (MAGA3_HUMAN)
KIAELVHFLE

SEQ ID NO: 54610 - protein, 9 aa, Artificial Sequence
  Description of Artificial Sequence: Synthetic peptide
  Seed: LQLVFGIEL (MAGA3_HUMAN)
LILVFGIEV

SEQ ID NO: 54611 - protein, 10 aa, Artificial Sequence
  Description of Artificial Sequence: Synthetic peptide
  Seed: DLESEFQAAL (MAGA3_HUMAN)
DNESEFQAAF

SEQ ID NO: 54612 - protein, 10 aa, Artificial Sequence
  Description of Artificial Sequence: Synthetic peptide
  Seed: LYIFATCLGL (MAGA3_HUMAN)
LKIFATCLGV

SEQ ID NO: 54613 - protein, 10 aa, Artificial Sequence
  Description of Artificial Sequence: Synthetic peptide
  Seed: STFPDLESEF (MAGA3_HUMAN)
STFPDLESEY

SEQ ID NO: 54614 - protein, 11 aa, Artificial Sequence
  Description of Artificial Sequence: Synthetic peptide
  Seed: KVAELVHFLLL (MAGA3_HUMAN)
KMAELVHFLLV

SEQ ID NO: 54615 - protein, 10 aa, Artificial Sequence
  Description of Artificial Sequence: Synthetic peptide
  Seed: AEMLGSVVGN (MAGA3_HUMAN)
AEMLGSVVGF

SEQ ID NO: 54616 - protein, 10 aa, Artificial Sequence
  Description of Artificial Sequence: Synthetic peptide
  Seed: KASSSLQLVF (MAGA3_HUMAN)
KVSSSLQLVI

SEQ ID NO: 54617 - protein, 9 aa, Artificial Sequence
  Description of Artificial Sequence: Synthetic peptide
  Seed: LQLVFGIEL (MAGA3_HUMAN)
LHLVFGIEL

SEQ ID NO: 54618 - protein, 9 aa, Artificial Sequence
  Description of Artificial Sequence: Synthetic peptide
  Seed: RALVETSYV (MAGA3_HUMAN)
RVLVETSYL

SEQ ID NO: 54619 - protein, 9 aa, Artificial Sequence
  Description of Artificial Sequence: Synthetic peptide
  Seed: FVQENYLEY (MAGA3_HUMAN)
FQQENYLEW

SEQ ID NO: 54620 - protein, 10 aa, Artificial Sequence
  Description of Artificial Sequence: Synthetic peptide
  Seed: AALSRKVAEL (MAGA3_HUMAN)
AALSRKVAEV

SEQ ID NO: 54621 - protein, 10 aa, Artificial Sequence
  Description of Artificial Sequence: Synthetic peptide
  Seed: HISYPPLHEW (MAGA3_HUMAN)
HCSYPPLHEW

SEQ ID NO: 54622 - protein, 9 aa, Artificial Sequence
  Description of Artificial Sequence: Synthetic peptide
  Seed: KIWEELSVL (MAGA3_HUMAN)
KMWEELSVC

SEQ ID NO: 54623 - protein, 9 aa, Artificial Sequence
  Description of Artificial Sequence: Synthetic peptide
  Seed: FATCLGLSY (MAGA3_HUMAN)
FQTCLGLSL

SEQ ID NO: 54624 - protein, 10 aa, Artificial Sequence
  Description of Artificial Sequence: Synthetic peptide
  Seed: FLWGPRALVE (MAGA3_HUMAN)
FLWGPRALVN

SEQ ID NO: 54625 - protein, 10 aa, Artificial Sequence
  Description of Artificial Sequence: Synthetic peptide
  Seed: AELVHFLLLK (MAGA3_HUMAN)
AGLVHFLLLK

SEQ ID NO: 54626 - protein, 10 aa, Artificial Sequence
  Description of Artificial Sequence: Synthetic peptide
  Seed: HISYPPLHEW (MAGA3_HUMAN)
HTSYPPLHEW

SEQ ID NO: 54627 - protein, 9 aa, Artificial Sequence
  Description of Artificial Sequence: Synthetic peptide
  Seed: MEVDPIGHL (MAGA3_HUMAN)
MQVDPIGHW

SEQ ID NO: 54628 - protein, 9 aa, Artificial Sequence
  Description of Artificial Sequence: Synthetic peptide
  Seed: SSSSTLVEV (MAGA3_HUMAN)
SISSTLVEY

SEQ ID NO: 54629 - protein, 10 aa, Artificial Sequence
  Description of Artificial Sequence: Synthetic peptide
  Seed: HISYPPLHEW (MAGA3_HUMAN)
HASYPPLHEY

SEQ ID NO: 54630 - protein, 9 aa, Artificial Sequence
  Description of Artificial Sequence: Synthetic peptide
  Seed: YIFATCLGL (MAGA3_HUMAN)
YSFATCLGF

SEQ ID NO: 54631 - protein, 11 aa, Artificial Sequence
  Description of Artificial Sequence: Synthetic peptide
  Seed: YIFATCLGLSY (MAGA3_HUMAN)
YQFATCLGLSY

SEQ ID NO: 54632 - protein, 9 aa, Artificial Sequence
  Description of Artificial Sequence: Synthetic peptide
  Seed: GEALGLVGA (MAGA3_HUMAN)
GEALGLVGF

SEQ ID NO: 54633 - protein, 9 aa, Artificial Sequence
  Description of Artificial Sequence: Synthetic peptide
  Seed: YIFATCLGL (MAGA3_HUMAN)
YMFATCLGW

SEQ ID NO: 54634 - protein, 9 aa, Artificial Sequence
  Description of Artificial Sequence: Synthetic peptide
  Seed: RQVPGSDPA (MAGA3_HUMAN)
RQVPGSDPH

SEQ ID NO: 54635 - protein, 8 aa, Artificial Sequence
  Description of Artificial Sequence: Synthetic peptide
  Seed: FPDLESEF (MAGA3_HUMAN)
FLDLESEL

SEQ ID NO: 54636 - protein, 9 aa, Artificial Sequence
  Description of Artificial Sequence: Synthetic peptide
  Seed: VTLGEVPAA (MAGA3_HUMAN)
VMLGEVPAL

SEQ ID NO: 54637 - protein, 10 aa, Artificial Sequence
  Description of Artificial Sequence: Synthetic peptide
  Seed: ASSSSTLVEV (MAGA3_HUMAN)
AQSSSTLVEI

SEQ ID NO: 54638 - protein, 10 aa, Artificial Sequence
  Description of Artificial Sequence: Synthetic peptide
  Seed: SLQLVFGIEL (MAGA3_HUMAN)
SPQLVFGIEY

SEQ ID NO: 54639 - protein, 11 aa, Artificial Sequence
  Description of Artificial Sequence: Synthetic peptide
  Seed: VKISGGPHISY (MAGA3_HUMAN)
VLISGGPHISF

SEQ ID NO: 54640 - protein, 10 aa, Artificial Sequence
  Description of Artificial Sequence: Synthetic peptide
  Seed: ISYPPLHEWV (MAGA3_HUMAN)
IYYPPLHEWW

SEQ ID NO: 54641 - protein, 9 aa, Artificial Sequence
  Description of Artificial Sequence: Synthetic peptide
  Seed: SILGDPKKL (MAGA3_HUMAN)
SALGDPKKY

SEQ ID NO: 54642 - protein, 9 aa, Artificial Sequence
  Description of Artificial Sequence: Synthetic peptide
  Seed: VAELVHFLL (MAGA3_HUMAN)
VAELVHFLF

SEQ ID NO: 54643 - protein, 9 aa, Artificial Sequence
  Description of Artificial Sequence: Synthetic peptide
  Seed: IMPKAGLLI (MAGA3_HUMAN)
IAPKAGLLM

SEQ ID NO: 54644 - protein, 9 aa, Artificial Sequence
  Description of Artificial Sequence: Synthetic peptide
  Seed: KVAELVHFL (MAGA3_HUMAN)
KGAELVHFW

SEQ ID NO: 54645 - protein, 10 aa, Artificial Sequence
  Description of Artificial Sequence: Synthetic peptide
  Seed: KISGGPHISY (MAGA3_HUMAN)
KFSGGPHISY

SEQ ID NO: 54646 - protein, 10 aa, Artificial Sequence
  Description of Artificial Sequence: Synthetic peptide
  Seed: QYFFPVIFSK (MAGA3_HUMAN)
QQFFPVIFSK

SEQ ID NO: 54647 - protein, 9 aa, Artificial Sequence
  Description of Artificial Sequence: Synthetic peptide
  Seed: MEVDPIGHL (MAGA3_HUMAN)
MVVDPIGHA

SEQ ID NO: 54648 - protein, 9 aa, Artificial Sequence
  Description of Artificial Sequence: Synthetic peptide
  Seed: LESEFQAAL (MAGA3_HUMAN)
LHSEFQAAM

SEQ ID NO: 54649 - protein, 10 aa, Artificial Sequence
  Description of Artificial Sequence: Synthetic peptide
  Seed: SLQLVFGIEL (MAGA3_HUMAN)
SGQLVFGIEF

SEQ ID NO: 54650 - protein, 10 aa, Artificial Sequence
  Description of Artificial Sequence: Synthetic peptide
  Seed: YIFATCLGLS (MAGA3_HUMAN)
YLFATCLGLP

SEQ ID NO: 54651 - protein, 10 aa, Artificial Sequence
  Description of Artificial Sequence: Synthetic peptide
  Seed: ELMEVDPIGH (MAGA3_HUMAN)
EMMEVDPIGR

SEQ ID NO: 54652 - protein, 9 aa, Artificial Sequence
  Description of Artificial Sequence: Synthetic peptide
  Seed: KASSSLQLV (MAGA3_HUMAN)
KMSSSLQLK

SEQ ID NO: 54653 - protein, 10 aa, Artificial Sequence
  Description of Artificial Sequence: Synthetic peptide
  Seed: TLVEVTLGEV (MAGA3_HUMAN)
TTVEVTLGEL

SEQ ID NO: 54654 - protein, 9 aa, Artificial Sequence
  Description of Artificial Sequence: Synthetic peptide
  Seed: GNWQYFFPV (MAGA3_HUMAN)
GMWQYFFPL

SEQ ID NO: 54655 - protein, 9 aa, Artificial Sequence
  Description of Artificial Sequence: Synthetic peptide
  Seed: EAASSSSTL (MAGA3_HUMAN)
ESASSSSTF

SEQ ID NO: 54656 - protein, 9 aa, Artificial Sequence
  Description of Artificial Sequence: Synthetic peptide
  Seed: GSDPACYEF (MAGA3_HUMAN)
GQDPACYEW

SEQ ID NO: 54657 - protein, 9 aa, Artificial Sequence
  Description of Artificial Sequence: Synthetic peptide
  Seed: KVLHHMVKI (MAGA3_HUMAN)
KLLHHMVKF

SEQ ID NO: 54658 - protein, 10 aa, Artificial Sequence
  Description of Artificial Sequence: Synthetic peptide
  Seed: DLESEFQAAL (MAGA3_HUMAN)
DFESEFQAAY

SEQ ID NO: 54659 - protein, 9 aa, Artificial Sequence
  Description of Artificial Sequence: Synthetic peptide
  Seed: EAASSSSTL (MAGA3_HUMAN)
ESASSSSTV

SEQ ID NO: 54660 - protein, 9 aa, Artificial Sequence
  Description of Artificial Sequence: Synthetic peptide
  Seed: FPVIFSKAS (MAGA3_HUMAN)
FPVIFSKAV

SEQ ID NO: 54661 - protein, 9 aa, Artificial Sequence
  Description of Artificial Sequence: Synthetic peptide
  Seed: ISYPPLHEW (MAGA3_HUMAN)
IQYPPLHEM

SEQ ID NO: 54662 - protein, 10 aa, Artificial Sequence
  Description of Artificial Sequence: Synthetic peptide
  Seed: KISGGPHISY (MAGA3_HUMAN)
KMSGGPHISK

SEQ ID NO: 54663 - protein, 10 aa, Artificial Sequence
  Description of Artificial Sequence: Synthetic peptide
  Seed: MVKISGGPHI (MAGA3_HUMAN)
MRKISGGPHY

SEQ ID NO: 54664 - protein, 8 aa, Artificial Sequence
  Description of Artificial Sequence: Synthetic peptide
  Seed: SGGPHISY (MAGA3_HUMAN)
SMGPHISY

SEQ ID NO: 54665 - protein, 9 aa, Artificial Sequence
  Description of Artificial Sequence: Synthetic peptide
  Seed: VTLGEVPAA (MAGA3_HUMAN)
VALGEVPAL

SEQ ID NO: 54666 - protein, 9 aa, Artificial Sequence
  Description of Artificial Sequence: Synthetic peptide
  Seed: YFFPVIFSK (MAGA3_HUMAN)
YLFPVIFSM

SEQ ID NO: 54667 - protein, 9 aa, Artificial Sequence
  Description of Artificial Sequence: Synthetic peptide
  Seed: SKASSSLQL (MAGA3_HUMAN)
SRASSSLQI

SEQ ID NO: 54668 - protein, 9 aa, Artificial Sequence
  Description of Artificial Sequence: Synthetic peptide
  Seed: FLWGPRALV (MAGA3_HUMAN)
FTWGPRALA

SEQ ID NO: 54669 - protein, 10 aa, Artificial Sequence
  Description of Artificial Sequence: Synthetic peptide
  Seed: MNYPLWSQSY (MAGA3_HUMAN)
MHYPLWSQSL

SEQ ID NO: 54670 - protein, 9 aa, Artificial Sequence
  Description of Artificial Sequence: Synthetic peptide
  Seed: KVLHHMVKI (MAGA3_HUMAN)
KQLHHMVKF

SEQ ID NO: 54671 - protein, 9 aa, Artificial Sequence
  Description of Artificial Sequence: Synthetic peptide
  Seed: SSTLVEVTL (MAGA3_HUMAN)
SLTLVEVTL

SEQ ID NO: 54672 - protein, 10 aa, Artificial Sequence
  Description of Artificial Sequence: Synthetic peptide
  Seed: KAEMLGSVVG (MAGA3_HUMAN)
KREMLGSVVV

SEQ ID NO: 54673 - protein, 11 aa, Artificial Sequence
  Description of Artificial Sequence: Synthetic peptide
  Seed: KVAELVHFLLL (MAGA3_HUMAN)
KLAELVHFLLL

SEQ ID NO: 54674 - protein, 10 aa, Artificial Sequence
  Description of Artificial Sequence: Synthetic peptide
  Seed: LQLVFGIELM (MAGA3_HUMAN)
LNLVFGIELL

SEQ ID NO: 54675 - protein, 9 aa, Artificial Sequence
  Description of Artificial Sequence: Synthetic peptide
  Seed: IAREGDCAP (MAGA3_HUMAN)
IIREGDCAY

SEQ ID NO: 54676 - protein, 9 aa, Artificial Sequence
  Description of Artificial Sequence: Synthetic peptide
  Seed: KIWEELSVL (MAGA3_HUMAN)
KMWEELSVF

SEQ ID NO: 54677 - protein, 10 aa, Artificial Sequence
  Description of Artificial Sequence: Synthetic peptide
  Seed: SLPTTMNYPL (MAGA3_HUMAN)
SLPTTMNYPI

SEQ ID NO: 54678 - protein, 11 aa, Artificial Sequence
  Description of Artificial Sequence: Synthetic peptide
  Seed: SYPPLHEWVLR (MAGA3_HUMAN)
SYPPLHEWVLL

SEQ ID NO: 54679 - protein, 9 aa, Artificial Sequence
  Description of Artificial Sequence: Synthetic peptide
  Seed: ILGDPKKLL (MAGA3_HUMAN)
IAGDPKKLL

SEQ ID NO: 54680 - protein, 10 aa, Artificial Sequence
  Description of Artificial Sequence: Synthetic peptide
  Seed: YRQVPGSDPA (MAGA3_HUMAN)
YLQVPGSDPV

SEQ ID NO: 54681 - protein, 10 aa, Artificial Sequence
  Description of Artificial Sequence: Synthetic peptide
  Seed: MEVDPIGHLY (MAGA3_HUMAN)
MRVDPIGHLY

SEQ ID NO: 54682 - protein, 9 aa, Artificial Sequence
  Description of Artificial Sequence: Synthetic peptide
  Seed: ILGDPKKLL (MAGA3_HUMAN)
ISGDPKKLY

SEQ ID NO: 54683 - protein, 9 aa, Artificial Sequence
  Description of Artificial Sequence: Synthetic peptide
  Seed: SYPPLHEWV (MAGA3_HUMAN)
SRPPLHEWM

SEQ ID NO: 54684 - protein, 11 aa, Artificial Sequence
  Description of Artificial Sequence: Synthetic peptide
  Seed: SRKVAELVHFL (MAGA3_HUMAN)
SMKVAELVHFA

SEQ ID NO: 54685 - protein, 10 aa, Artificial Sequence
  Description of Artificial Sequence: Synthetic peptide
  Seed: HISYPPLHEW (MAGA3_HUMAN)
HQSYPPLHEW

SEQ ID NO: 54686 - protein, 9 aa, Artificial Sequence
  Description of Artificial Sequence: Synthetic peptide
  Seed: FATCLGLSY (MAGA3_HUMAN)
FMTCLGLSR

SEQ ID NO: 54687 - protein, 9 aa, Artificial Sequence
  Description of Artificial Sequence: Synthetic peptide
  Seed: NWQYFFPVI (MAGA3_HUMAN)
NYQYFFPVW

SEQ ID NO: 54688 - protein, 11 aa, Artificial Sequence
  Description of Artificial Sequence: Synthetic peptide
  Seed: FLWGPRALVET (MAGA3_HUMAN)
FMWGPRALVEI

SEQ ID NO: 54689 - protein, 9 aa, Artificial Sequence
  Description of Artificial Sequence: Synthetic peptide
  Seed: LQLVFGIEL (MAGA3_HUMAN)
LVLVFGIEF

SEQ ID NO: 54690 - protein, 9 aa, Artificial Sequence
  Description of Artificial Sequence: Synthetic peptide
  Seed: NQIMPKAGL (MAGA3_HUMAN)
NQIMPKAGY

SEQ ID NO: 54691 - protein, 9 aa, Artificial Sequence
  Description of Artificial Sequence: Synthetic peptide
  Seed: TQHFVQENY (MAGA3_HUMAN)
TQHFVQENV

SEQ ID NO: 54692 - protein, 10 aa, Artificial Sequence
  Description of Artificial Sequence: Synthetic peptide
  Seed: TSYVKVLHHM (MAGA3_HUMAN)
TMYVKVLHHI

SEQ ID NO: 54693 - protein, 9 aa, Artificial Sequence
  Description of Artificial Sequence: Synthetic peptide
  Seed: HLYIFATCL (MAGA3_HUMAN)
HKYIFATCF

SEQ ID NO: 54694 - protein, 10 aa, Artificial Sequence
  Description of Artificial Sequence: Synthetic peptide
  Seed: SLPTTMNYPL (MAGA3_HUMAN)
SFPTTMNYPL

SEQ ID NO: 54695 - protein, 10 aa, Artificial Sequence
  Description of Artificial Sequence: Synthetic peptide
  Seed: IFATCLGLSY (MAGA3_HUMAN)
IRATCLGLSY

SEQ ID NO: 54696 - protein, 10 aa, Artificial Sequence
  Description of Artificial Sequence: Synthetic peptide
  Seed: MNYPLWSQSY (MAGA3_HUMAN)
MMYPLWSQSY

SEQ ID NO: 54697 - protein, 9 aa, Artificial Sequence
  Description of Artificial Sequence: Synthetic peptide
  Seed: GASSLPTTM (MAGA3_HUMAN)
GKSSLPTTY

SEQ ID NO: 54698 - protein, 10 aa, Artificial Sequence
  Description of Artificial Sequence: Synthetic peptide
  Seed: MPKAGLLIIV (MAGA3_HUMAN)
MPKAGLLIIA

SEQ ID NO: 54699 - protein, 9 aa, Artificial Sequence
  Description of Artificial Sequence: Synthetic peptide
  Seed: VKISGGPHI (MAGA3_HUMAN)
VLISGGPHY

SEQ ID NO: 54700 - protein, 10 aa, Artificial Sequence
  Description of Artificial Sequence: Synthetic peptide
  Seed: MEVDPIGHLY (MAGA3_HUMAN)
MTVDPIGHLF

SEQ ID NO: 54701 - protein, 11 aa, Artificial Sequence
  Description of Artificial Sequence: Synthetic peptide
  Seed: RQVPGSDPACY (MAGA3_HUMAN)
RQVPGSDPACI

SEQ ID NO: 54702 - protein, 9 aa, Artificial Sequence
  Description of Artificial Sequence: Synthetic peptide
  Seed: SSSSTLVEV (MAGA3_HUMAN)
SSSSTLVEL

SEQ ID NO: 54703 - protein, 9 aa, Artificial Sequence
  Description of Artificial Sequence: Synthetic peptide
  Seed: EAASSSSTL (MAGA3_HUMAN)
ETASSSSTK

SEQ ID NO: 54704 - protein, 9 aa, Artificial Sequence
  Description of Artificial Sequence: Synthetic peptide
  Seed: IMPKAGLLI (MAGA3_HUMAN)
ICPKAGLLL

SEQ ID NO: 54705 - protein, 9 aa, Artificial Sequence
  Description of Artificial Sequence: Synthetic peptide
  Seed: GSDPACYEF (MAGA3_HUMAN)
GMDPACYEY

SEQ ID NO: 54706 - protein, 11 aa, Artificial Sequence
  Description of Artificial Sequence: Synthetic peptide
  Seed: SNQEEEGPSTF (MAGA3_HUMAN)
SEQEEEGPSTF

SEQ ID NO: 54707 - protein, 11 aa, Artificial Sequence
  Description of Artificial Sequence: Synthetic peptide
  Seed: YIFATCLGLSY (MAGA3_HUMAN)
YLFATCLGLSM

SEQ ID NO: 54708 - protein, 10 aa, Artificial Sequence
  Description of Artificial Sequence: Synthetic peptide
  Seed: WEELSVLEVF (MAGA3_HUMAN)
WQELSVLEVM

SEQ ID NO: 54709 - protein, 9 aa, Artificial Sequence
  Description of Artificial Sequence: Synthetic peptide
  Seed: FVQENYLEY (MAGA3_HUMAN)
FSQENYLEW

SEQ ID NO: 54710 - protein, 10 aa, Artificial Sequence
  Description of Artificial Sequence: Synthetic peptide
  Seed: KISGGPHISY (MAGA3_HUMAN)
KASGGPHISF

SEQ ID NO: 54711 - protein, 11 aa, Artificial Sequence
  Description of Artificial Sequence: Synthetic peptide
  Seed: EVFEGREDSIL (MAGA3_HUMAN)
ELFEGREDSIR

SEQ ID NO: 54712 - protein, 10 aa, Artificial Sequence
  Description of Artificial Sequence: Synthetic peptide
  Seed: KASSSLQLVF (MAGA3_HUMAN)
KPSSSLQLVF

SEQ ID NO: 54713 - protein, 10 aa, Artificial Sequence
  Description of Artificial Sequence: Synthetic peptide
  Seed: QENYLEYRQV (MAGA3_HUMAN)
QENYLEYRQF

SEQ ID NO: 54714 - protein, 9 aa, Artificial Sequence
  Description of Artificial Sequence: Synthetic peptide
  Seed: LVHFLLLKY (MAGA3_HUMAN)
LTHFLLLKW

SEQ ID NO: 54715 - protein, 10 aa, Artificial Sequence
  Description of Artificial Sequence: Synthetic peptide
  Seed: KISGGPHISY (MAGA3_HUMAN)
KTSGGPHISF

SEQ ID NO: 54716 - protein, 9 aa, Artificial Sequence
  Description of Artificial Sequence: Synthetic peptide
  Seed: SSSSTLVEV (MAGA3_HUMAN)
SMSSTLVEW

SEQ ID NO: 54717 - protein, 9 aa, Artificial Sequence
  Description of Artificial Sequence: Synthetic peptide
  Seed: KVLHHMVKI (MAGA3_HUMAN)
KMLHHMVKK

SEQ ID NO: 54718 - protein, 10 aa, Artificial Sequence
  Description of Artificial Sequence: Synthetic peptide
  Seed: MNYPLWSQSY (MAGA3_HUMAN)
MHYPLWSQSY

SEQ ID NO: 54719 - protein, 10 aa, Artificial Sequence
  Description of Artificial Sequence: Synthetic peptide
  Seed: EALGLVGAQA (MAGA3_HUMAN)
EVLGLVGAQI

SEQ ID NO: 54720 - protein, 9 aa, Artificial Sequence
  Description of Artificial Sequence: Synthetic peptide
  Seed: GNWQYFFPV (MAGA3_HUMAN)
GQWQYFFPV

SEQ ID NO: 54721 - protein, 11 aa, Artificial Sequence
  Description of Artificial Sequence: Synthetic peptide
  Seed: HISYPPLHEWV (MAGA3_HUMAN)
HKSYPPLHEWW

SEQ ID NO: 54722 - protein, 9 aa, Artificial Sequence
  Description of Artificial Sequence: Synthetic peptide
  Seed: SYPPLHEWV (MAGA3_HUMAN)
SMPPLHEWF

SEQ ID NO: 54723 - protein, 9 aa, Artificial Sequence
  Description of Artificial Sequence: Synthetic peptide
  Seed: VETSYVKVL (MAGA3_HUMAN)
VQTSYVKVV

SEQ ID NO: 54724 - protein, 9 aa, Artificial Sequence
  Description of Artificial Sequence: Synthetic peptide
  Seed: KASSSLQLV (MAGA3_HUMAN)
KMSSSLQLA

SEQ ID NO: 54725 - protein, 10 aa, Artificial Sequence
  Description of Artificial Sequence: Synthetic peptide
  Seed: SVVGNWQYFF (MAGA3_HUMAN)
SYVGNWQYFA

SEQ ID NO: 54726 - protein, 10 aa, Artificial Sequence
  Description of Artificial Sequence: Synthetic peptide
  Seed: EMLGSVVGNW (MAGA3_HUMAN)
EILGSVVGNF

SEQ ID NO: 54727 - protein, 9 aa, Artificial Sequence
  Description of Artificial Sequence: Synthetic peptide
  Seed: GLVGAQAPA (MAGA3_HUMAN)
GVVGAQAPV

SEQ ID NO: 54728 - protein, 10 aa, Artificial Sequence
  Description of Artificial Sequence: Synthetic peptide
  Seed: ASSLPTTMNY (MAGA3_HUMAN)
AWSLPTTMNY

SEQ ID NO: 54729 - protein, 9 aa, Artificial Sequence
  Description of Artificial Sequence: Synthetic peptide
  Seed: SEFQAALSR (MAGA3_HUMAN)
SDFQAALSF

SEQ ID NO: 54730 - protein, 9 aa, Artificial Sequence
  Description of Artificial Sequence: Synthetic peptide
  Seed: VKISGGPHI (MAGA3_HUMAN)
VHISGGPHF

SEQ ID NO: 54731 - protein, 10 aa, Artificial Sequence
  Description of Artificial Sequence: Synthetic peptide
  Seed: ASSSSTLVEV (MAGA3_HUMAN)
AQSSSTLVEV

SEQ ID NO: 54732 - protein, 10 aa, Artificial Sequence
  Description of Artificial Sequence: Synthetic peptide
  Seed: NWQYFFPVIF (MAGA3_HUMAN)
NRQYFFPVIM

SEQ ID NO: 54733 - protein, 9 aa, Artificial Sequence
  Description of Artificial Sequence: Synthetic peptide
  Seed: KASSSLQLV (MAGA3_HUMAN)
KSSSSLQLY

SEQ ID NO: 54734 - protein, 9 aa, Artificial Sequence
  Description of Artificial Sequence: Synthetic peptide
  Seed: ASSSLQLVF (MAGA3_HUMAN)
AISSLQLVY

SEQ ID NO: 54735 - protein, 9 aa, Artificial Sequence
  Description of Artificial Sequence: Synthetic peptide
  Seed: SSLPTTMNY (MAGA3_HUMAN)
SMLPTTMNR

SEQ ID NO: 54736 - protein, 9 aa, Artificial Sequence
  Description of Artificial Sequence: Synthetic peptide
  Seed: SYVKVLHHM (MAGA3_HUMAN)
SFVKVLHHM

SEQ ID NO: 54737 - protein, 9 aa, Artificial Sequence
  Description of Artificial Sequence: Synthetic peptide
  Seed: EVDPIGHLY (MAGA3_HUMAN)
EFDPIGHLF

SEQ ID NO: 54738 - protein, 9 aa, Artificial Sequence
  Description of Artificial Sequence: Synthetic peptide
  Seed: GASSLPTTM (MAGA3_HUMAN)
GKSSLPTTF

SEQ ID NO: 54739 - protein, 11 aa, Artificial Sequence
  Description of Artificial Sequence: Synthetic peptide
  Seed: REGDCAPEEKI (MAGA3_HUMAN)
REGDCAPEEKW

SEQ ID NO: 54740 - protein, 9 aa, Artificial Sequence
  Description of Artificial Sequence: Synthetic peptide
  Seed: QLVFGIELM (MAGA3_HUMAN)
QQVFGIELI

SEQ ID NO: 54741 - protein, 11 aa, Artificial Sequence
  Description of Artificial Sequence: Synthetic peptide
  Seed: SRKVAELVHFL (MAGA3_HUMAN)
SLKVAELVHFI

SEQ ID NO: 54742 - protein, 10 aa, Artificial Sequence
  Description of Artificial Sequence: Synthetic peptide
  Seed: EVFEGREDSI (MAGA3_HUMAN)
ETFEGREDSL

SEQ ID NO: 54743 - protein, 9 aa, Artificial Sequence
  Description of Artificial Sequence: Synthetic peptide
  Seed: WQYFFPVIF (MAGA3_HUMAN)
WSYFFPVIY

SEQ ID NO: 54744 - protein, 8 aa, Artificial Sequence
  Description of Artificial Sequence: Synthetic peptide
  Seed: YPLWSQSY (MAGA3_HUMAN)
YFLWSQSL

SEQ ID NO: 54745 - protein, 9 aa, Artificial Sequence
  Description of Artificial Sequence: Synthetic peptide
  Seed: TSYVKVLHH (MAGA3_HUMAN)
TVYVKVLHR

SEQ ID NO: 54746 - protein, 9 aa, Artificial Sequence
  Description of Artificial Sequence: Synthetic peptide
  Seed: GSDPACYEF (MAGA3_HUMAN)
GIDPACYEY

SEQ ID NO: 54747 - protein, 10 aa, Artificial Sequence
  Description of Artificial Sequence: Synthetic peptide
  Seed: KISGGPHISY (MAGA3_HUMAN)
KSSGGPHISK

SEQ ID NO: 54748 - protein, 10 aa, Artificial Sequence
  Description of Artificial Sequence: Synthetic peptide
  Seed: SLQLVFGIEL (MAGA3_HUMAN)
SVQLVFGIEF

SEQ ID NO: 54749 - protein, 9 aa, Artificial Sequence
  Description of Artificial Sequence: Synthetic peptide
  Seed: SSSSTLVEV (MAGA3_HUMAN)
SSSSTLVEI

SEQ ID NO: 54750 - protein, 9 aa, Artificial Sequence
  Description of Artificial Sequence: Synthetic peptide
  Seed: SSTLVEVTL (MAGA3_HUMAN)
SQTLVEVTL

SEQ ID NO: 54751 - protein, 10 aa, Artificial Sequence
  Description of Artificial Sequence: Synthetic peptide
  Seed: FSKASSSLQL (MAGA3_HUMAN)
FNKASSSLQF

SEQ ID NO: 54752 - protein, 10 aa, Artificial Sequence
  Description of Artificial Sequence: Synthetic peptide
  Seed: LGLVGAQAPA (MAGA3_HUMAN)
LTLVGAQAPL

SEQ ID NO: 54753 - protein, 10 aa, Artificial Sequence
  Description of Artificial Sequence: Synthetic peptide
  Seed: MEVDPIGHLY (MAGA3_HUMAN)
MPVDPIGHLL

SEQ ID NO: 54754 - protein, 9 aa, Artificial Sequence
  Description of Artificial Sequence: Synthetic peptide
  Seed: ISGGPHISY (MAGA3_HUMAN)
IHGGPHISY

SEQ ID NO: 54755 - protein, 9 aa, Artificial Sequence
  Description of Artificial Sequence: Synthetic peptide
  Seed: KIWEELSVL (MAGA3_HUMAN)
KTWEELSVF

SEQ ID NO: 54756 - protein, 9 aa, Artificial Sequence
  Description of Artificial Sequence: Synthetic peptide
  Seed: VVGNWQYFF (MAGA3_HUMAN)
VMGNWQYFY

SEQ ID NO: 54757 - protein, 10 aa, Artificial Sequence
  Description of Artificial Sequence: Synthetic peptide
  Seed: IFATCLGLSY (MAGA3_HUMAN)
IVATCLGLSW

SEQ ID NO: 54758 - protein, 10 aa, Artificial Sequence
  Description of Artificial Sequence: Synthetic peptide
  Seed: GDCAPEEKIW (MAGA3_HUMAN)
GTCAPEEKIW

SEQ ID NO: 54759 - protein, 10 aa, Artificial Sequence
  Description of Artificial Sequence: Synthetic peptide
  Seed: SLQLVFGIEL (MAGA3_HUMAN)
SMQLVFGIEF

SEQ ID NO: 54760 - protein, 9 aa, Artificial Sequence
  Description of Artificial Sequence: Synthetic peptide
  Seed: EVTLGEVPA (MAGA3_HUMAN)
EVTLGEVPV

SEQ ID NO: 54761 - protein, 9 aa, Artificial Sequence
  Description of Artificial Sequence: Synthetic peptide
  Seed: MEVDPIGHL (MAGA3_HUMAN)
MYVDPIGHF

SEQ ID NO: 54762 - protein, 9 aa, Artificial Sequence
  Description of Artificial Sequence: Synthetic peptide
  Seed: SSSSTLVEV (MAGA3_HUMAN)
SMSSTLVEL

SEQ ID NO: 54763 - protein, 11 aa, Artificial Sequence
  Description of Artificial Sequence: Synthetic peptide
  Seed: SGGPHISYPPL (MAGA3_HUMAN)
SPGPHISYPPL

SEQ ID NO: 54764 - protein, 9 aa, Artificial Sequence
  Description of Artificial Sequence: Synthetic peptide
  Seed: SSTLVEVTL (MAGA3_HUMAN)
SSTLVEVTM

SEQ ID NO: 54765 - protein, 10 aa, Artificial Sequence
  Description of Artificial Sequence: Synthetic peptide
  Seed: SLQLVFGIEL (MAGA3_HUMAN)
SRQLVFGIEY

SEQ ID NO: 54766 - protein, 9 aa, Artificial Sequence
  Description of Artificial Sequence: Synthetic peptide
  Seed: KASSSLQLV (MAGA3_HUMAN)
KMSSSLQLF

SEQ ID NO: 54767 - protein, 10 aa, Artificial Sequence
  Description of Artificial Sequence: Synthetic peptide
  Seed: YRQVPGSDPA (MAGA3_HUMAN)
YCQVPGSDPV

SEQ ID NO: 54768 - protein, 9 aa, Artificial Sequence
  Description of Artificial Sequence: Synthetic peptide
  Seed: GSVVGNWQY (MAGA3_HUMAN)
GPVVGNWQY

SEQ ID NO: 54769 - protein, 9 aa, Artificial Sequence
  Description of Artificial Sequence: Synthetic peptide
  Seed: VPAAESPDP (MAGA3_HUMAN)
VPAAESPDA

SEQ ID NO: 54770 - protein, 11 aa, Artificial Sequence
  Description of Artificial Sequence: Synthetic peptide
  Seed: SNQEEEGPSTF (MAGA3_HUMAN)
SHQEEEGPSTI

SEQ ID NO: 54771 - protein, 10 aa, Artificial Sequence
  Description of Artificial Sequence: Synthetic peptide
  Seed: SYPPLHEWVL (MAGA3_HUMAN)
SWPPLHEWVW

SEQ ID NO: 54772 - protein, 10 aa, Artificial Sequence
  Description of Artificial Sequence: Synthetic peptide
  Seed: YLEYRQVPGS (MAGA3_HUMAN)
YMEYRQVPGI

SEQ ID NO: 54773 - protein, 9 aa, Artificial Sequence
  Description of Artificial Sequence: Synthetic peptide
  Seed: YIFATCLGL (MAGA3_HUMAN)
YTFATCLGF

SEQ ID NO: 54774 - protein, 8 aa, Artificial Sequence
  Description of Artificial Sequence: Synthetic peptide
  Seed: SGGPHISY (MAGA3_HUMAN)
SSGPHISL

SEQ ID NO: 54775 - protein, 10 aa, Artificial Sequence
  Description of Artificial Sequence: Synthetic peptide
  Seed: STFPDLESEF (MAGA3_HUMAN)
SYFPDLESEL

SEQ ID NO: 54776 - protein, 10 aa, Artificial Sequence
  Description of Artificial Sequence: Synthetic peptide
  Seed: EEQEAASSSS (MAGA3_HUMAN)
EEQEAASSSA

SEQ ID NO: 54777 - protein, 9 aa, Artificial Sequence
  Description of Artificial Sequence: Synthetic peptide
  Seed: KASSSLQLV (MAGA3_HUMAN)
KTSSSLQLW

SEQ ID NO: 54778 - protein, 10 aa, Artificial Sequence
  Description of Artificial Sequence: Synthetic peptide
  Seed: FLWGPRALVE (MAGA3_HUMAN)
FMWGPRALVT

SEQ ID NO: 54779 - protein, 10 aa, Artificial Sequence
  Description of Artificial Sequence: Synthetic peptide
  Seed: LVFGIELMEV (MAGA3_HUMAN)
LLFGIELMEI

SEQ ID NO: 54780 - protein, 10 aa, Artificial Sequence
  Description of Artificial Sequence: Synthetic peptide
  Seed: YIFATCLGLS (MAGA3_HUMAN)
YMFATCLGLI

SEQ ID NO: 54781 - protein, 9 aa, Artificial Sequence
  Description of Artificial Sequence: Synthetic peptide
  Seed: ISYPPLHEW (MAGA3_HUMAN)
IYYPPLHEV

SEQ ID NO: 54782 - protein, 9 aa, Artificial Sequence
  Description of Artificial Sequence: Synthetic peptide
  Seed: VETSYVKVL (MAGA3_HUMAN)
VETSYVKVM

SEQ ID NO: 54783 - protein, 9 aa, Artificial Sequence
  Description of Artificial Sequence: Synthetic peptide
  Seed: IMPKAGLLI (MAGA3_HUMAN)
IYPKAGLLF

SEQ ID NO: 54784 - protein, 11 aa, Artificial Sequence
  Description of Artificial Sequence: Synthetic peptide
  Seed: AQAPATEEQEA (MAGA3_HUMAN)
AIAPATEEQEF

SEQ ID NO: 54785 - protein, 9 aa, Artificial Sequence
  Description of Artificial Sequence: Synthetic peptide
  Seed: LQLVFGIEL (MAGA3_HUMAN)
LLLVFGIEI

SEQ ID NO: 54786 - protein, 10 aa, Artificial Sequence
  Description of Artificial Sequence: Synthetic peptide
  Seed: SDPACYEFLW (MAGA3_HUMAN)
SCPACYEFLW

SEQ ID NO: 54787 - protein, 9 aa, Artificial Sequence
  Description of Artificial Sequence: Synthetic peptide
  Seed: TFPDLESEF (MAGA3_HUMAN)
TYPDLESEY

SEQ ID NO: 54788 - protein, 9 aa, Artificial Sequence
  Description of Artificial Sequence: Synthetic peptide
  Seed: QHCKPEEGL (MAGA3_HUMAN)
QHCKPEEGM

SEQ ID NO: 54789 - protein, 11 aa, Artificial Sequence
  Description of Artificial Sequence: Synthetic peptide
  Seed: RQVPGSDPACY (MAGA3_HUMAN)
RIVPGSDPACW

SEQ ID NO: 54790 - protein, 9 aa, Artificial Sequence
  Description of Artificial Sequence: Synthetic peptide
  Seed: SVVGNWQYF (MAGA3_HUMAN)
STVGNWQYL

SEQ ID NO: 54791 - protein, 10 aa, Artificial Sequence
  Description of Artificial Sequence: Synthetic peptide
  Seed: TSYVKVLHHM (MAGA3_HUMAN)
THYVKVLHHW

SEQ ID NO: 54792 - protein, 9 aa, Artificial Sequence
  Description of Artificial Sequence: Synthetic peptide
  Seed: MEVDPIGHL (MAGA3_HUMAN)
MQVDPIGHY

SEQ ID NO: 54793 - protein, 9 aa, Artificial Sequence
  Description of Artificial Sequence: Synthetic peptide
  Seed: YPLWSQSYE (MAGA3_HUMAN)
YMLWSQSYY

SEQ ID NO: 54794 - protein, 11 aa, Artificial Sequence
  Description of Artificial Sequence: Synthetic peptide
  Seed: AQAPATEEQEA (MAGA3_HUMAN)
AMAPATEEQEL

SEQ ID NO: 54795 - protein, 9 aa, Artificial Sequence
  Description of Artificial Sequence: Synthetic peptide
  Seed: SVVGNWQYF (MAGA3_HUMAN)
SFVGNWQYV

SEQ ID NO: 54796 - protein, 10 aa, Artificial Sequence
  Description of Artificial Sequence: Synthetic peptide
  Seed: HISYPPLHEW (MAGA3_HUMAN)
HPSYPPLHEW

SEQ ID NO: 54797 - protein, 10 aa, Artificial Sequence
  Description of Artificial Sequence: Synthetic peptide
  Seed: EMLGSVVGNW (MAGA3_HUMAN)
ETLGSVVGNW

SEQ ID NO: 54798 - protein, 9 aa, Artificial Sequence
  Description of Artificial Sequence: Synthetic peptide
  Seed: LESEFQAAL (MAGA3_HUMAN)
LTSEFQAAL

SEQ ID NO: 54799 - protein, 10 aa, Artificial Sequence
  Description of Artificial Sequence: Synthetic peptide
  Seed: NQEEEGPSTF (MAGA3_HUMAN)
NHEEEGPSTV

SEQ ID NO: 54800 - protein, 9 aa, Artificial Sequence
  Description of Artificial Sequence: Synthetic peptide
  Seed: KVAELVHFL (MAGA3_HUMAN)
KTAELVHFM

SEQ ID NO: 54801 - protein, 10 aa, Artificial Sequence
  Description of Artificial Sequence: Synthetic peptide
  Seed: WEELSVLEVF (MAGA3_HUMAN)
WDELSVLEVM

SEQ ID NO: 54802 - protein, 9 aa, Artificial Sequence
  Description of Artificial Sequence: Synthetic peptide
  Seed: LESEFQAAL (MAGA3_HUMAN)
LMSEFQAAM

SEQ ID NO: 54803 - protein, 9 aa, Artificial Sequence
  Description of Artificial Sequence: Synthetic peptide
  Seed: EVDPIGHLY (MAGA3_HUMAN)
ETDPIGHLW

SEQ ID NO: 54804 - protein, 9 aa, Artificial Sequence
  Description of Artificial Sequence: Synthetic peptide
  Seed: MPKAGLLII (MAGA3_HUMAN)
MTKAGLLIY

SEQ ID NO: 54805 - protein, 10 aa, Artificial Sequence
  Description of Artificial Sequence: Synthetic peptide
  Seed: TTMNYPLWSQ (MAGA3_HUMAN)
TIMNYPLWSR

SEQ ID NO: 54806 - protein, 9 aa, Artificial Sequence
  Description of Artificial Sequence: Synthetic peptide
  Seed: FATCLGLSY (MAGA3_HUMAN)
FLTCLGLSF

SEQ ID NO: 54807 - protein, 9 aa, Artificial Sequence
  Description of Artificial Sequence: Synthetic peptide
  Seed: SSLPTTMNY (MAGA3_HUMAN)
SYLPTTMNF

SEQ ID NO: 54808 - protein, 9 aa, Artificial Sequence
  Description of Artificial Sequence: Synthetic peptide
  Seed: VTLGEVPAA (MAGA3_HUMAN)
VLLGEVPAV

SEQ ID NO: 54809 - protein, 10 aa, Artificial Sequence
  Description of Artificial Sequence: Synthetic peptide
  Seed: YIFATCLGLS (MAGA3_HUMAN)
YLFATCLGLK

SEQ ID NO: 54810 - protein, 9 aa, Artificial Sequence
  Description of Artificial Sequence: Synthetic peptide
  Seed: KVLHHMVKI (MAGA3_HUMAN)
KELHHMVKV

SEQ ID NO: 54811 - protein, 8 aa, Artificial Sequence
  Description of Artificial Sequence: Synthetic peptide
  Seed: LSRKVAEL (MAGA3_HUMAN)
LQRKVAEL

SEQ ID NO: 54812 - protein, 9 aa, Artificial Sequence
  Description of Artificial Sequence: Synthetic peptide
  Seed: GNWQYFFPV (MAGA3_HUMAN)
GMWQYFFPS

SEQ ID NO: 54813 - protein, 10 aa, Artificial Sequence
  Description of Artificial Sequence: Synthetic peptide
  Seed: MVKISGGPHI (MAGA3_HUMAN)
MIKISGGPHM

SEQ ID NO: 54814 - protein, 9 aa, Artificial Sequence
  Description of Artificial Sequence: Synthetic peptide
  Seed: AELVHFLLL (MAGA3_HUMAN)
AKLVHFLLM

SEQ ID NO: 54815 - protein, 9 aa, Artificial Sequence
  Description of Artificial Sequence: Synthetic peptide
  Seed: VTLGEVPAA (MAGA3_HUMAN)
VVLGEVPAA

SEQ ID NO: 54816 - protein, 11 aa, Artificial Sequence
  Description of Artificial Sequence: Synthetic peptide
  Seed: KVAELVHFLLL (MAGA3_HUMAN)
KMAELVHFLLH

SEQ ID NO: 54817 - protein, 11 aa, Artificial Sequence
  Description of Artificial Sequence: Synthetic peptide
  Seed: SNQEEEGPSTF (MAGA3_HUMAN)
SAQEEEGPSTY

SEQ ID NO: 54818 - protein, 9 aa, Artificial Sequence
  Description of Artificial Sequence: Synthetic peptide
  Seed: ISGGPHISY (MAGA3_HUMAN)
IKGGPHISF

SEQ ID NO: 54819 - protein, 9 aa, Artificial Sequence
  Description of Artificial Sequence: Synthetic peptide
  Seed: FPVIFSKAS (MAGA3_HUMAN)
FAVIFSKAM

SEQ ID NO: 54820 - protein, 9 aa, Artificial Sequence
  Description of Artificial Sequence: Synthetic peptide
  Seed: ISYPPLHEW (MAGA3_HUMAN)
ILYPPLHEL

SEQ ID NO: 54821 - protein, 10 aa, Artificial Sequence
  Description of Artificial Sequence: Synthetic peptide
  Seed: HISYPPLHEW (MAGA3_HUMAN)
HHSYPPLHEY

SEQ ID NO: 54822 - protein, 9 aa, Artificial Sequence
  Description of Artificial Sequence: Synthetic peptide
  Seed: ISYPPLHEW (MAGA3_HUMAN)
IQYPPLHEI

SEQ ID NO: 54823 - protein, 10 aa, Artificial Sequence
  Description of Artificial Sequence: Synthetic peptide
  Seed: MVKISGGPHI (MAGA3_HUMAN)
MDKISGGPHF

SEQ ID NO: 54824 - protein, 8 aa, Artificial Sequence
  Description of Artificial Sequence: Synthetic peptide
  Seed: FPDLESEF (MAGA3_HUMAN)
FYDLESEV

SEQ ID NO: 54825 - protein, 9 aa, Artificial Sequence
  Description of Artificial Sequence: Synthetic peptide
  Seed: IFSKASSSL (MAGA3_HUMAN)
IWSKASSSL

SEQ ID NO: 54826 - protein, 9 aa, Artificial Sequence
  Description of Artificial Sequence: Synthetic peptide
  Seed: SYPPLHEWV (MAGA3_HUMAN)
SYPPLHEWY

SEQ ID NO: 54827 - protein, 10 aa, Artificial Sequence
  Description of Artificial Sequence: Synthetic peptide
  Seed: ISYPPLHEWV (MAGA3_HUMAN)
IIYPPLHEWW

SEQ ID NO: 54828 - protein, 11 aa, Artificial Sequence
  Description of Artificial Sequence: Synthetic peptide
  Seed: MLGSVVGNWQY (MAGA3_HUMAN)
MWGSVVGNWQW

SEQ ID NO: 54829 - protein, 9 aa, Artificial Sequence
  Description of Artificial Sequence: Synthetic peptide
  Seed: KVAELVHFL (MAGA3_HUMAN)
KYAELVHFR

SEQ ID NO: 54830 - protein, 10 aa, Artificial Sequence
  Description of Artificial Sequence: Synthetic peptide
  Seed: RQVPGSDPAC (MAGA3_HUMAN)
REVPGSDPAA

SEQ ID NO: 54831 - protein, 10 aa, Artificial Sequence
  Description of Artificial Sequence: Synthetic peptide
  Seed: HMVKISGGPH (MAGA3_HUMAN)
HAVKISGGPY

SEQ ID NO: 54832 - protein, 10 aa, Artificial Sequence
  Description of Artificial Sequence: Synthetic peptide
  Seed: HISYPPLHEW (MAGA3_HUMAN)
HASYPPLHEF

SEQ ID NO: 54833 - protein, 10 aa, Artificial Sequence
  Description of Artificial Sequence: Synthetic peptide
  Seed: SVVGNWQYFF (MAGA3_HUMAN)
SMVGNWQYFF

SEQ ID NO: 54834 - protein, 9 aa, Artificial Sequence
  Description of Artificial Sequence: Synthetic peptide
  Seed: AELVHFLLL (MAGA3_HUMAN)
AKLVHFLLY

SEQ ID NO: 54835 - protein, 9 aa, Artificial Sequence
  Description of Artificial Sequence: Synthetic peptide
  Seed: QLVFGIELM (MAGA3_HUMAN)
QQVFGIELL

SEQ ID NO: 54836 - protein, 9 aa, Artificial Sequence
  Description of Artificial Sequence: Synthetic peptide
  Seed: SVVGNWQYF (MAGA3_HUMAN)
SPVGNWQYM

SEQ ID NO: 54837 - protein, 9 aa, Artificial Sequence
  Description of Artificial Sequence: Synthetic peptide
  Seed: KVAELVHFL (MAGA3_HUMAN)
KVAELVHFF

SEQ ID NO: 54838 - protein, 10 aa, Artificial Sequence
  Description of Artificial Sequence: Synthetic peptide
  Seed: NQEEEGPSTF (MAGA3_HUMAN)
NEEEEGPSTY

SEQ ID NO: 54839 - protein, 9 aa, Artificial Sequence
  Description of Artificial Sequence: Synthetic peptide
  Seed: IMPKAGLLI (MAGA3_HUMAN)
IVPKAGLLM

SEQ ID NO: 54840 - protein, 10 aa, Artificial Sequence
  Description of Artificial Sequence: Synthetic peptide
  Seed: HISYPPLHEW (MAGA3_HUMAN)
HASYPPLHEM

SEQ ID NO: 54841 - protein, 10 aa, Artificial Sequence
  Description of Artificial Sequence: Synthetic peptide
  Seed: ISYPPLHEWV (MAGA3_HUMAN)
INYPPLHEWL

SEQ ID NO: 54842 - protein, 10 aa, Artificial Sequence
  Description of Artificial Sequence: Synthetic peptide
  Seed: SVVGNWQYFF (MAGA3_HUMAN)
SHVGNWQYFY

SEQ ID NO: 54843 - protein, 9 aa, Artificial Sequence
  Description of Artificial Sequence: Synthetic peptide
  Seed: VVGNWQYFF (MAGA3_HUMAN)
VTGNWQYFW

SEQ ID NO: 54844 - protein, 10 aa, Artificial Sequence
  Description of Artificial Sequence: Synthetic peptide
  Seed: ETSYVKVLHH (MAGA3_HUMAN)
ETSYVKVLHK

SEQ ID NO: 54845 - protein, 9 aa, Artificial Sequence
  Description of Artificial Sequence: Synthetic peptide
  Seed: SSTLVEVTL (MAGA3_HUMAN)
SATLVEVTV

SEQ ID NO: 54846 - protein, 8 aa, Artificial Sequence
  Description of Artificial Sequence: Synthetic peptide
  Seed: SYPPLHEW (MAGA3_HUMAN)
SFPPLHEY

SEQ ID NO: 54847 - protein, 9 aa, Artificial Sequence
  Description of Artificial Sequence: Synthetic peptide
  Seed: FVQENYLEY (MAGA3_HUMAN)
FQQENYLEI

SEQ ID NO: 54848 - protein, 9 aa, Artificial Sequence
  Description of Artificial Sequence: Synthetic peptide
  Seed: WQYFFPVIF (MAGA3_HUMAN)
WRYFFPVIL

SEQ ID NO: 54849 - protein, 10 aa, Artificial Sequence
  Description of Artificial Sequence: Synthetic peptide
  Seed: RKVAELVHFL (MAGA3_HUMAN)
RDVAELVHFI

SEQ ID NO: 54850 - protein, 8 aa, Artificial Sequence
  Description of Artificial Sequence: Synthetic peptide
  Seed: FPDLESEF (MAGA3_HUMAN)
FVDLESEL

SEQ ID NO: 54851 - protein, 10 aa, Artificial Sequence
  Description of Artificial Sequence: Synthetic peptide
  Seed: VIFSKASSSL (MAGA3_HUMAN)
VYFSKASSSY

SEQ ID NO: 54852 - protein, 9 aa, Artificial Sequence
  Description of Artificial Sequence: Synthetic peptide
  Seed: MEVDPIGHL (MAGA3_HUMAN)
MEVDPIGHV

SEQ ID NO: 54853 - protein, 10 aa, Artificial Sequence
  Description of Artificial Sequence: Synthetic peptide
  Seed: RQVPGSDPAC (MAGA3_HUMAN)
REVPGSDPAI

SEQ ID NO: 54854 - protein, 9 aa, Artificial Sequence
  Description of Artificial Sequence: Synthetic peptide
  Seed: LESEFQAAL (MAGA3_HUMAN)
LMSEFQAAV

SEQ ID NO: 54855 - protein, 9 aa, Artificial Sequence
  Description of Artificial Sequence: Synthetic peptide
  Seed: FATCLGLSY (MAGA3_HUMAN)
FITCLGLSM

SEQ ID NO: 54856 - protein, 10 aa, Artificial Sequence
  Description of Artificial Sequence: Synthetic peptide
  Seed: LPTTMNYPLW (MAGA3_HUMAN)
LTTTMNYPLF

SEQ ID NO: 54857 - protein, 11 aa, Artificial Sequence
  Description of Artificial Sequence: Synthetic peptide
  Seed: RKVAELVHFLL (MAGA3_HUMAN)
RRVAELVHFLL

SEQ ID NO: 54858 - protein, 9 aa, Artificial Sequence
  Description of Artificial Sequence: Synthetic peptide
  Seed: MEVDPIGHL (MAGA3_HUMAN)
MAVDPIGHF

SEQ ID NO: 54859 - protein, 10 aa, Artificial Sequence
  Description of Artificial Sequence: Synthetic peptide
  Seed: QIMPKAGLLI (MAGA3_HUMAN)
QQMPKAGLLV

SEQ ID NO: 54860 - protein, 10 aa, Artificial Sequence
  Description of Artificial Sequence: Synthetic peptide
  Seed: DLESEFQAAL (MAGA3_HUMAN)
DAESEFQAAY

SEQ ID NO: 54861 - protein, 10 aa, Artificial Sequence
  Description of Artificial Sequence: Synthetic peptide
  Seed: ASSSSTLVEV (MAGA3_HUMAN)
AISSSTLVEV

SEQ ID NO: 54862 - protein, 10 aa, Artificial Sequence
  Description of Artificial Sequence: Synthetic peptide
  Seed: YFFPVIFSKA (MAGA3_HUMAN)
YLFPVIFSKS

SEQ ID NO: 54863 - protein, 9 aa, Artificial Sequence
  Description of Artificial Sequence: Synthetic peptide
  Seed: EALGLVGAQ (MAGA3_HUMAN)
EILGLVGAK

SEQ ID NO: 54864 - protein, 9 aa, Artificial Sequence
  Description of Artificial Sequence: Synthetic peptide
  Seed: VKISGGPHI (MAGA3_HUMAN)
VQISGGPHW

SEQ ID NO: 54865 - protein, 9 aa, Artificial Sequence
  Description of Artificial Sequence: Synthetic peptide
  Seed: LESEFQAAL (MAGA3_HUMAN)
LFSEFQAAF

SEQ ID NO: 54866 - protein, 9 aa, Artificial Sequence
  Description of Artificial Sequence: Synthetic peptide
  Seed: EAASSSSTL (MAGA3_HUMAN)
ETASSSSTR

SEQ ID NO: 54867 - protein, 9 aa, Artificial Sequence
  Description of Artificial Sequence: Synthetic peptide
  Seed: MEVDPIGHL (MAGA3_HUMAN)
MIVDPIGHY

SEQ ID NO: 54868 - protein, 11 aa, Artificial Sequence
  Description of Artificial Sequence: Synthetic peptide
  Seed: RQVPGSDPACY (MAGA3_HUMAN)
RLVPGSDPACM

SEQ ID NO: 54869 - protein, 10 aa, Artificial Sequence
  Description of Artificial Sequence: Synthetic peptide
  Seed: SVVGNWQYFF (MAGA3_HUMAN)
SNVGNWQYFY

SEQ ID NO: 54870 - protein, 9 aa, Artificial Sequence
  Description of Artificial Sequence: Synthetic peptide
  Seed: ISYPPLHEW (MAGA3_HUMAN)
IWYPPLHEI

SEQ ID NO: 54871 - protein, 10 aa, Artificial Sequence
  Description of Artificial Sequence: Synthetic peptide
  Seed: RKVAELVHFL (MAGA3_HUMAN)
RSVAELVHFV

SEQ ID NO: 54872 - protein, 9 aa, Artificial Sequence
  Description of Artificial Sequence: Synthetic peptide
  Seed: SYVKVLHHM (MAGA3_HUMAN)
STVKVLHHL

SEQ ID NO: 54873 - protein, 9 aa, Artificial Sequence
  Description of Artificial Sequence: Synthetic peptide
  Seed: VVGNWQYFF (MAGA3_HUMAN)
VFGNWQYFW

SEQ ID NO: 54874 - protein, 10 aa, Artificial Sequence
  Description of Artificial Sequence: Synthetic peptide
  Seed: LPTTMNYPLW (MAGA3_HUMAN)
LNTTMNYPLW

SEQ ID NO: 54875 - protein, 9 aa, Artificial Sequence
  Description of Artificial Sequence: Synthetic peptide
  Seed: ELVHFLLLK (MAGA3_HUMAN)
ETVHFLLLH

SEQ ID NO: 54876 - protein, 10 aa, Artificial Sequence
  Description of Artificial Sequence: Synthetic peptide
  Seed: VIFSKASSSL (MAGA3_HUMAN)
VMFSKASSSM

SEQ ID NO: 54877 - protein, 10 aa, Artificial Sequence
  Description of Artificial Sequence: Synthetic peptide
  Seed: LGLVGAQAPA (MAGA3_HUMAN)
LALVGAQAPV

SEQ ID NO: 54878 - protein, 11 aa, Artificial Sequence
  Description of Artificial Sequence: Synthetic peptide
  Seed: SYPPLHEWVLR (MAGA3_HUMAN)
SFPPLHEWVLF

SEQ ID NO: 54879 - protein, 10 aa, Artificial Sequence
  Description of Artificial Sequence: Synthetic peptide
  Seed: SLPTTMNYPL (MAGA3_HUMAN)
SWPTTMNYPL

SEQ ID NO: 54880 - protein, 9 aa, Artificial Sequence
  Description of Artificial Sequence: Synthetic peptide
  Seed: MEVDPIGHL (MAGA3_HUMAN)
MHVDPIGHY

SEQ ID NO: 54881 - protein, 9 aa, Artificial Sequence
  Description of Artificial Sequence: Synthetic peptide
  Seed: VTLGEVPAA (MAGA3_HUMAN)
VLLGEVPAC

SEQ ID NO: 54882 - protein, 9 aa, Artificial Sequence
  Description of Artificial Sequence: Synthetic peptide
  Seed: YIFATCLGL (MAGA3_HUMAN)
YIFATCLGV

SEQ ID NO: 54883 - protein, 9 aa, Artificial Sequence
  Description of Artificial Sequence: Synthetic peptide
  Seed: FVQENYLEY (MAGA3_HUMAN)
FVQENYLEM

SEQ ID NO: 54884 - protein, 11 aa, Artificial Sequence
  Description of Artificial Sequence: Synthetic peptide
  Seed: VVGNWQYFFPV (MAGA3_HUMAN)
VLGNWQYFFPI

SEQ ID NO: 54885 - protein, 9 aa, Artificial Sequence
  Description of Artificial Sequence: Synthetic peptide
  Seed: QEEEGPSTF (MAGA3_HUMAN)
QHEEGPSTV

SEQ ID NO: 54886 - protein, 10 aa, Artificial Sequence
  Description of Artificial Sequence: Synthetic peptide
  Seed: LGLVGAQAPA (MAGA3_HUMAN)
LYLVGAQAPL

SEQ ID NO: 54887 - protein, 8 aa, Artificial Sequence
  Description of Artificial Sequence: Synthetic peptide
  Seed: YVKVLHHM (MAGA3_HUMAN)
YTKVLHHL

SEQ ID NO: 54888 - protein, 10 aa, Artificial Sequence
  Description of Artificial Sequence: Synthetic peptide
  Seed: ASSSLQLVFG (MAGA3_HUMAN)
ACSSLQLVFW

SEQ ID NO: 54889 - protein, 9 aa, Artificial Sequence
  Description of Artificial Sequence: Synthetic peptide
  Seed: FVQENYLEY (MAGA3_HUMAN)
FGQENYLEF

SEQ ID NO: 54890 - protein, 9 aa, Artificial Sequence
  Description of Artificial Sequence: Synthetic peptide
  Seed: GSDPACYEF (MAGA3_HUMAN)
GMDPACYEF

SEQ ID NO: 54891 - protein, 10 aa, Artificial Sequence
  Description of Artificial Sequence: Synthetic peptide
  Seed: MEVDPIGHLY (MAGA3_HUMAN)
MVVDPIGHLM

SEQ ID NO: 54892 - protein, 9 aa, Artificial Sequence
  Description of Artificial Sequence: Synthetic peptide
  Seed: GEVPAAESP (MAGA3_HUMAN)
GDVPAAESF

SEQ ID NO: 54893 - protein, 10 aa, Artificial Sequence
  Description of Artificial Sequence: Synthetic peptide
  Seed: ISYPPLHEWV (MAGA3_HUMAN)
IMYPPLHEWA

SEQ ID NO: 54894 - protein, 8 aa, Artificial Sequence
  Description of Artificial Sequence: Synthetic peptide
  Seed: KIWEELSV (MAGA3_HUMAN)
KMWEELSV

SEQ ID NO: 54895 - protein, 9 aa, Artificial Sequence
  Description of Artificial Sequence: Synthetic peptide
  Seed: ISYPPLHEW (MAGA3_HUMAN)
IPYPPLHEL

SEQ ID NO: 54896 - protein, 9 aa, Artificial Sequence
  Description of Artificial Sequence: Synthetic peptide
  Seed: QIMPKAGLL (MAGA3_HUMAN)
QAMPKAGLY

SEQ ID NO: 54897 - protein, 10 aa, Artificial Sequence
  Description of Artificial Sequence: Synthetic peptide
  Seed: KVAELVHFLL (MAGA3_HUMAN)
KSAELVHFLY

SEQ ID NO: 54898 - protein, 9 aa, Artificial Sequence
  Description of Artificial Sequence: Synthetic peptide
  Seed: YFFPVIFSK (MAGA3_HUMAN)
YIFPVIFSR

SEQ ID NO: 54899 - protein, 9 aa, Artificial Sequence
  Description of Artificial Sequence: Synthetic peptide
  Seed: LHHMVKISG (MAGA3_HUMAN)
LHHMVKISA

SEQ ID NO: 54900 - protein, 9 aa, Artificial Sequence
  Description of Artificial Sequence: Synthetic peptide
  Seed: LPTTMNYPL (MAGA3_HUMAN)
LPTTMNYPY

SEQ ID NO: 54901 - protein, 9 aa, Artificial Sequence
  Description of Artificial Sequence: Synthetic peptide
  Seed: KASSSLQLV (MAGA3_HUMAN)
KYSSSLQLK

SEQ ID NO: 54902 - protein, 9 aa, Artificial Sequence
  Description of Artificial Sequence: Synthetic peptide
  Seed: ISYPPLHEW (MAGA3_HUMAN)
IGYPPLHEL

SEQ ID NO: 54903 - protein, 10 aa, Artificial Sequence
  Description of Artificial Sequence: Synthetic peptide
  Seed: FFPVIFSKAS (MAGA3_HUMAN)
FHPVIFSKAV

SEQ ID NO: 54904 - protein, 9 aa, Artificial Sequence
  Description of Artificial Sequence: Synthetic peptide
  Seed: YVKVLHHMV (MAGA3_HUMAN)
YLKVLHHMV

SEQ ID NO: 54905 - protein, 10 aa, Artificial Sequence
  Description of Artificial Sequence: Synthetic peptide
  Seed: FFPVIFSKAS (MAGA3_HUMAN)
FSPVIFSKAA

SEQ ID NO: 54906 - protein, 10 aa, Artificial Sequence
  Description of Artificial Sequence: Synthetic peptide
  Seed: HISYPPLHEW (MAGA3_HUMAN)
HQSYPPLHEF

SEQ ID NO: 54907 - protein, 9 aa, Artificial Sequence
  Description of Artificial Sequence: Synthetic peptide
  Seed: FATCLGLSY (MAGA3_HUMAN)
FYTCLGLSL

SEQ ID NO: 54908 - protein, 10 aa, Artificial Sequence
  Description of Artificial Sequence: Synthetic peptide
  Seed: SVVGNWQYFF (MAGA3_HUMAN)
SMVGNWQYFW

SEQ ID NO: 54909 - protein, 11 aa, Artificial Sequence
  Description of Artificial Sequence: Synthetic peptide
  Seed: RQVPGSDPACY (MAGA3_HUMAN)
RQVPGSDPACL

SEQ ID NO: 54910 - protein, 10 aa, Artificial Sequence
  Description of Artificial Sequence: Synthetic peptide
  Seed: FSKASSSLQL (MAGA3_HUMAN)
FMKASSSLQY

SEQ ID NO: 54911 - protein, 9 aa, Artificial Sequence
  Description of Artificial Sequence: Synthetic peptide
  Seed: AASSSSTLV (MAGA3_HUMAN)
AMSSSSTLM

SEQ ID NO: 54912 - protein, 9 aa, Artificial Sequence
  Description of Artificial Sequence: Synthetic peptide
  Seed: KVAELVHFL (MAGA3_HUMAN)
KSAELVHFW

SEQ ID NO: 54913 - protein, 10 aa, Artificial Sequence
  Description of Artificial Sequence: Synthetic peptide
  Seed: FFPVIFSKAS (MAGA3_HUMAN)
FCPVIFSKAA

SEQ ID NO: 54914 - protein, 10 aa, Artificial Sequence
  Description of Artificial Sequence: Synthetic peptide
  Seed: LYIFATCLGL (MAGA3_HUMAN)
LLIFATCLGV

SEQ ID NO: 54915 - protein, 11 aa, Artificial Sequence
  Description of Artificial Sequence: Synthetic peptide
  Seed: HCKPEEGLEAR (MAGA3_HUMAN)
HAKPEEGLEAR

SEQ ID NO: 54916 - protein, 9 aa, Artificial Sequence
  Description of Artificial Sequence: Synthetic peptide
  Seed: SYVKVLHHM (MAGA3_HUMAN)
SRVKVLHHY

SEQ ID NO: 54917 - protein, 10 aa, Artificial Sequence
  Description of Artificial Sequence: Synthetic peptide
  Seed: EMLGSVVGNW (MAGA3_HUMAN)
EVLGSVVGNF

SEQ ID NO: 54918 - protein, 9 aa, Artificial Sequence
  Description of Artificial Sequence: Synthetic peptide
  Seed: HLYIFATCL (MAGA3_HUMAN)
HFYIFATCY

SEQ ID NO: 54919 - protein, 9 aa, Artificial Sequence
  Description of Artificial Sequence: Synthetic peptide
  Seed: SVVGNWQYF (MAGA3_HUMAN)
SPVGNWQYY

SEQ ID NO: 54920 - protein, 10 aa, Artificial Sequence
  Description of Artificial Sequence: Synthetic peptide
  Seed: RQVPGSDPAC (MAGA3_HUMAN)
RQVPGSDPAL

SEQ ID NO: 54921 - protein, 10 aa, Artificial Sequence
  Description of Artificial Sequence: Synthetic peptide
  Seed: SLPTTMNYPL (MAGA3_HUMAN)
SRPTTMNYPL

SEQ ID NO: 54922 - protein, 10 aa, Artificial Sequence
  Description of Artificial Sequence: Synthetic peptide
  Seed: LVHFLLLKYR (MAGA3_HUMAN)
LFHFLLLKYR

SEQ ID NO: 54923 - protein, 10 aa, Artificial Sequence
  Description of Artificial Sequence: Synthetic peptide
  Seed: LGLVGAQAPA (MAGA3_HUMAN)
LALVGAQAPL

SEQ ID NO: 54924 - protein, 10 aa, Artificial Sequence
  Description of Artificial Sequence: Synthetic peptide
  Seed: RQVPGSDPAC (MAGA3_HUMAN)
RMVPGSDPAL

SEQ ID NO: 54925 - protein, 11 aa, Artificial Sequence
  Description of Artificial Sequence: Synthetic peptide
  Seed: VVGNWQYFFPV (MAGA3_HUMAN)
VLGNWQYFFPV

SEQ ID NO: 54926 - protein, 9 aa, Artificial Sequence
  Description of Artificial Sequence: Synthetic peptide
  Seed: KIWEELSVL (MAGA3_HUMAN)
KVWEELSVK

SEQ ID NO: 54927 - protein, 10 aa, Artificial Sequence
  Description of Artificial Sequence: Synthetic peptide
  Seed: SEFQAALSRK (MAGA3_HUMAN)
SSFQAALSRK

SEQ ID NO: 54928 - protein, 9 aa, Artificial Sequence
  Description of Artificial Sequence: Synthetic peptide
  Seed: SSLPTTMNY (MAGA3_HUMAN)
SYLPTTMNM

SEQ ID NO: 54929 - protein, 10 aa, Artificial Sequence
  Description of Artificial Sequence: Synthetic peptide
  Seed: ISYPPLHEWV (MAGA3_HUMAN)
IFYPPLHEWI

SEQ ID NO: 54930 - protein, 9 aa, Artificial Sequence
  Description of Artificial Sequence: Synthetic peptide
  Seed: GSVVGNWQY (MAGA3_HUMAN)
GVVVGNWQW

SEQ ID NO: 54931 - protein, 9 aa, Artificial Sequence
  Description of Artificial Sequence: Synthetic peptide
  Seed: AQAPATEEQ (MAGA3_HUMAN)
AQAPATEEM

SEQ ID NO: 54932 - protein, 9 aa, Artificial Sequence
  Description of Artificial Sequence: Synthetic peptide
  Seed: NQIMPKAGL (MAGA3_HUMAN)
NHIMPKAGI

SEQ ID NO: 54933 - protein, 10 aa, Artificial Sequence
  Description of Artificial Sequence: Synthetic peptide
  Seed: FFPVIFSKAS (MAGA3_HUMAN)
FDPVIFSKAV

SEQ ID NO: 54934 - protein, 9 aa, Artificial Sequence
  Description of Artificial Sequence: Synthetic peptide
  Seed: MVKISGGPH (MAGA3_HUMAN)
MAKISGGPL

SEQ ID NO: 54935 - protein, 9 aa, Artificial Sequence
  Description of Artificial Sequence: Synthetic peptide
  Seed: GNWQYFFPV (MAGA3_HUMAN)
GMWQYFFPA

SEQ ID NO: 54936 - protein, 9 aa, Artificial Sequence
  Description of Artificial Sequence: Synthetic peptide
  Seed: RALVETSYV (MAGA3_HUMAN)
RSLVETSYF

SEQ ID NO: 54937 - protein, 9 aa, Artificial Sequence
  Description of Artificial Sequence: Synthetic peptide
  Seed: KIWEELSVL (MAGA3_HUMAN)
KFWEELSVF

SEQ ID NO: 54938 - protein, 9 aa, Artificial Sequence
  Description of Artificial Sequence: Synthetic peptide
  Seed: ILGDPKKLL (MAGA3_HUMAN)
IFGDPKKLF

SEQ ID NO: 54939 - protein, 10 aa, Artificial Sequence
  Description of Artificial Sequence: Synthetic peptide
  Seed: SLQLVFGIEL (MAGA3_HUMAN)
SYQLVFGIEF

SEQ ID NO: 54940 - protein, 9 aa, Artificial Sequence
  Description of Artificial Sequence: Synthetic peptide
  Seed: FATCLGLSY (MAGA3_HUMAN)
FITCLGLSK

SEQ ID NO: 54941 - protein, 9 aa, Artificial Sequence
  Description of Artificial Sequence: Synthetic peptide
  Seed: YFFPVIFSK (MAGA3_HUMAN)
YQFPVIFSY

SEQ ID NO: 54942 - protein, 9 aa, Artificial Sequence
  Description of Artificial Sequence: Synthetic peptide
  Seed: KASSSLQLV (MAGA3_HUMAN)
KTSSSLQLF

SEQ ID NO: 54943 - protein, 10 aa, Artificial Sequence
  Description of Artificial Sequence: Synthetic peptide
  Seed: VDPIGHLYIF (MAGA3_HUMAN)
VIPIGHLYIW

SEQ ID NO: 54944 - protein, 10 aa, Artificial Sequence
  Description of Artificial Sequence: Synthetic peptide
  Seed: VDPIGHLYIF (MAGA3_HUMAN)
VPPIGHLYIY

SEQ ID NO: 54945 - protein, 9 aa, Artificial Sequence
  Description of Artificial Sequence: Synthetic peptide
  Seed: ALGLVGAQA (MAGA3_HUMAN)
AMGLVGAQA

SEQ ID NO: 54946 - protein, 9 aa, Artificial Sequence
  Description of Artificial Sequence: Synthetic peptide
  Seed: HLYIFATCL (MAGA3_HUMAN)
HHYIFATCF

SEQ ID NO: 54947 - protein, 9 aa, Artificial Sequence
  Description of Artificial Sequence: Synthetic peptide
  Seed: EAASSSSTL (MAGA3_HUMAN)
EIASSSSTM

SEQ ID NO: 54948 - protein, 9 aa, Artificial Sequence
  Description of Artificial Sequence: Synthetic peptide
  Seed: QSPQGASSL (MAGA3_HUMAN)
QLPQGASSL

SEQ ID NO: 54949 - protein, 9 aa, Artificial Sequence
  Description of Artificial Sequence: Synthetic peptide
  Seed: RKVAELVHF (MAGA3_HUMAN)
RLVAELVHF

SEQ ID NO: 54950 - protein, 9 aa, Artificial Sequence
  Description of Artificial Sequence: Synthetic peptide
  Seed: EVDPIGHLY (MAGA3_HUMAN)
ESDPIGHLR

SEQ ID NO: 54951 - protein, 8 aa, Artificial Sequence
  Description of Artificial Sequence: Synthetic peptide
  Seed: SYPPLHEW (MAGA3_HUMAN)
SFPPLHEM

SEQ ID NO: 54952 - protein, 9 aa, Artificial Sequence
  Description of Artificial Sequence: Synthetic peptide
  Seed: VPGSDPACY (MAGA3_HUMAN)
VPGSDPACF

SEQ ID NO: 54953 - protein, 10 aa, Artificial Sequence
  Description of Artificial Sequence: Synthetic peptide
  Seed: STFPDLESEF (MAGA3_HUMAN)
SKFPDLESEF

SEQ ID NO: 54954 - protein, 10 aa, Artificial Sequence
  Description of Artificial Sequence: Synthetic peptide
  Seed: MVKISGGPHI (MAGA3_HUMAN)
MIKISGGPHY

SEQ ID NO: 54955 - protein, 11 aa, Artificial Sequence
  Description of Artificial Sequence: Synthetic peptide
  Seed: YIFATCLGLSY (MAGA3_HUMAN)
YKFATCLGLSL

SEQ ID NO: 54956 - protein, 9 aa, Artificial Sequence
  Description of Artificial Sequence: Synthetic peptide
  Seed: ISYPPLHEW (MAGA3_HUMAN)
ILYPPLHEM

SEQ ID NO: 54957 - protein, 9 aa, Artificial Sequence
  Description of Artificial Sequence: Synthetic peptide
  Seed: LSRKVAELV (MAGA3_HUMAN)
LARKVAELW

SEQ ID NO: 54958 - protein, 9 aa, Artificial Sequence
  Description of Artificial Sequence: Synthetic peptide
  Seed: YIFATCLGL (MAGA3_HUMAN)
YLFATCLGC

SEQ ID NO: 54959 - protein, 10 aa, Artificial Sequence
  Description of Artificial Sequence: Synthetic peptide
  Seed: ASSLPTTMNY (MAGA3_HUMAN)
ACSLPTTMNF

SEQ ID NO: 54960 - protein, 9 aa, Artificial Sequence
  Description of Artificial Sequence: Synthetic peptide
  Seed: EALGLVGAQ (MAGA3_HUMAN)
ETLGLVGAL

SEQ ID NO: 54961 - protein, 10 aa, Artificial Sequence
  Description of Artificial Sequence: Synthetic peptide
  Seed: MEVDPIGHLY (MAGA3_HUMAN)
MSVDPIGHLM

SEQ ID NO: 54962 - protein, 9 aa, Artificial Sequence
  Description of Artificial Sequence: Synthetic peptide
  Seed: FVQENYLEY (MAGA3_HUMAN)
FQQENYLEM

SEQ ID NO: 54963 - protein, 10 aa, Artificial Sequence
  Description of Artificial Sequence: Synthetic peptide
  Seed: ASSLPTTMNY (MAGA3_HUMAN)
AQSLPTTMNK

SEQ ID NO: 54964 - protein, 10 aa, Artificial Sequence
  Description of Artificial Sequence: Synthetic peptide
  Seed: VDPIGHLYIF (MAGA3_HUMAN)
VMPIGHLYIM

SEQ ID NO: 54965 - protein, 11 aa, Artificial Sequence
  Description of Artificial Sequence: Synthetic peptide
  Seed: AEMLGSVVGNW (MAGA3_HUMAN)
AEMLGSVVGNC

SEQ ID NO: 54966 - protein, 9 aa, Artificial Sequence
  Description of Artificial Sequence: Synthetic peptide
  Seed: EELSVLEVF (MAGA3_HUMAN)
EQLSVLEVL

SEQ ID NO: 54967 - protein, 9 aa, Artificial Sequence
  Description of Artificial Sequence: Synthetic peptide
  Seed: GNWQYFFPV (MAGA3_HUMAN)
GMWQYFFPC

SEQ ID NO: 54968 - protein, 9 aa, Artificial Sequence
  Description of Artificial Sequence: Synthetic peptide
  Seed: ISYPPLHEW (MAGA3_HUMAN)
ILYPPLHEW

SEQ ID NO: 54969 - protein, 8 aa, Artificial Sequence
  Description of Artificial Sequence: Synthetic peptide
  Seed: SYPPLHEW (MAGA3_HUMAN)
SYPPLHEV

SEQ ID NO: 54970 - protein, 9 aa, Artificial Sequence
  Description of Artificial Sequence: Synthetic peptide
  Seed: SSLQLVFGI (MAGA3_HUMAN)
STLQLVFGV

SEQ ID NO: 54971 - protein, 9 aa, Artificial Sequence
  Description of Artificial Sequence: Synthetic peptide
  Seed: VKISGGPHI (MAGA3_HUMAN)
VQISGGPHI

SEQ ID NO: 54972 - protein, 9 aa, Artificial Sequence
  Description of Artificial Sequence: Synthetic peptide
  Seed: SKASSSLQL (MAGA3_HUMAN)
SLASSSLQY

SEQ ID NO: 54973 - protein, 11 aa, Artificial Sequence
  Description of Artificial Sequence: Synthetic peptide
  Seed: SRKVAELVHFL (MAGA3_HUMAN)
SLKVAELVHFM

SEQ ID NO: 54974 - protein, 11 aa, Artificial Sequence
  Description of Artificial Sequence: Synthetic peptide
  Seed: QHCKPEEGLEA (MAGA3_HUMAN)
QHCKPEEGLEI

SEQ ID NO: 54975 - protein, 10 aa, Artificial Sequence
  Description of Artificial Sequence: Synthetic peptide
  Seed: STFPDLESEF (MAGA3_HUMAN)
SAFPDLESEY

SEQ ID NO: 54976 - protein, 9 aa, Artificial Sequence
  Description of Artificial Sequence: Synthetic peptide
  Seed: EAASSSSTL (MAGA3_HUMAN)
EQASSSSTF

SEQ ID NO: 54977 - protein, 9 aa, Artificial Sequence
  Description of Artificial Sequence: Synthetic peptide
  Seed: IFSKASSSL (MAGA3_HUMAN)
IYSKASSSF

SEQ ID NO: 54978 - protein, 10 aa, Artificial Sequence
  Description of Artificial Sequence: Synthetic peptide
  Seed: YFFPVIFSKA (MAGA3_HUMAN)
YGFPVIFSKR

SEQ ID NO: 54979 - protein, 10 aa, Artificial Sequence
  Description of Artificial Sequence: Synthetic peptide
  Seed: HISYPPLHEW (MAGA3_HUMAN)
HSSYPPLHEF

SEQ ID NO: 54980 - protein, 9 aa, Artificial Sequence
  Description of Artificial Sequence: Synthetic peptide
  Seed: HLYIFATCL (MAGA3_HUMAN)
HQYIFATCL

SEQ ID NO: 54981 - protein, 10 aa, Artificial Sequence
  Description of Artificial Sequence: Synthetic peptide
  Seed: LYIFATCLGL (MAGA3_HUMAN)
LLIFATCLGL

SEQ ID NO: 54982 - protein, 9 aa, Artificial Sequence
  Description of Artificial Sequence: Synthetic peptide
  Seed: TFPDLESEF (MAGA3_HUMAN)
TMPDLESEM

SEQ ID NO: 54983 - protein, 10 aa, Artificial Sequence
  Description of Artificial Sequence: Synthetic peptide
  Seed: YIFATCLGLS (MAGA3_HUMAN)
YLFATCLGLA

SEQ ID NO: 54984 - protein, 11 aa, Artificial Sequence
  Description of Artificial Sequence: Synthetic peptide
  Seed: YIFATCLGLSY (MAGA3_HUMAN)
YPFATCLGLSF

SEQ ID NO: 54985 - protein, 9 aa, Artificial Sequence
  Description of Artificial Sequence: Synthetic peptide
  Seed: CYEFLWGPR (MAGA3_HUMAN)
CFEFLWGPR

SEQ ID NO: 54986 - protein, 10 aa, Artificial Sequence
  Description of Artificial Sequence: Synthetic peptide
  Seed: MEVDPIGHLY (MAGA3_HUMAN)
MLVDPIGHLW

SEQ ID NO: 54987 - protein, 10 aa, Artificial Sequence
  Description of Artificial Sequence: Synthetic peptide
  Seed: QYFFPVIFSK (MAGA3_HUMAN)
QAFFPVIFSR

SEQ ID NO: 54988 - protein, 10 aa, Artificial Sequence
  Description of Artificial Sequence: Synthetic peptide
  Seed: RKVAELVHFL (MAGA3_HUMAN)
RLVAELVHFM

SEQ ID NO: 54989 - protein, 11 aa, Artificial Sequence
  Description of Artificial Sequence: Synthetic peptide
  Seed: RQVPGSDPACY (MAGA3_HUMAN)
RTVPGSDPACR

SEQ ID NO: 54990 - protein, 9 aa, Artificial Sequence
  Description of Artificial Sequence: Synthetic peptide
  Seed: KASSSLQLV (MAGA3_HUMAN)
KGSSSLQLY

SEQ ID NO: 54991 - protein, 10 aa, Artificial Sequence
  Description of Artificial Sequence: Synthetic peptide
  Seed: ISYPPLHEWV (MAGA3_HUMAN)
IAYPPLHEWL

SEQ ID NO: 54992 - protein, 9 aa, Artificial Sequence
  Description of Artificial Sequence: Synthetic peptide
  Seed: ISYPPLHEW (MAGA3_HUMAN)
IPYPPLHEY

SEQ ID NO: 54993 - protein, 9 aa, Artificial Sequence
  Description of Artificial Sequence: Synthetic peptide
  Seed: LVHFLLLKY (MAGA3_HUMAN)
LSHFLLLKL

SEQ ID NO: 54994 - protein, 10 aa, Artificial Sequence
  Description of Artificial Sequence: Synthetic peptide
  Seed: YIFATCLGLS (MAGA3_HUMAN)
YVFATCLGLA

SEQ ID NO: 54995 - protein, 9 aa, Artificial Sequence
  Description of Artificial Sequence: Synthetic peptide
  Seed: SSLPTTMNY (MAGA3_HUMAN)
SRLPTTMNV

SEQ ID NO: 54996 - protein, 9 aa, Artificial Sequence
  Description of Artificial Sequence: Synthetic peptide
  Seed: SSLPTTMNY (MAGA3_HUMAN)
SQLPTTMNR

SEQ ID NO: 54997 - protein, 9 aa, Artificial Sequence
  Description of Artificial Sequence: Synthetic peptide
  Seed: TFPDLESEF (MAGA3_HUMAN)
TLPDLESEF

SEQ ID NO: 54998 - protein, 9 aa, Artificial Sequence
  Description of Artificial Sequence: Synthetic peptide
  Seed: IFSKASSSL (MAGA3_HUMAN)
IASKASSSM

SEQ ID NO: 54999 - protein, 9 aa, Artificial Sequence
  Description of Artificial Sequence: Synthetic peptide
  Seed: ALSRKVAEL (MAGA3_HUMAN)
AISRKVAEF

SEQ ID NO: 55000 - protein, 9 aa, Artificial Sequence
  Description of Artificial Sequence: Synthetic peptide
  Seed: SSLPTTMNY (MAGA3_HUMAN)
SPLPTTMNM

SEQ ID NO: 55001 - protein, 10 aa, Artificial Sequence
  Description of Artificial Sequence: Synthetic peptide
  Seed: KISGGPHISY (MAGA3_HUMAN)
KLSGGPHISR

SEQ ID NO: 55002 - protein, 11 aa, Artificial Sequence
  Description of Artificial Sequence: Synthetic peptide
  Seed: KIWEELSVLEV (MAGA3_HUMAN)
KMWEELSVLEM

SEQ ID NO: 55003 - protein, 9 aa, Artificial Sequence
  Description of Artificial Sequence: Synthetic peptide
  Seed: TQHFVQENY (MAGA3_HUMAN)
TRHFVQENL

SEQ ID NO: 55004 - protein, 9 aa, Artificial Sequence
  Description of Artificial Sequence: Synthetic peptide
  Seed: GLVGAQAPA (MAGA3_HUMAN)
GMVGAQAPA

SEQ ID NO: 55005 - protein, 10 aa, Artificial Sequence
  Description of Artificial Sequence: Synthetic peptide
  Seed: QVPGSDPACY (MAGA3_HUMAN)
QIPGSDPACR

SEQ ID NO: 55006 - protein, 9 aa, Artificial Sequence
  Description of Artificial Sequence: Synthetic peptide
  Seed: SSLPTTMNY (MAGA3_HUMAN)
STLPTTMNK

SEQ ID NO: 55007 - protein, 9 aa, Artificial Sequence
  Description of Artificial Sequence: Synthetic peptide
  Seed: TSYVKVLHH (MAGA3_HUMAN)
TMYVKVLHY

SEQ ID NO: 55008 - protein, 10 aa, Artificial Sequence
  Description of Artificial Sequence: Synthetic peptide
  Seed: WEELSVLEVF (MAGA3_HUMAN)
WTELSVLEVW

SEQ ID NO: 55009 - protein, 8 aa, Artificial Sequence
  Description of Artificial Sequence: Synthetic peptide
  Seed: RALVETSY (MAGA3_HUMAN)
RQLVETSF

SEQ ID NO: 55010 - protein, 10 aa, Artificial Sequence
  Description of Artificial Sequence: Synthetic peptide
  Seed: MNYPLWSQSY (MAGA3_HUMAN)
MYYPLWSQSF

SEQ ID NO: 55011 - protein, 10 aa, Artificial Sequence
  Description of Artificial Sequence: Synthetic peptide
  Seed: WEELSVLEVF (MAGA3_HUMAN)
WNELSVLEVM

SEQ ID NO: 55012 - protein, 10 aa, Artificial Sequence
  Description of Artificial Sequence: Synthetic peptide
  Seed: VIFSKASSSL (MAGA3_HUMAN)
VYFSKASSSI

SEQ ID NO: 55013 - protein, 9 aa, Artificial Sequence
  Description of Artificial Sequence: Synthetic peptide
  Seed: SVLEVFEGR (MAGA3_HUMAN)
SALEVFEGK

SEQ ID NO: 55014 - protein, 10 aa, Artificial Sequence
  Description of Artificial Sequence: Synthetic peptide
  Seed: YIFATCLGLS (MAGA3_HUMAN)
YMFATCLGLL

SEQ ID NO: 55015 - protein, 9 aa, Artificial Sequence
  Description of Artificial Sequence: Synthetic peptide
  Seed: YIFATCLGL (MAGA3_HUMAN)
YAFATCLGH

SEQ ID NO: 55016 - protein, 9 aa, Artificial Sequence
  Description of Artificial Sequence: Synthetic peptide
  Seed: RALVETSYV (MAGA3_HUMAN)
RSLVETSYM

SEQ ID NO: 55017 - protein, 9 aa, Artificial Sequence
  Description of Artificial Sequence: Synthetic peptide
  Seed: SSTLVEVTL (MAGA3_HUMAN)
SRTLVEVTM

SEQ ID NO: 55018 - protein, 10 aa, Artificial Sequence
  Description of Artificial Sequence: Synthetic peptide
  Seed: LGSVVGNWQY (MAGA3_HUMAN)
LTSVVGNWQW

SEQ ID NO: 55019 - protein, 9 aa, Artificial Sequence
  Description of Artificial Sequence: Synthetic peptide
  Seed: MPLEQRSQH (MAGA3_HUMAN)
MALEQRSQY

SEQ ID NO: 55020 - protein, 11 aa, Artificial Sequence
  Description of Artificial Sequence: Synthetic peptide
  Seed: SSLPTTMNYPL (MAGA3_HUMAN)
STLPTTMNYPY

SEQ ID NO: 55021 - protein, 10 aa, Artificial Sequence
  Description of Artificial Sequence: Synthetic peptide
  Seed: LQLVFGIELM (MAGA3_HUMAN)
LVLVFGIELL

SEQ ID NO: 55022 - protein, 9 aa, Artificial Sequence
  Description of Artificial Sequence: Synthetic peptide
  Seed: YPLWSQSYE (MAGA3_HUMAN)
YPLWSQSYM

SEQ ID NO: 55023 - protein, 9 aa, Artificial Sequence
  Description of Artificial Sequence: Synthetic peptide
  Seed: IMPKAGLLI (MAGA3_HUMAN)
IAPKAGLLY

SEQ ID NO: 55024 - protein, 9 aa, Artificial Sequence
  Description of Artificial Sequence: Synthetic peptide
  Seed: RKVAELVHF (MAGA3_HUMAN)
REVAELVHF

SEQ ID NO: 55025 - protein, 10 aa, Artificial Sequence
  Description of Artificial Sequence: Synthetic peptide
  Seed: GHLYIFATCL (MAGA3_HUMAN)
GFLYIFATCV

SEQ ID NO: 55026 - protein, 10 aa, Artificial Sequence
  Description of Artificial Sequence: Synthetic peptide
  Seed: MPKAGLLIIV (MAGA3_HUMAN)
MTKAGLLIIV

SEQ ID NO: 55027 - protein, 9 aa, Artificial Sequence
  Description of Artificial Sequence: Synthetic peptide
  Seed: SSLPTTMNY (MAGA3_HUMAN)
SWLPTTMNL

SEQ ID NO: 55028 - protein, 10 aa, Artificial Sequence
  Description of Artificial Sequence: Synthetic peptide
  Seed: LGSVVGNWQY (MAGA3_HUMAN)
LASVVGNWQW

SEQ ID NO: 55029 - protein, 9 aa, Artificial Sequence
  Description of Artificial Sequence: Synthetic peptide
  Seed: SSLPTTMNY (MAGA3_HUMAN)
SYLPTTMNY

SEQ ID NO: 55030 - protein, 9 aa, Artificial Sequence
  Description of Artificial Sequence: Synthetic peptide
  Seed: LGDPKKLLT (MAGA3_HUMAN)
LVDPKKLLI

SEQ ID NO: 55031 - protein, 8 aa, Artificial Sequence
  Description of Artificial Sequence: Synthetic peptide
  Seed: SGGPHISY (MAGA3_HUMAN)
STGPHISF

SEQ ID NO: 55032 - protein, 10 aa, Artificial Sequence
  Description of Artificial Sequence: Synthetic peptide
  Seed: VDPIGHLYIF (MAGA3_HUMAN)
VHPIGHLYIY

SEQ ID NO: 55033 - protein, 9 aa, Artificial Sequence
  Description of Artificial Sequence: Synthetic peptide
  Seed: LPTTMNYPL (MAGA3_HUMAN)
LITTMNYPY

SEQ ID NO: 55034 - protein, 10 aa, Artificial Sequence
  Description of Artificial Sequence: Synthetic peptide
  Seed: ISYPPLHEWV (MAGA3_HUMAN)
IAYPPLHEWF

SEQ ID NO: 55035 - protein, 9 aa, Artificial Sequence
  Description of Artificial Sequence: Synthetic peptide
  Seed: WQYFFPVIF (MAGA3_HUMAN)
WHYFFPVIM

SEQ ID NO: 55036 - protein, 11 aa, Artificial Sequence
  Description of Artificial Sequence: Synthetic peptide
  Seed: VVGNWQYFFPV (MAGA3_HUMAN)
VMGNWQYFFPI

SEQ ID NO: 55037 - protein, 10 aa, Artificial Sequence
  Description of Artificial Sequence: Synthetic peptide
  Seed: YIFATCLGLS (MAGA3_HUMAN)
YVFATCLGLI

SEQ ID NO: 55038 - protein, 10 aa, Artificial Sequence
  Description of Artificial Sequence: Synthetic peptide
  Seed: GHLYIFATCL (MAGA3_HUMAN)
GSLYIFATCV

SEQ ID NO: 55039 - protein, 10 aa, Artificial Sequence
  Description of Artificial Sequence: Synthetic peptide
  Seed: ASSLPTTMNY (MAGA3_HUMAN)
AVSLPTTMNF

SEQ ID NO: 55040 - protein, 10 aa, Artificial Sequence
  Description of Artificial Sequence: Synthetic peptide
  Seed: ISYPPLHEWV (MAGA3_HUMAN)
IKYPPLHEWF

SEQ ID NO: 55041 - protein, 10 aa, Artificial Sequence
  Description of Artificial Sequence: Synthetic peptide
  Seed: LVFGIELMEV (MAGA3_HUMAN)
LMFGIELMEA

SEQ ID NO: 55042 - protein, 9 aa, Artificial Sequence
  Description of Artificial Sequence: Synthetic peptide
  Seed: YIFATCLGL (MAGA3_HUMAN)
YLFATCLGI

SEQ ID NO: 55043 - protein, 9 aa, Artificial Sequence
  Description of Artificial Sequence: Synthetic peptide
  Seed: KASSSLQLV (MAGA3_HUMAN)
KASSSLQLF

SEQ ID NO: 55044 - protein, 9 aa, Artificial Sequence
  Description of Artificial Sequence: Synthetic peptide
  Seed: FLWGPRALV (MAGA3_HUMAN)
FAWGPRALL

SEQ ID NO: 55045 - protein, 9 aa, Artificial Sequence
  Description of Artificial Sequence: Synthetic peptide
  Seed: GNWQYFFPV (MAGA3_HUMAN)
GMWQYFFPM

SEQ ID NO: 55046 - protein, 9 aa, Artificial Sequence
  Description of Artificial Sequence: Synthetic peptide
  Seed: QSPQGASSL (MAGA3_HUMAN)
QVPQGASSW

SEQ ID NO: 55047 - protein, 8 aa, Artificial Sequence
  Description of Artificial Sequence: Synthetic peptide
  Seed: FPDLESEF (MAGA3_HUMAN)
FIDLESEI

SEQ ID NO: 55048 - protein, 9 aa, Artificial Sequence
  Description of Artificial Sequence: Synthetic peptide
  Seed: LESEFQAAL (MAGA3_HUMAN)
LLSEFQAAA

SEQ ID NO: 55049 - protein, 10 aa, Artificial Sequence
  Description of Artificial Sequence: Synthetic peptide
  Seed: SLQLVFGIEL (MAGA3_HUMAN)
SMQLVFGIEY

SEQ ID NO: 55050 - protein, 9 aa, Artificial Sequence
  Description of Artificial Sequence: Synthetic peptide
  Seed: SYVKVLHHM (MAGA3_HUMAN)
SMVKVLHHF

SEQ ID NO: 55051 - protein, 11 aa, Artificial Sequence
  Description of Artificial Sequence: Synthetic peptide
  Seed: MEVDPIGHLYI (MAGA3_HUMAN)
MEVDPIGHLYW

SEQ ID NO: 55052 - protein, 10 aa, Artificial Sequence
  Description of Artificial Sequence: Synthetic peptide
  Seed: SLPTTMNYPL (MAGA3_HUMAN)
SLPTTMNYPM

SEQ ID NO: 55053 - protein, 10 aa, Artificial Sequence
  Description of Artificial Sequence: Synthetic peptide
  Seed: ISYPPLHEWV (MAGA3_HUMAN)
IKYPPLHEWL

SEQ ID NO: 55054 - protein, 9 aa, Artificial Sequence
  Description of Artificial Sequence: Synthetic peptide
  Seed: ILGDPKKLL (MAGA3_HUMAN)
ILGDPKKLY

SEQ ID NO: 55055 - protein, 10 aa, Artificial Sequence
  Description of Artificial Sequence: Synthetic peptide
  Seed: RKVAELVHFL (MAGA3_HUMAN)
RCVAELVHFL

SEQ ID NO: 55056 - protein, 9 aa, Artificial Sequence
  Description of Artificial Sequence: Synthetic peptide
  Seed: SSTLVEVTL (MAGA3_HUMAN)
SATLVEVTF

SEQ ID NO: 55057 - protein, 10 aa, Artificial Sequence
  Description of Artificial Sequence: Synthetic peptide
  Seed: KVAELVHFLL (MAGA3_HUMAN)
KLAELVHFLN

SEQ ID NO: 55058 - protein, 9 aa, Artificial Sequence
  Description of Artificial Sequence: Synthetic peptide
  Seed: AESPDPPQS (MAGA3_HUMAN)
AESPDPPQI

SEQ ID NO: 55059 - protein, 9 aa, Artificial Sequence
  Description of Artificial Sequence: Synthetic peptide
  Seed: EVDPIGHLY (MAGA3_HUMAN)
EADPIGHLR

SEQ ID NO: 55060 - protein, 9 aa, Artificial Sequence
  Description of Artificial Sequence: Synthetic peptide
  Seed: MEVDPIGHL (MAGA3_HUMAN)
MSVDPIGHM

SEQ ID NO: 55061 - protein, 10 aa, Artificial Sequence
  Description of Artificial Sequence: Synthetic peptide
  Seed: MNYPLWSQSY (MAGA3_HUMAN)
MQYPLWSQSL

SEQ ID NO: 55062 - protein, 9 aa, Artificial Sequence
  Description of Artificial Sequence: Synthetic peptide
  Seed: SEFQAALSR (MAGA3_HUMAN)
SWFQAALSR

SEQ ID NO: 55063 - protein, 11 aa, Artificial Sequence
  Description of Artificial Sequence: Synthetic peptide
  Seed: PHISYPPLHEW (MAGA3_HUMAN)
PKISYPPLHEW

SEQ ID NO: 55064 - protein, 9 aa, Artificial Sequence
  Description of Artificial Sequence: Synthetic peptide
  Seed: SILGDPKKL (MAGA3_HUMAN)
SQLGDPKKL

SEQ ID NO: 55065 - protein, 10 aa, Artificial Sequence
  Description of Artificial Sequence: Synthetic peptide
  Seed: GHLYIFATCL (MAGA3_HUMAN)
GVLYIFATCV

SEQ ID NO: 55066 - protein, 10 aa, Artificial Sequence
  Description of Artificial Sequence: Synthetic peptide
  Seed: KAEMLGSVVG (MAGA3_HUMAN)
KSEMLGSVVV

SEQ ID NO: 55067 - protein, 9 aa, Artificial Sequence
  Description of Artificial Sequence: Synthetic peptide
  Seed: SSSSTLVEV (MAGA3_HUMAN)
SVSSTLVEM

SEQ ID NO: 55068 - protein, 11 aa, Artificial Sequence
  Description of Artificial Sequence: Synthetic peptide
  Seed: REGDCAPEEKI (MAGA3_HUMAN)
RMGDCAPEEKL

SEQ ID NO: 55069 - protein, 10 aa, Artificial Sequence
  Description of Artificial Sequence: Synthetic peptide
  Seed: ISYPPLHEWV (MAGA3_HUMAN)
IEYPPLHEWL

SEQ ID NO: 55070 - protein, 9 aa, Artificial Sequence
  Description of Artificial Sequence: Synthetic peptide
  Seed: NYPLWSQSY (MAGA3_HUMAN)
NAPLWSQSM

SEQ ID NO: 55071 - protein, 10 aa, Artificial Sequence
  Description of Artificial Sequence: Synthetic peptide
  Seed: RKVAELVHFL (MAGA3_HUMAN)
RPVAELVHFI

SEQ ID NO: 55072 - protein, 9 aa, Artificial Sequence
  Description of Artificial Sequence: Synthetic peptide
  Seed: SSLQLVFGI (MAGA3_HUMAN)
SSLQLVFGF

SEQ ID NO: 55073 - protein, 10 aa, Artificial Sequence
  Description of Artificial Sequence: Synthetic peptide
  Seed: MNYPLWSQSY (MAGA3_HUMAN)
MIYPLWSQSI

SEQ ID NO: 55074 - protein, 10 aa, Artificial Sequence
  Description of Artificial Sequence: Synthetic peptide
  Seed: LGSVVGNWQY (MAGA3_HUMAN)
LYSVVGNWQY

SEQ ID NO: 55075 - protein, 9 aa, Artificial Sequence
  Description of Artificial Sequence: Synthetic peptide
  Seed: ISYPPLHEW (MAGA3_HUMAN)
IPYPPLHEF

SEQ ID NO: 55076 - protein, 10 aa, Artificial Sequence
  Description of Artificial Sequence: Synthetic peptide
  Seed: MEVDPIGHLY (MAGA3_HUMAN)
MRVDPIGHLM

SEQ ID NO: 55077 - protein, 9 aa, Artificial Sequence
  Description of Artificial Sequence: Synthetic peptide
  Seed: IMPKAGLLI (MAGA3_HUMAN)
IIPKAGLLI

SEQ ID NO: 55078 - protein, 9 aa, Artificial Sequence
  Description of Artificial Sequence: Synthetic peptide
  Seed: FATCLGLSY (MAGA3_HUMAN)
FTTCLGLSL

SEQ ID NO: 55079 - protein, 10 aa, Artificial Sequence
  Description of Artificial Sequence: Synthetic peptide
  Seed: KASSSLQLVF (MAGA3_HUMAN)
KQSSSLQLVW

SEQ ID NO: 55080 - protein, 11 aa, Artificial Sequence
  Description of Artificial Sequence: Synthetic peptide
  Seed: REGDCAPEEKI (MAGA3_HUMAN)
RVGDCAPEEKL

SEQ ID NO: 55081 - protein, 9 aa, Artificial Sequence
  Description of Artificial Sequence: Synthetic peptide
  Seed: KVAELVHFL (MAGA3_HUMAN)
KHAELVHFY

SEQ ID NO: 55082 - protein, 10 aa, Artificial Sequence
  Description of Artificial Sequence: Synthetic peptide
  Seed: WEELSVLEVF (MAGA3_HUMAN)
WPELSVLEVL

SEQ ID NO: 55083 - protein, 11 aa, Artificial Sequence
  Description of Artificial Sequence: Synthetic peptide
  Seed: ISYPPLHEWVL (MAGA3_HUMAN)
IYYPPLHEWVM

SEQ ID NO: 55084 - protein, 9 aa, Artificial Sequence
  Description of Artificial Sequence: Synthetic peptide
  Seed: SSLPTTMNY (MAGA3_HUMAN)
SALPTTMNM

SEQ ID NO: 55085 - protein, 11 aa, Artificial Sequence
  Description of Artificial Sequence: Synthetic peptide
  Seed: KVAELVHFLLL (MAGA3_HUMAN)
KLAELVHFLLG

SEQ ID NO: 55086 - protein, 9 aa, Artificial Sequence
  Description of Artificial Sequence: Synthetic peptide
  Seed: GSDPACYEF (MAGA3_HUMAN)
GYDPACYEI

SEQ ID NO: 55087 - protein, 9 aa, Artificial Sequence
  Description of Artificial Sequence: Synthetic peptide
  Seed: SSTLVEVTL (MAGA3_HUMAN)
SVTLVEVTF

SEQ ID NO: 55088 - protein, 10 aa, Artificial Sequence
  Description of Artificial Sequence: Synthetic peptide
  Seed: HISYPPLHEW (MAGA3_HUMAN)
HESYPPLHEF

SEQ ID NO: 55089 - protein, 10 aa, Artificial Sequence
  Description of Artificial Sequence: Synthetic peptide
  Seed: TSYVKVLHHM (MAGA3_HUMAN)
THYVKVLHHF

SEQ ID NO: 55090 - protein, 10 aa, Artificial Sequence
  Description of Artificial Sequence: Synthetic peptide
  Seed: MEVDPIGHLY (MAGA3_HUMAN)
MRVDPIGHLF

SEQ ID NO: 55091 - protein, 9 aa, Artificial Sequence
  Description of Artificial Sequence: Synthetic peptide
  Seed: YIFATCLGL (MAGA3_HUMAN)
YYFATCLGL

SEQ ID NO: 55092 - protein, 9 aa, Artificial Sequence
  Description of Artificial Sequence: Synthetic peptide
  Seed: EELSVLEVF (MAGA3_HUMAN)
EELSVLEVY

SEQ ID NO: 55093 - protein, 10 aa, Artificial Sequence
  Description of Artificial Sequence: Synthetic peptide
  Seed: RQVPGSDPAC (MAGA3_HUMAN)
RQVPGSDPAY

SEQ ID NO: 55094 - protein, 10 aa, Artificial Sequence
  Description of Artificial Sequence: Synthetic peptide
  Seed: NWQYFFPVIF (MAGA3_HUMAN)
NEQYFFPVIY

SEQ ID NO: 55095 - protein, 8 aa, Artificial Sequence
  Description of Artificial Sequence: Synthetic peptide
  Seed: EVDPIGHL (MAGA3_HUMAN)
ESDPIGHL

SEQ ID NO: 55096 - protein, 10 aa, Artificial Sequence
  Description of Artificial Sequence: Synthetic peptide
  Seed: SRKVAELVHF (MAGA3_HUMAN)
SQKVAELVHY

SEQ ID NO: 55097 - protein, 9 aa, Artificial Sequence
  Description of Artificial Sequence: Synthetic peptide
  Seed: YIFATCLGL (MAGA3_HUMAN)
YLFATCLGR

SEQ ID NO: 55098 - protein, 11 aa, Artificial Sequence
  Description of Artificial Sequence: Synthetic peptide
  Seed: AEMLGSVVGNW (MAGA3_HUMAN)
AEMLGSVVGNL

SEQ ID NO: 55099 - protein, 9 aa, Artificial Sequence
  Description of Artificial Sequence: Synthetic peptide
  Seed: KVAELVHFL (MAGA3_HUMAN)
KMAELVHFC

SEQ ID NO: 55100 - protein, 10 aa, Artificial Sequence
  Description of Artificial Sequence: Synthetic peptide
  Seed: YIFATCLGLS (MAGA3_HUMAN)
YIFATCLGLL

SEQ ID NO: 55101 - protein, 10 aa, Artificial Sequence
  Description of Artificial Sequence: Synthetic peptide
  Seed: ASSLPTTMNY (MAGA3_HUMAN)
ANSLPTTMNK

SEQ ID NO: 55102 - protein, 10 aa, Artificial Sequence
  Description of Artificial Sequence: Synthetic peptide
  Seed: FSKASSSLQL (MAGA3_HUMAN)
FFKASSSLQM

SEQ ID NO: 55103 - protein, 10 aa, Artificial Sequence
  Description of Artificial Sequence: Synthetic peptide
  Seed: MNYPLWSQSY (MAGA3_HUMAN)
MVYPLWSQSW

SEQ ID NO: 55104 - protein, 9 aa, Artificial Sequence
  Description of Artificial Sequence: Synthetic peptide
  Seed: EAASSSSTL (MAGA3_HUMAN)
EPASSSSTM

SEQ ID NO: 55105 - protein, 10 aa, Artificial Sequence
  Description of Artificial Sequence: Synthetic peptide
  Seed: ETSYVKVLHH (MAGA3_HUMAN)
ESSYVKVLHK

SEQ ID NO: 55106 - protein, 10 aa, Artificial Sequence
  Description of Artificial Sequence: Synthetic peptide
  Seed: QYFFPVIFSK (MAGA3_HUMAN)
QLFFPVIFSK

SEQ ID NO: 55107 - protein, 11 aa, Artificial Sequence
  Description of Artificial Sequence: Synthetic peptide
  Seed: AEMLGSVVGNW (MAGA3_HUMAN)
ATMLGSVVGNF

SEQ ID NO: 55108 - protein, 10 aa, Artificial Sequence
  Description of Artificial Sequence: Synthetic peptide
  Seed: VIFSKASSSL (MAGA3_HUMAN)
VAFSKASSSM

SEQ ID NO: 55109 - protein, 9 aa, Artificial Sequence
  Description of Artificial Sequence: Synthetic peptide
  Seed: QHCKPEEGL (MAGA3_HUMAN)
QHCKPEEGF

SEQ ID NO: 55110 - protein, 10 aa, Artificial Sequence
  Description of Artificial Sequence: Synthetic peptide
  Seed: MVKISGGPHI (MAGA3_HUMAN)
MHKISGGPHY

SEQ ID NO: 55111 - protein, 10 aa, Artificial Sequence
  Description of Artificial Sequence: Synthetic peptide
  Seed: MNYPLWSQSY (MAGA3_HUMAN)
MKYPLWSQSW

SEQ ID NO: 55112 - protein, 9 aa, Artificial Sequence
  Description of Artificial Sequence: Synthetic peptide
  Seed: VFEGREDSI (MAGA3_HUMAN)
VAEGREDSM

SEQ ID NO: 55113 - protein, 9 aa, Artificial Sequence
  Description of Artificial Sequence: Synthetic peptide
  Seed: RALVETSYV (MAGA3_HUMAN)
RYLVETSYK

SEQ ID NO: 55114 - protein, 9 aa, Artificial Sequence
  Description of Artificial Sequence: Synthetic peptide
  Seed: RALVETSYV (MAGA3_HUMAN)
RVLVETSYM

SEQ ID NO: 55115 - protein, 11 aa, Artificial Sequence
  Description of Artificial Sequence: Synthetic peptide
  Seed: KIWEELSVLEV (MAGA3_HUMAN)
KQWEELSVLEV

SEQ ID NO: 55116 - protein, 9 aa, Artificial Sequence
  Description of Artificial Sequence: Synthetic peptide
  Seed: QIMPKAGLL (MAGA3_HUMAN)
QQMPKAGLF

SEQ ID NO: 55117 - protein, 10 aa, Artificial Sequence
  Description of Artificial Sequence: Synthetic peptide
  Seed: WEELSVLEVF (MAGA3_HUMAN)
WLELSVLEVW

SEQ ID NO: 55118 - protein, 10 aa, Artificial Sequence
  Description of Artificial Sequence: Synthetic peptide
  Seed: ASSLPTTMNY (MAGA3_HUMAN)
AQSLPTTMNF

SEQ ID NO: 55119 - protein, 10 aa, Artificial Sequence
  Description of Artificial Sequence: Synthetic peptide
  Seed: SVVGNWQYFF (MAGA3_HUMAN)
SQVGNWQYFY

SEQ ID NO: 55120 - protein, 9 aa, Artificial Sequence
  Description of Artificial Sequence: Synthetic peptide
  Seed: ISGGPHISY (MAGA3_HUMAN)
IWGGPHISM

SEQ ID NO: 55121 - protein, 9 aa, Artificial Sequence
  Description of Artificial Sequence: Synthetic peptide
  Seed: VTLGEVPAA (MAGA3_HUMAN)
VLLGEVPAM

SEQ ID NO: 55122 - protein, 10 aa, Artificial Sequence
  Description of Artificial Sequence: Synthetic peptide
  Seed: ETSYVKVLHH (MAGA3_HUMAN)
ETSYVKVLHR

SEQ ID NO: 55123 - protein, 10 aa, Artificial Sequence
  Description of Artificial Sequence: Synthetic peptide
  Seed: ASSSSTLVEV (MAGA3_HUMAN)
AVSSSTLVEA

SEQ ID NO: 55124 - protein, 9 aa, Artificial Sequence
  Description of Artificial Sequence: Synthetic peptide
  Seed: ISYPPLHEW (MAGA3_HUMAN)
IIYPPLHEV

SEQ ID NO: 55125 - protein, 9 aa, Artificial Sequence
  Description of Artificial Sequence: Synthetic peptide
  Seed: KVAELVHFL (MAGA3_HUMAN)
KRAELVHFF

SEQ ID NO: 55126 - protein, 10 aa, Artificial Sequence
  Description of Artificial Sequence: Synthetic peptide
  Seed: KASSSLQLVF (MAGA3_HUMAN)
KISSSLQLVM

SEQ ID NO: 55127 - protein, 9 aa, Artificial Sequence
  Description of Artificial Sequence: Synthetic peptide
  Seed: QEEEGPSTF (MAGA3_HUMAN)
QEEEGPSTW

SEQ ID NO: 55128 - protein, 9 aa, Artificial Sequence
  Description of Artificial Sequence: Synthetic peptide
  Seed: YFFPVIFSK (MAGA3_HUMAN)
YGFPVIFSY

SEQ ID NO: 55129 - protein, 10 aa, Artificial Sequence
  Description of Artificial Sequence: Synthetic peptide
  Seed: RKVAELVHFL (MAGA3_HUMAN)
REVAELVHFI

SEQ ID NO: 55130 - protein, 9 aa, Artificial Sequence
  Description of Artificial Sequence: Synthetic peptide
  Seed: EARGEALGL (MAGA3_HUMAN)
EVRGEALGK

SEQ ID NO: 55131 - protein, 10 aa, Artificial Sequence
  Description of Artificial Sequence: Synthetic peptide
  Seed: ASSLPTTMNY (MAGA3_HUMAN)
ADSLPTTMNK

SEQ ID NO: 55132 - protein, 9 aa, Artificial Sequence
  Description of Artificial Sequence: Synthetic peptide
  Seed: FATCLGLSY (MAGA3_HUMAN)
FKTCLGLSL

SEQ ID NO: 55133 - protein, 11 aa, Artificial Sequence
  Description of Artificial Sequence: Synthetic peptide
  Seed: QHFVQENYLEY (MAGA3_HUMAN)
QQFVQENYLEY

SEQ ID NO: 55134 - protein, 9 aa, Artificial Sequence
  Description of Artificial Sequence: Synthetic peptide
  Seed: FQAALSRKV (MAGA3_HUMAN)
FQAALSRKF

SEQ ID NO: 55135 - protein, 10 aa, Artificial Sequence
  Description of Artificial Sequence: Synthetic peptide
  Seed: LGSVVGNWQY (MAGA3_HUMAN)
LESVVGNWQF

SEQ ID NO: 55136 - protein, 9 aa, Artificial Sequence
  Description of Artificial Sequence: Synthetic peptide
  Seed: SSSSTLVEV (MAGA3_HUMAN)
SASSTLVEM

SEQ ID NO: 55137 - protein, 10 aa, Artificial Sequence
  Description of Artificial Sequence: Synthetic peptide
  Seed: YEDSSNQEEE (MAGA3_HUMAN)
YEDSSNQEEA

SEQ ID NO: 55138 - protein, 9 aa, Artificial Sequence
  Description of Artificial Sequence: Synthetic peptide
  Seed: FATCLGLSY (MAGA3_HUMAN)
FATCLGLSV

SEQ ID NO: 55139 - protein, 10 aa, Artificial Sequence
  Description of Artificial Sequence: Synthetic peptide
  Seed: KVAELVHFLL (MAGA3_HUMAN)
KLAELVHFLF

SEQ ID NO: 55140 - protein, 9 aa, Artificial Sequence
  Description of Artificial Sequence: Synthetic peptide
  Seed: MEVDPIGHL (MAGA3_HUMAN)
MAVDPIGHV

SEQ ID NO: 55141 - protein, 9 aa, Artificial Sequence
  Description of Artificial Sequence: Synthetic peptide
  Seed: RALVETSYV (MAGA3_HUMAN)
RMLVETSYY

SEQ ID NO: 55142 - protein, 10 aa, Artificial Sequence
  Description of Artificial Sequence: Synthetic peptide
  Seed: YPPLHEWVLR (MAGA3_HUMAN)
YFPLHEWVLR

SEQ ID NO: 55143 - protein, 9 aa, Artificial Sequence
  Description of Artificial Sequence: Synthetic peptide
  Seed: TSYVKVLHH (MAGA3_HUMAN)
TVYVKVLHL

SEQ ID NO: 55144 - protein, 9 aa, Artificial Sequence
  Description of Artificial Sequence: Synthetic peptide
  Seed: SSSSTLVEV (MAGA3_HUMAN)
SISSTLVEV

SEQ ID NO: 55145 - protein, 11 aa, Artificial Sequence
  Description of Artificial Sequence: Synthetic peptide
  Seed: RQVPGSDPACY (MAGA3_HUMAN)
RLVPGSDPACR

SEQ ID NO: 55146 - protein, 9 aa, Artificial Sequence
  Description of Artificial Sequence: Synthetic peptide
  Seed: HLYIFATCL (MAGA3_HUMAN)
HQYIFATCH

SEQ ID NO: 55147 - protein, 9 aa, Artificial Sequence
  Description of Artificial Sequence: Synthetic peptide
  Seed: NQIMPKAGL (MAGA3_HUMAN)
NEIMPKAGV

SEQ ID NO: 55148 - protein, 10 aa, Artificial Sequence
  Description of Artificial Sequence: Synthetic peptide
  Seed: RKVAELVHFL (MAGA3_HUMAN)
RQVAELVHFY

SEQ ID NO: 55149 - protein, 10 aa, Artificial Sequence
  Description of Artificial Sequence: Synthetic peptide
  Seed: KISGGPHISY (MAGA3_HUMAN)
KASGGPHISL

SEQ ID NO: 55150 - protein, 9 aa, Artificial Sequence
  Description of Artificial Sequence: Synthetic peptide
  Seed: HLYIFATCL (MAGA3_HUMAN)
HSYIFATCY

SEQ ID NO: 55151 - protein, 10 aa, Artificial Sequence
  Description of Artificial Sequence: Synthetic peptide
  Seed: AALSRKVAEL (MAGA3_HUMAN)
APLSRKVAEV

SEQ ID NO: 55152 - protein, 9 aa, Artificial Sequence
  Description of Artificial Sequence: Synthetic peptide
  Seed: ISYPPLHEW (MAGA3_HUMAN)
IYYPPLHEW

SEQ ID NO: 55153 - protein, 9 aa, Artificial Sequence
  Description of Artificial Sequence: Synthetic peptide
  Seed: GSVVGNWQY (MAGA3_HUMAN)
GGVVGNWQW

SEQ ID NO: 55154 - protein, 9 aa, Artificial Sequence
  Description of Artificial Sequence: Synthetic peptide
  Seed: SPQGASSLP (MAGA3_HUMAN)
SPQGASSLA

SEQ ID NO: 55155 - protein, 8 aa, Artificial Sequence
  Description of Artificial Sequence: Synthetic peptide
  Seed: YVKVLHHM (MAGA3_HUMAN)
YSKVLHHF

SEQ ID NO: 55156 - protein, 10 aa, Artificial Sequence
  Description of Artificial Sequence: Synthetic peptide
  Seed: KVAELVHFLL (MAGA3_HUMAN)
KSAELVHFLW

SEQ ID NO: 55157 - protein, 10 aa, Artificial Sequence
  Description of Artificial Sequence: Synthetic peptide
  Seed: KASSSLQLVF (MAGA3_HUMAN)
KVSSSLQLVY

SEQ ID NO: 55158 - protein, 9 aa, Artificial Sequence
  Description of Artificial Sequence: Synthetic peptide
  Seed: KVAELVHFL (MAGA3_HUMAN)
KFAELVHFM

SEQ ID NO: 55159 - protein, 9 aa, Artificial Sequence
  Description of Artificial Sequence: Synthetic peptide
  Seed: ASSSLQLVF (MAGA3_HUMAN)
AASSLQLVL

SEQ ID NO: 55160 - protein, 9 aa, Artificial Sequence
  Description of Artificial Sequence: Synthetic peptide
  Seed: HLYIFATCL (MAGA3_HUMAN)
HLYIFATCI

SEQ ID NO: 55161 - protein, 9 aa, Artificial Sequence
  Description of Artificial Sequence: Synthetic peptide
  Seed: ALVETSYVK (MAGA3_HUMAN)
AIVETSYVR

SEQ ID NO: 55162 - protein, 10 aa, Artificial Sequence
  Description of Artificial Sequence: Synthetic peptide
  Seed: STFPDLESEF (MAGA3_HUMAN)
SMFPDLESEL

SEQ ID NO: 55163 - protein, 10 aa, Artificial Sequence
  Description of Artificial Sequence: Synthetic peptide
  Seed: MNYPLWSQSY (MAGA3_HUMAN)
MEYPLWSQSI

SEQ ID NO: 55164 - protein, 9 aa, Artificial Sequence
  Description of Artificial Sequence: Synthetic peptide
  Seed: QLVFGIELM (MAGA3_HUMAN)
QLVFGIELV

SEQ ID NO: 55165 - protein, 9 aa, Artificial Sequence
  Description of Artificial Sequence: Synthetic peptide
  Seed: ALVETSYVK (MAGA3_HUMAN)
AVVETSYVR

SEQ ID NO: 55166 - protein, 9 aa, Artificial Sequence
  Description of Artificial Sequence: Synthetic peptide
  Seed: IMPKAGLLI (MAGA3_HUMAN)
ILPKAGLLM

SEQ ID NO: 55167 - protein, 10 aa, Artificial Sequence
  Description of Artificial Sequence: Synthetic peptide
  Seed: LYIFATCLGL (MAGA3_HUMAN)
LYIFATCLGV

SEQ ID NO: 55168 - protein, 9 aa, Artificial Sequence
  Description of Artificial Sequence: Synthetic peptide
  Seed: HLYIFATCL (MAGA3_HUMAN)
HNYIFATCY

SEQ ID NO: 55169 - protein, 9 aa, Artificial Sequence
  Description of Artificial Sequence: Synthetic peptide
  Seed: EAASSSSTL (MAGA3_HUMAN)
EQASSSSTY

SEQ ID NO: 55170 - protein, 10 aa, Artificial Sequence
  Description of Artificial Sequence: Synthetic peptide
  Seed: ELVHFLLLKY (MAGA3_HUMAN)
ETVHFLLLKK

SEQ ID NO: 55171 - protein, 10 aa, Artificial Sequence
  Description of Artificial Sequence: Synthetic peptide
  Seed: SLPTTMNYPL (MAGA3_HUMAN)
SIPTTMNYPM

SEQ ID NO: 55172 - protein, 9 aa, Artificial Sequence
  Description of Artificial Sequence: Synthetic peptide
  Seed: GNWQYFFPV (MAGA3_HUMAN)
GVWQYFFPA

SEQ ID NO: 55173 - protein, 9 aa, Artificial Sequence
  Description of Artificial Sequence: Synthetic peptide
  Seed: ALSRKVAEL (MAGA3_HUMAN)
AISRKVAEV

SEQ ID NO: 55174 - protein, 10 aa, Artificial Sequence
  Description of Artificial Sequence: Synthetic peptide
  Seed: SLPTTMNYPL (MAGA3_HUMAN)
SIPTTMNYPL

SEQ ID NO: 55175 - protein, 9 aa, Artificial Sequence
  Description of Artificial Sequence: Synthetic peptide
  Seed: SVVGNWQYF (MAGA3_HUMAN)
SYVGNWQYV

SEQ ID NO: 55176 - protein, 9 aa, Artificial Sequence
  Description of Artificial Sequence: Synthetic peptide
  Seed: KAGLLIIVL (MAGA3_HUMAN)
KQGLLIIVY

SEQ ID NO: 55177 - protein, 10 aa, Artificial Sequence
  Description of Artificial Sequence: Synthetic peptide
  Seed: DLESEFQAAL (MAGA3_HUMAN)
DCESEFQAAY

SEQ ID NO: 55178 - protein, 9 aa, Artificial Sequence
  Description of Artificial Sequence: Synthetic peptide
  Seed: SSLPTTMNY (MAGA3_HUMAN)
SRLPTTMNL

SEQ ID NO: 55179 - protein, 10 aa, Artificial Sequence
  Description of Artificial Sequence: Synthetic peptide
  Seed: FLWGPRALVE (MAGA3_HUMAN)
FLWGPRALVA

SEQ ID NO: 55180 - protein, 11 aa, Artificial Sequence
  Description of Artificial Sequence: Synthetic peptide
  Seed: HISYPPLHEWV (MAGA3_HUMAN)
HASYPPLHEWW

SEQ ID NO: 55181 - protein, 10 aa, Artificial Sequence
  Description of Artificial Sequence: Synthetic peptide
  Seed: KISGGPHISY (MAGA3_HUMAN)
KQSGGPHISI

SEQ ID NO: 55182 - protein, 9 aa, Artificial Sequence
  Description of Artificial Sequence: Synthetic peptide
  Seed: IMPKAGLLI (MAGA3_HUMAN)
IIPKAGLLV

SEQ ID NO: 55183 - protein, 9 aa, Artificial Sequence
  Description of Artificial Sequence: Synthetic peptide
  Seed: LSRKVAELV (MAGA3_HUMAN)
LARKVAELL

SEQ ID NO: 55184 - protein, 10 aa, Artificial Sequence
  Description of Artificial Sequence: Synthetic peptide
  Seed: ISYPPLHEWV (MAGA3_HUMAN)
IHYPPLHEWF

SEQ ID NO: 55185 - protein, 11 aa, Artificial Sequence
  Description of Artificial Sequence: Synthetic peptide
  Seed: LSRKVAELVHF (MAGA3_HUMAN)
LARKVAELVHW

SEQ ID NO: 55186 - protein, 9 aa, Artificial Sequence
  Description of Artificial Sequence: Synthetic peptide
  Seed: LGDPKKLLT (MAGA3_HUMAN)
LIDPKKLLV

SEQ ID NO: 55187 - protein, 10 aa, Artificial Sequence
  Description of Artificial Sequence: Synthetic peptide
  Seed: IFATCLGLSY (MAGA3_HUMAN)
IAATCLGLSW

SEQ ID NO: 55188 - protein, 10 aa, Artificial Sequence
  Description of Artificial Sequence: Synthetic peptide
  Seed: KISGGPHISY (MAGA3_HUMAN)
KISGGPHISK

SEQ ID NO: 55189 - protein, 10 aa, Artificial Sequence
  Description of Artificial Sequence: Synthetic peptide
  Seed: STFPDLESEF (MAGA3_HUMAN)
SAFPDLESEM

SEQ ID NO: 55190 - protein, 9 aa, Artificial Sequence
  Description of Artificial Sequence: Synthetic peptide
  Seed: LESEFQAAL (MAGA3_HUMAN)
LKSEFQAAL

SEQ ID NO: 55191 - protein, 9 aa, Artificial Sequence
  Description of Artificial Sequence: Synthetic peptide
  Seed: SSLQLVFGI (MAGA3_HUMAN)
SMLQLVFGL

SEQ ID NO: 55192 - protein, 10 aa, Artificial Sequence
  Description of Artificial Sequence: Synthetic peptide
  Seed: FLWGPRALVE (MAGA3_HUMAN)
FLWGPRALVY

SEQ ID NO: 55193 - protein, 9 aa, Artificial Sequence
  Description of Artificial Sequence: Synthetic peptide
  Seed: ILGDPKKLL (MAGA3_HUMAN)
IVGDPKKLL

SEQ ID NO: 55194 - protein, 10 aa, Artificial Sequence
  Description of Artificial Sequence: Synthetic peptide
  Seed: MPKAGLLIIV (MAGA3_HUMAN)
MPKAGLLIIF

SEQ ID NO: 55195 - protein, 9 aa, Artificial Sequence
  Description of Artificial Sequence: Synthetic peptide
  Seed: ALSRKVAEL (MAGA3_HUMAN)
AFSRKVAEY

SEQ ID NO: 55196 - protein, 10 aa, Artificial Sequence
  Description of Artificial Sequence: Synthetic peptide
  Seed: LYIFATCLGL (MAGA3_HUMAN)
LPIFATCLGV

SEQ ID NO: 55197 - protein, 10 aa, Artificial Sequence
  Description of Artificial Sequence: Synthetic peptide
  Seed: HISYPPLHEW (MAGA3_HUMAN)
HDSYPPLHEF

SEQ ID NO: 55198 - protein, 9 aa, Artificial Sequence
  Description of Artificial Sequence: Synthetic peptide
  Seed: SYVKVLHHM (MAGA3_HUMAN)
SNVKVLHHY

SEQ ID NO: 55199 - protein, 9 aa, Artificial Sequence
  Description of Artificial Sequence: Synthetic peptide
  Seed: YFFPVIFSK (MAGA3_HUMAN)
YQFPVIFSR

SEQ ID NO: 55200 - protein, 9 aa, Artificial Sequence
  Description of Artificial Sequence: Synthetic peptide
  Seed: SILGDPKKL (MAGA3_HUMAN)
SYLGDPKKM

SEQ ID NO: 55201 - protein, 9 aa, Artificial Sequence
  Description of Artificial Sequence: Synthetic peptide
  Seed: LESEFQAAL (MAGA3_HUMAN)
LASEFQAAM

SEQ ID NO: 55202 - protein, 9 aa, Artificial Sequence
  Description of Artificial Sequence: Synthetic peptide
  Seed: KVAELVHFL (MAGA3_HUMAN)
KVAELVHFY

SEQ ID NO: 55203 - protein, 10 aa, Artificial Sequence
  Description of Artificial Sequence: Synthetic peptide
  Seed: LGSVVGNWQY (MAGA3_HUMAN)
LVSVVGNWQF

SEQ ID NO: 55204 - protein, 9 aa, Artificial Sequence
  Description of Artificial Sequence: Synthetic peptide
  Seed: NQIMPKAGL (MAGA3_HUMAN)
NEIMPKAGM

SEQ ID NO: 55205 - protein, 10 aa, Artificial Sequence
  Description of Artificial Sequence: Synthetic peptide
  Seed: KISGGPHISY (MAGA3_HUMAN)
KYSGGPHISF

SEQ ID NO: 55206 - protein, 9 aa, Artificial Sequence
  Description of Artificial Sequence: Synthetic peptide
  Seed: SSLPTTMNY (MAGA3_HUMAN)
SGLPTTMNY

SEQ ID NO: 55207 - protein, 10 aa, Artificial Sequence
  Description of Artificial Sequence: Synthetic peptide
  Seed: LGLVGAQAPA (MAGA3_HUMAN)
LLLVGAQAPI

SEQ ID NO: 55208 - protein, 10 aa, Artificial Sequence
  Description of Artificial Sequence: Synthetic peptide
  Seed: RQVPGSDPAC (MAGA3_HUMAN)
RLVPGSDPAL

SEQ ID NO: 55209 - protein, 10 aa, Artificial Sequence
  Description of Artificial Sequence: Synthetic peptide
  Seed: NWQYFFPVIF (MAGA3_HUMAN)
NKQYFFPVIY

SEQ ID NO: 55210 - protein, 11 aa, Artificial Sequence
  Description of Artificial Sequence: Synthetic peptide
  Seed: SKASSSLQLVF (MAGA3_HUMAN)
SQASSSLQLVW

SEQ ID NO: 55211 - protein, 10 aa, Artificial Sequence
  Description of Artificial Sequence: Synthetic peptide
  Seed: FSKASSSLQL (MAGA3_HUMAN)
FQKASSSLQL

SEQ ID NO: 55212 - protein, 9 aa, Artificial Sequence
  Description of Artificial Sequence: Synthetic peptide
  Seed: IMPKAGLLI (MAGA3_HUMAN)
ITPKAGLLI

SEQ ID NO: 55213 - protein, 9 aa, Artificial Sequence
  Description of Artificial Sequence: Synthetic peptide
  Seed: GPHISYPPL (MAGA3_HUMAN)
GPHISYPPM

SEQ ID NO: 55214 - protein, 9 aa, Artificial Sequence
  Description of Artificial Sequence: Synthetic peptide
  Seed: VFGIELMEV (MAGA3_HUMAN)
VYGIELMEF

SEQ ID NO: 55215 - protein, 8 aa, Artificial Sequence
  Description of Artificial Sequence: Synthetic peptide
  Seed: YPLWSQSY (MAGA3_HUMAN)
YYLWSQSL

SEQ ID NO: 55216 - protein, 10 aa, Artificial Sequence
  Description of Artificial Sequence: Synthetic peptide
  Seed: QIMPKAGLLI (MAGA3_HUMAN)
QMMPKAGLLV

SEQ ID NO: 55217 - protein, 11 aa, Artificial Sequence
  Description of Artificial Sequence: Synthetic peptide
  Seed: HCKPEEGLEAR (MAGA3_HUMAN)
HYKPEEGLEAR

SEQ ID NO: 55218 - protein, 9 aa, Artificial Sequence
  Description of Artificial Sequence: Synthetic peptide
  Seed: VFEGREDSI (MAGA3_HUMAN)
VSEGREDSL

SEQ ID NO: 55219 - protein, 9 aa, Artificial Sequence
  Description of Artificial Sequence: Synthetic peptide
  Seed: MPKAGLLII (MAGA3_HUMAN)
MTKAGLLIF

SEQ ID NO: 55220 - protein, 9 aa, Artificial Sequence
  Description of Artificial Sequence: Synthetic peptide
  Seed: SSTLVEVTL (MAGA3_HUMAN)
SQTLVEVTY

SEQ ID NO: 55221 - protein, 9 aa, Artificial Sequence
  Description of Artificial Sequence: Synthetic peptide
  Seed: RQVPGSDPA (MAGA3_HUMAN)
RAVPGSDPV

SEQ ID NO: 55222 - protein, 10 aa, Artificial Sequence
  Description of Artificial Sequence: Synthetic peptide
  Seed: KVAELVHFLL (MAGA3_HUMAN)
KIAELVHFLA

SEQ ID NO: 55223 - protein, 10 aa, Artificial Sequence
  Description of Artificial Sequence: Synthetic peptide
  Seed: LYIFATCLGL (MAGA3_HUMAN)
LLIFATCLGA

SEQ ID NO: 55224 - protein, 10 aa, Artificial Sequence
  Description of Artificial Sequence: Synthetic peptide
  Seed: QYFFPVIFSK (MAGA3_HUMAN)
QQFFPVIFSR

SEQ ID NO: 55225 - protein, 10 aa, Artificial Sequence
  Description of Artificial Sequence: Synthetic peptide
  Seed: SLPTTMNYPL (MAGA3_HUMAN)
SNPTTMNYPM

SEQ ID NO: 55226 - protein, 10 aa, Artificial Sequence
  Description of Artificial Sequence: Synthetic peptide
  Seed: VDPIGHLYIF (MAGA3_HUMAN)
VHPIGHLYIW

SEQ ID NO: 55227 - protein, 9 aa, Artificial Sequence
  Description of Artificial Sequence: Synthetic peptide
  Seed: QLVFGIELM (MAGA3_HUMAN)
QQVFGIELM

SEQ ID NO: 55228 - protein, 9 aa, Artificial Sequence
  Description of Artificial Sequence: Synthetic peptide
  Seed: TSYVKVLHH (MAGA3_HUMAN)
TSYVKVLHK

SEQ ID NO: 55229 - protein, 9 aa, Artificial Sequence
  Description of Artificial Sequence: Synthetic peptide
  Seed: ISGGPHISY (MAGA3_HUMAN)
IRGGPHISL

SEQ ID NO: 55230 - protein, 10 aa, Artificial Sequence
  Description of Artificial Sequence: Synthetic peptide
  Seed: LGLVGAQAPA (MAGA3_HUMAN)
LQLVGAQAPV

SEQ ID NO: 55231 - protein, 10 aa, Artificial Sequence
  Description of Artificial Sequence: Synthetic peptide
  Seed: KISGGPHISY (MAGA3_HUMAN)
KSSGGPHISM

SEQ ID NO: 55232 - protein, 9 aa, Artificial Sequence
  Description of Artificial Sequence: Synthetic peptide
  Seed: KVLHHMVKI (MAGA3_HUMAN)
KVLHHMVKV

SEQ ID NO: 55233 - protein, 10 aa, Artificial Sequence
  Description of Artificial Sequence: Synthetic peptide
  Seed: SLPTTMNYPL (MAGA3_HUMAN)
SCPTTMNYPM

SEQ ID NO: 55234 - protein, 9 aa, Artificial Sequence
  Description of Artificial Sequence: Synthetic peptide
  Seed: YFFPVIFSK (MAGA3_HUMAN)
YLFPVIFSI

SEQ ID NO: 55235 - protein, 9 aa, Artificial Sequence
  Description of Artificial Sequence: Synthetic peptide
  Seed: LSRKVAELV (MAGA3_HUMAN)
LTRKVAELY

SEQ ID NO: 55236 - protein, 10 aa, Artificial Sequence
  Description of Artificial Sequence: Synthetic peptide
  Seed: SVVGNWQYFF (MAGA3_HUMAN)
SLVGNWQYFY

SEQ ID NO: 55237 - protein, 10 aa, Artificial Sequence
  Description of Artificial Sequence: Synthetic peptide
  Seed: VDPIGHLYIF (MAGA3_HUMAN)
VRPIGHLYIW

SEQ ID NO: 55238 - protein, 9 aa, Artificial Sequence
  Description of Artificial Sequence: Synthetic peptide
  Seed: FVQENYLEY (MAGA3_HUMAN)
FPQENYLEW

SEQ ID NO: 55239 - protein, 9 aa, Artificial Sequence
  Description of Artificial Sequence: Synthetic peptide
  Seed: ILGDPKKLL (MAGA3_HUMAN)
IYGDPKKLM

SEQ ID NO: 55240 - protein, 10 aa, Artificial Sequence
  Description of Artificial Sequence: Synthetic peptide
  Seed: TSYVKVLHHM (MAGA3_HUMAN)
TEYVKVLHHW

SEQ ID NO: 55241 - protein, 9 aa, Artificial Sequence
  Description of Artificial Sequence: Synthetic peptide
  Seed: HLYIFATCL (MAGA3_HUMAN)
HQYIFATCF

SEQ ID NO: 55242 - protein, 9 aa, Artificial Sequence
  Description of Artificial Sequence: Synthetic peptide
  Seed: LGDPKKLLT (MAGA3_HUMAN)
LYDPKKLLL

SEQ ID NO: 55243 - protein, 11 aa, Artificial Sequence
  Description of Artificial Sequence: Synthetic peptide
  Seed: SRKVAELVHFL (MAGA3_HUMAN)
SWKVAELVHFV

SEQ ID NO: 55244 - protein, 9 aa, Artificial Sequence
  Description of Artificial Sequence: Synthetic peptide
  Seed: IMPKAGLLI (MAGA3_HUMAN)
IRPKAGLLM

SEQ ID NO: 55245 - protein, 9 aa, Artificial Sequence
  Description of Artificial Sequence: Synthetic peptide
  Seed: ALSRKVAEL (MAGA3_HUMAN)
ATSRKVAEI

SEQ ID NO: 55246 - protein, 10 aa, Artificial Sequence
  Description of Artificial Sequence: Synthetic peptide
  Seed: FSKASSSLQL (MAGA3_HUMAN)
FLKASSSLQF

SEQ ID NO: 55247 - protein, 11 aa, Artificial Sequence
  Description of Artificial Sequence: Synthetic peptide
  Seed: EEQEAASSSST (MAGA3_HUMAN)
EEQEAASSSSV

SEQ ID NO: 55248 - protein, 10 aa, Artificial Sequence
  Description of Artificial Sequence: Synthetic peptide
  Seed: ASSLPTTMNY (MAGA3_HUMAN)
AFSLPTTMNY

SEQ ID NO: 55249 - protein, 10 aa, Artificial Sequence
  Description of Artificial Sequence: Synthetic peptide
  Seed: LGSVVGNWQY (MAGA3_HUMAN)
LGSVVGNWQW

SEQ ID NO: 55250 - protein, 10 aa, Artificial Sequence
  Description of Artificial Sequence: Synthetic peptide
  Seed: SDPACYEFLW (MAGA3_HUMAN)
SIPACYEFLW

SEQ ID NO: 55251 - protein, 10 aa, Artificial Sequence
  Description of Artificial Sequence: Synthetic peptide
  Seed: SVVGNWQYFF (MAGA3_HUMAN)
SYVGNWQYFI

SEQ ID NO: 55252 - protein, 10 aa, Artificial Sequence
  Description of Artificial Sequence: Synthetic peptide
  Seed: RKVAELVHFL (MAGA3_HUMAN)
RQVAELVHFI

SEQ ID NO: 55253 - protein, 9 aa, Artificial Sequence
  Description of Artificial Sequence: Synthetic peptide
  Seed: DPIGHLYIF (MAGA3_HUMAN)
DAIGHLYIM

SEQ ID NO: 55254 - protein, 9 aa, Artificial Sequence
  Description of Artificial Sequence: Synthetic peptide
  Seed: EAASSSSTL (MAGA3_HUMAN)
ELASSSSTY

SEQ ID NO: 55255 - protein, 9 aa, Artificial Sequence
  Description of Artificial Sequence: Synthetic peptide
  Seed: TFPDLESEF (MAGA3_HUMAN)
TYPDLESEF

SEQ ID NO: 55256 - protein, 9 aa, Artificial Sequence
  Description of Artificial Sequence: Synthetic peptide
  Seed: VKISGGPHI (MAGA3_HUMAN)
VVISGGPHY

SEQ ID NO: 55257 - protein, 9 aa, Artificial Sequence
  Description of Artificial Sequence: Synthetic peptide
  Seed: ASSSLQLVF (MAGA3_HUMAN)
AKSSLQLVF

SEQ ID NO: 55258 - protein, 10 aa, Artificial Sequence
  Description of Artificial Sequence: Synthetic peptide
  Seed: LVFGIELMEV (MAGA3_HUMAN)
LLFGIELMET

SEQ ID NO: 55259 - protein, 9 aa, Artificial Sequence
  Description of Artificial Sequence: Synthetic peptide
  Seed: FVQENYLEY (MAGA3_HUMAN)
FEQENYLEY

SEQ ID NO: 55260 - protein, 9 aa, Artificial Sequence
  Description of Artificial Sequence: Synthetic peptide
  Seed: GLLIIVLAI (MAGA3_HUMAN)
GVLIIVLAV

SEQ ID NO: 55261 - protein, 9 aa, Artificial Sequence
  Description of Artificial Sequence: Synthetic peptide
  Seed: FQAALSRKV (MAGA3_HUMAN)
FKAALSRKY

SEQ ID NO: 55262 - protein, 10 aa, Artificial Sequence
  Description of Artificial Sequence: Synthetic peptide
  Seed: IFATCLGLSY (MAGA3_HUMAN)
IAATCLGLSF

SEQ ID NO: 55263 - protein, 10 aa, Artificial Sequence
  Description of Artificial Sequence: Synthetic peptide
  Seed: MNYPLWSQSY (MAGA3_HUMAN)
MIYPLWSQSV

SEQ ID NO: 55264 - protein, 10 aa, Artificial Sequence
  Description of Artificial Sequence: Synthetic peptide
  Seed: KVAELVHFLL (MAGA3_HUMAN)
KLAELVHFLQ

SEQ ID NO: 55265 - protein, 10 aa, Artificial Sequence
  Description of Artificial Sequence: Synthetic peptide
  Seed: FSKASSSLQL (MAGA3_HUMAN)
FHKASSSLQF

SEQ ID NO: 55266 - protein, 9 aa, Artificial Sequence
  Description of Artificial Sequence: Synthetic peptide
  Seed: DPIGHLYIF (MAGA3_HUMAN)
DEIGHLYIW

SEQ ID NO: 55267 - protein, 11 aa, Artificial Sequence
  Description of Artificial Sequence: Synthetic peptide
  Seed: ISYPPLHEWVL (MAGA3_HUMAN)
ISYPPLHEWVW

SEQ ID NO: 55268 - protein, 10 aa, Artificial Sequence
  Description of Artificial Sequence: Synthetic peptide
  Seed: VTKAEMLGSV (MAGA3_HUMAN)
VVKAEMLGSV

SEQ ID NO: 55269 - protein, 10 aa, Artificial Sequence
  Description of Artificial Sequence: Synthetic peptide
  Seed: ALVETSYVKV (MAGA3_HUMAN)
AMVETSYVKI

SEQ ID NO: 55270 - protein, 10 aa, Artificial Sequence
  Description of Artificial Sequence: Synthetic peptide
  Seed: VIFSKASSSL (MAGA3_HUMAN)
VMFSKASSSF

SEQ ID NO: 55271 - protein, 9 aa, Artificial Sequence
  Description of Artificial Sequence: Synthetic peptide
  Seed: EAASSSSTL (MAGA3_HUMAN)
EVASSSSTV

SEQ ID NO: 55272 - protein, 9 aa, Artificial Sequence
  Description of Artificial Sequence: Synthetic peptide
  Seed: RALVETSYV (MAGA3_HUMAN)
RQLVETSYY

SEQ ID NO: 55273 - protein, 10 aa, Artificial Sequence
  Description of Artificial Sequence: Synthetic peptide
  Seed: SVVGNWQYFF (MAGA3_HUMAN)
STVGNWQYFF

SEQ ID NO: 55274 - protein, 10 aa, Artificial Sequence
  Description of Artificial Sequence: Synthetic peptide
  Seed: QEAASSSSTL (MAGA3_HUMAN)
QEAASSSSTF

SEQ ID NO: 55275 - protein, 8 aa, Artificial Sequence
  Description of Artificial Sequence: Synthetic peptide
  Seed: SYPPLHEW (MAGA3_HUMAN)
SFPPLHEI

SEQ ID NO: 55276 - protein, 9 aa, Artificial Sequence
  Description of Artificial Sequence: Synthetic peptide
  Seed: SSLPTTMNY (MAGA3_HUMAN)
SQLPTTMNW

SEQ ID NO: 55277 - protein, 11 aa, Artificial Sequence
  Description of Artificial Sequence: Synthetic peptide
  Seed: YIFATCLGLSY (MAGA3_HUMAN)
YQFATCLGLSI

SEQ ID NO: 55278 - protein, 10 aa, Artificial Sequence
  Description of Artificial Sequence: Synthetic peptide
  Seed: KASSSLQLVF (MAGA3_HUMAN)
KMSSSLQLVI

SEQ ID NO: 55279 - protein, 10 aa, Artificial Sequence
  Description of Artificial Sequence: Synthetic peptide
  Seed: WEELSVLEVF (MAGA3_HUMAN)
WWELSVLEVM

SEQ ID NO: 55280 - protein, 9 aa, Artificial Sequence
  Description of Artificial Sequence: Synthetic peptide
  Seed: RQVPGSDPA (MAGA3_HUMAN)
RIVPGSDPL

SEQ ID NO: 55281 - protein, 9 aa, Artificial Sequence
  Description of Artificial Sequence: Synthetic peptide
  Seed: KVAELVHFL (MAGA3_HUMAN)
KSAELVHFK

SEQ ID NO: 55282 - protein, 10 aa, Artificial Sequence
  Description of Artificial Sequence: Synthetic peptide
  Seed: MEVDPIGHLY (MAGA3_HUMAN)
MPVDPIGHLY

SEQ ID NO: 55283 - protein, 11 aa, Artificial Sequence
  Description of Artificial Sequence: Synthetic peptide
  Seed: SYPPLHEWVLR (MAGA3_HUMAN)
SYPPLHEWVLV

SEQ ID NO: 55284 - protein, 10 aa, Artificial Sequence
  Description of Artificial Sequence: Synthetic peptide
  Seed: ASSLPTTMNY (MAGA3_HUMAN)
ADSLPTTMNW

SEQ ID NO: 55285 - protein, 10 aa, Artificial Sequence
  Description of Artificial Sequence: Synthetic peptide
  Seed: MEVDPIGHLY (MAGA3_HUMAN)
MTVDPIGHLY

SEQ ID NO: 55286 - protein, 9 aa, Artificial Sequence
  Description of Artificial Sequence: Synthetic peptide
  Seed: TQHFVQENY (MAGA3_HUMAN)
TWHFVQENY

SEQ ID NO: 55287 - protein, 9 aa, Artificial Sequence
  Description of Artificial Sequence: Synthetic peptide
  Seed: EAASSSSTL (MAGA3_HUMAN)
EMASSSSTY

SEQ ID NO: 55288 - protein, 9 aa, Artificial Sequence
  Description of Artificial Sequence: Synthetic peptide
  Seed: RQVPGSDPA (MAGA3_HUMAN)
RIVPGSDPI

SEQ ID NO: 55289 - protein, 9 aa, Artificial Sequence
  Description of Artificial Sequence: Synthetic peptide
  Seed: SSSSTLVEV (MAGA3_HUMAN)
SVSSTLVEL

SEQ ID NO: 55290 - protein, 9 aa, Artificial Sequence
  Description of Artificial Sequence: Synthetic peptide
  Seed: SSLPTTMNY (MAGA3_HUMAN)
SFLPTTMNY

SEQ ID NO: 55291 - protein, 9 aa, Artificial Sequence
  Description of Artificial Sequence: Synthetic peptide
  Seed: NYPLWSQSY (MAGA3_HUMAN)
NLPLWSQSY

SEQ ID NO: 55292 - protein, 9 aa, Artificial Sequence
  Description of Artificial Sequence: Synthetic peptide
  Seed: HLYIFATCL (MAGA3_HUMAN)
HEYIFATCF

SEQ ID NO: 55293 - protein, 9 aa, Artificial Sequence
  Description of Artificial Sequence: Synthetic peptide
  Seed: ISYPPLHEW (MAGA3_HUMAN)
IIYPPLHEW

SEQ ID NO: 55294 - protein, 9 aa, Artificial Sequence
  Description of Artificial Sequence: Synthetic peptide
  Seed: KVAELVHFL (MAGA3_HUMAN)
KLAELVHFR

SEQ ID NO: 55295 - protein, 11 aa, Artificial Sequence
  Description of Artificial Sequence: Synthetic peptide
  Seed: YIFATCLGLSY (MAGA3_HUMAN)
YVFATCLGLSY

SEQ ID NO: 55296 - protein, 9 aa, Artificial Sequence
  Description of Artificial Sequence: Synthetic peptide
  Seed: SSSSTLVEV (MAGA3_HUMAN)
SQSSTLVEL

SEQ ID NO: 55297 - protein, 10 aa, Artificial Sequence
  Description of Artificial Sequence: Synthetic peptide
  Seed: VIFSKASSSL (MAGA3_HUMAN)
VMFSKASSSA

SEQ ID NO: 55298 - protein, 9 aa, Artificial Sequence
  Description of Artificial Sequence: Synthetic peptide
  Seed: FVQENYLEY (MAGA3_HUMAN)
FAQENYLEM

SEQ ID NO: 55299 - protein, 10 aa, Artificial Sequence
  Description of Artificial Sequence: Synthetic peptide
  Seed: DLESEFQAAL (MAGA3_HUMAN)
DIESEFQAAY

SEQ ID NO: 55300 - protein, 9 aa, Artificial Sequence
  Description of Artificial Sequence: Synthetic peptide
  Seed: VQENYLEYR (MAGA3_HUMAN)
VYENYLEYR

SEQ ID NO: 55301 - protein, 11 aa, Artificial Sequence
  Description of Artificial Sequence: Synthetic peptide
  Seed: EEQEAASSSST (MAGA3_HUMAN)
EEQEAASSSSL

SEQ ID NO: 55302 - protein, 9 aa, Artificial Sequence
  Description of Artificial Sequence: Synthetic peptide
  Seed: GLLIIVLAI (MAGA3_HUMAN)
GLLIIVLAL

SEQ ID NO: 55303 - protein, 10 aa, Artificial Sequence
  Description of Artificial Sequence: Synthetic peptide
  Seed: RALVETSYVK (MAGA3_HUMAN)
RVLVETSYVR

SEQ ID NO: 55304 - protein, 10 aa, Artificial Sequence
  Description of Artificial Sequence: Synthetic peptide
  Seed: ISYPPLHEWV (MAGA3_HUMAN)
IEYPPLHEWW

SEQ ID NO: 55305 - protein, 10 aa, Artificial Sequence
  Description of Artificial Sequence: Synthetic peptide
  Seed: KVAELVHFLL (MAGA3_HUMAN)
KIAELVHFLD

SEQ ID NO: 55306 - protein, 9 aa, Artificial Sequence
  Description of Artificial Sequence: Synthetic peptide
  Seed: YFFPVIFSK (MAGA3_HUMAN)
YWFPVIFSY

SEQ ID NO: 55307 - protein, 8 aa, Artificial Sequence
  Description of Artificial Sequence: Synthetic peptide
  Seed: SEFQAALS (MAGA3_HUMAN)
SEFQAALA

SEQ ID NO: 55308 - protein, 9 aa, Artificial Sequence
  Description of Artificial Sequence: Synthetic peptide
  Seed: KIWEELSVL (MAGA3_HUMAN)
KLWEELSVS

SEQ ID NO: 55309 - protein, 9 aa, Artificial Sequence
  Description of Artificial Sequence: Synthetic peptide
  Seed: KVAELVHFL (MAGA3_HUMAN)
KWAELVHFM

SEQ ID NO: 55310 - protein, 9 aa, Artificial Sequence
  Description of Artificial Sequence: Synthetic peptide
  Seed: GASSLPTTM (MAGA3_HUMAN)
GQSSLPTTY

SEQ ID NO: 55311 - protein, 9 aa, Artificial Sequence
  Description of Artificial Sequence: Synthetic peptide
  Seed: GEVPAAESP (MAGA3_HUMAN)
GEVPAAESL

SEQ ID NO: 55312 - protein, 9 aa, Artificial Sequence
  Description of Artificial Sequence: Synthetic peptide
  Seed: LQLVFGIEL (MAGA3_HUMAN)
LSLVFGIEY

SEQ ID NO: 55313 - protein, 10 aa, Artificial Sequence
  Description of Artificial Sequence: Synthetic peptide
  Seed: HISYPPLHEW (MAGA3_HUMAN)
HPSYPPLHEF

SEQ ID NO: 55314 - protein, 9 aa, Artificial Sequence
  Description of Artificial Sequence: Synthetic peptide
  Seed: DPIGHLYIF (MAGA3_HUMAN)
DMIGHLYIY

SEQ ID NO: 55315 - protein, 11 aa, Artificial Sequence
  Description of Artificial Sequence: Synthetic peptide
  Seed: YIFATCLGLSY (MAGA3_HUMAN)
YSFATCLGLSL

SEQ ID NO: 55316 - protein, 11 aa, Artificial Sequence
  Description of Artificial Sequence: Synthetic peptide
  Seed: RQVPGSDPACY (MAGA3_HUMAN)
RMVPGSDPACF

SEQ ID NO: 55317 - protein, 9 aa, Artificial Sequence
  Description of Artificial Sequence: Synthetic peptide
  Seed: KVAELVHFL (MAGA3_HUMAN)
KIAELVHFW

SEQ ID NO: 55318 - protein, 11 aa, Artificial Sequence
  Description of Artificial Sequence: Synthetic peptide
  Seed: RQVPGSDPACY (MAGA3_HUMAN)
RRVPGSDPACY

SEQ ID NO: 55319 - protein, 9 aa, Artificial Sequence
  Description of Artificial Sequence: Synthetic peptide
  Seed: ISYPPLHEW (MAGA3_HUMAN)
ILYPPLHEY

SEQ ID NO: 55320 - protein, 9 aa, Artificial Sequence
  Description of Artificial Sequence: Synthetic peptide
  Seed: KIWEELSVL (MAGA3_HUMAN)
KIWEELSVA

SEQ ID NO: 55321 - protein, 9 aa, Artificial Sequence
  Description of Artificial Sequence: Synthetic peptide
  Seed: ISGGPHISY (MAGA3_HUMAN)
ISGGPHISL

SEQ ID NO: 55322 - protein, 11 aa, Artificial Sequence
  Description of Artificial Sequence: Synthetic peptide
  Seed: YIFATCLGLSY (MAGA3_HUMAN)
YPFATCLGLSL

SEQ ID NO: 55323 - protein, 9 aa, Artificial Sequence
  Description of Artificial Sequence: Synthetic peptide
  Seed: FVQENYLEY (MAGA3_HUMAN)
FTQENYLEM

SEQ ID NO: 55324 - protein, 9 aa, Artificial Sequence
  Description of Artificial Sequence: Synthetic peptide
  Seed: SSLPTTMNY (MAGA3_HUMAN)
SMLPTTMNI

SEQ ID NO: 55325 - protein, 9 aa, Artificial Sequence
  Description of Artificial Sequence: Synthetic peptide
  Seed: YIFATCLGL (MAGA3_HUMAN)
YTFATCLGA

SEQ ID NO: 55326 - protein, 9 aa, Artificial Sequence
  Description of Artificial Sequence: Synthetic peptide
  Seed: KIWEELSVL (MAGA3_HUMAN)
KSWEELSVV

SEQ ID NO: 55327 - protein, 10 aa, Artificial Sequence
  Description of Artificial Sequence: Synthetic peptide
  Seed: MNYPLWSQSY (MAGA3_HUMAN)
MNYPLWSQSF

SEQ ID NO: 55328 - protein, 10 aa, Artificial Sequence
  Description of Artificial Sequence: Synthetic peptide
  Seed: QYFFPVIFSK (MAGA3_HUMAN)
QFFFPVIFSR

SEQ ID NO: 55329 - protein, 9 aa, Artificial Sequence
  Description of Artificial Sequence: Synthetic peptide
  Seed: ELVHFLLLK (MAGA3_HUMAN)
EFVHFLLLK

SEQ ID NO: 55330 - protein, 9 aa, Artificial Sequence
  Description of Artificial Sequence: Synthetic peptide
  Seed: EFQAALSRK (MAGA3_HUMAN)
EMQAALSRK

SEQ ID NO: 55331 - protein, 9 aa, Artificial Sequence
  Description of Artificial Sequence: Synthetic peptide
  Seed: KASSSLQLV (MAGA3_HUMAN)
KLSSSLQLY

SEQ ID NO: 55332 - protein, 9 aa, Artificial Sequence
  Description of Artificial Sequence: Synthetic peptide
  Seed: FATCLGLSY (MAGA3_HUMAN)
FVTCLGLSK

SEQ ID NO: 55333 - protein, 10 aa, Artificial Sequence
  Description of Artificial Sequence: Synthetic peptide
  Seed: ISYPPLHEWV (MAGA3_HUMAN)
ILYPPLHEWW

SEQ ID NO: 55334 - protein, 10 aa, Artificial Sequence
  Description of Artificial Sequence: Synthetic peptide
  Seed: YIFATCLGLS (MAGA3_HUMAN)
YMFATCLGLW

SEQ ID NO: 55335 - protein, 9 aa, Artificial Sequence
  Description of Artificial Sequence: Synthetic peptide
  Seed: SILGDPKKL (MAGA3_HUMAN)
SLLGDPKKY

SEQ ID NO: 55336 - protein, 9 aa, Artificial Sequence
  Description of Artificial Sequence: Synthetic peptide
  Seed: ALVETSYVK (MAGA3_HUMAN)
AVVETSYVK

SEQ ID NO: 55337 - protein, 8 aa, Artificial Sequence
  Description of Artificial Sequence: Synthetic peptide
  Seed: TTMNYPLW (MAGA3_HUMAN)
TSMNYPLW

SEQ ID NO: 55338 - protein, 10 aa, Artificial Sequence
  Description of Artificial Sequence: Synthetic peptide
  Seed: YRQVPGSDPA (MAGA3_HUMAN)
YNQVPGSDPV

SEQ ID NO: 55339 - protein, 9 aa, Artificial Sequence
  Description of Artificial Sequence: Synthetic peptide
  Seed: IMPKAGLLI (MAGA3_HUMAN)
IRPKAGLLL

SEQ ID NO: 55340 - protein, 9 aa, Artificial Sequence
  Description of Artificial Sequence: Synthetic peptide
  Seed: ALSRKVAEL (MAGA3_HUMAN)
AQSRKVAEV

SEQ ID NO: 55341 - protein, 10 aa, Artificial Sequence
  Description of Artificial Sequence: Synthetic peptide
  Seed: SLQLVFGIEL (MAGA3_HUMAN)
SWQLVFGIEF

SEQ ID NO: 55342 - protein, 9 aa, Artificial Sequence
  Description of Artificial Sequence: Synthetic peptide
  Seed: KVAELVHFL (MAGA3_HUMAN)
KNAELVHFI

SEQ ID NO: 55343 - protein, 9 aa, Artificial Sequence
  Description of Artificial Sequence: Synthetic peptide
  Seed: YFFPVIFSK (MAGA3_HUMAN)
YQFPVIFSF

SEQ ID NO: 55344 - protein, 11 aa, Artificial Sequence
  Description of Artificial Sequence: Synthetic peptide
  Seed: KIWEELSVLEV (MAGA3_HUMAN)
KLWEELSVLEL

SEQ ID NO: 55345 - protein, 9 aa, Artificial Sequence
  Description of Artificial Sequence: Synthetic peptide
  Seed: SYPPLHEWV (MAGA3_HUMAN)
SFPPLHEWI

SEQ ID NO: 55346 - protein, 10 aa, Artificial Sequence
  Description of Artificial Sequence: Synthetic peptide
  Seed: SSSLQLVFGI (MAGA3_HUMAN)
SVSLQLVFGV

SEQ ID NO: 55347 - protein, 9 aa, Artificial Sequence
  Description of Artificial Sequence: Synthetic peptide
  Seed: SSTLVEVTL (MAGA3_HUMAN)
SGTLVEVTW

SEQ ID NO: 55348 - protein, 9 aa, Artificial Sequence
  Description of Artificial Sequence: Synthetic peptide
  Seed: EVDPIGHLY (MAGA3_HUMAN)
ETDPIGHLF

SEQ ID NO: 55349 - protein, 10 aa, Artificial Sequence
  Description of Artificial Sequence: Synthetic peptide
  Seed: SVVGNWQYFF (MAGA3_HUMAN)
SWVGNWQYFL

SEQ ID NO: 55350 - protein, 9 aa, Artificial Sequence
  Description of Artificial Sequence: Synthetic peptide
  Seed: YIFATCLGL (MAGA3_HUMAN)
YTFATCLGR

SEQ ID NO: 55351 - protein, 10 aa, Artificial Sequence
  Description of Artificial Sequence: Synthetic peptide
  Seed: ISYPPLHEWV (MAGA3_HUMAN)
ILYPPLHEWV

SEQ ID NO: 55352 - protein, 10 aa, Artificial Sequence
  Description of Artificial Sequence: Synthetic peptide
  Seed: MNYPLWSQSY (MAGA3_HUMAN)
MRYPLWSQSL

SEQ ID NO: 55353 - protein, 10 aa, Artificial Sequence
  Description of Artificial Sequence: Synthetic peptide
  Seed: FFPVIFSKAS (MAGA3_HUMAN)
FLPVIFSKAA

SEQ ID NO: 55354 - protein, 11 aa, Artificial Sequence
  Description of Artificial Sequence: Synthetic peptide
  Seed: WQYFFPVIFSK (MAGA3_HUMAN)
WLYFFPVIFSR

SEQ ID NO: 55355 - protein, 9 aa, Artificial Sequence
  Description of Artificial Sequence: Synthetic peptide
  Seed: KAGLLIIVL (MAGA3_HUMAN)
KTGLLIIVW

SEQ ID NO: 55356 - protein, 9 aa, Artificial Sequence
  Description of Artificial Sequence: Synthetic peptide
  Seed: RALVETSYV (MAGA3_HUMAN)
RALVETSYK

SEQ ID NO: 55357 - protein, 9 aa, Artificial Sequence
  Description of Artificial Sequence: Synthetic peptide
  Seed: ASSSLQLVF (MAGA3_HUMAN)
AVSSLQLVF

SEQ ID NO: 55358 - protein, 9 aa, Artificial Sequence
  Description of Artificial Sequence: Synthetic peptide
  Seed: AASSSSTLV (MAGA3_HUMAN)
ALSSSSTLI

SEQ ID NO: 55359 - protein, 10 aa, Artificial Sequence
  Description of Artificial Sequence: Synthetic peptide
  Seed: FFPVIFSKAS (MAGA3_HUMAN)
FTPVIFSKAA

SEQ ID NO: 55360 - protein, 9 aa, Artificial Sequence
  Description of Artificial Sequence: Synthetic peptide
  Seed: GNWQYFFPV (MAGA3_HUMAN)
GIWQYFFPA

SEQ ID NO: 55361 - protein, 10 aa, Artificial Sequence
  Description of Artificial Sequence: Synthetic peptide
  Seed: SEFQAALSRK (MAGA3_HUMAN)
SEFQAALSRF

SEQ ID NO: 55362 - protein, 9 aa, Artificial Sequence
  Description of Artificial Sequence: Synthetic peptide
  Seed: LESEFQAAL (MAGA3_HUMAN)
LISEFQAAI

SEQ ID NO: 55363 - protein, 11 aa, Artificial Sequence
  Description of Artificial Sequence: Synthetic peptide
  Seed: MLGSVVGNWQY (MAGA3_HUMAN)
MGGSVVGNWQW

SEQ ID NO: 55364 - protein, 9 aa, Artificial Sequence
  Description of Artificial Sequence: Synthetic peptide
  Seed: MPKAGLLII (MAGA3_HUMAN)
MGKAGLLIY

SEQ ID NO: 55365 - protein, 9 aa, Artificial Sequence
  Description of Artificial Sequence: Synthetic peptide
  Seed: LVEVTLGEV (MAGA3_HUMAN)
LAEVTLGEL

SEQ ID NO: 55366 - protein, 10 aa, Artificial Sequence
  Description of Artificial Sequence: Synthetic peptide
  Seed: KASSSLQLVF (MAGA3_HUMAN)
KGSSSLQLVW

SEQ ID NO: 55367 - protein, 9 aa, Artificial Sequence
  Description of Artificial Sequence: Synthetic peptide
  Seed: RKVAELVHF (MAGA3_HUMAN)
RQVAELVHI

SEQ ID NO: 55368 - protein, 10 aa, Artificial Sequence
  Description of Artificial Sequence: Synthetic peptide
  Seed: ISYPPLHEWV (MAGA3_HUMAN)
ILYPPLHEWF

SEQ ID NO: 55369 - protein, 10 aa, Artificial Sequence
  Description of Artificial Sequence: Synthetic peptide
  Seed: HISYPPLHEW (MAGA3_HUMAN)
HKSYPPLHEY

SEQ ID NO: 55370 - protein, 9 aa, Artificial Sequence
  Description of Artificial Sequence: Synthetic peptide
  Seed: QLVFGIELM (MAGA3_HUMAN)
QLVFGIELI

SEQ ID NO: 55371 - protein, 9 aa, Artificial Sequence
  Description of Artificial Sequence: Synthetic peptide
  Seed: GASSLPTTM (MAGA3_HUMAN)
GRSSLPTTI

SEQ ID NO: 55372 - protein, 9 aa, Artificial Sequence
  Description of Artificial Sequence: Synthetic peptide
  Seed: FVQENYLEY (MAGA3_HUMAN)
FYQENYLEA

SEQ ID NO: 55373 - protein, 9 aa, Artificial Sequence
  Description of Artificial Sequence: Synthetic peptide
  Seed: TSYVKVLHH (MAGA3_HUMAN)
TLYVKVLHR

SEQ ID NO: 55374 - protein, 9 aa, Artificial Sequence
  Description of Artificial Sequence: Synthetic peptide
  Seed: KVAELVHFL (MAGA3_HUMAN)
KGAELVHFV

SEQ ID NO: 55375 - protein, 10 aa, Artificial Sequence
  Description of Artificial Sequence: Synthetic peptide
  Seed: ESPDPPQSPQ (MAGA3_HUMAN)
EAPDPPQSPK

SEQ ID NO: 55376 - protein, 9 aa, Artificial Sequence
  Description of Artificial Sequence: Synthetic peptide
  Seed: SSSSTLVEV (MAGA3_HUMAN)
SQSSTLVEV

SEQ ID NO: 55377 - protein, 9 aa, Artificial Sequence
  Description of Artificial Sequence: Synthetic peptide
  Seed: AELVHFLLL (MAGA3_HUMAN)
AMLVHFLLY

SEQ ID NO: 55378 - protein, 10 aa, Artificial Sequence
  Description of Artificial Sequence: Synthetic peptide
  Seed: KISGGPHISY (MAGA3_HUMAN)
KMSGGPHISF

SEQ ID NO: 55379 - protein, 10 aa, Artificial Sequence
  Description of Artificial Sequence: Synthetic peptide
  Seed: RALVETSYVK (MAGA3_HUMAN)
RSLVETSYVR

SEQ ID NO: 55380 - protein, 9 aa, Artificial Sequence
  Description of Artificial Sequence: Synthetic peptide
  Seed: EVDPIGHLY (MAGA3_HUMAN)
EADPIGHLL

SEQ ID NO: 55381 - protein, 9 aa, Artificial Sequence
  Description of Artificial Sequence: Synthetic peptide
  Seed: ASSSLQLVF (MAGA3_HUMAN)
ATSSLQLVW

SEQ ID NO: 55382 - protein, 9 aa, Artificial Sequence
  Description of Artificial Sequence: Synthetic peptide
  Seed: LVHFLLLKY (MAGA3_HUMAN)
LSHFLLLKK

SEQ ID NO: 55383 - protein, 8 aa, Artificial Sequence
  Description of Artificial Sequence: Synthetic peptide
  Seed: SSSTLVEV (MAGA3_HUMAN)
SQSTLVEV

SEQ ID NO: 55384 - protein, 8 aa, Artificial Sequence
  Description of Artificial Sequence: Synthetic peptide
  Seed: HEWVLREG (MAGA3_HUMAN)
HEWVLREI

SEQ ID NO: 55385 - protein, 9 aa, Artificial Sequence
  Description of Artificial Sequence: Synthetic peptide
  Seed: TQHFVQENY (MAGA3_HUMAN)
TEHFVQENW

SEQ ID NO: 55386 - protein, 11 aa, Artificial Sequence
  Description of Artificial Sequence: Synthetic peptide
  Seed: LGSVVGNWQYF (MAGA3_HUMAN)
LVSVVGNWQYW

SEQ ID NO: 55387 - protein, 10 aa, Artificial Sequence
  Description of Artificial Sequence: Synthetic peptide
  Seed: ISYPPLHEWV (MAGA3_HUMAN)
IMYPPLHEWV

SEQ ID NO: 55388 - protein, 10 aa, Artificial Sequence
  Description of Artificial Sequence: Synthetic peptide
  Seed: TSYVKVLHHM (MAGA3_HUMAN)
TFYVKVLHHI

SEQ ID NO: 55389 - protein, 8 aa, Artificial Sequence
  Description of Artificial Sequence: Synthetic peptide
  Seed: HEWVLREG (MAGA3_HUMAN)
HEWVLREF

SEQ ID NO: 55390 - protein, 9 aa, Artificial Sequence
  Description of Artificial Sequence: Synthetic peptide
  Seed: FATCLGLSY (MAGA3_HUMAN)
FSTCLGLSM

SEQ ID NO: 55391 - protein, 10 aa, Artificial Sequence
  Description of Artificial Sequence: Synthetic peptide
  Seed: EVFEGREDSI (MAGA3_HUMAN)
EIFEGREDSR

SEQ ID NO: 55392 - protein, 9 aa, Artificial Sequence
  Description of Artificial Sequence: Synthetic peptide
  Seed: MEVDPIGHL (MAGA3_HUMAN)
MQVDPIGHM

SEQ ID NO: 55393 - protein, 9 aa, Artificial Sequence
  Description of Artificial Sequence: Synthetic peptide
  Seed: SRKVAELVH (MAGA3_HUMAN)
SRKVAELVF

SEQ ID NO: 55394 - protein, 9 aa, Artificial Sequence
  Description of Artificial Sequence: Synthetic peptide
  Seed: GSDPACYEF (MAGA3_HUMAN)
GSDPACYEM

SEQ ID NO: 55395 - protein, 9 aa, Artificial Sequence
  Description of Artificial Sequence: Synthetic peptide
  Seed: GASSLPTTM (MAGA3_HUMAN)
GTSSLPTTF

SEQ ID NO: 55396 - protein, 8 aa, Artificial Sequence
  Description of Artificial Sequence: Synthetic peptide
  Seed: HEWVLREG (MAGA3_HUMAN)
HEWVLREY

SEQ ID NO: 55397 - protein, 9 aa, Artificial Sequence
  Description of Artificial Sequence: Synthetic peptide
  Seed: FVQENYLEY (MAGA3_HUMAN)
FVQENYLEL

SEQ ID NO: 55398 - protein, 9 aa, Artificial Sequence
  Description of Artificial Sequence: Synthetic peptide
  Seed: SVLEVFEGR (MAGA3_HUMAN)
SQLEVFEGR

SEQ ID NO: 55399 - protein, 9 aa, Artificial Sequence
  Description of Artificial Sequence: Synthetic peptide
  Seed: DPIGHLYIF (MAGA3_HUMAN)
DVIGHLYIY

SEQ ID NO: 55400 - protein, 11 aa, Artificial Sequence
  Description of Artificial Sequence: Synthetic peptide
  Seed: EQEAASSSSTL (MAGA3_HUMAN)
EHEAASSSSTL

SEQ ID NO: 55401 - protein, 10 aa, Artificial Sequence
  Description of Artificial Sequence: Synthetic peptide
  Seed: FFPVIFSKAS (MAGA3_HUMAN)
FMPVIFSKAV

SEQ ID NO: 55402 - protein, 9 aa, Artificial Sequence
  Description of Artificial Sequence: Synthetic peptide
  Seed: SILGDPKKL (MAGA3_HUMAN)
SVLGDPKKY

SEQ ID NO: 55403 - protein, 10 aa, Artificial Sequence
  Description of Artificial Sequence: Synthetic peptide
  Seed: YIFATCLGLS (MAGA3_HUMAN)
YQFATCLGLI

SEQ ID NO: 55404 - protein, 10 aa, Artificial Sequence
  Description of Artificial Sequence: Synthetic peptide
  Seed: MNYPLWSQSY (MAGA3_HUMAN)
MMYPLWSQSI

SEQ ID NO: 55405 - protein, 10 aa, Artificial Sequence
  Description of Artificial Sequence: Synthetic peptide
  Seed: ASSSSTLVEV (MAGA3_HUMAN)
AMSSSTLVEL

SEQ ID NO: 55406 - protein, 9 aa, Artificial Sequence
  Description of Artificial Sequence: Synthetic peptide
  Seed: LESEFQAAL (MAGA3_HUMAN)
LGSEFQAAY

SEQ ID NO: 55407 - protein, 9 aa, Artificial Sequence
  Description of Artificial Sequence: Synthetic peptide
  Seed: LSRKVAELV (MAGA3_HUMAN)
LSRKVAELY

SEQ ID NO: 55408 - protein, 10 aa, Artificial Sequence
  Description of Artificial Sequence: Synthetic peptide
  Seed: KASSSLQLVF (MAGA3_HUMAN)
KASSSLQLVW

SEQ ID NO: 55409 - protein, 9 aa, Artificial Sequence
  Description of Artificial Sequence: Synthetic peptide
  Seed: SEFQAALSR (MAGA3_HUMAN)
SIFQAALSK

SEQ ID NO: 55410 - protein, 9 aa, Artificial Sequence
  Description of Artificial Sequence: Synthetic peptide
  Seed: KVAELVHFL (MAGA3_HUMAN)
KCAELVHFV

SEQ ID NO: 55411 - protein, 9 aa, Artificial Sequence
  Description of Artificial Sequence: Synthetic peptide
  Seed: YVKVLHHMV (MAGA3_HUMAN)
YMKVLHHML

SEQ ID NO: 55412 - protein, 8 aa, Artificial Sequence
  Description of Artificial Sequence: Synthetic peptide
  Seed: SGGPHISY (MAGA3_HUMAN)
STGPHISM

SEQ ID NO: 55413 - protein, 9 aa, Artificial Sequence
  Description of Artificial Sequence: Synthetic peptide
  Seed: QIMPKAGLL (MAGA3_HUMAN)
QLMPKAGLW

SEQ ID NO: 55414 - protein, 9 aa, Artificial Sequence
  Description of Artificial Sequence: Synthetic peptide
  Seed: KVAELVHFL (MAGA3_HUMAN)
KSAELVHFY

SEQ ID NO: 55415 - protein, 10 aa, Artificial Sequence
  Description of Artificial Sequence: Synthetic peptide
  Seed: YRQVPGSDPA (MAGA3_HUMAN)
YRQVPGSDPV

SEQ ID NO: 55416 - protein, 10 aa, Artificial Sequence
  Description of Artificial Sequence: Synthetic peptide
  Seed: ESPDPPQSPQ (MAGA3_HUMAN)
EIPDPPQSPK

SEQ ID NO: 55417 - protein, 10 aa, Artificial Sequence
  Description of Artificial Sequence: Synthetic peptide
  Seed: NQEEEGPSTF (MAGA3_HUMAN)
NTEEEGPSTL

SEQ ID NO: 55418 - protein, 10 aa, Artificial Sequence
  Description of Artificial Sequence: Synthetic peptide
  Seed: HISYPPLHEW (MAGA3_HUMAN)
HPSYPPLHEM

SEQ ID NO: 55419 - protein, 9 aa, Artificial Sequence
  Description of Artificial Sequence: Synthetic peptide
  Seed: SSTLVEVTL (MAGA3_HUMAN)
SQTLVEVTF

SEQ ID NO: 55420 - protein, 10 aa, Artificial Sequence
  Description of Artificial Sequence: Synthetic peptide
  Seed: IFATCLGLSY (MAGA3_HUMAN)
IIATCLGLSF

SEQ ID NO: 55421 - protein, 9 aa, Artificial Sequence
  Description of Artificial Sequence: Synthetic peptide
  Seed: TSYVKVLHH (MAGA3_HUMAN)
TTYVKVLHI

SEQ ID NO: 55422 - protein, 9 aa, Artificial Sequence
  Description of Artificial Sequence: Synthetic peptide
  Seed: LESEFQAAL (MAGA3_HUMAN)
LRSEFQAAF

SEQ ID NO: 55423 - protein, 9 aa, Artificial Sequence
  Description of Artificial Sequence: Synthetic peptide
  Seed: KVLHHMVKI (MAGA3_HUMAN)
KLLHHMVKK

SEQ ID NO: 55424 - protein, 10 aa, Artificial Sequence
  Description of Artificial Sequence: Synthetic peptide
  Seed: FLWGPRALVE (MAGA3_HUMAN)
FLWGPRALVV

SEQ ID NO: 55425 - protein, 10 aa, Artificial Sequence
  Description of Artificial Sequence: Synthetic peptide
  Seed: MEVDPIGHLY (MAGA3_HUMAN)
MYVDPIGHLL

SEQ ID NO: 55426 - protein, 10 aa, Artificial Sequence
  Description of Artificial Sequence: Synthetic peptide
  Seed: SLQLVFGIEL (MAGA3_HUMAN)
SLQLVFGIEF

SEQ ID NO: 55427 - protein, 9 aa, Artificial Sequence
  Description of Artificial Sequence: Synthetic peptide
  Seed: SILGDPKKL (MAGA3_HUMAN)
SQLGDPKKM

SEQ ID NO: 55428 - protein, 9 aa, Artificial Sequence
  Description of Artificial Sequence: Synthetic peptide
  Seed: SSLPTTMNY (MAGA3_HUMAN)
SWLPTTMNY

SEQ ID NO: 55429 - protein, 9 aa, Artificial Sequence
  Description of Artificial Sequence: Synthetic peptide
  Seed: TQHFVQENY (MAGA3_HUMAN)
TIHFVQENY

SEQ ID NO: 55430 - protein, 9 aa, Artificial Sequence
  Description of Artificial Sequence: Synthetic peptide
  Seed: ISGGPHISY (MAGA3_HUMAN)
IPGGPHISY

SEQ ID NO: 55431 - protein, 10 aa, Artificial Sequence
  Description of Artificial Sequence: Synthetic peptide
  Seed: FLWGPRALVE (MAGA3_HUMAN)
FMWGPRALVV

SEQ ID NO: 55432 - protein, 9 aa, Artificial Sequence
  Description of Artificial Sequence: Synthetic peptide
  Seed: YIFATCLGL (MAGA3_HUMAN)
YHFATCLGL

SEQ ID NO: 55433 - protein, 9 aa, Artificial Sequence
  Description of Artificial Sequence: Synthetic peptide
  Seed: EVDPIGHLY (MAGA3_HUMAN)
EMDPIGHLL

SEQ ID NO: 55434 - protein, 11 aa, Artificial Sequence
  Description of Artificial Sequence: Synthetic peptide
  Seed: KVAELVHFLLL (MAGA3_HUMAN)
KLAELVHFLLA

SEQ ID NO: 55435 - protein, 9 aa, Artificial Sequence
  Description of Artificial Sequence: Synthetic peptide
  Seed: KVLHHMVKI (MAGA3_HUMAN)
KLLHHMVKL

SEQ ID NO: 55436 - protein, 9 aa, Artificial Sequence
  Description of Artificial Sequence: Synthetic peptide
  Seed: WQYFFPVIF (MAGA3_HUMAN)
WSYFFPVIM

SEQ ID NO: 55437 - protein, 9 aa, Artificial Sequence
  Description of Artificial Sequence: Synthetic peptide
  Seed: QHCKPEEGL (MAGA3_HUMAN)
QHCKPEEGI

SEQ ID NO: 55438 - protein, 10 aa, Artificial Sequence
  Description of Artificial Sequence: Synthetic peptide
  Seed: FSKASSSLQL (MAGA3_HUMAN)
FQKASSSLQY

SEQ ID NO: 55439 - protein, 8 aa, Artificial Sequence
  Description of Artificial Sequence: Synthetic peptide
  Seed: GEVPAAES (MAGA3_HUMAN)
GEVPAAEV

SEQ ID NO: 55440 - protein, 9 aa, Artificial Sequence
  Description of Artificial Sequence: Synthetic peptide
  Seed: IMPKAGLLI (MAGA3_HUMAN)
IFPKAGLLM

SEQ ID NO: 55441 - protein, 10 aa, Artificial Sequence
  Description of Artificial Sequence: Synthetic peptide
  Seed: TLVEVTLGEV (MAGA3_HUMAN)
TIVEVTLGEV

SEQ ID NO: 55442 - protein, 10 aa, Artificial Sequence
  Description of Artificial Sequence: Synthetic peptide
  Seed: KAEMLGSVVG (MAGA3_HUMAN)
KMEMLGSVVA

SEQ ID NO: 55443 - protein, 9 aa, Artificial Sequence
  Description of Artificial Sequence: Synthetic peptide
  Seed: HLYIFATCL (MAGA3_HUMAN)
HAYIFATCF

SEQ ID NO: 55444 - protein, 8 aa, Artificial Sequence
  Description of Artificial Sequence: Synthetic peptide
  Seed: ASSLPTTM (MAGA3_HUMAN)
AASLPTTL

SEQ ID NO: 55445 - protein, 10 aa, Artificial Sequence
  Description of Artificial Sequence: Synthetic peptide
  Seed: FLWGPRALVE (MAGA3_HUMAN)
FMWGPRALVL

SEQ ID NO: 55446 - protein, 8 aa, Artificial Sequence
  Description of Artificial Sequence: Synthetic peptide
  Seed: RALVETSY (MAGA3_HUMAN)
RQLVETSY

SEQ ID NO: 55447 - protein, 10 aa, Artificial Sequence
  Description of Artificial Sequence: Synthetic peptide
  Seed: GLVGAQAPAT (MAGA3_HUMAN)
GLVGAQAPAL

SEQ ID NO: 55448 - protein, 10 aa, Artificial Sequence
  Description of Artificial Sequence: Synthetic peptide
  Seed: EVFEGREDSI (MAGA3_HUMAN)
EIFEGREDSW

SEQ ID NO: 55449 - protein, 10 aa, Artificial Sequence
  Description of Artificial Sequence: Synthetic peptide
  Seed: STFPDLESEF (MAGA3_HUMAN)
SLFPDLESEW

SEQ ID NO: 55450 - protein, 10 aa, Artificial Sequence
  Description of Artificial Sequence: Synthetic peptide
  Seed: MPKAGLLIIV (MAGA3_HUMAN)
MTKAGLLIII

SEQ ID NO: 55451 - protein, 10 aa, Artificial Sequence
  Description of Artificial Sequence: Synthetic peptide
  Seed: EMLGSVVGNW (MAGA3_HUMAN)
ESLGSVVGNW

SEQ ID NO: 55452 - protein, 9 aa, Artificial Sequence
  Description of Artificial Sequence: Synthetic peptide
  Seed: TFPDLESEF (MAGA3_HUMAN)
TYPDLESEV

SEQ ID NO: 55453 - protein, 9 aa, Artificial Sequence
  Description of Artificial Sequence: Synthetic peptide
  Seed: QSPQGASSL (MAGA3_HUMAN)
QVPQGASSL

SEQ ID NO: 55454 - protein, 9 aa, Artificial Sequence
  Description of Artificial Sequence: Synthetic peptide
  Seed: YFFPVIFSK (MAGA3_HUMAN)
YVFPVIFSM

SEQ ID NO: 55455 - protein, 11 aa, Artificial Sequence
  Description of Artificial Sequence: Synthetic peptide
  Seed: WQYFFPVIFSK (MAGA3_HUMAN)
WHYFFPVIFSR

SEQ ID NO: 55456 - protein, 10 aa, Artificial Sequence
  Description of Artificial Sequence: Synthetic peptide
  Seed: RKVAELVHFL (MAGA3_HUMAN)
RIVAELVHFI

SEQ ID NO: 55457 - protein, 9 aa, Artificial Sequence
  Description of Artificial Sequence: Synthetic peptide
  Seed: KVAELVHFL (MAGA3_HUMAN)
KFAELVHFF

SEQ ID NO: 55458 - protein, 9 aa, Artificial Sequence
  Description of Artificial Sequence: Synthetic peptide
  Seed: KVAELVHFL (MAGA3_HUMAN)
KYAELVHFF

SEQ ID NO: 55459 - protein, 9 aa, Artificial Sequence
  Description of Artificial Sequence: Synthetic peptide
  Seed: WQYFFPVIF (MAGA3_HUMAN)
WTYFFPVIY

SEQ ID NO: 55460 - protein, 10 aa, Artificial Sequence
  Description of Artificial Sequence: Synthetic peptide
  Seed: LTQHFVQENY (MAGA3_HUMAN)
LVQHFVQENW

SEQ ID NO: 55461 - protein, 9 aa, Artificial Sequence
  Description of Artificial Sequence: Synthetic peptide
  Seed: MEVDPIGHL (MAGA3_HUMAN)
MLVDPIGHA

SEQ ID NO: 55462 - protein, 10 aa, Artificial Sequence
  Description of Artificial Sequence: Synthetic peptide
  Seed: KASSSLQLVF (MAGA3_HUMAN)
KESSSLQLVY

SEQ ID NO: 55463 - protein, 9 aa, Artificial Sequence
  Description of Artificial Sequence: Synthetic peptide
  Seed: RKVAELVHF (MAGA3_HUMAN)
RKVAELVHM

SEQ ID NO: 55464 - protein, 10 aa, Artificial Sequence
  Description of Artificial Sequence: Synthetic peptide
  Seed: ISYPPLHEWV (MAGA3_HUMAN)
IFYPPLHEWM

SEQ ID NO: 55465 - protein, 9 aa, Artificial Sequence
  Description of Artificial Sequence: Synthetic peptide
  Seed: ALSRKVAEL (MAGA3_HUMAN)
ASSRKVAEF

SEQ ID NO: 55466 - protein, 9 aa, Artificial Sequence
  Description of Artificial Sequence: Synthetic peptide
  Seed: FQAALSRKV (MAGA3_HUMAN)
FKAALSRKM

SEQ ID NO: 55467 - protein, 10 aa, Artificial Sequence
  Description of Artificial Sequence: Synthetic peptide
  Seed: VIFSKASSSL (MAGA3_HUMAN)
VVFSKASSSM

SEQ ID NO: 55468 - protein, 9 aa, Artificial Sequence
  Description of Artificial Sequence: Synthetic peptide
  Seed: LSRKVAELV (MAGA3_HUMAN)
LSRKVAELF

SEQ ID NO: 55469 - protein, 9 aa, Artificial Sequence
  Description of Artificial Sequence: Synthetic peptide
  Seed: TFPDLESEF (MAGA3_HUMAN)
TAPDLESEY

SEQ ID NO: 55470 - protein, 9 aa, Artificial Sequence
  Description of Artificial Sequence: Synthetic peptide
  Seed: VETSYVKVL (MAGA3_HUMAN)
VETSYVKVA

SEQ ID NO: 55471 - protein, 9 aa, Artificial Sequence
  Description of Artificial Sequence: Synthetic peptide
  Seed: QIMPKAGLL (MAGA3_HUMAN)
QIMPKAGLY

SEQ ID NO: 55472 - protein, 9 aa, Artificial Sequence
  Description of Artificial Sequence: Synthetic peptide
  Seed: EVDPIGHLY (MAGA3_HUMAN)
EVDPIGHLL

SEQ ID NO: 55473 - protein, 9 aa, Artificial Sequence
  Description of Artificial Sequence: Synthetic peptide
  Seed: SKASSSLQL (MAGA3_HUMAN)
SKASSSLQF

SEQ ID NO: 55474 - protein, 9 aa, Artificial Sequence
  Description of Artificial Sequence: Synthetic peptide
  Seed: MLGSVVGNW (MAGA3_HUMAN)
MSGSVVGNW

SEQ ID NO: 55475 - protein, 9 aa, Artificial Sequence
  Description of Artificial Sequence: Synthetic peptide
  Seed: SSLPTTMNY (MAGA3_HUMAN)
SSLPTTMNF

SEQ ID NO: 55476 - protein, 10 aa, Artificial Sequence
  Description of Artificial Sequence: Synthetic peptide
  Seed: DLESEFQAAL (MAGA3_HUMAN)
DCESEFQAAF

SEQ ID NO: 55477 - protein, 9 aa, Artificial Sequence
  Description of Artificial Sequence: Synthetic peptide
  Seed: GASSLPTTM (MAGA3_HUMAN)
GMSSLPTTL

SEQ ID NO: 55478 - protein, 10 aa, Artificial Sequence
  Description of Artificial Sequence: Synthetic peptide
  Seed: TSYVKVLHHM (MAGA3_HUMAN)
TNYVKVLHHI

SEQ ID NO: 55479 - protein, 9 aa, Artificial Sequence
  Description of Artificial Sequence: Synthetic peptide
  Seed: FATCLGLSY (MAGA3_HUMAN)
FATCLGLSL

SEQ ID NO: 55480 - protein, 10 aa, Artificial Sequence
  Description of Artificial Sequence: Synthetic peptide
  Seed: MEVDPIGHLY (MAGA3_HUMAN)
MMVDPIGHLL

SEQ ID NO: 55481 - protein, 10 aa, Artificial Sequence
  Description of Artificial Sequence: Synthetic peptide
  Seed: YRQVPGSDPA (MAGA3_HUMAN)
YLQVPGSDPL

SEQ ID NO: 55482 - protein, 9 aa, Artificial Sequence
  Description of Artificial Sequence: Synthetic peptide
  Seed: SSTLVEVTL (MAGA3_HUMAN)
SDTLVEVTF

SEQ ID NO: 55483 - protein, 10 aa, Artificial Sequence
  Description of Artificial Sequence: Synthetic peptide
  Seed: RKVAELVHFL (MAGA3_HUMAN)
RLVAELVHFL

SEQ ID NO: 55484 - protein, 9 aa, Artificial Sequence
  Description of Artificial Sequence: Synthetic peptide
  Seed: KIWEELSVL (MAGA3_HUMAN)
KVWEELSVM

SEQ ID NO: 55485 - protein, 9 aa, Artificial Sequence
  Description of Artificial Sequence: Synthetic peptide
  Seed: TFPDLESEF (MAGA3_HUMAN)
TTPDLESEL

SEQ ID NO: 55486 - protein, 10 aa, Artificial Sequence
  Description of Artificial Sequence: Synthetic peptide
  Seed: WEELSVLEVF (MAGA3_HUMAN)
WQELSVLEVW

SEQ ID NO: 55487 - protein, 10 aa, Artificial Sequence
  Description of Artificial Sequence: Synthetic peptide
  Seed: KAEMLGSVVG (MAGA3_HUMAN)
KWEMLGSVVA

SEQ ID NO: 55488 - protein, 11 aa, Artificial Sequence
  Description of Artificial Sequence: Synthetic peptide
  Seed: SKASSSLQLVF (MAGA3_HUMAN)
STASSSLQLVF

SEQ ID NO: 55489 - protein, 9 aa, Artificial Sequence
  Description of Artificial Sequence: Synthetic peptide
  Seed: GPHISYPPL (MAGA3_HUMAN)
GPHISYPPV

SEQ ID NO: 55490 - protein, 10 aa, Artificial Sequence
  Description of Artificial Sequence: Synthetic peptide
  Seed: SLQLVFGIEL (MAGA3_HUMAN)
SPQLVFGIEF

SEQ ID NO: 55491 - protein, 9 aa, Artificial Sequence
  Description of Artificial Sequence: Synthetic peptide
  Seed: ISYPPLHEW (MAGA3_HUMAN)
IVYPPLHEI

SEQ ID NO: 55492 - protein, 9 aa, Artificial Sequence
  Description of Artificial Sequence: Synthetic peptide
  Seed: ISYPPLHEW (MAGA3_HUMAN)
IMYPPLHEM

SEQ ID NO: 55493 - protein, 9 aa, Artificial Sequence
  Description of Artificial Sequence: Synthetic peptide
  Seed: VVGNWQYFF (MAGA3_HUMAN)
VFGNWQYFF

SEQ ID NO: 55494 - protein, 10 aa, Artificial Sequence
  Description of Artificial Sequence: Synthetic peptide
  Seed: ASSSSTLVEV (MAGA3_HUMAN)
ATSSSTLVEV

SEQ ID NO: 55495 - protein, 10 aa, Artificial Sequence
  Description of Artificial Sequence: Synthetic peptide
  Seed: RQVPGSDPAC (MAGA3_HUMAN)
RMVPGSDPAM

SEQ ID NO: 55496 - protein, 9 aa, Artificial Sequence
  Description of Artificial Sequence: Synthetic peptide
  Seed: KVLHHMVKI (MAGA3_HUMAN)
KILHHMVKF

SEQ ID NO: 55497 - protein, 9 aa, Artificial Sequence
  Description of Artificial Sequence: Synthetic peptide
  Seed: HLYIFATCL (MAGA3_HUMAN)
HAYIFATCY

SEQ ID NO: 55498 - protein, 10 aa, Artificial Sequence
  Description of Artificial Sequence: Synthetic peptide
  Seed: SDPACYEFLW (MAGA3_HUMAN)
SGPACYEFLW

SEQ ID NO: 55499 - protein, 9 aa, Artificial Sequence
  Description of Artificial Sequence: Synthetic peptide
  Seed: GASSLPTTM (MAGA3_HUMAN)
GQSSLPTTV

SEQ ID NO: 55500 - protein, 10 aa, Artificial Sequence
  Description of Artificial Sequence: Synthetic peptide
  Seed: RKVAELVHFL (MAGA3_HUMAN)
RVVAELVHFL

SEQ ID NO: 55501 - protein, 9 aa, Artificial Sequence
  Description of Artificial Sequence: Synthetic peptide
  Seed: QSPQGASSL (MAGA3_HUMAN)
QVPQGASSF

SEQ ID NO: 55502 - protein, 9 aa, Artificial Sequence
  Description of Artificial Sequence: Synthetic peptide
  Seed: VVGNWQYFF (MAGA3_HUMAN)
VLGNWQYFF

SEQ ID NO: 55503 - protein, 8 aa, Artificial Sequence
  Description of Artificial Sequence: Synthetic peptide
  Seed: LSRKVAEL (MAGA3_HUMAN)
LQRKVAEV

SEQ ID NO: 55504 - protein, 10 aa, Artificial Sequence
  Description of Artificial Sequence: Synthetic peptide
  Seed: FSKASSSLQL (MAGA3_HUMAN)
FEKASSSLQM

SEQ ID NO: 55505 - protein, 9 aa, Artificial Sequence
  Description of Artificial Sequence: Synthetic peptide
  Seed: SSSSTLVEV (MAGA3_HUMAN)
STSSTLVEY

SEQ ID NO: 55506 - protein, 10 aa, Artificial Sequence
  Description of Artificial Sequence: Synthetic peptide
  Seed: SDPACYEFLW (MAGA3_HUMAN)
SVPACYEFLW

SEQ ID NO: 55507 - protein, 10 aa, Artificial Sequence
  Description of Artificial Sequence: Synthetic peptide
  Seed: SLPTTMNYPL (MAGA3_HUMAN)
SNPTTMNYPL

SEQ ID NO: 55508 - protein, 10 aa, Artificial Sequence
  Description of Artificial Sequence: Synthetic peptide
  Seed: IFATCLGLSY (MAGA3_HUMAN)
IEATCLGLSF

SEQ ID NO: 55509 - protein, 9 aa, Artificial Sequence
  Description of Artificial Sequence: Synthetic peptide
  Seed: FATCLGLSY (MAGA3_HUMAN)
FVTCLGLSW

SEQ ID NO: 55510 - protein, 9 aa, Artificial Sequence
  Description of Artificial Sequence: Synthetic peptide
  Seed: KVAELVHFL (MAGA3_HUMAN)
KGAELVHFK

SEQ ID NO: 55511 - protein, 9 aa, Artificial Sequence
  Description of Artificial Sequence: Synthetic peptide
  Seed: RALVETSYV (MAGA3_HUMAN)
RALVETSYW

SEQ ID NO: 55512 - protein, 9 aa, Artificial Sequence
  Description of Artificial Sequence: Synthetic peptide
  Seed: KVAELVHFL (MAGA3_HUMAN)
KCAELVHFW

SEQ ID NO: 55513 - protein, 9 aa, Artificial Sequence
  Description of Artificial Sequence: Synthetic peptide
  Seed: ISYPPLHEW (MAGA3_HUMAN)
IEYPPLHEF

SEQ ID NO: 55514 - protein, 9 aa, Artificial Sequence
  Description of Artificial Sequence: Synthetic peptide
  Seed: SYVKVLHHM (MAGA3_HUMAN)
SRVKVLHHM

SEQ ID NO: 55515 - protein, 9 aa, Artificial Sequence
  Description of Artificial Sequence: Synthetic peptide
  Seed: HLYIFATCL (MAGA3_HUMAN)
HIYIFATCV

SEQ ID NO: 55516 - protein, 9 aa, Artificial Sequence
  Description of Artificial Sequence: Synthetic peptide
  Seed: GLVGAQAPA (MAGA3_HUMAN)
GMVGAQAPI

SEQ ID NO: 55517 - protein, 9 aa, Artificial Sequence
  Description of Artificial Sequence: Synthetic peptide
  Seed: ALSRKVAEL (MAGA3_HUMAN)
AQSRKVAEM

SEQ ID NO: 55518 - protein, 9 aa, Artificial Sequence
  Description of Artificial Sequence: Synthetic peptide
  Seed: GSDPACYEF (MAGA3_HUMAN)
GTDPACYEY

SEQ ID NO: 55519 - protein, 9 aa, Artificial Sequence
  Description of Artificial Sequence: Synthetic peptide
  Seed: KVAELVHFL (MAGA3_HUMAN)
KSAELVHFL

SEQ ID NO: 55520 - protein, 9 aa, Artificial Sequence
  Description of Artificial Sequence: Synthetic peptide
  Seed: MEVDPIGHL (MAGA3_HUMAN)
MQVDPIGHF

SEQ ID NO: 55521 - protein, 10 aa, Artificial Sequence
  Description of Artificial Sequence: Synthetic peptide
  Seed: TTMNYPLWSQ (MAGA3_HUMAN)
TNMNYPLWSR

SEQ ID NO: 55522 - protein, 9 aa, Artificial Sequence
  Description of Artificial Sequence: Synthetic peptide
  Seed: SVVGNWQYF (MAGA3_HUMAN)
SFVGNWQYM

SEQ ID NO: 55523 - protein, 10 aa, Artificial Sequence
  Description of Artificial Sequence: Synthetic peptide
  Seed: FLWGPRALVE (MAGA3_HUMAN)
FLWGPRALVF

SEQ ID NO: 55524 - protein, 9 aa, Artificial Sequence
  Description of Artificial Sequence: Synthetic peptide
  Seed: ISGGPHISY (MAGA3_HUMAN)
ITGGPHISW

SEQ ID NO: 55525 - protein, 9 aa, Artificial Sequence
  Description of Artificial Sequence: Synthetic peptide
  Seed: ISYPPLHEW (MAGA3_HUMAN)
ITYPPLHEY

SEQ ID NO: 55526 - protein, 10 aa, Artificial Sequence
  Description of Artificial Sequence: Synthetic peptide
  Seed: YFFPVIFSKA (MAGA3_HUMAN)
YLFPVIFSKM

SEQ ID NO: 55527 - protein, 10 aa, Artificial Sequence
  Description of Artificial Sequence: Synthetic peptide
  Seed: NWQYFFPVIF (MAGA3_HUMAN)
NLQYFFPVIY

SEQ ID NO: 55528 - protein, 9 aa, Artificial Sequence
  Description of Artificial Sequence: Synthetic peptide
  Seed: KVAELVHFL (MAGA3_HUMAN)
KPAELVHFL

SEQ ID NO: 55529 - protein, 9 aa, Artificial Sequence
  Description of Artificial Sequence: Synthetic peptide
  Seed: SVLEVFEGR (MAGA3_HUMAN)
SSLEVFEGY

SEQ ID NO: 55530 - protein, 10 aa, Artificial Sequence
  Description of Artificial Sequence: Synthetic peptide
  Seed: KASSSLQLVF (MAGA3_HUMAN)
KNSSSLQLVI

SEQ ID NO: 55531 - protein, 9 aa, Artificial Sequence
  Description of Artificial Sequence: Synthetic peptide
  Seed: YFFPVIFSK (MAGA3_HUMAN)
YIFPVIFSK

SEQ ID NO: 55532 - protein, 9 aa, Artificial Sequence
  Description of Artificial Sequence: Synthetic peptide
  Seed: GASSLPTTM (MAGA3_HUMAN)
GISSLPTTF

SEQ ID NO: 55533 - protein, 10 aa, Artificial Sequence
  Description of Artificial Sequence: Synthetic peptide
  Seed: KASSSLQLVF (MAGA3_HUMAN)
KVSSSLQLVW

SEQ ID NO: 55534 - protein, 10 aa, Artificial Sequence
  Description of Artificial Sequence: Synthetic peptide
  Seed: SDPACYEFLW (MAGA3_HUMAN)
SWPACYEFLW

SEQ ID NO: 55535 - protein, 10 aa, Artificial Sequence
  Description of Artificial Sequence: Synthetic peptide
  Seed: FSKASSSLQL (MAGA3_HUMAN)
FAKASSSLQW

SEQ ID NO: 55536 - protein, 10 aa, Artificial Sequence
  Description of Artificial Sequence: Synthetic peptide
  Seed: ISYPPLHEWV (MAGA3_HUMAN)
IGYPPLHEWI

SEQ ID NO: 55537 - protein, 10 aa, Artificial Sequence
  Description of Artificial Sequence: Synthetic peptide
  Seed: RQVPGSDPAC (MAGA3_HUMAN)
REVPGSDPAP

SEQ ID NO: 55538 - protein, 10 aa, Artificial Sequence
  Description of Artificial Sequence: Synthetic peptide
  Seed: HISYPPLHEW (MAGA3_HUMAN)
HISYPPLHEF

SEQ ID NO: 55539 - protein, 9 aa, Artificial Sequence
  Description of Artificial Sequence: Synthetic peptide
  Seed: SSLPTTMNY (MAGA3_HUMAN)
STLPTTMNL

SEQ ID NO: 55540 - protein, 11 aa, Artificial Sequence
  Description of Artificial Sequence: Synthetic peptide
  Seed: AQAPATEEQEA (MAGA3_HUMAN)
AVAPATEEQEF

SEQ ID NO: 55541 - protein, 9 aa, Artificial Sequence
  Description of Artificial Sequence: Synthetic peptide
  Seed: WQYFFPVIF (MAGA3_HUMAN)
WRYFFPVIF

SEQ ID NO: 55542 - protein, 11 aa, Artificial Sequence
  Description of Artificial Sequence: Synthetic peptide
  Seed: SNQEEEGPSTF (MAGA3_HUMAN)
SLQEEEGPSTY

SEQ ID NO: 55543 - protein, 8 aa, Artificial Sequence
  Description of Artificial Sequence: Synthetic peptide
  Seed: YVKVLHHM (MAGA3_HUMAN)
YLKVLHHL

SEQ ID NO: 55544 - protein, 10 aa, Artificial Sequence
  Description of Artificial Sequence: Synthetic peptide
  Seed: FVQENYLEYR (MAGA3_HUMAN)
FLQENYLEYR

SEQ ID NO: 55545 - protein, 9 aa, Artificial Sequence
  Description of Artificial Sequence: Synthetic peptide
  Seed: TFPDLESEF (MAGA3_HUMAN)
TRPDLESEF

SEQ ID NO: 55546 - protein, 10 aa, Artificial Sequence
  Description of Artificial Sequence: Synthetic peptide
  Seed: IFATCLGLSY (MAGA3_HUMAN)
IHATCLGLSY

SEQ ID NO: 55547 - protein, 10 aa, Artificial Sequence
  Description of Artificial Sequence: Synthetic peptide
  Seed: HISYPPLHEW (MAGA3_HUMAN)
HASYPPLHEL

SEQ ID NO: 55548 - protein, 10 aa, Artificial Sequence
  Description of Artificial Sequence: Synthetic peptide
  Seed: KVAELVHFLL (MAGA3_HUMAN)
KTAELVHFLL

SEQ ID NO: 55549 - protein, 10 aa, Artificial Sequence
  Description of Artificial Sequence: Synthetic peptide
  Seed: FFPVIFSKAS (MAGA3_HUMAN)
FPPVIFSKAV

SEQ ID NO: 55550 - protein, 10 aa, Artificial Sequence
  Description of Artificial Sequence: Synthetic peptide
  Seed: AESPDPPQSP (MAGA3_HUMAN)
AESPDPPQST

SEQ ID NO: 55551 - protein, 10 aa, Artificial Sequence
  Description of Artificial Sequence: Synthetic peptide
  Seed: AALSRKVAEL (MAGA3_HUMAN)
ASLSRKVAEV

SEQ ID NO: 55552 - protein, 9 aa, Artificial Sequence
  Description of Artificial Sequence: Synthetic peptide
  Seed: GNWQYFFPV (MAGA3_HUMAN)
GIWQYFFPL

SEQ ID NO: 55553 - protein, 9 aa, Artificial Sequence
  Description of Artificial Sequence: Synthetic peptide
  Seed: FQAALSRKV (MAGA3_HUMAN)
FVAALSRKI

SEQ ID NO: 55554 - protein, 9 aa, Artificial Sequence
  Description of Artificial Sequence: Synthetic peptide
  Seed: KVLHHMVKI (MAGA3_HUMAN)
KLLHHMVKW

SEQ ID NO: 55555 - protein, 9 aa, Artificial Sequence
  Description of Artificial Sequence: Synthetic peptide
  Seed: MEVDPIGHL (MAGA3_HUMAN)
MQVDPIGHV

SEQ ID NO: 55556 - protein, 10 aa, Artificial Sequence
  Description of Artificial Sequence: Synthetic peptide
  Seed: LQLVFGIELM (MAGA3_HUMAN)
LQLVFGIELY

SEQ ID NO: 55557 - protein, 10 aa, Artificial Sequence
  Description of Artificial Sequence: Synthetic peptide
  Seed: VDPIGHLYIF (MAGA3_HUMAN)
VYPIGHLYIY

SEQ ID NO: 55558 - protein, 9 aa, Artificial Sequence
  Description of Artificial Sequence: Synthetic peptide
  Seed: TQHFVQENY (MAGA3_HUMAN)
TQHFVQENW

SEQ ID NO: 55559 - protein, 9 aa, Artificial Sequence
  Description of Artificial Sequence: Synthetic peptide
  Seed: SSLQLVFGI (MAGA3_HUMAN)
SILQLVFGV

SEQ ID NO: 55560 - protein, 9 aa, Artificial Sequence
  Description of Artificial Sequence: Synthetic peptide
  Seed: SSSSTLVEV (MAGA3_HUMAN)
SVSSTLVEW

SEQ ID NO: 55561 - protein, 9 aa, Artificial Sequence
  Description of Artificial Sequence: Synthetic peptide
  Seed: GSVVGNWQY (MAGA3_HUMAN)
GQVVGNWQY

SEQ ID NO: 55562 - protein, 9 aa, Artificial Sequence
  Description of Artificial Sequence: Synthetic peptide
  Seed: LSRKVAELV (MAGA3_HUMAN)
LSRKVAELM

SEQ ID NO: 55563 - protein, 9 aa, Artificial Sequence
  Description of Artificial Sequence: Synthetic peptide
  Seed: KVLHHMVKI (MAGA3_HUMAN)
KQLHHMVKK

SEQ ID NO: 55564 - protein, 9 aa, Artificial Sequence
  Description of Artificial Sequence: Synthetic peptide
  Seed: KVAELVHFL (MAGA3_HUMAN)
KQAELVHFY

SEQ ID NO: 55565 - protein, 9 aa, Artificial Sequence
  Description of Artificial Sequence: Synthetic peptide
  Seed: TFPDLESEF (MAGA3_HUMAN)
TVPDLESEV

SEQ ID NO: 55566 - protein, 9 aa, Artificial Sequence
  Description of Artificial Sequence: Synthetic peptide
  Seed: GASSLPTTM (MAGA3_HUMAN)
GISSLPTTL

SEQ ID NO: 55567 - protein, 9 aa, Artificial Sequence
  Description of Artificial Sequence: Synthetic peptide
  Seed: IFSKASSSL (MAGA3_HUMAN)
IVSKASSSL

SEQ ID NO: 55568 - protein, 9 aa, Artificial Sequence
  Description of Artificial Sequence: Synthetic peptide
  Seed: SSLQLVFGI (MAGA3_HUMAN)
SILQLVFGI

SEQ ID NO: 55569 - protein, 10 aa, Artificial Sequence
  Description of Artificial Sequence: Synthetic peptide
  Seed: SLQLVFGIEL (MAGA3_HUMAN)
SYQLVFGIEY

SEQ ID NO: 55570 - protein, 10 aa, Artificial Sequence
  Description of Artificial Sequence: Synthetic peptide
  Seed: KISGGPHISY (MAGA3_HUMAN)
KQSGGPHISV

SEQ ID NO: 55571 - protein, 10 aa, Artificial Sequence
  Description of Artificial Sequence: Synthetic peptide
  Seed: LQLVFGIELM (MAGA3_HUMAN)
LYLVFGIELL

SEQ ID NO: 55572 - protein, 10 aa, Artificial Sequence
  Description of Artificial Sequence: Synthetic peptide
  Seed: YRQVPGSDPA (MAGA3_HUMAN)
YQQVPGSDPV

SEQ ID NO: 55573 - protein, 9 aa, Artificial Sequence
  Description of Artificial Sequence: Synthetic peptide
  Seed: YIFATCLGL (MAGA3_HUMAN)
YTFATCLGM

SEQ ID NO: 55574 - protein, 9 aa, Artificial Sequence
  Description of Artificial Sequence: Synthetic peptide
  Seed: ALSRKVAEL (MAGA3_HUMAN)
AISRKVAEI

SEQ ID NO: 55575 - protein, 9 aa, Artificial Sequence
  Description of Artificial Sequence: Synthetic peptide
  Seed: TQHFVQENY (MAGA3_HUMAN)
TAHFVQENF

SEQ ID NO: 55576 - protein, 9 aa, Artificial Sequence
  Description of Artificial Sequence: Synthetic peptide
  Seed: ILGDPKKLL (MAGA3_HUMAN)
IRGDPKKLF

SEQ ID NO: 55577 - protein, 10 aa, Artificial Sequence
  Description of Artificial Sequence: Synthetic peptide
  Seed: HFVQENYLEY (MAGA3_HUMAN)
HYVQENYLEL

SEQ ID NO: 55578 - protein, 9 aa, Artificial Sequence
  Description of Artificial Sequence: Synthetic peptide
  Seed: QSPQGASSL (MAGA3_HUMAN)
QGPQGASSM

SEQ ID NO: 55579 - protein, 10 aa, Artificial Sequence
  Description of Artificial Sequence: Synthetic peptide
  Seed: ASSLPTTMNY (MAGA3_HUMAN)
AVSLPTTMNR

SEQ ID NO: 55580 - protein, 9 aa, Artificial Sequence
  Description of Artificial Sequence: Synthetic peptide
  Seed: RALVETSYV (MAGA3_HUMAN)
RILVETSYL

SEQ ID NO: 55581 - protein, 9 aa, Artificial Sequence
  Description of Artificial Sequence: Synthetic peptide
  Seed: LSRKVAELV (MAGA3_HUMAN)
LMRKVAELK

SEQ ID NO: 55582 - protein, 9 aa, Artificial Sequence
  Description of Artificial Sequence: Synthetic peptide
  Seed: SSLPTTMNY (MAGA3_HUMAN)
SMLPTTMNM

SEQ ID NO: 55583 - protein, 9 aa, Artificial Sequence
  Description of Artificial Sequence: Synthetic peptide
  Seed: NYPLWSQSY (MAGA3_HUMAN)
NFPLWSQSW

SEQ ID NO: 55584 - protein, 9 aa, Artificial Sequence
  Description of Artificial Sequence: Synthetic peptide
  Seed: YFFPVIFSK (MAGA3_HUMAN)
YMFPVIFSI

SEQ ID NO: 55585 - protein, 10 aa, Artificial Sequence
  Description of Artificial Sequence: Synthetic peptide
  Seed: LVFGIELMEV (MAGA3_HUMAN)
LSFGIELMEV

SEQ ID NO: 55586 - protein, 10 aa, Artificial Sequence
  Description of Artificial Sequence: Synthetic peptide
  Seed: AALSRKVAEL (MAGA3_HUMAN)
AFLSRKVAEI

SEQ ID NO: 55587 - protein, 9 aa, Artificial Sequence
  Description of Artificial Sequence: Synthetic peptide
  Seed: ISYPPLHEW (MAGA3_HUMAN)
IVYPPLHEY

SEQ ID NO: 55588 - protein, 11 aa, Artificial Sequence
  Description of Artificial Sequence: Synthetic peptide
  Seed: YIFATCLGLSY (MAGA3_HUMAN)
YRFATCLGLSF

SEQ ID NO: 55589 - protein, 9 aa, Artificial Sequence
  Description of Artificial Sequence: Synthetic peptide
  Seed: KVAELVHFL (MAGA3_HUMAN)
KAAELVHFW

SEQ ID NO: 55590 - protein, 9 aa, Artificial Sequence
  Description of Artificial Sequence: Synthetic peptide
  Seed: VTLGEVPAA (MAGA3_HUMAN)
VQLGEVPAL

SEQ ID NO: 55591 - protein, 9 aa, Artificial Sequence
  Description of Artificial Sequence: Synthetic peptide
  Seed: YIFATCLGL (MAGA3_HUMAN)
YYFATCLGY

SEQ ID NO: 55592 - protein, 9 aa, Artificial Sequence
  Description of Artificial Sequence: Synthetic peptide
  Seed: FLWGPRALV (MAGA3_HUMAN)
FAWGPRALM

SEQ ID NO: 55593 - protein, 10 aa, Artificial Sequence
  Description of Artificial Sequence: Synthetic peptide
  Seed: QYFFPVIFSK (MAGA3_HUMAN)
QKFFPVIFSR

SEQ ID NO: 55594 - protein, 9 aa, Artificial Sequence
  Description of Artificial Sequence: Synthetic peptide
  Seed: LGDPKKLLT (MAGA3_HUMAN)
LIDPKKLLL

SEQ ID NO: 55595 - protein, 9 aa, Artificial Sequence
  Description of Artificial Sequence: Synthetic peptide
  Seed: GASSLPTTM (MAGA3_HUMAN)
GPSSLPTTM

SEQ ID NO: 55596 - protein, 10 aa, Artificial Sequence
  Description of Artificial Sequence: Synthetic peptide
  Seed: ASSSSTLVEV (MAGA3_HUMAN)
ALSSSTLVEI

SEQ ID NO: 55597 - protein, 10 aa, Artificial Sequence
  Description of Artificial Sequence: Synthetic peptide
  Seed: KASSSLQLVF (MAGA3_HUMAN)
KMSSSLQLVM

SEQ ID NO: 55598 - protein, 9 aa, Artificial Sequence
  Description of Artificial Sequence: Synthetic peptide
  Seed: YPLWSQSYE (MAGA3_HUMAN)
YPLWSQSYF

SEQ ID NO: 55599 - protein, 9 aa, Artificial Sequence
  Description of Artificial Sequence: Synthetic peptide
  Seed: FQAALSRKV (MAGA3_HUMAN)
FMAALSRKI

SEQ ID NO: 55600 - protein, 9 aa, Artificial Sequence
  Description of Artificial Sequence: Synthetic peptide
  Seed: YVKVLHHMV (MAGA3_HUMAN)
YMKVLHHMF

SEQ ID NO: 55601 - protein, 9 aa, Artificial Sequence
  Description of Artificial Sequence: Synthetic peptide
  Seed: ASSSLQLVF (MAGA3_HUMAN)
ALSSLQLVY

SEQ ID NO: 55602 - protein, 10 aa, Artificial Sequence
  Description of Artificial Sequence: Synthetic peptide
  Seed: STFPDLESEF (MAGA3_HUMAN)
SRFPDLESEM

SEQ ID NO: 55603 - protein, 9 aa, Artificial Sequence
  Description of Artificial Sequence: Synthetic peptide
  Seed: LESEFQAAL (MAGA3_HUMAN)
LSSEFQAAF

SEQ ID NO: 55604 - protein, 10 aa, Artificial Sequence
  Description of Artificial Sequence: Synthetic peptide
  Seed: RKVAELVHFL (MAGA3_HUMAN)
RFVAELVHFM

SEQ ID NO: 55605 - protein, 10 aa, Artificial Sequence
  Description of Artificial Sequence: Synthetic peptide
  Seed: LGSVVGNWQY (MAGA3_HUMAN)
LCSVVGNWQF

SEQ ID NO: 55606 - protein, 10 aa, Artificial Sequence
  Description of Artificial Sequence: Synthetic peptide
  Seed: MVKISGGPHI (MAGA3_HUMAN)
MGKISGGPHM

SEQ ID NO: 55607 - protein, 9 aa, Artificial Sequence
  Description of Artificial Sequence: Synthetic peptide
  Seed: LVHFLLLKY (MAGA3_HUMAN)
LTHFLLLKY

SEQ ID NO: 55608 - protein, 9 aa, Artificial Sequence
  Description of Artificial Sequence: Synthetic peptide
  Seed: YIFATCLGL (MAGA3_HUMAN)
YIFATCLGM

SEQ ID NO: 55609 - protein, 10 aa, Artificial Sequence
  Description of Artificial Sequence: Synthetic peptide
  Seed: KVAELVHFLL (MAGA3_HUMAN)
KLAELVHFLM

SEQ ID NO: 55610 - protein, 8 aa, Artificial Sequence
  Description of Artificial Sequence: Synthetic peptide
  Seed: VLHHMVKI (MAGA3_HUMAN)
VQHHMVKI

SEQ ID NO: 55611 - protein, 9 aa, Artificial Sequence
  Description of Artificial Sequence: Synthetic peptide
  Seed: IFSKASSSL (MAGA3_HUMAN)
IYSKASSSM

SEQ ID NO: 55612 - protein, 9 aa, Artificial Sequence
  Description of Artificial Sequence: Synthetic peptide
  Seed: FVQENYLEY (MAGA3_HUMAN)
FFQENYLEW

SEQ ID NO: 55613 - protein, 10 aa, Artificial Sequence
  Description of Artificial Sequence: Synthetic peptide
  Seed: KVAELVHFLL (MAGA3_HUMAN)
KMAELVHFLN

SEQ ID NO: 55614 - protein, 10 aa, Artificial Sequence
  Description of Artificial Sequence: Synthetic peptide
  Seed: ELMEVDPIGH (MAGA3_HUMAN)
EAMEVDPIGR

SEQ ID NO: 55615 - protein, 8 aa, Artificial Sequence
  Description of Artificial Sequence: Synthetic peptide
  Seed: SGGPHISY (MAGA3_HUMAN)
SRGPHISY

SEQ ID NO: 55616 - protein, 9 aa, Artificial Sequence
  Description of Artificial Sequence: Synthetic peptide
  Seed: SSSSTLVEV (MAGA3_HUMAN)
SISSTLVEF

SEQ ID NO: 55617 - protein, 9 aa, Artificial Sequence
  Description of Artificial Sequence: Synthetic peptide
  Seed: TQHFVQENY (MAGA3_HUMAN)
TAHFVQENY

SEQ ID NO: 55618 - protein, 9 aa, Artificial Sequence
  Description of Artificial Sequence: Synthetic peptide
  Seed: GNWQYFFPV (MAGA3_HUMAN)
GSWQYFFPL

SEQ ID NO: 55619 - protein, 10 aa, Artificial Sequence
  Description of Artificial Sequence: Synthetic peptide
  Seed: SYVKVLHHMV (MAGA3_HUMAN)
SFVKVLHHMF

SEQ ID NO: 55620 - protein, 9 aa, Artificial Sequence
  Description of Artificial Sequence: Synthetic peptide
  Seed: LVHFLLLKY (MAGA3_HUMAN)
LWHFLLLKY

SEQ ID NO: 55621 - protein, 10 aa, Artificial Sequence
  Description of Artificial Sequence: Synthetic peptide
  Seed: MVKISGGPHI (MAGA3_HUMAN)
MMKISGGPHM

SEQ ID NO: 55622 - protein, 10 aa, Artificial Sequence
  Description of Artificial Sequence: Synthetic peptide
  Seed: KAEMLGSVVG (MAGA3_HUMAN)
KMEMLGSVVV

SEQ ID NO: 55623 - protein, 9 aa, Artificial Sequence
  Description of Artificial Sequence: Synthetic peptide
  Seed: FVQENYLEY (MAGA3_HUMAN)
FVQENYLEH

SEQ ID NO: 55624 - protein, 9 aa, Artificial Sequence
  Description of Artificial Sequence: Synthetic peptide
  Seed: TEEQEAASS (MAGA3_HUMAN)
TEEQEAASV

SEQ ID NO: 55625 - protein, 9 aa, Artificial Sequence
  Description of Artificial Sequence: Synthetic peptide
  Seed: QLVFGIELM (MAGA3_HUMAN)
QTVFGIELV

SEQ ID NO: 55626 - protein, 9 aa, Artificial Sequence
  Description of Artificial Sequence: Synthetic peptide
  Seed: SSTLVEVTL (MAGA3_HUMAN)
SITLVEVTF

SEQ ID NO: 55627 - protein, 9 aa, Artificial Sequence
  Description of Artificial Sequence: Synthetic peptide
  Seed: KVLHHMVKI (MAGA3_HUMAN)
KTLHHMVKW

SEQ ID NO: 55628 - protein, 9 aa, Artificial Sequence
  Description of Artificial Sequence: Synthetic peptide
  Seed: SILGDPKKL (MAGA3_HUMAN)
SRLGDPKKF

SEQ ID NO: 55629 - protein, 9 aa, Artificial Sequence
  Description of Artificial Sequence: Synthetic peptide
  Seed: FVQENYLEY (MAGA3_HUMAN)
FGQENYLEV

SEQ ID NO: 55630 - protein, 9 aa, Artificial Sequence
  Description of Artificial Sequence: Synthetic peptide
  Seed: LQLVFGIEL (MAGA3_HUMAN)
LHLVFGIEA

SEQ ID NO: 55631 - protein, 10 aa, Artificial Sequence
  Description of Artificial Sequence: Synthetic peptide
  Seed: KASSSLQLVF (MAGA3_HUMAN)
KMSSSLQLVY

SEQ ID NO: 55632 - protein, 11 aa, Artificial Sequence
  Description of Artificial Sequence: Synthetic peptide
  Seed: REGDCAPEEKI (MAGA3_HUMAN)
RQGDCAPEEKL

SEQ ID NO: 55633 - protein, 9 aa, Artificial Sequence
  Description of Artificial Sequence: Synthetic peptide
  Seed: LPTTMNYPL (MAGA3_HUMAN)
LHTTMNYPV

SEQ ID NO: 55634 - protein, 9 aa, Artificial Sequence
  Description of Artificial Sequence: Synthetic peptide
  Seed: ASSSLQLVF (MAGA3_HUMAN)
AESSLQLVF

SEQ ID NO: 55635 - protein, 10 aa, Artificial Sequence
  Description of Artificial Sequence: Synthetic peptide
  Seed: RQVPGSDPAC (MAGA3_HUMAN)
RGVPGSDPAY

SEQ ID NO: 55636 - protein, 10 aa, Artificial Sequence
  Description of Artificial Sequence: Synthetic peptide
  Seed: RQVPGSDPAC (MAGA3_HUMAN)
REVPGSDPAM

SEQ ID NO: 55637 - protein, 9 aa, Artificial Sequence
  Description of Artificial Sequence: Synthetic peptide
  Seed: EARGEALGL (MAGA3_HUMAN)
EVRGEALGR

SEQ ID NO: 55638 - protein, 10 aa, Artificial Sequence
  Description of Artificial Sequence: Synthetic peptide
  Seed: HISYPPLHEW (MAGA3_HUMAN)
HYSYPPLHEY

SEQ ID NO: 55639 - protein, 9 aa, Artificial Sequence
  Description of Artificial Sequence: Synthetic peptide
  Seed: KASSSLQLV (MAGA3_HUMAN)
KCSSSLQLW

SEQ ID NO: 55640 - protein, 9 aa, Artificial Sequence
  Description of Artificial Sequence: Synthetic peptide
  Seed: QEEEGPSTF (MAGA3_HUMAN)
QHEEGPSTL

SEQ ID NO: 55641 - protein, 9 aa, Artificial Sequence
  Description of Artificial Sequence: Synthetic peptide
  Seed: VVGNWQYFF (MAGA3_HUMAN)
VQGNWQYFY

SEQ ID NO: 55642 - protein, 9 aa, Artificial Sequence
  Description of Artificial Sequence: Synthetic peptide
  Seed: LVHFLLLKY (MAGA3_HUMAN)
LYHFLLLKY

SEQ ID NO: 55643 - protein, 11 aa, Artificial Sequence
  Description of Artificial Sequence: Synthetic peptide
  Seed: AQAPATEEQEA (MAGA3_HUMAN)
ALAPATEEQEF

SEQ ID NO: 55644 - protein, 8 aa, Artificial Sequence
  Description of Artificial Sequence: Synthetic peptide
  Seed: LESEFQAA (MAGA3_HUMAN)
LESEFQAI

SEQ ID NO: 55645 - protein, 10 aa, Artificial Sequence
  Description of Artificial Sequence: Synthetic peptide
  Seed: RALVETSYVK (MAGA3_HUMAN)
RMLVETSYVR

SEQ ID NO: 55646 - protein, 9 aa, Artificial Sequence
  Description of Artificial Sequence: Synthetic peptide
  Seed: FPVIFSKAS (MAGA3_HUMAN)
FSVIFSKAY

SEQ ID NO: 55647 - protein, 9 aa, Artificial Sequence
  Description of Artificial Sequence: Synthetic peptide
  Seed: GNWQYFFPV (MAGA3_HUMAN)
GTWQYFFPI

SEQ ID NO: 55648 - protein, 9 aa, Artificial Sequence
  Description of Artificial Sequence: Synthetic peptide
  Seed: MEVDPIGHL (MAGA3_HUMAN)
MPVDPIGHY

SEQ ID NO: 55649 - protein, 9 aa, Artificial Sequence
  Description of Artificial Sequence: Synthetic peptide
  Seed: MPKAGLLII (MAGA3_HUMAN)
MQKAGLLII

SEQ ID NO: 55650 - protein, 9 aa, Artificial Sequence
  Description of Artificial Sequence: Synthetic peptide
  Seed: TFPDLESEF (MAGA3_HUMAN)
TIPDLESEF

SEQ ID NO: 55651 - protein, 10 aa, Artificial Sequence
  Description of Artificial Sequence: Synthetic peptide
  Seed: AELVHFLLLK (MAGA3_HUMAN)
ASLVHFLLLR

SEQ ID NO: 55652 - protein, 10 aa, Artificial Sequence
  Description of Artificial Sequence: Synthetic peptide
  Seed: ISYPPLHEWV (MAGA3_HUMAN)
ILYPPLHEWA

SEQ ID NO: 55653 - protein, 10 aa, Artificial Sequence
  Description of Artificial Sequence: Synthetic peptide
  Seed: KASSSLQLVF (MAGA3_HUMAN)
KHSSSLQLVY

SEQ ID NO: 55654 - protein, 9 aa, Artificial Sequence
  Description of Artificial Sequence: Synthetic peptide
  Seed: EAASSSSTL (MAGA3_HUMAN)
EMASSSSTV

SEQ ID NO: 55655 - protein, 9 aa, Artificial Sequence
  Description of Artificial Sequence: Synthetic peptide
  Seed: KVLHHMVKI (MAGA3_HUMAN)
KSLHHMVKW

SEQ ID NO: 55656 - protein, 9 aa, Artificial Sequence
  Description of Artificial Sequence: Synthetic peptide
  Seed: YIFATCLGL (MAGA3_HUMAN)
YSFATCLGR

SEQ ID NO: 55657 - protein, 9 aa, Artificial Sequence
  Description of Artificial Sequence: Synthetic peptide
  Seed: SSSSTLVEV (MAGA3_HUMAN)
SASSTLVEL

SEQ ID NO: 55658 - protein, 9 aa, Artificial Sequence
  Description of Artificial Sequence: Synthetic peptide
  Seed: ILGDPKKLL (MAGA3_HUMAN)
IMGDPKKLV

SEQ ID NO: 55659 - protein, 9 aa, Artificial Sequence
  Description of Artificial Sequence: Synthetic peptide
  Seed: ISYPPLHEW (MAGA3_HUMAN)
ISYPPLHEY

SEQ ID NO: 55660 - protein, 9 aa, Artificial Sequence
  Description of Artificial Sequence: Synthetic peptide
  Seed: SKASSSLQL (MAGA3_HUMAN)
SSASSSLQY

SEQ ID NO: 55661 - protein, 8 aa, Artificial Sequence
  Description of Artificial Sequence: Synthetic peptide
  Seed: FPDLESEF (MAGA3_HUMAN)
FFDLESEM

SEQ ID NO: 55662 - protein, 11 aa, Artificial Sequence
  Description of Artificial Sequence: Synthetic peptide
  Seed: HCKPEEGLEAR (MAGA3_HUMAN)
HAKPEEGLEAF

SEQ ID NO: 55663 - protein, 10 aa, Artificial Sequence
  Description of Artificial Sequence: Synthetic peptide
  Seed: MNYPLWSQSY (MAGA3_HUMAN)
MIYPLWSQSY

SEQ ID NO: 55664 - protein, 9 aa, Artificial Sequence
  Description of Artificial Sequence: Synthetic peptide
  Seed: MPKAGLLII (MAGA3_HUMAN)
MSKAGLLIF

SEQ ID NO: 55665 - protein, 10 aa, Artificial Sequence
  Description of Artificial Sequence: Synthetic peptide
  Seed: FSKASSSLQL (MAGA3_HUMAN)
FPKASSSLQM

SEQ ID NO: 55666 - protein, 9 aa, Artificial Sequence
  Description of Artificial Sequence: Synthetic peptide
  Seed: IMPKAGLLI (MAGA3_HUMAN)
ISPKAGLLI

SEQ ID NO: 55667 - protein, 11 aa, Artificial Sequence
  Description of Artificial Sequence: Synthetic peptide
  Seed: SNQEEEGPSTF (MAGA3_HUMAN)
SQQEEEGPSTY

SEQ ID NO: 55668 - protein, 10 aa, Artificial Sequence
  Description of Artificial Sequence: Synthetic peptide
  Seed: ISYPPLHEWV (MAGA3_HUMAN)
ILYPPLHEWI

SEQ ID NO: 55669 - protein, 9 aa, Artificial Sequence
  Description of Artificial Sequence: Synthetic peptide
  Seed: RALVETSYV (MAGA3_HUMAN)
RGLVETSYW

SEQ ID NO: 55670 - protein, 10 aa, Artificial Sequence
  Description of Artificial Sequence: Synthetic peptide
  Seed: KASSSLQLVF (MAGA3_HUMAN)
KRSSSLQLVI

SEQ ID NO: 55671 - protein, 10 aa, Artificial Sequence
  Description of Artificial Sequence: Synthetic peptide
  Seed: ISYPPLHEWV (MAGA3_HUMAN)
ILYPPLHEWT

SEQ ID NO: 55672 - protein, 9 aa, Artificial Sequence
  Description of Artificial Sequence: Synthetic peptide
  Seed: KVAELVHFL (MAGA3_HUMAN)
KNAELVHFW

SEQ ID NO: 55673 - protein, 9 aa, Artificial Sequence
  Description of Artificial Sequence: Synthetic peptide
  Seed: RQVPGSDPA (MAGA3_HUMAN)
RKVPGSDPY

SEQ ID NO: 55674 - protein, 9 aa, Artificial Sequence
  Description of Artificial Sequence: Synthetic peptide
  Seed: SVLEVFEGR (MAGA3_HUMAN)
SLLEVFEGR

SEQ ID NO: 55675 - protein, 10 aa, Artificial Sequence
  Description of Artificial Sequence: Synthetic peptide
  Seed: TTMNYPLWSQ (MAGA3_HUMAN)
TAMNYPLWSR

SEQ ID NO: 55676 - protein, 10 aa, Artificial Sequence
  Description of Artificial Sequence: Synthetic peptide
  Seed: KISGGPHISY (MAGA3_HUMAN)
KLSGGPHISF

SEQ ID NO: 55677 - protein, 9 aa, Artificial Sequence
  Description of Artificial Sequence: Synthetic peptide
  Seed: ISYPPLHEW (MAGA3_HUMAN)
IPYPPLHEM

SEQ ID NO: 55678 - protein, 10 aa, Artificial Sequence
  Description of Artificial Sequence: Synthetic peptide
  Seed: VIFSKASSSL (MAGA3_HUMAN)
VIFSKASSSV

SEQ ID NO: 55679 - protein, 8 aa, Artificial Sequence
  Description of Artificial Sequence: Synthetic peptide
  Seed: QYFFPVIF (MAGA3_HUMAN)
QMFFPVIF

SEQ ID NO: 55680 - protein, 10 aa, Artificial Sequence
  Description of Artificial Sequence: Synthetic peptide
  Seed: HFVQENYLEY (MAGA3_HUMAN)
HAVQENYLEY

SEQ ID NO: 55681 - protein, 10 aa, Artificial Sequence
  Description of Artificial Sequence: Synthetic peptide
  Seed: YIFATCLGLS (MAGA3_HUMAN)
YLFATCLGLS

SEQ ID NO: 55682 - protein, 10 aa, Artificial Sequence
  Description of Artificial Sequence: Synthetic peptide
  Seed: ISYPPLHEWV (MAGA3_HUMAN)
IGYPPLHEWF

SEQ ID NO: 55683 - protein, 8 aa, Artificial Sequence
  Description of Artificial Sequence: Synthetic peptide
  Seed: FPDLESEF (MAGA3_HUMAN)
FTDLESEM

SEQ ID NO: 55684 - protein, 10 aa, Artificial Sequence
  Description of Artificial Sequence: Synthetic peptide
  Seed: AEMLGSVVGN (MAGA3_HUMAN)
AEMLGSVVGY

SEQ ID NO: 55685 - protein, 9 aa, Artificial Sequence
  Description of Artificial Sequence: Synthetic peptide
  Seed: GEVPAAESP (MAGA3_HUMAN)
GDVPAAESM

SEQ ID NO: 55686 - protein, 9 aa, Artificial Sequence
  Description of Artificial Sequence: Synthetic peptide
  Seed: ASSSLQLVF (MAGA3_HUMAN)
AKSSLQLVL

SEQ ID NO: 55687 - protein, 11 aa, Artificial Sequence
  Description of Artificial Sequence: Synthetic peptide
  Seed: RQVPGSDPACY (MAGA3_HUMAN)
RIVPGSDPACF

SEQ ID NO: 55688 - protein, 10 aa, Artificial Sequence
  Description of Artificial Sequence: Synthetic peptide
  Seed: QEEEGPSTFP (MAGA3_HUMAN)
QEEEGPSTFL

SEQ ID NO: 55689 - protein, 10 aa, Artificial Sequence
  Description of Artificial Sequence: Synthetic peptide
  Seed: ASSLPTTMNY (MAGA3_HUMAN)
AMSLPTTMNW

SEQ ID NO: 55690 - protein, 9 aa, Artificial Sequence
  Description of Artificial Sequence: Synthetic peptide
  Seed: SSSSTLVEV (MAGA3_HUMAN)
SQSSTLVEY

SEQ ID NO: 55691 - protein, 9 aa, Artificial Sequence
  Description of Artificial Sequence: Synthetic peptide
  Seed: GSDPACYEF (MAGA3_HUMAN)
GVDPACYEL

SEQ ID NO: 55692 - protein, 9 aa, Artificial Sequence
  Description of Artificial Sequence: Synthetic peptide
  Seed: RQVPGSDPA (MAGA3_HUMAN)
RMVPGSDPI

SEQ ID NO: 55693 - protein, 9 aa, Artificial Sequence
  Description of Artificial Sequence: Synthetic peptide
  Seed: SYVKVLHHM (MAGA3_HUMAN)
SYVKVLHHW

SEQ ID NO: 55694 - protein, 9 aa, Artificial Sequence
  Description of Artificial Sequence: Synthetic peptide
  Seed: AEMLGSVVG (MAGA3_HUMAN)
AEMLGSVVW

SEQ ID NO: 55695 - protein, 9 aa, Artificial Sequence
  Description of Artificial Sequence: Synthetic peptide
  Seed: GLVGAQAPA (MAGA3_HUMAN)
GMVGAQAPV

SEQ ID NO: 55696 - protein, 9 aa, Artificial Sequence
  Description of Artificial Sequence: Synthetic peptide
  Seed: YFFPVIFSK (MAGA3_HUMAN)
YDFPVIFSY

SEQ ID NO: 55697 - protein, 9 aa, Artificial Sequence
  Description of Artificial Sequence: Synthetic peptide
  Seed: LQLVFGIEL (MAGA3_HUMAN)
LALVFGIEY

SEQ ID NO: 55698 - protein, 10 aa, Artificial Sequence
  Description of Artificial Sequence: Synthetic peptide
  Seed: SEFQAALSRK (MAGA3_HUMAN)
SMFQAALSRR

SEQ ID NO: 55699 - protein, 9 aa, Artificial Sequence
  Description of Artificial Sequence: Synthetic peptide
  Seed: FQAALSRKV (MAGA3_HUMAN)
FHAALSRKY

SEQ ID NO: 55700 - protein, 8 aa, Artificial Sequence
  Description of Artificial Sequence: Synthetic peptide
  Seed: LESEFQAA (MAGA3_HUMAN)
LESEFQAL

SEQ ID NO: 55701 - protein, 9 aa, Artificial Sequence
  Description of Artificial Sequence: Synthetic peptide
  Seed: SSSSTLVEV (MAGA3_HUMAN)
SLSSTLVEC

SEQ ID NO: 55702 - protein, 10 aa, Artificial Sequence
  Description of Artificial Sequence: Synthetic peptide
  Seed: WEELSVLEVF (MAGA3_HUMAN)
WAELSVLEVM

SEQ ID NO: 55703 - protein, 9 aa, Artificial Sequence
  Description of Artificial Sequence: Synthetic peptide
  Seed: EVDPIGHLY (MAGA3_HUMAN)
EQDPIGHLM

SEQ ID NO: 55704 - protein, 11 aa, Artificial Sequence
  Description of Artificial Sequence: Synthetic peptide
  Seed: YIFATCLGLSY (MAGA3_HUMAN)
YLFATCLGLSY

SEQ ID NO: 55705 - protein, 8 aa, Artificial Sequence
  Description of Artificial Sequence: Synthetic peptide
  Seed: WQYFFPVI (MAGA3_HUMAN)
WMYFFPVF

SEQ ID NO: 55706 - protein, 9 aa, Artificial Sequence
  Description of Artificial Sequence: Synthetic peptide
  Seed: QEEEGPSTF (MAGA3_HUMAN)
QQEEGPSTW

SEQ ID NO: 55707 - protein, 9 aa, Artificial Sequence
  Description of Artificial Sequence: Synthetic peptide
  Seed: IFSKASSSL (MAGA3_HUMAN)
IQSKASSSF

SEQ ID NO: 55708 - protein, 9 aa, Artificial Sequence
  Description of Artificial Sequence: Synthetic peptide
  Seed: ASSSLQLVF (MAGA3_HUMAN)
AASSLQLVI

SEQ ID NO: 55709 - protein, 9 aa, Artificial Sequence
  Description of Artificial Sequence: Synthetic peptide
  Seed: TFPDLESEF (MAGA3_HUMAN)
TWPDLESEF

SEQ ID NO: 55710 - protein, 9 aa, Artificial Sequence
  Description of Artificial Sequence: Synthetic peptide
  Seed: KIWEELSVL (MAGA3_HUMAN)
KIWEELSVI

SEQ ID NO: 55711 - protein, 9 aa, Artificial Sequence
  Description of Artificial Sequence: Synthetic peptide
  Seed: MPKAGLLII (MAGA3_HUMAN)
MAKAGLLIY

SEQ ID NO: 55712 - protein, 9 aa, Artificial Sequence
  Description of Artificial Sequence: Synthetic peptide
  Seed: RALVETSYV (MAGA3_HUMAN)
RYLVETSYY

SEQ ID NO: 55713 - protein, 9 aa, Artificial Sequence
  Description of Artificial Sequence: Synthetic peptide
  Seed: IFSKASSSL (MAGA3_HUMAN)
IISKASSSL

SEQ ID NO: 55714 - protein, 9 aa, Artificial Sequence
  Description of Artificial Sequence: Synthetic peptide
  Seed: ILGDPKKLL (MAGA3_HUMAN)
IAGDPKKLF

SEQ ID NO: 55715 - protein, 11 aa, Artificial Sequence
  Description of Artificial Sequence: Synthetic peptide
  Seed: SKASSSLQLVF (MAGA3_HUMAN)
SSASSSLQLVW

SEQ ID NO: 55716 - protein, 10 aa, Artificial Sequence
  Description of Artificial Sequence: Synthetic peptide
  Seed: MNYPLWSQSY (MAGA3_HUMAN)
MFYPLWSQSI

SEQ ID NO: 55717 - protein, 9 aa, Artificial Sequence
  Description of Artificial Sequence: Synthetic peptide
  Seed: AASSSSTLV (MAGA3_HUMAN)
AMSSSSTLI

SEQ ID NO: 55718 - protein, 9 aa, Artificial Sequence
  Description of Artificial Sequence: Synthetic peptide
  Seed: ISYPPLHEW (MAGA3_HUMAN)
IMYPPLHEV

SEQ ID NO: 55719 - protein, 9 aa, Artificial Sequence
  Description of Artificial Sequence: Synthetic peptide
  Seed: KVAELVHFL (MAGA3_HUMAN)
KRAELVHFL

SEQ ID NO: 55720 - protein, 10 aa, Artificial Sequence
  Description of Artificial Sequence: Synthetic peptide
  Seed: TTMNYPLWSQ (MAGA3_HUMAN)
TIMNYPLWSK

SEQ ID NO: 55721 - protein, 9 aa, Artificial Sequence
  Description of Artificial Sequence: Synthetic peptide
  Seed: TSYVKVLHH (MAGA3_HUMAN)
TAYVKVLHR

SEQ ID NO: 55722 - protein, 10 aa, Artificial Sequence
  Description of Artificial Sequence: Synthetic peptide
  Seed: MNYPLWSQSY (MAGA3_HUMAN)
MKYPLWSQSM

SEQ ID NO: 55723 - protein, 10 aa, Artificial Sequence
  Description of Artificial Sequence: Synthetic peptide
  Seed: SLPTTMNYPL (MAGA3_HUMAN)
SDPTTMNYPM

SEQ ID NO: 55724 - protein, 9 aa, Artificial Sequence
  Description of Artificial Sequence: Synthetic peptide
  Seed: EVDPIGHLY (MAGA3_HUMAN)
ESDPIGHLY

SEQ ID NO: 55725 - protein, 10 aa, Artificial Sequence
  Description of Artificial Sequence: Synthetic peptide
  Seed: ELVHFLLLKY (MAGA3_HUMAN)
ESVHFLLLKK

SEQ ID NO: 55726 - protein, 11 aa, Artificial Sequence
  Description of Artificial Sequence: Synthetic peptide
  Seed: EEGLEARGEAL (MAGA3_HUMAN)
EEGLEARGEAF

SEQ ID NO: 55727 - protein, 9 aa, Artificial Sequence
  Description of Artificial Sequence: Synthetic peptide
  Seed: QEEEGPSTF (MAGA3_HUMAN)
QLEEGPSTF

SEQ ID NO: 55728 - protein, 9 aa, Artificial Sequence
  Description of Artificial Sequence: Synthetic peptide
  Seed: MPLEQRSQH (MAGA3_HUMAN)
MILEQRSQY

SEQ ID NO: 55729 - protein, 9 aa, Artificial Sequence
  Description of Artificial Sequence: Synthetic peptide
  Seed: IMPKAGLLI (MAGA3_HUMAN)
IRPKAGLLF

SEQ ID NO: 55730 - protein, 9 aa, Artificial Sequence
  Description of Artificial Sequence: Synthetic peptide
  Seed: EAASSSSTL (MAGA3_HUMAN)
EVASSSSTI

SEQ ID NO: 55731 - protein, 9 aa, Artificial Sequence
  Description of Artificial Sequence: Synthetic peptide
  Seed: IIVLAIIAR (MAGA3_HUMAN)
ISVLAIIAR

SEQ ID NO: 55732 - protein, 9 aa, Artificial Sequence
  Description of Artificial Sequence: Synthetic peptide
  Seed: KIWEELSVL (MAGA3_HUMAN)
KMWEELSVW

SEQ ID NO: 55733 - protein, 10 aa, Artificial Sequence
  Description of Artificial Sequence: Synthetic peptide
  Seed: IFATCLGLSY (MAGA3_HUMAN)
IQATCLGLSF

SEQ ID NO: 55734 - protein, 9 aa, Artificial Sequence
  Description of Artificial Sequence: Synthetic peptide
  Seed: SSLQLVFGI (MAGA3_HUMAN)
SMLQLVFGW

SEQ ID NO: 55735 - protein, 10 aa, Artificial Sequence
  Description of Artificial Sequence: Synthetic peptide
  Seed: RQVPGSDPAC (MAGA3_HUMAN)
RLVPGSDPAW

SEQ ID NO: 55736 - protein, 10 aa, Artificial Sequence
  Description of Artificial Sequence: Synthetic peptide
  Seed: STFPDLESEF (MAGA3_HUMAN)
SPFPDLESEF

SEQ ID NO: 55737 - protein, 9 aa, Artificial Sequence
  Description of Artificial Sequence: Synthetic peptide
  Seed: KIWEELSVL (MAGA3_HUMAN)
KLWEELSVL

SEQ ID NO: 55738 - protein, 9 aa, Artificial Sequence
  Description of Artificial Sequence: Synthetic peptide
  Seed: YPPLHEWVL (MAGA3_HUMAN)
YMPLHEWVL

SEQ ID NO: 55739 - protein, 10 aa, Artificial Sequence
  Description of Artificial Sequence: Synthetic peptide
  Seed: MEVDPIGHLY (MAGA3_HUMAN)
MVVDPIGHLW

SEQ ID NO: 55740 - protein, 9 aa, Artificial Sequence
  Description of Artificial Sequence: Synthetic peptide
  Seed: SYPPLHEWV (MAGA3_HUMAN)
SMPPLHEWW

SEQ ID NO: 55741 - protein, 10 aa, Artificial Sequence
  Description of Artificial Sequence: Synthetic peptide
  Seed: MEVDPIGHLY (MAGA3_HUMAN)
MGVDPIGHLY

SEQ ID NO: 55742 - protein, 9 aa, Artificial Sequence
  Description of Artificial Sequence: Synthetic peptide
  Seed: YIFATCLGL (MAGA3_HUMAN)
YMFATCLGA

SEQ ID NO: 55743 - protein, 9 aa, Artificial Sequence
  Description of Artificial Sequence: Synthetic peptide
  Seed: QSPQGASSL (MAGA3_HUMAN)
QTPQGASSV

SEQ ID NO: 55744 - protein, 10 aa, Artificial Sequence
  Description of Artificial Sequence: Synthetic peptide
  Seed: EMLGSVVGNW (MAGA3_HUMAN)
ETLGSVVGNY

SEQ ID NO: 55745 - protein, 8 aa, Artificial Sequence
  Description of Artificial Sequence: Synthetic peptide
  Seed: FPDLESEF (MAGA3_HUMAN)
FSDLESEI

SEQ ID NO: 55746 - protein, 9 aa, Artificial Sequence
  Description of Artificial Sequence: Synthetic peptide
  Seed: SVVGNWQYF (MAGA3_HUMAN)
SSVGNWQYW

SEQ ID NO: 55747 - protein, 9 aa, Artificial Sequence
  Description of Artificial Sequence: Synthetic peptide
  Seed: SVLEVFEGR (MAGA3_HUMAN)
SLLEVFEGL

SEQ ID NO: 55748 - protein, 9 aa, Artificial Sequence
  Description of Artificial Sequence: Synthetic peptide
  Seed: YIFATCLGL (MAGA3_HUMAN)
YIFATCLGT

SEQ ID NO: 55749 - protein, 10 aa, Artificial Sequence
  Description of Artificial Sequence: Synthetic peptide
  Seed: ISYPPLHEWV (MAGA3_HUMAN)
IFYPPLHEWF

SEQ ID NO: 55750 - protein, 10 aa, Artificial Sequence
  Description of Artificial Sequence: Synthetic peptide
  Seed: KVAELVHFLL (MAGA3_HUMAN)
KMAELVHFLD

SEQ ID NO: 55751 - protein, 9 aa, Artificial Sequence
  Description of Artificial Sequence: Synthetic peptide
  Seed: QEAASSSST (MAGA3_HUMAN)
QEAASSSSV

SEQ ID NO: 55752 - protein, 10 aa, Artificial Sequence
  Description of Artificial Sequence: Synthetic peptide
  Seed: HISYPPLHEW (MAGA3_HUMAN)
HESYPPLHEW

SEQ ID NO: 55753 - protein, 11 aa, Artificial Sequence
  Description of Artificial Sequence: Synthetic peptide
  Seed: KVAELVHFLLL (MAGA3_HUMAN)
KMAELVHFLLK

SEQ ID NO: 55754 - protein, 10 aa, Artificial Sequence
  Description of Artificial Sequence: Synthetic peptide
  Seed: YIFATCLGLS (MAGA3_HUMAN)
YMFATCLGLQ

SEQ ID NO: 55755 - protein, 9 aa, Artificial Sequence
  Description of Artificial Sequence: Synthetic peptide
  Seed: SEFQAALSR (MAGA3_HUMAN)
SLFQAALSY

SEQ ID NO: 55756 - protein, 9 aa, Artificial Sequence
  Description of Artificial Sequence: Synthetic peptide
  Seed: LVHFLLLKY (MAGA3_HUMAN)
LTHFLLLKR

SEQ ID NO: 55757 - protein, 9 aa, Artificial Sequence
  Description of Artificial Sequence: Synthetic peptide
  Seed: SSLQLVFGI (MAGA3_HUMAN)
SLLQLVFGW

SEQ ID NO: 55758 - protein, 9 aa, Artificial Sequence
  Description of Artificial Sequence: Synthetic peptide
  Seed: QHCKPEEGL (MAGA3_HUMAN)
QHCKPEEGV

SEQ ID NO: 55759 - protein, 9 aa, Artificial Sequence
  Description of Artificial Sequence: Synthetic peptide
  Seed: FATCLGLSY (MAGA3_HUMAN)
FETCLGLSM

SEQ ID NO: 55760 - protein, 9 aa, Artificial Sequence
  Description of Artificial Sequence: Synthetic peptide
  Seed: LSRKVAELV (MAGA3_HUMAN)
LSRKVAELK

SEQ ID NO: 55761 - protein, 10 aa, Artificial Sequence
  Description of Artificial Sequence: Synthetic peptide
  Seed: STFPDLESEF (MAGA3_HUMAN)
SWFPDLESEW

SEQ ID NO: 55762 - protein, 9 aa, Artificial Sequence
  Description of Artificial Sequence: Synthetic peptide
  Seed: GSDPACYEF (MAGA3_HUMAN)
GYDPACYEM

SEQ ID NO: 55763 - protein, 11 aa, Artificial Sequence
  Description of Artificial Sequence: Synthetic peptide
  Seed: ISYPPLHEWVL (MAGA3_HUMAN)
IVYPPLHEWVW

SEQ ID NO: 55764 - protein, 10 aa, Artificial Sequence
  Description of Artificial Sequence: Synthetic peptide
  Seed: TSYVKVLHHM (MAGA3_HUMAN)
TWYVKVLHHF

SEQ ID NO: 55765 - protein, 9 aa, Artificial Sequence
  Description of Artificial Sequence: Synthetic peptide
  Seed: ISYPPLHEW (MAGA3_HUMAN)
IIYPPLHEI

SEQ ID NO: 55766 - protein, 10 aa, Artificial Sequence
  Description of Artificial Sequence: Synthetic peptide
  Seed: EVTLGEVPAA (MAGA3_HUMAN)
EVTLGEVPAV

SEQ ID NO: 55767 - protein, 10 aa, Artificial Sequence
  Description of Artificial Sequence: Synthetic peptide
  Seed: LVFGIELMEV (MAGA3_HUMAN)
LIFGIELMEV

SEQ ID NO: 55768 - protein, 10 aa, Artificial Sequence
  Description of Artificial Sequence: Synthetic peptide
  Seed: RKVAELVHFL (MAGA3_HUMAN)
RYVAELVHFM

SEQ ID NO: 55769 - protein, 8 aa, Artificial Sequence
  Description of Artificial Sequence: Synthetic peptide
  Seed: SGGPHISY (MAGA3_HUMAN)
STGPHISI

SEQ ID NO: 55770 - protein, 10 aa, Artificial Sequence
  Description of Artificial Sequence: Synthetic peptide
  Seed: RKVAELVHFL (MAGA3_HUMAN)
RRVAELVHFV

SEQ ID NO: 55771 - protein, 10 aa, Artificial Sequence
  Description of Artificial Sequence: Synthetic peptide
  Seed: ELMEVDPIGH (MAGA3_HUMAN)
ETMEVDPIGK

SEQ ID NO: 55772 - protein, 9 aa, Artificial Sequence
  Description of Artificial Sequence: Synthetic peptide
  Seed: MPKAGLLII (MAGA3_HUMAN)
MAKAGLLIW

SEQ ID NO: 55773 - protein, 10 aa, Artificial Sequence
  Description of Artificial Sequence: Synthetic peptide
  Seed: HISYPPLHEW (MAGA3_HUMAN)
HCSYPPLHEM

SEQ ID NO: 55774 - protein, 10 aa, Artificial Sequence
  Description of Artificial Sequence: Synthetic peptide
  Seed: STFPDLESEF (MAGA3_HUMAN)
SPFPDLESEY

SEQ ID NO: 55775 - protein, 9 aa, Artificial Sequence
  Description of Artificial Sequence: Synthetic peptide
  Seed: SSLPTTMNY (MAGA3_HUMAN)
SLLPTTMNR

SEQ ID NO: 55776 - protein, 9 aa, Artificial Sequence
  Description of Artificial Sequence: Synthetic peptide
  Seed: YIFATCLGL (MAGA3_HUMAN)
YKFATCLGW

SEQ ID NO: 55777 - protein, 10 aa, Artificial Sequence
  Description of Artificial Sequence: Synthetic peptide
  Seed: SLQLVFGIEL (MAGA3_HUMAN)
SWQLVFGIEY

SEQ ID NO: 55778 - protein, 9 aa, Artificial Sequence
  Description of Artificial Sequence: Synthetic peptide
  Seed: TQHFVQENY (MAGA3_HUMAN)
TRHFVQENF

SEQ ID NO: 55779 - protein, 9 aa, Artificial Sequence
  Description of Artificial Sequence: Synthetic peptide
  Seed: HLYIFATCL (MAGA3_HUMAN)
HKYIFATCY

SEQ ID NO: 55780 - protein, 10 aa, Artificial Sequence
  Description of Artificial Sequence: Synthetic peptide
  Seed: SEFQAALSRK (MAGA3_HUMAN)
STFQAALSRR

SEQ ID NO: 55781 - protein, 8 aa, Artificial Sequence
  Description of Artificial Sequence: Synthetic peptide
  Seed: LGDPKKLL (MAGA3_HUMAN)
LYDPKKLM

SEQ ID NO: 55782 - protein, 9 aa, Artificial Sequence
  Description of Artificial Sequence: Synthetic peptide
  Seed: VTLGEVPAA (MAGA3_HUMAN)
VTLGEVPAV

SEQ ID NO: 55783 - protein, 9 aa, Artificial Sequence
  Description of Artificial Sequence: Synthetic peptide
  Seed: RALVETSYV (MAGA3_HUMAN)
RTLVETSYI

SEQ ID NO: 55784 - protein, 9 aa, Artificial Sequence
  Description of Artificial Sequence: Synthetic peptide
  Seed: LLIIVLAII (MAGA3_HUMAN)
LMIIVLAIA

SEQ ID NO: 55785 - protein, 9 aa, Artificial Sequence
  Description of Artificial Sequence: Synthetic peptide
  Seed: ISYPPLHEW (MAGA3_HUMAN)
IQYPPLHEH

SEQ ID NO: 55786 - protein, 9 aa, Artificial Sequence
  Description of Artificial Sequence: Synthetic peptide
  Seed: LESEFQAAL (MAGA3_HUMAN)
LLSEFQAAY

SEQ ID NO: 55787 - protein, 10 aa, Artificial Sequence
  Description of Artificial Sequence: Synthetic peptide
  Seed: MEVDPIGHLY (MAGA3_HUMAN)
MIVDPIGHLL

SEQ ID NO: 55788 - protein, 9 aa, Artificial Sequence
  Description of Artificial Sequence: Synthetic peptide
  Seed: ALSRKVAEL (MAGA3_HUMAN)
AVSRKVAEV

SEQ ID NO: 55789 - protein, 10 aa, Artificial Sequence
  Description of Artificial Sequence: Synthetic peptide
  Seed: MEVDPIGHLY (MAGA3_HUMAN)
MCVDPIGHLY

SEQ ID NO: 55790 - protein, 10 aa, Artificial Sequence
  Description of Artificial Sequence: Synthetic peptide
  Seed: ASSLPTTMNY (MAGA3_HUMAN)
AFSLPTTMNF

SEQ ID NO: 55791 - protein, 9 aa, Artificial Sequence
  Description of Artificial Sequence: Synthetic peptide
  Seed: IMPKAGLLI (MAGA3_HUMAN)
IFPKAGLLL

SEQ ID NO: 55792 - protein, 9 aa, Artificial Sequence
  Description of Artificial Sequence: Synthetic peptide
  Seed: LPTTMNYPL (MAGA3_HUMAN)
LITTMNYPF

SEQ ID NO: 55793 - protein, 9 aa, Artificial Sequence
  Description of Artificial Sequence: Synthetic peptide
  Seed: MPKAGLLII (MAGA3_HUMAN)
MSKAGLLIY

SEQ ID NO: 55794 - protein, 10 aa, Artificial Sequence
  Description of Artificial Sequence: Synthetic peptide
  Seed: RKVAELVHFL (MAGA3_HUMAN)
RTVAELVHFI

SEQ ID NO: 55795 - protein, 9 aa, Artificial Sequence
  Description of Artificial Sequence: Synthetic peptide
  Seed: ISGGPHISY (MAGA3_HUMAN)
ITGGPHISM

SEQ ID NO: 55796 - protein, 10 aa, Artificial Sequence
  Description of Artificial Sequence: Synthetic peptide
  Seed: MNYPLWSQSY (MAGA3_HUMAN)
MEYPLWSQSV

SEQ ID NO: 55797 - protein, 9 aa, Artificial Sequence
  Description of Artificial Sequence: Synthetic peptide
  Seed: SSLPTTMNY (MAGA3_HUMAN)
SRLPTTMNM

SEQ ID NO: 55798 - protein, 9 aa, Artificial Sequence
  Description of Artificial Sequence: Synthetic peptide
  Seed: SSSSTLVEV (MAGA3_HUMAN)
SISSTLVEW

SEQ ID NO: 55799 - protein, 10 aa, Artificial Sequence
  Description of Artificial Sequence: Synthetic peptide
  Seed: FVQENYLEYR (MAGA3_HUMAN)
FSQENYLEYR

SEQ ID NO: 55800 - protein, 10 aa, Artificial Sequence
  Description of Artificial Sequence: Synthetic peptide
  Seed: SLQLVFGIEL (MAGA3_HUMAN)
SEQLVFGIEY

SEQ ID NO: 55801 - protein, 10 aa, Artificial Sequence
  Description of Artificial Sequence: Synthetic peptide
  Seed: EALGLVGAQA (MAGA3_HUMAN)
EVLGLVGAQL

SEQ ID NO: 55802 - protein, 9 aa, Artificial Sequence
  Description of Artificial Sequence: Synthetic peptide
  Seed: ISGGPHISY (MAGA3_HUMAN)
IYGGPHISF

SEQ ID NO: 55803 - protein, 10 aa, Artificial Sequence
  Description of Artificial Sequence: Synthetic peptide
  Seed: MPKAGLLIIV (MAGA3_HUMAN)
MTKAGLLIIL

SEQ ID NO: 55804 - protein, 8 aa, Artificial Sequence
  Description of Artificial Sequence: Synthetic peptide
  Seed: ILGDPKKL (MAGA3_HUMAN)
IAGDPKKL

SEQ ID NO: 55805 - protein, 10 aa, Artificial Sequence
  Description of Artificial Sequence: Synthetic peptide
  Seed: EVFEGREDSI (MAGA3_HUMAN)
ETFEGREDSK

SEQ ID NO: 55806 - protein, 10 aa, Artificial Sequence
  Description of Artificial Sequence: Synthetic peptide
  Seed: MEVDPIGHLY (MAGA3_HUMAN)
MTVDPIGHLM

SEQ ID NO: 55807 - protein, 9 aa, Artificial Sequence
  Description of Artificial Sequence: Synthetic peptide
  Seed: EAASSSSTL (MAGA3_HUMAN)
ESASSSSTY

SEQ ID NO: 55808 - protein, 9 aa, Artificial Sequence
  Description of Artificial Sequence: Synthetic peptide
  Seed: YVKVLHHMV (MAGA3_HUMAN)
YIKVLHHMV

SEQ ID NO: 55809 - protein, 9 aa, Artificial Sequence
  Description of Artificial Sequence: Synthetic peptide
  Seed: SSTLVEVTL (MAGA3_HUMAN)
SDTLVEVTM

SEQ ID NO: 55810 - protein, 9 aa, Artificial Sequence
  Description of Artificial Sequence: Synthetic peptide
  Seed: FATCLGLSY (MAGA3_HUMAN)
FRTCLGLSL

SEQ ID NO: 55811 - protein, 9 aa, Artificial Sequence
  Description of Artificial Sequence: Synthetic peptide
  Seed: EVDPIGHLY (MAGA3_HUMAN)
ESDPIGHLW

SEQ ID NO: 55812 - protein, 9 aa, Artificial Sequence
  Description of Artificial Sequence: Synthetic peptide
  Seed: RKVAELVHF (MAGA3_HUMAN)
RTVAELVHF

SEQ ID NO: 55813 - protein, 9 aa, Artificial Sequence
  Description of Artificial Sequence: Synthetic peptide
  Seed: KVAELVHFL (MAGA3_HUMAN)
KSAELVHFI

SEQ ID NO: 55814 - protein, 9 aa, Artificial Sequence
  Description of Artificial Sequence: Synthetic peptide
  Seed: EALGLVGAQ (MAGA3_HUMAN)
ETLGLVGAM

SEQ ID NO: 55815 - protein, 9 aa, Artificial Sequence
  Description of Artificial Sequence: Synthetic peptide
  Seed: ISYPPLHEW (MAGA3_HUMAN)
INYPPLHEM

SEQ ID NO: 55816 - protein, 9 aa, Artificial Sequence
  Description of Artificial Sequence: Synthetic peptide
  Seed: RKVAELVHF (MAGA3_HUMAN)
REVAELVHY

SEQ ID NO: 55817 - protein, 9 aa, Artificial Sequence
  Description of Artificial Sequence: Synthetic peptide
  Seed: YEDSSNQEE (MAGA3_HUMAN)
YEDSSNQEL

SEQ ID NO: 55818 - protein, 10 aa, Artificial Sequence
  Description of Artificial Sequence: Synthetic peptide
  Seed: MNYPLWSQSY (MAGA3_HUMAN)
MVYPLWSQSI

SEQ ID NO: 55819 - protein, 9 aa, Artificial Sequence
  Description of Artificial Sequence: Synthetic peptide
  Seed: ALSRKVAEL (MAGA3_HUMAN)
AISRKVAEL

SEQ ID NO: 55820 - protein, 9 aa, Artificial Sequence
  Description of Artificial Sequence: Synthetic peptide
  Seed: YFFPVIFSK (MAGA3_HUMAN)
YLFPVIFSV

SEQ ID NO: 55821 - protein, 9 aa, Artificial Sequence
  Description of Artificial Sequence: Synthetic peptide
  Seed: MVKISGGPH (MAGA3_HUMAN)
MAKISGGPY

SEQ ID NO: 55822 - protein, 10 aa, Artificial Sequence
  Description of Artificial Sequence: Synthetic peptide
  Seed: ISYPPLHEWV (MAGA3_HUMAN)
IVYPPLHEWV

SEQ ID NO: 55823 - protein, 10 aa, Artificial Sequence
  Description of Artificial Sequence: Synthetic peptide
  Seed: KVAELVHFLL (MAGA3_HUMAN)
KWAELVHFLW

SEQ ID NO: 55824 - protein, 9 aa, Artificial Sequence
  Description of Artificial Sequence: Synthetic peptide
  Seed: RQVPGSDPA (MAGA3_HUMAN)
RAVPGSDPM

SEQ ID NO: 55825 - protein, 8 aa, Artificial Sequence
  Description of Artificial Sequence: Synthetic peptide
  Seed: FGIELMEV (MAGA3_HUMAN)
FQIELMEI

SEQ ID NO: 55826 - protein, 9 aa, Artificial Sequence
  Description of Artificial Sequence: Synthetic peptide
  Seed: KASSSLQLV (MAGA3_HUMAN)
KSSSSLQLL

SEQ ID NO: 55827 - protein, 10 aa, Artificial Sequence
  Description of Artificial Sequence: Synthetic peptide
  Seed: TSYVKVLHHM (MAGA3_HUMAN)
TIYVKVLHHL

SEQ ID NO: 55828 - protein, 9 aa, Artificial Sequence
  Description of Artificial Sequence: Synthetic peptide
  Seed: SILGDPKKL (MAGA3_HUMAN)
SSLGDPKKY

SEQ ID NO: 55829 - protein, 10 aa, Artificial Sequence
  Description of Artificial Sequence: Synthetic peptide
  Seed: NWQYFFPVIF (MAGA3_HUMAN)
NSQYFFPVIY

SEQ ID NO: 55830 - protein, 10 aa, Artificial Sequence
  Description of Artificial Sequence: Synthetic peptide
  Seed: MNYPLWSQSY (MAGA3_HUMAN)
MCYPLWSQSM

SEQ ID NO: 55831 - protein, 9 aa, Artificial Sequence
  Description of Artificial Sequence: Synthetic peptide
  Seed: KIWEELSVL (MAGA3_HUMAN)
KTWEELSVM

SEQ ID NO: 55832 - protein, 9 aa, Artificial Sequence
  Description of Artificial Sequence: Synthetic peptide
  Seed: WQYFFPVIF (MAGA3_HUMAN)
WQYFFPVII

SEQ ID NO: 55833 - protein, 10 aa, Artificial Sequence
  Description of Artificial Sequence: Synthetic peptide
  Seed: MEVDPIGHLY (MAGA3_HUMAN)
MAVDPIGHLH

SEQ ID NO: 55834 - protein, 9 aa, Artificial Sequence
  Description of Artificial Sequence: Synthetic peptide
  Seed: SYVKVLHHM (MAGA3_HUMAN)
SAVKVLHHI

SEQ ID NO: 55835 - protein, 11 aa, Artificial Sequence
  Description of Artificial Sequence: Synthetic peptide
  Seed: YIFATCLGLSY (MAGA3_HUMAN)
YAFATCLGLSL

SEQ ID NO: 55836 - protein, 10 aa, Artificial Sequence
  Description of Artificial Sequence: Synthetic peptide
  Seed: HISYPPLHEW (MAGA3_HUMAN)
HQSYPPLHEM

SEQ ID NO: 55837 - protein, 9 aa, Artificial Sequence
  Description of Artificial Sequence: Synthetic peptide
  Seed: IMPKAGLLI (MAGA3_HUMAN)
IWPKAGLLL

SEQ ID NO: 55838 - protein, 9 aa, Artificial Sequence
  Description of Artificial Sequence: Synthetic peptide
  Seed: LSRKVAELV (MAGA3_HUMAN)
LTRKVAELL

SEQ ID NO: 55839 - protein, 10 aa, Artificial Sequence
  Description of Artificial Sequence: Synthetic peptide
  Seed: AELVHFLLLK (MAGA3_HUMAN)
AKLVHFLLLK

SEQ ID NO: 55840 - protein, 9 aa, Artificial Sequence
  Description of Artificial Sequence: Synthetic peptide
  Seed: SSLPTTMNY (MAGA3_HUMAN)
SKLPTTMNY

SEQ ID NO: 55841 - protein, 9 aa, Artificial Sequence
  Description of Artificial Sequence: Synthetic peptide
  Seed: EARGEALGL (MAGA3_HUMAN)
EIRGEALGR

SEQ ID NO: 55842 - protein, 10 aa, Artificial Sequence
  Description of Artificial Sequence: Synthetic peptide
  Seed: TSYVKVLHHM (MAGA3_HUMAN)
TQYVKVLHHF

SEQ ID NO: 55843 - protein, 9 aa, Artificial Sequence
  Description of Artificial Sequence: Synthetic peptide
  Seed: KVAELVHFL (MAGA3_HUMAN)
KNAELVHFL

SEQ ID NO: 55844 - protein, 9 aa, Artificial Sequence
  Description of Artificial Sequence: Synthetic peptide
  Seed: DPIGHLYIF (MAGA3_HUMAN)
DAIGHLYII

SEQ ID NO: 55845 - protein, 10 aa, Artificial Sequence
  Description of Artificial Sequence: Synthetic peptide
  Seed: LQLVFGIELM (MAGA3_HUMAN)
LSLVFGIELV

SEQ ID NO: 55846 - protein, 9 aa, Artificial Sequence
  Description of Artificial Sequence: Synthetic peptide
  Seed: RALVETSYV (MAGA3_HUMAN)
RTLVETSYY

SEQ ID NO: 55847 - protein, 10 aa, Artificial Sequence
  Description of Artificial Sequence: Synthetic peptide
  Seed: TSYVKVLHHM (MAGA3_HUMAN)
TRYVKVLHHM

SEQ ID NO: 55848 - protein, 11 aa, Artificial Sequence
  Description of Artificial Sequence: Synthetic peptide
  Seed: EVFEGREDSIL (MAGA3_HUMAN)
ESFEGREDSIR

SEQ ID NO: 55849 - protein, 9 aa, Artificial Sequence
  Description of Artificial Sequence: Synthetic peptide
  Seed: AQAPATEEQ (MAGA3_HUMAN)
AMAPATEEM

SEQ ID NO: 55850 - protein, 9 aa, Artificial Sequence
  Description of Artificial Sequence: Synthetic peptide
  Seed: SSTLVEVTL (MAGA3_HUMAN)
SETLVEVTF

SEQ ID NO: 55851 - protein, 9 aa, Artificial Sequence
  Description of Artificial Sequence: Synthetic peptide
  Seed: SVVGNWQYF (MAGA3_HUMAN)
SYVGNWQYI

SEQ ID NO: 55852 - protein, 9 aa, Artificial Sequence
  Description of Artificial Sequence: Synthetic peptide
  Seed: NQIMPKAGL (MAGA3_HUMAN)
NEIMPKAGI

SEQ ID NO: 55853 - protein, 11 aa, Artificial Sequence
  Description of Artificial Sequence: Synthetic peptide
  Seed: SEFQAALSRKV (MAGA3_HUMAN)
SEFQAALSRKW

SEQ ID NO: 55854 - protein, 9 aa, Artificial Sequence
  Description of Artificial Sequence: Synthetic peptide
  Seed: ASSSLQLVF (MAGA3_HUMAN)
AGSSLQLVW

SEQ ID NO: 55855 - protein, 9 aa, Artificial Sequence
  Description of Artificial Sequence: Synthetic peptide
  Seed: ALSRKVAEL (MAGA3_HUMAN)
AMSRKVAEI

SEQ ID NO: 55856 - protein, 10 aa, Artificial Sequence
  Description of Artificial Sequence: Synthetic peptide
  Seed: KASSSLQLVF (MAGA3_HUMAN)
KFSSSLQLVM

SEQ ID NO: 55857 - protein, 9 aa, Artificial Sequence
  Description of Artificial Sequence: Synthetic peptide
  Seed: MEVDPIGHL (MAGA3_HUMAN)
MVVDPIGHI

SEQ ID NO: 55858 - protein, 9 aa, Artificial Sequence
  Description of Artificial Sequence: Synthetic peptide
  Seed: RQVPGSDPA (MAGA3_HUMAN)
REVPGSDPA

SEQ ID NO: 55859 - protein, 10 aa, Artificial Sequence
  Description of Artificial Sequence: Synthetic peptide
  Seed: HISYPPLHEW (MAGA3_HUMAN)
HRSYPPLHEY

SEQ ID NO: 55860 - protein, 10 aa, Artificial Sequence
  Description of Artificial Sequence: Synthetic peptide
  Seed: YIFATCLGLS (MAGA3_HUMAN)
YLFATCLGLH

SEQ ID NO: 55861 - protein, 9 aa, Artificial Sequence
  Description of Artificial Sequence: Synthetic peptide
  Seed: YFFPVIFSK (MAGA3_HUMAN)
YWFPVIFSK

SEQ ID NO: 55862 - protein, 9 aa, Artificial Sequence
  Description of Artificial Sequence: Synthetic peptide
  Seed: SPDPPQSPQ (MAGA3_HUMAN)
SPDPPQSPF

SEQ ID NO: 55863 - protein, 9 aa, Artificial Sequence
  Description of Artificial Sequence: Synthetic peptide
  Seed: SVLEVFEGR (MAGA3_HUMAN)
SMLEVFEGM

SEQ ID NO: 55864 - protein, 9 aa, Artificial Sequence
  Description of Artificial Sequence: Synthetic peptide
  Seed: EAASSSSTL (MAGA3_HUMAN)
ELASSSSTV

SEQ ID NO: 55865 - protein, 11 aa, Artificial Sequence
  Description of Artificial Sequence: Synthetic peptide
  Seed: SNQEEEGPSTF (MAGA3_HUMAN)
SMQEEEGPSTM

SEQ ID NO: 55866 - protein, 9 aa, Artificial Sequence
  Description of Artificial Sequence: Synthetic peptide
  Seed: EELSVLEVF (MAGA3_HUMAN)
EALSVLEVY

SEQ ID NO: 55867 - protein, 9 aa, Artificial Sequence
  Description of Artificial Sequence: Synthetic peptide
  Seed: KVLHHMVKI (MAGA3_HUMAN)
KVLHHMVKM

SEQ ID NO: 55868 - protein, 10 aa, Artificial Sequence
  Description of Artificial Sequence: Synthetic peptide
  Seed: KISGGPHISY (MAGA3_HUMAN)
KISGGPHISR

SEQ ID NO: 55869 - protein, 9 aa, Artificial Sequence
  Description of Artificial Sequence: Synthetic peptide
  Seed: YPPLHEWVL (MAGA3_HUMAN)
YSPLHEWVM

SEQ ID NO: 55870 - protein, 10 aa, Artificial Sequence
  Description of Artificial Sequence: Synthetic peptide
  Seed: SDPACYEFLW (MAGA3_HUMAN)
SMPACYEFLW

SEQ ID NO: 55871 - protein, 9 aa, Artificial Sequence
  Description of Artificial Sequence: Synthetic peptide
  Seed: RKVAELVHF (MAGA3_HUMAN)
RHVAELVHY

SEQ ID NO: 55872 - protein, 10 aa, Artificial Sequence
  Description of Artificial Sequence: Synthetic peptide
  Seed: TLVEVTLGEV (MAGA3_HUMAN)
TVVEVTLGEI

SEQ ID NO: 55873 - protein, 9 aa, Artificial Sequence
  Description of Artificial Sequence: Synthetic peptide
  Seed: FPVIFSKAS (MAGA3_HUMAN)
FPVIFSKAP

SEQ ID NO: 55874 - protein, 9 aa, Artificial Sequence
  Description of Artificial Sequence: Synthetic peptide
  Seed: FVQENYLEY (MAGA3_HUMAN)
FWQENYLEM

SEQ ID NO: 55875 - protein, 9 aa, Artificial Sequence
  Description of Artificial Sequence: Synthetic peptide
  Seed: VQENYLEYR (MAGA3_HUMAN)
VLENYLEYY

SEQ ID NO: 55876 - protein, 10 aa, Artificial Sequence
  Description of Artificial Sequence: Synthetic peptide
  Seed: KASSSLQLVF (MAGA3_HUMAN)
KDSSSLQLVW

SEQ ID NO: 55877 - protein, 10 aa, Artificial Sequence
  Description of Artificial Sequence: Synthetic peptide
  Seed: LYIFATCLGL (MAGA3_HUMAN)
LQIFATCLGI

SEQ ID NO: 55878 - protein, 10 aa, Artificial Sequence
  Description of Artificial Sequence: Synthetic peptide
  Seed: RKVAELVHFL (MAGA3_HUMAN)
RGVAELVHFI

SEQ ID NO: 55879 - protein, 9 aa, Artificial Sequence
  Description of Artificial Sequence: Synthetic peptide
  Seed: GLVGAQAPA (MAGA3_HUMAN)
GLVGAQAPV

SEQ ID NO: 55880 - protein, 9 aa, Artificial Sequence
  Description of Artificial Sequence: Synthetic peptide
  Seed: SYPPLHEWV (MAGA3_HUMAN)
SRPPLHEWF

SEQ ID NO: 55881 - protein, 9 aa, Artificial Sequence
  Description of Artificial Sequence: Synthetic peptide
  Seed: SSLQLVFGI (MAGA3_HUMAN)
SALQLVFGL

SEQ ID NO: 55882 - protein, 9 aa, Artificial Sequence
  Description of Artificial Sequence: Synthetic peptide
  Seed: QSPQGASSL (MAGA3_HUMAN)
QTPQGASSR

SEQ ID NO: 55883 - protein, 10 aa, Artificial Sequence
  Description of Artificial Sequence: Synthetic peptide
  Seed: LTQHFVQENY (MAGA3_HUMAN)
LTQHFVQENW

SEQ ID NO: 55884 - protein, 9 aa, Artificial Sequence
  Description of Artificial Sequence: Synthetic peptide
  Seed: SVVGNWQYF (MAGA3_HUMAN)
SAVGNWQYV

SEQ ID NO: 55885 - protein, 10 aa, Artificial Sequence
  Description of Artificial Sequence: Synthetic peptide
  Seed: HISYPPLHEW (MAGA3_HUMAN)
HLSYPPLHEM

SEQ ID NO: 55886 - protein, 10 aa, Artificial Sequence
  Description of Artificial Sequence: Synthetic peptide
  Seed: LGLVGAQAPA (MAGA3_HUMAN)
LHLVGAQAPV

SEQ ID NO: 55887 - protein, 9 aa, Artificial Sequence
  Description of Artificial Sequence: Synthetic peptide
  Seed: LGDPKKLLT (MAGA3_HUMAN)
LDDPKKLLM

SEQ ID NO: 55888 - protein, 11 aa, Artificial Sequence
  Description of Artificial Sequence: Synthetic peptide
  Seed: SRKVAELVHFL (MAGA3_HUMAN)
SNKVAELVHFV

SEQ ID NO: 55889 - protein, 11 aa, Artificial Sequence
  Description of Artificial Sequence: Synthetic peptide
  Seed: SNQEEEGPSTF (MAGA3_HUMAN)
SLQEEEGPSTI

SEQ ID NO: 55890 - protein, 9 aa, Artificial Sequence
  Description of Artificial Sequence: Synthetic peptide
  Seed: SVVGNWQYF (MAGA3_HUMAN)
SFVGNWQYW

SEQ ID NO: 55891 - protein, 9 aa, Artificial Sequence
  Description of Artificial Sequence: Synthetic peptide
  Seed: WQYFFPVIF (MAGA3_HUMAN)
WTYFFPVIF

SEQ ID NO: 55892 - protein, 9 aa, Artificial Sequence
  Description of Artificial Sequence: Synthetic peptide
  Seed: KIWEELSVL (MAGA3_HUMAN)
KTWEELSVK

SEQ ID NO: 55893 - protein, 9 aa, Artificial Sequence
  Description of Artificial Sequence: Synthetic peptide
  Seed: DPIGHLYIF (MAGA3_HUMAN)
DEIGHLYIF

SEQ ID NO: 55894 - protein, 9 aa, Artificial Sequence
  Description of Artificial Sequence: Synthetic peptide
  Seed: KVLHHMVKI (MAGA3_HUMAN)
KLLHHMVKC

SEQ ID NO: 55895 - protein, 11 aa, Artificial Sequence
  Description of Artificial Sequence: Synthetic peptide
  Seed: AEMLGSVVGNW (MAGA3_HUMAN)
AEMLGSVVGNI

SEQ ID NO: 55896 - protein, 10 aa, Artificial Sequence
  Description of Artificial Sequence: Synthetic peptide
  Seed: KVAELVHFLL (MAGA3_HUMAN)
KYAELVHFLW

SEQ ID NO: 55897 - protein, 9 aa, Artificial Sequence
  Description of Artificial Sequence: Synthetic peptide
  Seed: QSPQGASSL (MAGA3_HUMAN)
QSPQGASSM

SEQ ID NO: 55898 - protein, 9 aa, Artificial Sequence
  Description of Artificial Sequence: Synthetic peptide
  Seed: YFFPVIFSK (MAGA3_HUMAN)
YHFPVIFSY

SEQ ID NO: 55899 - protein, 9 aa, Artificial Sequence
  Description of Artificial Sequence: Synthetic peptide
  Seed: SKASSSLQL (MAGA3_HUMAN)
SKASSSLQY

SEQ ID NO: 55900 - protein, 10 aa, Artificial Sequence
  Description of Artificial Sequence: Synthetic peptide
  Seed: LYIFATCLGL (MAGA3_HUMAN)
LWIFATCLGF

SEQ ID NO: 55901 - protein, 9 aa, Artificial Sequence
  Description of Artificial Sequence: Synthetic peptide
  Seed: KVAELVHFL (MAGA3_HUMAN)
KIAELVHFI

SEQ ID NO: 55902 - protein, 10 aa, Artificial Sequence
  Description of Artificial Sequence: Synthetic peptide
  Seed: AELVHFLLLK (MAGA3_HUMAN)
AWLVHFLLLR

SEQ ID NO: 55903 - protein, 10 aa, Artificial Sequence
  Description of Artificial Sequence: Synthetic peptide
  Seed: STFPDLESEF (MAGA3_HUMAN)
STFPDLESEL

SEQ ID NO: 55904 - protein, 9 aa, Artificial Sequence
  Description of Artificial Sequence: Synthetic peptide
  Seed: MEVDPIGHL (MAGA3_HUMAN)
MYVDPIGHM

SEQ ID NO: 55905 - protein, 9 aa, Artificial Sequence
  Description of Artificial Sequence: Synthetic peptide
  Seed: GSVVGNWQY (MAGA3_HUMAN)
GIVVGNWQY

SEQ ID NO: 55906 - protein, 9 aa, Artificial Sequence
  Description of Artificial Sequence: Synthetic peptide
  Seed: DPIGHLYIF (MAGA3_HUMAN)
DEIGHLYIL

SEQ ID NO: 55907 - protein, 10 aa, Artificial Sequence
  Description of Artificial Sequence: Synthetic peptide
  Seed: RALVETSYVK (MAGA3_HUMAN)
RYLVETSYVK

SEQ ID NO: 55908 - protein, 10 aa, Artificial Sequence
  Description of Artificial Sequence: Synthetic peptide
  Seed: SVVGNWQYFF (MAGA3_HUMAN)
SWVGNWQYFW

SEQ ID NO: 55909 - protein, 9 aa, Artificial Sequence
  Description of Artificial Sequence: Synthetic peptide
  Seed: LHHMVKISG (MAGA3_HUMAN)
LHHMVKISV

SEQ ID NO: 55910 - protein, 11 aa, Artificial Sequence
  Description of Artificial Sequence: Synthetic peptide
  Seed: YIFATCLGLSY (MAGA3_HUMAN)
YTFATCLGLSY

SEQ ID NO: 55911 - protein, 9 aa, Artificial Sequence
  Description of Artificial Sequence: Synthetic peptide
  Seed: ALGLVGAQA (MAGA3_HUMAN)
ALGLVGAQI

SEQ ID NO: 55912 - protein, 10 aa, Artificial Sequence
  Description of Artificial Sequence: Synthetic peptide
  Seed: KASSSLQLVF (MAGA3_HUMAN)
KWSSSLQLVF

SEQ ID NO: 55913 - protein, 10 aa, Artificial Sequence
  Description of Artificial Sequence: Synthetic peptide
  Seed: FFPVIFSKAS (MAGA3_HUMAN)
FYPVIFSKAV

SEQ ID NO: 55914 - protein, 10 aa, Artificial Sequence
  Description of Artificial Sequence: Synthetic peptide
  Seed: WEELSVLEVF (MAGA3_HUMAN)
WQELSVLEVY

SEQ ID NO: 55915 - protein, 10 aa, Artificial Sequence
  Description of Artificial Sequence: Synthetic peptide
  Seed: NWQYFFPVIF (MAGA3_HUMAN)
NHQYFFPVIF

SEQ ID NO: 55916 - protein, 9 aa, Artificial Sequence
  Description of Artificial Sequence: Synthetic peptide
  Seed: SYVKVLHHM (MAGA3_HUMAN)
SSVKVLHHL

SEQ ID NO: 55917 - protein, 10 aa, Artificial Sequence
  Description of Artificial Sequence: Synthetic peptide
  Seed: SVVGNWQYFF (MAGA3_HUMAN)
SYVGNWQYFD

SEQ ID NO: 55918 - protein, 10 aa, Artificial Sequence
  Description of Artificial Sequence: Synthetic peptide
  Seed: LGLVGAQAPA (MAGA3_HUMAN)
LSLVGAQAPL

SEQ ID NO: 55919 - protein, 9 aa, Artificial Sequence
  Description of Artificial Sequence: Synthetic peptide
  Seed: NYPLWSQSY (MAGA3_HUMAN)
NWPLWSQSI

SEQ ID NO: 55920 - protein, 9 aa, Artificial Sequence
  Description of Artificial Sequence: Synthetic peptide
  Seed: SEFQAALSR (MAGA3_HUMAN)
SDFQAALSM

SEQ ID NO: 55921 - protein, 10 aa, Artificial Sequence
  Description of Artificial Sequence: Synthetic peptide
  Seed: ASSSSTLVEV (MAGA3_HUMAN)
AMSSSTLVEM

SEQ ID NO: 55922 - protein, 10 aa, Artificial Sequence
  Description of Artificial Sequence: Synthetic peptide
  Seed: LYIFATCLGL (MAGA3_HUMAN)
LEIFATCLGV

SEQ ID NO: 55923 - protein, 9 aa, Artificial Sequence
  Description of Artificial Sequence: Synthetic peptide
  Seed: YIFATCLGL (MAGA3_HUMAN)
YVFATCLGW

SEQ ID NO: 55924 - protein, 11 aa, Artificial Sequence
  Description of Artificial Sequence: Synthetic peptide
  Seed: ISYPPLHEWVL (MAGA3_HUMAN)
ISYPPLHEWVY

SEQ ID NO: 55925 - protein, 10 aa, Artificial Sequence
  Description of Artificial Sequence: Synthetic peptide
  Seed: FFPVIFSKAS (MAGA3_HUMAN)
FYPVIFSKAA

SEQ ID NO: 55926 - protein, 9 aa, Artificial Sequence
  Description of Artificial Sequence: Synthetic peptide
  Seed: RKVAELVHF (MAGA3_HUMAN)
RQVAELVHL

SEQ ID NO: 55927 - protein, 10 aa, Artificial Sequence
  Description of Artificial Sequence: Synthetic peptide
  Seed: SVVGNWQYFF (MAGA3_HUMAN)
SYVGNWQYFC

SEQ ID NO: 55928 - protein, 10 aa, Artificial Sequence
  Description of Artificial Sequence: Synthetic peptide
  Seed: MNYPLWSQSY (MAGA3_HUMAN)
MNYPLWSQSM

SEQ ID NO: 55929 - protein, 10 aa, Artificial Sequence
  Description of Artificial Sequence: Synthetic peptide
  Seed: SVVGNWQYFF (MAGA3_HUMAN)
SDVGNWQYFY

SEQ ID NO: 55930 - protein, 11 aa, Artificial Sequence
  Description of Artificial Sequence: Synthetic peptide
  Seed: ISYPPLHEWVL (MAGA3_HUMAN)
IVYPPLHEWVF

SEQ ID NO: 55931 - protein, 9 aa, Artificial Sequence
  Description of Artificial Sequence: Synthetic peptide
  Seed: FATCLGLSY (MAGA3_HUMAN)
FRTCLGLSF

SEQ ID NO: 55932 - protein, 9 aa, Artificial Sequence
  Description of Artificial Sequence: Synthetic peptide
  Seed: FQAALSRKV (MAGA3_HUMAN)
FMAALSRKL

SEQ ID NO: 55933 - protein, 10 aa, Artificial Sequence
  Description of Artificial Sequence: Synthetic peptide
  Seed: SPQGASSLPT (MAGA3_HUMAN)
SPQGASSLPI

SEQ ID NO: 55934 - protein, 9 aa, Artificial Sequence
  Description of Artificial Sequence: Synthetic peptide
  Seed: VETSYVKVL (MAGA3_HUMAN)
VETSYVKVP

SEQ ID NO: 55935 - protein, 9 aa, Artificial Sequence
  Description of Artificial Sequence: Synthetic peptide
  Seed: AQAPATEEQ (MAGA3_HUMAN)
AGAPATEEY

SEQ ID NO: 55936 - protein, 9 aa, Artificial Sequence
  Description of Artificial Sequence: Synthetic peptide
  Seed: YPPLHEWVL (MAGA3_HUMAN)
YSPLHEWVF

SEQ ID NO: 55937 - protein, 9 aa, Artificial Sequence
  Description of Artificial Sequence: Synthetic peptide
  Seed: TEEQEAASS (MAGA3_HUMAN)
TEEQEAASI

SEQ ID NO: 55938 - protein, 10 aa, Artificial Sequence
  Description of Artificial Sequence: Synthetic peptide
  Seed: KISGGPHISY (MAGA3_HUMAN)
KWSGGPHISY

SEQ ID NO: 55939 - protein, 10 aa, Artificial Sequence
  Description of Artificial Sequence: Synthetic peptide
  Seed: AEMLGSVVGN (MAGA3_HUMAN)
AEMLGSVVGW

SEQ ID NO: 55940 - protein, 10 aa, Artificial Sequence
  Description of Artificial Sequence: Synthetic peptide
  Seed: GDCAPEEKIW (MAGA3_HUMAN)
GSCAPEEKIW

SEQ ID NO: 55941 - protein, 9 aa, Artificial Sequence
  Description of Artificial Sequence: Synthetic peptide
  Seed: IMPKAGLLI (MAGA3_HUMAN)
IGPKAGLLM

SEQ ID NO: 55942 - protein, 9 aa, Artificial Sequence
  Description of Artificial Sequence: Synthetic peptide
  Seed: EAASSSSTL (MAGA3_HUMAN)
EIASSSSTR

SEQ ID NO: 55943 - protein, 9 aa, Artificial Sequence
  Description of Artificial Sequence: Synthetic peptide
  Seed: FQAALSRKV (MAGA3_HUMAN)
FTAALSRKL

SEQ ID NO: 55944 - protein, 9 aa, Artificial Sequence
  Description of Artificial Sequence: Synthetic peptide
  Seed: HLYIFATCL (MAGA3_HUMAN)
HMYIFATCV

SEQ ID NO: 55945 - protein, 9 aa, Artificial Sequence
  Description of Artificial Sequence: Synthetic peptide
  Seed: VKISGGPHI (MAGA3_HUMAN)
VMISGGPHM

SEQ ID NO: 55946 - protein, 9 aa, Artificial Sequence
  Description of Artificial Sequence: Synthetic peptide
  Seed: LESEFQAAL (MAGA3_HUMAN)
LVSEFQAAM

SEQ ID NO: 55947 - protein, 9 aa, Artificial Sequence
  Description of Artificial Sequence: Synthetic peptide
  Seed: EVDPIGHLY (MAGA3_HUMAN)
EFDPIGHLL

SEQ ID NO: 55948 - protein, 10 aa, Artificial Sequence
  Description of Artificial Sequence: Synthetic peptide
  Seed: LGSVVGNWQY (MAGA3_HUMAN)
LSSVVGNWQY

SEQ ID NO: 55949 - protein, 10 aa, Artificial Sequence
  Description of Artificial Sequence: Synthetic peptide
  Seed: SVVGNWQYFF (MAGA3_HUMAN)
SYVGNWQYFY

SEQ ID NO: 55950 - protein, 9 aa, Artificial Sequence
  Description of Artificial Sequence: Synthetic peptide
  Seed: EEEGPSTFP (MAGA3_HUMAN)
EEEGPSTFV

SEQ ID NO: 55951 - protein, 9 aa, Artificial Sequence
  Description of Artificial Sequence: Synthetic peptide
  Seed: QHFVQENYL (MAGA3_HUMAN)
QHFVQENYF

SEQ ID NO: 55952 - protein, 10 aa, Artificial Sequence
  Description of Artificial Sequence: Synthetic peptide
  Seed: SVVGNWQYFF (MAGA3_HUMAN)
SYVGNWQYFM

SEQ ID NO: 55953 - protein, 9 aa, Artificial Sequence
  Description of Artificial Sequence: Synthetic peptide
  Seed: KVLHHMVKI (MAGA3_HUMAN)
KFLHHMVKY

SEQ ID NO: 55954 - protein, 9 aa, Artificial Sequence
  Description of Artificial Sequence: Synthetic peptide
  Seed: KVLHHMVKI (MAGA3_HUMAN)
KGLHHMVKK

SEQ ID NO: 55955 - protein, 10 aa, Artificial Sequence
  Description of Artificial Sequence: Synthetic peptide
  Seed: FATCLGLSYD (MAGA3_HUMAN)
FATCLGLSYL

SEQ ID NO: 55956 - protein, 9 aa, Artificial Sequence
  Description of Artificial Sequence: Synthetic peptide
  Seed: KIWEELSVL (MAGA3_HUMAN)
KMWEELSVA

SEQ ID NO: 55957 - protein, 10 aa, Artificial Sequence
  Description of Artificial Sequence: Synthetic peptide
  Seed: VIFSKASSSL (MAGA3_HUMAN)
VIFSKASSSF

SEQ ID NO: 55958 - protein, 10 aa, Artificial Sequence
  Description of Artificial Sequence: Synthetic peptide
  Seed: LVHFLLLKYR (MAGA3_HUMAN)
LQHFLLLKYR

SEQ ID NO: 55959 - protein, 9 aa, Artificial Sequence
  Description of Artificial Sequence: Synthetic peptide
  Seed: ISYPPLHEW (MAGA3_HUMAN)
IVYPPLHEL

SEQ ID NO: 55960 - protein, 9 aa, Artificial Sequence
  Description of Artificial Sequence: Synthetic peptide
  Seed: SEFQAALSR (MAGA3_HUMAN)
SYFQAALSK

SEQ ID NO: 55961 - protein, 9 aa, Artificial Sequence
  Description of Artificial Sequence: Synthetic peptide
  Seed: IIVLAIIAR (MAGA3_HUMAN)
ITVLAIIAK

SEQ ID NO: 55962 - protein, 10 aa, Artificial Sequence
  Description of Artificial Sequence: Synthetic peptide
  Seed: EVFEGREDSI (MAGA3_HUMAN)
EIFEGREDSV

SEQ ID NO: 55963 - protein, 10 aa, Artificial Sequence
  Description of Artificial Sequence: Synthetic peptide
  Seed: ELMEVDPIGH (MAGA3_HUMAN)
EAMEVDPIGK

SEQ ID NO: 55964 - protein, 10 aa, Artificial Sequence
  Description of Artificial Sequence: Synthetic peptide
  Seed: LYIFATCLGL (MAGA3_HUMAN)
LFIFATCLGV

SEQ ID NO: 55965 - protein, 10 aa, Artificial Sequence
  Description of Artificial Sequence: Synthetic peptide
  Seed: MVKISGGPHI (MAGA3_HUMAN)
MSKISGGPHK

SEQ ID NO: 55966 - protein, 9 aa, Artificial Sequence
  Description of Artificial Sequence: Synthetic peptide
  Seed: QIMPKAGLL (MAGA3_HUMAN)
QAMPKAGLR

SEQ ID NO: 55967 - protein, 9 aa, Artificial Sequence
  Description of Artificial Sequence: Synthetic peptide
  Seed: FVQENYLEY (MAGA3_HUMAN)
FYQENYLEI

SEQ ID NO: 55968 - protein, 10 aa, Artificial Sequence
  Description of Artificial Sequence: Synthetic peptide
  Seed: LQLVFGIELM (MAGA3_HUMAN)
LHLVFGIELV

SEQ ID NO: 55969 - protein, 10 aa, Artificial Sequence
  Description of Artificial Sequence: Synthetic peptide
  Seed: FVQENYLEYR (MAGA3_HUMAN)
FAQENYLEYR

SEQ ID NO: 55970 - protein, 10 aa, Artificial Sequence
  Description of Artificial Sequence: Synthetic peptide
  Seed: ISYPPLHEWV (MAGA3_HUMAN)
IMYPPLHEWI

SEQ ID NO: 55971 - protein, 9 aa, Artificial Sequence
  Description of Artificial Sequence: Synthetic peptide
  Seed: IMPKAGLLI (MAGA3_HUMAN)
IWPKAGLLI

SEQ ID NO: 55972 - protein, 10 aa, Artificial Sequence
  Description of Artificial Sequence: Synthetic peptide
  Seed: SVVGNWQYFF (MAGA3_HUMAN)
SSVGNWQYFW

SEQ ID NO: 55973 - protein, 9 aa, Artificial Sequence
  Description of Artificial Sequence: Synthetic peptide
  Seed: YPPLHEWVL (MAGA3_HUMAN)
YRPLHEWVY

SEQ ID NO: 55974 - protein, 9 aa, Artificial Sequence
  Description of Artificial Sequence: Synthetic peptide
  Seed: YFFPVIFSK (MAGA3_HUMAN)
YHFPVIFSR

SEQ ID NO: 55975 - protein, 10 aa, Artificial Sequence
  Description of Artificial Sequence: Synthetic peptide
  Seed: RALVETSYVK (MAGA3_HUMAN)
RFLVETSYVK

SEQ ID NO: 55976 - protein, 9 aa, Artificial Sequence
  Description of Artificial Sequence: Synthetic peptide
  Seed: FPVIFSKAS (MAGA3_HUMAN)
FPVIFSKAF

SEQ ID NO: 55977 - protein, 9 aa, Artificial Sequence
  Description of Artificial Sequence: Synthetic peptide
  Seed: NYPLWSQSY (MAGA3_HUMAN)
NYPLWSQSV

SEQ ID NO: 55978 - protein, 10 aa, Artificial Sequence
  Description of Artificial Sequence: Synthetic peptide
  Seed: ASSLPTTMNY (MAGA3_HUMAN)
AWSLPTTMNF

SEQ ID NO: 55979 - protein, 8 aa, Artificial Sequence
  Description of Artificial Sequence: Synthetic peptide
  Seed: EVDPIGHL (MAGA3_HUMAN)
ETDPIGHL

SEQ ID NO: 55980 - protein, 9 aa, Artificial Sequence
  Description of Artificial Sequence: Synthetic peptide
  Seed: RKVAELVHF (MAGA3_HUMAN)
RLVAELVHM

SEQ ID NO: 55981 - protein, 9 aa, Artificial Sequence
  Description of Artificial Sequence: Synthetic peptide
  Seed: KVAELVHFL (MAGA3_HUMAN)
KVAELVHFK

SEQ ID NO: 55982 - protein, 9 aa, Artificial Sequence
  Description of Artificial Sequence: Synthetic peptide
  Seed: SVLEVFEGR (MAGA3_HUMAN)
SMLEVFEGR

SEQ ID NO: 55983 - protein, 9 aa, Artificial Sequence
  Description of Artificial Sequence: Synthetic peptide
  Seed: LVHFLLLKY (MAGA3_HUMAN)
LMHFLLLKW

SEQ ID NO: 55984 - protein, 9 aa, Artificial Sequence
  Description of Artificial Sequence: Synthetic peptide
  Seed: ISGGPHISY (MAGA3_HUMAN)
ILGGPHISF

SEQ ID NO: 55985 - protein, 9 aa, Artificial Sequence
  Description of Artificial Sequence: Synthetic peptide
  Seed: SSTLVEVTL (MAGA3_HUMAN)
SATLVEVTL

SEQ ID NO: 55986 - protein, 9 aa, Artificial Sequence
  Description of Artificial Sequence: Synthetic peptide
  Seed: EALGLVGAQ (MAGA3_HUMAN)
ETLGLVGAF

SEQ ID NO: 55987 - protein, 10 aa, Artificial Sequence
  Description of Artificial Sequence: Synthetic peptide
  Seed: ASSLPTTMNY (MAGA3_HUMAN)
ARSLPTTMNK

SEQ ID NO: 55988 - protein, 9 aa, Artificial Sequence
  Description of Artificial Sequence: Synthetic peptide
  Seed: SEFQAALSR (MAGA3_HUMAN)
SQFQAALSY

SEQ ID NO: 55989 - protein, 10 aa, Artificial Sequence
  Description of Artificial Sequence: Synthetic peptide
  Seed: EVTLGEVPAA (MAGA3_HUMAN)
ETTLGEVPAV

SEQ ID NO: 55990 - protein, 9 aa, Artificial Sequence
  Description of Artificial Sequence: Synthetic peptide
  Seed: KVAELVHFL (MAGA3_HUMAN)
KVAELVHFV

SEQ ID NO: 55991 - protein, 9 aa, Artificial Sequence
  Description of Artificial Sequence: Synthetic peptide
  Seed: VVGNWQYFF (MAGA3_HUMAN)
VFGNWQYFM

SEQ ID NO: 55992 - protein, 10 aa, Artificial Sequence
  Description of Artificial Sequence: Synthetic peptide
  Seed: MEVDPIGHLY (MAGA3_HUMAN)
MQVDPIGHLV

SEQ ID NO: 55993 - protein, 10 aa, Artificial Sequence
  Description of Artificial Sequence: Synthetic peptide
  Seed: MNYPLWSQSY (MAGA3_HUMAN)
MTYPLWSQSF

SEQ ID NO: 55994 - protein, 9 aa, Artificial Sequence
  Description of Artificial Sequence: Synthetic peptide
  Seed: KVAELVHFL (MAGA3_HUMAN)
KEAELVHFI

SEQ ID NO: 55995 - protein, 10 aa, Artificial Sequence
  Description of Artificial Sequence: Synthetic peptide
  Seed: YIFATCLGLS (MAGA3_HUMAN)
YLFATCLGLM

SEQ ID NO: 55996 - protein, 10 aa, Artificial Sequence
  Description of Artificial Sequence: Synthetic peptide
  Seed: KISGGPHISY (MAGA3_HUMAN)
KQSGGPHISY

SEQ ID NO: 55997 - protein, 11 aa, Artificial Sequence
  Description of Artificial Sequence: Synthetic peptide
  Seed: SPQGASSLPTT (MAGA3_HUMAN)
SPQGASSLPTL

SEQ ID NO: 55998 - protein, 10 aa, Artificial Sequence
  Description of Artificial Sequence: Synthetic peptide
  Seed: LQLVFGIELM (MAGA3_HUMAN)
LTLVFGIELL

SEQ ID NO: 55999 - protein, 10 aa, Artificial Sequence
  Description of Artificial Sequence: Synthetic peptide
  Seed: KAEMLGSVVG (MAGA3_HUMAN)
KNEMLGSVVV

SEQ ID NO: 56000 - protein, 9 aa, Artificial Sequence
  Description of Artificial Sequence: Synthetic peptide
  Seed: ALSRKVAEL (MAGA3_HUMAN)
AISRKVAEW

SEQ ID NO: 56001 - protein, 10 aa, Artificial Sequence
  Description of Artificial Sequence: Synthetic peptide
  Seed: SLPTTMNYPL (MAGA3_HUMAN)
SFPTTMNYPM

SEQ ID NO: 56002 - protein, 10 aa, Artificial Sequence
  Description of Artificial Sequence: Synthetic peptide
  Seed: AALSRKVAEL (MAGA3_HUMAN)
ARLSRKVAEV

SEQ ID NO: 56003 - protein, 9 aa, Artificial Sequence
  Description of Artificial Sequence: Synthetic peptide
  Seed: LPTTMNYPL (MAGA3_HUMAN)
LKTTMNYPL

SEQ ID NO: 56004 - protein, 9 aa, Artificial Sequence
  Description of Artificial Sequence: Synthetic peptide
  Seed: VTLGEVPAA (MAGA3_HUMAN)
VILGEVPAV

SEQ ID NO: 56005 - protein, 9 aa, Artificial Sequence
  Description of Artificial Sequence: Synthetic peptide
  Seed: GEVPAAESP (MAGA3_HUMAN)
GEVPAAESF

SEQ ID NO: 56006 - protein, 11 aa, Artificial Sequence
  Description of Artificial Sequence: Synthetic peptide
  Seed: AEMLGSVVGNW (MAGA3_HUMAN)
AGMLGSVVGNW

SEQ ID NO: 56007 - protein, 10 aa, Artificial Sequence
  Description of Artificial Sequence: Synthetic peptide
  Seed: ASSLPTTMNY (MAGA3_HUMAN)
AHSLPTTMNF

SEQ ID NO: 56008 - protein, 9 aa, Artificial Sequence
  Description of Artificial Sequence: Synthetic peptide
  Seed: LESEFQAAL (MAGA3_HUMAN)
LMSEFQAAT

SEQ ID NO: 56009 - protein, 10 aa, Artificial Sequence
  Description of Artificial Sequence: Synthetic peptide
  Seed: SLQLVFGIEL (MAGA3_HUMAN)
SKQLVFGIEY

SEQ ID NO: 56010 - protein, 10 aa, Artificial Sequence
  Description of Artificial Sequence: Synthetic peptide
  Seed: FLWGPRALVE (MAGA3_HUMAN)
FLWGPRALVK

SEQ ID NO: 56011 - protein, 10 aa, Artificial Sequence
  Description of Artificial Sequence: Synthetic peptide
  Seed: MNYPLWSQSY (MAGA3_HUMAN)
MRYPLWSQSI

SEQ ID NO: 56012 - protein, 9 aa, Artificial Sequence
  Description of Artificial Sequence: Synthetic peptide
  Seed: TQHFVQENY (MAGA3_HUMAN)
TSHFVQENY

SEQ ID NO: 56013 - protein, 9 aa, Artificial Sequence
  Description of Artificial Sequence: Synthetic peptide
  Seed: YIFATCLGL (MAGA3_HUMAN)
YWFATCLGF

SEQ ID NO: 56014 - protein, 9 aa, Artificial Sequence
  Description of Artificial Sequence: Synthetic peptide
  Seed: FATCLGLSY (MAGA3_HUMAN)
FATCLGLSM

SEQ ID NO: 56015 - protein, 10 aa, Artificial Sequence
  Description of Artificial Sequence: Synthetic peptide
  Seed: GSVVGNWQYF (MAGA3_HUMAN)
GQVVGNWQYY

SEQ ID NO: 56016 - protein, 10 aa, Artificial Sequence
  Description of Artificial Sequence: Synthetic peptide
  Seed: FFPVIFSKAS (MAGA3_HUMAN)
FAPVIFSKAV

SEQ ID NO: 56017 - protein, 10 aa, Artificial Sequence
  Description of Artificial Sequence: Synthetic peptide
  Seed: FLWGPRALVE (MAGA3_HUMAN)
FMWGPRALVS

SEQ ID NO: 56018 - protein, 10 aa, Artificial Sequence
  Description of Artificial Sequence: Synthetic peptide
  Seed: KAEMLGSVVG (MAGA3_HUMAN)
KAEMLGSVVV

SEQ ID NO: 56019 - protein, 11 aa, Artificial Sequence
  Description of Artificial Sequence: Synthetic peptide
  Seed: RQVPGSDPACY (MAGA3_HUMAN)
RVVPGSDPACK

SEQ ID NO: 56020 - protein, 9 aa, Artificial Sequence
  Description of Artificial Sequence: Synthetic peptide
  Seed: SYPPLHEWV (MAGA3_HUMAN)
SYPPLHEWL

SEQ ID NO: 56021 - protein, 9 aa, Artificial Sequence
  Description of Artificial Sequence: Synthetic peptide
  Seed: IMPKAGLLI (MAGA3_HUMAN)
IFPKAGLLF

SEQ ID NO: 56022 - protein, 10 aa, Artificial Sequence
  Description of Artificial Sequence: Synthetic peptide
  Seed: KVAELVHFLL (MAGA3_HUMAN)
KIAELVHFLF

SEQ ID NO: 56023 - protein, 9 aa, Artificial Sequence
  Description of Artificial Sequence: Synthetic peptide
  Seed: FQAALSRKV (MAGA3_HUMAN)
FAAALSRKV

SEQ ID NO: 56024 - protein, 10 aa, Artificial Sequence
  Description of Artificial Sequence: Synthetic peptide
  Seed: LPTTMNYPLW (MAGA3_HUMAN)
LPTTMNYPLF

SEQ ID NO: 56025 - protein, 10 aa, Artificial Sequence
  Description of Artificial Sequence: Synthetic peptide
  Seed: VIFSKASSSL (MAGA3_HUMAN)
VWFSKASSSF

SEQ ID NO: 56026 - protein, 9 aa, Artificial Sequence
  Description of Artificial Sequence: Synthetic peptide
  Seed: FVQENYLEY (MAGA3_HUMAN)
FAQENYLEH

SEQ ID NO: 56027 - protein, 9 aa, Artificial Sequence
  Description of Artificial Sequence: Synthetic peptide
  Seed: ELVHFLLLK (MAGA3_HUMAN)
EGVHFLLLR

SEQ ID NO: 56028 - protein, 10 aa, Artificial Sequence
  Description of Artificial Sequence: Synthetic peptide
  Seed: VDPIGHLYIF (MAGA3_HUMAN)
VLPIGHLYIW

SEQ ID NO: 56029 - protein, 10 aa, Artificial Sequence
  Description of Artificial Sequence: Synthetic peptide
  Seed: ASSSLQLVFG (MAGA3_HUMAN)
ALSSLQLVFW

SEQ ID NO: 56030 - protein, 8 aa, Artificial Sequence
  Description of Artificial Sequence: Synthetic peptide
  Seed: KIWEELSV (MAGA3_HUMAN)
KMWEELSI

SEQ ID NO: 56031 - protein, 11 aa, Artificial Sequence
  Description of Artificial Sequence: Synthetic peptide
  Seed: REGDCAPEEKI (MAGA3_HUMAN)
RQGDCAPEEKI

SEQ ID NO: 56032 - protein, 10 aa, Artificial Sequence
  Description of Artificial Sequence: Synthetic peptide
  Seed: IFATCLGLSY (MAGA3_HUMAN)
IKATCLGLSY

SEQ ID NO: 56033 - protein, 9 aa, Artificial Sequence
  Description of Artificial Sequence: Synthetic peptide
  Seed: YVKVLHHMV (MAGA3_HUMAN)
YMKVLHHMA

SEQ ID NO: 56034 - protein, 10 aa, Artificial Sequence
  Description of Artificial Sequence: Synthetic peptide
  Seed: QYFFPVIFSK (MAGA3_HUMAN)
QVFFPVIFSK

SEQ ID NO: 56035 - protein, 10 aa, Artificial Sequence
  Description of Artificial Sequence: Synthetic peptide
  Seed: RKVAELVHFL (MAGA3_HUMAN)
RVVAELVHFI

SEQ ID NO: 56036 - protein, 11 aa, Artificial Sequence
  Description of Artificial Sequence: Synthetic peptide
  Seed: NQIMPKAGLLI (MAGA3_HUMAN)
NHIMPKAGLLF

SEQ ID NO: 56037 - protein, 9 aa, Artificial Sequence
  Description of Artificial Sequence: Synthetic peptide
  Seed: ISGGPHISY (MAGA3_HUMAN)
IFGGPHISM

SEQ ID NO: 56038 - protein, 10 aa, Artificial Sequence
  Description of Artificial Sequence: Synthetic peptide
  Seed: LVHFLLLKYR (MAGA3_HUMAN)
LIHFLLLKYR

SEQ ID NO: 56039 - protein, 10 aa, Artificial Sequence
  Description of Artificial Sequence: Synthetic peptide
  Seed: WEELSVLEVF (MAGA3_HUMAN)
WGELSVLEVM

SEQ ID NO: 56040 - protein, 11 aa, Artificial Sequence
  Description of Artificial Sequence: Synthetic peptide
  Seed: SPQGASSLPTT (MAGA3_HUMAN)
SPQGASSLPTA

SEQ ID NO: 56041 - protein, 9 aa, Artificial Sequence
  Description of Artificial Sequence: Synthetic peptide
  Seed: KIWEELSVL (MAGA3_HUMAN)
KGWEELSVF

SEQ ID NO: 56042 - protein, 9 aa, Artificial Sequence
  Description of Artificial Sequence: Synthetic peptide
  Seed: YVKVLHHMV (MAGA3_HUMAN)
YVKVLHHML

SEQ ID NO: 56043 - protein, 10 aa, Artificial Sequence
  Description of Artificial Sequence: Synthetic peptide
  Seed: EALGLVGAQA (MAGA3_HUMAN)
ESLGLVGAQV

SEQ ID NO: 56044 - protein, 10 aa, Artificial Sequence
  Description of Artificial Sequence: Synthetic peptide
  Seed: ISYPPLHEWV (MAGA3_HUMAN)
INYPPLHEWW

SEQ ID NO: 56045 - protein, 9 aa, Artificial Sequence
  Description of Artificial Sequence: Synthetic peptide
  Seed: RQVPGSDPA (MAGA3_HUMAN)
REVPGSDPF

SEQ ID NO: 56046 - protein, 9 aa, Artificial Sequence
  Description of Artificial Sequence: Synthetic peptide
  Seed: TFPDLESEF (MAGA3_HUMAN)
TYPDLESEL

SEQ ID NO: 56047 - protein, 10 aa, Artificial Sequence
  Description of Artificial Sequence: Synthetic peptide
  Seed: HISYPPLHEW (MAGA3_HUMAN)
HSSYPPLHEW

SEQ ID NO: 56048 - protein, 8 aa, Artificial Sequence
  Description of Artificial Sequence: Synthetic peptide
  Seed: LGDPKKLL (MAGA3_HUMAN)
LSDPKKLI

SEQ ID NO: 56049 - protein, 9 aa, Artificial Sequence
  Description of Artificial Sequence: Synthetic peptide
  Seed: GLLIIVLAI (MAGA3_HUMAN)
GQLIIVLAV

SEQ ID NO: 56050 - protein, 8 aa, Artificial Sequence
  Description of Artificial Sequence: Synthetic peptide
  Seed: SGGPHISY (MAGA3_HUMAN)
SYGPHISL

SEQ ID NO: 56051 - protein, 10 aa, Artificial Sequence
  Description of Artificial Sequence: Synthetic peptide
  Seed: QVPGSDPACY (MAGA3_HUMAN)
QVPGSDPACR

SEQ ID NO: 56052 - protein, 9 aa, Artificial Sequence
  Description of Artificial Sequence: Synthetic peptide
  Seed: VQENYLEYR (MAGA3_HUMAN)
VMENYLEYY

SEQ ID NO: 56053 - protein, 9 aa, Artificial Sequence
  Description of Artificial Sequence: Synthetic peptide
  Seed: SVVGNWQYF (MAGA3_HUMAN)
SQVGNWQYY

SEQ ID NO: 56054 - protein, 10 aa, Artificial Sequence
  Description of Artificial Sequence: Synthetic peptide
  Seed: HFVQENYLEY (MAGA3_HUMAN)
HYVQENYLEY

SEQ ID NO: 56055 - protein, 9 aa, Artificial Sequence
  Description of Artificial Sequence: Synthetic peptide
  Seed: SSSSTLVEV (MAGA3_HUMAN)
SLSSTLVEW

SEQ ID NO: 56056 - protein, 9 aa, Artificial Sequence
  Description of Artificial Sequence: Synthetic peptide
  Seed: SSLPTTMNY (MAGA3_HUMAN)
SQLPTTMNI

SEQ ID NO: 56057 - protein, 10 aa, Artificial Sequence
  Description of Artificial Sequence: Synthetic peptide
  Seed: YFFPVIFSKA (MAGA3_HUMAN)
YYFPVIFSKR

SEQ ID NO: 56058 - protein, 9 aa, Artificial Sequence
  Description of Artificial Sequence: Synthetic peptide
  Seed: LESEFQAAL (MAGA3_HUMAN)
LTSEFQAAI

SEQ ID NO: 56059 - protein, 9 aa, Artificial Sequence
  Description of Artificial Sequence: Synthetic peptide
  Seed: QEAASSSST (MAGA3_HUMAN)
QEAASSSSA

SEQ ID NO: 56060 - protein, 9 aa, Artificial Sequence
  Description of Artificial Sequence: Synthetic peptide
  Seed: ALVETSYVK (MAGA3_HUMAN)
AMVETSYVK

SEQ ID NO: 56061 - protein, 10 aa, Artificial Sequence
  Description of Artificial Sequence: Synthetic peptide
  Seed: LYIFATCLGL (MAGA3_HUMAN)
LMIFATCLGI

SEQ ID NO: 56062 - protein, 9 aa, Artificial Sequence
  Description of Artificial Sequence: Synthetic peptide
  Seed: EVDPIGHLY (MAGA3_HUMAN)
ESDPIGHLL

SEQ ID NO: 56063 - protein, 10 aa, Artificial Sequence
  Description of Artificial Sequence: Synthetic peptide
  Seed: SLQLVFGIEL (MAGA3_HUMAN)
SDQLVFGIEY

SEQ ID NO: 56064 - protein, 9 aa, Artificial Sequence
  Description of Artificial Sequence: Synthetic peptide
  Seed: GNWQYFFPV (MAGA3_HUMAN)
GQWQYFFPL

SEQ ID NO: 56065 - protein, 10 aa, Artificial Sequence
  Description of Artificial Sequence: Synthetic peptide
  Seed: HISYPPLHEW (MAGA3_HUMAN)
HTSYPPLHEM

SEQ ID NO: 56066 - protein, 10 aa, Artificial Sequence
  Description of Artificial Sequence: Synthetic peptide
  Seed: ELMEVDPIGH (MAGA3_HUMAN)
ELMEVDPIGK

SEQ ID NO: 56067 - protein, 9 aa, Artificial Sequence
  Description of Artificial Sequence: Synthetic peptide
  Seed: EAASSSSTL (MAGA3_HUMAN)
EQASSSSTR

SEQ ID NO: 56068 - protein, 9 aa, Artificial Sequence
  Description of Artificial Sequence: Synthetic peptide
  Seed: RALVETSYV (MAGA3_HUMAN)
RTLVETSYW

SEQ ID NO: 56069 - protein, 9 aa, Artificial Sequence
  Description of Artificial Sequence: Synthetic peptide
  Seed: LESEFQAAL (MAGA3_HUMAN)
LISEFQAAM

SEQ ID NO: 56070 - protein, 10 aa, Artificial Sequence
  Description of Artificial Sequence: Synthetic peptide
  Seed: YFFPVIFSKA (MAGA3_HUMAN)
YAFPVIFSKV

SEQ ID NO: 56071 - protein, 9 aa, Artificial Sequence
  Description of Artificial Sequence: Synthetic peptide
  Seed: KVAELVHFL (MAGA3_HUMAN)
KYAELVHFW

SEQ ID NO: 56072 - protein, 9 aa, Artificial Sequence
  Description of Artificial Sequence: Synthetic peptide
  Seed: SSSSTLVEV (MAGA3_HUMAN)
SVSSTLVEV

SEQ ID NO: 56073 - protein, 9 aa, Artificial Sequence
  Description of Artificial Sequence: Synthetic peptide
  Seed: QHFVQENYL (MAGA3_HUMAN)
QHFVQENYM

SEQ ID NO: 56074 - protein, 11 aa, Artificial Sequence
  Description of Artificial Sequence: Synthetic peptide
  Seed: GASSLPTTMNY (MAGA3_HUMAN)
GQSSLPTTMNY

SEQ ID NO: 56075 - protein, 10 aa, Artificial Sequence
  Description of Artificial Sequence: Synthetic peptide
  Seed: ISYPPLHEWV (MAGA3_HUMAN)
IKYPPLHEWW

SEQ ID NO: 56076 - protein, 10 aa, Artificial Sequence
  Description of Artificial Sequence: Synthetic peptide
  Seed: LVFGIELMEV (MAGA3_HUMAN)
LTFGIELMEA

SEQ ID NO: 56077 - protein, 9 aa, Artificial Sequence
  Description of Artificial Sequence: Synthetic peptide
  Seed: YPLWSQSYE (MAGA3_HUMAN)
YPLWSQSYY

SEQ ID NO: 56078 - protein, 9 aa, Artificial Sequence
  Description of Artificial Sequence: Synthetic peptide
  Seed: ISYPPLHEW (MAGA3_HUMAN)
IIYPPLHEM

SEQ ID NO: 56079 - protein, 9 aa, Artificial Sequence
  Description of Artificial Sequence: Synthetic peptide
  Seed: AQAPATEEQ (MAGA3_HUMAN)
AAAPATEEF

SEQ ID NO: 56080 - protein, 9 aa, Artificial Sequence
  Description of Artificial Sequence: Synthetic peptide
  Seed: ISYPPLHEW (MAGA3_HUMAN)
ITYPPLHEM

SEQ ID NO: 56081 - protein, 10 aa, Artificial Sequence
  Description of Artificial Sequence: Synthetic peptide
  Seed: KISGGPHISY (MAGA3_HUMAN)
KMSGGPHISM

SEQ ID NO: 56082 - protein, 9 aa, Artificial Sequence
  Description of Artificial Sequence: Synthetic peptide
  Seed: SVVGNWQYF (MAGA3_HUMAN)
SSVGNWQYF

SEQ ID NO: 56083 - protein, 9 aa, Artificial Sequence
  Description of Artificial Sequence: Synthetic peptide
  Seed: VFEGREDSI (MAGA3_HUMAN)
VIEGREDSL

SEQ ID NO: 56084 - protein, 10 aa, Artificial Sequence
  Description of Artificial Sequence: Synthetic peptide
  Seed: FLWGPRALVE (MAGA3_HUMAN)
FLWGPRALVG

SEQ ID NO: 56085 - protein, 10 aa, Artificial Sequence
  Description of Artificial Sequence: Synthetic peptide
  Seed: YIFATCLGLS (MAGA3_HUMAN)
YLFATCLGLC

SEQ ID NO: 56086 - protein, 9 aa, Artificial Sequence
  Description of Artificial Sequence: Synthetic peptide
  Seed: RQVPGSDPA (MAGA3_HUMAN)
RMVPGSDPW

SEQ ID NO: 56087 - protein, 11 aa, Artificial Sequence
  Description of Artificial Sequence: Synthetic peptide
  Seed: SPQGASSLPTT (MAGA3_HUMAN)
SPQGASSLPTV

SEQ ID NO: 56088 - protein, 10 aa, Artificial Sequence
  Description of Artificial Sequence: Synthetic peptide
  Seed: FSKASSSLQL (MAGA3_HUMAN)
FYKASSSLQY

SEQ ID NO: 56089 - protein, 9 aa, Artificial Sequence
  Description of Artificial Sequence: Synthetic peptide
  Seed: QSPQGASSL (MAGA3_HUMAN)
QIPQGASSM

SEQ ID NO: 56090 - protein, 9 aa, Artificial Sequence
  Description of Artificial Sequence: Synthetic peptide
  Seed: SSLQLVFGI (MAGA3_HUMAN)
SQLQLVFGL

SEQ ID NO: 56091 - protein, 10 aa, Artificial Sequence
  Description of Artificial Sequence: Synthetic peptide
  Seed: LVFGIELMEV (MAGA3_HUMAN)
LAFGIELMEV

SEQ ID NO: 56092 - protein, 11 aa, Artificial Sequence
  Description of Artificial Sequence: Synthetic peptide
  Seed: KIWEELSVLEV (MAGA3_HUMAN)
KVWEELSVLEV

SEQ ID NO: 56093 - protein, 9 aa, Artificial Sequence
  Description of Artificial Sequence: Synthetic peptide
  Seed: KAGLLIIVL (MAGA3_HUMAN)
KRGLLIIVM

SEQ ID NO: 56094 - protein, 10 aa, Artificial Sequence
  Description of Artificial Sequence: Synthetic peptide
  Seed: SYPPLHEWVL (MAGA3_HUMAN)
SWPPLHEWVL

SEQ ID NO: 56095 - protein, 10 aa, Artificial Sequence
  Description of Artificial Sequence: Synthetic peptide
  Seed: ASSLPTTMNY (MAGA3_HUMAN)
ADSLPTTMNF

SEQ ID NO: 56096 - protein, 10 aa, Artificial Sequence
  Description of Artificial Sequence: Synthetic peptide
  Seed: MNYPLWSQSY (MAGA3_HUMAN)
MIYPLWSQSL

SEQ ID NO: 56097 - protein, 10 aa, Artificial Sequence
  Description of Artificial Sequence: Synthetic peptide
  Seed: ASSLPTTMNY (MAGA3_HUMAN)
AGSLPTTMNK

SEQ ID NO: 56098 - protein, 10 aa, Artificial Sequence
  Description of Artificial Sequence: Synthetic peptide
  Seed: ISYPPLHEWV (MAGA3_HUMAN)
ISYPPLHEWY

SEQ ID NO: 56099 - protein, 9 aa, Artificial Sequence
  Description of Artificial Sequence: Synthetic peptide
  Seed: QIMPKAGLL (MAGA3_HUMAN)
QTMPKAGLR

SEQ ID NO: 56100 - protein, 10 aa, Artificial Sequence
  Description of Artificial Sequence: Synthetic peptide
  Seed: EVFEGREDSI (MAGA3_HUMAN)
EVFEGREDSK

SEQ ID NO: 56101 - protein, 9 aa, Artificial Sequence
  Description of Artificial Sequence: Synthetic peptide
  Seed: VTLGEVPAA (MAGA3_HUMAN)
VSLGEVPAM

SEQ ID NO: 56102 - protein, 10 aa, Artificial Sequence
  Description of Artificial Sequence: Synthetic peptide
  Seed: LTQHFVQENY (MAGA3_HUMAN)
LSQHFVQENW

SEQ ID NO: 56103 - protein, 9 aa, Artificial Sequence
  Description of Artificial Sequence: Synthetic peptide
  Seed: RQVPGSDPA (MAGA3_HUMAN)
RIVPGSDPF

SEQ ID NO: 56104 - protein, 10 aa, Artificial Sequence
  Description of Artificial Sequence: Synthetic peptide
  Seed: RALVETSYVK (MAGA3_HUMAN)
RLLVETSYVK

SEQ ID NO: 56105 - protein, 11 aa, Artificial Sequence
  Description of Artificial Sequence: Synthetic peptide
  Seed: AEMLGSVVGNW (MAGA3_HUMAN)
AEMLGSVVGNF

SEQ ID NO: 56106 - protein, 11 aa, Artificial Sequence
  Description of Artificial Sequence: Synthetic peptide
  Seed: TMNYPLWSQSY (MAGA3_HUMAN)
TQNYPLWSQSF

SEQ ID NO: 56107 - protein, 10 aa, Artificial Sequence
  Description of Artificial Sequence: Synthetic peptide
  Seed: EVFEGREDSI (MAGA3_HUMAN)
EIFEGREDSF

SEQ ID NO: 56108 - protein, 9 aa, Artificial Sequence
  Description of Artificial Sequence: Synthetic peptide
  Seed: ISYPPLHEW (MAGA3_HUMAN)
IWYPPLHEL

SEQ ID NO: 56109 - protein, 9 aa, Artificial Sequence
  Description of Artificial Sequence: Synthetic peptide
  Seed: MEVDPIGHL (MAGA3_HUMAN)
MTVDPIGHI

SEQ ID NO: 56110 - protein, 9 aa, Artificial Sequence
  Description of Artificial Sequence: Synthetic peptide
  Seed: QIMPKAGLL (MAGA3_HUMAN)
QSMPKAGLR

SEQ ID NO: 56111 - protein, 11 aa, Artificial Sequence
  Description of Artificial Sequence: Synthetic peptide
  Seed: MLGSVVGNWQY (MAGA3_HUMAN)
MIGSVVGNWQW

SEQ ID NO: 56112 - protein, 10 aa, Artificial Sequence
  Description of Artificial Sequence: Synthetic peptide
  Seed: KVAELVHFLL (MAGA3_HUMAN)
KQAELVHFLL

SEQ ID NO: 56113 - protein, 10 aa, Artificial Sequence
  Description of Artificial Sequence: Synthetic peptide
  Seed: SPQGASSLPT (MAGA3_HUMAN)
SPQGASSLPV

SEQ ID NO: 56114 - protein, 10 aa, Artificial Sequence
  Description of Artificial Sequence: Synthetic peptide
  Seed: SEFQAALSRK (MAGA3_HUMAN)
SVFQAALSRK

SEQ ID NO: 56115 - protein, 10 aa, Artificial Sequence
  Description of Artificial Sequence: Synthetic peptide
  Seed: LQLVFGIELM (MAGA3_HUMAN)
LMLVFGIELI

SEQ ID NO: 56116 - protein, 9 aa, Artificial Sequence
  Description of Artificial Sequence: Synthetic peptide
  Seed: KIWEELSVL (MAGA3_HUMAN)
KTWEELSVR

SEQ ID NO: 56117 - protein, 10 aa, Artificial Sequence
  Description of Artificial Sequence: Synthetic peptide
  Seed: WEELSVLEVF (MAGA3_HUMAN)
WKELSVLEVW

SEQ ID NO: 56118 - protein, 10 aa, Artificial Sequence
  Description of Artificial Sequence: Synthetic peptide
  Seed: TSYVKVLHHM (MAGA3_HUMAN)
TKYVKVLHHW

SEQ ID NO: 56119 - protein, 9 aa, Artificial Sequence
  Description of Artificial Sequence: Synthetic peptide
  Seed: ASSSLQLVF (MAGA3_HUMAN)
AQSSLQLVV

SEQ ID NO: 56120 - protein, 9 aa, Artificial Sequence
  Description of Artificial Sequence: Synthetic peptide
  Seed: MEVDPIGHL (MAGA3_HUMAN)
MQVDPIGHA

SEQ ID NO: 56121 - protein, 11 aa, Artificial Sequence
  Description of Artificial Sequence: Synthetic peptide
  Seed: RQVPGSDPACY (MAGA3_HUMAN)
RFVPGSDPACY

SEQ ID NO: 56122 - protein, 10 aa, Artificial Sequence
  Description of Artificial Sequence: Synthetic peptide
  Seed: TTMNYPLWSQ (MAGA3_HUMAN)
TSMNYPLWSK

SEQ ID NO: 56123 - protein, 9 aa, Artificial Sequence
  Description of Artificial Sequence: Synthetic peptide
  Seed: VKISGGPHI (MAGA3_HUMAN)
VVISGGPHF

SEQ ID NO: 56124 - protein, 9 aa, Artificial Sequence
  Description of Artificial Sequence: Synthetic peptide
  Seed: EGDCAPEEK (MAGA3_HUMAN)
ETDCAPEEY

SEQ ID NO: 56125 - protein, 9 aa, Artificial Sequence
  Description of Artificial Sequence: Synthetic peptide
  Seed: KIWEELSVL (MAGA3_HUMAN)
KVWEELSVF

SEQ ID NO: 56126 - protein, 10 aa, Artificial Sequence
  Description of Artificial Sequence: Synthetic peptide
  Seed: WEELSVLEVF (MAGA3_HUMAN)
WHELSVLEVM

SEQ ID NO: 56127 - protein, 10 aa, Artificial Sequence
  Description of Artificial Sequence: Synthetic peptide
  Seed: MNYPLWSQSY (MAGA3_HUMAN)
MDYPLWSQSY

SEQ ID NO: 56128 - protein, 10 aa, Artificial Sequence
  Description of Artificial Sequence: Synthetic peptide
  Seed: ISYPPLHEWV (MAGA3_HUMAN)
INYPPLHEWF

SEQ ID NO: 56129 - protein, 10 aa, Artificial Sequence
  Description of Artificial Sequence: Synthetic peptide
  Seed: DLESEFQAAL (MAGA3_HUMAN)
DSESEFQAAY

SEQ ID NO: 56130 - protein, 10 aa, Artificial Sequence
  Description of Artificial Sequence: Synthetic peptide
  Seed: LVFGIELMEV (MAGA3_HUMAN)
LQFGIELMEI

SEQ ID NO: 56131 - protein, 10 aa, Artificial Sequence
  Description of Artificial Sequence: Synthetic peptide
  Seed: RQVPGSDPAC (MAGA3_HUMAN)
RMVPGSDPAI

SEQ ID NO: 56132 - protein, 9 aa, Artificial Sequence
  Description of Artificial Sequence: Synthetic peptide
  Seed: ISGGPHISY (MAGA3_HUMAN)
IWGGPHISF

SEQ ID NO: 56133 - protein, 11 aa, Artificial Sequence
  Description of Artificial Sequence: Synthetic peptide
  Seed: RKVAELVHFLL (MAGA3_HUMAN)
RRVAELVHFLV

SEQ ID NO: 56134 - protein, 9 aa, Artificial Sequence
  Description of Artificial Sequence: Synthetic peptide
  Seed: IIVLAIIAR (MAGA3_HUMAN)
IAVLAIIAI

SEQ ID NO: 56135 - protein, 9 aa, Artificial Sequence
  Description of Artificial Sequence: Synthetic peptide
  Seed: AESPDPPQS (MAGA3_HUMAN)
AESPDPPQC

SEQ ID NO: 56136 - protein, 9 aa, Artificial Sequence
  Description of Artificial Sequence: Synthetic peptide
  Seed: KASSSLQLV (MAGA3_HUMAN)
KFSSSLQLY

SEQ ID NO: 56137 - protein, 10 aa, Artificial Sequence
  Description of Artificial Sequence: Synthetic peptide
  Seed: KVAELVHFLL (MAGA3_HUMAN)
KQAELVHFLV

SEQ ID NO: 56138 - protein, 11 aa, Artificial Sequence
  Description of Artificial Sequence: Synthetic peptide
  Seed: KVAELVHFLLL (MAGA3_HUMAN)
KMAELVHFLLQ

SEQ ID NO: 56139 - protein, 9 aa, Artificial Sequence
  Description of Artificial Sequence: Synthetic peptide
  Seed: RQVPGSDPA (MAGA3_HUMAN)
RQVPGSDPF

SEQ ID NO: 56140 - protein, 10 aa, Artificial Sequence
  Description of Artificial Sequence: Synthetic peptide
  Seed: QYFFPVIFSK (MAGA3_HUMAN)
QMFFPVIFSR

SEQ ID NO: 56141 - protein, 10 aa, Artificial Sequence
  Description of Artificial Sequence: Synthetic peptide
  Seed: RKVAELVHFL (MAGA3_HUMAN)
REVAELVHFL

SEQ ID NO: 56142 - protein, 9 aa, Artificial Sequence
  Description of Artificial Sequence: Synthetic peptide
  Seed: KASSSLQLV (MAGA3_HUMAN)
KLSSSLQLM

SEQ ID NO: 56143 - protein, 9 aa, Artificial Sequence
  Description of Artificial Sequence: Synthetic peptide
  Seed: KASSSLQLV (MAGA3_HUMAN)
KNSSSLQLY

SEQ ID NO: 56144 - protein, 10 aa, Artificial Sequence
  Description of Artificial Sequence: Synthetic peptide
  Seed: AELVHFLLLK (MAGA3_HUMAN)
ATLVHFLLLR

SEQ ID NO: 56145 - protein, 9 aa, Artificial Sequence
  Description of Artificial Sequence: Synthetic peptide
  Seed: SSLPTTMNY (MAGA3_HUMAN)
SALPTTMNW

SEQ ID NO: 56146 - protein, 9 aa, Artificial Sequence
  Description of Artificial Sequence: Synthetic peptide
  Seed: FVQENYLEY (MAGA3_HUMAN)
FIQENYLEY

SEQ ID NO: 56147 - protein, 9 aa, Artificial Sequence
  Description of Artificial Sequence: Synthetic peptide
  Seed: KVLHHMVKI (MAGA3_HUMAN)
KVLHHMVKA

SEQ ID NO: 56148 - protein, 10 aa, Artificial Sequence
  Description of Artificial Sequence: Synthetic peptide
  Seed: KISGGPHISY (MAGA3_HUMAN)
KQSGGPHISM

SEQ ID NO: 56149 - protein, 10 aa, Artificial Sequence
  Description of Artificial Sequence: Synthetic peptide
  Seed: MEVDPIGHLY (MAGA3_HUMAN)
MPVDPIGHLM

SEQ ID NO: 56150 - protein, 8 aa, Artificial Sequence
  Description of Artificial Sequence: Synthetic peptide
  Seed: YPLWSQSY (MAGA3_HUMAN)
YFLWSQSY

SEQ ID NO: 56151 - protein, 10 aa, Artificial Sequence
  Description of Artificial Sequence: Synthetic peptide
  Seed: KISGGPHISY (MAGA3_HUMAN)
KGSGGPHISW

SEQ ID NO: 56152 - protein, 9 aa, Artificial Sequence
  Description of Artificial Sequence: Synthetic peptide
  Seed: MPKAGLLII (MAGA3_HUMAN)
MPKAGLLIA

SEQ ID NO: 56153 - protein, 10 aa, Artificial Sequence
  Description of Artificial Sequence: Synthetic peptide
  Seed: ASSSSTLVEV (MAGA3_HUMAN)
AASSSTLVEL

SEQ ID NO: 56154 - protein, 10 aa, Artificial Sequence
  Description of Artificial Sequence: Synthetic peptide
  Seed: KVAELVHFLL (MAGA3_HUMAN)
KMAELVHFLL

SEQ ID NO: 56155 - protein, 10 aa, Artificial Sequence
  Description of Artificial Sequence: Synthetic peptide
  Seed: KISGGPHISY (MAGA3_HUMAN)
KMSGGPHISL

SEQ ID NO: 56156 - protein, 9 aa, Artificial Sequence
  Description of Artificial Sequence: Synthetic peptide
  Seed: HLYIFATCL (MAGA3_HUMAN)
HMYIFATCF

SEQ ID NO: 56157 - protein, 9 aa, Artificial Sequence
  Description of Artificial Sequence: Synthetic peptide
  Seed: KVLHHMVKI (MAGA3_HUMAN)
KSLHHMVKF

SEQ ID NO: 56158 - protein, 8 aa, Artificial Sequence
  Description of Artificial Sequence: Synthetic peptide
  Seed: HEWVLREG (MAGA3_HUMAN)
HEWVLREL

SEQ ID NO: 56159 - protein, 9 aa, Artificial Sequence
  Description of Artificial Sequence: Synthetic peptide
  Seed: ISYPPLHEW (MAGA3_HUMAN)
IRYPPLHEL

SEQ ID NO: 56160 - protein, 9 aa, Artificial Sequence
  Description of Artificial Sequence: Synthetic peptide
  Seed: EAASSSSTL (MAGA3_HUMAN)
EIASSSSTY

SEQ ID NO: 56161 - protein, 9 aa, Artificial Sequence
  Description of Artificial Sequence: Synthetic peptide
  Seed: NWQYFFPVI (MAGA3_HUMAN)
NFQYFFPVF

SEQ ID NO: 56162 - protein, 9 aa, Artificial Sequence
  Description of Artificial Sequence: Synthetic peptide
  Seed: TSYVKVLHH (MAGA3_HUMAN)
TTYVKVLHL

SEQ ID NO: 56163 - protein, 10 aa, Artificial Sequence
  Description of Artificial Sequence: Synthetic peptide
  Seed: YIFATCLGLS (MAGA3_HUMAN)
YLFATCLGLV

SEQ ID NO: 56164 - protein, 9 aa, Artificial Sequence
  Description of Artificial Sequence: Synthetic peptide
  Seed: ISGGPHISY (MAGA3_HUMAN)
IAGGPHISL

SEQ ID NO: 56165 - protein, 10 aa, Artificial Sequence
  Description of Artificial Sequence: Synthetic peptide
  Seed: LGSVVGNWQY (MAGA3_HUMAN)
LHSVVGNWQW

SEQ ID NO: 56166 - protein, 9 aa, Artificial Sequence
  Description of Artificial Sequence: Synthetic peptide
  Seed: ALSRKVAEL (MAGA3_HUMAN)
AMSRKVAEW

SEQ ID NO: 56167 - protein, 9 aa, Artificial Sequence
  Description of Artificial Sequence: Synthetic peptide
  Seed: ALSRKVAEL (MAGA3_HUMAN)
ATSRKVAEV

SEQ ID NO: 56168 - protein, 9 aa, Artificial Sequence
  Description of Artificial Sequence: Synthetic peptide
  Seed: VKISGGPHI (MAGA3_HUMAN)
VLISGGPHM

SEQ ID NO: 56169 - protein, 10 aa, Artificial Sequence
  Description of Artificial Sequence: Synthetic peptide
  Seed: LPTTMNYPLW (MAGA3_HUMAN)
LITTMNYPLW

SEQ ID NO: 56170 - protein, 9 aa, Artificial Sequence
  Description of Artificial Sequence: Synthetic peptide
  Seed: IIVLAIIAR (MAGA3_HUMAN)
IAVLAIIAL

SEQ ID NO: 56171 - protein, 8 aa, Artificial Sequence
  Description of Artificial Sequence: Synthetic peptide
  Seed: EVDPIGHL (MAGA3_HUMAN)
EYDPIGHL

SEQ ID NO: 56172 - protein, 11 aa, Artificial Sequence
  Description of Artificial Sequence: Synthetic peptide
  Seed: RQVPGSDPACY (MAGA3_HUMAN)
RMVPGSDPACY

SEQ ID NO: 56173 - protein, 9 aa, Artificial Sequence
  Description of Artificial Sequence: Synthetic peptide
  Seed: FATCLGLSY (MAGA3_HUMAN)
FVTCLGLSY

SEQ ID NO: 56174 - protein, 10 aa, Artificial Sequence
  Description of Artificial Sequence: Synthetic peptide
  Seed: SLQLVFGIEL (MAGA3_HUMAN)
SAQLVFGIEY

SEQ ID NO: 56175 - protein, 10 aa, Artificial Sequence
  Description of Artificial Sequence: Synthetic peptide
  Seed: EALGLVGAQA (MAGA3_HUMAN)
ETLGLVGAQA

SEQ ID NO: 56176 - protein, 9 aa, Artificial Sequence
  Description of Artificial Sequence: Synthetic peptide
  Seed: SSLPTTMNY (MAGA3_HUMAN)
SWLPTTMNM

SEQ ID NO: 56177 - protein, 10 aa, Artificial Sequence
  Description of Artificial Sequence: Synthetic peptide
  Seed: WEELSVLEVF (MAGA3_HUMAN)
WYELSVLEVM

SEQ ID NO: 56178 - protein, 9 aa, Artificial Sequence
  Description of Artificial Sequence: Synthetic peptide
  Seed: KASSSLQLV (MAGA3_HUMAN)
KVSSSLQLL

SEQ ID NO: 56179 - protein, 10 aa, Artificial Sequence
  Description of Artificial Sequence: Synthetic peptide
  Seed: EVFEGREDSI (MAGA3_HUMAN)
ESFEGREDSR

SEQ ID NO: 56180 - protein, 9 aa, Artificial Sequence
  Description of Artificial Sequence: Synthetic peptide
  Seed: SEFQAALSR (MAGA3_HUMAN)
SEFQAALSP

SEQ ID NO: 56181 - protein, 10 aa, Artificial Sequence
  Description of Artificial Sequence: Synthetic peptide
  Seed: MNYPLWSQSY (MAGA3_HUMAN)
MQYPLWSQSF

SEQ ID NO: 56182 - protein, 10 aa, Artificial Sequence
  Description of Artificial Sequence: Synthetic peptide
  Seed: NWQYFFPVIF (MAGA3_HUMAN)
NYQYFFPVIF

SEQ ID NO: 56183 - protein, 9 aa, Artificial Sequence
  Description of Artificial Sequence: Synthetic peptide
  Seed: VFGIELMEV (MAGA3_HUMAN)
VYGIELMEY

SEQ ID NO: 56184 - protein, 9 aa, Artificial Sequence
  Description of Artificial Sequence: Synthetic peptide
  Seed: QIMPKAGLL (MAGA3_HUMAN)
QQMPKAGLI

SEQ ID NO: 56185 - protein, 9 aa, Artificial Sequence
  Description of Artificial Sequence: Synthetic peptide
  Seed: ISGGPHISY (MAGA3_HUMAN)
ISGGPHISF

SEQ ID NO: 56186 - protein, 10 aa, Artificial Sequence
  Description of Artificial Sequence: Synthetic peptide
  Seed: YFFPVIFSKA (MAGA3_HUMAN)
YLFPVIFSKR

SEQ ID NO: 56187 - protein, 9 aa, Artificial Sequence
  Description of Artificial Sequence: Synthetic peptide
  Seed: GASSLPTTM (MAGA3_HUMAN)
GRSSLPTTL

SEQ ID NO: 56188 - protein, 11 aa, Artificial Sequence
  Description of Artificial Sequence: Synthetic peptide
  Seed: SNQEEEGPSTF (MAGA3_HUMAN)
SHQEEEGPSTL

SEQ ID NO: 56189 - protein, 10 aa, Artificial Sequence
  Description of Artificial Sequence: Synthetic peptide
  Seed: HISYPPLHEW (MAGA3_HUMAN)
HMSYPPLHEF

SEQ ID NO: 56190 - protein, 10 aa, Artificial Sequence
  Description of Artificial Sequence: Synthetic peptide
  Seed: YRQVPGSDPA (MAGA3_HUMAN)
YMQVPGSDPI

SEQ ID NO: 56191 - protein, 11 aa, Artificial Sequence
  Description of Artificial Sequence: Synthetic peptide
  Seed: AQAPATEEQEA (MAGA3_HUMAN)
ALAPATEEQEI

SEQ ID NO: 56192 - protein, 10 aa, Artificial Sequence
  Description of Artificial Sequence: Synthetic peptide
  Seed: SVVGNWQYFF (MAGA3_HUMAN)
SKVGNWQYFY

SEQ ID NO: 56193 - protein, 9 aa, Artificial Sequence
  Description of Artificial Sequence: Synthetic peptide
  Seed: SEFQAALSR (MAGA3_HUMAN)
SQFQAALSF

SEQ ID NO: 56194 - protein, 10 aa, Artificial Sequence
  Description of Artificial Sequence: Synthetic peptide
  Seed: NWQYFFPVIF (MAGA3_HUMAN)
NYQYFFPVIM

SEQ ID NO: 56195 - protein, 9 aa, Artificial Sequence
  Description of Artificial Sequence: Synthetic peptide
  Seed: FVQENYLEY (MAGA3_HUMAN)
FSQENYLEV

SEQ ID NO: 56196 - protein, 8 aa, Artificial Sequence
  Description of Artificial Sequence: Synthetic peptide
  Seed: FPDLESEF (MAGA3_HUMAN)
FGDLESEV

SEQ ID NO: 56197 - protein, 10 aa, Artificial Sequence
  Description of Artificial Sequence: Synthetic peptide
  Seed: YIFATCLGLS (MAGA3_HUMAN)
YLFATCLGLY

SEQ ID NO: 56198 - protein, 9 aa, Artificial Sequence
  Description of Artificial Sequence: Synthetic peptide
  Seed: KASSSLQLV (MAGA3_HUMAN)
KVSSSLQLA

SEQ ID NO: 56199 - protein, 10 aa, Artificial Sequence
  Description of Artificial Sequence: Synthetic peptide
  Seed: FFPVIFSKAS (MAGA3_HUMAN)
FNPVIFSKAV

SEQ ID NO: 56200 - protein, 9 aa, Artificial Sequence
  Description of Artificial Sequence: Synthetic peptide
  Seed: RALVETSYV (MAGA3_HUMAN)
RALVETSYY

SEQ ID NO: 56201 - protein, 10 aa, Artificial Sequence
  Description of Artificial Sequence: Synthetic peptide
  Seed: KISGGPHISY (MAGA3_HUMAN)
KTSGGPHISL

SEQ ID NO: 56202 - protein, 9 aa, Artificial Sequence
  Description of Artificial Sequence: Synthetic peptide
  Seed: SSLPTTMNY (MAGA3_HUMAN)
SKLPTTMNF

SEQ ID NO: 56203 - protein, 9 aa, Artificial Sequence
  Description of Artificial Sequence: Synthetic peptide
  Seed: TFPDLESEF (MAGA3_HUMAN)
TWPDLESEY

SEQ ID NO: 56204 - protein, 10 aa, Artificial Sequence
  Description of Artificial Sequence: Synthetic peptide
  Seed: RGEALGLVGA (MAGA3_HUMAN)
REEALGLVGA

SEQ ID NO: 56205 - protein, 9 aa, Artificial Sequence
  Description of Artificial Sequence: Synthetic peptide
  Seed: ISYPPLHEW (MAGA3_HUMAN)
IRYPPLHEV

SEQ ID NO: 56206 - protein, 9 aa, Artificial Sequence
  Description of Artificial Sequence: Synthetic peptide
  Seed: TSYVKVLHH (MAGA3_HUMAN)
TSYVKVLHF

SEQ ID NO: 56207 - protein, 10 aa, Artificial Sequence
  Description of Artificial Sequence: Synthetic peptide
  Seed: TSYVKVLHHM (MAGA3_HUMAN)
THYVKVLHHL

SEQ ID NO: 56208 - protein, 8 aa, Artificial Sequence
  Description of Artificial Sequence: Synthetic peptide
  Seed: SYPPLHEW (MAGA3_HUMAN)
SYPPLHEI

SEQ ID NO: 56209 - protein, 9 aa, Artificial Sequence
  Description of Artificial Sequence: Synthetic peptide
  Seed: FVQENYLEY (MAGA3_HUMAN)
FHQENYLEY

SEQ ID NO: 56210 - protein, 9 aa, Artificial Sequence
  Description of Artificial Sequence: Synthetic peptide
  Seed: ISGGPHISY (MAGA3_HUMAN)
ITGGPHISL

SEQ ID NO: 56211 - protein, 9 aa, Artificial Sequence
  Description of Artificial Sequence: Synthetic peptide
  Seed: LGDPKKLLT (MAGA3_HUMAN)
LFDPKKLLV

SEQ ID NO: 56212 - protein, 9 aa, Artificial Sequence
  Description of Artificial Sequence: Synthetic peptide
  Seed: LSRKVAELV (MAGA3_HUMAN)
LMRKVAELW

SEQ ID NO: 56213 - protein, 10 aa, Artificial Sequence
  Description of Artificial Sequence: Synthetic peptide
  Seed: SLPTTMNYPL (MAGA3_HUMAN)
SGPTTMNYPM

SEQ ID NO: 56214 - protein, 10 aa, Artificial Sequence
  Description of Artificial Sequence: Synthetic peptide
  Seed: ALVETSYVKV (MAGA3_HUMAN)
AIVETSYVKV

SEQ ID NO: 56215 - protein, 10 aa, Artificial Sequence
  Description of Artificial Sequence: Synthetic peptide
  Seed: RQVPGSDPAC (MAGA3_HUMAN)
RLVPGSDPAV

SEQ ID NO: 56216 - protein, 9 aa, Artificial Sequence
  Description of Artificial Sequence: Synthetic peptide
  Seed: SSLPTTMNY (MAGA3_HUMAN)
SVLPTTMNI

SEQ ID NO: 56217 - protein, 9 aa, Artificial Sequence
  Description of Artificial Sequence: Synthetic peptide
  Seed: ISYPPLHEW (MAGA3_HUMAN)
IFYPPLHEW

SEQ ID NO: 56218 - protein, 9 aa, Artificial Sequence
  Description of Artificial Sequence: Synthetic peptide
  Seed: LESEFQAAL (MAGA3_HUMAN)
LQSEFQAAI

SEQ ID NO: 56219 - protein, 9 aa, Artificial Sequence
  Description of Artificial Sequence: Synthetic peptide
  Seed: EVDPIGHLY (MAGA3_HUMAN)
EADPIGHLV

SEQ ID NO: 56220 - protein, 9 aa, Artificial Sequence
  Description of Artificial Sequence: Synthetic peptide
  Seed: GLLIIVLAI (MAGA3_HUMAN)
GMLIIVLAL

SEQ ID NO: 56221 - protein, 10 aa, Artificial Sequence
  Description of Artificial Sequence: Synthetic peptide
  Seed: GPRALVETSY (MAGA3_HUMAN)
GPRALVETSA

SEQ ID NO: 56222 - protein, 10 aa, Artificial Sequence
  Description of Artificial Sequence: Synthetic peptide
  Seed: FATCLGLSYD (MAGA3_HUMAN)
FATCLGLSYM

SEQ ID NO: 56223 - protein, 9 aa, Artificial Sequence
  Description of Artificial Sequence: Synthetic peptide
  Seed: LQLVFGIEL (MAGA3_HUMAN)
LVLVFGIEY

SEQ ID NO: 56224 - protein, 10 aa, Artificial Sequence
  Description of Artificial Sequence: Synthetic peptide
  Seed: TSYVKVLHHM (MAGA3_HUMAN)
TKYVKVLHHF

SEQ ID NO: 56225 - protein, 9 aa, Artificial Sequence
  Description of Artificial Sequence: Synthetic peptide
  Seed: KIWEELSVL (MAGA3_HUMAN)
KMWEELSVR

SEQ ID NO: 56226 - protein, 10 aa, Artificial Sequence
  Description of Artificial Sequence: Synthetic peptide
  Seed: KASSSLQLVF (MAGA3_HUMAN)
KQSSSLQLVF

SEQ ID NO: 56227 - protein, 10 aa, Artificial Sequence
  Description of Artificial Sequence: Synthetic peptide
  Seed: FLWGPRALVE (MAGA3_HUMAN)
FLWGPRALVC

SEQ ID NO: 56228 - protein, 9 aa, Artificial Sequence
  Description of Artificial Sequence: Synthetic peptide
  Seed: SYPPLHEWV (MAGA3_HUMAN)
SLPPLHEWF

SEQ ID NO: 56229 - protein, 9 aa, Artificial Sequence
  Description of Artificial Sequence: Synthetic peptide
  Seed: ISGGPHISY (MAGA3_HUMAN)
IKGGPHISY

SEQ ID NO: 56230 - protein, 10 aa, Artificial Sequence
  Description of Artificial Sequence: Synthetic peptide
  Seed: VIFSKASSSL (MAGA3_HUMAN)
VTFSKASSSV

SEQ ID NO: 56231 - protein, 9 aa, Artificial Sequence
  Description of Artificial Sequence: Synthetic peptide
  Seed: KIWEELSVL (MAGA3_HUMAN)
KVWEELSVY

SEQ ID NO: 56232 - protein, 9 aa, Artificial Sequence
  Description of Artificial Sequence: Synthetic peptide
  Seed: SSLQLVFGI (MAGA3_HUMAN)
SMLQLVFGV

SEQ ID NO: 56233 - protein, 10 aa, Artificial Sequence
  Description of Artificial Sequence: Synthetic peptide
  Seed: AELVHFLLLK (MAGA3_HUMAN)
AFLVHFLLLR

SEQ ID NO: 56234 - protein, 9 aa, Artificial Sequence
  Description of Artificial Sequence: Synthetic peptide
  Seed: RQVPGSDPA (MAGA3_HUMAN)
REVPGSDPM

SEQ ID NO: 56235 - protein, 11 aa, Artificial Sequence
  Description of Artificial Sequence: Synthetic peptide
  Seed: KVAELVHFLLL (MAGA3_HUMAN)
KLAELVHFLLF

SEQ ID NO: 56236 - protein, 9 aa, Artificial Sequence
  Description of Artificial Sequence: Synthetic peptide
  Seed: GNWQYFFPV (MAGA3_HUMAN)
GLWQYFFPS

SEQ ID NO: 56237 - protein, 11 aa, Artificial Sequence
  Description of Artificial Sequence: Synthetic peptide
  Seed: GASSLPTTMNY (MAGA3_HUMAN)
GGSSLPTTMNW

SEQ ID NO: 56238 - protein, 9 aa, Artificial Sequence
  Description of Artificial Sequence: Synthetic peptide
  Seed: KVAELVHFL (MAGA3_HUMAN)
KFAELVHFW

SEQ ID NO: 56239 - protein, 9 aa, Artificial Sequence
  Description of Artificial Sequence: Synthetic peptide
  Seed: AEMLGSVVG (MAGA3_HUMAN)
AEMLGSVVS

SEQ ID NO: 56240 - protein, 10 aa, Artificial Sequence
  Description of Artificial Sequence: Synthetic peptide
  Seed: LGLVGAQAPA (MAGA3_HUMAN)
LNLVGAQAPV

SEQ ID NO: 56241 - protein, 9 aa, Artificial Sequence
  Description of Artificial Sequence: Synthetic peptide
  Seed: RKVAELVHF (MAGA3_HUMAN)
RAVAELVHF

SEQ ID NO: 56242 - protein, 9 aa, Artificial Sequence
  Description of Artificial Sequence: Synthetic peptide
  Seed: SSTLVEVTL (MAGA3_HUMAN)
SQTLVEVTW

SEQ ID NO: 56243 - protein, 9 aa, Artificial Sequence
  Description of Artificial Sequence: Synthetic peptide
  Seed: YIFATCLGL (MAGA3_HUMAN)
YQFATCLGL

SEQ ID NO: 56244 - protein, 9 aa, Artificial Sequence
  Description of Artificial Sequence: Synthetic peptide
  Seed: LVHFLLLKY (MAGA3_HUMAN)
LSHFLLLKY

SEQ ID NO: 56245 - protein, 9 aa, Artificial Sequence
  Description of Artificial Sequence: Synthetic peptide
  Seed: SVVGNWQYF (MAGA3_HUMAN)
SKVGNWQYF

SEQ ID NO: 56246 - protein, 11 aa, Artificial Sequence
  Description of Artificial Sequence: Synthetic peptide
  Seed: RQVPGSDPACY (MAGA3_HUMAN)
RAVPGSDPACF

SEQ ID NO: 56247 - protein, 9 aa, Artificial Sequence
  Description of Artificial Sequence: Synthetic peptide
  Seed: SYVKVLHHM (MAGA3_HUMAN)
STVKVLHHM

SEQ ID NO: 56248 - protein, 9 aa, Artificial Sequence
  Description of Artificial Sequence: Synthetic peptide
  Seed: IFSKASSSL (MAGA3_HUMAN)
IVSKASSSY

SEQ ID NO: 56249 - protein, 9 aa, Artificial Sequence
  Description of Artificial Sequence: Synthetic peptide
  Seed: AQAPATEEQ (MAGA3_HUMAN)
AFAPATEEY

SEQ ID NO: 56250 - protein, 10 aa, Artificial Sequence
  Description of Artificial Sequence: Synthetic peptide
  Seed: LVFGIELMEV (MAGA3_HUMAN)
LVFGIELMEL

SEQ ID NO: 56251 - protein, 10 aa, Artificial Sequence
  Description of Artificial Sequence: Synthetic peptide
  Seed: ISYPPLHEWV (MAGA3_HUMAN)
IWYPPLHEWF

SEQ ID NO: 56252 - protein, 10 aa, Artificial Sequence
  Description of Artificial Sequence: Synthetic peptide
  Seed: WEELSVLEVF (MAGA3_HUMAN)
WVELSVLEVM

SEQ ID NO: 56253 - protein, 8 aa, Artificial Sequence
  Description of Artificial Sequence: Synthetic peptide
  Seed: FPDLESEF (MAGA3_HUMAN)
FADLESEM

SEQ ID NO: 56254 - protein, 9 aa, Artificial Sequence
  Description of Artificial Sequence: Synthetic peptide
  Seed: KASSSLQLV (MAGA3_HUMAN)
KLSSSLQLA

SEQ ID NO: 56255 - protein, 8 aa, Artificial Sequence
  Description of Artificial Sequence: Synthetic peptide
  Seed: ATCLGLSY (MAGA3_HUMAN)
AQCLGLSY

SEQ ID NO: 56256 - protein, 9 aa, Artificial Sequence
  Description of Artificial Sequence: Synthetic peptide
  Seed: TSYVKVLHH (MAGA3_HUMAN)
TAYVKVLHV

SEQ ID NO: 56257 - protein, 11 aa, Artificial Sequence
  Description of Artificial Sequence: Synthetic peptide
  Seed: QHCKPEEGLEA (MAGA3_HUMAN)
QHCKPEEGLEF

SEQ ID NO: 56258 - protein, 9 aa, Artificial Sequence
  Description of Artificial Sequence: Synthetic peptide
  Seed: LVHFLLLKY (MAGA3_HUMAN)
LSHFLLLKF

SEQ ID NO: 56259 - protein, 10 aa, Artificial Sequence
  Description of Artificial Sequence: Synthetic peptide
  Seed: KAEMLGSVVG (MAGA3_HUMAN)
KQEMLGSVVV

SEQ ID NO: 56260 - protein, 9 aa, Artificial Sequence
  Description of Artificial Sequence: Synthetic peptide
  Seed: FVQENYLEY (MAGA3_HUMAN)
FFQENYLEI

SEQ ID NO: 56261 - protein, 8 aa, Artificial Sequence
  Description of Artificial Sequence: Synthetic peptide
  Seed: SGGPHISY (MAGA3_HUMAN)
STGPHISV

SEQ ID NO: 56262 - protein, 9 aa, Artificial Sequence
  Description of Artificial Sequence: Synthetic peptide
  Seed: WQYFFPVIF (MAGA3_HUMAN)
WQYFFPVIW

SEQ ID NO: 56263 - protein, 9 aa, Artificial Sequence
  Description of Artificial Sequence: Synthetic peptide
  Seed: RALVETSYV (MAGA3_HUMAN)
RSLVETSYW

SEQ ID NO: 56264 - protein, 9 aa, Artificial Sequence
  Description of Artificial Sequence: Synthetic peptide
  Seed: FQAALSRKV (MAGA3_HUMAN)
FVAALSRKL

SEQ ID NO: 56265 - protein, 9 aa, Artificial Sequence
  Description of Artificial Sequence: Synthetic peptide
  Seed: SVLEVFEGR (MAGA3_HUMAN)
SGLEVFEGR

SEQ ID NO: 56266 - protein, 9 aa, Artificial Sequence
  Description of Artificial Sequence: Synthetic peptide
  Seed: HEWVLREGE (MAGA3_HUMAN)
HEWVLREGI

SEQ ID NO: 56267 - protein, 9 aa, Artificial Sequence
  Description of Artificial Sequence: Synthetic peptide
  Seed: LSRKVAELV (MAGA3_HUMAN)
LCRKVAELW

SEQ ID NO: 56268 - protein, 10 aa, Artificial Sequence
  Description of Artificial Sequence: Synthetic peptide
  Seed: IFATCLGLSY (MAGA3_HUMAN)
IVATCLGLSF

SEQ ID NO: 56269 - protein, 9 aa, Artificial Sequence
  Description of Artificial Sequence: Synthetic peptide
  Seed: YFFPVIFSK (MAGA3_HUMAN)
YTFPVIFSL

SEQ ID NO: 56270 - protein, 10 aa, Artificial Sequence
  Description of Artificial Sequence: Synthetic peptide
  Seed: LGSVVGNWQY (MAGA3_HUMAN)
LESVVGNWQW

SEQ ID NO: 56271 - protein, 9 aa, Artificial Sequence
  Description of Artificial Sequence: Synthetic peptide
  Seed: YIFATCLGL (MAGA3_HUMAN)
YQFATCLGM

SEQ ID NO: 56272 - protein, 8 aa, Artificial Sequence
  Description of Artificial Sequence: Synthetic peptide
  Seed: AEMLGSVV (MAGA3_HUMAN)
AEMLGSVF

SEQ ID NO: 56273 - protein, 8 aa, Artificial Sequence
  Description of Artificial Sequence: Synthetic peptide
  Seed: SGGPHISY (MAGA3_HUMAN)
SRGPHISL

SEQ ID NO: 56274 - protein, 9 aa, Artificial Sequence
  Description of Artificial Sequence: Synthetic peptide
  Seed: WQYFFPVIF (MAGA3_HUMAN)
WNYFFPVIY

SEQ ID NO: 56275 - protein, 11 aa, Artificial Sequence
  Description of Artificial Sequence: Synthetic peptide
  Seed: MEVDPIGHLYI (MAGA3_HUMAN)
MQVDPIGHLYL

SEQ ID NO: 56276 - protein, 9 aa, Artificial Sequence
  Description of Artificial Sequence: Synthetic peptide
  Seed: LPTTMNYPL (MAGA3_HUMAN)
LTTTMNYPY

SEQ ID NO: 56277 - protein, 9 aa, Artificial Sequence
  Description of Artificial Sequence: Synthetic peptide
  Seed: KAGLLIIVL (MAGA3_HUMAN)
KAGLLIIVW

SEQ ID NO: 56278 - protein, 10 aa, Artificial Sequence
  Description of Artificial Sequence: Synthetic peptide
  Seed: FFPVIFSKAS (MAGA3_HUMAN)
FIPVIFSKAV

SEQ ID NO: 56279 - protein, 11 aa, Artificial Sequence
  Description of Artificial Sequence: Synthetic peptide
  Seed: SKASSSLQLVF (MAGA3_HUMAN)
SDASSSLQLVW

SEQ ID NO: 56280 - protein, 10 aa, Artificial Sequence
  Description of Artificial Sequence: Synthetic peptide
  Seed: LMEVDPIGHL (MAGA3_HUMAN)
LMEVDPIGHV

SEQ ID NO: 56281 - protein, 10 aa, Artificial Sequence
  Description of Artificial Sequence: Synthetic peptide
  Seed: EMLGSVVGNW (MAGA3_HUMAN)
EALGSVVGNF

SEQ ID NO: 56282 - protein, 9 aa, Artificial Sequence
  Description of Artificial Sequence: Synthetic peptide
  Seed: SEFQAALSR (MAGA3_HUMAN)
SVFQAALSR

SEQ ID NO: 56283 - protein, 9 aa, Artificial Sequence
  Description of Artificial Sequence: Synthetic peptide
  Seed: SSTLVEVTL (MAGA3_HUMAN)
SATLVEVTY

SEQ ID NO: 56284 - protein, 11 aa, Artificial Sequence
  Description of Artificial Sequence: Synthetic peptide
  Seed: SRKVAELVHFL (MAGA3_HUMAN)
SVKVAELVHFV

SEQ ID NO: 56285 - protein, 11 aa, Artificial Sequence
  Description of Artificial Sequence: Synthetic peptide
  Seed: KVAELVHFLLL (MAGA3_HUMAN)
KIAELVHFLLV

SEQ ID NO: 56286 - protein, 10 aa, Artificial Sequence
  Description of Artificial Sequence: Synthetic peptide
  Seed: AELVHFLLLK (MAGA3_HUMAN)
APLVHFLLLK

SEQ ID NO: 56287 - protein, 8 aa, Artificial Sequence
  Description of Artificial Sequence: Synthetic peptide
  Seed: HEWVLREG (MAGA3_HUMAN)
HEWVLREV

SEQ ID NO: 56288 - protein, 9 aa, Artificial Sequence
  Description of Artificial Sequence: Synthetic peptide
  Seed: MEVDPIGHL (MAGA3_HUMAN)
MQVDPIGHL

SEQ ID NO: 56289 - protein, 9 aa, Artificial Sequence
  Description of Artificial Sequence: Synthetic peptide
  Seed: WQYFFPVIF (MAGA3_HUMAN)
WLYFFPVIF

SEQ ID NO: 56290 - protein, 11 aa, Artificial Sequence
  Description of Artificial Sequence: Synthetic peptide
  Seed: YIFATCLGLSY (MAGA3_HUMAN)
YPFATCLGLSY

SEQ ID NO: 56291 - protein, 10 aa, Artificial Sequence
  Description of Artificial Sequence: Synthetic peptide
  Seed: FLWGPRALVE (MAGA3_HUMAN)
FIWGPRALVV

SEQ ID NO: 56292 - protein, 9 aa, Artificial Sequence
  Description of Artificial Sequence: Synthetic peptide
  Seed: EARGEALGL (MAGA3_HUMAN)
EVRGEALGY

SEQ ID NO: 56293 - protein, 10 aa, Artificial Sequence
  Description of Artificial Sequence: Synthetic peptide
  Seed: KASSSLQLVF (MAGA3_HUMAN)
KGSSSLQLVY

SEQ ID NO: 56294 - protein, 9 aa, Artificial Sequence
  Description of Artificial Sequence: Synthetic peptide
  Seed: LGDPKKLLT (MAGA3_HUMAN)
LTDPKKLLF

SEQ ID NO: 56295 - protein, 9 aa, Artificial Sequence
  Description of Artificial Sequence: Synthetic peptide
  Seed: TSYVKVLHH (MAGA3_HUMAN)
TIYVKVLHK

SEQ ID NO: 56296 - protein, 9 aa, Artificial Sequence
  Description of Artificial Sequence: Synthetic peptide
  Seed: GNWQYFFPV (MAGA3_HUMAN)
GTWQYFFPA

SEQ ID NO: 56297 - protein, 10 aa, Artificial Sequence
  Description of Artificial Sequence: Synthetic peptide
  Seed: REGDCAPEEK (MAGA3_HUMAN)
REGDCAPEEW

SEQ ID NO: 56298 - protein, 10 aa, Artificial Sequence
  Description of Artificial Sequence: Synthetic peptide
  Seed: IFATCLGLSY (MAGA3_HUMAN)
IMATCLGLSM

SEQ ID NO: 56299 - protein, 10 aa, Artificial Sequence
  Description of Artificial Sequence: Synthetic peptide
  Seed: ESPDPPQSPQ (MAGA3_HUMAN)
ELPDPPQSPK

SEQ ID NO: 56300 - protein, 10 aa, Artificial Sequence
  Description of Artificial Sequence: Synthetic peptide
  Seed: YFFPVIFSKA (MAGA3_HUMAN)
YVFPVIFSKR

SEQ ID NO: 56301 - protein, 10 aa, Artificial Sequence
  Description of Artificial Sequence: Synthetic peptide
  Seed: ASSLPTTMNY (MAGA3_HUMAN)
AQSLPTTMNM

SEQ ID NO: 56302 - protein, 10 aa, Artificial Sequence
  Description of Artificial Sequence: Synthetic peptide
  Seed: QIMPKAGLLI (MAGA3_HUMAN)
QLMPKAGLLV

SEQ ID NO: 56303 - protein, 9 aa, Artificial Sequence
  Description of Artificial Sequence: Synthetic peptide
  Seed: HLYIFATCL (MAGA3_HUMAN)
HEYIFATCM

SEQ ID NO: 56304 - protein, 8 aa, Artificial Sequence
  Description of Artificial Sequence: Synthetic peptide
  Seed: FPDLESEF (MAGA3_HUMAN)
FSDLESEV

SEQ ID NO: 56305 - protein, 9 aa, Artificial Sequence
  Description of Artificial Sequence: Synthetic peptide
  Seed: LPTTMNYPL (MAGA3_HUMAN)
LMTTMNYPY

SEQ ID NO: 56306 - protein, 10 aa, Artificial Sequence
  Description of Artificial Sequence: Synthetic peptide
  Seed: LPTTMNYPLW (MAGA3_HUMAN)
LWTTMNYPLW

SEQ ID NO: 56307 - protein, 9 aa, Artificial Sequence
  Description of Artificial Sequence: Synthetic peptide
  Seed: FVQENYLEY (MAGA3_HUMAN)
FNQENYLEV

SEQ ID NO: 56308 - protein, 10 aa, Artificial Sequence
  Description of Artificial Sequence: Synthetic peptide
  Seed: HISYPPLHEW (MAGA3_HUMAN)
HISYPPLHEY

SEQ ID NO: 56309 - protein, 9 aa, Artificial Sequence
  Description of Artificial Sequence: Synthetic peptide
  Seed: WQYFFPVIF (MAGA3_HUMAN)
WEYFFPVIV

SEQ ID NO: 56310 - protein, 9 aa, Artificial Sequence
  Description of Artificial Sequence: Synthetic peptide
  Seed: TFPDLESEF (MAGA3_HUMAN)
TVPDLESEI

SEQ ID NO: 56311 - protein, 9 aa, Artificial Sequence
  Description of Artificial Sequence: Synthetic peptide
  Seed: ISYPPLHEW (MAGA3_HUMAN)
IWYPPLHEF

SEQ ID NO: 56312 - protein, 10 aa, Artificial Sequence
  Description of Artificial Sequence: Synthetic peptide
  Seed: ASSLPTTMNY (MAGA3_HUMAN)
ALSLPTTMNF

SEQ ID NO: 56313 - protein, 9 aa, Artificial Sequence
  Description of Artificial Sequence: Synthetic peptide
  Seed: FVQENYLEY (MAGA3_HUMAN)
FFQENYLEV

SEQ ID NO: 56314 - protein, 11 aa, Artificial Sequence
  Description of Artificial Sequence: Synthetic peptide
  Seed: LGSVVGNWQYF (MAGA3_HUMAN)
LGSVVGNWQYW

SEQ ID NO: 56315 - protein, 9 aa, Artificial Sequence
  Description of Artificial Sequence: Synthetic peptide
  Seed: LVHFLLLKY (MAGA3_HUMAN)
LKHFLLLKY

SEQ ID NO: 56316 - protein, 9 aa, Artificial Sequence
  Description of Artificial Sequence: Synthetic peptide
  Seed: IMPKAGLLI (MAGA3_HUMAN)
ILPKAGLLI

SEQ ID NO: 56317 - protein, 10 aa, Artificial Sequence
  Description of Artificial Sequence: Synthetic peptide
  Seed: ELMEVDPIGH (MAGA3_HUMAN)
ETMEVDPIGR

SEQ ID NO: 56318 - protein, 9 aa, Artificial Sequence
  Description of Artificial Sequence: Synthetic peptide
  Seed: SILGDPKKL (MAGA3_HUMAN)
SRLGDPKKY

SEQ ID NO: 56319 - protein, 9 aa, Artificial Sequence
  Description of Artificial Sequence: Synthetic peptide
  Seed: HLYIFATCL (MAGA3_HUMAN)
HFYIFATCF

SEQ ID NO: 56320 - protein, 9 aa, Artificial Sequence
  Description of Artificial Sequence: Synthetic peptide
  Seed: YIFATCLGL (MAGA3_HUMAN)
YQFATCLGA

SEQ ID NO: 56321 - protein, 9 aa, Artificial Sequence
  Description of Artificial Sequence: Synthetic peptide
  Seed: GNWQYFFPV (MAGA3_HUMAN)
GQWQYFFPS

SEQ ID NO: 56322 - protein, 10 aa, Artificial Sequence
  Description of Artificial Sequence: Synthetic peptide
  Seed: KVAELVHFLL (MAGA3_HUMAN)
KTAELVHFLY

SEQ ID NO: 56323 - protein, 11 aa, Artificial Sequence
  Description of Artificial Sequence: Synthetic peptide
  Seed: SSSSTLVEVTL (MAGA3_HUMAN)
SSSSTLVEVTW

SEQ ID NO: 56324 - protein, 10 aa, Artificial Sequence
  Description of Artificial Sequence: Synthetic peptide
  Seed: MPKAGLLIIV (MAGA3_HUMAN)
MVKAGLLIIV

SEQ ID NO: 56325 - protein, 11 aa, Artificial Sequence
  Description of Artificial Sequence: Synthetic peptide
  Seed: AQAPATEEQEA (MAGA3_HUMAN)
AEAPATEEQEA

SEQ ID NO: 56326 - protein, 10 aa, Artificial Sequence
  Description of Artificial Sequence: Synthetic peptide
  Seed: TSYVKVLHHM (MAGA3_HUMAN)
TDYVKVLHHL

SEQ ID NO: 56327 - protein, 11 aa, Artificial Sequence
  Description of Artificial Sequence: Synthetic peptide
  Seed: KVAELVHFLLL (MAGA3_HUMAN)
KMAELVHFLLT

SEQ ID NO: 56328 - protein, 9 aa, Artificial Sequence
  Description of Artificial Sequence: Synthetic peptide
  Seed: AELVHFLLL (MAGA3_HUMAN)
AQLVHFLLV

SEQ ID NO: 56329 - protein, 10 aa, Artificial Sequence
  Description of Artificial Sequence: Synthetic peptide
  Seed: FATCLGLSYD (MAGA3_HUMAN)
FATCLGLSYF

SEQ ID NO: 56330 - protein, 9 aa, Artificial Sequence
  Description of Artificial Sequence: Synthetic peptide
  Seed: RQVPGSDPA (MAGA3_HUMAN)
RAVPGSDPF

SEQ ID NO: 56331 - protein, 10 aa, Artificial Sequence
  Description of Artificial Sequence: Synthetic peptide
  Seed: HFVQENYLEY (MAGA3_HUMAN)
HYVQENYLEM

SEQ ID NO: 56332 - protein, 9 aa, Artificial Sequence
  Description of Artificial Sequence: Synthetic peptide
  Seed: YIFATCLGL (MAGA3_HUMAN)
YVFATCLGL

SEQ ID NO: 56333 - protein, 10 aa, Artificial Sequence
  Description of Artificial Sequence: Synthetic peptide
  Seed: RKVAELVHFL (MAGA3_HUMAN)
RHVAELVHFI

SEQ ID NO: 56334 - protein, 9 aa, Artificial Sequence
  Description of Artificial Sequence: Synthetic peptide
  Seed: ASSSLQLVF (MAGA3_HUMAN)
AKSSLQLVM

SEQ ID NO: 56335 - protein, 9 aa, Artificial Sequence
  Description of Artificial Sequence: Synthetic peptide
  Seed: RQVPGSDPA (MAGA3_HUMAN)
RIVPGSDPY

SEQ ID NO: 56336 - protein, 9 aa, Artificial Sequence
  Description of Artificial Sequence: Synthetic peptide
  Seed: RQVPGSDPA (MAGA3_HUMAN)
RVVPGSDPF

SEQ ID NO: 56337 - protein, 9 aa, Artificial Sequence
  Description of Artificial Sequence: Synthetic peptide
  Seed: KIWEELSVL (MAGA3_HUMAN)
KVWEELSVL

SEQ ID NO: 56338 - protein, 10 aa, Artificial Sequence
  Description of Artificial Sequence: Synthetic peptide
  Seed: SDPACYEFLW (MAGA3_HUMAN)
SFPACYEFLF

SEQ ID NO: 56339 - protein, 9 aa, Artificial Sequence
  Description of Artificial Sequence: Synthetic peptide
  Seed: VTLGEVPAA (MAGA3_HUMAN)
VTLGEVPAM

SEQ ID NO: 56340 - protein, 10 aa, Artificial Sequence
  Description of Artificial Sequence: Synthetic peptide
  Seed: MEVDPIGHLY (MAGA3_HUMAN)
MTVDPIGHLL

SEQ ID NO: 56341 - protein, 10 aa, Artificial Sequence
  Description of Artificial Sequence: Synthetic peptide
  Seed: KVAELVHFLL (MAGA3_HUMAN)
KSAELVHFLF

SEQ ID NO: 56342 - protein, 10 aa, Artificial Sequence
  Description of Artificial Sequence: Synthetic peptide
  Seed: FFPVIFSKAS (MAGA3_HUMAN)
FHPVIFSKAA

SEQ ID NO: 56343 - protein, 9 aa, Artificial Sequence
  Description of Artificial Sequence: Synthetic peptide
  Seed: EFQAALSRK (MAGA3_HUMAN)
EMQAALSRR

SEQ ID NO: 56344 - protein, 9 aa, Artificial Sequence
  Description of Artificial Sequence: Synthetic peptide
  Seed: EAASSSSTL (MAGA3_HUMAN)
ETASSSSTI

SEQ ID NO: 56345 - protein, 10 aa, Artificial Sequence
  Description of Artificial Sequence: Synthetic peptide
  Seed: SSSTLVEVTL (MAGA3_HUMAN)
STSTLVEVTF

SEQ ID NO: 56346 - protein, 9 aa, Artificial Sequence
  Description of Artificial Sequence: Synthetic peptide
  Seed: FATCLGLSY (MAGA3_HUMAN)
FSTCLGLSV

SEQ ID NO: 56347 - protein, 9 aa, Artificial Sequence
  Description of Artificial Sequence: Synthetic peptide
  Seed: VVGNWQYFF (MAGA3_HUMAN)
VFGNWQYFY

SEQ ID NO: 56348 - protein, 10 aa, Artificial Sequence
  Description of Artificial Sequence: Synthetic peptide
  Seed: HISYPPLHEW (MAGA3_HUMAN)
HFSYPPLHEM

SEQ ID NO: 56349 - protein, 9 aa, Artificial Sequence
  Description of Artificial Sequence: Synthetic peptide
  Seed: QSPQGASSL (MAGA3_HUMAN)
QVPQGASSM

SEQ ID NO: 56350 - protein, 9 aa, Artificial Sequence
  Description of Artificial Sequence: Synthetic peptide
  Seed: VEVTLGEVP (MAGA3_HUMAN)
VEVTLGEVV

SEQ ID NO: 56351 - protein, 10 aa, Artificial Sequence
  Description of Artificial Sequence: Synthetic peptide
  Seed: YFFPVIFSKA (MAGA3_HUMAN)
YTFPVIFSKL

SEQ ID NO: 56352 - protein, 9 aa, Artificial Sequence
  Description of Artificial Sequence: Synthetic peptide
  Seed: QEEEGPSTF (MAGA3_HUMAN)
QEEEGPSTL

SEQ ID NO: 56353 - protein, 10 aa, Artificial Sequence
  Description of Artificial Sequence: Synthetic peptide
  Seed: TSYVKVLHHM (MAGA3_HUMAN)
TPYVKVLHHW

SEQ ID NO: 56354 - protein, 9 aa, Artificial Sequence
  Description of Artificial Sequence: Synthetic peptide
  Seed: VVGNWQYFF (MAGA3_HUMAN)
VWGNWQYFF

SEQ ID NO: 56355 - protein, 10 aa, Artificial Sequence
  Description of Artificial Sequence: Synthetic peptide
  Seed: MEVDPIGHLY (MAGA3_HUMAN)
MEVDPIGHLF

SEQ ID NO: 56356 - protein, 10 aa, Artificial Sequence
  Description of Artificial Sequence: Synthetic peptide
  Seed: RALVETSYVK (MAGA3_HUMAN)
RILVETSYVK

SEQ ID NO: 56357 - protein, 9 aa, Artificial Sequence
  Description of Artificial Sequence: Synthetic peptide
  Seed: SSLPTTMNY (MAGA3_HUMAN)
SLLPTTMNI

SEQ ID NO: 56358 - protein, 9 aa, Artificial Sequence
  Description of Artificial Sequence: Synthetic peptide
  Seed: LVHFLLLKY (MAGA3_HUMAN)
LQHFLLLKM

SEQ ID NO: 56359 - protein, 9 aa, Artificial Sequence
  Description of Artificial Sequence: Synthetic peptide
  Seed: YIFATCLGL (MAGA3_HUMAN)
YVFATCLGF

SEQ ID NO: 56360 - protein, 9 aa, Artificial Sequence
  Description of Artificial Sequence: Synthetic peptide
  Seed: ILGDPKKLL (MAGA3_HUMAN)
IMGDPKKLY

SEQ ID NO: 56361 - protein, 9 aa, Artificial Sequence
  Description of Artificial Sequence: Synthetic peptide
  Seed: ALSRKVAEL (MAGA3_HUMAN)
ARSRKVAEM

SEQ ID NO: 56362 - protein, 9 aa, Artificial Sequence
  Description of Artificial Sequence: Synthetic peptide
  Seed: EFQAALSRK (MAGA3_HUMAN)
EIQAALSRK

SEQ ID NO: 56363 - protein, 11 aa, Artificial Sequence
  Description of Artificial Sequence: Synthetic peptide
  Seed: KVAELVHFLLL (MAGA3_HUMAN)
KLAELVHFLLH

SEQ ID NO: 56364 - protein, 9 aa, Artificial Sequence
  Description of Artificial Sequence: Synthetic peptide
  Seed: SSLPTTMNY (MAGA3_HUMAN)
SVLPTTMNR

SEQ ID NO: 56365 - protein, 8 aa, Artificial Sequence
  Description of Artificial Sequence: Synthetic peptide
  Seed: LGDPKKLL (MAGA3_HUMAN)
LYDPKKLF

SEQ ID NO: 56366 - protein, 10 aa, Artificial Sequence
  Description of Artificial Sequence: Synthetic peptide
  Seed: MPLEQRSQHC (MAGA3_HUMAN)
MPLEQRSQHA

SEQ ID NO: 56367 - protein, 9 aa, Artificial Sequence
  Description of Artificial Sequence: Synthetic peptide
  Seed: HLYIFATCL (MAGA3_HUMAN)
HKYIFATCL

SEQ ID NO: 56368 - protein, 9 aa, Artificial Sequence
  Description of Artificial Sequence: Synthetic peptide
  Seed: YFFPVIFSK (MAGA3_HUMAN)
YFFPVIFSF

SEQ ID NO: 56369 - protein, 9 aa, Artificial Sequence
  Description of Artificial Sequence: Synthetic peptide
  Seed: RKVAELVHF (MAGA3_HUMAN)
RTVAELVHY

SEQ ID NO: 56370 - protein, 9 aa, Artificial Sequence
  Description of Artificial Sequence: Synthetic peptide
  Seed: ISGGPHISY (MAGA3_HUMAN)
IGGGPHISM

SEQ ID NO: 56371 - protein, 11 aa, Artificial Sequence
  Description of Artificial Sequence: Synthetic peptide
  Seed: SSSSTLVEVTL (MAGA3_HUMAN)
SCSSTLVEVTW

SEQ ID NO: 56372 - protein, 9 aa, Artificial Sequence
  Description of Artificial Sequence: Synthetic peptide
  Seed: YPPLHEWVL (MAGA3_HUMAN)
YAPLHEWVV

SEQ ID NO: 56373 - protein, 9 aa, Artificial Sequence
  Description of Artificial Sequence: Synthetic peptide
  Seed: KIWEELSVL (MAGA3_HUMAN)
KAWEELSVI

SEQ ID NO: 56374 - protein, 9 aa, Artificial Sequence
  Description of Artificial Sequence: Synthetic peptide
  Seed: SSSSTLVEV (MAGA3_HUMAN)
SISSTLVEI

SEQ ID NO: 56375 - protein, 9 aa, Artificial Sequence
  Description of Artificial Sequence: Synthetic peptide
  Seed: EAASSSSTL (MAGA3_HUMAN)
EVASSSSTF

SEQ ID NO: 56376 - protein, 9 aa, Artificial Sequence
  Description of Artificial Sequence: Synthetic peptide
  Seed: HLYIFATCL (MAGA3_HUMAN)
HLYIFATCY

SEQ ID NO: 56377 - protein, 11 aa, Artificial Sequence
  Description of Artificial Sequence: Synthetic peptide
  Seed: SNQEEEGPSTF (MAGA3_HUMAN)
SQQEEEGPSTW

SEQ ID NO: 56378 - protein, 9 aa, Artificial Sequence
  Description of Artificial Sequence: Synthetic peptide
  Seed: QIMPKAGLL (MAGA3_HUMAN)
QLMPKAGLF

SEQ ID NO: 56379 - protein, 10 aa, Artificial Sequence
  Description of Artificial Sequence: Synthetic peptide
  Seed: RQVPGSDPAC (MAGA3_HUMAN)
RQVPGSDPAF

SEQ ID NO: 56380 - protein, 9 aa, Artificial Sequence
  Description of Artificial Sequence: Synthetic peptide
  Seed: YPLWSQSYE (MAGA3_HUMAN)
YVLWSQSYY

SEQ ID NO: 56381 - protein, 11 aa, Artificial Sequence
  Description of Artificial Sequence: Synthetic peptide
  Seed: SSLPTTMNYPL (MAGA3_HUMAN)
SPLPTTMNYPF

SEQ ID NO: 56382 - protein, 9 aa, Artificial Sequence
  Description of Artificial Sequence: Synthetic peptide
  Seed: EELSVLEVF (MAGA3_HUMAN)
EELSVLEVM

SEQ ID NO: 56383 - protein, 9 aa, Artificial Sequence
  Description of Artificial Sequence: Synthetic peptide
  Seed: SEFQAALSR (MAGA3_HUMAN)
SSFQAALSK

SEQ ID NO: 56384 - protein, 10 aa, Artificial Sequence
  Description of Artificial Sequence: Synthetic peptide
  Seed: ASSLPTTMNY (MAGA3_HUMAN)
ARSLPTTMNY

SEQ ID NO: 56385 - protein, 9 aa, Artificial Sequence
  Description of Artificial Sequence: Synthetic peptide
  Seed: FVQENYLEY (MAGA3_HUMAN)
FMQENYLEK

SEQ ID NO: 56386 - protein, 10 aa, Artificial Sequence
  Description of Artificial Sequence: Synthetic peptide
  Seed: FPVIFSKASS (MAGA3_HUMAN)
FPVIFSKASA

SEQ ID NO: 56387 - protein, 11 aa, Artificial Sequence
  Description of Artificial Sequence: Synthetic peptide
  Seed: AESPDPPQSPQ (MAGA3_HUMAN)
AESPDPPQSPA

SEQ ID NO: 56388 - protein, 10 aa, Artificial Sequence
  Description of Artificial Sequence: Synthetic peptide
  Seed: QYFFPVIFSK (MAGA3_HUMAN)
QWFFPVIFSK

SEQ ID NO: 56389 - protein, 10 aa, Artificial Sequence
  Description of Artificial Sequence: Synthetic peptide
  Seed: LQLVFGIELM (MAGA3_HUMAN)
LNLVFGIELV

SEQ ID NO: 56390 - protein, 11 aa, Artificial Sequence
  Description of Artificial Sequence: Synthetic peptide
  Seed: GASSLPTTMNY (MAGA3_HUMAN)
GTSSLPTTMNW

SEQ ID NO: 56391 - protein, 9 aa, Artificial Sequence
  Description of Artificial Sequence: Synthetic peptide
  Seed: KVLHHMVKI (MAGA3_HUMAN)
KTLHHMVKI

SEQ ID NO: 56392 - protein, 10 aa, Artificial Sequence
  Description of Artificial Sequence: Synthetic peptide
  Seed: LPTTMNYPLW (MAGA3_HUMAN)
LATTMNYPLW

SEQ ID NO: 56393 - protein, 9 aa, Artificial Sequence
  Description of Artificial Sequence: Synthetic peptide
  Seed: LVHFLLLKY (MAGA3_HUMAN)
LFHFLLLKY

SEQ ID NO: 56394 - protein, 9 aa, Artificial Sequence
  Description of Artificial Sequence: Synthetic peptide
  Seed: LGDPKKLLT (MAGA3_HUMAN)
LCDPKKLLM

SEQ ID NO: 56395 - protein, 9 aa, Artificial Sequence
  Description of Artificial Sequence: Synthetic peptide
  Seed: FPVIFSKAS (MAGA3_HUMAN)
FAVIFSKAF

SEQ ID NO: 56396 - protein, 9 aa, Artificial Sequence
  Description of Artificial Sequence: Synthetic peptide
  Seed: GNWQYFFPV (MAGA3_HUMAN)
GAWQYFFPI

SEQ ID NO: 56397 - protein, 11 aa, Artificial Sequence
  Description of Artificial Sequence: Synthetic peptide
  Seed: SKASSSLQLVF (MAGA3_HUMAN)
SYASSSLQLVW

SEQ ID NO: 56398 - protein, 9 aa, Artificial Sequence
  Description of Artificial Sequence: Synthetic peptide
  Seed: GSVVGNWQY (MAGA3_HUMAN)
GSVVGNWQF

SEQ ID NO: 56399 - protein, 11 aa, Artificial Sequence
  Description of Artificial Sequence: Synthetic peptide
  Seed: ISYPPLHEWVL (MAGA3_HUMAN)
IRYPPLHEWVF

SEQ ID NO: 56400 - protein, 9 aa, Artificial Sequence
  Description of Artificial Sequence: Synthetic peptide
  Seed: AELVHFLLL (MAGA3_HUMAN)
ASLVHFLLF

SEQ ID NO: 56401 - protein, 9 aa, Artificial Sequence
  Description of Artificial Sequence: Synthetic peptide
  Seed: NYPLWSQSY (MAGA3_HUMAN)
NAPLWSQSY

SEQ ID NO: 56402 - protein, 10 aa, Artificial Sequence
  Description of Artificial Sequence: Synthetic peptide
  Seed: YRQVPGSDPA (MAGA3_HUMAN)
YWQVPGSDPV

SEQ ID NO: 56403 - protein, 10 aa, Artificial Sequence
  Description of Artificial Sequence: Synthetic peptide
  Seed: MNYPLWSQSY (MAGA3_HUMAN)
MYYPLWSQSW

SEQ ID NO: 56404 - protein, 9 aa, Artificial Sequence
  Description of Artificial Sequence: Synthetic peptide
  Seed: TFPDLESEF (MAGA3_HUMAN)
TRPDLESEY

SEQ ID NO: 56405 - protein, 9 aa, Artificial Sequence
  Description of Artificial Sequence: Synthetic peptide
  Seed: ASSSLQLVF (MAGA3_HUMAN)
AVSSLQLVL

SEQ ID NO: 56406 - protein, 9 aa, Artificial Sequence
  Description of Artificial Sequence: Synthetic peptide
  Seed: YFFPVIFSK (MAGA3_HUMAN)
YMFPVIFSH

SEQ ID NO: 56407 - protein, 8 aa, Artificial Sequence
  Description of Artificial Sequence: Synthetic peptide
  Seed: KVAELVHF (MAGA3_HUMAN)
KSAELVHW

SEQ ID NO: 56408 - protein, 9 aa, Artificial Sequence
  Description of Artificial Sequence: Synthetic peptide
  Seed: FQAALSRKV (MAGA3_HUMAN)
FAAALSRKF

SEQ ID NO: 56409 - protein, 9 aa, Artificial Sequence
  Description of Artificial Sequence: Synthetic peptide
  Seed: SKASSSLQL (MAGA3_HUMAN)
SRASSSLQF

SEQ ID NO: 56410 - protein, 9 aa, Artificial Sequence
  Description of Artificial Sequence: Synthetic peptide
  Seed: EVDPIGHLY (MAGA3_HUMAN)
ETDPIGHLR

SEQ ID NO: 56411 - protein, 10 aa, Artificial Sequence
  Description of Artificial Sequence: Synthetic peptide
  Seed: LPTTMNYPLW (MAGA3_HUMAN)
LLTTMNYPLW

SEQ ID NO: 56412 - protein, 9 aa, Artificial Sequence
  Description of Artificial Sequence: Synthetic peptide
  Seed: SSLPTTMNY (MAGA3_HUMAN)
SLLPTTMNY

SEQ ID NO: 56413 - protein, 9 aa, Artificial Sequence
  Description of Artificial Sequence: Synthetic peptide
  Seed: TFPDLESEF (MAGA3_HUMAN)
TTPDLESEM

SEQ ID NO: 56414 - protein, 9 aa, Artificial Sequence
  Description of Artificial Sequence: Synthetic peptide
  Seed: GASSLPTTM (MAGA3_HUMAN)
GASSLPTTY

SEQ ID NO: 56415 - protein, 10 aa, Artificial Sequence
  Description of Artificial Sequence: Synthetic peptide
  Seed: FSKASSSLQL (MAGA3_HUMAN)
FRKASSSLQF

SEQ ID NO: 56416 - protein, 11 aa, Artificial Sequence
  Description of Artificial Sequence: Synthetic peptide
  Seed: KVAELVHFLLL (MAGA3_HUMAN)
KLAELVHFLLY

SEQ ID NO: 56417 - protein, 9 aa, Artificial Sequence
  Description of Artificial Sequence: Synthetic peptide
  Seed: RALVETSYV (MAGA3_HUMAN)
RLLVETSYK

SEQ ID NO: 56418 - protein, 10 aa, Artificial Sequence
  Description of Artificial Sequence: Synthetic peptide
  Seed: LGLVGAQAPA (MAGA3_HUMAN)
LILVGAQAPV

SEQ ID NO: 56419 - protein, 9 aa, Artificial Sequence
  Description of Artificial Sequence: Synthetic peptide
  Seed: LGDPKKLLT (MAGA3_HUMAN)
LNDPKKLLL

SEQ ID NO: 56420 - protein, 10 aa, Artificial Sequence
  Description of Artificial Sequence: Synthetic peptide
  Seed: QVPGSDPACY (MAGA3_HUMAN)
QQPGSDPACY

SEQ ID NO: 56421 - protein, 9 aa, Artificial Sequence
  Description of Artificial Sequence: Synthetic peptide
  Seed: NYPLWSQSY (MAGA3_HUMAN)
NQPLWSQSY

SEQ ID NO: 56422 - protein, 10 aa, Artificial Sequence
  Description of Artificial Sequence: Synthetic peptide
  Seed: IFATCLGLSY (MAGA3_HUMAN)
ITATCLGLSY

SEQ ID NO: 56423 - protein, 8 aa, Artificial Sequence
  Description of Artificial Sequence: Synthetic peptide
  Seed: LGDPKKLL (MAGA3_HUMAN)
LSDPKKLV

SEQ ID NO: 56424 - protein, 10 aa, Artificial Sequence
  Description of Artificial Sequence: Synthetic peptide
  Seed: KVAELVHFLL (MAGA3_HUMAN)
KQAELVHFLF

SEQ ID NO: 56425 - protein, 10 aa, Artificial Sequence
  Description of Artificial Sequence: Synthetic peptide
  Seed: YFFPVIFSKA (MAGA3_HUMAN)
YQFPVIFSKI

SEQ ID NO: 56426 - protein, 9 aa, Artificial Sequence
  Description of Artificial Sequence: Synthetic peptide
  Seed: RQVPGSDPA (MAGA3_HUMAN)
RGVPGSDPY

SEQ ID NO: 56427 - protein, 10 aa, Artificial Sequence
  Description of Artificial Sequence: Synthetic peptide
  Seed: VDPIGHLYIF (MAGA3_HUMAN)
VAPIGHLYIY

SEQ ID NO: 56428 - protein, 9 aa, Artificial Sequence
  Description of Artificial Sequence: Synthetic peptide
  Seed: RALVETSYV (MAGA3_HUMAN)
RMLVETSYW

SEQ ID NO: 56429 - protein, 10 aa, Artificial Sequence
  Description of Artificial Sequence: Synthetic peptide
  Seed: MVKISGGPHI (MAGA3_HUMAN)
MEKISGGPHY

SEQ ID NO: 56430 - protein, 9 aa, Artificial Sequence
  Description of Artificial Sequence: Synthetic peptide
  Seed: FATCLGLSY (MAGA3_HUMAN)
FPTCLGLSS

SEQ ID NO: 56431 - protein, 9 aa, Artificial Sequence
  Description of Artificial Sequence: Synthetic peptide
  Seed: ILGDPKKLL (MAGA3_HUMAN)
ITGDPKKLL

SEQ ID NO: 56432 - protein, 10 aa, Artificial Sequence
  Description of Artificial Sequence: Synthetic peptide
  Seed: NQEEEGPSTF (MAGA3_HUMAN)
NHEEEGPSTL

SEQ ID NO: 56433 - protein, 9 aa, Artificial Sequence
  Description of Artificial Sequence: Synthetic peptide
  Seed: SSLPTTMNY (MAGA3_HUMAN)
SFLPTTMNF

SEQ ID NO: 56434 - protein, 10 aa, Artificial Sequence
  Description of Artificial Sequence: Synthetic peptide
  Seed: FSKASSSLQL (MAGA3_HUMAN)
FSKASSSLQF

SEQ ID NO: 56435 - protein, 10 aa, Artificial Sequence
  Description of Artificial Sequence: Synthetic peptide
  Seed: LGLVGAQAPA (MAGA3_HUMAN)
LRLVGAQAPV

SEQ ID NO: 56436 - protein, 9 aa, Artificial Sequence
  Description of Artificial Sequence: Synthetic peptide
  Seed: LQLVFGIEL (MAGA3_HUMAN)
LRLVFGIEM

SEQ ID NO: 56437 - protein, 9 aa, Artificial Sequence
  Description of Artificial Sequence: Synthetic peptide
  Seed: SSLQLVFGI (MAGA3_HUMAN)
SVLQLVFGL

SEQ ID NO: 56438 - protein, 10 aa, Artificial Sequence
  Description of Artificial Sequence: Synthetic peptide
  Seed: ESPDPPQSPQ (MAGA3_HUMAN)
EMPDPPQSPK

SEQ ID NO: 56439 - protein, 8 aa, Artificial Sequence
  Description of Artificial Sequence: Synthetic peptide
  Seed: SGGPHISY (MAGA3_HUMAN)
SVGPHISL

SEQ ID NO: 56440 - protein, 8 aa, Artificial Sequence
  Description of Artificial Sequence: Synthetic peptide
  Seed: EEKIWEEL (MAGA3_HUMAN)
EEKIWEEF

SEQ ID NO: 56441 - protein, 9 aa, Artificial Sequence
  Description of Artificial Sequence: Synthetic peptide
  Seed: AELVHFLLL (MAGA3_HUMAN)
AALVHFLLY

SEQ ID NO: 56442 - protein, 9 aa, Artificial Sequence
  Description of Artificial Sequence: Synthetic peptide
  Seed: SKASSSLQL (MAGA3_HUMAN)
SYASSSLQY

SEQ ID NO: 56443 - protein, 10 aa, Artificial Sequence
  Description of Artificial Sequence: Synthetic peptide
  Seed: KVAELVHFLL (MAGA3_HUMAN)
KMAELVHFLH

SEQ ID NO: 56444 - protein, 9 aa, Artificial Sequence
  Description of Artificial Sequence: Synthetic peptide
  Seed: ALSRKVAEL (MAGA3_HUMAN)
AISRKVAEY

SEQ ID NO: 56445 - protein, 10 aa, Artificial Sequence
  Description of Artificial Sequence: Synthetic peptide
  Seed: ASSSLQLVFG (MAGA3_HUMAN)
AGSSLQLVFW

SEQ ID NO: 56446 - protein, 10 aa, Artificial Sequence
  Description of Artificial Sequence: Synthetic peptide
  Seed: FFPVIFSKAS (MAGA3_HUMAN)
FGPVIFSKAV

SEQ ID NO: 56447 - protein, 10 aa, Artificial Sequence
  Description of Artificial Sequence: Synthetic peptide
  Seed: VIFSKASSSL (MAGA3_HUMAN)
VFFSKASSSF

SEQ ID NO: 56448 - protein, 10 aa, Artificial Sequence
  Description of Artificial Sequence: Synthetic peptide
  Seed: WQYFFPVIFS (MAGA3_HUMAN)
WKYFFPVIFY

SEQ ID NO: 56449 - protein, 9 aa, Artificial Sequence
  Description of Artificial Sequence: Synthetic peptide
  Seed: GNWQYFFPV (MAGA3_HUMAN)
GIWQYFFPI

SEQ ID NO: 56450 - protein, 10 aa, Artificial Sequence
  Description of Artificial Sequence: Synthetic peptide
  Seed: RALVETSYVK (MAGA3_HUMAN)
RQLVETSYVR

SEQ ID NO: 56451 - protein, 9 aa, Artificial Sequence
  Description of Artificial Sequence: Synthetic peptide
  Seed: QLVFGIELM (MAGA3_HUMAN)
QIVFGIELI

SEQ ID NO: 56452 - protein, 10 aa, Artificial Sequence
  Description of Artificial Sequence: Synthetic peptide
  Seed: FLWGPRALVE (MAGA3_HUMAN)
FMWGPRALVA

SEQ ID NO: 56453 - protein, 9 aa, Artificial Sequence
  Description of Artificial Sequence: Synthetic peptide
  Seed: YIFATCLGL (MAGA3_HUMAN)
YKFATCLGM

SEQ ID NO: 56454 - protein, 9 aa, Artificial Sequence
  Description of Artificial Sequence: Synthetic peptide
  Seed: RALVETSYV (MAGA3_HUMAN)
RMLVETSYV

SEQ ID NO: 56455 - protein, 9 aa, Artificial Sequence
  Description of Artificial Sequence: Synthetic peptide
  Seed: YVKVLHHMV (MAGA3_HUMAN)
YLKVLHHMM

SEQ ID NO: 56456 - protein, 10 aa, Artificial Sequence
  Description of Artificial Sequence: Synthetic peptide
  Seed: FLWGPRALVE (MAGA3_HUMAN)
FMWGPRALVG

SEQ ID NO: 56457 - protein, 10 aa, Artificial Sequence
  Description of Artificial Sequence: Synthetic peptide
  Seed: YIFATCLGLS (MAGA3_HUMAN)
YQFATCLGLV

SEQ ID NO: 56458 - protein, 9 aa, Artificial Sequence
  Description of Artificial Sequence: Synthetic peptide
  Seed: ALSRKVAEL (MAGA3_HUMAN)
ALSRKVAEY

SEQ ID NO: 56459 - protein, 8 aa, Artificial Sequence
  Description of Artificial Sequence: Synthetic peptide
  Seed: KVAELVHF (MAGA3_HUMAN)
KQAELVHY

SEQ ID NO: 56460 - protein, 10 aa, Artificial Sequence
  Description of Artificial Sequence: Synthetic peptide
  Seed: ISYPPLHEWV (MAGA3_HUMAN)
IMYPPLHEWL

SEQ ID NO: 56461 - protein, 11 aa, Artificial Sequence
  Description of Artificial Sequence: Synthetic peptide
  Seed: KVAELVHFLLL (MAGA3_HUMAN)
KLAELVHFLLD

SEQ ID NO: 56462 - protein, 9 aa, Artificial Sequence
  Description of Artificial Sequence: Synthetic peptide
  Seed: KVAELVHFL (MAGA3_HUMAN)
KLAELVHFI

SEQ ID NO: 56463 - protein, 9 aa, Artificial Sequence
  Description of Artificial Sequence: Synthetic peptide
  Seed: YVKVLHHMV (MAGA3_HUMAN)
YMKVLHHMI

SEQ ID NO: 56464 - protein, 9 aa, Artificial Sequence
  Description of Artificial Sequence: Synthetic peptide
  Seed: LESEFQAAL (MAGA3_HUMAN)
LLSEFQAAI

SEQ ID NO: 56465 - protein, 9 aa, Artificial Sequence
  Description of Artificial Sequence: Synthetic peptide
  Seed: DPIGHLYIF (MAGA3_HUMAN)
DQIGHLYIF

SEQ ID NO: 56466 - protein, 10 aa, Artificial Sequence
  Description of Artificial Sequence: Synthetic peptide
  Seed: TSYVKVLHHM (MAGA3_HUMAN)
TLYVKVLHHL

SEQ ID NO: 56467 - protein, 9 aa, Artificial Sequence
  Description of Artificial Sequence: Synthetic peptide
  Seed: YFFPVIFSK (MAGA3_HUMAN)
YTFPVIFSI

SEQ ID NO: 56468 - protein, 9 aa, Artificial Sequence
  Description of Artificial Sequence: Synthetic peptide
  Seed: TQHFVQENY (MAGA3_HUMAN)
TRHFVQENY

SEQ ID NO: 56469 - protein, 9 aa, Artificial Sequence
  Description of Artificial Sequence: Synthetic peptide
  Seed: SVVGNWQYF (MAGA3_HUMAN)
SWVGNWQYM

SEQ ID NO: 56470 - protein, 9 aa, Artificial Sequence
  Description of Artificial Sequence: Synthetic peptide
  Seed: SPDPPQSPQ (MAGA3_HUMAN)
SPDPPQSPV

SEQ ID NO: 56471 - protein, 9 aa, Artificial Sequence
  Description of Artificial Sequence: Synthetic peptide
  Seed: KIWEELSVL (MAGA3_HUMAN)
KLWEELSVI

SEQ ID NO: 56472 - protein, 9 aa, Artificial Sequence
  Description of Artificial Sequence: Synthetic peptide
  Seed: GASSLPTTM (MAGA3_HUMAN)
GESSLPTTY

SEQ ID NO: 56473 - protein, 10 aa, Artificial Sequence
  Description of Artificial Sequence: Synthetic peptide
  Seed: MPKAGLLIIV (MAGA3_HUMAN)
MPKAGLLIIW

SEQ ID NO: 56474 - protein, 10 aa, Artificial Sequence
  Description of Artificial Sequence: Synthetic peptide
  Seed: QGASSLPTTM (MAGA3_HUMAN)
QAASSLPTTY

SEQ ID NO: 56475 - protein, 10 aa, Artificial Sequence
  Description of Artificial Sequence: Synthetic peptide
  Seed: SYPPLHEWVL (MAGA3_HUMAN)
SYPPLHEWVM

SEQ ID NO: 56476 - protein, 9 aa, Artificial Sequence
  Description of Artificial Sequence: Synthetic peptide
  Seed: MEVDPIGHL (MAGA3_HUMAN)
MLVDPIGHT

SEQ ID NO: 56477 - protein, 9 aa, Artificial Sequence
  Description of Artificial Sequence: Synthetic peptide
  Seed: YIFATCLGL (MAGA3_HUMAN)
YGFATCLGV

SEQ ID NO: 56478 - protein, 10 aa, Artificial Sequence
  Description of Artificial Sequence: Synthetic peptide
  Seed: SVVGNWQYFF (MAGA3_HUMAN)
SYVGNWQYFQ

SEQ ID NO: 56479 - protein, 9 aa, Artificial Sequence
  Description of Artificial Sequence: Synthetic peptide
  Seed: MEVDPIGHL (MAGA3_HUMAN)
MMVDPIGHM

SEQ ID NO: 56480 - protein, 9 aa, Artificial Sequence
  Description of Artificial Sequence: Synthetic peptide
  Seed: GPRALVETS (MAGA3_HUMAN)
GPRALVETF

SEQ ID NO: 56481 - protein, 10 aa, Artificial Sequence
  Description of Artificial Sequence: Synthetic peptide
  Seed: KVAELVHFLL (MAGA3_HUMAN)
KLAELVHFLL

SEQ ID NO: 56482 - protein, 9 aa, Artificial Sequence
  Description of Artificial Sequence: Synthetic peptide
  Seed: ISGGPHISY (MAGA3_HUMAN)
IIGGPHISL

SEQ ID NO: 56483 - protein, 9 aa, Artificial Sequence
  Description of Artificial Sequence: Synthetic peptide
  Seed: FVQENYLEY (MAGA3_HUMAN)
FFQENYLEM

SEQ ID NO: 56484 - protein, 10 aa, Artificial Sequence
  Description of Artificial Sequence: Synthetic peptide
  Seed: GSDPACYEFL (MAGA3_HUMAN)
GLDPACYEFY

SEQ ID NO: 56485 - protein, 9 aa, Artificial Sequence
  Description of Artificial Sequence: Synthetic peptide
  Seed: ILGDPKKLL (MAGA3_HUMAN)
ITGDPKKLM

SEQ ID NO: 56486 - protein, 10 aa, Artificial Sequence
  Description of Artificial Sequence: Synthetic peptide
  Seed: YIFATCLGLS (MAGA3_HUMAN)
YIFATCLGLV

SEQ ID NO: 56487 - protein, 9 aa, Artificial Sequence
  Description of Artificial Sequence: Synthetic peptide
  Seed: KIWEELSVL (MAGA3_HUMAN)
KMWEELSVT

SEQ ID NO: 56488 - protein, 10 aa, Artificial Sequence
  Description of Artificial Sequence: Synthetic peptide
  Seed: LVFGIELMEV (MAGA3_HUMAN)
LQFGIELMEA

SEQ ID NO: 56489 - protein, 9 aa, Artificial Sequence
  Description of Artificial Sequence: Synthetic peptide
  Seed: FVQENYLEY (MAGA3_HUMAN)
FLQENYLEK

SEQ ID NO: 56490 - protein, 11 aa, Artificial Sequence
  Description of Artificial Sequence: Synthetic peptide
  Seed: GASSLPTTMNY (MAGA3_HUMAN)
GMSSLPTTMNW

SEQ ID NO: 56491 - protein, 10 aa, Artificial Sequence
  Description of Artificial Sequence: Synthetic peptide
  Seed: YFFPVIFSKA (MAGA3_HUMAN)
YQFPVIFSKM

SEQ ID NO: 56492 - protein, 10 aa, Artificial Sequence
  Description of Artificial Sequence: Synthetic peptide
  Seed: YIFATCLGLS (MAGA3_HUMAN)
YLFATCLGLW

SEQ ID NO: 56493 - protein, 9 aa, Artificial Sequence
  Description of Artificial Sequence: Synthetic peptide
  Seed: MEVDPIGHL (MAGA3_HUMAN)
MHVDPIGHV

SEQ ID NO: 56494 - protein, 10 aa, Artificial Sequence
  Description of Artificial Sequence: Synthetic peptide
  Seed: KVAELVHFLL (MAGA3_HUMAN)
KLAELVHFLY

SEQ ID NO: 56495 - protein, 9 aa, Artificial Sequence
  Description of Artificial Sequence: Synthetic peptide
  Seed: GEALGLVGA (MAGA3_HUMAN)
GEALGLVGT

SEQ ID NO: 56496 - protein, 9 aa, Artificial Sequence
  Description of Artificial Sequence: Synthetic peptide
  Seed: KVLHHMVKI (MAGA3_HUMAN)
KTLHHMVKM

SEQ ID NO: 56497 - protein, 9 aa, Artificial Sequence
  Description of Artificial Sequence: Synthetic peptide
  Seed: QSPQGASSL (MAGA3_HUMAN)
QVPQGASSV

SEQ ID NO: 56498 - protein, 9 aa, Artificial Sequence
  Description of Artificial Sequence: Synthetic peptide
  Seed: LPTTMNYPL (MAGA3_HUMAN)
LVTTMNYPY

SEQ ID NO: 56499 - protein, 10 aa, Artificial Sequence
  Description of Artificial Sequence: Synthetic peptide
  Seed: VDPIGHLYIF (MAGA3_HUMAN)
VWPIGHLYIW

SEQ ID NO: 56500 - protein, 9 aa, Artificial Sequence
  Description of Artificial Sequence: Synthetic peptide
  Seed: QEEEGPSTF (MAGA3_HUMAN)
QFEEGPSTL

SEQ ID NO: 56501 - protein, 9 aa, Artificial Sequence
  Description of Artificial Sequence: Synthetic peptide
  Seed: ASSSLQLVF (MAGA3_HUMAN)
ARSSLQLVL

SEQ ID NO: 56502 - protein, 9 aa, Artificial Sequence
  Description of Artificial Sequence: Synthetic peptide
  Seed: KASSSLQLV (MAGA3_HUMAN)
KVSSSLQLI

SEQ ID NO: 56503 - protein, 9 aa, Artificial Sequence
  Description of Artificial Sequence: Synthetic peptide
  Seed: RALVETSYV (MAGA3_HUMAN)
RQLVETSYL

SEQ ID NO: 56504 - protein, 10 aa, Artificial Sequence
  Description of Artificial Sequence: Synthetic peptide
  Seed: KVAELVHFLL (MAGA3_HUMAN)
KVAELVHFLF

SEQ ID NO: 56505 - protein, 9 aa, Artificial Sequence
  Description of Artificial Sequence: Synthetic peptide
  Seed: ISYPPLHEW (MAGA3_HUMAN)
IFYPPLHEY

SEQ ID NO: 56506 - protein, 9 aa, Artificial Sequence
  Description of Artificial Sequence: Synthetic peptide
  Seed: ASSSLQLVF (MAGA3_HUMAN)
AVSSLQLVY

SEQ ID NO: 56507 - protein, 10 aa, Artificial Sequence
  Description of Artificial Sequence: Synthetic peptide
  Seed: ASSLPTTMNY (MAGA3_HUMAN)
AYSLPTTMNK

SEQ ID NO: 56508 - protein, 10 aa, Artificial Sequence
  Description of Artificial Sequence: Synthetic peptide
  Seed: DLESEFQAAL (MAGA3_HUMAN)
DEESEFQAAF

SEQ ID NO: 56509 - protein, 10 aa, Artificial Sequence
  Description of Artificial Sequence: Synthetic peptide
  Seed: DLESEFQAAL (MAGA3_HUMAN)
DVESEFQAAY

SEQ ID NO: 56510 - protein, 9 aa, Artificial Sequence
  Description of Artificial Sequence: Synthetic peptide
  Seed: IMPKAGLLI (MAGA3_HUMAN)
IFPKAGLLW

SEQ ID NO: 56511 - protein, 9 aa, Artificial Sequence
  Description of Artificial Sequence: Synthetic peptide
  Seed: AQAPATEEQ (MAGA3_HUMAN)
AQAPATEEY

SEQ ID NO: 56512 - protein, 9 aa, Artificial Sequence
  Description of Artificial Sequence: Synthetic peptide
  Seed: ISGGPHISY (MAGA3_HUMAN)
IVGGPHISK

SEQ ID NO: 56513 - protein, 10 aa, Artificial Sequence
  Description of Artificial Sequence: Synthetic peptide
  Seed: YIFATCLGLS (MAGA3_HUMAN)
YMFATCLGLK

SEQ ID NO: 56514 - protein, 9 aa, Artificial Sequence
  Description of Artificial Sequence: Synthetic peptide
  Seed: FATCLGLSY (MAGA3_HUMAN)
FQTCLGLSM

SEQ ID NO: 56515 - protein, 10 aa, Artificial Sequence
  Description of Artificial Sequence: Synthetic peptide
  Seed: MEVDPIGHLY (MAGA3_HUMAN)
MVVDPIGHLK

SEQ ID NO: 56516 - protein, 11 aa, Artificial Sequence
  Description of Artificial Sequence: Synthetic peptide
  Seed: MLGSVVGNWQY (MAGA3_HUMAN)
MAGSVVGNWQF

SEQ ID NO: 56517 - protein, 10 aa, Artificial Sequence
  Description of Artificial Sequence: Synthetic peptide
  Seed: RKVAELVHFL (MAGA3_HUMAN)
RMVAELVHFY

SEQ ID NO: 56518 - protein, 10 aa, Artificial Sequence
  Description of Artificial Sequence: Synthetic peptide
  Seed: MVKISGGPHI (MAGA3_HUMAN)
MKKISGGPHY

SEQ ID NO: 56519 - protein, 9 aa, Artificial Sequence
  Description of Artificial Sequence: Synthetic peptide
  Seed: RQVPGSDPA (MAGA3_HUMAN)
RGVPGSDPF

SEQ ID NO: 56520 - protein, 9 aa, Artificial Sequence
  Description of Artificial Sequence: Synthetic peptide
  Seed: YIFATCLGL (MAGA3_HUMAN)
YSFATCLGY

SEQ ID NO: 56521 - protein, 10 aa, Artificial Sequence
  Description of Artificial Sequence: Synthetic peptide
  Seed: LGLVGAQAPA (MAGA3_HUMAN)
LYLVGAQAPV

SEQ ID NO: 56522 - protein, 9 aa, Artificial Sequence
  Description of Artificial Sequence: Synthetic peptide
  Seed: YIFATCLGL (MAGA3_HUMAN)
YNFATCLGF

SEQ ID NO: 56523 - protein, 9 aa, Artificial Sequence
  Description of Artificial Sequence: Synthetic peptide
  Seed: AELVHFLLL (MAGA3_HUMAN)
AELVHFLLT

SEQ ID NO: 56524 - protein, 10 aa, Artificial Sequence
  Description of Artificial Sequence: Synthetic peptide
  Seed: QVPGSDPACY (MAGA3_HUMAN)
QTPGSDPACK

SEQ ID NO: 56525 - protein, 10 aa, Artificial Sequence
  Description of Artificial Sequence: Synthetic peptide
  Seed: KASSSLQLVF (MAGA3_HUMAN)
KMSSSLQLVL

SEQ ID NO: 56526 - protein, 10 aa, Artificial Sequence
  Description of Artificial Sequence: Synthetic peptide
  Seed: YFFPVIFSKA (MAGA3_HUMAN)
YMFPVIFSKC

SEQ ID NO: 56527 - protein, 9 aa, Artificial Sequence
  Description of Artificial Sequence: Synthetic peptide
  Seed: SSLPTTMNY (MAGA3_HUMAN)
SSLPTTMNL

SEQ ID NO: 56528 - protein, 10 aa, Artificial Sequence
  Description of Artificial Sequence: Synthetic peptide
  Seed: MVKISGGPHI (MAGA3_HUMAN)
MKKISGGPHM

SEQ ID NO: 56529 - protein, 9 aa, Artificial Sequence
  Description of Artificial Sequence: Synthetic peptide
  Seed: VTLGEVPAA (MAGA3_HUMAN)
VQLGEVPAM

SEQ ID NO: 56530 - protein, 10 aa, Artificial Sequence
  Description of Artificial Sequence: Synthetic peptide
  Seed: IFATCLGLSY (MAGA3_HUMAN)
IPATCLGLSY

SEQ ID NO: 56531 - protein, 10 aa, Artificial Sequence
  Description of Artificial Sequence: Synthetic peptide
  Seed: ASSLPTTMNY (MAGA3_HUMAN)
ACSLPTTMNK

SEQ ID NO: 56532 - protein, 9 aa, Artificial Sequence
  Description of Artificial Sequence: Synthetic peptide
  Seed: SEFQAALSR (MAGA3_HUMAN)
SIFQAALSR

SEQ ID NO: 56533 - protein, 10 aa, Artificial Sequence
  Description of Artificial Sequence: Synthetic peptide
  Seed: DLESEFQAAL (MAGA3_HUMAN)
DGESEFQAAF

SEQ ID NO: 56534 - protein, 9 aa, Artificial Sequence
  Description of Artificial Sequence: Synthetic peptide
  Seed: SSSSTLVEV (MAGA3_HUMAN)
SVSSTLVEA

SEQ ID NO: 56535 - protein, 10 aa, Artificial Sequence
  Description of Artificial Sequence: Synthetic peptide
  Seed: SVVGNWQYFF (MAGA3_HUMAN)
SYVGNWQYFN

SEQ ID NO: 56536 - protein, 10 aa, Artificial Sequence
  Description of Artificial Sequence: Synthetic peptide
  Seed: KISGGPHISY (MAGA3_HUMAN)
KQSGGPHISL

SEQ ID NO: 56537 - protein, 9 aa, Artificial Sequence
  Description of Artificial Sequence: Synthetic peptide
  Seed: GNWQYFFPV (MAGA3_HUMAN)
GQWQYFFPA

SEQ ID NO: 56538 - protein, 10 aa, Artificial Sequence
  Description of Artificial Sequence: Synthetic peptide
  Seed: KASSSLQLVF (MAGA3_HUMAN)
KTSSSLQLVF

SEQ ID NO: 56539 - protein, 10 aa, Artificial Sequence
  Description of Artificial Sequence: Synthetic peptide
  Seed: LYIFATCLGL (MAGA3_HUMAN)
LTIFATCLGV

SEQ ID NO: 56540 - protein, 10 aa, Artificial Sequence
  Description of Artificial Sequence: Synthetic peptide
  Seed: RKVAELVHFL (MAGA3_HUMAN)
RNVAELVHFL

SEQ ID NO: 56541 - protein, 10 aa, Artificial Sequence
  Description of Artificial Sequence: Synthetic peptide
  Seed: SRKVAELVHF (MAGA3_HUMAN)
SQKVAELVHF

SEQ ID NO: 56542 - protein, 9 aa, Artificial Sequence
  Description of Artificial Sequence: Synthetic peptide
  Seed: TFPDLESEF (MAGA3_HUMAN)
TVPDLESEY

SEQ ID NO: 56543 - protein, 9 aa, Artificial Sequence
  Description of Artificial Sequence: Synthetic peptide
  Seed: FQAALSRKV (MAGA3_HUMAN)
FIAALSRKI

SEQ ID NO: 56544 - protein, 9 aa, Artificial Sequence
  Description of Artificial Sequence: Synthetic peptide
  Seed: IFSKASSSL (MAGA3_HUMAN)
IVSKASSSF

SEQ ID NO: 56545 - protein, 9 aa, Artificial Sequence
  Description of Artificial Sequence: Synthetic peptide
  Seed: SSTLVEVTL (MAGA3_HUMAN)
SETLVEVTI

SEQ ID NO: 56546 - protein, 9 aa, Artificial Sequence
  Description of Artificial Sequence: Synthetic peptide
  Seed: ASSSLQLVF (MAGA3_HUMAN)
AASSLQLVW

SEQ ID NO: 56547 - protein, 10 aa, Artificial Sequence
  Description of Artificial Sequence: Synthetic peptide
  Seed: HFVQENYLEY (MAGA3_HUMAN)
HTVQENYLEY

SEQ ID NO: 56548 - protein, 10 aa, Artificial Sequence
  Description of Artificial Sequence: Synthetic peptide
  Seed: KVAELVHFLL (MAGA3_HUMAN)
KTAELVHFLR

SEQ ID NO: 56549 - protein, 10 aa, Artificial Sequence
  Description of Artificial Sequence: Synthetic peptide
  Seed: KASSSLQLVF (MAGA3_HUMAN)
KTSSSLQLVW

SEQ ID NO: 56550 - protein, 10 aa, Artificial Sequence
  Description of Artificial Sequence: Synthetic peptide
  Seed: STFPDLESEF (MAGA3_HUMAN)
SAFPDLESEL

SEQ ID NO: 56551 - protein, 10 aa, Artificial Sequence
  Description of Artificial Sequence: Synthetic peptide
  Seed: ISYPPLHEWV (MAGA3_HUMAN)
IGYPPLHEWL

SEQ ID NO: 56552 - protein, 10 aa, Artificial Sequence
  Description of Artificial Sequence: Synthetic peptide
  Seed: IFATCLGLSY (MAGA3_HUMAN)
IQATCLGLSM

SEQ ID NO: 56553 - protein, 9 aa, Artificial Sequence
  Description of Artificial Sequence: Synthetic peptide
  Seed: DPIGHLYIF (MAGA3_HUMAN)
DAIGHLYIW

SEQ ID NO: 56554 - protein, 10 aa, Artificial Sequence
  Description of Artificial Sequence: Synthetic peptide
  Seed: VIFSKASSSL (MAGA3_HUMAN)
VLFSKASSSY

SEQ ID NO: 56555 - protein, 9 aa, Artificial Sequence
  Description of Artificial Sequence: Synthetic peptide
  Seed: FATCLGLSY (MAGA3_HUMAN)
FKTCLGLSM

SEQ ID NO: 56556 - protein, 10 aa, Artificial Sequence
  Description of Artificial Sequence: Synthetic peptide
  Seed: GDCAPEEKIW (MAGA3_HUMAN)
GECAPEEKIY

SEQ ID NO: 56557 - protein, 9 aa, Artificial Sequence
  Description of Artificial Sequence: Synthetic peptide
  Seed: MPKAGLLII (MAGA3_HUMAN)
MPKAGLLIP

SEQ ID NO: 56558 - protein, 9 aa, Artificial Sequence
  Description of Artificial Sequence: Synthetic peptide
  Seed: TFPDLESEF (MAGA3_HUMAN)
TWPDLESEL

SEQ ID NO: 56559 - protein, 9 aa, Artificial Sequence
  Description of Artificial Sequence: Synthetic peptide
  Seed: SSTLVEVTL (MAGA3_HUMAN)
SVTLVEVTW

SEQ ID NO: 56560 - protein, 9 aa, Artificial Sequence
  Description of Artificial Sequence: Synthetic peptide
  Seed: YIFATCLGL (MAGA3_HUMAN)
YTFATCLGW

SEQ ID NO: 56561 - protein, 9 aa, Artificial Sequence
  Description of Artificial Sequence: Synthetic peptide
  Seed: SSSSTLVEV (MAGA3_HUMAN)
SASSTLVEA

SEQ ID NO: 56562 - protein, 10 aa, Artificial Sequence
  Description of Artificial Sequence: Synthetic peptide
  Seed: HISYPPLHEW (MAGA3_HUMAN)
HYSYPPLHEW

SEQ ID NO: 56563 - protein, 9 aa, Artificial Sequence
  Description of Artificial Sequence: Synthetic peptide
  Seed: IIVLAIIAR (MAGA3_HUMAN)
IAVLAIIAV

SEQ ID NO: 56564 - protein, 9 aa, Artificial Sequence
  Description of Artificial Sequence: Synthetic peptide
  Seed: LSRKVAELV (MAGA3_HUMAN)
LNRKVAELW

SEQ ID NO: 56565 - protein, 9 aa, Artificial Sequence
  Description of Artificial Sequence: Synthetic peptide
  Seed: ALSRKVAEL (MAGA3_HUMAN)
ASSRKVAEL

SEQ ID NO: 56566 - protein, 9 aa, Artificial Sequence
  Description of Artificial Sequence: Synthetic peptide
  Seed: ISYPPLHEW (MAGA3_HUMAN)
IMYPPLHEW

SEQ ID NO: 56567 - protein, 9 aa, Artificial Sequence
  Description of Artificial Sequence: Synthetic peptide
  Seed: GSDPACYEF (MAGA3_HUMAN)
GFDPACYEL

SEQ ID NO: 56568 - protein, 9 aa, Artificial Sequence
  Description of Artificial Sequence: Synthetic peptide
  Seed: KAGLLIIVL (MAGA3_HUMAN)
KMGLLIIVF

SEQ ID NO: 56569 - protein, 10 aa, Artificial Sequence
  Description of Artificial Sequence: Synthetic peptide
  Seed: MPKAGLLIIV (MAGA3_HUMAN)
MSKAGLLIIV

SEQ ID NO: 56570 - protein, 10 aa, Artificial Sequence
  Description of Artificial Sequence: Synthetic peptide
  Seed: LQLVFGIELM (MAGA3_HUMAN)
LKLVFGIELV

SEQ ID NO: 56571 - protein, 10 aa, Artificial Sequence
  Description of Artificial Sequence: Synthetic peptide
  Seed: MEVDPIGHLY (MAGA3_HUMAN)
MFVDPIGHLF

SEQ ID NO: 56572 - protein, 10 aa, Artificial Sequence
  Description of Artificial Sequence: Synthetic peptide
  Seed: MNYPLWSQSY (MAGA3_HUMAN)
MAYPLWSQSV

SEQ ID NO: 56573 - protein, 9 aa, Artificial Sequence
  Description of Artificial Sequence: Synthetic peptide
  Seed: GSDPACYEF (MAGA3_HUMAN)
GFDPACYEF

SEQ ID NO: 56574 - protein, 8 aa, Artificial Sequence
  Description of Artificial Sequence: Synthetic peptide
  Seed: FPDLESEF (MAGA3_HUMAN)
FVDLESEF

SEQ ID NO: 56575 - protein, 9 aa, Artificial Sequence
  Description of Artificial Sequence: Synthetic peptide
  Seed: SSLQLVFGI (MAGA3_HUMAN)
SMLQLVFGC

SEQ ID NO: 56576 - protein, 9 aa, Artificial Sequence
  Description of Artificial Sequence: Synthetic peptide
  Seed: TFPDLESEF (MAGA3_HUMAN)
TRPDLESEL

SEQ ID NO: 56577 - protein, 11 aa, Artificial Sequence
  Description of Artificial Sequence: Synthetic peptide
  Seed: ISYPPLHEWVL (MAGA3_HUMAN)
ITYPPLHEWVW

SEQ ID NO: 56578 - protein, 10 aa, Artificial Sequence
  Description of Artificial Sequence: Synthetic peptide
  Seed: KASSSLQLVF (MAGA3_HUMAN)
KWSSSLQLVW

SEQ ID NO: 56579 - protein, 9 aa, Artificial Sequence
  Description of Artificial Sequence: Synthetic peptide
  Seed: SYVKVLHHM (MAGA3_HUMAN)
SYVKVLHHV

SEQ ID NO: 56580 - protein, 11 aa, Artificial Sequence
  Description of Artificial Sequence: Synthetic peptide
  Seed: YIFATCLGLSY (MAGA3_HUMAN)
YAFATCLGLSW

SEQ ID NO: 56581 - protein, 9 aa, Artificial Sequence
  Description of Artificial Sequence: Synthetic peptide
  Seed: VKISGGPHI (MAGA3_HUMAN)
VKISGGPHY

SEQ ID NO: 56582 - protein, 11 aa, Artificial Sequence
  Description of Artificial Sequence: Synthetic peptide
  Seed: YIFATCLGLSY (MAGA3_HUMAN)
YAFATCLGLSF

SEQ ID NO: 56583 - protein, 9 aa, Artificial Sequence
  Description of Artificial Sequence: Synthetic peptide
  Seed: FLWGPRALV (MAGA3_HUMAN)
FSWGPRALL

SEQ ID NO: 56584 - protein, 9 aa, Artificial Sequence
  Description of Artificial Sequence: Synthetic peptide
  Seed: YPLWSQSYE (MAGA3_HUMAN)
YALWSQSYF

SEQ ID NO: 56585 - protein, 9 aa, Artificial Sequence
  Description of Artificial Sequence: Synthetic peptide
  Seed: GNWQYFFPV (MAGA3_HUMAN)
GMWQYFFPT

SEQ ID NO: 56586 - protein, 9 aa, Artificial Sequence
  Description of Artificial Sequence: Synthetic peptide
  Seed: VKISGGPHI (MAGA3_HUMAN)
VQISGGPHV

SEQ ID NO: 56587 - protein, 11 aa, Artificial Sequence
  Description of Artificial Sequence: Synthetic peptide
  Seed: SKASSSLQLVF (MAGA3_HUMAN)
SMASSSLQLVW

SEQ ID NO: 56588 - protein, 10 aa, Artificial Sequence
  Description of Artificial Sequence: Synthetic peptide
  Seed: MEVDPIGHLY (MAGA3_HUMAN)
MVVDPIGHLR

SEQ ID NO: 56589 - protein, 11 aa, Artificial Sequence
  Description of Artificial Sequence: Synthetic peptide
  Seed: SKASSSLQLVF (MAGA3_HUMAN)
SNASSSLQLVW

SEQ ID NO: 56590 - protein, 10 aa, Artificial Sequence
  Description of Artificial Sequence: Synthetic peptide
  Seed: FSKASSSLQL (MAGA3_HUMAN)
FGKASSSLQF

SEQ ID NO: 56591 - protein, 10 aa, Artificial Sequence
  Description of Artificial Sequence: Synthetic peptide
  Seed: MNYPLWSQSY (MAGA3_HUMAN)
MYYPLWSQSM

SEQ ID NO: 56592 - protein, 9 aa, Artificial Sequence
  Description of Artificial Sequence: Synthetic peptide
  Seed: LVHFLLLKY (MAGA3_HUMAN)
LTHFLLLKF

SEQ ID NO: 56593 - protein, 9 aa, Artificial Sequence
  Description of Artificial Sequence: Synthetic peptide
  Seed: QEEEGPSTF (MAGA3_HUMAN)
QEEEGPSTM

SEQ ID NO: 56594 - protein, 10 aa, Artificial Sequence
  Description of Artificial Sequence: Synthetic peptide
  Seed: ASSSSTLVEV (MAGA3_HUMAN)
AVSSSTLVEI

SEQ ID NO: 56595 - protein, 9 aa, Artificial Sequence
  Description of Artificial Sequence: Synthetic peptide
  Seed: QEEEGPSTF (MAGA3_HUMAN)
QQEEGPSTF

SEQ ID NO: 56596 - protein, 8 aa, Artificial Sequence
  Description of Artificial Sequence: Synthetic peptide
  Seed: FPDLESEF (MAGA3_HUMAN)
FQDLESEL

SEQ ID NO: 56597 - protein, 9 aa, Artificial Sequence
  Description of Artificial Sequence: Synthetic peptide
  Seed: ALSRKVAEL (MAGA3_HUMAN)
AVSRKVAEF

SEQ ID NO: 56598 - protein, 10 aa, Artificial Sequence
  Description of Artificial Sequence: Synthetic peptide
  Seed: DLESEFQAAL (MAGA3_HUMAN)
DTESEFQAAY

SEQ ID NO: 56599 - protein, 10 aa, Artificial Sequence
  Description of Artificial Sequence: Synthetic peptide
  Seed: ISYPPLHEWV (MAGA3_HUMAN)
IWYPPLHEWM

SEQ ID NO: 56600 - protein, 9 aa, Artificial Sequence
  Description of Artificial Sequence: Synthetic peptide
  Seed: SVLEVFEGR (MAGA3_HUMAN)
SFLEVFEGR

SEQ ID NO: 56601 - protein, 11 aa, Artificial Sequence
  Description of Artificial Sequence: Synthetic peptide
  Seed: RQVPGSDPACY (MAGA3_HUMAN)
RAVPGSDPACY

SEQ ID NO: 56602 - protein, 9 aa, Artificial Sequence
  Description of Artificial Sequence: Synthetic peptide
  Seed: LPTTMNYPL (MAGA3_HUMAN)
LPTTMNYPM

SEQ ID NO: 56603 - protein, 9 aa, Artificial Sequence
  Description of Artificial Sequence: Synthetic peptide
  Seed: YIFATCLGL (MAGA3_HUMAN)
YKFATCLGI

SEQ ID NO: 56604 - protein, 9 aa, Artificial Sequence
  Description of Artificial Sequence: Synthetic peptide
  Seed: EAASSSSTL (MAGA3_HUMAN)
ETASSSSTL

SEQ ID NO: 56605 - protein, 10 aa, Artificial Sequence
  Description of Artificial Sequence: Synthetic peptide
  Seed: SVVGNWQYFF (MAGA3_HUMAN)
SSVGNWQYFF

SEQ ID NO: 56606 - protein, 10 aa, Artificial Sequence
  Description of Artificial Sequence: Synthetic peptide
  Seed: YFFPVIFSKA (MAGA3_HUMAN)
YTFPVIFSKI

SEQ ID NO: 56607 - protein, 9 aa, Artificial Sequence
  Description of Artificial Sequence: Synthetic peptide
  Seed: SSTLVEVTL (MAGA3_HUMAN)
SATLVEVTW

SEQ ID NO: 56608 - protein, 10 aa, Artificial Sequence
  Description of Artificial Sequence: Synthetic peptide
  Seed: LMEVDPIGHL (MAGA3_HUMAN)
LLEVDPIGHV

SEQ ID NO: 56609 - protein, 9 aa, Artificial Sequence
  Description of Artificial Sequence: Synthetic peptide
  Seed: ALGLVGAQA (MAGA3_HUMAN)
AMGLVGAQI

SEQ ID NO: 56610 - protein, 9 aa, Artificial Sequence
  Description of Artificial Sequence: Synthetic peptide
  Seed: LQLVFGIEL (MAGA3_HUMAN)
LQLVFGIEV

SEQ ID NO: 56611 - protein, 9 aa, Artificial Sequence
  Description of Artificial Sequence: Synthetic peptide
  Seed: VTLGEVPAA (MAGA3_HUMAN)
VQLGEVPAV

SEQ ID NO: 56612 - protein, 9 aa, Artificial Sequence
  Description of Artificial Sequence: Synthetic peptide
  Seed: YPLWSQSYE (MAGA3_HUMAN)
YVLWSQSYF

SEQ ID NO: 56613 - protein, 9 aa, Artificial Sequence
  Description of Artificial Sequence: Synthetic peptide
  Seed: TSYVKVLHH (MAGA3_HUMAN)
TAYVKVLHY

SEQ ID NO: 56614 - protein, 11 aa, Artificial Sequence
  Description of Artificial Sequence: Synthetic peptide
  Seed: SLPTTMNYPLW (MAGA3_HUMAN)
SYPTTMNYPLL

SEQ ID NO: 56615 - protein, 10 aa, Artificial Sequence
  Description of Artificial Sequence: Synthetic peptide
  Seed: AELVHFLLLK (MAGA3_HUMAN)
AQLVHFLLLK

SEQ ID NO: 56616 - protein, 9 aa, Artificial Sequence
  Description of Artificial Sequence: Synthetic peptide
  Seed: FVQENYLEY (MAGA3_HUMAN)
FQQENYLEY

SEQ ID NO: 56617 - protein, 9 aa, Artificial Sequence
  Description of Artificial Sequence: Synthetic peptide
  Seed: VVGNWQYFF (MAGA3_HUMAN)
VWGNWQYFI

SEQ ID NO: 56618 - protein, 9 aa, Artificial Sequence
  Description of Artificial Sequence: Synthetic peptide
  Seed: LQLVFGIEL (MAGA3_HUMAN)
LQLVFGIEM

SEQ ID NO: 56619 - protein, 9 aa, Artificial Sequence
  Description of Artificial Sequence: Synthetic peptide
  Seed: GSDPACYEF (MAGA3_HUMAN)
GGDPACYEM

SEQ ID NO: 56620 - protein, 10 aa, Artificial Sequence
  Description of Artificial Sequence: Synthetic peptide
  Seed: MEVDPIGHLY (MAGA3_HUMAN)
MQVDPIGHLI

SEQ ID NO: 56621 - protein, 11 aa, Artificial Sequence
  Description of Artificial Sequence: Synthetic peptide
  Seed: STFPDLESEFQ (MAGA3_HUMAN)
SVFPDLESEFR

SEQ ID NO: 56622 - protein, 9 aa, Artificial Sequence
  Description of Artificial Sequence: Synthetic peptide
  Seed: GSDPACYEF (MAGA3_HUMAN)
GLDPACYEY

SEQ ID NO: 56623 - protein, 9 aa, Artificial Sequence
  Description of Artificial Sequence: Synthetic peptide
  Seed: SYVKVLHHM (MAGA3_HUMAN)
SQVKVLHHL

SEQ ID NO: 56624 - protein, 9 aa, Artificial Sequence
  Description of Artificial Sequence: Synthetic peptide
  Seed: KVAELVHFL (MAGA3_HUMAN)
KVAELVHFM

SEQ ID NO: 56625 - protein, 9 aa, Artificial Sequence
  Description of Artificial Sequence: Synthetic peptide
  Seed: SVVGNWQYF (MAGA3_HUMAN)
SSVGNWQYY

SEQ ID NO: 56626 - protein, 9 aa, Artificial Sequence
  Description of Artificial Sequence: Synthetic peptide
  Seed: ISGGPHISY (MAGA3_HUMAN)
ISGGPHISI

SEQ ID NO: 56627 - protein, 11 aa, Artificial Sequence
  Description of Artificial Sequence: Synthetic peptide
  Seed: SNQEEEGPSTF (MAGA3_HUMAN)
SIQEEEGPSTY

SEQ ID NO: 56628 - protein, 10 aa, Artificial Sequence
  Description of Artificial Sequence: Synthetic peptide
  Seed: HISYPPLHEW (MAGA3_HUMAN)
HDSYPPLHEM

SEQ ID NO: 56629 - protein, 9 aa, Artificial Sequence
  Description of Artificial Sequence: Synthetic peptide
  Seed: GLVGAQAPA (MAGA3_HUMAN)
GLVGAQAPI

SEQ ID NO: 56630 - protein, 9 aa, Artificial Sequence
  Description of Artificial Sequence: Synthetic peptide
  Seed: GASSLPTTM (MAGA3_HUMAN)
GYSSLPTTL

SEQ ID NO: 56631 - protein, 9 aa, Artificial Sequence
  Description of Artificial Sequence: Synthetic peptide
  Seed: SSLPTTMNY (MAGA3_HUMAN)
SALPTTMNK

SEQ ID NO: 56632 - protein, 10 aa, Artificial Sequence
  Description of Artificial Sequence: Synthetic peptide
  Seed: QGASSLPTTM (MAGA3_HUMAN)
QAASSLPTTF

SEQ ID NO: 56633 - protein, 10 aa, Artificial Sequence
  Description of Artificial Sequence: Synthetic peptide
  Seed: VIFSKASSSL (MAGA3_HUMAN)
VQFSKASSSM

SEQ ID NO: 56634 - protein, 8 aa, Artificial Sequence
  Description of Artificial Sequence: Synthetic peptide
  Seed: FPDLESEF (MAGA3_HUMAN)
FQDLESEM

SEQ ID NO: 56635 - protein, 9 aa, Artificial Sequence
  Description of Artificial Sequence: Synthetic peptide
  Seed: LPTTMNYPL (MAGA3_HUMAN)
LHTTMNYPI

SEQ ID NO: 56636 - protein, 9 aa, Artificial Sequence
  Description of Artificial Sequence: Synthetic peptide
  Seed: AQAPATEEQ (MAGA3_HUMAN)
AAAPATEEM

SEQ ID NO: 56637 - protein, 9 aa, Artificial Sequence
  Description of Artificial Sequence: Synthetic peptide
  Seed: GEVPAAESP (MAGA3_HUMAN)
GEVPAAESI

SEQ ID NO: 56638 - protein, 11 aa, Artificial Sequence
  Description of Artificial Sequence: Synthetic peptide
  Seed: VEVTLGEVPAA (MAGA3_HUMAN)
VEVTLGEVPAM

SEQ ID NO: 56639 - protein, 10 aa, Artificial Sequence
  Description of Artificial Sequence: Synthetic peptide
  Seed: MVKISGGPHI (MAGA3_HUMAN)
MLKISGGPHF

SEQ ID NO: 56640 - protein, 9 aa, Artificial Sequence
  Description of Artificial Sequence: Synthetic peptide
  Seed: SSLQLVFGI (MAGA3_HUMAN)
SLLQLVFGC

SEQ ID NO: 56641 - protein, 9 aa, Artificial Sequence
  Description of Artificial Sequence: Synthetic peptide
  Seed: YFFPVIFSK (MAGA3_HUMAN)
YLFPVIFSF

SEQ ID NO: 56642 - protein, 11 aa, Artificial Sequence
  Description of Artificial Sequence: Synthetic peptide
  Seed: RQVPGSDPACY (MAGA3_HUMAN)
RIVPGSDPACR

SEQ ID NO: 56643 - protein, 9 aa, Artificial Sequence
  Description of Artificial Sequence: Synthetic peptide
  Seed: FQAALSRKV (MAGA3_HUMAN)
FSAALSRKL

SEQ ID NO: 56644 - protein, 11 aa, Artificial Sequence
  Description of Artificial Sequence: Synthetic peptide
  Seed: LMEVDPIGHLY (MAGA3_HUMAN)
LIEVDPIGHLY

SEQ ID NO: 56645 - protein, 10 aa, Artificial Sequence
  Description of Artificial Sequence: Synthetic peptide
  Seed: FFPVIFSKAS (MAGA3_HUMAN)
FVPVIFSKAA

SEQ ID NO: 56646 - protein, 11 aa, Artificial Sequence
  Description of Artificial Sequence: Synthetic peptide
  Seed: SNQEEEGPSTF (MAGA3_HUMAN)
SQQEEEGPSTL

SEQ ID NO: 56647 - protein, 9 aa, Artificial Sequence
  Description of Artificial Sequence: Synthetic peptide
  Seed: GASSLPTTM (MAGA3_HUMAN)
GFSSLPTTL

SEQ ID NO: 56648 - protein, 9 aa, Artificial Sequence
  Description of Artificial Sequence: Synthetic peptide
  Seed: SVVGNWQYF (MAGA3_HUMAN)
SKVGNWQYM

SEQ ID NO: 56649 - protein, 9 aa, Artificial Sequence
  Description of Artificial Sequence: Synthetic peptide
  Seed: EALGLVGAQ (MAGA3_HUMAN)
ESLGLVGAK

SEQ ID NO: 56650 - protein, 9 aa, Artificial Sequence
  Description of Artificial Sequence: Synthetic peptide
  Seed: KAGLLIIVL (MAGA3_HUMAN)
KTGLLIIVL

SEQ ID NO: 56651 - protein, 11 aa, Artificial Sequence
  Description of Artificial Sequence: Synthetic peptide
  Seed: MLGSVVGNWQY (MAGA3_HUMAN)
MVGSVVGNWQW

SEQ ID NO: 56652 - protein, 9 aa, Artificial Sequence
  Description of Artificial Sequence: Synthetic peptide
  Seed: GNWQYFFPV (MAGA3_HUMAN)
GSWQYFFPV

SEQ ID NO: 56653 - protein, 9 aa, Artificial Sequence
  Description of Artificial Sequence: Synthetic peptide
  Seed: MEVDPIGHL (MAGA3_HUMAN)
MMVDPIGHY

SEQ ID NO: 56654 - protein, 9 aa, Artificial Sequence
  Description of Artificial Sequence: Synthetic peptide
  Seed: SYPPLHEWV (MAGA3_HUMAN)
SYPPLHEWI

SEQ ID NO: 56655 - protein, 10 aa, Artificial Sequence
  Description of Artificial Sequence: Synthetic peptide
  Seed: FSKASSSLQL (MAGA3_HUMAN)
FQKASSSLQF

SEQ ID NO: 56656 - protein, 11 aa, Artificial Sequence
  Description of Artificial Sequence: Synthetic peptide
  Seed: ELSVLEVFEGR (MAGA3_HUMAN)
EVSVLEVFEGR

SEQ ID NO: 56657 - protein, 10 aa, Artificial Sequence
  Description of Artificial Sequence: Synthetic peptide
  Seed: YFFPVIFSKA (MAGA3_HUMAN)
YSFPVIFSKV

SEQ ID NO: 56658 - protein, 11 aa, Artificial Sequence
  Description of Artificial Sequence: Synthetic peptide
  Seed: LGSVVGNWQYF (MAGA3_HUMAN)
LISVVGNWQYW

SEQ ID NO: 56659 - protein, 10 aa, Artificial Sequence
  Description of Artificial Sequence: Synthetic peptide
  Seed: MEVDPIGHLY (MAGA3_HUMAN)
MYVDPIGHLF

SEQ ID NO: 56660 - protein, 10 aa, Artificial Sequence
  Description of Artificial Sequence: Synthetic peptide
  Seed: TSYVKVLHHM (MAGA3_HUMAN)
TMYVKVLHHW

SEQ ID NO: 56661 - protein, 9 aa, Artificial Sequence
  Description of Artificial Sequence: Synthetic peptide
  Seed: TQHFVQENY (MAGA3_HUMAN)
TEHFVQENY

SEQ ID NO: 56662 - protein, 9 aa, Artificial Sequence
  Description of Artificial Sequence: Synthetic peptide
  Seed: TSYVKVLHH (MAGA3_HUMAN)
TTYVKVLHK

SEQ ID NO: 56663 - protein, 10 aa, Artificial Sequence
  Description of Artificial Sequence: Synthetic peptide
  Seed: GPRALVETSY (MAGA3_HUMAN)
GLRALVETSY

SEQ ID NO: 56664 - protein, 9 aa, Artificial Sequence
  Description of Artificial Sequence: Synthetic peptide
  Seed: ISGGPHISY (MAGA3_HUMAN)
IYGGPHISI

SEQ ID NO: 56665 - protein, 9 aa, Artificial Sequence
  Description of Artificial Sequence: Synthetic peptide
  Seed: EAASSSSTL (MAGA3_HUMAN)
ESASSSSTR

SEQ ID NO: 56666 - protein, 10 aa, Artificial Sequence
  Description of Artificial Sequence: Synthetic peptide
  Seed: RKVAELVHFL (MAGA3_HUMAN)
RMVAELVHFF

SEQ ID NO: 56667 - protein, 9 aa, Artificial Sequence
  Description of Artificial Sequence: Synthetic peptide
  Seed: KIWEELSVL (MAGA3_HUMAN)
KIWEELSVR

SEQ ID NO: 56668 - protein, 9 aa, Artificial Sequence
  Description of Artificial Sequence: Synthetic peptide
  Seed: FATCLGLSY (MAGA3_HUMAN)
FTTCLGLSM

SEQ ID NO: 56669 - protein, 9 aa, Artificial Sequence
  Description of Artificial Sequence: Synthetic peptide
  Seed: SSLQLVFGI (MAGA3_HUMAN)
SQLQLVFGV

SEQ ID NO: 56670 - protein, 8 aa, Artificial Sequence
  Description of Artificial Sequence: Synthetic peptide
  Seed: YPLWSQSY (MAGA3_HUMAN)
YFLWSQSM

SEQ ID NO: 56671 - protein, 10 aa, Artificial Sequence
  Description of Artificial Sequence: Synthetic peptide
  Seed: EVFEGREDSI (MAGA3_HUMAN)
ELFEGREDSW

SEQ ID NO: 56672 - protein, 9 aa, Artificial Sequence
  Description of Artificial Sequence: Synthetic peptide
  Seed: GSDPACYEF (MAGA3_HUMAN)
GGDPACYEL

SEQ ID NO: 56673 - protein, 9 aa, Artificial Sequence
  Description of Artificial Sequence: Synthetic peptide
  Seed: SILGDPKKL (MAGA3_HUMAN)
SRLGDPKKL

SEQ ID NO: 56674 - protein, 10 aa, Artificial Sequence
  Description of Artificial Sequence: Synthetic peptide
  Seed: WQYFFPVIFS (MAGA3_HUMAN)
WKYFFPVIFF

SEQ ID NO: 56675 - protein, 9 aa, Artificial Sequence
  Description of Artificial Sequence: Synthetic peptide
  Seed: RQVPGSDPA (MAGA3_HUMAN)
RKVPGSDPM

SEQ ID NO: 56676 - protein, 9 aa, Artificial Sequence
  Description of Artificial Sequence: Synthetic peptide
  Seed: ISGGPHISY (MAGA3_HUMAN)
IYGGPHISV

SEQ ID NO: 56677 - protein, 9 aa, Artificial Sequence
  Description of Artificial Sequence: Synthetic peptide
  Seed: RALVETSYV (MAGA3_HUMAN)
RILVETSYF

SEQ ID NO: 56678 - protein, 9 aa, Artificial Sequence
  Description of Artificial Sequence: Synthetic peptide
  Seed: GSDPACYEF (MAGA3_HUMAN)
GQDPACYEF

SEQ ID NO: 56679 - protein, 9 aa, Artificial Sequence
  Description of Artificial Sequence: Synthetic peptide
  Seed: LESEFQAAL (MAGA3_HUMAN)
LESEFQAAY

SEQ ID NO: 56680 - protein, 8 aa, Artificial Sequence
  Description of Artificial Sequence: Synthetic peptide
  Seed: FPDLESEF (MAGA3_HUMAN)
FYDLESEM

SEQ ID NO: 56681 - protein, 9 aa, Artificial Sequence
  Description of Artificial Sequence: Synthetic peptide
  Seed: AQAPATEEQ (MAGA3_HUMAN)
AEAPATEEY

SEQ ID NO: 56682 - protein, 9 aa, Artificial Sequence
  Description of Artificial Sequence: Synthetic peptide
  Seed: WQYFFPVIF (MAGA3_HUMAN)
WAYFFPVIL

SEQ ID NO: 56683 - protein, 9 aa, Artificial Sequence
  Description of Artificial Sequence: Synthetic peptide
  Seed: ALSRKVAEL (MAGA3_HUMAN)
ARSRKVAEL

SEQ ID NO: 56684 - protein, 9 aa, Artificial Sequence
  Description of Artificial Sequence: Synthetic peptide
  Seed: MPKAGLLII (MAGA3_HUMAN)
MLKAGLLIF

SEQ ID NO: 56685 - protein, 10 aa, Artificial Sequence
  Description of Artificial Sequence: Synthetic peptide
  Seed: VTKAEMLGSV (MAGA3_HUMAN)
VLKAEMLGSL

SEQ ID NO: 56686 - protein, 9 aa, Artificial Sequence
  Description of Artificial Sequence: Synthetic peptide
  Seed: QIMPKAGLL (MAGA3_HUMAN)
QLMPKAGLL

SEQ ID NO: 56687 - protein, 9 aa, Artificial Sequence
  Description of Artificial Sequence: Synthetic peptide
  Seed: FVQENYLEY (MAGA3_HUMAN)
FTQENYLER

SEQ ID NO: 56688 - protein, 10 aa, Artificial Sequence
  Description of Artificial Sequence: Synthetic peptide
  Seed: KASSSLQLVF (MAGA3_HUMAN)
KCSSSLQLVI

SEQ ID NO: 56689 - protein, 9 aa, Artificial Sequence
  Description of Artificial Sequence: Synthetic peptide
  Seed: KIWEELSVL (MAGA3_HUMAN)
KMWEELSVM

SEQ ID NO: 56690 - protein, 9 aa, Artificial Sequence
  Description of Artificial Sequence: Synthetic peptide
  Seed: YIFATCLGL (MAGA3_HUMAN)
YMFATCLGI

SEQ ID NO: 56691 - protein, 10 aa, Artificial Sequence
  Description of Artificial Sequence: Synthetic peptide
  Seed: ESPDPPQSPQ (MAGA3_HUMAN)
ESPDPPQSPR

SEQ ID NO: 56692 - protein, 9 aa, Artificial Sequence
  Description of Artificial Sequence: Synthetic peptide
  Seed: SILGDPKKL (MAGA3_HUMAN)
SALGDPKKL

SEQ ID NO: 56693 - protein, 10 aa, Artificial Sequence
  Description of Artificial Sequence: Synthetic peptide
  Seed: KAEMLGSVVG (MAGA3_HUMAN)
KDEMLGSVVV

SEQ ID NO: 56694 - protein, 10 aa, Artificial Sequence
  Description of Artificial Sequence: Synthetic peptide
  Seed: AALSRKVAEL (MAGA3_HUMAN)
AMLSRKVAEA

SEQ ID NO: 56695 - protein, 9 aa, Artificial Sequence
  Description of Artificial Sequence: Synthetic peptide
  Seed: SSTLVEVTL (MAGA3_HUMAN)
SMTLVEVTV

SEQ ID NO: 56696 - protein, 10 aa, Artificial Sequence
  Description of Artificial Sequence: Synthetic peptide
  Seed: MNYPLWSQSY (MAGA3_HUMAN)
MPYPLWSQSL

SEQ ID NO: 56697 - protein, 9 aa, Artificial Sequence
  Description of Artificial Sequence: Synthetic peptide
  Seed: YVKVLHHMV (MAGA3_HUMAN)
YAKVLHHML

SEQ ID NO: 56698 - protein, 10 aa, Artificial Sequence
  Description of Artificial Sequence: Synthetic peptide
  Seed: MEVDPIGHLY (MAGA3_HUMAN)
MLVDPIGHLF

SEQ ID NO: 56699 - protein, 10 aa, Artificial Sequence
  Description of Artificial Sequence: Synthetic peptide
  Seed: MVKISGGPHI (MAGA3_HUMAN)
MTKISGGPHK

SEQ ID NO: 56700 - protein, 9 aa, Artificial Sequence
  Description of Artificial Sequence: Synthetic peptide
  Seed: FVQENYLEY (MAGA3_HUMAN)
FAQENYLER

SEQ ID NO: 56701 - protein, 9 aa, Artificial Sequence
  Description of Artificial Sequence: Synthetic peptide
  Seed: ASSSLQLVF (MAGA3_HUMAN)
ALSSLQLVW

SEQ ID NO: 56702 - protein, 9 aa, Artificial Sequence
  Description of Artificial Sequence: Synthetic peptide
  Seed: VAELVHFLL (MAGA3_HUMAN)
VSELVHFLF

SEQ ID NO: 56703 - protein, 11 aa, Artificial Sequence
  Description of Artificial Sequence: Synthetic peptide
  Seed: LGSVVGNWQYF (MAGA3_HUMAN)
LASVVGNWQYW

SEQ ID NO: 56704 - protein, 10 aa, Artificial Sequence
  Description of Artificial Sequence: Synthetic peptide
  Seed: LGLVGAQAPA (MAGA3_HUMAN)
LILVGAQAPL

SEQ ID NO: 56705 - protein, 9 aa, Artificial Sequence
  Description of Artificial Sequence: Synthetic peptide
  Seed: EVDPIGHLY (MAGA3_HUMAN)
EPDPIGHLY

SEQ ID NO: 56706 - protein, 9 aa, Artificial Sequence
  Description of Artificial Sequence: Synthetic peptide
  Seed: KIWEELSVL (MAGA3_HUMAN)
KEWEELSVY

SEQ ID NO: 56707 - protein, 9 aa, Artificial Sequence
  Description of Artificial Sequence: Synthetic peptide
  Seed: TFPDLESEF (MAGA3_HUMAN)
TMPDLESEY

SEQ ID NO: 56708 - protein, 9 aa, Artificial Sequence
  Description of Artificial Sequence: Synthetic peptide
  Seed: KVAELVHFL (MAGA3_HUMAN)
KVAELVHFI

SEQ ID NO: 56709 - protein, 9 aa, Artificial Sequence
  Description of Artificial Sequence: Synthetic peptide
  Seed: KVAELVHFL (MAGA3_HUMAN)
KMAELVHFP

SEQ ID NO: 56710 - protein, 10 aa, Artificial Sequence
  Description of Artificial Sequence: Synthetic peptide
  Seed: NWQYFFPVIF (MAGA3_HUMAN)
NGQYFFPVIF

SEQ ID NO: 56711 - protein, 9 aa, Artificial Sequence
  Description of Artificial Sequence: Synthetic peptide
  Seed: EVTLGEVPA (MAGA3_HUMAN)
ETTLGEVPI

SEQ ID NO: 56712 - protein, 10 aa, Artificial Sequence
  Description of Artificial Sequence: Synthetic peptide
  Seed: NWQYFFPVIF (MAGA3_HUMAN)
NSQYFFPVIM

SEQ ID NO: 56713 - protein, 10 aa, Artificial Sequence
  Description of Artificial Sequence: Synthetic peptide
  Seed: VDPIGHLYIF (MAGA3_HUMAN)
VFPIGHLYIW

SEQ ID NO: 56714 - protein, 9 aa, Artificial Sequence
  Description of Artificial Sequence: Synthetic peptide
  Seed: SSLPTTMNY (MAGA3_HUMAN)
SNLPTTMNK

SEQ ID NO: 56715 - protein, 9 aa, Artificial Sequence
  Description of Artificial Sequence: Synthetic peptide
  Seed: RQVPGSDPA (MAGA3_HUMAN)
RSVPGSDPY

SEQ ID NO: 56716 - protein, 9 aa, Artificial Sequence
  Description of Artificial Sequence: Synthetic peptide
  Seed: KIWEELSVL (MAGA3_HUMAN)
KQWEELSVF

SEQ ID NO: 56717 - protein, 11 aa, Artificial Sequence
  Description of Artificial Sequence: Synthetic peptide
  Seed: LSRKVAELVHF (MAGA3_HUMAN)
LSRKVAELVHW

SEQ ID NO: 56718 - protein, 10 aa, Artificial Sequence
  Description of Artificial Sequence: Synthetic peptide
  Seed: LPTTMNYPLW (MAGA3_HUMAN)
LSTTMNYPLY

SEQ ID NO: 56719 - protein, 11 aa, Artificial Sequence
  Description of Artificial Sequence: Synthetic peptide
  Seed: GEALGLVGAQA (MAGA3_HUMAN)
GEALGLVGAQV

SEQ ID NO: 56720 - protein, 10 aa, Artificial Sequence
  Description of Artificial Sequence: Synthetic peptide
  Seed: GSVVGNWQYF (MAGA3_HUMAN)
GTVVGNWQYW

SEQ ID NO: 56721 - protein, 9 aa, Artificial Sequence
  Description of Artificial Sequence: Synthetic peptide
  Seed: EVDPIGHLY (MAGA3_HUMAN)
EIDPIGHLI

SEQ ID NO: 56722 - protein, 9 aa, Artificial Sequence
  Description of Artificial Sequence: Synthetic peptide
  Seed: YVKVLHHMV (MAGA3_HUMAN)
YIKVLHHMM

SEQ ID NO: 56723 - protein, 9 aa, Artificial Sequence
  Description of Artificial Sequence: Synthetic peptide
  Seed: SSLQLVFGI (MAGA3_HUMAN)
SSLQLVFGL

SEQ ID NO: 56724 - protein, 10 aa, Artificial Sequence
  Description of Artificial Sequence: Synthetic peptide
  Seed: SDPACYEFLW (MAGA3_HUMAN)
SPPACYEFLW

SEQ ID NO: 56725 - protein, 9 aa, Artificial Sequence
  Description of Artificial Sequence: Synthetic peptide
  Seed: RQVPGSDPA (MAGA3_HUMAN)
RMVPGSDPH

SEQ ID NO: 56726 - protein, 9 aa, Artificial Sequence
  Description of Artificial Sequence: Synthetic peptide
  Seed: RALVETSYV (MAGA3_HUMAN)
RLLVETSYY

SEQ ID NO: 56727 - protein, 9 aa, Artificial Sequence
  Description of Artificial Sequence: Synthetic peptide
  Seed: FQAALSRKV (MAGA3_HUMAN)
FAAALSRKY

SEQ ID NO: 56728 - protein, 10 aa, Artificial Sequence
  Description of Artificial Sequence: Synthetic peptide
  Seed: VDPIGHLYIF (MAGA3_HUMAN)
VKPIGHLYIW

SEQ ID NO: 56729 - protein, 10 aa, Artificial Sequence
  Description of Artificial Sequence: Synthetic peptide
  Seed: FFPVIFSKAS (MAGA3_HUMAN)
FFPVIFSKAV

SEQ ID NO: 56730 - protein, 10 aa, Artificial Sequence
  Description of Artificial Sequence: Synthetic peptide
  Seed: FFPVIFSKAS (MAGA3_HUMAN)
FVPVIFSKAV

SEQ ID NO: 56731 - protein, 10 aa, Artificial Sequence
  Description of Artificial Sequence: Synthetic peptide
  Seed: RQVPGSDPAC (MAGA3_HUMAN)
REVPGSDPAT

SEQ ID NO: 56732 - protein, 10 aa, Artificial Sequence
  Description of Artificial Sequence: Synthetic peptide
  Seed: YEDSSNQEEE (MAGA3_HUMAN)
YEDSSNQEEV

SEQ ID NO: 56733 - protein, 9 aa, Artificial Sequence
  Description of Artificial Sequence: Synthetic peptide
  Seed: SVLEVFEGR (MAGA3_HUMAN)
SALEVFEGR

SEQ ID NO: 56734 - protein, 8 aa, Artificial Sequence
  Description of Artificial Sequence: Synthetic peptide
  Seed: SGGPHISY (MAGA3_HUMAN)
SRGPHISF

SEQ ID NO: 56735 - protein, 9 aa, Artificial Sequence
  Description of Artificial Sequence: Synthetic peptide
  Seed: LQLVFGIEL (MAGA3_HUMAN)
LQLVFGIEF

SEQ ID NO: 56736 - protein, 9 aa, Artificial Sequence
  Description of Artificial Sequence: Synthetic peptide
  Seed: KIWEELSVL (MAGA3_HUMAN)
KIWEELSVF

SEQ ID NO: 56737 - protein, 9 aa, Artificial Sequence
  Description of Artificial Sequence: Synthetic peptide
  Seed: YPPLHEWVL (MAGA3_HUMAN)
YQPLHEWVL

SEQ ID NO: 56738 - protein, 10 aa, Artificial Sequence
  Description of Artificial Sequence: Synthetic peptide
  Seed: REGDCAPEEK (MAGA3_HUMAN)
RTGDCAPEEY

SEQ ID NO: 56739 - protein, 8 aa, Artificial Sequence
  Description of Artificial Sequence: Synthetic peptide
  Seed: RALVETSY (MAGA3_HUMAN)
RMLVETSF

SEQ ID NO: 56740 - protein, 9 aa, Artificial Sequence
  Description of Artificial Sequence: Synthetic peptide
  Seed: NYPLWSQSY (MAGA3_HUMAN)
NMPLWSQSM

SEQ ID NO: 56741 - protein, 10 aa, Artificial Sequence
  Description of Artificial Sequence: Synthetic peptide
  Seed: LVFGIELMEV (MAGA3_HUMAN)
LLFGIELMEV

SEQ ID NO: 56742 - protein, 9 aa, Artificial Sequence
  Description of Artificial Sequence: Synthetic peptide
  Seed: WQYFFPVIF (MAGA3_HUMAN)
WMYFFPVIM

SEQ ID NO: 56743 - protein, 9 aa, Artificial Sequence
  Description of Artificial Sequence: Synthetic peptide
  Seed: TFPDLESEF (MAGA3_HUMAN)
TPPDLESEY

SEQ ID NO: 56744 - protein, 9 aa, Artificial Sequence
  Description of Artificial Sequence: Synthetic peptide
  Seed: GPHISYPPL (MAGA3_HUMAN)
GPHISYPPI

SEQ ID NO: 56745 - protein, 10 aa, Artificial Sequence
  Description of Artificial Sequence: Synthetic peptide
  Seed: SDPACYEFLW (MAGA3_HUMAN)
SYPACYEFLF

SEQ ID NO: 56746 - protein, 10 aa, Artificial Sequence
  Description of Artificial Sequence: Synthetic peptide
  Seed: FFPVIFSKAS (MAGA3_HUMAN)
FQPVIFSKAV

SEQ ID NO: 56747 - protein, 10 aa, Artificial Sequence
  Description of Artificial Sequence: Synthetic peptide
  Seed: ISYPPLHEWV (MAGA3_HUMAN)
IWYPPLHEWL

SEQ ID NO: 56748 - protein, 10 aa, Artificial Sequence
  Description of Artificial Sequence: Synthetic peptide
  Seed: KASSSLQLVF (MAGA3_HUMAN)
KASSSLQLVI

SEQ ID NO: 56749 - protein, 9 aa, Artificial Sequence
  Description of Artificial Sequence: Synthetic peptide
  Seed: FQAALSRKV (MAGA3_HUMAN)
FLAALSRKF

SEQ ID NO: 56750 - protein, 9 aa, Artificial Sequence
  Description of Artificial Sequence: Synthetic peptide
  Seed: LESEFQAAL (MAGA3_HUMAN)
LLSEFQAAM

SEQ ID NO: 56751 - protein, 9 aa, Artificial Sequence
  Description of Artificial Sequence: Synthetic peptide
  Seed: MEVDPIGHL (MAGA3_HUMAN)
MRVDPIGHF

SEQ ID NO: 56752 - protein, 9 aa, Artificial Sequence
  Description of Artificial Sequence: Synthetic peptide
  Seed: GSDPACYEF (MAGA3_HUMAN)
GTDPACYEW

SEQ ID NO: 56753 - protein, 9 aa, Artificial Sequence
  Description of Artificial Sequence: Synthetic peptide
  Seed: EELSVLEVF (MAGA3_HUMAN)
EELSVLEVA

SEQ ID NO: 56754 - protein, 10 aa, Artificial Sequence
  Description of Artificial Sequence: Synthetic peptide
  Seed: IFATCLGLSY (MAGA3_HUMAN)
ITATCLGLSM

SEQ ID NO: 56755 - protein, 10 aa, Artificial Sequence
  Description of Artificial Sequence: Synthetic peptide
  Seed: ELMEVDPIGH (MAGA3_HUMAN)
EVMEVDPIGK

SEQ ID NO: 56756 - protein, 10 aa, Artificial Sequence
  Description of Artificial Sequence: Synthetic peptide
  Seed: RALVETSYVK (MAGA3_HUMAN)
RILVETSYVR

SEQ ID NO: 56757 - protein, 9 aa, Artificial Sequence
  Description of Artificial Sequence: Synthetic peptide
  Seed: GNWQYFFPV (MAGA3_HUMAN)
GLWQYFFPA

SEQ ID NO: 56758 - protein, 11 aa, Artificial Sequence
  Description of Artificial Sequence: Synthetic peptide
  Seed: SNQEEEGPSTF (MAGA3_HUMAN)
SVQEEEGPSTY

SEQ ID NO: 56759 - protein, 9 aa, Artificial Sequence
  Description of Artificial Sequence: Synthetic peptide
  Seed: RQVPGSDPA (MAGA3_HUMAN)
RQVPGSDPW

SEQ ID NO: 56760 - protein, 11 aa, Artificial Sequence
  Description of Artificial Sequence: Synthetic peptide
  Seed: ISYPPLHEWVL (MAGA3_HUMAN)
IMYPPLHEWVF

SEQ ID NO: 56761 - protein, 9 aa, Artificial Sequence
  Description of Artificial Sequence: Synthetic peptide
  Seed: HHMVKISGG (MAGA3_HUMAN)
HHMVKISGI

SEQ ID NO: 56762 - protein, 9 aa, Artificial Sequence
  Description of Artificial Sequence: Synthetic peptide
  Seed: FVQENYLEY (MAGA3_HUMAN)
FFQENYLEL

SEQ ID NO: 56763 - protein, 9 aa, Artificial Sequence
  Description of Artificial Sequence: Synthetic peptide
  Seed: ALSRKVAEL (MAGA3_HUMAN)
AMSRKVAEY

SEQ ID NO: 56764 - protein, 11 aa, Artificial Sequence
  Description of Artificial Sequence: Synthetic peptide
  Seed: AEMLGSVVGNW (MAGA3_HUMAN)
ATMLGSVVGNW

SEQ ID NO: 56765 - protein, 9 aa, Artificial Sequence
  Description of Artificial Sequence: Synthetic peptide
  Seed: TSYVKVLHH (MAGA3_HUMAN)
TTYVKVLHY

SEQ ID NO: 56766 - protein, 10 aa, Artificial Sequence
  Description of Artificial Sequence: Synthetic peptide
  Seed: WQYFFPVIFS (MAGA3_HUMAN)
WMYFFPVIFY

SEQ ID NO: 56767 - protein, 9 aa, Artificial Sequence
  Description of Artificial Sequence: Synthetic peptide
  Seed: LGDPKKLLT (MAGA3_HUMAN)
LCDPKKLLL

SEQ ID NO: 56768 - protein, 9 aa, Artificial Sequence
  Description of Artificial Sequence: Synthetic peptide
  Seed: KAEMLGSVV (MAGA3_HUMAN)
KAEMLGSVM

SEQ ID NO: 56769 - protein, 10 aa, Artificial Sequence
  Description of Artificial Sequence: Synthetic peptide
  Seed: YFFPVIFSKA (MAGA3_HUMAN)
YLFPVIFSKA

SEQ ID NO: 56770 - protein, 8 aa, Artificial Sequence
  Description of Artificial Sequence: Synthetic peptide
  Seed: SYPPLHEW (MAGA3_HUMAN)
SRPPLHEY

SEQ ID NO: 56771 - protein, 10 aa, Artificial Sequence
  Description of Artificial Sequence: Synthetic peptide
  Seed: LVHFLLLKYR (MAGA3_HUMAN)
LTHFLLLKYR

SEQ ID NO: 56772 - protein, 9 aa, Artificial Sequence
  Description of Artificial Sequence: Synthetic peptide
  Seed: GEVPAAESP (MAGA3_HUMAN)
GDVPAAESL

SEQ ID NO: 56773 - protein, 9 aa, Artificial Sequence
  Description of Artificial Sequence: Synthetic peptide
  Seed: FPVIFSKAS (MAGA3_HUMAN)
FPVIFSKAM

SEQ ID NO: 56774 - protein, 10 aa, Artificial Sequence
  Description of Artificial Sequence: Synthetic peptide
  Seed: KVAELVHFLL (MAGA3_HUMAN)
KIAELVHFLV

SEQ ID NO: 56775 - protein, 9 aa, Artificial Sequence
  Description of Artificial Sequence: Synthetic peptide
  Seed: KVLHHMVKI (MAGA3_HUMAN)
KNLHHMVKY

SEQ ID NO: 56776 - protein, 9 aa, Artificial Sequence
  Description of Artificial Sequence: Synthetic peptide
  Seed: KVLHHMVKI (MAGA3_HUMAN)
KCLHHMVKW

SEQ ID NO: 56777 - protein, 9 aa, Artificial Sequence
  Description of Artificial Sequence: Synthetic peptide
  Seed: SSSSTLVEV (MAGA3_HUMAN)
SVSSTLVEI

SEQ ID NO: 56778 - protein, 8 aa, Artificial Sequence
  Description of Artificial Sequence: Synthetic peptide
  Seed: SYPPLHEW (MAGA3_HUMAN)
STPPLHEW

SEQ ID NO: 56779 - protein, 10 aa, Artificial Sequence
  Description of Artificial Sequence: Synthetic peptide
  Seed: KAEMLGSVVG (MAGA3_HUMAN)
KHEMLGSVVV

SEQ ID NO: 56780 - protein, 10 aa, Artificial Sequence
  Description of Artificial Sequence: Synthetic peptide
  Seed: QEAASSSSTL (MAGA3_HUMAN)
QEAASSSSTY

SEQ ID NO: 56781 - protein, 11 aa, Artificial Sequence
  Description of Artificial Sequence: Synthetic peptide
  Seed: NQIMPKAGLLI (MAGA3_HUMAN)
NHIMPKAGLLL

SEQ ID NO: 56782 - protein, 9 aa, Artificial Sequence
  Description of Artificial Sequence: Synthetic peptide
  Seed: ISYPPLHEW (MAGA3_HUMAN)
IMYPPLHEY

SEQ ID NO: 56783 - protein, 9 aa, Artificial Sequence
  Description of Artificial Sequence: Synthetic peptide
  Seed: DPIGHLYIF (MAGA3_HUMAN)
DAIGHLYIY

SEQ ID NO: 56784 - protein, 9 aa, Artificial Sequence
  Description of Artificial Sequence: Synthetic peptide
  Seed: KVAELVHFL (MAGA3_HUMAN)
KAAELVHFA

SEQ ID NO: 56785 - protein, 8 aa, Artificial Sequence
  Description of Artificial Sequence: Synthetic peptide
  Seed: KKLLTQHF (MAGA3_HUMAN)
KQLLTQHY

SEQ ID NO: 56786 - protein, 10 aa, Artificial Sequence
  Description of Artificial Sequence: Synthetic peptide
  Seed: LYIFATCLGL (MAGA3_HUMAN)
LYIFATCLGW

SEQ ID NO: 56787 - protein, 10 aa, Artificial Sequence
  Description of Artificial Sequence: Synthetic peptide
  Seed: GSDPACYEFL (MAGA3_HUMAN)
GVDPACYEFY

SEQ ID NO: 56788 - protein, 9 aa, Artificial Sequence
  Description of Artificial Sequence: Synthetic peptide
  Seed: ISGGPHISY (MAGA3_HUMAN)
IAGGPHISW

SEQ ID NO: 56789 - protein, 10 aa, Artificial Sequence
  Description of Artificial Sequence: Synthetic peptide
  Seed: WEELSVLEVF (MAGA3_HUMAN)
WVELSVLEVW

SEQ ID NO: 56790 - protein, 11 aa, Artificial Sequence
  Description of Artificial Sequence: Synthetic peptide
  Seed: KIWEELSVLEV (MAGA3_HUMAN)
KLWEELSVLEF

SEQ ID NO: 56791 - protein, 9 aa, Artificial Sequence
  Description of Artificial Sequence: Synthetic peptide
  Seed: LSRKVAELV (MAGA3_HUMAN)
LARKVAELK

SEQ ID NO: 56792 - protein, 10 aa, Artificial Sequence
  Description of Artificial Sequence: Synthetic peptide
  Seed: HFVQENYLEY (MAGA3_HUMAN)
HQVQENYLEF

SEQ ID NO: 56793 - protein, 9 aa, Artificial Sequence
  Description of Artificial Sequence: Synthetic peptide
  Seed: EALGLVGAQ (MAGA3_HUMAN)
EVLGLVGAM

SEQ ID NO: 56794 - protein, 9 aa, Artificial Sequence
  Description of Artificial Sequence: Synthetic peptide
  Seed: LESEFQAAL (MAGA3_HUMAN)
LQSEFQAAA

SEQ ID NO: 56795 - protein, 10 aa, Artificial Sequence
  Description of Artificial Sequence: Synthetic peptide
  Seed: LQLVFGIELM (MAGA3_HUMAN)
LCLVFGIELL

SEQ ID NO: 56796 - protein, 10 aa, Artificial Sequence
  Description of Artificial Sequence: Synthetic peptide
  Seed: HFLLLKYRAR (MAGA3_HUMAN)
HMLLLKYRAR

SEQ ID NO: 56797 - protein, 9 aa, Artificial Sequence
  Description of Artificial Sequence: Synthetic peptide
  Seed: QIMPKAGLL (MAGA3_HUMAN)
QIMPKAGLR

SEQ ID NO: 56798 - protein, 10 aa, Artificial Sequence
  Description of Artificial Sequence: Synthetic peptide
  Seed: MPKAGLLIIV (MAGA3_HUMAN)
MPKAGLLIII

SEQ ID NO: 56799 - protein, 9 aa, Artificial Sequence
  Description of Artificial Sequence: Synthetic peptide
  Seed: LQLVFGIEL (MAGA3_HUMAN)
LELVFGIEM

SEQ ID NO: 56800 - protein, 9 aa, Artificial Sequence
  Description of Artificial Sequence: Synthetic peptide
  Seed: SVLEVFEGR (MAGA3_HUMAN)
SMLEVFEGK

SEQ ID NO: 56801 - protein, 9 aa, Artificial Sequence
  Description of Artificial Sequence: Synthetic peptide
  Seed: RALVETSYV (MAGA3_HUMAN)
RALVETSYM

SEQ ID NO: 56802 - protein, 10 aa, Artificial Sequence
  Description of Artificial Sequence: Synthetic peptide
  Seed: RQVPGSDPAC (MAGA3_HUMAN)
REVPGSDPAF

SEQ ID NO: 56803 - protein, 10 aa, Artificial Sequence
  Description of Artificial Sequence: Synthetic peptide
  Seed: HISYPPLHEW (MAGA3_HUMAN)
HLSYPPLHEF

SEQ ID NO: 56804 - protein, 9 aa, Artificial Sequence
  Description of Artificial Sequence: Synthetic peptide
  Seed: QSPQGASSL (MAGA3_HUMAN)
QWPQGASSM

SEQ ID NO: 56805 - protein, 10 aa, Artificial Sequence
  Description of Artificial Sequence: Synthetic peptide
  Seed: TSYVKVLHHM (MAGA3_HUMAN)
TSYVKVLHHY

SEQ ID NO: 56806 - protein, 9 aa, Artificial Sequence
  Description of Artificial Sequence: Synthetic peptide
  Seed: KASSSLQLV (MAGA3_HUMAN)
KISSSLQLA

SEQ ID NO: 56807 - protein, 10 aa, Artificial Sequence
  Description of Artificial Sequence: Synthetic peptide
  Seed: ELMEVDPIGH (MAGA3_HUMAN)
EMMEVDPIGK

SEQ ID NO: 56808 - protein, 9 aa, Artificial Sequence
  Description of Artificial Sequence: Synthetic peptide
  Seed: KVLHHMVKI (MAGA3_HUMAN)
KLLHHMVKM

SEQ ID NO: 56809 - protein, 9 aa, Artificial Sequence
  Description of Artificial Sequence: Synthetic peptide
  Seed: KVAELVHFL (MAGA3_HUMAN)
KFAELVHFI

SEQ ID NO: 56810 - protein, 9 aa, Artificial Sequence
  Description of Artificial Sequence: Synthetic peptide
  Seed: VVGNWQYFF (MAGA3_HUMAN)
VYGNWQYFI

SEQ ID NO: 56811 - protein, 10 aa, Artificial Sequence
  Description of Artificial Sequence: Synthetic peptide
  Seed: SDPACYEFLW (MAGA3_HUMAN)
SLPACYEFLW

SEQ ID NO: 56812 - protein, 9 aa, Artificial Sequence
  Description of Artificial Sequence: Synthetic peptide
  Seed: SKASSSLQL (MAGA3_HUMAN)
SAASSSLQF

SEQ ID NO: 56813 - protein, 9 aa, Artificial Sequence
  Description of Artificial Sequence: Synthetic peptide
  Seed: SKASSSLQL (MAGA3_HUMAN)
SQASSSLQM

SEQ ID NO: 56814 - protein, 9 aa, Artificial Sequence
  Description of Artificial Sequence: Synthetic peptide
  Seed: YFFPVIFSK (MAGA3_HUMAN)
YMFPVIFSM

SEQ ID NO: 56815 - protein, 8 aa, Artificial Sequence
  Description of Artificial Sequence: Synthetic peptide
  Seed: FPDLESEF (MAGA3_HUMAN)
FNDLESEM

SEQ ID NO: 56816 - protein, 9 aa, Artificial Sequence
  Description of Artificial Sequence: Synthetic peptide
  Seed: YPPLHEWVL (MAGA3_HUMAN)
YAPLHEWVL

SEQ ID NO: 56817 - protein, 9 aa, Artificial Sequence
  Description of Artificial Sequence: Synthetic peptide
  Seed: RQVPGSDPA (MAGA3_HUMAN)
RFVPGSDPF

SEQ ID NO: 56818 - protein, 9 aa, Artificial Sequence
  Description of Artificial Sequence: Synthetic peptide
  Seed: LVHFLLLKY (MAGA3_HUMAN)
LQHFLLLKL

SEQ ID NO: 56819 - protein, 9 aa, Artificial Sequence
  Description of Artificial Sequence: Synthetic peptide
  Seed: QIMPKAGLL (MAGA3_HUMAN)
QLMPKAGLV

SEQ ID NO: 56820 - protein, 9 aa, Artificial Sequence
  Description of Artificial Sequence: Synthetic peptide
  Seed: NWQYFFPVI (MAGA3_HUMAN)
NWQYFFPVF

SEQ ID NO: 56821 - protein, 9 aa, Artificial Sequence
  Description of Artificial Sequence: Synthetic peptide
  Seed: NYPLWSQSY (MAGA3_HUMAN)
NFPLWSQSF

SEQ ID NO: 56822 - protein, 10 aa, Artificial Sequence
  Description of Artificial Sequence: Synthetic peptide
  Seed: IFATCLGLSY (MAGA3_HUMAN)
IAATCLGLSY

SEQ ID NO: 56823 - protein, 10 aa, Artificial Sequence
  Description of Artificial Sequence: Synthetic peptide
  Seed: WEELSVLEVF (MAGA3_HUMAN)
WNELSVLEVW

SEQ ID NO: 56824 - protein, 10 aa, Artificial Sequence
  Description of Artificial Sequence: Synthetic peptide
  Seed: VIFSKASSSL (MAGA3_HUMAN)
VLFSKASSSL

SEQ ID NO: 56825 - protein, 9 aa, Artificial Sequence
  Description of Artificial Sequence: Synthetic peptide
  Seed: SSLPTTMNY (MAGA3_HUMAN)
SRLPTTMNF

SEQ ID NO: 56826 - protein, 10 aa, Artificial Sequence
  Description of Artificial Sequence: Synthetic peptide
  Seed: HISYPPLHEW (MAGA3_HUMAN)
HKSYPPLHEM

SEQ ID NO: 56827 - protein, 9 aa, Artificial Sequence
  Description of Artificial Sequence: Synthetic peptide
  Seed: KIWEELSVL (MAGA3_HUMAN)
KMWEELSVY

SEQ ID NO: 56828 - protein, 9 aa, Artificial Sequence
  Description of Artificial Sequence: Synthetic peptide
  Seed: SPDPPQSPQ (MAGA3_HUMAN)
SPDPPQSPY

SEQ ID NO: 56829 - protein, 9 aa, Artificial Sequence
  Description of Artificial Sequence: Synthetic peptide
  Seed: FVQENYLEY (MAGA3_HUMAN)
FYQENYLEL

SEQ ID NO: 56830 - protein, 10 aa, Artificial Sequence
  Description of Artificial Sequence: Synthetic peptide
  Seed: FLWGPRALVE (MAGA3_HUMAN)
FLWGPRALVH

SEQ ID NO: 56831 - protein, 10 aa, Artificial Sequence
  Description of Artificial Sequence: Synthetic peptide
  Seed: YFFPVIFSKA (MAGA3_HUMAN)
YLFPVIFSKV

SEQ ID NO: 56832 - protein, 9 aa, Artificial Sequence
  Description of Artificial Sequence: Synthetic peptide
  Seed: SSSSTLVEV (MAGA3_HUMAN)
SASSTLVEY

SEQ ID NO: 56833 - protein, 10 aa, Artificial Sequence
  Description of Artificial Sequence: Synthetic peptide
  Seed: KVAELVHFLL (MAGA3_HUMAN)
KLAELVHFLR

SEQ ID NO: 56834 - protein, 8 aa, Artificial Sequence
  Description of Artificial Sequence: Synthetic peptide
  Seed: FPDLESEF (MAGA3_HUMAN)
FADLESEF

SEQ ID NO: 56835 - protein, 10 aa, Artificial Sequence
  Description of Artificial Sequence: Synthetic peptide
  Seed: FLWGPRALVE (MAGA3_HUMAN)
FLWGPRALVW

SEQ ID NO: 56836 - protein, 10 aa, Artificial Sequence
  Description of Artificial Sequence: Synthetic peptide
  Seed: LGLVGAQAPA (MAGA3_HUMAN)
LKLVGAQAPV

SEQ ID NO: 56837 - protein, 9 aa, Artificial Sequence
  Description of Artificial Sequence: Synthetic peptide
  Seed: ILGDPKKLL (MAGA3_HUMAN)
IMGDPKKLF

SEQ ID NO: 56838 - protein, 9 aa, Artificial Sequence
  Description of Artificial Sequence: Synthetic peptide
  Seed: MEVDPIGHL (MAGA3_HUMAN)
MYVDPIGHY

SEQ ID NO: 56839 - protein, 10 aa, Artificial Sequence
  Description of Artificial Sequence: Synthetic peptide
  Seed: FFPVIFSKAS (MAGA3_HUMAN)
FTPVIFSKAV

SEQ ID NO: 56840 - protein, 10 aa, Artificial Sequence
  Description of Artificial Sequence: Synthetic peptide
  Seed: IFATCLGLSY (MAGA3_HUMAN)
IKATCLGLSM

SEQ ID NO: 56841 - protein, 9 aa, Artificial Sequence
  Description of Artificial Sequence: Synthetic peptide
  Seed: AESPDPPQS (MAGA3_HUMAN)
AESPDPPQF

SEQ ID NO: 56842 - protein, 9 aa, Artificial Sequence
  Description of Artificial Sequence: Synthetic peptide
  Seed: KVAELVHFL (MAGA3_HUMAN)
KLAELVHFV

SEQ ID NO: 56843 - protein, 9 aa, Artificial Sequence
  Description of Artificial Sequence: Synthetic peptide
  Seed: FATCLGLSY (MAGA3_HUMAN)
FPTCLGLSW

SEQ ID NO: 56844 - protein, 9 aa, Artificial Sequence
  Description of Artificial Sequence: Synthetic peptide
  Seed: RALVETSYV (MAGA3_HUMAN)
RALVETSYI

SEQ ID NO: 56845 - protein, 11 aa, Artificial Sequence
  Description of Artificial Sequence: Synthetic peptide
  Seed: AASSSSTLVEV (MAGA3_HUMAN)
AASSSSTLVEF

SEQ ID NO: 56846 - protein, 9 aa, Artificial Sequence
  Description of Artificial Sequence: Synthetic peptide
  Seed: FLWGPRALV (MAGA3_HUMAN)
FSWGPRALF

SEQ ID NO: 56847 - protein, 9 aa, Artificial Sequence
  Description of Artificial Sequence: Synthetic peptide
  Seed: ISYPPLHEW (MAGA3_HUMAN)
IHYPPLHEL

SEQ ID NO: 56848 - protein, 10 aa, Artificial Sequence
  Description of Artificial Sequence: Synthetic peptide
  Seed: ASSLPTTMNY (MAGA3_HUMAN)
ATSLPTTMNR

SEQ ID NO: 56849 - protein, 10 aa, Artificial Sequence
  Description of Artificial Sequence: Synthetic peptide
  Seed: MNYPLWSQSY (MAGA3_HUMAN)
MQYPLWSQSM

SEQ ID NO: 56850 - protein, 9 aa, Artificial Sequence
  Description of Artificial Sequence: Synthetic peptide
  Seed: FQAALSRKV (MAGA3_HUMAN)
FSAALSRKF

SEQ ID NO: 56851 - protein, 9 aa, Artificial Sequence
  Description of Artificial Sequence: Synthetic peptide
  Seed: YIFATCLGL (MAGA3_HUMAN)
YSFATCLGA

SEQ ID NO: 56852 - protein, 10 aa, Artificial Sequence
  Description of Artificial Sequence: Synthetic peptide
  Seed: LGLVGAQAPA (MAGA3_HUMAN)
LTLVGAQAPV

SEQ ID NO: 56853 - protein, 10 aa, Artificial Sequence
  Description of Artificial Sequence: Synthetic peptide
  Seed: LQLVFGIELM (MAGA3_HUMAN)
LLLVFGIELL

SEQ ID NO: 56854 - protein, 10 aa, Artificial Sequence
  Description of Artificial Sequence: Synthetic peptide
  Seed: MNYPLWSQSY (MAGA3_HUMAN)
MTYPLWSQSM

SEQ ID NO: 56855 - protein, 10 aa, Artificial Sequence
  Description of Artificial Sequence: Synthetic peptide
  Seed: RKVAELVHFL (MAGA3_HUMAN)
RDVAELVHFV

SEQ ID NO: 56856 - protein, 9 aa, Artificial Sequence
  Description of Artificial Sequence: Synthetic peptide
  Seed: ISYPPLHEW (MAGA3_HUMAN)
IYYPPLHEY

SEQ ID NO: 56857 - protein, 9 aa, Artificial Sequence
  Description of Artificial Sequence: Synthetic peptide
  Seed: FVQENYLEY (MAGA3_HUMAN)
FIQENYLEW

SEQ ID NO: 56858 - protein, 10 aa, Artificial Sequence
  Description of Artificial Sequence: Synthetic peptide
  Seed: YIFATCLGLS (MAGA3_HUMAN)
YMFATCLGLC

SEQ ID NO: 56859 - protein, 9 aa, Artificial Sequence
  Description of Artificial Sequence: Synthetic peptide
  Seed: EAASSSSTL (MAGA3_HUMAN)
ELASSSSTR

SEQ ID NO: 56860 - protein, 9 aa, Artificial Sequence
  Description of Artificial Sequence: Synthetic peptide
  Seed: YEDSSNQEE (MAGA3_HUMAN)
YEDSSNQEM

SEQ ID NO: 56861 - protein, 9 aa, Artificial Sequence
  Description of Artificial Sequence: Synthetic peptide
  Seed: FLWGPRALV (MAGA3_HUMAN)
FGWGPRALM

SEQ ID NO: 56862 - protein, 10 aa, Artificial Sequence
  Description of Artificial Sequence: Synthetic peptide
  Seed: SYPPLHEWVL (MAGA3_HUMAN)
SFPPLHEWVL

SEQ ID NO: 56863 - protein, 9 aa, Artificial Sequence
  Description of Artificial Sequence: Synthetic peptide
  Seed: SVVGNWQYF (MAGA3_HUMAN)
SWVGNWQYY

SEQ ID NO: 56864 - protein, 9 aa, Artificial Sequence
  Description of Artificial Sequence: Synthetic peptide
  Seed: MPKAGLLII (MAGA3_HUMAN)
MMKAGLLIF

SEQ ID NO: 56865 - protein, 9 aa, Artificial Sequence
  Description of Artificial Sequence: Synthetic peptide
  Seed: QIMPKAGLL (MAGA3_HUMAN)
QQMPKAGLL

SEQ ID NO: 56866 - protein, 9 aa, Artificial Sequence
  Description of Artificial Sequence: Synthetic peptide
  Seed: LGDPKKLLT (MAGA3_HUMAN)
LSDPKKLLF

SEQ ID NO: 56867 - protein, 9 aa, Artificial Sequence
  Description of Artificial Sequence: Synthetic peptide
  Seed: LGDPKKLLT (MAGA3_HUMAN)
LLDPKKLLL

SEQ ID NO: 56868 - protein, 11 aa, Artificial Sequence
  Description of Artificial Sequence: Synthetic peptide
  Seed: SRKVAELVHFL (MAGA3_HUMAN)
SLKVAELVHFL

SEQ ID NO: 56869 - protein, 9 aa, Artificial Sequence
  Description of Artificial Sequence: Synthetic peptide
  Seed: VVGNWQYFF (MAGA3_HUMAN)
VIGNWQYFW

SEQ ID NO: 56870 - protein, 9 aa, Artificial Sequence
  Description of Artificial Sequence: Synthetic peptide
  Seed: LVHFLLLKY (MAGA3_HUMAN)
LKHFLLLKM

SEQ ID NO: 56871 - protein, 11 aa, Artificial Sequence
  Description of Artificial Sequence: Synthetic peptide
  Seed: SLPTTMNYPLW (MAGA3_HUMAN)
SWPTTMNYPLF

SEQ ID NO: 56872 - protein, 9 aa, Artificial Sequence
  Description of Artificial Sequence: Synthetic peptide
  Seed: LQLVFGIEL (MAGA3_HUMAN)
LALVFGIEL

SEQ ID NO: 56873 - protein, 10 aa, Artificial Sequence
  Description of Artificial Sequence: Synthetic peptide
  Seed: MNYPLWSQSY (MAGA3_HUMAN)
MPYPLWSQSY

SEQ ID NO: 56874 - protein, 9 aa, Artificial Sequence
  Description of Artificial Sequence: Synthetic peptide
  Seed: VVGNWQYFF (MAGA3_HUMAN)
VYGNWQYFY

SEQ ID NO: 56875 - protein, 9 aa, Artificial Sequence
  Description of Artificial Sequence: Synthetic peptide
  Seed: KVLHHMVKI (MAGA3_HUMAN)
KSLHHMVKY

SEQ ID NO: 56876 - protein, 10 aa, Artificial Sequence
  Description of Artificial Sequence: Synthetic peptide
  Seed: ASSLPTTMNY (MAGA3_HUMAN)
AESLPTTMNF

SEQ ID NO: 56877 - protein, 9 aa, Artificial Sequence
  Description of Artificial Sequence: Synthetic peptide
  Seed: YIFATCLGL (MAGA3_HUMAN)
YLFATCLGY

SEQ ID NO: 56878 - protein, 9 aa, Artificial Sequence
  Description of Artificial Sequence: Synthetic peptide
  Seed: FVQENYLEY (MAGA3_HUMAN)
FPQENYLEI

SEQ ID NO: 56879 - protein, 10 aa, Artificial Sequence
  Description of Artificial Sequence: Synthetic peptide
  Seed: HFVQENYLEY (MAGA3_HUMAN)
HRVQENYLEY

SEQ ID NO: 56880 - protein, 9 aa, Artificial Sequence
  Description of Artificial Sequence: Synthetic peptide
  Seed: TQHFVQENY (MAGA3_HUMAN)
THHFVQENY

SEQ ID NO: 56881 - protein, 9 aa, Artificial Sequence
  Description of Artificial Sequence: Synthetic peptide
  Seed: VFEGREDSI (MAGA3_HUMAN)
VFEGREDSF

SEQ ID NO: 56882 - protein, 8 aa, Artificial Sequence
  Description of Artificial Sequence: Synthetic peptide
  Seed: FPDLESEF (MAGA3_HUMAN)
FGDLESEI

SEQ ID NO: 56883 - protein, 10 aa, Artificial Sequence
  Description of Artificial Sequence: Synthetic peptide
  Seed: MEVDPIGHLY (MAGA3_HUMAN)
MAVDPIGHLI

SEQ ID NO: 56884 - protein, 10 aa, Artificial Sequence
  Description of Artificial Sequence: Synthetic peptide
  Seed: STFPDLESEF (MAGA3_HUMAN)
STFPDLESER

SEQ ID NO: 56885 - protein, 10 aa, Artificial Sequence
  Description of Artificial Sequence: Synthetic peptide
  Seed: SLPTTMNYPL (MAGA3_HUMAN)
SGPTTMNYPL

SEQ ID NO: 56886 - protein, 10 aa, Artificial Sequence
  Description of Artificial Sequence: Synthetic peptide
  Seed: WEELSVLEVF (MAGA3_HUMAN)
WEELSVLEVM

SEQ ID NO: 56887 - protein, 9 aa, Artificial Sequence
  Description of Artificial Sequence: Synthetic peptide
  Seed: AELVHFLLL (MAGA3_HUMAN)
ARLVHFLLY

SEQ ID NO: 56888 - protein, 9 aa, Artificial Sequence
  Description of Artificial Sequence: Synthetic peptide
  Seed: VTLGEVPAA (MAGA3_HUMAN)
VSLGEVPAL

SEQ ID NO: 56889 - protein, 10 aa, Artificial Sequence
  Description of Artificial Sequence: Synthetic peptide
  Seed: SVVGNWQYFF (MAGA3_HUMAN)
SYVGNWQYFS

SEQ ID NO: 56890 - protein, 9 aa, Artificial Sequence
  Description of Artificial Sequence: Synthetic peptide
  Seed: KASSSLQLV (MAGA3_HUMAN)
KLSSSLQLI

SEQ ID NO: 56891 - protein, 9 aa, Artificial Sequence
  Description of Artificial Sequence: Synthetic peptide
  Seed: ISGGPHISY (MAGA3_HUMAN)
IPGGPHISM

SEQ ID NO: 56892 - protein, 9 aa, Artificial Sequence
  Description of Artificial Sequence: Synthetic peptide
  Seed: TFPDLESEF (MAGA3_HUMAN)
TLPDLESEM

SEQ ID NO: 56893 - protein, 9 aa, Artificial Sequence
  Description of Artificial Sequence: Synthetic peptide
  Seed: KVLHHMVKI (MAGA3_HUMAN)
KMLHHMVKR

SEQ ID NO: 56894 - protein, 10 aa, Artificial Sequence
  Description of Artificial Sequence: Synthetic peptide
  Seed: SLQLVFGIEL (MAGA3_HUMAN)
SSQLVFGIEF

SEQ ID NO: 56895 - protein, 10 aa, Artificial Sequence
  Description of Artificial Sequence: Synthetic peptide
  Seed: FATCLGLSYD (MAGA3_HUMAN)
FSTCLGLSYF

SEQ ID NO: 56896 - protein, 8 aa, Artificial Sequence
  Description of Artificial Sequence: Synthetic peptide
  Seed: SGGPHISY (MAGA3_HUMAN)
SSGPHISV

SEQ ID NO: 56897 - protein, 10 aa, Artificial Sequence
  Description of Artificial Sequence: Synthetic peptide
  Seed: SLPTTMNYPL (MAGA3_HUMAN)
SMPTTMNYPM

SEQ ID NO: 56898 - protein, 11 aa, Artificial Sequence
  Description of Artificial Sequence: Synthetic peptide
  Seed: RQVPGSDPACY (MAGA3_HUMAN)
RQVPGSDPACV

SEQ ID NO: 56899 - protein, 9 aa, Artificial Sequence
  Description of Artificial Sequence: Synthetic peptide
  Seed: YFFPVIFSK (MAGA3_HUMAN)
YIFPVIFSI

SEQ ID NO: 56900 - protein, 9 aa, Artificial Sequence
  Description of Artificial Sequence: Synthetic peptide
  Seed: ISYPPLHEW (MAGA3_HUMAN)
IWYPPLHEY

SEQ ID NO: 56901 - protein, 9 aa, Artificial Sequence
  Description of Artificial Sequence: Synthetic peptide
  Seed: FVQENYLEY (MAGA3_HUMAN)
FVQENYLEI

SEQ ID NO: 56902 - protein, 9 aa, Artificial Sequence
  Description of Artificial Sequence: Synthetic peptide
  Seed: KAGLLIIVL (MAGA3_HUMAN)
KQGLLIIVF

SEQ ID NO: 56903 - protein, 10 aa, Artificial Sequence
  Description of Artificial Sequence: Synthetic peptide
  Seed: SSSTLVEVTL (MAGA3_HUMAN)
SKSTLVEVTW

SEQ ID NO: 56904 - protein, 11 aa, Artificial Sequence
  Description of Artificial Sequence: Synthetic peptide
  Seed: AQAPATEEQEA (MAGA3_HUMAN)
AQAPATEEQEW

SEQ ID NO: 56905 - protein, 9 aa, Artificial Sequence
  Description of Artificial Sequence: Synthetic peptide
  Seed: GSDPACYEF (MAGA3_HUMAN)
GADPACYEW

SEQ ID NO: 56906 - protein, 9 aa, Artificial Sequence
  Description of Artificial Sequence: Synthetic peptide
  Seed: RQVPGSDPA (MAGA3_HUMAN)
RQVPGSDPV

SEQ ID NO: 56907 - protein, 11 aa, Artificial Sequence
  Description of Artificial Sequence: Synthetic peptide
  Seed: WQYFFPVIFSK (MAGA3_HUMAN)
WKYFFPVIFSR

SEQ ID NO: 56908 - protein, 10 aa, Artificial Sequence
  Description of Artificial Sequence: Synthetic peptide
  Seed: HFVQENYLEY (MAGA3_HUMAN)
HMVQENYLEY

SEQ ID NO: 56909 - protein, 9 aa, Artificial Sequence
  Description of Artificial Sequence: Synthetic peptide
  Seed: ISYPPLHEW (MAGA3_HUMAN)
IEYPPLHEY

SEQ ID NO: 56910 - protein, 10 aa, Artificial Sequence
  Description of Artificial Sequence: Synthetic peptide
  Seed: TSYVKVLHHM (MAGA3_HUMAN)
TTYVKVLHHL

SEQ ID NO: 56911 - protein, 11 aa, Artificial Sequence
  Description of Artificial Sequence: Synthetic peptide
  Seed: SNQEEEGPSTF (MAGA3_HUMAN)
SQQEEEGPSTM

SEQ ID NO: 56912 - protein, 10 aa, Artificial Sequence
  Description of Artificial Sequence: Synthetic peptide
  Seed: LQLVFGIELM (MAGA3_HUMAN)
LFLVFGIELV

SEQ ID NO: 56913 - protein, 11 aa, Artificial Sequence
  Description of Artificial Sequence: Synthetic peptide
  Seed: SRKVAELVHFL (MAGA3_HUMAN)
SCKVAELVHFV

SEQ ID NO: 56914 - protein, 10 aa, Artificial Sequence
  Description of Artificial Sequence: Synthetic peptide
  Seed: MEVDPIGHLY (MAGA3_HUMAN)
MQVDPIGHLF

SEQ ID NO: 56915 - protein, 9 aa, Artificial Sequence
  Description of Artificial Sequence: Synthetic peptide
  Seed: EAASSSSTL (MAGA3_HUMAN)
ETASSSSTW

SEQ ID NO: 56916 - protein, 9 aa, Artificial Sequence
  Description of Artificial Sequence: Synthetic peptide
  Seed: KIWEELSVL (MAGA3_HUMAN)
KAWEELSVV

SEQ ID NO: 56917 - protein, 9 aa, Artificial Sequence
  Description of Artificial Sequence: Synthetic peptide
  Seed: QLVFGIELM (MAGA3_HUMAN)
QMVFGIELL

SEQ ID NO: 56918 - protein, 10 aa, Artificial Sequence
  Description of Artificial Sequence: Synthetic peptide
  Seed: STFPDLESEF (MAGA3_HUMAN)
STFPDLESEW

SEQ ID NO: 56919 - protein, 9 aa, Artificial Sequence
  Description of Artificial Sequence: Synthetic peptide
  Seed: FATCLGLSY (MAGA3_HUMAN)
FSTCLGLSL

SEQ ID NO: 56920 - protein, 9 aa, Artificial Sequence
  Description of Artificial Sequence: Synthetic peptide
  Seed: EVDPIGHLY (MAGA3_HUMAN)
EMDPIGHLR

SEQ ID NO: 56921 - protein, 11 aa, Artificial Sequence
  Description of Artificial Sequence: Synthetic peptide
  Seed: RKVAELVHFLL (MAGA3_HUMAN)
RRVAELVHFLA

SEQ ID NO: 56922 - protein, 11 aa, Artificial Sequence
  Description of Artificial Sequence: Synthetic peptide
  Seed: MLGSVVGNWQY (MAGA3_HUMAN)
MQGSVVGNWQW

SEQ ID NO: 56923 - protein, 9 aa, Artificial Sequence
  Description of Artificial Sequence: Synthetic peptide
  Seed: SSLPTTMNY (MAGA3_HUMAN)
SILPTTMNR

SEQ ID NO: 56924 - protein, 9 aa, Artificial Sequence
  Description of Artificial Sequence: Synthetic peptide
  Seed: WQYFFPVIF (MAGA3_HUMAN)
WLYFFPVIY

SEQ ID NO: 56925 - protein, 9 aa, Artificial Sequence
  Description of Artificial Sequence: Synthetic peptide
  Seed: DPIGHLYIF (MAGA3_HUMAN)
DPIGHLYIL

SEQ ID NO: 56926 - protein, 8 aa, Artificial Sequence
  Description of Artificial Sequence: Synthetic peptide
  Seed: QYFFPVIF (MAGA3_HUMAN)
QQFFPVIF

SEQ ID NO: 56927 - protein, 11 aa, Artificial Sequence
  Description of Artificial Sequence: Synthetic peptide
  Seed: YIFATCLGLSY (MAGA3_HUMAN)
YEFATCLGLSF

SEQ ID NO: 56928 - protein, 9 aa, Artificial Sequence
  Description of Artificial Sequence: Synthetic peptide
  Seed: LQLVFGIEL (MAGA3_HUMAN)
LELVFGIEL

SEQ ID NO: 56929 - protein, 9 aa, Artificial Sequence
  Description of Artificial Sequence: Synthetic peptide
  Seed: YFFPVIFSK (MAGA3_HUMAN)
YSFPVIFSF

SEQ ID NO: 56930 - protein, 10 aa, Artificial Sequence
  Description of Artificial Sequence: Synthetic peptide
  Seed: ASSSLQLVFG (MAGA3_HUMAN)
ARSSLQLVFW

SEQ ID NO: 56931 - protein, 8 aa, Artificial Sequence
  Description of Artificial Sequence: Synthetic peptide
  Seed: WQYFFPVI (MAGA3_HUMAN)
WMYFFPVY

SEQ ID NO: 56932 - protein, 9 aa, Artificial Sequence
  Description of Artificial Sequence: Synthetic peptide
  Seed: YFFPVIFSK (MAGA3_HUMAN)
YNFPVIFSY

SEQ ID NO: 56933 - protein, 10 aa, Artificial Sequence
  Description of Artificial Sequence: Synthetic peptide
  Seed: MVKISGGPHI (MAGA3_HUMAN)
MPKISGGPHY

SEQ ID NO: 56934 - protein, 9 aa, Artificial Sequence
  Description of Artificial Sequence: Synthetic peptide
  Seed: ISYPPLHEW (MAGA3_HUMAN)
INYPPLHEV

SEQ ID NO: 56935 - protein, 9 aa, Artificial Sequence
  Description of Artificial Sequence: Synthetic peptide
  Seed: QSPQGASSL (MAGA3_HUMAN)
QPPQGASSM

SEQ ID NO: 56936 - protein, 10 aa, Artificial Sequence
  Description of Artificial Sequence: Synthetic peptide
  Seed: MNYPLWSQSY (MAGA3_HUMAN)
MNYPLWSQSL

SEQ ID NO: 56937 - protein, 9 aa, Artificial Sequence
  Description of Artificial Sequence: Synthetic peptide
  Seed: KVAELVHFL (MAGA3_HUMAN)
KAAELVHFR

SEQ ID NO: 56938 - protein, 9 aa, Artificial Sequence
  Description of Artificial Sequence: Synthetic peptide
  Seed: SSLPTTMNY (MAGA3_HUMAN)
SVLPTTMNK

SEQ ID NO: 56939 - protein, 9 aa, Artificial Sequence
  Description of Artificial Sequence: Synthetic peptide
  Seed: RKVAELVHF (MAGA3_HUMAN)
RMVAELVHL

SEQ ID NO: 56940 - protein, 9 aa, Artificial Sequence
  Description of Artificial Sequence: Synthetic peptide
  Seed: LPTTMNYPL (MAGA3_HUMAN)
LMTTMNYPF

SEQ ID NO: 56941 - protein, 10 aa, Artificial Sequence
  Description of Artificial Sequence: Synthetic peptide
  Seed: WEELSVLEVF (MAGA3_HUMAN)
WPELSVLEVW

SEQ ID NO: 56942 - protein, 11 aa, Artificial Sequence
  Description of Artificial Sequence: Synthetic peptide
  Seed: MLGSVVGNWQY (MAGA3_HUMAN)
MTGSVVGNWQW

SEQ ID NO: 56943 - protein, 10 aa, Artificial Sequence
  Description of Artificial Sequence: Synthetic peptide
  Seed: MNYPLWSQSY (MAGA3_HUMAN)
MKYPLWSQSL

SEQ ID NO: 56944 - protein, 8 aa, Artificial Sequence
  Description of Artificial Sequence: Synthetic peptide
  Seed: EEKIWEEL (MAGA3_HUMAN)
EEKIWEEY

SEQ ID NO: 56945 - protein, 11 aa, Artificial Sequence
  Description of Artificial Sequence: Synthetic peptide
  Seed: YIFATCLGLSY (MAGA3_HUMAN)
YIFATCLGLSF

SEQ ID NO: 56946 - protein, 10 aa, Artificial Sequence
  Description of Artificial Sequence: Synthetic peptide
  Seed: LGSVVGNWQY (MAGA3_HUMAN)
LHSVVGNWQF

SEQ ID NO: 56947 - protein, 9 aa, Artificial Sequence
  Description of Artificial Sequence: Synthetic peptide
  Seed: MPKAGLLII (MAGA3_HUMAN)
MQKAGLLIV

SEQ ID NO: 56948 - protein, 9 aa, Artificial Sequence
  Description of Artificial Sequence: Synthetic peptide
  Seed: SSTLVEVTL (MAGA3_HUMAN)
SMTLVEVTW

SEQ ID NO: 56949 - protein, 10 aa, Artificial Sequence
  Description of Artificial Sequence: Synthetic peptide
  Seed: MEVDPIGHLY (MAGA3_HUMAN)
MQVDPIGHLL

SEQ ID NO: 56950 - protein, 10 aa, Artificial Sequence
  Description of Artificial Sequence: Synthetic peptide
  Seed: AELVHFLLLK (MAGA3_HUMAN)
AGLVHFLLLR

SEQ ID NO: 56951 - protein, 8 aa, Artificial Sequence
  Description of Artificial Sequence: Synthetic peptide
  Seed: SYPPLHEW (MAGA3_HUMAN)
SRPPLHEM

SEQ ID NO: 56952 - protein, 9 aa, Artificial Sequence
  Description of Artificial Sequence: Synthetic peptide
  Seed: SSTLVEVTL (MAGA3_HUMAN)
SATLVEVTM

SEQ ID NO: 56953 - protein, 10 aa, Artificial Sequence
  Description of Artificial Sequence: Synthetic peptide
  Seed: FFPVIFSKAS (MAGA3_HUMAN)
FDPVIFSKAA

SEQ ID NO: 56954 - protein, 9 aa, Artificial Sequence
  Description of Artificial Sequence: Synthetic peptide
  Seed: SVLEVFEGR (MAGA3_HUMAN)
SILEVFEGY

SEQ ID NO: 56955 - protein, 9 aa, Artificial Sequence
  Description of Artificial Sequence: Synthetic peptide
  Seed: ALSRKVAEL (MAGA3_HUMAN)
AASRKVAEM

SEQ ID NO: 56956 - protein, 9 aa, Artificial Sequence
  Description of Artificial Sequence: Synthetic peptide
  Seed: LESEFQAAL (MAGA3_HUMAN)
LHSEFQAAV

SEQ ID NO: 56957 - protein, 10 aa, Artificial Sequence
  Description of Artificial Sequence: Synthetic peptide
  Seed: DLESEFQAAL (MAGA3_HUMAN)
DLESEFQAAY

SEQ ID NO: 56958 - protein, 10 aa, Artificial Sequence
  Description of Artificial Sequence: Synthetic peptide
  Seed: KASSSLQLVF (MAGA3_HUMAN)
KMSSSLQLVF

SEQ ID NO: 56959 - protein, 9 aa, Artificial Sequence
  Description of Artificial Sequence: Synthetic peptide
  Seed: RALVETSYV (MAGA3_HUMAN)
RLLVETSYV

SEQ ID NO: 56960 - protein, 10 aa, Artificial Sequence
  Description of Artificial Sequence: Synthetic peptide
  Seed: KVAELVHFLL (MAGA3_HUMAN)
KMAELVHFLS

SEQ ID NO: 56961 - protein, 9 aa, Artificial Sequence
  Description of Artificial Sequence: Synthetic peptide
  Seed: EVDPIGHLY (MAGA3_HUMAN)
EIDPIGHLK

SEQ ID NO: 56962 - protein, 10 aa, Artificial Sequence
  Description of Artificial Sequence: Synthetic peptide
  Seed: FFPVIFSKAS (MAGA3_HUMAN)
FKPVIFSKAA

SEQ ID NO: 56963 - protein, 10 aa, Artificial Sequence
  Description of Artificial Sequence: Synthetic peptide
  Seed: KVAELVHFLL (MAGA3_HUMAN)
KAAELVHFLY

SEQ ID NO: 56964 - protein, 10 aa, Artificial Sequence
  Description of Artificial Sequence: Synthetic peptide
  Seed: KVAELVHFLL (MAGA3_HUMAN)
KLAELVHFLK

SEQ ID NO: 56965 - protein, 9 aa, Artificial Sequence
  Description of Artificial Sequence: Synthetic peptide
  Seed: VETSYVKVL (MAGA3_HUMAN)
VETSYVKVF

SEQ ID NO: 56966 - protein, 10 aa, Artificial Sequence
  Description of Artificial Sequence: Synthetic peptide
  Seed: SEFQAALSRK (MAGA3_HUMAN)
SLFQAALSRK

SEQ ID NO: 56967 - protein, 9 aa, Artificial Sequence
  Description of Artificial Sequence: Synthetic peptide
  Seed: RQVPGSDPA (MAGA3_HUMAN)
RRVPGSDPF

SEQ ID NO: 56968 - protein, 9 aa, Artificial Sequence
  Description of Artificial Sequence: Synthetic peptide
  Seed: GASSLPTTM (MAGA3_HUMAN)
GFSSLPTTF

SEQ ID NO: 56969 - protein, 9 aa, Artificial Sequence
  Description of Artificial Sequence: Synthetic peptide
  Seed: KVLHHMVKI (MAGA3_HUMAN)
KMLHHMVKW

SEQ ID NO: 56970 - protein, 9 aa, Artificial Sequence
  Description of Artificial Sequence: Synthetic peptide
  Seed: MPKAGLLII (MAGA3_HUMAN)
MIKAGLLIY

SEQ ID NO: 56971 - protein, 9 aa, Artificial Sequence
  Description of Artificial Sequence: Synthetic peptide
  Seed: EAASSSSTL (MAGA3_HUMAN)
EAASSSSTM

SEQ ID NO: 56972 - protein, 10 aa, Artificial Sequence
  Description of Artificial Sequence: Synthetic peptide
  Seed: LQLVFGIELM (MAGA3_HUMAN)
LMLVFGIELV

SEQ ID NO: 56973 - protein, 9 aa, Artificial Sequence
  Description of Artificial Sequence: Synthetic peptide
  Seed: ISYPPLHEW (MAGA3_HUMAN)
IWYPPLHEM

SEQ ID NO: 56974 - protein, 11 aa, Artificial Sequence
  Description of Artificial Sequence: Synthetic peptide
  Seed: ELVHFLLLKYR (MAGA3_HUMAN)
ETVHFLLLKYR

SEQ ID NO: 56975 - protein, 9 aa, Artificial Sequence
  Description of Artificial Sequence: Synthetic peptide
  Seed: IMPKAGLLI (MAGA3_HUMAN)
IAPKAGLLI

SEQ ID NO: 56976 - protein, 10 aa, Artificial Sequence
  Description of Artificial Sequence: Synthetic peptide
  Seed: ISYPPLHEWV (MAGA3_HUMAN)
IPYPPLHEWW

SEQ ID NO: 56977 - protein, 9 aa, Artificial Sequence
  Description of Artificial Sequence: Synthetic peptide
  Seed: YIFATCLGL (MAGA3_HUMAN)
YQFATCLGV

SEQ ID NO: 56978 - protein, 10 aa, Artificial Sequence
  Description of Artificial Sequence: Synthetic peptide
  Seed: KVAELVHFLL (MAGA3_HUMAN)
KKAELVHFLW

SEQ ID NO: 56979 - protein, 11 aa, Artificial Sequence
  Description of Artificial Sequence: Synthetic peptide
  Seed: ISYPPLHEWVL (MAGA3_HUMAN)
IWYPPLHEWVW

SEQ ID NO: 56980 - protein, 10 aa, Artificial Sequence
  Description of Artificial Sequence: Synthetic peptide
  Seed: TSYVKVLHHM (MAGA3_HUMAN)
TIYVKVLHHI

SEQ ID NO: 56981 - protein, 9 aa, Artificial Sequence
  Description of Artificial Sequence: Synthetic peptide
  Seed: IFSKASSSL (MAGA3_HUMAN)
IYSKASSSV

SEQ ID NO: 56982 - protein, 9 aa, Artificial Sequence
  Description of Artificial Sequence: Synthetic peptide
  Seed: ALVETSYVK (MAGA3_HUMAN)
AMVETSYVR

SEQ ID NO: 56983 - protein, 9 aa, Artificial Sequence
  Description of Artificial Sequence: Synthetic peptide
  Seed: FQAALSRKV (MAGA3_HUMAN)
FQAALSRKM

SEQ ID NO: 56984 - protein, 10 aa, Artificial Sequence
  Description of Artificial Sequence: Synthetic peptide
  Seed: GSDPACYEFL (MAGA3_HUMAN)
GADPACYEFY

SEQ ID NO: 56985 - protein, 10 aa, Artificial Sequence
  Description of Artificial Sequence: Synthetic peptide
  Seed: ETSYVKVLHH (MAGA3_HUMAN)
EASYVKVLHK

SEQ ID NO: 56986 - protein, 9 aa, Artificial Sequence
  Description of Artificial Sequence: Synthetic peptide
  Seed: EARGEALGL (MAGA3_HUMAN)
ETRGEALGW

SEQ ID NO: 56987 - protein, 10 aa, Artificial Sequence
  Description of Artificial Sequence: Synthetic peptide
  Seed: LGSVVGNWQY (MAGA3_HUMAN)
LSSVVGNWQW

SEQ ID NO: 56988 - protein, 10 aa, Artificial Sequence
  Description of Artificial Sequence: Synthetic peptide
  Seed: ASSSSTLVEV (MAGA3_HUMAN)
ALSSSTLVEA

SEQ ID NO: 56989 - protein, 10 aa, Artificial Sequence
  Description of Artificial Sequence: Synthetic peptide
  Seed: STFPDLESEF (MAGA3_HUMAN)
SFFPDLESEY

SEQ ID NO: 56990 - protein, 10 aa, Artificial Sequence
  Description of Artificial Sequence: Synthetic peptide
  Seed: VTKAEMLGSV (MAGA3_HUMAN)
VIKAEMLGSV

SEQ ID NO: 56991 - protein, 9 aa, Artificial Sequence
  Description of Artificial Sequence: Synthetic peptide
  Seed: SRKVAELVH (MAGA3_HUMAN)
SRKVAELVM

SEQ ID NO: 56992 - protein, 10 aa, Artificial Sequence
  Description of Artificial Sequence: Synthetic peptide
  Seed: SLQLVFGIEL (MAGA3_HUMAN)
SQQLVFGIEY

SEQ ID NO: 56993 - protein, 11 aa, Artificial Sequence
  Description of Artificial Sequence: Synthetic peptide
  Seed: MLGSVVGNWQY (MAGA3_HUMAN)
MYGSVVGNWQW

SEQ ID NO: 56994 - protein, 10 aa, Artificial Sequence
  Description of Artificial Sequence: Synthetic peptide
  Seed: LQLVFGIELM (MAGA3_HUMAN)
LPLVFGIELV

SEQ ID NO: 56995 - protein, 9 aa, Artificial Sequence
  Description of Artificial Sequence: Synthetic peptide
  Seed: KVAELVHFL (MAGA3_HUMAN)
KMAELVHFY

SEQ ID NO: 56996 - protein, 10 aa, Artificial Sequence
  Description of Artificial Sequence: Synthetic peptide
  Seed: TTMNYPLWSQ (MAGA3_HUMAN)
TAMNYPLWSK

SEQ ID NO: 56997 - protein, 10 aa, Artificial Sequence
  Description of Artificial Sequence: Synthetic peptide
  Seed: YFFPVIFSKA (MAGA3_HUMAN)
YLFPVIFSKT

SEQ ID NO: 56998 - protein, 9 aa, Artificial Sequence
  Description of Artificial Sequence: Synthetic peptide
  Seed: TSYVKVLHH (MAGA3_HUMAN)
TSYVKVLHR

SEQ ID NO: 56999 - protein, 9 aa, Artificial Sequence
  Description of Artificial Sequence: Synthetic peptide
  Seed: FVQENYLEY (MAGA3_HUMAN)
FPQENYLEM

SEQ ID NO: 57000 - protein, 9 aa, Artificial Sequence
  Description of Artificial Sequence: Synthetic peptide
  Seed: YIFATCLGL (MAGA3_HUMAN)
YNFATCLGM

SEQ ID NO: 57001 - protein, 8 aa, Artificial Sequence
  Description of Artificial Sequence: Synthetic peptide
  Seed: WQYFFPVI (MAGA3_HUMAN)
WQYFFPVY

SEQ ID NO: 57002 - protein, 9 aa, Artificial Sequence
  Description of Artificial Sequence: Synthetic peptide
  Seed: FATCLGLSY (MAGA3_HUMAN)
FMTCLGLSL

SEQ ID NO: 57003 - protein, 10 aa, Artificial Sequence
  Description of Artificial Sequence: Synthetic peptide
  Seed: SLPTTMNYPL (MAGA3_HUMAN)
SQPTTMNYPL

SEQ ID NO: 57004 - protein, 10 aa, Artificial Sequence
  Description of Artificial Sequence: Synthetic peptide
  Seed: NWQYFFPVIF (MAGA3_HUMAN)
NHQYFFPVIM

SEQ ID NO: 57005 - protein, 10 aa, Artificial Sequence
  Description of Artificial Sequence: Synthetic peptide
  Seed: AELVHFLLLK (MAGA3_HUMAN)
ARLVHFLLLK

SEQ ID NO: 57006 - protein, 9 aa, Artificial Sequence
  Description of Artificial Sequence: Synthetic peptide
  Seed: YFFPVIFSK (MAGA3_HUMAN)
YTFPVIFSM

SEQ ID NO: 57007 - protein, 11 aa, Artificial Sequence
  Description of Artificial Sequence: Synthetic peptide
  Seed: SGGPHISYPPL (MAGA3_HUMAN)
SPGPHISYPPM

SEQ ID NO: 57008 - protein, 10 aa, Artificial Sequence
  Description of Artificial Sequence: Synthetic peptide
  Seed: ASSLPTTMNY (MAGA3_HUMAN)
AISLPTTMNK

SEQ ID NO: 57009 - protein, 9 aa, Artificial Sequence
  Description of Artificial Sequence: Synthetic peptide
  Seed: KVLHHMVKI (MAGA3_HUMAN)
KRLHHMVKL

SEQ ID NO: 57010 - protein, 9 aa, Artificial Sequence
  Description of Artificial Sequence: Synthetic peptide
  Seed: QIMPKAGLL (MAGA3_HUMAN)
QLMPKAGLA

SEQ ID NO: 57011 - protein, 9 aa, Artificial Sequence
  Description of Artificial Sequence: Synthetic peptide
  Seed: SVVGNWQYF (MAGA3_HUMAN)
SQVGNWQYI

SEQ ID NO: 57012 - protein, 9 aa, Artificial Sequence
  Description of Artificial Sequence: Synthetic peptide
  Seed: SSLPTTMNY (MAGA3_HUMAN)
STLPTTMNM

SEQ ID NO: 57013 - protein, 10 aa, Artificial Sequence
  Description of Artificial Sequence: Synthetic peptide
  Seed: KVAELVHFLL (MAGA3_HUMAN)
KTAELVHFLM

SEQ ID NO: 57014 - protein, 10 aa, Artificial Sequence
  Description of Artificial Sequence: Synthetic peptide
  Seed: RKVAELVHFL (MAGA3_HUMAN)
RKVAELVHFF

SEQ ID NO: 57015 - protein, 10 aa, Artificial Sequence
  Description of Artificial Sequence: Synthetic peptide
  Seed: SSSTLVEVTL (MAGA3_HUMAN)
SFSTLVEVTW

SEQ ID NO: 57016 - protein, 10 aa, Artificial Sequence
  Description of Artificial Sequence: Synthetic peptide
  Seed: KASSSLQLVF (MAGA3_HUMAN)
KVSSSLQLVF

SEQ ID NO: 57017 - protein, 10 aa, Artificial Sequence
  Description of Artificial Sequence: Synthetic peptide
  Seed: IFATCLGLSY (MAGA3_HUMAN)
IRATCLGLSF

SEQ ID NO: 57018 - protein, 9 aa, Artificial Sequence
  Description of Artificial Sequence: Synthetic peptide
  Seed: SYVKVLHHM (MAGA3_HUMAN)
SVVKVLHHL

SEQ ID NO: 57019 - protein, 9 aa, Artificial Sequence
  Description of Artificial Sequence: Synthetic peptide
  Seed: VEVTLGEVP (MAGA3_HUMAN)
VEVTLGEVF

SEQ ID NO: 57020 - protein, 9 aa, Artificial Sequence
  Description of Artificial Sequence: Synthetic peptide
  Seed: LESEFQAAL (MAGA3_HUMAN)
LRSEFQAAM

SEQ ID NO: 57021 - protein, 11 aa, Artificial Sequence
  Description of Artificial Sequence: Synthetic peptide
  Seed: SNQEEEGPSTF (MAGA3_HUMAN)
SIQEEEGPSTF

SEQ ID NO: 57022 - protein, 9 aa, Artificial Sequence
  Description of Artificial Sequence: Synthetic peptide
  Seed: VVGNWQYFF (MAGA3_HUMAN)
VGGNWQYFW

SEQ ID NO: 57023 - protein, 9 aa, Artificial Sequence
  Description of Artificial Sequence: Synthetic peptide
  Seed: RKVAELVHF (MAGA3_HUMAN)
RLVAELVHY

SEQ ID NO: 57024 - protein, 9 aa, Artificial Sequence
  Description of Artificial Sequence: Synthetic peptide
  Seed: RALVETSYV (MAGA3_HUMAN)
RQLVETSYM

SEQ ID NO: 57025 - protein, 11 aa, Artificial Sequence
  Description of Artificial Sequence: Synthetic peptide
  Seed: HCKPEEGLEAR (MAGA3_HUMAN)
HIKPEEGLEAR

SEQ ID NO: 57026 - protein, 10 aa, Artificial Sequence
  Description of Artificial Sequence: Synthetic peptide
  Seed: FSKASSSLQL (MAGA3_HUMAN)
FMKASSSLQF

SEQ ID NO: 57027 - protein, 8 aa, Artificial Sequence
  Description of Artificial Sequence: Synthetic peptide
  Seed: SYPPLHEW (MAGA3_HUMAN)
SWPPLHEL

SEQ ID NO: 57028 - protein, 9 aa, Artificial Sequence
  Description of Artificial Sequence: Synthetic peptide
  Seed: SILGDPKKL (MAGA3_HUMAN)
SILGDPKKY

SEQ ID NO: 57029 - protein, 9 aa, Artificial Sequence
  Description of Artificial Sequence: Synthetic peptide
  Seed: GASSLPTTM (MAGA3_HUMAN)
GKSSLPTTM

SEQ ID NO: 57030 - protein, 9 aa, Artificial Sequence
  Description of Artificial Sequence: Synthetic peptide
  Seed: KIWEELSVL (MAGA3_HUMAN)
KNWEELSVF

SEQ ID NO: 57031 - protein, 10 aa, Artificial Sequence
  Description of Artificial Sequence: Synthetic peptide
  Seed: LPTTMNYPLW (MAGA3_HUMAN)
LSTTMNYPLW

SEQ ID NO: 57032 - protein, 9 aa, Artificial Sequence
  Description of Artificial Sequence: Synthetic peptide
  Seed: GSVVGNWQY (MAGA3_HUMAN)
GKVVGNWQY

SEQ ID NO: 57033 - protein, 9 aa, Artificial Sequence
  Description of Artificial Sequence: Synthetic peptide
  Seed: AQAPATEEQ (MAGA3_HUMAN)
AMAPATEEF

SEQ ID NO: 57034 - protein, 9 aa, Artificial Sequence
  Description of Artificial Sequence: Synthetic peptide
  Seed: AEMLGSVVG (MAGA3_HUMAN)
AEMLGSVVT

SEQ ID NO: 57035 - protein, 9 aa, Artificial Sequence
  Description of Artificial Sequence: Synthetic peptide
  Seed: ISYPPLHEW (MAGA3_HUMAN)
IAYPPLHEA

SEQ ID NO: 57036 - protein, 10 aa, Artificial Sequence
  Description of Artificial Sequence: Synthetic peptide
  Seed: NWQYFFPVIF (MAGA3_HUMAN)
NDQYFFPVIY

SEQ ID NO: 57037 - protein, 9 aa, Artificial Sequence
  Description of Artificial Sequence: Synthetic peptide
  Seed: IFSKASSSL (MAGA3_HUMAN)
ILSKASSSY

SEQ ID NO: 57038 - protein, 10 aa, Artificial Sequence
  Description of Artificial Sequence: Synthetic peptide
  Seed: MNYPLWSQSY (MAGA3_HUMAN)
MDYPLWSQSW

SEQ ID NO: 57039 - protein, 9 aa, Artificial Sequence
  Description of Artificial Sequence: Synthetic peptide
  Seed: LQLVFGIEL (MAGA3_HUMAN)
LMLVFGIEM

SEQ ID NO: 57040 - protein, 9 aa, Artificial Sequence
  Description of Artificial Sequence: Synthetic peptide
  Seed: AQAPATEEQ (MAGA3_HUMAN)
AQAPATEEL

SEQ ID NO: 57041 - protein, 9 aa, Artificial Sequence
  Description of Artificial Sequence: Synthetic peptide
  Seed: FVQENYLEY (MAGA3_HUMAN)
FMQENYLEI

SEQ ID NO: 57042 - protein, 9 aa, Artificial Sequence
  Description of Artificial Sequence: Synthetic peptide
  Seed: QIMPKAGLL (MAGA3_HUMAN)
QVMPKAGLY

SEQ ID NO: 57043 - protein, 11 aa, Artificial Sequence
  Description of Artificial Sequence: Synthetic peptide
  Seed: AQAPATEEQEA (MAGA3_HUMAN)
AEAPATEEQEC

SEQ ID NO: 57044 - protein, 9 aa, Artificial Sequence
  Description of Artificial Sequence: Synthetic peptide
  Seed: SSLPTTMNY (MAGA3_HUMAN)
SALPTTMNY

SEQ ID NO: 57045 - protein, 9 aa, Artificial Sequence
  Description of Artificial Sequence: Synthetic peptide
  Seed: KVAELVHFL (MAGA3_HUMAN)
KQAELVHFF

SEQ ID NO: 57046 - protein, 9 aa, Artificial Sequence
  Description of Artificial Sequence: Synthetic peptide
  Seed: LESEFQAAL (MAGA3_HUMAN)
LVSEFQAAV

SEQ ID NO: 57047 - protein, 9 aa, Artificial Sequence
  Description of Artificial Sequence: Synthetic peptide
  Seed: AESPDPPQS (MAGA3_HUMAN)
AESPDPPQM

SEQ ID NO: 57048 - protein, 9 aa, Artificial Sequence
  Description of Artificial Sequence: Synthetic peptide
  Seed: TQHFVQENY (MAGA3_HUMAN)
TTHFVQENY

SEQ ID NO: 57049 - protein, 11 aa, Artificial Sequence
  Description of Artificial Sequence: Synthetic peptide
  Seed: YIFATCLGLSY (MAGA3_HUMAN)
YSFATCLGLSY

SEQ ID NO: 57050 - protein, 9 aa, Artificial Sequence
  Description of Artificial Sequence: Synthetic peptide
  Seed: FATCLGLSY (MAGA3_HUMAN)
FPTCLGLSA

SEQ ID NO: 57051 - protein, 10 aa, Artificial Sequence
  Description of Artificial Sequence: Synthetic peptide
  Seed: MVKISGGPHI (MAGA3_HUMAN)
MHKISGGPHM

SEQ ID NO: 57052 - protein, 11 aa, Artificial Sequence
  Description of Artificial Sequence: Synthetic peptide
  Seed: SRKVAELVHFL (MAGA3_HUMAN)
SMKVAELVHFL

SEQ ID NO: 57053 - protein, 9 aa, Artificial Sequence
  Description of Artificial Sequence: Synthetic peptide
  Seed: LESEFQAAL (MAGA3_HUMAN)
LESEFQAAC

SEQ ID NO: 57054 - protein, 9 aa, Artificial Sequence
  Description of Artificial Sequence: Synthetic peptide
  Seed: FVQENYLEY (MAGA3_HUMAN)
FSQENYLEL

SEQ ID NO: 57055 - protein, 9 aa, Artificial Sequence
  Description of Artificial Sequence: Synthetic peptide
  Seed: HLYIFATCL (MAGA3_HUMAN)
HLYIFATCF

SEQ ID NO: 57056 - protein, 11 aa, Artificial Sequence
  Description of Artificial Sequence: Synthetic peptide
  Seed: KVAELVHFLLL (MAGA3_HUMAN)
KMAELVHFLLS

SEQ ID NO: 57057 - protein, 11 aa, Artificial Sequence
  Description of Artificial Sequence: Synthetic peptide
  Seed: LMEVDPIGHLY (MAGA3_HUMAN)
LAEVDPIGHLY

SEQ ID NO: 57058 - protein, 9 aa, Artificial Sequence
  Description of Artificial Sequence: Synthetic peptide
  Seed: GNWQYFFPV (MAGA3_HUMAN)
GIWQYFFPV

SEQ ID NO: 57059 - protein, 9 aa, Artificial Sequence
  Description of Artificial Sequence: Synthetic peptide
  Seed: SILGDPKKL (MAGA3_HUMAN)
SQLGDPKKV

SEQ ID NO: 57060 - protein, 9 aa, Artificial Sequence
  Description of Artificial Sequence: Synthetic peptide
  Seed: FATCLGLSY (MAGA3_HUMAN)
FWTCLGLSM

SEQ ID NO: 57061 - protein, 9 aa, Artificial Sequence
  Description of Artificial Sequence: Synthetic peptide
  Seed: SYVKVLHHM (MAGA3_HUMAN)
SRVKVLHHL

SEQ ID NO: 57062 - protein, 11 aa, Artificial Sequence
  Description of Artificial Sequence: Synthetic peptide
  Seed: WQYFFPVIFSK (MAGA3_HUMAN)
WNYFFPVIFSR

SEQ ID NO: 57063 - protein, 9 aa, Artificial Sequence
  Description of Artificial Sequence: Synthetic peptide
  Seed: SSLPTTMNY (MAGA3_HUMAN)
SVLPTTMNM

SEQ ID NO: 57064 - protein, 9 aa, Artificial Sequence
  Description of Artificial Sequence: Synthetic peptide
  Seed: SSLPTTMNY (MAGA3_HUMAN)
SMLPTTMNL

SEQ ID NO: 57065 - protein, 10 aa, Artificial Sequence
  Description of Artificial Sequence: Synthetic peptide
  Seed: KISGGPHISY (MAGA3_HUMAN)
KYSGGPHISY

SEQ ID NO: 57066 - protein, 10 aa, Artificial Sequence
  Description of Artificial Sequence: Synthetic peptide
  Seed: KASSSLQLVF (MAGA3_HUMAN)
KSSSSLQLVM

SEQ ID NO: 57067 - protein, 10 aa, Artificial Sequence
  Description of Artificial Sequence: Synthetic peptide
  Seed: GLVGAQAPAT (MAGA3_HUMAN)
GLVGAQAPAI

SEQ ID NO: 57068 - protein, 9 aa, Artificial Sequence
  Description of Artificial Sequence: Synthetic peptide
  Seed: YIFATCLGL (MAGA3_HUMAN)
YQFATCLGT

SEQ ID NO: 57069 - protein, 9 aa, Artificial Sequence
  Description of Artificial Sequence: Synthetic peptide
  Seed: GSDPACYEF (MAGA3_HUMAN)
GIDPACYEL

SEQ ID NO: 57070 - protein, 9 aa, Artificial Sequence
  Description of Artificial Sequence: Synthetic peptide
  Seed: MEVDPIGHL (MAGA3_HUMAN)
MGVDPIGHF

SEQ ID NO: 57071 - protein, 10 aa, Artificial Sequence
  Description of Artificial Sequence: Synthetic peptide
  Seed: SLQLVFGIEL (MAGA3_HUMAN)
STQLVFGIEF

SEQ ID NO: 57072 - protein, 10 aa, Artificial Sequence
  Description of Artificial Sequence: Synthetic peptide
  Seed: FSKASSSLQL (MAGA3_HUMAN)
FEKASSSLQF

SEQ ID NO: 57073 - protein, 10 aa, Artificial Sequence
  Description of Artificial Sequence: Synthetic peptide
  Seed: SLPTTMNYPL (MAGA3_HUMAN)
SMPTTMNYPV

SEQ ID NO: 57074 - protein, 8 aa, Artificial Sequence
  Description of Artificial Sequence: Synthetic peptide
  Seed: ASSLPTTM (MAGA3_HUMAN)
ASSLPTTL

SEQ ID NO: 57075 - protein, 9 aa, Artificial Sequence
  Description of Artificial Sequence: Synthetic peptide
  Seed: KVAELVHFL (MAGA3_HUMAN)
KCAELVHFY

SEQ ID NO: 57076 - protein, 9 aa, Artificial Sequence
  Description of Artificial Sequence: Synthetic peptide
  Seed: SVLEVFEGR (MAGA3_HUMAN)
SMLEVFEGL

SEQ ID NO: 57077 - protein, 9 aa, Artificial Sequence
  Description of Artificial Sequence: Synthetic peptide
  Seed: SSLPTTMNY (MAGA3_HUMAN)
SLLPTTMNK

SEQ ID NO: 57078 - protein, 9 aa, Artificial Sequence
  Description of Artificial Sequence: Synthetic peptide
  Seed: MEVDPIGHL (MAGA3_HUMAN)
MRVDPIGHL

SEQ ID NO: 57079 - protein, 10 aa, Artificial Sequence
  Description of Artificial Sequence: Synthetic peptide
  Seed: YFFPVIFSKA (MAGA3_HUMAN)
YYFPVIFSKK

SEQ ID NO: 57080 - protein, 10 aa, Artificial Sequence
  Description of Artificial Sequence: Synthetic peptide
  Seed: RQVPGSDPAC (MAGA3_HUMAN)
RVVPGSDPAF

SEQ ID NO: 57081 - protein, 10 aa, Artificial Sequence
  Description of Artificial Sequence: Synthetic peptide
  Seed: ISYPPLHEWV (MAGA3_HUMAN)
IDYPPLHEWF

SEQ ID NO: 57082 - protein, 9 aa, Artificial Sequence
  Description of Artificial Sequence: Synthetic peptide
  Seed: ASSSLQLVF (MAGA3_HUMAN)
AISSLQLVF

SEQ ID NO: 57083 - protein, 8 aa, Artificial Sequence
  Description of Artificial Sequence: Synthetic peptide
  Seed: SSSTLVEV (MAGA3_HUMAN)
SASTLVEL

SEQ ID NO: 57084 - protein, 10 aa, Artificial Sequence
  Description of Artificial Sequence: Synthetic peptide
  Seed: KVAELVHFLL (MAGA3_HUMAN)
KMAELVHFLI

SEQ ID NO: 57085 - protein, 10 aa, Artificial Sequence
  Description of Artificial Sequence: Synthetic peptide
  Seed: WEELSVLEVF (MAGA3_HUMAN)
WFELSVLEVL

SEQ ID NO: 57086 - protein, 9 aa, Artificial Sequence
  Description of Artificial Sequence: Synthetic peptide
  Seed: SSLQLVFGI (MAGA3_HUMAN)
SMLQLVFGY

SEQ ID NO: 57087 - protein, 9 aa, Artificial Sequence
  Description of Artificial Sequence: Synthetic peptide
  Seed: AQAPATEEQ (MAGA3_HUMAN)
ATAPATEEY

SEQ ID NO: 57088 - protein, 11 aa, Artificial Sequence
  Description of Artificial Sequence: Synthetic peptide
  Seed: SPQGASSLPTT (MAGA3_HUMAN)
SPQGASSLPTM

SEQ ID NO: 57089 - protein, 9 aa, Artificial Sequence
  Description of Artificial Sequence: Synthetic peptide
  Seed: SSLQLVFGI (MAGA3_HUMAN)
SLLQLVFGA

SEQ ID NO: 57090 - protein, 9 aa, Artificial Sequence
  Description of Artificial Sequence: Synthetic peptide
  Seed: NYPLWSQSY (MAGA3_HUMAN)
NRPLWSQSY

SEQ ID NO: 57091 - protein, 10 aa, Artificial Sequence
  Description of Artificial Sequence: Synthetic peptide
  Seed: STFPDLESEF (MAGA3_HUMAN)
SLFPDLESEI

SEQ ID NO: 57092 - protein, 8 aa, Artificial Sequence
  Description of Artificial Sequence: Synthetic peptide
  Seed: LESEFQAA (MAGA3_HUMAN)
LESEFQAV

SEQ ID NO: 57093 - protein, 11 aa, Artificial Sequence
  Description of Artificial Sequence: Synthetic peptide
  Seed: ELSVLEVFEGR (MAGA3_HUMAN)
ETSVLEVFEGK

SEQ ID NO: 57094 - protein, 10 aa, Artificial Sequence
  Description of Artificial Sequence: Synthetic peptide
  Seed: YFFPVIFSKA (MAGA3_HUMAN)
YQFPVIFSKV

SEQ ID NO: 57095 - protein, 10 aa, Artificial Sequence
  Description of Artificial Sequence: Synthetic peptide
  Seed: HISYPPLHEW (MAGA3_HUMAN)
HMSYPPLHEW

SEQ ID NO: 57096 - protein, 9 aa, Artificial Sequence
  Description of Artificial Sequence: Synthetic peptide
  Seed: GPHISYPPL (MAGA3_HUMAN)
GPHISYPPF

SEQ ID NO: 57097 - protein, 9 aa, Artificial Sequence
  Description of Artificial Sequence: Synthetic peptide
  Seed: FATCLGLSY (MAGA3_HUMAN)
FITCLGLSF

SEQ ID NO: 57098 - protein, 9 aa, Artificial Sequence
  Description of Artificial Sequence: Synthetic peptide
  Seed: LGDPKKLLT (MAGA3_HUMAN)
LFDPKKLLM

SEQ ID NO: 57099 - protein, 10 aa, Artificial Sequence
  Description of Artificial Sequence: Synthetic peptide
  Seed: YVKVLHHMVK (MAGA3_HUMAN)
YTKVLHHMVR

SEQ ID NO: 57100 - protein, 9 aa, Artificial Sequence
  Description of Artificial Sequence: Synthetic peptide
  Seed: TSYVKVLHH (MAGA3_HUMAN)
TTYVKVLHV

SEQ ID NO: 57101 - protein, 10 aa, Artificial Sequence
  Description of Artificial Sequence: Synthetic peptide
  Seed: MNYPLWSQSY (MAGA3_HUMAN)
MAYPLWSQSI

SEQ ID NO: 57102 - protein, 10 aa, Artificial Sequence
  Description of Artificial Sequence: Synthetic peptide
  Seed: RKVAELVHFL (MAGA3_HUMAN)
RRVAELVHFI

SEQ ID NO: 57103 - protein, 9 aa, Artificial Sequence
  Description of Artificial Sequence: Synthetic peptide
  Seed: KVAELVHFL (MAGA3_HUMAN)
KKAELVHFY

SEQ ID NO: 57104 - protein, 11 aa, Artificial Sequence
  Description of Artificial Sequence: Synthetic peptide
  Seed: SRKVAELVHFL (MAGA3_HUMAN)
SEKVAELVHFV

SEQ ID NO: 57105 - protein, 10 aa, Artificial Sequence
  Description of Artificial Sequence: Synthetic peptide
  Seed: QYFFPVIFSK (MAGA3_HUMAN)
QRFFPVIFSK

SEQ ID NO: 57106 - protein, 10 aa, Artificial Sequence
  Description of Artificial Sequence: Synthetic peptide
  Seed: KASSSLQLVF (MAGA3_HUMAN)
KRSSSLQLVW

SEQ ID NO: 57107 - protein, 10 aa, Artificial Sequence
  Description of Artificial Sequence: Synthetic peptide
  Seed: KVAELVHFLL (MAGA3_HUMAN)
KIAELVHFLQ

SEQ ID NO: 57108 - protein, 10 aa, Artificial Sequence
  Description of Artificial Sequence: Synthetic peptide
  Seed: FSKASSSLQL (MAGA3_HUMAN)
FRKASSSLQY

SEQ ID NO: 57109 - protein, 10 aa, Artificial Sequence
  Description of Artificial Sequence: Synthetic peptide
  Seed: LGSVVGNWQY (MAGA3_HUMAN)
LWSVVGNWQF

SEQ ID NO: 57110 - protein, 9 aa, Artificial Sequence
  Description of Artificial Sequence: Synthetic peptide
  Seed: GSVVGNWQY (MAGA3_HUMAN)
GYVVGNWQY

SEQ ID NO: 57111 - protein, 10 aa, Artificial Sequence
  Description of Artificial Sequence: Synthetic peptide
  Seed: KISGGPHISY (MAGA3_HUMAN)
KLSGGPHISI

SEQ ID NO: 57112 - protein, 10 aa, Artificial Sequence
  Description of Artificial Sequence: Synthetic peptide
  Seed: FFPVIFSKAS (MAGA3_HUMAN)
FEPVIFSKAV

SEQ ID NO: 57113 - protein, 10 aa, Artificial Sequence
  Description of Artificial Sequence: Synthetic peptide
  Seed: LGSVVGNWQY (MAGA3_HUMAN)
LNSVVGNWQF

SEQ ID NO: 57114 - protein, 9 aa, Artificial Sequence
  Description of Artificial Sequence: Synthetic peptide
  Seed: KVLHHMVKI (MAGA3_HUMAN)
KSLHHMVKA

SEQ ID NO: 57115 - protein, 9 aa, Artificial Sequence
  Description of Artificial Sequence: Synthetic peptide
  Seed: KAGLLIIVL (MAGA3_HUMAN)
KRGLLIIVF

SEQ ID NO: 57116 - protein, 9 aa, Artificial Sequence
  Description of Artificial Sequence: Synthetic peptide
  Seed: VTLGEVPAA (MAGA3_HUMAN)
VALGEVPAY

SEQ ID NO: 57117 - protein, 9 aa, Artificial Sequence
  Description of Artificial Sequence: Synthetic peptide
  Seed: NWQYFFPVI (MAGA3_HUMAN)
NFQYFFPVY

SEQ ID NO: 57118 - protein, 10 aa, Artificial Sequence
  Description of Artificial Sequence: Synthetic peptide
  Seed: TSYVKVLHHM (MAGA3_HUMAN)
TLYVKVLHHW

SEQ ID NO: 57119 - protein, 9 aa, Artificial Sequence
  Description of Artificial Sequence: Synthetic peptide
  Seed: AQAPATEEQ (MAGA3_HUMAN)
ANAPATEEY

SEQ ID NO: 57120 - protein, 10 aa, Artificial Sequence
  Description of Artificial Sequence: Synthetic peptide
  Seed: SYPPLHEWVL (MAGA3_HUMAN)
SYPPLHEWVI

SEQ ID NO: 57121 - protein, 10 aa, Artificial Sequence
  Description of Artificial Sequence: Synthetic peptide
  Seed: TSYVKVLHHM (MAGA3_HUMAN)
TTYVKVLHHI

SEQ ID NO: 57122 - protein, 10 aa, Artificial Sequence
  Description of Artificial Sequence: Synthetic peptide
  Seed: HISYPPLHEW (MAGA3_HUMAN)
HNSYPPLHEF

SEQ ID NO: 57123 - protein, 9 aa, Artificial Sequence
  Description of Artificial Sequence: Synthetic peptide
  Seed: SKASSSLQL (MAGA3_HUMAN)
SQASSSLQY

SEQ ID NO: 57124 - protein, 10 aa, Artificial Sequence
  Description of Artificial Sequence: Synthetic peptide
  Seed: EMLGSVVGNW (MAGA3_HUMAN)
EVLGSVVGNW

SEQ ID NO: 57125 - protein, 11 aa, Artificial Sequence
  Description of Artificial Sequence: Synthetic peptide
  Seed: FLWGPRALVET (MAGA3_HUMAN)
FLWGPRALVEM

SEQ ID NO: 57126 - protein, 8 aa, Artificial Sequence
  Description of Artificial Sequence: Synthetic peptide
  Seed: YPLWSQSY (MAGA3_HUMAN)
YYLWSQSF

SEQ ID NO: 57127 - protein, 9 aa, Artificial Sequence
  Description of Artificial Sequence: Synthetic peptide
  Seed: LGDPKKLLT (MAGA3_HUMAN)
LSDPKKLLV

SEQ ID NO: 57128 - protein, 10 aa, Artificial Sequence
  Description of Artificial Sequence: Synthetic peptide
  Seed: YRQVPGSDPA (MAGA3_HUMAN)
YYQVPGSDPV

SEQ ID NO: 57129 - protein, 10 aa, Artificial Sequence
  Description of Artificial Sequence: Synthetic peptide
  Seed: ASSSLQLVFG (MAGA3_HUMAN)
APSSLQLVFW

SEQ ID NO: 57130 - protein, 11 aa, Artificial Sequence
  Description of Artificial Sequence: Synthetic peptide
  Seed: KVAELVHFLLL (MAGA3_HUMAN)
KMAELVHFLLD

SEQ ID NO: 57131 - protein, 10 aa, Artificial Sequence
  Description of Artificial Sequence: Synthetic peptide
  Seed: AALSRKVAEL (MAGA3_HUMAN)
AELSRKVAEV

SEQ ID NO: 57132 - protein, 11 aa, Artificial Sequence
  Description of Artificial Sequence: Synthetic peptide
  Seed: STFPDLESEFQ (MAGA3_HUMAN)
SIFPDLESEFY

SEQ ID NO: 57133 - protein, 10 aa, Artificial Sequence
  Description of Artificial Sequence: Synthetic peptide
  Seed: TLVEVTLGEV (MAGA3_HUMAN)
TSVEVTLGEV

SEQ ID NO: 57134 - protein, 11 aa, Artificial Sequence
  Description of Artificial Sequence: Synthetic peptide
  Seed: SYPPLHEWVLR (MAGA3_HUMAN)
SWPPLHEWVLL

SEQ ID NO: 57135 - protein, 10 aa, Artificial Sequence
  Description of Artificial Sequence: Synthetic peptide
  Seed: ASSLPTTMNY (MAGA3_HUMAN)
ANSLPTTMNY

SEQ ID NO: 57136 - protein, 9 aa, Artificial Sequence
  Description of Artificial Sequence: Synthetic peptide
  Seed: GSDPACYEF (MAGA3_HUMAN)
GLDPACYEF

SEQ ID NO: 57137 - protein, 10 aa, Artificial Sequence
  Description of Artificial Sequence: Synthetic peptide
  Seed: WEELSVLEVF (MAGA3_HUMAN)
WCELSVLEVL

SEQ ID NO: 57138 - protein, 10 aa, Artificial Sequence
  Description of Artificial Sequence: Synthetic peptide
  Seed: KVAELVHFLL (MAGA3_HUMAN)
KTAELVHFLI

SEQ ID NO: 57139 - protein, 10 aa, Artificial Sequence
  Description of Artificial Sequence: Synthetic peptide
  Seed: MNYPLWSQSY (MAGA3_HUMAN)
MMYPLWSQSL

SEQ ID NO: 57140 - protein, 10 aa, Artificial Sequence
  Description of Artificial Sequence: Synthetic peptide
  Seed: YFFPVIFSKA (MAGA3_HUMAN)
YTFPVIFSKA

SEQ ID NO: 57141 - protein, 11 aa, Artificial Sequence
  Description of Artificial Sequence: Synthetic peptide
  Seed: RQVPGSDPACY (MAGA3_HUMAN)
RLVPGSDPACF

SEQ ID NO: 57142 - protein, 11 aa, Artificial Sequence
  Description of Artificial Sequence: Synthetic peptide
  Seed: KIWEELSVLEV (MAGA3_HUMAN)
KQWEELSVLEI

SEQ ID NO: 57143 - protein, 10 aa, Artificial Sequence
  Description of Artificial Sequence: Synthetic peptide
  Seed: ASSLPTTMNY (MAGA3_HUMAN)
ANSLPTTMNF

SEQ ID NO: 57144 - protein, 9 aa, Artificial Sequence
  Description of Artificial Sequence: Synthetic peptide
  Seed: VKISGGPHI (MAGA3_HUMAN)
VSISGGPHY

SEQ ID NO: 57145 - protein, 9 aa, Artificial Sequence
  Description of Artificial Sequence: Synthetic peptide
  Seed: IMPKAGLLI (MAGA3_HUMAN)
IFPKAGLLY

SEQ ID NO: 57146 - protein, 10 aa, Artificial Sequence
  Description of Artificial Sequence: Synthetic peptide
  Seed: LVHFLLLKYR (MAGA3_HUMAN)
LLHFLLLKYR

SEQ ID NO: 57147 - protein, 11 aa, Artificial Sequence
  Description of Artificial Sequence: Synthetic peptide
  Seed: HISYPPLHEWV (MAGA3_HUMAN)
HRSYPPLHEWW

SEQ ID NO: 57148 - protein, 9 aa, Artificial Sequence
  Description of Artificial Sequence: Synthetic peptide
  Seed: VKISGGPHI (MAGA3_HUMAN)
VMISGGPHL

SEQ ID NO: 57149 - protein, 9 aa, Artificial Sequence
  Description of Artificial Sequence: Synthetic peptide
  Seed: KIWEELSVL (MAGA3_HUMAN)
KHWEELSVY

SEQ ID NO: 57150 - protein, 10 aa, Artificial Sequence
  Description of Artificial Sequence: Synthetic peptide
  Seed: MVKISGGPHI (MAGA3_HUMAN)
MAKISGGPHK

SEQ ID NO: 57151 - protein, 10 aa, Artificial Sequence
  Description of Artificial Sequence: Synthetic peptide
  Seed: FSKASSSLQL (MAGA3_HUMAN)
FKKASSSLQM

SEQ ID NO: 57152 - protein, 10 aa, Artificial Sequence
  Description of Artificial Sequence: Synthetic peptide
  Seed: YIFATCLGLS (MAGA3_HUMAN)
YQFATCLGLL

SEQ ID NO: 57153 - protein, 10 aa, Artificial Sequence
  Description of Artificial Sequence: Synthetic peptide
  Seed: FLWGPRALVE (MAGA3_HUMAN)
FIWGPRALVI

SEQ ID NO: 57154 - protein, 9 aa, Artificial Sequence
  Description of Artificial Sequence: Synthetic peptide
  Seed: HLYIFATCL (MAGA3_HUMAN)
HAYIFATCL

SEQ ID NO: 57155 - protein, 10 aa, Artificial Sequence
  Description of Artificial Sequence: Synthetic peptide
  Seed: YLEYRQVPGS (MAGA3_HUMAN)
YQEYRQVPGV

SEQ ID NO: 57156 - protein, 8 aa, Artificial Sequence
  Description of Artificial Sequence: Synthetic peptide
  Seed: SEFQAALS (MAGA3_HUMAN)
SEFQAALV

SEQ ID NO: 57157 - protein, 10 aa, Artificial Sequence
  Description of Artificial Sequence: Synthetic peptide
  Seed: EALGLVGAQA (MAGA3_HUMAN)
ETLGLVGAQL

SEQ ID NO: 57158 - protein, 10 aa, Artificial Sequence
  Description of Artificial Sequence: Synthetic peptide
  Seed: HFVQENYLEY (MAGA3_HUMAN)
HWVQENYLEY

SEQ ID NO: 57159 - protein, 10 aa, Artificial Sequence
  Description of Artificial Sequence: Synthetic peptide
  Seed: VEVTLGEVPA (MAGA3_HUMAN)
VEVTLGEVPL

SEQ ID NO: 57160 - protein, 9 aa, Artificial Sequence
  Description of Artificial Sequence: Synthetic peptide
  Seed: KIWEELSVL (MAGA3_HUMAN)
KLWEELSVV

SEQ ID NO: 57161 - protein, 9 aa, Artificial Sequence
  Description of Artificial Sequence: Synthetic peptide
  Seed: RKVAELVHF (MAGA3_HUMAN)
RRVAELVHF

SEQ ID NO: 57162 - protein, 10 aa, Artificial Sequence
  Description of Artificial Sequence: Synthetic peptide
  Seed: ASSLPTTMNY (MAGA3_HUMAN)
ASSLPTTMNF

SEQ ID NO: 57163 - protein, 9 aa, Artificial Sequence
  Description of Artificial Sequence: Synthetic peptide
  Seed: LGDPKKLLT (MAGA3_HUMAN)
LDDPKKLLL

SEQ ID NO: 57164 - protein, 9 aa, Artificial Sequence
  Description of Artificial Sequence: Synthetic peptide
  Seed: IFSKASSSL (MAGA3_HUMAN)
IFSKASSSM

SEQ ID NO: 57165 - protein, 11 aa, Artificial Sequence
  Description of Artificial Sequence: Synthetic peptide
  Seed: AESPDPPQSPQ (MAGA3_HUMAN)
AESPDPPQSPM

SEQ ID NO: 57166 - protein, 9 aa, Artificial Sequence
  Description of Artificial Sequence: Synthetic peptide
  Seed: SSSSTLVEV (MAGA3_HUMAN)
SQSSTLVEA

SEQ ID NO: 57167 - protein, 9 aa, Artificial Sequence
  Description of Artificial Sequence: Synthetic peptide
  Seed: GASSLPTTM (MAGA3_HUMAN)
GRSSLPTTM

SEQ ID NO: 57168 - protein, 8 aa, Artificial Sequence
  Description of Artificial Sequence: Synthetic peptide
  Seed: EVDPIGHL (MAGA3_HUMAN)
EMDPIGHL

SEQ ID NO: 57169 - protein, 9 aa, Artificial Sequence
  Description of Artificial Sequence: Synthetic peptide
  Seed: IFSKASSSL (MAGA3_HUMAN)
IFSKASSSI

SEQ ID NO: 57170 - protein, 10 aa, Artificial Sequence
  Description of Artificial Sequence: Synthetic peptide
  Seed: SEFQAALSRK (MAGA3_HUMAN)
SVFQAALSRY

SEQ ID NO: 57171 - protein, 10 aa, Artificial Sequence
  Description of Artificial Sequence: Synthetic peptide
  Seed: EVDPIGHLYI (MAGA3_HUMAN)
ETDPIGHLYV

SEQ ID NO: 57172 - protein, 10 aa, Artificial Sequence
  Description of Artificial Sequence: Synthetic peptide
  Seed: SRKVAELVHF (MAGA3_HUMAN)
SQKVAELVHM

SEQ ID NO: 57173 - protein, 9 aa, Artificial Sequence
  Description of Artificial Sequence: Synthetic peptide
  Seed: AQAPATEEQ (MAGA3_HUMAN)
AIAPATEEM

SEQ ID NO: 57174 - protein, 9 aa, Artificial Sequence
  Description of Artificial Sequence: Synthetic peptide
  Seed: YIFATCLGL (MAGA3_HUMAN)
YVFATCLGR

SEQ ID NO: 57175 - protein, 9 aa, Artificial Sequence
  Description of Artificial Sequence: Synthetic peptide
  Seed: FVQENYLEY (MAGA3_HUMAN)
FWQENYLEL

SEQ ID NO: 57176 - protein, 9 aa, Artificial Sequence
  Description of Artificial Sequence: Synthetic peptide
  Seed: YPLWSQSYE (MAGA3_HUMAN)
YLLWSQSYY

SEQ ID NO: 57177 - protein, 9 aa, Artificial Sequence
  Description of Artificial Sequence: Synthetic peptide
  Seed: FQAALSRKV (MAGA3_HUMAN)
FVAALSRKA

SEQ ID NO: 57178 - protein, 8 aa, Artificial Sequence
  Description of Artificial Sequence: Synthetic peptide
  Seed: SYPPLHEW (MAGA3_HUMAN)
SYPPLHEL

SEQ ID NO: 57179 - protein, 9 aa, Artificial Sequence
  Description of Artificial Sequence: Synthetic peptide
  Seed: TFPDLESEF (MAGA3_HUMAN)
TIPDLESEM

SEQ ID NO: 57180 - protein, 11 aa, Artificial Sequence
  Description of Artificial Sequence: Synthetic peptide
  Seed: VKISGGPHISY (MAGA3_HUMAN)
VRISGGPHISF

SEQ ID NO: 57181 - protein, 9 aa, Artificial Sequence
  Description of Artificial Sequence: Synthetic peptide
  Seed: SSTLVEVTL (MAGA3_HUMAN)
STTLVEVTW

SEQ ID NO: 57182 - protein, 9 aa, Artificial Sequence
  Description of Artificial Sequence: Synthetic peptide
  Seed: SSLQLVFGI (MAGA3_HUMAN)
SLLQLVFGL

SEQ ID NO: 57183 - protein, 10 aa, Artificial Sequence
  Description of Artificial Sequence: Synthetic peptide
  Seed: AELVHFLLLK (MAGA3_HUMAN)
AFLVHFLLLK

SEQ ID NO: 57184 - protein, 9 aa, Artificial Sequence
  Description of Artificial Sequence: Synthetic peptide
  Seed: LVHFLLLKY (MAGA3_HUMAN)
LTHFLLLKK

SEQ ID NO: 57185 - protein, 9 aa, Artificial Sequence
  Description of Artificial Sequence: Synthetic peptide
  Seed: ASSSLQLVF (MAGA3_HUMAN)
AQSSLQLVW

SEQ ID NO: 57186 - protein, 10 aa, Artificial Sequence
  Description of Artificial Sequence: Synthetic peptide
  Seed: AESPDPPQSP (MAGA3_HUMAN)
AESPDPPQSV

SEQ ID NO: 57187 - protein, 10 aa, Artificial Sequence
  Description of Artificial Sequence: Synthetic peptide
  Seed: FLWGPRALVE (MAGA3_HUMAN)
FLWGPRALVI

SEQ ID NO: 57188 - protein, 10 aa, Artificial Sequence
  Description of Artificial Sequence: Synthetic peptide
  Seed: ESPDPPQSPQ (MAGA3_HUMAN)
EVPDPPQSPK

SEQ ID NO: 57189 - protein, 9 aa, Artificial Sequence
  Description of Artificial Sequence: Synthetic peptide
  Seed: HLYIFATCL (MAGA3_HUMAN)
HMYIFATCA

SEQ ID NO: 57190 - protein, 8 aa, Artificial Sequence
  Description of Artificial Sequence: Synthetic peptide
  Seed: YPLWSQSY (MAGA3_HUMAN)
YFLWSQSI

SEQ ID NO: 57191 - protein, 9 aa, Artificial Sequence
  Description of Artificial Sequence: Synthetic peptide
  Seed: VETSYVKVL (MAGA3_HUMAN)
VETSYVKVW

SEQ ID NO: 57192 - protein, 9 aa, Artificial Sequence
  Description of Artificial Sequence: Synthetic peptide
  Seed: ALSRKVAEL (MAGA3_HUMAN)
AMSRKVAEF

SEQ ID NO: 57193 - protein, 10 aa, Artificial Sequence
  Description of Artificial Sequence: Synthetic peptide
  Seed: LGSVVGNWQY (MAGA3_HUMAN)
LFSVVGNWQW

SEQ ID NO: 57194 - protein, 9 aa, Artificial Sequence
  Description of Artificial Sequence: Synthetic peptide
  Seed: FQAALSRKV (MAGA3_HUMAN)
FTAALSRKF

SEQ ID NO: 57195 - protein, 9 aa, Artificial Sequence
  Description of Artificial Sequence: Synthetic peptide
  Seed: FQAALSRKV (MAGA3_HUMAN)
FQAALSRKY

SEQ ID NO: 57196 - protein, 10 aa, Artificial Sequence
  Description of Artificial Sequence: Synthetic peptide
  Seed: TSYVKVLHHM (MAGA3_HUMAN)
TEYVKVLHHI

SEQ ID NO: 57197 - protein, 10 aa, Artificial Sequence
  Description of Artificial Sequence: Synthetic peptide
  Seed: ELMEVDPIGH (MAGA3_HUMAN)
EIMEVDPIGR

SEQ ID NO: 57198 - protein, 10 aa, Artificial Sequence
  Description of Artificial Sequence: Synthetic peptide
  Seed: VDPIGHLYIF (MAGA3_HUMAN)
VFPIGHLYIF

SEQ ID NO: 57199 - protein, 9 aa, Artificial Sequence
  Description of Artificial Sequence: Synthetic peptide
  Seed: EFQAALSRK (MAGA3_HUMAN)
EIQAALSRR

SEQ ID NO: 57200 - protein, 10 aa, Artificial Sequence
  Description of Artificial Sequence: Synthetic peptide
  Seed: LYIFATCLGL (MAGA3_HUMAN)
LHIFATCLGV

SEQ ID NO: 57201 - protein, 10 aa, Artificial Sequence
  Description of Artificial Sequence: Synthetic peptide
  Seed: ELVHFLLLKY (MAGA3_HUMAN)
EVVHFLLLKK

SEQ ID NO: 57202 - protein, 9 aa, Artificial Sequence
  Description of Artificial Sequence: Synthetic peptide
  Seed: TFPDLESEF (MAGA3_HUMAN)
TIPDLESEL

SEQ ID NO: 57203 - protein, 9 aa, Artificial Sequence
  Description of Artificial Sequence: Synthetic peptide
  Seed: GNWQYFFPV (MAGA3_HUMAN)
GAWQYFFPA

SEQ ID NO: 57204 - protein, 10 aa, Artificial Sequence
  Description of Artificial Sequence: Synthetic peptide
  Seed: FSKASSSLQL (MAGA3_HUMAN)
FWKASSSLQF

SEQ ID NO: 57205 - protein, 10 aa, Artificial Sequence
  Description of Artificial Sequence: Synthetic peptide
  Seed: KVAELVHFLL (MAGA3_HUMAN)
KIAELVHFLL

SEQ ID NO: 57206 - protein, 9 aa, Artificial Sequence
  Description of Artificial Sequence: Synthetic peptide
  Seed: MLGSVVGNW (MAGA3_HUMAN)
MGGSVVGNW

SEQ ID NO: 57207 - protein, 11 aa, Artificial Sequence
  Description of Artificial Sequence: Synthetic peptide
  Seed: ELVHFLLLKYR (MAGA3_HUMAN)
EVVHFLLLKYR

SEQ ID NO: 57208 - protein, 9 aa, Artificial Sequence
  Description of Artificial Sequence: Synthetic peptide
  Seed: ISGGPHISY (MAGA3_HUMAN)
IAGGPHISI

SEQ ID NO: 57209 - protein, 9 aa, Artificial Sequence
  Description of Artificial Sequence: Synthetic peptide
  Seed: YIFATCLGL (MAGA3_HUMAN)
YMFATCLGR

SEQ ID NO: 57210 - protein, 9 aa, Artificial Sequence
  Description of Artificial Sequence: Synthetic peptide
  Seed: ASSSLQLVF (MAGA3_HUMAN)
AMSSLQLVY

SEQ ID NO: 57211 - protein, 8 aa, Artificial Sequence
  Description of Artificial Sequence: Synthetic peptide
  Seed: FPDLESEF (MAGA3_HUMAN)
FTDLESEL

SEQ ID NO: 57212 - protein, 9 aa, Artificial Sequence
  Description of Artificial Sequence: Synthetic peptide
  Seed: GEALGLVGA (MAGA3_HUMAN)
GEALGLVGV

SEQ ID NO: 57213 - protein, 9 aa, Artificial Sequence
  Description of Artificial Sequence: Synthetic peptide
  Seed: GSDPACYEF (MAGA3_HUMAN)
GFDPACYEI

SEQ ID NO: 57214 - protein, 10 aa, Artificial Sequence
  Description of Artificial Sequence: Synthetic peptide
  Seed: TSYVKVLHHM (MAGA3_HUMAN)
TLYVKVLHHI

SEQ ID NO: 57215 - protein, 10 aa, Artificial Sequence
  Description of Artificial Sequence: Synthetic peptide
  Seed: MNYPLWSQSY (MAGA3_HUMAN)
MIYPLWSQSF

SEQ ID NO: 57216 - protein, 8 aa, Artificial Sequence
  Description of Artificial Sequence: Synthetic peptide
  Seed: FPDLESEF (MAGA3_HUMAN)
FNDLESEF

SEQ ID NO: 57217 - protein, 10 aa, Artificial Sequence
  Description of Artificial Sequence: Synthetic peptide
  Seed: HISYPPLHEW (MAGA3_HUMAN)
HVSYPPLHEW

SEQ ID NO: 57218 - protein, 10 aa, Artificial Sequence
  Description of Artificial Sequence: Synthetic peptide
  Seed: STFPDLESEF (MAGA3_HUMAN)
SSFPDLESER

SEQ ID NO: 57219 - protein, 9 aa, Artificial Sequence
  Description of Artificial Sequence: Synthetic peptide
  Seed: SSLPTTMNY (MAGA3_HUMAN)
SQLPTTMNK

SEQ ID NO: 57220 - protein, 10 aa, Artificial Sequence
  Description of Artificial Sequence: Synthetic peptide
  Seed: WEELSVLEVF (MAGA3_HUMAN)
WDELSVLEVW

SEQ ID NO: 57221 - protein, 11 aa, Artificial Sequence
  Description of Artificial Sequence: Synthetic peptide
  Seed: QHFVQENYLEY (MAGA3_HUMAN)
QQFVQENYLEF

SEQ ID NO: 57222 - protein, 11 aa, Artificial Sequence
  Description of Artificial Sequence: Synthetic peptide
  Seed: EVFEGREDSIL (MAGA3_HUMAN)
EMFEGREDSIR

SEQ ID NO: 57223 - protein, 9 aa, Artificial Sequence
  Description of Artificial Sequence: Synthetic peptide
  Seed: SSLPTTMNY (MAGA3_HUMAN)
SHLPTTMNY

SEQ ID NO: 57224 - protein, 9 aa, Artificial Sequence
  Description of Artificial Sequence: Synthetic peptide
  Seed: ISGGPHISY (MAGA3_HUMAN)
IQGGPHISM

SEQ ID NO: 57225 - protein, 10 aa, Artificial Sequence
  Description of Artificial Sequence: Synthetic peptide
  Seed: RQVPGSDPAC (MAGA3_HUMAN)
RAVPGSDPAF

SEQ ID NO: 57226 - protein, 11 aa, Artificial Sequence
  Description of Artificial Sequence: Synthetic peptide
  Seed: SLPTTMNYPLW (MAGA3_HUMAN)
SFPTTMNYPLF

SEQ ID NO: 57227 - protein, 9 aa, Artificial Sequence
  Description of Artificial Sequence: Synthetic peptide
  Seed: TSYVKVLHH (MAGA3_HUMAN)
TGYVKVLHY

SEQ ID NO: 57228 - protein, 9 aa, Artificial Sequence
  Description of Artificial Sequence: Synthetic peptide
  Seed: KIWEELSVL (MAGA3_HUMAN)
KTWEELSVV

SEQ ID NO: 57229 - protein, 9 aa, Artificial Sequence
  Description of Artificial Sequence: Synthetic peptide
  Seed: SSSSTLVEV (MAGA3_HUMAN)
SRSSTLVEI

SEQ ID NO: 57230 - protein, 10 aa, Artificial Sequence
  Description of Artificial Sequence: Synthetic peptide
  Seed: SSSTLVEVTL (MAGA3_HUMAN)
SRSTLVEVTW

SEQ ID NO: 57231 - protein, 8 aa, Artificial Sequence
  Description of Artificial Sequence: Synthetic peptide
  Seed: EVDPIGHL (MAGA3_HUMAN)
EADPIGHL

SEQ ID NO: 57232 - protein, 9 aa, Artificial Sequence
  Description of Artificial Sequence: Synthetic peptide
  Seed: ISGGPHISY (MAGA3_HUMAN)
IYGGPHISY

SEQ ID NO: 57233 - protein, 9 aa, Artificial Sequence
  Description of Artificial Sequence: Synthetic peptide
  Seed: FPVIFSKAS (MAGA3_HUMAN)
FTVIFSKAY

SEQ ID NO: 57234 - protein, 9 aa, Artificial Sequence
  Description of Artificial Sequence: Synthetic peptide
  Seed: EFQAALSRK (MAGA3_HUMAN)
EAQAALSRR

SEQ ID NO: 57235 - protein, 9 aa, Artificial Sequence
  Description of Artificial Sequence: Synthetic peptide
  Seed: LGDPKKLLT (MAGA3_HUMAN)
LSDPKKLLL

SEQ ID NO: 57236 - protein, 9 aa, Artificial Sequence
  Description of Artificial Sequence: Synthetic peptide
  Seed: SSTLVEVTL (MAGA3_HUMAN)
STTLVEVTY

SEQ ID NO: 57237 - protein, 10 aa, Artificial Sequence
  Description of Artificial Sequence: Synthetic peptide
  Seed: MNYPLWSQSY (MAGA3_HUMAN)
MLYPLWSQSY

SEQ ID NO: 57238 - protein, 9 aa, Artificial Sequence
  Description of Artificial Sequence: Synthetic peptide
  Seed: VTLGEVPAA (MAGA3_HUMAN)
VMLGEVPAA

SEQ ID NO: 57239 - protein, 10 aa, Artificial Sequence
  Description of Artificial Sequence: Synthetic peptide
  Seed: SDPACYEFLW (MAGA3_HUMAN)
SMPACYEFLF

SEQ ID NO: 57240 - protein, 9 aa, Artificial Sequence
  Description of Artificial Sequence: Synthetic peptide
  Seed: FATCLGLSY (MAGA3_HUMAN)
FGTCLGLSF

SEQ ID NO: 57241 - protein, 9 aa, Artificial Sequence
  Description of Artificial Sequence: Synthetic peptide
  Seed: SKASSSLQL (MAGA3_HUMAN)
SEASSSLQY

SEQ ID NO: 57242 - protein, 10 aa, Artificial Sequence
  Description of Artificial Sequence: Synthetic peptide
  Seed: LPTTMNYPLW (MAGA3_HUMAN)
LQTTMNYPLW

SEQ ID NO: 57243 - protein, 10 aa, Artificial Sequence
  Description of Artificial Sequence: Synthetic peptide
  Seed: ISYPPLHEWV (MAGA3_HUMAN)
IPYPPLHEWI

SEQ ID NO: 57244 - protein, 9 aa, Artificial Sequence
  Description of Artificial Sequence: Synthetic peptide
  Seed: MEVDPIGHL (MAGA3_HUMAN)
MTVDPIGHA

SEQ ID NO: 57245 - protein, 9 aa, Artificial Sequence
  Description of Artificial Sequence: Synthetic peptide
  Seed: TFPDLESEF (MAGA3_HUMAN)
TFPDLESEM

SEQ ID NO: 57246 - protein, 10 aa, Artificial Sequence
  Description of Artificial Sequence: Synthetic peptide
  Seed: WEELSVLEVF (MAGA3_HUMAN)
WKELSVLEVM

SEQ ID NO: 57247 - protein, 9 aa, Artificial Sequence
  Description of Artificial Sequence: Synthetic peptide
  Seed: EAASSSSTL (MAGA3_HUMAN)
ETASSSSTF

SEQ ID NO: 57248 - protein, 10 aa, Artificial Sequence
  Description of Artificial Sequence: Synthetic peptide
  Seed: ASSSSTLVEV (MAGA3_HUMAN)
AISSSTLVEL

SEQ ID NO: 57249 - protein, 9 aa, Artificial Sequence
  Description of Artificial Sequence: Synthetic peptide
  Seed: LGDPKKLLT (MAGA3_HUMAN)
LGDPKKLLV

SEQ ID NO: 57250 - protein, 9 aa, Artificial Sequence
  Description of Artificial Sequence: Synthetic peptide
  Seed: LPTTMNYPL (MAGA3_HUMAN)
LPTTMNYPH

SEQ ID NO: 57251 - protein, 10 aa, Artificial Sequence
  Description of Artificial Sequence: Synthetic peptide
  Seed: YFFPVIFSKA (MAGA3_HUMAN)
YMFPVIFSKM

SEQ ID NO: 57252 - protein, 10 aa, Artificial Sequence
  Description of Artificial Sequence: Synthetic peptide
  Seed: LTQHFVQENY (MAGA3_HUMAN)
LTQHFVQENF

SEQ ID NO: 57253 - protein, 8 aa, Artificial Sequence
  Description of Artificial Sequence: Synthetic peptide
  Seed: LGDPKKLL (MAGA3_HUMAN)
LVDPKKLL

SEQ ID NO: 57254 - protein, 11 aa, Artificial Sequence
  Description of Artificial Sequence: Synthetic peptide
  Seed: SNQEEEGPSTF (MAGA3_HUMAN)
SLQEEEGPSTF

SEQ ID NO: 57255 - protein, 9 aa, Artificial Sequence
  Description of Artificial Sequence: Synthetic peptide
  Seed: YFFPVIFSK (MAGA3_HUMAN)
YMFPVIFSV

SEQ ID NO: 57256 - protein, 9 aa, Artificial Sequence
  Description of Artificial Sequence: Synthetic peptide
  Seed: RKVAELVHF (MAGA3_HUMAN)
RHVAELVHF

SEQ ID NO: 57257 - protein, 9 aa, Artificial Sequence
  Description of Artificial Sequence: Synthetic peptide
  Seed: GSDPACYEF (MAGA3_HUMAN)
GVDPACYEI

SEQ ID NO: 57258 - protein, 8 aa, Artificial Sequence
  Description of Artificial Sequence: Synthetic peptide
  Seed: SGGPHISY (MAGA3_HUMAN)
SYGPHISY

SEQ ID NO: 57259 - protein, 9 aa, Artificial Sequence
  Description of Artificial Sequence: Synthetic peptide
  Seed: FATCLGLSY (MAGA3_HUMAN)
FETCLGLSF

SEQ ID NO: 57260 - protein, 9 aa, Artificial Sequence
  Description of Artificial Sequence: Synthetic peptide
  Seed: LGDPKKLLT (MAGA3_HUMAN)
LLDPKKLLV

SEQ ID NO: 57261 - protein, 9 aa, Artificial Sequence
  Description of Artificial Sequence: Synthetic peptide
  Seed: MEVDPIGHL (MAGA3_HUMAN)
MEVDPIGHW

SEQ ID NO: 57262 - protein, 10 aa, Artificial Sequence
  Description of Artificial Sequence: Synthetic peptide
  Seed: ASSSSTLVEV (MAGA3_HUMAN)
AMSSSTLVEV

SEQ ID NO: 57263 - protein, 9 aa, Artificial Sequence
  Description of Artificial Sequence: Synthetic peptide
  Seed: SSSSTLVEV (MAGA3_HUMAN)
SISSTLVEA

SEQ ID NO: 57264 - protein, 9 aa, Artificial Sequence
  Description of Artificial Sequence: Synthetic peptide
  Seed: LESEFQAAL (MAGA3_HUMAN)
LHSEFQAAF

SEQ ID NO: 57265 - protein, 9 aa, Artificial Sequence
  Description of Artificial Sequence: Synthetic peptide
  Seed: GLVGAQAPA (MAGA3_HUMAN)
GIVGAQAPL

SEQ ID NO: 57266 - protein, 9 aa, Artificial Sequence
  Description of Artificial Sequence: Synthetic peptide
  Seed: SYPPLHEWV (MAGA3_HUMAN)
SYPPLHEWW

SEQ ID NO: 57267 - protein, 9 aa, Artificial Sequence
  Description of Artificial Sequence: Synthetic peptide
  Seed: RQVPGSDPA (MAGA3_HUMAN)
RLVPGSDPI

SEQ ID NO: 57268 - protein, 9 aa, Artificial Sequence
  Description of Artificial Sequence: Synthetic peptide
  Seed: SSLPTTMNY (MAGA3_HUMAN)
SVLPTTMNV

SEQ ID NO: 57269 - protein, 9 aa, Artificial Sequence
  Description of Artificial Sequence: Synthetic peptide
  Seed: YIFATCLGL (MAGA3_HUMAN)
YLFATCLGV

SEQ ID NO: 57270 - protein, 9 aa, Artificial Sequence
  Description of Artificial Sequence: Synthetic peptide
  Seed: SSLPTTMNY (MAGA3_HUMAN)
SILPTTMNV

SEQ ID NO: 57271 - protein, 9 aa, Artificial Sequence
  Description of Artificial Sequence: Synthetic peptide
  Seed: FVQENYLEY (MAGA3_HUMAN)
FAQENYLEL

SEQ ID NO: 57272 - protein, 10 aa, Artificial Sequence
  Description of Artificial Sequence: Synthetic peptide
  Seed: RKVAELVHFL (MAGA3_HUMAN)
RIVAELVHFL

SEQ ID NO: 57273 - protein, 9 aa, Artificial Sequence
  Description of Artificial Sequence: Synthetic peptide
  Seed: TFPDLESEF (MAGA3_HUMAN)
TCPDLESEM

SEQ ID NO: 57274 - protein, 9 aa, Artificial Sequence
  Description of Artificial Sequence: Synthetic peptide
  Seed: YFFPVIFSK (MAGA3_HUMAN)
YTFPVIFSY

SEQ ID NO: 57275 - protein, 9 aa, Artificial Sequence
  Description of Artificial Sequence: Synthetic peptide
  Seed: VKISGGPHI (MAGA3_HUMAN)
VAISGGPHF

SEQ ID NO: 57276 - protein, 9 aa, Artificial Sequence
  Description of Artificial Sequence: Synthetic peptide
  Seed: EVDPIGHLY (MAGA3_HUMAN)
EIDPIGHLV

SEQ ID NO: 57277 - protein, 9 aa, Artificial Sequence
  Description of Artificial Sequence: Synthetic peptide
  Seed: ISYPPLHEW (MAGA3_HUMAN)
INYPPLHEI

SEQ ID NO: 57278 - protein, 9 aa, Artificial Sequence
  Description of Artificial Sequence: Synthetic peptide
  Seed: EALGLVGAQ (MAGA3_HUMAN)
EVLGLVGAK

SEQ ID NO: 57279 - protein, 9 aa, Artificial Sequence
  Description of Artificial Sequence: Synthetic peptide
  Seed: FATCLGLSY (MAGA3_HUMAN)
FFTCLGLSM

SEQ ID NO: 57280 - protein, 10 aa, Artificial Sequence
  Description of Artificial Sequence: Synthetic peptide
  Seed: STFPDLESEF (MAGA3_HUMAN)
SWFPDLESEF

SEQ ID NO: 57281 - protein, 11 aa, Artificial Sequence
  Description of Artificial Sequence: Synthetic peptide
  Seed: STLVEVTLGEV (MAGA3_HUMAN)
SYLVEVTLGEV

SEQ ID NO: 57282 - protein, 9 aa, Artificial Sequence
  Description of Artificial Sequence: Synthetic peptide
  Seed: ISYPPLHEW (MAGA3_HUMAN)
IAYPPLHEI

SEQ ID NO: 57283 - protein, 9 aa, Artificial Sequence
  Description of Artificial Sequence: Synthetic peptide
  Seed: FQAALSRKV (MAGA3_HUMAN)
FLAALSRKM

SEQ ID NO: 57284 - protein, 11 aa, Artificial Sequence
  Description of Artificial Sequence: Synthetic peptide
  Seed: RALVETSYVKV (MAGA3_HUMAN)
RFLVETSYVKV

SEQ ID NO: 57285 - protein, 11 aa, Artificial Sequence
  Description of Artificial Sequence: Synthetic peptide
  Seed: SKASSSLQLVF (MAGA3_HUMAN)
STASSSLQLVW

SEQ ID NO: 57286 - protein, 10 aa, Artificial Sequence
  Description of Artificial Sequence: Synthetic peptide
  Seed: RQVPGSDPAC (MAGA3_HUMAN)
REVPGSDPAY

SEQ ID NO: 57287 - protein, 10 aa, Artificial Sequence
  Description of Artificial Sequence: Synthetic peptide
  Seed: SEFQAALSRK (MAGA3_HUMAN)
SGFQAALSRR

SEQ ID NO: 57288 - protein, 8 aa, Artificial Sequence
  Description of Artificial Sequence: Synthetic peptide
  Seed: YPLWSQSY (MAGA3_HUMAN)
YWLWSQSM

SEQ ID NO: 57289 - protein, 9 aa, Artificial Sequence
  Description of Artificial Sequence: Synthetic peptide
  Seed: MEVDPIGHL (MAGA3_HUMAN)
MLVDPIGHF

SEQ ID NO: 57290 - protein, 9 aa, Artificial Sequence
  Description of Artificial Sequence: Synthetic peptide
  Seed: YPLWSQSYE (MAGA3_HUMAN)
YPLWSQSYH

SEQ ID NO: 57291 - protein, 11 aa, Artificial Sequence
  Description of Artificial Sequence: Synthetic peptide
  Seed: KVAELVHFLLL (MAGA3_HUMAN)
KLAELVHFLLE

SEQ ID NO: 57292 - protein, 9 aa, Artificial Sequence
  Description of Artificial Sequence: Synthetic peptide
  Seed: FQAALSRKV (MAGA3_HUMAN)
FLAALSRKT

SEQ ID NO: 57293 - protein, 10 aa, Artificial Sequence
  Description of Artificial Sequence: Synthetic peptide
  Seed: DLESEFQAAL (MAGA3_HUMAN)
DMESEFQAAY

SEQ ID NO: 57294 - protein, 9 aa, Artificial Sequence
  Description of Artificial Sequence: Synthetic peptide
  Seed: RQVPGSDPA (MAGA3_HUMAN)
REVPGSDPV

SEQ ID NO: 57295 - protein, 9 aa, Artificial Sequence
  Description of Artificial Sequence: Synthetic peptide
  Seed: FVQENYLEY (MAGA3_HUMAN)
FTQENYLEI

SEQ ID NO: 57296 - protein, 10 aa, Artificial Sequence
  Description of Artificial Sequence: Synthetic peptide
  Seed: HFLLLKYRAR (MAGA3_HUMAN)
HSLLLKYRAR

SEQ ID NO: 57297 - protein, 9 aa, Artificial Sequence
  Description of Artificial Sequence: Synthetic peptide
  Seed: SSSSTLVEV (MAGA3_HUMAN)
SSSSTLVEY

SEQ ID NO: 57298 - protein, 11 aa, Artificial Sequence
  Description of Artificial Sequence: Synthetic peptide
  Seed: LSRKVAELVHF (MAGA3_HUMAN)
LTRKVAELVHW

SEQ ID NO: 57299 - protein, 10 aa, Artificial Sequence
  Description of Artificial Sequence: Synthetic peptide
  Seed: TSYVKVLHHM (MAGA3_HUMAN)
TAYVKVLHHI

SEQ ID NO: 57300 - protein, 10 aa, Artificial Sequence
  Description of Artificial Sequence: Synthetic peptide
  Seed: MEVDPIGHLY (MAGA3_HUMAN)
MYVDPIGHLM

SEQ ID NO: 57301 - protein, 9 aa, Artificial Sequence
  Description of Artificial Sequence: Synthetic peptide
  Seed: GDNQIMPKA (MAGA3_HUMAN)
GENQIMPKC

SEQ ID NO: 57302 - protein, 10 aa, Artificial Sequence
  Description of Artificial Sequence: Synthetic peptide
  Seed: AALSRKVAEL (MAGA3_HUMAN)
AKLSRKVAEV

SEQ ID NO: 57303 - protein, 9 aa, Artificial Sequence
  Description of Artificial Sequence: Synthetic peptide
  Seed: GEALGLVGA (MAGA3_HUMAN)
GEALGLVGP

SEQ ID NO: 57304 - protein, 10 aa, Artificial Sequence
  Description of Artificial Sequence: Synthetic peptide
  Seed: SSSTLVEVTL (MAGA3_HUMAN)
SGSTLVEVTW

SEQ ID NO: 57305 - protein, 11 aa, Artificial Sequence
  Description of Artificial Sequence: Synthetic peptide
  Seed: FLWGPRALVET (MAGA3_HUMAN)
FLWGPRALVEL

SEQ ID NO: 57306 - protein, 9 aa, Artificial Sequence
  Description of Artificial Sequence: Synthetic peptide
  Seed: MPKAGLLII (MAGA3_HUMAN)
MQKAGLLIY

SEQ ID NO: 57307 - protein, 11 aa, Artificial Sequence
  Description of Artificial Sequence: Synthetic peptide
  Seed: ISYPPLHEWVL (MAGA3_HUMAN)
ITYPPLHEWVF

SEQ ID NO: 57308 - protein, 9 aa, Artificial Sequence
  Description of Artificial Sequence: Synthetic peptide
  Seed: MPLEQRSQH (MAGA3_HUMAN)
MPLEQRSQL

SEQ ID NO: 57309 - protein, 9 aa, Artificial Sequence
  Description of Artificial Sequence: Synthetic peptide
  Seed: KVLHHMVKI (MAGA3_HUMAN)
KQLHHMVKI

SEQ ID NO: 57310 - protein, 9 aa, Artificial Sequence
  Description of Artificial Sequence: Synthetic peptide
  Seed: LGDPKKLLT (MAGA3_HUMAN)
LLDPKKLLI

SEQ ID NO: 57311 - protein, 9 aa, Artificial Sequence
  Description of Artificial Sequence: Synthetic peptide
  Seed: FQAALSRKV (MAGA3_HUMAN)
FAAALSRKI

SEQ ID NO: 57312 - protein, 10 aa, Artificial Sequence
  Description of Artificial Sequence: Synthetic peptide
  Seed: ASSLPTTMNY (MAGA3_HUMAN)
APSLPTTMNK

SEQ ID NO: 57313 - protein, 8 aa, Artificial Sequence
  Description of Artificial Sequence: Synthetic peptide
  Seed: VLHHMVKI (MAGA3_HUMAN)
VQHHMVKV

SEQ ID NO: 57314 - protein, 9 aa, Artificial Sequence
  Description of Artificial Sequence: Synthetic peptide
  Seed: KVAELVHFL (MAGA3_HUMAN)
KMAELVHFV

SEQ ID NO: 57315 - protein, 10 aa, Artificial Sequence
  Description of Artificial Sequence: Synthetic peptide
  Seed: VDPIGHLYIF (MAGA3_HUMAN)
VTPIGHLYIW

SEQ ID NO: 57316 - protein, 10 aa, Artificial Sequence
  Description of Artificial Sequence: Synthetic peptide
  Seed: QGASSLPTTM (MAGA3_HUMAN)
QAASSLPTTM

SEQ ID NO: 57317 - protein, 10 aa, Artificial Sequence
  Description of Artificial Sequence: Synthetic peptide
  Seed: ALVETSYVKV (MAGA3_HUMAN)
AMVETSYVKL

SEQ ID NO: 57318 - protein, 9 aa, Artificial Sequence
  Description of Artificial Sequence: Synthetic peptide
  Seed: SYVKVLHHM (MAGA3_HUMAN)
SFVKVLHHI

SEQ ID NO: 57319 - protein, 10 aa, Artificial Sequence
  Description of Artificial Sequence: Synthetic peptide
  Seed: NQEEEGPSTF (MAGA3_HUMAN)
NEEEEGPSTW

SEQ ID NO: 57320 - protein, 8 aa, Artificial Sequence
  Description of Artificial Sequence: Synthetic peptide
  Seed: SYPPLHEW (MAGA3_HUMAN)
SWPPLHEY

SEQ ID NO: 57321 - protein, 9 aa, Artificial Sequence
  Description of Artificial Sequence: Synthetic peptide
  Seed: GSDPACYEF (MAGA3_HUMAN)
GSDPACYEY

SEQ ID NO: 57322 - protein, 9 aa, Artificial Sequence
  Description of Artificial Sequence: Synthetic peptide
  Seed: KVLHHMVKI (MAGA3_HUMAN)
KTLHHMVKY

SEQ ID NO: 57323 - protein, 9 aa, Artificial Sequence
  Description of Artificial Sequence: Synthetic peptide
  Seed: EALGLVGAQ (MAGA3_HUMAN)
ETLGLVGAR

SEQ ID NO: 57324 - protein, 9 aa, Artificial Sequence
  Description of Artificial Sequence: Synthetic peptide
  Seed: YIFATCLGL (MAGA3_HUMAN)
YTFATCLGI

SEQ ID NO: 57325 - protein, 9 aa, Artificial Sequence
  Description of Artificial Sequence: Synthetic peptide
  Seed: ISGGPHISY (MAGA3_HUMAN)
ITGGPHISV

SEQ ID NO: 57326 - protein, 9 aa, Artificial Sequence
  Description of Artificial Sequence: Synthetic peptide
  Seed: QEEEGPSTF (MAGA3_HUMAN)
QLEEGPSTL

SEQ ID NO: 57327 - protein, 10 aa, Artificial Sequence
  Description of Artificial Sequence: Synthetic peptide
  Seed: FSKASSSLQL (MAGA3_HUMAN)
FFKASSSLQF

SEQ ID NO: 57328 - protein, 11 aa, Artificial Sequence
  Description of Artificial Sequence: Synthetic peptide
  Seed: SRKVAELVHFL (MAGA3_HUMAN)
SDKVAELVHFV

SEQ ID NO: 57329 - protein, 10 aa, Artificial Sequence
  Description of Artificial Sequence: Synthetic peptide
  Seed: QYFFPVIFSK (MAGA3_HUMAN)
QPFFPVIFSR

SEQ ID NO: 57330 - protein, 10 aa, Artificial Sequence
  Description of Artificial Sequence: Synthetic peptide
  Seed: DLESEFQAAL (MAGA3_HUMAN)
DGESEFQAAY

SEQ ID NO: 57331 - protein, 9 aa, Artificial Sequence
  Description of Artificial Sequence: Synthetic peptide
  Seed: ASSSLQLVF (MAGA3_HUMAN)
AVSSLQLVV

SEQ ID NO: 57332 - protein, 9 aa, Artificial Sequence
  Description of Artificial Sequence: Synthetic peptide
  Seed: ASSSLQLVF (MAGA3_HUMAN)
AMSSLQLVF

SEQ ID NO: 57333 - protein, 10 aa, Artificial Sequence
  Description of Artificial Sequence: Synthetic peptide
  Seed: HISYPPLHEW (MAGA3_HUMAN)
HWSYPPLHEW

SEQ ID NO: 57334 - protein, 9 aa, Artificial Sequence
  Description of Artificial Sequence: Synthetic peptide
  Seed: ISGGPHISY (MAGA3_HUMAN)
IYGGPHISM

SEQ ID NO: 57335 - protein, 10 aa, Artificial Sequence
  Description of Artificial Sequence: Synthetic peptide
  Seed: KVAELVHFLL (MAGA3_HUMAN)
KMAELVHFLM

SEQ ID NO: 57336 - protein, 9 aa, Artificial Sequence
  Description of Artificial Sequence: Synthetic peptide
  Seed: LSRKVAELV (MAGA3_HUMAN)
LIRKVAELW

SEQ ID NO: 57337 - protein, 11 aa, Artificial Sequence
  Description of Artificial Sequence: Synthetic peptide
  Seed: MLGSVVGNWQY (MAGA3_HUMAN)
MRGSVVGNWQW

SEQ ID NO: 57338 - protein, 9 aa, Artificial Sequence
  Description of Artificial Sequence: Synthetic peptide
  Seed: KVLHHMVKI (MAGA3_HUMAN)
KSLHHMVKL

SEQ ID NO: 57339 - protein, 11 aa, Artificial Sequence
  Description of Artificial Sequence: Synthetic peptide
  Seed: KVAELVHFLLL (MAGA3_HUMAN)
KLAELVHFLLP

SEQ ID NO: 57340 - protein, 10 aa, Artificial Sequence
  Description of Artificial Sequence: Synthetic peptide
  Seed: SLPTTMNYPL (MAGA3_HUMAN)
SAPTTMNYPM

SEQ ID NO: 57341 - protein, 9 aa, Artificial Sequence
  Description of Artificial Sequence: Synthetic peptide
  Seed: ISGGPHISY (MAGA3_HUMAN)
IPGGPHISL

SEQ ID NO: 57342 - protein, 10 aa, Artificial Sequence
  Description of Artificial Sequence: Synthetic peptide
  Seed: SEFQAALSRK (MAGA3_HUMAN)
STFQAALSRL

SEQ ID NO: 57343 - protein, 9 aa, Artificial Sequence
  Description of Artificial Sequence: Synthetic peptide
  Seed: NYPLWSQSY (MAGA3_HUMAN)
NYPLWSQSF

SEQ ID NO: 57344 - protein, 9 aa, Artificial Sequence
  Description of Artificial Sequence: Synthetic peptide
  Seed: LGDPKKLLT (MAGA3_HUMAN)
LMDPKKLLM

SEQ ID NO: 57345 - protein, 9 aa, Artificial Sequence
  Description of Artificial Sequence: Synthetic peptide
  Seed: SVVGNWQYF (MAGA3_HUMAN)
SRVGNWQYM

SEQ ID NO: 57346 - protein, 10 aa, Artificial Sequence
  Description of Artificial Sequence: Synthetic peptide
  Seed: HISYPPLHEW (MAGA3_HUMAN)
HGSYPPLHEW

SEQ ID NO: 57347 - protein, 11 aa, Artificial Sequence
  Description of Artificial Sequence: Synthetic peptide
  Seed: KVAELVHFLLL (MAGA3_HUMAN)
KMAELVHFLLA

SEQ ID NO: 57348 - protein, 10 aa, Artificial Sequence
  Description of Artificial Sequence: Synthetic peptide
  Seed: LGSVVGNWQY (MAGA3_HUMAN)
LLSVVGNWQF

SEQ ID NO: 57349 - protein, 9 aa, Artificial Sequence
  Description of Artificial Sequence: Synthetic peptide
  Seed: KVAELVHFL (MAGA3_HUMAN)
KLAELVHFS

SEQ ID NO: 57350 - protein, 10 aa, Artificial Sequence
  Description of Artificial Sequence: Synthetic peptide
  Seed: KVAELVHFLL (MAGA3_HUMAN)
KEAELVHFLW

SEQ ID NO: 57351 - protein, 9 aa, Artificial Sequence
  Description of Artificial Sequence: Synthetic peptide
  Seed: ISYPPLHEW (MAGA3_HUMAN)
IGYPPLHEH

SEQ ID NO: 57352 - protein, 9 aa, Artificial Sequence
  Description of Artificial Sequence: Synthetic peptide
  Seed: LPTTMNYPL (MAGA3_HUMAN)
LPTTMNYPA

SEQ ID NO: 57353 - protein, 10 aa, Artificial Sequence
  Description of Artificial Sequence: Synthetic peptide
  Seed: GNWQYFFPVI (MAGA3_HUMAN)
GKWQYFFPVF

SEQ ID NO: 57354 - protein, 9 aa, Artificial Sequence
  Description of Artificial Sequence: Synthetic peptide
  Seed: KVLHHMVKI (MAGA3_HUMAN)
KFLHHMVKK

SEQ ID NO: 57355 - protein, 9 aa, Artificial Sequence
  Description of Artificial Sequence: Synthetic peptide
  Seed: ALSRKVAEL (MAGA3_HUMAN)
AFSRKVAEL

SEQ ID NO: 57356 - protein, 10 aa, Artificial Sequence
  Description of Artificial Sequence: Synthetic peptide
  Seed: RQVPGSDPAC (MAGA3_HUMAN)
RLVPGSDPAI

SEQ ID NO: 57357 - protein, 11 aa, Artificial Sequence
  Description of Artificial Sequence: Synthetic peptide
  Seed: ISYPPLHEWVL (MAGA3_HUMAN)
IFYPPLHEWVF

SEQ ID NO: 57358 - protein, 10 aa, Artificial Sequence
  Description of Artificial Sequence: Synthetic peptide
  Seed: KASSSLQLVF (MAGA3_HUMAN)
KYSSSLQLVI

SEQ ID NO: 57359 - protein, 8 aa, Artificial Sequence
  Description of Artificial Sequence: Synthetic peptide
  Seed: SYPPLHEW (MAGA3_HUMAN)
SFPPLHEF

SEQ ID NO: 57360 - protein, 10 aa, Artificial Sequence
  Description of Artificial Sequence: Synthetic peptide
  Seed: ESPDPPQSPQ (MAGA3_HUMAN)
ETPDPPQSPR

SEQ ID NO: 57361 - protein, 9 aa, Artificial Sequence
  Description of Artificial Sequence: Synthetic peptide
  Seed: LQLVFGIEL (MAGA3_HUMAN)
LRLVFGIEL

SEQ ID NO: 57362 - protein, 9 aa, Artificial Sequence
  Description of Artificial Sequence: Synthetic peptide
  Seed: KIWEELSVL (MAGA3_HUMAN)
KVWEELSVA

SEQ ID NO: 57363 - protein, 9 aa, Artificial Sequence
  Description of Artificial Sequence: Synthetic peptide
  Seed: WQYFFPVIF (MAGA3_HUMAN)
WHYFFPVIF

SEQ ID NO: 57364 - protein, 10 aa, Artificial Sequence
  Description of Artificial Sequence: Synthetic peptide
  Seed: WEELSVLEVF (MAGA3_HUMAN)
WYELSVLEVW

SEQ ID NO: 57365 - protein, 11 aa, Artificial Sequence
  Description of Artificial Sequence: Synthetic peptide
  Seed: SRKVAELVHFL (MAGA3_HUMAN)
SLKVAELVHFA

SEQ ID NO: 57366 - protein, 9 aa, Artificial Sequence
  Description of Artificial Sequence: Synthetic peptide
  Seed: ISYPPLHEW (MAGA3_HUMAN)
ILYPPLHEF

SEQ ID NO: 57367 - protein, 10 aa, Artificial Sequence
  Description of Artificial Sequence: Synthetic peptide
  Seed: HFLLLKYRAR (MAGA3_HUMAN)
HYLLLKYRAR

SEQ ID NO: 57368 - protein, 9 aa, Artificial Sequence
  Description of Artificial Sequence: Synthetic peptide
  Seed: SKASSSLQL (MAGA3_HUMAN)
SRASSSLQM

SEQ ID NO: 57369 - protein, 10 aa, Artificial Sequence
  Description of Artificial Sequence: Synthetic peptide
  Seed: MNYPLWSQSY (MAGA3_HUMAN)
MMYPLWSQSH

SEQ ID NO: 57370 - protein, 11 aa, Artificial Sequence
  Description of Artificial Sequence: Synthetic peptide
  Seed: STLVEVTLGEV (MAGA3_HUMAN)
SFLVEVTLGEV

SEQ ID NO: 57371 - protein, 9 aa, Artificial Sequence
  Description of Artificial Sequence: Synthetic peptide
  Seed: ISYPPLHEW (MAGA3_HUMAN)
INYPPLHEY

SEQ ID NO: 57372 - protein, 9 aa, Artificial Sequence
  Description of Artificial Sequence: Synthetic peptide
  Seed: ASSSLQLVF (MAGA3_HUMAN)
AYSSLQLVF

SEQ ID NO: 57373 - protein, 10 aa, Artificial Sequence
  Description of Artificial Sequence: Synthetic peptide
  Seed: FSKASSSLQL (MAGA3_HUMAN)
FSKASSSLQM

SEQ ID NO: 57374 - protein, 10 aa, Artificial Sequence
  Description of Artificial Sequence: Synthetic peptide
  Seed: FFPVIFSKAS (MAGA3_HUMAN)
FGPVIFSKAA

SEQ ID NO: 57375 - protein, 10 aa, Artificial Sequence
  Description of Artificial Sequence: Synthetic peptide
  Seed: TLVEVTLGEV (MAGA3_HUMAN)
TTVEVTLGEV

SEQ ID NO: 57376 - protein, 10 aa, Artificial Sequence
  Description of Artificial Sequence: Synthetic peptide
  Seed: EVFEGREDSI (MAGA3_HUMAN)
EAFEGREDSW

SEQ ID NO: 57377 - protein, 9 aa, Artificial Sequence
  Description of Artificial Sequence: Synthetic peptide
  Seed: QAALSRKVA (MAGA3_HUMAN)
QPALSRKVA

SEQ ID NO: 57378 - protein, 9 aa, Artificial Sequence
  Description of Artificial Sequence: Synthetic peptide
  Seed: ISYPPLHEW (MAGA3_HUMAN)
IKYPPLHEF

SEQ ID NO: 57379 - protein, 9 aa, Artificial Sequence
  Description of Artificial Sequence: Synthetic peptide
  Seed: WQYFFPVIF (MAGA3_HUMAN)
WRYFFPVIY

SEQ ID NO: 57380 - protein, 9 aa, Artificial Sequence
  Description of Artificial Sequence: Synthetic peptide
  Seed: SRKVAELVH (MAGA3_HUMAN)
SRKVAELVY

SEQ ID NO: 57381 - protein, 8 aa, Artificial Sequence
  Description of Artificial Sequence: Synthetic peptide
  Seed: YPLWSQSY (MAGA3_HUMAN)
YYLWSQSV

SEQ ID NO: 57382 - protein, 11 aa, Artificial Sequence
  Description of Artificial Sequence: Synthetic peptide
  Seed: SNQEEEGPSTF (MAGA3_HUMAN)
SIQEEEGPSTW

SEQ ID NO: 57383 - protein, 10 aa, Artificial Sequence
  Description of Artificial Sequence: Synthetic peptide
  Seed: FSKASSSLQL (MAGA3_HUMAN)
FPKASSSLQF

SEQ ID NO: 57384 - protein, 11 aa, Artificial Sequence
  Description of Artificial Sequence: Synthetic peptide
  Seed: FLWGPRALVET (MAGA3_HUMAN)
FQWGPRALVEV

SEQ ID NO: 57385 - protein, 10 aa, Artificial Sequence
  Description of Artificial Sequence: Synthetic peptide
  Seed: ISYPPLHEWV (MAGA3_HUMAN)
IWYPPLHEWW

SEQ ID NO: 57386 - protein, 9 aa, Artificial Sequence
  Description of Artificial Sequence: Synthetic peptide
  Seed: ISGGPHISY (MAGA3_HUMAN)
IAGGPHISV

SEQ ID NO: 57387 - protein, 10 aa, Artificial Sequence
  Description of Artificial Sequence: Synthetic peptide
  Seed: KISGGPHISY (MAGA3_HUMAN)
KESGGPHISY

SEQ ID NO: 57388 - protein, 9 aa, Artificial Sequence
  Description of Artificial Sequence: Synthetic peptide
  Seed: SSSSTLVEV (MAGA3_HUMAN)
SSSSTLVEW

SEQ ID NO: 57389 - protein, 10 aa, Artificial Sequence
  Description of Artificial Sequence: Synthetic peptide
  Seed: SYVKVLHHMV (MAGA3_HUMAN)
SYVKVLHHMF

SEQ ID NO: 57390 - protein, 11 aa, Artificial Sequence
  Description of Artificial Sequence: Synthetic peptide
  Seed: SPDPPQSPQGA (MAGA3_HUMAN)
SPDPPQSPQGY

SEQ ID NO: 57391 - protein, 10 aa, Artificial Sequence
  Description of Artificial Sequence: Synthetic peptide
  Seed: KVAELVHFLL (MAGA3_HUMAN)
KVAELVHFLV

SEQ ID NO: 57392 - protein, 10 aa, Artificial Sequence
  Description of Artificial Sequence: Synthetic peptide
  Seed: ASSLPTTMNY (MAGA3_HUMAN)
AGSLPTTMNF

SEQ ID NO: 57393 - protein, 9 aa, Artificial Sequence
  Description of Artificial Sequence: Synthetic peptide
  Seed: YPPLHEWVL (MAGA3_HUMAN)
YAPLHEWVI

SEQ ID NO: 57394 - protein, 9 aa, Artificial Sequence
  Description of Artificial Sequence: Synthetic peptide
  Seed: SYVKVLHHM (MAGA3_HUMAN)
SSVKVLHHM

SEQ ID NO: 57395 - protein, 9 aa, Artificial Sequence
  Description of Artificial Sequence: Synthetic peptide
  Seed: GSDPACYEF (MAGA3_HUMAN)
GMDPACYEL

SEQ ID NO: 57396 - protein, 10 aa, Artificial Sequence
  Description of Artificial Sequence: Synthetic peptide
  Seed: LGSVVGNWQY (MAGA3_HUMAN)
LFSVVGNWQY

SEQ ID NO: 57397 - protein, 9 aa, Artificial Sequence
  Description of Artificial Sequence: Synthetic peptide
  Seed: ISGGPHISY (MAGA3_HUMAN)
IIGGPHISF

SEQ ID NO: 57398 - protein, 9 aa, Artificial Sequence
  Description of Artificial Sequence: Synthetic peptide
  Seed: HLYIFATCL (MAGA3_HUMAN)
HEYIFATCY

SEQ ID NO: 57399 - protein, 9 aa, Artificial Sequence
  Description of Artificial Sequence: Synthetic peptide
  Seed: FQAALSRKV (MAGA3_HUMAN)
FLAALSRKA

SEQ ID NO: 57400 - protein, 9 aa, Artificial Sequence
  Description of Artificial Sequence: Synthetic peptide
  Seed: FPVIFSKAS (MAGA3_HUMAN)
FIVIFSKAY

SEQ ID NO: 57401 - protein, 11 aa, Artificial Sequence
  Description of Artificial Sequence: Synthetic peptide
  Seed: RALVETSYVKV (MAGA3_HUMAN)
RMLVETSYVKV

SEQ ID NO: 57402 - protein, 10 aa, Artificial Sequence
  Description of Artificial Sequence: Synthetic peptide
  Seed: MVKISGGPHI (MAGA3_HUMAN)
MDKISGGPHM

SEQ ID NO: 57403 - protein, 9 aa, Artificial Sequence
  Description of Artificial Sequence: Synthetic peptide
  Seed: MPLEQRSQH (MAGA3_HUMAN)
MPLEQRSQF

SEQ ID NO: 57404 - protein, 9 aa, Artificial Sequence
  Description of Artificial Sequence: Synthetic peptide
  Seed: EAASSSSTL (MAGA3_HUMAN)
EAASSSSTF

SEQ ID NO: 57405 - protein, 9 aa, Artificial Sequence
  Description of Artificial Sequence: Synthetic peptide
  Seed: TSYVKVLHH (MAGA3_HUMAN)
TLYVKVLHK

SEQ ID NO: 57406 - protein, 9 aa, Artificial Sequence
  Description of Artificial Sequence: Synthetic peptide
  Seed: YVKVLHHMV (MAGA3_HUMAN)
YAKVLHHMY

SEQ ID NO: 57407 - protein, 9 aa, Artificial Sequence
  Description of Artificial Sequence: Synthetic peptide
  Seed: FATCLGLSY (MAGA3_HUMAN)
FTTCLGLSR

SEQ ID NO: 57408 - protein, 9 aa, Artificial Sequence
  Description of Artificial Sequence: Synthetic peptide
  Seed: YPLWSQSYE (MAGA3_HUMAN)
YTLWSQSYY

SEQ ID NO: 57409 - protein, 8 aa, Artificial Sequence
  Description of Artificial Sequence: Synthetic peptide
  Seed: EVDPIGHL (MAGA3_HUMAN)
EWDPIGHL

SEQ ID NO: 57410 - protein, 9 aa, Artificial Sequence
  Description of Artificial Sequence: Synthetic peptide
  Seed: FQAALSRKV (MAGA3_HUMAN)
FMAALSRKA

SEQ ID NO: 57411 - protein, 9 aa, Artificial Sequence
  Description of Artificial Sequence: Synthetic peptide
  Seed: SKASSSLQL (MAGA3_HUMAN)
SHASSSLQF

SEQ ID NO: 57412 - protein, 9 aa, Artificial Sequence
  Description of Artificial Sequence: Synthetic peptide
  Seed: MEVDPIGHL (MAGA3_HUMAN)
MSVDPIGHI

SEQ ID NO: 57413 - protein, 10 aa, Artificial Sequence
  Description of Artificial Sequence: Synthetic peptide
  Seed: KISGGPHISY (MAGA3_HUMAN)
KKSGGPHISY

SEQ ID NO: 57414 - protein, 9 aa, Artificial Sequence
  Description of Artificial Sequence: Synthetic peptide
  Seed: ISYPPLHEW (MAGA3_HUMAN)
IRYPPLHEM

SEQ ID NO: 57415 - protein, 10 aa, Artificial Sequence
  Description of Artificial Sequence: Synthetic peptide
  Seed: NWQYFFPVIF (MAGA3_HUMAN)
NYQYFFPVIL

SEQ ID NO: 57416 - protein, 9 aa, Artificial Sequence
  Description of Artificial Sequence: Synthetic peptide
  Seed: MEVDPIGHL (MAGA3_HUMAN)
MIVDPIGHA

SEQ ID NO: 57417 - protein, 9 aa, Artificial Sequence
  Description of Artificial Sequence: Synthetic peptide
  Seed: KVAELVHFL (MAGA3_HUMAN)
KLAELVHFM

SEQ ID NO: 57418 - protein, 9 aa, Artificial Sequence
  Description of Artificial Sequence: Synthetic peptide
  Seed: QEEEGPSTF (MAGA3_HUMAN)
QAEEGPSTY

SEQ ID NO: 57419 - protein, 9 aa, Artificial Sequence
  Description of Artificial Sequence: Synthetic peptide
  Seed: LSRKVAELV (MAGA3_HUMAN)
LVRKVAELK

SEQ ID NO: 57420 - protein, 9 aa, Artificial Sequence
  Description of Artificial Sequence: Synthetic peptide
  Seed: WQYFFPVIF (MAGA3_HUMAN)
WQYFFPVIY

SEQ ID NO: 57421 - protein, 9 aa, Artificial Sequence
  Description of Artificial Sequence: Synthetic peptide
  Seed: GASSLPTTM (MAGA3_HUMAN)
GQSSLPTTL

SEQ ID NO: 57422 - protein, 9 aa, Artificial Sequence
  Description of Artificial Sequence: Synthetic peptide
  Seed: YFFPVIFSK (MAGA3_HUMAN)
YAFPVIFSY

SEQ ID NO: 57423 - protein, 9 aa, Artificial Sequence
  Description of Artificial Sequence: Synthetic peptide
  Seed: SPDPPQSPQ (MAGA3_HUMAN)
SPDPPQSPA

SEQ ID NO: 57424 - protein, 9 aa, Artificial Sequence
  Description of Artificial Sequence: Synthetic peptide
  Seed: KVAELVHFL (MAGA3_HUMAN)
KLAELVHFY

SEQ ID NO: 57425 - protein, 9 aa, Artificial Sequence
  Description of Artificial Sequence: Synthetic peptide
  Seed: KASSSLQLV (MAGA3_HUMAN)
KTSSSLQLI

SEQ ID NO: 57426 - protein, 9 aa, Artificial Sequence
  Description of Artificial Sequence: Synthetic peptide
  Seed: AASSSSTLV (MAGA3_HUMAN)
ASSSSSTLL

SEQ ID NO: 57427 - protein, 10 aa, Artificial Sequence
  Description of Artificial Sequence: Synthetic peptide
  Seed: KAEMLGSVVG (MAGA3_HUMAN)
KCEMLGSVVV

SEQ ID NO: 57428 - protein, 9 aa, Artificial Sequence
  Description of Artificial Sequence: Synthetic peptide
  Seed: VKISGGPHI (MAGA3_HUMAN)
VKISGGPHF

SEQ ID NO: 57429 - protein, 9 aa, Artificial Sequence
  Description of Artificial Sequence: Synthetic peptide
  Seed: VTLGEVPAA (MAGA3_HUMAN)
VLLGEVPAT

SEQ ID NO: 57430 - protein, 9 aa, Artificial Sequence
  Description of Artificial Sequence: Synthetic peptide
  Seed: QSPQGASSL (MAGA3_HUMAN)
QVPQGASSR

SEQ ID NO: 57431 - protein, 9 aa, Artificial Sequence
  Description of Artificial Sequence: Synthetic peptide
  Seed: DPIGHLYIF (MAGA3_HUMAN)
DAIGHLYIF

SEQ ID NO: 57432 - protein, 11 aa, Artificial Sequence
  Description of Artificial Sequence: Synthetic peptide
  Seed: KVAELVHFLLL (MAGA3_HUMAN)
KLAELVHFLLI

SEQ ID NO: 57433 - protein, 9 aa, Artificial Sequence
  Description of Artificial Sequence: Synthetic peptide
  Seed: MEVDPIGHL (MAGA3_HUMAN)
MVVDPIGHM

SEQ ID NO: 57434 - protein, 10 aa, Artificial Sequence
  Description of Artificial Sequence: Synthetic peptide
  Seed: RQVPGSDPAC (MAGA3_HUMAN)
RMVPGSDPAW

SEQ ID NO: 57435 - protein, 9 aa, Artificial Sequence
  Description of Artificial Sequence: Synthetic peptide
  Seed: ILGDPKKLL (MAGA3_HUMAN)
IAGDPKKLI

SEQ ID NO: 57436 - protein, 9 aa, Artificial Sequence
  Description of Artificial Sequence: Synthetic peptide
  Seed: FATCLGLSY (MAGA3_HUMAN)
FPTCLGLSY

SEQ ID NO: 57437 - protein, 10 aa, Artificial Sequence
  Description of Artificial Sequence: Synthetic peptide
  Seed: AELVHFLLLK (MAGA3_HUMAN)
AILVHFLLLR

SEQ ID NO: 57438 - protein, 9 aa, Artificial Sequence
  Description of Artificial Sequence: Synthetic peptide
  Seed: GNWQYFFPV (MAGA3_HUMAN)
GQWQYFFPI

SEQ ID NO: 57439 - protein, 10 aa, Artificial Sequence
  Description of Artificial Sequence: Synthetic peptide
  Seed: MNYPLWSQSY (MAGA3_HUMAN)
MAYPLWSQSM

SEQ ID NO: 57440 - protein, 9 aa, Artificial Sequence
  Description of Artificial Sequence: Synthetic peptide
  Seed: TSYVKVLHH (MAGA3_HUMAN)
TAYVKVLHK

SEQ ID NO: 57441 - protein, 9 aa, Artificial Sequence
  Description of Artificial Sequence: Synthetic peptide
  Seed: SILGDPKKL (MAGA3_HUMAN)
SLLGDPKKF

SEQ ID NO: 57442 - protein, 10 aa, Artificial Sequence
  Description of Artificial Sequence: Synthetic peptide
  Seed: RKVAELVHFL (MAGA3_HUMAN)
REVAELVHFV

SEQ ID NO: 57443 - protein, 10 aa, Artificial Sequence
  Description of Artificial Sequence: Synthetic peptide
  Seed: SLQLVFGIEL (MAGA3_HUMAN)
STQLVFGIEY

SEQ ID NO: 57444 - protein, 9 aa, Artificial Sequence
  Description of Artificial Sequence: Synthetic peptide
  Seed: SSLPTTMNY (MAGA3_HUMAN)
SELPTTMNY

SEQ ID NO: 57445 - protein, 9 aa, Artificial Sequence
  Description of Artificial Sequence: Synthetic peptide
  Seed: IMPKAGLLI (MAGA3_HUMAN)
IYPKAGLLM

SEQ ID NO: 57446 - protein, 9 aa, Artificial Sequence
  Description of Artificial Sequence: Synthetic peptide
  Seed: LESEFQAAL (MAGA3_HUMAN)
LESEFQAAF

SEQ ID NO: 57447 - protein, 9 aa, Artificial Sequence
  Description of Artificial Sequence: Synthetic peptide
  Seed: ISYPPLHEW (MAGA3_HUMAN)
IKYPPLHEY

SEQ ID NO: 57448 - protein, 9 aa, Artificial Sequence
  Description of Artificial Sequence: Synthetic peptide
  Seed: IMPKAGLLI (MAGA3_HUMAN)
IVPKAGLLL

SEQ ID NO: 57449 - protein, 8 aa, Artificial Sequence
  Description of Artificial Sequence: Synthetic peptide
  Seed: EVDPIGHL (MAGA3_HUMAN)
EFDPIGHL

SEQ ID NO: 57450 - protein, 11 aa, Artificial Sequence
  Description of Artificial Sequence: Synthetic peptide
  Seed: YIFATCLGLSY (MAGA3_HUMAN)
YNFATCLGLSF

SEQ ID NO: 57451 - protein, 9 aa, Artificial Sequence
  Description of Artificial Sequence: Synthetic peptide
  Seed: GASSLPTTM (MAGA3_HUMAN)
GFSSLPTTY

SEQ ID NO: 57452 - protein, 9 aa, Artificial Sequence
  Description of Artificial Sequence: Synthetic peptide
  Seed: QLVFGIELM (MAGA3_HUMAN)
QQVFGIELW

SEQ ID NO: 57453 - protein, 11 aa, Artificial Sequence
  Description of Artificial Sequence: Synthetic peptide
  Seed: HISYPPLHEWV (MAGA3_HUMAN)
HTSYPPLHEWW

SEQ ID NO: 57454 - protein, 10 aa, Artificial Sequence
  Description of Artificial Sequence: Synthetic peptide
  Seed: NQEEEGPSTF (MAGA3_HUMAN)
NHEEEGPSTI

SEQ ID NO: 57455 - protein, 10 aa, Artificial Sequence
  Description of Artificial Sequence: Synthetic peptide
  Seed: RKVAELVHFL (MAGA3_HUMAN)
RLVAELVHFI

SEQ ID NO: 57456 - protein, 10 aa, Artificial Sequence
  Description of Artificial Sequence: Synthetic peptide
  Seed: RKVAELVHFL (MAGA3_HUMAN)
RMVAELVHFV

SEQ ID NO: 57457 - protein, 10 aa, Artificial Sequence
  Description of Artificial Sequence: Synthetic peptide
  Seed: WEELSVLEVF (MAGA3_HUMAN)
WLELSVLEVL

SEQ ID NO: 57458 - protein, 11 aa, Artificial Sequence
  Description of Artificial Sequence: Synthetic peptide
  Seed: SRKVAELVHFL (MAGA3_HUMAN)
SHKVAELVHFV

SEQ ID NO: 57459 - protein, 10 aa, Artificial Sequence
  Description of Artificial Sequence: Synthetic peptide
  Seed: VIFSKASSSL (MAGA3_HUMAN)
VLFSKASSSA

SEQ ID NO: 57460 - protein, 9 aa, Artificial Sequence
  Description of Artificial Sequence: Synthetic peptide
  Seed: FATCLGLSY (MAGA3_HUMAN)
FETCLGLSY

SEQ ID NO: 57461 - protein, 9 aa, Artificial Sequence
  Description of Artificial Sequence: Synthetic peptide
  Seed: MPKAGLLII (MAGA3_HUMAN)
MVKAGLLIY

SEQ ID NO: 57462 - protein, 11 aa, Artificial Sequence
  Description of Artificial Sequence: Synthetic peptide
  Seed: FLWGPRALVET (MAGA3_HUMAN)
FIWGPRALVEV

SEQ ID NO: 57463 - protein, 8 aa, Artificial Sequence
  Description of Artificial Sequence: Synthetic peptide
  Seed: YVKVLHHM (MAGA3_HUMAN)
YAKVLHHL

SEQ ID NO: 57464 - protein, 9 aa, Artificial Sequence
  Description of Artificial Sequence: Synthetic peptide
  Seed: ALSRKVAEL (MAGA3_HUMAN)
ARSRKVAEY

SEQ ID NO: 57465 - protein, 9 aa, Artificial Sequence
  Description of Artificial Sequence: Synthetic peptide
  Seed: GASSLPTTM (MAGA3_HUMAN)
GVSSLPTTY

SEQ ID NO: 57466 - protein, 9 aa, Artificial Sequence
  Description of Artificial Sequence: Synthetic peptide
  Seed: GEALGLVGA (MAGA3_HUMAN)
GEALGLVGM

SEQ ID NO: 57467 - protein, 9 aa, Artificial Sequence
  Description of Artificial Sequence: Synthetic peptide
  Seed: VVGNWQYFF (MAGA3_HUMAN)
VYGNWQYFW

SEQ ID NO: 57468 - protein, 9 aa, Artificial Sequence
  Description of Artificial Sequence: Synthetic peptide
  Seed: KVLHHMVKI (MAGA3_HUMAN)
KLLHHMVKY

SEQ ID NO: 57469 - protein, 9 aa, Artificial Sequence
  Description of Artificial Sequence: Synthetic peptide
  Seed: ASSSLQLVF (MAGA3_HUMAN)
ATSSLQLVV

SEQ ID NO: 57470 - protein, 9 aa, Artificial Sequence
  Description of Artificial Sequence: Synthetic peptide
  Seed: ISYPPLHEW (MAGA3_HUMAN)
ITYPPLHEH

SEQ ID NO: 57471 - protein, 9 aa, Artificial Sequence
  Description of Artificial Sequence: Synthetic peptide
  Seed: TFPDLESEF (MAGA3_HUMAN)
TQPDLESEY

SEQ ID NO: 57472 - protein, 9 aa, Artificial Sequence
  Description of Artificial Sequence: Synthetic peptide
  Seed: EALGLVGAQ (MAGA3_HUMAN)
ELLGLVGAR

SEQ ID NO: 57473 - protein, 8 aa, Artificial Sequence
  Description of Artificial Sequence: Synthetic peptide
  Seed: LGDPKKLL (MAGA3_HUMAN)
LFDPKKLM

SEQ ID NO: 57474 - protein, 10 aa, Artificial Sequence
  Description of Artificial Sequence: Synthetic peptide
  Seed: SLPTTMNYPL (MAGA3_HUMAN)
SCPTTMNYPL

SEQ ID NO: 57475 - protein, 9 aa, Artificial Sequence
  Description of Artificial Sequence: Synthetic peptide
  Seed: FLWGPRALV (MAGA3_HUMAN)
FTWGPRALF

SEQ ID NO: 57476 - protein, 10 aa, Artificial Sequence
  Description of Artificial Sequence: Synthetic peptide
  Seed: HISYPPLHEW (MAGA3_HUMAN)
HNSYPPLHEW

SEQ ID NO: 57477 - protein, 9 aa, Artificial Sequence
  Description of Artificial Sequence: Synthetic peptide
  Seed: IMPKAGLLI (MAGA3_HUMAN)
ILPKAGLLL

SEQ ID NO: 57478 - protein, 9 aa, Artificial Sequence
  Description of Artificial Sequence: Synthetic peptide
  Seed: TFPDLESEF (MAGA3_HUMAN)
TYPDLESEM

SEQ ID NO: 57479 - protein, 11 aa, Artificial Sequence
  Description of Artificial Sequence: Synthetic peptide
  Seed: KVAELVHFLLL (MAGA3_HUMAN)
KQAELVHFLLI

SEQ ID NO: 57480 - protein, 11 aa, Artificial Sequence
  Description of Artificial Sequence: Synthetic peptide
  Seed: AQAPATEEQEA (MAGA3_HUMAN)
AIAPATEEQEL

SEQ ID NO: 57481 - protein, 10 aa, Artificial Sequence
  Description of Artificial Sequence: Synthetic peptide
  Seed: LQLVFGIELM (MAGA3_HUMAN)
LMLVFGIELL

SEQ ID NO: 57482 - protein, 9 aa, Artificial Sequence
  Description of Artificial Sequence: Synthetic peptide
  Seed: TQHFVQENY (MAGA3_HUMAN)
THHFVQENF

SEQ ID NO: 57483 - protein, 11 aa, Artificial Sequence
  Description of Artificial Sequence: Synthetic peptide
  Seed: RQVPGSDPACY (MAGA3_HUMAN)
RVVPGSDPACY

SEQ ID NO: 57484 - protein, 10 aa, Artificial Sequence
  Description of Artificial Sequence: Synthetic peptide
  Seed: FLWGPRALVE (MAGA3_HUMAN)
FMWGPRALVM

SEQ ID NO: 57485 - protein, 10 aa, Artificial Sequence
  Description of Artificial Sequence: Synthetic peptide
  Seed: KISGGPHISY (MAGA3_HUMAN)
KTSGGPHISW

SEQ ID NO: 57486 - protein, 9 aa, Artificial Sequence
  Description of Artificial Sequence: Synthetic peptide
  Seed: SSLQLVFGI (MAGA3_HUMAN)
SSLQLVFGV

SEQ ID NO: 57487 - protein, 10 aa, Artificial Sequence
  Description of Artificial Sequence: Synthetic peptide
  Seed: STFPDLESEF (MAGA3_HUMAN)
SMFPDLESER

SEQ ID NO: 57488 - protein, 8 aa, Artificial Sequence
  Description of Artificial Sequence: Synthetic peptide
  Seed: SGGPHISY (MAGA3_HUMAN)
SYGPHISF

SEQ ID NO: 57489 - protein, 9 aa, Artificial Sequence
  Description of Artificial Sequence: Synthetic peptide
  Seed: MEVDPIGHL (MAGA3_HUMAN)
MLVDPIGHV

SEQ ID NO: 57490 - protein, 9 aa, Artificial Sequence
  Description of Artificial Sequence: Synthetic peptide
  Seed: SVVGNWQYF (MAGA3_HUMAN)
SAVGNWQYL

SEQ ID NO: 57491 - protein, 11 aa, Artificial Sequence
  Description of Artificial Sequence: Synthetic peptide
  Seed: WQYFFPVIFSK (MAGA3_HUMAN)
WQYFFPVIFSR

SEQ ID NO: 57492 - protein, 9 aa, Artificial Sequence
  Description of Artificial Sequence: Synthetic peptide
  Seed: ASSSLQLVF (MAGA3_HUMAN)
AISSLQLVL

SEQ ID NO: 57493 - protein, 9 aa, Artificial Sequence
  Description of Artificial Sequence: Synthetic peptide
  Seed: FATCLGLSY (MAGA3_HUMAN)
FFTCLGLSL

SEQ ID NO: 57494 - protein, 10 aa, Artificial Sequence
  Description of Artificial Sequence: Synthetic peptide
  Seed: KASSSLQLVF (MAGA3_HUMAN)
KCSSSLQLVW

SEQ ID NO: 57495 - protein, 10 aa, Artificial Sequence
  Description of Artificial Sequence: Synthetic peptide
  Seed: FVQENYLEYR (MAGA3_HUMAN)
FTQENYLEYY

SEQ ID NO: 57496 - protein, 9 aa, Artificial Sequence
  Description of Artificial Sequence: Synthetic peptide
  Seed: KIWEELSVL (MAGA3_HUMAN)
KLWEELSVR

SEQ ID NO: 57497 - protein, 9 aa, Artificial Sequence
  Description of Artificial Sequence: Synthetic peptide
  Seed: GASSLPTTM (MAGA3_HUMAN)
GYSSLPTTF

SEQ ID NO: 57498 - protein, 9 aa, Artificial Sequence
  Description of Artificial Sequence: Synthetic peptide
  Seed: ISYPPLHEW (MAGA3_HUMAN)
ISYPPLHEL

SEQ ID NO: 57499 - protein, 9 aa, Artificial Sequence
  Description of Artificial Sequence: Synthetic peptide
  Seed: ISYPPLHEW (MAGA3_HUMAN)
IVYPPLHEF

SEQ ID NO: 57500 - protein, 10 aa, Artificial Sequence
  Description of Artificial Sequence: Synthetic peptide
  Seed: MNYPLWSQSY (MAGA3_HUMAN)
MLYPLWSQSW

SEQ ID NO: 57501 - protein, 9 aa, Artificial Sequence
  Description of Artificial Sequence: Synthetic peptide
  Seed: NYPLWSQSY (MAGA3_HUMAN)
NWPLWSQSL

SEQ ID NO: 57502 - protein, 10 aa, Artificial Sequence
  Description of Artificial Sequence: Synthetic peptide
  Seed: VDPIGHLYIF (MAGA3_HUMAN)
VFPIGHLYIM

SEQ ID NO: 57503 - protein, 9 aa, Artificial Sequence
  Description of Artificial Sequence: Synthetic peptide
  Seed: RALVETSYV (MAGA3_HUMAN)
RQLVETSYI

SEQ ID NO: 57504 - protein, 10 aa, Artificial Sequence
  Description of Artificial Sequence: Synthetic peptide
  Seed: FSKASSSLQL (MAGA3_HUMAN)
FTKASSSLQW

SEQ ID NO: 57505 - protein, 10 aa, Artificial Sequence
  Description of Artificial Sequence: Synthetic peptide
  Seed: HISYPPLHEW (MAGA3_HUMAN)
HESYPPLHEM

SEQ ID NO: 57506 - protein, 9 aa, Artificial Sequence
  Description of Artificial Sequence: Synthetic peptide
  Seed: AEMLGSVVG (MAGA3_HUMAN)
ADMLGSVVL

SEQ ID NO: 57507 - protein, 8 aa, Artificial Sequence
  Description of Artificial Sequence: Synthetic peptide
  Seed: IMPKAGLL (MAGA3_HUMAN)
IAPKAGLL

SEQ ID NO: 57508 - protein, 9 aa, Artificial Sequence
  Description of Artificial Sequence: Synthetic peptide
  Seed: KIWEELSVL (MAGA3_HUMAN)
KMWEELSVL

SEQ ID NO: 57509 - protein, 9 aa, Artificial Sequence
  Description of Artificial Sequence: Synthetic peptide
  Seed: KVAELVHFL (MAGA3_HUMAN)
KAAELVHFK

SEQ ID NO: 57510 - protein, 9 aa, Artificial Sequence
  Description of Artificial Sequence: Synthetic peptide
  Seed: MLGSVVGNW (MAGA3_HUMAN)
MSGSVVGNF

SEQ ID NO: 57511 - protein, 9 aa, Artificial Sequence
  Description of Artificial Sequence: Synthetic peptide
  Seed: ALSRKVAEL (MAGA3_HUMAN)
ALSRKVAEF

SEQ ID NO: 57512 - protein, 10 aa, Artificial Sequence
  Description of Artificial Sequence: Synthetic peptide
  Seed: VIFSKASSSL (MAGA3_HUMAN)
VMFSKASSSY

SEQ ID NO: 57513 - protein, 9 aa, Artificial Sequence
  Description of Artificial Sequence: Synthetic peptide
  Seed: FVQENYLEY (MAGA3_HUMAN)
FPQENYLEA

SEQ ID NO: 57514 - protein, 9 aa, Artificial Sequence
  Description of Artificial Sequence: Synthetic peptide
  Seed: KVAELVHFL (MAGA3_HUMAN)
KWAELVHFV

SEQ ID NO: 57515 - protein, 10 aa, Artificial Sequence
  Description of Artificial Sequence: Synthetic peptide
  Seed: SLPTTMNYPL (MAGA3_HUMAN)
STPTTMNYPM

SEQ ID NO: 57516 - protein, 8 aa, Artificial Sequence
  Description of Artificial Sequence: Synthetic peptide
  Seed: LGDPKKLL (MAGA3_HUMAN)
LSDPKKLL

SEQ ID NO: 57517 - protein, 9 aa, Artificial Sequence
  Description of Artificial Sequence: Synthetic peptide
  Seed: YIFATCLGL (MAGA3_HUMAN)
YAFATCLGY

SEQ ID NO: 57518 - protein, 8 aa, Artificial Sequence
  Description of Artificial Sequence: Synthetic peptide
  Seed: FPDLESEF (MAGA3_HUMAN)
FTDLESEV

SEQ ID NO: 57519 - protein, 9 aa, Artificial Sequence
  Description of Artificial Sequence: Synthetic peptide
  Seed: YFFPVIFSK (MAGA3_HUMAN)
YMFPVIFSY

SEQ ID NO: 57520 - protein, 9 aa, Artificial Sequence
  Description of Artificial Sequence: Synthetic peptide
  Seed: GASSLPTTM (MAGA3_HUMAN)
GRSSLPTTY

SEQ ID NO: 57521 - protein, 10 aa, Artificial Sequence
  Description of Artificial Sequence: Synthetic peptide
  Seed: SVVGNWQYFF (MAGA3_HUMAN)
SFVGNWQYFY

SEQ ID NO: 57522 - protein, 10 aa, Artificial Sequence
  Description of Artificial Sequence: Synthetic peptide
  Seed: LPTTMNYPLW (MAGA3_HUMAN)
LSTTMNYPLF

SEQ ID NO: 57523 - protein, 8 aa, Artificial Sequence
  Description of Artificial Sequence: Synthetic peptide
  Seed: QYFFPVIF (MAGA3_HUMAN)
QQFFPVIY

SEQ ID NO: 57524 - protein, 9 aa, Artificial Sequence
  Description of Artificial Sequence: Synthetic peptide
  Seed: NWQYFFPVI (MAGA3_HUMAN)
NYQYFFPVL

SEQ ID NO: 57525 - protein, 9 aa, Artificial Sequence
  Description of Artificial Sequence: Synthetic peptide
  Seed: FQAALSRKV (MAGA3_HUMAN)
FIAALSRKY

SEQ ID NO: 57526 - protein, 10 aa, Artificial Sequence
  Description of Artificial Sequence: Synthetic peptide
  Seed: ASSSSTLVEV (MAGA3_HUMAN)
AMSSSTLVEA

SEQ ID NO: 57527 - protein, 9 aa, Artificial Sequence
  Description of Artificial Sequence: Synthetic peptide
  Seed: AASSSSTLV (MAGA3_HUMAN)
AISSSSTLI

SEQ ID NO: 57528 - protein, 9 aa, Artificial Sequence
  Description of Artificial Sequence: Synthetic peptide
  Seed: FVQENYLEY (MAGA3_HUMAN)
FVQENYLEF

SEQ ID NO: 57529 - protein, 9 aa, Artificial Sequence
  Description of Artificial Sequence: Synthetic peptide
  Seed: KASSSLQLV (MAGA3_HUMAN)
KISSSLQLV

SEQ ID NO: 57530 - protein, 9 aa, Artificial Sequence
  Description of Artificial Sequence: Synthetic peptide
  Seed: YFFPVIFSK (MAGA3_HUMAN)
YSFPVIFSY

SEQ ID NO: 57531 - protein, 9 aa, Artificial Sequence
  Description of Artificial Sequence: Synthetic peptide
  Seed: FPVIFSKAS (MAGA3_HUMAN)
FAVIFSKAY

SEQ ID NO: 57532 - protein, 10 aa, Artificial Sequence
  Description of Artificial Sequence: Synthetic peptide
  Seed: MNYPLWSQSY (MAGA3_HUMAN)
MVYPLWSQSM

SEQ ID NO: 57533 - protein, 10 aa, Artificial Sequence
  Description of Artificial Sequence: Synthetic peptide
  Seed: RALVETSYVK (MAGA3_HUMAN)
RWLVETSYVR

SEQ ID NO: 57534 - protein, 10 aa, Artificial Sequence
  Description of Artificial Sequence: Synthetic peptide
  Seed: LYIFATCLGL (MAGA3_HUMAN)
LNIFATCLGV

SEQ ID NO: 57535 - protein, 10 aa, Artificial Sequence
  Description of Artificial Sequence: Synthetic peptide
  Seed: EALGLVGAQA (MAGA3_HUMAN)
EILGLVGAQV

SEQ ID NO: 57536 - protein, 10 aa, Artificial Sequence
  Description of Artificial Sequence: Synthetic peptide
  Seed: RKVAELVHFL (MAGA3_HUMAN)
RHVAELVHFL

SEQ ID NO: 57537 - protein, 9 aa, Artificial Sequence
  Description of Artificial Sequence: Synthetic peptide
  Seed: SILGDPKKL (MAGA3_HUMAN)
SYLGDPKKF

SEQ ID NO: 57538 - protein, 10 aa, Artificial Sequence
  Description of Artificial Sequence: Synthetic peptide
  Seed: LQLVFGIELM (MAGA3_HUMAN)
LRLVFGIELL

SEQ ID NO: 57539 - protein, 11 aa, Artificial Sequence
  Description of Artificial Sequence: Synthetic peptide
  Seed: KVAELVHFLLL (MAGA3_HUMAN)
KIAELVHFLLL

SEQ ID NO: 57540 - protein, 9 aa, Artificial Sequence
  Description of Artificial Sequence: Synthetic peptide
  Seed: VETSYVKVL (MAGA3_HUMAN)
VETSYVKVY

SEQ ID NO: 57541 - protein, 10 aa, Artificial Sequence
  Description of Artificial Sequence: Synthetic peptide
  Seed: SLQLVFGIEL (MAGA3_HUMAN)
SKQLVFGIEF

SEQ ID NO: 57542 - protein, 11 aa, Artificial Sequence
  Description of Artificial Sequence: Synthetic peptide
  Seed: HISYPPLHEWV (MAGA3_HUMAN)
HYSYPPLHEWW

SEQ ID NO: 57543 - protein, 10 aa, Artificial Sequence
  Description of Artificial Sequence: Synthetic peptide
  Seed: QVPGSDPACY (MAGA3_HUMAN)
QLPGSDPACY

SEQ ID NO: 57544 - protein, 10 aa, Artificial Sequence
  Description of Artificial Sequence: Synthetic peptide
  Seed: KASSSLQLVF (MAGA3_HUMAN)
KYSSSLQLVF

SEQ ID NO: 57545 - protein, 9 aa, Artificial Sequence
  Description of Artificial Sequence: Synthetic peptide
  Seed: ASSSLQLVF (MAGA3_HUMAN)
AWSSLQLVY

SEQ ID NO: 57546 - protein, 9 aa, Artificial Sequence
  Description of Artificial Sequence: Synthetic peptide
  Seed: SVVGNWQYF (MAGA3_HUMAN)
SMVGNWQYF

SEQ ID NO: 57547 - protein, 9 aa, Artificial Sequence
  Description of Artificial Sequence: Synthetic peptide
  Seed: SYPPLHEWV (MAGA3_HUMAN)
SFPPLHEWM

SEQ ID NO: 57548 - protein, 10 aa, Artificial Sequence
  Description of Artificial Sequence: Synthetic peptide
  Seed: VDPIGHLYIF (MAGA3_HUMAN)
VQPIGHLYIY

SEQ ID NO: 57549 - protein, 9 aa, Artificial Sequence
  Description of Artificial Sequence: Synthetic peptide
  Seed: SYVKVLHHM (MAGA3_HUMAN)
SVVKVLHHF

SEQ ID NO: 57550 - protein, 10 aa, Artificial Sequence
  Description of Artificial Sequence: Synthetic peptide
  Seed: YLEYRQVPGS (MAGA3_HUMAN)
YLEYRQVPGI

SEQ ID NO: 57551 - protein, 10 aa, Artificial Sequence
  Description of Artificial Sequence: Synthetic peptide
  Seed: LVFGIELMEV (MAGA3_HUMAN)
LQFGIELMEL

SEQ ID NO: 57552 - protein, 9 aa, Artificial Sequence
  Description of Artificial Sequence: Synthetic peptide
  Seed: VKISGGPHI (MAGA3_HUMAN)
VEISGGPHY

SEQ ID NO: 57553 - protein, 9 aa, Artificial Sequence
  Description of Artificial Sequence: Synthetic peptide
  Seed: EAASSSSTL (MAGA3_HUMAN)
ETASSSSTA

SEQ ID NO: 57554 - protein, 10 aa, Artificial Sequence
  Description of Artificial Sequence: Synthetic peptide
  Seed: KISGGPHISY (MAGA3_HUMAN)
KVSGGPHISF

SEQ ID NO: 57555 - protein, 11 aa, Artificial Sequence
  Description of Artificial Sequence: Synthetic peptide
  Seed: SSLPTTMNYPL (MAGA3_HUMAN)
STLPTTMNYPW

SEQ ID NO: 57556 - protein, 10 aa, Artificial Sequence
  Description of Artificial Sequence: Synthetic peptide
  Seed: VTKAEMLGSV (MAGA3_HUMAN)
VLKAEMLGSA

SEQ ID NO: 57557 - protein, 9 aa, Artificial Sequence
  Description of Artificial Sequence: Synthetic peptide
  Seed: YFFPVIFSK (MAGA3_HUMAN)
YAFPVIFSF

SEQ ID NO: 57558 - protein, 9 aa, Artificial Sequence
  Description of Artificial Sequence: Synthetic peptide
  Seed: KVAELVHFL (MAGA3_HUMAN)
KYAELVHFV

SEQ ID NO: 57559 - protein, 11 aa, Artificial Sequence
  Description of Artificial Sequence: Synthetic peptide
  Seed: SKASSSLQLVF (MAGA3_HUMAN)
SAASSSLQLVW

SEQ ID NO: 57560 - protein, 9 aa, Artificial Sequence
  Description of Artificial Sequence: Synthetic peptide
  Seed: SYPPLHEWV (MAGA3_HUMAN)
SRPPLHEWY

SEQ ID NO: 57561 - protein, 9 aa, Artificial Sequence
  Description of Artificial Sequence: Synthetic peptide
  Seed: LEYRQVPGS (MAGA3_HUMAN)
LEYRQVPGC

SEQ ID NO: 57562 - protein, 9 aa, Artificial Sequence
  Description of Artificial Sequence: Synthetic peptide
  Seed: MPLEQRSQH (MAGA3_HUMAN)
MALEQRSQM

SEQ ID NO: 57563 - protein, 9 aa, Artificial Sequence
  Description of Artificial Sequence: Synthetic peptide
  Seed: LGDPKKLLT (MAGA3_HUMAN)
LADPKKLLF

SEQ ID NO: 57564 - protein, 10 aa, Artificial Sequence
  Description of Artificial Sequence: Synthetic peptide
  Seed: LSVLEVFEGR (MAGA3_HUMAN)
LTVLEVFEGK

SEQ ID NO: 57565 - protein, 10 aa, Artificial Sequence
  Description of Artificial Sequence: Synthetic peptide
  Seed: NWQYFFPVIF (MAGA3_HUMAN)
NSQYFFPVIF

SEQ ID NO: 57566 - protein, 9 aa, Artificial Sequence
  Description of Artificial Sequence: Synthetic peptide
  Seed: FVQENYLEY (MAGA3_HUMAN)
FAQENYLEA

SEQ ID NO: 57567 - protein, 11 aa, Artificial Sequence
  Description of Artificial Sequence: Synthetic peptide
  Seed: FLWGPRALVET (MAGA3_HUMAN)
FIWGPRALVEI

SEQ ID NO: 57568 - protein, 9 aa, Artificial Sequence
  Description of Artificial Sequence: Synthetic peptide
  Seed: KAGLLIIVL (MAGA3_HUMAN)
KVGLLIIVW

SEQ ID NO: 57569 - protein, 9 aa, Artificial Sequence
  Description of Artificial Sequence: Synthetic peptide
  Seed: FQAALSRKV (MAGA3_HUMAN)
FVAALSRKY

SEQ ID NO: 57570 - protein, 9 aa, Artificial Sequence
  Description of Artificial Sequence: Synthetic peptide
  Seed: SVVGNWQYF (MAGA3_HUMAN)
SIVGNWQYY

SEQ ID NO: 57571 - protein, 11 aa, Artificial Sequence
  Description of Artificial Sequence: Synthetic peptide
  Seed: YIFATCLGLSY (MAGA3_HUMAN)
YFFATCLGLSY

SEQ ID NO: 57572 - protein, 9 aa, Artificial Sequence
  Description of Artificial Sequence: Synthetic peptide
  Seed: SSLPTTMNY (MAGA3_HUMAN)
STLPTTMNV

SEQ ID NO: 57573 - protein, 10 aa, Artificial Sequence
  Description of Artificial Sequence: Synthetic peptide
  Seed: SEFQAALSRK (MAGA3_HUMAN)
SMFQAALSRY

SEQ ID NO: 57574 - protein, 10 aa, Artificial Sequence
  Description of Artificial Sequence: Synthetic peptide
  Seed: ASSLPTTMNY (MAGA3_HUMAN)
ACSLPTTMNY

SEQ ID NO: 57575 - protein, 11 aa, Artificial Sequence
  Description of Artificial Sequence: Synthetic peptide
  Seed: HLYIFATCLGL (MAGA3_HUMAN)
HLYIFATCLGV

SEQ ID NO: 57576 - protein, 9 aa, Artificial Sequence
  Description of Artificial Sequence: Synthetic peptide
  Seed: RALVETSYV (MAGA3_HUMAN)
RMLVETSYM

SEQ ID NO: 57577 - protein, 10 aa, Artificial Sequence
  Description of Artificial Sequence: Synthetic peptide
  Seed: STFPDLESEF (MAGA3_HUMAN)
SMFPDLESEY

SEQ ID NO: 57578 - protein, 11 aa, Artificial Sequence
  Description of Artificial Sequence: Synthetic peptide
  Seed: YIFATCLGLSY (MAGA3_HUMAN)
YGFATCLGLSY

SEQ ID NO: 57579 - protein, 9 aa, Artificial Sequence
  Description of Artificial Sequence: Synthetic peptide
  Seed: MEVDPIGHL (MAGA3_HUMAN)
MTVDPIGHV

SEQ ID NO: 57580 - protein, 9 aa, Artificial Sequence
  Description of Artificial Sequence: Synthetic peptide
  Seed: SSTLVEVTL (MAGA3_HUMAN)
SRTLVEVTL

SEQ ID NO: 57581 - protein, 9 aa, Artificial Sequence
  Description of Artificial Sequence: Synthetic peptide
  Seed: SYVKVLHHM (MAGA3_HUMAN)
SSVKVLHHY

SEQ ID NO: 57582 - protein, 9 aa, Artificial Sequence
  Description of Artificial Sequence: Synthetic peptide
  Seed: QSPQGASSL (MAGA3_HUMAN)
QMPQGASSL

SEQ ID NO: 57583 - protein, 9 aa, Artificial Sequence
  Description of Artificial Sequence: Synthetic peptide
  Seed: ARGEALGLV (MAGA3_HUMAN)
ARGEALGLF

SEQ ID NO: 57584 - protein, 9 aa, Artificial Sequence
  Description of Artificial Sequence: Synthetic peptide
  Seed: SSLPTTMNY (MAGA3_HUMAN)
SVLPTTMNW

SEQ ID NO: 57585 - protein, 11 aa, Artificial Sequence
  Description of Artificial Sequence: Synthetic peptide
  Seed: VKISGGPHISY (MAGA3_HUMAN)
VLISGGPHISY

SEQ ID NO: 57586 - protein, 10 aa, Artificial Sequence
  Description of Artificial Sequence: Synthetic peptide
  Seed: STFPDLESEF (MAGA3_HUMAN)
SVFPDLESER

SEQ ID NO: 57587 - protein, 8 aa, Artificial Sequence
  Description of Artificial Sequence: Synthetic peptide
  Seed: FPDLESEF (MAGA3_HUMAN)
FYDLESEI

SEQ ID NO: 57588 - protein, 10 aa, Artificial Sequence
  Description of Artificial Sequence: Synthetic peptide
  Seed: ASSLPTTMNY (MAGA3_HUMAN)
AESLPTTMNY

SEQ ID NO: 57589 - protein, 10 aa, Artificial Sequence
  Description of Artificial Sequence: Synthetic peptide
  Seed: LQLVFGIELM (MAGA3_HUMAN)
LMLVFGIELY

SEQ ID NO: 57590 - protein, 9 aa, Artificial Sequence
  Description of Artificial Sequence: Synthetic peptide
  Seed: ASSSLQLVF (MAGA3_HUMAN)
ARSSLQLVY

SEQ ID NO: 57591 - protein, 10 aa, Artificial Sequence
  Description of Artificial Sequence: Synthetic peptide
  Seed: HISYPPLHEW (MAGA3_HUMAN)
HFSYPPLHEF

SEQ ID NO: 57592 - protein, 10 aa, Artificial Sequence
  Description of Artificial Sequence: Synthetic peptide
  Seed: MPKAGLLIIV (MAGA3_HUMAN)
MAKAGLLIIV

SEQ ID NO: 57593 - protein, 9 aa, Artificial Sequence
  Description of Artificial Sequence: Synthetic peptide
  Seed: EEQEAASSS (MAGA3_HUMAN)
EEQEAASSL

SEQ ID NO: 57594 - protein, 10 aa, Artificial Sequence
  Description of Artificial Sequence: Synthetic peptide
  Seed: KISGGPHISY (MAGA3_HUMAN)
KTSGGPHISK

SEQ ID NO: 57595 - protein, 9 aa, Artificial Sequence
  Description of Artificial Sequence: Synthetic peptide
  Seed: SVVGNWQYF (MAGA3_HUMAN)
SLVGNWQYY

SEQ ID NO: 57596 - protein, 11 aa, Artificial Sequence
  Description of Artificial Sequence: Synthetic peptide
  Seed: AQAPATEEQEA (MAGA3_HUMAN)
AEAPATEEQEI

SEQ ID NO: 57597 - protein, 10 aa, Artificial Sequence
  Description of Artificial Sequence: Synthetic peptide
  Seed: MNYPLWSQSY (MAGA3_HUMAN)
MCYPLWSQSW

SEQ ID NO: 57598 - protein, 9 aa, Artificial Sequence
  Description of Artificial Sequence: Synthetic peptide
  Seed: DPIGHLYIF (MAGA3_HUMAN)
DEIGHLYIV

SEQ ID NO: 57599 - protein, 10 aa, Artificial Sequence
  Description of Artificial Sequence: Synthetic peptide
  Seed: KVAELVHFLL (MAGA3_HUMAN)
KLAELVHFLV

SEQ ID NO: 57600 - protein, 9 aa, Artificial Sequence
  Description of Artificial Sequence: Synthetic peptide
  Seed: ISYPPLHEW (MAGA3_HUMAN)
ISYPPLHEM

SEQ ID NO: 57601 - protein, 9 aa, Artificial Sequence
  Description of Artificial Sequence: Synthetic peptide
  Seed: VKISGGPHI (MAGA3_HUMAN)
VQISGGPHF

SEQ ID NO: 57602 - protein, 9 aa, Artificial Sequence
  Description of Artificial Sequence: Synthetic peptide
  Seed: GSDPACYEF (MAGA3_HUMAN)
GWDPACYEM

SEQ ID NO: 57603 - protein, 9 aa, Artificial Sequence
  Description of Artificial Sequence: Synthetic peptide
  Seed: DPIGHLYIF (MAGA3_HUMAN)
DPIGHLYIY

SEQ ID NO: 57604 - protein, 10 aa, Artificial Sequence
  Description of Artificial Sequence: Synthetic peptide
  Seed: TSYVKVLHHM (MAGA3_HUMAN)
TQYVKVLHHL

SEQ ID NO: 57605 - protein, 10 aa, Artificial Sequence
  Description of Artificial Sequence: Synthetic peptide
  Seed: MVKISGGPHI (MAGA3_HUMAN)
MWKISGGPHM

SEQ ID NO: 57606 - protein, 10 aa, Artificial Sequence
  Description of Artificial Sequence: Synthetic peptide
  Seed: RKVAELVHFL (MAGA3_HUMAN)
RAVAELVHFI

SEQ ID NO: 57607 - protein, 10 aa, Artificial Sequence
  Description of Artificial Sequence: Synthetic peptide
  Seed: TSYVKVLHHM (MAGA3_HUMAN)
TSYVKVLHHW

SEQ ID NO: 57608 - protein, 10 aa, Artificial Sequence
  Description of Artificial Sequence: Synthetic peptide
  Seed: GLVGAQAPAT (MAGA3_HUMAN)
GMVGAQAPAV

SEQ ID NO: 57609 - protein, 10 aa, Artificial Sequence
  Description of Artificial Sequence: Synthetic peptide
  Seed: RKVAELVHFL (MAGA3_HUMAN)
RSVAELVHFL

SEQ ID NO: 57610 - protein, 9 aa, Artificial Sequence
  Description of Artificial Sequence: Synthetic peptide
  Seed: AELVHFLLL (MAGA3_HUMAN)
ADLVHFLLL

SEQ ID NO: 57611 - protein, 9 aa, Artificial Sequence
  Description of Artificial Sequence: Synthetic peptide
  Seed: GASSLPTTM (MAGA3_HUMAN)
GVSSLPTTW

SEQ ID NO: 57612 - protein, 9 aa, Artificial Sequence
  Description of Artificial Sequence: Synthetic peptide
  Seed: SVVGNWQYF (MAGA3_HUMAN)
SWVGNWQYF

SEQ ID NO: 57613 - protein, 9 aa, Artificial Sequence
  Description of Artificial Sequence: Synthetic peptide
  Seed: ISYPPLHEW (MAGA3_HUMAN)
IPYPPLHEW

SEQ ID NO: 57614 - protein, 9 aa, Artificial Sequence
  Description of Artificial Sequence: Synthetic peptide
  Seed: FVQENYLEY (MAGA3_HUMAN)
FTQENYLEL

SEQ ID NO: 57615 - protein, 9 aa, Artificial Sequence
  Description of Artificial Sequence: Synthetic peptide
  Seed: SSSSTLVEV (MAGA3_HUMAN)
SMSSTLVEI

SEQ ID NO: 57616 - protein, 9 aa, Artificial Sequence
  Description of Artificial Sequence: Synthetic peptide
  Seed: YFFPVIFSK (MAGA3_HUMAN)
YFFPVIFSM

SEQ ID NO: 57617 - protein, 10 aa, Artificial Sequence
  Description of Artificial Sequence: Synthetic peptide
  Seed: MVKISGGPHI (MAGA3_HUMAN)
MTKISGGPHY

SEQ ID NO: 57618 - protein, 9 aa, Artificial Sequence
  Description of Artificial Sequence: Synthetic peptide
  Seed: DPIGHLYIF (MAGA3_HUMAN)
DAIGHLYIV

SEQ ID NO: 57619 - protein, 11 aa, Artificial Sequence
  Description of Artificial Sequence: Synthetic peptide
  Seed: HCKPEEGLEAR (MAGA3_HUMAN)
HVKPEEGLEAR

SEQ ID NO: 57620 - protein, 10 aa, Artificial Sequence
  Description of Artificial Sequence: Synthetic peptide
  Seed: MNYPLWSQSY (MAGA3_HUMAN)
MQYPLWSQSH

SEQ ID NO: 57621 - protein, 9 aa, Artificial Sequence
  Description of Artificial Sequence: Synthetic peptide
  Seed: RQVPGSDPA (MAGA3_HUMAN)
RLVPGSDPF

SEQ ID NO: 57622 - protein, 9 aa, Artificial Sequence
  Description of Artificial Sequence: Synthetic peptide
  Seed: KVAELVHFL (MAGA3_HUMAN)
KRAELVHFV

SEQ ID NO: 57623 - protein, 10 aa, Artificial Sequence
  Description of Artificial Sequence: Synthetic peptide
  Seed: STFPDLESEF (MAGA3_HUMAN)
SAFPDLESER

SEQ ID NO: 57624 - protein, 9 aa, Artificial Sequence
  Description of Artificial Sequence: Synthetic peptide
  Seed: VTKAEMLGS (MAGA3_HUMAN)
VSKAEMLGK

SEQ ID NO: 57625 - protein, 9 aa, Artificial Sequence
  Description of Artificial Sequence: Synthetic peptide
  Seed: KVAELVHFL (MAGA3_HUMAN)
KLAELVHFK

SEQ ID NO: 57626 - protein, 11 aa, Artificial Sequence
  Description of Artificial Sequence: Synthetic peptide
  Seed: REGDCAPEEKI (MAGA3_HUMAN)
RQGDCAPEEKF

SEQ ID NO: 57627 - protein, 10 aa, Artificial Sequence
  Description of Artificial Sequence: Synthetic peptide
  Seed: SVVGNWQYFF (MAGA3_HUMAN)
SPVGNWQYFY

SEQ ID NO: 57628 - protein, 11 aa, Artificial Sequence
  Description of Artificial Sequence: Synthetic peptide
  Seed: RQVPGSDPACY (MAGA3_HUMAN)
RAVPGSDPACM

SEQ ID NO: 57629 - protein, 9 aa, Artificial Sequence
  Description of Artificial Sequence: Synthetic peptide
  Seed: LPTTMNYPL (MAGA3_HUMAN)
LPTTMNYPF

SEQ ID NO: 57630 - protein, 10 aa, Artificial Sequence
  Description of Artificial Sequence: Synthetic peptide
  Seed: YRQVPGSDPA (MAGA3_HUMAN)
YIQVPGSDPV

SEQ ID NO: 57631 - protein, 10 aa, Artificial Sequence
  Description of Artificial Sequence: Synthetic peptide
  Seed: ASSLPTTMNY (MAGA3_HUMAN)
AMSLPTTMNF

SEQ ID NO: 57632 - protein, 10 aa, Artificial Sequence
  Description of Artificial Sequence: Synthetic peptide
  Seed: ISYPPLHEWV (MAGA3_HUMAN)
IMYPPLHEWF

SEQ ID NO: 57633 - protein, 9 aa, Artificial Sequence
  Description of Artificial Sequence: Synthetic peptide
  Seed: YIFATCLGL (MAGA3_HUMAN)
YLFATCLGA

SEQ ID NO: 57634 - protein, 10 aa, Artificial Sequence
  Description of Artificial Sequence: Synthetic peptide
  Seed: ISYPPLHEWV (MAGA3_HUMAN)
IIYPPLHEWV

SEQ ID NO: 57635 - protein, 9 aa, Artificial Sequence
  Description of Artificial Sequence: Synthetic peptide
  Seed: QEEEGPSTF (MAGA3_HUMAN)
QHEEGPSTF

SEQ ID NO: 57636 - protein, 9 aa, Artificial Sequence
  Description of Artificial Sequence: Synthetic peptide
  Seed: RALVETSYV (MAGA3_HUMAN)
RILVETSYY

SEQ ID NO: 57637 - protein, 10 aa, Artificial Sequence
  Description of Artificial Sequence: Synthetic peptide
  Seed: LYIFATCLGL (MAGA3_HUMAN)
LQIFATCLGV

SEQ ID NO: 57638 - protein, 10 aa, Artificial Sequence
  Description of Artificial Sequence: Synthetic peptide
  Seed: WEELSVLEVF (MAGA3_HUMAN)
WIELSVLEVM

SEQ ID NO: 57639 - protein, 9 aa, Artificial Sequence
  Description of Artificial Sequence: Synthetic peptide
  Seed: EALGLVGAQ (MAGA3_HUMAN)
ETLGLVGAK

SEQ ID NO: 57640 - protein, 9 aa, Artificial Sequence
  Description of Artificial Sequence: Synthetic peptide
  Seed: KVAELVHFL (MAGA3_HUMAN)
KWAELVHFR

SEQ ID NO: 57641 - protein, 9 aa, Artificial Sequence
  Description of Artificial Sequence: Synthetic peptide
  Seed: SSLQLVFGI (MAGA3_HUMAN)
SLLQLVFGI

SEQ ID NO: 57642 - protein, 9 aa, Artificial Sequence
  Description of Artificial Sequence: Synthetic peptide
  Seed: IFSKASSSL (MAGA3_HUMAN)
IISKASSSY

SEQ ID NO: 57643 - protein, 10 aa, Artificial Sequence
  Description of Artificial Sequence: Synthetic peptide
  Seed: SYPPLHEWVL (MAGA3_HUMAN)
SWPPLHEWVM

SEQ ID NO: 57644 - protein, 9 aa, Artificial Sequence
  Description of Artificial Sequence: Synthetic peptide
  Seed: FATCLGLSY (MAGA3_HUMAN)
FATCLGLSI

SEQ ID NO: 57645 - protein, 10 aa, Artificial Sequence
  Description of Artificial Sequence: Synthetic peptide
  Seed: FLWGPRALVE (MAGA3_HUMAN)
FLWGPRALVM

SEQ ID NO: 57646 - protein, 10 aa, Artificial Sequence
  Description of Artificial Sequence: Synthetic peptide
  Seed: RQVPGSDPAC (MAGA3_HUMAN)
RLVPGSDPAY

SEQ ID NO: 57647 - protein, 11 aa, Artificial Sequence
  Description of Artificial Sequence: Synthetic peptide
  Seed: RQVPGSDPACY (MAGA3_HUMAN)
RTVPGSDPACY

SEQ ID NO: 57648 - protein, 10 aa, Artificial Sequence
  Description of Artificial Sequence: Synthetic peptide
  Seed: MVKISGGPHI (MAGA3_HUMAN)
MSKISGGPHF

SEQ ID NO: 57649 - protein, 9 aa, Artificial Sequence
  Description of Artificial Sequence: Synthetic peptide
  Seed: KVAELVHFL (MAGA3_HUMAN)
KIAELVHFL

SEQ ID NO: 57650 - protein, 10 aa, Artificial Sequence
  Description of Artificial Sequence: Synthetic peptide
  Seed: ISYPPLHEWV (MAGA3_HUMAN)
IGYPPLHEWW

SEQ ID NO: 57651 - protein, 10 aa, Artificial Sequence
  Description of Artificial Sequence: Synthetic peptide
  Seed: EVDPIGHLYI (MAGA3_HUMAN)
EMDPIGHLYL

SEQ ID NO: 57652 - protein, 9 aa, Artificial Sequence
  Description of Artificial Sequence: Synthetic peptide
  Seed: FQAALSRKV (MAGA3_HUMAN)
FMAALSRKY

SEQ ID NO: 57653 - protein, 10 aa, Artificial Sequence
  Description of Artificial Sequence: Synthetic peptide
  Seed: RKVAELVHFL (MAGA3_HUMAN)
RHVAELVHFV

SEQ ID NO: 57654 - protein, 10 aa, Artificial Sequence
  Description of Artificial Sequence: Synthetic peptide
  Seed: ASSLPTTMNY (MAGA3_HUMAN)
APSLPTTMNW

SEQ ID NO: 57655 - protein, 10 aa, Artificial Sequence
  Description of Artificial Sequence: Synthetic peptide
  Seed: LGLVGAQAPA (MAGA3_HUMAN)
LFLVGAQAPI

SEQ ID NO: 57656 - protein, 10 aa, Artificial Sequence
  Description of Artificial Sequence: Synthetic peptide
  Seed: IFATCLGLSY (MAGA3_HUMAN)
IWATCLGLSY

SEQ ID NO: 57657 - protein, 9 aa, Artificial Sequence
  Description of Artificial Sequence: Synthetic peptide
  Seed: AELVHFLLL (MAGA3_HUMAN)
AHLVHFLLY

SEQ ID NO: 57658 - protein, 10 aa, Artificial Sequence
  Description of Artificial Sequence: Synthetic peptide
  Seed: KASSSLQLVF (MAGA3_HUMAN)
KNSSSLQLVF

SEQ ID NO: 57659 - protein, 9 aa, Artificial Sequence
  Description of Artificial Sequence: Synthetic peptide
  Seed: SSLQLVFGI (MAGA3_HUMAN)
SSLQLVFGA

SEQ ID NO: 57660 - protein, 10 aa, Artificial Sequence
  Description of Artificial Sequence: Synthetic peptide
  Seed: VDPIGHLYIF (MAGA3_HUMAN)
VSPIGHLYIW

SEQ ID NO: 57661 - protein, 10 aa, Artificial Sequence
  Description of Artificial Sequence: Synthetic peptide
  Seed: WQYFFPVIFS (MAGA3_HUMAN)
WQYFFPVIFY

SEQ ID NO: 57662 - protein, 9 aa, Artificial Sequence
  Description of Artificial Sequence: Synthetic peptide
  Seed: LESEFQAAL (MAGA3_HUMAN)
LKSEFQAAY

SEQ ID NO: 57663 - protein, 9 aa, Artificial Sequence
  Description of Artificial Sequence: Synthetic peptide
  Seed: ISYPPLHEW (MAGA3_HUMAN)
IAYPPLHEM

SEQ ID NO: 57664 - protein, 9 aa, Artificial Sequence
  Description of Artificial Sequence: Synthetic peptide
  Seed: SVVGNWQYF (MAGA3_HUMAN)
SWVGNWQYI

SEQ ID NO: 57665 - protein, 9 aa, Artificial Sequence
  Description of Artificial Sequence: Synthetic peptide
  Seed: SKASSSLQL (MAGA3_HUMAN)
SMASSSLQW

SEQ ID NO: 57666 - protein, 9 aa, Artificial Sequence
  Description of Artificial Sequence: Synthetic peptide
  Seed: LGDPKKLLT (MAGA3_HUMAN)
LGDPKKLLF

SEQ ID NO: 57667 - protein, 11 aa, Artificial Sequence
  Description of Artificial Sequence: Synthetic peptide
  Seed: SNQEEEGPSTF (MAGA3_HUMAN)
SQQEEEGPSTI

SEQ ID NO: 57668 - protein, 9 aa, Artificial Sequence
  Description of Artificial Sequence: Synthetic peptide
  Seed: SYPPLHEWV (MAGA3_HUMAN)
SFPPLHEWW

SEQ ID NO: 57669 - protein, 9 aa, Artificial Sequence
  Description of Artificial Sequence: Synthetic peptide
  Seed: QLVFGIELM (MAGA3_HUMAN)
QMVFGIELA

SEQ ID NO: 57670 - protein, 10 aa, Artificial Sequence
  Description of Artificial Sequence: Synthetic peptide
  Seed: MVKISGGPHI (MAGA3_HUMAN)
MWKISGGPHF

SEQ ID NO: 57671 - protein, 9 aa, Artificial Sequence
  Description of Artificial Sequence: Synthetic peptide
  Seed: FVQENYLEY (MAGA3_HUMAN)
FKQENYLEM

SEQ ID NO: 57672 - protein, 9 aa, Artificial Sequence
  Description of Artificial Sequence: Synthetic peptide
  Seed: LGDPKKLLT (MAGA3_HUMAN)
LFDPKKLLF

SEQ ID NO: 57673 - protein, 9 aa, Artificial Sequence
  Description of Artificial Sequence: Synthetic peptide
  Seed: RKVAELVHF (MAGA3_HUMAN)
RRVAELVHL

SEQ ID NO: 57674 - protein, 10 aa, Artificial Sequence
  Description of Artificial Sequence: Synthetic peptide
  Seed: ISYPPLHEWV (MAGA3_HUMAN)
ITYPPLHEWF

SEQ ID NO: 57675 - protein, 11 aa, Artificial Sequence
  Description of Artificial Sequence: Synthetic peptide
  Seed: KVAELVHFLLL (MAGA3_HUMAN)
KLAELVHFLLW

SEQ ID NO: 57676 - protein, 9 aa, Artificial Sequence
  Description of Artificial Sequence: Synthetic peptide
  Seed: QSPQGASSL (MAGA3_HUMAN)
QMPQGASSY

SEQ ID NO: 57677 - protein, 10 aa, Artificial Sequence
  Description of Artificial Sequence: Synthetic peptide
  Seed: LYIFATCLGL (MAGA3_HUMAN)
LIIFATCLGV

SEQ ID NO: 57678 - protein, 9 aa, Artificial Sequence
  Description of Artificial Sequence: Synthetic peptide
  Seed: ALSRKVAEL (MAGA3_HUMAN)
AFSRKVAEF

SEQ ID NO: 57679 - protein, 9 aa, Artificial Sequence
  Description of Artificial Sequence: Synthetic peptide
  Seed: KVAELVHFL (MAGA3_HUMAN)
KIAELVHFR

SEQ ID NO: 57680 - protein, 9 aa, Artificial Sequence
  Description of Artificial Sequence: Synthetic peptide
  Seed: IFSKASSSL (MAGA3_HUMAN)
IQSKASSSL

SEQ ID NO: 57681 - protein, 11 aa, Artificial Sequence
  Description of Artificial Sequence: Synthetic peptide
  Seed: MLGSVVGNWQY (MAGA3_HUMAN)
MAGSVVGNWQW

SEQ ID NO: 57682 - protein, 10 aa, Artificial Sequence
  Description of Artificial Sequence: Synthetic peptide
  Seed: SVVGNWQYFF (MAGA3_HUMAN)
SVVGNWQYFY

SEQ ID NO: 57683 - protein, 9 aa, Artificial Sequence
  Description of Artificial Sequence: Synthetic peptide
  Seed: VVGNWQYFF (MAGA3_HUMAN)
VIGNWQYFY

SEQ ID NO: 57684 - protein, 10 aa, Artificial Sequence
  Description of Artificial Sequence: Synthetic peptide
  Seed: HISYPPLHEW (MAGA3_HUMAN)
HGSYPPLHEM

SEQ ID NO: 57685 - protein, 9 aa, Artificial Sequence
  Description of Artificial Sequence: Synthetic peptide
  Seed: SSTLVEVTL (MAGA3_HUMAN)
SVTLVEVTY

SEQ ID NO: 57686 - protein, 9 aa, Artificial Sequence
  Description of Artificial Sequence: Synthetic peptide
  Seed: KVAELVHFL (MAGA3_HUMAN)
KIAELVHFC

SEQ ID NO: 57687 - protein, 9 aa, Artificial Sequence
  Description of Artificial Sequence: Synthetic peptide
  Seed: ASSSLQLVF (MAGA3_HUMAN)
AVSSLQLVW

SEQ ID NO: 57688 - protein, 10 aa, Artificial Sequence
  Description of Artificial Sequence: Synthetic peptide
  Seed: AELVHFLLLK (MAGA3_HUMAN)
ARLVHFLLLR

SEQ ID NO: 57689 - protein, 9 aa, Artificial Sequence
  Description of Artificial Sequence: Synthetic peptide
  Seed: FATCLGLSY (MAGA3_HUMAN)
FYTCLGLSM

SEQ ID NO: 57690 - protein, 10 aa, Artificial Sequence
  Description of Artificial Sequence: Synthetic peptide
  Seed: FSKASSSLQL (MAGA3_HUMAN)
FCKASSSLQY

SEQ ID NO: 57691 - protein, 8 aa, Artificial Sequence
  Description of Artificial Sequence: Synthetic peptide
  Seed: VLHHMVKI (MAGA3_HUMAN)
VQHHMVKL

SEQ ID NO: 57692 - protein, 9 aa, Artificial Sequence
  Description of Artificial Sequence: Synthetic peptide
  Seed: KVLHHMVKI (MAGA3_HUMAN)
KALHHMVKM

SEQ ID NO: 57693 - protein, 9 aa, Artificial Sequence
  Description of Artificial Sequence: Synthetic peptide
  Seed: SVLEVFEGR (MAGA3_HUMAN)
SSLEVFEGK

SEQ ID NO: 57694 - protein, 9 aa, Artificial Sequence
  Description of Artificial Sequence: Synthetic peptide
  Seed: YEDSSNQEE (MAGA3_HUMAN)
YEDSSNQEV

SEQ ID NO: 57695 - protein, 10 aa, Artificial Sequence
  Description of Artificial Sequence: Synthetic peptide
  Seed: LQLVFGIELM (MAGA3_HUMAN)
LKLVFGIELL

SEQ ID NO: 57696 - protein, 9 aa, Artificial Sequence
  Description of Artificial Sequence: Synthetic peptide
  Seed: KVAELVHFL (MAGA3_HUMAN)
KQAELVHFM

SEQ ID NO: 57697 - protein, 9 aa, Artificial Sequence
  Description of Artificial Sequence: Synthetic peptide
  Seed: WQYFFPVIF (MAGA3_HUMAN)
WRYFFPVIM

SEQ ID NO: 57698 - protein, 9 aa, Artificial Sequence
  Description of Artificial Sequence: Synthetic peptide
  Seed: AEMLGSVVG (MAGA3_HUMAN)
AEMLGSVVF

SEQ ID NO: 57699 - protein, 10 aa, Artificial Sequence
  Description of Artificial Sequence: Synthetic peptide
  Seed: SDPACYEFLW (MAGA3_HUMAN)
SQPACYEFLW

SEQ ID NO: 57700 - protein, 10 aa, Artificial Sequence
  Description of Artificial Sequence: Synthetic peptide
  Seed: MVKISGGPHI (MAGA3_HUMAN)
MMKISGGPHY

SEQ ID NO: 57701 - protein, 10 aa, Artificial Sequence
  Description of Artificial Sequence: Synthetic peptide
  Seed: NWQYFFPVIF (MAGA3_HUMAN)
NAQYFFPVIY

SEQ ID NO: 57702 - protein, 9 aa, Artificial Sequence
  Description of Artificial Sequence: Synthetic peptide
  Seed: AQAPATEEQ (MAGA3_HUMAN)
AVAPATEEF

SEQ ID NO: 57703 - protein, 10 aa, Artificial Sequence
  Description of Artificial Sequence: Synthetic peptide
  Seed: KVAELVHFLL (MAGA3_HUMAN)
KMAELVHFLA

SEQ ID NO: 57704 - protein, 10 aa, Artificial Sequence
  Description of Artificial Sequence: Synthetic peptide
  Seed: SVVGNWQYFF (MAGA3_HUMAN)
SWVGNWQYFM

SEQ ID NO: 57705 - protein, 10 aa, Artificial Sequence
  Description of Artificial Sequence: Synthetic peptide
  Seed: LGSVVGNWQY (MAGA3_HUMAN)
LYSVVGNWQF

SEQ ID NO: 57706 - protein, 10 aa, Artificial Sequence
  Description of Artificial Sequence: Synthetic peptide
  Seed: WEELSVLEVF (MAGA3_HUMAN)
WPELSVLEVM

SEQ ID NO: 57707 - protein, 10 aa, Artificial Sequence
  Description of Artificial Sequence: Synthetic peptide
  Seed: ESEFQAALSR (MAGA3_HUMAN)
EVEFQAALSR

SEQ ID NO: 57708 - protein, 9 aa, Artificial Sequence
  Description of Artificial Sequence: Synthetic peptide
  Seed: LGDPKKLLT (MAGA3_HUMAN)
LMDPKKLLF

SEQ ID NO: 57709 - protein, 11 aa, Artificial Sequence
  Description of Artificial Sequence: Synthetic peptide
  Seed: LGSVVGNWQYF (MAGA3_HUMAN)
LSSVVGNWQYW

SEQ ID NO: 57710 - protein, 10 aa, Artificial Sequence
  Description of Artificial Sequence: Synthetic peptide
  Seed: RALVETSYVK (MAGA3_HUMAN)
RALVETSYVR

SEQ ID NO: 57711 - protein, 9 aa, Artificial Sequence
  Description of Artificial Sequence: Synthetic peptide
  Seed: YIFATCLGL (MAGA3_HUMAN)
YHFATCLGM

SEQ ID NO: 57712 - protein, 9 aa, Artificial Sequence
  Description of Artificial Sequence: Synthetic peptide
  Seed: ISYPPLHEW (MAGA3_HUMAN)
IRYPPLHEY

SEQ ID NO: 57713 - protein, 9 aa, Artificial Sequence
  Description of Artificial Sequence: Synthetic peptide
  Seed: RQVPGSDPA (MAGA3_HUMAN)
RVVPGSDPM

SEQ ID NO: 57714 - protein, 9 aa, Artificial Sequence
  Description of Artificial Sequence: Synthetic peptide
  Seed: YFFPVIFSK (MAGA3_HUMAN)
YLFPVIFSR

SEQ ID NO: 57715 - protein, 10 aa, Artificial Sequence
  Description of Artificial Sequence: Synthetic peptide
  Seed: SLPTTMNYPL (MAGA3_HUMAN)
SWPTTMNYPM

SEQ ID NO: 57716 - protein, 10 aa, Artificial Sequence
  Description of Artificial Sequence: Synthetic peptide
  Seed: MVKISGGPHI (MAGA3_HUMAN)
MYKISGGPHM

SEQ ID NO: 57717 - protein, 10 aa, Artificial Sequence
  Description of Artificial Sequence: Synthetic peptide
  Seed: SLQLVFGIEL (MAGA3_HUMAN)
SQQLVFGIEM

SEQ ID NO: 57718 - protein, 9 aa, Artificial Sequence
  Description of Artificial Sequence: Synthetic peptide
  Seed: KVAELVHFL (MAGA3_HUMAN)
KPAELVHFM

SEQ ID NO: 57719 - protein, 10 aa, Artificial Sequence
  Description of Artificial Sequence: Synthetic peptide
  Seed: WEELSVLEVF (MAGA3_HUMAN)
WHELSVLEVL

SEQ ID NO: 57720 - protein, 8 aa, Artificial Sequence
  Description of Artificial Sequence: Synthetic peptide
  Seed: FSKASSSL (MAGA3_HUMAN)
FSKASSSM

SEQ ID NO: 57721 - protein, 9 aa, Artificial Sequence
  Description of Artificial Sequence: Synthetic peptide
  Seed: GNWQYFFPV (MAGA3_HUMAN)
GAWQYFFPL

SEQ ID NO: 57722 - protein, 10 aa, Artificial Sequence
  Description of Artificial Sequence: Synthetic peptide
  Seed: EVFEGREDSI (MAGA3_HUMAN)
EMFEGREDSR

SEQ ID NO: 57723 - protein, 10 aa, Artificial Sequence
  Description of Artificial Sequence: Synthetic peptide
  Seed: LQLVFGIELM (MAGA3_HUMAN)
LFLVFGIELL

SEQ ID NO: 57724 - protein, 10 aa, Artificial Sequence
  Description of Artificial Sequence: Synthetic peptide
  Seed: RALVETSYVK (MAGA3_HUMAN)
RTLVETSYVR

SEQ ID NO: 57725 - protein, 9 aa, Artificial Sequence
  Description of Artificial Sequence: Synthetic peptide
  Seed: SEFQAALSR (MAGA3_HUMAN)
SEFQAALSG

SEQ ID NO: 57726 - protein, 11 aa, Artificial Sequence
  Description of Artificial Sequence: Synthetic peptide
  Seed: KVAELVHFLLL (MAGA3_HUMAN)
KLAELVHFLLV

SEQ ID NO: 57727 - protein, 9 aa, Artificial Sequence
  Description of Artificial Sequence: Synthetic peptide
  Seed: SEFQAALSR (MAGA3_HUMAN)
SQFQAALSW

SEQ ID NO: 57728 - protein, 10 aa, Artificial Sequence
  Description of Artificial Sequence: Synthetic peptide
  Seed: EVDPIGHLYI (MAGA3_HUMAN)
EADPIGHLYL

SEQ ID NO: 57729 - protein, 9 aa, Artificial Sequence
  Description of Artificial Sequence: Synthetic peptide
  Seed: LSRKVAELV (MAGA3_HUMAN)
LTRKVAELW

SEQ ID NO: 57730 - protein, 11 aa, Artificial Sequence
  Description of Artificial Sequence: Synthetic peptide
  Seed: REGDCAPEEKI (MAGA3_HUMAN)
RQGDCAPEEKW

SEQ ID NO: 57731 - protein, 9 aa, Artificial Sequence
  Description of Artificial Sequence: Synthetic peptide
  Seed: LEARGEALG (MAGA3_HUMAN)
LEARGEALA

SEQ ID NO: 57732 - protein, 9 aa, Artificial Sequence
  Description of Artificial Sequence: Synthetic peptide
  Seed: VEVTLGEVP (MAGA3_HUMAN)
VEVTLGEVL

SEQ ID NO: 57733 - protein, 11 aa, Artificial Sequence
  Description of Artificial Sequence: Synthetic peptide
  Seed: KVAELVHFLLL (MAGA3_HUMAN)
KMAELVHFLLC

SEQ ID NO: 57734 - protein, 10 aa, Artificial Sequence
  Description of Artificial Sequence: Synthetic peptide
  Seed: RKVAELVHFL (MAGA3_HUMAN)
RYVAELVHFI

SEQ ID NO: 57735 - protein, 11 aa, Artificial Sequence
  Description of Artificial Sequence: Synthetic peptide
  Seed: YIFATCLGLSY (MAGA3_HUMAN)
YKFATCLGLSM

SEQ ID NO: 57736 - protein, 10 aa, Artificial Sequence
  Description of Artificial Sequence: Synthetic peptide
  Seed: ASSLPTTMNY (MAGA3_HUMAN)
ATSLPTTMNW

SEQ ID NO: 57737 - protein, 10 aa, Artificial Sequence
  Description of Artificial Sequence: Synthetic peptide
  Seed: SVVGNWQYFF (MAGA3_HUMAN)
SSVGNWQYFY

SEQ ID NO: 57738 - protein, 10 aa, Artificial Sequence
  Description of Artificial Sequence: Synthetic peptide
  Seed: ASSSLQLVFG (MAGA3_HUMAN)
AASSLQLVFW

SEQ ID NO: 57739 - protein, 10 aa, Artificial Sequence
  Description of Artificial Sequence: Synthetic peptide
  Seed: KVAELVHFLL (MAGA3_HUMAN)
KTAELVHFLV

SEQ ID NO: 57740 - protein, 9 aa, Artificial Sequence
  Description of Artificial Sequence: Synthetic peptide
  Seed: FATCLGLSY (MAGA3_HUMAN)
FPTCLGLSI

SEQ ID NO: 57741 - protein, 9 aa, Artificial Sequence
  Description of Artificial Sequence: Synthetic peptide
  Seed: SYVKVLHHM (MAGA3_HUMAN)
SIVKVLHHF

SEQ ID NO: 57742 - protein, 9 aa, Artificial Sequence
  Description of Artificial Sequence: Synthetic peptide
  Seed: TSYVKVLHH (MAGA3_HUMAN)
TVYVKVLHF

SEQ ID NO: 57743 - protein, 10 aa, Artificial Sequence
  Description of Artificial Sequence: Synthetic peptide
  Seed: SLPTTMNYPL (MAGA3_HUMAN)
SKPTTMNYPM

SEQ ID NO: 57744 - protein, 9 aa, Artificial Sequence
  Description of Artificial Sequence: Synthetic peptide
  Seed: SVVGNWQYF (MAGA3_HUMAN)
SRVGNWQYF

SEQ ID NO: 57745 - protein, 8 aa, Artificial Sequence
  Description of Artificial Sequence: Synthetic peptide
  Seed: FPDLESEF (MAGA3_HUMAN)
FIDLESEV

SEQ ID NO: 57746 - protein, 9 aa, Artificial Sequence
  Description of Artificial Sequence: Synthetic peptide
  Seed: YIFATCLGL (MAGA3_HUMAN)
YEFATCLGF

SEQ ID NO: 57747 - protein, 9 aa, Artificial Sequence
  Description of Artificial Sequence: Synthetic peptide
  Seed: EEQEAASSS (MAGA3_HUMAN)
EEQEAASSM

SEQ ID NO: 57748 - protein, 9 aa, Artificial Sequence
  Description of Artificial Sequence: Synthetic peptide
  Seed: EVDPIGHLY (MAGA3_HUMAN)
EMDPIGHLM

SEQ ID NO: 57749 - protein, 9 aa, Artificial Sequence
  Description of Artificial Sequence: Synthetic peptide
  Seed: VTLGEVPAA (MAGA3_HUMAN)
VVLGEVPAV

SEQ ID NO: 57750 - protein, 9 aa, Artificial Sequence
  Description of Artificial Sequence: Synthetic peptide
  Seed: IMPKAGLLI (MAGA3_HUMAN)
IYPKAGLLV

SEQ ID NO: 57751 - protein, 10 aa, Artificial Sequence
  Description of Artificial Sequence: Synthetic peptide
  Seed: SVVGNWQYFF (MAGA3_HUMAN)
SMVGNWQYFY

SEQ ID NO: 57752 - protein, 9 aa, Artificial Sequence
  Description of Artificial Sequence: Synthetic peptide
  Seed: YFFPVIFSK (MAGA3_HUMAN)
YCFPVIFSY

SEQ ID NO: 57753 - protein, 9 aa, Artificial Sequence
  Description of Artificial Sequence: Synthetic peptide
  Seed: RALVETSYV (MAGA3_HUMAN)
RQLVETSYV

SEQ ID NO: 57754 - protein, 9 aa, Artificial Sequence
  Description of Artificial Sequence: Synthetic peptide
  Seed: VPGSDPACY (MAGA3_HUMAN)
VMGSDPACY

SEQ ID NO: 57755 - protein, 8 aa, Artificial Sequence
  Description of Artificial Sequence: Synthetic peptide
  Seed: YVKVLHHM (MAGA3_HUMAN)
YSKVLHHY

SEQ ID NO: 57756 - protein, 9 aa, Artificial Sequence
  Description of Artificial Sequence: Synthetic peptide
  Seed: ISYPPLHEW (MAGA3_HUMAN)
IFYPPLHEM

SEQ ID NO: 57757 - protein, 9 aa, Artificial Sequence
  Description of Artificial Sequence: Synthetic peptide
  Seed: ISYPPLHEW (MAGA3_HUMAN)
ICYPPLHEW

SEQ ID NO: 57758 - protein, 10 aa, Artificial Sequence
  Description of Artificial Sequence: Synthetic peptide
  Seed: STFPDLESEF (MAGA3_HUMAN)
SYFPDLESEY

SEQ ID NO: 57759 - protein, 10 aa, Artificial Sequence
  Description of Artificial Sequence: Synthetic peptide
  Seed: SVVGNWQYFF (MAGA3_HUMAN)
SQVGNWQYFF

SEQ ID NO: 57760 - protein, 9 aa, Artificial Sequence
  Description of Artificial Sequence: Synthetic peptide
  Seed: AQAPATEEQ (MAGA3_HUMAN)
AIAPATEEF

SEQ ID NO: 57761 - protein, 9 aa, Artificial Sequence
  Description of Artificial Sequence: Synthetic peptide
  Seed: EAASSSSTL (MAGA3_HUMAN)
EMASSSSTF

SEQ ID NO: 57762 - protein, 9 aa, Artificial Sequence
  Description of Artificial Sequence: Synthetic peptide
  Seed: ALVETSYVK (MAGA3_HUMAN)
ATVETSYVR

SEQ ID NO: 57763 - protein, 9 aa, Artificial Sequence
  Description of Artificial Sequence: Synthetic peptide
  Seed: SVVGNWQYF (MAGA3_HUMAN)
SSVGNWQYM

SEQ ID NO: 57764 - protein, 10 aa, Artificial Sequence
  Description of Artificial Sequence: Synthetic peptide
  Seed: IFATCLGLSY (MAGA3_HUMAN)
IMATCLGLSY

SEQ ID NO: 57765 - protein, 10 aa, Artificial Sequence
  Description of Artificial Sequence: Synthetic peptide
  Seed: ASSLPTTMNY (MAGA3_HUMAN)
AKSLPTTMNF

SEQ ID NO: 57766 - protein, 9 aa, Artificial Sequence
  Description of Artificial Sequence: Synthetic peptide
  Seed: FATCLGLSY (MAGA3_HUMAN)
FQTCLGLSY

SEQ ID NO: 57767 - protein, 10 aa, Artificial Sequence
  Description of Artificial Sequence: Synthetic peptide
  Seed: SYPPLHEWVL (MAGA3_HUMAN)
SYPPLHEWVV

SEQ ID NO: 57768 - protein, 9 aa, Artificial Sequence
  Description of Artificial Sequence: Synthetic peptide
  Seed: VKISGGPHI (MAGA3_HUMAN)
VIISGGPHY

SEQ ID NO: 57769 - protein, 9 aa, Artificial Sequence
  Description of Artificial Sequence: Synthetic peptide
  Seed: KIWEELSVL (MAGA3_HUMAN)
KSWEELSVM

SEQ ID NO: 57770 - protein, 10 aa, Artificial Sequence
  Description of Artificial Sequence: Synthetic peptide
  Seed: AELVHFLLLK (MAGA3_HUMAN)
ACLVHFLLLK

SEQ ID NO: 57771 - protein, 10 aa, Artificial Sequence
  Description of Artificial Sequence: Synthetic peptide
  Seed: KAEMLGSVVG (MAGA3_HUMAN)
KYEMLGSVVV

SEQ ID NO: 57772 - protein, 9 aa, Artificial Sequence
  Description of Artificial Sequence: Synthetic peptide
  Seed: ASSSLQLVF (MAGA3_HUMAN)
AQSSLQLVI

SEQ ID NO: 57773 - protein, 10 aa, Artificial Sequence
  Description of Artificial Sequence: Synthetic peptide
  Seed: VIFSKASSSL (MAGA3_HUMAN)
VQFSKASSSF

SEQ ID NO: 57774 - protein, 10 aa, Artificial Sequence
  Description of Artificial Sequence: Synthetic peptide
  Seed: KAEMLGSVVG (MAGA3_HUMAN)
KKEMLGSVVA

SEQ ID NO: 57775 - protein, 9 aa, Artificial Sequence
  Description of Artificial Sequence: Synthetic peptide
  Seed: IIVLAIIAR (MAGA3_HUMAN)
ISVLAIIAL

SEQ ID NO: 57776 - protein, 9 aa, Artificial Sequence
  Description of Artificial Sequence: Synthetic peptide
  Seed: TFPDLESEF (MAGA3_HUMAN)
TSPDLESEY

SEQ ID NO: 57777 - protein, 10 aa, Artificial Sequence
  Description of Artificial Sequence: Synthetic peptide
  Seed: SYPPLHEWVL (MAGA3_HUMAN)
SWPPLHEWVI

SEQ ID NO: 57778 - protein, 11 aa, Artificial Sequence
  Description of Artificial Sequence: Synthetic peptide
  Seed: FPVIFSKASSS (MAGA3_HUMAN)
FPVIFSKASSA

SEQ ID NO: 57779 - protein, 10 aa, Artificial Sequence
  Description of Artificial Sequence: Synthetic peptide
  Seed: DLESEFQAAL (MAGA3_HUMAN)
DRESEFQAAY

SEQ ID NO: 57780 - protein, 10 aa, Artificial Sequence
  Description of Artificial Sequence: Synthetic peptide
  Seed: ISYPPLHEWV (MAGA3_HUMAN)
IFYPPLHEWL

SEQ ID NO: 57781 - protein, 9 aa, Artificial Sequence
  Description of Artificial Sequence: Synthetic peptide
  Seed: GASSLPTTM (MAGA3_HUMAN)
GTSSLPTTY

SEQ ID NO: 57782 - protein, 9 aa, Artificial Sequence
  Description of Artificial Sequence: Synthetic peptide
  Seed: EVDPIGHLY (MAGA3_HUMAN)
EQDPIGHLL

SEQ ID NO: 57783 - protein, 9 aa, Artificial Sequence
  Description of Artificial Sequence: Synthetic peptide
  Seed: SSLPTTMNY (MAGA3_HUMAN)
SQLPTTMNM

SEQ ID NO: 57784 - protein, 11 aa, Artificial Sequence
  Description of Artificial Sequence: Synthetic peptide
  Seed: AESPDPPQSPQ (MAGA3_HUMAN)
AESPDPPQSPI

SEQ ID NO: 57785 - protein, 10 aa, Artificial Sequence
  Description of Artificial Sequence: Synthetic peptide
  Seed: KISGGPHISY (MAGA3_HUMAN)
KMSGGPHISW

SEQ ID NO: 57786 - protein, 10 aa, Artificial Sequence
  Description of Artificial Sequence: Synthetic peptide
  Seed: ISYPPLHEWV (MAGA3_HUMAN)
IVYPPLHEWI

SEQ ID NO: 57787 - protein, 9 aa, Artificial Sequence
  Description of Artificial Sequence: Synthetic peptide
  Seed: YVKVLHHMV (MAGA3_HUMAN)
YLKVLHHML

SEQ ID NO: 57788 - protein, 9 aa, Artificial Sequence
  Description of Artificial Sequence: Synthetic peptide
  Seed: QIMPKAGLL (MAGA3_HUMAN)
QQMPKAGLY

SEQ ID NO: 57789 - protein, 10 aa, Artificial Sequence
  Description of Artificial Sequence: Synthetic peptide
  Seed: WEELSVLEVF (MAGA3_HUMAN)
WSELSVLEVL

SEQ ID NO: 57790 - protein, 9 aa, Artificial Sequence
  Description of Artificial Sequence: Synthetic peptide
  Seed: ALGLVGAQA (MAGA3_HUMAN)
AMGLVGAQV

SEQ ID NO: 57791 - protein, 9 aa, Artificial Sequence
  Description of Artificial Sequence: Synthetic peptide
  Seed: SSLQLVFGI (MAGA3_HUMAN)
SMLQLVFGS

SEQ ID NO: 57792 - protein, 9 aa, Artificial Sequence
  Description of Artificial Sequence: Synthetic peptide
  Seed: YEDSSNQEE (MAGA3_HUMAN)
YEDSSNQEA

SEQ ID NO: 57793 - protein, 11 aa, Artificial Sequence
  Description of Artificial Sequence: Synthetic peptide
  Seed: REGDCAPEEKI (MAGA3_HUMAN)
RMGDCAPEEKW

SEQ ID NO: 57794 - protein, 9 aa, Artificial Sequence
  Description of Artificial Sequence: Synthetic peptide
  Seed: ISGGPHISY (MAGA3_HUMAN)
IFGGPHISY

SEQ ID NO: 57795 - protein, 9 aa, Artificial Sequence
  Description of Artificial Sequence: Synthetic peptide
  Seed: EAASSSSTL (MAGA3_HUMAN)
ESASSSSTI

SEQ ID NO: 57796 - protein, 10 aa, Artificial Sequence
  Description of Artificial Sequence: Synthetic peptide
  Seed: ISYPPLHEWV (MAGA3_HUMAN)
ICYPPLHEWI

SEQ ID NO: 57797 - protein, 9 aa, Artificial Sequence
  Description of Artificial Sequence: Synthetic peptide
  Seed: SSLPTTMNY (MAGA3_HUMAN)
SALPTTMNF

SEQ ID NO: 57798 - protein, 9 aa, Artificial Sequence
  Description of Artificial Sequence: Synthetic peptide
  Seed: HEWVLREGE (MAGA3_HUMAN)
HEWVLREGV

SEQ ID NO: 57799 - protein, 9 aa, Artificial Sequence
  Description of Artificial Sequence: Synthetic peptide
  Seed: FATCLGLSY (MAGA3_HUMAN)
FYTCLGLSV

SEQ ID NO: 57800 - protein, 8 aa, Artificial Sequence
  Description of Artificial Sequence: Synthetic peptide
  Seed: FPDLESEF (MAGA3_HUMAN)
FNDLESEL

SEQ ID NO: 57801 - protein, 10 aa, Artificial Sequence
  Description of Artificial Sequence: Synthetic peptide
  Seed: STFPDLESEF (MAGA3_HUMAN)
SRFPDLESEF

SEQ ID NO: 57802 - protein, 9 aa, Artificial Sequence
  Description of Artificial Sequence: Synthetic peptide
  Seed: AELVHFLLL (MAGA3_HUMAN)
AELVHFLLY

SEQ ID NO: 57803 - protein, 11 aa, Artificial Sequence
  Description of Artificial Sequence: Synthetic peptide
  Seed: QEAASSSSTLV (MAGA3_HUMAN)
QEAASSSSTLW

SEQ ID NO: 57804 - protein, 10 aa, Artificial Sequence
  Description of Artificial Sequence: Synthetic peptide
  Seed: ELMEVDPIGH (MAGA3_HUMAN)
ESMEVDPIGK

SEQ ID NO: 57805 - protein, 9 aa, Artificial Sequence
  Description of Artificial Sequence: Synthetic peptide
  Seed: KASSSLQLV (MAGA3_HUMAN)
KISSSLQLL

SEQ ID NO: 57806 - protein, 9 aa, Artificial Sequence
  Description of Artificial Sequence: Synthetic peptide
  Seed: EAASSSSTL (MAGA3_HUMAN)
EVASSSSTA

SEQ ID NO: 57807 - protein, 9 aa, Artificial Sequence
  Description of Artificial Sequence: Synthetic peptide
  Seed: QLVFGIELM (MAGA3_HUMAN)
QQVFGIELY

SEQ ID NO: 57808 - protein, 10 aa, Artificial Sequence
  Description of Artificial Sequence: Synthetic peptide
  Seed: LVHFLLLKYR (MAGA3_HUMAN)
LSHFLLLKYR

SEQ ID NO: 57809 - protein, 9 aa, Artificial Sequence
  Description of Artificial Sequence: Synthetic peptide
  Seed: KVAELVHFL (MAGA3_HUMAN)
KEAELVHFY

SEQ ID NO: 57810 - protein, 9 aa, Artificial Sequence
  Description of Artificial Sequence: Synthetic peptide
  Seed: VVGNWQYFF (MAGA3_HUMAN)
VMGNWQYFW

SEQ ID NO: 57811 - protein, 9 aa, Artificial Sequence
  Description of Artificial Sequence: Synthetic peptide
  Seed: VQENYLEYR (MAGA3_HUMAN)
VSENYLEYY

SEQ ID NO: 57812 - protein, 9 aa, Artificial Sequence
  Description of Artificial Sequence: Synthetic peptide
  Seed: YIFATCLGL (MAGA3_HUMAN)
YMFATCLGH

SEQ ID NO: 57813 - protein, 10 aa, Artificial Sequence
  Description of Artificial Sequence: Synthetic peptide
  Seed: VDPIGHLYIF (MAGA3_HUMAN)
VKPIGHLYIY

SEQ ID NO: 57814 - protein, 10 aa, Artificial Sequence
  Description of Artificial Sequence: Synthetic peptide
  Seed: RQVPGSDPAC (MAGA3_HUMAN)
RQVPGSDPAM

SEQ ID NO: 57815 - protein, 9 aa, Artificial Sequence
  Description of Artificial Sequence: Synthetic peptide
  Seed: KVLHHMVKI (MAGA3_HUMAN)
KLLHHMVKV

SEQ ID NO: 57816 - protein, 9 aa, Artificial Sequence
  Description of Artificial Sequence: Synthetic peptide
  Seed: ISYPPLHEW (MAGA3_HUMAN)
IGYPPLHEW

SEQ ID NO: 57817 - protein, 9 aa, Artificial Sequence
  Description of Artificial Sequence: Synthetic peptide
  Seed: ISGGPHISY (MAGA3_HUMAN)
IFGGPHISL

SEQ ID NO: 57818 - protein, 10 aa, Artificial Sequence
  Description of Artificial Sequence: Synthetic peptide
  Seed: KASSSLQLVF (MAGA3_HUMAN)
KWSSSLQLVM

SEQ ID NO: 57819 - protein, 9 aa, Artificial Sequence
  Description of Artificial Sequence: Synthetic peptide
  Seed: TQHFVQENY (MAGA3_HUMAN)
TMHFVQENI

SEQ ID NO: 57820 - protein, 9 aa, Artificial Sequence
  Description of Artificial Sequence: Synthetic peptide
  Seed: KIWEELSVL (MAGA3_HUMAN)
KMWEELSVI

SEQ ID NO: 57821 - protein, 9 aa, Artificial Sequence
  Description of Artificial Sequence: Synthetic peptide
  Seed: KASSSLQLV (MAGA3_HUMAN)
KNSSSLQLW

SEQ ID NO: 57822 - protein, 10 aa, Artificial Sequence
  Description of Artificial Sequence: Synthetic peptide
  Seed: REGDCAPEEK (MAGA3_HUMAN)
REGDCAPEEA

SEQ ID NO: 57823 - protein, 9 aa, Artificial Sequence
  Description of Artificial Sequence: Synthetic peptide
  Seed: KVLHHMVKI (MAGA3_HUMAN)
KNLHHMVKW

SEQ ID NO: 57824 - protein, 11 aa, Artificial Sequence
  Description of Artificial Sequence: Synthetic peptide
  Seed: QEAASSSSTLV (MAGA3_HUMAN)
QEAASSSSTLF

SEQ ID NO: 57825 - protein, 9 aa, Artificial Sequence
  Description of Artificial Sequence: Synthetic peptide
  Seed: WQYFFPVIF (MAGA3_HUMAN)
WEYFFPVIM

SEQ ID NO: 57826 - protein, 9 aa, Artificial Sequence
  Description of Artificial Sequence: Synthetic peptide
  Seed: ELVHFLLLK (MAGA3_HUMAN)
EYVHFLLLR

SEQ ID NO: 57827 - protein, 10 aa, Artificial Sequence
  Description of Artificial Sequence: Synthetic peptide
  Seed: MEVDPIGHLY (MAGA3_HUMAN)
MVVDPIGHLL

SEQ ID NO: 57828 - protein, 10 aa, Artificial Sequence
  Description of Artificial Sequence: Synthetic peptide
  Seed: KAEMLGSVVG (MAGA3_HUMAN)
KHEMLGSVVA

SEQ ID NO: 57829 - protein, 10 aa, Artificial Sequence
  Description of Artificial Sequence: Synthetic peptide
  Seed: RKVAELVHFL (MAGA3_HUMAN)
RWVAELVHFV

SEQ ID NO: 57830 - protein, 11 aa, Artificial Sequence
  Description of Artificial Sequence: Synthetic peptide
  Seed: AQAPATEEQEA (MAGA3_HUMAN)
AIAPATEEQEW

SEQ ID NO: 57831 - protein, 9 aa, Artificial Sequence
  Description of Artificial Sequence: Synthetic peptide
  Seed: FVQENYLEY (MAGA3_HUMAN)
FTQENYLEV

SEQ ID NO: 57832 - protein, 10 aa, Artificial Sequence
  Description of Artificial Sequence: Synthetic peptide
  Seed: RKVAELVHFL (MAGA3_HUMAN)
RFVAELVHFA

SEQ ID NO: 57833 - protein, 10 aa, Artificial Sequence
  Description of Artificial Sequence: Synthetic peptide
  Seed: MVKISGGPHI (MAGA3_HUMAN)
MHKISGGPHF

SEQ ID NO: 57834 - protein, 9 aa, Artificial Sequence
  Description of Artificial Sequence: Synthetic peptide
  Seed: YIFATCLGL (MAGA3_HUMAN)
YQFATCLGY

SEQ ID NO: 57835 - protein, 10 aa, Artificial Sequence
  Description of Artificial Sequence: Synthetic peptide
  Seed: RKVAELVHFL (MAGA3_HUMAN)
RMVAELVHFA

SEQ ID NO: 57836 - protein, 9 aa, Artificial Sequence
  Description of Artificial Sequence: Synthetic peptide
  Seed: FATCLGLSY (MAGA3_HUMAN)
FHTCLGLSM

SEQ ID NO: 57837 - protein, 9 aa, Artificial Sequence
  Description of Artificial Sequence: Synthetic peptide
  Seed: LESEFQAAL (MAGA3_HUMAN)
LRSEFQAAL

SEQ ID NO: 57838 - protein, 11 aa, Artificial Sequence
  Description of Artificial Sequence: Synthetic peptide
  Seed: VKISGGPHISY (MAGA3_HUMAN)
VKISGGPHISF

SEQ ID NO: 57839 - protein, 9 aa, Artificial Sequence
  Description of Artificial Sequence: Synthetic peptide
  Seed: GNWQYFFPV (MAGA3_HUMAN)
GTWQYFFPL

SEQ ID NO: 57840 - protein, 8 aa, Artificial Sequence
  Description of Artificial Sequence: Synthetic peptide
  Seed: AELVHFLL (MAGA3_HUMAN)
AELVHFLM

SEQ ID NO: 57841 - protein, 8 aa, Artificial Sequence
  Description of Artificial Sequence: Synthetic peptide
  Seed: SGGPHISY (MAGA3_HUMAN)
SAGPHISY

SEQ ID NO: 57842 - protein, 11 aa, Artificial Sequence
  Description of Artificial Sequence: Synthetic peptide
  Seed: IFSKASSSLQL (MAGA3_HUMAN)
IYSKASSSLQF

SEQ ID NO: 57843 - protein, 9 aa, Artificial Sequence
  Description of Artificial Sequence: Synthetic peptide
  Seed: ASSSLQLVF (MAGA3_HUMAN)
AHSSLQLVM

SEQ ID NO: 57844 - protein, 9 aa, Artificial Sequence
  Description of Artificial Sequence: Synthetic peptide
  Seed: ISGGPHISY (MAGA3_HUMAN)
IAGGPHISK

SEQ ID NO: 57845 - protein, 9 aa, Artificial Sequence
  Description of Artificial Sequence: Synthetic peptide
  Seed: KASSSLQLV (MAGA3_HUMAN)
KSSSSLQLI

SEQ ID NO: 57846 - protein, 9 aa, Artificial Sequence
  Description of Artificial Sequence: Synthetic peptide
  Seed: VKISGGPHI (MAGA3_HUMAN)
VRISGGPHF

SEQ ID NO: 57847 - protein, 10 aa, Artificial Sequence
  Description of Artificial Sequence: Synthetic peptide
  Seed: HISYPPLHEW (MAGA3_HUMAN)
HSSYPPLHEM

SEQ ID NO: 57848 - protein, 9 aa, Artificial Sequence
  Description of Artificial Sequence: Synthetic peptide
  Seed: ISYPPLHEW (MAGA3_HUMAN)
IQYPPLHEW

SEQ ID NO: 57849 - protein, 10 aa, Artificial Sequence
  Description of Artificial Sequence: Synthetic peptide
  Seed: STFPDLESEF (MAGA3_HUMAN)
SIFPDLESEK

SEQ ID NO: 57850 - protein, 9 aa, Artificial Sequence
  Description of Artificial Sequence: Synthetic peptide
  Seed: YFFPVIFSK (MAGA3_HUMAN)
YDFPVIFSR

SEQ ID NO: 57851 - protein, 9 aa, Artificial Sequence
  Description of Artificial Sequence: Synthetic peptide
  Seed: MEVDPIGHL (MAGA3_HUMAN)
MLVDPIGHL

SEQ ID NO: 57852 - protein, 10 aa, Artificial Sequence
  Description of Artificial Sequence: Synthetic peptide
  Seed: ALVETSYVKV (MAGA3_HUMAN)
AVVETSYVKV

SEQ ID NO: 57853 - protein, 10 aa, Artificial Sequence
  Description of Artificial Sequence: Synthetic peptide
  Seed: YIFATCLGLS (MAGA3_HUMAN)
YIFATCLGLA

SEQ ID NO: 57854 - protein, 11 aa, Artificial Sequence
  Description of Artificial Sequence: Synthetic peptide
  Seed: QLVFGIELMEV (MAGA3_HUMAN)
QFVFGIELMEV

SEQ ID NO: 57855 - protein, 10 aa, Artificial Sequence
  Description of Artificial Sequence: Synthetic peptide
  Seed: REGDCAPEEK (MAGA3_HUMAN)
REGDCAPEEV

SEQ ID NO: 57856 - protein, 9 aa, Artificial Sequence
  Description of Artificial Sequence: Synthetic peptide
  Seed: FVQENYLEY (MAGA3_HUMAN)
FSQENYLEF

SEQ ID NO: 57857 - protein, 10 aa, Artificial Sequence
  Description of Artificial Sequence: Synthetic peptide
  Seed: TSYVKVLHHM (MAGA3_HUMAN)
TWYVKVLHHL

SEQ ID NO: 57858 - protein, 9 aa, Artificial Sequence
  Description of Artificial Sequence: Synthetic peptide
  Seed: MEVDPIGHL (MAGA3_HUMAN)
MGVDPIGHM

SEQ ID NO: 57859 - protein, 9 aa, Artificial Sequence
  Description of Artificial Sequence: Synthetic peptide
  Seed: KVAELVHFL (MAGA3_HUMAN)
KTAELVHFF

SEQ ID NO: 57860 - protein, 11 aa, Artificial Sequence
  Description of Artificial Sequence: Synthetic peptide
  Seed: AQAPATEEQEA (MAGA3_HUMAN)
AEAPATEEQEL

SEQ ID NO: 57861 - protein, 9 aa, Artificial Sequence
  Description of Artificial Sequence: Synthetic peptide
  Seed: FVQENYLEY (MAGA3_HUMAN)
FRQENYLEV

SEQ ID NO: 57862 - protein, 10 aa, Artificial Sequence
  Description of Artificial Sequence: Synthetic peptide
  Seed: ISYPPLHEWV (MAGA3_HUMAN)
IDYPPLHEWL

SEQ ID NO: 57863 - protein, 9 aa, Artificial Sequence
  Description of Artificial Sequence: Synthetic peptide
  Seed: LGDPKKLLT (MAGA3_HUMAN)
LADPKKLLV

SEQ ID NO: 57864 - protein, 11 aa, Artificial Sequence
  Description of Artificial Sequence: Synthetic peptide
  Seed: KIWEELSVLEV (MAGA3_HUMAN)
KQWEELSVLEF

SEQ ID NO: 57865 - protein, 10 aa, Artificial Sequence
  Description of Artificial Sequence: Synthetic peptide
  Seed: STFPDLESEF (MAGA3_HUMAN)
SVFPDLESEF

SEQ ID NO: 57866 - protein, 9 aa, Artificial Sequence
  Description of Artificial Sequence: Synthetic peptide
  Seed: IFSKASSSL (MAGA3_HUMAN)
IASKASSSI

SEQ ID NO: 57867 - protein, 11 aa, Artificial Sequence
  Description of Artificial Sequence: Synthetic peptide
  Seed: ISYPPLHEWVL (MAGA3_HUMAN)
IAYPPLHEWVY

SEQ ID NO: 57868 - protein, 9 aa, Artificial Sequence
  Description of Artificial Sequence: Synthetic peptide
  Seed: SILGDPKKL (MAGA3_HUMAN)
SMLGDPKKY

SEQ ID NO: 57869 - protein, 9 aa, Artificial Sequence
  Description of Artificial Sequence: Synthetic peptide
  Seed: SSTLVEVTL (MAGA3_HUMAN)
SQTLVEVTI

SEQ ID NO: 57870 - protein, 9 aa, Artificial Sequence
  Description of Artificial Sequence: Synthetic peptide
  Seed: RQVPGSDPA (MAGA3_HUMAN)
REVPGSDPL

SEQ ID NO: 57871 - protein, 8 aa, Artificial Sequence
  Description of Artificial Sequence: Synthetic peptide
  Seed: ASSLPTTM (MAGA3_HUMAN)
AASLPTTY

SEQ ID NO: 57872 - protein, 10 aa, Artificial Sequence
  Description of Artificial Sequence: Synthetic peptide
  Seed: YIFATCLGLS (MAGA3_HUMAN)
YLFATCLGLE

SEQ ID NO: 57873 - protein, 9 aa, Artificial Sequence
  Description of Artificial Sequence: Synthetic peptide
  Seed: GLLIIVLAI (MAGA3_HUMAN)
GMLIIVLAA

SEQ ID NO: 57874 - protein, 11 aa, Artificial Sequence
  Description of Artificial Sequence: Synthetic peptide
  Seed: SLPTTMNYPLW (MAGA3_HUMAN)
SYPTTMNYPLF

SEQ ID NO: 57875 - protein, 9 aa, Artificial Sequence
  Description of Artificial Sequence: Synthetic peptide
  Seed: VTLGEVPAA (MAGA3_HUMAN)
VMLGEVPAV

SEQ ID NO: 57876 - protein, 9 aa, Artificial Sequence
  Description of Artificial Sequence: Synthetic peptide
  Seed: EVDPIGHLY (MAGA3_HUMAN)
EADPIGHLW

SEQ ID NO: 57877 - protein, 10 aa, Artificial Sequence
  Description of Artificial Sequence: Synthetic peptide
  Seed: KISGGPHISY (MAGA3_HUMAN)
KVSGGPHISY

SEQ ID NO: 57878 - protein, 9 aa, Artificial Sequence
  Description of Artificial Sequence: Synthetic peptide
  Seed: YIFATCLGL (MAGA3_HUMAN)
YVFATCLGT

SEQ ID NO: 57879 - protein, 9 aa, Artificial Sequence
  Description of Artificial Sequence: Synthetic peptide
  Seed: ALVETSYVK (MAGA3_HUMAN)
AAVETSYVL

SEQ ID NO: 57880 - protein, 9 aa, Artificial Sequence
  Description of Artificial Sequence: Synthetic peptide
  Seed: YFFPVIFSK (MAGA3_HUMAN)
YLFPVIFSY

SEQ ID NO: 57881 - protein, 10 aa, Artificial Sequence
  Description of Artificial Sequence: Synthetic peptide
  Seed: DLESEFQAAL (MAGA3_HUMAN)
DQESEFQAAY

SEQ ID NO: 57882 - protein, 8 aa, Artificial Sequence
  Description of Artificial Sequence: Synthetic peptide
  Seed: SGGPHISY (MAGA3_HUMAN)
STGPHISY

SEQ ID NO: 57883 - protein, 10 aa, Artificial Sequence
  Description of Artificial Sequence: Synthetic peptide
  Seed: AELVHFLLLK (MAGA3_HUMAN)
AQLVHFLLLR

SEQ ID NO: 57884 - protein, 9 aa, Artificial Sequence
  Description of Artificial Sequence: Synthetic peptide
  Seed: REGDCAPEE (MAGA3_HUMAN)
REGDCAPEV

SEQ ID NO: 57885 - protein, 9 aa, Artificial Sequence
  Description of Artificial Sequence: Synthetic peptide
  Seed: ASSSLQLVF (MAGA3_HUMAN)
AHSSLQLVY

SEQ ID NO: 57886 - protein, 10 aa, Artificial Sequence
  Description of Artificial Sequence: Synthetic peptide
  Seed: TSYVKVLHHM (MAGA3_HUMAN)
TPYVKVLHHL

SEQ ID NO: 57887 - protein, 11 aa, Artificial Sequence
  Description of Artificial Sequence: Synthetic peptide
  Seed: YIFATCLGLSY (MAGA3_HUMAN)
YQFATCLGLSH

SEQ ID NO: 57888 - protein, 11 aa, Artificial Sequence
  Description of Artificial Sequence: Synthetic peptide
  Seed: SYPPLHEWVLR (MAGA3_HUMAN)
SWPPLHEWVLI

SEQ ID NO: 57889 - protein, 9 aa, Artificial Sequence
  Description of Artificial Sequence: Synthetic peptide
  Seed: FVQENYLEY (MAGA3_HUMAN)
FIQENYLEK

SEQ ID NO: 57890 - protein, 9 aa, Artificial Sequence
  Description of Artificial Sequence: Synthetic peptide
  Seed: QHFVQENYL (MAGA3_HUMAN)
QHFVQENYI

SEQ ID NO: 57891 - protein, 10 aa, Artificial Sequence
  Description of Artificial Sequence: Synthetic peptide
  Seed: KASSSLQLVF (MAGA3_HUMAN)
KGSSSLQLVI

SEQ ID NO: 57892 - protein, 11 aa, Artificial Sequence
  Description of Artificial Sequence: Synthetic peptide
  Seed: YIFATCLGLSY (MAGA3_HUMAN)
YRFATCLGLSY

SEQ ID NO: 57893 - protein, 9 aa, Artificial Sequence
  Description of Artificial Sequence: Synthetic peptide
  Seed: EAASSSSTL (MAGA3_HUMAN)
EIASSSSTI

SEQ ID NO: 57894 - protein, 10 aa, Artificial Sequence
  Description of Artificial Sequence: Synthetic peptide
  Seed: RKVAELVHFL (MAGA3_HUMAN)
RWVAELVHFI

SEQ ID NO: 57895 - protein, 9 aa, Artificial Sequence
  Description of Artificial Sequence: Synthetic peptide
  Seed: ILGDPKKLL (MAGA3_HUMAN)
IFGDPKKLL

SEQ ID NO: 57896 - protein, 9 aa, Artificial Sequence
  Description of Artificial Sequence: Synthetic peptide
  Seed: SVLEVFEGR (MAGA3_HUMAN)
SYLEVFEGY

SEQ ID NO: 57897 - protein, 11 aa, Artificial Sequence
  Description of Artificial Sequence: Synthetic peptide
  Seed: AEMLGSVVGNW (MAGA3_HUMAN)
AQMLGSVVGNY

SEQ ID NO: 57898 - protein, 9 aa, Artificial Sequence
  Description of Artificial Sequence: Synthetic peptide
  Seed: ASSSLQLVF (MAGA3_HUMAN)
ARSSLQLVM

SEQ ID NO: 57899 - protein, 10 aa, Artificial Sequence
  Description of Artificial Sequence: Synthetic peptide
  Seed: STFPDLESEF (MAGA3_HUMAN)
SSFPDLESEW

SEQ ID NO: 57900 - protein, 10 aa, Artificial Sequence
  Description of Artificial Sequence: Synthetic peptide
  Seed: FSKASSSLQL (MAGA3_HUMAN)
FPKASSSLQY

SEQ ID NO: 57901 - protein, 11 aa, Artificial Sequence
  Description of Artificial Sequence: Synthetic peptide
  Seed: WQYFFPVIFSK (MAGA3_HUMAN)
WYYFFPVIFSR

SEQ ID NO: 57902 - protein, 9 aa, Artificial Sequence
  Description of Artificial Sequence: Synthetic peptide
  Seed: TQHFVQENY (MAGA3_HUMAN)
TLHFVQENL

SEQ ID NO: 57903 - protein, 10 aa, Artificial Sequence
  Description of Artificial Sequence: Synthetic peptide
  Seed: LTQHFVQENY (MAGA3_HUMAN)
LQQHFVQENF

SEQ ID NO: 57904 - protein, 9 aa, Artificial Sequence
  Description of Artificial Sequence: Synthetic peptide
  Seed: KAGLLIIVL (MAGA3_HUMAN)
KQGLLIIVI

SEQ ID NO: 57905 - protein, 10 aa, Artificial Sequence
  Description of Artificial Sequence: Synthetic peptide
  Seed: YFFPVIFSKA (MAGA3_HUMAN)
YQFPVIFSKA

SEQ ID NO: 57906 - protein, 10 aa, Artificial Sequence
  Description of Artificial Sequence: Synthetic peptide
  Seed: AGLLIIVLAI (MAGA3_HUMAN)
AMLLIIVLAV

SEQ ID NO: 57907 - protein, 9 aa, Artificial Sequence
  Description of Artificial Sequence: Synthetic peptide
  Seed: EAASSSSTL (MAGA3_HUMAN)
EVASSSSTY

SEQ ID NO: 57908 - protein, 9 aa, Artificial Sequence
  Description of Artificial Sequence: Synthetic peptide
  Seed: LPTTMNYPL (MAGA3_HUMAN)
LSTTMNYPY

SEQ ID NO: 57909 - protein, 10 aa, Artificial Sequence
  Description of Artificial Sequence: Synthetic peptide
  Seed: MNYPLWSQSY (MAGA3_HUMAN)
MFYPLWSQSF

SEQ ID NO: 57910 - protein, 9 aa, Artificial Sequence
  Description of Artificial Sequence: Synthetic peptide
  Seed: HLYIFATCL (MAGA3_HUMAN)
HQYIFATCI

SEQ ID NO: 57911 - protein, 10 aa, Artificial Sequence
  Description of Artificial Sequence: Synthetic peptide
  Seed: KISGGPHISY (MAGA3_HUMAN)
KASGGPHISW

SEQ ID NO: 57912 - protein, 10 aa, Artificial Sequence
  Description of Artificial Sequence: Synthetic peptide
  Seed: GHLYIFATCL (MAGA3_HUMAN)
GTLYIFATCV

SEQ ID NO: 57913 - protein, 9 aa, Artificial Sequence
  Description of Artificial Sequence: Synthetic peptide
  Seed: SSTLVEVTL (MAGA3_HUMAN)
SQTLVEVTV

SEQ ID NO: 57914 - protein, 9 aa, Artificial Sequence
  Description of Artificial Sequence: Synthetic peptide
  Seed: SILGDPKKL (MAGA3_HUMAN)
SLLGDPKKI

SEQ ID NO: 57915 - protein, 9 aa, Artificial Sequence
  Description of Artificial Sequence: Synthetic peptide
  Seed: SYPPLHEWV (MAGA3_HUMAN)
SYPPLHEWM

SEQ ID NO: 57916 - protein, 10 aa, Artificial Sequence
  Description of Artificial Sequence: Synthetic peptide
  Seed: MEVDPIGHLY (MAGA3_HUMAN)
MPVDPIGHLF

SEQ ID NO: 57917 - protein, 9 aa, Artificial Sequence
  Description of Artificial Sequence: Synthetic peptide
  Seed: SSLPTTMNY (MAGA3_HUMAN)
SYLPTTMNI

SEQ ID NO: 57918 - protein, 10 aa, Artificial Sequence
  Description of Artificial Sequence: Synthetic peptide
  Seed: MNYPLWSQSY (MAGA3_HUMAN)
MAYPLWSQSF

SEQ ID NO: 57919 - protein, 9 aa, Artificial Sequence
  Description of Artificial Sequence: Synthetic peptide
  Seed: NYPLWSQSY (MAGA3_HUMAN)
NSPLWSQSL

SEQ ID NO: 57920 - protein, 10 aa, Artificial Sequence
  Description of Artificial Sequence: Synthetic peptide
  Seed: MNYPLWSQSY (MAGA3_HUMAN)
MSYPLWSQSM

SEQ ID NO: 57921 - protein, 9 aa, Artificial Sequence
  Description of Artificial Sequence: Synthetic peptide
  Seed: GASSLPTTM (MAGA3_HUMAN)
GQSSLPTTI

SEQ ID NO: 57922 - protein, 9 aa, Artificial Sequence
  Description of Artificial Sequence: Synthetic peptide
  Seed: VKISGGPHI (MAGA3_HUMAN)
VMISGGPHF

SEQ ID NO: 57923 - protein, 10 aa, Artificial Sequence
  Description of Artificial Sequence: Synthetic peptide
  Seed: ASSLPTTMNY (MAGA3_HUMAN)
AYSLPTTMNW

SEQ ID NO: 57924 - protein, 9 aa, Artificial Sequence
  Description of Artificial Sequence: Synthetic peptide
  Seed: SEFQAALSR (MAGA3_HUMAN)
SMFQAALSY

SEQ ID NO: 57925 - protein, 9 aa, Artificial Sequence
  Description of Artificial Sequence: Synthetic peptide
  Seed: IAREGDCAP (MAGA3_HUMAN)
IAREGDCAF

SEQ ID NO: 57926 - protein, 9 aa, Artificial Sequence
  Description of Artificial Sequence: Synthetic peptide
  Seed: IMPKAGLLI (MAGA3_HUMAN)
IYPKAGLLL

SEQ ID NO: 57927 - protein, 9 aa, Artificial Sequence
  Description of Artificial Sequence: Synthetic peptide
  Seed: KVLHHMVKI (MAGA3_HUMAN)
KMLHHMVKA

SEQ ID NO: 57928 - protein, 9 aa, Artificial Sequence
  Description of Artificial Sequence: Synthetic peptide
  Seed: KVLHHMVKI (MAGA3_HUMAN)
KGLHHMVKR

SEQ ID NO: 57929 - protein, 9 aa, Artificial Sequence
  Description of Artificial Sequence: Synthetic peptide
  Seed: SEFQAALSR (MAGA3_HUMAN)
SAFQAALSR

SEQ ID NO: 57930 - protein, 9 aa, Artificial Sequence
  Description of Artificial Sequence: Synthetic peptide
  Seed: EVDPIGHLY (MAGA3_HUMAN)
EADPIGHLF

SEQ ID NO: 57931 - protein, 11 aa, Artificial Sequence
  Description of Artificial Sequence: Synthetic peptide
  Seed: SYPPLHEWVLR (MAGA3_HUMAN)
SMPPLHEWVLF

SEQ ID NO: 57932 - protein, 9 aa, Artificial Sequence
  Description of Artificial Sequence: Synthetic peptide
  Seed: MLGSVVGNW (MAGA3_HUMAN)
MTGSVVGNY

SEQ ID NO: 57933 - protein, 10 aa, Artificial Sequence
  Description of Artificial Sequence: Synthetic peptide
  Seed: SLPTTMNYPL (MAGA3_HUMAN)
SVPTTMNYPL

SEQ ID NO: 57934 - protein, 11 aa, Artificial Sequence
  Description of Artificial Sequence: Synthetic peptide
  Seed: FPDLESEFQAA (MAGA3_HUMAN)
FPDLESEFQAL

SEQ ID NO: 57935 - protein, 10 aa, Artificial Sequence
  Description of Artificial Sequence: Synthetic peptide
  Seed: HISYPPLHEW (MAGA3_HUMAN)
HQSYPPLHEY

SEQ ID NO: 57936 - protein, 10 aa, Artificial Sequence
  Description of Artificial Sequence: Synthetic peptide
  Seed: SLQLVFGIEL (MAGA3_HUMAN)
SQQLVFGIEF

SEQ ID NO: 57937 - protein, 10 aa, Artificial Sequence
  Description of Artificial Sequence: Synthetic peptide
  Seed: HISYPPLHEW (MAGA3_HUMAN)
HNSYPPLHEM

SEQ ID NO: 57938 - protein, 9 aa, Artificial Sequence
  Description of Artificial Sequence: Synthetic peptide
  Seed: IFSKASSSL (MAGA3_HUMAN)
IMSKASSSY

SEQ ID NO: 57939 - protein, 11 aa, Artificial Sequence
  Description of Artificial Sequence: Synthetic peptide
  Seed: RQVPGSDPACY (MAGA3_HUMAN)
RQVPGSDPACF

SEQ ID NO: 57940 - protein, 9 aa, Artificial Sequence
  Description of Artificial Sequence: Synthetic peptide
  Seed: KVLHHMVKI (MAGA3_HUMAN)
KLLHHMVKA

SEQ ID NO: 57941 - protein, 9 aa, Artificial Sequence
  Description of Artificial Sequence: Synthetic peptide
  Seed: FQAALSRKV (MAGA3_HUMAN)
FLAALSRKL

SEQ ID NO: 57942 - protein, 9 aa, Artificial Sequence
  Description of Artificial Sequence: Synthetic peptide
  Seed: KVAELVHFL (MAGA3_HUMAN)
KYAELVHFY

SEQ ID NO: 57943 - protein, 10 aa, Artificial Sequence
  Description of Artificial Sequence: Synthetic peptide
  Seed: YRQVPGSDPA (MAGA3_HUMAN)
YKQVPGSDPV

SEQ ID NO: 57944 - protein, 9 aa, Artificial Sequence
  Description of Artificial Sequence: Synthetic peptide
  Seed: VQENYLEYR (MAGA3_HUMAN)
VLENYLEYR

SEQ ID NO: 57945 - protein, 9 aa, Artificial Sequence
  Description of Artificial Sequence: Synthetic peptide
  Seed: EARGEALGL (MAGA3_HUMAN)
EVRGEALGF

SEQ ID NO: 57946 - protein, 11 aa, Artificial Sequence
  Description of Artificial Sequence: Synthetic peptide
  Seed: KVAELVHFLLL (MAGA3_HUMAN)
KLAELVHFLLT

SEQ ID NO: 57947 - protein, 9 aa, Artificial Sequence
  Description of Artificial Sequence: Synthetic peptide
  Seed: EVDPIGHLY (MAGA3_HUMAN)
ETDPIGHLI

SEQ ID NO: 57948 - protein, 10 aa, Artificial Sequence
  Description of Artificial Sequence: Synthetic peptide
  Seed: VIFSKASSSL (MAGA3_HUMAN)
VLFSKASSSV

SEQ ID NO: 57949 - protein, 9 aa, Artificial Sequence
  Description of Artificial Sequence: Synthetic peptide
  Seed: IIVLAIIAR (MAGA3_HUMAN)
IVVLAIIAK

SEQ ID NO: 57950 - protein, 9 aa, Artificial Sequence
  Description of Artificial Sequence: Synthetic peptide
  Seed: MPKAGLLII (MAGA3_HUMAN)
MPKAGLLIS

SEQ ID NO: 57951 - protein, 9 aa, Artificial Sequence
  Description of Artificial Sequence: Synthetic peptide
  Seed: QSPQGASSL (MAGA3_HUMAN)
QQPQGASSY

SEQ ID NO: 57952 - protein, 9 aa, Artificial Sequence
  Description of Artificial Sequence: Synthetic peptide
  Seed: DPIGHLYIF (MAGA3_HUMAN)
DPIGHLYIM

SEQ ID NO: 57953 - protein, 9 aa, Artificial Sequence
  Description of Artificial Sequence: Synthetic peptide
  Seed: KASSSLQLV (MAGA3_HUMAN)
KISSSLQLF

SEQ ID NO: 57954 - protein, 10 aa, Artificial Sequence
  Description of Artificial Sequence: Synthetic peptide
  Seed: KVAELVHFLL (MAGA3_HUMAN)
KQAELVHFLM

SEQ ID NO: 57955 - protein, 11 aa, Artificial Sequence
  Description of Artificial Sequence: Synthetic peptide
  Seed: KVAELVHFLLL (MAGA3_HUMAN)
KLAELVHFLLN

SEQ ID NO: 57956 - protein, 10 aa, Artificial Sequence
  Description of Artificial Sequence: Synthetic peptide
  Seed: AALSRKVAEL (MAGA3_HUMAN)
ACLSRKVAEV

SEQ ID NO: 57957 - protein, 10 aa, Artificial Sequence
  Description of Artificial Sequence: Synthetic peptide
  Seed: LQLVFGIELM (MAGA3_HUMAN)
LMLVFGIELF

SEQ ID NO: 57958 - protein, 11 aa, Artificial Sequence
  Description of Artificial Sequence: Synthetic peptide
  Seed: KVAELVHFLLL (MAGA3_HUMAN)
KMAELVHFLLI

SEQ ID NO: 57959 - protein, 9 aa, Artificial Sequence
  Description of Artificial Sequence: Synthetic peptide
  Seed: ELVHFLLLK (MAGA3_HUMAN)
ELVHFLLLR

SEQ ID NO: 57960 - protein, 10 aa, Artificial Sequence
  Description of Artificial Sequence: Synthetic peptide
  Seed: HISYPPLHEW (MAGA3_HUMAN)
HHSYPPLHEF

SEQ ID NO: 57961 - protein, 9 aa, Artificial Sequence
  Description of Artificial Sequence: Synthetic peptide
  Seed: EEKIWEELS (MAGA3_HUMAN)
EEKIWEELV

SEQ ID NO: 57962 - protein, 9 aa, Artificial Sequence
  Description of Artificial Sequence: Synthetic peptide
  Seed: LGDPKKLLT (MAGA3_HUMAN)
LTDPKKLLL

SEQ ID NO: 57963 - protein, 10 aa, Artificial Sequence
  Description of Artificial Sequence: Synthetic peptide
  Seed: YIFATCLGLS (MAGA3_HUMAN)
YLFATCLGLT

SEQ ID NO: 57964 - protein, 11 aa, Artificial Sequence
  Description of Artificial Sequence: Synthetic peptide
  Seed: LMEVDPIGHLY (MAGA3_HUMAN)
LTEVDPIGHLY

SEQ ID NO: 57965 - protein, 10 aa, Artificial Sequence
  Description of Artificial Sequence: Synthetic peptide
  Seed: LQLVFGIELM (MAGA3_HUMAN)
LQLVFGIELF

SEQ ID NO: 57966 - protein, 9 aa, Artificial Sequence
  Description of Artificial Sequence: Synthetic peptide
  Seed: ASSSLQLVF (MAGA3_HUMAN)
ARSSLQLVV

SEQ ID NO: 57967 - protein, 9 aa, Artificial Sequence
  Description of Artificial Sequence: Synthetic peptide
  Seed: KVAELVHFL (MAGA3_HUMAN)
KFAELVHFV

SEQ ID NO: 57968 - protein, 9 aa, Artificial Sequence
  Description of Artificial Sequence: Synthetic peptide
  Seed: RALVETSYV (MAGA3_HUMAN)
RMLVETSYL

SEQ ID NO: 57969 - protein, 10 aa, Artificial Sequence
  Description of Artificial Sequence: Synthetic peptide
  Seed: GPRALVETSY (MAGA3_HUMAN)
GPRALVETSF

SEQ ID NO: 57970 - protein, 9 aa, Artificial Sequence
  Description of Artificial Sequence: Synthetic peptide
  Seed: QEAASSSST (MAGA3_HUMAN)
QEAASSSSM

SEQ ID NO: 57971 - protein, 9 aa, Artificial Sequence
  Description of Artificial Sequence: Synthetic peptide
  Seed: EVDPIGHLY (MAGA3_HUMAN)
ELDPIGHLV

SEQ ID NO: 57972 - protein, 10 aa, Artificial Sequence
  Description of Artificial Sequence: Synthetic peptide
  Seed: MVKISGGPHI (MAGA3_HUMAN)
MNKISGGPHF

SEQ ID NO: 57973 - protein, 8 aa, Artificial Sequence
  Description of Artificial Sequence: Synthetic peptide
  Seed: FPDLESEF (MAGA3_HUMAN)
FSDLESEM

SEQ ID NO: 57974 - protein, 9 aa, Artificial Sequence
  Description of Artificial Sequence: Synthetic peptide
  Seed: GNWQYFFPV (MAGA3_HUMAN)
GLWQYFFPC

SEQ ID NO: 57975 - protein, 9 aa, Artificial Sequence
  Description of Artificial Sequence: Synthetic peptide
  Seed: IMPKAGLLI (MAGA3_HUMAN)
IVPKAGLLY

SEQ ID NO: 57976 - protein, 9 aa, Artificial Sequence
  Description of Artificial Sequence: Synthetic peptide
  Seed: SSLQLVFGI (MAGA3_HUMAN)
SVLQLVFGW

SEQ ID NO: 57977 - protein, 9 aa, Artificial Sequence
  Description of Artificial Sequence: Synthetic peptide
  Seed: TFPDLESEF (MAGA3_HUMAN)
TGPDLESEM

SEQ ID NO: 57978 - protein, 10 aa, Artificial Sequence
  Description of Artificial Sequence: Synthetic peptide
  Seed: SSSTLVEVTL (MAGA3_HUMAN)
SWSTLVEVTW

SEQ ID NO: 57979 - protein, 10 aa, Artificial Sequence
  Description of Artificial Sequence: Synthetic peptide
  Seed: MNYPLWSQSY (MAGA3_HUMAN)
MCYPLWSQSV

SEQ ID NO: 57980 - protein, 10 aa, Artificial Sequence
  Description of Artificial Sequence: Synthetic peptide
  Seed: MEVDPIGHLY (MAGA3_HUMAN)
MLVDPIGHLL

SEQ ID NO: 57981 - protein, 9 aa, Artificial Sequence
  Description of Artificial Sequence: Synthetic peptide
  Seed: KVAELVHFL (MAGA3_HUMAN)
KIAELVHFA

SEQ ID NO: 57982 - protein, 8 aa, Artificial Sequence
  Description of Artificial Sequence: Synthetic peptide
  Seed: ASSLPTTM (MAGA3_HUMAN)
AASLPTTF

SEQ ID NO: 57983 - protein, 9 aa, Artificial Sequence
  Description of Artificial Sequence: Synthetic peptide
  Seed: GNWQYFFPV (MAGA3_HUMAN)
GLWQYFFPT

SEQ ID NO: 57984 - protein, 10 aa, Artificial Sequence
  Description of Artificial Sequence: Synthetic peptide
  Seed: SVVGNWQYFF (MAGA3_HUMAN)
SYVGNWQYFP

SEQ ID NO: 57985 - protein, 9 aa, Artificial Sequence
  Description of Artificial Sequence: Synthetic peptide
  Seed: YVKVLHHMV (MAGA3_HUMAN)
YAKVLHHMF

SEQ ID NO: 57986 - protein, 9 aa, Artificial Sequence
  Description of Artificial Sequence: Synthetic peptide
  Seed: KVLHHMVKI (MAGA3_HUMAN)
KALHHMVKY

SEQ ID NO: 57987 - protein, 9 aa, Artificial Sequence
  Description of Artificial Sequence: Synthetic peptide
  Seed: SSSSTLVEV (MAGA3_HUMAN)
SASSTLVEI

SEQ ID NO: 57988 - protein, 9 aa, Artificial Sequence
  Description of Artificial Sequence: Synthetic peptide
  Seed: SKASSSLQL (MAGA3_HUMAN)
SSASSSLQF

SEQ ID NO: 57989 - protein, 9 aa, Artificial Sequence
  Description of Artificial Sequence: Synthetic peptide
  Seed: SVVGNWQYF (MAGA3_HUMAN)
STVGNWQYF

SEQ ID NO: 57990 - protein, 9 aa, Artificial Sequence
  Description of Artificial Sequence: Synthetic peptide
  Seed: KASSSLQLV (MAGA3_HUMAN)
KLSSSLQLL

SEQ ID NO: 57991 - protein, 10 aa, Artificial Sequence
  Description of Artificial Sequence: Synthetic peptide
  Seed: TSYVKVLHHM (MAGA3_HUMAN)
TRYVKVLHHL

SEQ ID NO: 57992 - protein, 9 aa, Artificial Sequence
  Description of Artificial Sequence: Synthetic peptide
  Seed: LGDPKKLLT (MAGA3_HUMAN)
LVDPKKLLM

SEQ ID NO: 57993 - protein, 10 aa, Artificial Sequence
  Description of Artificial Sequence: Synthetic peptide
  Seed: TSYVKVLHHM (MAGA3_HUMAN)
TKYVKVLHHL

SEQ ID NO: 57994 - protein, 10 aa, Artificial Sequence
  Description of Artificial Sequence: Synthetic peptide
  Seed: STFPDLESEF (MAGA3_HUMAN)
SGFPDLESEW

SEQ ID NO: 57995 - protein, 10 aa, Artificial Sequence
  Description of Artificial Sequence: Synthetic peptide
  Seed: SLQLVFGIEL (MAGA3_HUMAN)
SHQLVFGIEF

SEQ ID NO: 57996 - protein, 9 aa, Artificial Sequence
  Description of Artificial Sequence: Synthetic peptide
  Seed: QEEEGPSTF (MAGA3_HUMAN)
QVEEGPSTF

SEQ ID NO: 57997 - protein, 10 aa, Artificial Sequence
  Description of Artificial Sequence: Synthetic peptide
  Seed: SEFQAALSRK (MAGA3_HUMAN)
SVFQAALSRR

SEQ ID NO: 57998 - protein, 10 aa, Artificial Sequence
  Description of Artificial Sequence: Synthetic peptide
  Seed: SLQLVFGIEL (MAGA3_HUMAN)
SVQLVFGIEY

SEQ ID NO: 57999 - protein, 8 aa, Artificial Sequence
  Description of Artificial Sequence: Synthetic peptide
  Seed: KVAELVHF (MAGA3_HUMAN)
KTAELVHW

SEQ ID NO: 58000 - protein, 10 aa, Artificial Sequence
  Description of Artificial Sequence: Synthetic peptide
  Seed: YFFPVIFSKA (MAGA3_HUMAN)
YTFPVIFSKR

SEQ ID NO: 58001 - protein, 9 aa, Artificial Sequence
  Description of Artificial Sequence: Synthetic peptide
  Seed: QSPQGASSL (MAGA3_HUMAN)
QSPQGASSI

SEQ ID NO: 58002 - protein, 10 aa, Artificial Sequence
  Description of Artificial Sequence: Synthetic peptide
  Seed: STFPDLESEF (MAGA3_HUMAN)
SKFPDLESEY

SEQ ID NO: 58003 - protein, 9 aa, Artificial Sequence
  Description of Artificial Sequence: Synthetic peptide
  Seed: YPPLHEWVL (MAGA3_HUMAN)
YPPLHEWVA

SEQ ID NO: 58004 - protein, 9 aa, Artificial Sequence
  Description of Artificial Sequence: Synthetic peptide
  Seed: FATCLGLSY (MAGA3_HUMAN)
FHTCLGLSF

SEQ ID NO: 58005 - protein, 10 aa, Artificial Sequence
  Description of Artificial Sequence: Synthetic peptide
  Seed: ISYPPLHEWV (MAGA3_HUMAN)
IIYPPLHEWL

SEQ ID NO: 58006 - protein, 9 aa, Artificial Sequence
  Description of Artificial Sequence: Synthetic peptide
  Seed: SSLPTTMNY (MAGA3_HUMAN)
STLPTTMNF

SEQ ID NO: 58007 - protein, 8 aa, Artificial Sequence
  Description of Artificial Sequence: Synthetic peptide
  Seed: YVKVLHHM (MAGA3_HUMAN)
YAKVLHHM

SEQ ID NO: 58008 - protein, 9 aa, Artificial Sequence
  Description of Artificial Sequence: Synthetic peptide
  Seed: KVAELVHFL (MAGA3_HUMAN)
KQAELVHFT

SEQ ID NO: 58009 - protein, 10 aa, Artificial Sequence
  Description of Artificial Sequence: Synthetic peptide
  Seed: SDPACYEFLW (MAGA3_HUMAN)
SRPACYEFLW

SEQ ID NO: 58010 - protein, 9 aa, Artificial Sequence
  Description of Artificial Sequence: Synthetic peptide
  Seed: LQLVFGIEL (MAGA3_HUMAN)
LILVFGIEF

SEQ ID NO: 58011 - protein, 10 aa, Artificial Sequence
  Description of Artificial Sequence: Synthetic peptide
  Seed: WEELSVLEVF (MAGA3_HUMAN)
WMELSVLEVW

SEQ ID NO: 58012 - protein, 9 aa, Artificial Sequence
  Description of Artificial Sequence: Synthetic peptide
  Seed: EAASSSSTL (MAGA3_HUMAN)
EIASSSSTK

SEQ ID NO: 58013 - protein, 9 aa, Artificial Sequence
  Description of Artificial Sequence: Synthetic peptide
  Seed: IFSKASSSL (MAGA3_HUMAN)
IFSKASSSW

SEQ ID NO: 58014 - protein, 10 aa, Artificial Sequence
  Description of Artificial Sequence: Synthetic peptide
  Seed: KISGGPHISY (MAGA3_HUMAN)
KMSGGPHISR

SEQ ID NO: 58015 - protein, 9 aa, Artificial Sequence
  Description of Artificial Sequence: Synthetic peptide
  Seed: QHFVQENYL (MAGA3_HUMAN)
QHFVQENYA

SEQ ID NO: 58016 - protein, 9 aa, Artificial Sequence
  Description of Artificial Sequence: Synthetic peptide
  Seed: TKAEMLGSV (MAGA3_HUMAN)
THAEMLGSV

SEQ ID NO: 58017 - protein, 10 aa, Artificial Sequence
  Description of Artificial Sequence: Synthetic peptide
  Seed: YFFPVIFSKA (MAGA3_HUMAN)
YIFPVIFSKA

SEQ ID NO: 58018 - protein, 10 aa, Artificial Sequence
  Description of Artificial Sequence: Synthetic peptide
  Seed: ASSSSTLVEV (MAGA3_HUMAN)
AVSSSTLVEV

SEQ ID NO: 58019 - protein, 10 aa, Artificial Sequence
  Description of Artificial Sequence: Synthetic peptide
  Seed: EVFEGREDSI (MAGA3_HUMAN)
EVFEGREDSW

SEQ ID NO: 58020 - protein, 10 aa, Artificial Sequence
  Description of Artificial Sequence: Synthetic peptide
  Seed: KISGGPHISY (MAGA3_HUMAN)
KRSGGPHISL

SEQ ID NO: 58021 - protein, 11 aa, Artificial Sequence
  Description of Artificial Sequence: Synthetic peptide
  Seed: STFPDLESEFQ (MAGA3_HUMAN)
STFPDLESEFY

SEQ ID NO: 58022 - protein, 10 aa, Artificial Sequence
  Description of Artificial Sequence: Synthetic peptide
  Seed: FSKASSSLQL (MAGA3_HUMAN)
FMKASSSLQM

SEQ ID NO: 58023 - protein, 9 aa, Artificial Sequence
  Description of Artificial Sequence: Synthetic peptide
  Seed: SSLQLVFGI (MAGA3_HUMAN)
SSLQLVFGM

SEQ ID NO: 58024 - protein, 9 aa, Artificial Sequence
  Description of Artificial Sequence: Synthetic peptide
  Seed: FVQENYLEY (MAGA3_HUMAN)
FIQENYLEV

SEQ ID NO: 58025 - protein, 10 aa, Artificial Sequence
  Description of Artificial Sequence: Synthetic peptide
  Seed: ASSLPTTMNY (MAGA3_HUMAN)
AKSLPTTMNW

SEQ ID NO: 58026 - protein, 11 aa, Artificial Sequence
  Description of Artificial Sequence: Synthetic peptide
  Seed: ISYPPLHEWVL (MAGA3_HUMAN)
IAYPPLHEWVW

SEQ ID NO: 58027 - protein, 10 aa, Artificial Sequence
  Description of Artificial Sequence: Synthetic peptide
  Seed: IFATCLGLSY (MAGA3_HUMAN)
IPATCLGLSM

SEQ ID NO: 58028 - protein, 9 aa, Artificial Sequence
  Description of Artificial Sequence: Synthetic peptide
  Seed: EEQEAASSS (MAGA3_HUMAN)
EEQEAASSA

SEQ ID NO: 58029 - protein, 10 aa, Artificial Sequence
  Description of Artificial Sequence: Synthetic peptide
  Seed: SVVGNWQYFF (MAGA3_HUMAN)
SYVGNWQYFE

SEQ ID NO: 58030 - protein, 9 aa, Artificial Sequence
  Description of Artificial Sequence: Synthetic peptide
  Seed: EAASSSSTL (MAGA3_HUMAN)
EVASSSSTK

SEQ ID NO: 58031 - protein, 10 aa, Artificial Sequence
  Description of Artificial Sequence: Synthetic peptide
  Seed: LYIFATCLGL (MAGA3_HUMAN)
LGIFATCLGV

SEQ ID NO: 58032 - protein, 9 aa, Artificial Sequence
  Description of Artificial Sequence: Synthetic peptide
  Seed: RKVAELVHF (MAGA3_HUMAN)
RRVAELVHY

SEQ ID NO: 58033 - protein, 10 aa, Artificial Sequence
  Description of Artificial Sequence: Synthetic peptide
  Seed: KVAELVHFLL (MAGA3_HUMAN)
KTAELVHFLW

SEQ ID NO: 58034 - protein, 9 aa, Artificial Sequence
  Description of Artificial Sequence: Synthetic peptide
  Seed: VTLGEVPAA (MAGA3_HUMAN)
VMLGEVPAC

SEQ ID NO: 58035 - protein, 9 aa, Artificial Sequence
  Description of Artificial Sequence: Synthetic peptide
  Seed: YIFATCLGL (MAGA3_HUMAN)
YFFATCLGI

SEQ ID NO: 58036 - protein, 9 aa, Artificial Sequence
  Description of Artificial Sequence: Synthetic peptide
  Seed: RQVPGSDPA (MAGA3_HUMAN)
RVVPGSDPY

SEQ ID NO: 58037 - protein, 10 aa, Artificial Sequence
  Description of Artificial Sequence: Synthetic peptide
  Seed: RKVAELVHFL (MAGA3_HUMAN)
RTVAELVHFV

SEQ ID NO: 58038 - protein, 9 aa, Artificial Sequence
  Description of Artificial Sequence: Synthetic peptide
  Seed: FVQENYLEY (MAGA3_HUMAN)
FIQENYLEI

SEQ ID NO: 58039 - protein, 9 aa, Artificial Sequence
  Description of Artificial Sequence: Synthetic peptide
  Seed: FATCLGLSY (MAGA3_HUMAN)
FATCLGLSW

SEQ ID NO: 58040 - protein, 9 aa, Artificial Sequence
  Description of Artificial Sequence: Synthetic peptide
  Seed: LEYRQVPGS (MAGA3_HUMAN)
LEYRQVPGA

SEQ ID NO: 58041 - protein, 11 aa, Artificial Sequence
  Description of Artificial Sequence: Synthetic peptide
  Seed: SRKVAELVHFL (MAGA3_HUMAN)
SGKVAELVHFV

SEQ ID NO: 58042 - protein, 10 aa, Artificial Sequence
  Description of Artificial Sequence: Synthetic peptide
  Seed: MNYPLWSQSY (MAGA3_HUMAN)
MPYPLWSQSM

SEQ ID NO: 58043 - protein, 10 aa, Artificial Sequence
  Description of Artificial Sequence: Synthetic peptide
  Seed: KVAELVHFLL (MAGA3_HUMAN)
KVAELVHFLI

SEQ ID NO: 58044 - protein, 10 aa, Artificial Sequence
  Description of Artificial Sequence: Synthetic peptide
  Seed: TLVEVTLGEV (MAGA3_HUMAN)
TMVEVTLGEV

SEQ ID NO: 58045 - protein, 10 aa, Artificial Sequence
  Description of Artificial Sequence: Synthetic peptide
  Seed: IFATCLGLSY (MAGA3_HUMAN)
IYATCLGLSF

SEQ ID NO: 58046 - protein, 11 aa, Artificial Sequence
  Description of Artificial Sequence: Synthetic peptide
  Seed: AQAPATEEQEA (MAGA3_HUMAN)
AQAPATEEQEV

SEQ ID NO: 58047 - protein, 10 aa, Artificial Sequence
  Description of Artificial Sequence: Synthetic peptide
  Seed: ESPDPPQSPQ (MAGA3_HUMAN)
EMPDPPQSPR

SEQ ID NO: 58048 - protein, 9 aa, Artificial Sequence
  Description of Artificial Sequence: Synthetic peptide
  Seed: KVAELVHFL (MAGA3_HUMAN)
KEAELVHFV

SEQ ID NO: 58049 - protein, 9 aa, Artificial Sequence
  Description of Artificial Sequence: Synthetic peptide
  Seed: MEVDPIGHL (MAGA3_HUMAN)
MMVDPIGHT

SEQ ID NO: 58050 - protein, 10 aa, Artificial Sequence
  Description of Artificial Sequence: Synthetic peptide
  Seed: SSSTLVEVTL (MAGA3_HUMAN)
SASTLVEVTF

SEQ ID NO: 58051 - protein, 9 aa, Artificial Sequence
  Description of Artificial Sequence: Synthetic peptide
  Seed: ISYPPLHEW (MAGA3_HUMAN)
ITYPPLHEW

SEQ ID NO: 58052 - protein, 9 aa, Artificial Sequence
  Description of Artificial Sequence: Synthetic peptide
  Seed: KVLHHMVKI (MAGA3_HUMAN)
KALHHMVKL

SEQ ID NO: 58053 - protein, 9 aa, Artificial Sequence
  Description of Artificial Sequence: Synthetic peptide
  Seed: SSTLVEVTL (MAGA3_HUMAN)
SPTLVEVTV

SEQ ID NO: 58054 - protein, 10 aa, Artificial Sequence
  Description of Artificial Sequence: Synthetic peptide
  Seed: HISYPPLHEW (MAGA3_HUMAN)
HGSYPPLHEY

SEQ ID NO: 58055 - protein, 11 aa, Artificial Sequence
  Description of Artificial Sequence: Synthetic peptide
  Seed: QHCKPEEGLEA (MAGA3_HUMAN)
QHCKPEEGLEL

SEQ ID NO: 58056 - protein, 9 aa, Artificial Sequence
  Description of Artificial Sequence: Synthetic peptide
  Seed: EARGEALGL (MAGA3_HUMAN)
ELRGEALGR

SEQ ID NO: 58057 - protein, 9 aa, Artificial Sequence
  Description of Artificial Sequence: Synthetic peptide
  Seed: KASSSLQLV (MAGA3_HUMAN)
KISSSLQLY

SEQ ID NO: 58058 - protein, 11 aa, Artificial Sequence
  Description of Artificial Sequence: Synthetic peptide
  Seed: LMEVDPIGHLY (MAGA3_HUMAN)
LVEVDPIGHLY

SEQ ID NO: 58059 - protein, 10 aa, Artificial Sequence
  Description of Artificial Sequence: Synthetic peptide
  Seed: SLPTTMNYPL (MAGA3_HUMAN)
SVPTTMNYPM

SEQ ID NO: 58060 - protein, 10 aa, Artificial Sequence
  Description of Artificial Sequence: Synthetic peptide
  Seed: KISGGPHISY (MAGA3_HUMAN)
KTSGGPHISM

SEQ ID NO: 58061 - protein, 9 aa, Artificial Sequence
  Description of Artificial Sequence: Synthetic peptide
  Seed: YIFATCLGL (MAGA3_HUMAN)
YIFATCLGY

SEQ ID NO: 58062 - protein, 10 aa, Artificial Sequence
  Description of Artificial Sequence: Synthetic peptide
  Seed: MEVDPIGHLY (MAGA3_HUMAN)
MVVDPIGHLF

SEQ ID NO: 58063 - protein, 9 aa, Artificial Sequence
  Description of Artificial Sequence: Synthetic peptide
  Seed: GHLYIFATC (MAGA3_HUMAN)
GHLYIFATA

SEQ ID NO: 58064 - protein, 10 aa, Artificial Sequence
  Description of Artificial Sequence: Synthetic peptide
  Seed: LGLVGAQAPA (MAGA3_HUMAN)
LMLVGAQAPV

SEQ ID NO: 58065 - protein, 11 aa, Artificial Sequence
  Description of Artificial Sequence: Synthetic peptide
  Seed: SSSSTLVEVTL (MAGA3_HUMAN)
SASSTLVEVTF

SEQ ID NO: 58066 - protein, 11 aa, Artificial Sequence
  Description of Artificial Sequence: Synthetic peptide
  Seed: KVAELVHFLLL (MAGA3_HUMAN)
KMAELVHFLLL

SEQ ID NO: 58067 - protein, 9 aa, Artificial Sequence
  Description of Artificial Sequence: Synthetic peptide
  Seed: LGDPKKLLT (MAGA3_HUMAN)
LMDPKKLLV

SEQ ID NO: 58068 - protein, 10 aa, Artificial Sequence
  Description of Artificial Sequence: Synthetic peptide
  Seed: LGLVGAQAPA (MAGA3_HUMAN)
LPLVGAQAPL

SEQ ID NO: 58069 - protein, 9 aa, Artificial Sequence
  Description of Artificial Sequence: Synthetic peptide
  Seed: RALVETSYV (MAGA3_HUMAN)
RSLVETSYL

SEQ ID NO: 58070 - protein, 9 aa, Artificial Sequence
  Description of Artificial Sequence: Synthetic peptide
  Seed: IFSKASSSL (MAGA3_HUMAN)
IWSKASSSI

SEQ ID NO: 58071 - protein, 9 aa, Artificial Sequence
  Description of Artificial Sequence: Synthetic peptide
  Seed: LGDPKKLLT (MAGA3_HUMAN)
LNDPKKLLM

SEQ ID NO: 58072 - protein, 10 aa, Artificial Sequence
  Description of Artificial Sequence: Synthetic peptide
  Seed: RALVETSYVK (MAGA3_HUMAN)
RLLVETSYVR

SEQ ID NO: 58073 - protein, 10 aa, Artificial Sequence
  Description of Artificial Sequence: Synthetic peptide
  Seed: REGDCAPEEK (MAGA3_HUMAN)
REGDCAPEEY

SEQ ID NO: 58074 - protein, 10 aa, Artificial Sequence
  Description of Artificial Sequence: Synthetic peptide
  Seed: SLPTTMNYPL (MAGA3_HUMAN)
SHPTTMNYPL

SEQ ID NO: 58075 - protein, 9 aa, Artificial Sequence
  Description of Artificial Sequence: Synthetic peptide
  Seed: KAGLLIIVL (MAGA3_HUMAN)
KTGLLIIVF

SEQ ID NO: 58076 - protein, 9 aa, Artificial Sequence
  Description of Artificial Sequence: Synthetic peptide
  Seed: VTLGEVPAA (MAGA3_HUMAN)
VTLGEVPAL

SEQ ID NO: 58077 - protein, 8 aa, Artificial Sequence
  Description of Artificial Sequence: Synthetic peptide
  Seed: FSKASSSL (MAGA3_HUMAN)
FAKASSSL

SEQ ID NO: 58078 - protein, 8 aa, Artificial Sequence
  Description of Artificial Sequence: Synthetic peptide
  Seed: RALVETSY (MAGA3_HUMAN)
RQLVETSM

SEQ ID NO: 58079 - protein, 10 aa, Artificial Sequence
  Description of Artificial Sequence: Synthetic peptide
  Seed: KVAELVHFLL (MAGA3_HUMAN)
KAAELVHFLF

SEQ ID NO: 58080 - protein, 9 aa, Artificial Sequence
  Description of Artificial Sequence: Synthetic peptide
  Seed: SSSSTLVEV (MAGA3_HUMAN)
SLSSTLVEV

SEQ ID NO: 58081 - protein, 9 aa, Artificial Sequence
  Description of Artificial Sequence: Synthetic peptide
  Seed: KVAELVHFL (MAGA3_HUMAN)
KIAELVHFY

SEQ ID NO: 58082 - protein, 10 aa, Artificial Sequence
  Description of Artificial Sequence: Synthetic peptide
  Seed: LSVLEVFEGR (MAGA3_HUMAN)
LVVLEVFEGR

SEQ ID NO: 58083 - protein, 10 aa, Artificial Sequence
  Description of Artificial Sequence: Synthetic peptide
  Seed: SEFQAALSRK (MAGA3_HUMAN)
SAFQAALSRR

SEQ ID NO: 58084 - protein, 10 aa, Artificial Sequence
  Description of Artificial Sequence: Synthetic peptide
  Seed: VIFSKASSSL (MAGA3_HUMAN)
VTFSKASSSY

SEQ ID NO: 58085 - protein, 9 aa, Artificial Sequence
  Description of Artificial Sequence: Synthetic peptide
  Seed: YIFATCLGL (MAGA3_HUMAN)
YGFATCLGF

SEQ ID NO: 58086 - protein, 9 aa, Artificial Sequence
  Description of Artificial Sequence: Synthetic peptide
  Seed: LESEFQAAL (MAGA3_HUMAN)
LSSEFQAAM

SEQ ID NO: 58087 - protein, 9 aa, Artificial Sequence
  Description of Artificial Sequence: Synthetic peptide
  Seed: QIMPKAGLL (MAGA3_HUMAN)
QPMPKAGLF

SEQ ID NO: 58088 - protein, 9 aa, Artificial Sequence
  Description of Artificial Sequence: Synthetic peptide
  Seed: TFPDLESEF (MAGA3_HUMAN)
TVPDLESEF

SEQ ID NO: 58089 - protein, 9 aa, Artificial Sequence
  Description of Artificial Sequence: Synthetic peptide
  Seed: SEFQAALSR (MAGA3_HUMAN)
SEFQAALSM

SEQ ID NO: 58090 - protein, 9 aa, Artificial Sequence
  Description of Artificial Sequence: Synthetic peptide
  Seed: SVLEVFEGR (MAGA3_HUMAN)
SLLEVFEGY

SEQ ID NO: 58091 - protein, 10 aa, Artificial Sequence
  Description of Artificial Sequence: Synthetic peptide
  Seed: KASSSLQLVF (MAGA3_HUMAN)
KKSSSLQLVF

SEQ ID NO: 58092 - protein, 9 aa, Artificial Sequence
  Description of Artificial Sequence: Synthetic peptide
  Seed: LGDPKKLLT (MAGA3_HUMAN)
LQDPKKLLF

SEQ ID NO: 58093 - protein, 10 aa, Artificial Sequence
  Description of Artificial Sequence: Synthetic peptide
  Seed: MEVDPIGHLY (MAGA3_HUMAN)
MFVDPIGHLM

SEQ ID NO: 58094 - protein, 9 aa, Artificial Sequence
  Description of Artificial Sequence: Synthetic peptide
  Seed: KIWEELSVL (MAGA3_HUMAN)
KVWEELSVR

SEQ ID NO: 58095 - protein, 10 aa, Artificial Sequence
  Description of Artificial Sequence: Synthetic peptide
  Seed: MEVDPIGHLY (MAGA3_HUMAN)
MLVDPIGHLY

SEQ ID NO: 58096 - protein, 10 aa, Artificial Sequence
  Description of Artificial Sequence: Synthetic peptide
  Seed: EFLWGPRALV (MAGA3_HUMAN)
EVLWGPRALV

SEQ ID NO: 58097 - protein, 10 aa, Artificial Sequence
  Description of Artificial Sequence: Synthetic peptide
  Seed: ELMEVDPIGH (MAGA3_HUMAN)
ESMEVDPIGR

SEQ ID NO: 58098 - protein, 10 aa, Artificial Sequence
  Description of Artificial Sequence: Synthetic peptide
  Seed: STFPDLESEF (MAGA3_HUMAN)
SQFPDLESEV

SEQ ID NO: 58099 - protein, 9 aa, Artificial Sequence
  Description of Artificial Sequence: Synthetic peptide
  Seed: VVGNWQYFF (MAGA3_HUMAN)
VVGNWQYFW

SEQ ID NO: 58100 - protein, 10 aa, Artificial Sequence
  Description of Artificial Sequence: Synthetic peptide
  Seed: RQVPGSDPAC (MAGA3_HUMAN)
RAVPGSDPAY

SEQ ID NO: 58101 - protein, 10 aa, Artificial Sequence
  Description of Artificial Sequence: Synthetic peptide
  Seed: ASSLPTTMNY (MAGA3_HUMAN)
AFSLPTTMNK

SEQ ID NO: 58102 - protein, 9 aa, Artificial Sequence
  Description of Artificial Sequence: Synthetic peptide
  Seed: IMPKAGLLI (MAGA3_HUMAN)
IFPKAGLLI

SEQ ID NO: 58103 - protein, 10 aa, Artificial Sequence
  Description of Artificial Sequence: Synthetic peptide
  Seed: FSKASSSLQL (MAGA3_HUMAN)
FIKASSSLQF

SEQ ID NO: 58104 - protein, 9 aa, Artificial Sequence
  Description of Artificial Sequence: Synthetic peptide
  Seed: LVHFLLLKY (MAGA3_HUMAN)
LMHFLLLKF

SEQ ID NO: 58105 - protein, 9 aa, Artificial Sequence
  Description of Artificial Sequence: Synthetic peptide
  Seed: VKISGGPHI (MAGA3_HUMAN)
VQISGGPHM

SEQ ID NO: 58106 - protein, 9 aa, Artificial Sequence
  Description of Artificial Sequence: Synthetic peptide
  Seed: ELVHFLLLK (MAGA3_HUMAN)
ESVHFLLLR

SEQ ID NO: 58107 - protein, 9 aa, Artificial Sequence
  Description of Artificial Sequence: Synthetic peptide
  Seed: GSDPACYEF (MAGA3_HUMAN)
GTDPACYEM

SEQ ID NO: 58108 - protein, 10 aa, Artificial Sequence
  Description of Artificial Sequence: Synthetic peptide
  Seed: EFLWGPRALV (MAGA3_HUMAN)
ETLWGPRALL

SEQ ID NO: 58109 - protein, 10 aa, Artificial Sequence
  Description of Artificial Sequence: Synthetic peptide
  Seed: VIFSKASSSL (MAGA3_HUMAN)
VFFSKASSSM

SEQ ID NO: 58110 - protein, 9 aa, Artificial Sequence
  Description of Artificial Sequence: Synthetic peptide
  Seed: IMPKAGLLI (MAGA3_HUMAN)
IWPKAGLLM

SEQ ID NO: 58111 - protein, 9 aa, Artificial Sequence
  Description of Artificial Sequence: Synthetic peptide
  Seed: SVVGNWQYF (MAGA3_HUMAN)
SAVGNWQYR

SEQ ID NO: 58112 - protein, 9 aa, Artificial Sequence
  Description of Artificial Sequence: Synthetic peptide
  Seed: KASSSLQLV (MAGA3_HUMAN)
KASSSLQLL

SEQ ID NO: 58113 - protein, 9 aa, Artificial Sequence
  Description of Artificial Sequence: Synthetic peptide
  Seed: SYVKVLHHM (MAGA3_HUMAN)
SWVKVLHHW

SEQ ID NO: 58114 - protein, 9 aa, Artificial Sequence
  Description of Artificial Sequence: Synthetic peptide
  Seed: TQHFVQENY (MAGA3_HUMAN)
TFHFVQENY

SEQ ID NO: 58115 - protein, 10 aa, Artificial Sequence
  Description of Artificial Sequence: Synthetic peptide
  Seed: RKVAELVHFL (MAGA3_HUMAN)
RIVAELVHFV

SEQ ID NO: 58116 - protein, 9 aa, Artificial Sequence
  Description of Artificial Sequence: Synthetic peptide
  Seed: SYVKVLHHM (MAGA3_HUMAN)
SYVKVLHHY

SEQ ID NO: 58117 - protein, 9 aa, Artificial Sequence
  Description of Artificial Sequence: Synthetic peptide
  Seed: EELSVLEVF (MAGA3_HUMAN)
EMLSVLEVY

SEQ ID NO: 58118 - protein, 9 aa, Artificial Sequence
  Description of Artificial Sequence: Synthetic peptide
  Seed: YFFPVIFSK (MAGA3_HUMAN)
YQFPVIFSL

SEQ ID NO: 58119 - protein, 9 aa, Artificial Sequence
  Description of Artificial Sequence: Synthetic peptide
  Seed: SSLPTTMNY (MAGA3_HUMAN)
SVLPTTMNY

SEQ ID NO: 58120 - protein, 9 aa, Artificial Sequence
  Description of Artificial Sequence: Synthetic peptide
  Seed: LQLVFGIEL (MAGA3_HUMAN)
LLLVFGIEL

SEQ ID NO: 58121 - protein, 9 aa, Artificial Sequence
  Description of Artificial Sequence: Synthetic peptide
  Seed: FQAALSRKV (MAGA3_HUMAN)
FMAALSRKT

SEQ ID NO: 58122 - protein, 9 aa, Artificial Sequence
  Description of Artificial Sequence: Synthetic peptide
  Seed: GDNQIMPKA (MAGA3_HUMAN)
GENQIMPKF

SEQ ID NO: 58123 - protein, 9 aa, Artificial Sequence
  Description of Artificial Sequence: Synthetic peptide
  Seed: KIWEELSVL (MAGA3_HUMAN)
KKWEELSVF

SEQ ID NO: 58124 - protein, 9 aa, Artificial Sequence
  Description of Artificial Sequence: Synthetic peptide
  Seed: RKVAELVHF (MAGA3_HUMAN)
RQVAELVHM

SEQ ID NO: 58125 - protein, 8 aa, Artificial Sequence
  Description of Artificial Sequence: Synthetic peptide
  Seed: SGGPHISY (MAGA3_HUMAN)
SFGPHISF

SEQ ID NO: 58126 - protein, 10 aa, Artificial Sequence
  Description of Artificial Sequence: Synthetic peptide
  Seed: GSVVGNWQYF (MAGA3_HUMAN)
GSVVGNWQYW

SEQ ID NO: 58127 - protein, 11 aa, Artificial Sequence
  Description of Artificial Sequence: Synthetic peptide
  Seed: SPQGASSLPTT (MAGA3_HUMAN)
SPQGASSLPTF

SEQ ID NO: 58128 - protein, 10 aa, Artificial Sequence
  Description of Artificial Sequence: Synthetic peptide
  Seed: LTQHFVQENY (MAGA3_HUMAN)
LQQHFVQENY

SEQ ID NO: 58129 - protein, 9 aa, Artificial Sequence
  Description of Artificial Sequence: Synthetic peptide
  Seed: FATCLGLSY (MAGA3_HUMAN)
FRTCLGLSM

SEQ ID NO: 58130 - protein, 9 aa, Artificial Sequence
  Description of Artificial Sequence: Synthetic peptide
  Seed: EVDPIGHLY (MAGA3_HUMAN)
EGDPIGHLL

SEQ ID NO: 58131 - protein, 10 aa, Artificial Sequence
  Description of Artificial Sequence: Synthetic peptide
  Seed: STFPDLESEF (MAGA3_HUMAN)
SQFPDLESEY

SEQ ID NO: 58132 - protein, 9 aa, Artificial Sequence
  Description of Artificial Sequence: Synthetic peptide
  Seed: SEFQAALSR (MAGA3_HUMAN)
SEFQAALSF

SEQ ID NO: 58133 - protein, 9 aa, Artificial Sequence
  Description of Artificial Sequence: Synthetic peptide
  Seed: DPIGHLYIF (MAGA3_HUMAN)
DEIGHLYIY

SEQ ID NO: 58134 - protein, 9 aa, Artificial Sequence
  Description of Artificial Sequence: Synthetic peptide
  Seed: LESEFQAAL (MAGA3_HUMAN)
LHSEFQAAI

SEQ ID NO: 58135 - protein, 9 aa, Artificial Sequence
  Description of Artificial Sequence: Synthetic peptide
  Seed: SYVKVLHHM (MAGA3_HUMAN)
STVKVLHHV

SEQ ID NO: 58136 - protein, 10 aa, Artificial Sequence
  Description of Artificial Sequence: Synthetic peptide
  Seed: LQLVFGIELM (MAGA3_HUMAN)
LHLVFGIELL

SEQ ID NO: 58137 - protein, 9 aa, Artificial Sequence
  Description of Artificial Sequence: Synthetic peptide
  Seed: EVDPIGHLY (MAGA3_HUMAN)
EFDPIGHLY

SEQ ID NO: 58138 - protein, 9 aa, Artificial Sequence
  Description of Artificial Sequence: Synthetic peptide
  Seed: DSILGDPKK (MAGA3_HUMAN)
DTILGDPKK

SEQ ID NO: 58139 - protein, 11 aa, Artificial Sequence
  Description of Artificial Sequence: Synthetic peptide
  Seed: ISYPPLHEWVL (MAGA3_HUMAN)
ISYPPLHEWVM

SEQ ID NO: 58140 - protein, 10 aa, Artificial Sequence
  Description of Artificial Sequence: Synthetic peptide
  Seed: SSSTLVEVTL (MAGA3_HUMAN)
SESTLVEVTW

SEQ ID NO: 58141 - protein, 9 aa, Artificial Sequence
  Description of Artificial Sequence: Synthetic peptide
  Seed: KASSSLQLV (MAGA3_HUMAN)
KASSSLQLY

SEQ ID NO: 58142 - protein, 10 aa, Artificial Sequence
  Description of Artificial Sequence: Synthetic peptide
  Seed: ESEFQAALSR (MAGA3_HUMAN)
EVEFQAALSK

SEQ ID NO: 58143 - protein, 11 aa, Artificial Sequence
  Description of Artificial Sequence: Synthetic peptide
  Seed: SYPPLHEWVLR (MAGA3_HUMAN)
SYPPLHEWVLM

SEQ ID NO: 58144 - protein, 10 aa, Artificial Sequence
  Description of Artificial Sequence: Synthetic peptide
  Seed: ETSYVKVLHH (MAGA3_HUMAN)
EMSYVKVLHR

SEQ ID NO: 58145 - protein, 9 aa, Artificial Sequence
  Description of Artificial Sequence: Synthetic peptide
  Seed: VQENYLEYR (MAGA3_HUMAN)
VVENYLEYY

SEQ ID NO: 58146 - protein, 10 aa, Artificial Sequence
  Description of Artificial Sequence: Synthetic peptide
  Seed: KVAELVHFLL (MAGA3_HUMAN)
KRAELVHFLW

SEQ ID NO: 58147 - protein, 10 aa, Artificial Sequence
  Description of Artificial Sequence: Synthetic peptide
  Seed: ISYPPLHEWV (MAGA3_HUMAN)
IHYPPLHEWI

SEQ ID NO: 58148 - protein, 9 aa, Artificial Sequence
  Description of Artificial Sequence: Synthetic peptide
  Seed: SEFQAALSR (MAGA3_HUMAN)
SEFQAALSI

SEQ ID NO: 58149 - protein, 9 aa, Artificial Sequence
  Description of Artificial Sequence: Synthetic peptide
  Seed: QEAASSSST (MAGA3_HUMAN)
QEAASSSSL

SEQ ID NO: 58150 - protein, 9 aa, Artificial Sequence
  Description of Artificial Sequence: Synthetic peptide
  Seed: ISGGPHISY (MAGA3_HUMAN)
IMGGPHISY

SEQ ID NO: 58151 - protein, 9 aa, Artificial Sequence
  Description of Artificial Sequence: Synthetic peptide
  Seed: YIFATCLGL (MAGA3_HUMAN)
YQFATCLGW

SEQ ID NO: 58152 - protein, 9 aa, Artificial Sequence
  Description of Artificial Sequence: Synthetic peptide
  Seed: VPGSDPACY (MAGA3_HUMAN)
VMGSDPACF

SEQ ID NO: 58153 - protein, 9 aa, Artificial Sequence
  Description of Artificial Sequence: Synthetic peptide
  Seed: AELVHFLLL (MAGA3_HUMAN)
AQLVHFLLY

SEQ ID NO: 58154 - protein, 11 aa, Artificial Sequence
  Description of Artificial Sequence: Synthetic peptide
  Seed: STFPDLESEFQ (MAGA3_HUMAN)
SVFPDLESEFY

SEQ ID NO: 58155 - protein, 10 aa, Artificial Sequence
  Description of Artificial Sequence: Synthetic peptide
  Seed: KASSSLQLVF (MAGA3_HUMAN)
KKSSSLQLVW

SEQ ID NO: 58156 - protein, 9 aa, Artificial Sequence
  Description of Artificial Sequence: Synthetic peptide
  Seed: FATCLGLSY (MAGA3_HUMAN)
FITCLGLSY

SEQ ID NO: 58157 - protein, 11 aa, Artificial Sequence
  Description of Artificial Sequence: Synthetic peptide
  Seed: AESPDPPQSPQ (MAGA3_HUMAN)
AESPDPPQSPC

SEQ ID NO: 58158 - protein, 9 aa, Artificial Sequence
  Description of Artificial Sequence: Synthetic peptide
  Seed: QLVFGIELM (MAGA3_HUMAN)
QAVFGIELY

SEQ ID NO: 58159 - protein, 9 aa, Artificial Sequence
  Description of Artificial Sequence: Synthetic peptide
  Seed: AEMLGSVVG (MAGA3_HUMAN)
ADMLGSVVM

SEQ ID NO: 58160 - protein, 10 aa, Artificial Sequence
  Description of Artificial Sequence: Synthetic peptide
  Seed: MVKISGGPHI (MAGA3_HUMAN)
MQKISGGPHF

SEQ ID NO: 58161 - protein, 10 aa, Artificial Sequence
  Description of Artificial Sequence: Synthetic peptide
  Seed: MNYPLWSQSY (MAGA3_HUMAN)
MHYPLWSQSW

SEQ ID NO: 58162 - protein, 9 aa, Artificial Sequence
  Description of Artificial Sequence: Synthetic peptide
  Seed: KVLHHMVKI (MAGA3_HUMAN)
KGLHHMVKY

SEQ ID NO: 58163 - protein, 10 aa, Artificial Sequence
  Description of Artificial Sequence: Synthetic peptide
  Seed: KAEMLGSVVG (MAGA3_HUMAN)
KGEMLGSVVV

SEQ ID NO: 58164 - protein, 10 aa, Artificial Sequence
  Description of Artificial Sequence: Synthetic peptide
  Seed: STFPDLESEF (MAGA3_HUMAN)
SYFPDLESEF

SEQ ID NO: 58165 - protein, 11 aa, Artificial Sequence
  Description of Artificial Sequence: Synthetic peptide
  Seed: SNQEEEGPSTF (MAGA3_HUMAN)
SVQEEEGPSTF

SEQ ID NO: 58166 - protein, 8 aa, Artificial Sequence
  Description of Artificial Sequence: Synthetic peptide
  Seed: FPDLESEF (MAGA3_HUMAN)
FWDLESEF

SEQ ID NO: 58167 - protein, 9 aa, Artificial Sequence
  Description of Artificial Sequence: Synthetic peptide
  Seed: ELVHFLLLK (MAGA3_HUMAN)
ETVHFLLLK

SEQ ID NO: 58168 - protein, 9 aa, Artificial Sequence
  Description of Artificial Sequence: Synthetic peptide
  Seed: MEVDPIGHL (MAGA3_HUMAN)
MKVDPIGHY

SEQ ID NO: 58169 - protein, 9 aa, Artificial Sequence
  Description of Artificial Sequence: Synthetic peptide
  Seed: QEEEGPSTF (MAGA3_HUMAN)
QVEEGPSTY

SEQ ID NO: 58170 - protein, 11 aa, Artificial Sequence
  Description of Artificial Sequence: Synthetic peptide
  Seed: SKASSSLQLVF (MAGA3_HUMAN)
SKASSSLQLVW

SEQ ID NO: 58171 - protein, 10 aa, Artificial Sequence
  Description of Artificial Sequence: Synthetic peptide
  Seed: ISYPPLHEWV (MAGA3_HUMAN)
IWYPPLHEWI

SEQ ID NO: 58172 - protein, 10 aa, Artificial Sequence
  Description of Artificial Sequence: Synthetic peptide
  Seed: MEVDPIGHLY (MAGA3_HUMAN)
MEVDPIGHLP

SEQ ID NO: 58173 - protein, 10 aa, Artificial Sequence
  Description of Artificial Sequence: Synthetic peptide
  Seed: SEFQAALSRK (MAGA3_HUMAN)
STFQAALSRY

SEQ ID NO: 58174 - protein, 9 aa, Artificial Sequence
  Description of Artificial Sequence: Synthetic peptide
  Seed: QSPQGASSL (MAGA3_HUMAN)
QYPQGASSL

SEQ ID NO: 58175 - protein, 9 aa, Artificial Sequence
  Description of Artificial Sequence: Synthetic peptide
  Seed: MEVDPIGHL (MAGA3_HUMAN)
MGVDPIGHY

SEQ ID NO: 58176 - protein, 10 aa, Artificial Sequence
  Description of Artificial Sequence: Synthetic peptide
  Seed: HISYPPLHEW (MAGA3_HUMAN)
HWSYPPLHEY

SEQ ID NO: 58177 - protein, 9 aa, Artificial Sequence
  Description of Artificial Sequence: Synthetic peptide
  Seed: GDCAPEEKI (MAGA3_HUMAN)
GECAPEEKA

SEQ ID NO: 58178 - protein, 9 aa, Artificial Sequence
  Description of Artificial Sequence: Synthetic peptide
  Seed: ISYPPLHEW (MAGA3_HUMAN)
IGYPPLHEI

SEQ ID NO: 58179 - protein, 10 aa, Artificial Sequence
  Description of Artificial Sequence: Synthetic peptide
  Seed: MNYPLWSQSY (MAGA3_HUMAN)
MDYPLWSQSM

SEQ ID NO: 58180 - protein, 9 aa, Artificial Sequence
  Description of Artificial Sequence: Synthetic peptide
  Seed: EVDPIGHLY (MAGA3_HUMAN)
ETDPIGHLK

SEQ ID NO: 58181 - protein, 10 aa, Artificial Sequence
  Description of Artificial Sequence: Synthetic peptide
  Seed: ASSSSTLVEV (MAGA3_HUMAN)
AISSSTLVEI

SEQ ID NO: 58182 - protein, 9 aa, Artificial Sequence
  Description of Artificial Sequence: Synthetic peptide
  Seed: EVDPIGHLY (MAGA3_HUMAN)
ESDPIGHLM

SEQ ID NO: 58183 - protein, 9 aa, Artificial Sequence
  Description of Artificial Sequence: Synthetic peptide
  Seed: SSSSTLVEV (MAGA3_HUMAN)
SLSSTLVET

SEQ ID NO: 58184 - protein, 10 aa, Artificial Sequence
  Description of Artificial Sequence: Synthetic peptide
  Seed: KVAELVHFLL (MAGA3_HUMAN)
KIAELVHFLR

SEQ ID NO: 58185 - protein, 9 aa, Artificial Sequence
  Description of Artificial Sequence: Synthetic peptide
  Seed: SEFQAALSR (MAGA3_HUMAN)
SVFQAALSH

SEQ ID NO: 58186 - protein, 9 aa, Artificial Sequence
  Description of Artificial Sequence: Synthetic peptide
  Seed: FATCLGLSY (MAGA3_HUMAN)
FYTCLGLSF

SEQ ID NO: 58187 - protein, 9 aa, Artificial Sequence
  Description of Artificial Sequence: Synthetic peptide
  Seed: IMPKAGLLI (MAGA3_HUMAN)
ILPKAGLLV

SEQ ID NO: 58188 - protein, 9 aa, Artificial Sequence
  Description of Artificial Sequence: Synthetic peptide
  Seed: FLWGPRALV (MAGA3_HUMAN)
FVWGPRALY

SEQ ID NO: 58189 - protein, 9 aa, Artificial Sequence
  Description of Artificial Sequence: Synthetic peptide
  Seed: QHFVQENYL (MAGA3_HUMAN)
QHFVQENYV

SEQ ID NO: 58190 - protein, 11 aa, Artificial Sequence
  Description of Artificial Sequence: Synthetic peptide
  Seed: STLVEVTLGEV (MAGA3_HUMAN)
SMLVEVTLGEV

SEQ ID NO: 58191 - protein, 9 aa, Artificial Sequence
  Description of Artificial Sequence: Synthetic peptide
  Seed: GSDPACYEF (MAGA3_HUMAN)
GSDPACYEW

SEQ ID NO: 58192 - protein, 11 aa, Artificial Sequence
  Description of Artificial Sequence: Synthetic peptide
  Seed: GEVPAAESPDP (MAGA3_HUMAN)
GEVPAAESPDL

SEQ ID NO: 58193 - protein, 10 aa, Artificial Sequence
  Description of Artificial Sequence: Synthetic peptide
  Seed: ASSLPTTMNY (MAGA3_HUMAN)
AYSLPTTMNY

SEQ ID NO: 58194 - protein, 10 aa, Artificial Sequence
  Description of Artificial Sequence: Synthetic peptide
  Seed: YRQVPGSDPA (MAGA3_HUMAN)
YHQVPGSDPV

SEQ ID NO: 58195 - protein, 10 aa, Artificial Sequence
  Description of Artificial Sequence: Synthetic peptide
  Seed: MNYPLWSQSY (MAGA3_HUMAN)
MHYPLWSQSF

SEQ ID NO: 58196 - protein, 9 aa, Artificial Sequence
  Description of Artificial Sequence: Synthetic peptide
  Seed: LESEFQAAL (MAGA3_HUMAN)
LQSEFQAAY

SEQ ID NO: 58197 - protein, 9 aa, Artificial Sequence
  Description of Artificial Sequence: Synthetic peptide
  Seed: SSSSTLVEV (MAGA3_HUMAN)
SMSSTLVEC

SEQ ID NO: 58198 - protein, 10 aa, Artificial Sequence
  Description of Artificial Sequence: Synthetic peptide
  Seed: KISGGPHISY (MAGA3_HUMAN)
KASGGPHISR

SEQ ID NO: 58199 - protein, 10 aa, Artificial Sequence
  Description of Artificial Sequence: Synthetic peptide
  Seed: LGLVGAQAPA (MAGA3_HUMAN)
LMLVGAQAPI

SEQ ID NO: 58200 - protein, 9 aa, Artificial Sequence
  Description of Artificial Sequence: Synthetic peptide
  Seed: LESEFQAAL (MAGA3_HUMAN)
LPSEFQAAF

SEQ ID NO: 58201 - protein, 9 aa, Artificial Sequence
  Description of Artificial Sequence: Synthetic peptide
  Seed: TFPDLESEF (MAGA3_HUMAN)
TLPDLESEY

SEQ ID NO: 58202 - protein, 10 aa, Artificial Sequence
  Description of Artificial Sequence: Synthetic peptide
  Seed: VTKAEMLGSV (MAGA3_HUMAN)
VLKAEMLGSV

SEQ ID NO: 58203 - protein, 10 aa, Artificial Sequence
  Description of Artificial Sequence: Synthetic peptide
  Seed: MEVDPIGHLY (MAGA3_HUMAN)
MEVDPIGHLS

SEQ ID NO: 58204 - protein, 10 aa, Artificial Sequence
  Description of Artificial Sequence: Synthetic peptide
  Seed: WEELSVLEVF (MAGA3_HUMAN)
WTELSVLEVL

SEQ ID NO: 58205 - protein, 9 aa, Artificial Sequence
  Description of Artificial Sequence: Synthetic peptide
  Seed: ISGGPHISY (MAGA3_HUMAN)
IMGGPHISW

SEQ ID NO: 58206 - protein, 9 aa, Artificial Sequence
  Description of Artificial Sequence: Synthetic peptide
  Seed: QSPQGASSL (MAGA3_HUMAN)
QTPQGASSL

SEQ ID NO: 58207 - protein, 9 aa, Artificial Sequence
  Description of Artificial Sequence: Synthetic peptide
  Seed: VEVTLGEVP (MAGA3_HUMAN)
VEVTLGEVI

SEQ ID NO: 58208 - protein, 9 aa, Artificial Sequence
  Description of Artificial Sequence: Synthetic peptide
  Seed: YIFATCLGL (MAGA3_HUMAN)
YPFATCLGY

SEQ ID NO: 58209 - protein, 10 aa, Artificial Sequence
  Description of Artificial Sequence: Synthetic peptide
  Seed: FSKASSSLQL (MAGA3_HUMAN)
FAKASSSLQM

SEQ ID NO: 58210 - protein, 8 aa, Artificial Sequence
  Description of Artificial Sequence: Synthetic peptide
  Seed: FPDLESEF (MAGA3_HUMAN)
FGDLESEL

SEQ ID NO: 58211 - protein, 9 aa, Artificial Sequence
  Description of Artificial Sequence: Synthetic peptide
  Seed: SILGDPKKL (MAGA3_HUMAN)
SALGDPKKM

SEQ ID NO: 58212 - protein, 10 aa, Artificial Sequence
  Description of Artificial Sequence: Synthetic peptide
  Seed: MEVDPIGHLY (MAGA3_HUMAN)
MIVDPIGHLY

SEQ ID NO: 58213 - protein, 11 aa, Artificial Sequence
  Description of Artificial Sequence: Synthetic peptide
  Seed: ARGEALGLVGA (MAGA3_HUMAN)
ARGEALGLVGF

SEQ ID NO: 58214 - protein, 10 aa, Artificial Sequence
  Description of Artificial Sequence: Synthetic peptide
  Seed: EEQEAASSSS (MAGA3_HUMAN)
EEQEAASSSV

SEQ ID NO: 58215 - protein, 9 aa, Artificial Sequence
  Description of Artificial Sequence: Synthetic peptide
  Seed: GASSLPTTM (MAGA3_HUMAN)
GSSSLPTTL

SEQ ID NO: 58216 - protein, 10 aa, Artificial Sequence
  Description of Artificial Sequence: Synthetic peptide
  Seed: MEVDPIGHLY (MAGA3_HUMAN)
MEVDPIGHLW

SEQ ID NO: 58217 - protein, 8 aa, Artificial Sequence
  Description of Artificial Sequence: Synthetic peptide
  Seed: FPDLESEF (MAGA3_HUMAN)
FIDLESEM

SEQ ID NO: 58218 - protein, 9 aa, Artificial Sequence
  Description of Artificial Sequence: Synthetic peptide
  Seed: LESEFQAAL (MAGA3_HUMAN)
LMSEFQAAY

SEQ ID NO: 58219 - protein, 9 aa, Artificial Sequence
  Description of Artificial Sequence: Synthetic peptide
  Seed: LESEFQAAL (MAGA3_HUMAN)
LASEFQAAY

SEQ ID NO: 58220 - protein, 9 aa, Artificial Sequence
  Description of Artificial Sequence: Synthetic peptide
  Seed: GLLIIVLAI (MAGA3_HUMAN)
GQLIIVLAL

SEQ ID NO: 58221 - protein, 10 aa, Artificial Sequence
  Description of Artificial Sequence: Synthetic peptide
  Seed: LQLVFGIELM (MAGA3_HUMAN)
LYLVFGIELV

SEQ ID NO: 58222 - protein, 10 aa, Artificial Sequence
  Description of Artificial Sequence: Synthetic peptide
  Seed: MVKISGGPHI (MAGA3_HUMAN)
MQKISGGPHY

SEQ ID NO: 58223 - protein, 9 aa, Artificial Sequence
  Description of Artificial Sequence: Synthetic peptide
  Seed: LEYRQVPGS (MAGA3_HUMAN)
LEYRQVPGL

SEQ ID NO: 58224 - protein, 11 aa, Artificial Sequence
  Description of Artificial Sequence: Synthetic peptide
  Seed: SKASSSLQLVF (MAGA3_HUMAN)
SRASSSLQLVW

SEQ ID NO: 58225 - protein, 9 aa, Artificial Sequence
  Description of Artificial Sequence: Synthetic peptide
  Seed: YIFATCLGL (MAGA3_HUMAN)
YTFATCLGL

SEQ ID NO: 58226 - protein, 10 aa, Artificial Sequence
  Description of Artificial Sequence: Synthetic peptide
  Seed: YLEYRQVPGS (MAGA3_HUMAN)
YLEYRQVPGL

SEQ ID NO: 58227 - protein, 10 aa, Artificial Sequence
  Description of Artificial Sequence: Synthetic peptide
  Seed: AESPDPPQSP (MAGA3_HUMAN)
AESPDPPQSM

SEQ ID NO: 58228 - protein, 9 aa, Artificial Sequence
  Description of Artificial Sequence: Synthetic peptide
  Seed: IAREGDCAP (MAGA3_HUMAN)
IAREGDCAL

SEQ ID NO: 58229 - protein, 10 aa, Artificial Sequence
  Description of Artificial Sequence: Synthetic peptide
  Seed: EMLGSVVGNW (MAGA3_HUMAN)
EILGSVVGNY

SEQ ID NO: 58230 - protein, 10 aa, Artificial Sequence
  Description of Artificial Sequence: Synthetic peptide
  Seed: SVVGNWQYFF (MAGA3_HUMAN)
SYVGNWQYFF

SEQ ID NO: 58231 - protein, 10 aa, Artificial Sequence
  Description of Artificial Sequence: Synthetic peptide
  Seed: KISGGPHISY (MAGA3_HUMAN)
KASGGPHISY

SEQ ID NO: 58232 - protein, 10 aa, Artificial Sequence
  Description of Artificial Sequence: Synthetic peptide
  Seed: TTMNYPLWSQ (MAGA3_HUMAN)
TLMNYPLWSR

SEQ ID NO: 58233 - protein, 9 aa, Artificial Sequence
  Description of Artificial Sequence: Synthetic peptide
  Seed: YIFATCLGL (MAGA3_HUMAN)
YQFATCLGH

SEQ ID NO: 58234 - protein, 9 aa, Artificial Sequence
  Description of Artificial Sequence: Synthetic peptide
  Seed: SEFQAALSR (MAGA3_HUMAN)
SSFQAALSR

SEQ ID NO: 58235 - protein, 10 aa, Artificial Sequence
  Description of Artificial Sequence: Synthetic peptide
  Seed: RALVETSYVK (MAGA3_HUMAN)
RYLVETSYVR

SEQ ID NO: 58236 - protein, 9 aa, Artificial Sequence
  Description of Artificial Sequence: Synthetic peptide
  Seed: FPVIFSKAS (MAGA3_HUMAN)
FPVIFSKAH

SEQ ID NO: 58237 - protein, 10 aa, Artificial Sequence
  Description of Artificial Sequence: Synthetic peptide
  Seed: MEVDPIGHLY (MAGA3_HUMAN)
MAVDPIGHLF

SEQ ID NO: 58238 - protein, 9 aa, Artificial Sequence
  Description of Artificial Sequence: Synthetic peptide
  Seed: SSSSTLVEV (MAGA3_HUMAN)
SRSSTLVEV

SEQ ID NO: 58239 - protein, 9 aa, Artificial Sequence
  Description of Artificial Sequence: Synthetic peptide
  Seed: GASSLPTTM (MAGA3_HUMAN)
GLSSLPTTL

SEQ ID NO: 58240 - protein, 10 aa, Artificial Sequence
  Description of Artificial Sequence: Synthetic peptide
  Seed: DLESEFQAAL (MAGA3_HUMAN)
DDESEFQAAF

SEQ ID NO: 58241 - protein, 10 aa, Artificial Sequence
  Description of Artificial Sequence: Synthetic peptide
  Seed: YFFPVIFSKA (MAGA3_HUMAN)
YVFPVIFSKM

SEQ ID NO: 58242 - protein, 9 aa, Artificial Sequence
  Description of Artificial Sequence: Synthetic peptide
  Seed: TQHFVQENY (MAGA3_HUMAN)
TQHFVQENL

SEQ ID NO: 58243 - protein, 10 aa, Artificial Sequence
  Description of Artificial Sequence: Synthetic peptide
  Seed: VDPIGHLYIF (MAGA3_HUMAN)
VGPIGHLYIY

SEQ ID NO: 58244 - protein, 9 aa, Artificial Sequence
  Description of Artificial Sequence: Synthetic peptide
  Seed: KIWEELSVL (MAGA3_HUMAN)
KYWEELSVF

SEQ ID NO: 58245 - protein, 9 aa, Artificial Sequence
  Description of Artificial Sequence: Synthetic peptide
  Seed: YIFATCLGL (MAGA3_HUMAN)
YPFATCLGF

SEQ ID NO: 58246 - protein, 10 aa, Artificial Sequence
  Description of Artificial Sequence: Synthetic peptide
  Seed: TSYVKVLHHM (MAGA3_HUMAN)
TQYVKVLHHI

SEQ ID NO: 58247 - protein, 10 aa, Artificial Sequence
  Description of Artificial Sequence: Synthetic peptide
  Seed: MEVDPIGHLY (MAGA3_HUMAN)
MIVDPIGHLW

SEQ ID NO: 58248 - protein, 9 aa, Artificial Sequence
  Description of Artificial Sequence: Synthetic peptide
  Seed: SKASSSLQL (MAGA3_HUMAN)
SHASSSLQV

SEQ ID NO: 58249 - protein, 9 aa, Artificial Sequence
  Description of Artificial Sequence: Synthetic peptide
  Seed: EFQAALSRK (MAGA3_HUMAN)
EVQAALSRL

SEQ ID NO: 58250 - protein, 9 aa, Artificial Sequence
  Description of Artificial Sequence: Synthetic peptide
  Seed: RALVETSYV (MAGA3_HUMAN)
RTLVETSYV

SEQ ID NO: 58251 - protein, 10 aa, Artificial Sequence
  Description of Artificial Sequence: Synthetic peptide
  Seed: SLPTTMNYPL (MAGA3_HUMAN)
SHPTTMNYPM

SEQ ID NO: 58252 - protein, 8 aa, Artificial Sequence
  Description of Artificial Sequence: Synthetic peptide
  Seed: SYPPLHEW (MAGA3_HUMAN)
SYPPLHEF

SEQ ID NO: 58253 - protein, 10 aa, Artificial Sequence
  Description of Artificial Sequence: Synthetic peptide
  Seed: AELVHFLLLK (MAGA3_HUMAN)
ALLVHFLLLK

SEQ ID NO: 58254 - protein, 9 aa, Artificial Sequence
  Description of Artificial Sequence: Synthetic peptide
  Seed: ISYPPLHEW (MAGA3_HUMAN)
IVYPPLHEV

SEQ ID NO: 58255 - protein, 9 aa, Artificial Sequence
  Description of Artificial Sequence: Synthetic peptide
  Seed: ILGDPKKLL (MAGA3_HUMAN)
ISGDPKKLL

SEQ ID NO: 58256 - protein, 10 aa, Artificial Sequence
  Description of Artificial Sequence: Synthetic peptide
  Seed: LQLVFGIELM (MAGA3_HUMAN)
LRLVFGIELV

SEQ ID NO: 58257 - protein, 10 aa, Artificial Sequence
  Description of Artificial Sequence: Synthetic peptide
  Seed: ALVETSYVKV (MAGA3_HUMAN)
AQVETSYVKL

SEQ ID NO: 58258 - protein, 10 aa, Artificial Sequence
  Description of Artificial Sequence: Synthetic peptide
  Seed: SLPTTMNYPL (MAGA3_HUMAN)
SRPTTMNYPM

SEQ ID NO: 58259 - protein, 9 aa, Artificial Sequence
  Description of Artificial Sequence: Synthetic peptide
  Seed: HHMVKISGG (MAGA3_HUMAN)
HHMVKISGA

SEQ ID NO: 58260 - protein, 9 aa, Artificial Sequence
  Description of Artificial Sequence: Synthetic peptide
  Seed: QSPQGASSL (MAGA3_HUMAN)
QYPQGASSF

SEQ ID NO: 58261 - protein, 9 aa, Artificial Sequence
  Description of Artificial Sequence: Synthetic peptide
  Seed: LQLVFGIEL (MAGA3_HUMAN)
LSLVFGIEF

SEQ ID NO: 58262 - protein, 9 aa, Artificial Sequence
  Description of Artificial Sequence: Synthetic peptide
  Seed: RALVETSYV (MAGA3_HUMAN)
RNLVETSYY

SEQ ID NO: 58263 - protein, 10 aa, Artificial Sequence
  Description of Artificial Sequence: Synthetic peptide
  Seed: LPTTMNYPLW (MAGA3_HUMAN)
LTTTMNYPLW

SEQ ID NO: 58264 - protein, 9 aa, Artificial Sequence
  Description of Artificial Sequence: Synthetic peptide
  Seed: VVGNWQYFF (MAGA3_HUMAN)
VYGNWQYFV

SEQ ID NO: 58265 - protein, 9 aa, Artificial Sequence
  Description of Artificial Sequence: Synthetic peptide
  Seed: YIFATCLGL (MAGA3_HUMAN)
YVFATCLGV

SEQ ID NO: 58266 - protein, 10 aa, Artificial Sequence
  Description of Artificial Sequence: Synthetic peptide
  Seed: SVVGNWQYFF (MAGA3_HUMAN)
SWVGNWQYFY

SEQ ID NO: 58267 - protein, 10 aa, Artificial Sequence
  Description of Artificial Sequence: Synthetic peptide
  Seed: AEMLGSVVGN (MAGA3_HUMAN)
AEMLGSVVGM

SEQ ID NO: 58268 - protein, 9 aa, Artificial Sequence
  Description of Artificial Sequence: Synthetic peptide
  Seed: TFPDLESEF (MAGA3_HUMAN)
TFPDLESEY

SEQ ID NO: 58269 - protein, 10 aa, Artificial Sequence
  Description of Artificial Sequence: Synthetic peptide
  Seed: KAEMLGSVVG (MAGA3_HUMAN)
KPEMLGSVVA

SEQ ID NO: 58270 - protein, 9 aa, Artificial Sequence
  Description of Artificial Sequence: Synthetic peptide
  Seed: AASSSSTLV (MAGA3_HUMAN)
AVSSSSTLL

SEQ ID NO: 58271 - protein, 9 aa, Artificial Sequence
  Description of Artificial Sequence: Synthetic peptide
  Seed: SSTLVEVTL (MAGA3_HUMAN)
SETLVEVTM

SEQ ID NO: 58272 - protein, 11 aa, Artificial Sequence
  Description of Artificial Sequence: Synthetic peptide
  Seed: REGDCAPEEKI (MAGA3_HUMAN)
REGDCAPEEKL

SEQ ID NO: 58273 - protein, 10 aa, Artificial Sequence
  Description of Artificial Sequence: Synthetic peptide
  Seed: MNYPLWSQSY (MAGA3_HUMAN)
MFYPLWSQSY

SEQ ID NO: 58274 - protein, 9 aa, Artificial Sequence
  Description of Artificial Sequence: Synthetic peptide
  Seed: SSTLVEVTL (MAGA3_HUMAN)
SLTLVEVTY

SEQ ID NO: 58275 - protein, 9 aa, Artificial Sequence
  Description of Artificial Sequence: Synthetic peptide
  Seed: HLYIFATCL (MAGA3_HUMAN)
HYYIFATCL

SEQ ID NO: 58276 - protein, 10 aa, Artificial Sequence
  Description of Artificial Sequence: Synthetic peptide
  Seed: FSKASSSLQL (MAGA3_HUMAN)
FHKASSSLQY

SEQ ID NO: 58277 - protein, 10 aa, Artificial Sequence
  Description of Artificial Sequence: Synthetic peptide
  Seed: TSYVKVLHHM (MAGA3_HUMAN)
TNYVKVLHHF

SEQ ID NO: 58278 - protein, 9 aa, Artificial Sequence
  Description of Artificial Sequence: Synthetic peptide
  Seed: EVDPIGHLY (MAGA3_HUMAN)
EVDPIGHLF

SEQ ID NO: 58279 - protein, 10 aa, Artificial Sequence
  Description of Artificial Sequence: Synthetic peptide
  Seed: LPTTMNYPLW (MAGA3_HUMAN)
LTTTMNYPLY

SEQ ID NO: 58280 - protein, 10 aa, Artificial Sequence
  Description of Artificial Sequence: Synthetic peptide
  Seed: WEELSVLEVF (MAGA3_HUMAN)
WKELSVLEVY

SEQ ID NO: 58281 - protein, 10 aa, Artificial Sequence
  Description of Artificial Sequence: Synthetic peptide
  Seed: RKVAELVHFL (MAGA3_HUMAN)
RQVAELVHFL

SEQ ID NO: 58282 - protein, 10 aa, Artificial Sequence
  Description of Artificial Sequence: Synthetic peptide
  Seed: ISYPPLHEWV (MAGA3_HUMAN)
ISYPPLHEWL

SEQ ID NO: 58283 - protein, 9 aa, Artificial Sequence
  Description of Artificial Sequence: Synthetic peptide
  Seed: NWQYFFPVI (MAGA3_HUMAN)
NWQYFFPVW

SEQ ID NO: 58284 - protein, 11 aa, Artificial Sequence
  Description of Artificial Sequence: Synthetic peptide
  Seed: AQAPATEEQEA (MAGA3_HUMAN)
AMAPATEEQEM

SEQ ID NO: 58285 - protein, 10 aa, Artificial Sequence
  Description of Artificial Sequence: Synthetic peptide
  Seed: AELVHFLLLK (MAGA3_HUMAN)
AVLVHFLLLR

SEQ ID NO: 58286 - protein, 9 aa, Artificial Sequence
  Description of Artificial Sequence: Synthetic peptide
  Seed: KASSSLQLV (MAGA3_HUMAN)
KQSSSLQLL

SEQ ID NO: 58287 - protein, 9 aa, Artificial Sequence
  Description of Artificial Sequence: Synthetic peptide
  Seed: RQVPGSDPA (MAGA3_HUMAN)
RLVPGSDPY

SEQ ID NO: 58288 - protein, 10 aa, Artificial Sequence
  Description of Artificial Sequence: Synthetic peptide
  Seed: ISYPPLHEWV (MAGA3_HUMAN)
IRYPPLHEWL

SEQ ID NO: 58289 - protein, 9 aa, Artificial Sequence
  Description of Artificial Sequence: Synthetic peptide
  Seed: EARGEALGL (MAGA3_HUMAN)
ETRGEALGF

SEQ ID NO: 58290 - protein, 9 aa, Artificial Sequence
  Description of Artificial Sequence: Synthetic peptide
  Seed: LGDPKKLLT (MAGA3_HUMAN)
LMDPKKLLI

SEQ ID NO: 58291 - protein, 9 aa, Artificial Sequence
  Description of Artificial Sequence: Synthetic peptide
  Seed: KASSSLQLV (MAGA3_HUMAN)
KASSSLQLW

SEQ ID NO: 58292 - protein, 9 aa, Artificial Sequence
  Description of Artificial Sequence: Synthetic peptide
  Seed: HLYIFATCL (MAGA3_HUMAN)
HAYIFATCV

SEQ ID NO: 58293 - protein, 10 aa, Artificial Sequence
  Description of Artificial Sequence: Synthetic peptide
  Seed: IFATCLGLSY (MAGA3_HUMAN)
IQATCLGLSY

SEQ ID NO: 58294 - protein, 10 aa, Artificial Sequence
  Description of Artificial Sequence: Synthetic peptide
  Seed: EEQEAASSSS (MAGA3_HUMAN)
EEQEAASSSL

SEQ ID NO: 58295 - protein, 9 aa, Artificial Sequence
  Description of Artificial Sequence: Synthetic peptide
  Seed: IMPKAGLLI (MAGA3_HUMAN)
IYPKAGLLI

SEQ ID NO: 58296 - protein, 9 aa, Artificial Sequence
  Description of Artificial Sequence: Synthetic peptide
  Seed: GNWQYFFPV (MAGA3_HUMAN)
GIWQYFFPT

SEQ ID NO: 58297 - protein, 10 aa, Artificial Sequence
  Description of Artificial Sequence: Synthetic peptide
  Seed: KVAELVHFLL (MAGA3_HUMAN)
KMAELVHFLG

SEQ ID NO: 58298 - protein, 9 aa, Artificial Sequence
  Description of Artificial Sequence: Synthetic peptide
  Seed: GDCAPEEKI (MAGA3_HUMAN)
GECAPEEKL

SEQ ID NO: 58299 - protein, 9 aa, Artificial Sequence
  Description of Artificial Sequence: Synthetic peptide
  Seed: EFQAALSRK (MAGA3_HUMAN)
ETQAALSRR

SEQ ID NO: 58300 - protein, 9 aa, Artificial Sequence
  Description of Artificial Sequence: Synthetic peptide
  Seed: SKASSSLQL (MAGA3_HUMAN)
SYASSSLQF

SEQ ID NO: 58301 - protein, 10 aa, Artificial Sequence
  Description of Artificial Sequence: Synthetic peptide
  Seed: MNYPLWSQSY (MAGA3_HUMAN)
MEYPLWSQSM

SEQ ID NO: 58302 - protein, 9 aa, Artificial Sequence
  Description of Artificial Sequence: Synthetic peptide
  Seed: SYVKVLHHM (MAGA3_HUMAN)
SLVKVLHHF

SEQ ID NO: 58303 - protein, 10 aa, Artificial Sequence
  Description of Artificial Sequence: Synthetic peptide
  Seed: RQVPGSDPAC (MAGA3_HUMAN)
RIVPGSDPAL

SEQ ID NO: 58304 - protein, 9 aa, Artificial Sequence
  Description of Artificial Sequence: Synthetic peptide
  Seed: EELSVLEVF (MAGA3_HUMAN)
EQLSVLEVF

SEQ ID NO: 58305 - protein, 9 aa, Artificial Sequence
  Description of Artificial Sequence: Synthetic peptide
  Seed: QSPQGASSL (MAGA3_HUMAN)
QSPQGASSY

SEQ ID NO: 58306 - protein, 10 aa, Artificial Sequence
  Description of Artificial Sequence: Synthetic peptide
  Seed: ETSYVKVLHH (MAGA3_HUMAN)
EISYVKVLHK

SEQ ID NO: 58307 - protein, 10 aa, Artificial Sequence
  Description of Artificial Sequence: Synthetic peptide
  Seed: RQVPGSDPAC (MAGA3_HUMAN)
RQVPGSDPAW

SEQ ID NO: 58308 - protein, 10 aa, Artificial Sequence
  Description of Artificial Sequence: Synthetic peptide
  Seed: LGSVVGNWQY (MAGA3_HUMAN)
LRSVVGNWQW

SEQ ID NO: 58309 - protein, 9 aa, Artificial Sequence
  Description of Artificial Sequence: Synthetic peptide
  Seed: GLVGAQAPA (MAGA3_HUMAN)
GAVGAQAPV

SEQ ID NO: 58310 - protein, 9 aa, Artificial Sequence
  Description of Artificial Sequence: Synthetic peptide
  Seed: DPACYEFLW (MAGA3_HUMAN)
DPACYEFLF

SEQ ID NO: 58311 - protein, 9 aa, Artificial Sequence
  Description of Artificial Sequence: Synthetic peptide
  Seed: SYVKVLHHM (MAGA3_HUMAN)
SQVKVLHHF

SEQ ID NO: 58312 - protein, 9 aa, Artificial Sequence
  Description of Artificial Sequence: Synthetic peptide
  Seed: LGDPKKLLT (MAGA3_HUMAN)
LIDPKKLLF

SEQ ID NO: 58313 - protein, 9 aa, Artificial Sequence
  Description of Artificial Sequence: Synthetic peptide
  Seed: IMPKAGLLI (MAGA3_HUMAN)
IIPKAGLLL

SEQ ID NO: 58314 - protein, 10 aa, Artificial Sequence
  Description of Artificial Sequence: Synthetic peptide
  Seed: SSSTLVEVTL (MAGA3_HUMAN)
STSTLVEVTW

SEQ ID NO: 58315 - protein, 9 aa, Artificial Sequence
  Description of Artificial Sequence: Synthetic peptide
  Seed: ASSSLQLVF (MAGA3_HUMAN)
ASSSLQLVY

SEQ ID NO: 58316 - protein, 10 aa, Artificial Sequence
  Description of Artificial Sequence: Synthetic peptide
  Seed: EVFEGREDSI (MAGA3_HUMAN)
ELFEGREDSR

SEQ ID NO: 58317 - protein, 11 aa, Artificial Sequence
  Description of Artificial Sequence: Synthetic peptide
  Seed: WQYFFPVIFSK (MAGA3_HUMAN)
WTYFFPVIFSR

SEQ ID NO: 58318 - protein, 9 aa, Artificial Sequence
  Description of Artificial Sequence: Synthetic peptide
  Seed: KVAELVHFL (MAGA3_HUMAN)
KYAELVHFM

SEQ ID NO: 58319 - protein, 9 aa, Artificial Sequence
  Description of Artificial Sequence: Synthetic peptide
  Seed: VTLGEVPAA (MAGA3_HUMAN)
VALGEVPAH

SEQ ID NO: 58320 - protein, 9 aa, Artificial Sequence
  Description of Artificial Sequence: Synthetic peptide
  Seed: KIWEELSVL (MAGA3_HUMAN)
KVWEELSVW

SEQ ID NO: 58321 - protein, 9 aa, Artificial Sequence
  Description of Artificial Sequence: Synthetic peptide
  Seed: YFFPVIFSK (MAGA3_HUMAN)
YYFPVIFSR

SEQ ID NO: 58322 - protein, 9 aa, Artificial Sequence
  Description of Artificial Sequence: Synthetic peptide
  Seed: AASSSSTLV (MAGA3_HUMAN)
AMSSSSTLA

SEQ ID NO: 58323 - protein, 9 aa, Artificial Sequence
  Description of Artificial Sequence: Synthetic peptide
  Seed: VTLGEVPAA (MAGA3_HUMAN)
VMLGEVPAM

SEQ ID NO: 58324 - protein, 8 aa, Artificial Sequence
  Description of Artificial Sequence: Synthetic peptide
  Seed: KIWEELSV (MAGA3_HUMAN)
KLWEELSL

SEQ ID NO: 58325 - protein, 9 aa, Artificial Sequence
  Description of Artificial Sequence: Synthetic peptide
  Seed: SSLQLVFGI (MAGA3_HUMAN)
SSLQLVFGY

SEQ ID NO: 58326 - protein, 9 aa, Artificial Sequence
  Description of Artificial Sequence: Synthetic peptide
  Seed: VEVTLGEVP (MAGA3_HUMAN)
VEVTLGEVT

SEQ ID NO: 58327 - protein, 11 aa, Artificial Sequence
  Description of Artificial Sequence: Synthetic peptide
  Seed: GASSLPTTMNY (MAGA3_HUMAN)
GVSSLPTTMNW

SEQ ID NO: 58328 - protein, 9 aa, Artificial Sequence
  Description of Artificial Sequence: Synthetic peptide
  Seed: EAASSSSTL (MAGA3_HUMAN)
EIASSSSTW

SEQ ID NO: 58329 - protein, 10 aa, Artificial Sequence
  Description of Artificial Sequence: Synthetic peptide
  Seed: MEVDPIGHLY (MAGA3_HUMAN)
MEVDPIGHLM

SEQ ID NO: 58330 - protein, 10 aa, Artificial Sequence
  Description of Artificial Sequence: Synthetic peptide
  Seed: HISYPPLHEW (MAGA3_HUMAN)
HDSYPPLHEW

SEQ ID NO: 58331 - protein, 9 aa, Artificial Sequence
  Description of Artificial Sequence: Synthetic peptide
  Seed: MEVDPIGHL (MAGA3_HUMAN)
MAVDPIGHI

SEQ ID NO: 58332 - protein, 10 aa, Artificial Sequence
  Description of Artificial Sequence: Synthetic peptide
  Seed: KASSSLQLVF (MAGA3_HUMAN)
KTSSSLQLVL

SEQ ID NO: 58333 - protein, 10 aa, Artificial Sequence
  Description of Artificial Sequence: Synthetic peptide
  Seed: DLESEFQAAL (MAGA3_HUMAN)
DLESEFQAAF

SEQ ID NO: 58334 - protein, 9 aa, Artificial Sequence
  Description of Artificial Sequence: Synthetic peptide
  Seed: KVAELVHFL (MAGA3_HUMAN)
KNAELVHFV

SEQ ID NO: 58335 - protein, 9 aa, Artificial Sequence
  Description of Artificial Sequence: Synthetic peptide
  Seed: LESEFQAAL (MAGA3_HUMAN)
LISEFQAAL

SEQ ID NO: 58336 - protein, 10 aa, Artificial Sequence
  Description of Artificial Sequence: Synthetic peptide
  Seed: YFFPVIFSKA (MAGA3_HUMAN)
YAFPVIFSKR

SEQ ID NO: 58337 - protein, 10 aa, Artificial Sequence
  Description of Artificial Sequence: Synthetic peptide
  Seed: NWQYFFPVIF (MAGA3_HUMAN)
NFQYFFPVIM

SEQ ID NO: 58338 - protein, 10 aa, Artificial Sequence
  Description of Artificial Sequence: Synthetic peptide
  Seed: TSYVKVLHHM (MAGA3_HUMAN)
TRYVKVLHHF

SEQ ID NO: 58339 - protein, 9 aa, Artificial Sequence
  Description of Artificial Sequence: Synthetic peptide
  Seed: MPLEQRSQH (MAGA3_HUMAN)
MPLEQRSQY

SEQ ID NO: 58340 - protein, 9 aa, Artificial Sequence
  Description of Artificial Sequence: Synthetic peptide
  Seed: KVAELVHFL (MAGA3_HUMAN)
KCAELVHFF

SEQ ID NO: 58341 - protein, 10 aa, Artificial Sequence
  Description of Artificial Sequence: Synthetic peptide
  Seed: ESEFQAALSR (MAGA3_HUMAN)
EIEFQAALSR

SEQ ID NO: 58342 - protein, 9 aa, Artificial Sequence
  Description of Artificial Sequence: Synthetic peptide
  Seed: GASSLPTTM (MAGA3_HUMAN)
GVSSLPTTF

SEQ ID NO: 58343 - protein, 9 aa, Artificial Sequence
  Description of Artificial Sequence: Synthetic peptide
  Seed: RKVAELVHF (MAGA3_HUMAN)
RRVAELVHV

SEQ ID NO: 58344 - protein, 9 aa, Artificial Sequence
  Description of Artificial Sequence: Synthetic peptide
  Seed: KVLHHMVKI (MAGA3_HUMAN)
KTLHHMVKK

SEQ ID NO: 58345 - protein, 10 aa, Artificial Sequence
  Description of Artificial Sequence: Synthetic peptide
  Seed: MNYPLWSQSY (MAGA3_HUMAN)
MPYPLWSQSF

SEQ ID NO: 58346 - protein, 10 aa, Artificial Sequence
  Description of Artificial Sequence: Synthetic peptide
  Seed: NWQYFFPVIF (MAGA3_HUMAN)
NMQYFFPVIF

SEQ ID NO: 58347 - protein, 9 aa, Artificial Sequence
  Description of Artificial Sequence: Synthetic peptide
  Seed: IFSKASSSL (MAGA3_HUMAN)
IMSKASSSL

SEQ ID NO: 58348 - protein, 9 aa, Artificial Sequence
  Description of Artificial Sequence: Synthetic peptide
  Seed: QIMPKAGLL (MAGA3_HUMAN)
QMMPKAGLY

SEQ ID NO: 58349 - protein, 9 aa, Artificial Sequence
  Description of Artificial Sequence: Synthetic peptide
  Seed: GLVGAQAPA (MAGA3_HUMAN)
GMVGAQAPM

SEQ ID NO: 58350 - protein, 10 aa, Artificial Sequence
  Description of Artificial Sequence: Synthetic peptide
  Seed: TLVEVTLGEV (MAGA3_HUMAN)
TMVEVTLGEI

SEQ ID NO: 58351 - protein, 9 aa, Artificial Sequence
  Description of Artificial Sequence: Synthetic peptide
  Seed: YIFATCLGL (MAGA3_HUMAN)
YHFATCLGY

SEQ ID NO: 58352 - protein, 10 aa, Artificial Sequence
  Description of Artificial Sequence: Synthetic peptide
  Seed: ASSLPTTMNY (MAGA3_HUMAN)
AQSLPTTMNY

SEQ ID NO: 58353 - protein, 9 aa, Artificial Sequence
  Description of Artificial Sequence: Synthetic peptide
  Seed: EFQAALSRK (MAGA3_HUMAN)
ELQAALSRR

SEQ ID NO: 58354 - protein, 10 aa, Artificial Sequence
  Description of Artificial Sequence: Synthetic peptide
  Seed: SLPTTMNYPL (MAGA3_HUMAN)
STPTTMNYPL

SEQ ID NO: 58355 - protein, 9 aa, Artificial Sequence
  Description of Artificial Sequence: Synthetic peptide
  Seed: SSSSTLVEV (MAGA3_HUMAN)
STSSTLVEV

SEQ ID NO: 58356 - protein, 9 aa, Artificial Sequence
  Description of Artificial Sequence: Synthetic peptide
  Seed: GSDPACYEF (MAGA3_HUMAN)
GCDPACYEL

SEQ ID NO: 58357 - protein, 9 aa, Artificial Sequence
  Description of Artificial Sequence: Synthetic peptide
  Seed: KASSSLQLV (MAGA3_HUMAN)
KVSSSLQLM

SEQ ID NO: 58358 - protein, 10 aa, Artificial Sequence
  Description of Artificial Sequence: Synthetic peptide
  Seed: LYIFATCLGL (MAGA3_HUMAN)
LAIFATCLGV

SEQ ID NO: 58359 - protein, 9 aa, Artificial Sequence
  Description of Artificial Sequence: Synthetic peptide
  Seed: HLYIFATCL (MAGA3_HUMAN)
HYYIFATCF

SEQ ID NO: 58360 - protein, 10 aa, Artificial Sequence
  Description of Artificial Sequence: Synthetic peptide
  Seed: LQLVFGIELM (MAGA3_HUMAN)
LLLVFGIELV

SEQ ID NO: 58361 - protein, 9 aa, Artificial Sequence
  Description of Artificial Sequence: Synthetic peptide
  Seed: KVAELVHFL (MAGA3_HUMAN)
KHAELVHFF

SEQ ID NO: 58362 - protein, 9 aa, Artificial Sequence
  Description of Artificial Sequence: Synthetic peptide
  Seed: AELVHFLLL (MAGA3_HUMAN)
AQLVHFLLM

SEQ ID NO: 58363 - protein, 9 aa, Artificial Sequence
  Description of Artificial Sequence: Synthetic peptide
  Seed: SEFQAALSR (MAGA3_HUMAN)
STFQAALSY

SEQ ID NO: 58364 - protein, 10 aa, Artificial Sequence
  Description of Artificial Sequence: Synthetic peptide
  Seed: HISYPPLHEW (MAGA3_HUMAN)
HTSYPPLHEY

SEQ ID NO: 58365 - protein, 11 aa, Artificial Sequence
  Description of Artificial Sequence: Synthetic peptide
  Seed: ISYPPLHEWVL (MAGA3_HUMAN)
IIYPPLHEWVF

SEQ ID NO: 58366 - protein, 10 aa, Artificial Sequence
  Description of Artificial Sequence: Synthetic peptide
  Seed: ISYPPLHEWV (MAGA3_HUMAN)
ICYPPLHEWF

SEQ ID NO: 58367 - protein, 9 aa, Artificial Sequence
  Description of Artificial Sequence: Synthetic peptide
  Seed: TQHFVQENY (MAGA3_HUMAN)
TMHFVQENY

SEQ ID NO: 58368 - protein, 10 aa, Artificial Sequence
  Description of Artificial Sequence: Synthetic peptide
  Seed: MNYPLWSQSY (MAGA3_HUMAN)
MGYPLWSQSW

SEQ ID NO: 58369 - protein, 10 aa, Artificial Sequence
  Description of Artificial Sequence: Synthetic peptide
  Seed: RQVPGSDPAC (MAGA3_HUMAN)
RVVPGSDPAW

SEQ ID NO: 58370 - protein, 10 aa, Artificial Sequence
  Description of Artificial Sequence: Synthetic peptide
  Seed: GPRALVETSY (MAGA3_HUMAN)
GMRALVETSY

SEQ ID NO: 58371 - protein, 10 aa, Artificial Sequence
  Description of Artificial Sequence: Synthetic peptide
  Seed: SYPPLHEWVL (MAGA3_HUMAN)
SFPPLHEWVW

SEQ ID NO: 58372 - protein, 9 aa, Artificial Sequence
  Description of Artificial Sequence: Synthetic peptide
  Seed: EVDPIGHLY (MAGA3_HUMAN)
EGDPIGHLI

SEQ ID NO: 58373 - protein, 9 aa, Artificial Sequence
  Description of Artificial Sequence: Synthetic peptide
  Seed: WQYFFPVIF (MAGA3_HUMAN)
WQYFFPVIH

SEQ ID NO: 58374 - protein, 10 aa, Artificial Sequence
  Description of Artificial Sequence: Synthetic peptide
  Seed: MNYPLWSQSY (MAGA3_HUMAN)
MTYPLWSQSW

SEQ ID NO: 58375 - protein, 9 aa, Artificial Sequence
  Description of Artificial Sequence: Synthetic peptide
  Seed: FQAALSRKV (MAGA3_HUMAN)
FVAALSRKF

SEQ ID NO: 58376 - protein, 10 aa, Artificial Sequence
  Description of Artificial Sequence: Synthetic peptide
  Seed: TLVEVTLGEV (MAGA3_HUMAN)
TAVEVTLGEV

SEQ ID NO: 58377 - protein, 11 aa, Artificial Sequence
  Description of Artificial Sequence: Synthetic peptide
  Seed: SKASSSLQLVF (MAGA3_HUMAN)
SLASSSLQLVW

SEQ ID NO: 58378 - protein, 9 aa, Artificial Sequence
  Description of Artificial Sequence: Synthetic peptide
  Seed: ALSRKVAEL (MAGA3_HUMAN)
AYSRKVAEF

SEQ ID NO: 58379 - protein, 10 aa, Artificial Sequence
  Description of Artificial Sequence: Synthetic peptide
  Seed: DLESEFQAAL (MAGA3_HUMAN)
DWESEFQAAY

SEQ ID NO: 58380 - protein, 9 aa, Artificial Sequence
  Description of Artificial Sequence: Synthetic peptide
  Seed: KVLHHMVKI (MAGA3_HUMAN)
KVLHHMVKR

SEQ ID NO: 58381 - protein, 9 aa, Artificial Sequence
  Description of Artificial Sequence: Synthetic peptide
  Seed: YIFATCLGL (MAGA3_HUMAN)
YHFATCLGF

SEQ ID NO: 58382 - protein, 8 aa, Artificial Sequence
  Description of Artificial Sequence: Synthetic peptide
  Seed: FPDLESEF (MAGA3_HUMAN)
FQDLESEI

SEQ ID NO: 58383 - protein, 9 aa, Artificial Sequence
  Description of Artificial Sequence: Synthetic peptide
  Seed: FVQENYLEY (MAGA3_HUMAN)
FNQENYLEY

SEQ ID NO: 58384 - protein, 9 aa, Artificial Sequence
  Description of Artificial Sequence: Synthetic peptide
  Seed: QSPQGASSL (MAGA3_HUMAN)
QLPQGASSY

SEQ ID NO: 58385 - protein, 10 aa, Artificial Sequence
  Description of Artificial Sequence: Synthetic peptide
  Seed: RQVPGSDPAC (MAGA3_HUMAN)
RMVPGSDPAY

SEQ ID NO: 58386 - protein, 10 aa, Artificial Sequence
  Description of Artificial Sequence: Synthetic peptide
  Seed: TSYVKVLHHM (MAGA3_HUMAN)
TNYVKVLHHL

SEQ ID NO: 58387 - protein, 9 aa, Artificial Sequence
  Description of Artificial Sequence: Synthetic peptide
  Seed: VKISGGPHI (MAGA3_HUMAN)
VEISGGPHF

SEQ ID NO: 58388 - protein, 9 aa, Artificial Sequence
  Description of Artificial Sequence: Synthetic peptide
  Seed: IMPKAGLLI (MAGA3_HUMAN)
IMPKAGLLW

SEQ ID NO: 58389 - protein, 10 aa, Artificial Sequence
  Description of Artificial Sequence: Synthetic peptide
  Seed: KASSSLQLVF (MAGA3_HUMAN)
KHSSSLQLVM

SEQ ID NO: 58390 - protein, 10 aa, Artificial Sequence
  Description of Artificial Sequence: Synthetic peptide
  Seed: ISYPPLHEWV (MAGA3_HUMAN)
ICYPPLHEWW

SEQ ID NO: 58391 - protein, 9 aa, Artificial Sequence
  Description of Artificial Sequence: Synthetic peptide
  Seed: YFFPVIFSK (MAGA3_HUMAN)
YAFPVIFSR

SEQ ID NO: 58392 - protein, 9 aa, Artificial Sequence
  Description of Artificial Sequence: Synthetic peptide
  Seed: HLYIFATCL (MAGA3_HUMAN)
HKYIFATCM

SEQ ID NO: 58393 - protein, 9 aa, Artificial Sequence
  Description of Artificial Sequence: Synthetic peptide
  Seed: SSLPTTMNY (MAGA3_HUMAN)
SHLPTTMNF

SEQ ID NO: 58394 - protein, 9 aa, Artificial Sequence
  Description of Artificial Sequence: Synthetic peptide
  Seed: NQIMPKAGL (MAGA3_HUMAN)
NMIMPKAGY

SEQ ID NO: 58395 - protein, 9 aa, Artificial Sequence
  Description of Artificial Sequence: Synthetic peptide
  Seed: KAGLLIIVL (MAGA3_HUMAN)
KSGLLIIVW

SEQ ID NO: 58396 - protein, 9 aa, Artificial Sequence
  Description of Artificial Sequence: Synthetic peptide
  Seed: QEAASSSST (MAGA3_HUMAN)
QEAASSSSI

SEQ ID NO: 58397 - protein, 10 aa, Artificial Sequence
  Description of Artificial Sequence: Synthetic peptide
  Seed: VIFSKASSSL (MAGA3_HUMAN)
VAFSKASSSF

SEQ ID NO: 58398 - protein, 11 aa, Artificial Sequence
  Description of Artificial Sequence: Synthetic peptide
  Seed: RQVPGSDPACY (MAGA3_HUMAN)
RKVPGSDPACF

SEQ ID NO: 58399 - protein, 9 aa, Artificial Sequence
  Description of Artificial Sequence: Synthetic peptide
  Seed: LESEFQAAL (MAGA3_HUMAN)
LKSEFQAAM

SEQ ID NO: 58400 - protein, 9 aa, Artificial Sequence
  Description of Artificial Sequence: Synthetic peptide
  Seed: KVLHHMVKI (MAGA3_HUMAN)
KALHHMVKR

SEQ ID NO: 58401 - protein, 9 aa, Artificial Sequence
  Description of Artificial Sequence: Synthetic peptide
  Seed: SSLQLVFGI (MAGA3_HUMAN)
SMLQLVFGT

SEQ ID NO: 58402 - protein, 10 aa, Artificial Sequence
  Description of Artificial Sequence: Synthetic peptide
  Seed: ISYPPLHEWV (MAGA3_HUMAN)
ICYPPLHEWL

SEQ ID NO: 58403 - protein, 10 aa, Artificial Sequence
  Description of Artificial Sequence: Synthetic peptide
  Seed: LVFGIELMEV (MAGA3_HUMAN)
LTFGIELMEV

SEQ ID NO: 58404 - protein, 10 aa, Artificial Sequence
  Description of Artificial Sequence: Synthetic peptide
  Seed: LQLVFGIELM (MAGA3_HUMAN)
LQLVFGIELV

SEQ ID NO: 58405 - protein, 10 aa, Artificial Sequence
  Description of Artificial Sequence: Synthetic peptide
  Seed: KVAELVHFLL (MAGA3_HUMAN)
KMAELVHFLF

SEQ ID NO: 58406 - protein, 9 aa, Artificial Sequence
  Description of Artificial Sequence: Synthetic peptide
  Seed: KVAELVHFL (MAGA3_HUMAN)
KGAELVHFF

SEQ ID NO: 58407 - protein, 9 aa, Artificial Sequence
  Description of Artificial Sequence: Synthetic peptide
  Seed: KIWEELSVL (MAGA3_HUMAN)
KTWEELSVY

SEQ ID NO: 58408 - protein, 10 aa, Artificial Sequence
  Description of Artificial Sequence: Synthetic peptide
  Seed: VDPIGHLYIF (MAGA3_HUMAN)
VRPIGHLYIY

SEQ ID NO: 58409 - protein, 10 aa, Artificial Sequence
  Description of Artificial Sequence: Synthetic peptide
  Seed: TSYVKVLHHM (MAGA3_HUMAN)
TSYVKVLHHL

SEQ ID NO: 58410 - protein, 10 aa, Artificial Sequence
  Description of Artificial Sequence: Synthetic peptide
  Seed: GPRALVETSY (MAGA3_HUMAN)
GQRALVETSY

SEQ ID NO: 58411 - protein, 9 aa, Artificial Sequence
  Description of Artificial Sequence: Synthetic peptide
  Seed: QEEEGPSTF (MAGA3_HUMAN)
QEEEGPSTT

SEQ ID NO: 58412 - protein, 9 aa, Artificial Sequence
  Description of Artificial Sequence: Synthetic peptide
  Seed: LVHFLLLKY (MAGA3_HUMAN)
LKHFLLLKF

SEQ ID NO: 58413 - protein, 9 aa, Artificial Sequence
  Description of Artificial Sequence: Synthetic peptide
  Seed: QIMPKAGLL (MAGA3_HUMAN)
QQMPKAGLV

SEQ ID NO: 58414 - protein, 10 aa, Artificial Sequence
  Description of Artificial Sequence: Synthetic peptide
  Seed: ASSLPTTMNY (MAGA3_HUMAN)
AASLPTTMNW

SEQ ID NO: 58415 - protein, 11 aa, Artificial Sequence
  Description of Artificial Sequence: Synthetic peptide
  Seed: SKASSSLQLVF (MAGA3_HUMAN)
SQASSSLQLVY

SEQ ID NO: 58416 - protein, 9 aa, Artificial Sequence
  Description of Artificial Sequence: Synthetic peptide
  Seed: ALSRKVAEL (MAGA3_HUMAN)
ASSRKVAEV

SEQ ID NO: 58417 - protein, 10 aa, Artificial Sequence
  Description of Artificial Sequence: Synthetic peptide
  Seed: MVKISGGPHI (MAGA3_HUMAN)
MQKISGGPHL

SEQ ID NO: 58418 - protein, 10 aa, Artificial Sequence
  Description of Artificial Sequence: Synthetic peptide
  Seed: SEFQAALSRK (MAGA3_HUMAN)
SRFQAALSRR

SEQ ID NO: 58419 - protein, 9 aa, Artificial Sequence
  Description of Artificial Sequence: Synthetic peptide
  Seed: LPTTMNYPL (MAGA3_HUMAN)
LVTTMNYPF

SEQ ID NO: 58420 - protein, 9 aa, Artificial Sequence
  Description of Artificial Sequence: Synthetic peptide
  Seed: VFEGREDSI (MAGA3_HUMAN)
VFEGREDSM

SEQ ID NO: 58421 - protein, 9 aa, Artificial Sequence
  Description of Artificial Sequence: Synthetic peptide
  Seed: SSLQLVFGI (MAGA3_HUMAN)
SILQLVFGL

SEQ ID NO: 58422 - protein, 10 aa, Artificial Sequence
  Description of Artificial Sequence: Synthetic peptide
  Seed: GHLYIFATCL (MAGA3_HUMAN)
GKLYIFATCV

SEQ ID NO: 58423 - protein, 9 aa, Artificial Sequence
  Description of Artificial Sequence: Synthetic peptide
  Seed: MEVDPIGHL (MAGA3_HUMAN)
MHVDPIGHI

SEQ ID NO: 58424 - protein, 10 aa, Artificial Sequence
  Description of Artificial Sequence: Synthetic peptide
  Seed: AELVHFLLLK (MAGA3_HUMAN)
AMLVHFLLLK

SEQ ID NO: 58425 - protein, 10 aa, Artificial Sequence
  Description of Artificial Sequence: Synthetic peptide
  Seed: KASSSLQLVF (MAGA3_HUMAN)
KFSSSLQLVI

SEQ ID NO: 58426 - protein, 9 aa, Artificial Sequence
  Description of Artificial Sequence: Synthetic peptide
  Seed: SSLPTTMNY (MAGA3_HUMAN)
SVLPTTMNL

SEQ ID NO: 58427 - protein, 10 aa, Artificial Sequence
  Description of Artificial Sequence: Synthetic peptide
  Seed: ASSLPTTMNY (MAGA3_HUMAN)
AMSLPTTMNY

SEQ ID NO: 58428 - protein, 10 aa, Artificial Sequence
  Description of Artificial Sequence: Synthetic peptide
  Seed: ESEFQAALSR (MAGA3_HUMAN)
EAEFQAALSR

SEQ ID NO: 58429 - protein, 10 aa, Artificial Sequence
  Description of Artificial Sequence: Synthetic peptide
  Seed: SSSTLVEVTL (MAGA3_HUMAN)
SLSTLVEVTW

SEQ ID NO: 58430 - protein, 9 aa, Artificial Sequence
  Description of Artificial Sequence: Synthetic peptide
  Seed: SSTLVEVTL (MAGA3_HUMAN)
SITLVEVTY

SEQ ID NO: 58431 - protein, 10 aa, Artificial Sequence
  Description of Artificial Sequence: Synthetic peptide
  Seed: AESPDPPQSP (MAGA3_HUMAN)
AESPDPPQSY

SEQ ID NO: 58432 - protein, 10 aa, Artificial Sequence
  Description of Artificial Sequence: Synthetic peptide
  Seed: YFFPVIFSKA (MAGA3_HUMAN)
YFFPVIFSKR

SEQ ID NO: 58433 - protein, 10 aa, Artificial Sequence
  Description of Artificial Sequence: Synthetic peptide
  Seed: EALGLVGAQA (MAGA3_HUMAN)
ETLGLVGAQV

SEQ ID NO: 58434 - protein, 9 aa, Artificial Sequence
  Description of Artificial Sequence: Synthetic peptide
  Seed: SYPPLHEWV (MAGA3_HUMAN)
SFPPLHEWY

SEQ ID NO: 58435 - protein, 10 aa, Artificial Sequence
  Description of Artificial Sequence: Synthetic peptide
  Seed: HISYPPLHEW (MAGA3_HUMAN)
HQSYPPLHEL

SEQ ID NO: 58436 - protein, 11 aa, Artificial Sequence
  Description of Artificial Sequence: Synthetic peptide
  Seed: LMEVDPIGHLY (MAGA3_HUMAN)
LSEVDPIGHLY

SEQ ID NO: 58437 - protein, 9 aa, Artificial Sequence
  Description of Artificial Sequence: Synthetic peptide
  Seed: NYPLWSQSY (MAGA3_HUMAN)
NMPLWSQSY

SEQ ID NO: 58438 - protein, 9 aa, Artificial Sequence
  Description of Artificial Sequence: Synthetic peptide
  Seed: SSSSTLVEV (MAGA3_HUMAN)
STSSTLVEL

SEQ ID NO: 58439 - protein, 10 aa, Artificial Sequence
  Description of Artificial Sequence: Synthetic peptide
  Seed: ISYPPLHEWV (MAGA3_HUMAN)
IYYPPLHEWV

SEQ ID NO: 58440 - protein, 11 aa, Artificial Sequence
  Description of Artificial Sequence: Synthetic peptide
  Seed: AEMLGSVVGNW (MAGA3_HUMAN)
AEMLGSVVGNV

SEQ ID NO: 58441 - protein, 9 aa, Artificial Sequence
  Description of Artificial Sequence: Synthetic peptide
  Seed: ISYPPLHEW (MAGA3_HUMAN)
IQYPPLHEV

SEQ ID NO: 58442 - protein, 10 aa, Artificial Sequence
  Description of Artificial Sequence: Synthetic peptide
  Seed: KAEMLGSVVG (MAGA3_HUMAN)
KREMLGSVVA

SEQ ID NO: 58443 - protein, 8 aa, Artificial Sequence
  Description of Artificial Sequence: Synthetic peptide
  Seed: HEWVLREG (MAGA3_HUMAN)
HDWVLREM

SEQ ID NO: 58444 - protein, 9 aa, Artificial Sequence
  Description of Artificial Sequence: Synthetic peptide
  Seed: SEFQAALSR (MAGA3_HUMAN)
SDFQAALSA

SEQ ID NO: 58445 - protein, 9 aa, Artificial Sequence
  Description of Artificial Sequence: Synthetic peptide
  Seed: YIFATCLGL (MAGA3_HUMAN)
YRFATCLGF

SEQ ID NO: 58446 - protein, 9 aa, Artificial Sequence
  Description of Artificial Sequence: Synthetic peptide
  Seed: MEVDPIGHL (MAGA3_HUMAN)
MHVDPIGHF

SEQ ID NO: 58447 - protein, 9 aa, Artificial Sequence
  Description of Artificial Sequence: Synthetic peptide
  Seed: ALSRKVAEL (MAGA3_HUMAN)
AVSRKVAEY

SEQ ID NO: 58448 - protein, 9 aa, Artificial Sequence
  Description of Artificial Sequence: Synthetic peptide
  Seed: YPPLHEWVL (MAGA3_HUMAN)
YRPLHEWVL

SEQ ID NO: 58449 - protein, 9 aa, Artificial Sequence
  Description of Artificial Sequence: Synthetic peptide
  Seed: KVLHHMVKI (MAGA3_HUMAN)
KMLHHMVKV

SEQ ID NO: 58450 - protein, 10 aa, Artificial Sequence
  Description of Artificial Sequence: Synthetic peptide
  Seed: AALSRKVAEL (MAGA3_HUMAN)
AMLSRKVAEV

SEQ ID NO: 58451 - protein, 9 aa, Artificial Sequence
  Description of Artificial Sequence: Synthetic peptide
  Seed: ISGGPHISY (MAGA3_HUMAN)
ISGGPHISK

SEQ ID NO: 58452 - protein, 9 aa, Artificial Sequence
  Description of Artificial Sequence: Synthetic peptide
  Seed: WQYFFPVIF (MAGA3_HUMAN)
WAYFFPVIF

SEQ ID NO: 58453 - protein, 11 aa, Artificial Sequence
  Description of Artificial Sequence: Synthetic peptide
  Seed: SPDPPQSPQGA (MAGA3_HUMAN)
SPDPPQSPQGF

SEQ ID NO: 58454 - protein, 9 aa, Artificial Sequence
  Description of Artificial Sequence: Synthetic peptide
  Seed: FATCLGLSY (MAGA3_HUMAN)
FYTCLGLSI

SEQ ID NO: 58455 - protein, 9 aa, Artificial Sequence
  Description of Artificial Sequence: Synthetic peptide
  Seed: GNWQYFFPV (MAGA3_HUMAN)
GSWQYFFPI

SEQ ID NO: 58456 - protein, 9 aa, Artificial Sequence
  Description of Artificial Sequence: Synthetic peptide
  Seed: AQAPATEEQ (MAGA3_HUMAN)
ALAPATEEM

SEQ ID NO: 58457 - protein, 10 aa, Artificial Sequence
  Description of Artificial Sequence: Synthetic peptide
  Seed: ELVHFLLLKY (MAGA3_HUMAN)
EVVHFLLLKR

SEQ ID NO: 58458 - protein, 10 aa, Artificial Sequence
  Description of Artificial Sequence: Synthetic peptide
  Seed: STFPDLESEF (MAGA3_HUMAN)
SRFPDLESEY

SEQ ID NO: 58459 - protein, 9 aa, Artificial Sequence
  Description of Artificial Sequence: Synthetic peptide
  Seed: QIMPKAGLL (MAGA3_HUMAN)
QMMPKAGLW

SEQ ID NO: 58460 - protein, 9 aa, Artificial Sequence
  Description of Artificial Sequence: Synthetic peptide
  Seed: LQLVFGIEL (MAGA3_HUMAN)
LHLVFGIEI

SEQ ID NO: 58461 - protein, 10 aa, Artificial Sequence
  Description of Artificial Sequence: Synthetic peptide
  Seed: KVAELVHFLL (MAGA3_HUMAN)
KMAELVHFLY

SEQ ID NO: 58462 - protein, 9 aa, Artificial Sequence
  Description of Artificial Sequence: Synthetic peptide
  Seed: GSDPACYEF (MAGA3_HUMAN)
GSDPACYEL

SEQ ID NO: 58463 - protein, 10 aa, Artificial Sequence
  Description of Artificial Sequence: Synthetic peptide
  Seed: ASSSSTLVEV (MAGA3_HUMAN)
AASSSTLVEV

SEQ ID NO: 58464 - protein, 11 aa, Artificial Sequence
  Description of Artificial Sequence: Synthetic peptide
  Seed: KVAELVHFLLL (MAGA3_HUMAN)
KMAELVHFLLG

SEQ ID NO: 58465 - protein, 9 aa, Artificial Sequence
  Description of Artificial Sequence: Synthetic peptide
  Seed: KVAELVHFL (MAGA3_HUMAN)
KQAELVHFI

SEQ ID NO: 58466 - protein, 9 aa, Artificial Sequence
  Description of Artificial Sequence: Synthetic peptide
  Seed: TFPDLESEF (MAGA3_HUMAN)
TGPDLESEL

SEQ ID NO: 58467 - protein, 10 aa, Artificial Sequence
  Description of Artificial Sequence: Synthetic peptide
  Seed: MNYPLWSQSY (MAGA3_HUMAN)
MRYPLWSQSY

SEQ ID NO: 58468 - protein, 9 aa, Artificial Sequence
  Description of Artificial Sequence: Synthetic peptide
  Seed: LQLVFGIEL (MAGA3_HUMAN)
LLLVFGIEY

SEQ ID NO: 58469 - protein, 9 aa, Artificial Sequence
  Description of Artificial Sequence: Synthetic peptide
  Seed: FVQENYLEY (MAGA3_HUMAN)
FMQENYLER

SEQ ID NO: 58470 - protein, 10 aa, Artificial Sequence
  Description of Artificial Sequence: Synthetic peptide
  Seed: KVAELVHFLL (MAGA3_HUMAN)
KSAELVHFLR

SEQ ID NO: 58471 - protein, 9 aa, Artificial Sequence
  Description of Artificial Sequence: Synthetic peptide
  Seed: FVQENYLEY (MAGA3_HUMAN)
FIQENYLEM

SEQ ID NO: 58472 - protein, 10 aa, Artificial Sequence
  Description of Artificial Sequence: Synthetic peptide
  Seed: TSYVKVLHHM (MAGA3_HUMAN)
TQYVKVLHHW

SEQ ID NO: 58473 - protein, 9 aa, Artificial Sequence
  Description of Artificial Sequence: Synthetic peptide
  Seed: EVDPIGHLY (MAGA3_HUMAN)
ENDPIGHLL

SEQ ID NO: 58474 - protein, 11 aa, Artificial Sequence
  Description of Artificial Sequence: Synthetic peptide
  Seed: WQYFFPVIFSK (MAGA3_HUMAN)
WVYFFPVIFSR

SEQ ID NO: 58475 - protein, 9 aa, Artificial Sequence
  Description of Artificial Sequence: Synthetic peptide
  Seed: LQLVFGIEL (MAGA3_HUMAN)
LQLVFGIEI

SEQ ID NO: 58476 - protein, 9 aa, Artificial Sequence
  Description of Artificial Sequence: Synthetic peptide
  Seed: IMPKAGLLI (MAGA3_HUMAN)
ISPKAGLLW

SEQ ID NO: 58477 - protein, 10 aa, Artificial Sequence
  Description of Artificial Sequence: Synthetic peptide
  Seed: ISYPPLHEWV (MAGA3_HUMAN)
ITYPPLHEWY

SEQ ID NO: 58478 - protein, 9 aa, Artificial Sequence
  Description of Artificial Sequence: Synthetic peptide
  Seed: ASSSLQLVF (MAGA3_HUMAN)
AFSSLQLVY

SEQ ID NO: 58479 - protein, 9 aa, Artificial Sequence
  Description of Artificial Sequence: Synthetic peptide
  Seed: RALVETSYV (MAGA3_HUMAN)
RMLVETSYA

SEQ ID NO: 58480 - protein, 9 aa, Artificial Sequence
  Description of Artificial Sequence: Synthetic peptide
  Seed: FQAALSRKV (MAGA3_HUMAN)
FHAALSRKF

SEQ ID NO: 58481 - protein, 9 aa, Artificial Sequence
  Description of Artificial Sequence: Synthetic peptide
  Seed: KVAELVHFL (MAGA3_HUMAN)
KTAELVHFV

SEQ ID NO: 58482 - protein, 9 aa, Artificial Sequence
  Description of Artificial Sequence: Synthetic peptide
  Seed: DPIGHLYIF (MAGA3_HUMAN)
DEIGHLYII

SEQ ID NO: 58483 - protein, 10 aa, Artificial Sequence
  Description of Artificial Sequence: Synthetic peptide
  Seed: QYFFPVIFSK (MAGA3_HUMAN)
QNFFPVIFSR

SEQ ID NO: 58484 - protein, 10 aa, Artificial Sequence
  Description of Artificial Sequence: Synthetic peptide
  Seed: ISYPPLHEWV (MAGA3_HUMAN)
ITYPPLHEWM

SEQ ID NO: 58485 - protein, 10 aa, Artificial Sequence
  Description of Artificial Sequence: Synthetic peptide
  Seed: RKVAELVHFL (MAGA3_HUMAN)
RKVAELVHFY

SEQ ID NO: 58486 - protein, 10 aa, Artificial Sequence
  Description of Artificial Sequence: Synthetic peptide
  Seed: YFFPVIFSKA (MAGA3_HUMAN)
YVFPVIFSKI

SEQ ID NO: 58487 - protein, 10 aa, Artificial Sequence
  Description of Artificial Sequence: Synthetic peptide
  Seed: MEVDPIGHLY (MAGA3_HUMAN)
MEVDPIGHLT

SEQ ID NO: 58488 - protein, 9 aa, Artificial Sequence
  Description of Artificial Sequence: Synthetic peptide
  Seed: VAELVHFLL (MAGA3_HUMAN)
VSELVHFLW

SEQ ID NO: 58489 - protein, 9 aa, Artificial Sequence
  Description of Artificial Sequence: Synthetic peptide
  Seed: ASSSLQLVF (MAGA3_HUMAN)
ALSSLQLVF

SEQ ID NO: 58490 - protein, 9 aa, Artificial Sequence
  Description of Artificial Sequence: Synthetic peptide
  Seed: KIWEELSVL (MAGA3_HUMAN)
KWWEELSVY

SEQ ID NO: 58491 - protein, 9 aa, Artificial Sequence
  Description of Artificial Sequence: Synthetic peptide
  Seed: RALVETSYV (MAGA3_HUMAN)
RMLVETSYF

SEQ ID NO: 58492 - protein, 9 aa, Artificial Sequence
  Description of Artificial Sequence: Synthetic peptide
  Seed: LVHFLLLKY (MAGA3_HUMAN)
LLHFLLLKK

SEQ ID NO: 58493 - protein, 8 aa, Artificial Sequence
  Description of Artificial Sequence: Synthetic peptide
  Seed: SGGPHISY (MAGA3_HUMAN)
STGPHISL

SEQ ID NO: 58494 - protein, 9 aa, Artificial Sequence
  Description of Artificial Sequence: Synthetic peptide
  Seed: DCAPEEKIW (MAGA3_HUMAN)
DAAPEEKIW

SEQ ID NO: 58495 - protein, 10 aa, Artificial Sequence
  Description of Artificial Sequence: Synthetic peptide
  Seed: KISGGPHISY (MAGA3_HUMAN)
KQSGGPHISK

SEQ ID NO: 58496 - protein, 10 aa, Artificial Sequence
  Description of Artificial Sequence: Synthetic peptide
  Seed: KISGGPHISY (MAGA3_HUMAN)
KLSGGPHISL

SEQ ID NO: 58497 - protein, 11 aa, Artificial Sequence
  Description of Artificial Sequence: Synthetic peptide
  Seed: MEVDPIGHLYI (MAGA3_HUMAN)
MQVDPIGHLYW

SEQ ID NO: 58498 - protein, 9 aa, Artificial Sequence
  Description of Artificial Sequence: Synthetic peptide
  Seed: ALSRKVAEL (MAGA3_HUMAN)
ALSRKVAEV

SEQ ID NO: 58499 - protein, 9 aa, Artificial Sequence
  Description of Artificial Sequence: Synthetic peptide
  Seed: IFSKASSSL (MAGA3_HUMAN)
IWSKASSSY

SEQ ID NO: 58500 - protein, 9 aa, Artificial Sequence
  Description of Artificial Sequence: Synthetic peptide
  Seed: AEMLGSVVG (MAGA3_HUMAN)
AEMLGSVVM

SEQ ID NO: 58501 - protein, 9 aa, Artificial Sequence
  Description of Artificial Sequence: Synthetic peptide
  Seed: ALSRKVAEL (MAGA3_HUMAN)
ASSRKVAEM

SEQ ID NO: 58502 - protein, 9 aa, Artificial Sequence
  Description of Artificial Sequence: Synthetic peptide
  Seed: SILGDPKKL (MAGA3_HUMAN)
SQLGDPKKF

SEQ ID NO: 58503 - protein, 9 aa, Artificial Sequence
  Description of Artificial Sequence: Synthetic peptide
  Seed: GDCAPEEKI (MAGA3_HUMAN)
GECAPEEKM

SEQ ID NO: 58504 - protein, 8 aa, Artificial Sequence
  Description of Artificial Sequence: Synthetic peptide
  Seed: FPDLESEF (MAGA3_HUMAN)
FYDLESEF

SEQ ID NO: 58505 - protein, 10 aa, Artificial Sequence
  Description of Artificial Sequence: Synthetic peptide
  Seed: YRQVPGSDPA (MAGA3_HUMAN)
YEQVPGSDPV

SEQ ID NO: 58506 - protein, 10 aa, Artificial Sequence
  Description of Artificial Sequence: Synthetic peptide
  Seed: YIFATCLGLS (MAGA3_HUMAN)
YLFATCLGLN

SEQ ID NO: 58507 - protein, 9 aa, Artificial Sequence
  Description of Artificial Sequence: Synthetic peptide
  Seed: IMPKAGLLI (MAGA3_HUMAN)
IMPKAGLLV

SEQ ID NO: 58508 - protein, 10 aa, Artificial Sequence
  Description of Artificial Sequence: Synthetic peptide
  Seed: MNYPLWSQSY (MAGA3_HUMAN)
MGYPLWSQSM

SEQ ID NO: 58509 - protein, 9 aa, Artificial Sequence
  Description of Artificial Sequence: Synthetic peptide
  Seed: KASSSLQLV (MAGA3_HUMAN)
KSSSSLQLM

SEQ ID NO: 58510 - protein, 11 aa, Artificial Sequence
  Description of Artificial Sequence: Synthetic peptide
  Seed: KVAELVHFLLL (MAGA3_HUMAN)
KVAELVHFLLV

SEQ ID NO: 58511 - protein, 11 aa, Artificial Sequence
  Description of Artificial Sequence: Synthetic peptide
  Seed: AESPDPPQSPQ (MAGA3_HUMAN)
AESPDPPQSPL

SEQ ID NO: 58512 - protein, 10 aa, Artificial Sequence
  Description of Artificial Sequence: Synthetic peptide
  Seed: EVFEGREDSI (MAGA3_HUMAN)
ETFEGREDSR

SEQ ID NO: 58513 - protein, 10 aa, Artificial Sequence
  Description of Artificial Sequence: Synthetic peptide
  Seed: TSYVKVLHHM (MAGA3_HUMAN)
TCYVKVLHHI

SEQ ID NO: 58514 - protein, 10 aa, Artificial Sequence
  Description of Artificial Sequence: Synthetic peptide
  Seed: ASSLPTTMNY (MAGA3_HUMAN)
ARSLPTTMNF

SEQ ID NO: 58515 - protein, 9 aa, Artificial Sequence
  Description of Artificial Sequence: Synthetic peptide
  Seed: SYVKVLHHM (MAGA3_HUMAN)
SMVKVLHHY

SEQ ID NO: 58516 - protein, 9 aa, Artificial Sequence
  Description of Artificial Sequence: Synthetic peptide
  Seed: RQVPGSDPA (MAGA3_HUMAN)
REVPGSDPY

SEQ ID NO: 58517 - protein, 9 aa, Artificial Sequence
  Description of Artificial Sequence: Synthetic peptide
  Seed: AASSSSTLV (MAGA3_HUMAN)
ALSSSSTLM

SEQ ID NO: 58518 - protein, 10 aa, Artificial Sequence
  Description of Artificial Sequence: Synthetic peptide
  Seed: KISGGPHISY (MAGA3_HUMAN)
KSSGGPHISW

SEQ ID NO: 58519 - protein, 9 aa, Artificial Sequence
  Description of Artificial Sequence: Synthetic peptide
  Seed: EAASSSSTL (MAGA3_HUMAN)
EAASSSSTV

SEQ ID NO: 58520 - protein, 9 aa, Artificial Sequence
  Description of Artificial Sequence: Synthetic peptide
  Seed: KASSSLQLV (MAGA3_HUMAN)
KWSSSLQLY

SEQ ID NO: 58521 - protein, 9 aa, Artificial Sequence
  Description of Artificial Sequence: Synthetic peptide
  Seed: QEEEGPSTF (MAGA3_HUMAN)
QHEEGPSTI

SEQ ID NO: 58522 - protein, 9 aa, Artificial Sequence
  Description of Artificial Sequence: Synthetic peptide
  Seed: EVDPIGHLY (MAGA3_HUMAN)
ESDPIGHLF

SEQ ID NO: 58523 - protein, 9 aa, Artificial Sequence
  Description of Artificial Sequence: Synthetic peptide
  Seed: SYVKVLHHM (MAGA3_HUMAN)
SRVKVLHHF

SEQ ID NO: 58524 - protein, 11 aa, Artificial Sequence
  Description of Artificial Sequence: Synthetic peptide
  Seed: YIFATCLGLSY (MAGA3_HUMAN)
YMFATCLGLSY

SEQ ID NO: 58525 - protein, 11 aa, Artificial Sequence
  Description of Artificial Sequence: Synthetic peptide
  Seed: HCKPEEGLEAR (MAGA3_HUMAN)
HFKPEEGLEAR

SEQ ID NO: 58526 - protein, 9 aa, Artificial Sequence
  Description of Artificial Sequence: Synthetic peptide
  Seed: LESEFQAAL (MAGA3_HUMAN)
LNSEFQAAF

SEQ ID NO: 58527 - protein, 9 aa, Artificial Sequence
  Description of Artificial Sequence: Synthetic peptide
  Seed: YFFPVIFSK (MAGA3_HUMAN)
YGFPVIFSR

SEQ ID NO: 58528 - protein, 10 aa, Artificial Sequence
  Description of Artificial Sequence: Synthetic peptide
  Seed: ASSLPTTMNY (MAGA3_HUMAN)
AESLPTTMNK

SEQ ID NO: 58529 - protein, 9 aa, Artificial Sequence
  Description of Artificial Sequence: Synthetic peptide
  Seed: LVHFLLLKY (MAGA3_HUMAN)
LQHFLLLKF

SEQ ID NO: 58530 - protein, 10 aa, Artificial Sequence
  Description of Artificial Sequence: Synthetic peptide
  Seed: GHLYIFATCL (MAGA3_HUMAN)
GMLYIFATCV

SEQ ID NO: 58531 - protein, 9 aa, Artificial Sequence
  Description of Artificial Sequence: Synthetic peptide
  Seed: TFPDLESEF (MAGA3_HUMAN)
TAPDLESEM

SEQ ID NO: 58532 - protein, 9 aa, Artificial Sequence
  Description of Artificial Sequence: Synthetic peptide
  Seed: LESEFQAAL (MAGA3_HUMAN)
LMSEFQAAI

SEQ ID NO: 58533 - protein, 10 aa, Artificial Sequence
  Description of Artificial Sequence: Synthetic peptide
  Seed: LGSVVGNWQY (MAGA3_HUMAN)
LPSVVGNWQW

SEQ ID NO: 58534 - protein, 9 aa, Artificial Sequence
  Description of Artificial Sequence: Synthetic peptide
  Seed: EELSVLEVF (MAGA3_HUMAN)
EHLSVLEVY

SEQ ID NO: 58535 - protein, 9 aa, Artificial Sequence
  Description of Artificial Sequence: Synthetic peptide
  Seed: TFPDLESEF (MAGA3_HUMAN)
TTPDLESEV

SEQ ID NO: 58536 - protein, 9 aa, Artificial Sequence
  Description of Artificial Sequence: Synthetic peptide
  Seed: AASSSSTLV (MAGA3_HUMAN)
AASSSSTLL

SEQ ID NO: 58537 - protein, 11 aa, Artificial Sequence
  Description of Artificial Sequence: Synthetic peptide
  Seed: ELVHFLLLKYR (MAGA3_HUMAN)
ESVHFLLLKYR

SEQ ID NO: 58538 - protein, 9 aa, Artificial Sequence
  Description of Artificial Sequence: Synthetic peptide
  Seed: SPQGASSLP (MAGA3_HUMAN)
SPQGASSLL

SEQ ID NO: 58539 - protein, 9 aa, Artificial Sequence
  Description of Artificial Sequence: Synthetic peptide
  Seed: ASSSLQLVF (MAGA3_HUMAN)
AMSSLQLVW

SEQ ID NO: 58540 - protein, 9 aa, Artificial Sequence
  Description of Artificial Sequence: Synthetic peptide
  Seed: FVQENYLEY (MAGA3_HUMAN)
FWQENYLEY

SEQ ID NO: 58541 - protein, 11 aa, Artificial Sequence
  Description of Artificial Sequence: Synthetic peptide
  Seed: EVFEGREDSIL (MAGA3_HUMAN)
ETFEGREDSIK

SEQ ID NO: 58542 - protein, 11 aa, Artificial Sequence
  Description of Artificial Sequence: Synthetic peptide
  Seed: REGDCAPEEKI (MAGA3_HUMAN)
RLGDCAPEEKF

SEQ ID NO: 58543 - protein, 10 aa, Artificial Sequence
  Description of Artificial Sequence: Synthetic peptide
  Seed: FSKASSSLQL (MAGA3_HUMAN)
FYKASSSLQM

SEQ ID NO: 58544 - protein, 10 aa, Artificial Sequence
  Description of Artificial Sequence: Synthetic peptide
  Seed: FSKASSSLQL (MAGA3_HUMAN)
FWKASSSLQM

SEQ ID NO: 58545 - protein, 9 aa, Artificial Sequence
  Description of Artificial Sequence: Synthetic peptide
  Seed: KIWEELSVL (MAGA3_HUMAN)
KKWEELSVY

SEQ ID NO: 58546 - protein, 10 aa, Artificial Sequence
  Description of Artificial Sequence: Synthetic peptide
  Seed: KVAELVHFLL (MAGA3_HUMAN)
KLAELVHFLH

SEQ ID NO: 58547 - protein, 9 aa, Artificial Sequence
  Description of Artificial Sequence: Synthetic peptide
  Seed: GLVGAQAPA (MAGA3_HUMAN)
GLVGAQAPL

SEQ ID NO: 58548 - protein, 10 aa, Artificial Sequence
  Description of Artificial Sequence: Synthetic peptide
  Seed: IFATCLGLSY (MAGA3_HUMAN)
IMATCLGLSF

SEQ ID NO: 58549 - protein, 11 aa, Artificial Sequence
  Description of Artificial Sequence: Synthetic peptide
  Seed: YIFATCLGLSY (MAGA3_HUMAN)
YSFATCLGLSI

SEQ ID NO: 58550 - protein, 9 aa, Artificial Sequence
  Description of Artificial Sequence: Synthetic peptide
  Seed: FVQENYLEY (MAGA3_HUMAN)
FKQENYLEL

SEQ ID NO: 58551 - protein, 10 aa, Artificial Sequence
  Description of Artificial Sequence: Synthetic peptide
  Seed: AALSRKVAEL (MAGA3_HUMAN)
ALLSRKVAEA

SEQ ID NO: 58552 - protein, 9 aa, Artificial Sequence
  Description of Artificial Sequence: Synthetic peptide
  Seed: YFFPVIFSK (MAGA3_HUMAN)
YYFPVIFSK

SEQ ID NO: 58553 - protein, 9 aa, Artificial Sequence
  Description of Artificial Sequence: Synthetic peptide
  Seed: VFEGREDSI (MAGA3_HUMAN)
VWEGREDSL

SEQ ID NO: 58554 - protein, 10 aa, Artificial Sequence
  Description of Artificial Sequence: Synthetic peptide
  Seed: KVAELVHFLL (MAGA3_HUMAN)
KLAELVHFLA

SEQ ID NO: 58555 - protein, 10 aa, Artificial Sequence
  Description of Artificial Sequence: Synthetic peptide
  Seed: RKVAELVHFL (MAGA3_HUMAN)
RPVAELVHFL

SEQ ID NO: 58556 - protein, 10 aa, Artificial Sequence
  Description of Artificial Sequence: Synthetic peptide
  Seed: FSKASSSLQL (MAGA3_HUMAN)
FVKASSSLQF

SEQ ID NO: 58557 - protein, 11 aa, Artificial Sequence
  Description of Artificial Sequence: Synthetic peptide
  Seed: MLGSVVGNWQY (MAGA3_HUMAN)
MEGSVVGNWQW

SEQ ID NO: 58558 - protein, 9 aa, Artificial Sequence
  Description of Artificial Sequence: Synthetic peptide
  Seed: SSSSTLVEV (MAGA3_HUMAN)
SQSSTLVEF

SEQ ID NO: 58559 - protein, 8 aa, Artificial Sequence
  Description of Artificial Sequence: Synthetic peptide
  Seed: AEMLGSVV (MAGA3_HUMAN)
AEMLGSVY

SEQ ID NO: 58560 - protein, 10 aa, Artificial Sequence
  Description of Artificial Sequence: Synthetic peptide
  Seed: ALSRKVAELV (MAGA3_HUMAN)
ALSRKVAELL

SEQ ID NO: 58561 - protein, 9 aa, Artificial Sequence
  Description of Artificial Sequence: Synthetic peptide
  Seed: LGDPKKLLT (MAGA3_HUMAN)
LIDPKKLLM

SEQ ID NO: 58562 - protein, 10 aa, Artificial Sequence
  Description of Artificial Sequence: Synthetic peptide
  Seed: MPKAGLLIIV (MAGA3_HUMAN)
MPKAGLLIIL

SEQ ID NO: 58563 - protein, 9 aa, Artificial Sequence
  Description of Artificial Sequence: Synthetic peptide
  Seed: LVHFLLLKY (MAGA3_HUMAN)
LMHFLLLKM

SEQ ID NO: 58564 - protein, 9 aa, Artificial Sequence
  Description of Artificial Sequence: Synthetic peptide
  Seed: IFSKASSSL (MAGA3_HUMAN)
IWSKASSSW

SEQ ID NO: 58565 - protein, 9 aa, Artificial Sequence
  Description of Artificial Sequence: Synthetic peptide
  Seed: KASSSLQLV (MAGA3_HUMAN)
KVSSSLQLY

SEQ ID NO: 58566 - protein, 10 aa, Artificial Sequence
  Description of Artificial Sequence: Synthetic peptide
  Seed: WEELSVLEVF (MAGA3_HUMAN)
WEELSVLEVL

SEQ ID NO: 58567 - protein, 10 aa, Artificial Sequence
  Description of Artificial Sequence: Synthetic peptide
  Seed: YFFPVIFSKA (MAGA3_HUMAN)
YVFPVIFSKL

SEQ ID NO: 58568 - protein, 10 aa, Artificial Sequence
  Description of Artificial Sequence: Synthetic peptide
  Seed: EMLGSVVGNW (MAGA3_HUMAN)
EALGSVVGNY

SEQ ID NO: 58569 - protein, 8 aa, Artificial Sequence
  Description of Artificial Sequence: Synthetic peptide
  Seed: KIWEELSV (MAGA3_HUMAN)
KLWEELSI

SEQ ID NO: 58570 - protein, 10 aa, Artificial Sequence
  Description of Artificial Sequence: Synthetic peptide
  Seed: HFLLLKYRAR (MAGA3_HUMAN)
HVLLLKYRAR

SEQ ID NO: 58571 - protein, 9 aa, Artificial Sequence
  Description of Artificial Sequence: Synthetic peptide
  Seed: AELVHFLLL (MAGA3_HUMAN)
AQLVHFLLI

SEQ ID NO: 58572 - protein, 10 aa, Artificial Sequence
  Description of Artificial Sequence: Synthetic peptide
  Seed: FLWGPRALVE (MAGA3_HUMAN)
FMWGPRALVC

SEQ ID NO: 58573 - protein, 9 aa, Artificial Sequence
  Description of Artificial Sequence: Synthetic peptide
  Seed: IIVLAIIAR (MAGA3_HUMAN)
IAVLAIIAR

SEQ ID NO: 58574 - protein, 9 aa, Artificial Sequence
  Description of Artificial Sequence: Synthetic peptide
  Seed: LGDPKKLLT (MAGA3_HUMAN)
LADPKKLLL

SEQ ID NO: 58575 - protein, 10 aa, Artificial Sequence
  Description of Artificial Sequence: Synthetic peptide
  Seed: SSSTLVEVTL (MAGA3_HUMAN)
SQSTLVEVTW

SEQ ID NO: 58576 - protein, 8 aa, Artificial Sequence
  Description of Artificial Sequence: Synthetic peptide
  Seed: AEMLGSVV (MAGA3_HUMAN)
AEMLGSVM

SEQ ID NO: 58577 - protein, 9 aa, Artificial Sequence
  Description of Artificial Sequence: Synthetic peptide
  Seed: KIWEELSVL (MAGA3_HUMAN)
KMWEELSVV

SEQ ID NO: 58578 - protein, 8 aa, Artificial Sequence
  Description of Artificial Sequence: Synthetic peptide
  Seed: FGIELMEV (MAGA3_HUMAN)
FQIELMEV

SEQ ID NO: 58579 - protein, 10 aa, Artificial Sequence
  Description of Artificial Sequence: Synthetic peptide
  Seed: WEELSVLEVF (MAGA3_HUMAN)
WSELSVLEVW

SEQ ID NO: 58580 - protein, 9 aa, Artificial Sequence
  Description of Artificial Sequence: Synthetic peptide
  Seed: SVVGNWQYF (MAGA3_HUMAN)
SAVGNWQYF

SEQ ID NO: 58581 - protein, 9 aa, Artificial Sequence
  Description of Artificial Sequence: Synthetic peptide
  Seed: EVDPIGHLY (MAGA3_HUMAN)
ELDPIGHLY

SEQ ID NO: 58582 - protein, 9 aa, Artificial Sequence
  Description of Artificial Sequence: Synthetic peptide
  Seed: KVAELVHFL (MAGA3_HUMAN)
KSAELVHFM

SEQ ID NO: 58583 - protein, 10 aa, Artificial Sequence
  Description of Artificial Sequence: Synthetic peptide
  Seed: MNYPLWSQSY (MAGA3_HUMAN)
MEYPLWSQSL

SEQ ID NO: 58584 - protein, 10 aa, Artificial Sequence
  Description of Artificial Sequence: Synthetic peptide
  Seed: HFVQENYLEY (MAGA3_HUMAN)
HPVQENYLEM

SEQ ID NO: 58585 - protein, 10 aa, Artificial Sequence
  Description of Artificial Sequence: Synthetic peptide
  Seed: IMPKAGLLII (MAGA3_HUMAN)
IMPKAGLLIV

SEQ ID NO: 58586 - protein, 9 aa, Artificial Sequence
  Description of Artificial Sequence: Synthetic peptide
  Seed: KASSSLQLV (MAGA3_HUMAN)
KASSSLQLI

SEQ ID NO: 58587 - protein, 10 aa, Artificial Sequence
  Description of Artificial Sequence: Synthetic peptide
  Seed: MNYPLWSQSY (MAGA3_HUMAN)
MCYPLWSQSF

SEQ ID NO: 58588 - protein, 10 aa, Artificial Sequence
  Description of Artificial Sequence: Synthetic peptide
  Seed: LGLVGAQAPA (MAGA3_HUMAN)
LNLVGAQAPL

SEQ ID NO: 58589 - protein, 10 aa, Artificial Sequence
  Description of Artificial Sequence: Synthetic peptide
  Seed: LGLVGAQAPA (MAGA3_HUMAN)
LSLVGAQAPV

SEQ ID NO: 58590 - protein, 10 aa, Artificial Sequence
  Description of Artificial Sequence: Synthetic peptide
  Seed: VDPIGHLYIF (MAGA3_HUMAN)
VYPIGHLYIF

SEQ ID NO: 58591 - protein, 11 aa, Artificial Sequence
  Description of Artificial Sequence: Synthetic peptide
  Seed: GEVPAAESPDP (MAGA3_HUMAN)
GEVPAAESPDA

SEQ ID NO: 58592 - protein, 10 aa, Artificial Sequence
  Description of Artificial Sequence: Synthetic peptide
  Seed: MNYPLWSQSY (MAGA3_HUMAN)
MVYPLWSQSF

SEQ ID NO: 58593 - protein, 9 aa, Artificial Sequence
  Description of Artificial Sequence: Synthetic peptide
  Seed: KVAELVHFL (MAGA3_HUMAN)
KMAELVHFM

SEQ ID NO: 58594 - protein, 9 aa, Artificial Sequence
  Description of Artificial Sequence: Synthetic peptide
  Seed: LESEFQAAL (MAGA3_HUMAN)
LKSEFQAAF

SEQ ID NO: 58595 - protein, 8 aa, Artificial Sequence
  Description of Artificial Sequence: Synthetic peptide
  Seed: EVDPIGHL (MAGA3_HUMAN)
EIDPIGHL

SEQ ID NO: 58596 - protein, 10 aa, Artificial Sequence
  Description of Artificial Sequence: Synthetic peptide
  Seed: ASSLPTTMNY (MAGA3_HUMAN)
AESLPTTMNW

SEQ ID NO: 58597 - protein, 9 aa, Artificial Sequence
  Description of Artificial Sequence: Synthetic peptide
  Seed: GSVVGNWQY (MAGA3_HUMAN)
GWVVGNWQY

SEQ ID NO: 58598 - protein, 10 aa, Artificial Sequence
  Description of Artificial Sequence: Synthetic peptide
  Seed: GSDPACYEFL (MAGA3_HUMAN)
GTDPACYEFY

SEQ ID NO: 58599 - protein, 9 aa, Artificial Sequence
  Description of Artificial Sequence: Synthetic peptide
  Seed: SSTLVEVTL (MAGA3_HUMAN)
SLTLVEVTV

SEQ ID NO: 58600 - protein, 9 aa, Artificial Sequence
  Description of Artificial Sequence: Synthetic peptide
  Seed: SSTLVEVTL (MAGA3_HUMAN)
SMTLVEVTL

SEQ ID NO: 58601 - protein, 11 aa, Artificial Sequence
  Description of Artificial Sequence: Synthetic peptide
  Seed: RQVPGSDPACY (MAGA3_HUMAN)
RLVPGSDPACL

SEQ ID NO: 58602 - protein, 9 aa, Artificial Sequence
  Description of Artificial Sequence: Synthetic peptide
  Seed: KIWEELSVL (MAGA3_HUMAN)
KAWEELSVW

SEQ ID NO: 58603 - protein, 9 aa, Artificial Sequence
  Description of Artificial Sequence: Synthetic peptide
  Seed: HLYIFATCL (MAGA3_HUMAN)
HNYIFATCF

SEQ ID NO: 58604 - protein, 10 aa, Artificial Sequence
  Description of Artificial Sequence: Synthetic peptide
  Seed: KVAELVHFLL (MAGA3_HUMAN)
KMAELVHFLC

SEQ ID NO: 58605 - protein, 10 aa, Artificial Sequence
  Description of Artificial Sequence: Synthetic peptide
  Seed: LQLVFGIELM (MAGA3_HUMAN)
LYLVFGIELI

SEQ ID NO: 58606 - protein, 10 aa, Artificial Sequence
  Description of Artificial Sequence: Synthetic peptide
  Seed: QYFFPVIFSK (MAGA3_HUMAN)
QVFFPVIFSR

SEQ ID NO: 58607 - protein, 9 aa, Artificial Sequence
  Description of Artificial Sequence: Synthetic peptide
  Seed: SSLPTTMNY (MAGA3_HUMAN)
SALPTTMNL

SEQ ID NO: 58608 - protein, 10 aa, Artificial Sequence
  Description of Artificial Sequence: Synthetic peptide
  Seed: KASSSLQLVF (MAGA3_HUMAN)
KSSSSLQLVW

SEQ ID NO: 58609 - protein, 9 aa, Artificial Sequence
  Description of Artificial Sequence: Synthetic peptide
  Seed: ASSSLQLVF (MAGA3_HUMAN)
AASSLQLVY

SEQ ID NO: 58610 - protein, 10 aa, Artificial Sequence
  Description of Artificial Sequence: Synthetic peptide
  Seed: ASSLPTTMNY (MAGA3_HUMAN)
AHSLPTTMNK

SEQ ID NO: 58611 - protein, 10 aa, Artificial Sequence
  Description of Artificial Sequence: Synthetic peptide
  Seed: KAEMLGSVVG (MAGA3_HUMAN)
KFEMLGSVVA

SEQ ID NO: 58612 - protein, 8 aa, Artificial Sequence
  Description of Artificial Sequence: Synthetic peptide
  Seed: FSKASSSL (MAGA3_HUMAN)
FSKASSSY

SEQ ID NO: 58613 - protein, 9 aa, Artificial Sequence
  Description of Artificial Sequence: Synthetic peptide
  Seed: SEFQAALSR (MAGA3_HUMAN)
SEFQAALSS

SEQ ID NO: 58614 - protein, 10 aa, Artificial Sequence
  Description of Artificial Sequence: Synthetic peptide
  Seed: RKVAELVHFL (MAGA3_HUMAN)
RAVAELVHFV

SEQ ID NO: 58615 - protein, 9 aa, Artificial Sequence
  Description of Artificial Sequence: Synthetic peptide
  Seed: EAASSSSTL (MAGA3_HUMAN)
EPASSSSTY

SEQ ID NO: 58616 - protein, 10 aa, Artificial Sequence
  Description of Artificial Sequence: Synthetic peptide
  Seed: AALSRKVAEL (MAGA3_HUMAN)
AVLSRKVAEV

SEQ ID NO: 58617 - protein, 9 aa, Artificial Sequence
  Description of Artificial Sequence: Synthetic peptide
  Seed: YIFATCLGL (MAGA3_HUMAN)
YSFATCLGM

SEQ ID NO: 58618 - protein, 10 aa, Artificial Sequence
  Description of Artificial Sequence: Synthetic peptide
  Seed: TSYVKVLHHM (MAGA3_HUMAN)
TPYVKVLHHF

SEQ ID NO: 58619 - protein, 9 aa, Artificial Sequence
  Description of Artificial Sequence: Synthetic peptide
  Seed: HLYIFATCL (MAGA3_HUMAN)
HSYIFATCF

SEQ ID NO: 58620 - protein, 9 aa, Artificial Sequence
  Description of Artificial Sequence: Synthetic peptide
  Seed: SVVGNWQYF (MAGA3_HUMAN)
SWVGNWQYW

SEQ ID NO: 58621 - protein, 9 aa, Artificial Sequence
  Description of Artificial Sequence: Synthetic peptide
  Seed: VVGNWQYFF (MAGA3_HUMAN)
VWGNWQYFV

SEQ ID NO: 58622 - protein, 9 aa, Artificial Sequence
  Description of Artificial Sequence: Synthetic peptide
  Seed: YIFATCLGL (MAGA3_HUMAN)
YIFATCLGF

SEQ ID NO: 58623 - protein, 11 aa, Artificial Sequence
  Description of Artificial Sequence: Synthetic peptide
  Seed: SKASSSLQLVF (MAGA3_HUMAN)
SHASSSLQLVW

SEQ ID NO: 58624 - protein, 8 aa, Artificial Sequence
  Description of Artificial Sequence: Synthetic peptide
  Seed: SYPPLHEW (MAGA3_HUMAN)
SFPPLHEL

SEQ ID NO: 58625 - protein, 11 aa, Artificial Sequence
  Description of Artificial Sequence: Synthetic peptide
  Seed: KIWEELSVLEV (MAGA3_HUMAN)
KMWEELSVLEA

SEQ ID NO: 58626 - protein, 9 aa, Artificial Sequence
  Description of Artificial Sequence: Synthetic peptide
  Seed: GSDPACYEF (MAGA3_HUMAN)
GADPACYEM

SEQ ID NO: 58627 - protein, 9 aa, Artificial Sequence
  Description of Artificial Sequence: Synthetic peptide
  Seed: IFSKASSSL (MAGA3_HUMAN)
ILSKASSSM

SEQ ID NO: 58628 - protein, 9 aa, Artificial Sequence
  Description of Artificial Sequence: Synthetic peptide
  Seed: SSLPTTMNY (MAGA3_HUMAN)
SFLPTTMNM

SEQ ID NO: 58629 - protein, 10 aa, Artificial Sequence
  Description of Artificial Sequence: Synthetic peptide
  Seed: FLWGPRALVE (MAGA3_HUMAN)
FMWGPRALVY

SEQ ID NO: 58630 - protein, 8 aa, Artificial Sequence
  Description of Artificial Sequence: Synthetic peptide
  Seed: LGDPKKLL (MAGA3_HUMAN)
LFDPKKLL

SEQ ID NO: 58631 - protein, 9 aa, Artificial Sequence
  Description of Artificial Sequence: Synthetic peptide
  Seed: QIMPKAGLL (MAGA3_HUMAN)
QMMPKAGLL

SEQ ID NO: 58632 - protein, 10 aa, Artificial Sequence
  Description of Artificial Sequence: Synthetic peptide
  Seed: MNYPLWSQSY (MAGA3_HUMAN)
MRYPLWSQSM

SEQ ID NO: 58633 - protein, 10 aa, Artificial Sequence
  Description of Artificial Sequence: Synthetic peptide
  Seed: LPTTMNYPLW (MAGA3_HUMAN)
LATTMNYPLY

SEQ ID NO: 58634 - protein, 9 aa, Artificial Sequence
  Description of Artificial Sequence: Synthetic peptide
  Seed: EVDPIGHLY (MAGA3_HUMAN)
EYDPIGHLL

SEQ ID NO: 58635 - protein, 10 aa, Artificial Sequence
  Description of Artificial Sequence: Synthetic peptide
  Seed: MNYPLWSQSY (MAGA3_HUMAN)
MQYPLWSQSY

SEQ ID NO: 58636 - protein, 10 aa, Artificial Sequence
  Description of Artificial Sequence: Synthetic peptide
  Seed: YRQVPGSDPA (MAGA3_HUMAN)
YPQVPGSDPV

SEQ ID NO: 58637 - protein, 9 aa, Artificial Sequence
  Description of Artificial Sequence: Synthetic peptide
  Seed: SSLQLVFGI (MAGA3_HUMAN)
STLQLVFGI

SEQ ID NO: 58638 - protein, 9 aa, Artificial Sequence
  Description of Artificial Sequence: Synthetic peptide
  Seed: FVQENYLEY (MAGA3_HUMAN)
FPQENYLEL

SEQ ID NO: 58639 - protein, 11 aa, Artificial Sequence
  Description of Artificial Sequence: Synthetic peptide
  Seed: SNQEEEGPSTF (MAGA3_HUMAN)
SSQEEEGPSTW

SEQ ID NO: 58640 - protein, 9 aa, Artificial Sequence
  Description of Artificial Sequence: Synthetic peptide
  Seed: FVQENYLEY (MAGA3_HUMAN)
FLQENYLER

SEQ ID NO: 58641 - protein, 10 aa, Artificial Sequence
  Description of Artificial Sequence: Synthetic peptide
  Seed: KASSSLQLVF (MAGA3_HUMAN)
KTSSSLQLVI

SEQ ID NO: 58642 - protein, 10 aa, Artificial Sequence
  Description of Artificial Sequence: Synthetic peptide
  Seed: STFPDLESEF (MAGA3_HUMAN)
SAFPDLESEW

SEQ ID NO: 58643 - protein, 9 aa, Artificial Sequence
  Description of Artificial Sequence: Synthetic peptide
  Seed: SSSSTLVEV (MAGA3_HUMAN)
SLSSTLVEI

SEQ ID NO: 58644 - protein, 9 aa, Artificial Sequence
  Description of Artificial Sequence: Synthetic peptide
  Seed: GSDPACYEF (MAGA3_HUMAN)
GMDPACYEW

SEQ ID NO: 58645 - protein, 9 aa, Artificial Sequence
  Description of Artificial Sequence: Synthetic peptide
  Seed: LGDPKKLLT (MAGA3_HUMAN)
LADPKKLLC

SEQ ID NO: 58646 - protein, 10 aa, Artificial Sequence
  Description of Artificial Sequence: Synthetic peptide
  Seed: RQVPGSDPAC (MAGA3_HUMAN)
RMVPGSDPAF

SEQ ID NO: 58647 - protein, 9 aa, Artificial Sequence
  Description of Artificial Sequence: Synthetic peptide
  Seed: FATCLGLSY (MAGA3_HUMAN)
FGTCLGLSM

SEQ ID NO: 58648 - protein, 9 aa, Artificial Sequence
  Description of Artificial Sequence: Synthetic peptide
  Seed: ISYPPLHEW (MAGA3_HUMAN)
IAYPPLHET

SEQ ID NO: 58649 - protein, 9 aa, Artificial Sequence
  Description of Artificial Sequence: Synthetic peptide
  Seed: FATCLGLSY (MAGA3_HUMAN)
FGTCLGLSW

SEQ ID NO: 58650 - protein, 9 aa, Artificial Sequence
  Description of Artificial Sequence: Synthetic peptide
  Seed: ISYPPLHEW (MAGA3_HUMAN)
IMYPPLHEL

SEQ ID NO: 58651 - protein, 10 aa, Artificial Sequence
  Description of Artificial Sequence: Synthetic peptide
  Seed: KISGGPHISY (MAGA3_HUMAN)
KSSGGPHISL

SEQ ID NO: 58652 - protein, 10 aa, Artificial Sequence
  Description of Artificial Sequence: Synthetic peptide
  Seed: MNYPLWSQSY (MAGA3_HUMAN)
MFYPLWSQSL

SEQ ID NO: 58653 - protein, 11 aa, Artificial Sequence
  Description of Artificial Sequence: Synthetic peptide
  Seed: YIFATCLGLSY (MAGA3_HUMAN)
YHFATCLGLSF

SEQ ID NO: 58654 - protein, 9 aa, Artificial Sequence
  Description of Artificial Sequence: Synthetic peptide
  Seed: SILGDPKKL (MAGA3_HUMAN)
SILGDPKKV

SEQ ID NO: 58655 - protein, 9 aa, Artificial Sequence
  Description of Artificial Sequence: Synthetic peptide
  Seed: KIWEELSVL (MAGA3_HUMAN)
KRWEELSVL

SEQ ID NO: 58656 - protein, 10 aa, Artificial Sequence
  Description of Artificial Sequence: Synthetic peptide
  Seed: LGSVVGNWQY (MAGA3_HUMAN)
LMSVVGNWQF

SEQ ID NO: 58657 - protein, 8 aa, Artificial Sequence
  Description of Artificial Sequence: Synthetic peptide
  Seed: SYPPLHEW (MAGA3_HUMAN)
SYPPLHEM

SEQ ID NO: 58658 - protein, 10 aa, Artificial Sequence
  Description of Artificial Sequence: Synthetic peptide
  Seed: KISGGPHISY (MAGA3_HUMAN)
KRSGGPHISY

SEQ ID NO: 58659 - protein, 9 aa, Artificial Sequence
  Description of Artificial Sequence: Synthetic peptide
  Seed: GDCAPEEKI (MAGA3_HUMAN)
GECAPEEKI

SEQ ID NO: 58660 - protein, 10 aa, Artificial Sequence
  Description of Artificial Sequence: Synthetic peptide
  Seed: KASSSLQLVF (MAGA3_HUMAN)
KESSSLQLVI

SEQ ID NO: 58661 - protein, 9 aa, Artificial Sequence
  Description of Artificial Sequence: Synthetic peptide
  Seed: RQVPGSDPA (MAGA3_HUMAN)
RNVPGSDPF

SEQ ID NO: 58662 - protein, 9 aa, Artificial Sequence
  Description of Artificial Sequence: Synthetic peptide
  Seed: KVAELVHFL (MAGA3_HUMAN)
KYAELVHFL

SEQ ID NO: 58663 - protein, 9 aa, Artificial Sequence
  Description of Artificial Sequence: Synthetic peptide
  Seed: VVGNWQYFF (MAGA3_HUMAN)
VAGNWQYFY

SEQ ID NO: 58664 - protein, 11 aa, Artificial Sequence
  Description of Artificial Sequence: Synthetic peptide
  Seed: REGDCAPEEKI (MAGA3_HUMAN)
RLGDCAPEEKW

SEQ ID NO: 58665 - protein, 9 aa, Artificial Sequence
  Description of Artificial Sequence: Synthetic peptide
  Seed: ELVHFLLLK (MAGA3_HUMAN)
EVVHFLLLK

SEQ ID NO: 58666 - protein, 10 aa, Artificial Sequence
  Description of Artificial Sequence: Synthetic peptide
  Seed: NWQYFFPVIF (MAGA3_HUMAN)
NPQYFFPVIF

SEQ ID NO: 58667 - protein, 10 aa, Artificial Sequence
  Description of Artificial Sequence: Synthetic peptide
  Seed: FVQENYLEYR (MAGA3_HUMAN)
FTQENYLEYK

SEQ ID NO: 58668 - protein, 9 aa, Artificial Sequence
  Description of Artificial Sequence: Synthetic peptide
  Seed: ISGGPHISY (MAGA3_HUMAN)
ISGGPHISM

SEQ ID NO: 58669 - protein, 9 aa, Artificial Sequence
  Description of Artificial Sequence: Synthetic peptide
  Seed: KIWEELSVL (MAGA3_HUMAN)
KIWEELSVV

SEQ ID NO: 58670 - protein, 9 aa, Artificial Sequence
  Description of Artificial Sequence: Synthetic peptide
  Seed: YIFATCLGL (MAGA3_HUMAN)
YTFATCLGK

SEQ ID NO: 58671 - protein, 9 aa, Artificial Sequence
  Description of Artificial Sequence: Synthetic peptide
  Seed: LSRKVAELV (MAGA3_HUMAN)
LTRKVAELM

SEQ ID NO: 58672 - protein, 8 aa, Artificial Sequence
  Description of Artificial Sequence: Synthetic peptide
  Seed: LGDPKKLL (MAGA3_HUMAN)
LFDPKKLI

SEQ ID NO: 58673 - protein, 11 aa, Artificial Sequence
  Description of Artificial Sequence: Synthetic peptide
  Seed: RALVETSYVKV (MAGA3_HUMAN)
RYLVETSYVKV

SEQ ID NO: 58674 - protein, 9 aa, Artificial Sequence
  Description of Artificial Sequence: Synthetic peptide
  Seed: QEEEGPSTF (MAGA3_HUMAN)
QYEEGPSTL

SEQ ID NO: 58675 - protein, 9 aa, Artificial Sequence
  Description of Artificial Sequence: Synthetic peptide
  Seed: FVQENYLEY (MAGA3_HUMAN)
FRQENYLEM

SEQ ID NO: 58676 - protein, 9 aa, Artificial Sequence
  Description of Artificial Sequence: Synthetic peptide
  Seed: RALVETSYV (MAGA3_HUMAN)
RLLVETSYW

SEQ ID NO: 58677 - protein, 9 aa, Artificial Sequence
  Description of Artificial Sequence: Synthetic peptide
  Seed: YVKVLHHMV (MAGA3_HUMAN)
YMKVLHHMV

SEQ ID NO: 58678 - protein, 11 aa, Artificial Sequence
  Description of Artificial Sequence: Synthetic peptide
  Seed: FLWGPRALVET (MAGA3_HUMAN)
FLWGPRALVEI

SEQ ID NO: 58679 - protein, 9 aa, Artificial Sequence
  Description of Artificial Sequence: Synthetic peptide
  Seed: GLVGAQAPA (MAGA3_HUMAN)
GIVGAQAPV

SEQ ID NO: 58680 - protein, 9 aa, Artificial Sequence
  Description of Artificial Sequence: Synthetic peptide
  Seed: MEVDPIGHL (MAGA3_HUMAN)
MGVDPIGHL

SEQ ID NO: 58681 - protein, 9 aa, Artificial Sequence
  Description of Artificial Sequence: Synthetic peptide
  Seed: GASSLPTTM (MAGA3_HUMAN)
GRSSLPTTV

SEQ ID NO: 58682 - protein, 10 aa, Artificial Sequence
  Description of Artificial Sequence: Synthetic peptide
  Seed: ISYPPLHEWV (MAGA3_HUMAN)
IRYPPLHEWF

SEQ ID NO: 58683 - protein, 9 aa, Artificial Sequence
  Description of Artificial Sequence: Synthetic peptide
  Seed: QEEEGPSTF (MAGA3_HUMAN)
QEEEGPSTA

SEQ ID NO: 58684 - protein, 10 aa, Artificial Sequence
  Description of Artificial Sequence: Synthetic peptide
  Seed: YLEYRQVPGS (MAGA3_HUMAN)
YVEYRQVPGV

SEQ ID NO: 58685 - protein, 10 aa, Artificial Sequence
  Description of Artificial Sequence: Synthetic peptide
  Seed: KASSSLQLVF (MAGA3_HUMAN)
KPSSSLQLVY

SEQ ID NO: 58686 - protein, 9 aa, Artificial Sequence
  Description of Artificial Sequence: Synthetic peptide
  Seed: TSYVKVLHH (MAGA3_HUMAN)
TVYVKVLHK

SEQ ID NO: 58687 - protein, 10 aa, Artificial Sequence
  Description of Artificial Sequence: Synthetic peptide
  Seed: GPRALVETSY (MAGA3_HUMAN)
GPRALVETSI

SEQ ID NO: 58688 - protein, 9 aa, Artificial Sequence
  Description of Artificial Sequence: Synthetic peptide
  Seed: SVVGNWQYF (MAGA3_HUMAN)
SYVGNWQYF

SEQ ID NO: 58689 - protein, 9 aa, Artificial Sequence
  Description of Artificial Sequence: Synthetic peptide
  Seed: NQIMPKAGL (MAGA3_HUMAN)
NAIMPKAGY

SEQ ID NO: 58690 - protein, 10 aa, Artificial Sequence
  Description of Artificial Sequence: Synthetic peptide
  Seed: VDPIGHLYIF (MAGA3_HUMAN)
VDPIGHLYIY

SEQ ID NO: 58691 - protein, 9 aa, Artificial Sequence
  Description of Artificial Sequence: Synthetic peptide
  Seed: SSLPTTMNY (MAGA3_HUMAN)
SKLPTTMNM

SEQ ID NO: 58692 - protein, 9 aa, Artificial Sequence
  Description of Artificial Sequence: Synthetic peptide
  Seed: GSDPACYEF (MAGA3_HUMAN)
GADPACYEL

SEQ ID NO: 58693 - protein, 10 aa, Artificial Sequence
  Description of Artificial Sequence: Synthetic peptide
  Seed: RQVPGSDPAC (MAGA3_HUMAN)
RSVPGSDPAF

SEQ ID NO: 58694 - protein, 11 aa, Artificial Sequence
  Description of Artificial Sequence: Synthetic peptide
  Seed: SPQGASSLPTT (MAGA3_HUMAN)
SPQGASSLPTI

SEQ ID NO: 58695 - protein, 10 aa, Artificial Sequence
  Description of Artificial Sequence: Synthetic peptide
  Seed: DLESEFQAAL (MAGA3_HUMAN)
DFESEFQAAF

SEQ ID NO: 58696 - protein, 9 aa, Artificial Sequence
  Description of Artificial Sequence: Synthetic peptide
  Seed: ALSRKVAEL (MAGA3_HUMAN)
ATSRKVAEM

SEQ ID NO: 58697 - protein, 11 aa, Artificial Sequence
  Description of Artificial Sequence: Synthetic peptide
  Seed: KIWEELSVLEV (MAGA3_HUMAN)
KMWEELSVLEI

SEQ ID NO: 58698 - protein, 10 aa, Artificial Sequence
  Description of Artificial Sequence: Synthetic peptide
  Seed: ASSLPTTMNY (MAGA3_HUMAN)
ATSLPTTMNF

SEQ ID NO: 58699 - protein, 9 aa, Artificial Sequence
  Description of Artificial Sequence: Synthetic peptide
  Seed: FATCLGLSY (MAGA3_HUMAN)
FQTCLGLSF

SEQ ID NO: 58700 - protein, 10 aa, Artificial Sequence
  Description of Artificial Sequence: Synthetic peptide
  Seed: TLVEVTLGEV (MAGA3_HUMAN)
TLVEVTLGEL

SEQ ID NO: 58701 - protein, 9 aa, Artificial Sequence
  Description of Artificial Sequence: Synthetic peptide
  Seed: LSRKVAELV (MAGA3_HUMAN)
LARKVAELY

SEQ ID NO: 58702 - protein, 10 aa, Artificial Sequence
  Description of Artificial Sequence: Synthetic peptide
  Seed: QYFFPVIFSK (MAGA3_HUMAN)
QIFFPVIFSK

SEQ ID NO: 58703 - protein, 10 aa, Artificial Sequence
  Description of Artificial Sequence: Synthetic peptide
  Seed: MEVDPIGHLY (MAGA3_HUMAN)
MMVDPIGHLI

SEQ ID NO: 58704 - protein, 9 aa, Artificial Sequence
  Description of Artificial Sequence: Synthetic peptide
  Seed: ISYPPLHEW (MAGA3_HUMAN)
IEYPPLHEW

SEQ ID NO: 58705 - protein, 9 aa, Artificial Sequence
  Description of Artificial Sequence: Synthetic peptide
  Seed: SSLQLVFGI (MAGA3_HUMAN)
SILQLVFGA

SEQ ID NO: 58706 - protein, 10 aa, Artificial Sequence
  Description of Artificial Sequence: Synthetic peptide
  Seed: KVAELVHFLL (MAGA3_HUMAN)
KQAELVHFLW

SEQ ID NO: 58707 - protein, 8 aa, Artificial Sequence
  Description of Artificial Sequence: Synthetic peptide
  Seed: EELSVLEV (MAGA3_HUMAN)
EELSVLEL

SEQ ID NO: 58708 - protein, 10 aa, Artificial Sequence
  Description of Artificial Sequence: Synthetic peptide
  Seed: TSYVKVLHHM (MAGA3_HUMAN)
TLYVKVLHHF

SEQ ID NO: 58709 - protein, 10 aa, Artificial Sequence
  Description of Artificial Sequence: Synthetic peptide
  Seed: KVAELVHFLL (MAGA3_HUMAN)
KIAELVHFLI

SEQ ID NO: 58710 - protein, 9 aa, Artificial Sequence
  Description of Artificial Sequence: Synthetic peptide
  Seed: YIFATCLGL (MAGA3_HUMAN)
YVFATCLGY

SEQ ID NO: 58711 - protein, 9 aa, Artificial Sequence
  Description of Artificial Sequence: Synthetic peptide
  Seed: SKASSSLQL (MAGA3_HUMAN)
STASSSLQF

SEQ ID NO: 58712 - protein, 9 aa, Artificial Sequence
  Description of Artificial Sequence: Synthetic peptide
  Seed: QSPQGASSL (MAGA3_HUMAN)
QVPQGASSI

SEQ ID NO: 58713 - protein, 9 aa, Artificial Sequence
  Description of Artificial Sequence: Synthetic peptide
  Seed: MEVDPIGHL (MAGA3_HUMAN)
MSVDPIGHY

SEQ ID NO: 58714 - protein, 9 aa, Artificial Sequence
  Description of Artificial Sequence: Synthetic peptide
  Seed: ASSSLQLVF (MAGA3_HUMAN)
AKSSLQLVY

SEQ ID NO: 58715 - protein, 10 aa, Artificial Sequence
  Description of Artificial Sequence: Synthetic peptide
  Seed: RQVPGSDPAC (MAGA3_HUMAN)
RIVPGSDPAW

SEQ ID NO: 58716 - protein, 9 aa, Artificial Sequence
  Description of Artificial Sequence: Synthetic peptide
  Seed: VFEGREDSI (MAGA3_HUMAN)
VTEGREDSL

SEQ ID NO: 58717 - protein, 9 aa, Artificial Sequence
  Description of Artificial Sequence: Synthetic peptide
  Seed: KVAELVHFL (MAGA3_HUMAN)
KQAELVHFC

SEQ ID NO: 58718 - protein, 10 aa, Artificial Sequence
  Description of Artificial Sequence: Synthetic peptide
  Seed: SYPPLHEWVL (MAGA3_HUMAN)
SYPPLHEWVW

SEQ ID NO: 58719 - protein, 9 aa, Artificial Sequence
  Description of Artificial Sequence: Synthetic peptide
  Seed: QHFVQENYL (MAGA3_HUMAN)
QRFVQENYF

SEQ ID NO: 58720 - protein, 10 aa, Artificial Sequence
  Description of Artificial Sequence: Synthetic peptide
  Seed: SVVGNWQYFF (MAGA3_HUMAN)
SFVGNWQYFL

SEQ ID NO: 58721 - protein, 9 aa, Artificial Sequence
  Description of Artificial Sequence: Synthetic peptide
  Seed: ASSSLQLVF (MAGA3_HUMAN)
AQSSLQLVY

SEQ ID NO: 58722 - protein, 9 aa, Artificial Sequence
  Description of Artificial Sequence: Synthetic peptide
  Seed: LPTTMNYPL (MAGA3_HUMAN)
LVTTMNYPM

SEQ ID NO: 58723 - protein, 10 aa, Artificial Sequence
  Description of Artificial Sequence: Synthetic peptide
  Seed: TEEQEAASSS (MAGA3_HUMAN)
TEEQEAASSV

SEQ ID NO: 58724 - protein, 9 aa, Artificial Sequence
  Description of Artificial Sequence: Synthetic peptide
  Seed: KVLHHMVKI (MAGA3_HUMAN)
KILHHMVKY

SEQ ID NO: 58725 - protein, 9 aa, Artificial Sequence
  Description of Artificial Sequence: Synthetic peptide
  Seed: IMPKAGLLI (MAGA3_HUMAN)
IIPKAGLLM

SEQ ID NO: 58726 - protein, 10 aa, Artificial Sequence
  Description of Artificial Sequence: Synthetic peptide
  Seed: ASSSSTLVEV (MAGA3_HUMAN)
AASSSTLVEY

SEQ ID NO: 58727 - protein, 9 aa, Artificial Sequence
  Description of Artificial Sequence: Synthetic peptide
  Seed: FATCLGLSY (MAGA3_HUMAN)
FPTCLGLSF

SEQ ID NO: 58728 - protein, 9 aa, Artificial Sequence
  Description of Artificial Sequence: Synthetic peptide
  Seed: HLYIFATCL (MAGA3_HUMAN)
HRYIFATCM

SEQ ID NO: 58729 - protein, 9 aa, Artificial Sequence
  Description of Artificial Sequence: Synthetic peptide
  Seed: IAREGDCAP (MAGA3_HUMAN)
IAREGDCAM

SEQ ID NO: 58730 - protein, 11 aa, Artificial Sequence
  Description of Artificial Sequence: Synthetic peptide
  Seed: RQVPGSDPACY (MAGA3_HUMAN)
RWVPGSDPACY

SEQ ID NO: 58731 - protein, 11 aa, Artificial Sequence
  Description of Artificial Sequence: Synthetic peptide
  Seed: AQAPATEEQEA (MAGA3_HUMAN)
AQAPATEEQEF

SEQ ID NO: 58732 - protein, 9 aa, Artificial Sequence
  Description of Artificial Sequence: Synthetic peptide
  Seed: FATCLGLSY (MAGA3_HUMAN)
FATCLGLSK

SEQ ID NO: 58733 - protein, 10 aa, Artificial Sequence
  Description of Artificial Sequence: Synthetic peptide
  Seed: DLESEFQAAL (MAGA3_HUMAN)
DYESEFQAAY

SEQ ID NO: 58734 - protein, 9 aa, Artificial Sequence
  Description of Artificial Sequence: Synthetic peptide
  Seed: FVQENYLEY (MAGA3_HUMAN)
FLQENYLEM

SEQ ID NO: 58735 - protein, 8 aa, Artificial Sequence
  Description of Artificial Sequence: Synthetic peptide
  Seed: FPDLESEF (MAGA3_HUMAN)
FVDLESEM

SEQ ID NO: 58736 - protein, 9 aa, Artificial Sequence
  Description of Artificial Sequence: Synthetic peptide
  Seed: ASSSLQLVF (MAGA3_HUMAN)
ARSSLQLVI

SEQ ID NO: 58737 - protein, 10 aa, Artificial Sequence
  Description of Artificial Sequence: Synthetic peptide
  Seed: HFVQENYLEY (MAGA3_HUMAN)
HRVQENYLEF

SEQ ID NO: 58738 - protein, 10 aa, Artificial Sequence
  Description of Artificial Sequence: Synthetic peptide
  Seed: AELVHFLLLK (MAGA3_HUMAN)
AILVHFLLLK

SEQ ID NO: 58739 - protein, 10 aa, Artificial Sequence
  Description of Artificial Sequence: Synthetic peptide
  Seed: LGSVVGNWQY (MAGA3_HUMAN)
LNSVVGNWQW

SEQ ID NO: 58740 - protein, 9 aa, Artificial Sequence
  Description of Artificial Sequence: Synthetic peptide
  Seed: RQVPGSDPA (MAGA3_HUMAN)
RTVPGSDPL

SEQ ID NO: 58741 - protein, 9 aa, Artificial Sequence
  Description of Artificial Sequence: Synthetic peptide
  Seed: LVHFLLLKY (MAGA3_HUMAN)
LIHFLLLKY

SEQ ID NO: 58742 - protein, 9 aa, Artificial Sequence
  Description of Artificial Sequence: Synthetic peptide
  Seed: GSDPACYEF (MAGA3_HUMAN)
GIDPACYEI

SEQ ID NO: 58743 - protein, 9 aa, Artificial Sequence
  Description of Artificial Sequence: Synthetic peptide
  Seed: TFPDLESEF (MAGA3_HUMAN)
TIPDLESEV

SEQ ID NO: 58744 - protein, 10 aa, Artificial Sequence
  Description of Artificial Sequence: Synthetic peptide
  Seed: VDPIGHLYIF (MAGA3_HUMAN)
VEPIGHLYIW

SEQ ID NO: 58745 - protein, 8 aa, Artificial Sequence
  Description of Artificial Sequence: Synthetic peptide
  Seed: ILGDPKKL (MAGA3_HUMAN)
IAGDPKKY

SEQ ID NO: 58746 - protein, 9 aa, Artificial Sequence
  Description of Artificial Sequence: Synthetic peptide
  Seed: SYVKVLHHM (MAGA3_HUMAN)
SAVKVLHHY

SEQ ID NO: 58747 - protein, 9 aa, Artificial Sequence
  Description of Artificial Sequence: Synthetic peptide
  Seed: FPVIFSKAS (MAGA3_HUMAN)
FPVIFSKAT

SEQ ID NO: 58748 - protein, 9 aa, Artificial Sequence
  Description of Artificial Sequence: Synthetic peptide
  Seed: QEEEGPSTF (MAGA3_HUMAN)
QAEEGPSTF

SEQ ID NO: 58749 - protein, 9 aa, Artificial Sequence
  Description of Artificial Sequence: Synthetic peptide
  Seed: ALSRKVAEL (MAGA3_HUMAN)
AVSRKVAEL

SEQ ID NO: 58750 - protein, 9 aa, Artificial Sequence
  Description of Artificial Sequence: Synthetic peptide
  Seed: SSSSTLVEV (MAGA3_HUMAN)
SGSSTLVEL

SEQ ID NO: 58751 - protein, 10 aa, Artificial Sequence
  Description of Artificial Sequence: Synthetic peptide
  Seed: RKVAELVHFL (MAGA3_HUMAN)
RQVAELVHFM

SEQ ID NO: 58752 - protein, 9 aa, Artificial Sequence
  Description of Artificial Sequence: Synthetic peptide
  Seed: EAASSSSTL (MAGA3_HUMAN)
ELASSSSTK

SEQ ID NO: 58753 - protein, 10 aa, Artificial Sequence
  Description of Artificial Sequence: Synthetic peptide
  Seed: LQLVFGIELM (MAGA3_HUMAN)
LELVFGIELV

SEQ ID NO: 58754 - protein, 10 aa, Artificial Sequence
  Description of Artificial Sequence: Synthetic peptide
  Seed: ASSSLQLVFG (MAGA3_HUMAN)
ASSSLQLVFW

SEQ ID NO: 58755 - protein, 10 aa, Artificial Sequence
  Description of Artificial Sequence: Synthetic peptide
  Seed: SEFQAALSRK (MAGA3_HUMAN)
SLFQAALSRR

SEQ ID NO: 58756 - protein, 10 aa, Artificial Sequence
  Description of Artificial Sequence: Synthetic peptide
  Seed: LVFGIELMEV (MAGA3_HUMAN)
LLFGIELMEL

SEQ ID NO: 58757 - protein, 11 aa, Artificial Sequence
  Description of Artificial Sequence: Synthetic peptide
  Seed: RQVPGSDPACY (MAGA3_HUMAN)
RMVPGSDPACW

SEQ ID NO: 58758 - protein, 11 aa, Artificial Sequence
  Description of Artificial Sequence: Synthetic peptide
  Seed: ELSVLEVFEGR (MAGA3_HUMAN)
EISVLEVFEGR

SEQ ID NO: 58759 - protein, 11 aa, Artificial Sequence
  Description of Artificial Sequence: Synthetic peptide
  Seed: SSSSTLVEVTL (MAGA3_HUMAN)
SASSTLVEVTW

SEQ ID NO: 58760 - protein, 11 aa, Artificial Sequence
  Description of Artificial Sequence: Synthetic peptide
  Seed: VKISGGPHISY (MAGA3_HUMAN)
VQISGGPHISY

SEQ ID NO: 58761 - protein, 10 aa, Artificial Sequence
  Description of Artificial Sequence: Synthetic peptide
  Seed: HFLLLKYRAR (MAGA3_HUMAN)
HTLLLKYRAR

SEQ ID NO: 58762 - protein, 10 aa, Artificial Sequence
  Description of Artificial Sequence: Synthetic peptide
  Seed: ASSLPTTMNY (MAGA3_HUMAN)
AWSLPTTMNW

SEQ ID NO: 58763 - protein, 9 aa, Artificial Sequence
  Description of Artificial Sequence: Synthetic peptide
  Seed: GLLIIVLAI (MAGA3_HUMAN)
GQLIIVLAI

SEQ ID NO: 58764 - protein, 8 aa, Artificial Sequence
  Description of Artificial Sequence: Synthetic peptide
  Seed: LSRKVAEL (MAGA3_HUMAN)
LQRKVAEI

SEQ ID NO: 58765 - protein, 10 aa, Artificial Sequence
  Description of Artificial Sequence: Synthetic peptide
  Seed: MVKISGGPHI (MAGA3_HUMAN)
MDKISGGPHY

SEQ ID NO: 58766 - protein, 10 aa, Artificial Sequence
  Description of Artificial Sequence: Synthetic peptide
  Seed: NWQYFFPVIF (MAGA3_HUMAN)
NIQYFFPVIY

SEQ ID NO: 58767 - protein, 9 aa, Artificial Sequence
  Description of Artificial Sequence: Synthetic peptide
  Seed: SKASSSLQL (MAGA3_HUMAN)
SMASSSLQY

SEQ ID NO: 58768 - protein, 9 aa, Artificial Sequence
  Description of Artificial Sequence: Synthetic peptide
  Seed: ALSRKVAEL (MAGA3_HUMAN)
ARSRKVAEF

SEQ ID NO: 58769 - protein, 9 aa, Artificial Sequence
  Description of Artificial Sequence: Synthetic peptide
  Seed: EFQAALSRK (MAGA3_HUMAN)
EVQAALSRR

SEQ ID NO: 58770 - protein, 9 aa, Artificial Sequence
  Description of Artificial Sequence: Synthetic peptide
  Seed: FQAALSRKV (MAGA3_HUMAN)
FTAALSRKM

SEQ ID NO: 58771 - protein, 10 aa, Artificial Sequence
  Description of Artificial Sequence: Synthetic peptide
  Seed: RQVPGSDPAC (MAGA3_HUMAN)
RVVPGSDPAL

SEQ ID NO: 58772 - protein, 9 aa, Artificial Sequence
  Description of Artificial Sequence: Synthetic peptide
  Seed: FQAALSRKV (MAGA3_HUMAN)
FQAALSRKL

SEQ ID NO: 58773 - protein, 9 aa, Artificial Sequence
  Description of Artificial Sequence: Synthetic peptide
  Seed: SSSSTLVEV (MAGA3_HUMAN)
SGSSTLVEW

SEQ ID NO: 58774 - protein, 10 aa, Artificial Sequence
  Description of Artificial Sequence: Synthetic peptide
  Seed: LVFGIELMEV (MAGA3_HUMAN)
LIFGIELMEL

SEQ ID NO: 58775 - protein, 10 aa, Artificial Sequence
  Description of Artificial Sequence: Synthetic peptide
  Seed: GHLYIFATCL (MAGA3_HUMAN)
GLLYIFATCL

SEQ ID NO: 58776 - protein, 10 aa, Artificial Sequence
  Description of Artificial Sequence: Synthetic peptide
  Seed: SLPTTMNYPL (MAGA3_HUMAN)
SMPTTMNYPL

SEQ ID NO: 58777 - protein, 10 aa, Artificial Sequence
  Description of Artificial Sequence: Synthetic peptide
  Seed: MVKISGGPHI (MAGA3_HUMAN)
MMKISGGPHK

SEQ ID NO: 58778 - protein, 10 aa, Artificial Sequence
  Description of Artificial Sequence: Synthetic peptide
  Seed: NWQYFFPVIF (MAGA3_HUMAN)
NVQYFFPVIY

SEQ ID NO: 58779 - protein, 9 aa, Artificial Sequence
  Description of Artificial Sequence: Synthetic peptide
  Seed: ISGGPHISY (MAGA3_HUMAN)
ITGGPHISK

SEQ ID NO: 58780 - protein, 11 aa, Artificial Sequence
  Description of Artificial Sequence: Synthetic peptide
  Seed: MEVDPIGHLYI (MAGA3_HUMAN)
MEVDPIGHLYF

SEQ ID NO: 58781 - protein, 11 aa, Artificial Sequence
  Description of Artificial Sequence: Synthetic peptide
  Seed: SNQEEEGPSTF (MAGA3_HUMAN)
SMQEEEGPSTL

SEQ ID NO: 58782 - protein, 10 aa, Artificial Sequence
  Description of Artificial Sequence: Synthetic peptide
  Seed: MNYPLWSQSY (MAGA3_HUMAN)
MAYPLWSQSL

SEQ ID NO: 58783 - protein, 9 aa, Artificial Sequence
  Description of Artificial Sequence: Synthetic peptide
  Seed: GSDPACYEF (MAGA3_HUMAN)
GTDPACYEV

SEQ ID NO: 58784 - protein, 10 aa, Artificial Sequence
  Description of Artificial Sequence: Synthetic peptide
  Seed: ISYPPLHEWV (MAGA3_HUMAN)
IAYPPLHEWI

SEQ ID NO: 58785 - protein, 9 aa, Artificial Sequence
  Description of Artificial Sequence: Synthetic peptide
  Seed: KASSSLQLV (MAGA3_HUMAN)
KSSSSLQLV

SEQ ID NO: 58786 - protein, 10 aa, Artificial Sequence
  Description of Artificial Sequence: Synthetic peptide
  Seed: DLESEFQAAL (MAGA3_HUMAN)
DVESEFQAAF

SEQ ID NO: 58787 - protein, 9 aa, Artificial Sequence
  Description of Artificial Sequence: Synthetic peptide
  Seed: EARGEALGL (MAGA3_HUMAN)
EVRGEALGW

SEQ ID NO: 58788 - protein, 9 aa, Artificial Sequence
  Description of Artificial Sequence: Synthetic peptide
  Seed: YFFPVIFSK (MAGA3_HUMAN)
YAFPVIFSV

SEQ ID NO: 58789 - protein, 10 aa, Artificial Sequence
  Description of Artificial Sequence: Synthetic peptide
  Seed: IFATCLGLSY (MAGA3_HUMAN)
IYATCLGLSM

SEQ ID NO: 58790 - protein, 9 aa, Artificial Sequence
  Description of Artificial Sequence: Synthetic peptide
  Seed: SKASSSLQL (MAGA3_HUMAN)
SVASSSLQF

SEQ ID NO: 58791 - protein, 9 aa, Artificial Sequence
  Description of Artificial Sequence: Synthetic peptide
  Seed: AASSSSTLV (MAGA3_HUMAN)
AQSSSSTLV

SEQ ID NO: 58792 - protein, 9 aa, Artificial Sequence
  Description of Artificial Sequence: Synthetic peptide
  Seed: IMPKAGLLI (MAGA3_HUMAN)
IMPKAGLLL

SEQ ID NO: 58793 - protein, 10 aa, Artificial Sequence
  Description of Artificial Sequence: Synthetic peptide
  Seed: LQLVFGIELM (MAGA3_HUMAN)
LGLVFGIELV

SEQ ID NO: 58794 - protein, 9 aa, Artificial Sequence
  Description of Artificial Sequence: Synthetic peptide
  Seed: LESEFQAAL (MAGA3_HUMAN)
LTSEFQAAV

SEQ ID NO: 58795 - protein, 9 aa, Artificial Sequence
  Description of Artificial Sequence: Synthetic peptide
  Seed: SKASSSLQL (MAGA3_HUMAN)
SKASSSLQM

SEQ ID NO: 58796 - protein, 9 aa, Artificial Sequence
  Description of Artificial Sequence: Synthetic peptide
  Seed: MPKAGLLII (MAGA3_HUMAN)
MVKAGLLIF

SEQ ID NO: 58797 - protein, 10 aa, Artificial Sequence
  Description of Artificial Sequence: Synthetic peptide
  Seed: KASSSLQLVF (MAGA3_HUMAN)
KSSSSLQLVI

SEQ ID NO: 58798 - protein, 9 aa, Artificial Sequence
  Description of Artificial Sequence: Synthetic peptide
  Seed: TSYVKVLHH (MAGA3_HUMAN)
TGYVKVLHM

SEQ ID NO: 58799 - protein, 9 aa, Artificial Sequence
  Description of Artificial Sequence: Synthetic peptide
  Seed: FQAALSRKV (MAGA3_HUMAN)
FSAALSRKY

SEQ ID NO: 58800 - protein, 9 aa, Artificial Sequence
  Description of Artificial Sequence: Synthetic peptide
  Seed: MEVDPIGHL (MAGA3_HUMAN)
MRVDPIGHY

SEQ ID NO: 58801 - protein, 11 aa, Artificial Sequence
  Description of Artificial Sequence: Synthetic peptide
  Seed: SLPTTMNYPLW (MAGA3_HUMAN)
SWPTTMNYPLW

SEQ ID NO: 58802 - protein, 10 aa, Artificial Sequence
  Description of Artificial Sequence: Synthetic peptide
  Seed: SVVGNWQYFF (MAGA3_HUMAN)
SFVGNWQYFF

SEQ ID NO: 58803 - protein, 9 aa, Artificial Sequence
  Description of Artificial Sequence: Synthetic peptide
  Seed: KVLHHMVKI (MAGA3_HUMAN)
KSLHHMVKK

SEQ ID NO: 58804 - protein, 9 aa, Artificial Sequence
  Description of Artificial Sequence: Synthetic peptide
  Seed: FVQENYLEY (MAGA3_HUMAN)
FPQENYLEV

SEQ ID NO: 58805 - protein, 8 aa, Artificial Sequence
  Description of Artificial Sequence: Synthetic peptide
  Seed: FSKASSSL (MAGA3_HUMAN)
FAKASSSF

SEQ ID NO: 58806 - protein, 10 aa, Artificial Sequence
  Description of Artificial Sequence: Synthetic peptide
  Seed: KASSSLQLVF (MAGA3_HUMAN)
KDSSSLQLVF

SEQ ID NO: 58807 - protein, 9 aa, Artificial Sequence
  Description of Artificial Sequence: Synthetic peptide
  Seed: LESEFQAAL (MAGA3_HUMAN)
LISEFQAAY

SEQ ID NO: 58808 - protein, 9 aa, Artificial Sequence
  Description of Artificial Sequence: Synthetic peptide
  Seed: RQVPGSDPA (MAGA3_HUMAN)
RQVPGSDPI

SEQ ID NO: 58809 - protein, 9 aa, Artificial Sequence
  Description of Artificial Sequence: Synthetic peptide
  Seed: VTKAEMLGS (MAGA3_HUMAN)
VTKAEMLGK

SEQ ID NO: 58810 - protein, 9 aa, Artificial Sequence
  Description of Artificial Sequence: Synthetic peptide
  Seed: LESEFQAAL (MAGA3_HUMAN)
LASEFQAAV

SEQ ID NO: 58811 - protein, 10 aa, Artificial Sequence
  Description of Artificial Sequence: Synthetic peptide
  Seed: EFLWGPRALV (MAGA3_HUMAN)
ETLWGPRALI

SEQ ID NO: 58812 - protein, 9 aa, Artificial Sequence
  Description of Artificial Sequence: Synthetic peptide
  Seed: FATCLGLSY (MAGA3_HUMAN)
FHTCLGLSY

SEQ ID NO: 58813 - protein, 9 aa, Artificial Sequence
  Description of Artificial Sequence: Synthetic peptide
  Seed: IIVLAIIAR (MAGA3_HUMAN)
IAVLAIIAM

SEQ ID NO: 58814 - protein, 9 aa, Artificial Sequence
  Description of Artificial Sequence: Synthetic peptide
  Seed: QSPQGASSL (MAGA3_HUMAN)
QIPQGASSY

SEQ ID NO: 58815 - protein, 10 aa, Artificial Sequence
  Description of Artificial Sequence: Synthetic peptide
  Seed: EALGLVGAQA (MAGA3_HUMAN)
ETLGLVGAQI

SEQ ID NO: 58816 - protein, 9 aa, Artificial Sequence
  Description of Artificial Sequence: Synthetic peptide
  Seed: SVVGNWQYF (MAGA3_HUMAN)
SQVGNWQYM

SEQ ID NO: 58817 - protein, 9 aa, Artificial Sequence
  Description of Artificial Sequence: Synthetic peptide
  Seed: TFPDLESEF (MAGA3_HUMAN)
TQPDLESEL

SEQ ID NO: 58818 - protein, 11 aa, Artificial Sequence
  Description of Artificial Sequence: Synthetic peptide
  Seed: SRKVAELVHFL (MAGA3_HUMAN)
SAKVAELVHFV

SEQ ID NO: 58819 - protein, 10 aa, Artificial Sequence
  Description of Artificial Sequence: Synthetic peptide
  Seed: STFPDLESEF (MAGA3_HUMAN)
SSFPDLESEF

SEQ ID NO: 58820 - protein, 11 aa, Artificial Sequence
  Description of Artificial Sequence: Synthetic peptide
  Seed: VKISGGPHISY (MAGA3_HUMAN)
VMISGGPHISF

SEQ ID NO: 58821 - protein, 10 aa, Artificial Sequence
  Description of Artificial Sequence: Synthetic peptide
  Seed: MEVDPIGHLY (MAGA3_HUMAN)
MEVDPIGHLL

SEQ ID NO: 58822 - protein, 9 aa, Artificial Sequence
  Description of Artificial Sequence: Synthetic peptide
  Seed: QIMPKAGLL (MAGA3_HUMAN)
QIMPKAGLW

SEQ ID NO: 58823 - protein, 10 aa, Artificial Sequence
  Description of Artificial Sequence: Synthetic peptide
  Seed: LGLVGAQAPA (MAGA3_HUMAN)
LYLVGAQAPI

SEQ ID NO: 58824 - protein, 9 aa, Artificial Sequence
  Description of Artificial Sequence: Synthetic peptide
  Seed: LESEFQAAL (MAGA3_HUMAN)
LQSEFQAAH

SEQ ID NO: 58825 - protein, 9 aa, Artificial Sequence
  Description of Artificial Sequence: Synthetic peptide
  Seed: AELVHFLLL (MAGA3_HUMAN)
ARLVHFLLF

SEQ ID NO: 58826 - protein, 9 aa, Artificial Sequence
  Description of Artificial Sequence: Synthetic peptide
  Seed: GNWQYFFPV (MAGA3_HUMAN)
GLWQYFFPV

SEQ ID NO: 58827 - protein, 10 aa, Artificial Sequence
  Description of Artificial Sequence: Synthetic peptide
  Seed: KASSSLQLVF (MAGA3_HUMAN)
KESSSLQLVM

SEQ ID NO: 58828 - protein, 10 aa, Artificial Sequence
  Description of Artificial Sequence: Synthetic peptide
  Seed: RQVPGSDPAC (MAGA3_HUMAN)
RIVPGSDPAF

SEQ ID NO: 58829 - protein, 9 aa, Artificial Sequence
  Description of Artificial Sequence: Synthetic peptide
  Seed: ISYPPLHEW (MAGA3_HUMAN)
ICYPPLHEF

SEQ ID NO: 58830 - protein, 9 aa, Artificial Sequence
  Description of Artificial Sequence: Synthetic peptide
  Seed: TQHFVQENY (MAGA3_HUMAN)
TLHFVQENY

SEQ ID NO: 58831 - protein, 9 aa, Artificial Sequence
  Description of Artificial Sequence: Synthetic peptide
  Seed: SILGDPKKL (MAGA3_HUMAN)
SQLGDPKKI

SEQ ID NO: 58832 - protein, 9 aa, Artificial Sequence
  Description of Artificial Sequence: Synthetic peptide
  Seed: EAASSSSTL (MAGA3_HUMAN)
EAASSSSTY

SEQ ID NO: 58833 - protein, 9 aa, Artificial Sequence
  Description of Artificial Sequence: Synthetic peptide
  Seed: ISYPPLHEW (MAGA3_HUMAN)
IFYPPLHEI

SEQ ID NO: 58834 - protein, 9 aa, Artificial Sequence
  Description of Artificial Sequence: Synthetic peptide
  Seed: ALVETSYVK (MAGA3_HUMAN)
ASVETSYVK

SEQ ID NO: 58835 - protein, 10 aa, Artificial Sequence
  Description of Artificial Sequence: Synthetic peptide
  Seed: EVFEGREDSI (MAGA3_HUMAN)
ETFEGREDSW

SEQ ID NO: 58836 - protein, 9 aa, Artificial Sequence
  Description of Artificial Sequence: Synthetic peptide
  Seed: EELSVLEVF (MAGA3_HUMAN)
EELSVLEVI

SEQ ID NO: 58837 - protein, 10 aa, Artificial Sequence
  Description of Artificial Sequence: Synthetic peptide
  Seed: TLVEVTLGEV (MAGA3_HUMAN)
TTVEVTLGEA

SEQ ID NO: 58838 - protein, 9 aa, Artificial Sequence
  Description of Artificial Sequence: Synthetic peptide
  Seed: YPPLHEWVL (MAGA3_HUMAN)
YPPLHEWVM

SEQ ID NO: 58839 - protein, 9 aa, Artificial Sequence
  Description of Artificial Sequence: Synthetic peptide
  Seed: SSLPTTMNY (MAGA3_HUMAN)
SSLPTTMNV

SEQ ID NO: 58840 - protein, 10 aa, Artificial Sequence
  Description of Artificial Sequence: Synthetic peptide
  Seed: HISYPPLHEW (MAGA3_HUMAN)
HESYPPLHEY

SEQ ID NO: 58841 - protein, 9 aa, Artificial Sequence
  Description of Artificial Sequence: Synthetic peptide
  Seed: VFGIELMEV (MAGA3_HUMAN)
VYGIELMEM

SEQ ID NO: 58842 - protein, 9 aa, Artificial Sequence
  Description of Artificial Sequence: Synthetic peptide
  Seed: QSPQGASSL (MAGA3_HUMAN)
QGPQGASSL

SEQ ID NO: 58843 - protein, 9 aa, Artificial Sequence
  Description of Artificial Sequence: Synthetic peptide
  Seed: AQAPATEEQ (MAGA3_HUMAN)
ASAPATEEY

SEQ ID NO: 58844 - protein, 9 aa, Artificial Sequence
  Description of Artificial Sequence: Synthetic peptide
  Seed: ISYPPLHEW (MAGA3_HUMAN)
IIYPPLHEY

SEQ ID NO: 58845 - protein, 9 aa, Artificial Sequence
  Description of Artificial Sequence: Synthetic peptide
  Seed: SSLPTTMNY (MAGA3_HUMAN)
SALPTTMNH

SEQ ID NO: 58846 - protein, 9 aa, Artificial Sequence
  Description of Artificial Sequence: Synthetic peptide
  Seed: HLYIFATCL (MAGA3_HUMAN)
HVYIFATCV

SEQ ID NO: 58847 - protein, 9 aa, Artificial Sequence
  Description of Artificial Sequence: Synthetic peptide
  Seed: ISYPPLHEW (MAGA3_HUMAN)
ITYPPLHEF

SEQ ID NO: 58848 - protein, 9 aa, Artificial Sequence
  Description of Artificial Sequence: Synthetic peptide
  Seed: EVDPIGHLY (MAGA3_HUMAN)
EPDPIGHLM

SEQ ID NO: 58849 - protein, 9 aa, Artificial Sequence
  Description of Artificial Sequence: Synthetic peptide
  Seed: ISYPPLHEW (MAGA3_HUMAN)
IGYPPLHEV

SEQ ID NO: 58850 - protein, 9 aa, Artificial Sequence
  Description of Artificial Sequence: Synthetic peptide
  Seed: ISYPPLHEW (MAGA3_HUMAN)
IVYPPLHEH

SEQ ID NO: 58851 - protein, 10 aa, Artificial Sequence
  Description of Artificial Sequence: Synthetic peptide
  Seed: MNYPLWSQSY (MAGA3_HUMAN)
MPYPLWSQSW

SEQ ID NO: 58852 - protein, 9 aa, Artificial Sequence
  Description of Artificial Sequence: Synthetic peptide
  Seed: KVAELVHFL (MAGA3_HUMAN)
KWAELVHFY

SEQ ID NO: 58853 - protein, 9 aa, Artificial Sequence
  Description of Artificial Sequence: Synthetic peptide
  Seed: AELVHFLLL (MAGA3_HUMAN)
AELVHFLLP

SEQ ID NO: 58854 - protein, 9 aa, Artificial Sequence
  Description of Artificial Sequence: Synthetic peptide
  Seed: ISYPPLHEW (MAGA3_HUMAN)
IYYPPLHEF

SEQ ID NO: 58855 - protein, 10 aa, Artificial Sequence
  Description of Artificial Sequence: Synthetic peptide
  Seed: LGLVGAQAPA (MAGA3_HUMAN)
LELVGAQAPV

SEQ ID NO: 58856 - protein, 9 aa, Artificial Sequence
  Description of Artificial Sequence: Synthetic peptide
  Seed: KVAELVHFL (MAGA3_HUMAN)
KRAELVHFM

SEQ ID NO: 58857 - protein, 9 aa, Artificial Sequence
  Description of Artificial Sequence: Synthetic peptide
  Seed: TFPDLESEF (MAGA3_HUMAN)
TSPDLESEL

SEQ ID NO: 58858 - protein, 10 aa, Artificial Sequence
  Description of Artificial Sequence: Synthetic peptide
  Seed: MEVDPIGHLY (MAGA3_HUMAN)
MGVDPIGHLF

SEQ ID NO: 58859 - protein, 9 aa, Artificial Sequence
  Description of Artificial Sequence: Synthetic peptide
  Seed: FPVIFSKAS (MAGA3_HUMAN)
FVVIFSKAY

SEQ ID NO: 58860 - protein, 10 aa, Artificial Sequence
  Description of Artificial Sequence: Synthetic peptide
  Seed: MVKISGGPHI (MAGA3_HUMAN)
MRKISGGPHM

SEQ ID NO: 58861 - protein, 11 aa, Artificial Sequence
  Description of Artificial Sequence: Synthetic peptide
  Seed: ISYPPLHEWVL (MAGA3_HUMAN)
IYYPPLHEWVW

SEQ ID NO: 58862 - protein, 9 aa, Artificial Sequence
  Description of Artificial Sequence: Synthetic peptide
  Seed: GASSLPTTM (MAGA3_HUMAN)
GSSSLPTTW

SEQ ID NO: 58863 - protein, 11 aa, Artificial Sequence
  Description of Artificial Sequence: Synthetic peptide
  Seed: MLGSVVGNWQY (MAGA3_HUMAN)
MMGSVVGNWQW

SEQ ID NO: 58864 - protein, 9 aa, Artificial Sequence
  Description of Artificial Sequence: Synthetic peptide
  Seed: SSLPTTMNY (MAGA3_HUMAN)
SILPTTMNK

SEQ ID NO: 58865 - protein, 10 aa, Artificial Sequence
  Description of Artificial Sequence: Synthetic peptide
  Seed: YIFATCLGLS (MAGA3_HUMAN)
YVFATCLGLL

SEQ ID NO: 58866 - protein, 9 aa, Artificial Sequence
  Description of Artificial Sequence: Synthetic peptide
  Seed: FQAALSRKV (MAGA3_HUMAN)
FLAALSRKY

SEQ ID NO: 58867 - protein, 10 aa, Artificial Sequence
  Description of Artificial Sequence: Synthetic peptide
  Seed: TSYVKVLHHM (MAGA3_HUMAN)
TSYVKVLHHF

SEQ ID NO: 58868 - protein, 9 aa, Artificial Sequence
  Description of Artificial Sequence: Synthetic peptide
  Seed: LGDPKKLLT (MAGA3_HUMAN)
LFDPKKLLL

SEQ ID NO: 58869 - protein, 9 aa, Artificial Sequence
  Description of Artificial Sequence: Synthetic peptide
  Seed: ALSRKVAEL (MAGA3_HUMAN)
AQSRKVAEL

SEQ ID NO: 58870 - protein, 10 aa, Artificial Sequence
  Description of Artificial Sequence: Synthetic peptide
  Seed: GNWQYFFPVI (MAGA3_HUMAN)
GYWQYFFPVW

SEQ ID NO: 58871 - protein, 10 aa, Artificial Sequence
  Description of Artificial Sequence: Synthetic peptide
  Seed: MNYPLWSQSY (MAGA3_HUMAN)
MMYPLWSQSW

SEQ ID NO: 58872 - protein, 10 aa, Artificial Sequence
  Description of Artificial Sequence: Synthetic peptide
  Seed: SLQLVFGIEL (MAGA3_HUMAN)
SSQLVFGIEY

SEQ ID NO: 58873 - protein, 9 aa, Artificial Sequence
  Description of Artificial Sequence: Synthetic peptide
  Seed: LQLVFGIEL (MAGA3_HUMAN)
LLLVFGIEV

SEQ ID NO: 58874 - protein, 11 aa, Artificial Sequence
  Description of Artificial Sequence: Synthetic peptide
  Seed: RALVETSYVKV (MAGA3_HUMAN)
RLLVETSYVKV

SEQ ID NO: 58875 - protein, 10 aa, Artificial Sequence
  Description of Artificial Sequence: Synthetic peptide
  Seed: VIFSKASSSL (MAGA3_HUMAN)
VYFSKASSSM

SEQ ID NO: 58876 - protein, 9 aa, Artificial Sequence
  Description of Artificial Sequence: Synthetic peptide
  Seed: MLGSVVGNW (MAGA3_HUMAN)
MSGSVVGNY

SEQ ID NO: 58877 - protein, 9 aa, Artificial Sequence
  Description of Artificial Sequence: Synthetic peptide
  Seed: RQVPGSDPA (MAGA3_HUMAN)
RSVPGSDPM

SEQ ID NO: 58878 - protein, 9 aa, Artificial Sequence
  Description of Artificial Sequence: Synthetic peptide
  Seed: RALVETSYV (MAGA3_HUMAN)
RSLVETSYV

SEQ ID NO: 58879 - protein, 9 aa, Artificial Sequence
  Description of Artificial Sequence: Synthetic peptide
  Seed: YIFATCLGL (MAGA3_HUMAN)
YMFATCLGC

SEQ ID NO: 58880 - protein, 10 aa, Artificial Sequence
  Description of Artificial Sequence: Synthetic peptide
  Seed: MNYPLWSQSY (MAGA3_HUMAN)
MGYPLWSQSI

SEQ ID NO: 58881 - protein, 9 aa, Artificial Sequence
  Description of Artificial Sequence: Synthetic peptide
  Seed: SVVGNWQYF (MAGA3_HUMAN)
SKVGNWQYY

SEQ ID NO: 58882 - protein, 9 aa, Artificial Sequence
  Description of Artificial Sequence: Synthetic peptide
  Seed: GEALGLVGA (MAGA3_HUMAN)
GEALGLVGL

SEQ ID NO: 58883 - protein, 11 aa, Artificial Sequence
  Description of Artificial Sequence: Synthetic peptide
  Seed: SRKVAELVHFL (MAGA3_HUMAN)
SRKVAELVHFV

SEQ ID NO: 58884 - protein, 9 aa, Artificial Sequence
  Description of Artificial Sequence: Synthetic peptide
  Seed: KIWEELSVL (MAGA3_HUMAN)
KIWEELSVK

SEQ ID NO: 58885 - protein, 11 aa, Artificial Sequence
  Description of Artificial Sequence: Synthetic peptide
  Seed: SSLPTTMNYPL (MAGA3_HUMAN)
SPLPTTMNYPL

SEQ ID NO: 58886 - protein, 11 aa, Artificial Sequence
  Description of Artificial Sequence: Synthetic peptide
  Seed: AQAPATEEQEA (MAGA3_HUMAN)
AMAPATEEQEF

SEQ ID NO: 58887 - protein, 9 aa, Artificial Sequence
  Description of Artificial Sequence: Synthetic peptide
  Seed: KIWEELSVL (MAGA3_HUMAN)
KLWEELSVC

SEQ ID NO: 58888 - protein, 10 aa, Artificial Sequence
  Description of Artificial Sequence: Synthetic peptide
  Seed: KASSSLQLVF (MAGA3_HUMAN)
KLSSSLQLVW

SEQ ID NO: 58889 - protein, 9 aa, Artificial Sequence
  Description of Artificial Sequence: Synthetic peptide
  Seed: FVQENYLEY (MAGA3_HUMAN)
FTQENYLEW

SEQ ID NO: 58890 - protein, 8 aa, Artificial Sequence
  Description of Artificial Sequence: Synthetic peptide
  Seed: AEMLGSVV (MAGA3_HUMAN)
AEMLGSVL

SEQ ID NO: 58891 - protein, 9 aa, Artificial Sequence
  Description of Artificial Sequence: Synthetic peptide
  Seed: SSSSTLVEV (MAGA3_HUMAN)
STSSTLVEI

SEQ ID NO: 58892 - protein, 9 aa, Artificial Sequence
  Description of Artificial Sequence: Synthetic peptide
  Seed: ASSSLQLVF (MAGA3_HUMAN)
AMSSLQLVI

SEQ ID NO: 58893 - protein, 10 aa, Artificial Sequence
  Description of Artificial Sequence: Synthetic peptide
  Seed: MNYPLWSQSY (MAGA3_HUMAN)
MHYPLWSQSI

SEQ ID NO: 58894 - protein, 9 aa, Artificial Sequence
  Description of Artificial Sequence: Synthetic peptide
  Seed: SEFQAALSR (MAGA3_HUMAN)
SGFQAALSR

SEQ ID NO: 58895 - protein, 9 aa, Artificial Sequence
  Description of Artificial Sequence: Synthetic peptide
  Seed: LESEFQAAL (MAGA3_HUMAN)
LMSEFQAAA

SEQ ID NO: 58896 - protein, 9 aa, Artificial Sequence
  Description of Artificial Sequence: Synthetic peptide
  Seed: HLYIFATCL (MAGA3_HUMAN)
HYYIFATCY

SEQ ID NO: 58897 - protein, 9 aa, Artificial Sequence
  Description of Artificial Sequence: Synthetic peptide
  Seed: WQYFFPVIF (MAGA3_HUMAN)
WEYFFPVIL

SEQ ID NO: 58898 - protein, 9 aa, Artificial Sequence
  Description of Artificial Sequence: Synthetic peptide
  Seed: MEVDPIGHL (MAGA3_HUMAN)
MVVDPIGHF

SEQ ID NO: 58899 - protein, 10 aa, Artificial Sequence
  Description of Artificial Sequence: Synthetic peptide
  Seed: FFPVIFSKAS (MAGA3_HUMAN)
FFPVIFSKAA

SEQ ID NO: 58900 - protein, 9 aa, Artificial Sequence
  Description of Artificial Sequence: Synthetic peptide
  Seed: SEFQAALSR (MAGA3_HUMAN)
SMFQAALSR

SEQ ID NO: 58901 - protein, 10 aa, Artificial Sequence
  Description of Artificial Sequence: Synthetic peptide
  Seed: FLWGPRALVE (MAGA3_HUMAN)
FTWGPRALVV

SEQ ID NO: 58902 - protein, 9 aa, Artificial Sequence
  Description of Artificial Sequence: Synthetic peptide
  Seed: QIMPKAGLL (MAGA3_HUMAN)
QLMPKAGLY

SEQ ID NO: 58903 - protein, 10 aa, Artificial Sequence
  Description of Artificial Sequence: Synthetic peptide
  Seed: SDPACYEFLW (MAGA3_HUMAN)
SEPACYEFLW

SEQ ID NO: 58904 - protein, 10 aa, Artificial Sequence
  Description of Artificial Sequence: Synthetic peptide
  Seed: KISGGPHISY (MAGA3_HUMAN)
KMSGGPHISY

SEQ ID NO: 58905 - protein, 9 aa, Artificial Sequence
  Description of Artificial Sequence: Synthetic peptide
  Seed: SVLEVFEGR (MAGA3_HUMAN)
SGLEVFEGY

SEQ ID NO: 58906 - protein, 9 aa, Artificial Sequence
  Description of Artificial Sequence: Synthetic peptide
  Seed: NYPLWSQSY (MAGA3_HUMAN)
NRPLWSQSF

SEQ ID NO: 58907 - protein, 9 aa, Artificial Sequence
  Description of Artificial Sequence: Synthetic peptide
  Seed: RALVETSYV (MAGA3_HUMAN)
RGLVETSYY

SEQ ID NO: 58908 - protein, 9 aa, Artificial Sequence
  Description of Artificial Sequence: Synthetic peptide
  Seed: SYVKVLHHM (MAGA3_HUMAN)
SSVKVLHHV

SEQ ID NO: 58909 - protein, 9 aa, Artificial Sequence
  Description of Artificial Sequence: Synthetic peptide
  Seed: RKVAELVHF (MAGA3_HUMAN)
RAVAELVHM

SEQ ID NO: 58910 - protein, 10 aa, Artificial Sequence
  Description of Artificial Sequence: Synthetic peptide
  Seed: FPVIFSKASS (MAGA3_HUMAN)
FPVIFSKASV

SEQ ID NO: 58911 - protein, 10 aa, Artificial Sequence
  Description of Artificial Sequence: Synthetic peptide
  Seed: KVAELVHFLL (MAGA3_HUMAN)
KSAELVHFLM

SEQ ID NO: 58912 - protein, 9 aa, Artificial Sequence
  Description of Artificial Sequence: Synthetic peptide
  Seed: QIMPKAGLL (MAGA3_HUMAN)
QVMPKAGLF

SEQ ID NO: 58913 - protein, 11 aa, Artificial Sequence
  Description of Artificial Sequence: Synthetic peptide
  Seed: SSSSTLVEVTL (MAGA3_HUMAN)
SVSSTLVEVTW

SEQ ID NO: 58914 - protein, 9 aa, Artificial Sequence
  Description of Artificial Sequence: Synthetic peptide
  Seed: LGDPKKLLT (MAGA3_HUMAN)
LLDPKKLLF

SEQ ID NO: 58915 - protein, 10 aa, Artificial Sequence
  Description of Artificial Sequence: Synthetic peptide
  Seed: LPTTMNYPLW (MAGA3_HUMAN)
LRTTMNYPLW

SEQ ID NO: 58916 - protein, 9 aa, Artificial Sequence
  Description of Artificial Sequence: Synthetic peptide
  Seed: KIWEELSVL (MAGA3_HUMAN)
KEWEELSVM

SEQ ID NO: 58917 - protein, 9 aa, Artificial Sequence
  Description of Artificial Sequence: Synthetic peptide
  Seed: LGDPKKLLT (MAGA3_HUMAN)
LLDPKKLLM

SEQ ID NO: 58918 - protein, 9 aa, Artificial Sequence
  Description of Artificial Sequence: Synthetic peptide
  Seed: FVQENYLEY (MAGA3_HUMAN)
FPQENYLEF

SEQ ID NO: 58919 - protein, 9 aa, Artificial Sequence
  Description of Artificial Sequence: Synthetic peptide
  Seed: KVLHHMVKI (MAGA3_HUMAN)
KILHHMVKV

SEQ ID NO: 58920 - protein, 9 aa, Artificial Sequence
  Description of Artificial Sequence: Synthetic peptide
  Seed: IMPKAGLLI (MAGA3_HUMAN)
IYPKAGLLY

SEQ ID NO: 58921 - protein, 9 aa, Artificial Sequence
  Description of Artificial Sequence: Synthetic peptide
  Seed: EVDPIGHLY (MAGA3_HUMAN)
EFDPIGHLM

SEQ ID NO: 58922 - protein, 11 aa, Artificial Sequence
  Description of Artificial Sequence: Synthetic peptide
  Seed: RQVPGSDPACY (MAGA3_HUMAN)
RMVPGSDPACR

SEQ ID NO: 58923 - protein, 9 aa, Artificial Sequence
  Description of Artificial Sequence: Synthetic peptide
  Seed: EVDPIGHLY (MAGA3_HUMAN)
ELDPIGHLL

SEQ ID NO: 58924 - protein, 9 aa, Artificial Sequence
  Description of Artificial Sequence: Synthetic peptide
  Seed: VTLGEVPAA (MAGA3_HUMAN)
VMLGEVPAI

SEQ ID NO: 58925 - protein, 9 aa, Artificial Sequence
  Description of Artificial Sequence: Synthetic peptide
  Seed: EVDPIGHLY (MAGA3_HUMAN)
EVDPIGHLV

SEQ ID NO: 58926 - protein, 9 aa, Artificial Sequence
  Description of Artificial Sequence: Synthetic peptide
  Seed: VVGNWQYFF (MAGA3_HUMAN)
VFGNWQYFI

SEQ ID NO: 58927 - protein, 10 aa, Artificial Sequence
  Description of Artificial Sequence: Synthetic peptide
  Seed: SVVGNWQYFF (MAGA3_HUMAN)
SWVGNWQYFF

SEQ ID NO: 58928 - protein, 9 aa, Artificial Sequence
  Description of Artificial Sequence: Synthetic peptide
  Seed: SYVKVLHHM (MAGA3_HUMAN)
SAVKVLHHM

SEQ ID NO: 58929 - protein, 9 aa, Artificial Sequence
  Description of Artificial Sequence: Synthetic peptide
  Seed: KVAELVHFL (MAGA3_HUMAN)
KNAELVHFR

SEQ ID NO: 58930 - protein, 9 aa, Artificial Sequence
  Description of Artificial Sequence: Synthetic peptide
  Seed: MEVDPIGHL (MAGA3_HUMAN)
MIVDPIGHM

SEQ ID NO: 58931 - protein, 11 aa, Artificial Sequence
  Description of Artificial Sequence: Synthetic peptide
  Seed: GSVVGNWQYFF (MAGA3_HUMAN)
GAVVGNWQYFW

SEQ ID NO: 58932 - protein, 9 aa, Artificial Sequence
  Description of Artificial Sequence: Synthetic peptide
  Seed: EALGLVGAQ (MAGA3_HUMAN)
EILGLVGAY

SEQ ID NO: 58933 - protein, 9 aa, Artificial Sequence
  Description of Artificial Sequence: Synthetic peptide
  Seed: IMPKAGLLI (MAGA3_HUMAN)
IAPKAGLLW

SEQ ID NO: 58934 - protein, 9 aa, Artificial Sequence
  Description of Artificial Sequence: Synthetic peptide
  Seed: MEVDPIGHL (MAGA3_HUMAN)
MLVDPIGHM

SEQ ID NO: 58935 - protein, 10 aa, Artificial Sequence
  Description of Artificial Sequence: Synthetic peptide
  Seed: FATCLGLSYD (MAGA3_HUMAN)
FATCLGLSYY

SEQ ID NO: 58936 - protein, 9 aa, Artificial Sequence
  Description of Artificial Sequence: Synthetic peptide
  Seed: VVGNWQYFF (MAGA3_HUMAN)
VYGNWQYFL

SEQ ID NO: 58937 - protein, 9 aa, Artificial Sequence
  Description of Artificial Sequence: Synthetic peptide
  Seed: YIFATCLGL (MAGA3_HUMAN)
YLFATCLGK

SEQ ID NO: 58938 - protein, 9 aa, Artificial Sequence
  Description of Artificial Sequence: Synthetic peptide
  Seed: FVQENYLEY (MAGA3_HUMAN)
FMQENYLEM

SEQ ID NO: 58939 - protein, 9 aa, Artificial Sequence
  Description of Artificial Sequence: Synthetic peptide
  Seed: ISGGPHISY (MAGA3_HUMAN)
ITGGPHISI

SEQ ID NO: 58940 - protein, 10 aa, Artificial Sequence
  Description of Artificial Sequence: Synthetic peptide
  Seed: KVAELVHFLL (MAGA3_HUMAN)
KIAELVHFLG

SEQ ID NO: 58941 - protein, 9 aa, Artificial Sequence
  Description of Artificial Sequence: Synthetic peptide
  Seed: ISYPPLHEW (MAGA3_HUMAN)
IHYPPLHEY

SEQ ID NO: 58942 - protein, 9 aa, Artificial Sequence
  Description of Artificial Sequence: Synthetic peptide
  Seed: AELVHFLLL (MAGA3_HUMAN)
AALVHFLLF

SEQ ID NO: 58943 - protein, 8 aa, Artificial Sequence
  Description of Artificial Sequence: Synthetic peptide
  Seed: LGDPKKLL (MAGA3_HUMAN)
LTDPKKLL

SEQ ID NO: 58944 - protein, 11 aa, Artificial Sequence
  Description of Artificial Sequence: Synthetic peptide
  Seed: RQVPGSDPACY (MAGA3_HUMAN)
RQVPGSDPACW

SEQ ID NO: 58945 - protein, 10 aa, Artificial Sequence
  Description of Artificial Sequence: Synthetic peptide
  Seed: RQVPGSDPAC (MAGA3_HUMAN)
REVPGSDPAC

SEQ ID NO: 58946 - protein, 10 aa, Artificial Sequence
  Description of Artificial Sequence: Synthetic peptide
  Seed: MEVDPIGHLY (MAGA3_HUMAN)
MSVDPIGHLF

SEQ ID NO: 58947 - protein, 10 aa, Artificial Sequence
  Description of Artificial Sequence: Synthetic peptide
  Seed: ASSLPTTMNY (MAGA3_HUMAN)
ALSLPTTMNW

SEQ ID NO: 58948 - protein, 10 aa, Artificial Sequence
  Description of Artificial Sequence: Synthetic peptide
  Seed: STFPDLESEF (MAGA3_HUMAN)
SMFPDLESEW

SEQ ID NO: 58949 - protein, 10 aa, Artificial Sequence
  Description of Artificial Sequence: Synthetic peptide
  Seed: YIFATCLGLS (MAGA3_HUMAN)
YMFATCLGLM

SEQ ID NO: 58950 - protein, 8 aa, Artificial Sequence
  Description of Artificial Sequence: Synthetic peptide
  Seed: AEMLGSVV (MAGA3_HUMAN)
AEMLGSVA

SEQ ID NO: 58951 - protein, 10 aa, Artificial Sequence
  Description of Artificial Sequence: Synthetic peptide
  Seed: KASSSLQLVF (MAGA3_HUMAN)
KESSSLQLVW

SEQ ID NO: 58952 - protein, 10 aa, Artificial Sequence
  Description of Artificial Sequence: Synthetic peptide
  Seed: EVDPIGHLYI (MAGA3_HUMAN)
EADPIGHLYM

SEQ ID NO: 58953 - protein, 10 aa, Artificial Sequence
  Description of Artificial Sequence: Synthetic peptide
  Seed: TSYVKVLHHM (MAGA3_HUMAN)
TFYVKVLHHF

SEQ ID NO: 58954 - protein, 9 aa, Artificial Sequence
  Description of Artificial Sequence: Synthetic peptide
  Seed: GLLIIVLAI (MAGA3_HUMAN)
GMLIIVLAV

SEQ ID NO: 58955 - protein, 10 aa, Artificial Sequence
  Description of Artificial Sequence: Synthetic peptide
  Seed: KVAELVHFLL (MAGA3_HUMAN)
KIAELVHFLM

SEQ ID NO: 58956 - protein, 9 aa, Artificial Sequence
  Description of Artificial Sequence: Synthetic peptide
  Seed: SVLEVFEGR (MAGA3_HUMAN)
SMLEVFEGY

SEQ ID NO: 58957 - protein, 11 aa, Artificial Sequence
  Description of Artificial Sequence: Synthetic peptide
  Seed: FLWGPRALVET (MAGA3_HUMAN)
FQWGPRALVEL

SEQ ID NO: 58958 - protein, 9 aa, Artificial Sequence
  Description of Artificial Sequence: Synthetic peptide
  Seed: REDSILGDP (MAGA3_HUMAN)
REDSILGDV

SEQ ID NO: 58959 - protein, 9 aa, Artificial Sequence
  Description of Artificial Sequence: Synthetic peptide
  Seed: NYPLWSQSY (MAGA3_HUMAN)
NYPLWSQSM

SEQ ID NO: 58960 - protein, 9 aa, Artificial Sequence
  Description of Artificial Sequence: Synthetic peptide
  Seed: SYVKVLHHM (MAGA3_HUMAN)
SFVKVLHHY

SEQ ID NO: 58961 - protein, 10 aa, Artificial Sequence
  Description of Artificial Sequence: Synthetic peptide
  Seed: MNYPLWSQSY (MAGA3_HUMAN)
MGYPLWSQSF

SEQ ID NO: 58962 - protein, 9 aa, Artificial Sequence
  Description of Artificial Sequence: Synthetic peptide
  Seed: SEFQAALSR (MAGA3_HUMAN)
SDFQAALSI

SEQ ID NO: 58963 - protein, 9 aa, Artificial Sequence
  Description of Artificial Sequence: Synthetic peptide
  Seed: GASSLPTTM (MAGA3_HUMAN)
GMSSLPTTM

SEQ ID NO: 58964 - protein, 9 aa, Artificial Sequence
  Description of Artificial Sequence: Synthetic peptide
  Seed: MEVDPIGHL (MAGA3_HUMAN)
MQVDPIGHI

SEQ ID NO: 58965 - protein, 10 aa, Artificial Sequence
  Description of Artificial Sequence: Synthetic peptide
  Seed: KASSSLQLVF (MAGA3_HUMAN)
KRSSSLQLVM

SEQ ID NO: 58966 - protein, 9 aa, Artificial Sequence
  Description of Artificial Sequence: Synthetic peptide
  Seed: QIMPKAGLL (MAGA3_HUMAN)
QPMPKAGLV

SEQ ID NO: 58967 - protein, 10 aa, Artificial Sequence
  Description of Artificial Sequence: Synthetic peptide
  Seed: ISYPPLHEWV (MAGA3_HUMAN)
IHYPPLHEWL

SEQ ID NO: 58968 - protein, 10 aa, Artificial Sequence
  Description of Artificial Sequence: Synthetic peptide
  Seed: DLESEFQAAL (MAGA3_HUMAN)
DQESEFQAAF

SEQ ID NO: 58969 - protein, 10 aa, Artificial Sequence
  Description of Artificial Sequence: Synthetic peptide
  Seed: SLPTTMNYPL (MAGA3_HUMAN)
SPPTTMNYPM

SEQ ID NO: 58970 - protein, 9 aa, Artificial Sequence
  Description of Artificial Sequence: Synthetic peptide
  Seed: ALSRKVAEL (MAGA3_HUMAN)
AMSRKVAEV

SEQ ID NO: 58971 - protein, 9 aa, Artificial Sequence
  Description of Artificial Sequence: Synthetic peptide
  Seed: FQAALSRKV (MAGA3_HUMAN)
FLAALSRKV

SEQ ID NO: 58972 - protein, 9 aa, Artificial Sequence
  Description of Artificial Sequence: Synthetic peptide
  Seed: RQVPGSDPA (MAGA3_HUMAN)
RKVPGSDPF

SEQ ID NO: 58973 - protein, 9 aa, Artificial Sequence
  Description of Artificial Sequence: Synthetic peptide
  Seed: FQAALSRKV (MAGA3_HUMAN)
FAAALSRKL

SEQ ID NO: 58974 - protein, 11 aa, Artificial Sequence
  Description of Artificial Sequence: Synthetic peptide
  Seed: AASSSSTLVEV (MAGA3_HUMAN)
AASSSSTLVEY

SEQ ID NO: 58975 - protein, 9 aa, Artificial Sequence
  Description of Artificial Sequence: Synthetic peptide
  Seed: YFFPVIFSK (MAGA3_HUMAN)
YVFPVIFSI

SEQ ID NO: 58976 - protein, 10 aa, Artificial Sequence
  Description of Artificial Sequence: Synthetic peptide
  Seed: ASSLPTTMNY (MAGA3_HUMAN)
ACSLPTTMNW

SEQ ID NO: 58977 - protein, 11 aa, Artificial Sequence
  Description of Artificial Sequence: Synthetic peptide
  Seed: RQVPGSDPACY (MAGA3_HUMAN)
RRVPGSDPACF

SEQ ID NO: 58978 - protein, 11 aa, Artificial Sequence
  Description of Artificial Sequence: Synthetic peptide
  Seed: RQVPGSDPACY (MAGA3_HUMAN)
RQVPGSDPACM

SEQ ID NO: 58979 - protein, 8 aa, Artificial Sequence
  Description of Artificial Sequence: Synthetic peptide
  Seed: FPDLESEF (MAGA3_HUMAN)
FSDLESEF

SEQ ID NO: 58980 - protein, 10 aa, Artificial Sequence
  Description of Artificial Sequence: Synthetic peptide
  Seed: LGSVVGNWQY (MAGA3_HUMAN)
LISVVGNWQF

SEQ ID NO: 58981 - protein, 9 aa, Artificial Sequence
  Description of Artificial Sequence: Synthetic peptide
  Seed: RKVAELVHF (MAGA3_HUMAN)
RQVAELVHY

SEQ ID NO: 58982 - protein, 10 aa, Artificial Sequence
  Description of Artificial Sequence: Synthetic peptide
  Seed: ASSLPTTMNY (MAGA3_HUMAN)
AASLPTTMNF

SEQ ID NO: 58983 - protein, 9 aa, Artificial Sequence
  Description of Artificial Sequence: Synthetic peptide
  Seed: KASSSLQLV (MAGA3_HUMAN)
KFSSSLQLK

SEQ ID NO: 58984 - protein, 9 aa, Artificial Sequence
  Description of Artificial Sequence: Synthetic peptide
  Seed: YIFATCLGL (MAGA3_HUMAN)
YAFATCLGM

SEQ ID NO: 58985 - protein, 10 aa, Artificial Sequence
  Description of Artificial Sequence: Synthetic peptide
  Seed: SDPACYEFLW (MAGA3_HUMAN)
SKPACYEFLW

SEQ ID NO: 58986 - protein, 9 aa, Artificial Sequence
  Description of Artificial Sequence: Synthetic peptide
  Seed: SSLPTTMNY (MAGA3_HUMAN)
SRLPTTMNY

SEQ ID NO: 58987 - protein, 10 aa, Artificial Sequence
  Description of Artificial Sequence: Synthetic peptide
  Seed: KISGGPHISY (MAGA3_HUMAN)
KVSGGPHISK

SEQ ID NO: 58988 - protein, 9 aa, Artificial Sequence
  Description of Artificial Sequence: Synthetic peptide
  Seed: RKVAELVHF (MAGA3_HUMAN)
RVVAELVHF

SEQ ID NO: 58989 - protein, 9 aa, Artificial Sequence
  Description of Artificial Sequence: Synthetic peptide
  Seed: FLWGPRALV (MAGA3_HUMAN)
FSWGPRALM

SEQ ID NO: 58990 - protein, 9 aa, Artificial Sequence
  Description of Artificial Sequence: Synthetic peptide
  Seed: ILGDPKKLL (MAGA3_HUMAN)
IMGDPKKLL

SEQ ID NO: 58991 - protein, 10 aa, Artificial Sequence
  Description of Artificial Sequence: Synthetic peptide
  Seed: MNYPLWSQSY (MAGA3_HUMAN)
MYYPLWSQSI

SEQ ID NO: 58992 - protein, 8 aa, Artificial Sequence
  Description of Artificial Sequence: Synthetic peptide
  Seed: SYPPLHEW (MAGA3_HUMAN)
SSPPLHEW

SEQ ID NO: 58993 - protein, 10 aa, Artificial Sequence
  Description of Artificial Sequence: Synthetic peptide
  Seed: MPKAGLLIIV (MAGA3_HUMAN)
MTKAGLLIIA

SEQ ID NO: 58994 - protein, 11 aa, Artificial Sequence
  Description of Artificial Sequence: Synthetic peptide
  Seed: FLWGPRALVET (MAGA3_HUMAN)
FTWGPRALVEV

SEQ ID NO: 58995 - protein, 9 aa, Artificial Sequence
  Description of Artificial Sequence: Synthetic peptide
  Seed: YIFATCLGL (MAGA3_HUMAN)
YEFATCLGY

SEQ ID NO: 58996 - protein, 9 aa, Artificial Sequence
  Description of Artificial Sequence: Synthetic peptide
  Seed: SVVGNWQYF (MAGA3_HUMAN)
SYVGNWQYY

SEQ ID NO: 58997 - protein, 9 aa, Artificial Sequence
  Description of Artificial Sequence: Synthetic peptide
  Seed: KIWEELSVL (MAGA3_HUMAN)
KLWEELSVM

SEQ ID NO: 58998 - protein, 9 aa, Artificial Sequence
  Description of Artificial Sequence: Synthetic peptide
  Seed: YIFATCLGL (MAGA3_HUMAN)
YYFATCLGF

SEQ ID NO: 58999 - protein, 9 aa, Artificial Sequence
  Description of Artificial Sequence: Synthetic peptide
  Seed: WQYFFPVIF (MAGA3_HUMAN)
WVYFFPVIY

SEQ ID NO: 59000 - protein, 9 aa, Artificial Sequence
  Description of Artificial Sequence: Synthetic peptide
  Seed: KVLHHMVKI (MAGA3_HUMAN)
KMLHHMVKT

SEQ ID NO: 59001 - protein, 9 aa, Artificial Sequence
  Description of Artificial Sequence: Synthetic peptide
  Seed: EELSVLEVF (MAGA3_HUMAN)
ELLSVLEVY

SEQ ID NO: 59002 - protein, 9 aa, Artificial Sequence
  Description of Artificial Sequence: Synthetic peptide
  Seed: SEFQAALSR (MAGA3_HUMAN)
STFQAALSR

SEQ ID NO: 59003 - protein, 9 aa, Artificial Sequence
  Description of Artificial Sequence: Synthetic peptide
  Seed: FLWGPRALV (MAGA3_HUMAN)
FGWGPRALY

SEQ ID NO: 59004 - protein, 9 aa, Artificial Sequence
  Description of Artificial Sequence: Synthetic peptide
  Seed: WQYFFPVIF (MAGA3_HUMAN)
WHYFFPVIY

SEQ ID NO: 59005 - protein, 9 aa, Artificial Sequence
  Description of Artificial Sequence: Synthetic peptide
  Seed: SYPPLHEWV (MAGA3_HUMAN)
SFPPLHEWF

SEQ ID NO: 59006 - protein, 11 aa, Artificial Sequence
  Description of Artificial Sequence: Synthetic peptide
  Seed: SSSSTLVEVTL (MAGA3_HUMAN)
SGSSTLVEVTW

SEQ ID NO: 59007 - protein, 9 aa, Artificial Sequence
  Description of Artificial Sequence: Synthetic peptide
  Seed: ALSRKVAEL (MAGA3_HUMAN)
AASRKVAEL

SEQ ID NO: 59008 - protein, 11 aa, Artificial Sequence
  Description of Artificial Sequence: Synthetic peptide
  Seed: KIWEELSVLEV (MAGA3_HUMAN)
KMWEELSVLEV

SEQ ID NO: 59009 - protein, 10 aa, Artificial Sequence
  Description of Artificial Sequence: Synthetic peptide
  Seed: HISYPPLHEW (MAGA3_HUMAN)
HASYPPLHEW

SEQ ID NO: 59010 - protein, 9 aa, Artificial Sequence
  Description of Artificial Sequence: Synthetic peptide
  Seed: EAASSSSTL (MAGA3_HUMAN)
EIASSSSTL

SEQ ID NO: 59011 - protein, 9 aa, Artificial Sequence
  Description of Artificial Sequence: Synthetic peptide
  Seed: YIFATCLGL (MAGA3_HUMAN)
YAFATCLGI

SEQ ID NO: 59012 - protein, 10 aa, Artificial Sequence
  Description of Artificial Sequence: Synthetic peptide
  Seed: KASSSLQLVF (MAGA3_HUMAN)
KKSSSLQLVY

SEQ ID NO: 59013 - protein, 9 aa, Artificial Sequence
  Description of Artificial Sequence: Synthetic peptide
  Seed: MLGSVVGNW (MAGA3_HUMAN)
MTGSVVGNF

SEQ ID NO: 59014 - protein, 9 aa, Artificial Sequence
  Description of Artificial Sequence: Synthetic peptide
  Seed: KVAELVHFL (MAGA3_HUMAN)
KRAELVHFY

SEQ ID NO: 59015 - protein, 9 aa, Artificial Sequence
  Description of Artificial Sequence: Synthetic peptide
  Seed: LVHFLLLKY (MAGA3_HUMAN)
LTHFLLLKL

SEQ ID NO: 59016 - protein, 9 aa, Artificial Sequence
  Description of Artificial Sequence: Synthetic peptide
  Seed: SPDPPQSPQ (MAGA3_HUMAN)
SPDPPQSPL

SEQ ID NO: 59017 - protein, 11 aa, Artificial Sequence
  Description of Artificial Sequence: Synthetic peptide
  Seed: YIFATCLGLSY (MAGA3_HUMAN)
YQFATCLGLSL

SEQ ID NO: 59018 - protein, 10 aa, Artificial Sequence
  Description of Artificial Sequence: Synthetic peptide
  Seed: MNYPLWSQSY (MAGA3_HUMAN)
MHYPLWSQSM

SEQ ID NO: 59019 - protein, 9 aa, Artificial Sequence
  Description of Artificial Sequence: Synthetic peptide
  Seed: RQVPGSDPA (MAGA3_HUMAN)
RTVPGSDPV

SEQ ID NO: 59020 - protein, 10 aa, Artificial Sequence
  Description of Artificial Sequence: Synthetic peptide
  Seed: SVVGNWQYFF (MAGA3_HUMAN)
SWVGNWQYFI

SEQ ID NO: 59021 - protein, 10 aa, Artificial Sequence
  Description of Artificial Sequence: Synthetic peptide
  Seed: FLWGPRALVE (MAGA3_HUMAN)
FMWGPRALVQ

SEQ ID NO: 59022 - protein, 9 aa, Artificial Sequence
  Description of Artificial Sequence: Synthetic peptide
  Seed: SKASSSLQL (MAGA3_HUMAN)
SLASSSLQF

SEQ ID NO: 59023 - protein, 9 aa, Artificial Sequence
  Description of Artificial Sequence: Synthetic peptide
  Seed: ISGGPHISY (MAGA3_HUMAN)
IAGGPHISF

SEQ ID NO: 59024 - protein, 9 aa, Artificial Sequence
  Description of Artificial Sequence: Synthetic peptide
  Seed: LESEFQAAL (MAGA3_HUMAN)
LVSEFQAAA

SEQ ID NO: 59025 - protein, 8 aa, Artificial Sequence
  Description of Artificial Sequence: Synthetic peptide
  Seed: FPDLESEF (MAGA3_HUMAN)
FFDLESEV

SEQ ID NO: 59026 - protein, 10 aa, Artificial Sequence
  Description of Artificial Sequence: Synthetic peptide
  Seed: MNYPLWSQSY (MAGA3_HUMAN)
MKYPLWSQSI

SEQ ID NO: 59027 - protein, 9 aa, Artificial Sequence
  Description of Artificial Sequence: Synthetic peptide
  Seed: SEFQAALSR (MAGA3_HUMAN)
SEFQAALSC

SEQ ID NO: 59028 - protein, 9 aa, Artificial Sequence
  Description of Artificial Sequence: Synthetic peptide
  Seed: IELMEVDPI (MAGA3_HUMAN)
IELMEVDPM

SEQ ID NO: 59029 - protein, 10 aa, Artificial Sequence
  Description of Artificial Sequence: Synthetic peptide
  Seed: GSVVGNWQYF (MAGA3_HUMAN)
GMVVGNWQYY

SEQ ID NO: 59030 - protein, 10 aa, Artificial Sequence
  Description of Artificial Sequence: Synthetic peptide
  Seed: SDPACYEFLW (MAGA3_HUMAN)
STPACYEFLW

SEQ ID NO: 59031 - protein, 9 aa, Artificial Sequence
  Description of Artificial Sequence: Synthetic peptide
  Seed: IAREGDCAP (MAGA3_HUMAN)
IVREGDCAY

SEQ ID NO: 59032 - protein, 10 aa, Artificial Sequence
  Description of Artificial Sequence: Synthetic peptide
  Seed: MNYPLWSQSY (MAGA3_HUMAN)
MGYPLWSQSL

SEQ ID NO: 59033 - protein, 9 aa, Artificial Sequence
  Description of Artificial Sequence: Synthetic peptide
  Seed: YIFATCLGL (MAGA3_HUMAN)
YLFATCLGT

SEQ ID NO: 59034 - protein, 10 aa, Artificial Sequence
  Description of Artificial Sequence: Synthetic peptide
  Seed: FLWGPRALVE (MAGA3_HUMAN)
FIWGPRALVL

SEQ ID NO: 59035 - protein, 9 aa, Artificial Sequence
  Description of Artificial Sequence: Synthetic peptide
  Seed: IFSKASSSL (MAGA3_HUMAN)
IQSKASSSM

SEQ ID NO: 59036 - protein, 11 aa, Artificial Sequence
  Description of Artificial Sequence: Synthetic peptide
  Seed: HLYIFATCLGL (MAGA3_HUMAN)
HMYIFATCLGV

SEQ ID NO: 59037 - protein, 10 aa, Artificial Sequence
  Description of Artificial Sequence: Synthetic peptide
  Seed: ISYPPLHEWV (MAGA3_HUMAN)
IKYPPLHEWI

SEQ ID NO: 59038 - protein, 10 aa, Artificial Sequence
  Description of Artificial Sequence: Synthetic peptide
  Seed: SLPTTMNYPL (MAGA3_HUMAN)
SEPTTMNYPL

SEQ ID NO: 59039 - protein, 9 aa, Artificial Sequence
  Description of Artificial Sequence: Synthetic peptide
  Seed: TFPDLESEF (MAGA3_HUMAN)
TAPDLESEI

SEQ ID NO: 59040 - protein, 9 aa, Artificial Sequence
  Description of Artificial Sequence: Synthetic peptide
  Seed: TFPDLESEF (MAGA3_HUMAN)
TFPDLESEI

SEQ ID NO: 59041 - protein, 10 aa, Artificial Sequence
  Description of Artificial Sequence: Synthetic peptide
  Seed: WEELSVLEVF (MAGA3_HUMAN)
WWELSVLEVL

SEQ ID NO: 59042 - protein, 9 aa, Artificial Sequence
  Description of Artificial Sequence: Synthetic peptide
  Seed: KVLHHMVKI (MAGA3_HUMAN)
KQLHHMVKL

SEQ ID NO: 59043 - protein, 10 aa, Artificial Sequence
  Description of Artificial Sequence: Synthetic peptide
  Seed: EMLGSVVGNW (MAGA3_HUMAN)
ETLGSVVGNF

SEQ ID NO: 59044 - protein, 10 aa, Artificial Sequence
  Description of Artificial Sequence: Synthetic peptide
  Seed: FFPVIFSKAS (MAGA3_HUMAN)
FCPVIFSKAV

SEQ ID NO: 59045 - protein, 9 aa, Artificial Sequence
  Description of Artificial Sequence: Synthetic peptide
  Seed: VKISGGPHI (MAGA3_HUMAN)
VHISGGPHY

SEQ ID NO: 59046 - protein, 10 aa, Artificial Sequence
  Description of Artificial Sequence: Synthetic peptide
  Seed: EVDPIGHLYI (MAGA3_HUMAN)
EVDPIGHLYV

SEQ ID NO: 59047 - protein, 10 aa, Artificial Sequence
  Description of Artificial Sequence: Synthetic peptide
  Seed: EAASSSSTLV (MAGA3_HUMAN)
EIASSSSTLV

SEQ ID NO: 59048 - protein, 9 aa, Artificial Sequence
  Description of Artificial Sequence: Synthetic peptide
  Seed: EAASSSSTL (MAGA3_HUMAN)
ESASSSSTK

SEQ ID NO: 59049 - protein, 9 aa, Artificial Sequence
  Description of Artificial Sequence: Synthetic peptide
  Seed: ILGDPKKLL (MAGA3_HUMAN)
ILGDPKKLV

SEQ ID NO: 59050 - protein, 10 aa, Artificial Sequence
  Description of Artificial Sequence: Synthetic peptide
  Seed: LYIFATCLGL (MAGA3_HUMAN)
LYIFATCLGI

SEQ ID NO: 59051 - protein, 9 aa, Artificial Sequence
  Description of Artificial Sequence: Synthetic peptide
  Seed: ASSSLQLVF (MAGA3_HUMAN)
ATSSLQLVY

SEQ ID NO: 59052 - protein, 9 aa, Artificial Sequence
  Description of Artificial Sequence: Synthetic peptide
  Seed: YVKVLHHMV (MAGA3_HUMAN)
YPKVLHHMM

SEQ ID NO: 59053 - protein, 10 aa, Artificial Sequence
  Description of Artificial Sequence: Synthetic peptide
  Seed: FSKASSSLQL (MAGA3_HUMAN)
FAKASSSLQY

SEQ ID NO: 59054 - protein, 9 aa, Artificial Sequence
  Description of Artificial Sequence: Synthetic peptide
  Seed: MPKAGLLII (MAGA3_HUMAN)
MPKAGLLIF

SEQ ID NO: 59055 - protein, 10 aa, Artificial Sequence
  Description of Artificial Sequence: Synthetic peptide
  Seed: YIFATCLGLS (MAGA3_HUMAN)
YLFATCLGLL

SEQ ID NO: 59056 - protein, 8 aa, Artificial Sequence
  Description of Artificial Sequence: Synthetic peptide
  Seed: SYPPLHEW (MAGA3_HUMAN)
SWPPLHEF

SEQ ID NO: 59057 - protein, 10 aa, Artificial Sequence
  Description of Artificial Sequence: Synthetic peptide
  Seed: HISYPPLHEW (MAGA3_HUMAN)
HISYPPLHEM

SEQ ID NO: 59058 - protein, 9 aa, Artificial Sequence
  Description of Artificial Sequence: Synthetic peptide
  Seed: SSLPTTMNY (MAGA3_HUMAN)
SSLPTTMNK

SEQ ID NO: 59059 - protein, 10 aa, Artificial Sequence
  Description of Artificial Sequence: Synthetic peptide
  Seed: STFPDLESEF (MAGA3_HUMAN)
SMFPDLESEK

SEQ ID NO: 59060 - protein, 10 aa, Artificial Sequence
  Description of Artificial Sequence: Synthetic peptide
  Seed: KASSSLQLVF (MAGA3_HUMAN)
KSSSSLQLVY

SEQ ID NO: 59061 - protein, 10 aa, Artificial Sequence
  Description of Artificial Sequence: Synthetic peptide
  Seed: YIFATCLGLS (MAGA3_HUMAN)
YQFATCLGLM

SEQ ID NO: 59062 - protein, 10 aa, Artificial Sequence
  Description of Artificial Sequence: Synthetic peptide
  Seed: EVFEGREDSI (MAGA3_HUMAN)
EMFEGREDSW

SEQ ID NO: 59063 - protein, 9 aa, Artificial Sequence
  Description of Artificial Sequence: Synthetic peptide
  Seed: VVGNWQYFF (MAGA3_HUMAN)
VFGNWQYFL

SEQ ID NO: 59064 - protein, 11 aa, Artificial Sequence
  Description of Artificial Sequence: Synthetic peptide
  Seed: QHCKPEEGLEA (MAGA3_HUMAN)
QHCKPEEGLEV

SEQ ID NO: 59065 - protein, 9 aa, Artificial Sequence
  Description of Artificial Sequence: Synthetic peptide
  Seed: SSSSTLVEV (MAGA3_HUMAN)
STSSTLVEF

SEQ ID NO: 59066 - protein, 9 aa, Artificial Sequence
  Description of Artificial Sequence: Synthetic peptide
  Seed: ALVETSYVK (MAGA3_HUMAN)
AAVETSYVM

SEQ ID NO: 59067 - protein, 9 aa, Artificial Sequence
  Description of Artificial Sequence: Synthetic peptide
  Seed: GSDPACYEF (MAGA3_HUMAN)
GSDPACYEV

SEQ ID NO: 59068 - protein, 11 aa, Artificial Sequence
  Description of Artificial Sequence: Synthetic peptide
  Seed: RQVPGSDPACY (MAGA3_HUMAN)
RMVPGSDPACK

SEQ ID NO: 59069 - protein, 9 aa, Artificial Sequence
  Description of Artificial Sequence: Synthetic peptide
  Seed: KIWEELSVL (MAGA3_HUMAN)
KTWEELSVA

SEQ ID NO: 59070 - protein, 9 aa, Artificial Sequence
  Description of Artificial Sequence: Synthetic peptide
  Seed: KIWEELSVL (MAGA3_HUMAN)
KQWEELSVW

SEQ ID NO: 59071 - protein, 9 aa, Artificial Sequence
  Description of Artificial Sequence: Synthetic peptide
  Seed: FQAALSRKV (MAGA3_HUMAN)
FVAALSRKM

SEQ ID NO: 59072 - protein, 9 aa, Artificial Sequence
  Description of Artificial Sequence: Synthetic peptide
  Seed: GNWQYFFPV (MAGA3_HUMAN)
GAWQYFFPV

SEQ ID NO: 59073 - protein, 9 aa, Artificial Sequence
  Description of Artificial Sequence: Synthetic peptide
  Seed: TFPDLESEF (MAGA3_HUMAN)
TSPDLESEM

SEQ ID NO: 59074 - protein, 9 aa, Artificial Sequence
  Description of Artificial Sequence: Synthetic peptide
  Seed: LPTTMNYPL (MAGA3_HUMAN)
LRTTMNYPL

SEQ ID NO: 59075 - protein, 9 aa, Artificial Sequence
  Description of Artificial Sequence: Synthetic peptide
  Seed: SEFQAALSR (MAGA3_HUMAN)
SIFQAALSY

SEQ ID NO: 59076 - protein, 9 aa, Artificial Sequence
  Description of Artificial Sequence: Synthetic peptide
  Seed: EVDPIGHLY (MAGA3_HUMAN)
ESDPIGHLI

SEQ ID NO: 59077 - protein, 9 aa, Artificial Sequence
  Description of Artificial Sequence: Synthetic peptide
  Seed: LESEFQAAL (MAGA3_HUMAN)
LVSEFQAAF

SEQ ID NO: 59078 - protein, 10 aa, Artificial Sequence
  Description of Artificial Sequence: Synthetic peptide
  Seed: YIFATCLGLS (MAGA3_HUMAN)
YMFATCLGLS

SEQ ID NO: 59079 - protein, 9 aa, Artificial Sequence
  Description of Artificial Sequence: Synthetic peptide
  Seed: LVHFLLLKY (MAGA3_HUMAN)
LIHFLLLKK

SEQ ID NO: 59080 - protein, 9 aa, Artificial Sequence
  Description of Artificial Sequence: Synthetic peptide
  Seed: RKVAELVHF (MAGA3_HUMAN)
RIVAELVHF

SEQ ID NO: 59081 - protein, 10 aa, Artificial Sequence
  Description of Artificial Sequence: Synthetic peptide
  Seed: YFFPVIFSKA (MAGA3_HUMAN)
YVFPVIFSKA

SEQ ID NO: 59082 - protein, 10 aa, Artificial Sequence
  Description of Artificial Sequence: Synthetic peptide
  Seed: LPTTMNYPLW (MAGA3_HUMAN)
LVTTMNYPLW

SEQ ID NO: 59083 - protein, 10 aa, Artificial Sequence
  Description of Artificial Sequence: Synthetic peptide
  Seed: AALSRKVAEL (MAGA3_HUMAN)
ANLSRKVAEV

SEQ ID NO: 59084 - protein, 9 aa, Artificial Sequence
  Description of Artificial Sequence: Synthetic peptide
  Seed: NQIMPKAGL (MAGA3_HUMAN)
NLIMPKAGY

SEQ ID NO: 59085 - protein, 9 aa, Artificial Sequence
  Description of Artificial Sequence: Synthetic peptide
  Seed: SVLEVFEGR (MAGA3_HUMAN)
SVLEVFEGY

SEQ ID NO: 59086 - protein, 10 aa, Artificial Sequence
  Description of Artificial Sequence: Synthetic peptide
  Seed: RKVAELVHFL (MAGA3_HUMAN)
RNVAELVHFI

SEQ ID NO: 59087 - protein, 10 aa, Artificial Sequence
  Description of Artificial Sequence: Synthetic peptide
  Seed: HFVQENYLEY (MAGA3_HUMAN)
HYVQENYLEF

SEQ ID NO: 59088 - protein, 10 aa, Artificial Sequence
  Description of Artificial Sequence: Synthetic peptide
  Seed: ETSYVKVLHH (MAGA3_HUMAN)
EMSYVKVLHK

SEQ ID NO: 59089 - protein, 11 aa, Artificial Sequence
  Description of Artificial Sequence: Synthetic peptide
  Seed: GSDPACYEFLW (MAGA3_HUMAN)
GADPACYEFLW

SEQ ID NO: 59090 - protein, 9 aa, Artificial Sequence
  Description of Artificial Sequence: Synthetic peptide
  Seed: IMPKAGLLI (MAGA3_HUMAN)
ITPKAGLLF

SEQ ID NO: 59091 - protein, 9 aa, Artificial Sequence
  Description of Artificial Sequence: Synthetic peptide
  Seed: RALVETSYV (MAGA3_HUMAN)
RVLVETSYI

SEQ ID NO: 59092 - protein, 9 aa, Artificial Sequence
  Description of Artificial Sequence: Synthetic peptide
  Seed: FVQENYLEY (MAGA3_HUMAN)
FLQENYLEL

SEQ ID NO: 59093 - protein, 9 aa, Artificial Sequence
  Description of Artificial Sequence: Synthetic peptide
  Seed: YIFATCLGL (MAGA3_HUMAN)
YSFATCLGV

SEQ ID NO: 59094 - protein, 9 aa, Artificial Sequence
  Description of Artificial Sequence: Synthetic peptide
  Seed: MPKAGLLII (MAGA3_HUMAN)
MQKAGLLIF

SEQ ID NO: 59095 - protein, 10 aa, Artificial Sequence
  Description of Artificial Sequence: Synthetic peptide
  Seed: FVQENYLEYR (MAGA3_HUMAN)
FSQENYLEYY

SEQ ID NO: 59096 - protein, 9 aa, Artificial Sequence
  Description of Artificial Sequence: Synthetic peptide
  Seed: LESEFQAAL (MAGA3_HUMAN)
LMSEFQAAF

SEQ ID NO: 59097 - protein, 8 aa, Artificial Sequence
  Description of Artificial Sequence: Synthetic peptide
  Seed: SGGPHISY (MAGA3_HUMAN)
SSGPHISM

SEQ ID NO: 59098 - protein, 9 aa, Artificial Sequence
  Description of Artificial Sequence: Synthetic peptide
  Seed: LGDPKKLLT (MAGA3_HUMAN)
LADPKKLLA

SEQ ID NO: 59099 - protein, 10 aa, Artificial Sequence
  Description of Artificial Sequence: Synthetic peptide
  Seed: RKVAELVHFL (MAGA3_HUMAN)
RRVAELVHFF

SEQ ID NO: 59100 - protein, 10 aa, Artificial Sequence
  Description of Artificial Sequence: Synthetic peptide
  Seed: WEELSVLEVF (MAGA3_HUMAN)
WQELSVLEVF

SEQ ID NO: 59101 - protein, 10 aa, Artificial Sequence
  Description of Artificial Sequence: Synthetic peptide
  Seed: LVFGIELMEV (MAGA3_HUMAN)
LMFGIELMEI

SEQ ID NO: 59102 - protein, 9 aa, Artificial Sequence
  Description of Artificial Sequence: Synthetic peptide
  Seed: LQLVFGIEL (MAGA3_HUMAN)
LALVFGIEF

SEQ ID NO: 59103 - protein, 9 aa, Artificial Sequence
  Description of Artificial Sequence: Synthetic peptide
  Seed: YPPLHEWVL (MAGA3_HUMAN)
YPPLHEWVW

SEQ ID NO: 59104 - protein, 10 aa, Artificial Sequence
  Description of Artificial Sequence: Synthetic peptide
  Seed: RQVPGSDPAC (MAGA3_HUMAN)
RSVPGSDPAY

SEQ ID NO: 59105 - protein, 9 aa, Artificial Sequence
  Description of Artificial Sequence: Synthetic peptide
  Seed: KASSSLQLV (MAGA3_HUMAN)
KVSSSLQLW

SEQ ID NO: 59106 - protein, 11 aa, Artificial Sequence
  Description of Artificial Sequence: Synthetic peptide
  Seed: KVAELVHFLLL (MAGA3_HUMAN)
KMAELVHFLLE

SEQ ID NO: 59107 - protein, 9 aa, Artificial Sequence
  Description of Artificial Sequence: Synthetic peptide
  Seed: FVQENYLEY (MAGA3_HUMAN)
FSQENYLEM

SEQ ID NO: 59108 - protein, 9 aa, Artificial Sequence
  Description of Artificial Sequence: Synthetic peptide
  Seed: KVLHHMVKI (MAGA3_HUMAN)
KILHHMVKI

SEQ ID NO: 59109 - protein, 10 aa, Artificial Sequence
  Description of Artificial Sequence: Synthetic peptide
  Seed: SLQLVFGIEL (MAGA3_HUMAN)
SDQLVFGIEF

SEQ ID NO: 59110 - protein, 9 aa, Artificial Sequence
  Description of Artificial Sequence: Synthetic peptide
  Seed: YIFATCLGL (MAGA3_HUMAN)
YRFATCLGY

SEQ ID NO: 59111 - protein, 9 aa, Artificial Sequence
  Description of Artificial Sequence: Synthetic peptide
  Seed: YPLWSQSYE (MAGA3_HUMAN)
YPLWSQSYL

SEQ ID NO: 59112 - protein, 10 aa, Artificial Sequence
  Description of Artificial Sequence: Synthetic peptide
  Seed: MEVDPIGHLY (MAGA3_HUMAN)
MEVDPIGHLI

SEQ ID NO: 59113 - protein, 11 aa, Artificial Sequence
  Description of Artificial Sequence: Synthetic peptide
  Seed: RQVPGSDPACY (MAGA3_HUMAN)
RTVPGSDPACW

SEQ ID NO: 59114 - protein, 10 aa, Artificial Sequence
  Description of Artificial Sequence: Synthetic peptide
  Seed: KASSSLQLVF (MAGA3_HUMAN)
KLSSSLQLVI

SEQ ID NO: 59115 - protein, 9 aa, Artificial Sequence
  Description of Artificial Sequence: Synthetic peptide
  Seed: SVLEVFEGR (MAGA3_HUMAN)
SSLEVFEGR

SEQ ID NO: 59116 - protein, 8 aa, Artificial Sequence
  Description of Artificial Sequence: Synthetic peptide
  Seed: SGGPHISY (MAGA3_HUMAN)
SYGPHISM

SEQ ID NO: 59117 - protein, 9 aa, Artificial Sequence
  Description of Artificial Sequence: Synthetic peptide
  Seed: SKASSSLQL (MAGA3_HUMAN)
SAASSSLQY

SEQ ID NO: 59118 - protein, 9 aa, Artificial Sequence
  Description of Artificial Sequence: Synthetic peptide
  Seed: GSDPACYEF (MAGA3_HUMAN)
GMDPACYEM

SEQ ID NO: 59119 - protein, 9 aa, Artificial Sequence
  Description of Artificial Sequence: Synthetic peptide
  Seed: KIWEELSVL (MAGA3_HUMAN)
KKWEELSVI

SEQ ID NO: 59120 - protein, 9 aa, Artificial Sequence
  Description of Artificial Sequence: Synthetic peptide
  Seed: ISYPPLHEW (MAGA3_HUMAN)
IRYPPLHEA

SEQ ID NO: 59121 - protein, 9 aa, Artificial Sequence
  Description of Artificial Sequence: Synthetic peptide
  Seed: LVHFLLLKY (MAGA3_HUMAN)
LSHFLLLKW

SEQ ID NO: 59122 - protein, 9 aa, Artificial Sequence
  Description of Artificial Sequence: Synthetic peptide
  Seed: IMPKAGLLI (MAGA3_HUMAN)
ITPKAGLLW

SEQ ID NO: 59123 - protein, 9 aa, Artificial Sequence
  Description of Artificial Sequence: Synthetic peptide
  Seed: SKASSSLQL (MAGA3_HUMAN)
SMASSSLQF

SEQ ID NO: 59124 - protein, 10 aa, Artificial Sequence
  Description of Artificial Sequence: Synthetic peptide
  Seed: FSKASSSLQL (MAGA3_HUMAN)
FDKASSSLQF

SEQ ID NO: 59125 - protein, 10 aa, Artificial Sequence
  Description of Artificial Sequence: Synthetic peptide
  Seed: QYFFPVIFSK (MAGA3_HUMAN)
QKFFPVIFSK

SEQ ID NO: 59126 - protein, 10 aa, Artificial Sequence
  Description of Artificial Sequence: Synthetic peptide
  Seed: WEELSVLEVF (MAGA3_HUMAN)
WKELSVLEVF

SEQ ID NO: 59127 - protein, 9 aa, Artificial Sequence
  Description of Artificial Sequence: Synthetic peptide
  Seed: RKVAELVHF (MAGA3_HUMAN)
RQVAELVHH

SEQ ID NO: 59128 - protein, 9 aa, Artificial Sequence
  Description of Artificial Sequence: Synthetic peptide
  Seed: KVAELVHFL (MAGA3_HUMAN)
KMAELVHFL

SEQ ID NO: 59129 - protein, 10 aa, Artificial Sequence
  Description of Artificial Sequence: Synthetic peptide
  Seed: GSDPACYEFL (MAGA3_HUMAN)
GMDPACYEFY

SEQ ID NO: 59130 - protein, 9 aa, Artificial Sequence
  Description of Artificial Sequence: Synthetic peptide
  Seed: SSTLVEVTL (MAGA3_HUMAN)
STTLVEVTF

SEQ ID NO: 59131 - protein, 9 aa, Artificial Sequence
  Description of Artificial Sequence: Synthetic peptide
  Seed: TSYVKVLHH (MAGA3_HUMAN)
TTYVKVLHH

SEQ ID NO: 59132 - protein, 9 aa, Artificial Sequence
  Description of Artificial Sequence: Synthetic peptide
  Seed: LQLVFGIEL (MAGA3_HUMAN)
LRLVFGIEY

SEQ ID NO: 59133 - protein, 10 aa, Artificial Sequence
  Description of Artificial Sequence: Synthetic peptide
  Seed: KISGGPHISY (MAGA3_HUMAN)
KQSGGPHISW

SEQ ID NO: 59134 - protein, 10 aa, Artificial Sequence
  Description of Artificial Sequence: Synthetic peptide
  Seed: LYIFATCLGL (MAGA3_HUMAN)
LCIFATCLGV

SEQ ID NO: 59135 - protein, 10 aa, Artificial Sequence
  Description of Artificial Sequence: Synthetic peptide
  Seed: KASSSLQLVF (MAGA3_HUMAN)
KISSSLQLVF

SEQ ID NO: 59136 - protein, 9 aa, Artificial Sequence
  Description of Artificial Sequence: Synthetic peptide
  Seed: QSPQGASSL (MAGA3_HUMAN)
QFPQGASSY

SEQ ID NO: 59137 - protein, 10 aa, Artificial Sequence
  Description of Artificial Sequence: Synthetic peptide
  Seed: LGSVVGNWQY (MAGA3_HUMAN)
LGSVVGNWQF

SEQ ID NO: 59138 - protein, 9 aa, Artificial Sequence
  Description of Artificial Sequence: Synthetic peptide
  Seed: SVLEVFEGR (MAGA3_HUMAN)
SWLEVFEGR

SEQ ID NO: 59139 - protein, 10 aa, Artificial Sequence
  Description of Artificial Sequence: Synthetic peptide
  Seed: VDPIGHLYIF (MAGA3_HUMAN)
VGPIGHLYIW

SEQ ID NO: 59140 - protein, 10 aa, Artificial Sequence
  Description of Artificial Sequence: Synthetic peptide
  Seed: LPTTMNYPLW (MAGA3_HUMAN)
LETTMNYPLW

SEQ ID NO: 59141 - protein, 10 aa, Artificial Sequence
  Description of Artificial Sequence: Synthetic peptide
  Seed: ISYPPLHEWV (MAGA3_HUMAN)
INYPPLHEWI

SEQ ID NO: 59142 - protein, 10 aa, Artificial Sequence
  Description of Artificial Sequence: Synthetic peptide
  Seed: GSDPACYEFL (MAGA3_HUMAN)
GSDPACYEFY

SEQ ID NO: 59143 - protein, 8 aa, Artificial Sequence
  Description of Artificial Sequence: Synthetic peptide
  Seed: YVKVLHHM (MAGA3_HUMAN)
YSKVLHHM

SEQ ID NO: 59144 - protein, 9 aa, Artificial Sequence
  Description of Artificial Sequence: Synthetic peptide
  Seed: GSVVGNWQY (MAGA3_HUMAN)
GTVVGNWQW

SEQ ID NO: 59145 - protein, 10 aa, Artificial Sequence
  Description of Artificial Sequence: Synthetic peptide
  Seed: VDPIGHLYIF (MAGA3_HUMAN)
VNPIGHLYIY

SEQ ID NO: 59146 - protein, 8 aa, Artificial Sequence
  Description of Artificial Sequence: Synthetic peptide
  Seed: LGDPKKLL (MAGA3_HUMAN)
LADPKKLI

SEQ ID NO: 59147 - protein, 9 aa, Artificial Sequence
  Description of Artificial Sequence: Synthetic peptide
  Seed: SSTLVEVTL (MAGA3_HUMAN)
SRTLVEVTF

SEQ ID NO: 59148 - protein, 9 aa, Artificial Sequence
  Description of Artificial Sequence: Synthetic peptide
  Seed: KVLHHMVKI (MAGA3_HUMAN)
KLLHHMVKI

SEQ ID NO: 59149 - protein, 10 aa, Artificial Sequence
  Description of Artificial Sequence: Synthetic peptide
  Seed: NQEEEGPSTF (MAGA3_HUMAN)
NAEEEGPSTL

SEQ ID NO: 59150 - protein, 10 aa, Artificial Sequence
  Description of Artificial Sequence: Synthetic peptide
  Seed: SSSTLVEVTL (MAGA3_HUMAN)
SDSTLVEVTW

SEQ ID NO: 59151 - protein, 9 aa, Artificial Sequence
  Description of Artificial Sequence: Synthetic peptide
  Seed: YIFATCLGL (MAGA3_HUMAN)
YCFATCLGY

SEQ ID NO: 59152 - protein, 11 aa, Artificial Sequence
  Description of Artificial Sequence: Synthetic peptide
  Seed: STFPDLESEFQ (MAGA3_HUMAN)
SSFPDLESEFY

SEQ ID NO: 59153 - protein, 9 aa, Artificial Sequence
  Description of Artificial Sequence: Synthetic peptide
  Seed: VVGNWQYFF (MAGA3_HUMAN)
VWGNWQYFL

SEQ ID NO: 59154 - protein, 9 aa, Artificial Sequence
  Description of Artificial Sequence: Synthetic peptide
  Seed: LPTTMNYPL (MAGA3_HUMAN)
LPTTMNYPV

SEQ ID NO: 59155 - protein, 10 aa, Artificial Sequence
  Description of Artificial Sequence: Synthetic peptide
  Seed: HISYPPLHEW (MAGA3_HUMAN)
HRSYPPLHEF

SEQ ID NO: 59156 - protein, 9 aa, Artificial Sequence
  Description of Artificial Sequence: Synthetic peptide
  Seed: SSLPTTMNY (MAGA3_HUMAN)
SMLPTTMNY

SEQ ID NO: 59157 - protein, 9 aa, Artificial Sequence
  Description of Artificial Sequence: Synthetic peptide
  Seed: YIFATCLGL (MAGA3_HUMAN)
YMFATCLGK

SEQ ID NO: 59158 - protein, 10 aa, Artificial Sequence
  Description of Artificial Sequence: Synthetic peptide
  Seed: ASSLPTTMNY (MAGA3_HUMAN)
AHSLPTTMNY

SEQ ID NO: 59159 - protein, 9 aa, Artificial Sequence
  Description of Artificial Sequence: Synthetic peptide
  Seed: KASSSLQLV (MAGA3_HUMAN)
KMSSSLQLW

SEQ ID NO: 59160 - protein, 9 aa, Artificial Sequence
  Description of Artificial Sequence: Synthetic peptide
  Seed: SVVGNWQYF (MAGA3_HUMAN)
SLVGNWQYF

SEQ ID NO: 59161 - protein, 9 aa, Artificial Sequence
  Description of Artificial Sequence: Synthetic peptide
  Seed: DSILGDPKK (MAGA3_HUMAN)
DTILGDPKR

SEQ ID NO: 59162 - protein, 10 aa, Artificial Sequence
  Description of Artificial Sequence: Synthetic peptide
  Seed: LGLVGAQAPA (MAGA3_HUMAN)
LHLVGAQAPL

SEQ ID NO: 59163 - protein, 10 aa, Artificial Sequence
  Description of Artificial Sequence: Synthetic peptide
  Seed: ESPDPPQSPQ (MAGA3_HUMAN)
EIPDPPQSPR

SEQ ID NO: 59164 - protein, 10 aa, Artificial Sequence
  Description of Artificial Sequence: Synthetic peptide
  Seed: KASSSLQLVF (MAGA3_HUMAN)
KLSSSLQLVL

SEQ ID NO: 59165 - protein, 9 aa, Artificial Sequence
  Description of Artificial Sequence: Synthetic peptide
  Seed: YIFATCLGL (MAGA3_HUMAN)
YVFATCLGM

SEQ ID NO: 59166 - protein, 9 aa, Artificial Sequence
  Description of Artificial Sequence: Synthetic peptide
  Seed: FQAALSRKV (MAGA3_HUMAN)
FKAALSRKF

SEQ ID NO: 59167 - protein, 9 aa, Artificial Sequence
  Description of Artificial Sequence: Synthetic peptide
  Seed: GASSLPTTM (MAGA3_HUMAN)
GTSSLPTTL

SEQ ID NO: 59168 - protein, 9 aa, Artificial Sequence
  Description of Artificial Sequence: Synthetic peptide
  Seed: SSTLVEVTL (MAGA3_HUMAN)
SETLVEVTA

SEQ ID NO: 59169 - protein, 9 aa, Artificial Sequence
  Description of Artificial Sequence: Synthetic peptide
  Seed: VTLGEVPAA (MAGA3_HUMAN)
VSLGEVPAF

SEQ ID NO: 59170 - protein, 9 aa, Artificial Sequence
  Description of Artificial Sequence: Synthetic peptide
  Seed: SKASSSLQL (MAGA3_HUMAN)
SMASSSLQI

SEQ ID NO: 59171 - protein, 9 aa, Artificial Sequence
  Description of Artificial Sequence: Synthetic peptide
  Seed: ELVHFLLLK (MAGA3_HUMAN)
EMVHFLLLK

SEQ ID NO: 59172 - protein, 10 aa, Artificial Sequence
  Description of Artificial Sequence: Synthetic peptide
  Seed: FATCLGLSYD (MAGA3_HUMAN)
FSTCLGLSYY

SEQ ID NO: 59173 - protein, 9 aa, Artificial Sequence
  Description of Artificial Sequence: Synthetic peptide
  Seed: SYVKVLHHM (MAGA3_HUMAN)
SAVKVLHHF

SEQ ID NO: 59174 - protein, 10 aa, Artificial Sequence
  Description of Artificial Sequence: Synthetic peptide
  Seed: GSDPACYEFL (MAGA3_HUMAN)
GADPACYEFL

SEQ ID NO: 59175 - protein, 10 aa, Artificial Sequence
  Description of Artificial Sequence: Synthetic peptide
  Seed: ASSLPTTMNY (MAGA3_HUMAN)
APSLPTTMNY

SEQ ID NO: 59176 - protein, 8 aa, Artificial Sequence
  Description of Artificial Sequence: Synthetic peptide
  Seed: LGDPKKLL (MAGA3_HUMAN)
LLDPKKLL

SEQ ID NO: 59177 - protein, 10 aa, Artificial Sequence
  Description of Artificial Sequence: Synthetic peptide
  Seed: AELVHFLLLK (MAGA3_HUMAN)
AALVHFLLLK

SEQ ID NO: 59178 - protein, 10 aa, Artificial Sequence
  Description of Artificial Sequence: Synthetic peptide
  Seed: ASSSSTLVEV (MAGA3_HUMAN)
ALSSSTLVEL

SEQ ID NO: 59179 - protein, 11 aa, Artificial Sequence
  Description of Artificial Sequence: Synthetic peptide
  Seed: KIWEELSVLEV (MAGA3_HUMAN)
KTWEELSVLEV

SEQ ID NO: 59180 - protein, 9 aa, Artificial Sequence
  Description of Artificial Sequence: Synthetic peptide
  Seed: QLVFGIELM (MAGA3_HUMAN)
QMVFGIELI

SEQ ID NO: 59181 - protein, 9 aa, Artificial Sequence
  Description of Artificial Sequence: Synthetic peptide
  Seed: KVLHHMVKI (MAGA3_HUMAN)
KALHHMVKK

SEQ ID NO: 59182 - protein, 9 aa, Artificial Sequence
  Description of Artificial Sequence: Synthetic peptide
  Seed: LGDPKKLLT (MAGA3_HUMAN)
LYDPKKLLM

SEQ ID NO: 59183 - protein, 9 aa, Artificial Sequence
  Description of Artificial Sequence: Synthetic peptide
  Seed: LQLVFGIEL (MAGA3_HUMAN)
LILVFGIEY

SEQ ID NO: 59184 - protein, 10 aa, Artificial Sequence
  Description of Artificial Sequence: Synthetic peptide
  Seed: VDPIGHLYIF (MAGA3_HUMAN)
VAPIGHLYIW

SEQ ID NO: 59185 - protein, 9 aa, Artificial Sequence
  Description of Artificial Sequence: Synthetic peptide
  Seed: HLYIFATCL (MAGA3_HUMAN)
HMYIFATCY

SEQ ID NO: 59186 - protein, 10 aa, Artificial Sequence
  Description of Artificial Sequence: Synthetic peptide
  Seed: ASSLPTTMNY (MAGA3_HUMAN)
AISLPTTMNY

SEQ ID NO: 59187 - protein, 11 aa, Artificial Sequence
  Description of Artificial Sequence: Synthetic peptide
  Seed: FLWGPRALVET (MAGA3_HUMAN)
FLWGPRALVEA

SEQ ID NO: 59188 - protein, 10 aa, Artificial Sequence
  Description of Artificial Sequence: Synthetic peptide
  Seed: EVFEGREDSI (MAGA3_HUMAN)
EIFEGREDSY

SEQ ID NO: 59189 - protein, 10 aa, Artificial Sequence
  Description of Artificial Sequence: Synthetic peptide
  Seed: RKVAELVHFL (MAGA3_HUMAN)
RRVAELVHFM

SEQ ID NO: 59190 - protein, 8 aa, Artificial Sequence
  Description of Artificial Sequence: Synthetic peptide
  Seed: AEMLGSVV (MAGA3_HUMAN)
AEMLGSVI

SEQ ID NO: 59191 - protein, 9 aa, Artificial Sequence
  Description of Artificial Sequence: Synthetic peptide
  Seed: QSPQGASSL (MAGA3_HUMAN)
QAPQGASSY

SEQ ID NO: 59192 - protein, 10 aa, Artificial Sequence
  Description of Artificial Sequence: Synthetic peptide
  Seed: AELVHFLLLK (MAGA3_HUMAN)
ALLVHFLLLR

SEQ ID NO: 59193 - protein, 9 aa, Artificial Sequence
  Description of Artificial Sequence: Synthetic peptide
  Seed: SSLQLVFGI (MAGA3_HUMAN)
SMLQLVFGI

SEQ ID NO: 59194 - protein, 10 aa, Artificial Sequence
  Description of Artificial Sequence: Synthetic peptide
  Seed: SSSTLVEVTL (MAGA3_HUMAN)
SCSTLVEVTW

SEQ ID NO: 59195 - protein, 11 aa, Artificial Sequence
  Description of Artificial Sequence: Synthetic peptide
  Seed: VKISGGPHISY (MAGA3_HUMAN)
VQISGGPHISF

SEQ ID NO: 59196 - protein, 9 aa, Artificial Sequence
  Description of Artificial Sequence: Synthetic peptide
  Seed: VTLGEVPAA (MAGA3_HUMAN)
VVLGEVPAY

SEQ ID NO: 59197 - protein, 10 aa, Artificial Sequence
  Description of Artificial Sequence: Synthetic peptide
  Seed: MEVDPIGHLY (MAGA3_HUMAN)
MNVDPIGHLY

SEQ ID NO: 59198 - protein, 11 aa, Artificial Sequence
  Description of Artificial Sequence: Synthetic peptide
  Seed: YIFATCLGLSY (MAGA3_HUMAN)
YEFATCLGLSY

SEQ ID NO: 59199 - protein, 11 aa, Artificial Sequence
  Description of Artificial Sequence: Synthetic peptide
  Seed: RQVPGSDPACY (MAGA3_HUMAN)
RAVPGSDPACL

SEQ ID NO: 59200 - protein, 10 aa, Artificial Sequence
  Description of Artificial Sequence: Synthetic peptide
  Seed: KVAELVHFLL (MAGA3_HUMAN)
KIAELVHFLK

SEQ ID NO: 59201 - protein, 9 aa, Artificial Sequence
  Description of Artificial Sequence: Synthetic peptide
  Seed: GASSLPTTM (MAGA3_HUMAN)
GMSSLPTTF

SEQ ID NO: 59202 - protein, 10 aa, Artificial Sequence
  Description of Artificial Sequence: Synthetic peptide
  Seed: SLQLVFGIEL (MAGA3_HUMAN)
SFQLVFGIEF

SEQ ID NO: 59203 - protein, 9 aa, Artificial Sequence
  Description of Artificial Sequence: Synthetic peptide
  Seed: ISYPPLHEW (MAGA3_HUMAN)
ICYPPLHEM

SEQ ID NO: 59204 - protein, 9 aa, Artificial Sequence
  Description of Artificial Sequence: Synthetic peptide
  Seed: GASSLPTTM (MAGA3_HUMAN)
GASSLPTTV

SEQ ID NO: 59205 - protein, 8 aa, Artificial Sequence
  Description of Artificial Sequence: Synthetic peptide
  Seed: GEVPAAES (MAGA3_HUMAN)
GEVPAAEA

SEQ ID NO: 59206 - protein, 10 aa, Artificial Sequence
  Description of Artificial Sequence: Synthetic peptide
  Seed: REDSILGDPK (MAGA3_HUMAN)
RVDSILGDPY

SEQ ID NO: 59207 - protein, 10 aa, Artificial Sequence
  Description of Artificial Sequence: Synthetic peptide
  Seed: KVAELVHFLL (MAGA3_HUMAN)
KIAELVHFLN

SEQ ID NO: 59208 - protein, 10 aa, Artificial Sequence
  Description of Artificial Sequence: Synthetic peptide
  Seed: GHLYIFATCL (MAGA3_HUMAN)
GILYIFATCV

SEQ ID NO: 59209 - protein, 10 aa, Artificial Sequence
  Description of Artificial Sequence: Synthetic peptide
  Seed: STFPDLESEF (MAGA3_HUMAN)
SIFPDLESEL

SEQ ID NO: 59210 - protein, 10 aa, Artificial Sequence
  Description of Artificial Sequence: Synthetic peptide
  Seed: LGLVGAQAPA (MAGA3_HUMAN)
LDLVGAQAPL

SEQ ID NO: 59211 - protein, 10 aa, Artificial Sequence
  Description of Artificial Sequence: Synthetic peptide
  Seed: MNYPLWSQSY (MAGA3_HUMAN)
MMYPLWSQSV

SEQ ID NO: 59212 - protein, 9 aa, Artificial Sequence
  Description of Artificial Sequence: Synthetic peptide
  Seed: GNWQYFFPV (MAGA3_HUMAN)
GTWQYFFPM

SEQ ID NO: 59213 - protein, 11 aa, Artificial Sequence
  Description of Artificial Sequence: Synthetic peptide
  Seed: PHISYPPLHEW (MAGA3_HUMAN)
PMISYPPLHEW

SEQ ID NO: 59214 - protein, 10 aa, Artificial Sequence
  Description of Artificial Sequence: Synthetic peptide
  Seed: KASSSLQLVF (MAGA3_HUMAN)
KASSSLQLVY

SEQ ID NO: 59215 - protein, 11 aa, Artificial Sequence
  Description of Artificial Sequence: Synthetic peptide
  Seed: HCKPEEGLEAR (MAGA3_HUMAN)
HMKPEEGLEAR

SEQ ID NO: 59216 - protein, 10 aa, Artificial Sequence
  Description of Artificial Sequence: Synthetic peptide
  Seed: ISYPPLHEWV (MAGA3_HUMAN)
IYYPPLHEWM

SEQ ID NO: 59217 - protein, 10 aa, Artificial Sequence
  Description of Artificial Sequence: Synthetic peptide
  Seed: SVVGNWQYFF (MAGA3_HUMAN)
SIVGNWQYFY

SEQ ID NO: 59218 - protein, 9 aa, Artificial Sequence
  Description of Artificial Sequence: Synthetic peptide
  Seed: MEVDPIGHL (MAGA3_HUMAN)
MVVDPIGHY

SEQ ID NO: 59219 - protein, 10 aa, Artificial Sequence
  Description of Artificial Sequence: Synthetic peptide
  Seed: HISYPPLHEW (MAGA3_HUMAN)
HMSYPPLHEM

SEQ ID NO: 59220 - protein, 9 aa, Artificial Sequence
  Description of Artificial Sequence: Synthetic peptide
  Seed: SSSSTLVEV (MAGA3_HUMAN)
SLSSTLVEL

SEQ ID NO: 59221 - protein, 9 aa, Artificial Sequence
  Description of Artificial Sequence: Synthetic peptide
  Seed: SYVKVLHHM (MAGA3_HUMAN)
SGVKVLHHY

SEQ ID NO: 59222 - protein, 11 aa, Artificial Sequence
  Description of Artificial Sequence: Synthetic peptide
  Seed: SSSSTLVEVTL (MAGA3_HUMAN)
STSSTLVEVTF

SEQ ID NO: 59223 - protein, 9 aa, Artificial Sequence
  Description of Artificial Sequence: Synthetic peptide
  Seed: ALGLVGAQA (MAGA3_HUMAN)
ALGLVGAQL

SEQ ID NO: 59224 - protein, 10 aa, Artificial Sequence
  Description of Artificial Sequence: Synthetic peptide
  Seed: ALVETSYVKV (MAGA3_HUMAN)
AMVETSYVKR

SEQ ID NO: 59225 - protein, 11 aa, Artificial Sequence
  Description of Artificial Sequence: Synthetic peptide
  Seed: SPDPPQSPQGA (MAGA3_HUMAN)
SPDPPQSPQGL

SEQ ID NO: 59226 - protein, 9 aa, Artificial Sequence
  Description of Artificial Sequence: Synthetic peptide
  Seed: YVKVLHHMV (MAGA3_HUMAN)
YAKVLHHMM

SEQ ID NO: 59227 - protein, 10 aa, Artificial Sequence
  Description of Artificial Sequence: Synthetic peptide
  Seed: NQIMPKAGLL (MAGA3_HUMAN)
NHIMPKAGLL

SEQ ID NO: 59228 - protein, 9 aa, Artificial Sequence
  Description of Artificial Sequence: Synthetic peptide
  Seed: EAASSSSTL (MAGA3_HUMAN)
ETASSSSTM

SEQ ID NO: 59229 - protein, 11 aa, Artificial Sequence
  Description of Artificial Sequence: Synthetic peptide
  Seed: SKASSSLQLVF (MAGA3_HUMAN)
SSASSSLQLVF

SEQ ID NO: 59230 - protein, 9 aa, Artificial Sequence
  Description of Artificial Sequence: Synthetic peptide
  Seed: GNWQYFFPV (MAGA3_HUMAN)
GVWQYFFPI

SEQ ID NO: 59231 - protein, 11 aa, Artificial Sequence
  Description of Artificial Sequence: Synthetic peptide
  Seed: KIWEELSVLEV (MAGA3_HUMAN)
KVWEELSVLEI

SEQ ID NO: 59232 - protein, 9 aa, Artificial Sequence
  Description of Artificial Sequence: Synthetic peptide
  Seed: IFSKASSSL (MAGA3_HUMAN)
IWSKASSSM

SEQ ID NO: 59233 - protein, 9 aa, Artificial Sequence
  Description of Artificial Sequence: Synthetic peptide
  Seed: SSLQLVFGI (MAGA3_HUMAN)
SQLQLVFGI

SEQ ID NO: 59234 - protein, 9 aa, Artificial Sequence
  Description of Artificial Sequence: Synthetic peptide
  Seed: YIFATCLGL (MAGA3_HUMAN)
YMFATCLGS

SEQ ID NO: 59235 - protein, 9 aa, Artificial Sequence
  Description of Artificial Sequence: Synthetic peptide
  Seed: SVVGNWQYF (MAGA3_HUMAN)
SFVGNWQYY

SEQ ID NO: 59236 - protein, 9 aa, Artificial Sequence
  Description of Artificial Sequence: Synthetic peptide
  Seed: EVDPIGHLY (MAGA3_HUMAN)
EPDPIGHLF

SEQ ID NO: 59237 - protein, 9 aa, Artificial Sequence
  Description of Artificial Sequence: Synthetic peptide
  Seed: KASSSLQLV (MAGA3_HUMAN)
KISSSLQLK

SEQ ID NO: 59238 - protein, 9 aa, Artificial Sequence
  Description of Artificial Sequence: Synthetic peptide
  Seed: VKISGGPHI (MAGA3_HUMAN)
VAISGGPHY

SEQ ID NO: 59239 - protein, 11 aa, Artificial Sequence
  Description of Artificial Sequence: Synthetic peptide
  Seed: WQYFFPVIFSK (MAGA3_HUMAN)
WGYFFPVIFSR

SEQ ID NO: 59240 - protein, 9 aa, Artificial Sequence
  Description of Artificial Sequence: Synthetic peptide
  Seed: MEVDPIGHL (MAGA3_HUMAN)
MRVDPIGHM

SEQ ID NO: 59241 - protein, 9 aa, Artificial Sequence
  Description of Artificial Sequence: Synthetic peptide
  Seed: SEFQAALSR (MAGA3_HUMAN)
SLFQAALSK

SEQ ID NO: 59242 - protein, 9 aa, Artificial Sequence
  Description of Artificial Sequence: Synthetic peptide
  Seed: LGDPKKLLT (MAGA3_HUMAN)
LVDPKKLLF

SEQ ID NO: 59243 - protein, 9 aa, Artificial Sequence
  Description of Artificial Sequence: Synthetic peptide
  Seed: ASSSLQLVF (MAGA3_HUMAN)
ATSSLQLVM

SEQ ID NO: 59244 - protein, 9 aa, Artificial Sequence
  Description of Artificial Sequence: Synthetic peptide
  Seed: RALVETSYV (MAGA3_HUMAN)
RWLVETSYY

SEQ ID NO: 59245 - protein, 9 aa, Artificial Sequence
  Description of Artificial Sequence: Synthetic peptide
  Seed: FVQENYLEY (MAGA3_HUMAN)
FAQENYLEW

SEQ ID NO: 59246 - protein, 9 aa, Artificial Sequence
  Description of Artificial Sequence: Synthetic peptide
  Seed: GLVGAQAPA (MAGA3_HUMAN)
GTVGAQAPV

SEQ ID NO: 59247 - protein, 9 aa, Artificial Sequence
  Description of Artificial Sequence: Synthetic peptide
  Seed: GNWQYFFPV (MAGA3_HUMAN)
GTWQYFFPV

SEQ ID NO: 59248 - protein, 9 aa, Artificial Sequence
  Description of Artificial Sequence: Synthetic peptide
  Seed: ALGLVGAQA (MAGA3_HUMAN)
ALGLVGAQV

SEQ ID NO: 59249 - protein, 9 aa, Artificial Sequence
  Description of Artificial Sequence: Synthetic peptide
  Seed: FQAALSRKV (MAGA3_HUMAN)
FIAALSRKL

SEQ ID NO: 59250 - protein, 9 aa, Artificial Sequence
  Description of Artificial Sequence: Synthetic peptide
  Seed: KASSSLQLV (MAGA3_HUMAN)
KQSSSLQLM

SEQ ID NO: 59251 - protein, 10 aa, Artificial Sequence
  Description of Artificial Sequence: Synthetic peptide
  Seed: ISYPPLHEWV (MAGA3_HUMAN)
IMYPPLHEWW

SEQ ID NO: 59252 - protein, 9 aa, Artificial Sequence
  Description of Artificial Sequence: Synthetic peptide
  Seed: SVVGNWQYF (MAGA3_HUMAN)
SWVGNWQYL

SEQ ID NO: 59253 - protein, 9 aa, Artificial Sequence
  Description of Artificial Sequence: Synthetic peptide
  Seed: HLYIFATCL (MAGA3_HUMAN)
HVYIFATCY

SEQ ID NO: 59254 - protein, 9 aa, Artificial Sequence
  Description of Artificial Sequence: Synthetic peptide
  Seed: KASSSLQLV (MAGA3_HUMAN)
KTSSSLQLA

SEQ ID NO: 59255 - protein, 10 aa, Artificial Sequence
  Description of Artificial Sequence: Synthetic peptide
  Seed: SSSTLVEVTL (MAGA3_HUMAN)
SYSTLVEVTW

SEQ ID NO: 59256 - protein, 10 aa, Artificial Sequence
  Description of Artificial Sequence: Synthetic peptide
  Seed: EMLGSVVGNW (MAGA3_HUMAN)
EILGSVVGNW

SEQ ID NO: 59257 - protein, 10 aa, Artificial Sequence
  Description of Artificial Sequence: Synthetic peptide
  Seed: MNYPLWSQSY (MAGA3_HUMAN)
MNYPLWSQSV

SEQ ID NO: 59258 - protein, 11 aa, Artificial Sequence
  Description of Artificial Sequence: Synthetic peptide
  Seed: RQVPGSDPACY (MAGA3_HUMAN)
RKVPGSDPACY

SEQ ID NO: 59259 - protein, 9 aa, Artificial Sequence
  Description of Artificial Sequence: Synthetic peptide
  Seed: YFFPVIFSK (MAGA3_HUMAN)
YMFPVIFSL

SEQ ID NO: 59260 - protein, 10 aa, Artificial Sequence
  Description of Artificial Sequence: Synthetic peptide
  Seed: IFATCLGLSY (MAGA3_HUMAN)
ILATCLGLSF

SEQ ID NO: 59261 - protein, 9 aa, Artificial Sequence
  Description of Artificial Sequence: Synthetic peptide
  Seed: IFSKASSSL (MAGA3_HUMAN)
IQSKASSSY

SEQ ID NO: 59262 - protein, 9 aa, Artificial Sequence
  Description of Artificial Sequence: Synthetic peptide
  Seed: VTLGEVPAA (MAGA3_HUMAN)
VSLGEVPAV

SEQ ID NO: 59263 - protein, 9 aa, Artificial Sequence
  Description of Artificial Sequence: Synthetic peptide
  Seed: KVAELVHFL (MAGA3_HUMAN)
KIAELVHFV

SEQ ID NO: 59264 - protein, 10 aa, Artificial Sequence
  Description of Artificial Sequence: Synthetic peptide
  Seed: SDPACYEFLW (MAGA3_HUMAN)
SFPACYEFLW

SEQ ID NO: 59265 - protein, 9 aa, Artificial Sequence
  Description of Artificial Sequence: Synthetic peptide
  Seed: IMPKAGLLI (MAGA3_HUMAN)
IMPKAGLLM

SEQ ID NO: 59266 - protein, 9 aa, Artificial Sequence
  Description of Artificial Sequence: Synthetic peptide
  Seed: VVGNWQYFF (MAGA3_HUMAN)
VTGNWQYFF

SEQ ID NO: 59267 - protein, 10 aa, Artificial Sequence
  Description of Artificial Sequence: Synthetic peptide
  Seed: RKVAELVHFL (MAGA3_HUMAN)
RMVAELVHFL

SEQ ID NO: 59268 - protein, 9 aa, Artificial Sequence
  Description of Artificial Sequence: Synthetic peptide
  Seed: SSLPTTMNY (MAGA3_HUMAN)
SMLPTTMNH

SEQ ID NO: 59269 - protein, 9 aa, Artificial Sequence
  Description of Artificial Sequence: Synthetic peptide
  Seed: NYPLWSQSY (MAGA3_HUMAN)
NRPLWSQSM

SEQ ID NO: 59270 - protein, 9 aa, Artificial Sequence
  Description of Artificial Sequence: Synthetic peptide
  Seed: ISYPPLHEW (MAGA3_HUMAN)
IIYPPLHEH

SEQ ID NO: 59271 - protein, 9 aa, Artificial Sequence
  Description of Artificial Sequence: Synthetic peptide
  Seed: AASSSSTLV (MAGA3_HUMAN)
ALSSSSTLA

SEQ ID NO: 59272 - protein, 10 aa, Artificial Sequence
  Description of Artificial Sequence: Synthetic peptide
  Seed: FLWGPRALVE (MAGA3_HUMAN)
FLWGPRALVL

SEQ ID NO: 59273 - protein, 11 aa, Artificial Sequence
  Description of Artificial Sequence: Synthetic peptide
  Seed: YIFATCLGLSY (MAGA3_HUMAN)
YMFATCLGLSL

SEQ ID NO: 59274 - protein, 8 aa, Artificial Sequence
  Description of Artificial Sequence: Synthetic peptide
  Seed: ILGDPKKL (MAGA3_HUMAN)
ISGDPKKL

SEQ ID NO: 59275 - protein, 10 aa, Artificial Sequence
  Description of Artificial Sequence: Synthetic peptide
  Seed: ISYPPLHEWV (MAGA3_HUMAN)
IAYPPLHEWW

SEQ ID NO: 59276 - protein, 10 aa, Artificial Sequence
  Description of Artificial Sequence: Synthetic peptide
  Seed: YRQVPGSDPA (MAGA3_HUMAN)
YMQVPGSDPL

SEQ ID NO: 59277 - protein, 9 aa, Artificial Sequence
  Description of Artificial Sequence: Synthetic peptide
  Seed: FVQENYLEY (MAGA3_HUMAN)
FGQENYLEY

SEQ ID NO: 59278 - protein, 9 aa, Artificial Sequence
  Description of Artificial Sequence: Synthetic peptide
  Seed: GSDPACYEF (MAGA3_HUMAN)
GVDPACYEV

SEQ ID NO: 59279 - protein, 10 aa, Artificial Sequence
  Description of Artificial Sequence: Synthetic peptide
  Seed: MVKISGGPHI (MAGA3_HUMAN)
MFKISGGPHF

SEQ ID NO: 59280 - protein, 9 aa, Artificial Sequence
  Description of Artificial Sequence: Synthetic peptide
  Seed: KVLHHMVKI (MAGA3_HUMAN)
KSLHHMVKR

SEQ ID NO: 59281 - protein, 9 aa, Artificial Sequence
  Description of Artificial Sequence: Synthetic peptide
  Seed: LLIIVLAII (MAGA3_HUMAN)
LVIIVLAIV

SEQ ID NO: 59282 - protein, 10 aa, Artificial Sequence
  Description of Artificial Sequence: Synthetic peptide
  Seed: KVAELVHFLL (MAGA3_HUMAN)
KLAELVHFLE

SEQ ID NO: 59283 - protein, 11 aa, Artificial Sequence
  Description of Artificial Sequence: Synthetic peptide
  Seed: STFPDLESEFQ (MAGA3_HUMAN)
SMFPDLESEFY

SEQ ID NO: 59284 - protein, 10 aa, Artificial Sequence
  Description of Artificial Sequence: Synthetic peptide
  Seed: KVAELVHFLL (MAGA3_HUMAN)
KAAELVHFLL

SEQ ID NO: 59285 - protein, 10 aa, Artificial Sequence
  Description of Artificial Sequence: Synthetic peptide
  Seed: YIFATCLGLS (MAGA3_HUMAN)
YLFATCLGLR

SEQ ID NO: 59286 - protein, 9 aa, Artificial Sequence
  Description of Artificial Sequence: Synthetic peptide
  Seed: KAGLLIIVL (MAGA3_HUMAN)
KMGLLIIVY

SEQ ID NO: 59287 - protein, 9 aa, Artificial Sequence
  Description of Artificial Sequence: Synthetic peptide
  Seed: SSLQLVFGI (MAGA3_HUMAN)
SILQLVFGW

SEQ ID NO: 59288 - protein, 9 aa, Artificial Sequence
  Description of Artificial Sequence: Synthetic peptide
  Seed: YFFPVIFSK (MAGA3_HUMAN)
YLFPVIFSK

SEQ ID NO: 59289 - protein, 10 aa, Artificial Sequence
  Description of Artificial Sequence: Synthetic peptide
  Seed: ISYPPLHEWV (MAGA3_HUMAN)
IVYPPLHEWF

SEQ ID NO: 59290 - protein, 9 aa, Artificial Sequence
  Description of Artificial Sequence: Synthetic peptide
  Seed: WQYFFPVIF (MAGA3_HUMAN)
WKYFFPVIM

SEQ ID NO: 59291 - protein, 10 aa, Artificial Sequence
  Description of Artificial Sequence: Synthetic peptide
  Seed: QEAASSSSTL (MAGA3_HUMAN)
QEAASSSSTV

SEQ ID NO: 59292 - protein, 9 aa, Artificial Sequence
  Description of Artificial Sequence: Synthetic peptide
  Seed: KVAELVHFL (MAGA3_HUMAN)
KIAELVHFF

SEQ ID NO: 59293 - protein, 9 aa, Artificial Sequence
  Description of Artificial Sequence: Synthetic peptide
  Seed: RALVETSYV (MAGA3_HUMAN)
RTLVETSYK

SEQ ID NO: 59294 - protein, 11 aa, Artificial Sequence
  Description of Artificial Sequence: Synthetic peptide
  Seed: WQYFFPVIFSK (MAGA3_HUMAN)
WWYFFPVIFSR

SEQ ID NO: 59295 - protein, 9 aa, Artificial Sequence
  Description of Artificial Sequence: Synthetic peptide
  Seed: ASSSLQLVF (MAGA3_HUMAN)
AQSSLQLVM

SEQ ID NO: 59296 - protein, 9 aa, Artificial Sequence
  Description of Artificial Sequence: Synthetic peptide
  Seed: MPKAGLLII (MAGA3_HUMAN)
MPKAGLLIW

SEQ ID NO: 59297 - protein, 9 aa, Artificial Sequence
  Description of Artificial Sequence: Synthetic peptide
  Seed: SEFQAALSR (MAGA3_HUMAN)
SEFQAALSL

SEQ ID NO: 59298 - protein, 10 aa, Artificial Sequence
  Description of Artificial Sequence: Synthetic peptide
  Seed: STFPDLESEF (MAGA3_HUMAN)
SQFPDLESEL

SEQ ID NO: 59299 - protein, 9 aa, Artificial Sequence
  Description of Artificial Sequence: Synthetic peptide
  Seed: VVGNWQYFF (MAGA3_HUMAN)
VVGNWQYFY

SEQ ID NO: 59300 - protein, 10 aa, Artificial Sequence
  Description of Artificial Sequence: Synthetic peptide
  Seed: MNYPLWSQSY (MAGA3_HUMAN)
MAYPLWSQSW

SEQ ID NO: 59301 - protein, 8 aa, Artificial Sequence
  Description of Artificial Sequence: Synthetic peptide
  Seed: GEALGLVG (MAGA3_HUMAN)
GEALGLVA

SEQ ID NO: 59302 - protein, 10 aa, Artificial Sequence
  Description of Artificial Sequence: Synthetic peptide
  Seed: LGLVGAQAPA (MAGA3_HUMAN)
LRLVGAQAPL

SEQ ID NO: 59303 - protein, 9 aa, Artificial Sequence
  Description of Artificial Sequence: Synthetic peptide
  Seed: QSPQGASSL (MAGA3_HUMAN)
QCPQGASSL

SEQ ID NO: 59304 - protein, 10 aa, Artificial Sequence
  Description of Artificial Sequence: Synthetic peptide
  Seed: ASSLPTTMNY (MAGA3_HUMAN)
AMSLPTTMNK

SEQ ID NO: 59305 - protein, 9 aa, Artificial Sequence
  Description of Artificial Sequence: Synthetic peptide
  Seed: WQYFFPVIF (MAGA3_HUMAN)
WKYFFPVIF

SEQ ID NO: 59306 - protein, 9 aa, Artificial Sequence
  Description of Artificial Sequence: Synthetic peptide
  Seed: KASSSLQLV (MAGA3_HUMAN)
KVSSSLQLK

SEQ ID NO: 59307 - protein, 10 aa, Artificial Sequence
  Description of Artificial Sequence: Synthetic peptide
  Seed: ASSSSTLVEV (MAGA3_HUMAN)
ALSSSTLVEV

SEQ ID NO: 59308 - protein, 9 aa, Artificial Sequence
  Description of Artificial Sequence: Synthetic peptide
  Seed: KVLHHMVKI (MAGA3_HUMAN)
KMLHHMVKL

SEQ ID NO: 59309 - protein, 10 aa, Artificial Sequence
  Description of Artificial Sequence: Synthetic peptide
  Seed: FFPVIFSKAS (MAGA3_HUMAN)
FWPVIFSKAA

SEQ ID NO: 59310 - protein, 9 aa, Artificial Sequence
  Description of Artificial Sequence: Synthetic peptide
  Seed: MEVDPIGHL (MAGA3_HUMAN)
MHVDPIGHM

SEQ ID NO: 59311 - protein, 9 aa, Artificial Sequence
  Description of Artificial Sequence: Synthetic peptide
  Seed: SSLQLVFGI (MAGA3_HUMAN)
SVLQLVFGV

SEQ ID NO: 59312 - protein, 10 aa, Artificial Sequence
  Description of Artificial Sequence: Synthetic peptide
  Seed: SEFQAALSRK (MAGA3_HUMAN)
SMFQAALSRK

SEQ ID NO: 59313 - protein, 9 aa, Artificial Sequence
  Description of Artificial Sequence: Synthetic peptide
  Seed: TSYVKVLHH (MAGA3_HUMAN)
TQYVKVLHR

SEQ ID NO: 59314 - protein, 9 aa, Artificial Sequence
  Description of Artificial Sequence: Synthetic peptide
  Seed: ISYPPLHEW (MAGA3_HUMAN)
INYPPLHEL

SEQ ID NO: 59315 - protein, 9 aa, Artificial Sequence
  Description of Artificial Sequence: Synthetic peptide
  Seed: RALVETSYV (MAGA3_HUMAN)
RMLVETSYI

SEQ ID NO: 59316 - protein, 11 aa, Artificial Sequence
  Description of Artificial Sequence: Synthetic peptide
  Seed: SKASSSLQLVF (MAGA3_HUMAN)
SIASSSLQLVW

SEQ ID NO: 59317 - protein, 9 aa, Artificial Sequence
  Description of Artificial Sequence: Synthetic peptide
  Seed: FVQENYLEY (MAGA3_HUMAN)
FVQENYLEV

SEQ ID NO: 59318 - protein, 9 aa, Artificial Sequence
  Description of Artificial Sequence: Synthetic peptide
  Seed: LVHFLLLKY (MAGA3_HUMAN)
LVHFLLLKK

SEQ ID NO: 59319 - protein, 9 aa, Artificial Sequence
  Description of Artificial Sequence: Synthetic peptide
  Seed: ASSSLQLVF (MAGA3_HUMAN)
AHSSLQLVF

SEQ ID NO: 59320 - protein, 10 aa, Artificial Sequence
  Description of Artificial Sequence: Synthetic peptide
  Seed: STFPDLESEF (MAGA3_HUMAN)
SYFPDLESEM

SEQ ID NO: 59321 - protein, 9 aa, Artificial Sequence
  Description of Artificial Sequence: Synthetic peptide
  Seed: VVGNWQYFF (MAGA3_HUMAN)
VHGNWQYFY

SEQ ID NO: 59322 - protein, 10 aa, Artificial Sequence
  Description of Artificial Sequence: Synthetic peptide
  Seed: YIFATCLGLS (MAGA3_HUMAN)
YMFATCLGLT

SEQ ID NO: 59323 - protein, 9 aa, Artificial Sequence
  Description of Artificial Sequence: Synthetic peptide
  Seed: AASSSSTLV (MAGA3_HUMAN)
AMSSSSTLL

SEQ ID NO: 59324 - protein, 9 aa, Artificial Sequence
  Description of Artificial Sequence: Synthetic peptide
  Seed: KVAELVHFL (MAGA3_HUMAN)
KMAELVHFR

SEQ ID NO: 59325 - protein, 9 aa, Artificial Sequence
  Description of Artificial Sequence: Synthetic peptide
  Seed: EVDPIGHLY (MAGA3_HUMAN)
ECDPIGHLL

SEQ ID NO: 59326 - protein, 9 aa, Artificial Sequence
  Description of Artificial Sequence: Synthetic peptide
  Seed: RQVPGSDPA (MAGA3_HUMAN)
RMVPGSDPA

SEQ ID NO: 59327 - protein, 10 aa, Artificial Sequence
  Description of Artificial Sequence: Synthetic peptide
  Seed: STFPDLESEF (MAGA3_HUMAN)
SLFPDLESEM

SEQ ID NO: 59328 - protein, 9 aa, Artificial Sequence
  Description of Artificial Sequence: Synthetic peptide
  Seed: ISYPPLHEW (MAGA3_HUMAN)
ITYPPLHEV

SEQ ID NO: 59329 - protein, 10 aa, Artificial Sequence
  Description of Artificial Sequence: Synthetic peptide
  Seed: MEVDPIGHLY (MAGA3_HUMAN)
MDVDPIGHLY

SEQ ID NO: 59330 - protein, 10 aa, Artificial Sequence
  Description of Artificial Sequence: Synthetic peptide
  Seed: WEELSVLEVF (MAGA3_HUMAN)
WDELSVLEVL

SEQ ID NO: 59331 - protein, 10 aa, Artificial Sequence
  Description of Artificial Sequence: Synthetic peptide
  Seed: VDPIGHLYIF (MAGA3_HUMAN)
VWPIGHLYIY

SEQ ID NO: 59332 - protein, 9 aa, Artificial Sequence
  Description of Artificial Sequence: Synthetic peptide
  Seed: GNWQYFFPV (MAGA3_HUMAN)
GVWQYFFPV

SEQ ID NO: 59333 - protein, 8 aa, Artificial Sequence
  Description of Artificial Sequence: Synthetic peptide
  Seed: ASSLPTTM (MAGA3_HUMAN)
AASLPTTM

SEQ ID NO: 59334 - protein, 10 aa, Artificial Sequence
  Description of Artificial Sequence: Synthetic peptide
  Seed: WEELSVLEVF (MAGA3_HUMAN)
WRELSVLEVM

SEQ ID NO: 59335 - protein, 9 aa, Artificial Sequence
  Description of Artificial Sequence: Synthetic peptide
  Seed: HEWVLREGE (MAGA3_HUMAN)
HEWVLREGC

SEQ ID NO: 59336 - protein, 8 aa, Artificial Sequence
  Description of Artificial Sequence: Synthetic peptide
  Seed: FPDLESEF (MAGA3_HUMAN)
FWDLESEV

SEQ ID NO: 59337 - protein, 9 aa, Artificial Sequence
  Description of Artificial Sequence: Synthetic peptide
  Seed: VVGNWQYFF (MAGA3_HUMAN)
VWGNWQYFY

SEQ ID NO: 59338 - protein, 9 aa, Artificial Sequence
  Description of Artificial Sequence: Synthetic peptide
  Seed: ASSSLQLVF (MAGA3_HUMAN)
ATSSLQLVL

SEQ ID NO: 59339 - protein, 9 aa, Artificial Sequence
  Description of Artificial Sequence: Synthetic peptide
  Seed: QEEEGPSTF (MAGA3_HUMAN)
QIEEGPSTY

SEQ ID NO: 59340 - protein, 9 aa, Artificial Sequence
  Description of Artificial Sequence: Synthetic peptide
  Seed: RKVAELVHF (MAGA3_HUMAN)
RRVAELVHI

SEQ ID NO: 59341 - protein, 9 aa, Artificial Sequence
  Description of Artificial Sequence: Synthetic peptide
  Seed: TFPDLESEF (MAGA3_HUMAN)
TIPDLESEY

SEQ ID NO: 59342 - protein, 9 aa, Artificial Sequence
  Description of Artificial Sequence: Synthetic peptide
  Seed: YIFATCLGL (MAGA3_HUMAN)
YLFATCLGW

SEQ ID NO: 59343 - protein, 9 aa, Artificial Sequence
  Description of Artificial Sequence: Synthetic peptide
  Seed: SVVGNWQYF (MAGA3_HUMAN)
SYVGNWQYM

SEQ ID NO: 59344 - protein, 10 aa, Artificial Sequence
  Description of Artificial Sequence: Synthetic peptide
  Seed: SLPTTMNYPL (MAGA3_HUMAN)
SYPTTMNYPL

SEQ ID NO: 59345 - protein, 9 aa, Artificial Sequence
  Description of Artificial Sequence: Synthetic peptide
  Seed: FVQENYLEY (MAGA3_HUMAN)
FAQENYLEF

SEQ ID NO: 59346 - protein, 10 aa, Artificial Sequence
  Description of Artificial Sequence: Synthetic peptide
  Seed: MNYPLWSQSY (MAGA3_HUMAN)
MKYPLWSQSY

SEQ ID NO: 59347 - protein, 10 aa, Artificial Sequence
  Description of Artificial Sequence: Synthetic peptide
  Seed: SPQGASSLPT (MAGA3_HUMAN)
SPQGASSLPF

SEQ ID NO: 59348 - protein, 9 aa, Artificial Sequence
  Description of Artificial Sequence: Synthetic peptide
  Seed: SYVKVLHHM (MAGA3_HUMAN)
SHVKVLHHY

SEQ ID NO: 59349 - protein, 10 aa, Artificial Sequence
  Description of Artificial Sequence: Synthetic peptide
  Seed: REDSILGDPK (MAGA3_HUMAN)
REDSILGDPA

SEQ ID NO: 59350 - protein, 9 aa, Artificial Sequence
  Description of Artificial Sequence: Synthetic peptide
  Seed: GSDPACYEF (MAGA3_HUMAN)
GADPACYEI

SEQ ID NO: 59351 - protein, 9 aa, Artificial Sequence
  Description of Artificial Sequence: Synthetic peptide
  Seed: ILGDPKKLL (MAGA3_HUMAN)
IQGDPKKLF

SEQ ID NO: 59352 - protein, 10 aa, Artificial Sequence
  Description of Artificial Sequence: Synthetic peptide
  Seed: MPLEQRSQHC (MAGA3_HUMAN)
MPLEQRSQHL

SEQ ID NO: 59353 - protein, 10 aa, Artificial Sequence
  Description of Artificial Sequence: Synthetic peptide
  Seed: KISGGPHISY (MAGA3_HUMAN)
KLSGGPHISK

SEQ ID NO: 59354 - protein, 9 aa, Artificial Sequence
  Description of Artificial Sequence: Synthetic peptide
  Seed: IAREGDCAP (MAGA3_HUMAN)
ISREGDCAY

SEQ ID NO: 59355 - protein, 9 aa, Artificial Sequence
  Description of Artificial Sequence: Synthetic peptide
  Seed: TSYVKVLHH (MAGA3_HUMAN)
TSYVKVLHY

SEQ ID NO: 59356 - protein, 11 aa, Artificial Sequence
  Description of Artificial Sequence: Synthetic peptide
  Seed: WQYFFPVIFSK (MAGA3_HUMAN)
WIYFFPVIFSR

SEQ ID NO: 59357 - protein, 9 aa, Artificial Sequence
  Description of Artificial Sequence: Synthetic peptide
  Seed: MEVDPIGHL (MAGA3_HUMAN)
MAVDPIGHL

SEQ ID NO: 59358 - protein, 9 aa, Artificial Sequence
  Description of Artificial Sequence: Synthetic peptide
  Seed: EVDPIGHLY (MAGA3_HUMAN)
EVDPIGHLK

SEQ ID NO: 59359 - protein, 9 aa, Artificial Sequence
  Description of Artificial Sequence: Synthetic peptide
  Seed: SEFQAALSR (MAGA3_HUMAN)
SEFQAALSA

SEQ ID NO: 59360 - protein, 10 aa, Artificial Sequence
  Description of Artificial Sequence: Synthetic peptide
  Seed: TSYVKVLHHM (MAGA3_HUMAN)
TDYVKVLHHF

SEQ ID NO: 59361 - protein, 10 aa, Artificial Sequence
  Description of Artificial Sequence: Synthetic peptide
  Seed: MVKISGGPHI (MAGA3_HUMAN)
MPKISGGPHM

SEQ ID NO: 59362 - protein, 10 aa, Artificial Sequence
  Description of Artificial Sequence: Synthetic peptide
  Seed: KVAELVHFLL (MAGA3_HUMAN)
KNAELVHFLW

SEQ ID NO: 59363 - protein, 10 aa, Artificial Sequence
  Description of Artificial Sequence: Synthetic peptide
  Seed: SLPTTMNYPL (MAGA3_HUMAN)
SIPTTMNYPV

SEQ ID NO: 59364 - protein, 9 aa, Artificial Sequence
  Description of Artificial Sequence: Synthetic peptide
  Seed: LESEFQAAL (MAGA3_HUMAN)
LESEFQAAM

SEQ ID NO: 59365 - protein, 10 aa, Artificial Sequence
  Description of Artificial Sequence: Synthetic peptide
  Seed: TSYVKVLHHM (MAGA3_HUMAN)
TWYVKVLHHW

SEQ ID NO: 59366 - protein, 10 aa, Artificial Sequence
  Description of Artificial Sequence: Synthetic peptide
  Seed: QYFFPVIFSK (MAGA3_HUMAN)
QWFFPVIFSR

SEQ ID NO: 59367 - protein, 9 aa, Artificial Sequence
  Description of Artificial Sequence: Synthetic peptide
  Seed: KIWEELSVL (MAGA3_HUMAN)
KSWEELSVF

SEQ ID NO: 59368 - protein, 9 aa, Artificial Sequence
  Description of Artificial Sequence: Synthetic peptide
  Seed: KVLHHMVKI (MAGA3_HUMAN)
KALHHMVKV

SEQ ID NO: 59369 - protein, 9 aa, Artificial Sequence
  Description of Artificial Sequence: Synthetic peptide
  Seed: MVKISGGPH (MAGA3_HUMAN)
MSKISGGPF

SEQ ID NO: 59370 - protein, 9 aa, Artificial Sequence
  Description of Artificial Sequence: Synthetic peptide
  Seed: WQYFFPVIF (MAGA3_HUMAN)
WQYFFPVIM

SEQ ID NO: 59371 - protein, 9 aa, Artificial Sequence
  Description of Artificial Sequence: Synthetic peptide
  Seed: LVHFLLLKY (MAGA3_HUMAN)
LQHFLLLKY

SEQ ID NO: 59372 - protein, 9 aa, Artificial Sequence
  Description of Artificial Sequence: Synthetic peptide
  Seed: GSDPACYEF (MAGA3_HUMAN)
GIDPACYEM

SEQ ID NO: 59373 - protein, 9 aa, Artificial Sequence
  Description of Artificial Sequence: Synthetic peptide
  Seed: SVVGNWQYF (MAGA3_HUMAN)
SQVGNWQYF

SEQ ID NO: 59374 - protein, 10 aa, Artificial Sequence
  Description of Artificial Sequence: Synthetic peptide
  Seed: TSYVKVLHHM (MAGA3_HUMAN)
TGYVKVLHHW

SEQ ID NO: 59375 - protein, 10 aa, Artificial Sequence
  Description of Artificial Sequence: Synthetic peptide
  Seed: KASSSLQLVF (MAGA3_HUMAN)
KDSSSLQLVI

SEQ ID NO: 59376 - protein, 10 aa, Artificial Sequence
  Description of Artificial Sequence: Synthetic peptide
  Seed: FSKASSSLQL (MAGA3_HUMAN)
FTKASSSLQY

SEQ ID NO: 59377 - protein, 10 aa, Artificial Sequence
  Description of Artificial Sequence: Synthetic peptide
  Seed: NWQYFFPVIF (MAGA3_HUMAN)
NNQYFFPVIY

SEQ ID NO: 59378 - protein, 11 aa, Artificial Sequence
  Description of Artificial Sequence: Synthetic peptide
  Seed: GPRALVETSYV (MAGA3_HUMAN)
GPRALVETSYL

SEQ ID NO: 59379 - protein, 9 aa, Artificial Sequence
  Description of Artificial Sequence: Synthetic peptide
  Seed: EVDPIGHLY (MAGA3_HUMAN)
EIDPIGHLF

SEQ ID NO: 59380 - protein, 9 aa, Artificial Sequence
  Description of Artificial Sequence: Synthetic peptide
  Seed: TFPDLESEF (MAGA3_HUMAN)
TMPDLESEL

SEQ ID NO: 59381 - protein, 10 aa, Artificial Sequence
  Description of Artificial Sequence: Synthetic peptide
  Seed: YFFPVIFSKA (MAGA3_HUMAN)
YLFPVIFSKL

SEQ ID NO: 59382 - protein, 10 aa, Artificial Sequence
  Description of Artificial Sequence: Synthetic peptide
  Seed: WEELSVLEVF (MAGA3_HUMAN)
WKELSVLEVL

SEQ ID NO: 59383 - protein, 10 aa, Artificial Sequence
  Description of Artificial Sequence: Synthetic peptide
  Seed: AALSRKVAEL (MAGA3_HUMAN)
AYLSRKVAEV

SEQ ID NO: 59384 - protein, 11 aa, Artificial Sequence
  Description of Artificial Sequence: Synthetic peptide
  Seed: EVFEGREDSIL (MAGA3_HUMAN)
EIFEGREDSIK

SEQ ID NO: 59385 - protein, 10 aa, Artificial Sequence
  Description of Artificial Sequence: Synthetic peptide
  Seed: DLESEFQAAL (MAGA3_HUMAN)
DPESEFQAAY

SEQ ID NO: 59386 - protein, 10 aa, Artificial Sequence
  Description of Artificial Sequence: Synthetic peptide
  Seed: NQEEEGPSTF (MAGA3_HUMAN)
NHEEEGPSTM

SEQ ID NO: 59387 - protein, 9 aa, Artificial Sequence
  Description of Artificial Sequence: Synthetic peptide
  Seed: TQHFVQENY (MAGA3_HUMAN)
TMHFVQENF

SEQ ID NO: 59388 - protein, 10 aa, Artificial Sequence
  Description of Artificial Sequence: Synthetic peptide
  Seed: GHLYIFATCL (MAGA3_HUMAN)
GYLYIFATCV

SEQ ID NO: 59389 - protein, 10 aa, Artificial Sequence
  Description of Artificial Sequence: Synthetic peptide
  Seed: EVFEGREDSI (MAGA3_HUMAN)
ETFEGREDSV

SEQ ID NO: 59390 - protein, 10 aa, Artificial Sequence
  Description of Artificial Sequence: Synthetic peptide
  Seed: TSYVKVLHHM (MAGA3_HUMAN)
TSYVKVLHHI

SEQ ID NO: 59391 - protein, 9 aa, Artificial Sequence
  Description of Artificial Sequence: Synthetic peptide
  Seed: TFPDLESEF (MAGA3_HUMAN)
TRPDLESEM

SEQ ID NO: 59392 - protein, 10 aa, Artificial Sequence
  Description of Artificial Sequence: Synthetic peptide
  Seed: IFATCLGLSY (MAGA3_HUMAN)
IQATCLGLSL

SEQ ID NO: 59393 - protein, 9 aa, Artificial Sequence
  Description of Artificial Sequence: Synthetic peptide
  Seed: FVQENYLEY (MAGA3_HUMAN)
FYQENYLEW

SEQ ID NO: 59394 - protein, 9 aa, Artificial Sequence
  Description of Artificial Sequence: Synthetic peptide
  Seed: TSYVKVLHH (MAGA3_HUMAN)
TAYVKVLHI

SEQ ID NO: 59395 - protein, 10 aa, Artificial Sequence
  Description of Artificial Sequence: Synthetic peptide
  Seed: FSKASSSLQL (MAGA3_HUMAN)
FWKASSSLQY

SEQ ID NO: 59396 - protein, 10 aa, Artificial Sequence
  Description of Artificial Sequence: Synthetic peptide
  Seed: ELVHFLLLKY (MAGA3_HUMAN)
ETVHFLLLKY

SEQ ID NO: 59397 - protein, 9 aa, Artificial Sequence
  Description of Artificial Sequence: Synthetic peptide
  Seed: LGDPKKLLT (MAGA3_HUMAN)
LGDPKKLLM

SEQ ID NO: 59398 - protein, 9 aa, Artificial Sequence
  Description of Artificial Sequence: Synthetic peptide
  Seed: ASSSLQLVF (MAGA3_HUMAN)
ATSSLQLVI

SEQ ID NO: 59399 - protein, 9 aa, Artificial Sequence
  Description of Artificial Sequence: Synthetic peptide
  Seed: EFQAALSRK (MAGA3_HUMAN)
EAQAALSRK

SEQ ID NO: 59400 - protein, 10 aa, Artificial Sequence
  Description of Artificial Sequence: Synthetic peptide
  Seed: ISYPPLHEWV (MAGA3_HUMAN)
IQYPPLHEWL

SEQ ID NO: 59401 - protein, 9 aa, Artificial Sequence
  Description of Artificial Sequence: Synthetic peptide
  Seed: HLYIFATCL (MAGA3_HUMAN)
HTYIFATCY

SEQ ID NO: 59402 - protein, 9 aa, Artificial Sequence
  Description of Artificial Sequence: Synthetic peptide
  Seed: GDNQIMPKA (MAGA3_HUMAN)
GENQIMPKM

SEQ ID NO: 59403 - protein, 10 aa, Artificial Sequence
  Description of Artificial Sequence: Synthetic peptide
  Seed: KVAELVHFLL (MAGA3_HUMAN)
KVAELVHFLK

SEQ ID NO: 59404 - protein, 8 aa, Artificial Sequence
  Description of Artificial Sequence: Synthetic peptide
  Seed: KIWEELSV (MAGA3_HUMAN)
KMWEELSL

SEQ ID NO: 59405 - protein, 9 aa, Artificial Sequence
  Description of Artificial Sequence: Synthetic peptide
  Seed: NYPLWSQSY (MAGA3_HUMAN)
NFPLWSQSI

SEQ ID NO: 59406 - protein, 9 aa, Artificial Sequence
  Description of Artificial Sequence: Synthetic peptide
  Seed: FATCLGLSY (MAGA3_HUMAN)
FFTCLGLSY

SEQ ID NO: 59407 - protein, 9 aa, Artificial Sequence
  Description of Artificial Sequence: Synthetic peptide
  Seed: SSLPTTMNY (MAGA3_HUMAN)
SSLPTTMNM

SEQ ID NO: 59408 - protein, 9 aa, Artificial Sequence
  Description of Artificial Sequence: Synthetic peptide
  Seed: HLYIFATCL (MAGA3_HUMAN)
HLYIFATCV

SEQ ID NO: 59409 - protein, 9 aa, Artificial Sequence
  Description of Artificial Sequence: Synthetic peptide
  Seed: IFSKASSSL (MAGA3_HUMAN)
ILSKASSSF

SEQ ID NO: 59410 - protein, 10 aa, Artificial Sequence
  Description of Artificial Sequence: Synthetic peptide
  Seed: STFPDLESEF (MAGA3_HUMAN)
SQFPDLESEF

SEQ ID NO: 59411 - protein, 10 aa, Artificial Sequence
  Description of Artificial Sequence: Synthetic peptide
  Seed: SVVGNWQYFF (MAGA3_HUMAN)
SYVGNWQYFV

SEQ ID NO: 59412 - protein, 9 aa, Artificial Sequence
  Description of Artificial Sequence: Synthetic peptide
  Seed: AASSSSTLV (MAGA3_HUMAN)
AVSSSSTLI

SEQ ID NO: 59413 - protein, 10 aa, Artificial Sequence
  Description of Artificial Sequence: Synthetic peptide
  Seed: RKVAELVHFL (MAGA3_HUMAN)
RCVAELVHFV

SEQ ID NO: 59414 - protein, 10 aa, Artificial Sequence
  Description of Artificial Sequence: Synthetic peptide
  Seed: NWQYFFPVIF (MAGA3_HUMAN)
NFQYFFPVIF

SEQ ID NO: 59415 - protein, 9 aa, Artificial Sequence
  Description of Artificial Sequence: Synthetic peptide
  Seed: VVGNWQYFF (MAGA3_HUMAN)
VLGNWQYFY

SEQ ID NO: 59416 - protein, 10 aa, Artificial Sequence
  Description of Artificial Sequence: Synthetic peptide
  Seed: VIFSKASSSL (MAGA3_HUMAN)
VVFSKASSSY

SEQ ID NO: 59417 - protein, 9 aa, Artificial Sequence
  Description of Artificial Sequence: Synthetic peptide
  Seed: GSDPACYEF (MAGA3_HUMAN)
GYDPACYEY

SEQ ID NO: 59418 - protein, 10 aa, Artificial Sequence
  Description of Artificial Sequence: Synthetic peptide
  Seed: GHLYIFATCL (MAGA3_HUMAN)
GMLYIFATCL

SEQ ID NO: 59419 - protein, 11 aa, Artificial Sequence
  Description of Artificial Sequence: Synthetic peptide
  Seed: AQAPATEEQEA (MAGA3_HUMAN)
ALAPATEEQEM

SEQ ID NO: 59420 - protein, 9 aa, Artificial Sequence
  Description of Artificial Sequence: Synthetic peptide
  Seed: EVDPIGHLY (MAGA3_HUMAN)
EWDPIGHLM

SEQ ID NO: 59421 - protein, 9 aa, Artificial Sequence
  Description of Artificial Sequence: Synthetic peptide
  Seed: AASSSSTLV (MAGA3_HUMAN)
ATSSSSTLL

SEQ ID NO: 59422 - protein, 10 aa, Artificial Sequence
  Description of Artificial Sequence: Synthetic peptide
  Seed: VDPIGHLYIF (MAGA3_HUMAN)
VFPIGHLYIY

SEQ ID NO: 59423 - protein, 9 aa, Artificial Sequence
  Description of Artificial Sequence: Synthetic peptide
  Seed: ASSSLQLVF (MAGA3_HUMAN)
AQSSLQLVF

SEQ ID NO: 59424 - protein, 10 aa, Artificial Sequence
  Description of Artificial Sequence: Synthetic peptide
  Seed: STFPDLESEF (MAGA3_HUMAN)
SIFPDLESEF

SEQ ID NO: 59425 - protein, 9 aa, Artificial Sequence
  Description of Artificial Sequence: Synthetic peptide
  Seed: SSLQLVFGI (MAGA3_HUMAN)
SGLQLVFGW

SEQ ID NO: 59426 - protein, 11 aa, Artificial Sequence
  Description of Artificial Sequence: Synthetic peptide
  Seed: LGSVVGNWQYF (MAGA3_HUMAN)
LTSVVGNWQYF

SEQ ID NO: 59427 - protein, 9 aa, Artificial Sequence
  Description of Artificial Sequence: Synthetic peptide
  Seed: GSDPACYEF (MAGA3_HUMAN)
GFDPACYEM

SEQ ID NO: 59428 - protein, 9 aa, Artificial Sequence
  Description of Artificial Sequence: Synthetic peptide
  Seed: TFPDLESEF (MAGA3_HUMAN)
TAPDLESEV

SEQ ID NO: 59429 - protein, 9 aa, Artificial Sequence
  Description of Artificial Sequence: Synthetic peptide
  Seed: ISGGPHISY (MAGA3_HUMAN)
IIGGPHISY

SEQ ID NO: 59430 - protein, 10 aa, Artificial Sequence
  Description of Artificial Sequence: Synthetic peptide
  Seed: VDPIGHLYIF (MAGA3_HUMAN)
VVPIGHLYIW

SEQ ID NO: 59431 - protein, 10 aa, Artificial Sequence
  Description of Artificial Sequence: Synthetic peptide
  Seed: MEVDPIGHLY (MAGA3_HUMAN)
MIVDPIGHLR

SEQ ID NO: 59432 - protein, 11 aa, Artificial Sequence
  Description of Artificial Sequence: Synthetic peptide
  Seed: RKVAELVHFLL (MAGA3_HUMAN)
RRVAELVHFLF

SEQ ID NO: 59433 - protein, 10 aa, Artificial Sequence
  Description of Artificial Sequence: Synthetic peptide
  Seed: GNWQYFFPVI (MAGA3_HUMAN)
GRWQYFFPVF

SEQ ID NO: 59434 - protein, 9 aa, Artificial Sequence
  Description of Artificial Sequence: Synthetic peptide
  Seed: EAASSSSTL (MAGA3_HUMAN)
EEASSSSTL

SEQ ID NO: 59435 - protein, 9 aa, Artificial Sequence
  Description of Artificial Sequence: Synthetic peptide
  Seed: ISYPPLHEW (MAGA3_HUMAN)
IYYPPLHEI

SEQ ID NO: 59436 - protein, 9 aa, Artificial Sequence
  Description of Artificial Sequence: Synthetic peptide
  Seed: SEFQAALSR (MAGA3_HUMAN)
SMFQAALSK

SEQ ID NO: 59437 - protein, 9 aa, Artificial Sequence
  Description of Artificial Sequence: Synthetic peptide
  Seed: SSLQLVFGI (MAGA3_HUMAN)
SSLQLVFGW

SEQ ID NO: 59438 - protein, 9 aa, Artificial Sequence
  Description of Artificial Sequence: Synthetic peptide
  Seed: EARGEALGL (MAGA3_HUMAN)
ESRGEALGR

SEQ ID NO: 59439 - protein, 10 aa, Artificial Sequence
  Description of Artificial Sequence: Synthetic peptide
  Seed: SLQLVFGIEL (MAGA3_HUMAN)
SFQLVFGIEY

SEQ ID NO: 59440 - protein, 9 aa, Artificial Sequence
  Description of Artificial Sequence: Synthetic peptide
  Seed: QIMPKAGLL (MAGA3_HUMAN)
QPMPKAGLL

SEQ ID NO: 59441 - protein, 10 aa, Artificial Sequence
  Description of Artificial Sequence: Synthetic peptide
  Seed: YIFATCLGLS (MAGA3_HUMAN)
YMFATCLGLP

SEQ ID NO: 59442 - protein, 9 aa, Artificial Sequence
  Description of Artificial Sequence: Synthetic peptide
  Seed: FLWGPRALV (MAGA3_HUMAN)
FTWGPRALY

SEQ ID NO: 59443 - protein, 9 aa, Artificial Sequence
  Description of Artificial Sequence: Synthetic peptide
  Seed: ISYPPLHEW (MAGA3_HUMAN)
ISYPPLHEH

SEQ ID NO: 59444 - protein, 9 aa, Artificial Sequence
  Description of Artificial Sequence: Synthetic peptide
  Seed: HEWVLREGE (MAGA3_HUMAN)
HEWVLREGA

SEQ ID NO: 59445 - protein, 10 aa, Artificial Sequence
  Description of Artificial Sequence: Synthetic peptide
  Seed: VIFSKASSSL (MAGA3_HUMAN)
VTFSKASSSF

SEQ ID NO: 59446 - protein, 10 aa, Artificial Sequence
  Description of Artificial Sequence: Synthetic peptide
  Seed: KAEMLGSVVG (MAGA3_HUMAN)
KQEMLGSVVA

SEQ ID NO: 59447 - protein, 9 aa, Artificial Sequence
  Description of Artificial Sequence: Synthetic peptide
  Seed: ISGGPHISY (MAGA3_HUMAN)
IAGGPHISM

SEQ ID NO: 59448 - protein, 10 aa, Artificial Sequence
  Description of Artificial Sequence: Synthetic peptide
  Seed: ASSLPTTMNY (MAGA3_HUMAN)
ATSLPTTMNY

SEQ ID NO: 59449 - protein, 9 aa, Artificial Sequence
  Description of Artificial Sequence: Synthetic peptide
  Seed: EVDPIGHLY (MAGA3_HUMAN)
EVDPIGHLW

SEQ ID NO: 59450 - protein, 9 aa, Artificial Sequence
  Description of Artificial Sequence: Synthetic peptide
  Seed: MEVDPIGHL (MAGA3_HUMAN)
MLVDPIGHI

SEQ ID NO: 59451 - protein, 10 aa, Artificial Sequence
  Description of Artificial Sequence: Synthetic peptide
  Seed: ISYPPLHEWV (MAGA3_HUMAN)
IQYPPLHEWI

SEQ ID NO: 59452 - protein, 9 aa, Artificial Sequence
  Description of Artificial Sequence: Synthetic peptide
  Seed: KASSSLQLV (MAGA3_HUMAN)
KLSSSLQLK

SEQ ID NO: 59453 - protein, 10 aa, Artificial Sequence
  Description of Artificial Sequence: Synthetic peptide
  Seed: FSKASSSLQL (MAGA3_HUMAN)
FCKASSSLQF

SEQ ID NO: 59454 - protein, 9 aa, Artificial Sequence
  Description of Artificial Sequence: Synthetic peptide
  Seed: KASSSLQLV (MAGA3_HUMAN)
KSSSSLQLF

SEQ ID NO: 59455 - protein, 9 aa, Artificial Sequence
  Description of Artificial Sequence: Synthetic peptide
  Seed: MLGSVVGNW (MAGA3_HUMAN)
MAGSVVGNW

SEQ ID NO: 59456 - protein, 9 aa, Artificial Sequence
  Description of Artificial Sequence: Synthetic peptide
  Seed: KVLHHMVKI (MAGA3_HUMAN)
KTLHHMVKL

SEQ ID NO: 59457 - protein, 9 aa, Artificial Sequence
  Description of Artificial Sequence: Synthetic peptide
  Seed: SVLEVFEGR (MAGA3_HUMAN)
SALEVFEGF

SEQ ID NO: 59458 - protein, 10 aa, Artificial Sequence
  Description of Artificial Sequence: Synthetic peptide
  Seed: DLESEFQAAL (MAGA3_HUMAN)
DHESEFQAAF

SEQ ID NO: 59459 - protein, 10 aa, Artificial Sequence
  Description of Artificial Sequence: Synthetic peptide
  Seed: ISYPPLHEWV (MAGA3_HUMAN)
ILYPPLHEWL

SEQ ID NO: 59460 - protein, 10 aa, Artificial Sequence
  Description of Artificial Sequence: Synthetic peptide
  Seed: AALSRKVAEL (MAGA3_HUMAN)
AFLSRKVAEL

SEQ ID NO: 59461 - protein, 9 aa, Artificial Sequence
  Description of Artificial Sequence: Synthetic peptide
  Seed: KVLHHMVKI (MAGA3_HUMAN)
KMLHHMVKI

SEQ ID NO: 59462 - protein, 9 aa, Artificial Sequence
  Description of Artificial Sequence: Synthetic peptide
  Seed: DPIGHLYIF (MAGA3_HUMAN)
DQIGHLYIY

SEQ ID NO: 59463 - protein, 11 aa, Artificial Sequence
  Description of Artificial Sequence: Synthetic peptide
  Seed: WQYFFPVIFSK (MAGA3_HUMAN)
WAYFFPVIFSR

SEQ ID NO: 59464 - protein, 10 aa, Artificial Sequence
  Description of Artificial Sequence: Synthetic peptide
  Seed: NQEEEGPSTF (MAGA3_HUMAN)
NMEEEGPSTY

SEQ ID NO: 59465 - protein, 10 aa, Artificial Sequence
  Description of Artificial Sequence: Synthetic peptide
  Seed: YRQVPGSDPA (MAGA3_HUMAN)
YTQVPGSDPL

SEQ ID NO: 59466 - protein, 10 aa, Artificial Sequence
  Description of Artificial Sequence: Synthetic peptide
  Seed: FSKASSSLQL (MAGA3_HUMAN)
FSKASSSLQY

SEQ ID NO: 59467 - protein, 11 aa, Artificial Sequence
  Description of Artificial Sequence: Synthetic peptide
  Seed: VKISGGPHISY (MAGA3_HUMAN)
VPISGGPHISY

SEQ ID NO: 59468 - protein, 10 aa, Artificial Sequence
  Description of Artificial Sequence: Synthetic peptide
  Seed: FLWGPRALVE (MAGA3_HUMAN)
FLWGPRALVD

SEQ ID NO: 59469 - protein, 10 aa, Artificial Sequence
  Description of Artificial Sequence: Synthetic peptide
  Seed: EFLWGPRALV (MAGA3_HUMAN)
ETLWGPRALV

SEQ ID NO: 59470 - protein, 8 aa, Artificial Sequence
  Description of Artificial Sequence: Synthetic peptide
  Seed: LGDPKKLL (MAGA3_HUMAN)
LADPKKLV

SEQ ID NO: 59471 - protein, 10 aa, Artificial Sequence
  Description of Artificial Sequence: Synthetic peptide
  Seed: TSYVKVLHHM (MAGA3_HUMAN)
TIYVKVLHHF

SEQ ID NO: 59472 - protein, 10 aa, Artificial Sequence
  Description of Artificial Sequence: Synthetic peptide
  Seed: LGLVGAQAPA (MAGA3_HUMAN)
LCLVGAQAPL

SEQ ID NO: 59473 - protein, 9 aa, Artificial Sequence
  Description of Artificial Sequence: Synthetic peptide
  Seed: SSLPTTMNY (MAGA3_HUMAN)
SFLPTTMNL

SEQ ID NO: 59474 - protein, 9 aa, Artificial Sequence
  Description of Artificial Sequence: Synthetic peptide
  Seed: RQVPGSDPA (MAGA3_HUMAN)
RLVPGSDPM

SEQ ID NO: 59475 - protein, 9 aa, Artificial Sequence
  Description of Artificial Sequence: Synthetic peptide
  Seed: SYVKVLHHM (MAGA3_HUMAN)
STVKVLHHI

SEQ ID NO: 59476 - protein, 9 aa, Artificial Sequence
  Description of Artificial Sequence: Synthetic peptide
  Seed: EARGEALGL (MAGA3_HUMAN)
EARGEALGR

SEQ ID NO: 59477 - protein, 9 aa, Artificial Sequence
  Description of Artificial Sequence: Synthetic peptide
  Seed: IFSKASSSL (MAGA3_HUMAN)
IYSKASSSY

SEQ ID NO: 59478 - protein, 9 aa, Artificial Sequence
  Description of Artificial Sequence: Synthetic peptide
  Seed: SSSSTLVEV (MAGA3_HUMAN)
SPSSTLVEV

SEQ ID NO: 59479 - protein, 9 aa, Artificial Sequence
  Description of Artificial Sequence: Synthetic peptide
  Seed: ALSRKVAEL (MAGA3_HUMAN)
AQSRKVAEI

SEQ ID NO: 59480 - protein, 9 aa, Artificial Sequence
  Description of Artificial Sequence: Synthetic peptide
  Seed: KVAELVHFL (MAGA3_HUMAN)
KFAELVHFK

SEQ ID NO: 59481 - protein, 10 aa, Artificial Sequence
  Description of Artificial Sequence: Synthetic peptide
  Seed: QVPGSDPACY (MAGA3_HUMAN)
QTPGSDPACR

SEQ ID NO: 59482 - protein, 9 aa, Artificial Sequence
  Description of Artificial Sequence: Synthetic peptide
  Seed: WQYFFPVIF (MAGA3_HUMAN)
WMYFFPVIF

SEQ ID NO: 59483 - protein, 11 aa, Artificial Sequence
  Description of Artificial Sequence: Synthetic peptide
  Seed: HISYPPLHEWV (MAGA3_HUMAN)
HSSYPPLHEWW

SEQ ID NO: 59484 - protein, 10 aa, Artificial Sequence
  Description of Artificial Sequence: Synthetic peptide
  Seed: MVKISGGPHI (MAGA3_HUMAN)
MWKISGGPHY

SEQ ID NO: 59485 - protein, 9 aa, Artificial Sequence
  Description of Artificial Sequence: Synthetic peptide
  Seed: RQVPGSDPA (MAGA3_HUMAN)
RSVPGSDPF

SEQ ID NO: 59486 - protein, 9 aa, Artificial Sequence
  Description of Artificial Sequence: Synthetic peptide
  Seed: KASSSLQLV (MAGA3_HUMAN)
KISSSLQLW

SEQ ID NO: 59487 - protein, 9 aa, Artificial Sequence
  Description of Artificial Sequence: Synthetic peptide
  Seed: SILGDPKKL (MAGA3_HUMAN)
STLGDPKKL

SEQ ID NO: 59488 - protein, 11 aa, Artificial Sequence
  Description of Artificial Sequence: Synthetic peptide
  Seed: SSSSTLVEVTL (MAGA3_HUMAN)
STSSTLVEVTW

SEQ ID NO: 59489 - protein, 10 aa, Artificial Sequence
  Description of Artificial Sequence: Synthetic peptide
  Seed: GNWQYFFPVI (MAGA3_HUMAN)
GWWQYFFPVF

SEQ ID NO: 59490 - protein, 10 aa, Artificial Sequence
  Description of Artificial Sequence: Synthetic peptide
  Seed: AEMLGSVVGN (MAGA3_HUMAN)
AEMLGSVVGL

SEQ ID NO: 59491 - protein, 11 aa, Artificial Sequence
  Description of Artificial Sequence: Synthetic peptide
  Seed: KVAELVHFLLL (MAGA3_HUMAN)
KMAELVHFLLY

SEQ ID NO: 59492 - protein, 11 aa, Artificial Sequence
  Description of Artificial Sequence: Synthetic peptide
  Seed: FLWGPRALVET (MAGA3_HUMAN)
FLWGPRALVEV

SEQ ID NO: 59493 - protein, 10 aa, Artificial Sequence
  Description of Artificial Sequence: Synthetic peptide
  Seed: HFVQENYLEY (MAGA3_HUMAN)
HLVQENYLEY

SEQ ID NO: 59494 - protein, 9 aa, Artificial Sequence
  Description of Artificial Sequence: Synthetic peptide
  Seed: QLVFGIELM (MAGA3_HUMAN)
QAVFGIELV

SEQ ID NO: 59495 - protein, 9 aa, Artificial Sequence
  Description of Artificial Sequence: Synthetic peptide
  Seed: YFFPVIFSK (MAGA3_HUMAN)
YTFPVIFSH

SEQ ID NO: 59496 - protein, 9 aa, Artificial Sequence
  Description of Artificial Sequence: Synthetic peptide
  Seed: KVLHHMVKI (MAGA3_HUMAN)
KTLHHMVKA

SEQ ID NO: 59497 - protein, 11 aa, Artificial Sequence
  Description of Artificial Sequence: Synthetic peptide
  Seed: VKISGGPHISY (MAGA3_HUMAN)
VQISGGPHISM

SEQ ID NO: 59498 - protein, 10 aa, Artificial Sequence
  Description of Artificial Sequence: Synthetic peptide
  Seed: SLQLVFGIEL (MAGA3_HUMAN)
SGQLVFGIEY

SEQ ID NO: 59499 - protein, 10 aa, Artificial Sequence
  Description of Artificial Sequence: Synthetic peptide
  Seed: QYFFPVIFSK (MAGA3_HUMAN)
QGFFPVIFSR

SEQ ID NO: 59500 - protein, 10 aa, Artificial Sequence
  Description of Artificial Sequence: Synthetic peptide
  Seed: KASSSLQLVF (MAGA3_HUMAN)
KDSSSLQLVM

SEQ ID NO: 59501 - protein, 9 aa, Artificial Sequence
  Description of Artificial Sequence: Synthetic peptide
  Seed: ISYPPLHEW (MAGA3_HUMAN)
IAYPPLHEC

SEQ ID NO: 59502 - protein, 10 aa, Artificial Sequence
  Description of Artificial Sequence: Synthetic peptide
  Seed: SRKVAELVHF (MAGA3_HUMAN)
SMKVAELVHY

SEQ ID NO: 59503 - protein, 9 aa, Artificial Sequence
  Description of Artificial Sequence: Synthetic peptide
  Seed: YFFPVIFSK (MAGA3_HUMAN)
YIFPVIFSM

SEQ ID NO: 59504 - protein, 9 aa, Artificial Sequence
  Description of Artificial Sequence: Synthetic peptide
  Seed: SSSSTLVEV (MAGA3_HUMAN)
STSSTLVEW

SEQ ID NO: 59505 - protein, 10 aa, Artificial Sequence
  Description of Artificial Sequence: Synthetic peptide
  Seed: MVKISGGPHI (MAGA3_HUMAN)
MYKISGGPHF

SEQ ID NO: 59506 - protein, 9 aa, Artificial Sequence
  Description of Artificial Sequence: Synthetic peptide
  Seed: EEKIWEELS (MAGA3_HUMAN)
EEKIWEELA

SEQ ID NO: 59507 - protein, 10 aa, Artificial Sequence
  Description of Artificial Sequence: Synthetic peptide
  Seed: SLPTTMNYPL (MAGA3_HUMAN)
SAPTTMNYPL

SEQ ID NO: 59508 - protein, 9 aa, Artificial Sequence
  Description of Artificial Sequence: Synthetic peptide
  Seed: IFSKASSSL (MAGA3_HUMAN)
ISSKASSSF

SEQ ID NO: 59509 - protein, 9 aa, Artificial Sequence
  Description of Artificial Sequence: Synthetic peptide
  Seed: IFSKASSSL (MAGA3_HUMAN)
IISKASSSF

SEQ ID NO: 59510 - protein, 9 aa, Artificial Sequence
  Description of Artificial Sequence: Synthetic peptide
  Seed: ISYPPLHEW (MAGA3_HUMAN)
IQYPPLHEF

SEQ ID NO: 59511 - protein, 10 aa, Artificial Sequence
  Description of Artificial Sequence: Synthetic peptide
  Seed: ISYPPLHEWV (MAGA3_HUMAN)
ITYPPLHEWL

SEQ ID NO: 59512 - protein, 10 aa, Artificial Sequence
  Description of Artificial Sequence: Synthetic peptide
  Seed: LGLVGAQAPA (MAGA3_HUMAN)
LGLVGAQAPL

SEQ ID NO: 59513 - protein, 9 aa, Artificial Sequence
  Description of Artificial Sequence: Synthetic peptide
  Seed: VVGNWQYFF (MAGA3_HUMAN)
VSGNWQYFW

SEQ ID NO: 59514 - protein, 9 aa, Artificial Sequence
  Description of Artificial Sequence: Synthetic peptide
  Seed: FATCLGLSY (MAGA3_HUMAN)
FSTCLGLSY

SEQ ID NO: 59515 - protein, 9 aa, Artificial Sequence
  Description of Artificial Sequence: Synthetic peptide
  Seed: TFPDLESEF (MAGA3_HUMAN)
TTPDLESEW

SEQ ID NO: 59516 - protein, 11 aa, Artificial Sequence
  Description of Artificial Sequence: Synthetic peptide
  Seed: KVAELVHFLLL (MAGA3_HUMAN)
KQAELVHFLLV

SEQ ID NO: 59517 - protein, 8 aa, Artificial Sequence
  Description of Artificial Sequence: Synthetic peptide
  Seed: YPLWSQSY (MAGA3_HUMAN)
YYLWSQSM

SEQ ID NO: 59518 - protein, 9 aa, Artificial Sequence
  Description of Artificial Sequence: Synthetic peptide
  Seed: AASSSSTLV (MAGA3_HUMAN)
AISSSSTLL

SEQ ID NO: 59519 - protein, 10 aa, Artificial Sequence
  Description of Artificial Sequence: Synthetic peptide
  Seed: SVVGNWQYFF (MAGA3_HUMAN)
SYVGNWQYFK

SEQ ID NO: 59520 - protein, 10 aa, Artificial Sequence
  Description of Artificial Sequence: Synthetic peptide
  Seed: ISYPPLHEWV (MAGA3_HUMAN)
IMYPPLHEWM

SEQ ID NO: 59521 - protein, 9 aa, Artificial Sequence
  Description of Artificial Sequence: Synthetic peptide
  Seed: KASSSLQLV (MAGA3_HUMAN)
KMSSSLQLV

SEQ ID NO: 59522 - protein, 10 aa, Artificial Sequence
  Description of Artificial Sequence: Synthetic peptide
  Seed: TSYVKVLHHM (MAGA3_HUMAN)
TFYVKVLHHW

SEQ ID NO: 59523 - protein, 10 aa, Artificial Sequence
  Description of Artificial Sequence: Synthetic peptide
  Seed: STFPDLESEF (MAGA3_HUMAN)
SAFPDLESEF

SEQ ID NO: 59524 - protein, 10 aa, Artificial Sequence
  Description of Artificial Sequence: Synthetic peptide
  Seed: QYFFPVIFSK (MAGA3_HUMAN)
QIFFPVIFSR

SEQ ID NO: 59525 - protein, 9 aa, Artificial Sequence
  Description of Artificial Sequence: Synthetic peptide
  Seed: KVAELVHFL (MAGA3_HUMAN)
KMAELVHFT

SEQ ID NO: 59526 - protein, 9 aa, Artificial Sequence
  Description of Artificial Sequence: Synthetic peptide
  Seed: EAASSSSTL (MAGA3_HUMAN)
EMASSSSTR

SEQ ID NO: 59527 - protein, 10 aa, Artificial Sequence
  Description of Artificial Sequence: Synthetic peptide
  Seed: YIFATCLGLS (MAGA3_HUMAN)
YMFATCLGLN

SEQ ID NO: 59528 - protein, 8 aa, Artificial Sequence
  Description of Artificial Sequence: Synthetic peptide
  Seed: LGDPKKLL (MAGA3_HUMAN)
LYDPKKLL

SEQ ID NO: 59529 - protein, 11 aa, Artificial Sequence
  Description of Artificial Sequence: Synthetic peptide
  Seed: NQIMPKAGLLI (MAGA3_HUMAN)
NHIMPKAGLLI

SEQ ID NO: 59530 - protein, 10 aa, Artificial Sequence
  Description of Artificial Sequence: Synthetic peptide
  Seed: EALGLVGAQA (MAGA3_HUMAN)
EVLGLVGAQV

SEQ ID NO: 59531 - protein, 10 aa, Artificial Sequence
  Description of Artificial Sequence: Synthetic peptide
  Seed: NWQYFFPVIF (MAGA3_HUMAN)
NIQYFFPVIF

SEQ ID NO: 59532 - protein, 10 aa, Artificial Sequence
  Description of Artificial Sequence: Synthetic peptide
  Seed: HISYPPLHEW (MAGA3_HUMAN)
HTSYPPLHEF

SEQ ID NO: 59533 - protein, 9 aa, Artificial Sequence
  Description of Artificial Sequence: Synthetic peptide
  Seed: IFSKASSSL (MAGA3_HUMAN)
IMSKASSSF

SEQ ID NO: 59534 - protein, 8 aa, Artificial Sequence
  Description of Artificial Sequence: Synthetic peptide
  Seed: SGGPHISY (MAGA3_HUMAN)
SAGPHISF

SEQ ID NO: 59535 - protein, 11 aa, Artificial Sequence
  Description of Artificial Sequence: Synthetic peptide
  Seed: QLVFGIELMEV (MAGA3_HUMAN)
QMVFGIELMEV

SEQ ID NO: 59536 - protein, 10 aa, Artificial Sequence
  Description of Artificial Sequence: Synthetic peptide
  Seed: KAEMLGSVVG (MAGA3_HUMAN)
KLEMLGSVVA

SEQ ID NO: 59537 - protein, 9 aa, Artificial Sequence
  Description of Artificial Sequence: Synthetic peptide
  Seed: SVVGNWQYF (MAGA3_HUMAN)
SVVGNWQYW

SEQ ID NO: 59538 - protein, 10 aa, Artificial Sequence
  Description of Artificial Sequence: Synthetic peptide
  Seed: SLPTTMNYPL (MAGA3_HUMAN)
SDPTTMNYPL

SEQ ID NO: 59539 - protein, 11 aa, Artificial Sequence
  Description of Artificial Sequence: Synthetic peptide
  Seed: VVGNWQYFFPV (MAGA3_HUMAN)
VMGNWQYFFPL

SEQ ID NO: 59540 - protein, 9 aa, Artificial Sequence
  Description of Artificial Sequence: Synthetic peptide
  Seed: KVAELVHFL (MAGA3_HUMAN)
KAAELVHFY

SEQ ID NO: 59541 - protein, 11 aa, Artificial Sequence
  Description of Artificial Sequence: Synthetic peptide
  Seed: MLGSVVGNWQY (MAGA3_HUMAN)
MNGSVVGNWQW

SEQ ID NO: 59542 - protein, 10 aa, Artificial Sequence
  Description of Artificial Sequence: Synthetic peptide
  Seed: LGSVVGNWQY (MAGA3_HUMAN)
LRSVVGNWQF

SEQ ID NO: 59543 - protein, 10 aa, Artificial Sequence
  Description of Artificial Sequence: Synthetic peptide
  Seed: VDPIGHLYIF (MAGA3_HUMAN)
VLPIGHLYIY

SEQ ID NO: 59544 - protein, 9 aa, Artificial Sequence
  Description of Artificial Sequence: Synthetic peptide
  Seed: KIWEELSVL (MAGA3_HUMAN)
KFWEELSVY

SEQ ID NO: 59545 - protein, 9 aa, Artificial Sequence
  Description of Artificial Sequence: Synthetic peptide
  Seed: KVAELVHFL (MAGA3_HUMAN)
KSAELVHFF

SEQ ID NO: 59546 - protein, 9 aa, Artificial Sequence
  Description of Artificial Sequence: Synthetic peptide
  Seed: SKASSSLQL (MAGA3_HUMAN)
SVASSSLQY

SEQ ID NO: 59547 - protein, 11 aa, Artificial Sequence
  Description of Artificial Sequence: Synthetic peptide
  Seed: WQYFFPVIFSK (MAGA3_HUMAN)
WSYFFPVIFSR

SEQ ID NO: 59548 - protein, 9 aa, Artificial Sequence
  Description of Artificial Sequence: Synthetic peptide
  Seed: ISYPPLHEW (MAGA3_HUMAN)
IPYPPLHEI

SEQ ID NO: 59549 - protein, 9 aa, Artificial Sequence
  Description of Artificial Sequence: Synthetic peptide
  Seed: TFPDLESEF (MAGA3_HUMAN)
TVPDLESEM

SEQ ID NO: 59550 - protein, 10 aa, Artificial Sequence
  Description of Artificial Sequence: Synthetic peptide
  Seed: RKVAELVHFL (MAGA3_HUMAN)
RQVAELVHFF

SEQ ID NO: 59551 - protein, 10 aa, Artificial Sequence
  Description of Artificial Sequence: Synthetic peptide
  Seed: REDSILGDPK (MAGA3_HUMAN)
RTDSILGDPY

SEQ ID NO: 59552 - protein, 9 aa, Artificial Sequence
  Description of Artificial Sequence: Synthetic peptide
  Seed: GSVVGNWQY (MAGA3_HUMAN)
GTVVGNWQY

SEQ ID NO: 59553 - protein, 9 aa, Artificial Sequence
  Description of Artificial Sequence: Synthetic peptide
  Seed: KVLHHMVKI (MAGA3_HUMAN)
KNLHHMVKK

SEQ ID NO: 59554 - protein, 10 aa, Artificial Sequence
  Description of Artificial Sequence: Synthetic peptide
  Seed: SYPPLHEWVL (MAGA3_HUMAN)
SMPPLHEWVF

SEQ ID NO: 59555 - protein, 9 aa, Artificial Sequence
  Description of Artificial Sequence: Synthetic peptide
  Seed: RALVETSYV (MAGA3_HUMAN)
RSLVETSYI

SEQ ID NO: 59556 - protein, 9 aa, Artificial Sequence
  Description of Artificial Sequence: Synthetic peptide
  Seed: SEFQAALSR (MAGA3_HUMAN)
SFFQAALSR

SEQ ID NO: 59557 - protein, 9 aa, Artificial Sequence
  Description of Artificial Sequence: Synthetic peptide
  Seed: SSSSTLVEV (MAGA3_HUMAN)
SMSSTLVEA

SEQ ID NO: 59558 - protein, 9 aa, Artificial Sequence
  Description of Artificial Sequence: Synthetic peptide
  Seed: ALVETSYVK (MAGA3_HUMAN)
AIVETSYVK

SEQ ID NO: 59559 - protein, 9 aa, Homo sapiens
  Native (MAGA3_HUMAN)
EEKIWEELS

SEQ ID NO: 59560 - protein, 10 aa, Homo sapiens
  Native (MAGA3_HUMAN)
GLVGAQAPAT

SEQ ID NO: 59561 - protein, 11 aa, Homo sapiens
  Native (MAGA3_HUMAN)
LEVFEGREDSI

SEQ ID NO: 59562 - protein, 10 aa, Homo sapiens
  Native (MAGA3_HUMAN)
ELMEVDPIGH

SEQ ID NO: 59563 - protein, 8 aa, Homo sapiens
  Native (MAGA3_HUMAN)
FGIELMEV

SEQ ID NO: 59564 - protein, 10 aa, Homo sapiens
  Native (MAGA3_HUMAN)
FLWGPRALVE

SEQ ID NO: 59565 - protein, 11 aa, Homo sapiens
  Native (MAGA3_HUMAN)
QHCKPEEGLEA

SEQ ID NO: 59566 - protein, 9 aa, Homo sapiens
  Native (MAGA3_HUMAN)
VTLGEVPAA

SEQ ID NO: 59567 - protein, 8 aa, Homo sapiens
  Native (MAGA3_HUMAN)
AASSSSTL

SEQ ID NO: 59568 - protein, 10 aa, Homo sapiens
  Native (MAGA3_HUMAN)
ESEFQAALSR

SEQ ID NO: 59569 - protein, 11 aa, Homo sapiens
  Native (MAGA3_HUMAN)
EQEAASSSSTL

SEQ ID NO: 59570 - protein, 8 aa, Homo sapiens
  Native (MAGA3_HUMAN)
QHFVQENY

SEQ ID NO: 59571 - protein, 8 aa, Homo sapiens
  Native (MAGA3_HUMAN)
MPKAGLLI

SEQ ID NO: 59572 - protein, 9 aa, Homo sapiens
  Native (MAGA3_HUMAN)
TQHFVQENY

SEQ ID NO: 59573 - protein, 10 aa, Homo sapiens
  Native (MAGA3_HUMAN)
GSDPACYEFL

SEQ ID NO: 59574 - protein, 9 aa, Homo sapiens
  Native (MAGA3_HUMAN)
SSTLVEVTL

SEQ ID NO: 59575 - protein, 10 aa, Homo sapiens
  Native (MAGA3_HUMAN)
SILGDPKKLL

SEQ ID NO: 59576 - protein, 9 aa, Homo sapiens
  Native (MAGA3_HUMAN)
EVTLGEVPA

SEQ ID NO: 59577 - protein, 11 aa, Homo sapiens
  Native (MAGA3_HUMAN)
HCKPEEGLEAR

SEQ ID NO: 59578 - protein, 9 aa, Homo sapiens
  Native (MAGA3_HUMAN)
VPAAESPDP

SEQ ID NO: 59579 - protein, 9 aa, Homo sapiens
  Native (MAGA3_HUMAN)
MPLEQRSQH

SEQ ID NO: 59580 - protein, 11 aa, Homo sapiens
  Native (MAGA3_HUMAN)
KVAELVHFLLL

SEQ ID NO: 59581 - protein, 9 aa, Homo sapiens
  Native (MAGA3_HUMAN)
REDSILGDP

SEQ ID NO: 59582 - protein, 9 aa, Homo sapiens
  Native (MAGA3_HUMAN)
RALVETSYV

SEQ ID NO: 59583 - protein, 9 aa, Homo sapiens
  Native (MAGA3_HUMAN)
QLVFGIELM

SEQ ID NO: 59584 - protein, 8 aa, Homo sapiens
  Native (MAGA3_HUMAN)
LEQRSQHC

SEQ ID NO: 59585 - protein, 9 aa, Homo sapiens
  Native (MAGA3_HUMAN)
VHFLLLKYR

SEQ ID NO: 59586 - protein, 10 aa, Homo sapiens
  Native (MAGA3_HUMAN)
REDSILGDPK

SEQ ID NO: 59587 - protein, 10 aa, Homo sapiens
  Native (MAGA3_HUMAN)
ESPDPPQSPQ

SEQ ID NO: 59588 - protein, 11 aa, Homo sapiens
  Native (MAGA3_HUMAN)
FPDLESEFQAA

SEQ ID NO: 59589 - protein, 10 aa, Homo sapiens
  Native (MAGA3_HUMAN)
GPRALVETSY

SEQ ID NO: 59590 - protein, 8 aa, Homo sapiens
  Native (MAGA3_HUMAN)
GEVPAAES

SEQ ID NO: 59591 - protein, 8 aa, Homo sapiens
  Native (MAGA3_HUMAN)
VEVTLGEV

SEQ ID NO: 59592 - protein, 11 aa, Homo sapiens
  Native (MAGA3_HUMAN)
ISYPPLHEWVL

SEQ ID NO: 59593 - protein, 9 aa, Homo sapiens
  Native (MAGA3_HUMAN)
RQVPGSDPA

SEQ ID NO: 59594 - protein, 10 aa, Homo sapiens
  Native (MAGA3_HUMAN)
EEGPSTFPDL

SEQ ID NO: 59595 - protein, 10 aa, Homo sapiens
  Native (MAGA3_HUMAN)
NQIMPKAGLL

SEQ ID NO: 59596 - protein, 10 aa, Homo sapiens
  Native (MAGA3_HUMAN)
QEEEGPSTFP

SEQ ID NO: 59597 - protein, 9 aa, Homo sapiens
  Native (MAGA3_HUMAN)
HLYIFATCL

SEQ ID NO: 59598 - protein, 10 aa, Homo sapiens
  Native (MAGA3_HUMAN)
ASSSLQLVFG

SEQ ID NO: 59599 - protein, 11 aa, Homo sapiens
  Native (MAGA3_HUMAN)
MEVDPIGHLYI

SEQ ID NO: 59600 - protein, 9 aa, Homo sapiens
  Native (MAGA3_HUMAN)
GLEARGEAL

SEQ ID NO: 59601 - protein, 11 aa, Homo sapiens
  Native (MAGA3_HUMAN)
MLGSVVGNWQY

SEQ ID NO: 59602 - protein, 8 aa, Homo sapiens
  Native (MAGA3_HUMAN)
YVKVLHHM

SEQ ID NO: 59603 - protein, 9 aa, Homo sapiens
  Native (MAGA3_HUMAN)
EGDCAPEEK

SEQ ID NO: 59604 - protein, 10 aa, Homo sapiens
  Native (MAGA3_HUMAN)
TEEQEAASSS

SEQ ID NO: 59605 - protein, 8 aa, Homo sapiens
  Native (MAGA3_HUMAN)
KLLTQHFV

SEQ ID NO: 59606 - protein, 10 aa, Homo sapiens
  Native (MAGA3_HUMAN)
KISGGPHISY

SEQ ID NO: 59607 - protein, 11 aa, Homo sapiens
  Native (MAGA3_HUMAN)
LMEVDPIGHLY

SEQ ID NO: 59608 - protein, 9 aa, Homo sapiens
  Native (MAGA3_HUMAN)
LGDPKKLLT

SEQ ID NO: 59609 - protein, 11 aa, Homo sapiens
  Native (MAGA3_HUMAN)
GNWQYFFPVIF

SEQ ID NO: 59610 - protein, 8 aa, Homo sapiens
  Native (MAGA3_HUMAN)
SPQGASSL

SEQ ID NO: 59611 - protein, 10 aa, Homo sapiens
  Native (MAGA3_HUMAN)
REGDCAPEEK

SEQ ID NO: 59612 - protein, 9 aa, Homo sapiens
  Native (MAGA3_HUMAN)
ELVHFLLLK

SEQ ID NO: 59613 - protein, 11 aa, Homo sapiens
  Native (MAGA3_HUMAN)
SPQGASSLPTT

SEQ ID NO: 59614 - protein, 11 aa, Homo sapiens
  Native (MAGA3_HUMAN)
CYEFLWGPRAL

SEQ ID NO: 59615 - protein, 9 aa, Homo sapiens
  Native (MAGA3_HUMAN)
KAEMLGSVV

SEQ ID NO: 59616 - protein, 10 aa, Homo sapiens
  Native (MAGA3_HUMAN)
SLQLVFGIEL

SEQ ID NO: 59617 - protein, 9 aa, Homo sapiens
  Native (MAGA3_HUMAN)
GDCAPEEKI

SEQ ID NO: 59618 - protein, 9 aa, Homo sapiens
  Native (MAGA3_HUMAN)
EDSILGDPK

SEQ ID NO: 59619 - protein, 8 aa, Homo sapiens
  Native (MAGA3_HUMAN)
AEMLGSVV

SEQ ID NO: 59620 - protein, 9 aa, Homo sapiens
  Native (MAGA3_HUMAN)
AQAPATEEQ

SEQ ID NO: 59621 - protein, 8 aa, Homo sapiens
  Native (MAGA3_HUMAN)
HHMVKISG

SEQ ID NO: 59622 - protein, 8 aa, Homo sapiens
  Native (MAGA3_HUMAN)
VQENYLEY

SEQ ID NO: 59623 - protein, 9 aa, Homo sapiens
  Native (MAGA3_HUMAN)
SPDPPQSPQ

SEQ ID NO: 59624 - protein, 11 aa, Homo sapiens
  Native (MAGA3_HUMAN)
NQIMPKAGLLI

SEQ ID NO: 59625 - protein, 10 aa, Homo sapiens
  Native (MAGA3_HUMAN)
YRQVPGSDPA

SEQ ID NO: 59626 - protein, 11 aa, Homo sapiens
  Native (MAGA3_HUMAN)
LLGDNQIMPKA

SEQ ID NO: 59627 - protein, 10 aa, Homo sapiens
  Native (MAGA3_HUMAN)
EMLGSVVGNW

SEQ ID NO: 59628 - protein, 10 aa, Homo sapiens
  Native (MAGA3_HUMAN)
GDCAPEEKIW

SEQ ID NO: 59629 - protein, 11 aa, Homo sapiens
  Native (MAGA3_HUMAN)
HMVKISGGPHI

SEQ ID NO: 59630 - protein, 10 aa, Homo sapiens
  Native (MAGA3_HUMAN)
EVDPIGHLYI

SEQ ID NO: 59631 - protein, 8 aa, Homo sapiens
  Native (MAGA3_HUMAN)
VLEVFEGR

SEQ ID NO: 59632 - protein, 11 aa, Homo sapiens
  Native (MAGA3_HUMAN)
LSRKVAELVHF

SEQ ID NO: 59633 - protein, 8 aa, Homo sapiens
  Native (MAGA3_HUMAN)
SSSLQLVF

SEQ ID NO: 59634 - protein, 11 aa, Homo sapiens
  Native (MAGA3_HUMAN)
TMNYPLWSQSY

SEQ ID NO: 59635 - protein, 10 aa, Homo sapiens
  Native (MAGA3_HUMAN)
SVVGNWQYFF

SEQ ID NO: 59636 - protein, 9 aa, Homo sapiens
  Native (MAGA3_HUMAN)
IAREGDCAP

SEQ ID NO: 59637 - protein, 9 aa, Homo sapiens
  Native (MAGA3_HUMAN)
MLGSVVGNW

SEQ ID NO: 59638 - protein, 10 aa, Homo sapiens
  Native (MAGA3_HUMAN)
YVKVLHHMVK

SEQ ID NO: 59639 - protein, 10 aa, Homo sapiens
  Native (MAGA3_HUMAN)
KASSSLQLVF

SEQ ID NO: 59640 - protein, 11 aa, Homo sapiens
  Native (MAGA3_HUMAN)
VAELVHFLLLK

SEQ ID NO: 59641 - protein, 11 aa, Homo sapiens
  Native (MAGA3_HUMAN)
PPQSPQGASSL

SEQ ID NO: 59642 - protein, 9 aa, Homo sapiens
  Native (MAGA3_HUMAN)
WQYFFPVIF

SEQ ID NO: 59643 - protein, 11 aa, Homo sapiens
  Native (MAGA3_HUMAN)
VVGNWQYFFPV

SEQ ID NO: 59644 - protein, 10 aa, Homo sapiens
  Native (MAGA3_HUMAN)
GLLIIVLAII

SEQ ID NO: 59645 - protein, 10 aa, Homo sapiens
  Native (MAGA3_HUMAN)
LVHFLLLKYR

SEQ ID NO: 59646 - protein, 9 aa, Homo sapiens
  Native (MAGA3_HUMAN)
AASSSSTLV

SEQ ID NO: 59647 - protein, 11 aa, Homo sapiens
  Native (MAGA3_HUMAN)
MPKAGLLIIVL

SEQ ID NO: 59648 - protein, 11 aa, Homo sapiens
  Native (MAGA3_HUMAN)
SNQEEEGPSTF

SEQ ID NO: 59649 - protein, 11 aa, Homo sapiens
  Native (MAGA3_HUMAN)
GSDPACYEFLW

SEQ ID NO: 59650 - protein, 9 aa, Homo sapiens
  Native (MAGA3_HUMAN)
LQLVFGIEL

SEQ ID NO: 59651 - protein, 11 aa, Homo sapiens
  Native (MAGA3_HUMAN)
SPDPPQSPQGA

SEQ ID NO: 59652 - protein, 9 aa, Homo sapiens
  Native (MAGA3_HUMAN)
SSLQLVFGI

SEQ ID NO: 59653 - protein, 10 aa, Homo sapiens
  Native (MAGA3_HUMAN)
ACYEFLWGPR

SEQ ID NO: 59654 - protein, 9 aa, Homo sapiens
  Native (MAGA3_HUMAN)
EEEGPSTFP

SEQ ID NO: 59655 - protein, 10 aa, Homo sapiens
  Native (MAGA3_HUMAN)
VPAAESPDPP

SEQ ID NO: 59656 - protein, 11 aa, Homo sapiens
  Native (MAGA3_HUMAN)
EGDCAPEEKIW

SEQ ID NO: 59657 - protein, 11 aa, Homo sapiens
  Native (MAGA3_HUMAN)
REDSILGDPKK

SEQ ID NO: 59658 - protein, 10 aa, Homo sapiens
  Native (MAGA3_HUMAN)
HMVKISGGPH

SEQ ID NO: 59659 - protein, 8 aa, Homo sapiens
  Native (MAGA3_HUMAN)
ILGDPKKL

SEQ ID NO: 59660 - protein, 11 aa, Homo sapiens
  Native (MAGA3_HUMAN)
SEFQAALSRKV

SEQ ID NO: 59661 - protein, 11 aa, Homo sapiens
  Native (MAGA3_HUMAN)
ALVETSYVKVL

SEQ ID NO: 59662 - protein, 9 aa, Homo sapiens
  Native (MAGA3_HUMAN)
DPACYEFLW

SEQ ID NO: 59663 - protein, 9 aa, Homo sapiens
  Native (MAGA3_HUMAN)
LVEVTLGEV

SEQ ID NO: 59664 - protein, 9 aa, Homo sapiens
  Native (MAGA3_HUMAN)
SRKVAELVH

SEQ ID NO: 59665 - protein, 8 aa, Homo sapiens
  Native (MAGA3_HUMAN)
FPDLESEF

SEQ ID NO: 59666 - protein, 10 aa, Homo sapiens
  Native (MAGA3_HUMAN)
EAASSSSTLV

SEQ ID NO: 59667 - protein, 8 aa, Homo sapiens
  Native (MAGA3_HUMAN)
YPPLHEWV

SEQ ID NO: 59668 - protein, 8 aa, Homo sapiens
  Native (MAGA3_HUMAN)
SILGDPKK

SEQ ID NO: 59669 - protein, 9 aa, Homo sapiens
  Native (MAGA3_HUMAN)
AEMLGSVVG

SEQ ID NO: 59670 - protein, 11 aa, Homo sapiens
  Native (MAGA3_HUMAN)
STLVEVTLGEV

SEQ ID NO: 59671 - protein, 8 aa, Homo sapiens
  Native (MAGA3_HUMAN)
EEGPSTFP

SEQ ID NO: 59672 - protein, 10 aa, Homo sapiens
  Native (MAGA3_HUMAN)
TTMNYPLWSQ

SEQ ID NO: 59673 - protein, 10 aa, Homo sapiens
  Native (MAGA3_HUMAN)
FATCLGLSYD

SEQ ID NO: 59674 - protein, 9 aa, Homo sapiens
  Native (MAGA3_HUMAN)
ETSYVKVLH

SEQ ID NO: 59675 - protein, 10 aa, Homo sapiens
  Native (MAGA3_HUMAN)
AEMLGSVVGN

SEQ ID NO: 59676 - protein, 10 aa, Homo sapiens
  Native (MAGA3_HUMAN)
ALSRKVAELV

SEQ ID NO: 59677 - protein, 8 aa, Homo sapiens
  Native (MAGA3_HUMAN)
FPVIFSKA

SEQ ID NO: 59678 - protein, 9 aa, Homo sapiens
  Native (MAGA3_HUMAN)
ALSRKVAEL

SEQ ID NO: 59679 - protein, 9 aa, Homo sapiens
  Native (MAGA3_HUMAN)
VPGSDPACY

SEQ ID NO: 59680 - protein, 9 aa, Homo sapiens
  Native (MAGA3_HUMAN)
MEVDPIGHL

SEQ ID NO: 59681 - protein, 10 aa, Homo sapiens
  Native (MAGA3_HUMAN)
SRKVAELVHF

SEQ ID NO: 59682 - protein, 10 aa, Homo sapiens
  Native (MAGA3_HUMAN)
EEGLEARGEA

SEQ ID NO: 59683 - protein, 9 aa, Homo sapiens
  Native (MAGA3_HUMAN)
GLLIIVLAI

SEQ ID NO: 59684 - protein, 9 aa, Homo sapiens
  Native (MAGA3_HUMAN)
IMPKAGLLI

SEQ ID NO: 59685 - protein, 9 aa, Homo sapiens
  Native (MAGA3_HUMAN)
YVKVLHHMV

SEQ ID NO: 59686 - protein, 8 aa, Homo sapiens
  Native (MAGA3_HUMAN)
SDPACYEF

SEQ ID NO: 59687 - protein, 10 aa, Homo sapiens
  Native (MAGA3_HUMAN)
VIFSKASSSL

SEQ ID NO: 59688 - protein, 9 aa, Homo sapiens
  Native (MAGA3_HUMAN)
NQIMPKAGL

SEQ ID NO: 59689 - protein, 11 aa, Homo sapiens
  Native (MAGA3_HUMAN)
LVFGIELMEVD

SEQ ID NO: 59690 - protein, 11 aa, Homo sapiens
  Native (MAGA3_HUMAN)
PHISYPPLHEW

SEQ ID NO: 59691 - protein, 10 aa, Homo sapiens
  Native (MAGA3_HUMAN)
MVKISGGPHI

SEQ ID NO: 59692 - protein, 8 aa, Homo sapiens
  Native (MAGA3_HUMAN)
QYFFPVIF

SEQ ID NO: 59693 - protein, 10 aa, Homo sapiens
  Native (MAGA3_HUMAN)
DPIGHLYIFA

SEQ ID NO: 59694 - protein, 10 aa, Homo sapiens
  Native (MAGA3_HUMAN)
GHLYIFATCL

SEQ ID NO: 59695 - protein, 9 aa, Homo sapiens
  Native (MAGA3_HUMAN)
TSYVKVLHH

SEQ ID NO: 59696 - protein, 10 aa, Homo sapiens
  Native (MAGA3_HUMAN)
VDPIGHLYIF

SEQ ID NO: 59697 - protein, 8 aa, Homo sapiens
  Native (MAGA3_HUMAN)
DSILGDPK

SEQ ID NO: 59698 - protein, 10 aa, Homo sapiens
  Native (MAGA3_HUMAN)
FVQENYLEYR

SEQ ID NO: 59699 - protein, 11 aa, Homo sapiens
  Native (MAGA3_HUMAN)
EEGLEARGEAL
